United States Patent 7,250,289 (METHODS OF GENETIC ANALYSIS OF MOUSE) - sequence listing, part 18

SEQ ID NO: 683475 - DNA, 25 bp, Mus musculus
gtcagtttaattattgagaactccc

SEQ ID NO: 683476 - DNA, 25 bp, Mus musculus
gtcagtttaatttttgagaactccc

SEQ ID NO: 683477 - DNA, 25 bp, Mus musculus
gtcagtttattccacttgattgcaa

SEQ ID NO: 683478 - DNA, 25 bp, Mus musculus
gtcagtttattcgacttgattgcaa

SEQ ID NO: 683479 - DNA, 25 bp, Mus musculus
gtcagtttcaggagaccaactccat

SEQ ID NO: 683480 - DNA, 25 bp, Mus musculus
gtcagtttcaggtgaccaactccat

SEQ ID NO: 683481 - DNA, 25 bp, Mus musculus
gtcagtttcattccaagatttccag

SEQ ID NO: 683482 - DNA, 25 bp, Mus musculus
gtcagtttcattgcaagatttccag

SEQ ID NO: 683483 - DNA, 25 bp, Mus musculus
gtcagtttctgactccttggctttt

SEQ ID NO: 683484 - DNA, 25 bp, Mus musculus
gtcagtttctgagtccttggctttt

SEQ ID NO: 683485 - DNA, 25 bp, Mus musculus
gtcagtttgaacctgtgttggtctt

SEQ ID NO: 683486 - DNA, 25 bp, Mus musculus
gtcagtttgaacgtgtgttggtctt

SEQ ID NO: 683487 - DNA, 25 bp, Mus musculus
gtcagtttgcatcagtaaagcccac

SEQ ID NO: 683488 - DNA, 25 bp, Mus musculus
gtcagtttgcatgagtaaagcccac

SEQ ID NO: 683489 - DNA, 25 bp, Mus musculus
gtcagtttgttaagatgctgtgcaa

SEQ ID NO: 683490 - DNA, 25 bp, Mus musculus
gtcagtttgttatgatgctgtgcaa

SEQ ID NO: 683491 - DNA, 25 bp, Mus musculus
gtcagttttctaatctcaccataga

SEQ ID NO: 683492 - DNA, 25 bp, Mus musculus
gtcagttttctattctcaccataga

SEQ ID NO: 683493 - DNA, 25 bp, Mus musculus
gtcagttttctgaaccacacttact

SEQ ID NO: 683494 - DNA, 25 bp, Mus musculus
gtcagttttctgaattcatagtcag

SEQ ID NO: 683495 - DNA, 25 bp, Mus musculus
gtcagttttctgtaccacacttact

SEQ ID NO: 683496 - DNA, 25 bp, Mus musculus
gtcagttttctgtattcatagtcag

SEQ ID NO: 683497 - DNA, 25 bp, Mus musculus
gtcagttttcttaccaggcgtggtc

SEQ ID NO: 683498 - DNA, 25 bp, Mus musculus
gtcagttttctttccaggcgtggtc

SEQ ID NO: 683499 - DNA, 25 bp, Mus musculus
gtcagttttgagaatcattggccct

SEQ ID NO: 683500 - DNA, 25 bp, Mus musculus
gtcagttttgagtatcattggccct

SEQ ID NO: 683501 - DNA, 25 bp, Mus musculus
gtcagttttgctactcgctatttga

SEQ ID NO: 683502 - DNA, 25 bp, Mus musculus
gtcagttttgcttctcgctatttga

SEQ ID NO: 683503 - DNA, 25 bp, Mus musculus
gtcagtttttataccgaccaccagt

SEQ ID NO: 683504 - DNA, 25 bp, Mus musculus
gtcagtttttattccgaccaccagt

SEQ ID NO: 683505 - DNA, 25 bp, Mus musculus
gtcataaacacaacgggcctgctgg

SEQ ID NO: 683506 - DNA, 25 bp, Mus musculus
gtcataaacacatcgggcctgctgg

SEQ ID NO: 683507 - DNA, 25 bp, Mus musculus
gtcataaactacagtggttctcatc

SEQ ID NO: 683508 - DNA, 25 bp, Mus musculus
gtcataaactactgtggttctcatc

SEQ ID NO: 683509 - DNA, 25 bp, Mus musculus
gtcataaactggagaagtccttcga

SEQ ID NO: 683510 - DNA, 25 bp, Mus musculus
gtcataaactggtgaagtccttcga

SEQ ID NO: 683511 - DNA, 25 bp, Mus musculus
gtcataaatcagagtgttggccaga

SEQ ID NO: 683512 - DNA, 25 bp, Mus musculus
gtcataaatcagtgtgttggccaga

SEQ ID NO: 683513 - DNA, 25 bp, Mus musculus
gtcataaatcctatcctgtactggg

SEQ ID NO: 683514 - DNA, 25 bp, Mus musculus
gtcataaatcctttcctgtactggg

SEQ ID NO: 683515 - DNA, 25 bp, Mus musculus
gtcataaatgatctgctgctgctgc

SEQ ID NO: 683516 - DNA, 25 bp, Mus musculus
gtcataaatgatgtgctgctgctgc

SEQ ID NO: 683517 - DNA, 25 bp, Mus musculus
gtcataaatggcaagtagctgagaa

SEQ ID NO: 683518 - DNA, 25 bp, Mus musculus
gtcataaatggctagtagctgagaa

SEQ ID NO: 683519 - DNA, 25 bp, Mus musculus
gtcataaattcaaagtcgccctcag

SEQ ID NO: 683520 - DNA, 25 bp, Mus musculus
gtcataaattcatagtcgccctcag

SEQ ID NO: 683521 - DNA, 25 bp, Mus musculus
gtcataaatttactcccaaggtcgg

SEQ ID NO: 683522 - DNA, 25 bp, Mus musculus
gtcataaatttagtcccaaggtcgg

SEQ ID NO: 683523 - DNA, 25 bp, Mus musculus
gtcataacaagtcgcctgtgtcctc

SEQ ID NO: 683524 - DNA, 25 bp, Mus musculus
gtcataacaagtggcctgtgtcctc

SEQ ID NO: 683525 - DNA, 25 bp, Mus musculus
gtcataacatttagagctgcattta

SEQ ID NO: 683526 - DNA, 25 bp, Mus musculus
gtcataacattttgagctgcattta

SEQ ID NO: 683527 - DNA, 25 bp, Mus musculus
gtcataaccttgctggtctgaaata

SEQ ID NO: 683528 - DNA, 25 bp, Mus musculus
gtcataaccttggtggtctgaaata

SEQ ID NO: 683529 - DNA, 25 bp, Mus musculus
gtcataacgaggacttccctttcca

SEQ ID NO: 683530 - DNA, 25 bp, Mus musculus
gtcataacgaggtcttccctttcca

SEQ ID NO: 683531 - DNA, 25 bp, Mus musculus
gtcataactagacatacttgttccc

SEQ ID NO: 683532 - DNA, 25 bp, Mus musculus
gtcataactagagatacttgttccc

SEQ ID NO: 683533 - DNA, 25 bp, Mus musculus
gtcataactcaaattcacagctagg

SEQ ID NO: 683534 - DNA, 25 bp, Mus musculus
gtcataactcaatttcacagctagg

SEQ ID NO: 683535 - DNA, 25 bp, Mus musculus
gtcataactgcaatcctgggtatta

SEQ ID NO: 683536 - DNA, 25 bp, Mus musculus
gtcataactgcattcctgggtatta

SEQ ID NO: 683537 - DNA, 25 bp, Mus musculus
gtcataactggaccgtgattttccc

SEQ ID NO: 683538 - DNA, 25 bp, Mus musculus
gtcataactggagcgtgattttccc

SEQ ID NO: 683539 - DNA, 25 bp, Mus musculus
gtcataactttcctccagctttaat

SEQ ID NO: 683540 - DNA, 25 bp, Mus musculus
gtcataactttcgtccagctttaat

SEQ ID NO: 683541 - DNA, 25 bp, Mus musculus
gtcataagcaaaaaactcacctgtc

SEQ ID NO: 683542 - DNA, 25 bp, Mus musculus
gtcataagcaaataactcacctgtc

SEQ ID NO: 683543 - DNA, 25 bp, Mus musculus
gtcataagccagcatcttaaacatt

SEQ ID NO: 683544 - DNA, 25 bp, Mus musculus
gtcataagccaggatcttaaacatt

SEQ ID NO: 683545 - DNA, 25 bp, Mus musculus
gtcataagcctaacatattgtctaa

SEQ ID NO: 683546 - DNA, 25 bp, Mus musculus
gtcataagcctatcatattgtctaa

SEQ ID NO: 683547 - DNA, 25 bp, Mus musculus
gtcataaggtccaggttctttccag

SEQ ID NO: 683548 - DNA, 25 bp, Mus musculus
gtcataaggtcctggttctttccag

SEQ ID NO: 683549 - DNA, 25 bp, Mus musculus
gtcataataagcattcccatcataa

SEQ ID NO: 683550 - DNA, 25 bp, Mus musculus
gtcataataagctttcccatcataa

SEQ ID NO: 683551 - DNA, 25 bp, Mus musculus
gtcataatcctccttttttacctga

SEQ ID NO: 683552 - DNA, 25 bp, Mus musculus
gtcataatcctcgttttttacctga

SEQ ID NO: 683553 - DNA, 25 bp, Mus musculus
gtcataatcgtgatttcaatgcccc

SEQ ID NO: 683554 - DNA, 25 bp, Mus musculus
gtcataatcgtgttttcaatgcccc

SEQ ID NO: 683555 - DNA, 25 bp, Mus musculus
gtcataattctccattctaccattt

SEQ ID NO: 683556 - DNA, 25 bp, Mus musculus
gtcataattctcgattctaccattt

SEQ ID NO: 683557 - DNA, 25 bp, Mus musculus
gtcataattgatccagacttctgta

SEQ ID NO: 683558 - DNA, 25 bp, Mus musculus
gtcataattgatgcagacttctgta

SEQ ID NO: 683559 - DNA, 25 bp, Mus musculus
gtcatacacaaaccttccaccaagt

SEQ ID NO: 683560 - DNA, 25 bp, Mus musculus
gtcatacacaaagcttccaccaagt

SEQ ID NO: 683561 - DNA, 25 bp, Mus musculus
gtcatacacataaacttcctgctat

SEQ ID NO: 683562 - DNA, 25 bp, Mus musculus
gtcatacacatatacttcctgctat

SEQ ID NO: 683563 - DNA, 25 bp, Mus musculus
gtcatacacccgatgcacagatggt

SEQ ID NO: 683564 - DNA, 25 bp, Mus musculus
gtcatacacccgttgcacagatggt

SEQ ID NO: 683565 - DNA, 25 bp, Mus musculus
gtcatacaggacatctgacctcagt

SEQ ID NO: 683566 - DNA, 25 bp, Mus musculus
gtcatacaggacttctgacctcagt

SEQ ID NO: 683567 - DNA, 25 bp, Mus musculus
gtcatacaggctcgctgtcctctga

SEQ ID NO: 683568 - DNA, 25 bp, Mus musculus
gtcatacaggctggctgtcctctga

SEQ ID NO: 683569 - DNA, 25 bp, Mus musculus
gtcatacatgctactgtacccataa

SEQ ID NO: 683570 - DNA, 25 bp, Mus musculus
gtcatacatgcttctgtacccataa

SEQ ID NO: 683571 - DNA, 25 bp, Mus musculus
gtcataccaactagggaagcccctg

SEQ ID NO: 683572 - DNA, 25 bp, Mus musculus
gtcataccaacttgggaagcccctg

SEQ ID NO: 683573 - DNA, 25 bp, Mus musculus
gtcataccaggtacacatcttttac

SEQ ID NO: 683574 - DNA, 25 bp, Mus musculus
gtcataccaggttcacatcttttac

SEQ ID NO: 683575 - DNA, 25 bp, Mus musculus
gtcataccgaaaaaccaaaggctat

SEQ ID NO: 683576 - DNA, 25 bp, Mus musculus
gtcataccgaaataccaaaggctat

SEQ ID NO: 683577 - DNA, 25 bp, Mus musculus
gtcatacctatcagttgcacgttta

SEQ ID NO: 683578 - DNA, 25 bp, Mus musculus
gtcatacctatctgttgcacgttta

SEQ ID NO: 683579 - DNA, 25 bp, Mus musculus
gtcatacctgacctgtgaccctggg

SEQ ID NO: 683580 - DNA, 25 bp, Mus musculus
gtcatacctgacgtgtgaccctggg

SEQ ID NO: 683581 - DNA, 25 bp, Mus musculus
gtcatacctgataccgtttcattac

SEQ ID NO: 683582 - DNA, 25 bp, Mus musculus
gtcatacctgattccgtttcattac

SEQ ID NO: 683583 - DNA, 25 bp, Mus musculus
gtcatacgattgattttcggtacaa

SEQ ID NO: 683584 - DNA, 25 bp, Mus musculus
gtcatacgattgtttttcggtacaa

SEQ ID NO: 683585 - DNA, 25 bp, Mus musculus
gtcatacgtgaacctcatgagagga

SEQ ID NO: 683586 - DNA, 25 bp, Mus musculus
gtcatacgtgaagctcatgagagga

SEQ ID NO: 683587 - DNA, 25 bp, Mus musculus
gtcatacgtttcaacttaaattatt

SEQ ID NO: 683588 - DNA, 25 bp, Mus musculus
gtcatacgtttctacttaaattatt

SEQ ID NO: 683589 - DNA, 25 bp, Mus musculus
gtcatactaacacctgtactctatc

SEQ ID NO: 683590 - DNA, 25 bp, Mus musculus
gtcatactaacagctgtactctatc

SEQ ID NO: 683591 - DNA, 25 bp, Mus musculus
gtcatactcagacactagctcccta

SEQ ID NO: 683592 - DNA, 25 bp, Mus musculus
gtcatactcagagactagctcccta

SEQ ID NO: 683593 - DNA, 25 bp, Mus musculus
gtcatactctggagctcaaaggcta

SEQ ID NO: 683594 - DNA, 25 bp, Mus musculus
gtcatactctggtgctcaaaggcta

SEQ ID NO: 683595 - DNA, 25 bp, Mus musculus
gtcatactgcagacttaaaatatag

SEQ ID NO: 683596 - DNA, 25 bp, Mus musculus
gtcatactgcagagggacagaacgg

SEQ ID NO: 683597 - DNA, 25 bp, Mus musculus
gtcatactgcagtcttaaaatatag

SEQ ID NO: 683598 - DNA, 25 bp, Mus musculus
gtcatactgcagtgggacagaacgg

SEQ ID NO: 683599 - DNA, 25 bp, Mus musculus
gtcatactgggtcagaaggaattca

SEQ ID NO: 683600 - DNA, 25 bp, Mus musculus
gtcatactgggtgagaaggaattca

SEQ ID NO: 683601 - DNA, 25 bp, Mus musculus
gtcatacttagcatcttggttccaa

SEQ ID NO: 683602 - DNA, 25 bp, Mus musculus
gtcatacttagcttcttggttccaa

SEQ ID NO: 683603 - DNA, 25 bp, Mus musculus
gtcatacttcataacttttgaacgt

SEQ ID NO: 683604 - DNA, 25 bp, Mus musculus
gtcatacttcattacttttgaacgt

SEQ ID NO: 683605 - DNA, 25 bp, Mus musculus
gtcatacttcttcctaactgtggat

SEQ ID NO: 683606 - DNA, 25 bp, Mus musculus
gtcatacttcttgctaactgtggat

SEQ ID NO: 683607 - DNA, 25 bp, Mus musculus
gtcatactttgaactttaccattgg

SEQ ID NO: 683608 - DNA, 25 bp, Mus musculus
gtcatactttgatctttaccattgg

SEQ ID NO: 683609 - DNA, 25 bp, Mus musculus
gtcatacttttgctttcaattctca

SEQ ID NO: 683610 - DNA, 25 bp, Mus musculus
gtcatacttttggtttcaattctca

SEQ ID NO: 683611 - DNA, 25 bp, Mus musculus
gtcatagaagcccaactgtagtggt

SEQ ID NO: 683612 - DNA, 25 bp, Mus musculus
gtcatagaagccgaactgtagtggt

SEQ ID NO: 683613 - DNA, 25 bp, Mus musculus
gtcatagacttgcttcttctgtttc

SEQ ID NO: 683614 - DNA, 25 bp, Mus musculus
gtcatagacttggttcttctgtttc

SEQ ID NO: 683615 - DNA, 25 bp, Mus musculus
gtcatagagattagctctgcttgct

SEQ ID NO: 683616 - DNA, 25 bp, Mus musculus
gtcatagagatttgctctgcttgct

SEQ ID NO: 683617 - DNA, 25 bp, Mus musculus
gtcatagatctcatgttaccctgct

SEQ ID NO: 683618 - DNA, 25 bp, Mus musculus
gtcatagatctcttgttaccctgct

SEQ ID NO: 683619 - DNA, 25 bp, Mus musculus
gtcatagattagcagtacttacctt

SEQ ID NO: 683620 - DNA, 25 bp, Mus musculus
gtcatagattaggagtacttacctt

SEQ ID NO: 683621 - DNA, 25 bp, Mus musculus
gtcatagcaaccctgattgtcatca

SEQ ID NO: 683622 - DNA, 25 bp, Mus musculus
gtcatagcaaccgtgattgtcatca

SEQ ID NO: 683623 - DNA, 25 bp, Mus musculus
gtcatagcatacatgtcccatactc

SEQ ID NO: 683624 - DNA, 25 bp, Mus musculus
gtcatagcatacttgtcccatactc

SEQ ID NO: 683625 - DNA, 25 bp, Mus musculus
gtcatagcccgcactgttgaagata

SEQ ID NO: 683626 - DNA, 25 bp, Mus musculus
gtcatagcccgctctgttgaagata

SEQ ID NO: 683627 - DNA, 25 bp, Mus musculus
gtcatagccctactctgtgctgata

SEQ ID NO: 683628 - DNA, 25 bp, Mus musculus
gtcatagccctagtctgtgctgata

SEQ ID NO: 683629 - DNA, 25 bp, Mus musculus
gtcatagctactctgtttctttctc

SEQ ID NO: 683630 - DNA, 25 bp, Mus musculus
gtcatagctactgtgtttctttctc

SEQ ID NO: 683631 - DNA, 25 bp, Mus musculus
gtcatagctaggactaagtgcacac

SEQ ID NO: 683632 - DNA, 25 bp, Mus musculus
gtcatagctaggtctaagtgcacac

SEQ ID NO: 683633 - DNA, 25 bp, Mus musculus
gtcatagctgatcgtgtccgggtcc

SEQ ID NO: 683634 - DNA, 25 bp, Mus musculus
gtcatagctgatggtgtccgggtcc

SEQ ID NO: 683635 - DNA, 25 bp, Mus musculus
gtcataggactgcatgccaagcata

SEQ ID NO: 683636 - DNA, 25 bp, Mus musculus
gtcataggactggatgccaagcata

SEQ ID NO: 683637 - DNA, 25 bp, Mus musculus
gtcataggccagatttataaataca

SEQ ID NO: 683638 - DNA, 25 bp, Mus musculus
gtcataggccagttttataaataca

SEQ ID NO: 683639 - DNA, 25 bp, Mus musculus
gtcataggcctccattgatatctct

SEQ ID NO: 683640 - DNA, 25 bp, Mus musculus
gtcataggcctcgattgatatctct

SEQ ID NO: 683641 - DNA, 25 bp, Mus musculus
gtcataggctgcaccgaagtaacaa

SEQ ID NO: 683642 - DNA, 25 bp, Mus musculus
gtcataggctgctccgaagtaacaa

SEQ ID NO: 683643 - DNA, 25 bp, Mus musculus
gtcatagtaactacagggaccatat

SEQ ID NO: 683644 - DNA, 25 bp, Mus musculus
gtcatagtaacttcagggaccatat

SEQ ID NO: 683645 - DNA, 25 bp, Mus musculus
gtcatagtccgtagtcttgttttgc

SEQ ID NO: 683646 - DNA, 25 bp, Mus musculus
gtcatagtccgttgtcttgttttgc

SEQ ID NO: 683647 - DNA, 25 bp, Mus musculus
gtcatagtctttagcataccgatag

SEQ ID NO: 683648 - DNA, 25 bp, Mus musculus
gtcatagtcttttgcataccgatag

SEQ ID NO: 683649 - DNA, 25 bp, Mus musculus
gtcatagtgcatatgccctaggcta

SEQ ID NO: 683650 - DNA, 25 bp, Mus musculus
gtcatagtgcatttgccctaggcta

SEQ ID NO: 683651 - DNA, 25 bp, Mus musculus
gtcatagtgttcaagcaggctgccc

SEQ ID NO: 683652 - DNA, 25 bp, Mus musculus
gtcatagtgttctagcaggctgccc

SEQ ID NO: 683653 - DNA, 25 bp, Mus musculus
gtcatagttacaccccagtcttgga

SEQ ID NO: 683654 - DNA, 25 bp, Mus musculus
gtcatagttacagcccagtcttgga

SEQ ID NO: 683655 - DNA, 25 bp, Mus musculus
gtcatagttcataccaagaccttgg

SEQ ID NO: 683656 - DNA, 25 bp, Mus musculus
gtcatagttcattccaagaccttgg

SEQ ID NO: 683657 - DNA, 25 bp, Mus musculus
gtcatagttgctagtgcacaccttt

SEQ ID NO: 683658 - DNA, 25 bp, Mus musculus
gtcatagttgcttgtgcacaccttt

SEQ ID NO: 683659 - DNA, 25 bp, Mus musculus
gtcatagttggcagaacgctggtta

SEQ ID NO: 683660 - DNA, 25 bp, Mus musculus
gtcatagttggctgaacgctggtta

SEQ ID NO: 683661 - DNA, 25 bp, Mus musculus
gtcatatacgaacccgcagatgatc

SEQ ID NO: 683662 - DNA, 25 bp, Mus musculus
gtcatatacgaagccgcagatgatc

SEQ ID NO: 683663 - DNA, 25 bp, Mus musculus
gtcatatagccaactggcagccatt

SEQ ID NO: 683664 - DNA, 25 bp, Mus musculus
gtcatatagccatctggcagccatt

SEQ ID NO: 683665 - DNA, 25 bp, Mus musculus
gtcatatagtcaattggtggcatac

SEQ ID NO: 683666 - DNA, 25 bp, Mus musculus
gtcatatagtcatttggtggcatac

SEQ ID NO: 683667 - DNA, 25 bp, Mus musculus
gtcatatatgttcggtgcacttctg

SEQ ID NO: 683668 - DNA, 25 bp, Mus musculus
gtcatatatgttgggtgcacttctg

SEQ ID NO: 683669 - DNA, 25 bp, Mus musculus
gtcatatccgcaacattaatggacg

SEQ ID NO: 683670 - DNA, 25 bp, Mus musculus
gtcatatccgcatcattaatggacg

SEQ ID NO: 683671 - DNA, 25 bp, Mus musculus
gtcatatctccaccagggctgtaaa

SEQ ID NO: 683672 - DNA, 25 bp, Mus musculus
gtcatatctccagcagggctgtaaa

SEQ ID NO: 683673 - DNA, 25 bp, Mus musculus
gtcatatctgccatcaggcatgtgc

SEQ ID NO: 683674 - DNA, 25 bp, Mus musculus
gtcatatctgccttcaggcatgtgc

SEQ ID NO: 683675 - DNA, 25 bp, Mus musculus
gtcatatcttacagaaacgcctctc

SEQ ID NO: 683676 - DNA, 25 bp, Mus musculus
gtcatatcttactgaaacgcctctc

SEQ ID NO: 683677 - DNA, 25 bp, Mus musculus
gtcatatgatctctattcacagact

SEQ ID NO: 683678 - DNA, 25 bp, Mus musculus
gtcatatgatctgtattcacagact

SEQ ID NO: 683679 - DNA, 25 bp, Mus musculus
gtcatatgctcaaaacagcccggct

SEQ ID NO: 683680 - DNA, 25 bp, Mus musculus
gtcatatgctcataacagcccggct

SEQ ID NO: 683681 - DNA, 25 bp, Mus musculus
gtcatatgtatacagtcactagcaa

SEQ ID NO: 683682 - DNA, 25 bp, Mus musculus
gtcatatgtatagagtcactagcaa

SEQ ID NO: 683683 - DNA, 25 bp, Mus musculus
gtcatattaacaaacatcacatcaa

SEQ ID NO: 683684 - DNA, 25 bp, Mus musculus
gtcatattaacatacatcacatcaa

SEQ ID NO: 683685 - DNA, 25 bp, Mus musculus
gtcatattagggatatctgtcacat

SEQ ID NO: 683686 - DNA, 25 bp, Mus musculus
gtcatattagggttatctgtcacat

SEQ ID NO: 683687 - DNA, 25 bp, Mus musculus
gtcatattagtcatcttttacacaa

SEQ ID NO: 683688 - DNA, 25 bp, Mus musculus
gtcatattagtcttcttttacacaa

SEQ ID NO: 683689 - DNA, 25 bp, Mus musculus
gtcatattctgtcgatctctgaggt

SEQ ID NO: 683690 - DNA, 25 bp, Mus musculus
gtcatattctgtggatctctgaggt

SEQ ID NO: 683691 - DNA, 25 bp, Mus musculus
gtcatattgcctattcatttagaat

SEQ ID NO: 683692 - DNA, 25 bp, Mus musculus
gtcatattgccttttcatttagaat

SEQ ID NO: 683693 - DNA, 25 bp, Mus musculus
gtcatattggtcctttgatactgtg

SEQ ID NO: 683694 - DNA, 25 bp, Mus musculus
gtcatattggtcgtttgatactgtg

SEQ ID NO: 683695 - DNA, 25 bp, Mus musculus
gtcatatttacactactctcttcat

SEQ ID NO: 683696 - DNA, 25 bp, Mus musculus
gtcatatttacagtactctcttcat

SEQ ID NO: 683697 - DNA, 25 bp, Mus musculus
gtcatatttgcgctgagtgcctgaa

SEQ ID NO: 683698 - DNA, 25 bp, Mus musculus
gtcatatttgcggtgagtgcctgaa

SEQ ID NO: 683699 - DNA, 25 bp, Mus musculus
gtcatatttgtgctagggtctgtaa

SEQ ID NO: 683700 - DNA, 25 bp, Mus musculus
gtcatatttgtggtagggtctgtaa

SEQ ID NO: 683701 - DNA, 25 bp, Mus musculus
gtcatcaaaacacactccaatatct

SEQ ID NO: 683702 - DNA, 25 bp, Mus musculus
gtcatcaaaacagactccaatatct

SEQ ID NO: 683703 - DNA, 25 bp, Mus musculus
gtcatcaaagttaaggcatcccagg

SEQ ID NO: 683704 - DNA, 25 bp, Mus musculus
gtcatcaaagtttaggcatcccagg

SEQ ID NO: 683705 - DNA, 25 bp, Mus musculus
gtcatcaacgccatgcagtgcaggt

SEQ ID NO: 683706 - DNA, 25 bp, Mus musculus
gtcatcaacgccttgcagtgcaggt

SEQ ID NO: 683707 - DNA, 25 bp, Mus musculus
gtcatcaagatgatctctgccctga

SEQ ID NO: 683708 - DNA, 25 bp, Mus musculus
gtcatcaagatgttctctgccctga

SEQ ID NO: 683709 - DNA, 25 bp, Mus musculus
gtcatcaagcagaccctggagcggg

SEQ ID NO: 683710 - DNA, 25 bp, Mus musculus
gtcatcaagcagtccctggagcggg

SEQ ID NO: 683711 - DNA, 25 bp, Mus musculus
gtcatcaaggaacggacagtggctc

SEQ ID NO: 683712 - DNA, 25 bp, Mus musculus
gtcatcaaggaagggacagtggctc

SEQ ID NO: 683713 - DNA, 25 bp, Mus musculus
gtcatcaaggataaccggaaccgct

SEQ ID NO: 683714 - DNA, 25 bp, Mus musculus
gtcatcaaggattaccggaaccgct

SEQ ID NO: 683715 - DNA, 25 bp, Mus musculus
gtcatcaaggtgaacatttttaaag

SEQ ID NO: 683716 - DNA, 25 bp, Mus musculus
gtcatcaaggtgtacatttttaaag

SEQ ID NO: 683717 - DNA, 25 bp, Mus musculus
gtcatcaagtagcagacatttggtg

SEQ ID NO: 683718 - DNA, 25 bp, Mus musculus
gtcatcaagtaggagacatttggtg

SEQ ID NO: 683719 - DNA, 25 bp, Mus musculus
gtcatcaagtccctgcataaacacg

SEQ ID NO: 683720 - DNA, 25 bp, Mus musculus
gtcatcaagtccgtgcataaacacg

SEQ ID NO: 683721 - DNA, 25 bp, Mus musculus
gtcatcaatttccacttgcctagtg

SEQ ID NO: 683722 - DNA, 25 bp, Mus musculus
gtcatcaatttcgacttgcctagtg

SEQ ID NO: 683723 - DNA, 25 bp, Mus musculus
gtcatcacaataaatcccctcaata

SEQ ID NO: 683724 - DNA, 25 bp, Mus musculus
gtcatcacaatatatcccctcaata

SEQ ID NO: 683725 - DNA, 25 bp, Mus musculus
gtcatcacacatagttcctaatgta

SEQ ID NO: 683726 - DNA, 25 bp, Mus musculus
gtcatcacacattgttcctaatgta

SEQ ID NO: 683727 - DNA, 25 bp, Mus musculus
gtcatcacaggacgtgccagcagat

SEQ ID NO: 683728 - DNA, 25 bp, Mus musculus
gtcatcacaggaggtgccagcagat

SEQ ID NO: 683729 - DNA, 25 bp, Mus musculus
gtcatcacccaacgctaggcgagag

SEQ ID NO: 683730 - DNA, 25 bp, Mus musculus
gtcatcacccaaggctaggcgagag

SEQ ID NO: 683731 - DNA, 25 bp, Mus musculus
gtcatcacctagaaagatggccaga

SEQ ID NO: 683732 - DNA, 25 bp, Mus musculus
gtcatcacctagtaagatggccaga

SEQ ID NO: 683733 - DNA, 25 bp, Mus musculus
gtcatcacctgaacaagaccctgga

SEQ ID NO: 683734 - DNA, 25 bp, Mus musculus
gtcatcacctgacatcgtagccact

SEQ ID NO: 683735 - DNA, 25 bp, Mus musculus
gtcatcacctgagatcgtagccact

SEQ ID NO: 683736 - DNA, 25 bp, Mus musculus
gtcatcacctgatcaagaccctgga

SEQ ID NO: 683737 - DNA, 25 bp, Mus musculus
gtcatcactacaactggatccagtc

SEQ ID NO: 683738 - DNA, 25 bp, Mus musculus
gtcatcactacatctggatccagtc

SEQ ID NO: 683739 - DNA, 25 bp, Mus musculus
gtcatcactccaacttttgtactgc

SEQ ID NO: 683740 - DNA, 25 bp, Mus musculus
gtcatcactccatcttttgtactgc

SEQ ID NO: 683741 - DNA, 25 bp, Mus musculus
gtcatcactgtcaacatttgggtat

SEQ ID NO: 683742 - DNA, 25 bp, Mus musculus
gtcatcactgtctacatttgggtat

SEQ ID NO: 683743 - DNA, 25 bp, Mus musculus
gtcatcagagcaaatttattataac

SEQ ID NO: 683744 - DNA, 25 bp, Mus musculus
gtcatcagagcatatttattataac

SEQ ID NO: 683745 - DNA, 25 bp, Mus musculus
gtcatcagcaacatggcagagcctt

SEQ ID NO: 683746 - DNA, 25 bp, Mus musculus
gtcatcagcaacttggcagagcctt

SEQ ID NO: 683747 - DNA, 25 bp, Mus musculus
gtcatcagcattctgtgacagcgtg

SEQ ID NO: 683748 - DNA, 25 bp, Mus musculus
gtcatcagcattgtgtgacagcgtg

SEQ ID NO: 683749 - DNA, 25 bp, Mus musculus
gtcatcaggtgactcaggatactta

SEQ ID NO: 683750 - DNA, 25 bp, Mus musculus
gtcatcaggtgagtcaggatactta

SEQ ID NO: 683751 - DNA, 25 bp, Mus musculus
gtcatcagtcagatcagtggaccca

SEQ ID NO: 683752 - DNA, 25 bp, Mus musculus
gtcatcagtcagttcagtggaccca

SEQ ID NO: 683753 - DNA, 25 bp, Mus musculus
gtcatcatatggaacatggccagtc

SEQ ID NO: 683754 - DNA, 25 bp, Mus musculus
gtcatcatatggtacatggccagtc

SEQ ID NO: 683755 - DNA, 25 bp, Mus musculus
gtcatcatatgtcaacccatcccta

SEQ ID NO: 683756 - DNA, 25 bp, Mus musculus
gtcatcatatgtgaacccatcccta

SEQ ID NO: 683757 - DNA, 25 bp, Mus musculus
gtcatcatcatgacgatgctgctca

SEQ ID NO: 683758 - DNA, 25 bp, Mus musculus
gtcatcatcatgtcgatgctgctca

SEQ ID NO: 683759 - DNA, 25 bp, Mus musculus
gtcatcatcccgctgctgaaagatg

SEQ ID NO: 683760 - DNA, 25 bp, Mus musculus
gtcatcatcccggtgctgaaagatg

SEQ ID NO: 683761 - DNA, 25 bp, Mus musculus
gtcatcatcctccagcaaaacactt

SEQ ID NO: 683762 - DNA, 25 bp, Mus musculus
gtcatcatcctcgagcaaaacactt

SEQ ID NO: 683763 - DNA, 25 bp, Mus musculus
gtcatcatcgtccttgtgaagagtc

SEQ ID NO: 683764 - DNA, 25 bp, Mus musculus
gtcatcatcgtcgttgtgaagagtc

SEQ ID NO: 683765 - DNA, 25 bp, Mus musculus
gtcatcatctgtctgattgtcctta

SEQ ID NO: 683766 - DNA, 25 bp, Mus musculus
gtcatcatctgtgtgattgtcctta

SEQ ID NO: 683767 - DNA, 25 bp, Mus musculus
gtcatcatgagcctcttggaagcag

SEQ ID NO: 683768 - DNA, 25 bp, Mus musculus
gtcatcatgagcgtcttggaagcag

SEQ ID NO: 683769 - DNA, 25 bp, Mus musculus
gtcatcatgcccacaggtagcatat

SEQ ID NO: 683770 - DNA, 25 bp, Mus musculus
gtcatcatgccctcaggtagcatat

SEQ ID NO: 683771 - DNA, 25 bp, Mus musculus
gtcatcatggcgacagagctctctc

SEQ ID NO: 683772 - DNA, 25 bp, Mus musculus
gtcatcatggcgtcagagctctctc

SEQ ID NO: 683773 - DNA, 25 bp, Mus musculus
gtcatcatgggccttttccagatat

SEQ ID NO: 683774 - DNA, 25 bp, Mus musculus
gtcatcatgggcgttttccagatat

SEQ ID NO: 683775 - DNA, 25 bp, Mus musculus
gtcatcattagaacagctccttact

SEQ ID NO: 683776 - DNA, 25 bp, Mus musculus
gtcatcattagatcagctccttact

SEQ ID NO: 683777 - DNA, 25 bp, Mus musculus
gtcatcattggtatatattcgagca

SEQ ID NO: 683778 - DNA, 25 bp, Mus musculus
gtcatcattggtttatattcgagca

SEQ ID NO: 683779 - DNA, 25 bp, Mus musculus
gtcatccaaaagcttcttgctggtt

SEQ ID NO: 683780 - DNA, 25 bp, Mus musculus
gtcatccaaaaggttcttgctggtt

SEQ ID NO: 683781 - DNA, 25 bp, Mus musculus
gtcatccaagcgcatctcaaagttg

SEQ ID NO: 683782 - DNA, 25 bp, Mus musculus
gtcatccaagcggatctcaaagttg

SEQ ID NO: 683783 - DNA, 25 bp, Mus musculus
gtcatccacaatctccacttttgga

SEQ ID NO: 683784 - DNA, 25 bp, Mus musculus
gtcatccacaatgtccacttttgga

SEQ ID NO: 683785 - DNA, 25 bp, Mus musculus
gtcatccacatgaccttgcacatgt

SEQ ID NO: 683786 - DNA, 25 bp, Mus musculus
gtcatccacatgtccttgcacatgt

SEQ ID NO: 683787 - DNA, 25 bp, Mus musculus
gtcatccactctcttaatgctttta

SEQ ID NO: 683788 - DNA, 25 bp, Mus musculus
gtcatccactctgttaatgctttta

SEQ ID NO: 683789 - DNA, 25 bp, Mus musculus
gtcatccactgcactgtggtagaca

SEQ ID NO: 683790 - DNA, 25 bp, Mus musculus
gtcatccactgctctgtggtagaca

SEQ ID NO: 683791 - DNA, 25 bp, Mus musculus
gtcatccactttaacttgttatcat

SEQ ID NO: 683792 - DNA, 25 bp, Mus musculus
gtcatccacttttacttgttatcat

SEQ ID NO: 683793 - DNA, 25 bp, Mus musculus
gtcatccagaatcttggcctcctaa

SEQ ID NO: 683794 - DNA, 25 bp, Mus musculus
gtcatccagaatgttggcctcctaa

SEQ ID NO: 683795 - DNA, 25 bp, Mus musculus
gtcatccagatgcatcttctattta

SEQ ID NO: 683796 - DNA, 25 bp, Mus musculus
gtcatccagatggatcttctattta

SEQ ID NO: 683797 - DNA, 25 bp, Mus musculus
gtcatccatgtgcaatttcccgaca

SEQ ID NO: 683798 - DNA, 25 bp, Mus musculus
gtcatccatgtggaatttcccgaca

SEQ ID NO: 683799 - DNA, 25 bp, Mus musculus
gtcatccattgtacccaaaagctaa

SEQ ID NO: 683800 - DNA, 25 bp, Mus musculus
gtcatccattgttcccaaaagctaa

SEQ ID NO: 683801 - DNA, 25 bp, Mus musculus
gtcatcccagcaatctgcaggctga

SEQ ID NO: 683802 - DNA, 25 bp, Mus musculus
gtcatcccagcattctgcaggctga

SEQ ID NO: 683803 - DNA, 25 bp, Mus musculus
gtcatcccatgtccacagaggatct

SEQ ID NO: 683804 - DNA, 25 bp, Mus musculus
gtcatcccatgtgcacagaggatct

SEQ ID NO: 683805 - DNA, 25 bp, Mus musculus
gtcatccccaaacgaaaatctgaca

SEQ ID NO: 683806 - DNA, 25 bp, Mus musculus
gtcatccccaaaggaaaatctgaca

SEQ ID NO: 683807 - DNA, 25 bp, Mus musculus
gtcatcccctctccaatagaagaaa

SEQ ID NO: 683808 - DNA, 25 bp, Mus musculus
gtcatcccctctgcaatagaagaaa

SEQ ID NO: 683809 - DNA, 25 bp, Mus musculus
gtcatcccgaatccgcaaactggag

SEQ ID NO: 683810 - DNA, 25 bp, Mus musculus
gtcatcccgaatgcgcaaactggag

SEQ ID NO: 683811 - DNA, 25 bp, Mus musculus
gtcatccctgtgaggttcaccaaag

SEQ ID NO: 683812 - DNA, 25 bp, Mus musculus
gtcatccctgtgtggttcaccaaag

SEQ ID NO: 683813 - DNA, 25 bp, Mus musculus
gtcatccgaattaaacccttcaagt

SEQ ID NO: 683814 - DNA, 25 bp, Mus musculus
gtcatccgaatttaacccttcaagt

SEQ ID NO: 683815 - DNA, 25 bp, Mus musculus
gtcatccgctaccatgtcacagtat

SEQ ID NO: 683816 - DNA, 25 bp, Mus musculus
gtcatccgctacgatgtcacagtat

SEQ ID NO: 683817 - DNA, 25 bp, Mus musculus
gtcatccggcagctggacgttgtaa

SEQ ID NO: 683818 - DNA, 25 bp, Mus musculus
gtcatccggcaggtggacgttgtaa

SEQ ID NO: 683819 - DNA, 25 bp, Mus musculus
gtcatccggcatcctatgaatctgg

SEQ ID NO: 683820 - DNA, 25 bp, Mus musculus
gtcatccggcatgctatgaatctgg

SEQ ID NO: 683821 - DNA, 25 bp, Mus musculus
gtcatcctacaaagagcagttggtt

SEQ ID NO: 683822 - DNA, 25 bp, Mus musculus
gtcatcctacaatgagcagttggtt

SEQ ID NO: 683823 - DNA, 25 bp, Mus musculus
gtcatcctacttctgacacgatctt

SEQ ID NO: 683824 - DNA, 25 bp, Mus musculus
gtcatcctacttgtgacacgatctt

SEQ ID NO: 683825 - DNA, 25 bp, Mus musculus
gtcatcctagacatctgcactacag

SEQ ID NO: 683826 - DNA, 25 bp, Mus musculus
gtcatcctagacttctgcactacag

SEQ ID NO: 683827 - DNA, 25 bp, Mus musculus
gtcatcctaggactggttgctttgt

SEQ ID NO: 683828 - DNA, 25 bp, Mus musculus
gtcatcctaggagtggttgctttgt

SEQ ID NO: 683829 - DNA, 25 bp, Mus musculus
gtcatcctatttcctaggtcacaga

SEQ ID NO: 683830 - DNA, 25 bp, Mus musculus
gtcatcctatttgctaggtcacaga

SEQ ID NO: 683831 - DNA, 25 bp, Mus musculus
gtcatcctccacaacatacagggtt

SEQ ID NO: 683832 - DNA, 25 bp, Mus musculus
gtcatcctccactacatacagggtt

SEQ ID NO: 683833 - DNA, 25 bp, Mus musculus
gtcatcctctaaaatggcctttctc

SEQ ID NO: 683834 - DNA, 25 bp, Mus musculus
gtcatcctctaatatggcctttctc

SEQ ID NO: 683835 - DNA, 25 bp, Mus musculus
gtcatcctctacactctagtggttg

SEQ ID NO: 683836 - DNA, 25 bp, Mus musculus
gtcatcctctacattgacgtctatg

SEQ ID NO: 683837 - DNA, 25 bp, Mus musculus
gtcatcctctactctctagtggttg

SEQ ID NO: 683838 - DNA, 25 bp, Mus musculus
gtcatcctctactttgacgtctatg

SEQ ID NO: 683839 - DNA, 25 bp, Mus musculus
gtcatcctgaggaaacttggttgtt

SEQ ID NO: 683840 - DNA, 25 bp, Mus musculus
gtcatcctgaggtaacttggttgtt

SEQ ID NO: 683841 - DNA, 25 bp, Mus musculus
gtcatcctgcagcaactttgaacca

SEQ ID NO: 683842 - DNA, 25 bp, Mus musculus
gtcatcctgcaggaactttgaacca

SEQ ID NO: 683843 - DNA, 25 bp, Mus musculus
gtcatccttatcaacagggccaaag

SEQ ID NO: 683844 - DNA, 25 bp, Mus musculus
gtcatccttatctacagggccaaag

SEQ ID NO: 683845 - DNA, 25 bp, Mus musculus
gtcatccttcatcttttgactttgt

SEQ ID NO: 683846 - DNA, 25 bp, Mus musculus
gtcatccttcatgttttgactttgt

SEQ ID NO: 683847 - DNA, 25 bp, Mus musculus
gtcatccttggcatcgtacaaagtc

SEQ ID NO: 683848 - DNA, 25 bp, Mus musculus
gtcatccttggcttcgtacaaagtc

SEQ ID NO: 683849 - DNA, 25 bp, Mus musculus
gtcatcctttggaaagcgtcgcaac

SEQ ID NO: 683850 - DNA, 25 bp, Mus musculus
gtcatcctttggtaagcgtcgcaac

SEQ ID NO: 683851 - DNA, 25 bp, Mus musculus
gtcatccttttgcacagtctactgc

SEQ ID NO: 683852 - DNA, 25 bp, Mus musculus
gtcatccttttggacagtctactgc

SEQ ID NO: 683853 - DNA, 25 bp, Mus musculus
gtcatcctttttcagtactaacgct

SEQ ID NO: 683854 - DNA, 25 bp, Mus musculus
gtcatcctttttgagtactaacgct

SEQ ID NO: 683855 - DNA, 25 bp, Mus musculus
gtcatcgacaagctcttccttgaca

SEQ ID NO: 683856 - DNA, 25 bp, Mus musculus
gtcatcgacaaggtcttccttgaca

SEQ ID NO: 683857 - DNA, 25 bp, Mus musculus
gtcatcgacgacactcttcaagtca

SEQ ID NO: 683858 - DNA, 25 bp, Mus musculus
gtcatcgacgactctcttcaagtca

SEQ ID NO: 683859 - DNA, 25 bp, Mus musculus
gtcatcgagatccagagcaaacact

SEQ ID NO: 683860 - DNA, 25 bp, Mus musculus
gtcatcgagatcgagagcaaacact

SEQ ID NO: 683861 - DNA, 25 bp, Mus musculus
gtcatcgagcagcaaatcatctatt

SEQ ID NO: 683862 - DNA, 25 bp, Mus musculus
gtcatcgagcaggaaatcatctatt

SEQ ID NO: 683863 - DNA, 25 bp, Mus musculus
gtcatcgctggcatttcagctcttt

SEQ ID NO: 683864 - DNA, 25 bp, Mus musculus
gtcatcgctggcttttcagctcttt

SEQ ID NO: 683865 - DNA, 25 bp, Mus musculus
gtcatcggactgctggctttgtatc

SEQ ID NO: 683866 - DNA, 25 bp, Mus musculus
gtcatcggactggtggctttgtatc

SEQ ID NO: 683867 - DNA, 25 bp, Mus musculus
gtcatcgggctgcatgagcttctca

SEQ ID NO: 683868 - DNA, 25 bp, Mus musculus
gtcatcgggctggatgagcttctca

SEQ ID NO: 683869 - DNA, 25 bp, Mus musculus
gtcatcgttcctcctggacggagaa

SEQ ID NO: 683870 - DNA, 25 bp, Mus musculus
gtcatcgttcctgctggacggagaa

SEQ ID NO: 683871 - DNA, 25 bp, Mus musculus
gtcatcgttcggatcttaaccgtga

SEQ ID NO: 683872 - DNA, 25 bp, Mus musculus
gtcatcgttcggttcttaaccgtga

SEQ ID NO: 683873 - DNA, 25 bp, Mus musculus
gtcatcgttcgtcagcgacaactgg

SEQ ID NO: 683874 - DNA, 25 bp, Mus musculus
gtcatcgttcgtgagcgacaactgg

SEQ ID NO: 683875 - DNA, 25 bp, Mus musculus
gtcatctaaccaccctccaataaat

SEQ ID NO: 683876 - DNA, 25 bp, Mus musculus
gtcatctaaccagcctccaataaat

SEQ ID NO: 683877 - DNA, 25 bp, Mus musculus
gtcatctaatggacattggccactt

SEQ ID NO: 683878 - DNA, 25 bp, Mus musculus
gtcatctaatggtcattggccactt

SEQ ID NO: 683879 - DNA, 25 bp, Mus musculus
gtcatctacaagatcctcagcatac

SEQ ID NO: 683880 - DNA, 25 bp, Mus musculus
gtcatctacaagttcctcagcatac

SEQ ID NO: 683881 - DNA, 25 bp, Mus musculus
gtcatctacaggaaaatccagggaa

SEQ ID NO: 683882 - DNA, 25 bp, Mus musculus
gtcatctacaggatcccacaaggtg

SEQ ID NO: 683883 - DNA, 25 bp, Mus musculus
gtcatctacaggtaaatccagggaa

SEQ ID NO: 683884 - DNA, 25 bp, Mus musculus
gtcatctacaggttcccacaaggtg

SEQ ID NO: 683885 - DNA, 25 bp, Mus musculus
gtcatctacgtgcacaacctgaaag

SEQ ID NO: 683886 - DNA, 25 bp, Mus musculus
gtcatctacgtggacaacctgaaag

SEQ ID NO: 683887 - DNA, 25 bp, Mus musculus
gtcatctactgacaataccacggct

SEQ ID NO: 683888 - DNA, 25 bp, Mus musculus
gtcatctactgagaataccacggct

SEQ ID NO: 683889 - DNA, 25 bp, Mus musculus
gtcatctactgcatcctgttattca

SEQ ID NO: 683890 - DNA, 25 bp, Mus musculus
gtcatctactgcttcctgttattca

SEQ ID NO: 683891 - DNA, 25 bp, Mus musculus
gtcatctagacacctttctgatggc

SEQ ID NO: 683892 - DNA, 25 bp, Mus musculus
gtcatctagacagctttctgatggc

SEQ ID NO: 683893 - DNA, 25 bp, Mus musculus
gtcatctagcaacggagctggtcgt

SEQ ID NO: 683894 - DNA, 25 bp, Mus musculus
gtcatctagcaagggagctggtcgt

SEQ ID NO: 683895 - DNA, 25 bp, Mus musculus
gtcatctatctcatgagtggtcaaa

SEQ ID NO: 683896 - DNA, 25 bp, Mus musculus
gtcatctatctcttgagtggtcaaa

SEQ ID NO: 683897 - DNA, 25 bp, Mus musculus
gtcatctatgagactgtgcatccca

SEQ ID NO: 683898 - DNA, 25 bp, Mus musculus
gtcatctatgagtctgtgcatccca

SEQ ID NO: 683899 - DNA, 25 bp, Mus musculus
gtcatctcagatattcctttctctg

SEQ ID NO: 683900 - DNA, 25 bp, Mus musculus
gtcatctcagattttcctttctctg

SEQ ID NO: 683901 - DNA, 25 bp, Mus musculus
gtcatctcataccatgagggcccta

SEQ ID NO: 683902 - DNA, 25 bp, Mus musculus
gtcatctcatacgatgagggcccta

SEQ ID NO: 683903 - DNA, 25 bp, Mus musculus
gtcatctcattaatataccgaaact

SEQ ID NO: 683904 - DNA, 25 bp, Mus musculus
gtcatctcattattataccgaaact

SEQ ID NO: 683905 - DNA, 25 bp, Mus musculus
gtcatctccaacaggctgaaaggct

SEQ ID NO: 683906 - DNA, 25 bp, Mus musculus
gtcatctccaactggctgaaaggct

SEQ ID NO: 683907 - DNA, 25 bp, Mus musculus
gtcatctccaagaggccacactatt

SEQ ID NO: 683908 - DNA, 25 bp, Mus musculus
gtcatctccaagtggccacactatt

SEQ ID NO: 683909 - DNA, 25 bp, Mus musculus
gtcatctccacactacatcagaagt

SEQ ID NO: 683910 - DNA, 25 bp, Mus musculus
gtcatctccacagtacatcagaagt

SEQ ID NO: 683911 - DNA, 25 bp, Mus musculus
gtcatctccatgctgaagttagact

SEQ ID NO: 683912 - DNA, 25 bp, Mus musculus
gtcatctccatggtgaagttagact

SEQ ID NO: 683913 - DNA, 25 bp, Mus musculus
gtcatctcctagacaatcagtcaaa

SEQ ID NO: 683914 - DNA, 25 bp, Mus musculus
gtcatctcctagtcaatcagtcaaa

SEQ ID NO: 683915 - DNA, 25 bp, Mus musculus
gtcatctcctttacctatgggtttg

SEQ ID NO: 683916 - DNA, 25 bp, Mus musculus
gtcatctccttttcctatgggtttg

SEQ ID NO: 683917 - DNA, 25 bp, Mus musculus
gtcatctcgcatcagaaaccgttac

SEQ ID NO: 683918 - DNA, 25 bp, Mus musculus
gtcatctcgcatgagaaaccgttac

SEQ ID NO: 683919 - DNA, 25 bp, Mus musculus
gtcatctcgctcctcatgtttaaaa

SEQ ID NO: 683920 - DNA, 25 bp, Mus musculus
gtcatctcgctcgtcatgtttaaaa

SEQ ID NO: 683921 - DNA, 25 bp, Mus musculus
gtcatctcgtggcacagtggtattt

SEQ ID NO: 683922 - DNA, 25 bp, Mus musculus
gtcatctcgtgggacagtggtattt

SEQ ID NO: 683923 - DNA, 25 bp, Mus musculus
gtcatctctaagacctagatgcctc

SEQ ID NO: 683924 - DNA, 25 bp, Mus musculus
gtcatctctaagtcctagatgcctc

SEQ ID NO: 683925 - DNA, 25 bp, Mus musculus
gtcatctctacacagctactttgga

SEQ ID NO: 683926 - DNA, 25 bp, Mus musculus
gtcatctctacagagctactttgga

SEQ ID NO: 683927 - DNA, 25 bp, Mus musculus
gtcatctctcggacagtaggtccga

SEQ ID NO: 683928 - DNA, 25 bp, Mus musculus
gtcatctctcggtcagtaggtccga

SEQ ID NO: 683929 - DNA, 25 bp, Mus musculus
gtcatctctcttcaagactttccaa

SEQ ID NO: 683930 - DNA, 25 bp, Mus musculus
gtcatctctcttgaagactttccaa

SEQ ID NO: 683931 - DNA, 25 bp, Mus musculus
gtcatctctgaaagggtctctggcc

SEQ ID NO: 683932 - DNA, 25 bp, Mus musculus
gtcatctctgaatgggtctctggcc

SEQ ID NO: 683933 - DNA, 25 bp, Mus musculus
gtcatctcttcaattgggttgaaca

SEQ ID NO: 683934 - DNA, 25 bp, Mus musculus
gtcatctcttcatttgggttgaaca

SEQ ID NO: 683935 - DNA, 25 bp, Mus musculus
gtcatctgacttaaacgagcggcta

SEQ ID NO: 683936 - DNA, 25 bp, Mus musculus
gtcatctgactttaacgagcggcta

SEQ ID NO: 683937 - DNA, 25 bp, Mus musculus
gtcatctgcattcgagggctcagca

SEQ ID NO: 683938 - DNA, 25 bp, Mus musculus
gtcatctgcattggagggctcagca

SEQ ID NO: 683939 - DNA, 25 bp, Mus musculus
gtcatctgccagagtatatgtccct

SEQ ID NO: 683940 - DNA, 25 bp, Mus musculus
gtcatctgccagtgtatatgtccct

SEQ ID NO: 683941 - DNA, 25 bp, Mus musculus
gtcatctgcccactttaaccatgat

SEQ ID NO: 683942 - DNA, 25 bp, Mus musculus
gtcatctgcccagtttaaccatgat

SEQ ID NO: 683943 - DNA, 25 bp, Mus musculus
gtcatctgccttaggtccagtttcc

SEQ ID NO: 683944 - DNA, 25 bp, Mus musculus
gtcatctgcctttggtccagtttcc

SEQ ID NO: 683945 - DNA, 25 bp, Mus musculus
gtcatctgctggattgtccataaca

SEQ ID NO: 683946 - DNA, 25 bp, Mus musculus
gtcatctgctggtttgtccataaca

SEQ ID NO: 683947 - DNA, 25 bp, Mus musculus
gtcatctgcttcatcatcattgtgc

SEQ ID NO: 683948 - DNA, 25 bp, Mus musculus
gtcatctgcttcttcatcattgtgc

SEQ ID NO: 683949 - DNA, 25 bp, Mus musculus
gtcatctggactaatcaagctggga

SEQ ID NO: 683950 - DNA, 25 bp, Mus musculus
gtcatctggacttatcaagctggga

SEQ ID NO: 683951 - DNA, 25 bp, Mus musculus
gtcatctggatgctgtatcactccc

SEQ ID NO: 683952 - DNA, 25 bp, Mus musculus
gtcatctggatggtgtatcactccc

SEQ ID NO: 683953 - DNA, 25 bp, Mus musculus
gtcatctggcaaatatctgctcctg

SEQ ID NO: 683954 - DNA, 25 bp, Mus musculus
gtcatctggcaattatctgctcctg

SEQ ID NO: 683955 - DNA, 25 bp, Mus musculus
gtcatctgtacgaacacagcagtgt

SEQ ID NO: 683956 - DNA, 25 bp, Mus musculus
gtcatctgtacgtacacagcagtgt

SEQ ID NO: 683957 - DNA, 25 bp, Mus musculus
gtcatctgtcagatctttctctgaa

SEQ ID NO: 683958 - DNA, 25 bp, Mus musculus
gtcatctgtcagttctttctctgaa

SEQ ID NO: 683959 - DNA, 25 bp, Mus musculus
gtcatctgtcccagggaagcgttca

SEQ ID NO: 683960 - DNA, 25 bp, Mus musculus
gtcatctgtccctgggaagcgttca

SEQ ID NO: 683961 - DNA, 25 bp, Mus musculus
gtcatctgtgccacggcatagacgt

SEQ ID NO: 683962 - DNA, 25 bp, Mus musculus
gtcatctgtgcctcggcatagacgt

SEQ ID NO: 683963 - DNA, 25 bp, Mus musculus
gtcatctgtttcaaattgtggcaaa

SEQ ID NO: 683964 - DNA, 25 bp, Mus musculus
gtcatctgtttctaattgtggcaaa

SEQ ID NO: 683965 - DNA, 25 bp, Mus musculus
gtcatcttaattaggcaagcacagc

SEQ ID NO: 683966 - DNA, 25 bp, Mus musculus
gtcatcttaatttggcaagcacagc

SEQ ID NO: 683967 - DNA, 25 bp, Mus musculus
gtcatcttacacaatttttactgtg

SEQ ID NO: 683968 - DNA, 25 bp, Mus musculus
gtcatcttacactatttttactgtg

SEQ ID NO: 683969 - DNA, 25 bp, Mus musculus
gtcatcttacatccaaaactacacg

SEQ ID NO: 683970 - DNA, 25 bp, Mus musculus
gtcatcttacatgcaaaactacacg

SEQ ID NO: 683971 - DNA, 25 bp, Mus musculus
gtcatcttagctcttaggactcagc

SEQ ID NO: 683972 - DNA, 25 bp, Mus musculus
gtcatcttagctgttaggactcagc

SEQ ID NO: 683973 - DNA, 25 bp, Mus musculus
gtcatcttaggcaagcgtgcagtaa

SEQ ID NO: 683974 - DNA, 25 bp, Mus musculus
gtcatcttaggctagcgtgcagtaa

SEQ ID NO: 683975 - DNA, 25 bp, Mus musculus
gtcatcttattcagccatacatttg

SEQ ID NO: 683976 - DNA, 25 bp, Mus musculus
gtcatcttattctgccatacatttg

SEQ ID NO: 683977 - DNA, 25 bp, Mus musculus
gtcatcttcaagaacgaggttccta

SEQ ID NO: 683978 - DNA, 25 bp, Mus musculus
gtcatcttcaagtacgaggttccta

SEQ ID NO: 683979 - DNA, 25 bp, Mus musculus
gtcatcttcatcactctcatagcca

SEQ ID NO: 683980 - DNA, 25 bp, Mus musculus
gtcatcttcatctctctcatagcca

SEQ ID NO: 683981 - DNA, 25 bp, Mus musculus
gtcatcttccaaccagcgtctgaga

SEQ ID NO: 683982 - DNA, 25 bp, Mus musculus
gtcatcttccaagcagcgtctgaga

SEQ ID NO: 683983 - DNA, 25 bp, Mus musculus
gtcatcttcccgactgatcaatata

SEQ ID NO: 683984 - DNA, 25 bp, Mus musculus
gtcatcttcccgtctgatcaatata

SEQ ID NO: 683985 - DNA, 25 bp, Mus musculus
gtcatcttcctgaatgtaaatgcta

SEQ ID NO: 683986 - DNA, 25 bp, Mus musculus
gtcatcttcctgcaaactgagttat

SEQ ID NO: 683987 - DNA, 25 bp, Mus musculus
gtcatcttcctggaaactgagttat

SEQ ID NO: 683988 - DNA, 25 bp, Mus musculus
gtcatcttcctgtatgtaaatgcta

SEQ ID NO: 683989 - DNA, 25 bp, Mus musculus
gtcatcttcggcagtggcacagtca

SEQ ID NO: 683990 - DNA, 25 bp, Mus musculus
gtcatcttcggctgtggcacagtca

SEQ ID NO: 683991 - DNA, 25 bp, Mus musculus
gtcatcttcgtcattttgtgtttgt

SEQ ID NO: 683992 - DNA, 25 bp, Mus musculus
gtcatcttcgtctttttgtgtttgt

SEQ ID NO: 683993 - DNA, 25 bp, Mus musculus
gtcatcttctaaaatggctgctttg

SEQ ID NO: 683994 - DNA, 25 bp, Mus musculus
gtcatcttctaatatggctgctttg

SEQ ID NO: 683995 - DNA, 25 bp, Mus musculus
gtcatcttctatccccgggtagggt

SEQ ID NO: 683996 - DNA, 25 bp, Mus musculus
gtcatcttctatgcccgggtagggt

SEQ ID NO: 683997 - DNA, 25 bp, Mus musculus
gtcatcttctcaaattttatcttca

SEQ ID NO: 683998 - DNA, 25 bp, Mus musculus
gtcatcttctcatattttatcttca

SEQ ID NO: 683999 - DNA, 25 bp, Mus musculus
gtcatcttgccacaatgctacaggt

SEQ ID NO: 684000 - DNA, 25 bp, Mus musculus
gtcatcttgccagaatgctacaggt

SEQ ID NO: 684001 - DNA, 25 bp, Mus musculus
gtcatcttgcctccagggaaggaac

SEQ ID NO: 684002 - DNA, 25 bp, Mus musculus
gtcatcttgcctgcagggaaggaac

SEQ ID NO: 684003 - DNA, 25 bp, Mus musculus
gtcatcttggaccttgtgctcaagg

SEQ ID NO: 684004 - DNA, 25 bp, Mus musculus
gtcatcttggacgttgtgctcaagg

SEQ ID NO: 684005 - DNA, 25 bp, Mus musculus
gtcatcttgtgacagcctgaagccc

SEQ ID NO: 684006 - DNA, 25 bp, Mus musculus
gtcatcttgtgagagcctgaagccc

SEQ ID NO: 684007 - DNA, 25 bp, Mus musculus
gtcatctttcagatttaaggccatg

SEQ ID NO: 684008 - DNA, 25 bp, Mus musculus
gtcatctttcagttttaaggccatg

SEQ ID NO: 684009 - DNA, 25 bp, Mus musculus
gtcatctttgacagttattttttcc

SEQ ID NO: 684010 - DNA, 25 bp, Mus musculus
gtcatctttgactgttattttttcc

SEQ ID NO: 684011 - DNA, 25 bp, Mus musculus
gtcatctttgcccatgtggcccagc

SEQ ID NO: 684012 - DNA, 25 bp, Mus musculus
gtcatctttgccgatgtggcccagc

SEQ ID NO: 684013 - DNA, 25 bp, Mus musculus
gtcatctttggtcacagagcacatg

SEQ ID NO: 684014 - DNA, 25 bp, Mus musculus
gtcatctttggtgacagagcacatg

SEQ ID NO: 684015 - DNA, 25 bp, Mus musculus
gtcatctttgtcataggcaagctat

SEQ ID NO: 684016 - DNA, 25 bp, Mus musculus
gtcatctttgtcttaggcaagctat

SEQ ID NO: 684017 - DNA, 25 bp, Mus musculus
gtcatctttgttcgaagccgttcag

SEQ ID NO: 684018 - DNA, 25 bp, Mus musculus
gtcatctttgttggaagccgttcag

SEQ ID NO: 684019 - DNA, 25 bp, Mus musculus
gtcatcttttcacccctagattttt

SEQ ID NO: 684020 - DNA, 25 bp, Mus musculus
gtcatcttttcagccctagattttt

SEQ ID NO: 684021 - DNA, 25 bp, Mus musculus
gtcatgaaaggccagcaacagtcag

SEQ ID NO: 684022 - DNA, 25 bp, Mus musculus
gtcatgaaaggcgagcaacagtcag

SEQ ID NO: 684023 - DNA, 25 bp, Mus musculus
gtcatgaaataaaaccacagtccag

SEQ ID NO: 684024 - DNA, 25 bp, Mus musculus
gtcatgaaataataccacagtccag

SEQ ID NO: 684025 - DNA, 25 bp, Mus musculus
gtcatgaaatttaaactgtcctaca

SEQ ID NO: 684026 - DNA, 25 bp, Mus musculus
gtcatgaaattttaactgtcctaca

SEQ ID NO: 684027 - DNA, 25 bp, Mus musculus
gtcatgaacaaacgatgcctgcagc

SEQ ID NO: 684028 - DNA, 25 bp, Mus musculus
gtcatgaacaaaggatgcctgcagc

SEQ ID NO: 684029 - DNA, 25 bp, Mus musculus
gtcatgaacgtcaatgtcatcctcc

SEQ ID NO: 684030 - DNA, 25 bp, Mus musculus
gtcatgaacgtctatgtcatcctcc

SEQ ID NO: 684031 - DNA, 25 bp, Mus musculus
gtcatgaacgtgagcgtgctttcct

SEQ ID NO: 684032 - DNA, 25 bp, Mus musculus
gtcatgaacgtgtgcgtgctttcct

SEQ ID NO: 684033 - DNA, 25 bp, Mus musculus
gtcatgaagctcattcatttcttaa

SEQ ID NO: 684034 - DNA, 25 bp, Mus musculus
gtcatgaagctctttcatttcttaa

SEQ ID NO: 684035 - DNA, 25 bp, Mus musculus
gtcatgaaggctacagacaagcaat

SEQ ID NO: 684036 - DNA, 25 bp, Mus musculus
gtcatgaaggcttcagacaagcaat

SEQ ID NO: 684037 - DNA, 25 bp, Mus musculus
gtcatgaatcagactaatggaccta

SEQ ID NO: 684038 - DNA, 25 bp, Mus musculus
gtcatgaatcagtctaatggaccta

SEQ ID NO: 684039 - DNA, 25 bp, Mus musculus
gtcatgacaaccctgttagctgctt

SEQ ID NO: 684040 - DNA, 25 bp, Mus musculus
gtcatgacaaccgtgttagctgctt

SEQ ID NO: 684041 - DNA, 25 bp, Mus musculus
gtcatgacagtgattgcctgcctca

SEQ ID NO: 684042 - DNA, 25 bp, Mus musculus
gtcatgacagtgtttgcctgcctca

SEQ ID NO: 684043 - DNA, 25 bp, Mus musculus
gtcatgacattactcttcatctaag

SEQ ID NO: 684044 - DNA, 25 bp, Mus musculus
gtcatgacattagtcttcatctaag

SEQ ID NO: 684045 - DNA, 25 bp, Mus musculus
gtcatgaccataatgttgtgttgat

SEQ ID NO: 684046 - DNA, 25 bp, Mus musculus
gtcatgaccatattgttgtgttgat

SEQ ID NO: 684047 - DNA, 25 bp, Mus musculus
gtcatgaccttactgtgtagccgag

SEQ ID NO: 684048 - DNA, 25 bp, Mus musculus
gtcatgaccttagtgtgtagccgag

SEQ ID NO: 684049 - DNA, 25 bp, Mus musculus
gtcatgaccttccagcagcaggaca

SEQ ID NO: 684050 - DNA, 25 bp, Mus musculus
gtcatgaccttcgagcagcaggaca

SEQ ID NO: 684051 - DNA, 25 bp, Mus musculus
gtcatgactccacatatcttagcta

SEQ ID NO: 684052 - DNA, 25 bp, Mus musculus
gtcatgactccagatatcttagcta

SEQ ID NO: 684053 - DNA, 25 bp, Mus musculus
gtcatgacttaacctctagctttgg

SEQ ID NO: 684054 - DNA, 25 bp, Mus musculus
gtcatgacttaagctctagctttgg

SEQ ID NO: 684055 - DNA, 25 bp, Mus musculus
gtcatgacttacacaacaaactgta

SEQ ID NO: 684056 - DNA, 25 bp, Mus musculus
gtcatgacttactcaacaaactgta

SEQ ID NO: 684057 - DNA, 25 bp, Mus musculus
gtcatgacttgtattgtccttctac

SEQ ID NO: 684058 - DNA, 25 bp, Mus musculus
gtcatgacttgttttgtccttctac

SEQ ID NO: 684059 - DNA, 25 bp, Mus musculus
gtcatgactttcagtggattgtttt

SEQ ID NO: 684060 - DNA, 25 bp, Mus musculus
gtcatgactttctgtggattgtttt

SEQ ID NO: 684061 - DNA, 25 bp, Mus musculus
gtcatgagaacccagtggacatcct

SEQ ID NO: 684062 - DNA, 25 bp, Mus musculus
gtcatgagaaccgagtggacatcct

SEQ ID NO: 684063 - DNA, 25 bp, Mus musculus
gtcatgagccagcttctttacttca

SEQ ID NO: 684064 - DNA, 25 bp, Mus musculus
gtcatgagccaggttctttacttca

SEQ ID NO: 684065 - DNA, 25 bp, Mus musculus
gtcatgagcggaacaatctccacgt

SEQ ID NO: 684066 - DNA, 25 bp, Mus musculus
gtcatgagcggatcaatctccacgt

SEQ ID NO: 684067 - DNA, 25 bp, Mus musculus
gtcatgaggcacacgaagaagcgaa

SEQ ID NO: 684068 - DNA, 25 bp, Mus musculus
gtcatgaggcactcgaagaagcgaa

SEQ ID NO: 684069 - DNA, 25 bp, Mus musculus
gtcatgaggcatattaatacaccaa

SEQ ID NO: 684070 - DNA, 25 bp, Mus musculus
gtcatgaggcattttaatacaccaa

SEQ ID NO: 684071 - DNA, 25 bp, Mus musculus
gtcatgaggtgaattgatttccttt

SEQ ID NO: 684072 - DNA, 25 bp, Mus musculus
gtcatgaggtgatttgatttccttt

SEQ ID NO: 684073 - DNA, 25 bp, Mus musculus
gtcatgagtaacacgacagtgccca

SEQ ID NO: 684074 - DNA, 25 bp, Mus musculus
gtcatgagtaactcgacagtgccca

SEQ ID NO: 684075 - DNA, 25 bp, Mus musculus
gtcatgagttgtcatttctctccat

SEQ ID NO: 684076 - DNA, 25 bp, Mus musculus
gtcatgagttgtgatttctctccat

SEQ ID NO: 684077 - DNA, 25 bp, Mus musculus
gtcatgatagttcaaatcgggtaca

SEQ ID NO: 684078 - DNA, 25 bp, Mus musculus
gtcatgatagttgaaatcgggtaca

SEQ ID NO: 684079 - DNA, 25 bp, Mus musculus
gtcatgatatctaaactgcaggagt

SEQ ID NO: 684080 - DNA, 25 bp, Mus musculus
gtcatgatatcttaactgcaggagt

SEQ ID NO: 684081 - DNA, 25 bp, Mus musculus
gtcatgatctgccagcaccaagaaa

SEQ ID NO: 684082 - DNA, 25 bp, Mus musculus
gtcatgatctgcgagcaccaagaaa

SEQ ID NO: 684083 - DNA, 25 bp, Mus musculus
gtcatgatgcagacaaatacattta

SEQ ID NO: 684084 - DNA, 25 bp, Mus musculus
gtcatgatgcagacaccacagctca

SEQ ID NO: 684085 - DNA, 25 bp, Mus musculus
gtcatgatgcagtcaaatacattta

SEQ ID NO: 684086 - DNA, 25 bp, Mus musculus
gtcatgatgcagtcaccacagctca

SEQ ID NO: 684087 - DNA, 25 bp, Mus musculus
gtcatgatgcccaaggaaactctcc

SEQ ID NO: 684088 - DNA, 25 bp, Mus musculus
gtcatgatgccctaggaaactctcc

SEQ ID NO: 684089 - DNA, 25 bp, Mus musculus
gtcatgatgctcatagcctgtgaga

SEQ ID NO: 684090 - DNA, 25 bp, Mus musculus
gtcatgatgctcttagcctgtgaga

SEQ ID NO: 684091 - DNA, 25 bp, Mus musculus
gtcatgatgtagctctcctggaaca

SEQ ID NO: 684092 - DNA, 25 bp, Mus musculus
gtcatgatgtaggtctcctggaaca

SEQ ID NO: 684093 - DNA, 25 bp, Mus musculus
gtcatgatttgaattctgttgccat

SEQ ID NO: 684094 - DNA, 25 bp, Mus musculus
gtcatgatttgatttctgttgccat

SEQ ID NO: 684095 - DNA, 25 bp, Mus musculus
gtcatgcaacacaaatgggatctac

SEQ ID NO: 684096 - DNA, 25 bp, Mus musculus
gtcatgcaacactaatgggatctac

SEQ ID NO: 684097 - DNA, 25 bp, Mus musculus
gtcatgcaagcaagaacagatttca

SEQ ID NO: 684098 - DNA, 25 bp, Mus musculus
gtcatgcaagcatgaacagatttca

SEQ ID NO: 684099 - DNA, 25 bp, Mus musculus
gtcatgcaccatctcctgagtgagt

SEQ ID NO: 684100 - DNA, 25 bp, Mus musculus
gtcatgcaccatgtcctgagtgagt

SEQ ID NO: 684101 - DNA, 25 bp, Mus musculus
gtcatgcaccctaatgtactcttaa

SEQ ID NO: 684102 - DNA, 25 bp, Mus musculus
gtcatgcacccttatgtactcttaa

SEQ ID NO: 684103 - DNA, 25 bp, Mus musculus
gtcatgcacctgaaacctgtataat

SEQ ID NO: 684104 - DNA, 25 bp, Mus musculus
gtcatgcacctgtaacctgtataat

SEQ ID NO: 684105 - DNA, 25 bp, Mus musculus
gtcatgcactggcattgtgagagaa

SEQ ID NO: 684106 - DNA, 25 bp, Mus musculus
gtcatgcactgggattgtgagagaa

SEQ ID NO: 684107 - DNA, 25 bp, Mus musculus
gtcatgcagttaacttagtcttaca

SEQ ID NO: 684108 - DNA, 25 bp, Mus musculus
gtcatgcagttatcttagtcttaca

SEQ ID NO: 684109 - DNA, 25 bp, Mus musculus
gtcatgcatgccagtttgttgtcac

SEQ ID NO: 684110 - DNA, 25 bp, Mus musculus
gtcatgcatgcctgtttgttgtcac

SEQ ID NO: 684111 - DNA, 25 bp, Mus musculus
gtcatgcattcaaagtttatgaact

SEQ ID NO: 684112 - DNA, 25 bp, Mus musculus
gtcatgcattcatagtttatgaact

SEQ ID NO: 684113 - DNA, 25 bp, Mus musculus
gtcatgccaaccaacattgtttctg

SEQ ID NO: 684114 - DNA, 25 bp, Mus musculus
gtcatgccaacctacattgtttctg

SEQ ID NO: 684115 - DNA, 25 bp, Mus musculus
gtcatgccaaggagaagagtctttt

SEQ ID NO: 684116 - DNA, 25 bp, Mus musculus
gtcatgccaaggtgaagagtctttt

SEQ ID NO: 684117 - DNA, 25 bp, Mus musculus
gtcatgccacgtaaaaaacactcag

SEQ ID NO: 684118 - DNA, 25 bp, Mus musculus
gtcatgccacgttaaaaacactcag

SEQ ID NO: 684119 - DNA, 25 bp, Mus musculus
gtcatgcccatcatgcccgagatgc

SEQ ID NO: 684120 - DNA, 25 bp, Mus musculus
gtcatgcccatcttgcccgagatgc

SEQ ID NO: 684121 - DNA, 25 bp, Mus musculus
gtcatgcccatgactgctgctatgg

SEQ ID NO: 684122 - DNA, 25 bp, Mus musculus
gtcatgcccatgtctgctgctatgg

SEQ ID NO: 684123 - DNA, 25 bp, Mus musculus
gtcatgccctcaccttggtgataat

SEQ ID NO: 684124 - DNA, 25 bp, Mus musculus
gtcatgccctcagcttggtgataat

SEQ ID NO: 684125 - DNA, 25 bp, Mus musculus
gtcatgccctgtcgccgaacagttc

SEQ ID NO: 684126 - DNA, 25 bp, Mus musculus
gtcatgccctgtctttgaaacgaca

SEQ ID NO: 684127 - DNA, 25 bp, Mus musculus
gtcatgccctgtggccgaacagttc

SEQ ID NO: 684128 - DNA, 25 bp, Mus musculus
gtcatgccctgtgtttgaaacgaca

SEQ ID NO: 684129 - DNA, 25 bp, Mus musculus
gtcatgcctaccattgtggtgggaa

SEQ ID NO: 684130 - DNA, 25 bp, Mus musculus
gtcatgcctacctttgtggtgggaa

SEQ ID NO: 684131 - DNA, 25 bp, Mus musculus
gtcatgcctaggatagcattcaaca

SEQ ID NO: 684132 - DNA, 25 bp, Mus musculus
gtcatgcctaggttagcattcaaca

SEQ ID NO: 684133 - DNA, 25 bp, Mus musculus
gtcatgcctgccataaatcaaggtg

SEQ ID NO: 684134 - DNA, 25 bp, Mus musculus
gtcatgcctgccttaaatcaaggtg

SEQ ID NO: 684135 - DNA, 25 bp, Mus musculus
gtcatgcctggcagatgttggtaga

SEQ ID NO: 684136 - DNA, 25 bp, Mus musculus
gtcatgcctggctgatgttggtaga

SEQ ID NO: 684137 - DNA, 25 bp, Mus musculus
gtcatgcctgttcgtgttttaatcc

SEQ ID NO: 684138 - DNA, 25 bp, Mus musculus
gtcatgcctgttggtgttttaatcc

SEQ ID NO: 684139 - DNA, 25 bp, Mus musculus
gtcatgcgacgcatctttgagagcc

SEQ ID NO: 684140 - DNA, 25 bp, Mus musculus
gtcatgcgacgcttctttgagagcc

SEQ ID NO: 684141 - DNA, 25 bp, Mus musculus
gtcatgcgactccatcctgggagac

SEQ ID NO: 684142 - DNA, 25 bp, Mus musculus
gtcatgcgactcgatcctgggagac

SEQ ID NO: 684143 - DNA, 25 bp, Mus musculus
gtcatgcgccacaaaaatgctaagc

SEQ ID NO: 684144 - DNA, 25 bp, Mus musculus
gtcatgcgccactaaaatgctaagc

SEQ ID NO: 684145 - DNA, 25 bp, Mus musculus
gtcatgcgtgttatctcaatcttaa

SEQ ID NO: 684146 - DNA, 25 bp, Mus musculus
gtcatgcgtgttttctcaatcttaa

SEQ ID NO: 684147 - DNA, 25 bp, Mus musculus
gtcatgctacaaagttgtctgtctt

SEQ ID NO: 684148 - DNA, 25 bp, Mus musculus
gtcatgctacaatgttgtctgtctt

SEQ ID NO: 684149 - DNA, 25 bp, Mus musculus
gtcatgctacccatatgtatttatt

SEQ ID NO: 684150 - DNA, 25 bp, Mus musculus
gtcatgctacccttatgtatttatt

SEQ ID NO: 684151 - DNA, 25 bp, Mus musculus
gtcatgctagggacagtggcacagt

SEQ ID NO: 684152 - DNA, 25 bp, Mus musculus
gtcatgctagggtcagtggcacagt

SEQ ID NO: 684153 - DNA, 25 bp, Mus musculus
gtcatgctagtaacacctcaacact

SEQ ID NO: 684154 - DNA, 25 bp, Mus musculus
gtcatgctagtatcacctcaacact

SEQ ID NO: 684155 - DNA, 25 bp, Mus musculus
gtcatgctccctagatggtactgaa

SEQ ID NO: 684156 - DNA, 25 bp, Mus musculus
gtcatgctcccttgatggtactgaa

SEQ ID NO: 684157 - DNA, 25 bp, Mus musculus
gtcatgctgagcattagatttaaca

SEQ ID NO: 684158 - DNA, 25 bp, Mus musculus
gtcatgctgagctttagatttaaca

SEQ ID NO: 684159 - DNA, 25 bp, Mus musculus
gtcatgctgatgacggagtccggaa

SEQ ID NO: 684160 - DNA, 25 bp, Mus musculus
gtcatgctgatgtcggagtccggaa

SEQ ID NO: 684161 - DNA, 25 bp, Mus musculus
gtcatgctgcagacatttctgctgt

SEQ ID NO: 684162 - DNA, 25 bp, Mus musculus
gtcatgctgcagtcatttctgctgt

SEQ ID NO: 684163 - DNA, 25 bp, Mus musculus
gtcatgctgcccaaactcagaggag

SEQ ID NO: 684164 - DNA, 25 bp, Mus musculus
gtcatgctgccctaactcagaggag

SEQ ID NO: 684165 - DNA, 25 bp, Mus musculus
gtcatgctgggtccagccactcaca

SEQ ID NO: 684166 - DNA, 25 bp, Mus musculus
gtcatgctgggtgcagccactcaca

SEQ ID NO: 684167 - DNA, 25 bp, Mus musculus
gtcatgctggtacttcctgccagtg

SEQ ID NO: 684168 - DNA, 25 bp, Mus musculus
gtcatgctggtagttcctgccagtg

SEQ ID NO: 684169 - DNA, 25 bp, Mus musculus
gtcatgctgtgcacgagtaccaata

SEQ ID NO: 684170 - DNA, 25 bp, Mus musculus
gtcatgctgtgctcgagtaccaata

SEQ ID NO: 684171 - DNA, 25 bp, Mus musculus
gtcatgcttaggacttcaccagagc

SEQ ID NO: 684172 - DNA, 25 bp, Mus musculus
gtcatgcttaggtcttcaccagagc

SEQ ID NO: 684173 - DNA, 25 bp, Mus musculus
gtcatggaattgacttgctgttata

SEQ ID NO: 684174 - DNA, 25 bp, Mus musculus
gtcatggaattgtcttgctgttata

SEQ ID NO: 684175 - DNA, 25 bp, Mus musculus
gtcatggacaccagggtgattcaca

SEQ ID NO: 684176 - DNA, 25 bp, Mus musculus
gtcatggacacctgggtgattcaca

SEQ ID NO: 684177 - DNA, 25 bp, Mus musculus
gtcatggacccacccttagcaaaga

SEQ ID NO: 684178 - DNA, 25 bp, Mus musculus
gtcatggacccagccttagcaaaga

SEQ ID NO: 684179 - DNA, 25 bp, Mus musculus
gtcatggacgaacctgttcaccagt

SEQ ID NO: 684180 - DNA, 25 bp, Mus musculus
gtcatggacgaagctgttcaccagt

SEQ ID NO: 684181 - DNA, 25 bp, Mus musculus
gtcatggactctccttctgtaacca

SEQ ID NO: 684182 - DNA, 25 bp, Mus musculus
gtcatggactctgcttctgtaacca

SEQ ID NO: 684183 - DNA, 25 bp, Mus musculus
gtcatggacttgaaaactttttgtt

SEQ ID NO: 684184 - DNA, 25 bp, Mus musculus
gtcatggacttgtaaactttttgtt

SEQ ID NO: 684185 - DNA, 25 bp, Mus musculus
gtcatggagagcctaggccttcaaa

SEQ ID NO: 684186 - DNA, 25 bp, Mus musculus
gtcatggagagcgtaggccttcaaa

SEQ ID NO: 684187 - DNA, 25 bp, Mus musculus
gtcatggagattcagtaagtgcctt

SEQ ID NO: 684188 - DNA, 25 bp, Mus musculus
gtcatggagattccagacacctctg

SEQ ID NO: 684189 - DNA, 25 bp, Mus musculus
gtcatggagattccagtggtcctct

SEQ ID NO: 684190 - DNA, 25 bp, Mus musculus
gtcatggagattgagtaagtgcctt

SEQ ID NO: 684191 - DNA, 25 bp, Mus musculus
gtcatggagattgcagacacctctg

SEQ ID NO: 684192 - DNA, 25 bp, Mus musculus
gtcatggagattgcagtggtcctct

SEQ ID NO: 684193 - DNA, 25 bp, Mus musculus
gtcatggagggtctctcagcctttc

SEQ ID NO: 684194 - DNA, 25 bp, Mus musculus
gtcatggagggtgtctcagcctttc

SEQ ID NO: 684195 - DNA, 25 bp, Mus musculus
gtcatggatggtcctgactacccaa

SEQ ID NO: 684196 - DNA, 25 bp, Mus musculus
gtcatggatggtgctgactacccaa

SEQ ID NO: 684197 - DNA, 25 bp, Mus musculus
gtcatggcacatctactccctcaca

SEQ ID NO: 684198 - DNA, 25 bp, Mus musculus
gtcatggcacatgtactccctcaca

SEQ ID NO: 684199 - DNA, 25 bp, Mus musculus
gtcatggcgggcatgctgaaaaaga

SEQ ID NO: 684200 - DNA, 25 bp, Mus musculus
gtcatggcgggcttgctgaaaaaga

SEQ ID NO: 684201 - DNA, 25 bp, Mus musculus
gtcatggcggtaaggccttcccagt

SEQ ID NO: 684202 - DNA, 25 bp, Mus musculus
gtcatggcggtatggccttcccagt

SEQ ID NO: 684203 - DNA, 25 bp, Mus musculus
gtcatggcgtttctctacttgtgta

SEQ ID NO: 684204 - DNA, 25 bp, Mus musculus
gtcatggcgtttgtctacttgtgta

SEQ ID NO: 684205 - DNA, 25 bp, Mus musculus
gtcatggctaggcatttaacttcaa

SEQ ID NO: 684206 - DNA, 25 bp, Mus musculus
gtcatggctagggatttaacttcaa

SEQ ID NO: 684207 - DNA, 25 bp, Mus musculus
gtcatggctatcaatatcctggagg

SEQ ID NO: 684208 - DNA, 25 bp, Mus musculus
gtcatggctatctatatcctggagg

SEQ ID NO: 684209 - DNA, 25 bp, Mus musculus
gtcatggctcacctggctggcttca

SEQ ID NO: 684210 - DNA, 25 bp, Mus musculus
gtcatggctcacgtggctggcttca

SEQ ID NO: 684211 - DNA, 25 bp, Mus musculus
gtcatggctgacacaggaccaattt

SEQ ID NO: 684212 - DNA, 25 bp, Mus musculus
gtcatggctgactcaggaccaattt

SEQ ID NO: 684213 - DNA, 25 bp, Mus musculus
gtcatggctgcccagaacataccag

SEQ ID NO: 684214 - DNA, 25 bp, Mus musculus
gtcatggctgccgagaacataccag

SEQ ID NO: 684215 - DNA, 25 bp, Mus musculus
gtcatggcttcaattctaatccaaa

SEQ ID NO: 684216 - DNA, 25 bp, Mus musculus
gtcatggcttcatttctaatccaaa

SEQ ID NO: 684217 - DNA, 25 bp, Mus musculus
gtcatgggaacgcttattgtcaaat

SEQ ID NO: 684218 - DNA, 25 bp, Mus musculus
gtcatgggaacggttattgtcaaat

SEQ ID NO: 684219 - DNA, 25 bp, Mus musculus
gtcatgggagacagcacttgtgtat

SEQ ID NO: 684220 - DNA, 25 bp, Mus musculus
gtcatgggagactgcacttgtgtat

SEQ ID NO: 684221 - DNA, 25 bp, Mus musculus
gtcatgggagccctttattcacact

SEQ ID NO: 684222 - DNA, 25 bp, Mus musculus
gtcatgggagccgtttattcacact

SEQ ID NO: 684223 - DNA, 25 bp, Mus musculus
gtcatgggatttcatgcctatacca

SEQ ID NO: 684224 - DNA, 25 bp, Mus musculus
gtcatgggatttgatgcctatacca

SEQ ID NO: 684225 - DNA, 25 bp, Mus musculus
gtcatgggccttcggcagatgccaa

SEQ ID NO: 684226 - DNA, 25 bp, Mus musculus
gtcatgggccttgggcagatgccaa

SEQ ID NO: 684227 - DNA, 25 bp, Mus musculus
gtcatgggcgtgatcgtactgtgct

SEQ ID NO: 684228 - DNA, 25 bp, Mus musculus
gtcatgggcgtgttcgtactgtgct

SEQ ID NO: 684229 - DNA, 25 bp, Mus musculus
gtcatgggtgggacacattaaaagg

SEQ ID NO: 684230 - DNA, 25 bp, Mus musculus
gtcatgggtgggtcacattaaaagg

SEQ ID NO: 684231 - DNA, 25 bp, Mus musculus
gtcatgggtgtcagtgggttattta

SEQ ID NO: 684232 - DNA, 25 bp, Mus musculus
gtcatgggtgtctgtgggttattta

SEQ ID NO: 684233 - DNA, 25 bp, Mus musculus
gtcatggtacccaaagctcaccttc

SEQ ID NO: 684234 - DNA, 25 bp, Mus musculus
gtcatggtaccctaagctcaccttc

SEQ ID NO: 684235 - DNA, 25 bp, Mus musculus
gtcatggtctgacattctgggctta

SEQ ID NO: 684236 - DNA, 25 bp, Mus musculus
gtcatggtctgagattctgggctta

SEQ ID NO: 684237 - DNA, 25 bp, Mus musculus
gtcatggtgaaactataactatcgc

SEQ ID NO: 684238 - DNA, 25 bp, Mus musculus
gtcatggtgaaagtataactatcgc

SEQ ID NO: 684239 - DNA, 25 bp, Mus musculus
gtcatggtgactagtccctgggatt

SEQ ID NO: 684240 - DNA, 25 bp, Mus musculus
gtcatggtgacttgtccctgggatt

SEQ ID NO: 684241 - DNA, 25 bp, Mus musculus
gtcatggtgtctcagggcatcgtct

SEQ ID NO: 684242 - DNA, 25 bp, Mus musculus
gtcatggtgtctgagggcatcgtct

SEQ ID NO: 684243 - DNA, 25 bp, Mus musculus
gtcatggttataacatccgcctgtc

SEQ ID NO: 684244 - DNA, 25 bp, Mus musculus
gtcatggttatatcatccgcctgtc

SEQ ID NO: 684245 - DNA, 25 bp, Mus musculus
gtcatggttttactgtaagttctct

SEQ ID NO: 684246 - DNA, 25 bp, Mus musculus
gtcatggttttagtgtaagttctct

SEQ ID NO: 684247 - DNA, 25 bp, Mus musculus
gtcatgtacatgaccgttctgtagc

SEQ ID NO: 684248 - DNA, 25 bp, Mus musculus
gtcatgtacatgtccgttctgtagc

SEQ ID NO: 684249 - DNA, 25 bp, Mus musculus
gtcatgtacattccactttgatctg

SEQ ID NO: 684250 - DNA, 25 bp, Mus musculus
gtcatgtacattgcactttgatctg

SEQ ID NO: 684251 - DNA, 25 bp, Mus musculus
gtcatgtataccagcataaggcaaa

SEQ ID NO: 684252 - DNA, 25 bp, Mus musculus
gtcatgtatacctgcataaggcaaa

SEQ ID NO: 684253 - DNA, 25 bp, Mus musculus
gtcatgtatatgacacactttgttc

SEQ ID NO: 684254 - DNA, 25 bp, Mus musculus
gtcatgtatatgtcacactttgttc

SEQ ID NO: 684255 - DNA, 25 bp, Mus musculus
gtcatgtcacttatcaaggattcct

SEQ ID NO: 684256 - DNA, 25 bp, Mus musculus
gtcatgtcacttttcaaggattcct

SEQ ID NO: 684257 - DNA, 25 bp, Mus musculus
gtcatgtcagccaaacacggcataa

SEQ ID NO: 684258 - DNA, 25 bp, Mus musculus
gtcatgtcagcctaacacggcataa

SEQ ID NO: 684259 - DNA, 25 bp, Mus musculus
gtcatgtcatcactatttctagtcc

SEQ ID NO: 684260 - DNA, 25 bp, Mus musculus
gtcatgtcatcagtatttctagtcc

SEQ ID NO: 684261 - DNA, 25 bp, Mus musculus
gtcatgtccgtgagttttatcttag

SEQ ID NO: 684262 - DNA, 25 bp, Mus musculus
gtcatgtccgtgtgttttatcttag

SEQ ID NO: 684263 - DNA, 25 bp, Mus musculus
gtcatgtcctaacaacaagaccgtg

SEQ ID NO: 684264 - DNA, 25 bp, Mus musculus
gtcatgtcctaagaacaagaccgtg

SEQ ID NO: 684265 - DNA, 25 bp, Mus musculus
gtcatgtcctacaaaaatatcagtg

SEQ ID NO: 684266 - DNA, 25 bp, Mus musculus
gtcatgtcctactaaaatatcagtg

SEQ ID NO: 684267 - DNA, 25 bp, Mus musculus
gtcatgtctatcaatgtggcctggc

SEQ ID NO: 684268 - DNA, 25 bp, Mus musculus
gtcatgtctatctatgtggcctggc

SEQ ID NO: 684269 - DNA, 25 bp, Mus musculus
gtcatgtctattaaccaaaccggga

SEQ ID NO: 684270 - DNA, 25 bp, Mus musculus
gtcatgtctatttaccaaaccggga

SEQ ID NO: 684271 - DNA, 25 bp, Mus musculus
gtcatgtctctaagctatatcccta

SEQ ID NO: 684272 - DNA, 25 bp, Mus musculus
gtcatgtctctatgctatatcccta

SEQ ID NO: 684273 - DNA, 25 bp, Mus musculus
gtcatgtctcttaatagcaactgcg

SEQ ID NO: 684274 - DNA, 25 bp, Mus musculus
gtcatgtctctttatagcaactgcg

SEQ ID NO: 684275 - DNA, 25 bp, Mus musculus
gtcatgtctgttaacttcctgttta

SEQ ID NO: 684276 - DNA, 25 bp, Mus musculus
gtcatgtctgtttacttcctgttta

SEQ ID NO: 684277 - DNA, 25 bp, Mus musculus
gtcatgtcttagcagtgttacagtc

SEQ ID NO: 684278 - DNA, 25 bp, Mus musculus
gtcatgtcttaggagtgttacagtc

SEQ ID NO: 684279 - DNA, 25 bp, Mus musculus
gtcatgtgaagaacctgggtactgt

SEQ ID NO: 684280 - DNA, 25 bp, Mus musculus
gtcatgtgaagatcctgggtactgt

SEQ ID NO: 684281 - DNA, 25 bp, Mus musculus
gtcatgtgactgaagttcccagcaa

SEQ ID NO: 684282 - DNA, 25 bp, Mus musculus
gtcatgtgactgtagttcccagcaa

SEQ ID NO: 684283 - DNA, 25 bp, Mus musculus
gtcatgtgatgtactgtactcgttt

SEQ ID NO: 684284 - DNA, 25 bp, Mus musculus
gtcatgtgatgttctgtactcgttt

SEQ ID NO: 684285 - DNA, 25 bp, Mus musculus
gtcatgtgcctcagctgattggctg

SEQ ID NO: 684286 - DNA, 25 bp, Mus musculus
gtcatgtgcctctgctgattggctg

SEQ ID NO: 684287 - DNA, 25 bp, Mus musculus
gtcatgtgctggctttaggttttat

SEQ ID NO: 684288 - DNA, 25 bp, Mus musculus
gtcatgtgctgggtttaggttttat

SEQ ID NO: 684289 - DNA, 25 bp, Mus musculus
gtcatgtgctgtacaagtataactt

SEQ ID NO: 684290 - DNA, 25 bp, Mus musculus
gtcatgtgctgttcaagtataactt

SEQ ID NO: 684291 - DNA, 25 bp, Mus musculus
gtcatgtgcttgcattattttgcgt

SEQ ID NO: 684292 - DNA, 25 bp, Mus musculus
gtcatgtgcttggattattttgcgt

SEQ ID NO: 684293 - DNA, 25 bp, Mus musculus
gtcatgtggagcagcccagctataa

SEQ ID NO: 684294 - DNA, 25 bp, Mus musculus
gtcatgtggagctgcccagctataa

SEQ ID NO: 684295 - DNA, 25 bp, Mus musculus
gtcatgtgggttacctgtatgctag

SEQ ID NO: 684296 - DNA, 25 bp, Mus musculus
gtcatgtgggtttcctgtatgctag

SEQ ID NO: 684297 - DNA, 25 bp, Mus musculus
gtcatgtgttagagattgcaggcct

SEQ ID NO: 684298 - DNA, 25 bp, Mus musculus
gtcatgtgttagtgattgcaggcct

SEQ ID NO: 684299 - DNA, 25 bp, Mus musculus
gtcatgtgttgtccttacaggattc

SEQ ID NO: 684300 - DNA, 25 bp, Mus musculus
gtcatgtgttgtgcttacaggattc

SEQ ID NO: 684301 - DNA, 25 bp, Mus musculus
gtcatgttattcacagacccttgat

SEQ ID NO: 684302 - DNA, 25 bp, Mus musculus
gtcatgttattctcagacccttgat

SEQ ID NO: 684303 - DNA, 25 bp, Mus musculus
gtcatgttcataactatatcacccc

SEQ ID NO: 684304 - DNA, 25 bp, Mus musculus
gtcatgttcatatctatatcacccc

SEQ ID NO: 684305 - DNA, 25 bp, Mus musculus
gtcatgttcatccagaccagcgcga

SEQ ID NO: 684306 - DNA, 25 bp, Mus musculus
gtcatgttcatcgagaccagcgcga

SEQ ID NO: 684307 - DNA, 25 bp, Mus musculus
gtcatgttctatctatgcactgatg

SEQ ID NO: 684308 - DNA, 25 bp, Mus musculus
gtcatgttctatgtatgcactgatg

SEQ ID NO: 684309 - DNA, 25 bp, Mus musculus
gtcatgttcttactgatcatttcta

SEQ ID NO: 684310 - DNA, 25 bp, Mus musculus
gtcatgttcttagtgatcatttcta

SEQ ID NO: 684311 - DNA, 25 bp, Mus musculus
gtcatgttgattaaaagtagctgcc

SEQ ID NO: 684312 - DNA, 25 bp, Mus musculus
gtcatgttgatttaaagtagctgcc

SEQ ID NO: 684313 - DNA, 25 bp, Mus musculus
gtcatgttgccaaaacttacttatt

SEQ ID NO: 684314 - DNA, 25 bp, Mus musculus
gtcatgttgccataacttacttatt

SEQ ID NO: 684315 - DNA, 25 bp, Mus musculus
gtcatgttggatctctatgggttca

SEQ ID NO: 684316 - DNA, 25 bp, Mus musculus
gtcatgttggatgtctatgggttca

SEQ ID NO: 684317 - DNA, 25 bp, Mus musculus
gtcatgttggcaatgtccagctcac

SEQ ID NO: 684318 - DNA, 25 bp, Mus musculus
gtcatgttggcattgtccagctcac

SEQ ID NO: 684319 - DNA, 25 bp, Mus musculus
gtcatgttgtagagtagctcagggt

SEQ ID NO: 684320 - DNA, 25 bp, Mus musculus
gtcatgttgtagtgtagctcagggt

SEQ ID NO: 684321 - DNA, 25 bp, Mus musculus
gtcatgtttaagcagcacccaccac

SEQ ID NO: 684322 - DNA, 25 bp, Mus musculus
gtcatgtttaaggagcacccaccac

SEQ ID NO: 684323 - DNA, 25 bp, Mus musculus
gtcatgtttgaaaatatccactggc

SEQ ID NO: 684324 - DNA, 25 bp, Mus musculus
gtcatgtttgaatatatccactggc

SEQ ID NO: 684325 - DNA, 25 bp, Mus musculus
gtcatgtttggtcatagctttctat

SEQ ID NO: 684326 - DNA, 25 bp, Mus musculus
gtcatgtttggtgatagctttctat

SEQ ID NO: 684327 - DNA, 25 bp, Mus musculus
gtcatgttttctcatgctctaatgt

SEQ ID NO: 684328 - DNA, 25 bp, Mus musculus
gtcatgttttctgatgctctaatgt

SEQ ID NO: 684329 - DNA, 25 bp, Mus musculus
gtcatgtttttcacttactgttatt

SEQ ID NO: 684330 - DNA, 25 bp, Mus musculus
gtcatgtttttctcttactgttatt

SEQ ID NO: 684331 - DNA, 25 bp, Mus musculus
gtcattaaaaaccttgtgcctattt

SEQ ID NO: 684332 - DNA, 25 bp, Mus musculus
gtcattaaaaacgttgtgcctattt

SEQ ID NO: 684333 - DNA, 25 bp, Mus musculus
gtcattaaaactcttaccaattggt

SEQ ID NO: 684334 - DNA, 25 bp, Mus musculus
gtcattaaaactgttaccaattggt

SEQ ID NO: 684335 - DNA, 25 bp, Mus musculus
gtcattaaatggattgcttccccta

SEQ ID NO: 684336 - DNA, 25 bp, Mus musculus
gtcattaaatggtttgcttccccta

SEQ ID NO: 684337 - DNA, 25 bp, Mus musculus
gtcattaaccacaaccgcatgaggg

SEQ ID NO: 684338 - DNA, 25 bp, Mus musculus
gtcattaaccactaccgcatgaggg

SEQ ID NO: 684339 - DNA, 25 bp, Mus musculus
gtcattaaccataagtgctcaagtg

SEQ ID NO: 684340 - DNA, 25 bp, Mus musculus
gtcattaaccattagtgctcaagtg

SEQ ID NO: 684341 - DNA, 25 bp, Mus musculus
gtcattaaccttagtctgaagcagt

SEQ ID NO: 684342 - DNA, 25 bp, Mus musculus
gtcattaacctttgtctgaagcagt

SEQ ID NO: 684343 - DNA, 25 bp, Mus musculus
gtcattaagtgtattagtgccgaaa

SEQ ID NO: 684344 - DNA, 25 bp, Mus musculus
gtcattaagtgttttagtgccgaaa

SEQ ID NO: 684345 - DNA, 25 bp, Mus musculus
gtcattaatgcacgcctgtgtccca

SEQ ID NO: 684346 - DNA, 25 bp, Mus musculus
gtcattaatgcaggcctgtgtccca

SEQ ID NO: 684347 - DNA, 25 bp, Mus musculus
gtcattaattccctggacataccca

SEQ ID NO: 684348 - DNA, 25 bp, Mus musculus
gtcattaattccgtggacataccca

SEQ ID NO: 684349 - DNA, 25 bp, Mus musculus
gtcattacaactaaggcctcattcc

SEQ ID NO: 684350 - DNA, 25 bp, Mus musculus
gtcattacaacttaggcctcattcc

SEQ ID NO: 684351 - DNA, 25 bp, Mus musculus
gtcattacagtcaaaccacacacac

SEQ ID NO: 684352 - DNA, 25 bp, Mus musculus
gtcattacagtctaaccacacacac

SEQ ID NO: 684353 - DNA, 25 bp, Mus musculus
gtcattacattgatcactcatgtgt

SEQ ID NO: 684354 - DNA, 25 bp, Mus musculus
gtcattacattgttcactcatgtgt

SEQ ID NO: 684355 - DNA, 25 bp, Mus musculus
gtcattaccaatccaatggccatac

SEQ ID NO: 684356 - DNA, 25 bp, Mus musculus
gtcattaccaatgcaatggccatac

SEQ ID NO: 684357 - DNA, 25 bp, Mus musculus
gtcattaccctcacggatgactgag

SEQ ID NO: 684358 - DNA, 25 bp, Mus musculus
gtcattaccctctcggatgactgag

SEQ ID NO: 684359 - DNA, 25 bp, Mus musculus
gtcattactcaccaaatacccatgt

SEQ ID NO: 684360 - DNA, 25 bp, Mus musculus
gtcattactcacgaaatacccatgt

SEQ ID NO: 684361 - DNA, 25 bp, Mus musculus
gtcattactgttcaggtcactgtag

SEQ ID NO: 684362 - DNA, 25 bp, Mus musculus
gtcattactgttgaggtcactgtag

SEQ ID NO: 684363 - DNA, 25 bp, Mus musculus
gtcattacttcacgccttaaggaat

SEQ ID NO: 684364 - DNA, 25 bp, Mus musculus
gtcattacttcaggccttaaggaat

SEQ ID NO: 684365 - DNA, 25 bp, Mus musculus
gtcattacttctatcactgttcaca

SEQ ID NO: 684366 - DNA, 25 bp, Mus musculus
gtcattacttctttcactgttcaca

SEQ ID NO: 684367 - DNA, 25 bp, Mus musculus
gtcattagccgacccaaagtgatga

SEQ ID NO: 684368 - DNA, 25 bp, Mus musculus
gtcattagccgagccaaagtgatga

SEQ ID NO: 684369 - DNA, 25 bp, Mus musculus
gtcattagctgtatccatctactgt

SEQ ID NO: 684370 - DNA, 25 bp, Mus musculus
gtcattagctgtttccatctactgt

SEQ ID NO: 684371 - DNA, 25 bp, Mus musculus
gtcattagggagactatctgcacat

SEQ ID NO: 684372 - DNA, 25 bp, Mus musculus
gtcattagggagtctatctgcacat

SEQ ID NO: 684373 - DNA, 25 bp, Mus musculus
gtcattagggctagactaagtccat

SEQ ID NO: 684374 - DNA, 25 bp, Mus musculus
gtcattagggcttgactaagtccat

SEQ ID NO: 684375 - DNA, 25 bp, Mus musculus
gtcattagtgttcccagaggcagag

SEQ ID NO: 684376 - DNA, 25 bp, Mus musculus
gtcattagtgttgccagaggcagag

SEQ ID NO: 684377 - DNA, 25 bp, Mus musculus
gtcattagtttacagctagcacttt

SEQ ID NO: 684378 - DNA, 25 bp, Mus musculus
gtcattagtttagagctagcacttt

SEQ ID NO: 684379 - DNA, 25 bp, Mus musculus
gtcattatagtgacattctaccata

SEQ ID NO: 684380 - DNA, 25 bp, Mus musculus
gtcattatagtgtcattctaccata

SEQ ID NO: 684381 - DNA, 25 bp, Mus musculus
gtcattatcaccctgttgcaaggta

SEQ ID NO: 684382 - DNA, 25 bp, Mus musculus
gtcattatcaccgtgttgcaaggta

SEQ ID NO: 684383 - DNA, 25 bp, Mus musculus
gtcattatccataaaggaccttgtt

SEQ ID NO: 684384 - DNA, 25 bp, Mus musculus
gtcattatccattaaggaccttgtt

SEQ ID NO: 684385 - DNA, 25 bp, Mus musculus
gtcattatcgcaatagtgtcacaga

SEQ ID NO: 684386 - DNA, 25 bp, Mus musculus
gtcattatcgcattagtgtcacaga

SEQ ID NO: 684387 - DNA, 25 bp, Mus musculus
gtcattatgccaacattcttgagtt

SEQ ID NO: 684388 - DNA, 25 bp, Mus musculus
gtcattatgccatcattcttgagtt

SEQ ID NO: 684389 - DNA, 25 bp, Mus musculus
gtcattatgttaagaactggcctaa

SEQ ID NO: 684390 - DNA, 25 bp, Mus musculus
gtcattatgttatgaactggcctaa

SEQ ID NO: 684391 - DNA, 25 bp, Mus musculus
gtcattattgagcaccggatagaaa

SEQ ID NO: 684392 - DNA, 25 bp, Mus musculus
gtcattattgaggaccggatagaaa

SEQ ID NO: 684393 - DNA, 25 bp, Mus musculus
gtcattattggcattctttacttgt

SEQ ID NO: 684394 - DNA, 25 bp, Mus musculus
gtcattattggctttctttacttgt

SEQ ID NO: 684395 - DNA, 25 bp, Mus musculus
gtcattatttatcacactcatgaga

SEQ ID NO: 684396 - DNA, 25 bp, Mus musculus
gtcattatttatcactcttgcattg

SEQ ID NO: 684397 - DNA, 25 bp, Mus musculus
gtcattatttatgacactcatgaga

SEQ ID NO: 684398 - DNA, 25 bp, Mus musculus
gtcattatttatgactcttgcattg

SEQ ID NO: 684399 - DNA, 25 bp, Mus musculus
gtcattcaaagtctacctaccagtt

SEQ ID NO: 684400 - DNA, 25 bp, Mus musculus
gtcattcaaagtgtacctaccagtt

SEQ ID NO: 684401 - DNA, 25 bp, Mus musculus
gtcattcaagccattgctctctgaa

SEQ ID NO: 684402 - DNA, 25 bp, Mus musculus
gtcattcaagcctttgctctctgaa

SEQ ID NO: 684403 - DNA, 25 bp, Mus musculus
gtcattcaagctctgattggctgtt

SEQ ID NO: 684404 - DNA, 25 bp, Mus musculus
gtcattcaagctgtgattggctgtt

SEQ ID NO: 684405 - DNA, 25 bp, Mus musculus
gtcattcaagtaacaaagggatcct

SEQ ID NO: 684406 - DNA, 25 bp, Mus musculus
gtcattcaagtatcaaagggatcct

SEQ ID NO: 684407 - DNA, 25 bp, Mus musculus
gtcattcacaccctggatttggtcg

SEQ ID NO: 684408 - DNA, 25 bp, Mus musculus
gtcattcacaccgtggatttggtcg

SEQ ID NO: 684409 - DNA, 25 bp, Mus musculus
gtcattcactcaaggtccatttggc

SEQ ID NO: 684410 - DNA, 25 bp, Mus musculus
gtcattcactcatggtccatttggc

SEQ ID NO: 684411 - DNA, 25 bp, Mus musculus
gtcattcagatcctagtatcatttc

SEQ ID NO: 684412 - DNA, 25 bp, Mus musculus
gtcattcagatcgtagtatcatttc

SEQ ID NO: 684413 - DNA, 25 bp, Mus musculus
gtcattcatagtactctaccacaag

SEQ ID NO: 684414 - DNA, 25 bp, Mus musculus
gtcattcatagttctctaccacaag

SEQ ID NO: 684415 - DNA, 25 bp, Mus musculus
gtcattcatcaacatcggtcttctg

SEQ ID NO: 684416 - DNA, 25 bp, Mus musculus
gtcattcatcaagatcggtcttctg

SEQ ID NO: 684417 - DNA, 25 bp, Mus musculus
gtcattcatcatacatgtcatcact

SEQ ID NO: 684418 - DNA, 25 bp, Mus musculus
gtcattcatcattcatgtcatcact

SEQ ID NO: 684419 - DNA, 25 bp, Mus musculus
gtcattcatgtgatcaggtatcctg

SEQ ID NO: 684420 - DNA, 25 bp, Mus musculus
gtcattcatgtgttcaggtatcctg

SEQ ID NO: 684421 - DNA, 25 bp, Mus musculus
gtcattcattcaatagcactccaat

SEQ ID NO: 684422 - DNA, 25 bp, Mus musculus
gtcattcattcattagcactccaat

SEQ ID NO: 684423 - DNA, 25 bp, Mus musculus
gtcattcattcgcaacctgagctat

SEQ ID NO: 684424 - DNA, 25 bp, Mus musculus
gtcattcattcggaacctgagctat

SEQ ID NO: 684425 - DNA, 25 bp, Mus musculus
gtcattcattgacacatctgctcta

SEQ ID NO: 684426 - DNA, 25 bp, Mus musculus
gtcattcattgagacatctgctcta

SEQ ID NO: 684427 - DNA, 25 bp, Mus musculus
gtcattccaaatctctatgcagcaa

SEQ ID NO: 684428 - DNA, 25 bp, Mus musculus
gtcattccaaatgtctatgcagcaa

SEQ ID NO: 684429 - DNA, 25 bp, Mus musculus
gtcattccaatccatgctcgagtta

SEQ ID NO: 684430 - DNA, 25 bp, Mus musculus
gtcattccaatcgatgctcgagtta

SEQ ID NO: 684431 - DNA, 25 bp, Mus musculus
gtcattccagacatgctagaaaatt

SEQ ID NO: 684432 - DNA, 25 bp, Mus musculus
gtcattccagacttgctagaaaatt

SEQ ID NO: 684433 - DNA, 25 bp, Mus musculus
gtcattccagatccctactcaacaa

SEQ ID NO: 684434 - DNA, 25 bp, Mus musculus
gtcattccagatgcctactcaacaa

SEQ ID NO: 684435 - DNA, 25 bp, Mus musculus
gtcattccaggaacctaagggctaa

SEQ ID NO: 684436 - DNA, 25 bp, Mus musculus
gtcattccaggatcctaagggctaa

SEQ ID NO: 684437 - DNA, 25 bp, Mus musculus
gtcattccaggcaggtctattcctg

SEQ ID NO: 684438 - DNA, 25 bp, Mus musculus
gtcattccaggctggtctattcctg

SEQ ID NO: 684439 - DNA, 25 bp, Mus musculus
gtcattcccaaaacatgccctttaa

SEQ ID NO: 684440 - DNA, 25 bp, Mus musculus
gtcattcccaaatcatgccctttaa

SEQ ID NO: 684441 - DNA, 25 bp, Mus musculus
gtcattcccaatcatggactctgtc

SEQ ID NO: 684442 - DNA, 25 bp, Mus musculus
gtcattcccaatgatggactctgtc

SEQ ID NO: 684443 - DNA, 25 bp, Mus musculus
gtcattcccagaccgtgagctcagg

SEQ ID NO: 684444 - DNA, 25 bp, Mus musculus
gtcattcccagagcgtgagctcagg

SEQ ID NO: 684445 - DNA, 25 bp, Mus musculus
gtcattccccctcacaacgtttggg

SEQ ID NO: 684446 - DNA, 25 bp, Mus musculus
gtcattccccctgacaacgtttggg

SEQ ID NO: 684447 - DNA, 25 bp, Mus musculus
gtcattccgaatagtgaagcagctt

SEQ ID NO: 684448 - DNA, 25 bp, Mus musculus
gtcattccgaattgtgaagcagctt

SEQ ID NO: 684449 - DNA, 25 bp, Mus musculus
gtcattccggagatggcccgctgaa

SEQ ID NO: 684450 - DNA, 25 bp, Mus musculus
gtcattccggagttggcccgctgaa

SEQ ID NO: 684451 - DNA, 25 bp, Mus musculus
gtcattcctacaacagtggcagcac

SEQ ID NO: 684452 - DNA, 25 bp, Mus musculus
gtcattcctacatcagtggcagcac

SEQ ID NO: 684453 - DNA, 25 bp, Mus musculus
gtcattcctcaccataattgcattg

SEQ ID NO: 684454 - DNA, 25 bp, Mus musculus
gtcattcctcacgataattgcattg

SEQ ID NO: 684455 - DNA, 25 bp, Mus musculus
gtcattcctcatcgtaaaactttcc

SEQ ID NO: 684456 - DNA, 25 bp, Mus musculus
gtcattcctcatggtaaaactttcc

SEQ ID NO: 684457 - DNA, 25 bp, Mus musculus
gtcattcctgagactgtcattttgt

SEQ ID NO: 684458 - DNA, 25 bp, Mus musculus
gtcattcctgagtctgtcattttgt

SEQ ID NO: 684459 - DNA, 25 bp, Mus musculus
gtcattcctgttagtgatgttcctg

SEQ ID NO: 684460 - DNA, 25 bp, Mus musculus
gtcattcctgtttgtgatgttcctg

SEQ ID NO: 684461 - DNA, 25 bp, Mus musculus
gtcattccttacagtttacagaact

SEQ ID NO: 684462 - DNA, 25 bp, Mus musculus
gtcattccttactgtttacagaact

SEQ ID NO: 684463 - DNA, 25 bp, Mus musculus
gtcattccttagatgccttttcagc

SEQ ID NO: 684464 - DNA, 25 bp, Mus musculus
gtcattccttagttgccttttcagc

SEQ ID NO: 684465 - DNA, 25 bp, Mus musculus
gtcattcctttcaggttgggactca

SEQ ID NO: 684466 - DNA, 25 bp, Mus musculus
gtcattcctttctggttgggactca

SEQ ID NO: 684467 - DNA, 25 bp, Mus musculus
gtcattcgaaacctgcaggaacgcc

SEQ ID NO: 684468 - DNA, 25 bp, Mus musculus
gtcattcgaaacgtgcaggaacgcc

SEQ ID NO: 684469 - DNA, 25 bp, Mus musculus
gtcattcgtcacctagaccatgagt

SEQ ID NO: 684470 - DNA, 25 bp, Mus musculus
gtcattcgtcacgtagaccatgagt

SEQ ID NO: 684471 - DNA, 25 bp, Mus musculus
gtcattctagacactgatctgtcct

SEQ ID NO: 684472 - DNA, 25 bp, Mus musculus
gtcattctagacattacgcaggtca

SEQ ID NO: 684473 - DNA, 25 bp, Mus musculus
gtcattctagaccacatttcctttt

SEQ ID NO: 684474 - DNA, 25 bp, Mus musculus
gtcattctagacgacatttcctttt

SEQ ID NO: 684475 - DNA, 25 bp, Mus musculus
gtcattctagactctgatctgtcct

SEQ ID NO: 684476 - DNA, 25 bp, Mus musculus
gtcattctagactttacgcaggtca

SEQ ID NO: 684477 - DNA, 25 bp, Mus musculus
gtcattctcaatcatggttgggcgc

SEQ ID NO: 684478 - DNA, 25 bp, Mus musculus
gtcattctcaatgatggttgggcgc

SEQ ID NO: 684479 - DNA, 25 bp, Mus musculus
gtcattctcaccaaggaaacattcc

SEQ ID NO: 684480 - DNA, 25 bp, Mus musculus
gtcattctcacctaggaaacattcc

SEQ ID NO: 684481 - DNA, 25 bp, Mus musculus
gtcattctctacacatttcagctat

SEQ ID NO: 684482 - DNA, 25 bp, Mus musculus
gtcattctctacaccagtgaagagt

SEQ ID NO: 684483 - DNA, 25 bp, Mus musculus
gtcattctctactcatttcagctat

SEQ ID NO: 684484 - DNA, 25 bp, Mus musculus
gtcattctctactccagtgaagagt

SEQ ID NO: 684485 - DNA, 25 bp, Mus musculus
gtcattctgagtcaggtctgttccc

SEQ ID NO: 684486 - DNA, 25 bp, Mus musculus
gtcattctgagtgaggtctgttccc

SEQ ID NO: 684487 - DNA, 25 bp, Mus musculus
gtcattctggagctcctactagaga

SEQ ID NO: 684488 - DNA, 25 bp, Mus musculus
gtcattctggaggtcctactagaga

SEQ ID NO: 684489 - DNA, 25 bp, Mus musculus
gtcattctggcaaagatctcactgt

SEQ ID NO: 684490 - DNA, 25 bp, Mus musculus
gtcattctggcatagatctcactgt

SEQ ID NO: 684491 - DNA, 25 bp, Mus musculus
gtcattcttacaacatgagctcttg

SEQ ID NO: 684492 - DNA, 25 bp, Mus musculus
gtcattcttacactgtgctttgtgt

SEQ ID NO: 684493 - DNA, 25 bp, Mus musculus
gtcattcttacagtgtgctttgtgt

SEQ ID NO: 684494 - DNA, 25 bp, Mus musculus
gtcattcttacatcatgagctcttg

SEQ ID NO: 684495 - DNA, 25 bp, Mus musculus
gtcattcttccaaccaagagtgaga

SEQ ID NO: 684496 - DNA, 25 bp, Mus musculus
gtcattcttccatccaagagtgaga

SEQ ID NO: 684497 - DNA, 25 bp, Mus musculus
gtcattctttcaagtctgtgtctaa

SEQ ID NO: 684498 - DNA, 25 bp, Mus musculus
gtcattctttcatgtctgtgtctaa

SEQ ID NO: 684499 - DNA, 25 bp, Mus musculus
gtcattcttttgatcatcctgtttc

SEQ ID NO: 684500 - DNA, 25 bp, Mus musculus
gtcattcttttgttcatcctgtttc

SEQ ID NO: 684501 - DNA, 25 bp, Mus musculus
gtcattgaacatatggaagtcccga

SEQ ID NO: 684502 - DNA, 25 bp, Mus musculus
gtcattgaacatttggaagtcccga

SEQ ID NO: 684503 - DNA, 25 bp, Mus musculus
gtcattgaactgaagccactctgta

SEQ ID NO: 684504 - DNA, 25 bp, Mus musculus
gtcattgaactgtagccactctgta

SEQ ID NO: 684505 - DNA, 25 bp, Mus musculus
gtcattgaagctaccagaaacccag

SEQ ID NO: 684506 - DNA, 25 bp, Mus musculus
gtcattgaagcttccagaaacccag

SEQ ID NO: 684507 - DNA, 25 bp, Mus musculus
gtcattgaattgctctctgttcttg

SEQ ID NO: 684508 - DNA, 25 bp, Mus musculus
gtcattgaattggtctctgttcttg

SEQ ID NO: 684509 - DNA, 25 bp, Mus musculus
gtcattgacacactctggccctggg

SEQ ID NO: 684510 - DNA, 25 bp, Mus musculus
gtcattgacacagtctggccctggg

SEQ ID NO: 684511 - DNA, 25 bp, Mus musculus
gtcattgacccactgaatgccagag

SEQ ID NO: 684512 - DNA, 25 bp, Mus musculus
gtcattgacccagtgaatgccagag

SEQ ID NO: 684513 - DNA, 25 bp, Mus musculus
gtcattgacctgctaacttgaaaga

SEQ ID NO: 684514 - DNA, 25 bp, Mus musculus
gtcattgacctggtaacttgaaaga

SEQ ID NO: 684515 - DNA, 25 bp, Mus musculus
gtcattgactccacagaggctatag

SEQ ID NO: 684516 - DNA, 25 bp, Mus musculus
gtcattgactcctcagaggctatag

SEQ ID NO: 684517 - DNA, 25 bp, Mus musculus
gtcattgactgaacttgctctaacc

SEQ ID NO: 684518 - DNA, 25 bp, Mus musculus
gtcattgactgatcttgctctaacc

SEQ ID NO: 684519 - DNA, 25 bp, Mus musculus
gtcattgagatcctcatagaagact

SEQ ID NO: 684520 - DNA, 25 bp, Mus musculus
gtcattgagatcgtcatagaagact

SEQ ID NO: 684521 - DNA, 25 bp, Mus musculus
gtcattgagcatatgtcccaacggg

SEQ ID NO: 684522 - DNA, 25 bp, Mus musculus
gtcattgagcatttgtcccaacggg

SEQ ID NO: 684523 - DNA, 25 bp, Mus musculus
gtcattgagcgactccaggaaacta

SEQ ID NO: 684524 - DNA, 25 bp, Mus musculus
gtcattgagcgagtccaggaaacta

SEQ ID NO: 684525 - DNA, 25 bp, Mus musculus
gtcattgagctcatggtcacaggcc

SEQ ID NO: 684526 - DNA, 25 bp, Mus musculus
gtcattgagctcttggtcacaggcc

SEQ ID NO: 684527 - DNA, 25 bp, Mus musculus
gtcattgagtaactctcccatcctt

SEQ ID NO: 684528 - DNA, 25 bp, Mus musculus
gtcattgagtaagtctcccatcctt

SEQ ID NO: 684529 - DNA, 25 bp, Mus musculus
gtcattgatattctccagcgaaggc

SEQ ID NO: 684530 - DNA, 25 bp, Mus musculus
gtcattgatattgtccagcgaaggc

SEQ ID NO: 684531 - DNA, 25 bp, Mus musculus
gtcattgatccccaagaactggcca

SEQ ID NO: 684532 - DNA, 25 bp, Mus musculus
gtcattgatcccgaagaactggcca

SEQ ID NO: 684533 - DNA, 25 bp, Mus musculus
gtcattgatgttatccatgatccca

SEQ ID NO: 684534 - DNA, 25 bp, Mus musculus
gtcattgatgttttccatgatccca

SEQ ID NO: 684535 - DNA, 25 bp, Mus musculus
gtcattgattgaatggctcctactg

SEQ ID NO: 684536 - DNA, 25 bp, Mus musculus
gtcattgattgattggctcctactg

SEQ ID NO: 684537 - DNA, 25 bp, Mus musculus
gtcattgcatcactagctacaaagg

SEQ ID NO: 684538 - DNA, 25 bp, Mus musculus
gtcattgcatcactggttgccacta

SEQ ID NO: 684539 - DNA, 25 bp, Mus musculus
gtcattgcatcagtagctacaaagg

SEQ ID NO: 684540 - DNA, 25 bp, Mus musculus
gtcattgcatcagtggttgccacta

SEQ ID NO: 684541 - DNA, 25 bp, Mus musculus
gtcattgccagactcagtgggtcag

SEQ ID NO: 684542 - DNA, 25 bp, Mus musculus
gtcattgccagagtcagtgggtcag

SEQ ID NO: 684543 - DNA, 25 bp, Mus musculus
gtcattgccctgctatgtgggctca

SEQ ID NO: 684544 - DNA, 25 bp, Mus musculus
gtcattgccctggtatgtgggctca

SEQ ID NO: 684545 - DNA, 25 bp, Mus musculus
gtcattgctaccacagtgacgttat

SEQ ID NO: 684546 - DNA, 25 bp, Mus musculus
gtcattgctacctcagtgacgttat

SEQ ID NO: 684547 - DNA, 25 bp, Mus musculus
gtcattgctataatcctcatacatc

SEQ ID NO: 684548 - DNA, 25 bp, Mus musculus
gtcattgctatattcctcatacatc

SEQ ID NO: 684549 - DNA, 25 bp, Mus musculus
gtcattgctcacacaatcacattgt

SEQ ID NO: 684550 - DNA, 25 bp, Mus musculus
gtcattgctcactcaatcacattgt

SEQ ID NO: 684551 - DNA, 25 bp, Mus musculus
gtcattgctgtaattctaagtgttc

SEQ ID NO: 684552 - DNA, 25 bp, Mus musculus
gtcattgctgtatttctaagtgttc

SEQ ID NO: 684553 - DNA, 25 bp, Mus musculus
gtcattgctgttctagagcctagag

SEQ ID NO: 684554 - DNA, 25 bp, Mus musculus
gtcattgctgttgtagagcctagag

SEQ ID NO: 684555 - DNA, 25 bp, Mus musculus
gtcattggctgaagttgttttatca

SEQ ID NO: 684556 - DNA, 25 bp, Mus musculus
gtcattggctgatgttgttttatca

SEQ ID NO: 684557 - DNA, 25 bp, Mus musculus
gtcattggtaggaccactaggccga

SEQ ID NO: 684558 - DNA, 25 bp, Mus musculus
gtcattggtaggtccactaggccga

SEQ ID NO: 684559 - DNA, 25 bp, Mus musculus
gtcattggtggcaggataggcttat

SEQ ID NO: 684560 - DNA, 25 bp, Mus musculus
gtcattggtggctggataggcttat

SEQ ID NO: 684561 - DNA, 25 bp, Mus musculus
gtcattggtgtcaagcttaagggca

SEQ ID NO: 684562 - DNA, 25 bp, Mus musculus
gtcattggtgtctagcttaagggca

SEQ ID NO: 684563 - DNA, 25 bp, Mus musculus
gtcattggttacagacagcttgtct

SEQ ID NO: 684564 - DNA, 25 bp, Mus musculus
gtcattggttactgacagcttgtct

SEQ ID NO: 684565 - DNA, 25 bp, Mus musculus
gtcattggttttagcctacacttca

SEQ ID NO: 684566 - DNA, 25 bp, Mus musculus
gtcattggtttttgcctacacttca

SEQ ID NO: 684567 - DNA, 25 bp, Mus musculus
gtcattgtaacgaaattgcagtgca

SEQ ID NO: 684568 - DNA, 25 bp, Mus musculus
gtcattgtaacgtaattgcagtgca

SEQ ID NO: 684569 - DNA, 25 bp, Mus musculus
gtcattgtaactcacagccacggct

SEQ ID NO: 684570 - DNA, 25 bp, Mus musculus
gtcattgtaactgacagccacggct

SEQ ID NO: 684571 - DNA, 25 bp, Mus musculus
gtcattgtacatccacatagctcag

SEQ ID NO: 684572 - DNA, 25 bp, Mus musculus
gtcattgtacatgcacatagctcag

SEQ ID NO: 684573 - DNA, 25 bp, Mus musculus
gtcattgtacttctttacccagaag

SEQ ID NO: 684574 - DNA, 25 bp, Mus musculus
gtcattgtacttgtttacccagaag

SEQ ID NO: 684575 - DNA, 25 bp, Mus musculus
gtcattgtagatctccaggtaaaag

SEQ ID NO: 684576 - DNA, 25 bp, Mus musculus
gtcattgtagatgtccaggtaaaag

SEQ ID NO: 684577 - DNA, 25 bp, Mus musculus
gtcattgtattgattcctggttttt

SEQ ID NO: 684578 - DNA, 25 bp, Mus musculus
gtcattgtattgtttcctggttttt

SEQ ID NO: 684579 - DNA, 25 bp, Mus musculus
gtcattgtatttatagcaggttcca

SEQ ID NO: 684580 - DNA, 25 bp, Mus musculus
gtcattgtatttttagcaggttcca

SEQ ID NO: 684581 - DNA, 25 bp, Mus musculus
gtcattgtcactattgcaggatata

SEQ ID NO: 684582 - DNA, 25 bp, Mus musculus
gtcattgtcacttttgcaggatata

SEQ ID NO: 684583 - DNA, 25 bp, Mus musculus
gtcattgtctacaatgtcttctaga

SEQ ID NO: 684584 - DNA, 25 bp, Mus musculus
gtcattgtctactatgtcttctaga

SEQ ID NO: 684585 - DNA, 25 bp, Mus musculus
gtcattgtcttgattgcactgtcag

SEQ ID NO: 684586 - DNA, 25 bp, Mus musculus
gtcattgtcttgtttgcactgtcag

SEQ ID NO: 684587 - DNA, 25 bp, Mus musculus
gtcattgtctttctatatagtgcag

SEQ ID NO: 684588 - DNA, 25 bp, Mus musculus
gtcattgtctttgtatatagtgcag

SEQ ID NO: 684589 - DNA, 25 bp, Mus musculus
gtcattgtgagtccagctctgtcat

SEQ ID NO: 684590 - DNA, 25 bp, Mus musculus
gtcattgtgagtgcagctctgtcat

SEQ ID NO: 684591 - DNA, 25 bp, Mus musculus
gtcattgtgcaccttaccattcatt

SEQ ID NO: 684592 - DNA, 25 bp, Mus musculus
gtcattgtgcacgttaccattcatt

SEQ ID NO: 684593 - DNA, 25 bp, Mus musculus
gtcattgtgcagagtattacccaga

SEQ ID NO: 684594 - DNA, 25 bp, Mus musculus
gtcattgtgcagtgtattacccaga

SEQ ID NO: 684595 - DNA, 25 bp, Mus musculus
gtcattgtgcatcttccaaaattat

SEQ ID NO: 684596 - DNA, 25 bp, Mus musculus
gtcattgtgcatgttccaaaattat

SEQ ID NO: 684597 - DNA, 25 bp, Mus musculus
gtcattgtgcttcatgaagcccatg

SEQ ID NO: 684598 - DNA, 25 bp, Mus musculus
gtcattgtgcttgatgaagcccatg

SEQ ID NO: 684599 - DNA, 25 bp, Mus musculus
gtcattgtggtaccgactgccagag

SEQ ID NO: 684600 - DNA, 25 bp, Mus musculus
gtcattgtggtagcgactgccagag

SEQ ID NO: 684601 - DNA, 25 bp, Mus musculus
gtcattgtggtgagtaccgttctac

SEQ ID NO: 684602 - DNA, 25 bp, Mus musculus
gtcattgtggtgtgtaccgttctac

SEQ ID NO: 684603 - DNA, 25 bp, Mus musculus
gtcattgtggttaccgactgcccag

SEQ ID NO: 684604 - DNA, 25 bp, Mus musculus
gtcattgtggtttccgactgcccag

SEQ ID NO: 684605 - DNA, 25 bp, Mus musculus
gtcattgttcatccttgtgtgcacg

SEQ ID NO: 684606 - DNA, 25 bp, Mus musculus
gtcattgttcatgcttgtgtgcacg

SEQ ID NO: 684607 - DNA, 25 bp, Mus musculus
gtcattgttctgagcaactgcgagc

SEQ ID NO: 684608 - DNA, 25 bp, Mus musculus
gtcattgttctgtgcaactgcgagc

SEQ ID NO: 684609 - DNA, 25 bp, Mus musculus
gtcattgttgagaccggttcctagg

SEQ ID NO: 684610 - DNA, 25 bp, Mus musculus
gtcattgttgagtccggttcctagg

SEQ ID NO: 684611 - DNA, 25 bp, Mus musculus
gtcattgttgccatcaggatttcaa

SEQ ID NO: 684612 - DNA, 25 bp, Mus musculus
gtcattgttgccttcaggatttcaa

SEQ ID NO: 684613 - DNA, 25 bp, Mus musculus
gtcattgtttacaatcctattactt

SEQ ID NO: 684614 - DNA, 25 bp, Mus musculus
gtcattgtttactatcctattactt

SEQ ID NO: 684615 - DNA, 25 bp, Mus musculus
gtcattgtttccaactttaaaagca

SEQ ID NO: 684616 - DNA, 25 bp, Mus musculus
gtcattgtttcctactttaaaagca

SEQ ID NO: 684617 - DNA, 25 bp, Mus musculus
gtcattgtttctaagcccatctttt

SEQ ID NO: 684618 - DNA, 25 bp, Mus musculus
gtcattgtttctattttctgatgca

SEQ ID NO: 684619 - DNA, 25 bp, Mus musculus
gtcattgtttcttagcccatctttt

SEQ ID NO: 684620 - DNA, 25 bp, Mus musculus
gtcattgtttcttttttctgatgca

SEQ ID NO: 684621 - DNA, 25 bp, Mus musculus
gtcattgttttgatccatccctttg

SEQ ID NO: 684622 - DNA, 25 bp, Mus musculus
gtcattgttttgttccatccctttg

SEQ ID NO: 684623 - DNA, 25 bp, Mus musculus
gtcattgtttttccttgtcctcgaa

SEQ ID NO: 684624 - DNA, 25 bp, Mus musculus
gtcattgtttttgcttgtcctcgaa

SEQ ID NO: 684625 - DNA, 25 bp, Mus musculus
gtcatttaagcgctacagctctagt

SEQ ID NO: 684626 - DNA, 25 bp, Mus musculus
gtcatttaagcggtacagctctagt

SEQ ID NO: 684627 - DNA, 25 bp, Mus musculus
gtcatttaattgcattctctttctg

SEQ ID NO: 684628 - DNA, 25 bp, Mus musculus
gtcatttaattggattctctttctg

SEQ ID NO: 684629 - DNA, 25 bp, Mus musculus
gtcatttacaccaggacatgtcaca

SEQ ID NO: 684630 - DNA, 25 bp, Mus musculus
gtcatttacacctggacatgtcaca

SEQ ID NO: 684631 - DNA, 25 bp, Mus musculus
gtcatttacatacttctcatggaac

SEQ ID NO: 684632 - DNA, 25 bp, Mus musculus
gtcatttacatagttctcatggaac

SEQ ID NO: 684633 - DNA, 25 bp, Mus musculus
gtcatttacccaactgtggctgagg

SEQ ID NO: 684634 - DNA, 25 bp, Mus musculus
gtcatttacccatctgtggctgagg

SEQ ID NO: 684635 - DNA, 25 bp, Mus musculus
gtcatttacttccatccaagagcac

SEQ ID NO: 684636 - DNA, 25 bp, Mus musculus
gtcatttacttcgatccaagagcac

SEQ ID NO: 684637 - DNA, 25 bp, Mus musculus
gtcatttatcacattctgcaaccaa

SEQ ID NO: 684638 - DNA, 25 bp, Mus musculus
gtcatttatcactttctgcaaccaa

SEQ ID NO: 684639 - DNA, 25 bp, Mus musculus
gtcatttcaaaaacctcagccttag

SEQ ID NO: 684640 - DNA, 25 bp, Mus musculus
gtcatttcaaaatcctcagccttag

SEQ ID NO: 684641 - DNA, 25 bp, Mus musculus
gtcatttcaaatcgatccttcgtag

SEQ ID NO: 684642 - DNA, 25 bp, Mus musculus
gtcatttcaaatggatccttcgtag

SEQ ID NO: 684643 - DNA, 25 bp, Mus musculus
gtcatttcaacgattctgtggcaga

SEQ ID NO: 684644 - DNA, 25 bp, Mus musculus
gtcatttcaacgtttctgtggcaga

SEQ ID NO: 684645 - DNA, 25 bp, Mus musculus
gtcatttcaactacatcagggagtc

SEQ ID NO: 684646 - DNA, 25 bp, Mus musculus
gtcatttcaactcttacaatcagga

SEQ ID NO: 684647 - DNA, 25 bp, Mus musculus
gtcatttcaactgttacaatcagga

SEQ ID NO: 684648 - DNA, 25 bp, Mus musculus
gtcatttcaacttcatcagggagtc

SEQ ID NO: 684649 - DNA, 25 bp, Mus musculus
gtcatttcacatccccagactctgg

SEQ ID NO: 684650 - DNA, 25 bp, Mus musculus
gtcatttcacatgcccagactctgg

SEQ ID NO: 684651 - DNA, 25 bp, Mus musculus
gtcatttcagacacatctgcaccat

SEQ ID NO: 684652 - DNA, 25 bp, Mus musculus
gtcatttcagactcatctgcaccat

SEQ ID NO: 684653 - DNA, 25 bp, Mus musculus
gtcatttcagagagtctccactttc

SEQ ID NO: 684654 - DNA, 25 bp, Mus musculus
gtcatttcagagtgtctccactttc

SEQ ID NO: 684655 - DNA, 25 bp, Mus musculus
gtcatttcaggacaactggtcttaa

SEQ ID NO: 684656 - DNA, 25 bp, Mus musculus
gtcatttcaggagaactggtcttaa

SEQ ID NO: 684657 - DNA, 25 bp, Mus musculus
gtcatttcagttccttaaggccaca

SEQ ID NO: 684658 - DNA, 25 bp, Mus musculus
gtcatttcagttgcttaaggccaca

SEQ ID NO: 684659 - DNA, 25 bp, Mus musculus
gtcatttccaccacaacaagaggcc

SEQ ID NO: 684660 - DNA, 25 bp, Mus musculus
gtcatttccacctcaacaagaggcc

SEQ ID NO: 684661 - DNA, 25 bp, Mus musculus
gtcatttccagcatacagatatgta

SEQ ID NO: 684662 - DNA, 25 bp, Mus musculus
gtcatttccagcttacagatatgta

SEQ ID NO: 684663 - DNA, 25 bp, Mus musculus
gtcatttcccggcacatcgacacag

SEQ ID NO: 684664 - DNA, 25 bp, Mus musculus
gtcatttcccgggacatcgacacag

SEQ ID NO: 684665 - DNA, 25 bp, Mus musculus
gtcatttccttactaactgcaagaa

SEQ ID NO: 684666 - DNA, 25 bp, Mus musculus
gtcatttccttagtaactgcaagaa

SEQ ID NO: 684667 - DNA, 25 bp, Mus musculus
gtcatttcgtgtctttattcctata

SEQ ID NO: 684668 - DNA, 25 bp, Mus musculus
gtcatttcgtgtgtttattcctata

SEQ ID NO: 684669 - DNA, 25 bp, Mus musculus
gtcatttctaacagctagtgcttgg

SEQ ID NO: 684670 - DNA, 25 bp, Mus musculus
gtcatttctaactgctagtgcttgg

SEQ ID NO: 684671 - DNA, 25 bp, Mus musculus
gtcatttctaccagcaacagagcat

SEQ ID NO: 684672 - DNA, 25 bp, Mus musculus
gtcatttctacctgcaacagagcat

SEQ ID NO: 684673 - DNA, 25 bp, Mus musculus
gtcatttctggaaacgcttgatgct

SEQ ID NO: 684674 - DNA, 25 bp, Mus musculus
gtcatttctggatacgcttgatgct

SEQ ID NO: 684675 - DNA, 25 bp, Mus musculus
gtcatttctgttcaggctctatatt

SEQ ID NO: 684676 - DNA, 25 bp, Mus musculus
gtcatttctgttgaggctctatatt

SEQ ID NO: 684677 - DNA, 25 bp, Mus musculus
gtcatttcttatcttctgttggctg

SEQ ID NO: 684678 - DNA, 25 bp, Mus musculus
gtcatttcttatgttctgttggctg

SEQ ID NO: 684679 - DNA, 25 bp, Mus musculus
gtcatttcttccaagtagcgtacag

SEQ ID NO: 684680 - DNA, 25 bp, Mus musculus
gtcatttcttcctagtagcgtacag

SEQ ID NO: 684681 - DNA, 25 bp, Mus musculus
gtcatttgaaaccaactcctgttgt

SEQ ID NO: 684682 - DNA, 25 bp, Mus musculus
gtcatttgaaacgaactcctgttgt

SEQ ID NO: 684683 - DNA, 25 bp, Mus musculus
gtcatttgacagatttttcccagcc

SEQ ID NO: 684684 - DNA, 25 bp, Mus musculus
gtcatttgacagttttttcccagcc

SEQ ID NO: 684685 - DNA, 25 bp, Mus musculus
gtcatttgatgacaagtgtattaaa

SEQ ID NO: 684686 - DNA, 25 bp, Mus musculus
gtcatttgatgagaagtgtattaaa

SEQ ID NO: 684687 - DNA, 25 bp, Mus musculus
gtcatttgattgatctgaggtctct

SEQ ID NO: 684688 - DNA, 25 bp, Mus musculus
gtcatttgattgttctgaggtctct

SEQ ID NO: 684689 - DNA, 25 bp, Mus musculus
gtcatttgccttctttcataattag

SEQ ID NO: 684690 - DNA, 25 bp, Mus musculus
gtcatttgccttgtttcataattag

SEQ ID NO: 684691 - DNA, 25 bp, Mus musculus
gtcatttgctttaggtctctgtgta

SEQ ID NO: 684692 - DNA, 25 bp, Mus musculus
gtcatttgcttttggtctctgtgta

SEQ ID NO: 684693 - DNA, 25 bp, Mus musculus
gtcatttgggctcttatttgttaaa

SEQ ID NO: 684694 - DNA, 25 bp, Mus musculus
gtcatttgggctgttatttgttaaa

SEQ ID NO: 684695 - DNA, 25 bp, Mus musculus
gtcatttggtaaaaatactgagcca

SEQ ID NO: 684696 - DNA, 25 bp, Mus musculus
gtcatttggtaataatactgagcca

SEQ ID NO: 684697 - DNA, 25 bp, Mus musculus
gtcatttggtacaaactccaccgtg

SEQ ID NO: 684698 - DNA, 25 bp, Mus musculus
gtcatttggtactaactccaccgtg

SEQ ID NO: 684699 - DNA, 25 bp, Mus musculus
gtcatttgtacaattaaagcagctg

SEQ ID NO: 684700 - DNA, 25 bp, Mus musculus
gtcatttgtacatttaaagcagctg

SEQ ID NO: 684701 - DNA, 25 bp, Mus musculus
gtcatttgtagtagaacacgagaca

SEQ ID NO: 684702 - DNA, 25 bp, Mus musculus
gtcatttgtagttgaacacgagaca

SEQ ID NO: 684703 - DNA, 25 bp, Mus musculus
gtcatttgtattaagcccagatcta

SEQ ID NO: 684704 - DNA, 25 bp, Mus musculus
gtcatttgtatttagcccagatcta

SEQ ID NO: 684705 - DNA, 25 bp, Mus musculus
gtcatttgtcaaactgctggccaac

SEQ ID NO: 684706 - DNA, 25 bp, Mus musculus
gtcatttgtcaaagactgccttact

SEQ ID NO: 684707 - DNA, 25 bp, Mus musculus
gtcatttgtcaatctgctggccaac

SEQ ID NO: 684708 - DNA, 25 bp, Mus musculus
gtcatttgtcaatgactgccttact

SEQ ID NO: 684709 - DNA, 25 bp, Mus musculus
gtcatttgtcttcaagttatatatc

SEQ ID NO: 684710 - DNA, 25 bp, Mus musculus
gtcatttgtcttgaagttatatatc

SEQ ID NO: 684711 - DNA, 25 bp, Mus musculus
gtcatttgtgaaccctacatctcaa

SEQ ID NO: 684712 - DNA, 25 bp, Mus musculus
gtcatttgtgaagcctacatctcaa

SEQ ID NO: 684713 - DNA, 25 bp, Mus musculus
gtcatttgtggaactttccattttg

SEQ ID NO: 684714 - DNA, 25 bp, Mus musculus
gtcatttgtggatctttccattttg

SEQ ID NO: 684715 - DNA, 25 bp, Mus musculus
gtcatttgttggagctgtgtttctg

SEQ ID NO: 684716 - DNA, 25 bp, Mus musculus
gtcatttgttggtgctgtgtttctg

SEQ ID NO: 684717 - DNA, 25 bp, Mus musculus
gtcattttacatagcatggccctgc

SEQ ID NO: 684718 - DNA, 25 bp, Mus musculus
gtcattttacattgcatggccctgc

SEQ ID NO: 684719 - DNA, 25 bp, Mus musculus
gtcattttacgaagtacctgtcctc

SEQ ID NO: 684720 - DNA, 25 bp, Mus musculus
gtcattttacgatgtacctgtcctc

SEQ ID NO: 684721 - DNA, 25 bp, Mus musculus
gtcattttataaagatctaccaaac

SEQ ID NO: 684722 - DNA, 25 bp, Mus musculus
gtcattttataatgatctaccaaac

SEQ ID NO: 684723 - DNA, 25 bp, Mus musculus
gtcattttatgtagaggtgccgctc

SEQ ID NO: 684724 - DNA, 25 bp, Mus musculus
gtcattttatgttgaggtgccgctc

SEQ ID NO: 684725 - DNA, 25 bp, Mus musculus
gtcattttcatgagacccagaccct

SEQ ID NO: 684726 - DNA, 25 bp, Mus musculus
gtcattttcatgtgacccagaccct

SEQ ID NO: 684727 - DNA, 25 bp, Mus musculus
gtcattttcccacgacatgttcagt

SEQ ID NO: 684728 - DNA, 25 bp, Mus musculus
gtcattttcccaggacatgttcagt

SEQ ID NO: 684729 - DNA, 25 bp, Mus musculus
gtcattttctgcacttggtctgtcc

SEQ ID NO: 684730 - DNA, 25 bp, Mus musculus
gtcattttctgctcttggtctgtcc

SEQ ID NO: 684731 - DNA, 25 bp, Mus musculus
gtcattttcttcagttgggtagcca

SEQ ID NO: 684732 - DNA, 25 bp, Mus musculus
gtcattttcttctgttgggtagcca

SEQ ID NO: 684733 - DNA, 25 bp, Mus musculus
gtcattttgaagaccctatatctaa

SEQ ID NO: 684734 - DNA, 25 bp, Mus musculus
gtcattttgaagtccctatatctaa

SEQ ID NO: 684735 - DNA, 25 bp, Mus musculus
gtcattttgagtcagatctttctga

SEQ ID NO: 684736 - DNA, 25 bp, Mus musculus
gtcattttgagtgagatctttctga

SEQ ID NO: 684737 - DNA, 25 bp, Mus musculus
gtcattttgcataagcattttccat

SEQ ID NO: 684738 - DNA, 25 bp, Mus musculus
gtcattttgcattagcattttccat

SEQ ID NO: 684739 - DNA, 25 bp, Mus musculus
gtcattttggagactttttttcatt

SEQ ID NO: 684740 - DNA, 25 bp, Mus musculus
gtcattttggagatctgggcatcaa

SEQ ID NO: 684741 - DNA, 25 bp, Mus musculus
gtcattttggagtctttttttcatt

SEQ ID NO: 684742 - DNA, 25 bp, Mus musculus
gtcattttggagttctgggcatcaa

SEQ ID NO: 684743 - DNA, 25 bp, Mus musculus
gtcattttgggaaatcagcggcaac

SEQ ID NO: 684744 - DNA, 25 bp, Mus musculus
gtcattttgggatatcagcggcaac

SEQ ID NO: 684745 - DNA, 25 bp, Mus musculus
gtcattttggttcgaagcctccaga

SEQ ID NO: 684746 - DNA, 25 bp, Mus musculus
gtcattttggttggaagcctccaga

SEQ ID NO: 684747 - DNA, 25 bp, Mus musculus
gtcattttgtccacattgtccctag

SEQ ID NO: 684748 - DNA, 25 bp, Mus musculus
gtcattttgtcctcattgtccctag

SEQ ID NO: 684749 - DNA, 25 bp, Mus musculus
gtcattttgtgcctgatcagtctaa

SEQ ID NO: 684750 - DNA, 25 bp, Mus musculus
gtcattttgtgcgtgatcagtctaa

SEQ ID NO: 684751 - DNA, 25 bp, Mus musculus
gtcattttgtggaactactattagc

SEQ ID NO: 684752 - DNA, 25 bp, Mus musculus
gtcattttgtggtactactattagc

SEQ ID NO: 684753 - DNA, 25 bp, Mus musculus
gtcattttgtttataatcagtggct

SEQ ID NO: 684754 - DNA, 25 bp, Mus musculus
gtcattttgtttttaatcagtggct

SEQ ID NO: 684755 - DNA, 25 bp, Mus musculus
gtcatttttactaagtgtcttctac

SEQ ID NO: 684756 - DNA, 25 bp, Mus musculus
gtcatttttactcccaatttttgga

SEQ ID NO: 684757 - DNA, 25 bp, Mus musculus
gtcatttttactgccaatttttgga

SEQ ID NO: 684758 - DNA, 25 bp, Mus musculus
gtcatttttacttagtgtcttctac

SEQ ID NO: 684759 - DNA, 25 bp, Mus musculus
gtcatttttattagcctaactgaag

SEQ ID NO: 684760 - DNA, 25 bp, Mus musculus
gtcatttttatttgcctaactgaag

SEQ ID NO: 684761 - DNA, 25 bp, Mus musculus
gtcatttttctcatcactggatgtt

SEQ ID NO: 684762 - DNA, 25 bp, Mus musculus
gtcatttttctcttcactggatgtt

SEQ ID NO: 684763 - DNA, 25 bp, Mus musculus
gtcatttttttgcgcgacccgctga

SEQ ID NO: 684764 - DNA, 25 bp, Mus musculus
gtcatttttttgggcgacccgctga

SEQ ID NO: 684765 - DNA, 25 bp, Mus musculus
gtccaaaaccagaagctgtcagcca

SEQ ID NO: 684766 - DNA, 25 bp, Mus musculus
gtccaaaaccagtagctgtcagcca

SEQ ID NO: 684767 - DNA, 25 bp, Mus musculus
gtccaaaagactagattattttcct

SEQ ID NO: 684768 - DNA, 25 bp, Mus musculus
gtccaaaagacttgattattttcct

SEQ ID NO: 684769 - DNA, 25 bp, Mus musculus
gtccaaaagttcactctaagaacgt

SEQ ID NO: 684770 - DNA, 25 bp, Mus musculus
gtccaaaagttctctctaagaacgt

SEQ ID NO: 684771 - DNA, 25 bp, Mus musculus
gtccaaaatcccaaccatgtctaag

SEQ ID NO: 684772 - DNA, 25 bp, Mus musculus
gtccaaaatccctaccatgtctaag

SEQ ID NO: 684773 - DNA, 25 bp, Mus musculus
gtccaaaatcttacctggaaatcct

SEQ ID NO: 684774 - DNA, 25 bp, Mus musculus
gtccaaaatctttcctggaaatcct

SEQ ID NO: 684775 - DNA, 25 bp, Mus musculus
gtccaaaattatacttgagcactga

SEQ ID NO: 684776 - DNA, 25 bp, Mus musculus
gtccaaaattattcttgagcactga

SEQ ID NO: 684777 - DNA, 25 bp, Mus musculus
gtccaaaattgtccacaagaccttt

SEQ ID NO: 684778 - DNA, 25 bp, Mus musculus
gtccaaaattgtgcacaagaccttt

SEQ ID NO: 684779 - DNA, 25 bp, Mus musculus
gtccaaacacccagaagtaactcat

SEQ ID NO: 684780 - DNA, 25 bp, Mus musculus
gtccaaacaccctgaagtaactcat

SEQ ID NO: 684781 - DNA, 25 bp, Mus musculus
gtccaaaccagtactgttcacaact

SEQ ID NO: 684782 - DNA, 25 bp, Mus musculus
gtccaaaccagttctgttcacaact

SEQ ID NO: 684783 - DNA, 25 bp, Mus musculus
gtccaaacccacagtaaaatgaagc

SEQ ID NO: 684784 - DNA, 25 bp, Mus musculus
gtccaaacccactgtaaaatgaagc

SEQ ID NO: 684785 - DNA, 25 bp, Mus musculus
gtccaaactaaccacaatgcaataa

SEQ ID NO: 684786 - DNA, 25 bp, Mus musculus
gtccaaactaacgacaatgcaataa

SEQ ID NO: 684787 - DNA, 25 bp, Mus musculus
gtccaaactgggatatctgaccctg

SEQ ID NO: 684788 - DNA, 25 bp, Mus musculus
gtccaaactgggttatctgaccctg

SEQ ID NO: 684789 - DNA, 25 bp, Mus musculus
gtccaaactttcagctagacactga

SEQ ID NO: 684790 - DNA, 25 bp, Mus musculus
gtccaaactttctgctagacactga

SEQ ID NO: 684791 - DNA, 25 bp, Mus musculus
gtccaaagacatcccggaacttgct

SEQ ID NO: 684792 - DNA, 25 bp, Mus musculus
gtccaaagacatgccggaacttgct

SEQ ID NO: 684793 - DNA, 25 bp, Mus musculus
gtccaaagactcagccatcaggcta

SEQ ID NO: 684794 - DNA, 25 bp, Mus musculus
gtccaaagactctgccatcaggcta

SEQ ID NO: 684795 - DNA, 25 bp, Mus musculus
gtccaaagacttccaggccacaggt

SEQ ID NO: 684796 - DNA, 25 bp, Mus musculus
gtccaaagacttgcaggccacaggt

SEQ ID NO: 684797 - DNA, 25 bp, Mus musculus
gtccaaagagtgagtgggctttcct

SEQ ID NO: 684798 - DNA, 25 bp, Mus musculus
gtccaaagagtgtgtgggctttcct

SEQ ID NO: 684799 - DNA, 25 bp, Mus musculus
gtccaaagcatacaagaaaacccaa

SEQ ID NO: 684800 - DNA, 25 bp, Mus musculus
gtccaaagcatagaagaaaacccaa

SEQ ID NO: 684801 - DNA, 25 bp, Mus musculus
gtccaaagcccaacatgacttctgg

SEQ ID NO: 684802 - DNA, 25 bp, Mus musculus
gtccaaagcccatcatgacttctgg

SEQ ID NO: 684803 - DNA, 25 bp, Mus musculus
gtccaaagctcactatatatcccag

SEQ ID NO: 684804 - DNA, 25 bp, Mus musculus
gtccaaagctcagtatatatcccag

SEQ ID NO: 684805 - DNA, 25 bp, Mus musculus
gtccaaagcttgcagtgacttttta

SEQ ID NO: 684806 - DNA, 25 bp, Mus musculus
gtccaaagcttggagtgacttttta

SEQ ID NO: 684807 - DNA, 25 bp, Mus musculus
gtccaaaggcatcaaggcccacttt

SEQ ID NO: 684808 - DNA, 25 bp, Mus musculus
gtccaaaggcatgaaggcccacttt

SEQ ID NO: 684809 - DNA, 25 bp, Mus musculus
gtccaaagtctcatctacaattcat

SEQ ID NO: 684810 - DNA, 25 bp, Mus musculus
gtccaaagtctcttctacaattcat

SEQ ID NO: 684811 - DNA, 25 bp, Mus musculus
gtccaaagtgcaccagcaagtggtc

SEQ ID NO: 684812 - DNA, 25 bp, Mus musculus
gtccaaagtgcagcagcaagtggtc

SEQ ID NO: 684813 - DNA, 25 bp, Mus musculus
gtccaaatactcatagctctcaaag

SEQ ID NO: 684814 - DNA, 25 bp, Mus musculus
gtccaaatactcttagctctcaaag

SEQ ID NO: 684815 - DNA, 25 bp, Mus musculus
gtccaaatcccacctgagcctgagt

SEQ ID NO: 684816 - DNA, 25 bp, Mus musculus
gtccaaatcccagctgagcctgagt

SEQ ID NO: 684817 - DNA, 25 bp, Mus musculus
gtccaaatcgcaagcagtgcacgtt

SEQ ID NO: 684818 - DNA, 25 bp, Mus musculus
gtccaaatcgcatgcagtgcacgtt

SEQ ID NO: 684819 - DNA, 25 bp, Mus musculus
gtccaaatctggctccaacaaaagc

SEQ ID NO: 684820 - DNA, 25 bp, Mus musculus
gtccaaatctgggtccaacaaaagc

SEQ ID NO: 684821 - DNA, 25 bp, Mus musculus
gtccaaatgaaaatctccgagctct

SEQ ID NO: 684822 - DNA, 25 bp, Mus musculus
gtccaaatgaaattctccgagctct

SEQ ID NO: 684823 - DNA, 25 bp, Mus musculus
gtccaaatgcgtacactgtatcttt

SEQ ID NO: 684824 - DNA, 25 bp, Mus musculus
gtccaaatgcgttcactgtatcttt

SEQ ID NO: 684825 - DNA, 25 bp, Mus musculus
gtccaaatgcttctctttgaatcaa

SEQ ID NO: 684826 - DNA, 25 bp, Mus musculus
gtccaaatgcttgtctttgaatcaa

SEQ ID NO: 684827 - DNA, 25 bp, Mus musculus
gtccaaatggaacgtcacccctttg

SEQ ID NO: 684828 - DNA, 25 bp, Mus musculus
gtccaaatggaaggtcacccctttg

SEQ ID NO: 684829 - DNA, 25 bp, Mus musculus
gtccaaattaaaacccagcaggctg

SEQ ID NO: 684830 - DNA, 25 bp, Mus musculus
gtccaaattaaatcccagcaggctg

SEQ ID NO: 684831 - DNA, 25 bp, Mus musculus
gtccaaattcagctagtttctcagt

SEQ ID NO: 684832 - DNA, 25 bp, Mus musculus
gtccaaattcaggtagtttctcagt

SEQ ID NO: 684833 - DNA, 25 bp, Mus musculus
gtccaaattgatacttgtcctgctg

SEQ ID NO: 684834 - DNA, 25 bp, Mus musculus
gtccaaattgattcttgtcctgctg

SEQ ID NO: 684835 - DNA, 25 bp, Mus musculus
gtccaacaactcaaagacctgcttt

SEQ ID NO: 684836 - DNA, 25 bp, Mus musculus
gtccaacaactctaagacctgcttt

SEQ ID NO: 684837 - DNA, 25 bp, Mus musculus
gtccaacaaggtctcgctggcgctg

SEQ ID NO: 684838 - DNA, 25 bp, Mus musculus
gtccaacaaggtgtcgctggcgctg

SEQ ID NO: 684839 - DNA, 25 bp, Mus musculus
gtccaacagatgcactcgtcaaaag

SEQ ID NO: 684840 - DNA, 25 bp, Mus musculus
gtccaacagatggactcgtcaaaag

SEQ ID NO: 684841 - DNA, 25 bp, Mus musculus
gtccaacagctgaaacctcagtaca

SEQ ID NO: 684842 - DNA, 25 bp, Mus musculus
gtccaacagctgtaacctcagtaca

SEQ ID NO: 684843 - DNA, 25 bp, Mus musculus
gtccaacatcacaggtgctgacatg

SEQ ID NO: 684844 - DNA, 25 bp, Mus musculus
gtccaacatcacagtcacatacaga

SEQ ID NO: 684845 - DNA, 25 bp, Mus musculus
gtccaacatcactggtgctgacatg

SEQ ID NO: 684846 - DNA, 25 bp, Mus musculus
gtccaacatcactgtcacatacaga

SEQ ID NO: 684847 - DNA, 25 bp, Mus musculus
gtccaacatcctaagggaaccattg

SEQ ID NO: 684848 - DNA, 25 bp, Mus musculus
gtccaacatcctagagcgcaacaag

SEQ ID NO: 684849 - DNA, 25 bp, Mus musculus
gtccaacatccttagggaaccattg

SEQ ID NO: 684850 - DNA, 25 bp, Mus musculus
gtccaacatccttgagcgcaacaag

SEQ ID NO: 684851 - DNA, 25 bp, Mus musculus
gtccaacatttcaagcttacagagg

SEQ ID NO: 684852 - DNA, 25 bp, Mus musculus
gtccaacatttccatgcaagatgtg

SEQ ID NO: 684853 - DNA, 25 bp, Mus musculus
gtccaacatttcgatgcaagatgtg

SEQ ID NO: 684854 - DNA, 25 bp, Mus musculus
gtccaacatttctagcttacagagg

SEQ ID NO: 684855 - DNA, 25 bp, Mus musculus
gtccaaccaggaccagatcctcaat

SEQ ID NO: 684856 - DNA, 25 bp, Mus musculus
gtccaaccaggagcagatcctcaat

SEQ ID NO: 684857 - DNA, 25 bp, Mus musculus
gtccaaccccagctaagctgaatct

SEQ ID NO: 684858 - DNA, 25 bp, Mus musculus
gtccaaccccaggtaagctgaatct

SEQ ID NO: 684859 - DNA, 25 bp, Mus musculus
gtccaactagaaagttcctttcctt

SEQ ID NO: 684860 - DNA, 25 bp, Mus musculus
gtccaactagaatgttcctttcctt

SEQ ID NO: 684861 - DNA, 25 bp, Mus musculus
gtccaactagatagttcaccatcag

SEQ ID NO: 684862 - DNA, 25 bp, Mus musculus
gtccaactagattgttcaccatcag

SEQ ID NO: 684863 - DNA, 25 bp, Mus musculus
gtccaactatttagaccccaccaag

SEQ ID NO: 684864 - DNA, 25 bp, Mus musculus
gtccaactattttgaccccaccaag

SEQ ID NO: 684865 - DNA, 25 bp, Mus musculus
gtccaactgcatccaactgaaaact

SEQ ID NO: 684866 - DNA, 25 bp, Mus musculus
gtccaactgcatgcaactgaaaact

SEQ ID NO: 684867 - DNA, 25 bp, Mus musculus
gtccaactgtccctgttgtaagtgc

SEQ ID NO: 684868 - DNA, 25 bp, Mus musculus
gtccaactgtccgtgttgtaagtgc

SEQ ID NO: 684869 - DNA, 25 bp, Mus musculus
gtccaacttagaagtggtgaacctc

SEQ ID NO: 684870 - DNA, 25 bp, Mus musculus
gtccaacttagatgtggtgaacctc

SEQ ID NO: 684871 - DNA, 25 bp, Mus musculus
gtccaagaaggacctttctacctca

SEQ ID NO: 684872 - DNA, 25 bp, Mus musculus
gtccaagaaggagctttctacctca

SEQ ID NO: 684873 - DNA, 25 bp, Mus musculus
gtccaagacctcactttggtttctg

SEQ ID NO: 684874 - DNA, 25 bp, Mus musculus
gtccaagacctctctttggtttctg

SEQ ID NO: 684875 - DNA, 25 bp, Mus musculus
gtccaagacgagaaaaacggcttca

SEQ ID NO: 684876 - DNA, 25 bp, Mus musculus
gtccaagacgagtaaaacggcttca

SEQ ID NO: 684877 - DNA, 25 bp, Mus musculus
gtccaagactaactgtgaaagccct

SEQ ID NO: 684878 - DNA, 25 bp, Mus musculus
gtccaagactaagtgtgaaagccct

SEQ ID NO: 684879 - DNA, 25 bp, Mus musculus
gtccaagagactcgtggttcctgct

SEQ ID NO: 684880 - DNA, 25 bp, Mus musculus
gtccaagagactggtggttcctgct

SEQ ID NO: 684881 - DNA, 25 bp, Mus musculus
gtccaagagctcaatgtcctccagg

SEQ ID NO: 684882 - DNA, 25 bp, Mus musculus
gtccaagagctctatgtcctccagg

SEQ ID NO: 684883 - DNA, 25 bp, Mus musculus
gtccaagagtgaaggcctagctccc

SEQ ID NO: 684884 - DNA, 25 bp, Mus musculus
gtccaagagtgatggcctagctccc

SEQ ID NO: 684885 - DNA, 25 bp, Mus musculus
gtccaagatgtcagagcctagctga

SEQ ID NO: 684886 - DNA, 25 bp, Mus musculus
gtccaagatgtctgagcctagctga

SEQ ID NO: 684887 - DNA, 25 bp, Mus musculus
gtccaagatgtgatgagctagccta

SEQ ID NO: 684888 - DNA, 25 bp, Mus musculus
gtccaagatgtgttgagctagccta

SEQ ID NO: 684889 - DNA, 25 bp, Mus musculus
gtccaagcaagaacagctaccaggg

SEQ ID NO: 684890 - DNA, 25 bp, Mus musculus
gtccaagcaagatcagctaccaggg

SEQ ID NO: 684891 - DNA, 25 bp, Mus musculus
gtccaagcacaaaattttatagggc

SEQ ID NO: 684892 - DNA, 25 bp, Mus musculus
gtccaagcacaatattttatagggc

SEQ ID NO: 684893 - DNA, 25 bp, Mus musculus
gtccaagcacgccaatgagctggtg

SEQ ID NO: 684894 - DNA, 25 bp, Mus musculus
gtccaagcacgcgaatgagctggtg

SEQ ID NO: 684895 - DNA, 25 bp, Mus musculus
gtccaagcagagatgatcagcccct

SEQ ID NO: 684896 - DNA, 25 bp, Mus musculus
gtccaagcagagttgatcagcccct

SEQ ID NO: 684897 - DNA, 25 bp, Mus musculus
gtccaagcagtactggtaccctaaa

SEQ ID NO: 684898 - DNA, 25 bp, Mus musculus
gtccaagcagtagtggtaccctaaa

SEQ ID NO: 684899 - DNA, 25 bp, Mus musculus
gtccaagccaacagataacatcgat

SEQ ID NO: 684900 - DNA, 25 bp, Mus musculus
gtccaagccaactgataacatcgat

SEQ ID NO: 684901 - DNA, 25 bp, Mus musculus
gtccaagcctccagttagattgcca

SEQ ID NO: 684902 - DNA, 25 bp, Mus musculus
gtccaagcctcctgttagattgcca

SEQ ID NO: 684903 - DNA, 25 bp, Mus musculus
gtccaagctacaccaaacattaacc

SEQ ID NO: 684904 - DNA, 25 bp, Mus musculus
gtccaagctacagcaaacattaacc

SEQ ID NO: 684905 - DNA, 25 bp, Mus musculus
gtccaagcttaacacgggcagtcac

SEQ ID NO: 684906 - DNA, 25 bp, Mus musculus
gtccaagcttaagacgggcagtcac

SEQ ID NO: 684907 - DNA, 25 bp, Mus musculus
gtccaaggaatgaggcttcggctat

SEQ ID NO: 684908 - DNA, 25 bp, Mus musculus
gtccaaggaatgtggcttcggctat

SEQ ID NO: 684909 - DNA, 25 bp, Mus musculus
gtccaaggactaaattacttcatta

SEQ ID NO: 684910 - DNA, 25 bp, Mus musculus
gtccaaggactatattacttcatta

SEQ ID NO: 684911 - DNA, 25 bp, Mus musculus
gtccaaggccgccactgttttgtct

SEQ ID NO: 684912 - DNA, 25 bp, Mus musculus
gtccaaggccgcgactgttttgtct

SEQ ID NO: 684913 - DNA, 25 bp, Mus musculus
gtccaaggcctgcttcaggtagcca

SEQ ID NO: 684914 - DNA, 25 bp, Mus musculus
gtccaaggcctggttcaggtagcca

SEQ ID NO: 684915 - DNA, 25 bp, Mus musculus
gtccaaggctcgctgcattgagagt

SEQ ID NO: 684916 - DNA, 25 bp, Mus musculus
gtccaaggctcggtgcattgagagt

SEQ ID NO: 684917 - DNA, 25 bp, Mus musculus
gtccaagggcacacaagcagctcaa

SEQ ID NO: 684918 - DNA, 25 bp, Mus musculus
gtccaagggcactcaagcagctcaa

SEQ ID NO: 684919 - DNA, 25 bp, Mus musculus
gtccaagggcttctctccaattatg

SEQ ID NO: 684920 - DNA, 25 bp, Mus musculus
gtccaagggcttgtctccaattatg

SEQ ID NO: 684921 - DNA, 25 bp, Mus musculus
gtccaagggtgtattttgttcccat

SEQ ID NO: 684922 - DNA, 25 bp, Mus musculus
gtccaagggtgttttttgttcccat

SEQ ID NO: 684923 - DNA, 25 bp, Mus musculus
gtccaaggtatgctaggttcaccaa

SEQ ID NO: 684924 - DNA, 25 bp, Mus musculus
gtccaaggtatggtaggttcaccaa

SEQ ID NO: 684925 - DNA, 25 bp, Mus musculus
gtccaaggtccccaacatatacaga

SEQ ID NO: 684926 - DNA, 25 bp, Mus musculus
gtccaaggtcccgaacatatacaga

SEQ ID NO: 684927 - DNA, 25 bp, Mus musculus
gtccaaggtgttaccgatttcctgc

SEQ ID NO: 684928 - DNA, 25 bp, Mus musculus
gtccaaggtgtttccgatttcctgc

SEQ ID NO: 684929 - DNA, 25 bp, Mus musculus
gtccaagtataccaaccagaacaca

SEQ ID NO: 684930 - DNA, 25 bp, Mus musculus
gtccaagtatacgaaccagaacaca

SEQ ID NO: 684931 - DNA, 25 bp, Mus musculus
gtccaagtcaacatccatcagcttg

SEQ ID NO: 684932 - DNA, 25 bp, Mus musculus
gtccaagtcaacttccatcagcttg

SEQ ID NO: 684933 - DNA, 25 bp, Mus musculus
gtccaagtcacaaaattaccacaga

SEQ ID NO: 684934 - DNA, 25 bp, Mus musculus
gtccaagtcacataattaccacaga

SEQ ID NO: 684935 - DNA, 25 bp, Mus musculus
gtccaagtcattagtgcagtcaaca

SEQ ID NO: 684936 - DNA, 25 bp, Mus musculus
gtccaagtcatttgtgcagtcaaca

SEQ ID NO: 684937 - DNA, 25 bp, Mus musculus
gtccaagtgataaacgcatagctta

SEQ ID NO: 684938 - DNA, 25 bp, Mus musculus
gtccaagtgatatacgcatagctta

SEQ ID NO: 684939 - DNA, 25 bp, Mus musculus
gtccaagtgatcactggaggtactg

SEQ ID NO: 684940 - DNA, 25 bp, Mus musculus
gtccaagtgatctctggaggtactg

SEQ ID NO: 684941 - DNA, 25 bp, Mus musculus
gtccaagtgcccaagtgggcttggc

SEQ ID NO: 684942 - DNA, 25 bp, Mus musculus
gtccaagtgccctagtgggcttggc

SEQ ID NO: 684943 - DNA, 25 bp, Mus musculus
gtccaagtgcttaagtcttagtata

SEQ ID NO: 684944 - DNA, 25 bp, Mus musculus
gtccaagtgctttagtcttagtata

SEQ ID NO: 684945 - DNA, 25 bp, Mus musculus
gtccaagtgtgtccagcttctgcag

SEQ ID NO: 684946 - DNA, 25 bp, Mus musculus
gtccaagtgtgtgcagcttctgcag

SEQ ID NO: 684947 - DNA, 25 bp, Mus musculus
gtccaagtgttgatgaatgtaagtt

SEQ ID NO: 684948 - DNA, 25 bp, Mus musculus
gtccaagtgttgttgaatgtaagtt

SEQ ID NO: 684949 - DNA, 25 bp, Mus musculus
gtccaagttcttaaactccattgat

SEQ ID NO: 684950 - DNA, 25 bp, Mus musculus
gtccaagttctttaactccattgat

SEQ ID NO: 684951 - DNA, 25 bp, Mus musculus
gtccaagttttaactgtgtcaagca

SEQ ID NO: 684952 - DNA, 25 bp, Mus musculus
gtccaagttttatctgtgtcaagca

SEQ ID NO: 684953 - DNA, 25 bp, Mus musculus
gtccaatacattatccaaccatagc

SEQ ID NO: 684954 - DNA, 25 bp, Mus musculus
gtccaatacattttccaaccatagc

SEQ ID NO: 684955 - DNA, 25 bp, Mus musculus
gtccaatactcgagggattgttttt

SEQ ID NO: 684956 - DNA, 25 bp, Mus musculus
gtccaatactcgtgggattgttttt

SEQ ID NO: 684957 - DNA, 25 bp, Mus musculus
gtccaatattttatgcaggtcatct

SEQ ID NO: 684958 - DNA, 25 bp, Mus musculus
gtccaatattttttgcaggtcatct

SEQ ID NO: 684959 - DNA, 25 bp, Mus musculus
gtccaatcagagatcctcacaaggt

SEQ ID NO: 684960 - DNA, 25 bp, Mus musculus
gtccaatcagagttcctcacaaggt

SEQ ID NO: 684961 - DNA, 25 bp, Mus musculus
gtccaatcataacctgtacaagcat

SEQ ID NO: 684962 - DNA, 25 bp, Mus musculus
gtccaatcataagctgtacaagcat

SEQ ID NO: 684963 - DNA, 25 bp, Mus musculus
gtccaatgcacgcttgatttacaga

SEQ ID NO: 684964 - DNA, 25 bp, Mus musculus
gtccaatgcacggttgatttacaga

SEQ ID NO: 684965 - DNA, 25 bp, Mus musculus
gtccaatggcatacgttatccttaa

SEQ ID NO: 684966 - DNA, 25 bp, Mus musculus
gtccaatggcattcgttatccttaa

SEQ ID NO: 684967 - DNA, 25 bp, Mus musculus
gtccaatgggaacttctttgccgca

SEQ ID NO: 684968 - DNA, 25 bp, Mus musculus
gtccaatgggaagttctttgccgca

SEQ ID NO: 684969 - DNA, 25 bp, Mus musculus
gtccaatgtccacagcccgaggcag

SEQ ID NO: 684970 - DNA, 25 bp, Mus musculus
gtccaatgtccagagcccgaggcag

SEQ ID NO: 684971 - DNA, 25 bp, Mus musculus
gtccaatgtcctatttcaggtggtt

SEQ ID NO: 684972 - DNA, 25 bp, Mus musculus
gtccaatgtcctttttcaggtggtt

SEQ ID NO: 684973 - DNA, 25 bp, Mus musculus
gtccaatgtgatcagaggtccttgt

SEQ ID NO: 684974 - DNA, 25 bp, Mus musculus
gtccaatgtgatgagaggtccttgt

SEQ ID NO: 684975 - DNA, 25 bp, Mus musculus
gtccaattcacaatagtttccaagt

SEQ ID NO: 684976 - DNA, 25 bp, Mus musculus
gtccaattcacattagtttccaagt

SEQ ID NO: 684977 - DNA, 25 bp, Mus musculus
gtccaattccagactatccacatgt

SEQ ID NO: 684978 - DNA, 25 bp, Mus musculus
gtccaattccagtctatccacatgt

SEQ ID NO: 684979 - DNA, 25 bp, Mus musculus
gtccaattcccaatcagaagctcta

SEQ ID NO: 684980 - DNA, 25 bp, Mus musculus
gtccaattcccattcagaagctcta

SEQ ID NO: 684981 - DNA, 25 bp, Mus musculus
gtccaattctccacatactggagtc

SEQ ID NO: 684982 - DNA, 25 bp, Mus musculus
gtccaattctcctcatactggagtc

SEQ ID NO: 684983 - DNA, 25 bp, Mus musculus
gtccaattgcacagtactgtctact

SEQ ID NO: 684984 - DNA, 25 bp, Mus musculus
gtccaattgcactgtactgtctact

SEQ ID NO: 684985 - DNA, 25 bp, Mus musculus
gtccaattggacagtgagccctggg

SEQ ID NO: 684986 - DNA, 25 bp, Mus musculus
gtccaattggactgtgagccctggg

SEQ ID NO: 684987 - DNA, 25 bp, Mus musculus
gtccaattggctatggtgctcactg

SEQ ID NO: 684988 - DNA, 25 bp, Mus musculus
gtccaattggctttggtgctcactg

SEQ ID NO: 684989 - DNA, 25 bp, Mus musculus
gtccaatttctcaacatctgtgaag

SEQ ID NO: 684990 - DNA, 25 bp, Mus musculus
gtccaatttctctacatctgtgaag

SEQ ID NO: 684991 - DNA, 25 bp, Mus musculus
gtccaattttgtcacatcatcttgt

SEQ ID NO: 684992 - DNA, 25 bp, Mus musculus
gtccaattttgtgacatcatcttgt

SEQ ID NO: 684993 - DNA, 25 bp, Mus musculus
gtccacaaactgatagggcctacat

SEQ ID NO: 684994 - DNA, 25 bp, Mus musculus
gtccacaaactgttagggcctacat

SEQ ID NO: 684995 - DNA, 25 bp, Mus musculus
gtccacaacaagagaaggttctggg

SEQ ID NO: 684996 - DNA, 25 bp, Mus musculus
gtccacaacaagtgaaggttctggg

SEQ ID NO: 684997 - DNA, 25 bp, Mus musculus
gtccacaaccagaaaagccagctca

SEQ ID NO: 684998 - DNA, 25 bp, Mus musculus
gtccacaaccagtaaagccagctca

SEQ ID NO: 684999 - DNA, 25 bp, Mus musculus
gtccacaacgaccagttcggcctgt

SEQ ID NO: 685000 - DNA, 25 bp, Mus musculus
gtccacaacgacgagttcggcctgt

SEQ ID NO: 685001 - DNA, 25 bp, Mus musculus
gtccacaactcaagagcttacacac

SEQ ID NO: 685002 - DNA, 25 bp, Mus musculus
gtccacaactcatgagcttacacac

SEQ ID NO: 685003 - DNA, 25 bp, Mus musculus
gtccacaaggaacgaactgtcactt

SEQ ID NO: 685004 - DNA, 25 bp, Mus musculus
gtccacaaggaaggaactgtcactt

SEQ ID NO: 685005 - DNA, 25 bp, Mus musculus
gtccacaagtggacagagctcagct

SEQ ID NO: 685006 - DNA, 25 bp, Mus musculus
gtccacaagtggtcagagctcagct

SEQ ID NO: 685007 - DNA, 25 bp, Mus musculus
gtccacaataccaataggtgctttt

SEQ ID NO: 685008 - DNA, 25 bp, Mus musculus
gtccacaatacctataggtgctttt

SEQ ID NO: 685009 - DNA, 25 bp, Mus musculus
gtccacaatgttcaagtacctcagg

SEQ ID NO: 685010 - DNA, 25 bp, Mus musculus
gtccacaatgttgaagtacctcagg

SEQ ID NO: 685011 - DNA, 25 bp, Mus musculus
gtccacacagaactgcaagtccaga

SEQ ID NO: 685012 - DNA, 25 bp, Mus musculus
gtccacacagaagtgcaagtccaga

SEQ ID NO: 685013 - DNA, 25 bp, Mus musculus
gtccacacatggagatgctgcctca

SEQ ID NO: 685014 - DNA, 25 bp, Mus musculus
gtccacacatggtgatgctgcctca

SEQ ID NO: 685015 - DNA, 25 bp, Mus musculus
gtccacacctggagggagcgtgtat

SEQ ID NO: 685016 - DNA, 25 bp, Mus musculus
gtccacacctggtgggagcgtgtat

SEQ ID NO: 685017 - DNA, 25 bp, Mus musculus
gtccacactgggaaactatcaagtc

SEQ ID NO: 685018 - DNA, 25 bp, Mus musculus
gtccacactgggtaactatcaagtc

SEQ ID NO: 685019 - DNA, 25 bp, Mus musculus
gtccacacttcgattagcctggaaa

SEQ ID NO: 685020 - DNA, 25 bp, Mus musculus
gtccacacttcgtttagcctggaaa

SEQ ID NO: 685021 - DNA, 25 bp, Mus musculus
gtccacagactaaggcttttgccag

SEQ ID NO: 685022 - DNA, 25 bp, Mus musculus
gtccacagactatggcttttgccag

SEQ ID NO: 685023 - DNA, 25 bp, Mus musculus
gtccacagagaccattttgagtatt

SEQ ID NO: 685024 - DNA, 25 bp, Mus musculus
gtccacagagacgattttgagtatt

SEQ ID NO: 685025 - DNA, 25 bp, Mus musculus
gtccacagaggtccatttagctgct

SEQ ID NO: 685026 - DNA, 25 bp, Mus musculus
gtccacagaggtgcatttagctgct

SEQ ID NO: 685027 - DNA, 25 bp, Mus musculus
gtccacagatatccatgctggtaaa

SEQ ID NO: 685028 - DNA, 25 bp, Mus musculus
gtccacagatatgcatgctggtaaa

SEQ ID NO: 685029 - DNA, 25 bp, Mus musculus
gtccacagatggatcctgcctgaga

SEQ ID NO: 685030 - DNA, 25 bp, Mus musculus
gtccacagatggttcctgcctgaga

SEQ ID NO: 685031 - DNA, 25 bp, Mus musculus
gtccacagcaaaacggccgaaccgg

SEQ ID NO: 685032 - DNA, 25 bp, Mus musculus
gtccacagcaaatcggccgaaccgg

SEQ ID NO: 685033 - DNA, 25 bp, Mus musculus
gtccacagccaacaaagtgaattcg

SEQ ID NO: 685034 - DNA, 25 bp, Mus musculus
gtccacagccaagaaagtgaattcg

SEQ ID NO: 685035 - DNA, 25 bp, Mus musculus
gtccacagccacagcggaggagaga

SEQ ID NO: 685036 - DNA, 25 bp, Mus musculus
gtccacagccactgcggaggagaga

SEQ ID NO: 685037 - DNA, 25 bp, Mus musculus
gtccacagccatcggctaggacaga

SEQ ID NO: 685038 - DNA, 25 bp, Mus musculus
gtccacagccatgggctaggacaga

SEQ ID NO: 685039 - DNA, 25 bp, Mus musculus
gtccacagccttattgatattttat

SEQ ID NO: 685040 - DNA, 25 bp, Mus musculus
gtccacagccttcggcattcttgta

SEQ ID NO: 685041 - DNA, 25 bp, Mus musculus
gtccacagccttgggcattcttgta

SEQ ID NO: 685042 - DNA, 25 bp, Mus musculus
gtccacagcctttttgatattttat

SEQ ID NO: 685043 - DNA, 25 bp, Mus musculus
gtccacagtcttagcttgaatacag

SEQ ID NO: 685044 - DNA, 25 bp, Mus musculus
gtccacagtctttgcttgaatacag

SEQ ID NO: 685045 - DNA, 25 bp, Mus musculus
gtccacagtggcctgcatttcatga

SEQ ID NO: 685046 - DNA, 25 bp, Mus musculus
gtccacagtggcgtgcatttcatga

SEQ ID NO: 685047 - DNA, 25 bp, Mus musculus
gtccacagtgggaccttgttgcttc

SEQ ID NO: 685048 - DNA, 25 bp, Mus musculus
gtccacagtgggtccttgttgcttc

SEQ ID NO: 685049 - DNA, 25 bp, Mus musculus
gtccacataataccatgaagagttt

SEQ ID NO: 685050 - DNA, 25 bp, Mus musculus
gtccacataatagcatgaagagttt

SEQ ID NO: 685051 - DNA, 25 bp, Mus musculus
gtccacatagacattgcagatcgaa

SEQ ID NO: 685052 - DNA, 25 bp, Mus musculus
gtccacatagactttgcagatcgaa

SEQ ID NO: 685053 - DNA, 25 bp, Mus musculus
gtccacatatctaccattacacagg

SEQ ID NO: 685054 - DNA, 25 bp, Mus musculus
gtccacatatcttccattacacagg

SEQ ID NO: 685055 - DNA, 25 bp, Mus musculus
gtccacatctggactggaagcagca

SEQ ID NO: 685056 - DNA, 25 bp, Mus musculus
gtccacatctggtctggaagcagca

SEQ ID NO: 685057 - DNA, 25 bp, Mus musculus
gtccacatgacaatgattagttcgt

SEQ ID NO: 685058 - DNA, 25 bp, Mus musculus
gtccacatgacattgattagttcgt

SEQ ID NO: 685059 - DNA, 25 bp, Mus musculus
gtccacatgcatagtatgagcccag

SEQ ID NO: 685060 - DNA, 25 bp, Mus musculus
gtccacatgcattgtatgagcccag

SEQ ID NO: 685061 - DNA, 25 bp, Mus musculus
gtccacatgtatctaagactctatt

SEQ ID NO: 685062 - DNA, 25 bp, Mus musculus
gtccacatgtatgtaagactctatt

SEQ ID NO: 685063 - DNA, 25 bp, Mus musculus
gtccaccaaaagacttccatgaaat

SEQ ID NO: 685064 - DNA, 25 bp, Mus musculus
gtccaccaaaagtcttccatgaaat

SEQ ID NO: 685065 - DNA, 25 bp, Mus musculus
gtccaccaaggtaatttagccgcta

SEQ ID NO: 685066 - DNA, 25 bp, Mus musculus
gtccaccaaggttatttagccgcta

SEQ ID NO: 685067 - DNA, 25 bp, Mus musculus
gtccaccaattacagaggcatacgt

SEQ ID NO: 685068 - DNA, 25 bp, Mus musculus
gtccaccaattagagaggcatacgt

SEQ ID NO: 685069 - DNA, 25 bp, Mus musculus
gtccaccacataaccgagataaaaa

SEQ ID NO: 685070 - DNA, 25 bp, Mus musculus
gtccaccacatatccgagataaaaa

SEQ ID NO: 685071 - DNA, 25 bp, Mus musculus
gtccaccagaatagctccatgaggc

SEQ ID NO: 685072 - DNA, 25 bp, Mus musculus
gtccaccagaattgctccatgaggc

SEQ ID NO: 685073 - DNA, 25 bp, Mus musculus
gtccaccaggacattagacagtcgt

SEQ ID NO: 685074 - DNA, 25 bp, Mus musculus
gtccaccaggactttagacagtcgt

SEQ ID NO: 685075 - DNA, 25 bp, Mus musculus
gtccaccaggctcaagatgacaccg

SEQ ID NO: 685076 - DNA, 25 bp, Mus musculus
gtccaccaggctgaagatgacaccg

SEQ ID NO: 685077 - DNA, 25 bp, Mus musculus
gtccaccagtggctagcagcctact

SEQ ID NO: 685078 - DNA, 25 bp, Mus musculus
gtccaccagtgggtagcagcctact

SEQ ID NO: 685079 - DNA, 25 bp, Mus musculus
gtccaccatcatctccatgaaaaag

SEQ ID NO: 685080 - DNA, 25 bp, Mus musculus
gtccaccatcatgtccatgaaaaag

SEQ ID NO: 685081 - DNA, 25 bp, Mus musculus
gtccaccatgaacccaccaagtaaa

SEQ ID NO: 685082 - DNA, 25 bp, Mus musculus
gtccaccatgaagccaccaagtaaa

SEQ ID NO: 685083 - DNA, 25 bp, Mus musculus
gtccaccatgatagggttccatgtt

SEQ ID NO: 685084 - DNA, 25 bp, Mus musculus
gtccaccatgattgggttccatgtt

SEQ ID NO: 685085 - DNA, 25 bp, Mus musculus
gtccaccatggaccgtagcgtgtgc

SEQ ID NO: 685086 - DNA, 25 bp, Mus musculus
gtccaccatggagcgtagcgtgtgc

SEQ ID NO: 685087 - DNA, 25 bp, Mus musculus
gtccaccatgtgaataagttatatt

SEQ ID NO: 685088 - DNA, 25 bp, Mus musculus
gtccaccatgtgtataagttatatt

SEQ ID NO: 685089 - DNA, 25 bp, Mus musculus
gtccaccatttgcagtcatgaacgg

SEQ ID NO: 685090 - DNA, 25 bp, Mus musculus
gtccaccatttggagtcatgaacgg

SEQ ID NO: 685091 - DNA, 25 bp, Mus musculus
gtccacccagtgattctcattaagg

SEQ ID NO: 685092 - DNA, 25 bp, Mus musculus
gtccacccagtgtttctcattaagg

SEQ ID NO: 685093 - DNA, 25 bp, Mus musculus
gtccacccatagctcaaggtctttt

SEQ ID NO: 685094 - DNA, 25 bp, Mus musculus
gtccacccataggtcaaggtctttt

SEQ ID NO: 685095 - DNA, 25 bp, Mus musculus
gtccaccctggtcatcagtatggta

SEQ ID NO: 685096 - DNA, 25 bp, Mus musculus
gtccaccctggtgatcagtatggta

SEQ ID NO: 685097 - DNA, 25 bp, Mus musculus
gtccaccgatgaccttgcttactgt

SEQ ID NO: 685098 - DNA, 25 bp, Mus musculus
gtccaccgatgagcttgcttactgt

SEQ ID NO: 685099 - DNA, 25 bp, Mus musculus
gtccaccgcttcacttagttaatgt

SEQ ID NO: 685100 - DNA, 25 bp, Mus musculus
gtccaccgcttctcttagttaatgt

SEQ ID NO: 685101 - DNA, 25 bp, Mus musculus
gtccaccggttgctggtagttgaca

SEQ ID NO: 685102 - DNA, 25 bp, Mus musculus
gtccaccggttggtggtagttgaca

SEQ ID NO: 685103 - DNA, 25 bp, Mus musculus
gtccacctagagaagtcccactgag

SEQ ID NO: 685104 - DNA, 25 bp, Mus musculus
gtccacctagagtagtcccactgag

SEQ ID NO: 685105 - DNA, 25 bp, Mus musculus
gtccacctaggaacaagcactgagt

SEQ ID NO: 685106 - DNA, 25 bp, Mus musculus
gtccacctaggatcaagcactgagt

SEQ ID NO: 685107 - DNA, 25 bp, Mus musculus
gtccacctcgttatgctagcgaaga

SEQ ID NO: 685108 - DNA, 25 bp, Mus musculus
gtccacctcgttttgctagcgaaga

SEQ ID NO: 685109 - DNA, 25 bp, Mus musculus
gtccacctggtcagttgtaatttaa

SEQ ID NO: 685110 - DNA, 25 bp, Mus musculus
gtccacctggtctgttgtaatttaa

SEQ ID NO: 685111 - DNA, 25 bp, Mus musculus
gtccacctgtacagttgaacgcggg

SEQ ID NO: 685112 - DNA, 25 bp, Mus musculus
gtccacctgtactgttgaacgcggg

SEQ ID NO: 685113 - DNA, 25 bp, Mus musculus
gtccacctgtagacctttggtgaag

SEQ ID NO: 685114 - DNA, 25 bp, Mus musculus
gtccacctgtagtcctttggtgaag

SEQ ID NO: 685115 - DNA, 25 bp, Mus musculus
gtccacctgtccacagagggaaggg

SEQ ID NO: 685116 - DNA, 25 bp, Mus musculus
gtccacctgtcctcagagggaaggg

SEQ ID NO: 685117 - DNA, 25 bp, Mus musculus
gtccaccttaccctgcaatgtgcaa

SEQ ID NO: 685118 - DNA, 25 bp, Mus musculus
gtccaccttaccgtgcaatgtgcaa

SEQ ID NO: 685119 - DNA, 25 bp, Mus musculus
gtccaccttataattacattgctgt

SEQ ID NO: 685120 - DNA, 25 bp, Mus musculus
gtccaccttatatttacattgctgt

SEQ ID NO: 685121 - DNA, 25 bp, Mus musculus
gtccaccttctcaatatgcaaatgt

SEQ ID NO: 685122 - DNA, 25 bp, Mus musculus
gtccaccttctctatatgcaaatgt

SEQ ID NO: 685123 - DNA, 25 bp, Mus musculus
gtccaccttgccatgactatatgta

SEQ ID NO: 685124 - DNA, 25 bp, Mus musculus
gtccaccttgccttgactatatgta

SEQ ID NO: 685125 - DNA, 25 bp, Mus musculus
gtccaccttgttatgttcttaacat

SEQ ID NO: 685126 - DNA, 25 bp, Mus musculus
gtccaccttgttttgttcttaacat

SEQ ID NO: 685127 - DNA, 25 bp, Mus musculus
gtccacgagaacatgacagctccat

SEQ ID NO: 685128 - DNA, 25 bp, Mus musculus
gtccacgagaacttgacagctccat

SEQ ID NO: 685129 - DNA, 25 bp, Mus musculus
gtccacgagtttacagagtgcttat

SEQ ID NO: 685130 - DNA, 25 bp, Mus musculus
gtccacgagttttcagagtgcttat

SEQ ID NO: 685131 - DNA, 25 bp, Mus musculus
gtccacgatcctactgtcctggatt

SEQ ID NO: 685132 - DNA, 25 bp, Mus musculus
gtccacgatccttctgtcctggatt

SEQ ID NO: 685133 - DNA, 25 bp, Mus musculus
gtccacgcaggcctcgcacgtatat

SEQ ID NO: 685134 - DNA, 25 bp, Mus musculus
gtccacgcaggcgtcgcacgtatat

SEQ ID NO: 685135 - DNA, 25 bp, Mus musculus
gtccacgcgcagaaggttttgtgaa

SEQ ID NO: 685136 - DNA, 25 bp, Mus musculus
gtccacgcgcagtaggttttgtgaa

SEQ ID NO: 685137 - DNA, 25 bp, Mus musculus
gtccacgcgctaaaccaggaagagt

SEQ ID NO: 685138 - DNA, 25 bp, Mus musculus
gtccacgcgctataccaggaagagt

SEQ ID NO: 685139 - DNA, 25 bp, Mus musculus
gtccacgctgccattagcattacaa

SEQ ID NO: 685140 - DNA, 25 bp, Mus musculus
gtccacgctgcctttagcattacaa

SEQ ID NO: 685141 - DNA, 25 bp, Mus musculus
gtccacgctggacgaagccttcgaa

SEQ ID NO: 685142 - DNA, 25 bp, Mus musculus
gtccacgctggaggaagccttcgaa

SEQ ID NO: 685143 - DNA, 25 bp, Mus musculus
gtccacgctgtgcattgtaatgtct

SEQ ID NO: 685144 - DNA, 25 bp, Mus musculus
gtccacgctgtggattgtaatgtct

SEQ ID NO: 685145 - DNA, 25 bp, Mus musculus
gtccacggcatcaatctggtgcagg

SEQ ID NO: 685146 - DNA, 25 bp, Mus musculus
gtccacggcatctatctggtgcagg

SEQ ID NO: 685147 - DNA, 25 bp, Mus musculus
gtccacggccataaaaactgagaag

SEQ ID NO: 685148 - DNA, 25 bp, Mus musculus
gtccacggccattaaaactgagaag

SEQ ID NO: 685149 - DNA, 25 bp, Mus musculus
gtccacgggcgtctttgaaccacat

SEQ ID NO: 685150 - DNA, 25 bp, Mus musculus
gtccacgggcgtgtttgaaccacat

SEQ ID NO: 685151 - DNA, 25 bp, Mus musculus
gtccacggtaggctgctgagatttt

SEQ ID NO: 685152 - DNA, 25 bp, Mus musculus
gtccacggtagggtgctgagatttt

SEQ ID NO: 685153 - DNA, 25 bp, Mus musculus
gtccacgttaccagcattgaggagc

SEQ ID NO: 685154 - DNA, 25 bp, Mus musculus
gtccacgttacctgcattgaggagc

SEQ ID NO: 685155 - DNA, 25 bp, Mus musculus
gtccacgttcatactatcatgtttt

SEQ ID NO: 685156 - DNA, 25 bp, Mus musculus
gtccacgttcattctatcatgtttt

SEQ ID NO: 685157 - DNA, 25 bp, Mus musculus
gtccactacacactgtgggcatgca

SEQ ID NO: 685158 - DNA, 25 bp, Mus musculus
gtccactacacagtgtgggcatgca

SEQ ID NO: 685159 - DNA, 25 bp, Mus musculus
gtccactagtagctccagcgaggat

SEQ ID NO: 685160 - DNA, 25 bp, Mus musculus
gtccactagtaggtccagcgaggat

SEQ ID NO: 685161 - DNA, 25 bp, Mus musculus
gtccactatcagcttccgctgtgat

SEQ ID NO: 685162 - DNA, 25 bp, Mus musculus
gtccactatcaggttccgctgtgat

SEQ ID NO: 685163 - DNA, 25 bp, Mus musculus
gtccactatcttatcatacttcata

SEQ ID NO: 685164 - DNA, 25 bp, Mus musculus
gtccactatcttttcatacttcata

SEQ ID NO: 685165 - DNA, 25 bp, Mus musculus
gtccactatgggataacttgtgcta

SEQ ID NO: 685166 - DNA, 25 bp, Mus musculus
gtccactatgggttaacttgtgcta

SEQ ID NO: 685167 - DNA, 25 bp, Mus musculus
gtccactatgtccagactggcatta

SEQ ID NO: 685168 - DNA, 25 bp, Mus musculus
gtccactatgtcgagactggcatta

SEQ ID NO: 685169 - DNA, 25 bp, Mus musculus
gtccactatgtgcttgttcacgtgt

SEQ ID NO: 685170 - DNA, 25 bp, Mus musculus
gtccactatgtggttgttcacgtgt

SEQ ID NO: 685171 - DNA, 25 bp, Mus musculus
gtccactcaaagctgtaaaggcggc

SEQ ID NO: 685172 - DNA, 25 bp, Mus musculus
gtccactcaaaggtgtaaaggcggc

SEQ ID NO: 685173 - DNA, 25 bp, Mus musculus
gtccactcaactcaactattgctga

SEQ ID NO: 685174 - DNA, 25 bp, Mus musculus
gtccactcaactgaactattgctga

SEQ ID NO: 685175 - DNA, 25 bp, Mus musculus
gtccactcagaaagtagccagtctc

SEQ ID NO: 685176 - DNA, 25 bp, Mus musculus
gtccactcagaatgtagccagtctc

SEQ ID NO: 685177 - DNA, 25 bp, Mus musculus
gtccactccaaaatcatgcttgcgc

SEQ ID NO: 685178 - DNA, 25 bp, Mus musculus
gtccactccaaattcatgcttgcgc

SEQ ID NO: 685179 - DNA, 25 bp, Mus musculus
gtccactccacaacctatagtggtt

SEQ ID NO: 685180 - DNA, 25 bp, Mus musculus
gtccactccacatcctatagtggtt

SEQ ID NO: 685181 - DNA, 25 bp, Mus musculus
gtccactcctcaatctggaagagcc

SEQ ID NO: 685182 - DNA, 25 bp, Mus musculus
gtccactcctcattctggaagagcc

SEQ ID NO: 685183 - DNA, 25 bp, Mus musculus
gtccactcggtgctgagacttatta

SEQ ID NO: 685184 - DNA, 25 bp, Mus musculus
gtccactcggtggtgagacttatta

SEQ ID NO: 685185 - DNA, 25 bp, Mus musculus
gtccactcggttaaatcttggcatg

SEQ ID NO: 685186 - DNA, 25 bp, Mus musculus
gtccactcggtttaatcttggcatg

SEQ ID NO: 685187 - DNA, 25 bp, Mus musculus
gtccactctaggacagaagtccagc

SEQ ID NO: 685188 - DNA, 25 bp, Mus musculus
gtccactctaggtcagaagtccagc

SEQ ID NO: 685189 - DNA, 25 bp, Mus musculus
gtccactctccaacacaatgcagaa

SEQ ID NO: 685190 - DNA, 25 bp, Mus musculus
gtccactctccatcacaatgcagaa

SEQ ID NO: 685191 - DNA, 25 bp, Mus musculus
gtccactctggaatcgtgaccaaag

SEQ ID NO: 685192 - DNA, 25 bp, Mus musculus
gtccactctggattcgtgaccaaag

SEQ ID NO: 685193 - DNA, 25 bp, Mus musculus
gtccactgagcccaatttgatatgt

SEQ ID NO: 685194 - DNA, 25 bp, Mus musculus
gtccactgagccgaatttgatatgt

SEQ ID NO: 685195 - DNA, 25 bp, Mus musculus
gtccactgccagctgtttgtgatat

SEQ ID NO: 685196 - DNA, 25 bp, Mus musculus
gtccactgccaggtgtttgtgatat

SEQ ID NO: 685197 - DNA, 25 bp, Mus musculus
gtccactgctgtacatttcatgcaa

SEQ ID NO: 685198 - DNA, 25 bp, Mus musculus
gtccactgctgttcatttcatgcaa

SEQ ID NO: 685199 - DNA, 25 bp, Mus musculus
gtccactgggcaaatgattacacgt

SEQ ID NO: 685200 - DNA, 25 bp, Mus musculus
gtccactgggcatatgattacacgt

SEQ ID NO: 685201 - DNA, 25 bp, Mus musculus
gtccactgggttagatagccttctg

SEQ ID NO: 685202 - DNA, 25 bp, Mus musculus
gtccactgggtttgatagccttctg

SEQ ID NO: 685203 - DNA, 25 bp, Mus musculus
gtccactgtagcaaagactgcaact

SEQ ID NO: 685204 - DNA, 25 bp, Mus musculus
gtccactgtagctaagactgcaact

SEQ ID NO: 685205 - DNA, 25 bp, Mus musculus
gtccactgtcctctgtttgactacg

SEQ ID NO: 685206 - DNA, 25 bp, Mus musculus
gtccactgtcctgtgtttgactacg

SEQ ID NO: 685207 - DNA, 25 bp, Mus musculus
gtccactgtctcagaagttcgaatc

SEQ ID NO: 685208 - DNA, 25 bp, Mus musculus
gtccactgtctctgaagttcgaatc

SEQ ID NO: 685209 - DNA, 25 bp, Mus musculus
gtccactgttgtataatcacatacc

SEQ ID NO: 685210 - DNA, 25 bp, Mus musculus
gtccactgttgtttaatcacatacc

SEQ ID NO: 685211 - DNA, 25 bp, Mus musculus
gtccacttagatataggccatgcat

SEQ ID NO: 685212 - DNA, 25 bp, Mus musculus
gtccacttagatttaggccatgcat

SEQ ID NO: 685213 - DNA, 25 bp, Mus musculus
gtccacttaggaacactttttaaag

SEQ ID NO: 685214 - DNA, 25 bp, Mus musculus
gtccacttaggatcactttttaaag

SEQ ID NO: 685215 - DNA, 25 bp, Mus musculus
gtccacttatatatatcctcactct

SEQ ID NO: 685216 - DNA, 25 bp, Mus musculus
gtccacttatatttatcctcactct

SEQ ID NO: 685217 - DNA, 25 bp, Mus musculus
gtccacttcattagcaggtgtccaa

SEQ ID NO: 685218 - DNA, 25 bp, Mus musculus
gtccacttcatttgcaggtgtccaa

SEQ ID NO: 685219 - DNA, 25 bp, Mus musculus
gtccacttgcaactgactttagcaa

SEQ ID NO: 685220 - DNA, 25 bp, Mus musculus
gtccacttgcaagtgactttagcaa

SEQ ID NO: 685221 - DNA, 25 bp, Mus musculus
gtccacttggccacaatgaatcagt

SEQ ID NO: 685222 - DNA, 25 bp, Mus musculus
gtccacttggcctcaatgaatcagt

SEQ ID NO: 685223 - DNA, 25 bp, Mus musculus
gtccacttgggtagaagtatatctc

SEQ ID NO: 685224 - DNA, 25 bp, Mus musculus
gtccacttgggttgaagtatatctc

SEQ ID NO: 685225 - DNA, 25 bp, Mus musculus
gtccactttgaaagccgagtgtcat

SEQ ID NO: 685226 - DNA, 25 bp, Mus musculus
gtccactttgaatgccgagtgtcat

SEQ ID NO: 685227 - DNA, 25 bp, Mus musculus
gtccagaaaagtaaacaaggttgct

SEQ ID NO: 685228 - DNA, 25 bp, Mus musculus
gtccagaaaagttaacaaggttgct

SEQ ID NO: 685229 - DNA, 25 bp, Mus musculus
gtccagaacaacctttgctttggca

SEQ ID NO: 685230 - DNA, 25 bp, Mus musculus
gtccagaacaacgtttgctttggca

SEQ ID NO: 685231 - DNA, 25 bp, Mus musculus
gtccagaaccttatagtgcagcctc

SEQ ID NO: 685232 - DNA, 25 bp, Mus musculus
gtccagaaccttttagtgcagcctc

SEQ ID NO: 685233 - DNA, 25 bp, Mus musculus
gtccagaacggaaggcttggcgctt

SEQ ID NO: 685234 - DNA, 25 bp, Mus musculus
gtccagaacggatggcttggcgctt

SEQ ID NO: 685235 - DNA, 25 bp, Mus musculus
gtccagaactggacgatgtggctaa

SEQ ID NO: 685236 - DNA, 25 bp, Mus musculus
gtccagaactggattgagttactta

SEQ ID NO: 685237 - DNA, 25 bp, Mus musculus
gtccagaactggtcgatgtggctaa

SEQ ID NO: 685238 - DNA, 25 bp, Mus musculus
gtccagaactggtttgagttactta

SEQ ID NO: 685239 - DNA, 25 bp, Mus musculus
gtccagaagaataatgaacacctat

SEQ ID NO: 685240 - DNA, 25 bp, Mus musculus
gtccagaagaattatgaacacctat

SEQ ID NO: 685241 - DNA, 25 bp, Mus musculus
gtccagaagatccagacatgccata

SEQ ID NO: 685242 - DNA, 25 bp, Mus musculus
gtccagaagatcgagacatgccata

SEQ ID NO: 685243 - DNA, 25 bp, Mus musculus
gtccagaagcccagacagatacttt

SEQ ID NO: 685244 - DNA, 25 bp, Mus musculus
gtccagaagccctgacagatacttt

SEQ ID NO: 685245 - DNA, 25 bp, Mus musculus
gtccagaaggagcactgaagcacat

SEQ ID NO: 685246 - DNA, 25 bp, Mus musculus
gtccagaaggaggactgaagcacat

SEQ ID NO: 685247 - DNA, 25 bp, Mus musculus
gtccagaaggtcagacacagatgcc

SEQ ID NO: 685248 - DNA, 25 bp, Mus musculus
gtccagaaggtctgacacagatgcc

SEQ ID NO: 685249 - DNA, 25 bp, Mus musculus
gtccagaagtccacatctcaaggga

SEQ ID NO: 685250 - DNA, 25 bp, Mus musculus
gtccagaagtcctcatctcaaggga

SEQ ID NO: 685251 - DNA, 25 bp, Mus musculus
gtccagaagtctccaccatagcgtg

SEQ ID NO: 685252 - DNA, 25 bp, Mus musculus
gtccagaagtctgcaccatagcgtg

SEQ ID NO: 685253 - DNA, 25 bp, Mus musculus
gtccagaatccaaccagatcaaaat

SEQ ID NO: 685254 - DNA, 25 bp, Mus musculus
gtccagaatccatccagatcaaaat

SEQ ID NO: 685255 - DNA, 25 bp, Mus musculus
gtccagaatgacctagaggtttcca

SEQ ID NO: 685256 - DNA, 25 bp, Mus musculus
gtccagaatgacgtagaggtttcca

SEQ ID NO: 685257 - DNA, 25 bp, Mus musculus
gtccagaatgcccagtaatcactca

SEQ ID NO: 685258 - DNA, 25 bp, Mus musculus
gtccagaatgccgagtaatcactca

SEQ ID NO: 685259 - DNA, 25 bp, Mus musculus
gtccagacaaaaaggcaggcttctt

SEQ ID NO: 685260 - DNA, 25 bp, Mus musculus
gtccagacaaaatggcaggcttctt

SEQ ID NO: 685261 - DNA, 25 bp, Mus musculus
gtccagacaatgatgaccacctctt

SEQ ID NO: 685262 - DNA, 25 bp, Mus musculus
gtccagacaatgttgaccacctctt

SEQ ID NO: 685263 - DNA, 25 bp, Mus musculus
gtccagacacggaatccggagccca

SEQ ID NO: 685264 - DNA, 25 bp, Mus musculus
gtccagacacggtatccggagccca

SEQ ID NO: 685265 - DNA, 25 bp, Mus musculus
gtccagacagaaccacagtaccggt

SEQ ID NO: 685266 - DNA, 25 bp, Mus musculus
gtccagacagaagcacagtaccggt

SEQ ID NO: 685267 - DNA, 25 bp, Mus musculus
gtccagacagaccttcgtgttgcac

SEQ ID NO: 685268 - DNA, 25 bp, Mus musculus
gtccagacagacgttcgtgttgcac

SEQ ID NO: 685269 - DNA, 25 bp, Mus musculus
gtccagaccatccataggtctctag

SEQ ID NO: 685270 - DNA, 25 bp, Mus musculus
gtccagaccatcgataggtctctag

SEQ ID NO: 685271 - DNA, 25 bp, Mus musculus
gtccagaccattatagcttttagag

SEQ ID NO: 685272 - DNA, 25 bp, Mus musculus
gtccagaccattttagcttttagag

SEQ ID NO: 685273 - DNA, 25 bp, Mus musculus
gtccagaccgctattttgtgtacag

SEQ ID NO: 685274 - DNA, 25 bp, Mus musculus
gtccagaccgcttttttgtgtacag

SEQ ID NO: 685275 - DNA, 25 bp, Mus musculus
gtccagaccgtcagcggctgcgagc

SEQ ID NO: 685276 - DNA, 25 bp, Mus musculus
gtccagaccgtctgcggctgcgagc

SEQ ID NO: 685277 - DNA, 25 bp, Mus musculus
gtccagaccgtgaactgacacatgt

SEQ ID NO: 685278 - DNA, 25 bp, Mus musculus
gtccagaccgtgtactgacacatgt

SEQ ID NO: 685279 - DNA, 25 bp, Mus musculus
gtccagacctttctacaaatgtgta

SEQ ID NO: 685280 - DNA, 25 bp, Mus musculus
gtccagacctttgtacaaatgtgta

SEQ ID NO: 685281 - DNA, 25 bp, Mus musculus
gtccagacgggcaggtgatctcact

SEQ ID NO: 685282 - DNA, 25 bp, Mus musculus
gtccagacgggcattgaactcagga

SEQ ID NO: 685283 - DNA, 25 bp, Mus musculus
gtccagacgggctggtgatctcact

SEQ ID NO: 685284 - DNA, 25 bp, Mus musculus
gtccagacgggctttgaactcagga

SEQ ID NO: 685285 - DNA, 25 bp, Mus musculus
gtccagactagccttaacttttatc

SEQ ID NO: 685286 - DNA, 25 bp, Mus musculus
gtccagactagcgttaacttttatc

SEQ ID NO: 685287 - DNA, 25 bp, Mus musculus
gtccagactcaaagtacagcagctt

SEQ ID NO: 685288 - DNA, 25 bp, Mus musculus
gtccagactcaatgtacagcagctt

SEQ ID NO: 685289 - DNA, 25 bp, Mus musculus
gtccagactcgcattgaattcatga

SEQ ID NO: 685290 - DNA, 25 bp, Mus musculus
gtccagactcgctttgaattcatga

SEQ ID NO: 685291 - DNA, 25 bp, Mus musculus
gtccagactgtcatacaatgcagat

SEQ ID NO: 685292 - DNA, 25 bp, Mus musculus
gtccagactgtcttacaatgcagat

SEQ ID NO: 685293 - DNA, 25 bp, Mus musculus
gtccagacttccaaagagggaggaa

SEQ ID NO: 685294 - DNA, 25 bp, Mus musculus
gtccagacttcctaagagggaggaa

SEQ ID NO: 685295 - DNA, 25 bp, Mus musculus
gtccagagagagaaccttcacacct

SEQ ID NO: 685296 - DNA, 25 bp, Mus musculus
gtccagagagagtaccttcacacct

SEQ ID NO: 685297 - DNA, 25 bp, Mus musculus
gtccagagagtgaatcagtaaccaa

SEQ ID NO: 685298 - DNA, 25 bp, Mus musculus
gtccagagagtgtatcagtaaccaa

SEQ ID NO: 685299 - DNA, 25 bp, Mus musculus
gtccagagcagactttacgggtctt

SEQ ID NO: 685300 - DNA, 25 bp, Mus musculus
gtccagagcagagtttacgggtctt

SEQ ID NO: 685301 - DNA, 25 bp, Mus musculus
gtccagaggaggattttacaatcat

SEQ ID NO: 685302 - DNA, 25 bp, Mus musculus
gtccagaggaggtttttacaatcat

SEQ ID NO: 685303 - DNA, 25 bp, Mus musculus
gtccagaggtgactcctgcctgctc

SEQ ID NO: 685304 - DNA, 25 bp, Mus musculus
gtccagaggtgagtcctgcctgctc

SEQ ID NO: 685305 - DNA, 25 bp, Mus musculus
gtccagagtggactattgctcagcc

SEQ ID NO: 685306 - DNA, 25 bp, Mus musculus
gtccagagtggagtattgctcagcc

SEQ ID NO: 685307 - DNA, 25 bp, Mus musculus
gtccagataactatattgacttgtt

SEQ ID NO: 685308 - DNA, 25 bp, Mus musculus
gtccagataactttattgacttgtt

SEQ ID NO: 685309 - DNA, 25 bp, Mus musculus
gtccagatattgctctccaatctat

SEQ ID NO: 685310 - DNA, 25 bp, Mus musculus
gtccagatattggtctccaatctat

SEQ ID NO: 685311 - DNA, 25 bp, Mus musculus
gtccagatatttacaaagttgccaa

SEQ ID NO: 685312 - DNA, 25 bp, Mus musculus
gtccagatattttcaaagttgccaa

SEQ ID NO: 685313 - DNA, 25 bp, Mus musculus
gtccagatccatatctgcttagtca

SEQ ID NO: 685314 - DNA, 25 bp, Mus musculus
gtccagatccatcgcagggccactg

SEQ ID NO: 685315 - DNA, 25 bp, Mus musculus
gtccagatccatggcagggccactg

SEQ ID NO: 685316 - DNA, 25 bp, Mus musculus
gtccagatccatttctgcttagtca

SEQ ID NO: 685317 - DNA, 25 bp, Mus musculus
gtccagatctgacgcctcgcgaaga

SEQ ID NO: 685318 - DNA, 25 bp, Mus musculus
gtccagatctgaggcctcgcgaaga

SEQ ID NO: 685319 - DNA, 25 bp, Mus musculus
gtccagatgccaaagtgcatagggc

SEQ ID NO: 685320 - DNA, 25 bp, Mus musculus
gtccagatgccatagtgcatagggc

SEQ ID NO: 685321 - DNA, 25 bp, Mus musculus
gtccagatgtgacccgagctagagt

SEQ ID NO: 685322 - DNA, 25 bp, Mus musculus
gtccagatgtgagccgagctagagt

SEQ ID NO: 685323 - DNA, 25 bp, Mus musculus
gtccagatgttcagtatctgtggct

SEQ ID NO: 685324 - DNA, 25 bp, Mus musculus
gtccagatgttctgtatctgtggct

SEQ ID NO: 685325 - DNA, 25 bp, Mus musculus
gtccagattgtgcatctcagtcaga

SEQ ID NO: 685326 - DNA, 25 bp, Mus musculus
gtccagattgtggatctcagtcaga

SEQ ID NO: 685327 - DNA, 25 bp, Mus musculus
gtccagatttggcactaacataact

SEQ ID NO: 685328 - DNA, 25 bp, Mus musculus
gtccagatttgggactaacataact

SEQ ID NO: 685329 - DNA, 25 bp, Mus musculus
gtccagattttcatactaagtcact

SEQ ID NO: 685330 - DNA, 25 bp, Mus musculus
gtccagattttcttactaagtcact

SEQ ID NO: 685331 - DNA, 25 bp, Mus musculus
gtccagcaatgacgacacagctaat

SEQ ID NO: 685332 - DNA, 25 bp, Mus musculus
gtccagcaatgaggacacagctaat

SEQ ID NO: 685333 - DNA, 25 bp, Mus musculus
gtccagcacacgctcattgaggtag

SEQ ID NO: 685334 - DNA, 25 bp, Mus musculus
gtccagcacacggtcattgaggtag

SEQ ID NO: 685335 - DNA, 25 bp, Mus musculus
gtccagcactcaaacaatagcatgt

SEQ ID NO: 685336 - DNA, 25 bp, Mus musculus
gtccagcactcatacaatagcatgt

SEQ ID NO: 685337 - DNA, 25 bp, Mus musculus
gtccagcagggtcatagttctagcc

SEQ ID NO: 685338 - DNA, 25 bp, Mus musculus
gtccagcagggtgatagttctagcc

SEQ ID NO: 685339 - DNA, 25 bp, Mus musculus
gtccagcaggtcattaccagtattg

SEQ ID NO: 685340 - DNA, 25 bp, Mus musculus
gtccagcaggtctttaccagtattg

SEQ ID NO: 685341 - DNA, 25 bp, Mus musculus
gtccagcaggttacaggcctgatgg

SEQ ID NO: 685342 - DNA, 25 bp, Mus musculus
gtccagcaggtttcaggcctgatgg

SEQ ID NO: 685343 - DNA, 25 bp, Mus musculus
gtccagcatattcattcttgcctaa

SEQ ID NO: 685344 - DNA, 25 bp, Mus musculus
gtccagcatattgattcttgcctaa

SEQ ID NO: 685345 - DNA, 25 bp, Mus musculus
gtccagcatcctagagaaaactcct

SEQ ID NO: 685346 - DNA, 25 bp, Mus musculus
gtccagcatccttgagaaaactcct

SEQ ID NO: 685347 - DNA, 25 bp, Mus musculus
gtccagcattgcaagcacatcagaa

SEQ ID NO: 685348 - DNA, 25 bp, Mus musculus
gtccagcattgctagcacatcagaa

SEQ ID NO: 685349 - DNA, 25 bp, Mus musculus
gtccagccaaaccagactacattaa

SEQ ID NO: 685350 - DNA, 25 bp, Mus musculus
gtccagccaaacgagactacattaa

SEQ ID NO: 685351 - DNA, 25 bp, Mus musculus
gtccagccacaactttgagcagagg

SEQ ID NO: 685352 - DNA, 25 bp, Mus musculus
gtccagccacaagtttgagcagagg

SEQ ID NO: 685353 - DNA, 25 bp, Mus musculus
gtccagccaccaagataagcgccag

SEQ ID NO: 685354 - DNA, 25 bp, Mus musculus
gtccagccaccatgataagcgccag

SEQ ID NO: 685355 - DNA, 25 bp, Mus musculus
gtccagcccaccattaatttatttg

SEQ ID NO: 685356 - DNA, 25 bp, Mus musculus
gtccagcccacctttaatttatttg

SEQ ID NO: 685357 - DNA, 25 bp, Mus musculus
gtccagcccaggacgtggaagtctg

SEQ ID NO: 685358 - DNA, 25 bp, Mus musculus
gtccagcccaggtcgtggaagtctg

SEQ ID NO: 685359 - DNA, 25 bp, Mus musculus
gtccagcccagtcagactctaataa

SEQ ID NO: 685360 - DNA, 25 bp, Mus musculus
gtccagcccagtgagactctaataa

SEQ ID NO: 685361 - DNA, 25 bp, Mus musculus
gtccagccccaactctgagattgag

SEQ ID NO: 685362 - DNA, 25 bp, Mus musculus
gtccagccccaagtctgagattgag

SEQ ID NO: 685363 - DNA, 25 bp, Mus musculus
gtccagcccttcactgtgtggctta

SEQ ID NO: 685364 - DNA, 25 bp, Mus musculus
gtccagcccttctctgtgtggctta

SEQ ID NO: 685365 - DNA, 25 bp, Mus musculus
gtccagccgcagagtactgattatt

SEQ ID NO: 685366 - DNA, 25 bp, Mus musculus
gtccagccgcagtgtactgattatt

SEQ ID NO: 685367 - DNA, 25 bp, Mus musculus
gtccagcctattaatgcactaacga

SEQ ID NO: 685368 - DNA, 25 bp, Mus musculus
gtccagcctatttatgcactaacga

SEQ ID NO: 685369 - DNA, 25 bp, Mus musculus
gtccagcctgatcttgtttccaaaa

SEQ ID NO: 685370 - DNA, 25 bp, Mus musculus
gtccagcctgatgttgtttccaaaa

SEQ ID NO: 685371 - DNA, 25 bp, Mus musculus
gtccagcgggaaaaccagctaactg

SEQ ID NO: 685372 - DNA, 25 bp, Mus musculus
gtccagcgggaataccagctaactg

SEQ ID NO: 685373 - DNA, 25 bp, Mus musculus
gtccagcgtggtcaggatagaacct

SEQ ID NO: 685374 - DNA, 25 bp, Mus musculus
gtccagcgtggtgaggatagaacct

SEQ ID NO: 685375 - DNA, 25 bp, Mus musculus
gtccagcgtttgacataccgccgta

SEQ ID NO: 685376 - DNA, 25 bp, Mus musculus
gtccagcgtttgtcataccgccgta

SEQ ID NO: 685377 - DNA, 25 bp, Mus musculus
gtccagctaaggcacaaagttgtta

SEQ ID NO: 685378 - DNA, 25 bp, Mus musculus
gtccagctaagggacaaagttgtta

SEQ ID NO: 685379 - DNA, 25 bp, Mus musculus
gtccagctacgcattggcagatgag

SEQ ID NO: 685380 - DNA, 25 bp, Mus musculus
gtccagctacgctttggcagatgag

SEQ ID NO: 685381 - DNA, 25 bp, Mus musculus
gtccagctactactatatgtactct

SEQ ID NO: 685382 - DNA, 25 bp, Mus musculus
gtccagctactagtatatgtactct

SEQ ID NO: 685383 - DNA, 25 bp, Mus musculus
gtccagctagtccaatgatggctgt

SEQ ID NO: 685384 - DNA, 25 bp, Mus musculus
gtccagctagtcgaatgatggctgt

SEQ ID NO: 685385 - DNA, 25 bp, Mus musculus
gtccagctattaatgccctgaggga

SEQ ID NO: 685386 - DNA, 25 bp, Mus musculus
gtccagctattattgccctgaggga

SEQ ID NO: 685387 - DNA, 25 bp, Mus musculus
gtccagctctgacgaatgggatact

SEQ ID NO: 685388 - DNA, 25 bp, Mus musculus
gtccagctctgaggaatgggatact

SEQ ID NO: 685389 - DNA, 25 bp, Mus musculus
gtccagctctggactctgtattttc

SEQ ID NO: 685390 - DNA, 25 bp, Mus musculus
gtccagctctggtctctgtattttc

SEQ ID NO: 685391 - DNA, 25 bp, Mus musculus
gtccagctctgtcacgtatggagtt

SEQ ID NO: 685392 - DNA, 25 bp, Mus musculus
gtccagctctgtgacgtatggagtt

SEQ ID NO: 685393 - DNA, 25 bp, Mus musculus
gtccagctgacaaaactacatgcca

SEQ ID NO: 685394 - DNA, 25 bp, Mus musculus
gtccagctgacataactacatgcca

SEQ ID NO: 685395 - DNA, 25 bp, Mus musculus
gtccagctgaggaactagtcttgat

SEQ ID NO: 685396 - DNA, 25 bp, Mus musculus
gtccagctgaggtactagtcttgat

SEQ ID NO: 685397 - DNA, 25 bp, Mus musculus
gtccagctggagaatggcttgccat

SEQ ID NO: 685398 - DNA, 25 bp, Mus musculus
gtccagctggagacgatcatgtcct

SEQ ID NO: 685399 - DNA, 25 bp, Mus musculus
gtccagctggagtatggcttgccat

SEQ ID NO: 685400 - DNA, 25 bp, Mus musculus
gtccagctggagtcgatcatgtcct

SEQ ID NO: 685401 - DNA, 25 bp, Mus musculus
gtccagctgtctcatgttcagtgag

SEQ ID NO: 685402 - DNA, 25 bp, Mus musculus
gtccagctgtctgatgttcagtgag

SEQ ID NO: 685403 - DNA, 25 bp, Mus musculus
gtccagctgttactattaagacaac

SEQ ID NO: 685404 - DNA, 25 bp, Mus musculus
gtccagctgttagtattaagacaac

SEQ ID NO: 685405 - DNA, 25 bp, Mus musculus
gtccagcttagcatgtaaccatagg

SEQ ID NO: 685406 - DNA, 25 bp, Mus musculus
gtccagcttagcttgtaaccatagg

SEQ ID NO: 685407 - DNA, 25 bp, Mus musculus
gtccagcttataccctgtgcaggga

SEQ ID NO: 685408 - DNA, 25 bp, Mus musculus
gtccagcttatagcctgtgcaggga

SEQ ID NO: 685409 - DNA, 25 bp, Mus musculus
gtccagcttcataaacaatgcacta

SEQ ID NO: 685410 - DNA, 25 bp, Mus musculus
gtccagcttcattaacaatgcacta

SEQ ID NO: 685411 - DNA, 25 bp, Mus musculus
gtccagcttgccatcagagaggaag

SEQ ID NO: 685412 - DNA, 25 bp, Mus musculus
gtccagcttgccttcagagaggaag

SEQ ID NO: 685413 - DNA, 25 bp, Mus musculus
gtccagctttggctgactgaagttc

SEQ ID NO: 685414 - DNA, 25 bp, Mus musculus
gtccagctttgggtgactgaagttc

SEQ ID NO: 685415 - DNA, 25 bp, Mus musculus
gtccagctttgtccttttcaagttt

SEQ ID NO: 685416 - DNA, 25 bp, Mus musculus
gtccagctttgtgcttttcaagttt

SEQ ID NO: 685417 - DNA, 25 bp, Mus musculus
gtccagcttttacttcttagaggtc

SEQ ID NO: 685418 - DNA, 25 bp, Mus musculus
gtccagcttttagttcttagaggtc

SEQ ID NO: 685419 - DNA, 25 bp, Mus musculus
gtccaggaaattctgtctgcttctg

SEQ ID NO: 685420 - DNA, 25 bp, Mus musculus
gtccaggaaattgtgtctgcttctg

SEQ ID NO: 685421 - DNA, 25 bp, Mus musculus
gtccaggaatgaattttctcattca

SEQ ID NO: 685422 - DNA, 25 bp, Mus musculus
gtccaggaatgatttttctcattca

SEQ ID NO: 685423 - DNA, 25 bp, Mus musculus
gtccaggacccacgcgttagaaaga

SEQ ID NO: 685424 - DNA, 25 bp, Mus musculus
gtccaggacccaggcgttagaaaga

SEQ ID NO: 685425 - DNA, 25 bp, Mus musculus
gtccaggacctgctggattccttaa

SEQ ID NO: 685426 - DNA, 25 bp, Mus musculus
gtccaggacctggtggattccttaa

SEQ ID NO: 685427 - DNA, 25 bp, Mus musculus
gtccaggagagtcagcatcttccct

SEQ ID NO: 685428 - DNA, 25 bp, Mus musculus
gtccaggagagtgagcatcttccct

SEQ ID NO: 685429 - DNA, 25 bp, Mus musculus
gtccaggagctgatgtcttgtaatg

SEQ ID NO: 685430 - DNA, 25 bp, Mus musculus
gtccaggagctgttgtcttgtaatg

SEQ ID NO: 685431 - DNA, 25 bp, Mus musculus
gtccaggatctacaaatttggtcaa

SEQ ID NO: 685432 - DNA, 25 bp, Mus musculus
gtccaggatctagaaatttggtcaa

SEQ ID NO: 685433 - DNA, 25 bp, Mus musculus
gtccaggatgctcattcggctgaca

SEQ ID NO: 685434 - DNA, 25 bp, Mus musculus
gtccaggatgctgattcggctgaca

SEQ ID NO: 685435 - DNA, 25 bp, Mus musculus
gtccaggattaaactcaatggtgtg

SEQ ID NO: 685436 - DNA, 25 bp, Mus musculus
gtccaggattaatctcaatggtgtg

SEQ ID NO: 685437 - DNA, 25 bp, Mus musculus
gtccaggatttgagcttggatcttc

SEQ ID NO: 685438 - DNA, 25 bp, Mus musculus
gtccaggatttgtgcttggatcttc

SEQ ID NO: 685439 - DNA, 25 bp, Mus musculus
gtccaggcaagtaacattcggttgt

SEQ ID NO: 685440 - DNA, 25 bp, Mus musculus
gtccaggcaagttacattcggttgt

SEQ ID NO: 685441 - DNA, 25 bp, Mus musculus
gtccaggcaataatgatacccaaaa

SEQ ID NO: 685442 - DNA, 25 bp, Mus musculus
gtccaggcaatattgatacccaaaa

SEQ ID NO: 685443 - DNA, 25 bp, Mus musculus
gtccaggcagcaagactataacatt

SEQ ID NO: 685444 - DNA, 25 bp, Mus musculus
gtccaggcagcatgactataacatt

SEQ ID NO: 685445 - DNA, 25 bp, Mus musculus
gtccaggccttacagccatggagca

SEQ ID NO: 685446 - DNA, 25 bp, Mus musculus
gtccaggccttagagccatggagca

SEQ ID NO: 685447 - DNA, 25 bp, Mus musculus
gtccaggctaatcttacccaaaaag

SEQ ID NO: 685448 - DNA, 25 bp, Mus musculus
gtccaggctaatgttacccaaaaag

SEQ ID NO: 685449 - DNA, 25 bp, Mus musculus
gtccaggctgtacatttttgcaaaa

SEQ ID NO: 685450 - DNA, 25 bp, Mus musculus
gtccaggctgtagatttttgcaaaa

SEQ ID NO: 685451 - DNA, 25 bp, Mus musculus
gtccagggagagaaccagcttcatt

SEQ ID NO: 685452 - DNA, 25 bp, Mus musculus
gtccagggagagtaccagcttcatt

SEQ ID NO: 685453 - DNA, 25 bp, Mus musculus
gtccagggatgacgcttaagacctt

SEQ ID NO: 685454 - DNA, 25 bp, Mus musculus
gtccagggatgaggcttaagacctt

SEQ ID NO: 685455 - DNA, 25 bp, Mus musculus
gtccagggtaagcaggtgactcttc

SEQ ID NO: 685456 - DNA, 25 bp, Mus musculus
gtccagggtaaggaggtgactcttc

SEQ ID NO: 685457 - DNA, 25 bp, Mus musculus
gtccagggttccactgatttatttg

SEQ ID NO: 685458 - DNA, 25 bp, Mus musculus
gtccagggttcctctgatttatttg

SEQ ID NO: 685459 - DNA, 25 bp, Mus musculus
gtccaggtaaaacactttgccaagt

SEQ ID NO: 685460 - DNA, 25 bp, Mus musculus
gtccaggtaaaagactttgccaagt

SEQ ID NO: 685461 - DNA, 25 bp, Mus musculus
gtccaggtcctcagtatcctaatta

SEQ ID NO: 685462 - DNA, 25 bp, Mus musculus
gtccaggtcctctgtatcctaatta

SEQ ID NO: 685463 - DNA, 25 bp, Mus musculus
gtccaggtcggtaggtatttcagac

SEQ ID NO: 685464 - DNA, 25 bp, Mus musculus
gtccaggtcggttggtatttcagac

SEQ ID NO: 685465 - DNA, 25 bp, Mus musculus
gtccaggtgatgcatgcctgccttc

SEQ ID NO: 685466 - DNA, 25 bp, Mus musculus
gtccaggtgatggatgcctgccttc

SEQ ID NO: 685467 - DNA, 25 bp, Mus musculus
gtccaggtgctacagaactttccat

SEQ ID NO: 685468 - DNA, 25 bp, Mus musculus
gtccaggtgctagagaactttccat

SEQ ID NO: 685469 - DNA, 25 bp, Mus musculus
gtccaggtgtcaatacttttcagca

SEQ ID NO: 685470 - DNA, 25 bp, Mus musculus
gtccaggtgtcattacttttcagca

SEQ ID NO: 685471 - DNA, 25 bp, Mus musculus
gtccaggtgttcatgtaatggcata

SEQ ID NO: 685472 - DNA, 25 bp, Mus musculus
gtccaggtgttcttgtaatggcata

SEQ ID NO: 685473 - DNA, 25 bp, Mus musculus
gtccaggttgcccagaaagtcacac

SEQ ID NO: 685474 - DNA, 25 bp, Mus musculus
gtccaggttgccgagaaagtcacac

SEQ ID NO: 685475 - DNA, 25 bp, Mus musculus
gtccaggttgcgaaattcgtcttta

SEQ ID NO: 685476 - DNA, 25 bp, Mus musculus
gtccaggttgcgtaattcgtcttta

SEQ ID NO: 685477 - DNA, 25 bp, Mus musculus
gtccagtacaagatcaaaacacaaa

SEQ ID NO: 685478 - DNA, 25 bp, Mus musculus
gtccagtacaagttcaaaacacaaa

SEQ ID NO: 685479 - DNA, 25 bp, Mus musculus
gtccagtaccctactaggactcgaa

SEQ ID NO: 685480 - DNA, 25 bp, Mus musculus
gtccagtacccttctaggactcgaa

SEQ ID NO: 685481 - DNA, 25 bp, Mus musculus
gtccagtacttacctgtcatccatg

SEQ ID NO: 685482 - DNA, 25 bp, Mus musculus
gtccagtacttagctgtcatccatg

SEQ ID NO: 685483 - DNA, 25 bp, Mus musculus
gtccagtattcacttctgacctatt

SEQ ID NO: 685484 - DNA, 25 bp, Mus musculus
gtccagtattcagttctgacctatt

SEQ ID NO: 685485 - DNA, 25 bp, Mus musculus
gtccagtcactactaagttgccagt

SEQ ID NO: 685486 - DNA, 25 bp, Mus musculus
gtccagtcactagtaagttgccagt

SEQ ID NO: 685487 - DNA, 25 bp, Mus musculus
gtccagtcagacattaagcagctaa

SEQ ID NO: 685488 - DNA, 25 bp, Mus musculus
gtccagtcagactttaagcagctaa

SEQ ID NO: 685489 - DNA, 25 bp, Mus musculus
gtccagtcagctcatcagagacctg

SEQ ID NO: 685490 - DNA, 25 bp, Mus musculus
gtccagtcagctgatcagagacctg

SEQ ID NO: 685491 - DNA, 25 bp, Mus musculus
gtccagtcagtgcagcctgttggaa

SEQ ID NO: 685492 - DNA, 25 bp, Mus musculus
gtccagtcagtggagcctgttggaa

SEQ ID NO: 685493 - DNA, 25 bp, Mus musculus
gtccagtcatgtatctaatgtatag

SEQ ID NO: 685494 - DNA, 25 bp, Mus musculus
gtccagtcatgtttctaatgtatag

SEQ ID NO: 685495 - DNA, 25 bp, Mus musculus
gtccagtccacactcagcaaaatag

SEQ ID NO: 685496 - DNA, 25 bp, Mus musculus
gtccagtccacagtcagcaaaatag

SEQ ID NO: 685497 - DNA, 25 bp, Mus musculus
gtccagtccatcagagcccagggac

SEQ ID NO: 685498 - DNA, 25 bp, Mus musculus
gtccagtccatctgagcccagggac

SEQ ID NO: 685499 - DNA, 25 bp, Mus musculus
gtccagtcgtgaaagtgttcttgct

SEQ ID NO: 685500 - DNA, 25 bp, Mus musculus
gtccagtcgtgatagtgttcttgct

SEQ ID NO: 685501 - DNA, 25 bp, Mus musculus
gtccagtctttgatacgattttgta

SEQ ID NO: 685502 - DNA, 25 bp, Mus musculus
gtccagtctttgttacgattttgta

SEQ ID NO: 685503 - DNA, 25 bp, Mus musculus
gtccagtgacctcgatgtcacgtga

SEQ ID NO: 685504 - DNA, 25 bp, Mus musculus
gtccagtgacctggatgtcacgtga

SEQ ID NO: 685505 - DNA, 25 bp, Mus musculus
gtccagtgaggacgaactttcagca

SEQ ID NO: 685506 - DNA, 25 bp, Mus musculus
gtccagtgaggaggaactttcagca

SEQ ID NO: 685507 - DNA, 25 bp, Mus musculus
gtccagtgatggaacgcagctcctt

SEQ ID NO: 685508 - DNA, 25 bp, Mus musculus
gtccagtgatggcagttgaattcaa

SEQ ID NO: 685509 - DNA, 25 bp, Mus musculus
gtccagtgatgggagttgaattcaa

SEQ ID NO: 685510 - DNA, 25 bp, Mus musculus
gtccagtgatggtacgcagctcctt

SEQ ID NO: 685511 - DNA, 25 bp, Mus musculus
gtccagtgattgatctttagagagt

SEQ ID NO: 685512 - DNA, 25 bp, Mus musculus
gtccagtgattgttctttagagagt

SEQ ID NO: 685513 - DNA, 25 bp, Mus musculus
gtccagtgcttaagtttgtgttaga

SEQ ID NO: 685514 - DNA, 25 bp, Mus musculus
gtccagtgcttatgtttgtgttaga

SEQ ID NO: 685515 - DNA, 25 bp, Mus musculus
gtccagtggcaaacacggttacgaa

SEQ ID NO: 685516 - DNA, 25 bp, Mus musculus
gtccagtggcaactgtgtattaatt

SEQ ID NO: 685517 - DNA, 25 bp, Mus musculus
gtccagtggcaagtgtgtattaatt

SEQ ID NO: 685518 - DNA, 25 bp, Mus musculus
gtccagtggcaatcacggttacgaa

SEQ ID NO: 685519 - DNA, 25 bp, Mus musculus
gtccagtggctcacatgaatttcag

SEQ ID NO: 685520 - DNA, 25 bp, Mus musculus
gtccagtggctctcatgaatttcag

SEQ ID NO: 685521 - DNA, 25 bp, Mus musculus
gtccagtgtaccaatgggaaccaca

SEQ ID NO: 685522 - DNA, 25 bp, Mus musculus
gtccagtgtacctatgggaaccaca

SEQ ID NO: 685523 - DNA, 25 bp, Mus musculus
gtccagtgtctccatgaaatctgcc

SEQ ID NO: 685524 - DNA, 25 bp, Mus musculus
gtccagtgtctcgatgaaatctgcc

SEQ ID NO: 685525 - DNA, 25 bp, Mus musculus
gtccagtgttaaaaggagctactct

SEQ ID NO: 685526 - DNA, 25 bp, Mus musculus
gtccagtgttaataggagctactct

SEQ ID NO: 685527 - DNA, 25 bp, Mus musculus
gtccagttaagcagcacttggtttt

SEQ ID NO: 685528 - DNA, 25 bp, Mus musculus
gtccagttaagctgcacttggtttt

SEQ ID NO: 685529 - DNA, 25 bp, Mus musculus
gtccagttaccaactccaaattgta

SEQ ID NO: 685530 - DNA, 25 bp, Mus musculus
gtccagttaccatctccaaattgta

SEQ ID NO: 685531 - DNA, 25 bp, Mus musculus
gtccagttcatcatctctcagctat

SEQ ID NO: 685532 - DNA, 25 bp, Mus musculus
gtccagttcatcttctctcagctat

SEQ ID NO: 685533 - DNA, 25 bp, Mus musculus
gtccagttccggcaggtcatgaaga

SEQ ID NO: 685534 - DNA, 25 bp, Mus musculus
gtccagttccgggaggtcatgaaga

SEQ ID NO: 685535 - DNA, 25 bp, Mus musculus
gtccagttcctaccgaggtctggga

SEQ ID NO: 685536 - DNA, 25 bp, Mus musculus
gtccagttcctagcgaggtctggga

SEQ ID NO: 685537 - DNA, 25 bp, Mus musculus
gtccagttcctgccgagatgtcctg

SEQ ID NO: 685538 - DNA, 25 bp, Mus musculus
gtccagttcctggcgagatgtcctg

SEQ ID NO: 685539 - DNA, 25 bp, Mus musculus
gtccagttccttctcatttcagaag

SEQ ID NO: 685540 - DNA, 25 bp, Mus musculus
gtccagttccttgtcatttcagaag

SEQ ID NO: 685541 - DNA, 25 bp, Mus musculus
gtccagttctttacttacaggaagc

SEQ ID NO: 685542 - DNA, 25 bp, Mus musculus
gtccagttcttttcttacaggaagc

SEQ ID NO: 685543 - DNA, 25 bp, Mus musculus
gtccagttgagtactcagtgcttag

SEQ ID NO: 685544 - DNA, 25 bp, Mus musculus
gtccagttgagttctcagtgcttag

SEQ ID NO: 685545 - DNA, 25 bp, Mus musculus
gtccagttgggtcggcctagcataa

SEQ ID NO: 685546 - DNA, 25 bp, Mus musculus
gtccagttgggtgggcctagcataa

SEQ ID NO: 685547 - DNA, 25 bp, Mus musculus
gtccagttgtgtctgggatgcctta

SEQ ID NO: 685548 - DNA, 25 bp, Mus musculus
gtccagttgtgtgtgggatgcctta

SEQ ID NO: 685549 - DNA, 25 bp, Mus musculus
gtccagtttatcaaagacaggattt

SEQ ID NO: 685550 - DNA, 25 bp, Mus musculus
gtccagtttatctaagacaggattt

SEQ ID NO: 685551 - DNA, 25 bp, Mus musculus
gtccagtttcccaactatgtattta

SEQ ID NO: 685552 - DNA, 25 bp, Mus musculus
gtccagtttccctactatgtattta

SEQ ID NO: 685553 - DNA, 25 bp, Mus musculus
gtccagtttggtatcctgtgaaagt

SEQ ID NO: 685554 - DNA, 25 bp, Mus musculus
gtccagtttggtttcctgtgaaagt

SEQ ID NO: 685555 - DNA, 25 bp, Mus musculus
gtccagttttcactatcttgtgctt

SEQ ID NO: 685556 - DNA, 25 bp, Mus musculus
gtccagttttcagtatcttgtgctt

SEQ ID NO: 685557 - DNA, 25 bp, Mus musculus
gtccagttttggctgcagtatcaat

SEQ ID NO: 685558 - DNA, 25 bp, Mus musculus
gtccagttttgggtgcagtatcaat

SEQ ID NO: 685559 - DNA, 25 bp, Mus musculus
gtccataaaaccagggataccttat

SEQ ID NO: 685560 - DNA, 25 bp, Mus musculus
gtccataaaacctgggataccttat

SEQ ID NO: 685561 - DNA, 25 bp, Mus musculus
gtccataaagacagtgttaccctgg

SEQ ID NO: 685562 - DNA, 25 bp, Mus musculus
gtccataaagactgtgttaccctgg

SEQ ID NO: 685563 - DNA, 25 bp, Mus musculus
gtccataaagtcaaactcattttta

SEQ ID NO: 685564 - DNA, 25 bp, Mus musculus
gtccataaagtctaactcattttta

SEQ ID NO: 685565 - DNA, 25 bp, Mus musculus
gtccataactgaccagctgagcact

SEQ ID NO: 685566 - DNA, 25 bp, Mus musculus
gtccataactgagcagctgagcact

SEQ ID NO: 685567 - DNA, 25 bp, Mus musculus
gtccataatggcctttgagcagcaa

SEQ ID NO: 685568 - DNA, 25 bp, Mus musculus
gtccataatggcgtttgagcagcaa

SEQ ID NO: 685569 - DNA, 25 bp, Mus musculus
gtccataattctatcgcttttacgc

SEQ ID NO: 685570 - DNA, 25 bp, Mus musculus
gtccataattctttcgcttttacgc

SEQ ID NO: 685571 - DNA, 25 bp, Mus musculus
gtccataccttcaagagtgttcttg

SEQ ID NO: 685572 - DNA, 25 bp, Mus musculus
gtccataccttctagagtgttcttg

SEQ ID NO: 685573 - DNA, 25 bp, Mus musculus
gtccatactgcgcatcctgcaggct

SEQ ID NO: 685574 - DNA, 25 bp, Mus musculus
gtccatactgcggatcctgcaggct

SEQ ID NO: 685575 - DNA, 25 bp, Mus musculus
gtccatagccgaattggtgcatatt

SEQ ID NO: 685576 - DNA, 25 bp, Mus musculus
gtccatagccgatttggtgcatatt

SEQ ID NO: 685577 - DNA, 25 bp, Mus musculus
gtccatagctgtccctaatccatgg

SEQ ID NO: 685578 - DNA, 25 bp, Mus musculus
gtccatagctgtgcctaatccatgg

SEQ ID NO: 685579 - DNA, 25 bp, Mus musculus
gtccataggcacagctaagagctgt

SEQ ID NO: 685580 - DNA, 25 bp, Mus musculus
gtccataggcactgctaagagctgt

SEQ ID NO: 685581 - DNA, 25 bp, Mus musculus
gtccatagtcaccacacttgggcca

SEQ ID NO: 685582 - DNA, 25 bp, Mus musculus
gtccatagtcacgacacttgggcca

SEQ ID NO: 685583 - DNA, 25 bp, Mus musculus
gtccatatatcactcactgtctttt

SEQ ID NO: 685584 - DNA, 25 bp, Mus musculus
gtccatatatcagtcactgtctttt

SEQ ID NO: 685585 - DNA, 25 bp, Mus musculus
gtccatatatggatgaccccagcac

SEQ ID NO: 685586 - DNA, 25 bp, Mus musculus
gtccatatatggttgaccccagcac

SEQ ID NO: 685587 - DNA, 25 bp, Mus musculus
gtccatatctggctctttttacttg

SEQ ID NO: 685588 - DNA, 25 bp, Mus musculus
gtccatatctgggtctttttacttg

SEQ ID NO: 685589 - DNA, 25 bp, Mus musculus
gtccatatgtggagcagtgctcaaa

SEQ ID NO: 685590 - DNA, 25 bp, Mus musculus
gtccatatgtggtgcagtgctcaaa

SEQ ID NO: 685591 - DNA, 25 bp, Mus musculus
gtccatatgtttctctcataagaca

SEQ ID NO: 685592 - DNA, 25 bp, Mus musculus
gtccatatgtttgtctcataagaca

SEQ ID NO: 685593 - DNA, 25 bp, Mus musculus
gtccatattcagcaatctgagagtg

SEQ ID NO: 685594 - DNA, 25 bp, Mus musculus
gtccatattcaggaatctgagagtg

SEQ ID NO: 685595 - DNA, 25 bp, Mus musculus
gtccatattggcaatcttcctaaca

SEQ ID NO: 685596 - DNA, 25 bp, Mus musculus
gtccatattggctatcttcctaaca

SEQ ID NO: 685597 - DNA, 25 bp, Mus musculus
gtccatattgttattacctcatagt

SEQ ID NO: 685598 - DNA, 25 bp, Mus musculus
gtccatattgtttttacctcatagt

SEQ ID NO: 685599 - DNA, 25 bp, Mus musculus
gtccatcaaaagaacgtgtctcctg

SEQ ID NO: 685600 - DNA, 25 bp, Mus musculus
gtccatcaaaagtacgtgtctcctg

SEQ ID NO: 685601 - DNA, 25 bp, Mus musculus
gtccatcaacatctatgcgctctct

SEQ ID NO: 685602 - DNA, 25 bp, Mus musculus
gtccatcaacatgtatgcgctctct

SEQ ID NO: 685603 - DNA, 25 bp, Mus musculus
gtccatcaactgataggtgtataga

SEQ ID NO: 685604 - DNA, 25 bp, Mus musculus
gtccatcaactgttaggtgtataga

SEQ ID NO: 685605 - DNA, 25 bp, Mus musculus
gtccatcaagctcagtaaaggttgg

SEQ ID NO: 685606 - DNA, 25 bp, Mus musculus
gtccatcaagctgagtaaaggttgg

SEQ ID NO: 685607 - DNA, 25 bp, Mus musculus
gtccatcaataccactgaaggatct

SEQ ID NO: 685608 - DNA, 25 bp, Mus musculus
gtccatcaatacgactgaaggatct

SEQ ID NO: 685609 - DNA, 25 bp, Mus musculus
gtccatcaatgtcttcattcacagt

SEQ ID NO: 685610 - DNA, 25 bp, Mus musculus
gtccatcaatgtgttcattcacagt

SEQ ID NO: 685611 - DNA, 25 bp, Mus musculus
gtccatcacagcacgattcagaaat

SEQ ID NO: 685612 - DNA, 25 bp, Mus musculus
gtccatcacagctcgattcagaaat

SEQ ID NO: 685613 - DNA, 25 bp, Mus musculus
gtccatcagacgcagttttgagtgt

SEQ ID NO: 685614 - DNA, 25 bp, Mus musculus
gtccatcagacggagttttgagtgt

SEQ ID NO: 685615 - DNA, 25 bp, Mus musculus
gtccatcaggaaaggctagtcccat

SEQ ID NO: 685616 - DNA, 25 bp, Mus musculus
gtccatcaggaatggctagtcccat

SEQ ID NO: 685617 - DNA, 25 bp, Mus musculus
gtccatcagttccttagccttcaaa

SEQ ID NO: 685618 - DNA, 25 bp, Mus musculus
gtccatcagttcgttagccttcaaa

SEQ ID NO: 685619 - DNA, 25 bp, Mus musculus
gtccatcatctgatgtccatggcaa

SEQ ID NO: 685620 - DNA, 25 bp, Mus musculus
gtccatcatctgttgtccatggcaa

SEQ ID NO: 685621 - DNA, 25 bp, Mus musculus
gtccatccacctcttgaaggagcat

SEQ ID NO: 685622 - DNA, 25 bp, Mus musculus
gtccatccacctgttgaaggagcat

SEQ ID NO: 685623 - DNA, 25 bp, Mus musculus
gtccatccatctatcctattgttgg

SEQ ID NO: 685624 - DNA, 25 bp, Mus musculus
gtccatccatctttcctattgttgg

SEQ ID NO: 685625 - DNA, 25 bp, Mus musculus
gtccatccatttacagaagtctcat

SEQ ID NO: 685626 - DNA, 25 bp, Mus musculus
gtccatccattttcagaagtctcat

SEQ ID NO: 685627 - DNA, 25 bp, Mus musculus
gtccatcccgtgcaaatggctgttt

SEQ ID NO: 685628 - DNA, 25 bp, Mus musculus
gtccatcccgtggaaatggctgttt

SEQ ID NO: 685629 - DNA, 25 bp, Mus musculus
gtccatccctttatagagcaagtct

SEQ ID NO: 685630 - DNA, 25 bp, Mus musculus
gtccatccctttttagagcaagtct

SEQ ID NO: 685631 - DNA, 25 bp, Mus musculus
gtccatcctatgaagcgtacgaatt

SEQ ID NO: 685632 - DNA, 25 bp, Mus musculus
gtccatcctatgtagcgtacgaatt

SEQ ID NO: 685633 - DNA, 25 bp, Mus musculus
gtccatcctcatccttaaacttagg

SEQ ID NO: 685634 - DNA, 25 bp, Mus musculus
gtccatcctcatgcttaaacttagg

SEQ ID NO: 685635 - DNA, 25 bp, Mus musculus
gtccatcctgttaaacctaagaggc

SEQ ID NO: 685636 - DNA, 25 bp, Mus musculus
gtccatcctgtttaacctaagaggc

SEQ ID NO: 685637 - DNA, 25 bp, Mus musculus
gtccatccttttcccacttgtgata

SEQ ID NO: 685638 - DNA, 25 bp, Mus musculus
gtccatccttttgccacttgtgata

SEQ ID NO: 685639 - DNA, 25 bp, Mus musculus
gtccatcggcaaactacacgggaag

SEQ ID NO: 685640 - DNA, 25 bp, Mus musculus
gtccatcggcaatctacacgggaag

SEQ ID NO: 685641 - DNA, 25 bp, Mus musculus
gtccatcgtcccagatcttaggagg

SEQ ID NO: 685642 - DNA, 25 bp, Mus musculus
gtccatcgtccctgatcttaggagg

SEQ ID NO: 685643 - DNA, 25 bp, Mus musculus
gtccatctacgtcggctgtgataaa

SEQ ID NO: 685644 - DNA, 25 bp, Mus musculus
gtccatctacgtgggctgtgataaa

SEQ ID NO: 685645 - DNA, 25 bp, Mus musculus
gtccatctcactataatttcattta

SEQ ID NO: 685646 - DNA, 25 bp, Mus musculus
gtccatctcactttaatttcattta

SEQ ID NO: 685647 - DNA, 25 bp, Mus musculus
gtccatctcatgagacagctgtcgt

SEQ ID NO: 685648 - DNA, 25 bp, Mus musculus
gtccatctcatgtgacagctgtcgt

SEQ ID NO: 685649 - DNA, 25 bp, Mus musculus
gtccatctccatcttgtgtcatatc

SEQ ID NO: 685650 - DNA, 25 bp, Mus musculus
gtccatctccatgttgtgtcatatc

SEQ ID NO: 685651 - DNA, 25 bp, Mus musculus
gtccatctccgtctgagggcaactg

SEQ ID NO: 685652 - DNA, 25 bp, Mus musculus
gtccatctccgtgtgagggcaactg

SEQ ID NO: 685653 - DNA, 25 bp, Mus musculus
gtccatctgctgaaatatgaaaaga

SEQ ID NO: 685654 - DNA, 25 bp, Mus musculus
gtccatctgctgtaatatgaaaaga

SEQ ID NO: 685655 - DNA, 25 bp, Mus musculus
gtccatctgtccatttaagcatcca

SEQ ID NO: 685656 - DNA, 25 bp, Mus musculus
gtccatctgtccttttaagcatcca

SEQ ID NO: 685657 - DNA, 25 bp, Mus musculus
gtccatcttctcaagggcttgggat

SEQ ID NO: 685658 - DNA, 25 bp, Mus musculus
gtccatcttctctagggcttgggat

SEQ ID NO: 685659 - DNA, 25 bp, Mus musculus
gtccatcttgttagggaacaccaga

SEQ ID NO: 685660 - DNA, 25 bp, Mus musculus
gtccatcttgtttgggaacaccaga

SEQ ID NO: 685661 - DNA, 25 bp, Mus musculus
gtccatctttggcatcataccagac

SEQ ID NO: 685662 - DNA, 25 bp, Mus musculus
gtccatctttgggatcataccagac

SEQ ID NO: 685663 - DNA, 25 bp, Mus musculus
gtccatgacagcagagtgcacacct

SEQ ID NO: 685664 - DNA, 25 bp, Mus musculus
gtccatgacagctgagtgcacacct

SEQ ID NO: 685665 - DNA, 25 bp, Mus musculus
gtccatgacgtcattgatctttacc

SEQ ID NO: 685666 - DNA, 25 bp, Mus musculus
gtccatgacgtctttgatctttacc

SEQ ID NO: 685667 - DNA, 25 bp, Mus musculus
gtccatgaggttcccagaggcgctc

SEQ ID NO: 685668 - DNA, 25 bp, Mus musculus
gtccatgaggttgccagaggcgctc

SEQ ID NO: 685669 - DNA, 25 bp, Mus musculus
gtccatgcaagcacagagacaggca

SEQ ID NO: 685670 - DNA, 25 bp, Mus musculus
gtccatgcaagctcagagacaggca

SEQ ID NO: 685671 - DNA, 25 bp, Mus musculus
gtccatgcactgagctcataagatg

SEQ ID NO: 685672 - DNA, 25 bp, Mus musculus
gtccatgcactgtgctcataagatg

SEQ ID NO: 685673 - DNA, 25 bp, Mus musculus
gtccatgcagctcacaccattgaga

SEQ ID NO: 685674 - DNA, 25 bp, Mus musculus
gtccatgcagctgacaccattgaga

SEQ ID NO: 685675 - DNA, 25 bp, Mus musculus
gtccatgcattcaatgtgatcacaa

SEQ ID NO: 685676 - DNA, 25 bp, Mus musculus
gtccatgcattctatgtgatcacaa

SEQ ID NO: 685677 - DNA, 25 bp, Mus musculus
gtccatgccagcatacctaaattat

SEQ ID NO: 685678 - DNA, 25 bp, Mus musculus
gtccatgccagcttacctaaattat

SEQ ID NO: 685679 - DNA, 25 bp, Mus musculus
gtccatgcccaacctataaaatttt

SEQ ID NO: 685680 - DNA, 25 bp, Mus musculus
gtccatgcccaagctataaaatttt

SEQ ID NO: 685681 - DNA, 25 bp, Mus musculus
gtccatgccgttagctttctaatca

SEQ ID NO: 685682 - DNA, 25 bp, Mus musculus
gtccatgccgtttgctttctaatca

SEQ ID NO: 685683 - DNA, 25 bp, Mus musculus
gtccatgcctttcggctaagtccat

SEQ ID NO: 685684 - DNA, 25 bp, Mus musculus
gtccatgcctttgggctaagtccat

SEQ ID NO: 685685 - DNA, 25 bp, Mus musculus
gtccatggatagaactttgtcccca

SEQ ID NO: 685686 - DNA, 25 bp, Mus musculus
gtccatggatagtactttgtcccca

SEQ ID NO: 685687 - DNA, 25 bp, Mus musculus
gtccatggatcaactaatctctcaa

SEQ ID NO: 685688 - DNA, 25 bp, Mus musculus
gtccatggatcatctaatctctcaa

SEQ ID NO: 685689 - DNA, 25 bp, Mus musculus
gtccatggatccattgacatcagat

SEQ ID NO: 685690 - DNA, 25 bp, Mus musculus
gtccatggatcctttgacatcagat

SEQ ID NO: 685691 - DNA, 25 bp, Mus musculus
gtccatggatgcagtaatctacaca

SEQ ID NO: 685692 - DNA, 25 bp, Mus musculus
gtccatggatgctgtaatctacaca

SEQ ID NO: 685693 - DNA, 25 bp, Mus musculus
gtccatggatttacattagttcttg

SEQ ID NO: 685694 - DNA, 25 bp, Mus musculus
gtccatggattttcattagttcttg

SEQ ID NO: 685695 - DNA, 25 bp, Mus musculus
gtccatggcaatacatctagctcta

SEQ ID NO: 685696 - DNA, 25 bp, Mus musculus
gtccatggcaattcatctagctcta

SEQ ID NO: 685697 - DNA, 25 bp, Mus musculus
gtccatggcttccactgcagtgtga

SEQ ID NO: 685698 - DNA, 25 bp, Mus musculus
gtccatggcttcgactgcagtgtga

SEQ ID NO: 685699 - DNA, 25 bp, Mus musculus
gtccatgggcatctctctgagggat

SEQ ID NO: 685700 - DNA, 25 bp, Mus musculus
gtccatgggcatgtctctgagggat

SEQ ID NO: 685701 - DNA, 25 bp, Mus musculus
gtccatgggctgatggtatagcttt

SEQ ID NO: 685702 - DNA, 25 bp, Mus musculus
gtccatgggctgttggtatagcttt

SEQ ID NO: 685703 - DNA, 25 bp, Mus musculus
gtccatgggtggagttctgtgaacc

SEQ ID NO: 685704 - DNA, 25 bp, Mus musculus
gtccatgggtggtgttctgtgaacc

SEQ ID NO: 685705 - DNA, 25 bp, Mus musculus
gtccatggttcacttagacataaat

SEQ ID NO: 685706 - DNA, 25 bp, Mus musculus
gtccatggttcagttagacataaat

SEQ ID NO: 685707 - DNA, 25 bp, Mus musculus
gtccatggtttcatcagcaataggg

SEQ ID NO: 685708 - DNA, 25 bp, Mus musculus
gtccatggtttcttcagcaataggg

SEQ ID NO: 685709 - DNA, 25 bp, Mus musculus
gtccatgtaaagatcttggagtaat

SEQ ID NO: 685710 - DNA, 25 bp, Mus musculus
gtccatgtaaagttcttggagtaat

SEQ ID NO: 685711 - DNA, 25 bp, Mus musculus
gtccatgtaaggagggtatggtata

SEQ ID NO: 685712 - DNA, 25 bp, Mus musculus
gtccatgtaaggtgggtatggtata

SEQ ID NO: 685713 - DNA, 25 bp, Mus musculus
gtccatgtacctctgagtcaagaaa

SEQ ID NO: 685714 - DNA, 25 bp, Mus musculus
gtccatgtacctgtgagtcaagaaa

SEQ ID NO: 685715 - DNA, 25 bp, Mus musculus
gtccatgtagttccgactgcagcag

SEQ ID NO: 685716 - DNA, 25 bp, Mus musculus
gtccatgtagttgcgactgcagcag

SEQ ID NO: 685717 - DNA, 25 bp, Mus musculus
gtccatgtatctataattcactatt

SEQ ID NO: 685718 - DNA, 25 bp, Mus musculus
gtccatgtatctttaattcactatt

SEQ ID NO: 685719 - DNA, 25 bp, Mus musculus
gtccatgtattgaaactaagcccat

SEQ ID NO: 685720 - DNA, 25 bp, Mus musculus
gtccatgtattgtaactaagcccat

SEQ ID NO: 685721 - DNA, 25 bp, Mus musculus
gtccatgtcaaacacttagacttga

SEQ ID NO: 685722 - DNA, 25 bp, Mus musculus
gtccatgtcaaagacttagacttga

SEQ ID NO: 685723 - DNA, 25 bp, Mus musculus
gtccatgtccatcctgcagaaagct

SEQ ID NO: 685724 - DNA, 25 bp, Mus musculus
gtccatgtccatgctgcagaaagct

SEQ ID NO: 685725 - DNA, 25 bp, Mus musculus
gtccatgtccccacatttgttttat

SEQ ID NO: 685726 - DNA, 25 bp, Mus musculus
gtccatgtcccctcatttgttttat

SEQ ID NO: 685727 - DNA, 25 bp, Mus musculus
gtccatgtcgaactaagtttggtac

SEQ ID NO: 685728 - DNA, 25 bp, Mus musculus
gtccatgtcgaagtaagtttggtac

SEQ ID NO: 685729 - DNA, 25 bp, Mus musculus
gtccatgtcgctcgtggcctcagca

SEQ ID NO: 685730 - DNA, 25 bp, Mus musculus
gtccatgtcgctggtggcctcagca

SEQ ID NO: 685731 - DNA, 25 bp, Mus musculus
gtccatgtctggcacatgtttcagg

SEQ ID NO: 685732 - DNA, 25 bp, Mus musculus
gtccatgtctgggacatgtttcagg

SEQ ID NO: 685733 - DNA, 25 bp, Mus musculus
gtccatgtctgtctcaatcatgaca

SEQ ID NO: 685734 - DNA, 25 bp, Mus musculus
gtccatgtctgtgtcaatcatgaca

SEQ ID NO: 685735 - DNA, 25 bp, Mus musculus
gtccatgtgcctaagcactatctgt

SEQ ID NO: 685736 - DNA, 25 bp, Mus musculus
gtccatgtgccttagcactatctgt

SEQ ID NO: 685737 - DNA, 25 bp, Mus musculus
gtccatgtgcgcaaccatctgcgga

SEQ ID NO: 685738 - DNA, 25 bp, Mus musculus
gtccatgtgcgctaccatctgcgga

SEQ ID NO: 685739 - DNA, 25 bp, Mus musculus
gtccatgtgctccaggctgcaggat

SEQ ID NO: 685740 - DNA, 25 bp, Mus musculus
gtccatgtgctcgaggctgcaggat

SEQ ID NO: 685741 - DNA, 25 bp, Mus musculus
gtccatgtgggcagataactagtac

SEQ ID NO: 685742 - DNA, 25 bp, Mus musculus
gtccatgtgggctgataactagtac

SEQ ID NO: 685743 - DNA, 25 bp, Mus musculus
gtccatgtgtgactggataataaat

SEQ ID NO: 685744 - DNA, 25 bp, Mus musculus
gtccatgtgtgagtggataataaat

SEQ ID NO: 685745 - DNA, 25 bp, Mus musculus
gtccatgtgtttctgctttcaggtt

SEQ ID NO: 685746 - DNA, 25 bp, Mus musculus
gtccatgtgtttgtgctttcaggtt

SEQ ID NO: 685747 - DNA, 25 bp, Mus musculus
gtccatgttcctactgcagcagaag

SEQ ID NO: 685748 - DNA, 25 bp, Mus musculus
gtccatgttcctccatattcttcat

SEQ ID NO: 685749 - DNA, 25 bp, Mus musculus
gtccatgttcctgcatattcttcat

SEQ ID NO: 685750 - DNA, 25 bp, Mus musculus
gtccatgttccttctgcagcagaag

SEQ ID NO: 685751 - DNA, 25 bp, Mus musculus
gtccatgttgtgcagtgtaacacct

SEQ ID NO: 685752 - DNA, 25 bp, Mus musculus
gtccatgttgtggagtgtaacacct

SEQ ID NO: 685753 - DNA, 25 bp, Mus musculus
gtccattaacacagctttgacttta

SEQ ID NO: 685754 - DNA, 25 bp, Mus musculus
gtccattaacactgctttgacttta

SEQ ID NO: 685755 - DNA, 25 bp, Mus musculus
gtccattaacatcagagatctttcc

SEQ ID NO: 685756 - DNA, 25 bp, Mus musculus
gtccattaacatgagagatctttcc

SEQ ID NO: 685757 - DNA, 25 bp, Mus musculus
gtccattacatcataagcagggctc

SEQ ID NO: 685758 - DNA, 25 bp, Mus musculus
gtccattacatcttaagcagggctc

SEQ ID NO: 685759 - DNA, 25 bp, Mus musculus
gtccattaccaaagaggtgtttgca

SEQ ID NO: 685760 - DNA, 25 bp, Mus musculus
gtccattaccaatgaggtgtttgca

SEQ ID NO: 685761 - DNA, 25 bp, Mus musculus
gtccattagtatcttgcctccagag

SEQ ID NO: 685762 - DNA, 25 bp, Mus musculus
gtccattagtatgttgcctccagag

SEQ ID NO: 685763 - DNA, 25 bp, Mus musculus
gtccattagttaatgtagtaggtcc

SEQ ID NO: 685764 - DNA, 25 bp, Mus musculus
gtccattagttaccatgttcaggta

SEQ ID NO: 685765 - DNA, 25 bp, Mus musculus
gtccattagttagcatgttcaggta

SEQ ID NO: 685766 - DNA, 25 bp, Mus musculus
gtccattagttattgtagtaggtcc

SEQ ID NO: 685767 - DNA, 25 bp, Mus musculus
gtccattatgtccaggcatcgctaa

SEQ ID NO: 685768 - DNA, 25 bp, Mus musculus
gtccattatgtcgaggcatcgctaa

SEQ ID NO: 685769 - DNA, 25 bp, Mus musculus
gtccattcaaacatacactcaaata

SEQ ID NO: 685770 - DNA, 25 bp, Mus musculus
gtccattcaaacttacactcaaata

SEQ ID NO: 685771 - DNA, 25 bp, Mus musculus
gtccattcacttatcgagacccaat

SEQ ID NO: 685772 - DNA, 25 bp, Mus musculus
gtccattcacttttcgagacccaat

SEQ ID NO: 685773 - DNA, 25 bp, Mus musculus
gtccattcctagagtagacacccta

SEQ ID NO: 685774 - DNA, 25 bp, Mus musculus
gtccattcctagtgtagacacccta

SEQ ID NO: 685775 - DNA, 25 bp, Mus musculus
gtccattcctttatccagggtggat

SEQ ID NO: 685776 - DNA, 25 bp, Mus musculus
gtccattcctttttccagggtggat

SEQ ID NO: 685777 - DNA, 25 bp, Mus musculus
gtccattcgagacgaggccagagcc

SEQ ID NO: 685778 - DNA, 25 bp, Mus musculus
gtccattcgagaggaggccagagcc

SEQ ID NO: 685779 - DNA, 25 bp, Mus musculus
gtccattctccacgctgtaaatatt

SEQ ID NO: 685780 - DNA, 25 bp, Mus musculus
gtccattctccaggctgtaaatatt

SEQ ID NO: 685781 - DNA, 25 bp, Mus musculus
gtccattctggtcaggtgacaactg

SEQ ID NO: 685782 - DNA, 25 bp, Mus musculus
gtccattctggtgaggtgacaactg

SEQ ID NO: 685783 - DNA, 25 bp, Mus musculus
gtccattgacataagttttgccatt

SEQ ID NO: 685784 - DNA, 25 bp, Mus musculus
gtccattgacattagttttgccatt

SEQ ID NO: 685785 - DNA, 25 bp, Mus musculus
gtccattgctaaatccctcaactgg

SEQ ID NO: 685786 - DNA, 25 bp, Mus musculus
gtccattgctaattccctcaactgg

SEQ ID NO: 685787 - DNA, 25 bp, Mus musculus
gtccattgctatctgactcttaatt

SEQ ID NO: 685788 - DNA, 25 bp, Mus musculus
gtccattgctatgtgactcttaatt

SEQ ID NO: 685789 - DNA, 25 bp, Mus musculus
gtccattgtggtcaagtgtagcgat

SEQ ID NO: 685790 - DNA, 25 bp, Mus musculus
gtccattgtggtgaagtgtagcgat

SEQ ID NO: 685791 - DNA, 25 bp, Mus musculus
gtccattgttaacagaagctgacct

SEQ ID NO: 685792 - DNA, 25 bp, Mus musculus
gtccattgttaagagaagctgacct

SEQ ID NO: 685793 - DNA, 25 bp, Mus musculus
gtccatttaaaaccctgcacaaacg

SEQ ID NO: 685794 - DNA, 25 bp, Mus musculus
gtccatttaaaagcctgcacaaacg

SEQ ID NO: 685795 - DNA, 25 bp, Mus musculus
gtccatttacttaaccagctataaa

SEQ ID NO: 685796 - DNA, 25 bp, Mus musculus
gtccatttactttaccagctataaa

SEQ ID NO: 685797 - DNA, 25 bp, Mus musculus
gtccatttagacatggtgacccctt

SEQ ID NO: 685798 - DNA, 25 bp, Mus musculus
gtccatttagacttggtgacccctt

SEQ ID NO: 685799 - DNA, 25 bp, Mus musculus
gtccatttagttcaatcaggcccct

SEQ ID NO: 685800 - DNA, 25 bp, Mus musculus
gtccatttagttgaatcaggcccct

SEQ ID NO: 685801 - DNA, 25 bp, Mus musculus
gtccatttcattacagatactctgt

SEQ ID NO: 685802 - DNA, 25 bp, Mus musculus
gtccatttcatttcagatactctgt

SEQ ID NO: 685803 - DNA, 25 bp, Mus musculus
gtccatttcttcaaaattttatatc

SEQ ID NO: 685804 - DNA, 25 bp, Mus musculus
gtccatttcttctaaattttatatc

SEQ ID NO: 685805 - DNA, 25 bp, Mus musculus
gtccatttgcttctgtttgcagtaa

SEQ ID NO: 685806 - DNA, 25 bp, Mus musculus
gtccatttgcttgtgtttgcagtaa

SEQ ID NO: 685807 - DNA, 25 bp, Mus musculus
gtccatttggctatcagagcaacct

SEQ ID NO: 685808 - DNA, 25 bp, Mus musculus
gtccatttggctttcagagcaacct

SEQ ID NO: 685809 - DNA, 25 bp, Mus musculus
gtccatttggtgattctttactcat

SEQ ID NO: 685810 - DNA, 25 bp, Mus musculus
gtccatttggtgtttctttactcat

SEQ ID NO: 685811 - DNA, 25 bp, Mus musculus
gtccatttgttgctgctgaagcagc

SEQ ID NO: 685812 - DNA, 25 bp, Mus musculus
gtccatttgttggtgctgaagcagc

SEQ ID NO: 685813 - DNA, 25 bp, Mus musculus
gtccattttcggatgagtttttcag

SEQ ID NO: 685814 - DNA, 25 bp, Mus musculus
gtccattttcggttgagtttttcag

SEQ ID NO: 685815 - DNA, 25 bp, Mus musculus
gtccattttctcctgtactgattat

SEQ ID NO: 685816 - DNA, 25 bp, Mus musculus
gtccattttctcgtgtactgattat

SEQ ID NO: 685817 - DNA, 25 bp, Mus musculus
gtccattttgaacaccatgtaaaga

SEQ ID NO: 685818 - DNA, 25 bp, Mus musculus
gtccattttgaagaccatgtaaaga

SEQ ID NO: 685819 - DNA, 25 bp, Mus musculus
gtcccaaaataaagagctctaggtt

SEQ ID NO: 685820 - DNA, 25 bp, Mus musculus
gtcccaaaataatgagctctaggtt

SEQ ID NO: 685821 - DNA, 25 bp, Mus musculus
gtcccaaaatgcaccagctggattt

SEQ ID NO: 685822 - DNA, 25 bp, Mus musculus
gtcccaaaatgctccagctggattt

SEQ ID NO: 685823 - DNA, 25 bp, Mus musculus
gtcccaaaatggagactgtccgctg

SEQ ID NO: 685824 - DNA, 25 bp, Mus musculus
gtcccaaaatggtgactgtccgctg

SEQ ID NO: 685825 - DNA, 25 bp, Mus musculus
gtcccaaaccagctaaaaagaacat

SEQ ID NO: 685826 - DNA, 25 bp, Mus musculus
gtcccaaaccaggtaaaaagaacat

SEQ ID NO: 685827 - DNA, 25 bp, Mus musculus
gtcccaaactctcgtgtttcaatgg

SEQ ID NO: 685828 - DNA, 25 bp, Mus musculus
gtcccaaactctggtgtttcaatgg

SEQ ID NO: 685829 - DNA, 25 bp, Mus musculus
gtcccaaactgcatcgtgtttgttt

SEQ ID NO: 685830 - DNA, 25 bp, Mus musculus
gtcccaaactgcttcgtgtttgttt

SEQ ID NO: 685831 - DNA, 25 bp, Mus musculus
gtcccaaagctcatcaacaaggtct

SEQ ID NO: 685832 - DNA, 25 bp, Mus musculus
gtcccaaagctcttcaacaaggtct

SEQ ID NO: 685833 - DNA, 25 bp, Mus musculus
gtcccaaagtgcaatcaaaccagat

SEQ ID NO: 685834 - DNA, 25 bp, Mus musculus
gtcccaaagtgctatcaaaccagat

SEQ ID NO: 685835 - DNA, 25 bp, Mus musculus
gtcccaaatgcaaagcctggtatta

SEQ ID NO: 685836 - DNA, 25 bp, Mus musculus
gtcccaaatgcatagcctggtatta

SEQ ID NO: 685837 - DNA, 25 bp, Mus musculus
gtcccaacagatacatagagcacag

SEQ ID NO: 685838 - DNA, 25 bp, Mus musculus
gtcccaacagattcatagagcacag

SEQ ID NO: 685839 - DNA, 25 bp, Mus musculus
gtcccaacaggaatacctagacagt

SEQ ID NO: 685840 - DNA, 25 bp, Mus musculus
gtcccaacaggattacctagacagt

SEQ ID NO: 685841 - DNA, 25 bp, Mus musculus
gtcccaacagttattgacactcaaa

SEQ ID NO: 685842 - DNA, 25 bp, Mus musculus
gtcccaacagttctcaggcatacag

SEQ ID NO: 685843 - DNA, 25 bp, Mus musculus
gtcccaacagttgtcaggcatacag

SEQ ID NO: 685844 - DNA, 25 bp, Mus musculus
gtcccaacagtttttgacactcaaa

SEQ ID NO: 685845 - DNA, 25 bp, Mus musculus
gtcccaaccctacattttacagttg

SEQ ID NO: 685846 - DNA, 25 bp, Mus musculus
gtcccaaccctagattttacagttg

SEQ ID NO: 685847 - DNA, 25 bp, Mus musculus
gtcccaactactacagatagactgt

SEQ ID NO: 685848 - DNA, 25 bp, Mus musculus
gtcccaactacttcagatagactgt

SEQ ID NO: 685849 - DNA, 25 bp, Mus musculus
gtcccaactgatccagcacgagaca

SEQ ID NO: 685850 - DNA, 25 bp, Mus musculus
gtcccaactgatgcagcacgagaca

SEQ ID NO: 685851 - DNA, 25 bp, Mus musculus
gtcccaactgcgactggaaactggt

SEQ ID NO: 685852 - DNA, 25 bp, Mus musculus
gtcccaactgcgtctggaaactggt

SEQ ID NO: 685853 - DNA, 25 bp, Mus musculus
gtcccaactggcaaatattccatct

SEQ ID NO: 685854 - DNA, 25 bp, Mus musculus
gtcccaactggctaatattccatct

SEQ ID NO: 685855 - DNA, 25 bp, Mus musculus
gtcccaacttctcagccttaagtta

SEQ ID NO: 685856 - DNA, 25 bp, Mus musculus
gtcccaacttctgagccttaagtta

SEQ ID NO: 685857 - DNA, 25 bp, Mus musculus
gtcccaagacaacaatctaattcag

SEQ ID NO: 685858 - DNA, 25 bp, Mus musculus
gtcccaagacaagaatctaattcag

SEQ ID NO: 685859 - DNA, 25 bp, Mus musculus
gtcccaagaccgctactgtaaggaa

SEQ ID NO: 685860 - DNA, 25 bp, Mus musculus
gtcccaagaccggtactgtaaggaa

SEQ ID NO: 685861 - DNA, 25 bp, Mus musculus
gtcccaagagaccaagcattttgaa

SEQ ID NO: 685862 - DNA, 25 bp, Mus musculus
gtcccaagagacgaagcattttgaa

SEQ ID NO: 685863 - DNA, 25 bp, Mus musculus
gtcccaagagagcagattgccccac

SEQ ID NO: 685864 - DNA, 25 bp, Mus musculus
gtcccaagagaggagattgccccac

SEQ ID NO: 685865 - DNA, 25 bp, Mus musculus
gtcccaagattgacagatactttca

SEQ ID NO: 685866 - DNA, 25 bp, Mus musculus
gtcccaagattgtcagatactttca

SEQ ID NO: 685867 - DNA, 25 bp, Mus musculus
gtcccaagcttccttgttaagtctg

SEQ ID NO: 685868 - DNA, 25 bp, Mus musculus
gtcccaagcttcgttgttaagtctg

SEQ ID NO: 685869 - DNA, 25 bp, Mus musculus
gtcccaaggtcacctgggtatttat

SEQ ID NO: 685870 - DNA, 25 bp, Mus musculus
gtcccaaggtcagctgggtatttat

SEQ ID NO: 685871 - DNA, 25 bp, Mus musculus
gtcccaagtattatttagctaccca

SEQ ID NO: 685872 - DNA, 25 bp, Mus musculus
gtcccaagtattttttagctaccca

SEQ ID NO: 685873 - DNA, 25 bp, Mus musculus
gtcccaagtgctcaggacttttagc

SEQ ID NO: 685874 - DNA, 25 bp, Mus musculus
gtcccaagtgctgaggacttttagc

SEQ ID NO: 685875 - DNA, 25 bp, Mus musculus
gtcccaatacacaggcagagttccg

SEQ ID NO: 685876 - DNA, 25 bp, Mus musculus
gtcccaatacactggcagagttccg

SEQ ID NO: 685877 - DNA, 25 bp, Mus musculus
gtcccaatagatccagtaccatcct

SEQ ID NO: 685878 - DNA, 25 bp, Mus musculus
gtcccaatagatgcagtaccatcct

SEQ ID NO: 685879 - DNA, 25 bp, Mus musculus
gtcccaatcaggactggttggctgt

SEQ ID NO: 685880 - DNA, 25 bp, Mus musculus
gtcccaatcaggtctggttggctgt

SEQ ID NO: 685881 - DNA, 25 bp, Mus musculus
gtcccaatcattaacatttcagagg

SEQ ID NO: 685882 - DNA, 25 bp, Mus musculus
gtcccaatcatttacatttcagagg

SEQ ID NO: 685883 - DNA, 25 bp, Mus musculus
gtcccaatgtagcttgcagatttct

SEQ ID NO: 685884 - DNA, 25 bp, Mus musculus
gtcccaatgtaggttgcagatttct

SEQ ID NO: 685885 - DNA, 25 bp, Mus musculus
gtcccaatttgccacttggtatcga

SEQ ID NO: 685886 - DNA, 25 bp, Mus musculus
gtcccaatttgcgacttggtatcga

SEQ ID NO: 685887 - DNA, 25 bp, Mus musculus
gtcccacaagttatctacagctgat

SEQ ID NO: 685888 - DNA, 25 bp, Mus musculus
gtcccacaagttttctacagctgat

SEQ ID NO: 685889 - DNA, 25 bp, Mus musculus
gtcccacacagtcccgacattagag

SEQ ID NO: 685890 - DNA, 25 bp, Mus musculus
gtcccacacagtgccgacattagag

SEQ ID NO: 685891 - DNA, 25 bp, Mus musculus
gtcccacactaaacctgacttatgt

SEQ ID NO: 685892 - DNA, 25 bp, Mus musculus
gtcccacactaatcctgacttatgt

SEQ ID NO: 685893 - DNA, 25 bp, Mus musculus
gtcccacagcaacagggcagtttgt

SEQ ID NO: 685894 - DNA, 25 bp, Mus musculus
gtcccacagcaagagggcagtttgt

SEQ ID NO: 685895 - DNA, 25 bp, Mus musculus
gtcccacaggcaatcttagggcggt

SEQ ID NO: 685896 - DNA, 25 bp, Mus musculus
gtcccacaggcattcttagggcggt

SEQ ID NO: 685897 - DNA, 25 bp, Mus musculus
gtcccacaggctcactctgtaggga

SEQ ID NO: 685898 - DNA, 25 bp, Mus musculus
gtcccacaggctgactctgtaggga

SEQ ID NO: 685899 - DNA, 25 bp, Mus musculus
gtcccaccaggcatcgcagtgactg

SEQ ID NO: 685900 - DNA, 25 bp, Mus musculus
gtcccaccaggcttcgcagtgactg

SEQ ID NO: 685901 - DNA, 25 bp, Mus musculus
gtcccaccatgtatcctaagaactg

SEQ ID NO: 685902 - DNA, 25 bp, Mus musculus
gtcccaccatgtttcctaagaactg

SEQ ID NO: 685903 - DNA, 25 bp, Mus musculus
gtcccacccctaacatgcagaaagt

SEQ ID NO: 685904 - DNA, 25 bp, Mus musculus
gtcccacccctatcatgcagaaagt

SEQ ID NO: 685905 - DNA, 25 bp, Mus musculus
gtcccacctaggattctttttagct

SEQ ID NO: 685906 - DNA, 25 bp, Mus musculus
gtcccacctaggtttctttttagct

SEQ ID NO: 685907 - DNA, 25 bp, Mus musculus
gtcccacctctcatttatgtttaga

SEQ ID NO: 685908 - DNA, 25 bp, Mus musculus
gtcccacctctcttttatgtttaga

SEQ ID NO: 685909 - DNA, 25 bp, Mus musculus
gtcccacctgaaccagtgcattgaa

SEQ ID NO: 685910 - DNA, 25 bp, Mus musculus
gtcccacctgaagcagtgcattgaa

SEQ ID NO: 685911 - DNA, 25 bp, Mus musculus
gtcccacctgcgaagtcccaggttt

SEQ ID NO: 685912 - DNA, 25 bp, Mus musculus
gtcccacctgcgtagtcccaggttt

SEQ ID NO: 685913 - DNA, 25 bp, Mus musculus
gtcccacctgtcagggtatggtagt

SEQ ID NO: 685914 - DNA, 25 bp, Mus musculus
gtcccacctgtctgggtatggtagt

SEQ ID NO: 685915 - DNA, 25 bp, Mus musculus
gtcccacgattaaccagcagtttaa

SEQ ID NO: 685916 - DNA, 25 bp, Mus musculus
gtcccacgattatccagcagtttaa

SEQ ID NO: 685917 - DNA, 25 bp, Mus musculus
gtcccacggaccagatgcaaagctg

SEQ ID NO: 685918 - DNA, 25 bp, Mus musculus
gtcccacggacctgatgcaaagctg

SEQ ID NO: 685919 - DNA, 25 bp, Mus musculus
gtcccacggagaaaaccatcttcat

SEQ ID NO: 685920 - DNA, 25 bp, Mus musculus
gtcccacggagataaccatcttcat

SEQ ID NO: 685921 - DNA, 25 bp, Mus musculus
gtcccacgtgcaatgtgtgcctgaa

SEQ ID NO: 685922 - DNA, 25 bp, Mus musculus
gtcccacgtgcattgtgtgcctgaa

SEQ ID NO: 685923 - DNA, 25 bp, Mus musculus
gtcccactaacacccattgtctagt

SEQ ID NO: 685924 - DNA, 25 bp, Mus musculus
gtcccactaacagccattgtctagt

SEQ ID NO: 685925 - DNA, 25 bp, Mus musculus
gtcccactcactaacatgataattt

SEQ ID NO: 685926 - DNA, 25 bp, Mus musculus
gtcccactcacttacatgataattt

SEQ ID NO: 685927 - DNA, 25 bp, Mus musculus
gtcccactccgtcagtaatttgaaa

SEQ ID NO: 685928 - DNA, 25 bp, Mus musculus
gtcccactccgtgagtaatttgaaa

SEQ ID NO: 685929 - DNA, 25 bp, Mus musculus
gtcccactctgcatatttgtcaagg

SEQ ID NO: 685930 - DNA, 25 bp, Mus musculus
gtcccactctgcttatttgtcaagg

SEQ ID NO: 685931 - DNA, 25 bp, Mus musculus
gtcccacttacactatgcagtatct

SEQ ID NO: 685932 - DNA, 25 bp, Mus musculus
gtcccacttacagtatgcagtatct

SEQ ID NO: 685933 - DNA, 25 bp, Mus musculus
gtcccacttcttcgcacagacagaa

SEQ ID NO: 685934 - DNA, 25 bp, Mus musculus
gtcccacttcttggcacagacagaa

SEQ ID NO: 685935 - DNA, 25 bp, Mus musculus
gtcccacttgtgagatcatggtgaa

SEQ ID NO: 685936 - DNA, 25 bp, Mus musculus
gtcccacttgtgtgatcatggtgaa

SEQ ID NO: 685937 - DNA, 25 bp, Mus musculus
gtcccacttgttacctacgtaaatg

SEQ ID NO: 685938 - DNA, 25 bp, Mus musculus
gtcccacttgtttcctacgtaaatg

SEQ ID NO: 685939 - DNA, 25 bp, Mus musculus
gtcccactttggaccttagttcaag

SEQ ID NO: 685940 - DNA, 25 bp, Mus musculus
gtcccactttggtccttagttcaag

SEQ ID NO: 685941 - DNA, 25 bp, Mus musculus
gtcccagaaaacatgataccatttg

SEQ ID NO: 685942 - DNA, 25 bp, Mus musculus
gtcccagaaaacttgataccatttg

SEQ ID NO: 685943 - DNA, 25 bp, Mus musculus
gtcccagaaatgaactcatatgccc

SEQ ID NO: 685944 - DNA, 25 bp, Mus musculus
gtcccagaaatgtactcatatgccc

SEQ ID NO: 685945 - DNA, 25 bp, Mus musculus
gtcccagaagttaccatgattccac

SEQ ID NO: 685946 - DNA, 25 bp, Mus musculus
gtcccagaagtttccatgattccac

SEQ ID NO: 685947 - DNA, 25 bp, Mus musculus
gtcccagaatctctgtcttcagcca

SEQ ID NO: 685948 - DNA, 25 bp, Mus musculus
gtcccagaatctgtgtcttcagcca

SEQ ID NO: 685949 - DNA, 25 bp, Mus musculus
gtcccagaatgaagctggattctta

SEQ ID NO: 685950 - DNA, 25 bp, Mus musculus
gtcccagaatgatgctggattctta

SEQ ID NO: 685951 - DNA, 25 bp, Mus musculus
gtcccagacacaattacatcataac

SEQ ID NO: 685952 - DNA, 25 bp, Mus musculus
gtcccagacacatttacatcataac

SEQ ID NO: 685953 - DNA, 25 bp, Mus musculus
gtcccagacctgagctaacaacaaa

SEQ ID NO: 685954 - DNA, 25 bp, Mus musculus
gtcccagacctgtgctaacaacaaa

SEQ ID NO: 685955 - DNA, 25 bp, Mus musculus
gtcccagactttactagtatttgcc

SEQ ID NO: 685956 - DNA, 25 bp, Mus musculus
gtcccagacttttctagtatttgcc

SEQ ID NO: 685957 - DNA, 25 bp, Mus musculus
gtcccagagaggcatggccctgctc

SEQ ID NO: 685958 - DNA, 25 bp, Mus musculus
gtcccagagagggatggccctgctc

SEQ ID NO: 685959 - DNA, 25 bp, Mus musculus
gtcccagagatgaacagtgcactca

SEQ ID NO: 685960 - DNA, 25 bp, Mus musculus
gtcccagagatgtacagtgcactca

SEQ ID NO: 685961 - DNA, 25 bp, Mus musculus
gtcccagaggatacttctggtcttt

SEQ ID NO: 685962 - DNA, 25 bp, Mus musculus
gtcccagaggattcttctggtcttt

SEQ ID NO: 685963 - DNA, 25 bp, Mus musculus
gtcccagataggatctttactccac

SEQ ID NO: 685964 - DNA, 25 bp, Mus musculus
gtcccagataggttctttactccac

SEQ ID NO: 685965 - DNA, 25 bp, Mus musculus
gtcccagatatcacagggtgacctt

SEQ ID NO: 685966 - DNA, 25 bp, Mus musculus
gtcccagatatctcagggtgacctt

SEQ ID NO: 685967 - DNA, 25 bp, Mus musculus
gtcccagatccacggtttgatcagc

SEQ ID NO: 685968 - DNA, 25 bp, Mus musculus
gtcccagatccagggtttgatcagc

SEQ ID NO: 685969 - DNA, 25 bp, Mus musculus
gtcccagattctagcgatattcatt

SEQ ID NO: 685970 - DNA, 25 bp, Mus musculus
gtcccagattcttgcgatattcatt

SEQ ID NO: 685971 - DNA, 25 bp, Mus musculus
gtcccagattgtcttcatctacttc

SEQ ID NO: 685972 - DNA, 25 bp, Mus musculus
gtcccagattgtgttcatctacttc

SEQ ID NO: 685973 - DNA, 25 bp, Mus musculus
gtcccagcaactagtgcttgcatta

SEQ ID NO: 685974 - DNA, 25 bp, Mus musculus
gtcccagcaacttgtgcttgcatta

SEQ ID NO: 685975 - DNA, 25 bp, Mus musculus
gtcccagcagctagaatattaggca

SEQ ID NO: 685976 - DNA, 25 bp, Mus musculus
gtcccagcagcttgaatattaggca

SEQ ID NO: 685977 - DNA, 25 bp, Mus musculus
gtcccagccaataactgcacgaaga

SEQ ID NO: 685978 - DNA, 25 bp, Mus musculus
gtcccagccaattactgcacgaaga

SEQ ID NO: 685979 - DNA, 25 bp, Mus musculus
gtcccagccaggagtgtggaagcct

SEQ ID NO: 685980 - DNA, 25 bp, Mus musculus
gtcccagccaggtgtgtggaagcct

SEQ ID NO: 685981 - DNA, 25 bp, Mus musculus
gtcccagcccagagtcagagttgag

SEQ ID NO: 685982 - DNA, 25 bp, Mus musculus
gtcccagcccagtgtcagagttgag

SEQ ID NO: 685983 - DNA, 25 bp, Mus musculus
gtcccagccgagctcagcaaacaga

SEQ ID NO: 685984 - DNA, 25 bp, Mus musculus
gtcccagccgaggtcagcaaacaga

SEQ ID NO: 685985 - DNA, 25 bp, Mus musculus
gtcccagcctataacacatgtagca

SEQ ID NO: 685986 - DNA, 25 bp, Mus musculus
gtcccagcctattacacatgtagca

SEQ ID NO: 685987 - DNA, 25 bp, Mus musculus
gtcccagcgtcacagctgaaggttt

SEQ ID NO: 685988 - DNA, 25 bp, Mus musculus
gtcccagcgtcagagctgaaggttt

SEQ ID NO: 685989 - DNA, 25 bp, Mus musculus
gtcccagctaacaccaaacttgatg

SEQ ID NO: 685990 - DNA, 25 bp, Mus musculus
gtcccagctaactccaaacttgatg

SEQ ID NO: 685991 - DNA, 25 bp, Mus musculus
gtcccagctaatcgtgtctgagcat

SEQ ID NO: 685992 - DNA, 25 bp, Mus musculus
gtcccagctaatggtgtctgagcat

SEQ ID NO: 685993 - DNA, 25 bp, Mus musculus
gtcccagctccaatttaccatatga

SEQ ID NO: 685994 - DNA, 25 bp, Mus musculus
gtcccagctccattttaccatatga

SEQ ID NO: 685995 - DNA, 25 bp, Mus musculus
gtcccagctctgaaaggagtacatt

SEQ ID NO: 685996 - DNA, 25 bp, Mus musculus
gtcccagctctgtaaggagtacatt

SEQ ID NO: 685997 - DNA, 25 bp, Mus musculus
gtcccagctgccatgttctaaagag

SEQ ID NO: 685998 - DNA, 25 bp, Mus musculus
gtcccagctgccttgttctaaagag

SEQ ID NO: 685999 - DNA, 25 bp, Mus musculus
gtcccagctgggacttagagtatct

SEQ ID NO: 686000 - DNA, 25 bp, Mus musculus
gtcccagctgggtcttagagtatct

SEQ ID NO: 686001 - DNA, 25 bp, Mus musculus
gtcccagctgtcatttcacttaaaa

SEQ ID NO: 686002 - DNA, 25 bp, Mus musculus
gtcccagctgtcttttcacttaaaa

SEQ ID NO: 686003 - DNA, 25 bp, Mus musculus
gtcccagctgtgattctaaggcaag

SEQ ID NO: 686004 - DNA, 25 bp, Mus musculus
gtcccagctgtgtttctaaggcaag

SEQ ID NO: 686005 - DNA, 25 bp, Mus musculus
gtcccagcttcgaatttatgtggca

SEQ ID NO: 686006 - DNA, 25 bp, Mus musculus
gtcccagcttcgtatttatgtggca

SEQ ID NO: 686007 - DNA, 25 bp, Mus musculus
gtcccaggaatgacatggtgcctca

SEQ ID NO: 686008 - DNA, 25 bp, Mus musculus
gtcccaggaatgtcatggtgcctca

SEQ ID NO: 686009 - DNA, 25 bp, Mus musculus
gtcccaggacagcagttctgaattc

SEQ ID NO: 686010 - DNA, 25 bp, Mus musculus
gtcccaggacaggagttctgaattc

SEQ ID NO: 686011 - DNA, 25 bp, Mus musculus
gtcccaggacataaaactctgacgt

SEQ ID NO: 686012 - DNA, 25 bp, Mus musculus
gtcccaggacattaaactctgacgt

SEQ ID NO: 686013 - DNA, 25 bp, Mus musculus
gtcccaggacgtccgactgcaaagt

SEQ ID NO: 686014 - DNA, 25 bp, Mus musculus
gtcccaggacgtgcgactgcaaagt

SEQ ID NO: 686015 - DNA, 25 bp, Mus musculus
gtcccaggagccaaggtctgcaaga

SEQ ID NO: 686016 - DNA, 25 bp, Mus musculus
gtcccaggagcctaggtctgcaaga

SEQ ID NO: 686017 - DNA, 25 bp, Mus musculus
gtcccaggatggaactgacctgcca

SEQ ID NO: 686018 - DNA, 25 bp, Mus musculus
gtcccaggatggtactgacctgcca

SEQ ID NO: 686019 - DNA, 25 bp, Mus musculus
gtcccaggcaggacatattttcctg

SEQ ID NO: 686020 - DNA, 25 bp, Mus musculus
gtcccaggcaggtcatattttcctg

SEQ ID NO: 686021 - DNA, 25 bp, Mus musculus
gtcccaggcggaattcttccaggaa

SEQ ID NO: 686022 - DNA, 25 bp, Mus musculus
gtcccaggcggatttcttccaggaa

SEQ ID NO: 686023 - DNA, 25 bp, Mus musculus
gtcccaggctccaagcatagtattt

SEQ ID NO: 686024 - DNA, 25 bp, Mus musculus
gtcccaggctcctagcatagtattt

SEQ ID NO: 686025 - DNA, 25 bp, Mus musculus
gtcccaggctctagttaaggtttgc

SEQ ID NO: 686026 - DNA, 25 bp, Mus musculus
gtcccaggctcttgttaaggtttgc

SEQ ID NO: 686027 - DNA, 25 bp, Mus musculus
gtcccagggaatactataccctctg

SEQ ID NO: 686028 - DNA, 25 bp, Mus musculus
gtcccagggaattctataccctctg

SEQ ID NO: 686029 - DNA, 25 bp, Mus musculus
gtcccagggtatagagtgccctctt

SEQ ID NO: 686030 - DNA, 25 bp, Mus musculus
gtcccagggtattgagtgccctctt

SEQ ID NO: 686031 - DNA, 25 bp, Mus musculus
gtcccagggtctaagatgctttcca

SEQ ID NO: 686032 - DNA, 25 bp, Mus musculus
gtcccagggtcttagatgctttcca

SEQ ID NO: 686033 - DNA, 25 bp, Mus musculus
gtcccaggttacagcagatgccaag

SEQ ID NO: 686034 - DNA, 25 bp, Mus musculus
gtcccaggttactgcagatgccaag

SEQ ID NO: 686035 - DNA, 25 bp, Mus musculus
gtcccaggttgaaaagcctgaggct

SEQ ID NO: 686036 - DNA, 25 bp, Mus musculus
gtcccaggttgataagcctgaggct

SEQ ID NO: 686037 - DNA, 25 bp, Mus musculus
gtcccaggtttacaagccatgccta

SEQ ID NO: 686038 - DNA, 25 bp, Mus musculus
gtcccaggtttagaagccatgccta

SEQ ID NO: 686039 - DNA, 25 bp, Mus musculus
gtcccagtacaaatggctgccagtt

SEQ ID NO: 686040 - DNA, 25 bp, Mus musculus
gtcccagtacaattggctgccagtt

SEQ ID NO: 686041 - DNA, 25 bp, Mus musculus
gtcccagtactcacaaaggcaggca

SEQ ID NO: 686042 - DNA, 25 bp, Mus musculus
gtcccagtactctcaaaggcaggca

SEQ ID NO: 686043 - DNA, 25 bp, Mus musculus
gtcccagtacttcacacggaggtca

SEQ ID NO: 686044 - DNA, 25 bp, Mus musculus
gtcccagtacttgacacggaggtca

SEQ ID NO: 686045 - DNA, 25 bp, Mus musculus
gtcccagtaggacatgatgtgtaac

SEQ ID NO: 686046 - DNA, 25 bp, Mus musculus
gtcccagtaggagatgatgtgtaac

SEQ ID NO: 686047 - DNA, 25 bp, Mus musculus
gtcccagtatgactgagtggcctta

SEQ ID NO: 686048 - DNA, 25 bp, Mus musculus
gtcccagtatgagtgagtggcctta

SEQ ID NO: 686049 - DNA, 25 bp, Mus musculus
gtcccagtccgaccagcagaggaga

SEQ ID NO: 686050 - DNA, 25 bp, Mus musculus
gtcccagtccgagcagcagaggaga

SEQ ID NO: 686051 - DNA, 25 bp, Mus musculus
gtcccagtctgaacgcgtagtggaa

SEQ ID NO: 686052 - DNA, 25 bp, Mus musculus
gtcccagtctgatcgcgtagtggaa

SEQ ID NO: 686053 - DNA, 25 bp, Mus musculus
gtcccagtgacgagtctgtgtgtga

SEQ ID NO: 686054 - DNA, 25 bp, Mus musculus
gtcccagtgacgtgtctgtgtgtga

SEQ ID NO: 686055 - DNA, 25 bp, Mus musculus
gtcccagtgaggagccacgattgat

SEQ ID NO: 686056 - DNA, 25 bp, Mus musculus
gtcccagtgaggtgccacgattgat

SEQ ID NO: 686057 - DNA, 25 bp, Mus musculus
gtcccagtgatcattctcgacaatg

SEQ ID NO: 686058 - DNA, 25 bp, Mus musculus
gtcccagtgatctttctcgacaatg

SEQ ID NO: 686059 - DNA, 25 bp, Mus musculus
gtcccagtggccaaggctgagcaca

SEQ ID NO: 686060 - DNA, 25 bp, Mus musculus
gtcccagtggcctaggctgagcaca

SEQ ID NO: 686061 - DNA, 25 bp, Mus musculus
gtcccagtgtccatgcgagcaggct

SEQ ID NO: 686062 - DNA, 25 bp, Mus musculus
gtcccagtgtccttgcgagcaggct

SEQ ID NO: 686063 - DNA, 25 bp, Mus musculus
gtcccagtgtgtccatggctacaca

SEQ ID NO: 686064 - DNA, 25 bp, Mus musculus
gtcccagtgtgtgcatggctacaca

SEQ ID NO: 686065 - DNA, 25 bp, Mus musculus
gtcccagttgtcctcttattgatta

SEQ ID NO: 686066 - DNA, 25 bp, Mus musculus
gtcccagttgtcctgaaagctctta

SEQ ID NO: 686067 - DNA, 25 bp, Mus musculus
gtcccagttgtcgtcttattgatta

SEQ ID NO: 686068 - DNA, 25 bp, Mus musculus
gtcccagttgtcgtgaaagctctta

SEQ ID NO: 686069 - DNA, 25 bp, Mus musculus
gtcccagtttgaaatcctcaaggca

SEQ ID NO: 686070 - DNA, 25 bp, Mus musculus
gtcccagtttgatatcctcaaggca

SEQ ID NO: 686071 - DNA, 25 bp, Mus musculus
gtcccataacaccttatagctcatt

SEQ ID NO: 686072 - DNA, 25 bp, Mus musculus
gtcccataacacgttatagctcatt

SEQ ID NO: 686073 - DNA, 25 bp, Mus musculus
gtcccataccccatatttgaaaatg

SEQ ID NO: 686074 - DNA, 25 bp, Mus musculus
gtcccataccccttatttgaaaatg

SEQ ID NO: 686075 - DNA, 25 bp, Mus musculus
gtcccatagataaggcctgtgtgct

SEQ ID NO: 686076 - DNA, 25 bp, Mus musculus
gtcccatagatatggcctgtgtgct

SEQ ID NO: 686077 - DNA, 25 bp, Mus musculus
gtcccatcacatcccattttatgta

SEQ ID NO: 686078 - DNA, 25 bp, Mus musculus
gtcccatcacatgccattttatgta

SEQ ID NO: 686079 - DNA, 25 bp, Mus musculus
gtcccatcagtaacagttcctaaca

SEQ ID NO: 686080 - DNA, 25 bp, Mus musculus
gtcccatcagtatcagttcctaaca

SEQ ID NO: 686081 - DNA, 25 bp, Mus musculus
gtcccatcagtcaccagctgtagaa

SEQ ID NO: 686082 - DNA, 25 bp, Mus musculus
gtcccatcagtctccagctgtagaa

SEQ ID NO: 686083 - DNA, 25 bp, Mus musculus
gtcccatcataaacagtaccacatt

SEQ ID NO: 686084 - DNA, 25 bp, Mus musculus
gtcccatcataatcagtaccacatt

SEQ ID NO: 686085 - DNA, 25 bp, Mus musculus
gtcccatcatccagtgctgaggaca

SEQ ID NO: 686086 - DNA, 25 bp, Mus musculus
gtcccatcatcctgtgctgaggaca

SEQ ID NO: 686087 - DNA, 25 bp, Mus musculus
gtcccatccctacttagagatctgt

SEQ ID NO: 686088 - DNA, 25 bp, Mus musculus
gtcccatccctagttagagatctgt

SEQ ID NO: 686089 - DNA, 25 bp, Mus musculus
gtcccatccctgaggtttgtgacca

SEQ ID NO: 686090 - DNA, 25 bp, Mus musculus
gtcccatccctgtggtttgtgacca

SEQ ID NO: 686091 - DNA, 25 bp, Mus musculus
gtcccatcgatcactgtacattttt

SEQ ID NO: 686092 - DNA, 25 bp, Mus musculus
gtcccatcgatctctgtacattttt

SEQ ID NO: 686093 - DNA, 25 bp, Mus musculus
gtcccatcgcatctgggttttacag

SEQ ID NO: 686094 - DNA, 25 bp, Mus musculus
gtcccatcgcatgtgggttttacag

SEQ ID NO: 686095 - DNA, 25 bp, Mus musculus
gtcccatcgtatcaaactttctata

SEQ ID NO: 686096 - DNA, 25 bp, Mus musculus
gtcccatcgtatgaaactttctata

SEQ ID NO: 686097 - DNA, 25 bp, Mus musculus
gtcccatctcagattgcaaaaagca

SEQ ID NO: 686098 - DNA, 25 bp, Mus musculus
gtcccatctcagtttgcaaaaagca

SEQ ID NO: 686099 - DNA, 25 bp, Mus musculus
gtcccatctgagatgctttgtttct

SEQ ID NO: 686100 - DNA, 25 bp, Mus musculus
gtcccatctgagttgctttgtttct

SEQ ID NO: 686101 - DNA, 25 bp, Mus musculus
gtcccatctggacgtttagctgtga

SEQ ID NO: 686102 - DNA, 25 bp, Mus musculus
gtcccatctggaggtttagctgtga

SEQ ID NO: 686103 - DNA, 25 bp, Mus musculus
gtcccatcttctccaaatcagtggg

SEQ ID NO: 686104 - DNA, 25 bp, Mus musculus
gtcccatcttctgcaaatcagtggg

SEQ ID NO: 686105 - DNA, 25 bp, Mus musculus
gtcccatgacatactgagctatata

SEQ ID NO: 686106 - DNA, 25 bp, Mus musculus
gtcccatgacattctgagctatata

SEQ ID NO: 686107 - DNA, 25 bp, Mus musculus
gtcccatgcatgataagtatttcac

SEQ ID NO: 686108 - DNA, 25 bp, Mus musculus
gtcccatgcatgttaagtatttcac

SEQ ID NO: 686109 - DNA, 25 bp, Mus musculus
gtcccatgccagctgttagacacat

SEQ ID NO: 686110 - DNA, 25 bp, Mus musculus
gtcccatgccaggtgttagacacat

SEQ ID NO: 686111 - DNA, 25 bp, Mus musculus
gtcccatgccatctgttgagtaggt

SEQ ID NO: 686112 - DNA, 25 bp, Mus musculus
gtcccatgccatgtgttgagtaggt

SEQ ID NO: 686113 - DNA, 25 bp, Mus musculus
gtcccatgccctcgaagtggttcag

SEQ ID NO: 686114 - DNA, 25 bp, Mus musculus
gtcccatgccctggaagtggttcag

SEQ ID NO: 686115 - DNA, 25 bp, Mus musculus
gtcccatgtatacccatgtacatag

SEQ ID NO: 686116 - DNA, 25 bp, Mus musculus
gtcccatgtatagccatgtacatag

SEQ ID NO: 686117 - DNA, 25 bp, Mus musculus
gtcccatgtattcagcagtattcgg

SEQ ID NO: 686118 - DNA, 25 bp, Mus musculus
gtcccatgtattgagcagtattcgg

SEQ ID NO: 686119 - DNA, 25 bp, Mus musculus
gtcccatgtctcaagtgactatgag

SEQ ID NO: 686120 - DNA, 25 bp, Mus musculus
gtcccatgtctctagtgactatgag

SEQ ID NO: 686121 - DNA, 25 bp, Mus musculus
gtcccatgtgctcccagaagccaga

SEQ ID NO: 686122 - DNA, 25 bp, Mus musculus
gtcccatgtgctgccagaagccaga

SEQ ID NO: 686123 - DNA, 25 bp, Mus musculus
gtcccatgtgggacatctgatgagt

SEQ ID NO: 686124 - DNA, 25 bp, Mus musculus
gtcccatgtgggtcatctgatgagt

SEQ ID NO: 686125 - DNA, 25 bp, Mus musculus
gtcccattaaccatctcattaacgg

SEQ ID NO: 686126 - DNA, 25 bp, Mus musculus
gtcccattaaccttctcattaacgg

SEQ ID NO: 686127 - DNA, 25 bp, Mus musculus
gtcccattcaaacggtctgtacact

SEQ ID NO: 686128 - DNA, 25 bp, Mus musculus
gtcccattcaaagggtctgtacact

SEQ ID NO: 686129 - DNA, 25 bp, Mus musculus
gtcccattcataacacacacattat

SEQ ID NO: 686130 - DNA, 25 bp, Mus musculus
gtcccattcatatcacacacattat

SEQ ID NO: 686131 - DNA, 25 bp, Mus musculus
gtcccattcccacatatatgcactt

SEQ ID NO: 686132 - DNA, 25 bp, Mus musculus
gtcccattcccagatatatgcactt

SEQ ID NO: 686133 - DNA, 25 bp, Mus musculus
gtcccattctagagacagccagaca

SEQ ID NO: 686134 - DNA, 25 bp, Mus musculus
gtcccattctagtgacagccagaca

SEQ ID NO: 686135 - DNA, 25 bp, Mus musculus
gtcccattggctccaagatcagcag

SEQ ID NO: 686136 - DNA, 25 bp, Mus musculus
gtcccattggctgcaagatcagcag

SEQ ID NO: 686137 - DNA, 25 bp, Mus musculus
gtcccattgtttcacacccagtgta

SEQ ID NO: 686138 - DNA, 25 bp, Mus musculus
gtcccattgtttgacacccagtgta

SEQ ID NO: 686139 - DNA, 25 bp, Mus musculus
gtcccatttacaactgagcactttg

SEQ ID NO: 686140 - DNA, 25 bp, Mus musculus
gtcccatttacatctgagcactttg

SEQ ID NO: 686141 - DNA, 25 bp, Mus musculus
gtcccatttatgagttctcttcttt

SEQ ID NO: 686142 - DNA, 25 bp, Mus musculus
gtcccatttatgtgttctcttcttt

SEQ ID NO: 686143 - DNA, 25 bp, Mus musculus
gtcccatttcttaaaccgtatcttg

SEQ ID NO: 686144 - DNA, 25 bp, Mus musculus
gtcccatttctttaaccgtatcttg

SEQ ID NO: 686145 - DNA, 25 bp, Mus musculus
gtccccaaactgcatcagcctttag

SEQ ID NO: 686146 - DNA, 25 bp, Mus musculus
gtccccaaactggatcagcctttag

SEQ ID NO: 686147 - DNA, 25 bp, Mus musculus
gtccccaaaggtcaacagtagtcga

SEQ ID NO: 686148 - DNA, 25 bp, Mus musculus
gtccccaaaggtgaacagtagtcga

SEQ ID NO: 686149 - DNA, 25 bp, Mus musculus
gtccccaaatccaagaaacctctgt

SEQ ID NO: 686150 - DNA, 25 bp, Mus musculus
gtccccaaatcctagaaacctctgt

SEQ ID NO: 686151 - DNA, 25 bp, Mus musculus
gtccccaacactacacattgtgtgt

SEQ ID NO: 686152 - DNA, 25 bp, Mus musculus
gtccccaacacttcacattgtgtgt

SEQ ID NO: 686153 - DNA, 25 bp, Mus musculus
gtccccaacagcatcattcagttga

SEQ ID NO: 686154 - DNA, 25 bp, Mus musculus
gtccccaacagcttcattcagttga

SEQ ID NO: 686155 - DNA, 25 bp, Mus musculus
gtccccaactgtaagaatttctctt

SEQ ID NO: 686156 - DNA, 25 bp, Mus musculus
gtccccaactgttagaatttctctt

SEQ ID NO: 686157 - DNA, 25 bp, Mus musculus
gtccccaagagacactgcattgagt

SEQ ID NO: 686158 - DNA, 25 bp, Mus musculus
gtccccaagagagactgcattgagt

SEQ ID NO: 686159 - DNA, 25 bp, Mus musculus
gtccccaagccaacgggattcggtg

SEQ ID NO: 686160 - DNA, 25 bp, Mus musculus
gtccccaagccatcgggattcggtg

SEQ ID NO: 686161 - DNA, 25 bp, Mus musculus
gtccccaagggaaacaggctggcct

SEQ ID NO: 686162 - DNA, 25 bp, Mus musculus
gtccccaagggatacaggctggcct

SEQ ID NO: 686163 - DNA, 25 bp, Mus musculus
gtccccaagtcactgagtagccagg

SEQ ID NO: 686164 - DNA, 25 bp, Mus musculus
gtccccaagtcagtgagtagccagg

SEQ ID NO: 686165 - DNA, 25 bp, Mus musculus
gtccccaatcccctatagtgataat

SEQ ID NO: 686166 - DNA, 25 bp, Mus musculus
gtccccaatcccgtatagtgataat

SEQ ID NO: 686167 - DNA, 25 bp, Mus musculus
gtccccaatgtgaccactgtaacca

SEQ ID NO: 686168 - DNA, 25 bp, Mus musculus
gtccccaatgtgtccactgtaacca

SEQ ID NO: 686169 - DNA, 25 bp, Mus musculus
gtccccacacatcttgccagatatg

SEQ ID NO: 686170 - DNA, 25 bp, Mus musculus
gtccccacacatgttgccagatatg

SEQ ID NO: 686171 - DNA, 25 bp, Mus musculus
gtccccacagatattggattcagga

SEQ ID NO: 686172 - DNA, 25 bp, Mus musculus
gtccccacagattttggattcagga

SEQ ID NO: 686173 - DNA, 25 bp, Mus musculus
gtccccaccactcagaaataacaga

SEQ ID NO: 686174 - DNA, 25 bp, Mus musculus
gtccccaccactgagaaataacaga

SEQ ID NO: 686175 - DNA, 25 bp, Mus musculus
gtccccaccatcagagcacatgtaa

SEQ ID NO: 686176 - DNA, 25 bp, Mus musculus
gtccccaccatctgagcacatgtaa

SEQ ID NO: 686177 - DNA, 25 bp, Mus musculus
gtccccacgtggctgaagttgacgt

SEQ ID NO: 686178 - DNA, 25 bp, Mus musculus
gtccccacgtgggtgaagttgacgt

SEQ ID NO: 686179 - DNA, 25 bp, Mus musculus
gtccccacgtgtccttggaattaga

SEQ ID NO: 686180 - DNA, 25 bp, Mus musculus
gtccccacgtgtgcttggaattaga

SEQ ID NO: 686181 - DNA, 25 bp, Mus musculus
gtccccactactaggcatctgttgg

SEQ ID NO: 686182 - DNA, 25 bp, Mus musculus
gtccccactacttggcatctgttgg

SEQ ID NO: 686183 - DNA, 25 bp, Mus musculus
gtccccactctgaagtcatgcaaaa

SEQ ID NO: 686184 - DNA, 25 bp, Mus musculus
gtccccactctgctttgggatagta

SEQ ID NO: 686185 - DNA, 25 bp, Mus musculus
gtccccactctggtttgggatagta

SEQ ID NO: 686186 - DNA, 25 bp, Mus musculus
gtccccactctgtagtcatgcaaaa

SEQ ID NO: 686187 - DNA, 25 bp, Mus musculus
gtccccactgatcgagactggtgac

SEQ ID NO: 686188 - DNA, 25 bp, Mus musculus
gtccccactgatggagactggtgac

SEQ ID NO: 686189 - DNA, 25 bp, Mus musculus
gtccccagaaatagctaaaacaaca

SEQ ID NO: 686190 - DNA, 25 bp, Mus musculus
gtccccagaaattgctaaaacaaca

SEQ ID NO: 686191 - DNA, 25 bp, Mus musculus
gtccccagaacacagaaactaccta

SEQ ID NO: 686192 - DNA, 25 bp, Mus musculus
gtccccagaacagagaaactaccta

SEQ ID NO: 686193 - DNA, 25 bp, Mus musculus
gtccccagaactccagatgaataag

SEQ ID NO: 686194 - DNA, 25 bp, Mus musculus
gtccccagaactgcagatgaataag

SEQ ID NO: 686195 - DNA, 25 bp, Mus musculus
gtccccagacgcacacagtggtaag

SEQ ID NO: 686196 - DNA, 25 bp, Mus musculus
gtccccagacgctcacagtggtaag

SEQ ID NO: 686197 - DNA, 25 bp, Mus musculus
gtccccagacttatgatttgcacta

SEQ ID NO: 686198 - DNA, 25 bp, Mus musculus
gtccccagacttttgatttgcacta

SEQ ID NO: 686199 - DNA, 25 bp, Mus musculus
gtccccagagacaatataacccatt

SEQ ID NO: 686200 - DNA, 25 bp, Mus musculus
gtccccagagactatataacccatt

SEQ ID NO: 686201 - DNA, 25 bp, Mus musculus
gtccccagagagaggctatacactg

SEQ ID NO: 686202 - DNA, 25 bp, Mus musculus
gtccccagagagtggctatacactg

SEQ ID NO: 686203 - DNA, 25 bp, Mus musculus
gtccccagcaggattcttgttcaaa

SEQ ID NO: 686204 - DNA, 25 bp, Mus musculus
gtccccagcaggtttcttgttcaaa

SEQ ID NO: 686205 - DNA, 25 bp, Mus musculus
gtccccagccagctctaacaagaag

SEQ ID NO: 686206 - DNA, 25 bp, Mus musculus
gtccccagccaggtctaacaagaag

SEQ ID NO: 686207 - DNA, 25 bp, Mus musculus
gtccccagctcacaggttcagaaca

SEQ ID NO: 686208 - DNA, 25 bp, Mus musculus
gtccccagctcagaggttcagaaca

SEQ ID NO: 686209 - DNA, 25 bp, Mus musculus
gtccccagcttgagtattgtggtca

SEQ ID NO: 686210 - DNA, 25 bp, Mus musculus
gtccccagcttgtgtattgtggtca

SEQ ID NO: 686211 - DNA, 25 bp, Mus musculus
gtccccaggctactttctcaaaatg

SEQ ID NO: 686212 - DNA, 25 bp, Mus musculus
gtccccaggctagtttctcaaaatg

SEQ ID NO: 686213 - DNA, 25 bp, Mus musculus
gtccccagtactcagaaatccagca

SEQ ID NO: 686214 - DNA, 25 bp, Mus musculus
gtccccagtactgagaaatccagca

SEQ ID NO: 686215 - DNA, 25 bp, Mus musculus
gtccccagtcagagacccgacacgg

SEQ ID NO: 686216 - DNA, 25 bp, Mus musculus
gtccccagtcagtgacccgacacgg

SEQ ID NO: 686217 - DNA, 25 bp, Mus musculus
gtccccagtgtcagacttgctaaat

SEQ ID NO: 686218 - DNA, 25 bp, Mus musculus
gtccccagtgtctgacttgctaaat

SEQ ID NO: 686219 - DNA, 25 bp, Mus musculus
gtccccagtgtgatgaaagctcagt

SEQ ID NO: 686220 - DNA, 25 bp, Mus musculus
gtccccagtgtgttgaaagctcagt

SEQ ID NO: 686221 - DNA, 25 bp, Mus musculus
gtccccatgcttatgtaatcttaca

SEQ ID NO: 686222 - DNA, 25 bp, Mus musculus
gtccccatgcttttgtaatcttaca

SEQ ID NO: 686223 - DNA, 25 bp, Mus musculus
gtccccatgtgtagcctgagtaaga

SEQ ID NO: 686224 - DNA, 25 bp, Mus musculus
gtccccatgtgtcactgattagata

SEQ ID NO: 686225 - DNA, 25 bp, Mus musculus
gtccccatgtgtgactgattagata

SEQ ID NO: 686226 - DNA, 25 bp, Mus musculus
gtccccatgtgttgcctgagtaaga

SEQ ID NO: 686227 - DNA, 25 bp, Mus musculus
gtccccattcatactctgaacaaaa

SEQ ID NO: 686228 - DNA, 25 bp, Mus musculus
gtccccattcattctctgaacaaaa

SEQ ID NO: 686229 - DNA, 25 bp, Mus musculus
gtccccattcgactgttaccgaagt

SEQ ID NO: 686230 - DNA, 25 bp, Mus musculus
gtccccattcgagtgttaccgaagt

SEQ ID NO: 686231 - DNA, 25 bp, Mus musculus
gtccccattctacggtggtcaggtt

SEQ ID NO: 686232 - DNA, 25 bp, Mus musculus
gtccccattctagggtggtcaggtt

SEQ ID NO: 686233 - DNA, 25 bp, Mus musculus
gtccccattgctctaatcataactg

SEQ ID NO: 686234 - DNA, 25 bp, Mus musculus
gtccccattgctgtaatcataactg

SEQ ID NO: 686235 - DNA, 25 bp, Mus musculus
gtccccattgggataagcaaatcaa

SEQ ID NO: 686236 - DNA, 25 bp, Mus musculus
gtccccattgggttaagcaaatcaa

SEQ ID NO: 686237 - DNA, 25 bp, Mus musculus
gtccccattttcactggtagtgaat

SEQ ID NO: 686238 - DNA, 25 bp, Mus musculus
gtccccattttctctggtagtgaat

SEQ ID NO: 686239 - DNA, 25 bp, Mus musculus
gtccccctgctcagcgggcagtgag

SEQ ID NO: 686240 - DNA, 25 bp, Mus musculus
gtccccctgctctgcgggcagtgag

SEQ ID NO: 686241 - DNA, 25 bp, Mus musculus
gtccccgaccaaagaccacgtggat

SEQ ID NO: 686242 - DNA, 25 bp, Mus musculus
gtccccgaccaatgaccacgtggat

SEQ ID NO: 686243 - DNA, 25 bp, Mus musculus
gtccccgaccaccatgagaactgag

SEQ ID NO: 686244 - DNA, 25 bp, Mus musculus
gtccccgaccacgatgagaactgag

SEQ ID NO: 686245 - DNA, 25 bp, Mus musculus
gtccccgcaggacgccaggttgttc

SEQ ID NO: 686246 - DNA, 25 bp, Mus musculus
gtccccgcaggaggccaggttgttc

SEQ ID NO: 686247 - DNA, 25 bp, Mus musculus
gtccccgcgctcctagaaagtgaag

SEQ ID NO: 686248 - DNA, 25 bp, Mus musculus
gtccccgcgctcgtagaaagtgaag

SEQ ID NO: 686249 - DNA, 25 bp, Mus musculus
gtccccgcggtacctgaagaagtat

SEQ ID NO: 686250 - DNA, 25 bp, Mus musculus
gtccccgcggtagctgaagaagtat

SEQ ID NO: 686251 - DNA, 25 bp, Mus musculus
gtccccgcgttcatattgcaacttt

SEQ ID NO: 686252 - DNA, 25 bp, Mus musculus
gtccccgcgttcttattgcaacttt

SEQ ID NO: 686253 - DNA, 25 bp, Mus musculus
gtccccggagccaggtgagtcatct

SEQ ID NO: 686254 - DNA, 25 bp, Mus musculus
gtccccggagcctggtgagtcatct

SEQ ID NO: 686255 - DNA, 25 bp, Mus musculus
gtccccggatctatctgggagcagt

SEQ ID NO: 686256 - DNA, 25 bp, Mus musculus
gtccccggatctttctgggagcagt

SEQ ID NO: 686257 - DNA, 25 bp, Mus musculus
gtccccggattcagagtagcatttg

SEQ ID NO: 686258 - DNA, 25 bp, Mus musculus
gtccccggattctgagtagcatttg

SEQ ID NO: 686259 - DNA, 25 bp, Mus musculus
gtccccggcttacttgacattaatt

SEQ ID NO: 686260 - DNA, 25 bp, Mus musculus
gtccccggcttagttgacattaatt

SEQ ID NO: 686261 - DNA, 25 bp, Mus musculus
gtccccgggaaccaagaaggcacag

SEQ ID NO: 686262 - DNA, 25 bp, Mus musculus
gtccccgggaacgaagaaggcacag

SEQ ID NO: 686263 - DNA, 25 bp, Mus musculus
gtccccgtagatcctagtgtagttt

SEQ ID NO: 686264 - DNA, 25 bp, Mus musculus
gtccccgtagatgctagtgtagttt

SEQ ID NO: 686265 - DNA, 25 bp, Mus musculus
gtccccgtattcagtgtgcagtgtg

SEQ ID NO: 686266 - DNA, 25 bp, Mus musculus
gtccccgtattctgtgtgcagtgtg

SEQ ID NO: 686267 - DNA, 25 bp, Mus musculus
gtccccgtggcgaatatcccaggaa

SEQ ID NO: 686268 - DNA, 25 bp, Mus musculus
gtccccgtggcgtatatcccaggaa

SEQ ID NO: 686269 - DNA, 25 bp, Mus musculus
gtccccgtgggaatctaccagaaag

SEQ ID NO: 686270 - DNA, 25 bp, Mus musculus
gtccccgtgggattctaccagaaag

SEQ ID NO: 686271 - DNA, 25 bp, Mus musculus
gtccccgttgtccagagttacagaa

SEQ ID NO: 686272 - DNA, 25 bp, Mus musculus
gtccccgttgtcgagagttacagaa

SEQ ID NO: 686273 - DNA, 25 bp, Mus musculus
gtccccgttttgaacctagatgacg

SEQ ID NO: 686274 - DNA, 25 bp, Mus musculus
gtccccgttttgtacctagatgacg

SEQ ID NO: 686275 - DNA, 25 bp, Mus musculus
gtcccctaacacaggagcaggagat

SEQ ID NO: 686276 - DNA, 25 bp, Mus musculus
gtcccctaacactggagcaggagat

SEQ ID NO: 686277 - DNA, 25 bp, Mus musculus
gtcccctaaggtcttgctgaggcta

SEQ ID NO: 686278 - DNA, 25 bp, Mus musculus
gtcccctaaggtgttgctgaggcta

SEQ ID NO: 686279 - DNA, 25 bp, Mus musculus
gtcccctaagttattacctctcttg

SEQ ID NO: 686280 - DNA, 25 bp, Mus musculus
gtcccctaagtttttacctctcttg

SEQ ID NO: 686281 - DNA, 25 bp, Mus musculus
gtcccctagccgagttacagtagtg

SEQ ID NO: 686282 - DNA, 25 bp, Mus musculus
gtcccctagccgtgttacagtagtg

SEQ ID NO: 686283 - DNA, 25 bp, Mus musculus
gtcccctagtccagttgggtcacat

SEQ ID NO: 686284 - DNA, 25 bp, Mus musculus
gtcccctagtcctgttgggtcacat

SEQ ID NO: 686285 - DNA, 25 bp, Mus musculus
gtcccctatgtcctctcaagagtgt

SEQ ID NO: 686286 - DNA, 25 bp, Mus musculus
gtcccctatgtcgtctcaagagtgt

SEQ ID NO: 686287 - DNA, 25 bp, Mus musculus
gtcccctcagttaagtgtcatcaga

SEQ ID NO: 686288 - DNA, 25 bp, Mus musculus
gtcccctcagtttagtgtcatcaga

SEQ ID NO: 686289 - DNA, 25 bp, Mus musculus
gtcccctccgtactgggtggattat

SEQ ID NO: 686290 - DNA, 25 bp, Mus musculus
gtcccctccgtagtgggtggattat

SEQ ID NO: 686291 - DNA, 25 bp, Mus musculus
gtcccctccgtgcaagtgtacatag

SEQ ID NO: 686292 - DNA, 25 bp, Mus musculus
gtcccctccgtggaagtgtacatag

SEQ ID NO: 686293 - DNA, 25 bp, Mus musculus
gtcccctcctacagagggactgtgt

SEQ ID NO: 686294 - DNA, 25 bp, Mus musculus
gtcccctcctactgagggactgtgt

SEQ ID NO: 686295 - DNA, 25 bp, Mus musculus
gtcccctcctgtaaagattgcatcg

SEQ ID NO: 686296 - DNA, 25 bp, Mus musculus
gtcccctcctgttaagattgcatcg

SEQ ID NO: 686297 - DNA, 25 bp, Mus musculus
gtcccctcgttcaggtgaacgttgg

SEQ ID NO: 686298 - DNA, 25 bp, Mus musculus
gtcccctcgttctggtgaacgttgg

SEQ ID NO: 686299 - DNA, 25 bp, Mus musculus
gtcccctctataaatctccatatga

SEQ ID NO: 686300 - DNA, 25 bp, Mus musculus
gtcccctctatatatctccatatga

SEQ ID NO: 686301 - DNA, 25 bp, Mus musculus
gtcccctctctgatacctaaaatat

SEQ ID NO: 686302 - DNA, 25 bp, Mus musculus
gtcccctctctgttacctaaaatat

SEQ ID NO: 686303 - DNA, 25 bp, Mus musculus
gtcccctctcttcaatactagacta

SEQ ID NO: 686304 - DNA, 25 bp, Mus musculus
gtcccctctcttgaatactagacta

SEQ ID NO: 686305 - DNA, 25 bp, Mus musculus
gtcccctgactactttgcaatgaga

SEQ ID NO: 686306 - DNA, 25 bp, Mus musculus
gtcccctgactagtttgcaatgaga

SEQ ID NO: 686307 - DNA, 25 bp, Mus musculus
gtcccctgaggaagtgcaagagtat

SEQ ID NO: 686308 - DNA, 25 bp, Mus musculus
gtcccctgaggacccattcaatcaa

SEQ ID NO: 686309 - DNA, 25 bp, Mus musculus
gtcccctgaggagccattcaatcaa

SEQ ID NO: 686310 - DNA, 25 bp, Mus musculus
gtcccctgaggatgtgcaagagtat

SEQ ID NO: 686311 - DNA, 25 bp, Mus musculus
gtcccctgatgacggtgggtcggta

SEQ ID NO: 686312 - DNA, 25 bp, Mus musculus
gtcccctgatgagggtgggtcggta

SEQ ID NO: 686313 - DNA, 25 bp, Mus musculus
gtcccctgcaagatccatgtaagga

SEQ ID NO: 686314 - DNA, 25 bp, Mus musculus
gtcccctgcaagttccatgtaagga

SEQ ID NO: 686315 - DNA, 25 bp, Mus musculus
gtcccctgcaataagaactacagac

SEQ ID NO: 686316 - DNA, 25 bp, Mus musculus
gtcccctgcaattagaactacagac

SEQ ID NO: 686317 - DNA, 25 bp, Mus musculus
gtcccctgccatactttggagaggt

SEQ ID NO: 686318 - DNA, 25 bp, Mus musculus
gtcccctgccattctttggagaggt

SEQ ID NO: 686319 - DNA, 25 bp, Mus musculus
gtcccctgcctcataggcacagatg

SEQ ID NO: 686320 - DNA, 25 bp, Mus musculus
gtcccctgcctcttaggcacagatg

SEQ ID NO: 686321 - DNA, 25 bp, Mus musculus
gtcccctgctggaggatgataaaat

SEQ ID NO: 686322 - DNA, 25 bp, Mus musculus
gtcccctgctggtggatgataaaat

SEQ ID NO: 686323 - DNA, 25 bp, Mus musculus
gtcccctgggaccatgctgtagaga

SEQ ID NO: 686324 - DNA, 25 bp, Mus musculus
gtcccctgggacgatgctgtagaga

SEQ ID NO: 686325 - DNA, 25 bp, Mus musculus
gtcccctgggtgaccggcatgtcat

SEQ ID NO: 686326 - DNA, 25 bp, Mus musculus
gtcccctgggtgtccggcatgtcat

SEQ ID NO: 686327 - DNA, 25 bp, Mus musculus
gtcccctgtatcatcaaaacgtcaa

SEQ ID NO: 686328 - DNA, 25 bp, Mus musculus
gtcccctgtatcttcaaaacgtcaa

SEQ ID NO: 686329 - DNA, 25 bp, Mus musculus
gtccccttagcccaggatcaggaaa

SEQ ID NO: 686330 - DNA, 25 bp, Mus musculus
gtccccttagccgaggatcaggaaa

SEQ ID NO: 686331 - DNA, 25 bp, Mus musculus
gtccccttatcaaatatcctgctat

SEQ ID NO: 686332 - DNA, 25 bp, Mus musculus
gtccccttatcatatatcctgctat

SEQ ID NO: 686333 - DNA, 25 bp, Mus musculus
gtccccttcaggaaacatctcaagt

SEQ ID NO: 686334 - DNA, 25 bp, Mus musculus
gtccccttcaggtaacatctcaagt

SEQ ID NO: 686335 - DNA, 25 bp, Mus musculus
gtccccttccatagatagatcattc

SEQ ID NO: 686336 - DNA, 25 bp, Mus musculus
gtccccttccattgatagatcattc

SEQ ID NO: 686337 - DNA, 25 bp, Mus musculus
gtccccttctagcttaagcagctgc

SEQ ID NO: 686338 - DNA, 25 bp, Mus musculus
gtccccttctaggttaagcagctgc

SEQ ID NO: 686339 - DNA, 25 bp, Mus musculus
gtccccttctgaacagcaggttgcc

SEQ ID NO: 686340 - DNA, 25 bp, Mus musculus
gtccccttctgatcagcaggttgcc

SEQ ID NO: 686341 - DNA, 25 bp, Mus musculus
gtccccttgacaaccatgaactaga

SEQ ID NO: 686342 - DNA, 25 bp, Mus musculus
gtccccttgacatccatgaactaga

SEQ ID NO: 686343 - DNA, 25 bp, Mus musculus
gtccccttgcaaacagactgctatt

SEQ ID NO: 686344 - DNA, 25 bp, Mus musculus
gtccccttgcaatcagactgctatt

SEQ ID NO: 686345 - DNA, 25 bp, Mus musculus
gtccccttggacagtttcctggccg

SEQ ID NO: 686346 - DNA, 25 bp, Mus musculus
gtccccttggactgtttcctggccg

SEQ ID NO: 686347 - DNA, 25 bp, Mus musculus
gtccccttggcaatgagcacacgat

SEQ ID NO: 686348 - DNA, 25 bp, Mus musculus
gtccccttggcattgagcacacgat

SEQ ID NO: 686349 - DNA, 25 bp, Mus musculus
gtccccttggttagtaaactgcctg

SEQ ID NO: 686350 - DNA, 25 bp, Mus musculus
gtccccttggtttgtaaactgcctg

SEQ ID NO: 686351 - DNA, 25 bp, Mus musculus
gtcccctttaatcattgcaacctaa

SEQ ID NO: 686352 - DNA, 25 bp, Mus musculus
gtcccctttaatgattgcaacctaa

SEQ ID NO: 686353 - DNA, 25 bp, Mus musculus
gtcccctttgagacttcattttgtc

SEQ ID NO: 686354 - DNA, 25 bp, Mus musculus
gtcccctttgagtcttcattttgtc

SEQ ID NO: 686355 - DNA, 25 bp, Mus musculus
gtcccgaattccaaaatcccaattg

SEQ ID NO: 686356 - DNA, 25 bp, Mus musculus
gtcccgaattcctaaatcccaattg

SEQ ID NO: 686357 - DNA, 25 bp, Mus musculus
gtcccgacatggctgttgtgaccta

SEQ ID NO: 686358 - DNA, 25 bp, Mus musculus
gtcccgacatgggtgttgtgaccta

SEQ ID NO: 686359 - DNA, 25 bp, Mus musculus
gtcccgacatgtctctctaagcaga

SEQ ID NO: 686360 - DNA, 25 bp, Mus musculus
gtcccgacatgtgtctctaagcaga

SEQ ID NO: 686361 - DNA, 25 bp, Mus musculus
gtcccgacggtgcaagatccccata

SEQ ID NO: 686362 - DNA, 25 bp, Mus musculus
gtcccgacggtggaagatccccata

SEQ ID NO: 686363 - DNA, 25 bp, Mus musculus
gtcccgagcttgacgaatgcggcat

SEQ ID NO: 686364 - DNA, 25 bp, Mus musculus
gtcccgagcttgtcgaatgcggcat

SEQ ID NO: 686365 - DNA, 25 bp, Mus musculus
gtcccgaggctacggaagcagctcc

SEQ ID NO: 686366 - DNA, 25 bp, Mus musculus
gtcccgaggctagggaagcagctcc

SEQ ID NO: 686367 - DNA, 25 bp, Mus musculus
gtcccgagtcgtcggctgttcctga

SEQ ID NO: 686368 - DNA, 25 bp, Mus musculus
gtcccgagtcgtgggctgttcctga

SEQ ID NO: 686369 - DNA, 25 bp, Mus musculus
gtcccgatagacaagctgagatgct

SEQ ID NO: 686370 - DNA, 25 bp, Mus musculus
gtcccgatagactagctgagatgct

SEQ ID NO: 686371 - DNA, 25 bp, Mus musculus
gtcccgatcaagctagtatactttt

SEQ ID NO: 686372 - DNA, 25 bp, Mus musculus
gtcccgatcaaggtagtatactttt

SEQ ID NO: 686373 - DNA, 25 bp, Mus musculus
gtcccgatcctgaaggcgacactgt

SEQ ID NO: 686374 - DNA, 25 bp, Mus musculus
gtcccgatcctgtaggcgacactgt

SEQ ID NO: 686375 - DNA, 25 bp, Mus musculus
gtcccgatgagaacctgagtgtgag

SEQ ID NO: 686376 - DNA, 25 bp, Mus musculus
gtcccgatgagatcctgagtgtgag

SEQ ID NO: 686377 - DNA, 25 bp, Mus musculus
gtcccgatgctacatatgtctctaa

SEQ ID NO: 686378 - DNA, 25 bp, Mus musculus
gtcccgatgctagatatgtctctaa

SEQ ID NO: 686379 - DNA, 25 bp, Mus musculus
gtcccgatgctgaggaatgaccgaa

SEQ ID NO: 686380 - DNA, 25 bp, Mus musculus
gtcccgatgctgtggaatgaccgaa

SEQ ID NO: 686381 - DNA, 25 bp, Mus musculus
gtcccgatgtctctagtgctggctc

SEQ ID NO: 686382 - DNA, 25 bp, Mus musculus
gtcccgatgtctgtagtgctggctc

SEQ ID NO: 686383 - DNA, 25 bp, Mus musculus
gtcccgcaaaacatgaatgaatctg

SEQ ID NO: 686384 - DNA, 25 bp, Mus musculus
gtcccgcaaaacttgaatgaatctg

SEQ ID NO: 686385 - DNA, 25 bp, Mus musculus
gtcccgcctcaaaactacagcaagt

SEQ ID NO: 686386 - DNA, 25 bp, Mus musculus
gtcccgcctcaatactacagcaagt

SEQ ID NO: 686387 - DNA, 25 bp, Mus musculus
gtcccgcctcatcctggatcttgta

SEQ ID NO: 686388 - DNA, 25 bp, Mus musculus
gtcccgcctcatgctggatcttgta

SEQ ID NO: 686389 - DNA, 25 bp, Mus musculus
gtcccgcctctaagtgttacgaaca

SEQ ID NO: 686390 - DNA, 25 bp, Mus musculus
gtcccgcctctatgtgttacgaaca

SEQ ID NO: 686391 - DNA, 25 bp, Mus musculus
gtcccgctcctgctaattattaaca

SEQ ID NO: 686392 - DNA, 25 bp, Mus musculus
gtcccgctcctggtaattattaaca

SEQ ID NO: 686393 - DNA, 25 bp, Mus musculus
gtcccgctggtgaatactggtctaa

SEQ ID NO: 686394 - DNA, 25 bp, Mus musculus
gtcccgctggtgtatactggtctaa

SEQ ID NO: 686395 - DNA, 25 bp, Mus musculus
gtcccggaacatatgcatggcgtct

SEQ ID NO: 686396 - DNA, 25 bp, Mus musculus
gtcccggaacatttgcatggcgtct

SEQ ID NO: 686397 - DNA, 25 bp, Mus musculus
gtcccggagaacaagtgaatgctca

SEQ ID NO: 686398 - DNA, 25 bp, Mus musculus
gtcccggagaactagtgaatgctca

SEQ ID NO: 686399 - DNA, 25 bp, Mus musculus
gtcccggaggcaactacgacttctt

SEQ ID NO: 686400 - DNA, 25 bp, Mus musculus
gtcccggaggcatctacgacttctt

SEQ ID NO: 686401 - DNA, 25 bp, Mus musculus
gtcccggcgctgcaaaacagaagct

SEQ ID NO: 686402 - DNA, 25 bp, Mus musculus
gtcccggcgctggaaaacagaagct

SEQ ID NO: 686403 - DNA, 25 bp, Mus musculus
gtcccggctttgacaggatcagcaa

SEQ ID NO: 686404 - DNA, 25 bp, Mus musculus
gtcccggctttgtcaggatcagcaa

SEQ ID NO: 686405 - DNA, 25 bp, Mus musculus
gtcccgggtcacagttgaaactaag

SEQ ID NO: 686406 - DNA, 25 bp, Mus musculus
gtcccgggtcactgttgaaactaag

SEQ ID NO: 686407 - DNA, 25 bp, Mus musculus
gtcccggtatccaaaggccaactga

SEQ ID NO: 686408 - DNA, 25 bp, Mus musculus
gtcccggtatcctaaggccaactga

SEQ ID NO: 686409 - DNA, 25 bp, Mus musculus
gtcccggtcgttatcggatgtgacg

SEQ ID NO: 686410 - DNA, 25 bp, Mus musculus
gtcccggtcgttttcggatgtgacg

SEQ ID NO: 686411 - DNA, 25 bp, Mus musculus
gtcccgtaaccgctgcatagtaatt

SEQ ID NO: 686412 - DNA, 25 bp, Mus musculus
gtcccgtaaccggtgcatagtaatt

SEQ ID NO: 686413 - DNA, 25 bp, Mus musculus
gtcccgtaagcaccccatcaaagag

SEQ ID NO: 686414 - DNA, 25 bp, Mus musculus
gtcccgtaagcagcccatcaaagag

SEQ ID NO: 686415 - DNA, 25 bp, Mus musculus
gtcccgtagcctcttcttttcttca

SEQ ID NO: 686416 - DNA, 25 bp, Mus musculus
gtcccgtagcctgttcttttcttca

SEQ ID NO: 686417 - DNA, 25 bp, Mus musculus
gtcccgtagggaaatgattcttttg

SEQ ID NO: 686418 - DNA, 25 bp, Mus musculus
gtcccgtagggatatgattcttttg

SEQ ID NO: 686419 - DNA, 25 bp, Mus musculus
gtcccgtcagtcaaaaccatggcag

SEQ ID NO: 686420 - DNA, 25 bp, Mus musculus
gtcccgtcagtctaaaccatggcag

SEQ ID NO: 686421 - DNA, 25 bp, Mus musculus
gtcccgtcttaaacttgttacacaa

SEQ ID NO: 686422 - DNA, 25 bp, Mus musculus
gtcccgtcttaatcttgttacacaa

SEQ ID NO: 686423 - DNA, 25 bp, Mus musculus
gtcccgtgccagctacagtttgttt

SEQ ID NO: 686424 - DNA, 25 bp, Mus musculus
gtcccgtgccaggtacagtttgttt

SEQ ID NO: 686425 - DNA, 25 bp, Mus musculus
gtcccgtggcagacatctgggatga

SEQ ID NO: 686426 - DNA, 25 bp, Mus musculus
gtcccgtggcagtcatctgggatga

SEQ ID NO: 686427 - DNA, 25 bp, Mus musculus
gtcccgtggcgtcatctgggctgat

SEQ ID NO: 686428 - DNA, 25 bp, Mus musculus
gtcccgtggcgtgatctgggctgat

SEQ ID NO: 686429 - DNA, 25 bp, Mus musculus
gtcccgtgtcatctggcaattttaa

SEQ ID NO: 686430 - DNA, 25 bp, Mus musculus
gtcccgtgtcatgtggcaattttaa

SEQ ID NO: 686431 - DNA, 25 bp, Mus musculus
gtcccgtgtgatctctgatgttgta

SEQ ID NO: 686432 - DNA, 25 bp, Mus musculus
gtcccgtgtgatgtctgatgttgta

SEQ ID NO: 686433 - DNA, 25 bp, Mus musculus
gtcccgtgtttacttctaattacag

SEQ ID NO: 686434 - DNA, 25 bp, Mus musculus
gtcccgtgtttagttctaattacag

SEQ ID NO: 686435 - DNA, 25 bp, Mus musculus
gtcccgtgtttcaagtagaaccatt

SEQ ID NO: 686436 - DNA, 25 bp, Mus musculus
gtcccgtgtttctagtagaaccatt

SEQ ID NO: 686437 - DNA, 25 bp, Mus musculus
gtcccgttcatgatacctgggaaca

SEQ ID NO: 686438 - DNA, 25 bp, Mus musculus
gtcccgttcatgttacctgggaaca

SEQ ID NO: 686439 - DNA, 25 bp, Mus musculus
gtcccgttcattcctcagtgaagag

SEQ ID NO: 686440 - DNA, 25 bp, Mus musculus
gtcccgttcattgctcagtgaagag

SEQ ID NO: 686441 - DNA, 25 bp, Mus musculus
gtcccgttcggtactcaggaagagg

SEQ ID NO: 686442 - DNA, 25 bp, Mus musculus
gtcccgttcggttctcaggaagagg

SEQ ID NO: 686443 - DNA, 25 bp, Mus musculus
gtcccgttctcgcagacaactgtgt

SEQ ID NO: 686444 - DNA, 25 bp, Mus musculus
gtcccgttctcggagacaactgtgt

SEQ ID NO: 686445 - DNA, 25 bp, Mus musculus
gtcccgttgtgtccttgcttgtctg

SEQ ID NO: 686446 - DNA, 25 bp, Mus musculus
gtcccgttgtgtgcttgcttgtctg

SEQ ID NO: 686447 - DNA, 25 bp, Mus musculus
gtccctaacctgactgcatgtttga

SEQ ID NO: 686448 - DNA, 25 bp, Mus musculus
gtccctaacctgtctgcatgtttga

SEQ ID NO: 686449 - DNA, 25 bp, Mus musculus
gtccctaacttactcacattctttc

SEQ ID NO: 686450 - DNA, 25 bp, Mus musculus
gtccctaacttagtcacattctttc

SEQ ID NO: 686451 - DNA, 25 bp, Mus musculus
gtccctaagaaacaagccccagttg

SEQ ID NO: 686452 - DNA, 25 bp, Mus musculus
gtccctaagaaagaagccccagttg

SEQ ID NO: 686453 - DNA, 25 bp, Mus musculus
gtccctaagattatgttcactactc

SEQ ID NO: 686454 - DNA, 25 bp, Mus musculus
gtccctaagattttgttcactactc

SEQ ID NO: 686455 - DNA, 25 bp, Mus musculus
gtccctaagcctagagcccagcagg

SEQ ID NO: 686456 - DNA, 25 bp, Mus musculus
gtccctaagccttgagcccagcagg

SEQ ID NO: 686457 - DNA, 25 bp, Mus musculus
gtccctaataatcaccagttttcat

SEQ ID NO: 686458 - DNA, 25 bp, Mus musculus
gtccctaataatgaccagttttcat

SEQ ID NO: 686459 - DNA, 25 bp, Mus musculus
gtccctaatgctccccaagagaaat

SEQ ID NO: 686460 - DNA, 25 bp, Mus musculus
gtccctaatgctgcccaagagaaat

SEQ ID NO: 686461 - DNA, 25 bp, Mus musculus
gtccctaatgtgacgttgctgattc

SEQ ID NO: 686462 - DNA, 25 bp, Mus musculus
gtccctaatgtgtcgttgctgattc

SEQ ID NO: 686463 - DNA, 25 bp, Mus musculus
gtccctaccagtctgtgtctttgga

SEQ ID NO: 686464 - DNA, 25 bp, Mus musculus
gtccctaccagtgtgtgtctttgga

SEQ ID NO: 686465 - DNA, 25 bp, Mus musculus
gtccctacctaaaggcagatagaac

SEQ ID NO: 686466 - DNA, 25 bp, Mus musculus
gtccctacctaaagggtgtctgctg

SEQ ID NO: 686467 - DNA, 25 bp, Mus musculus
gtccctacctaatggcagatagaac

SEQ ID NO: 686468 - DNA, 25 bp, Mus musculus
gtccctacctaatgggtgtctgctg

SEQ ID NO: 686469 - DNA, 25 bp, Mus musculus
gtccctacgctcagtgaatcactca

SEQ ID NO: 686470 - DNA, 25 bp, Mus musculus
gtccctacgctctgtgaatcactca

SEQ ID NO: 686471 - DNA, 25 bp, Mus musculus
gtccctactttcaagacgctatttc

SEQ ID NO: 686472 - DNA, 25 bp, Mus musculus
gtccctactttctagacgctatttc

SEQ ID NO: 686473 - DNA, 25 bp, Mus musculus
gtccctagacaactgaaagcccctg

SEQ ID NO: 686474 - DNA, 25 bp, Mus musculus
gtccctagacaagtgaaagcccctg

SEQ ID NO: 686475 - DNA, 25 bp, Mus musculus
gtccctagattcagaatcaatatgg

SEQ ID NO: 686476 - DNA, 25 bp, Mus musculus
gtccctagattctgaatcaatatgg

SEQ ID NO: 686477 - DNA, 25 bp, Mus musculus
gtccctaggaaaaatctgggtttca

SEQ ID NO: 686478 - DNA, 25 bp, Mus musculus
gtccctaggaaatatctgggtttca

SEQ ID NO: 686479 - DNA, 25 bp, Mus musculus
gtccctagggatagcagtaccacat

SEQ ID NO: 686480 - DNA, 25 bp, Mus musculus
gtccctagggattgcagtaccacat

SEQ ID NO: 686481 - DNA, 25 bp, Mus musculus
gtccctaggtccagcaatgattcta

SEQ ID NO: 686482 - DNA, 25 bp, Mus musculus
gtccctaggtcctgcaatgattcta

SEQ ID NO: 686483 - DNA, 25 bp, Mus musculus
gtccctagtcaaaacaatgagtctt

SEQ ID NO: 686484 - DNA, 25 bp, Mus musculus
gtccctagtcaatacaatgagtctt

SEQ ID NO: 686485 - DNA, 25 bp, Mus musculus
gtccctagtccaatttaggcattat

SEQ ID NO: 686486 - DNA, 25 bp, Mus musculus
gtccctagtccattttaggcattat

SEQ ID NO: 686487 - DNA, 25 bp, Mus musculus
gtccctagtcgcagttgaacgtgag

SEQ ID NO: 686488 - DNA, 25 bp, Mus musculus
gtccctagtcgctgttgaacgtgag

SEQ ID NO: 686489 - DNA, 25 bp, Mus musculus
gtccctatagccacatttttcaaat

SEQ ID NO: 686490 - DNA, 25 bp, Mus musculus
gtccctatagcctcatttttcaaat

SEQ ID NO: 686491 - DNA, 25 bp, Mus musculus
gtccctatcactcttagaggcctac

SEQ ID NO: 686492 - DNA, 25 bp, Mus musculus
gtccctatcactgttagaggcctac

SEQ ID NO: 686493 - DNA, 25 bp, Mus musculus
gtccctatgaacaggctctgggtgg

SEQ ID NO: 686494 - DNA, 25 bp, Mus musculus
gtccctatgaactggctctgggtgg

SEQ ID NO: 686495 - DNA, 25 bp, Mus musculus
gtccctatgactaaggttccatgca

SEQ ID NO: 686496 - DNA, 25 bp, Mus musculus
gtccctatgactacagccagtcaga

SEQ ID NO: 686497 - DNA, 25 bp, Mus musculus
gtccctatgacttaggttccatgca

SEQ ID NO: 686498 - DNA, 25 bp, Mus musculus
gtccctatgacttcagccagtcaga

SEQ ID NO: 686499 - DNA, 25 bp, Mus musculus
gtccctatgggtctaagaactggca

SEQ ID NO: 686500 - DNA, 25 bp, Mus musculus
gtccctatgggtgtaagaactggca

SEQ ID NO: 686501 - DNA, 25 bp, Mus musculus
gtccctattggaaggcacggcttac

SEQ ID NO: 686502 - DNA, 25 bp, Mus musculus
gtccctattggatggcacggcttac

SEQ ID NO: 686503 - DNA, 25 bp, Mus musculus
gtccctatttgaaatgttggccttt

SEQ ID NO: 686504 - DNA, 25 bp, Mus musculus
gtccctatttgatatgttggccttt

SEQ ID NO: 686505 - DNA, 25 bp, Mus musculus
gtccctatttgtcgttattggtcat

SEQ ID NO: 686506 - DNA, 25 bp, Mus musculus
gtccctatttgtggttattggtcat

SEQ ID NO: 686507 - DNA, 25 bp, Mus musculus
gtccctcaaattcccaaatactgtg

SEQ ID NO: 686508 - DNA, 25 bp, Mus musculus
gtccctcaaattgccaaatactgtg

SEQ ID NO: 686509 - DNA, 25 bp, Mus musculus
gtccctcaattgctagccatttaaa

SEQ ID NO: 686510 - DNA, 25 bp, Mus musculus
gtccctcaattggtagccatttaaa

SEQ ID NO: 686511 - DNA, 25 bp, Mus musculus
gtccctcacagtaccaaagctttaa

SEQ ID NO: 686512 - DNA, 25 bp, Mus musculus
gtccctcacagttccaaagctttaa

SEQ ID NO: 686513 - DNA, 25 bp, Mus musculus
gtccctcactctacaaggtctttgt

SEQ ID NO: 686514 - DNA, 25 bp, Mus musculus
gtccctcactcttcaaggtctttgt

SEQ ID NO: 686515 - DNA, 25 bp, Mus musculus
gtccctcagcagatgttcagcgatg

SEQ ID NO: 686516 - DNA, 25 bp, Mus musculus
gtccctcagcagttgttcagcgatg

SEQ ID NO: 686517 - DNA, 25 bp, Mus musculus
gtccctcagtagagacccgggaggt

SEQ ID NO: 686518 - DNA, 25 bp, Mus musculus
gtccctcagtagtgacccgggaggt

SEQ ID NO: 686519 - DNA, 25 bp, Mus musculus
gtccctcatcaaatacatctcaaaa

SEQ ID NO: 686520 - DNA, 25 bp, Mus musculus
gtccctcatcaattacatctcaaaa

SEQ ID NO: 686521 - DNA, 25 bp, Mus musculus
gtccctcatggacacataatggcta

SEQ ID NO: 686522 - DNA, 25 bp, Mus musculus
gtccctcatggagacataatggcta

SEQ ID NO: 686523 - DNA, 25 bp, Mus musculus
gtccctcatgtgagacttgtaacat

SEQ ID NO: 686524 - DNA, 25 bp, Mus musculus
gtccctcatgtgtgacttgtaacat

SEQ ID NO: 686525 - DNA, 25 bp, Mus musculus
gtccctcattacatagcaactggca

SEQ ID NO: 686526 - DNA, 25 bp, Mus musculus
gtccctcattacttagcaactggca

SEQ ID NO: 686527 - DNA, 25 bp, Mus musculus
gtccctccaactagctaacagctgt

SEQ ID NO: 686528 - DNA, 25 bp, Mus musculus
gtccctccaacttgctaacagctgt

SEQ ID NO: 686529 - DNA, 25 bp, Mus musculus
gtccctccaaggatttaattgcgct

SEQ ID NO: 686530 - DNA, 25 bp, Mus musculus
gtccctccaaggttttaattgcgct

SEQ ID NO: 686531 - DNA, 25 bp, Mus musculus
gtccctccaatcagtgaagcggaaa

SEQ ID NO: 686532 - DNA, 25 bp, Mus musculus
gtccctccaatcctgttagttatta

SEQ ID NO: 686533 - DNA, 25 bp, Mus musculus
gtccctccaatcgtgttagttatta

SEQ ID NO: 686534 - DNA, 25 bp, Mus musculus
gtccctccaatctgtgaagcggaaa

SEQ ID NO: 686535 - DNA, 25 bp, Mus musculus
gtccctccaggaagcgccaaaaagt

SEQ ID NO: 686536 - DNA, 25 bp, Mus musculus
gtccctccaggatgcgccaaaaagt

SEQ ID NO: 686537 - DNA, 25 bp, Mus musculus
gtccctcccatgactagatctttag

SEQ ID NO: 686538 - DNA, 25 bp, Mus musculus
gtccctcccatgtctagatctttag

SEQ ID NO: 686539 - DNA, 25 bp, Mus musculus
gtccctcccgagcagcatgaagaag

SEQ ID NO: 686540 - DNA, 25 bp, Mus musculus
gtccctcccgaggagcatgaagaag

SEQ ID NO: 686541 - DNA, 25 bp, Mus musculus
gtccctccgctccaaggtagatgaa

SEQ ID NO: 686542 - DNA, 25 bp, Mus musculus
gtccctccgctcgaaggtagatgaa

SEQ ID NO: 686543 - DNA, 25 bp, Mus musculus
gtccctccggtaatgtttgttcaga

SEQ ID NO: 686544 - DNA, 25 bp, Mus musculus
gtccctccggtattgtttgttcaga

SEQ ID NO: 686545 - DNA, 25 bp, Mus musculus
gtccctcctaaaagtgaattaagcc

SEQ ID NO: 686546 - DNA, 25 bp, Mus musculus
gtccctcctaaatgtgaattaagcc

SEQ ID NO: 686547 - DNA, 25 bp, Mus musculus
gtccctccttatcgatattggaaga

SEQ ID NO: 686548 - DNA, 25 bp, Mus musculus
gtccctccttatggatattggaaga

SEQ ID NO: 686549 - DNA, 25 bp, Mus musculus
gtccctcctttgatctgtaagagat

SEQ ID NO: 686550 - DNA, 25 bp, Mus musculus
gtccctcctttgttctgtaagagat

SEQ ID NO: 686551 - DNA, 25 bp, Mus musculus
gtccctcgatggaccaataaacctg

SEQ ID NO: 686552 - DNA, 25 bp, Mus musculus
gtccctcgatggtccaataaacctg

SEQ ID NO: 686553 - DNA, 25 bp, Mus musculus
gtccctcggcttcagaagacttcac

SEQ ID NO: 686554 - DNA, 25 bp, Mus musculus
gtccctcggcttgagaagacttcac

SEQ ID NO: 686555 - DNA, 25 bp, Mus musculus
gtccctcgggaacatggttttgatt

SEQ ID NO: 686556 - DNA, 25 bp, Mus musculus
gtccctcgggaagatggttttgatt

SEQ ID NO: 686557 - DNA, 25 bp, Mus musculus
gtccctcggtaactcaattagcacg

SEQ ID NO: 686558 - DNA, 25 bp, Mus musculus
gtccctcggtaagtcaattagcacg

SEQ ID NO: 686559 - DNA, 25 bp, Mus musculus
gtccctcggtggcagagaatcttgt

SEQ ID NO: 686560 - DNA, 25 bp, Mus musculus
gtccctcggtgggagagaatcttgt

SEQ ID NO: 686561 - DNA, 25 bp, Mus musculus
gtccctctaaatcattcagtccaga

SEQ ID NO: 686562 - DNA, 25 bp, Mus musculus
gtccctctaaatgattcagtccaga

SEQ ID NO: 686563 - DNA, 25 bp, Mus musculus
gtccctctacgaagggctggtatag

SEQ ID NO: 686564 - DNA, 25 bp, Mus musculus
gtccctctacgatgggctggtatag

SEQ ID NO: 686565 - DNA, 25 bp, Mus musculus
gtccctctactactgtgtaaggcgt

SEQ ID NO: 686566 - DNA, 25 bp, Mus musculus
gtccctctactagtgtgtaaggcgt

SEQ ID NO: 686567 - DNA, 25 bp, Mus musculus
gtccctctagctctcaaaggcaatg

SEQ ID NO: 686568 - DNA, 25 bp, Mus musculus
gtccctctagctgtcaaaggcaatg

SEQ ID NO: 686569 - DNA, 25 bp, Mus musculus
gtccctctgcacaggatagatttgt

SEQ ID NO: 686570 - DNA, 25 bp, Mus musculus
gtccctctgcactggatagatttgt

SEQ ID NO: 686571 - DNA, 25 bp, Mus musculus
gtccctctgctaaactggaatcttg

SEQ ID NO: 686572 - DNA, 25 bp, Mus musculus
gtccctctgctatactggaatcttg

SEQ ID NO: 686573 - DNA, 25 bp, Mus musculus
gtccctctgcttatgattacttggg

SEQ ID NO: 686574 - DNA, 25 bp, Mus musculus
gtccctctgcttttgattacttggg

SEQ ID NO: 686575 - DNA, 25 bp, Mus musculus
gtccctctgggaccacctggtgtga

SEQ ID NO: 686576 - DNA, 25 bp, Mus musculus
gtccctctgggagcacctggtgtga

SEQ ID NO: 686577 - DNA, 25 bp, Mus musculus
gtccctctgtcaccttaaactagaa

SEQ ID NO: 686578 - DNA, 25 bp, Mus musculus
gtccctctgtcagcttaaactagaa

SEQ ID NO: 686579 - DNA, 25 bp, Mus musculus
gtccctctgtgtaactctgccataa

SEQ ID NO: 686580 - DNA, 25 bp, Mus musculus
gtccctctgtgttactctgccataa

SEQ ID NO: 686581 - DNA, 25 bp, Mus musculus
gtccctctgttgaatttgacatggt

SEQ ID NO: 686582 - DNA, 25 bp, Mus musculus
gtccctctgttgtatttgacatggt

SEQ ID NO: 686583 - DNA, 25 bp, Mus musculus
gtccctcttagacctaggcgtctat

SEQ ID NO: 686584 - DNA, 25 bp, Mus musculus
gtccctcttagagctaggcgtctat

SEQ ID NO: 686585 - DNA, 25 bp, Mus musculus
gtccctcttattatagtattgaaat

SEQ ID NO: 686586 - DNA, 25 bp, Mus musculus
gtccctcttattttagtattgaaat

SEQ ID NO: 686587 - DNA, 25 bp, Mus musculus
gtccctcttctcacatatatctaga

SEQ ID NO: 686588 - DNA, 25 bp, Mus musculus
gtccctcttctctcatatatctaga

SEQ ID NO: 686589 - DNA, 25 bp, Mus musculus
gtccctcttggtccaggaatttgag

SEQ ID NO: 686590 - DNA, 25 bp, Mus musculus
gtccctcttggtgcaggaatttgag

SEQ ID NO: 686591 - DNA, 25 bp, Mus musculus
gtccctctttacacaaggtgacaga

SEQ ID NO: 686592 - DNA, 25 bp, Mus musculus
gtccctctttacagccgaaaagcat

SEQ ID NO: 686593 - DNA, 25 bp, Mus musculus
gtccctctttactcaaggtgacaga

SEQ ID NO: 686594 - DNA, 25 bp, Mus musculus
gtccctctttactgccgaaaagcat

SEQ ID NO: 686595 - DNA, 25 bp, Mus musculus
gtccctctttgtagtgttggctgtc

SEQ ID NO: 686596 - DNA, 25 bp, Mus musculus
gtccctctttgttgtgttggctgtc

SEQ ID NO: 686597 - DNA, 25 bp, Mus musculus
gtccctcttttcaaacgagattctc

SEQ ID NO: 686598 - DNA, 25 bp, Mus musculus
gtccctcttttctaacgagattctc

SEQ ID NO: 686599 - DNA, 25 bp, Mus musculus
gtccctgaaactcgcaacttagtcc

SEQ ID NO: 686600 - DNA, 25 bp, Mus musculus
gtccctgaaactggcaacttagtcc

SEQ ID NO: 686601 - DNA, 25 bp, Mus musculus
gtccctgaaatcctgcaccactatg

SEQ ID NO: 686602 - DNA, 25 bp, Mus musculus
gtccctgaaatcgtgcaccactatg

SEQ ID NO: 686603 - DNA, 25 bp, Mus musculus
gtccctgaaatgcacacaggctgtg

SEQ ID NO: 686604 - DNA, 25 bp, Mus musculus
gtccctgaaatggacacaggctgtg

SEQ ID NO: 686605 - DNA, 25 bp, Mus musculus
gtccctgaacgtacagtattctaag

SEQ ID NO: 686606 - DNA, 25 bp, Mus musculus
gtccctgaacgttcagtattctaag

SEQ ID NO: 686607 - DNA, 25 bp, Mus musculus
gtccctgaacttcccagtcctggaa

SEQ ID NO: 686608 - DNA, 25 bp, Mus musculus
gtccctgaacttgccagtcctggaa

SEQ ID NO: 686609 - DNA, 25 bp, Mus musculus
gtccctgaagctcactaatggcatt

SEQ ID NO: 686610 - DNA, 25 bp, Mus musculus
gtccctgaagctgactaatggcatt

SEQ ID NO: 686611 - DNA, 25 bp, Mus musculus
gtccctgaaggacttctgctagtct

SEQ ID NO: 686612 - DNA, 25 bp, Mus musculus
gtccctgaaggagttctgctagtct

SEQ ID NO: 686613 - DNA, 25 bp, Mus musculus
gtccctgaatcacttacttttcgta

SEQ ID NO: 686614 - DNA, 25 bp, Mus musculus
gtccctgaatcagttacttttcgta

SEQ ID NO: 686615 - DNA, 25 bp, Mus musculus
gtccctgacaacaggacgctgtagt

SEQ ID NO: 686616 - DNA, 25 bp, Mus musculus
gtccctgacaactggacgctgtagt

SEQ ID NO: 686617 - DNA, 25 bp, Mus musculus
gtccctgaccgcaagggagacgaac

SEQ ID NO: 686618 - DNA, 25 bp, Mus musculus
gtccctgaccgctagggagacgaac

SEQ ID NO: 686619 - DNA, 25 bp, Mus musculus
gtccctgaccgtctgtcaagtttat

SEQ ID NO: 686620 - DNA, 25 bp, Mus musculus
gtccctgaccgtgtgtcaagtttat

SEQ ID NO: 686621 - DNA, 25 bp, Mus musculus
gtccctgacctaatgtgctgattta

SEQ ID NO: 686622 - DNA, 25 bp, Mus musculus
gtccctgacctattgtgctgattta

SEQ ID NO: 686623 - DNA, 25 bp, Mus musculus
gtccctgacgttagaagtacactct

SEQ ID NO: 686624 - DNA, 25 bp, Mus musculus
gtccctgacgtttgaagtacactct

SEQ ID NO: 686625 - DNA, 25 bp, Mus musculus
gtccctgactgactacgtctcaagt

SEQ ID NO: 686626 - DNA, 25 bp, Mus musculus
gtccctgactgagtacgtctcaagt

SEQ ID NO: 686627 - DNA, 25 bp, Mus musculus
gtccctgaggaacaacacgtcacat

SEQ ID NO: 686628 - DNA, 25 bp, Mus musculus
gtccctgaggaagaacacgtcacat

SEQ ID NO: 686629 - DNA, 25 bp, Mus musculus
gtccctgaggtgctattactttcca

SEQ ID NO: 686630 - DNA, 25 bp, Mus musculus
gtccctgaggtggtattactttcca

SEQ ID NO: 686631 - DNA, 25 bp, Mus musculus
gtccctgagtttctcagtgctggga

SEQ ID NO: 686632 - DNA, 25 bp, Mus musculus
gtccctgagtttgtcagtgctggga

SEQ ID NO: 686633 - DNA, 25 bp, Mus musculus
gtccctgatatgaccccaataaaga

SEQ ID NO: 686634 - DNA, 25 bp, Mus musculus
gtccctgatatgtccccaataaaga

SEQ ID NO: 686635 - DNA, 25 bp, Mus musculus
gtccctgcaagacaagcttccagta

SEQ ID NO: 686636 - DNA, 25 bp, Mus musculus
gtccctgcaagagaagcttccagta

SEQ ID NO: 686637 - DNA, 25 bp, Mus musculus
gtccctgcagcccttggagtgacag

SEQ ID NO: 686638 - DNA, 25 bp, Mus musculus
gtccctgcagccgttggagtgacag

SEQ ID NO: 686639 - DNA, 25 bp, Mus musculus
gtccctgcagggaagcttggtgcat

SEQ ID NO: 686640 - DNA, 25 bp, Mus musculus
gtccctgcagggtagcttggtgcat

SEQ ID NO: 686641 - DNA, 25 bp, Mus musculus
gtccctgcatataatctcttcattg

SEQ ID NO: 686642 - DNA, 25 bp, Mus musculus
gtccctgcatattatctcttcattg

SEQ ID NO: 686643 - DNA, 25 bp, Mus musculus
gtccctgcattaaccaaccatagtg

SEQ ID NO: 686644 - DNA, 25 bp, Mus musculus
gtccctgcattatccaaccatagtg

SEQ ID NO: 686645 - DNA, 25 bp, Mus musculus
gtccctgcattcagaggtaccagaa

SEQ ID NO: 686646 - DNA, 25 bp, Mus musculus
gtccctgcattctgaggtaccagaa

SEQ ID NO: 686647 - DNA, 25 bp, Mus musculus
gtccctgccaggctgcatgcattcg

SEQ ID NO: 686648 - DNA, 25 bp, Mus musculus
gtccctgccagggtgcatgcattcg

SEQ ID NO: 686649 - DNA, 25 bp, Mus musculus
gtccctgccagtcattgtcacttta

SEQ ID NO: 686650 - DNA, 25 bp, Mus musculus
gtccctgccagtgattgtcacttta

SEQ ID NO: 686651 - DNA, 25 bp, Mus musculus
gtccctgccataacaactctggaga

SEQ ID NO: 686652 - DNA, 25 bp, Mus musculus
gtccctgccatatcaactctggaga

SEQ ID NO: 686653 - DNA, 25 bp, Mus musculus
gtccctgcccagaggcaacaactta

SEQ ID NO: 686654 - DNA, 25 bp, Mus musculus
gtccctgcccagtggcaacaactta

SEQ ID NO: 686655 - DNA, 25 bp, Mus musculus
gtccctgctagaccagtgttcatga

SEQ ID NO: 686656 - DNA, 25 bp, Mus musculus
gtccctgctagagcagtgttcatga

SEQ ID NO: 686657 - DNA, 25 bp, Mus musculus
gtccctgctatcaatggagcattga

SEQ ID NO: 686658 - DNA, 25 bp, Mus musculus
gtccctgctatctatggagcattga

SEQ ID NO: 686659 - DNA, 25 bp, Mus musculus
gtccctgctgatcttcaaattggat

SEQ ID NO: 686660 - DNA, 25 bp, Mus musculus
gtccctgctgatgttcaaattggat

SEQ ID NO: 686661 - DNA, 25 bp, Mus musculus
gtccctgctggccagaatctttgtc

SEQ ID NO: 686662 - DNA, 25 bp, Mus musculus
gtccctgctggcgagaatctttgtc

SEQ ID NO: 686663 - DNA, 25 bp, Mus musculus
gtccctgctggtacaaaccaaccat

SEQ ID NO: 686664 - DNA, 25 bp, Mus musculus
gtccctgctggtctctgtctagaga

SEQ ID NO: 686665 - DNA, 25 bp, Mus musculus
gtccctgctggtgtctgtctagaga

SEQ ID NO: 686666 - DNA, 25 bp, Mus musculus
gtccctgctggttcaaaccaaccat

SEQ ID NO: 686667 - DNA, 25 bp, Mus musculus
gtccctggaactcagaaagaaggca

SEQ ID NO: 686668 - DNA, 25 bp, Mus musculus
gtccctggaactgagaaagaaggca

SEQ ID NO: 686669 - DNA, 25 bp, Mus musculus
gtccctggacggcatggacatgctc

SEQ ID NO: 686670 - DNA, 25 bp, Mus musculus
gtccctggacgggatggacatgctc

SEQ ID NO: 686671 - DNA, 25 bp, Mus musculus
gtccctggactaagtctgatgacaa

SEQ ID NO: 686672 - DNA, 25 bp, Mus musculus
gtccctggactatgtctgatgacaa

SEQ ID NO: 686673 - DNA, 25 bp, Mus musculus
gtccctggagccaattatggtgatt

SEQ ID NO: 686674 - DNA, 25 bp, Mus musculus
gtccctggagcctattatggtgatt

SEQ ID NO: 686675 - DNA, 25 bp, Mus musculus
gtccctggaggcagtatcaggtctg

SEQ ID NO: 686676 - DNA, 25 bp, Mus musculus
gtccctggaggctgtatcaggtctg

SEQ ID NO: 686677 - DNA, 25 bp, Mus musculus
gtccctggatgcagtggcgacattt

SEQ ID NO: 686678 - DNA, 25 bp, Mus musculus
gtccctggatgctgtggcgacattt

SEQ ID NO: 686679 - DNA, 25 bp, Mus musculus
gtccctggcagaccgttgttactgt

SEQ ID NO: 686680 - DNA, 25 bp, Mus musculus
gtccctggcagagcgttgttactgt

SEQ ID NO: 686681 - DNA, 25 bp, Mus musculus
gtccctggccagagtgcaggaacca

SEQ ID NO: 686682 - DNA, 25 bp, Mus musculus
gtccctggccagtgtgcaggaacca

SEQ ID NO: 686683 - DNA, 25 bp, Mus musculus
gtccctggctgtcatgcagctgcag

SEQ ID NO: 686684 - DNA, 25 bp, Mus musculus
gtccctggctgtgatgcagctgcag

SEQ ID NO: 686685 - DNA, 25 bp, Mus musculus
gtccctgggaagctgttatcttcaa

SEQ ID NO: 686686 - DNA, 25 bp, Mus musculus
gtccctgggaaggtgttatcttcaa

SEQ ID NO: 686687 - DNA, 25 bp, Mus musculus
gtccctgggaataaatcttgtctgt

SEQ ID NO: 686688 - DNA, 25 bp, Mus musculus
gtccctgggaattaatcttgtctgt

SEQ ID NO: 686689 - DNA, 25 bp, Mus musculus
gtccctgggatccacattagcagaa

SEQ ID NO: 686690 - DNA, 25 bp, Mus musculus
gtccctgggatcgacattagcagaa

SEQ ID NO: 686691 - DNA, 25 bp, Mus musculus
gtccctgggtacagtccttgtacat

SEQ ID NO: 686692 - DNA, 25 bp, Mus musculus
gtccctgggtactgtccttgtacat

SEQ ID NO: 686693 - DNA, 25 bp, Mus musculus
gtccctggtcatagagtgtcactca

SEQ ID NO: 686694 - DNA, 25 bp, Mus musculus
gtccctggtcatccaggcctgagaa

SEQ ID NO: 686695 - DNA, 25 bp, Mus musculus
gtccctggtcatgcaggcctgagaa

SEQ ID NO: 686696 - DNA, 25 bp, Mus musculus
gtccctggtcattgagtgtcactca

SEQ ID NO: 686697 - DNA, 25 bp, Mus musculus
gtccctggtgctcctaactggtgaa

SEQ ID NO: 686698 - DNA, 25 bp, Mus musculus
gtccctggtgctgctaactggtgaa

SEQ ID NO: 686699 - DNA, 25 bp, Mus musculus
gtccctggttatacctgatggttga

SEQ ID NO: 686700 - DNA, 25 bp, Mus musculus
gtccctggttattcctgatggttga

SEQ ID NO: 686701 - DNA, 25 bp, Mus musculus
gtccctggttcacgagtccagtgta

SEQ ID NO: 686702 - DNA, 25 bp, Mus musculus
gtccctggttcaggagtccagtgta

SEQ ID NO: 686703 - DNA, 25 bp, Mus musculus
gtccctggttgactgaccaaagcag

SEQ ID NO: 686704 - DNA, 25 bp, Mus musculus
gtccctggttgagtgaccaaagcag

SEQ ID NO: 686705 - DNA, 25 bp, Mus musculus
gtccctgtaactaagaaagccctag

SEQ ID NO: 686706 - DNA, 25 bp, Mus musculus
gtccctgtaacttagaaagccctag

SEQ ID NO: 686707 - DNA, 25 bp, Mus musculus
gtccctgtaattcttcttacctaat

SEQ ID NO: 686708 - DNA, 25 bp, Mus musculus
gtccctgtaattgttcttacctaat

SEQ ID NO: 686709 - DNA, 25 bp, Mus musculus
gtccctgtacaacctgacaaaagcc

SEQ ID NO: 686710 - DNA, 25 bp, Mus musculus
gtccctgtacaagctgacaaaagcc

SEQ ID NO: 686711 - DNA, 25 bp, Mus musculus
gtccctgtacataacccatatggaa

SEQ ID NO: 686712 - DNA, 25 bp, Mus musculus
gtccctgtacattacccatatggaa

SEQ ID NO: 686713 - DNA, 25 bp, Mus musculus
gtccctgtacccactggtggaaatg

SEQ ID NO: 686714 - DNA, 25 bp, Mus musculus
gtccctgtaccctctggtggaaatg

SEQ ID NO: 686715 - DNA, 25 bp, Mus musculus
gtccctgtacctatgtctgtctgtc

SEQ ID NO: 686716 - DNA, 25 bp, Mus musculus
gtccctgtacctttgtctgtctgtc

SEQ ID NO: 686717 - DNA, 25 bp, Mus musculus
gtccctgtactcctgctggaaaaac

SEQ ID NO: 686718 - DNA, 25 bp, Mus musculus
gtccctgtactcgtgctggaaaaac

SEQ ID NO: 686719 - DNA, 25 bp, Mus musculus
gtccctgtactgaatctgtttgtta

SEQ ID NO: 686720 - DNA, 25 bp, Mus musculus
gtccctgtactgtatctgtttgtta

SEQ ID NO: 686721 - DNA, 25 bp, Mus musculus
gtccctgtacttagtggtgatgcgc

SEQ ID NO: 686722 - DNA, 25 bp, Mus musculus
gtccctgtactttgtggtgatgcgc

SEQ ID NO: 686723 - DNA, 25 bp, Mus musculus
gtccctgtagataagttccagagtg

SEQ ID NO: 686724 - DNA, 25 bp, Mus musculus
gtccctgtagattagttccagagtg

SEQ ID NO: 686725 - DNA, 25 bp, Mus musculus
gtccctgtaggcagcaggcatgcat

SEQ ID NO: 686726 - DNA, 25 bp, Mus musculus
gtccctgtaggctgcaggcatgcat

SEQ ID NO: 686727 - DNA, 25 bp, Mus musculus
gtccctgtatgactgccatccagag

SEQ ID NO: 686728 - DNA, 25 bp, Mus musculus
gtccctgtatgagtgccatccagag

SEQ ID NO: 686729 - DNA, 25 bp, Mus musculus
gtccctgtcaaaagttcagcaaact

SEQ ID NO: 686730 - DNA, 25 bp, Mus musculus
gtccctgtcaaatgttcagcaaact

SEQ ID NO: 686731 - DNA, 25 bp, Mus musculus
gtccctgtctctcatgacaggtcag

SEQ ID NO: 686732 - DNA, 25 bp, Mus musculus
gtccctgtctctgatgacaggtcag

SEQ ID NO: 686733 - DNA, 25 bp, Mus musculus
gtccctgtcttgctgtcttagagaa

SEQ ID NO: 686734 - DNA, 25 bp, Mus musculus
gtccctgtcttggtgtcttagagaa

SEQ ID NO: 686735 - DNA, 25 bp, Mus musculus
gtccctgtgattcctgcactagaaa

SEQ ID NO: 686736 - DNA, 25 bp, Mus musculus
gtccctgtgattgctgcactagaaa

SEQ ID NO: 686737 - DNA, 25 bp, Mus musculus
gtccctgtgcacagcttgataggtc

SEQ ID NO: 686738 - DNA, 25 bp, Mus musculus
gtccctgtgcactgcttgataggtc

SEQ ID NO: 686739 - DNA, 25 bp, Mus musculus
gtccctgtgggaactctgttacaca

SEQ ID NO: 686740 - DNA, 25 bp, Mus musculus
gtccctgtgggatctctgttacaca

SEQ ID NO: 686741 - DNA, 25 bp, Mus musculus
gtccctgtggtaccctggcagagaa

SEQ ID NO: 686742 - DNA, 25 bp, Mus musculus
gtccctgtggtagcctggcagagaa

SEQ ID NO: 686743 - DNA, 25 bp, Mus musculus
gtccctgtggttagtatgcgtggat

SEQ ID NO: 686744 - DNA, 25 bp, Mus musculus
gtccctgtggtttgtatgcgtggat

SEQ ID NO: 686745 - DNA, 25 bp, Mus musculus
gtccctgtgtctctatgctgtgctg

SEQ ID NO: 686746 - DNA, 25 bp, Mus musculus
gtccctgtgtctgtatgctgtgctg

SEQ ID NO: 686747 - DNA, 25 bp, Mus musculus
gtccctgtgtgcatgaagtaggctc

SEQ ID NO: 686748 - DNA, 25 bp, Mus musculus
gtccctgtgtgcttgaagtaggctc

SEQ ID NO: 686749 - DNA, 25 bp, Mus musculus
gtccctgtgtgtaacttccagtcca

SEQ ID NO: 686750 - DNA, 25 bp, Mus musculus
gtccctgtgtgttacttccagtcca

SEQ ID NO: 686751 - DNA, 25 bp, Mus musculus
gtccctgttaagaggactgcccctg

SEQ ID NO: 686752 - DNA, 25 bp, Mus musculus
gtccctgttaagtggactgcccctg

SEQ ID NO: 686753 - DNA, 25 bp, Mus musculus
gtccctgttactacacatactttga

SEQ ID NO: 686754 - DNA, 25 bp, Mus musculus
gtccctgttacttcacatactttga

SEQ ID NO: 686755 - DNA, 25 bp, Mus musculus
gtccctgttagacatgttcttccta

SEQ ID NO: 686756 - DNA, 25 bp, Mus musculus
gtccctgttagagatgttcttccta

SEQ ID NO: 686757 - DNA, 25 bp, Mus musculus
gtccctgttcagacattatgttgtc

SEQ ID NO: 686758 - DNA, 25 bp, Mus musculus
gtccctgttcagagataaagtgctg

SEQ ID NO: 686759 - DNA, 25 bp, Mus musculus
gtccctgttcagtcattatgttgtc

SEQ ID NO: 686760 - DNA, 25 bp, Mus musculus
gtccctgttcagtgataaagtgctg

SEQ ID NO: 686761 - DNA, 25 bp, Mus musculus
gtccctgttgaactcatatcggcat

SEQ ID NO: 686762 - DNA, 25 bp, Mus musculus
gtccctgttgaagtcatatcggcat

SEQ ID NO: 686763 - DNA, 25 bp, Mus musculus
gtccctgttgttactcctttcaaat

SEQ ID NO: 686764 - DNA, 25 bp, Mus musculus
gtccctgttgtttctcctttcaaat

SEQ ID NO: 686765 - DNA, 25 bp, Mus musculus
gtccctgtttcgctaagatggttgc

SEQ ID NO: 686766 - DNA, 25 bp, Mus musculus
gtccctgtttcggtaagatggttgc

SEQ ID NO: 686767 - DNA, 25 bp, Mus musculus
gtccctgtttgaacgtttagcacaa

SEQ ID NO: 686768 - DNA, 25 bp, Mus musculus
gtccctgtttgatcgtttagcacaa

SEQ ID NO: 686769 - DNA, 25 bp, Mus musculus
gtcccttactgtagagccatctata

SEQ ID NO: 686770 - DNA, 25 bp, Mus musculus
gtcccttactgttgagccatctata

SEQ ID NO: 686771 - DNA, 25 bp, Mus musculus
gtcccttaggctcagtctctgacac

SEQ ID NO: 686772 - DNA, 25 bp, Mus musculus
gtcccttaggctgagtctctgacac

SEQ ID NO: 686773 - DNA, 25 bp, Mus musculus
gtcccttaggttatggctgattagc

SEQ ID NO: 686774 - DNA, 25 bp, Mus musculus
gtcccttaggttttggctgattagc

SEQ ID NO: 686775 - DNA, 25 bp, Mus musculus
gtcccttagtgaaggttctttattg

SEQ ID NO: 686776 - DNA, 25 bp, Mus musculus
gtcccttagtgatggttctttattg

SEQ ID NO: 686777 - DNA, 25 bp, Mus musculus
gtcccttatccacatgtaacttgtt

SEQ ID NO: 686778 - DNA, 25 bp, Mus musculus
gtcccttatccagatgtaacttgtt

SEQ ID NO: 686779 - DNA, 25 bp, Mus musculus
gtcccttatctgatgggtcttcagt

SEQ ID NO: 686780 - DNA, 25 bp, Mus musculus
gtcccttatctgttgggtcttcagt

SEQ ID NO: 686781 - DNA, 25 bp, Mus musculus
gtcccttatggaaagctgtgatccc

SEQ ID NO: 686782 - DNA, 25 bp, Mus musculus
gtcccttatggatagctgtgatccc

SEQ ID NO: 686783 - DNA, 25 bp, Mus musculus
gtcccttcaattcgcaatgcaaacg

SEQ ID NO: 686784 - DNA, 25 bp, Mus musculus
gtcccttcaattggcaatgcaaacg

SEQ ID NO: 686785 - DNA, 25 bp, Mus musculus
gtcccttcacttctgccgagagaat

SEQ ID NO: 686786 - DNA, 25 bp, Mus musculus
gtcccttcacttgtgccgagagaat

SEQ ID NO: 686787 - DNA, 25 bp, Mus musculus
gtcccttcatgcacccaatatagaa

SEQ ID NO: 686788 - DNA, 25 bp, Mus musculus
gtcccttcatgctcccaatatagaa

SEQ ID NO: 686789 - DNA, 25 bp, Mus musculus
gtcccttccacgatgtaatttgcat

SEQ ID NO: 686790 - DNA, 25 bp, Mus musculus
gtcccttccacgttgtaatttgcat

SEQ ID NO: 686791 - DNA, 25 bp, Mus musculus
gtcccttcccacagcaacaaggaga

SEQ ID NO: 686792 - DNA, 25 bp, Mus musculus
gtcccttcccactgcaacaaggaga

SEQ ID NO: 686793 - DNA, 25 bp, Mus musculus
gtcccttccctaagttggccagatg

SEQ ID NO: 686794 - DNA, 25 bp, Mus musculus
gtcccttccctatgttggccagatg

SEQ ID NO: 686795 - DNA, 25 bp, Mus musculus
gtcccttccgttctacagtagttat

SEQ ID NO: 686796 - DNA, 25 bp, Mus musculus
gtcccttccgttgtacagtagttat

SEQ ID NO: 686797 - DNA, 25 bp, Mus musculus
gtcccttcctaaacagagccggata

SEQ ID NO: 686798 - DNA, 25 bp, Mus musculus
gtcccttcctaatcagagccggata

SEQ ID NO: 686799 - DNA, 25 bp, Mus musculus
gtcccttccttcaacagtttgcaaa

SEQ ID NO: 686800 - DNA, 25 bp, Mus musculus
gtcccttccttctacagtttgcaaa

SEQ ID NO: 686801 - DNA, 25 bp, Mus musculus
gtcccttcgcaccttgttgtgcgct

SEQ ID NO: 686802 - DNA, 25 bp, Mus musculus
gtcccttcgcacgttgttgtgcgct

SEQ ID NO: 686803 - DNA, 25 bp, Mus musculus
gtcccttctataagttggctcgaat

SEQ ID NO: 686804 - DNA, 25 bp, Mus musculus
gtcccttctatatgttggctcgaat

SEQ ID NO: 686805 - DNA, 25 bp, Mus musculus
gtcccttctcagatgtcttggaaat

SEQ ID NO: 686806 - DNA, 25 bp, Mus musculus
gtcccttctcagttgtcttggaaat

SEQ ID NO: 686807 - DNA, 25 bp, Mus musculus
gtcccttctgcaactactgaaacaa

SEQ ID NO: 686808 - DNA, 25 bp, Mus musculus
gtcccttctgcatctactgaaacaa

SEQ ID NO: 686809 - DNA, 25 bp, Mus musculus
gtcccttctgtaagcatatgtgaaa

SEQ ID NO: 686810 - DNA, 25 bp, Mus musculus
gtcccttctgtatgcatatgtgaaa

SEQ ID NO: 686811 - DNA, 25 bp, Mus musculus
gtcccttctgtgaggctagcaatta

SEQ ID NO: 686812 - DNA, 25 bp, Mus musculus
gtcccttctgtgtggctagcaatta

SEQ ID NO: 686813 - DNA, 25 bp, Mus musculus
gtcccttgcaaccttgcttcattaa

SEQ ID NO: 686814 - DNA, 25 bp, Mus musculus
gtcccttgcaacgttgcttcattaa

SEQ ID NO: 686815 - DNA, 25 bp, Mus musculus
gtcccttgcacacggtctttacctt

SEQ ID NO: 686816 - DNA, 25 bp, Mus musculus
gtcccttgcacagggtctttacctt

SEQ ID NO: 686817 - DNA, 25 bp, Mus musculus
gtcccttggaggcttgacaatcaga

SEQ ID NO: 686818 - DNA, 25 bp, Mus musculus
gtcccttggagggttgacaatcaga

SEQ ID NO: 686819 - DNA, 25 bp, Mus musculus
gtcccttggattcaagagtttcctt

SEQ ID NO: 686820 - DNA, 25 bp, Mus musculus
gtcccttggattgaagagtttcctt

SEQ ID NO: 686821 - DNA, 25 bp, Mus musculus
gtcccttggtcaactgctgagacaa

SEQ ID NO: 686822 - DNA, 25 bp, Mus musculus
gtcccttggtcatctgctgagacaa

SEQ ID NO: 686823 - DNA, 25 bp, Mus musculus
gtcccttgtacacgctgttggttat

SEQ ID NO: 686824 - DNA, 25 bp, Mus musculus
gtcccttgtacaggctgttggttat

SEQ ID NO: 686825 - DNA, 25 bp, Mus musculus
gtccctttaggtaagtctcatggct

SEQ ID NO: 686826 - DNA, 25 bp, Mus musculus
gtccctttaggttagtctcatggct

SEQ ID NO: 686827 - DNA, 25 bp, Mus musculus
gtccctttatggatccttcacaaga

SEQ ID NO: 686828 - DNA, 25 bp, Mus musculus
gtccctttatggttccttcacaaga

SEQ ID NO: 686829 - DNA, 25 bp, Mus musculus
gtccctttctcactagacttgagtt

SEQ ID NO: 686830 - DNA, 25 bp, Mus musculus
gtccctttctcagtagacttgagtt

SEQ ID NO: 686831 - DNA, 25 bp, Mus musculus
gtccctttctctcttatgaaaaata

SEQ ID NO: 686832 - DNA, 25 bp, Mus musculus
gtccctttctctgttatgaaaaata

SEQ ID NO: 686833 - DNA, 25 bp, Mus musculus
gtccctttctggcaagcagcaggta

SEQ ID NO: 686834 - DNA, 25 bp, Mus musculus
gtccctttctgggaagcagcaggta

SEQ ID NO: 686835 - DNA, 25 bp, Mus musculus
gtccctttcttcaggttgcttgccc

SEQ ID NO: 686836 - DNA, 25 bp, Mus musculus
gtccctttcttctggttgcttgccc

SEQ ID NO: 686837 - DNA, 25 bp, Mus musculus
gtccctttgcatatttgttaagaat

SEQ ID NO: 686838 - DNA, 25 bp, Mus musculus
gtccctttgcatttttgttaagaat

SEQ ID NO: 686839 - DNA, 25 bp, Mus musculus
gtcccttttatcagaactcagttaa

SEQ ID NO: 686840 - DNA, 25 bp, Mus musculus
gtcccttttatccttgttagtgttg

SEQ ID NO: 686841 - DNA, 25 bp, Mus musculus
gtcccttttatcgttgttagtgttg

SEQ ID NO: 686842 - DNA, 25 bp, Mus musculus
gtcccttttatctgaactcagttaa

SEQ ID NO: 686843 - DNA, 25 bp, Mus musculus
gtcccttttcacagatcaagcctaa

SEQ ID NO: 686844 - DNA, 25 bp, Mus musculus
gtcccttttcactgatcaagcctaa

SEQ ID NO: 686845 - DNA, 25 bp, Mus musculus
gtcccttttgccagcgccctggttg

SEQ ID NO: 686846 - DNA, 25 bp, Mus musculus
gtcccttttgcctgcgccctggttg

SEQ ID NO: 686847 - DNA, 25 bp, Mus musculus
gtcccttttgggacatcttggagga

SEQ ID NO: 686848 - DNA, 25 bp, Mus musculus
gtcccttttgggtcatcttggagga

SEQ ID NO: 686849 - DNA, 25 bp, Mus musculus
gtccctttttagctcactttgattt

SEQ ID NO: 686850 - DNA, 25 bp, Mus musculus
gtccctttttaggtcactttgattt

SEQ ID NO: 686851 - DNA, 25 bp, Mus musculus
gtccgaaagacaacgtttgaagagt

SEQ ID NO: 686852 - DNA, 25 bp, Mus musculus
gtccgaaagacatcgtttgaagagt

SEQ ID NO: 686853 - DNA, 25 bp, Mus musculus
gtccgaaccttaagcatctaaattt

SEQ ID NO: 686854 - DNA, 25 bp, Mus musculus
gtccgaaccttatgcatctaaattt

SEQ ID NO: 686855 - DNA, 25 bp, Mus musculus
gtccgaagcagtacccttacaataa

SEQ ID NO: 686856 - DNA, 25 bp, Mus musculus
gtccgaagcagttcccttacaataa

SEQ ID NO: 686857 - DNA, 25 bp, Mus musculus
gtccgaagcgtaaatataaaccaca

SEQ ID NO: 686858 - DNA, 25 bp, Mus musculus
gtccgaagcgtatatataaaccaca

SEQ ID NO: 686859 - DNA, 25 bp, Mus musculus
gtccgaaggtctccaaagcatactg

SEQ ID NO: 686860 - DNA, 25 bp, Mus musculus
gtccgaaggtctgcaaagcatactg

SEQ ID NO: 686861 - DNA, 25 bp, Mus musculus
gtccgactctctcgctatgtggtag

SEQ ID NO: 686862 - DNA, 25 bp, Mus musculus
gtccgactctctggctatgtggtag

SEQ ID NO: 686863 - DNA, 25 bp, Mus musculus
gtccgactgcttccagttgtgttat

SEQ ID NO: 686864 - DNA, 25 bp, Mus musculus
gtccgactgcttgcagttgtgttat

SEQ ID NO: 686865 - DNA, 25 bp, Mus musculus
gtccgacttctgatgttaaatccat

SEQ ID NO: 686866 - DNA, 25 bp, Mus musculus
gtccgacttctgttgttaaatccat

SEQ ID NO: 686867 - DNA, 25 bp, Mus musculus
gtccgagaggtcagaatctcctttt

SEQ ID NO: 686868 - DNA, 25 bp, Mus musculus
gtccgagaggtctgaatctcctttt

SEQ ID NO: 686869 - DNA, 25 bp, Mus musculus
gtccgagaggtgcagtctgctccat

SEQ ID NO: 686870 - DNA, 25 bp, Mus musculus
gtccgagaggtggagtctgctccat

SEQ ID NO: 686871 - DNA, 25 bp, Mus musculus
gtccgagatatcaacgaggctttca

SEQ ID NO: 686872 - DNA, 25 bp, Mus musculus
gtccgagatatctacgaggctttca

SEQ ID NO: 686873 - DNA, 25 bp, Mus musculus
gtccgagcttacagtcccgtgactg

SEQ ID NO: 686874 - DNA, 25 bp, Mus musculus
gtccgagcttactgtcccgtgactg

SEQ ID NO: 686875 - DNA, 25 bp, Mus musculus
gtccgaggagatctacctgcagcaa

SEQ ID NO: 686876 - DNA, 25 bp, Mus musculus
gtccgaggagatgtacctgcagcaa

SEQ ID NO: 686877 - DNA, 25 bp, Mus musculus
gtccgaggccatagtgtaccacaaa

SEQ ID NO: 686878 - DNA, 25 bp, Mus musculus
gtccgaggccattgtgtaccacaaa

SEQ ID NO: 686879 - DNA, 25 bp, Mus musculus
gtccgaggcccgcaagcgaaagaac

SEQ ID NO: 686880 - DNA, 25 bp, Mus musculus
gtccgaggcccggaagcgaaagaac

SEQ ID NO: 686881 - DNA, 25 bp, Mus musculus
gtccgaggcggacgacaatcctcca

SEQ ID NO: 686882 - DNA, 25 bp, Mus musculus
gtccgaggcggaggacaatcctcca

SEQ ID NO: 686883 - DNA, 25 bp, Mus musculus
gtccgaggcggtcatctttaagatt

SEQ ID NO: 686884 - DNA, 25 bp, Mus musculus
gtccgaggcggtgatctttaagatt

SEQ ID NO: 686885 - DNA, 25 bp, Mus musculus
gtccgagggtgcacattggccatta

SEQ ID NO: 686886 - DNA, 25 bp, Mus musculus
gtccgagggtgctcattggccatta

SEQ ID NO: 686887 - DNA, 25 bp, Mus musculus
gtccgagtatagcaacagtgtattc

SEQ ID NO: 686888 - DNA, 25 bp, Mus musculus
gtccgagtataggaacagtgtattc

SEQ ID NO: 686889 - DNA, 25 bp, Mus musculus
gtccgagtgaggaattgacactgct

SEQ ID NO: 686890 - DNA, 25 bp, Mus musculus
gtccgagtgaggtattgacactgct

SEQ ID NO: 686891 - DNA, 25 bp, Mus musculus
gtccgagttaagcagcagcacagcc

SEQ ID NO: 686892 - DNA, 25 bp, Mus musculus
gtccgagttaaggagcagcacagcc

SEQ ID NO: 686893 - DNA, 25 bp, Mus musculus
gtccgagttttcacttaccttattg

SEQ ID NO: 686894 - DNA, 25 bp, Mus musculus
gtccgagttttctcttaccttattg

SEQ ID NO: 686895 - DNA, 25 bp, Mus musculus
gtccgatagctcacatcagttttag

SEQ ID NO: 686896 - DNA, 25 bp, Mus musculus
gtccgatagctctcatcagttttag

SEQ ID NO: 686897 - DNA, 25 bp, Mus musculus
gtccgatcaattagtctagtgtgcg

SEQ ID NO: 686898 - DNA, 25 bp, Mus musculus
gtccgatcaatttgtctagtgtgcg

SEQ ID NO: 686899 - DNA, 25 bp, Mus musculus
gtccgatccgttagagtgttctgaa

SEQ ID NO: 686900 - DNA, 25 bp, Mus musculus
gtccgatccgtttgagtgttctgaa

SEQ ID NO: 686901 - DNA, 25 bp, Mus musculus
gtccgatgaactatgcagcaatatt

SEQ ID NO: 686902 - DNA, 25 bp, Mus musculus
gtccgatgaactttgcagcaatatt

SEQ ID NO: 686903 - DNA, 25 bp, Mus musculus
gtccgatgcccgagtgttaaacatt

SEQ ID NO: 686904 - DNA, 25 bp, Mus musculus
gtccgatgcccgtgtgttaaacatt

SEQ ID NO: 686905 - DNA, 25 bp, Mus musculus
gtccgatgtctccaacaagccagag

SEQ ID NO: 686906 - DNA, 25 bp, Mus musculus
gtccgatgtctcgaacaagccagag

SEQ ID NO: 686907 - DNA, 25 bp, Mus musculus
gtccgatgtgtaatcactgagctta

SEQ ID NO: 686908 - DNA, 25 bp, Mus musculus
gtccgatgtgtattcactgagctta

SEQ ID NO: 686909 - DNA, 25 bp, Mus musculus
gtccgattcctaaagtgtgaaccaa

SEQ ID NO: 686910 - DNA, 25 bp, Mus musculus
gtccgattcctatagtgtgaaccaa

SEQ ID NO: 686911 - DNA, 25 bp, Mus musculus
gtccgatttggacccttgagtatag

SEQ ID NO: 686912 - DNA, 25 bp, Mus musculus
gtccgatttggagccttgagtatag

SEQ ID NO: 686913 - DNA, 25 bp, Mus musculus
gtccgattttctccttcagtaacta

SEQ ID NO: 686914 - DNA, 25 bp, Mus musculus
gtccgattttctgcttcagtaacta

SEQ ID NO: 686915 - DNA, 25 bp, Mus musculus
gtccgcaaaggacgcctgatcttcg

SEQ ID NO: 686916 - DNA, 25 bp, Mus musculus
gtccgcaaaggaggcctgatcttcg

SEQ ID NO: 686917 - DNA, 25 bp, Mus musculus
gtccgcaattgcatatttaggcttc

SEQ ID NO: 686918 - DNA, 25 bp, Mus musculus
gtccgcaattgcttatttaggcttc

SEQ ID NO: 686919 - DNA, 25 bp, Mus musculus
gtccgcagaccgctcagatgccaag

SEQ ID NO: 686920 - DNA, 25 bp, Mus musculus
gtccgcagaccggtcagatgccaag

SEQ ID NO: 686921 - DNA, 25 bp, Mus musculus
gtccgcagatgcaaactgtgccgaa

SEQ ID NO: 686922 - DNA, 25 bp, Mus musculus
gtccgcagatgctaactgtgccgaa

SEQ ID NO: 686923 - DNA, 25 bp, Mus musculus
gtccgcagcacacccatgtgacaag

SEQ ID NO: 686924 - DNA, 25 bp, Mus musculus
gtccgcagcacagccatgtgacaag

SEQ ID NO: 686925 - DNA, 25 bp, Mus musculus
gtccgcagccaaaaaagtcggtgaa

SEQ ID NO: 686926 - DNA, 25 bp, Mus musculus
gtccgcagccaataaagtcggtgaa

SEQ ID NO: 686927 - DNA, 25 bp, Mus musculus
gtccgcatacagaatcccatacaga

SEQ ID NO: 686928 - DNA, 25 bp, Mus musculus
gtccgcatacagtatcccatacaga

SEQ ID NO: 686929 - DNA, 25 bp, Mus musculus
gtccgcatagacattcttggtaaag

SEQ ID NO: 686930 - DNA, 25 bp, Mus musculus
gtccgcatagactttcttggtaaag

SEQ ID NO: 686931 - DNA, 25 bp, Mus musculus
gtccgcatagtcctagttcccgtta

SEQ ID NO: 686932 - DNA, 25 bp, Mus musculus
gtccgcatagtcgtagttcccgtta

SEQ ID NO: 686933 - DNA, 25 bp, Mus musculus
gtccgcatcaaacccctggaggaag

SEQ ID NO: 686934 - DNA, 25 bp, Mus musculus
gtccgcatcaaagccctggaggaag

SEQ ID NO: 686935 - DNA, 25 bp, Mus musculus
gtccgcatcttgagtcagtggtgtc

SEQ ID NO: 686936 - DNA, 25 bp, Mus musculus
gtccgcatcttgtgtcagtggtgtc

SEQ ID NO: 686937 - DNA, 25 bp, Mus musculus
gtccgcatggagaacattggagcat

SEQ ID NO: 686938 - DNA, 25 bp, Mus musculus
gtccgcatggagtacattggagcat

SEQ ID NO: 686939 - DNA, 25 bp, Mus musculus
gtccgccaagcacatcgaagccaag

SEQ ID NO: 686940 - DNA, 25 bp, Mus musculus
gtccgccaagcagatcgaagccaag

SEQ ID NO: 686941 - DNA, 25 bp, Mus musculus
gtccgccagcggattgactaggcat

SEQ ID NO: 686942 - DNA, 25 bp, Mus musculus
gtccgccagcggtttgactaggcat

SEQ ID NO: 686943 - DNA, 25 bp, Mus musculus
gtccgccatcctctatgcagaacga

SEQ ID NO: 686944 - DNA, 25 bp, Mus musculus
gtccgccatcctgtatgcagaacga

SEQ ID NO: 686945 - DNA, 25 bp, Mus musculus
gtccgcccttatacatgctgtgaga

SEQ ID NO: 686946 - DNA, 25 bp, Mus musculus
gtccgcccttattcatgctgtgaga

SEQ ID NO: 686947 - DNA, 25 bp, Mus musculus
gtccgccgacgtatgagtgtaattg

SEQ ID NO: 686948 - DNA, 25 bp, Mus musculus
gtccgccgacgtttgagtgtaattg

SEQ ID NO: 686949 - DNA, 25 bp, Mus musculus
gtccgccgaggtagtgccaaagaag

SEQ ID NO: 686950 - DNA, 25 bp, Mus musculus
gtccgccgaggttgtgccaaagaag

SEQ ID NO: 686951 - DNA, 25 bp, Mus musculus
gtccgccgctggatgcaagcgcaag

SEQ ID NO: 686952 - DNA, 25 bp, Mus musculus
gtccgccgctggttgcaagcgcaag

SEQ ID NO: 686953 - DNA, 25 bp, Mus musculus
gtccgcctaattccagtcatgagat

SEQ ID NO: 686954 - DNA, 25 bp, Mus musculus
gtccgcctaattgcagtcatgagat

SEQ ID NO: 686955 - DNA, 25 bp, Mus musculus
gtccgcctacttcaaaatgctttcc

SEQ ID NO: 686956 - DNA, 25 bp, Mus musculus
gtccgcctacttgaaaatgctttcc

SEQ ID NO: 686957 - DNA, 25 bp, Mus musculus
gtccgccttgttaagaaagagattc

SEQ ID NO: 686958 - DNA, 25 bp, Mus musculus
gtccgccttgtttagaaagagattc

SEQ ID NO: 686959 - DNA, 25 bp, Mus musculus
gtccgcggacatacgagagaagcac

SEQ ID NO: 686960 - DNA, 25 bp, Mus musculus
gtccgcggacattcgagagaagcac

SEQ ID NO: 686961 - DNA, 25 bp, Mus musculus
gtccgcgtgggcactgtcatgagaa

SEQ ID NO: 686962 - DNA, 25 bp, Mus musculus
gtccgcgtgggctctgtcatgagaa

SEQ ID NO: 686963 - DNA, 25 bp, Mus musculus
gtccgctacacgaaagatgtctacg

SEQ ID NO: 686964 - DNA, 25 bp, Mus musculus
gtccgctacacgtaagatgtctacg

SEQ ID NO: 686965 - DNA, 25 bp, Mus musculus
gtccgctatagaatgctaaggtgta

SEQ ID NO: 686966 - DNA, 25 bp, Mus musculus
gtccgctatagattgctaaggtgta

SEQ ID NO: 686967 - DNA, 25 bp, Mus musculus
gtccgctcacgaagtctgtggccca

SEQ ID NO: 686968 - DNA, 25 bp, Mus musculus
gtccgctcacgatgtctgtggccca

SEQ ID NO: 686969 - DNA, 25 bp, Mus musculus
gtccgctcattgctgtccccagatg

SEQ ID NO: 686970 - DNA, 25 bp, Mus musculus
gtccgctcattggtgtccccagatg

SEQ ID NO: 686971 - DNA, 25 bp, Mus musculus
gtccgctctgtgaaaggtcctgtgg

SEQ ID NO: 686972 - DNA, 25 bp, Mus musculus
gtccgctctgtgtaaggtcctgtgg

SEQ ID NO: 686973 - DNA, 25 bp, Mus musculus
gtccgctgggcgaacatcctggcta

SEQ ID NO: 686974 - DNA, 25 bp, Mus musculus
gtccgctgggcgtacatcctggcta

SEQ ID NO: 686975 - DNA, 25 bp, Mus musculus
gtccgctgttccattcattatatca

SEQ ID NO: 686976 - DNA, 25 bp, Mus musculus
gtccgctgttcctttcattatatca

SEQ ID NO: 686977 - DNA, 25 bp, Mus musculus
gtccgcttattacttgtctcattta

SEQ ID NO: 686978 - DNA, 25 bp, Mus musculus
gtccgcttattagttgtctcattta

SEQ ID NO: 686979 - DNA, 25 bp, Mus musculus
gtccgcttcctcatctataaaacag

SEQ ID NO: 686980 - DNA, 25 bp, Mus musculus
gtccgcttcctcttctataaaacag

SEQ ID NO: 686981 - DNA, 25 bp, Mus musculus
gtccgcttgggaactagaggctcca

SEQ ID NO: 686982 - DNA, 25 bp, Mus musculus
gtccgcttgggatctagaggctcca

SEQ ID NO: 686983 - DNA, 25 bp, Mus musculus
gtccgcttgtggcagttactaactt

SEQ ID NO: 686984 - DNA, 25 bp, Mus musculus
gtccgcttgtgggagttactaactt

SEQ ID NO: 686985 - DNA, 25 bp, Mus musculus
gtccgctttctgcacacgagcagaa

SEQ ID NO: 686986 - DNA, 25 bp, Mus musculus
gtccgctttctggacacgagcagaa

SEQ ID NO: 686987 - DNA, 25 bp, Mus musculus
gtccggaaactgagcaagtctgcaa

SEQ ID NO: 686988 - DNA, 25 bp, Mus musculus
gtccggaaactgtgcaagtctgcaa

SEQ ID NO: 686989 - DNA, 25 bp, Mus musculus
gtccggaatttcaatgccaactcag

SEQ ID NO: 686990 - DNA, 25 bp, Mus musculus
gtccggaatttctatgccaactcag

SEQ ID NO: 686991 - DNA, 25 bp, Mus musculus
gtccggacgtcacccccaagaagtg

SEQ ID NO: 686992 - DNA, 25 bp, Mus musculus
gtccggacgtcagccccaagaagtg

SEQ ID NO: 686993 - DNA, 25 bp, Mus musculus
gtccggactcggatgttattatcag

SEQ ID NO: 686994 - DNA, 25 bp, Mus musculus
gtccggactcggttgttattatcag

SEQ ID NO: 686995 - DNA, 25 bp, Mus musculus
gtccggagaaatctggaactcttca

SEQ ID NO: 686996 - DNA, 25 bp, Mus musculus
gtccggagaaatgtggaactcttca

SEQ ID NO: 686997 - DNA, 25 bp, Mus musculus
gtccggagcccacccagtgaatttt

SEQ ID NO: 686998 - DNA, 25 bp, Mus musculus
gtccggagcccagccagtgaatttt

SEQ ID NO: 686999 - DNA, 25 bp, Mus musculus
gtccggagggagactatccaaccca

SEQ ID NO: 687000 - DNA, 25 bp, Mus musculus
gtccggagggagtctatccaaccca

SEQ ID NO: 687001 - DNA, 25 bp, Mus musculus
gtccggagtttaactggctttatga

SEQ ID NO: 687002 - DNA, 25 bp, Mus musculus
gtccggagtttatctggctttatga

SEQ ID NO: 687003 - DNA, 25 bp, Mus musculus
gtccggatagacaaatctgtactga

SEQ ID NO: 687004 - DNA, 25 bp, Mus musculus
gtccggatagactaatctgtactga

SEQ ID NO: 687005 - DNA, 25 bp, Mus musculus
gtccggatctcaataggagtggttg

SEQ ID NO: 687006 - DNA, 25 bp, Mus musculus
gtccggatctcattaggagtggttg

SEQ ID NO: 687007 - DNA, 25 bp, Mus musculus
gtccggcaatatcgtatcattcctt

SEQ ID NO: 687008 - DNA, 25 bp, Mus musculus
gtccggcaatatggtatcattcctt

SEQ ID NO: 687009 - DNA, 25 bp, Mus musculus
gtccggcagacaagttacctgctgt

SEQ ID NO: 687010 - DNA, 25 bp, Mus musculus
gtccggcagacatgttacctgctgt

SEQ ID NO: 687011 - DNA, 25 bp, Mus musculus
gtccggcataccattgtcgattcta

SEQ ID NO: 687012 - DNA, 25 bp, Mus musculus
gtccggcatacctttgtcgattcta

SEQ ID NO: 687013 - DNA, 25 bp, Mus musculus
gtccggctctcaacttatttaattt

SEQ ID NO: 687014 - DNA, 25 bp, Mus musculus
gtccggctctcatcttatttaattt

SEQ ID NO: 687015 - DNA, 25 bp, Mus musculus
gtccgggacctgcaagcgaaccatt

SEQ ID NO: 687016 - DNA, 25 bp, Mus musculus
gtccgggacctggaagcgaaccatt

SEQ ID NO: 687017 - DNA, 25 bp, Mus musculus
gtccgggagctgagagacctgtaca

SEQ ID NO: 687018 - DNA, 25 bp, Mus musculus
gtccgggagctgtgagacctgtaca

SEQ ID NO: 687019 - DNA, 25 bp, Mus musculus
gtccgggaggtcacagccttaggca

SEQ ID NO: 687020 - DNA, 25 bp, Mus musculus
gtccgggaggtctcagccttaggca

SEQ ID NO: 687021 - DNA, 25 bp, Mus musculus
gtccgggcacgcctaaggcttctcg

SEQ ID NO: 687022 - DNA, 25 bp, Mus musculus
gtccgggcacgcgtaaggcttctcg

SEQ ID NO: 687023 - DNA, 25 bp, Mus musculus
gtccgggccattactcttatggttg

SEQ ID NO: 687024 - DNA, 25 bp, Mus musculus
gtccgggccatttctcttatggttg

SEQ ID NO: 687025 - DNA, 25 bp, Mus musculus
gtccgggctgatcacgatagctccc

SEQ ID NO: 687026 - DNA, 25 bp, Mus musculus
gtccgggctgatgacgatagctccc

SEQ ID NO: 687027 - DNA, 25 bp, Mus musculus
gtccgggctgcactctctggaagaa

SEQ ID NO: 687028 - DNA, 25 bp, Mus musculus
gtccgggctgcagtctctggaagaa

SEQ ID NO: 687029 - DNA, 25 bp, Mus musculus
gtccgggctgtcactcagaatggaa

SEQ ID NO: 687030 - DNA, 25 bp, Mus musculus
gtccgggctgtctctcagaatggaa

SEQ ID NO: 687031 - DNA, 25 bp, Mus musculus
gtccgggtcagccataagatccttc

SEQ ID NO: 687032 - DNA, 25 bp, Mus musculus
gtccgggtcagcgataagatccttc

SEQ ID NO: 687033 - DNA, 25 bp, Mus musculus
gtccgggtgcctcagttgtaacttg

SEQ ID NO: 687034 - DNA, 25 bp, Mus musculus
gtccgggtgcctgagttgtaacttg

SEQ ID NO: 687035 - DNA, 25 bp, Mus musculus
gtccgggtgcggctccgctgagcgg

SEQ ID NO: 687036 - DNA, 25 bp, Mus musculus
gtccgggtgcgggtccgctgagcgg

SEQ ID NO: 687037 - DNA, 25 bp, Mus musculus
gtccgggttcacacagcgatgcaga

SEQ ID NO: 687038 - DNA, 25 bp, Mus musculus
gtccgggttcactcagcgatgcaga

SEQ ID NO: 687039 - DNA, 25 bp, Mus musculus
gtccgggttcttctgctgtgcagac

SEQ ID NO: 687040 - DNA, 25 bp, Mus musculus
gtccgggttcttgtgctgtgcagac

SEQ ID NO: 687041 - DNA, 25 bp, Mus musculus
gtccggtacagcatccggtacagct

SEQ ID NO: 687042 - DNA, 25 bp, Mus musculus
gtccggtacagcttccggtacagct

SEQ ID NO: 687043 - DNA, 25 bp, Mus musculus
gtccggtatgtacattcacagtact

SEQ ID NO: 687044 - DNA, 25 bp, Mus musculus
gtccggtatgtagattcacagtact

SEQ ID NO: 687045 - DNA, 25 bp, Mus musculus
gtccggtcctgtccgcagtggtcac

SEQ ID NO: 687046 - DNA, 25 bp, Mus musculus
gtccggtcctgtgcgcagtggtcac

SEQ ID NO: 687047 - DNA, 25 bp, Mus musculus
gtccgtaagtggacctttctcctca

SEQ ID NO: 687048 - DNA, 25 bp, Mus musculus
gtccgtaagtggtcctttctcctca

SEQ ID NO: 687049 - DNA, 25 bp, Mus musculus
gtccgtacatatcttgtagcactta

SEQ ID NO: 687050 - DNA, 25 bp, Mus musculus
gtccgtacatatgttgtagcactta

SEQ ID NO: 687051 - DNA, 25 bp, Mus musculus
gtccgtactgtgcacttttcacaag

SEQ ID NO: 687052 - DNA, 25 bp, Mus musculus
gtccgtactgtggacttttcacaag

SEQ ID NO: 687053 - DNA, 25 bp, Mus musculus
gtccgtagtgctccgctcgttttcg

SEQ ID NO: 687054 - DNA, 25 bp, Mus musculus
gtccgtagtgctgcgctcgttttcg

SEQ ID NO: 687055 - DNA, 25 bp, Mus musculus
gtccgtatcaccagtatgtatctta

SEQ ID NO: 687056 - DNA, 25 bp, Mus musculus
gtccgtatcacctgtatgtatctta

SEQ ID NO: 687057 - DNA, 25 bp, Mus musculus
gtccgtcaagcccatctataaaaaa

SEQ ID NO: 687058 - DNA, 25 bp, Mus musculus
gtccgtcaagccgatctataaaaaa

SEQ ID NO: 687059 - DNA, 25 bp, Mus musculus
gtccgtcacggcacagaaggagtca

SEQ ID NO: 687060 - DNA, 25 bp, Mus musculus
gtccgtcacggctcagaaggagtca

SEQ ID NO: 687061 - DNA, 25 bp, Mus musculus
gtccgtcatgttagctttttgtgat

SEQ ID NO: 687062 - DNA, 25 bp, Mus musculus
gtccgtcatgtttgctttttgtgat

SEQ ID NO: 687063 - DNA, 25 bp, Mus musculus
gtccgtccagtaaaacaacttaagt

SEQ ID NO: 687064 - DNA, 25 bp, Mus musculus
gtccgtccagtataacaacttaagt

SEQ ID NO: 687065 - DNA, 25 bp, Mus musculus
gtccgtccgacgagtgagatctact

SEQ ID NO: 687066 - DNA, 25 bp, Mus musculus
gtccgtccgacgtgtgagatctact

SEQ ID NO: 687067 - DNA, 25 bp, Mus musculus
gtccgtcctgtaagtatcacttttg

SEQ ID NO: 687068 - DNA, 25 bp, Mus musculus
gtccgtcctgtatgtatcacttttg

SEQ ID NO: 687069 - DNA, 25 bp, Mus musculus
gtccgtctactacagagtctattat

SEQ ID NO: 687070 - DNA, 25 bp, Mus musculus
gtccgtctactagagagtctattat

SEQ ID NO: 687071 - DNA, 25 bp, Mus musculus
gtccgtctgaatcgagctcttgaag

SEQ ID NO: 687072 - DNA, 25 bp, Mus musculus
gtccgtctgaatggagctcttgaag

SEQ ID NO: 687073 - DNA, 25 bp, Mus musculus
gtccgtctgcccattgaagcagaga

SEQ ID NO: 687074 - DNA, 25 bp, Mus musculus
gtccgtctgccctttgaagcagaga

SEQ ID NO: 687075 - DNA, 25 bp, Mus musculus
gtccgtctgtccagtaagcaggtaa

SEQ ID NO: 687076 - DNA, 25 bp, Mus musculus
gtccgtctgtcctgtaagcaggtaa

SEQ ID NO: 687077 - DNA, 25 bp, Mus musculus
gtccgtcttagacctgacagtctgt

SEQ ID NO: 687078 - DNA, 25 bp, Mus musculus
gtccgtcttagagctgacagtctgt

SEQ ID NO: 687079 - DNA, 25 bp, Mus musculus
gtccgtgaccaaagacgtcaagcag

SEQ ID NO: 687080 - DNA, 25 bp, Mus musculus
gtccgtgaccaatgacgtcaagcag

SEQ ID NO: 687081 - DNA, 25 bp, Mus musculus
gtccgtgagggcattccttctgttg

SEQ ID NO: 687082 - DNA, 25 bp, Mus musculus
gtccgtgagggctttccttctgttg

SEQ ID NO: 687083 - DNA, 25 bp, Mus musculus
gtccgtgccacacgagcgccaattg

SEQ ID NO: 687084 - DNA, 25 bp, Mus musculus
gtccgtgccacactaatgcagctga

SEQ ID NO: 687085 - DNA, 25 bp, Mus musculus
gtccgtgccacaggagcgccaattg

SEQ ID NO: 687086 - DNA, 25 bp, Mus musculus
gtccgtgccacagtaatgcagctga

SEQ ID NO: 687087 - DNA, 25 bp, Mus musculus
gtccgtgcgtgtactcaaagccaga

SEQ ID NO: 687088 - DNA, 25 bp, Mus musculus
gtccgtgcgtgttctcaaagccaga

SEQ ID NO: 687089 - DNA, 25 bp, Mus musculus
gtccgtgctaaaacccagtcaacag

SEQ ID NO: 687090 - DNA, 25 bp, Mus musculus
gtccgtgctaaatcccagtcaacag

SEQ ID NO: 687091 - DNA, 25 bp, Mus musculus
gtccgtggacaacttggttgattcc

SEQ ID NO: 687092 - DNA, 25 bp, Mus musculus
gtccgtggacaagttggttgattcc

SEQ ID NO: 687093 - DNA, 25 bp, Mus musculus
gtccgtggcatgctgctacaagaca

SEQ ID NO: 687094 - DNA, 25 bp, Mus musculus
gtccgtggcatggtgctacaagaca

SEQ ID NO: 687095 - DNA, 25 bp, Mus musculus
gtccgtggccaaccacagacttata

SEQ ID NO: 687096 - DNA, 25 bp, Mus musculus
gtccgtggccaagcacagacttata

SEQ ID NO: 687097 - DNA, 25 bp, Mus musculus
gtccgtgggagtaactttacagctt

SEQ ID NO: 687098 - DNA, 25 bp, Mus musculus
gtccgtgggagttactttacagctt

SEQ ID NO: 687099 - DNA, 25 bp, Mus musculus
gtccgtggtcgtaccgcgccgtcat

SEQ ID NO: 687100 - DNA, 25 bp, Mus musculus
gtccgtggtcgttccgcgccgtcat

SEQ ID NO: 687101 - DNA, 25 bp, Mus musculus
gtccgtggtttgctttgattgattt

SEQ ID NO: 687102 - DNA, 25 bp, Mus musculus
gtccgtggtttggtttgattgattt

SEQ ID NO: 687103 - DNA, 25 bp, Mus musculus
gtccgtgtagtcagtaaacaactcc

SEQ ID NO: 687104 - DNA, 25 bp, Mus musculus
gtccgtgtagtctgtaaacaactcc

SEQ ID NO: 687105 - DNA, 25 bp, Mus musculus
gtccgtgtcgaaagctgtactttaa

SEQ ID NO: 687106 - DNA, 25 bp, Mus musculus
gtccgtgtcgaatgctgtactttaa

SEQ ID NO: 687107 - DNA, 25 bp, Mus musculus
gtccgtgtcgatcctgtaactttaa

SEQ ID NO: 687108 - DNA, 25 bp, Mus musculus
gtccgtgtcgatgctgtaactttaa

SEQ ID NO: 687109 - DNA, 25 bp, Mus musculus
gtccgtgttcaacccttagagcttg

SEQ ID NO: 687110 - DNA, 25 bp, Mus musculus
gtccgtgttcaagccttagagcttg

SEQ ID NO: 687111 - DNA, 25 bp, Mus musculus
gtccgttaccttcccaaggagcagg

SEQ ID NO: 687112 - DNA, 25 bp, Mus musculus
gtccgttaccttgccaaggagcagg

SEQ ID NO: 687113 - DNA, 25 bp, Mus musculus
gtccgttatgttcatggctacatct

SEQ ID NO: 687114 - DNA, 25 bp, Mus musculus
gtccgttatgttgatggctacatct

SEQ ID NO: 687115 - DNA, 25 bp, Mus musculus
gtccgttcaaacattgtgattccct

SEQ ID NO: 687116 - DNA, 25 bp, Mus musculus
gtccgttcaaactttgtgattccct

SEQ ID NO: 687117 - DNA, 25 bp, Mus musculus
gtccgttcactcccgtgtgatttat

SEQ ID NO: 687118 - DNA, 25 bp, Mus musculus
gtccgttcactcgcgtgtgatttat

SEQ ID NO: 687119 - DNA, 25 bp, Mus musculus
gtccgttccatcagtgagaaatcac

SEQ ID NO: 687120 - DNA, 25 bp, Mus musculus
gtccgttccatctgtgagaaatcac

SEQ ID NO: 687121 - DNA, 25 bp, Mus musculus
gtccgttcttggatgccatgtatat

SEQ ID NO: 687122 - DNA, 25 bp, Mus musculus
gtccgttcttggttgccatgtatat

SEQ ID NO: 687123 - DNA, 25 bp, Mus musculus
gtccgttgttatcttcattttgctg

SEQ ID NO: 687124 - DNA, 25 bp, Mus musculus
gtccgttgttatgttcattttgctg

SEQ ID NO: 687125 - DNA, 25 bp, Mus musculus
gtcctaaacactctaggccaggtcc

SEQ ID NO: 687126 - DNA, 25 bp, Mus musculus
gtcctaaacactgtaggccaggtcc

SEQ ID NO: 687127 - DNA, 25 bp, Mus musculus
gtcctaacacctacactctaatatt

SEQ ID NO: 687128 - DNA, 25 bp, Mus musculus
gtcctaacaccttcactctaatatt

SEQ ID NO: 687129 - DNA, 25 bp, Mus musculus
gtcctaacatttagaagacctccat

SEQ ID NO: 687130 - DNA, 25 bp, Mus musculus
gtcctaacattttgaagacctccat

SEQ ID NO: 687131 - DNA, 25 bp, Mus musculus
gtcctaacgggcaatgtcatcatag

SEQ ID NO: 687132 - DNA, 25 bp, Mus musculus
gtcctaacgggctatgtcatcatag

SEQ ID NO: 687133 - DNA, 25 bp, Mus musculus
gtcctaagaggacacccgctgtgaa

SEQ ID NO: 687134 - DNA, 25 bp, Mus musculus
gtcctaagaggacatacgttctatt

SEQ ID NO: 687135 - DNA, 25 bp, Mus musculus
gtcctaagaggagacccgctgtgaa

SEQ ID NO: 687136 - DNA, 25 bp, Mus musculus
gtcctaagaggagatacgttctatt

SEQ ID NO: 687137 - DNA, 25 bp, Mus musculus
gtcctaagatctctgatattcaaaa

SEQ ID NO: 687138 - DNA, 25 bp, Mus musculus
gtcctaagatctgtgatattcaaaa

SEQ ID NO: 687139 - DNA, 25 bp, Mus musculus
gtcctaagattcatatgggcagcaa

SEQ ID NO: 687140 - DNA, 25 bp, Mus musculus
gtcctaagattcttatgggcagcaa

SEQ ID NO: 687141 - DNA, 25 bp, Mus musculus
gtcctaagctgtccactggagacat

SEQ ID NO: 687142 - DNA, 25 bp, Mus musculus
gtcctaagctgtgcactggagacat

SEQ ID NO: 687143 - DNA, 25 bp, Mus musculus
gtcctaaggaatcccatgctttctt

SEQ ID NO: 687144 - DNA, 25 bp, Mus musculus
gtcctaaggaatgccatgctttctt

SEQ ID NO: 687145 - DNA, 25 bp, Mus musculus
gtcctaaggagtaacaatgccagtt

SEQ ID NO: 687146 - DNA, 25 bp, Mus musculus
gtcctaaggagtagagaatggcact

SEQ ID NO: 687147 - DNA, 25 bp, Mus musculus
gtcctaaggagttacaatgccagtt

SEQ ID NO: 687148 - DNA, 25 bp, Mus musculus
gtcctaaggagttgagaatggcact

SEQ ID NO: 687149 - DNA, 25 bp, Mus musculus
gtcctaagggttagcctggagcgat

SEQ ID NO: 687150 - DNA, 25 bp, Mus musculus
gtcctaagggtttgcctggagcgat

SEQ ID NO: 687151 - DNA, 25 bp, Mus musculus
gtcctaagtctgaggctcgaattgc

SEQ ID NO: 687152 - DNA, 25 bp, Mus musculus
gtcctaagtctgtggctcgaattgc

SEQ ID NO: 687153 - DNA, 25 bp, Mus musculus
gtcctaagtgtgatcattgctattc

SEQ ID NO: 687154 - DNA, 25 bp, Mus musculus
gtcctaagtgtgttcattgctattc

SEQ ID NO: 687155 - DNA, 25 bp, Mus musculus
gtcctaatcctacatgtgagaacat

SEQ ID NO: 687156 - DNA, 25 bp, Mus musculus
gtcctaatcctagatgtgagaacat

SEQ ID NO: 687157 - DNA, 25 bp, Mus musculus
gtcctaatctgaatactgagcacga

SEQ ID NO: 687158 - DNA, 25 bp, Mus musculus
gtcctaatctgattactgagcacga

SEQ ID NO: 687159 - DNA, 25 bp, Mus musculus
gtcctaatgcagactttgcagctca

SEQ ID NO: 687160 - DNA, 25 bp, Mus musculus
gtcctaatgcagtctttgcagctca

SEQ ID NO: 687161 - DNA, 25 bp, Mus musculus
gtcctaattactactcagttgtcct

SEQ ID NO: 687162 - DNA, 25 bp, Mus musculus
gtcctaattacttctcagttgtcct

SEQ ID NO: 687163 - DNA, 25 bp, Mus musculus
gtcctaattgtactgtttgctgatt

SEQ ID NO: 687164 - DNA, 25 bp, Mus musculus
gtcctaattgtagtgtttgctgatt

SEQ ID NO: 687165 - DNA, 25 bp, Mus musculus
gtcctaatttcaaacttcagcctat

SEQ ID NO: 687166 - DNA, 25 bp, Mus musculus
gtcctaatttcacattatccacttt

SEQ ID NO: 687167 - DNA, 25 bp, Mus musculus
gtcctaatttcagattatccacttt

SEQ ID NO: 687168 - DNA, 25 bp, Mus musculus
gtcctaatttcatacttcagcctat

SEQ ID NO: 687169 - DNA, 25 bp, Mus musculus
gtcctacaatacaactctgccaact

SEQ ID NO: 687170 - DNA, 25 bp, Mus musculus
gtcctacaatactactctgccaact

SEQ ID NO: 687171 - DNA, 25 bp, Mus musculus
gtcctacacattagattccaaagtg

SEQ ID NO: 687172 - DNA, 25 bp, Mus musculus
gtcctacacatttgattccaaagtg

SEQ ID NO: 687173 - DNA, 25 bp, Mus musculus
gtcctacaccaaagttccacagaga

SEQ ID NO: 687174 - DNA, 25 bp, Mus musculus
gtcctacaccaatgttccacagaga

SEQ ID NO: 687175 - DNA, 25 bp, Mus musculus
gtcctacagacaaagcctccagaaa

SEQ ID NO: 687176 - DNA, 25 bp, Mus musculus
gtcctacagacatagcctccagaaa

SEQ ID NO: 687177 - DNA, 25 bp, Mus musculus
gtcctacagggcagcagcactaaga

SEQ ID NO: 687178 - DNA, 25 bp, Mus musculus
gtcctacagggctgcagcactaaga

SEQ ID NO: 687179 - DNA, 25 bp, Mus musculus
gtcctaccagaacaacagctatcag

SEQ ID NO: 687180 - DNA, 25 bp, Mus musculus
gtcctaccagaagaacagctatcag

SEQ ID NO: 687181 - DNA, 25 bp, Mus musculus
gtcctaccagatcgatttcaacatt

SEQ ID NO: 687182 - DNA, 25 bp, Mus musculus
gtcctaccagatggatttcaacatt

SEQ ID NO: 687183 - DNA, 25 bp, Mus musculus
gtcctacccattcaacagagtactg

SEQ ID NO: 687184 - DNA, 25 bp, Mus musculus
gtcctacccattgaacagagtactg

SEQ ID NO: 687185 - DNA, 25 bp, Mus musculus
gtcctacctattccctatctatgtg

SEQ ID NO: 687186 - DNA, 25 bp, Mus musculus
gtcctacctattgcctatctatgtg

SEQ ID NO: 687187 - DNA, 25 bp, Mus musculus
gtcctacctgagaatttcctagctg

SEQ ID NO: 687188 - DNA, 25 bp, Mus musculus
gtcctacctgagtatttcctagctg

SEQ ID NO: 687189 - DNA, 25 bp, Mus musculus
gtcctacctgtgagtaaatgctgat

SEQ ID NO: 687190 - DNA, 25 bp, Mus musculus
gtcctacctgtgtgtaaatgctgat

SEQ ID NO: 687191 - DNA, 25 bp, Mus musculus
gtcctaccttagagttccaggtaat

SEQ ID NO: 687192 - DNA, 25 bp, Mus musculus
gtcctaccttagtgttccaggtaat

SEQ ID NO: 687193 - DNA, 25 bp, Mus musculus
gtcctaccttctatcaaccaagaga

SEQ ID NO: 687194 - DNA, 25 bp, Mus musculus
gtcctaccttctttcaaccaagaga

SEQ ID NO: 687195 - DNA, 25 bp, Mus musculus
gtcctacgttccaggcatggatgtg

SEQ ID NO: 687196 - DNA, 25 bp, Mus musculus
gtcctacgttcctggcatggatgtg

SEQ ID NO: 687197 - DNA, 25 bp, Mus musculus
gtcctactccacagatgagactggt

SEQ ID NO: 687198 - DNA, 25 bp, Mus musculus
gtcctactccactgatgagactggt

SEQ ID NO: 687199 - DNA, 25 bp, Mus musculus
gtcctactcgctccatgcactggaa

SEQ ID NO: 687200 - DNA, 25 bp, Mus musculus
gtcctactcgctgcatgcactggaa

SEQ ID NO: 687201 - DNA, 25 bp, Mus musculus
gtcctactgatgactttccagatgt

SEQ ID NO: 687202 - DNA, 25 bp, Mus musculus
gtcctactgatgtctttccagatgt

SEQ ID NO: 687203 - DNA, 25 bp, Mus musculus
gtcctactgccacttctgaataatg

SEQ ID NO: 687204 - DNA, 25 bp, Mus musculus
gtcctactgccagttctgaataatg

SEQ ID NO: 687205 - DNA, 25 bp, Mus musculus
gtcctactgctcaacatgctcattg

SEQ ID NO: 687206 - DNA, 25 bp, Mus musculus
gtcctactgctctacatgctcattg

SEQ ID NO: 687207 - DNA, 25 bp, Mus musculus
gtcctactgtccagtttgtgagttc

SEQ ID NO: 687208 - DNA, 25 bp, Mus musculus
gtcctactgtcctgtttgtgagttc

SEQ ID NO: 687209 - DNA, 25 bp, Mus musculus
gtcctactgttaatctcccgtaaca

SEQ ID NO: 687210 - DNA, 25 bp, Mus musculus
gtcctactgttattctcccgtaaca

SEQ ID NO: 687211 - DNA, 25 bp, Mus musculus
gtcctacttaacaggtgaacccacg

SEQ ID NO: 687212 - DNA, 25 bp, Mus musculus
gtcctacttaactggtgaacccacg

SEQ ID NO: 687213 - DNA, 25 bp, Mus musculus
gtcctacttctaaagtccctactat

SEQ ID NO: 687214 - DNA, 25 bp, Mus musculus
gtcctacttctatagtccctactat

SEQ ID NO: 687215 - DNA, 25 bp, Mus musculus
gtcctacttctgattctgtaccata

SEQ ID NO: 687216 - DNA, 25 bp, Mus musculus
gtcctacttctgtttctgtaccata

SEQ ID NO: 687217 - DNA, 25 bp, Mus musculus
gtcctacttgagacaggcggttata

SEQ ID NO: 687218 - DNA, 25 bp, Mus musculus
gtcctacttgagtcaggcggttata

SEQ ID NO: 687219 - DNA, 25 bp, Mus musculus
gtcctactttgactgagcaggcgtg

SEQ ID NO: 687220 - DNA, 25 bp, Mus musculus
gtcctactttgagtgagcaggcgtg

SEQ ID NO: 687221 - DNA, 25 bp, Mus musculus
gtcctactttttaatgcaatggccg

SEQ ID NO: 687222 - DNA, 25 bp, Mus musculus
gtcctacttttttatgcaatggccg

SEQ ID NO: 687223 - DNA, 25 bp, Mus musculus
gtcctagaacttcccttgaatttac

SEQ ID NO: 687224 - DNA, 25 bp, Mus musculus
gtcctagaacttgccttgaatttac

SEQ ID NO: 687225 - DNA, 25 bp, Mus musculus
gtcctagacaaacttggtcccacag

SEQ ID NO: 687226 - DNA, 25 bp, Mus musculus
gtcctagacaaagttggtcccacag

SEQ ID NO: 687227 - DNA, 25 bp, Mus musculus
gtcctagactacagaagtgtcctct

SEQ ID NO: 687228 - DNA, 25 bp, Mus musculus
gtcctagactactgaagtgtcctct

SEQ ID NO: 687229 - DNA, 25 bp, Mus musculus
gtcctagagaaaaatgttttgattt

SEQ ID NO: 687230 - DNA, 25 bp, Mus musculus
gtcctagagaaatatgttttgattt

SEQ ID NO: 687231 - DNA, 25 bp, Mus musculus
gtcctagaggccacctatggagagt

SEQ ID NO: 687232 - DNA, 25 bp, Mus musculus
gtcctagaggcctcctatggagagt

SEQ ID NO: 687233 - DNA, 25 bp, Mus musculus
gtcctagatgtcaaaattctgtcag

SEQ ID NO: 687234 - DNA, 25 bp, Mus musculus
gtcctagatgtctaaattctgtcag

SEQ ID NO: 687235 - DNA, 25 bp, Mus musculus
gtcctagcaaagctacttgggccct

SEQ ID NO: 687236 - DNA, 25 bp, Mus musculus
gtcctagcaaaggtacttgggccct

SEQ ID NO: 687237 - DNA, 25 bp, Mus musculus
gtcctagcaacaatcacctttcggg

SEQ ID NO: 687238 - DNA, 25 bp, Mus musculus
gtcctagcaacattcacctttcggg

SEQ ID NO: 687239 - DNA, 25 bp, Mus musculus
gtcctagcagtgatagtccgagaga

SEQ ID NO: 687240 - DNA, 25 bp, Mus musculus
gtcctagcagtgttagtccgagaga

SEQ ID NO: 687241 - DNA, 25 bp, Mus musculus
gtcctagctgctcactcattataaa

SEQ ID NO: 687242 - DNA, 25 bp, Mus musculus
gtcctagctgctgactcattataaa

SEQ ID NO: 687243 - DNA, 25 bp, Mus musculus
gtcctagctttcactcagatggctt

SEQ ID NO: 687244 - DNA, 25 bp, Mus musculus
gtcctagctttctctcagatggctt

SEQ ID NO: 687245 - DNA, 25 bp, Mus musculus
gtcctaggaaacacaccataaattg

SEQ ID NO: 687246 - DNA, 25 bp, Mus musculus
gtcctaggaaactcaccataaattg

SEQ ID NO: 687247 - DNA, 25 bp, Mus musculus
gtcctaggaagcagacttatcctca

SEQ ID NO: 687248 - DNA, 25 bp, Mus musculus
gtcctaggaagctgacttatcctca

SEQ ID NO: 687249 - DNA, 25 bp, Mus musculus
gtcctaggaatccatgacactgcct

SEQ ID NO: 687250 - DNA, 25 bp, Mus musculus
gtcctaggaatcgatgacactgcct

SEQ ID NO: 687251 - DNA, 25 bp, Mus musculus
gtcctaggagagaccgtcgtttaca

SEQ ID NO: 687252 - DNA, 25 bp, Mus musculus
gtcctaggagagtccgtcgtttaca

SEQ ID NO: 687253 - DNA, 25 bp, Mus musculus
gtcctaggcagacaggtgctcaatt

SEQ ID NO: 687254 - DNA, 25 bp, Mus musculus
gtcctaggcagagaggtgctcaatt

SEQ ID NO: 687255 - DNA, 25 bp, Mus musculus
gtcctaggccatcagggatatgtag

SEQ ID NO: 687256 - DNA, 25 bp, Mus musculus
gtcctaggccatgagggatatgtag

SEQ ID NO: 687257 - DNA, 25 bp, Mus musculus
gtcctaggccggaagcacatgctga

SEQ ID NO: 687258 - DNA, 25 bp, Mus musculus
gtcctaggccggtagcacatgctga

SEQ ID NO: 687259 - DNA, 25 bp, Mus musculus
gtcctagggacacagttcatcaaga

SEQ ID NO: 687260 - DNA, 25 bp, Mus musculus
gtcctagggacagagttcatcaaga

SEQ ID NO: 687261 - DNA, 25 bp, Mus musculus
gtcctagggcctaaggttagcttct

SEQ ID NO: 687262 - DNA, 25 bp, Mus musculus
gtcctagggccttaggttagcttct

SEQ ID NO: 687263 - DNA, 25 bp, Mus musculus
gtcctagtaaggacgtgtgtcttct

SEQ ID NO: 687264 - DNA, 25 bp, Mus musculus
gtcctagtaaggtcgtgtgtcttct

SEQ ID NO: 687265 - DNA, 25 bp, Mus musculus
gtcctagtattaatcagccttgatt

SEQ ID NO: 687266 - DNA, 25 bp, Mus musculus
gtcctagtattattcagccttgatt

SEQ ID NO: 687267 - DNA, 25 bp, Mus musculus
gtcctagtcgatcgctgctccaaaa

SEQ ID NO: 687268 - DNA, 25 bp, Mus musculus
gtcctagtcgatggctgctccaaaa

SEQ ID NO: 687269 - DNA, 25 bp, Mus musculus
gtcctagtgaagagagggcgccctt

SEQ ID NO: 687270 - DNA, 25 bp, Mus musculus
gtcctagtgaagtgagggcgccctt

SEQ ID NO: 687271 - DNA, 25 bp, Mus musculus
gtcctagtgactaaaaatttcaatt

SEQ ID NO: 687272 - DNA, 25 bp, Mus musculus
gtcctagtgacttaaaatttcaatt

SEQ ID NO: 687273 - DNA, 25 bp, Mus musculus
gtcctagttagcaattctcttgcaa

SEQ ID NO: 687274 - DNA, 25 bp, Mus musculus
gtcctagttagctattctcttgcaa

SEQ ID NO: 687275 - DNA, 25 bp, Mus musculus
gtcctataaatccagagtttgggag

SEQ ID NO: 687276 - DNA, 25 bp, Mus musculus
gtcctataaatcgagagtttgggag

SEQ ID NO: 687277 - DNA, 25 bp, Mus musculus
gtcctataactgaaaatcgcctggt

SEQ ID NO: 687278 - DNA, 25 bp, Mus musculus
gtcctataactgtaaatcgcctggt

SEQ ID NO: 687279 - DNA, 25 bp, Mus musculus
gtcctataagccatgatttgtgtga

SEQ ID NO: 687280 - DNA, 25 bp, Mus musculus
gtcctataagccttgatttgtgtga

SEQ ID NO: 687281 - DNA, 25 bp, Mus musculus
gtcctataattaaacccctgcacat

SEQ ID NO: 687282 - DNA, 25 bp, Mus musculus
gtcctataattatacccctgcacat

SEQ ID NO: 687283 - DNA, 25 bp, Mus musculus
gtcctatactagagtgccatggcat

SEQ ID NO: 687284 - DNA, 25 bp, Mus musculus
gtcctatactagtgtgccatggcat

SEQ ID NO: 687285 - DNA, 25 bp, Mus musculus
gtcctatagagacaacggtccccag

SEQ ID NO: 687286 - DNA, 25 bp, Mus musculus
gtcctatagagagaacggtccccag

SEQ ID NO: 687287 - DNA, 25 bp, Mus musculus
gtcctataggtcacagagccacgcc

SEQ ID NO: 687288 - DNA, 25 bp, Mus musculus
gtcctataggtctcagagccacgcc

SEQ ID NO: 687289 - DNA, 25 bp, Mus musculus
gtcctatatcttctgtttctctaca

SEQ ID NO: 687290 - DNA, 25 bp, Mus musculus
gtcctatatcttgtgtttctctaca

SEQ ID NO: 687291 - DNA, 25 bp, Mus musculus
gtcctatcatatacatcaacaacgt

SEQ ID NO: 687292 - DNA, 25 bp, Mus musculus
gtcctatcatattcatcaacaacgt

SEQ ID NO: 687293 - DNA, 25 bp, Mus musculus
gtcctatcctatcgctcaaacaaga

SEQ ID NO: 687294 - DNA, 25 bp, Mus musculus
gtcctatcctatggctcaaacaaga

SEQ ID NO: 687295 - DNA, 25 bp, Mus musculus
gtcctatgaaaaccacccagcaggg

SEQ ID NO: 687296 - DNA, 25 bp, Mus musculus
gtcctatgaaaagcacccagcaggg

SEQ ID NO: 687297 - DNA, 25 bp, Mus musculus
gtcctatgaatcacttggcaagcca

SEQ ID NO: 687298 - DNA, 25 bp, Mus musculus
gtcctatgaatctcttggcaagcca

SEQ ID NO: 687299 - DNA, 25 bp, Mus musculus
gtcctatgagcacagctgtggtgct

SEQ ID NO: 687300 - DNA, 25 bp, Mus musculus
gtcctatgagcagagctgtggtgct

SEQ ID NO: 687301 - DNA, 25 bp, Mus musculus
gtcctatgatccagcttcatcttaa

SEQ ID NO: 687302 - DNA, 25 bp, Mus musculus
gtcctatgatcctgcttcatcttaa

SEQ ID NO: 687303 - DNA, 25 bp, Mus musculus
gtcctatgccagattggacgggctt

SEQ ID NO: 687304 - DNA, 25 bp, Mus musculus
gtcctatgccagtttggacgggctt

SEQ ID NO: 687305 - DNA, 25 bp, Mus musculus
gtcctatgccccacttgtggcaaaa

SEQ ID NO: 687306 - DNA, 25 bp, Mus musculus
gtcctatgcccctcttgtggcaaaa

SEQ ID NO: 687307 - DNA, 25 bp, Mus musculus
gtcctatggaaacctctcccagtag

SEQ ID NO: 687308 - DNA, 25 bp, Mus musculus
gtcctatggaaagctctcccagtag

SEQ ID NO: 687309 - DNA, 25 bp, Mus musculus
gtcctatggattcgcagcttggtgc

SEQ ID NO: 687310 - DNA, 25 bp, Mus musculus
gtcctatggattggcagcttggtgc

SEQ ID NO: 687311 - DNA, 25 bp, Mus musculus
gtcctatggccaatttcatttgata

SEQ ID NO: 687312 - DNA, 25 bp, Mus musculus
gtcctatggccattttcatttgata

SEQ ID NO: 687313 - DNA, 25 bp, Mus musculus
gtcctatggcccattctcgattttt

SEQ ID NO: 687314 - DNA, 25 bp, Mus musculus
gtcctatggccctttctcgattttt

SEQ ID NO: 687315 - DNA, 25 bp, Mus musculus
gtcctatggctcaagcaaagttggc

SEQ ID NO: 687316 - DNA, 25 bp, Mus musculus
gtcctatggctctagcaaagttggc

SEQ ID NO: 687317 - DNA, 25 bp, Mus musculus
gtcctatgttgactgtttcccatga

SEQ ID NO: 687318 - DNA, 25 bp, Mus musculus
gtcctatgttgagtgtttcccatga

SEQ ID NO: 687319 - DNA, 25 bp, Mus musculus
gtcctatgttggaaactggtctccc

SEQ ID NO: 687320 - DNA, 25 bp, Mus musculus
gtcctatgttggcttgttttctatt

SEQ ID NO: 687321 - DNA, 25 bp, Mus musculus
gtcctatgttgggttgttttctatt

SEQ ID NO: 687322 - DNA, 25 bp, Mus musculus
gtcctatgttggtaactggtctccc

SEQ ID NO: 687323 - DNA, 25 bp, Mus musculus
gtcctattaaatctgttgtgttcta

SEQ ID NO: 687324 - DNA, 25 bp, Mus musculus
gtcctattaaatgtgttgtgttcta

SEQ ID NO: 687325 - DNA, 25 bp, Mus musculus
gtcctattaatgataccagaagcaa

SEQ ID NO: 687326 - DNA, 25 bp, Mus musculus
gtcctattaatgttaccagaagcaa

SEQ ID NO: 687327 - DNA, 25 bp, Mus musculus
gtcctattaattcagctccggagca

SEQ ID NO: 687328 - DNA, 25 bp, Mus musculus
gtcctattaattgagctccggagca

SEQ ID NO: 687329 - DNA, 25 bp, Mus musculus
gtcctattctgcctggtgctgctgt

SEQ ID NO: 687330 - DNA, 25 bp, Mus musculus
gtcctattctgcgtggtgctgctgt

SEQ ID NO: 687331 - DNA, 25 bp, Mus musculus
gtcctattcttgacttgaactcagt

SEQ ID NO: 687332 - DNA, 25 bp, Mus musculus
gtcctattcttgtcttgaactcagt

SEQ ID NO: 687333 - DNA, 25 bp, Mus musculus
gtcctattggttatttgctgtgccc

SEQ ID NO: 687334 - DNA, 25 bp, Mus musculus
gtcctattggttttttgctgtgccc

SEQ ID NO: 687335 - DNA, 25 bp, Mus musculus
gtcctcaaacgcctgacttcaaaag

SEQ ID NO: 687336 - DNA, 25 bp, Mus musculus
gtcctcaaacgcgtgacttcaaaag

SEQ ID NO: 687337 - DNA, 25 bp, Mus musculus
gtcctcaaagtaacccttagctgtt

SEQ ID NO: 687338 - DNA, 25 bp, Mus musculus
gtcctcaaagtatcccttagctgtt

SEQ ID NO: 687339 - DNA, 25 bp, Mus musculus
gtcctcaaagtgagtctgtggctca

SEQ ID NO: 687340 - DNA, 25 bp, Mus musculus
gtcctcaaagtgtgtctgtggctca

SEQ ID NO: 687341 - DNA, 25 bp, Mus musculus
gtcctcaaatacacccatggctttt

SEQ ID NO: 687342 - DNA, 25 bp, Mus musculus
gtcctcaaatactcccatggctttt

SEQ ID NO: 687343 - DNA, 25 bp, Mus musculus
gtcctcaaatcaccaacagcttgtt

SEQ ID NO: 687344 - DNA, 25 bp, Mus musculus
gtcctcaaatcagcaacagcttgtt

SEQ ID NO: 687345 - DNA, 25 bp, Mus musculus
gtcctcaacactcatcagatccgat

SEQ ID NO: 687346 - DNA, 25 bp, Mus musculus
gtcctcaacactgatcagatccgat

SEQ ID NO: 687347 - DNA, 25 bp, Mus musculus
gtcctcaacataccctctgagtcaa

SEQ ID NO: 687348 - DNA, 25 bp, Mus musculus
gtcctcaacatagcctctgagtcaa

SEQ ID NO: 687349 - DNA, 25 bp, Mus musculus
gtcctcaacatccagttcaggtatg

SEQ ID NO: 687350 - DNA, 25 bp, Mus musculus
gtcctcaacatcgagttcaggtatg

SEQ ID NO: 687351 - DNA, 25 bp, Mus musculus
gtcctcaacggcctgtgtattgaag

SEQ ID NO: 687352 - DNA, 25 bp, Mus musculus
gtcctcaacggcgtgtgtattgaag

SEQ ID NO: 687353 - DNA, 25 bp, Mus musculus
gtcctcaagggcctccaggttatgg

SEQ ID NO: 687354 - DNA, 25 bp, Mus musculus
gtcctcaagggcgtccaggttatgg

SEQ ID NO: 687355 - DNA, 25 bp, Mus musculus
gtcctcacaattaagccctaagtca

SEQ ID NO: 687356 - DNA, 25 bp, Mus musculus
gtcctcacaatttagccctaagtca

SEQ ID NO: 687357 - DNA, 25 bp, Mus musculus
gtcctcacacagatctccagtaaga

SEQ ID NO: 687358 - DNA, 25 bp, Mus musculus
gtcctcacacagttctccagtaaga

SEQ ID NO: 687359 - DNA, 25 bp, Mus musculus
gtcctcacagatcgattcggtgtca

SEQ ID NO: 687360 - DNA, 25 bp, Mus musculus
gtcctcacagatggattcggtgtca

SEQ ID NO: 687361 - DNA, 25 bp, Mus musculus
gtcctcacaggacatccttaggtgt

SEQ ID NO: 687362 - DNA, 25 bp, Mus musculus
gtcctcacaggagatccttaggtgt

SEQ ID NO: 687363 - DNA, 25 bp, Mus musculus
gtcctcaccgaaagatcccttagat

SEQ ID NO: 687364 - DNA, 25 bp, Mus musculus
gtcctcaccgaatgatcccttagat

SEQ ID NO: 687365 - DNA, 25 bp, Mus musculus
gtcctcacctctagggctagaagtg

SEQ ID NO: 687366 - DNA, 25 bp, Mus musculus
gtcctcacctcttgggctagaagtg

SEQ ID NO: 687367 - DNA, 25 bp, Mus musculus
gtcctcacggctatcccgattgaca

SEQ ID NO: 687368 - DNA, 25 bp, Mus musculus
gtcctcacggctttcccgattgaca

SEQ ID NO: 687369 - DNA, 25 bp, Mus musculus
gtcctcactcaaatctccataattt

SEQ ID NO: 687370 - DNA, 25 bp, Mus musculus
gtcctcactcaattctccataattt

SEQ ID NO: 687371 - DNA, 25 bp, Mus musculus
gtcctcactcagcttcaggagccag

SEQ ID NO: 687372 - DNA, 25 bp, Mus musculus
gtcctcactcaggttcaggagccag

SEQ ID NO: 687373 - DNA, 25 bp, Mus musculus
gtcctcactcgaagtgttgcccaag

SEQ ID NO: 687374 - DNA, 25 bp, Mus musculus
gtcctcactcgatgtgttgcccaag

SEQ ID NO: 687375 - DNA, 25 bp, Mus musculus
gtcctcagaaagactattgctcctg

SEQ ID NO: 687376 - DNA, 25 bp, Mus musculus
gtcctcagaaagtctattgctcctg

SEQ ID NO: 687377 - DNA, 25 bp, Mus musculus
gtcctcagacctatatccagttttg

SEQ ID NO: 687378 - DNA, 25 bp, Mus musculus
gtcctcagacctttatccagttttg

SEQ ID NO: 687379 - DNA, 25 bp, Mus musculus
gtcctcagagagcattaaaccagtc

SEQ ID NO: 687380 - DNA, 25 bp, Mus musculus
gtcctcagagaggattaaaccagtc

SEQ ID NO: 687381 - DNA, 25 bp, Mus musculus
gtcctcagagctccacatgtgaact

SEQ ID NO: 687382 - DNA, 25 bp, Mus musculus
gtcctcagagctgcacatgtgaact

SEQ ID NO: 687383 - DNA, 25 bp, Mus musculus
gtcctcagagtaattgatgtctcca

SEQ ID NO: 687384 - DNA, 25 bp, Mus musculus
gtcctcagagtatttgatgtctcca

SEQ ID NO: 687385 - DNA, 25 bp, Mus musculus
gtcctcagcacaaaacagtttctcc

SEQ ID NO: 687386 - DNA, 25 bp, Mus musculus
gtcctcagcacataacagtttctcc

SEQ ID NO: 687387 - DNA, 25 bp, Mus musculus
gtcctcagcaggcttttgaccttga

SEQ ID NO: 687388 - DNA, 25 bp, Mus musculus
gtcctcagcagggttttgaccttga

SEQ ID NO: 687389 - DNA, 25 bp, Mus musculus
gtcctcagcgagctgatttttgatt

SEQ ID NO: 687390 - DNA, 25 bp, Mus musculus
gtcctcagcgaggtgatttttgatt

SEQ ID NO: 687391 - DNA, 25 bp, Mus musculus
gtcctcaggaggacactaatactca

SEQ ID NO: 687392 - DNA, 25 bp, Mus musculus
gtcctcaggaggtcactaatactca

SEQ ID NO: 687393 - DNA, 25 bp, Mus musculus
gtcctcaggcacatgtttctattaa

SEQ ID NO: 687394 - DNA, 25 bp, Mus musculus
gtcctcaggcacttgtttctattaa

SEQ ID NO: 687395 - DNA, 25 bp, Mus musculus
gtcctcaggcttatatcaccacaag

SEQ ID NO: 687396 - DNA, 25 bp, Mus musculus
gtcctcaggcttttatcaccacaag

SEQ ID NO: 687397 - DNA, 25 bp, Mus musculus
gtcctcagggacatctatgagtcca

SEQ ID NO: 687398 - DNA, 25 bp, Mus musculus
gtcctcagggacttctatgagtcca

SEQ ID NO: 687399 - DNA, 25 bp, Mus musculus
gtcctcagtcacatgggtctacaaa

SEQ ID NO: 687400 - DNA, 25 bp, Mus musculus
gtcctcagtcacttgggtctacaaa

SEQ ID NO: 687401 - DNA, 25 bp, Mus musculus
gtcctcagtcttatcttaaaggatg

SEQ ID NO: 687402 - DNA, 25 bp, Mus musculus
gtcctcagtcttttcttaaaggatg

SEQ ID NO: 687403 - DNA, 25 bp, Mus musculus
gtcctcagtgagatgcttaactact

SEQ ID NO: 687404 - DNA, 25 bp, Mus musculus
gtcctcagtgagttgcttaactact

SEQ ID NO: 687405 - DNA, 25 bp, Mus musculus
gtcctcagtggcagatgcagtgcac

SEQ ID NO: 687406 - DNA, 25 bp, Mus musculus
gtcctcagtggctgatgcagtgcac

SEQ ID NO: 687407 - DNA, 25 bp, Mus musculus
gtcctcagtgtgcagagcaaccggc

SEQ ID NO: 687408 - DNA, 25 bp, Mus musculus
gtcctcagtgtggagagcaaccggc

SEQ ID NO: 687409 - DNA, 25 bp, Mus musculus
gtcctcataaaaattctatccctct

SEQ ID NO: 687410 - DNA, 25 bp, Mus musculus
gtcctcataaaatttctatccctct

SEQ ID NO: 687411 - DNA, 25 bp, Mus musculus
gtcctcatacctccggaaccatgta

SEQ ID NO: 687412 - DNA, 25 bp, Mus musculus
gtcctcatacctgcggaaccatgta

SEQ ID NO: 687413 - DNA, 25 bp, Mus musculus
gtcctcatagctagcttacactgtt

SEQ ID NO: 687414 - DNA, 25 bp, Mus musculus
gtcctcatagcttgcttacactgtt

SEQ ID NO: 687415 - DNA, 25 bp, Mus musculus
gtcctcatcaggacttctgagtacc

SEQ ID NO: 687416 - DNA, 25 bp, Mus musculus
gtcctcatcaggtcttctgagtacc

SEQ ID NO: 687417 - DNA, 25 bp, Mus musculus
gtcctcatcagtaggtcatgttgcc

SEQ ID NO: 687418 - DNA, 25 bp, Mus musculus
gtcctcatcagttggtcatgttgcc

SEQ ID NO: 687419 - DNA, 25 bp, Mus musculus
gtcctcatccacatgggtagcaggg

SEQ ID NO: 687420 - DNA, 25 bp, Mus musculus
gtcctcatccacttgggtagcaggg

SEQ ID NO: 687421 - DNA, 25 bp, Mus musculus
gtcctcatcgagcacttgtaccaaa

SEQ ID NO: 687422 - DNA, 25 bp, Mus musculus
gtcctcatcgaggacttgtaccaaa

SEQ ID NO: 687423 - DNA, 25 bp, Mus musculus
gtcctcatctggatttggcttctaa

SEQ ID NO: 687424 - DNA, 25 bp, Mus musculus
gtcctcatctggttttggcttctaa

SEQ ID NO: 687425 - DNA, 25 bp, Mus musculus
gtcctcatctgtctttgaagacctg

SEQ ID NO: 687426 - DNA, 25 bp, Mus musculus
gtcctcatctgtgtttgaagacctg

SEQ ID NO: 687427 - DNA, 25 bp, Mus musculus
gtcctcatgaacaccattgtctttg

SEQ ID NO: 687428 - DNA, 25 bp, Mus musculus
gtcctcatgaactccattgtctttg

SEQ ID NO: 687429 - DNA, 25 bp, Mus musculus
gtcctcatgattatgaactgtccat

SEQ ID NO: 687430 - DNA, 25 bp, Mus musculus
gtcctcatgattttgaactgtccat

SEQ ID NO: 687431 - DNA, 25 bp, Mus musculus
gtcctcatggctctgcctgactaca

SEQ ID NO: 687432 - DNA, 25 bp, Mus musculus
gtcctcatggctgtgcctgactaca

SEQ ID NO: 687433 - DNA, 25 bp, Mus musculus
gtcctcatggtgacgcttctacaca

SEQ ID NO: 687434 - DNA, 25 bp, Mus musculus
gtcctcatggtgtcgcttctacaca

SEQ ID NO: 687435 - DNA, 25 bp, Mus musculus
gtcctcattaacagtcaacattaaa

SEQ ID NO: 687436 - DNA, 25 bp, Mus musculus
gtcctcattaactgtcaacattaaa

SEQ ID NO: 687437 - DNA, 25 bp, Mus musculus
gtcctcattcgaaaaggtgggcctt

SEQ ID NO: 687438 - DNA, 25 bp, Mus musculus
gtcctcattcgataaggtgggcctt

SEQ ID NO: 687439 - DNA, 25 bp, Mus musculus
gtcctcattggtactgtagctgtcg

SEQ ID NO: 687440 - DNA, 25 bp, Mus musculus
gtcctcattggttctgtagctgtcg

SEQ ID NO: 687441 - DNA, 25 bp, Mus musculus
gtcctcattgttacagtttcaattg

SEQ ID NO: 687442 - DNA, 25 bp, Mus musculus
gtcctcattgtttcagtttcaattg

SEQ ID NO: 687443 - DNA, 25 bp, Mus musculus
gtcctccaaaacaaaggtgctccta

SEQ ID NO: 687444 - DNA, 25 bp, Mus musculus
gtcctccaaaactaaggtgctccta

SEQ ID NO: 687445 - DNA, 25 bp, Mus musculus
gtcctccaaattccatgtagctcac

SEQ ID NO: 687446 - DNA, 25 bp, Mus musculus
gtcctccaaattgcatgtagctcac

SEQ ID NO: 687447 - DNA, 25 bp, Mus musculus
gtcctccaaccacaagcagtatttt

SEQ ID NO: 687448 - DNA, 25 bp, Mus musculus
gtcctccaaccagaagcagtatttt

SEQ ID NO: 687449 - DNA, 25 bp, Mus musculus
gtcctccaaggacctgtgctgtgtg

SEQ ID NO: 687450 - DNA, 25 bp, Mus musculus
gtcctccaaggagctgtgctgtgtg

SEQ ID NO: 687451 - DNA, 25 bp, Mus musculus
gtcctccaaggtcacccagtgcagg

SEQ ID NO: 687452 - DNA, 25 bp, Mus musculus
gtcctccaaggtgacccagtgcagg

SEQ ID NO: 687453 - DNA, 25 bp, Mus musculus
gtcctccacaaacaaatcctgcgtt

SEQ ID NO: 687454 - DNA, 25 bp, Mus musculus
gtcctccacaaagaaatcctgcgtt

SEQ ID NO: 687455 - DNA, 25 bp, Mus musculus
gtcctccacctcattgacacagagg

SEQ ID NO: 687456 - DNA, 25 bp, Mus musculus
gtcctccacctctttgacacagagg

SEQ ID NO: 687457 - DNA, 25 bp, Mus musculus
gtcctccacgacagcgatcggaaaa

SEQ ID NO: 687458 - DNA, 25 bp, Mus musculus
gtcctccacgactgcgatcggaaaa

SEQ ID NO: 687459 - DNA, 25 bp, Mus musculus
gtcctccactccaacatcaaggaaa

SEQ ID NO: 687460 - DNA, 25 bp, Mus musculus
gtcctccactcctacatcaaggaaa

SEQ ID NO: 687461 - DNA, 25 bp, Mus musculus
gtcctccactgtcgttttggttcaa

SEQ ID NO: 687462 - DNA, 25 bp, Mus musculus
gtcctccactgtggttttggttcaa

SEQ ID NO: 687463 - DNA, 25 bp, Mus musculus
gtcctccagaacaacttcgagcaga

SEQ ID NO: 687464 - DNA, 25 bp, Mus musculus
gtcctccagaactacttcgagcaga

SEQ ID NO: 687465 - DNA, 25 bp, Mus musculus
gtcctccagagtctaactttgggtt

SEQ ID NO: 687466 - DNA, 25 bp, Mus musculus
gtcctccagagtgtaactttgggtt

SEQ ID NO: 687467 - DNA, 25 bp, Mus musculus
gtcctccagatccatggagagctga

SEQ ID NO: 687468 - DNA, 25 bp, Mus musculus
gtcctccagatcgatggagagctga

SEQ ID NO: 687469 - DNA, 25 bp, Mus musculus
gtcctccagcttctgaacatctata

SEQ ID NO: 687470 - DNA, 25 bp, Mus musculus
gtcctccagcttgtgaacatctata

SEQ ID NO: 687471 - DNA, 25 bp, Mus musculus
gtcctccaggagattctactaatcc

SEQ ID NO: 687472 - DNA, 25 bp, Mus musculus
gtcctccaggagtttctactaatcc

SEQ ID NO: 687473 - DNA, 25 bp, Mus musculus
gtcctccagggcctatttattcagg

SEQ ID NO: 687474 - DNA, 25 bp, Mus musculus
gtcctccagggcgtatttattcagg

SEQ ID NO: 687475 - DNA, 25 bp, Mus musculus
gtcctccatgaacaagctcgtggcc

SEQ ID NO: 687476 - DNA, 25 bp, Mus musculus
gtcctccatgaagaagctcgtggcc

SEQ ID NO: 687477 - DNA, 25 bp, Mus musculus
gtcctccatgcgacaacgagttgaa

SEQ ID NO: 687478 - DNA, 25 bp, Mus musculus
gtcctccatgcgtcaacgagttgaa

SEQ ID NO: 687479 - DNA, 25 bp, Mus musculus
gtcctccatgctcaaagatgagtct

SEQ ID NO: 687480 - DNA, 25 bp, Mus musculus
gtcctccatgctgaaagatgagtct

SEQ ID NO: 687481 - DNA, 25 bp, Mus musculus
gtcctcccaatgatgggtaaggtgc

SEQ ID NO: 687482 - DNA, 25 bp, Mus musculus
gtcctcccaatgttgggtaaggtgc

SEQ ID NO: 687483 - DNA, 25 bp, Mus musculus
gtcctcccacagacctatgtaggaa

SEQ ID NO: 687484 - DNA, 25 bp, Mus musculus
gtcctcccacagtcctatgtaggaa

SEQ ID NO: 687485 - DNA, 25 bp, Mus musculus
gtcctcccctttagacggatggtat

SEQ ID NO: 687486 - DNA, 25 bp, Mus musculus
gtcctccccttttgacggatggtat

SEQ ID NO: 687487 - DNA, 25 bp, Mus musculus
gtcctcccgcttcaaagatttgcaa

SEQ ID NO: 687488 - DNA, 25 bp, Mus musculus
gtcctcccgcttgaaagatttgcaa

SEQ ID NO: 687489 - DNA, 25 bp, Mus musculus
gtcctcccgggccatcaaagtggaa

SEQ ID NO: 687490 - DNA, 25 bp, Mus musculus
gtcctcccgggcgatcaaagtggaa

SEQ ID NO: 687491 - DNA, 25 bp, Mus musculus
gtcctccctgcccaatgagcggaga

SEQ ID NO: 687492 - DNA, 25 bp, Mus musculus
gtcctccctgccgaatgagcggaga

SEQ ID NO: 687493 - DNA, 25 bp, Mus musculus
gtcctccggaagagttgccagtgtt

SEQ ID NO: 687494 - DNA, 25 bp, Mus musculus
gtcctccggaagtgttgccagtgtt

SEQ ID NO: 687495 - DNA, 25 bp, Mus musculus
gtcctcctagatatcattaacttgt

SEQ ID NO: 687496 - DNA, 25 bp, Mus musculus
gtcctcctagatttcattaacttgt

SEQ ID NO: 687497 - DNA, 25 bp, Mus musculus
gtcctcctagttactgtgtaacatt

SEQ ID NO: 687498 - DNA, 25 bp, Mus musculus
gtcctcctagtttctgtgtaacatt

SEQ ID NO: 687499 - DNA, 25 bp, Mus musculus
gtcctcctattacctcagtaggttg

SEQ ID NO: 687500 - DNA, 25 bp, Mus musculus
gtcctcctattagctcagtaggttg

SEQ ID NO: 687501 - DNA, 25 bp, Mus musculus
gtcctcctcagaagggtgtgtgacc

SEQ ID NO: 687502 - DNA, 25 bp, Mus musculus
gtcctcctcagatgggtgtgtgacc

SEQ ID NO: 687503 - DNA, 25 bp, Mus musculus
gtcctcctccatcaaaactgtgtac

SEQ ID NO: 687504 - DNA, 25 bp, Mus musculus
gtcctcctccatgaaaactgtgtac

SEQ ID NO: 687505 - DNA, 25 bp, Mus musculus
gtcctcctgagaagtatgcacttat

SEQ ID NO: 687506 - DNA, 25 bp, Mus musculus
gtcctcctgagatgtatgcacttat

SEQ ID NO: 687507 - DNA, 25 bp, Mus musculus
gtcctcctgatgactcaagctatgt

SEQ ID NO: 687508 - DNA, 25 bp, Mus musculus
gtcctcctgatgtctcaagctatgt

SEQ ID NO: 687509 - DNA, 25 bp, Mus musculus
gtcctcctgattccagggagaccat

SEQ ID NO: 687510 - DNA, 25 bp, Mus musculus
gtcctcctgattgcagggagaccat

SEQ ID NO: 687511 - DNA, 25 bp, Mus musculus
gtcctcctgcaaagtgcccagagtc

SEQ ID NO: 687512 - DNA, 25 bp, Mus musculus
gtcctcctgcaatgtgcccagagtc

SEQ ID NO: 687513 - DNA, 25 bp, Mus musculus
gtcctcctgcctaacaacaattatt

SEQ ID NO: 687514 - DNA, 25 bp, Mus musculus
gtcctcctgccttacaacaattatt

SEQ ID NO: 687515 - DNA, 25 bp, Mus musculus
gtcctcctggacattgtgtgatcac

SEQ ID NO: 687516 - DNA, 25 bp, Mus musculus
gtcctcctggactttgtgtgatcac

SEQ ID NO: 687517 - DNA, 25 bp, Mus musculus
gtcctcctggctctagaaattacat

SEQ ID NO: 687518 - DNA, 25 bp, Mus musculus
gtcctcctggctgtagaaattacat

SEQ ID NO: 687519 - DNA, 25 bp, Mus musculus
gtcctcctgggtcgaagagattcct

SEQ ID NO: 687520 - DNA, 25 bp, Mus musculus
gtcctcctgggtggaagagattcct

SEQ ID NO: 687521 - DNA, 25 bp, Mus musculus
gtcctcctgtagaatgcagtcttta

SEQ ID NO: 687522 - DNA, 25 bp, Mus musculus
gtcctcctgtagtatgcagtcttta

SEQ ID NO: 687523 - DNA, 25 bp, Mus musculus
gtcctcctgtctacaactttagagt

SEQ ID NO: 687524 - DNA, 25 bp, Mus musculus
gtcctcctgtcttcaactttagagt

SEQ ID NO: 687525 - DNA, 25 bp, Mus musculus
gtcctccttagtaaatacacttgtg

SEQ ID NO: 687526 - DNA, 25 bp, Mus musculus
gtcctccttagttaatacacttgtg

SEQ ID NO: 687527 - DNA, 25 bp, Mus musculus
gtcctccttggcagagtccgtagat

SEQ ID NO: 687528 - DNA, 25 bp, Mus musculus
gtcctccttggctgagtccgtagat

SEQ ID NO: 687529 - DNA, 25 bp, Mus musculus
gtcctccttgtgagacaagctgtcg

SEQ ID NO: 687530 - DNA, 25 bp, Mus musculus
gtcctccttgtgtgacaagctgtcg

SEQ ID NO: 687531 - DNA, 25 bp, Mus musculus
gtcctcctttctctgtgtttcataa

SEQ ID NO: 687532 - DNA, 25 bp, Mus musculus
gtcctcctttctgtgtgtttcataa

SEQ ID NO: 687533 - DNA, 25 bp, Mus musculus
gtcctcgcactgaggcagccagtat

SEQ ID NO: 687534 - DNA, 25 bp, Mus musculus
gtcctcgcactgtggcagccagtat

SEQ ID NO: 687535 - DNA, 25 bp, Mus musculus
gtcctcgccaagagtttctctgaga

SEQ ID NO: 687536 - DNA, 25 bp, Mus musculus
gtcctcgccaagtgtttctctgaga

SEQ ID NO: 687537 - DNA, 25 bp, Mus musculus
gtcctcgctgtgctcctcatgctgg

SEQ ID NO: 687538 - DNA, 25 bp, Mus musculus
gtcctcgctgtggtcctcatgctgg

SEQ ID NO: 687539 - DNA, 25 bp, Mus musculus
gtcctcggaatgcagaatgctcatc

SEQ ID NO: 687540 - DNA, 25 bp, Mus musculus
gtcctcggaatggagaatgctcatc

SEQ ID NO: 687541 - DNA, 25 bp, Mus musculus
gtcctcggatccattggaacacaga

SEQ ID NO: 687542 - DNA, 25 bp, Mus musculus
gtcctcggatcctttggaacacaga

SEQ ID NO: 687543 - DNA, 25 bp, Mus musculus
gtcctcggatgcaaacccaagagag

SEQ ID NO: 687544 - DNA, 25 bp, Mus musculus
gtcctcggatgctaacccaagagag

SEQ ID NO: 687545 - DNA, 25 bp, Mus musculus
gtcctcggcgacacgaaaaatcttt

SEQ ID NO: 687546 - DNA, 25 bp, Mus musculus
gtcctcggcgactcgaaaaatcttt

SEQ ID NO: 687547 - DNA, 25 bp, Mus musculus
gtcctcggctgtcattctgaggaga

SEQ ID NO: 687548 - DNA, 25 bp, Mus musculus
gtcctcggctgtgattctgaggaga

SEQ ID NO: 687549 - DNA, 25 bp, Mus musculus
gtcctcgtctcgaatatagcgccct

SEQ ID NO: 687550 - DNA, 25 bp, Mus musculus
gtcctcgtctcgtatatagcgccct

SEQ ID NO: 687551 - DNA, 25 bp, Mus musculus
gtcctctaatcacgcccggagtagg

SEQ ID NO: 687552 - DNA, 25 bp, Mus musculus
gtcctctaatcaggcccggagtagg

SEQ ID NO: 687553 - DNA, 25 bp, Mus musculus
gtcctctaatctccacacatgttct

SEQ ID NO: 687554 - DNA, 25 bp, Mus musculus
gtcctctaatctgcacacatgttct

SEQ ID NO: 687555 - DNA, 25 bp, Mus musculus
gtcctctacgacaatgtggtctaca

SEQ ID NO: 687556 - DNA, 25 bp, Mus musculus
gtcctctacgactatgtggtctaca

SEQ ID NO: 687557 - DNA, 25 bp, Mus musculus
gtcctctacgatctccacataggat

SEQ ID NO: 687558 - DNA, 25 bp, Mus musculus
gtcctctacgatgtccacataggat

SEQ ID NO: 687559 - DNA, 25 bp, Mus musculus
gtcctctacgtcaatcagctcctgg

SEQ ID NO: 687560 - DNA, 25 bp, Mus musculus
gtcctctacgtctatcagctcctgg

SEQ ID NO: 687561 - DNA, 25 bp, Mus musculus
gtcctctactttacacatctataac

SEQ ID NO: 687562 - DNA, 25 bp, Mus musculus
gtcctctacttttcacatctataac

SEQ ID NO: 687563 - DNA, 25 bp, Mus musculus
gtcctctagagcacgggtttggaga

SEQ ID NO: 687564 - DNA, 25 bp, Mus musculus
gtcctctagagctcgggtttggaga

SEQ ID NO: 687565 - DNA, 25 bp, Mus musculus
gtcctctagagtcacagccaagcac

SEQ ID NO: 687566 - DNA, 25 bp, Mus musculus
gtcctctagagtgacagccaagcac

SEQ ID NO: 687567 - DNA, 25 bp, Mus musculus
gtcctctaggatacattgcttcagt

SEQ ID NO: 687568 - DNA, 25 bp, Mus musculus
gtcctctaggattcattgcttcagt

SEQ ID NO: 687569 - DNA, 25 bp, Mus musculus
gtcctctagggaaccaaattgggtc

SEQ ID NO: 687570 - DNA, 25 bp, Mus musculus
gtcctctagggatccaaattgggtc

SEQ ID NO: 687571 - DNA, 25 bp, Mus musculus
gtcctctagtagactaagctctgct

SEQ ID NO: 687572 - DNA, 25 bp, Mus musculus
gtcctctagtagtctaagctctgct

SEQ ID NO: 687573 - DNA, 25 bp, Mus musculus
gtcctctatgctacctattcaaaaa

SEQ ID NO: 687574 - DNA, 25 bp, Mus musculus
gtcctctatgcttcctattcaaaaa

SEQ ID NO: 687575 - DNA, 25 bp, Mus musculus
gtcctctattttcgtagtgtttcac

SEQ ID NO: 687576 - DNA, 25 bp, Mus musculus
gtcctctattttggtagtgtttcac

SEQ ID NO: 687577 - DNA, 25 bp, Mus musculus
gtcctctcagacatgaagcgccata

SEQ ID NO: 687578 - DNA, 25 bp, Mus musculus
gtcctctcagacttgaagcgccata

SEQ ID NO: 687579 - DNA, 25 bp, Mus musculus
gtcctctcatttatcatgctgacat

SEQ ID NO: 687580 - DNA, 25 bp, Mus musculus
gtcctctcatttttcatgctgacat

SEQ ID NO: 687581 - DNA, 25 bp, Mus musculus
gtcctctccaggagtcttctgagaa

SEQ ID NO: 687582 - DNA, 25 bp, Mus musculus
gtcctctccaggtgtcttctgagaa

SEQ ID NO: 687583 - DNA, 25 bp, Mus musculus
gtcctctcccggaagtttgtggagg

SEQ ID NO: 687584 - DNA, 25 bp, Mus musculus
gtcctctcccggtagtttgtggagg

SEQ ID NO: 687585 - DNA, 25 bp, Mus musculus
gtcctctccgagcagacagtatgca

SEQ ID NO: 687586 - DNA, 25 bp, Mus musculus
gtcctctccgaggagacagtatgca

SEQ ID NO: 687587 - DNA, 25 bp, Mus musculus
gtcctctcgaccaatcttgacagaa

SEQ ID NO: 687588 - DNA, 25 bp, Mus musculus
gtcctctcgacctatcttgacagaa

SEQ ID NO: 687589 - DNA, 25 bp, Mus musculus
gtcctctctcaaccttttatcaaag

SEQ ID NO: 687590 - DNA, 25 bp, Mus musculus
gtcctctctcaagcttttatcaaag

SEQ ID NO: 687591 - DNA, 25 bp, Mus musculus
gtcctctctctgatctgatatacaa

SEQ ID NO: 687592 - DNA, 25 bp, Mus musculus
gtcctctctctgattagactgtcat

SEQ ID NO: 687593 - DNA, 25 bp, Mus musculus
gtcctctctctgttctgatatacaa

SEQ ID NO: 687594 - DNA, 25 bp, Mus musculus
gtcctctctctgtttagactgtcat

SEQ ID NO: 687595 - DNA, 25 bp, Mus musculus
gtcctctctgcgaggtgattgtgta

SEQ ID NO: 687596 - DNA, 25 bp, Mus musculus
gtcctctctgcgtggtgattgtgta

SEQ ID NO: 687597 - DNA, 25 bp, Mus musculus
gtcctctctttcacatttgctgtaa

SEQ ID NO: 687598 - DNA, 25 bp, Mus musculus
gtcctctctttctcatttgctgtaa

SEQ ID NO: 687599 - DNA, 25 bp, Mus musculus
gtcctctgaactcttgcttgtgcaa

SEQ ID NO: 687600 - DNA, 25 bp, Mus musculus
gtcctctgaactgttgcttgtgcaa

SEQ ID NO: 687601 - DNA, 25 bp, Mus musculus
gtcctctgacatctagaaatggtac

SEQ ID NO: 687602 - DNA, 25 bp, Mus musculus
gtcctctgacatgtagaaatggtac

SEQ ID NO: 687603 - DNA, 25 bp, Mus musculus
gtcctctgactcaggaacgggtgaa

SEQ ID NO: 687604 - DNA, 25 bp, Mus musculus
gtcctctgactctggaacgggtgaa

SEQ ID NO: 687605 - DNA, 25 bp, Mus musculus
gtcctctgagccctttattgtccaa

SEQ ID NO: 687606 - DNA, 25 bp, Mus musculus
gtcctctgagccgtttattgtccaa

SEQ ID NO: 687607 - DNA, 25 bp, Mus musculus
gtcctctgaggcactttggtcatca

SEQ ID NO: 687608 - DNA, 25 bp, Mus musculus
gtcctctgaggctctttggtcatca

SEQ ID NO: 687609 - DNA, 25 bp, Mus musculus
gtcctctgatctccagcatagactg

SEQ ID NO: 687610 - DNA, 25 bp, Mus musculus
gtcctctgatctgcagcatagactg

SEQ ID NO: 687611 - DNA, 25 bp, Mus musculus
gtcctctgcacacttgcacaaggga

SEQ ID NO: 687612 - DNA, 25 bp, Mus musculus
gtcctctgcacagttgcacaaggga

SEQ ID NO: 687613 - DNA, 25 bp, Mus musculus
gtcctctgcaggagctacaagtatt

SEQ ID NO: 687614 - DNA, 25 bp, Mus musculus
gtcctctgcaggtgctacaagtatt

SEQ ID NO: 687615 - DNA, 25 bp, Mus musculus
gtcctctgcataccgaagtgttcgt

SEQ ID NO: 687616 - DNA, 25 bp, Mus musculus
gtcctctgcatagcgaagtgttcgt

SEQ ID NO: 687617 - DNA, 25 bp, Mus musculus
gtcctctgcctgacgacactgaaca

SEQ ID NO: 687618 - DNA, 25 bp, Mus musculus
gtcctctgcctgtcgacactgaaca

SEQ ID NO: 687619 - DNA, 25 bp, Mus musculus
gtcctctgcgggagcagcaaggttt

SEQ ID NO: 687620 - DNA, 25 bp, Mus musculus
gtcctctgcgggtgcagcaaggttt

SEQ ID NO: 687621 - DNA, 25 bp, Mus musculus
gtcctctgcggtcacactgactgag

SEQ ID NO: 687622 - DNA, 25 bp, Mus musculus
gtcctctgcggtgacactgactgag

SEQ ID NO: 687623 - DNA, 25 bp, Mus musculus
gtcctctgcgttcgttcggtaggcc

SEQ ID NO: 687624 - DNA, 25 bp, Mus musculus
gtcctctgcgttggttcggtaggcc

SEQ ID NO: 687625 - DNA, 25 bp, Mus musculus
gtcctctgctacatatttctgtaca

SEQ ID NO: 687626 - DNA, 25 bp, Mus musculus
gtcctctgctacttatttctgtaca

SEQ ID NO: 687627 - DNA, 25 bp, Mus musculus
gtcctctgctgaagacattcatgcc

SEQ ID NO: 687628 - DNA, 25 bp, Mus musculus
gtcctctgctgatgacattcatgcc

SEQ ID NO: 687629 - DNA, 25 bp, Mus musculus
gtcctctggaaaagcgtacagggca

SEQ ID NO: 687630 - DNA, 25 bp, Mus musculus
gtcctctggaaatgcgtacagggca

SEQ ID NO: 687631 - DNA, 25 bp, Mus musculus
gtcctctggagccatcaacaaggag

SEQ ID NO: 687632 - DNA, 25 bp, Mus musculus
gtcctctggagcgatcaacaaggag

SEQ ID NO: 687633 - DNA, 25 bp, Mus musculus
gtcctctggcagagctactgatgat

SEQ ID NO: 687634 - DNA, 25 bp, Mus musculus
gtcctctggcagtgctactgatgat

SEQ ID NO: 687635 - DNA, 25 bp, Mus musculus
gtcctctgggttactcatatcacag

SEQ ID NO: 687636 - DNA, 25 bp, Mus musculus
gtcctctgggtttctcatatcacag

SEQ ID NO: 687637 - DNA, 25 bp, Mus musculus
gtcctctggtctcttgaatgtagcc

SEQ ID NO: 687638 - DNA, 25 bp, Mus musculus
gtcctctggtctgttgaatgtagcc

SEQ ID NO: 687639 - DNA, 25 bp, Mus musculus
gtcctctggtgtacggtggcatgaa

SEQ ID NO: 687640 - DNA, 25 bp, Mus musculus
gtcctctggtgttcggtggcatgaa

SEQ ID NO: 687641 - DNA, 25 bp, Mus musculus
gtcctctggtttctaaatctattcc

SEQ ID NO: 687642 - DNA, 25 bp, Mus musculus
gtcctctggtttgtaaatctattcc

SEQ ID NO: 687643 - DNA, 25 bp, Mus musculus
gtcctctgtaaccacaaccaaataa

SEQ ID NO: 687644 - DNA, 25 bp, Mus musculus
gtcctctgtaacgacaaccaaataa

SEQ ID NO: 687645 - DNA, 25 bp, Mus musculus
gtcctctgtgagaatgaacccatct

SEQ ID NO: 687646 - DNA, 25 bp, Mus musculus
gtcctctgtgagtatgaacccatct

SEQ ID NO: 687647 - DNA, 25 bp, Mus musculus
gtcctctgtgcaaatggatgacact

SEQ ID NO: 687648 - DNA, 25 bp, Mus musculus
gtcctctgtgcatatggatgacact

SEQ ID NO: 687649 - DNA, 25 bp, Mus musculus
gtcctctgtgtcaaacgtgggtaaa

SEQ ID NO: 687650 - DNA, 25 bp, Mus musculus
gtcctctgtgtctaacgtgggtaaa

SEQ ID NO: 687651 - DNA, 25 bp, Mus musculus
gtcctctgtgttagttcaatccttt

SEQ ID NO: 687652 - DNA, 25 bp, Mus musculus
gtcctctgtgtttgttcaatccttt

SEQ ID NO: 687653 - DNA, 25 bp, Mus musculus
gtcctctgttttagtgttccccaag

SEQ ID NO: 687654 - DNA, 25 bp, Mus musculus
gtcctctgtttttgtgttccccaag

SEQ ID NO: 687655 - DNA, 25 bp, Mus musculus
gtcctcttcactactttgcgattgt

SEQ ID NO: 687656 - DNA, 25 bp, Mus musculus
gtcctcttcacttctttgcgattgt

SEQ ID NO: 687657 - DNA, 25 bp, Mus musculus
gtcctcttgaagatacagcctccat

SEQ ID NO: 687658 - DNA, 25 bp, Mus musculus
gtcctcttgaagttacagcctccat

SEQ ID NO: 687659 - DNA, 25 bp, Mus musculus
gtcctcttgactcttacaaatccag

SEQ ID NO: 687660 - DNA, 25 bp, Mus musculus
gtcctcttgactgttacaaatccag

SEQ ID NO: 687661 - DNA, 25 bp, Mus musculus
gtcctcttgcataaaacctgcttat

SEQ ID NO: 687662 - DNA, 25 bp, Mus musculus
gtcctcttgcattaaacctgcttat

SEQ ID NO: 687663 - DNA, 25 bp, Mus musculus
gtcctcttggaaaatagggccgtgc

SEQ ID NO: 687664 - DNA, 25 bp, Mus musculus
gtcctcttggaatatagggccgtgc

SEQ ID NO: 687665 - DNA, 25 bp, Mus musculus
gtcctcttggttcccaagcaaacac

SEQ ID NO: 687666 - DNA, 25 bp, Mus musculus
gtcctcttggttgccaagcaaacac

SEQ ID NO: 687667 - DNA, 25 bp, Mus musculus
gtcctcttgtaaatcacacccagta

SEQ ID NO: 687668 - DNA, 25 bp, Mus musculus
gtcctcttgtaattcacacccagta

SEQ ID NO: 687669 - DNA, 25 bp, Mus musculus
gtcctcttgtttaatttgtcctcgt

SEQ ID NO: 687670 - DNA, 25 bp, Mus musculus
gtcctcttgttttatttgtcctcgt

SEQ ID NO: 687671 - DNA, 25 bp, Mus musculus
gtcctgaaaatcaaacttgccgctt

SEQ ID NO: 687672 - DNA, 25 bp, Mus musculus
gtcctgaaaatctaacttgccgctt

SEQ ID NO: 687673 - DNA, 25 bp, Mus musculus
gtcctgaaacctcaacatatactct

SEQ ID NO: 687674 - DNA, 25 bp, Mus musculus
gtcctgaaacctgaacatatactct

SEQ ID NO: 687675 - DNA, 25 bp, Mus musculus
gtcctgaaagacaggttacattacg

SEQ ID NO: 687676 - DNA, 25 bp, Mus musculus
gtcctgaaagactggttacattacg

SEQ ID NO: 687677 - DNA, 25 bp, Mus musculus
gtcctgaaagtcatggagtcacatt

SEQ ID NO: 687678 - DNA, 25 bp, Mus musculus
gtcctgaaagtcttggagtcacatt

SEQ ID NO: 687679 - DNA, 25 bp, Mus musculus
gtcctgaacttacattccgtcatcc

SEQ ID NO: 687680 - DNA, 25 bp, Mus musculus
gtcctgaacttagattccgtcatcc

SEQ ID NO: 687681 - DNA, 25 bp, Mus musculus
gtcctgaagagcacccaccatgggg

SEQ ID NO: 687682 - DNA, 25 bp, Mus musculus
gtcctgaagagctcccaccatgggg

SEQ ID NO: 687683 - DNA, 25 bp, Mus musculus
gtcctgaaggcccagtgcacttctg

SEQ ID NO: 687684 - DNA, 25 bp, Mus musculus
gtcctgaaggccgagtgcacttctg

SEQ ID NO: 687685 - DNA, 25 bp, Mus musculus
gtcctgaagtccaggatatacccag

SEQ ID NO: 687686 - DNA, 25 bp, Mus musculus
gtcctgaagtcctggatatacccag

SEQ ID NO: 687687 - DNA, 25 bp, Mus musculus
gtcctgaatgaactacttctgcata

SEQ ID NO: 687688 - DNA, 25 bp, Mus musculus
gtcctgaatgaagtacttctgcata

SEQ ID NO: 687689 - DNA, 25 bp, Mus musculus
gtcctgaatggtacttaaccacctg

SEQ ID NO: 687690 - DNA, 25 bp, Mus musculus
gtcctgaatggttcttaaccacctg

SEQ ID NO: 687691 - DNA, 25 bp, Mus musculus
gtcctgaatttcacgacctcgaaaa

SEQ ID NO: 687692 - DNA, 25 bp, Mus musculus
gtcctgaatttctcgacctcgaaaa

SEQ ID NO: 687693 - DNA, 25 bp, Mus musculus
gtcctgacaatgatcatgtagctct

SEQ ID NO: 687694 - DNA, 25 bp, Mus musculus
gtcctgacaatgttcatgtagctct

SEQ ID NO: 687695 - DNA, 25 bp, Mus musculus
gtcctgacacagaaaggctgcttct

SEQ ID NO: 687696 - DNA, 25 bp, Mus musculus
gtcctgacacagtaaggctgcttct

SEQ ID NO: 687697 - DNA, 25 bp, Mus musculus
gtcctgacactcaattagcactgaa

SEQ ID NO: 687698 - DNA, 25 bp, Mus musculus
gtcctgacactctattagcactgaa

SEQ ID NO: 687699 - DNA, 25 bp, Mus musculus
gtcctgacaggacatcccagcaaag

SEQ ID NO: 687700 - DNA, 25 bp, Mus musculus
gtcctgacaggagatcccagcaaag

SEQ ID NO: 687701 - DNA, 25 bp, Mus musculus
gtcctgacatttcttccttgtccta

SEQ ID NO: 687702 - DNA, 25 bp, Mus musculus
gtcctgacatttgttccttgtccta

SEQ ID NO: 687703 - DNA, 25 bp, Mus musculus
gtcctgacctgcaacttttggaaga

SEQ ID NO: 687704 - DNA, 25 bp, Mus musculus
gtcctgacctgctacttttggaaga

SEQ ID NO: 687705 - DNA, 25 bp, Mus musculus
gtcctgactacactggtcactggtg

SEQ ID NO: 687706 - DNA, 25 bp, Mus musculus
gtcctgactacagtggtcactggtg

SEQ ID NO: 687707 - DNA, 25 bp, Mus musculus
gtcctgactaccagtgcaaaggctt

SEQ ID NO: 687708 - DNA, 25 bp, Mus musculus
gtcctgactacctgtgcaaaggctt

SEQ ID NO: 687709 - DNA, 25 bp, Mus musculus
gtcctgactagcagagctgtggttt

SEQ ID NO: 687710 - DNA, 25 bp, Mus musculus
gtcctgactagctgagctgtggttt

SEQ ID NO: 687711 - DNA, 25 bp, Mus musculus
gtcctgactcgcctcctgcaataaa

SEQ ID NO: 687712 - DNA, 25 bp, Mus musculus
gtcctgactcgcgtcctgcaataaa

SEQ ID NO: 687713 - DNA, 25 bp, Mus musculus
gtcctgagaacgcatcttgtgcatc

SEQ ID NO: 687714 - DNA, 25 bp, Mus musculus
gtcctgagaacggatcttgtgcatc

SEQ ID NO: 687715 - DNA, 25 bp, Mus musculus
gtcctgagacgcaacatgatgctat

SEQ ID NO: 687716 - DNA, 25 bp, Mus musculus
gtcctgagacgctacatgatgctat

SEQ ID NO: 687717 - DNA, 25 bp, Mus musculus
gtcctgagagagatggctagctgct

SEQ ID NO: 687718 - DNA, 25 bp, Mus musculus
gtcctgagagagttggctagctgct

SEQ ID NO: 687719 - DNA, 25 bp, Mus musculus
gtcctgagagctacatggtgtcata

SEQ ID NO: 687720 - DNA, 25 bp, Mus musculus
gtcctgagagcttcatggtgtcata

SEQ ID NO: 687721 - DNA, 25 bp, Mus musculus
gtcctgagattgacacagtctttat

SEQ ID NO: 687722 - DNA, 25 bp, Mus musculus
gtcctgagattgtcacagtctttat

SEQ ID NO: 687723 - DNA, 25 bp, Mus musculus
gtcctgagcacccatgtcaaatgat

SEQ ID NO: 687724 - DNA, 25 bp, Mus musculus
gtcctgagcaccgatgtcaaatgat

SEQ ID NO: 687725 - DNA, 25 bp, Mus musculus
gtcctgagcagacatggtccagaat

SEQ ID NO: 687726 - DNA, 25 bp, Mus musculus
gtcctgagcagagatggtccagaat

SEQ ID NO: 687727 - DNA, 25 bp, Mus musculus
gtcctgagctcactcttcggatata

SEQ ID NO: 687728 - DNA, 25 bp, Mus musculus
gtcctgagctcagtcttcggatata

SEQ ID NO: 687729 - DNA, 25 bp, Mus musculus
gtcctgaggcagcataacaattctg

SEQ ID NO: 687730 - DNA, 25 bp, Mus musculus
gtcctgaggcaggataacaattctg

SEQ ID NO: 687731 - DNA, 25 bp, Mus musculus
gtcctgagtcagaacctagtaacca

SEQ ID NO: 687732 - DNA, 25 bp, Mus musculus
gtcctgagtcagtacctagtaacca

SEQ ID NO: 687733 - DNA, 25 bp, Mus musculus
gtcctgagtgttaaccaatgtactg

SEQ ID NO: 687734 - DNA, 25 bp, Mus musculus
gtcctgagtgtttaccaatgtactg

SEQ ID NO: 687735 - DNA, 25 bp, Mus musculus
gtcctgatacctacagcttgttcat

SEQ ID NO: 687736 - DNA, 25 bp, Mus musculus
gtcctgataccttcagcttgttcat

SEQ ID NO: 687737 - DNA, 25 bp, Mus musculus
gtcctgatagtgaagcagcctgcat

SEQ ID NO: 687738 - DNA, 25 bp, Mus musculus
gtcctgatagtgtagcagcctgcat

SEQ ID NO: 687739 - DNA, 25 bp, Mus musculus
gtcctgatcatgaagtgccaccaac

SEQ ID NO: 687740 - DNA, 25 bp, Mus musculus
gtcctgatcatgtagtgccaccaac

SEQ ID NO: 687741 - DNA, 25 bp, Mus musculus
gtcctgatcattatcgatgaacccc

SEQ ID NO: 687742 - DNA, 25 bp, Mus musculus
gtcctgatcattttcgatgaacccc

SEQ ID NO: 687743 - DNA, 25 bp, Mus musculus
gtcctgatgatcaataaccatttct

SEQ ID NO: 687744 - DNA, 25 bp, Mus musculus
gtcctgatgatctataaccatttct

SEQ ID NO: 687745 - DNA, 25 bp, Mus musculus
gtcctgatgggacgcacacccgcag

SEQ ID NO: 687746 - DNA, 25 bp, Mus musculus
gtcctgatgggaggcacacccgcag

SEQ ID NO: 687747 - DNA, 25 bp, Mus musculus
gtcctgattacacattactgtcctg

SEQ ID NO: 687748 - DNA, 25 bp, Mus musculus
gtcctgattacagattactgtcctg

SEQ ID NO: 687749 - DNA, 25 bp, Mus musculus
gtcctgattcacagttgtaaagcat

SEQ ID NO: 687750 - DNA, 25 bp, Mus musculus
gtcctgattcactgttgtaaagcat

SEQ ID NO: 687751 - DNA, 25 bp, Mus musculus
gtcctgattcctcattgtgagtctc

SEQ ID NO: 687752 - DNA, 25 bp, Mus musculus
gtcctgattcctccactaagaattc

SEQ ID NO: 687753 - DNA, 25 bp, Mus musculus
gtcctgattcctgattgtgagtctc

SEQ ID NO: 687754 - DNA, 25 bp, Mus musculus
gtcctgattcctgcactaagaattc

SEQ ID NO: 687755 - DNA, 25 bp, Mus musculus
gtcctgattggacctcagcataatg

SEQ ID NO: 687756 - DNA, 25 bp, Mus musculus
gtcctgattggagctcagcataatg

SEQ ID NO: 687757 - DNA, 25 bp, Mus musculus
gtcctgatttgaacaccagactgtg

SEQ ID NO: 687758 - DNA, 25 bp, Mus musculus
gtcctgatttgatcaccagactgtg

SEQ ID NO: 687759 - DNA, 25 bp, Mus musculus
gtcctgcaacttactaggttggcct

SEQ ID NO: 687760 - DNA, 25 bp, Mus musculus
gtcctgcaactttctaggttggcct

SEQ ID NO: 687761 - DNA, 25 bp, Mus musculus
gtcctgcacagcatctgacttcaac

SEQ ID NO: 687762 - DNA, 25 bp, Mus musculus
gtcctgcacagcttctgacttcaac

SEQ ID NO: 687763 - DNA, 25 bp, Mus musculus
gtcctgcacaggcaactttagctta

SEQ ID NO: 687764 - DNA, 25 bp, Mus musculus
gtcctgcacagggaactttagctta

SEQ ID NO: 687765 - DNA, 25 bp, Mus musculus
gtcctgcacagtagtgagggcacca

SEQ ID NO: 687766 - DNA, 25 bp, Mus musculus
gtcctgcacagttgtgagggcacca

SEQ ID NO: 687767 - DNA, 25 bp, Mus musculus
gtcctgcacattaatctgtaaacat

SEQ ID NO: 687768 - DNA, 25 bp, Mus musculus
gtcctgcacatttatctgtaaacat

SEQ ID NO: 687769 - DNA, 25 bp, Mus musculus
gtcctgcagaaaactccttgataga

SEQ ID NO: 687770 - DNA, 25 bp, Mus musculus
gtcctgcagaaatctccttgataga

SEQ ID NO: 687771 - DNA, 25 bp, Mus musculus
gtcctgcaggagcaaaccaaatgtt

SEQ ID NO: 687772 - DNA, 25 bp, Mus musculus
gtcctgcaggaggaaaccaaatgtt

SEQ ID NO: 687773 - DNA, 25 bp, Mus musculus
gtcctgcaggatactgactcagaag

SEQ ID NO: 687774 - DNA, 25 bp, Mus musculus
gtcctgcaggattctgactcagaag

SEQ ID NO: 687775 - DNA, 25 bp, Mus musculus
gtcctgcaggccaggtggaacatga

SEQ ID NO: 687776 - DNA, 25 bp, Mus musculus
gtcctgcaggcctggtggaacatga

SEQ ID NO: 687777 - DNA, 25 bp, Mus musculus
gtcctgcagggtattttctgcacat

SEQ ID NO: 687778 - DNA, 25 bp, Mus musculus
gtcctgcagggttttttctgcacat

SEQ ID NO: 687779 - DNA, 25 bp, Mus musculus
gtcctgcagtcaaacatgctactgt

SEQ ID NO: 687780 - DNA, 25 bp, Mus musculus
gtcctgcagtcatacatgctactgt

SEQ ID NO: 687781 - DNA, 25 bp, Mus musculus
gtcctgcagtgtacttttgcttgaa

SEQ ID NO: 687782 - DNA, 25 bp, Mus musculus
gtcctgcagtgttcttttgcttgaa

SEQ ID NO: 687783 - DNA, 25 bp, Mus musculus
gtcctgcagttcagagcccggtgga

SEQ ID NO: 687784 - DNA, 25 bp, Mus musculus
gtcctgcagttctgagcccggtgga

SEQ ID NO: 687785 - DNA, 25 bp, Mus musculus
gtcctgcatcagcgtttcagagcac

SEQ ID NO: 687786 - DNA, 25 bp, Mus musculus
gtcctgcatcagctttgtacatacg

SEQ ID NO: 687787 - DNA, 25 bp, Mus musculus
gtcctgcatcagggtttcagagcac

SEQ ID NO: 687788 - DNA, 25 bp, Mus musculus
gtcctgcatcaggtttgtacatacg

SEQ ID NO: 687789 - DNA, 25 bp, Mus musculus
gtcctgcatgacacaagctttatta

SEQ ID NO: 687790 - DNA, 25 bp, Mus musculus
gtcctgcatgactcaagctttatta

SEQ ID NO: 687791 - DNA, 25 bp, Mus musculus
gtcctgcatgccaacagtctgggaa

SEQ ID NO: 687792 - DNA, 25 bp, Mus musculus
gtcctgcatgcctacagtctgggaa

SEQ ID NO: 687793 - DNA, 25 bp, Mus musculus
gtcctgcattgtattgtgtctgtca

SEQ ID NO: 687794 - DNA, 25 bp, Mus musculus
gtcctgcattgtcatttttctgtgt

SEQ ID NO: 687795 - DNA, 25 bp, Mus musculus
gtcctgcattgtgatttttctgtgt

SEQ ID NO: 687796 - DNA, 25 bp, Mus musculus
gtcctgcattgttttgtgtctgtca

SEQ ID NO: 687797 - DNA, 25 bp, Mus musculus
gtcctgccacagaagcaagaagcag

SEQ ID NO: 687798 - DNA, 25 bp, Mus musculus
gtcctgccacagtagcaagaagcag

SEQ ID NO: 687799 - DNA, 25 bp, Mus musculus
gtcctgccactgacatgtcatgggt

SEQ ID NO: 687800 - DNA, 25 bp, Mus musculus
gtcctgccactgtcatgtcatgggt

SEQ ID NO: 687801 - DNA, 25 bp, Mus musculus
gtcctgccacttactgtctatagag

SEQ ID NO: 687802 - DNA, 25 bp, Mus musculus
gtcctgccactttctgtctatagag

SEQ ID NO: 687803 - DNA, 25 bp, Mus musculus
gtcctgcccagtatgtattcagttt

SEQ ID NO: 687804 - DNA, 25 bp, Mus musculus
gtcctgcccagtttgtattcagttt

SEQ ID NO: 687805 - DNA, 25 bp, Mus musculus
gtcctgccccttcagatgctgaaat

SEQ ID NO: 687806 - DNA, 25 bp, Mus musculus
gtcctgccccttgagatgctgaaat

SEQ ID NO: 687807 - DNA, 25 bp, Mus musculus
gtcctgcctatgagatttgctttag

SEQ ID NO: 687808 - DNA, 25 bp, Mus musculus
gtcctgcctatgtgatttgctttag

SEQ ID NO: 687809 - DNA, 25 bp, Mus musculus
gtcctgcctcttaaatccttaaatc

SEQ ID NO: 687810 - DNA, 25 bp, Mus musculus
gtcctgcctctttaatccttaaatc

SEQ ID NO: 687811 - DNA, 25 bp, Mus musculus
gtcctgcctggcatcgaacttgcaa

SEQ ID NO: 687812 - DNA, 25 bp, Mus musculus
gtcctgcctggcttcgaacttgcaa

SEQ ID NO: 687813 - DNA, 25 bp, Mus musculus
gtcctgcctgtacctgctgtgatag

SEQ ID NO: 687814 - DNA, 25 bp, Mus musculus
gtcctgcctgtagctgctgtgatag

SEQ ID NO: 687815 - DNA, 25 bp, Mus musculus
gtcctgccttgtacctgttagagtg

SEQ ID NO: 687816 - DNA, 25 bp, Mus musculus
gtcctgccttgttcctgttagagtg

SEQ ID NO: 687817 - DNA, 25 bp, Mus musculus
gtcctgcgaacgatgttcaacatgt

SEQ ID NO: 687818 - DNA, 25 bp, Mus musculus
gtcctgcgaacgttgttcaacatgt

SEQ ID NO: 687819 - DNA, 25 bp, Mus musculus
gtcctgcgcagaccgagttactgtg

SEQ ID NO: 687820 - DNA, 25 bp, Mus musculus
gtcctgcgcagagcgagttactgtg

SEQ ID NO: 687821 - DNA, 25 bp, Mus musculus
gtcctgcgcagtctagatgtgacca

SEQ ID NO: 687822 - DNA, 25 bp, Mus musculus
gtcctgcgcagtgtagatgtgacca

SEQ ID NO: 687823 - DNA, 25 bp, Mus musculus
gtcctgcgtgatacagacaaccaag

SEQ ID NO: 687824 - DNA, 25 bp, Mus musculus
gtcctgcgtgattcagacaaccaag

SEQ ID NO: 687825 - DNA, 25 bp, Mus musculus
gtcctgcgtgtaaatcctacataag

SEQ ID NO: 687826 - DNA, 25 bp, Mus musculus
gtcctgcgtgtatatcctacataag

SEQ ID NO: 687827 - DNA, 25 bp, Mus musculus
gtcctgctacagctttgctgttgtt

SEQ ID NO: 687828 - DNA, 25 bp, Mus musculus
gtcctgctacaggtttgctgttgtt

SEQ ID NO: 687829 - DNA, 25 bp, Mus musculus
gtcctgctacccagcaaggaggagc

SEQ ID NO: 687830 - DNA, 25 bp, Mus musculus
gtcctgctaccctgcaaggaggagc

SEQ ID NO: 687831 - DNA, 25 bp, Mus musculus
gtcctgctagcacgaagagctcaaa

SEQ ID NO: 687832 - DNA, 25 bp, Mus musculus
gtcctgctagcaggaagagctcaaa

SEQ ID NO: 687833 - DNA, 25 bp, Mus musculus
gtcctgctcaggatccaatgatgtc

SEQ ID NO: 687834 - DNA, 25 bp, Mus musculus
gtcctgctcaggttccaatgatgtc

SEQ ID NO: 687835 - DNA, 25 bp, Mus musculus
gtcctgctcatgaggtaggctagca

SEQ ID NO: 687836 - DNA, 25 bp, Mus musculus
gtcctgctcatgtggtaggctagca

SEQ ID NO: 687837 - DNA, 25 bp, Mus musculus
gtcctgctccaaagaaaactaaaat

SEQ ID NO: 687838 - DNA, 25 bp, Mus musculus
gtcctgctccaatgaaaactaaaat

SEQ ID NO: 687839 - DNA, 25 bp, Mus musculus
gtcctgctctctaaggctttaggaa

SEQ ID NO: 687840 - DNA, 25 bp, Mus musculus
gtcctgctctcttaggctttaggaa

SEQ ID NO: 687841 - DNA, 25 bp, Mus musculus
gtcctgctctggaaacctccacaat

SEQ ID NO: 687842 - DNA, 25 bp, Mus musculus
gtcctgctctggctcatcaaggcat

SEQ ID NO: 687843 - DNA, 25 bp, Mus musculus
gtcctgctctgggtcatcaaggcat

SEQ ID NO: 687844 - DNA, 25 bp, Mus musculus
gtcctgctctggtaacctccacaat

SEQ ID NO: 687845 - DNA, 25 bp, Mus musculus
gtcctgctcttccttagatgctgga

SEQ ID NO: 687846 - DNA, 25 bp, Mus musculus
gtcctgctcttcgttagatgctgga

SEQ ID NO: 687847 - DNA, 25 bp, Mus musculus
gtcctgctgcaaacccagtgaacag

SEQ ID NO: 687848 - DNA, 25 bp, Mus musculus
gtcctgctgcaatcccagtgaacag

SEQ ID NO: 687849 - DNA, 25 bp, Mus musculus
gtcctgctgggaagagccccaaagc

SEQ ID NO: 687850 - DNA, 25 bp, Mus musculus
gtcctgctgggacagtttcttctga

SEQ ID NO: 687851 - DNA, 25 bp, Mus musculus
gtcctgctgggagagtttcttctga

SEQ ID NO: 687852 - DNA, 25 bp, Mus musculus
gtcctgctgggatgagccccaaagc

SEQ ID NO: 687853 - DNA, 25 bp, Mus musculus
gtcctgctggtgagaagatgcttct

SEQ ID NO: 687854 - DNA, 25 bp, Mus musculus
gtcctgctggtgtgaagatgcttct

SEQ ID NO: 687855 - DNA, 25 bp, Mus musculus
gtcctgcttagcattaaatcgctat

SEQ ID NO: 687856 - DNA, 25 bp, Mus musculus
gtcctgcttagctttaaatcgctat

SEQ ID NO: 687857 - DNA, 25 bp, Mus musculus
gtcctgcttctcctgagatgatggt

SEQ ID NO: 687858 - DNA, 25 bp, Mus musculus
gtcctgcttctcgtgagatgatggt

SEQ ID NO: 687859 - DNA, 25 bp, Mus musculus
gtcctgctttataccagttgtcaca

SEQ ID NO: 687860 - DNA, 25 bp, Mus musculus
gtcctgctttattccagttgtcaca

SEQ ID NO: 687861 - DNA, 25 bp, Mus musculus
gtcctggaacctctttagactggtg

SEQ ID NO: 687862 - DNA, 25 bp, Mus musculus
gtcctggaacctgtttagactggtg

SEQ ID NO: 687863 - DNA, 25 bp, Mus musculus
gtcctggaacgtcagtggctgaact

SEQ ID NO: 687864 - DNA, 25 bp, Mus musculus
gtcctggaacgtgagtggctgaact

SEQ ID NO: 687865 - DNA, 25 bp, Mus musculus
gtcctggaatggcctgtctttttct

SEQ ID NO: 687866 - DNA, 25 bp, Mus musculus
gtcctggaatgggctgtctttttct

SEQ ID NO: 687867 - DNA, 25 bp, Mus musculus
gtcctggaattcaccattctttctt

SEQ ID NO: 687868 - DNA, 25 bp, Mus musculus
gtcctggaattctccattctttctt

SEQ ID NO: 687869 - DNA, 25 bp, Mus musculus
gtcctggaatttcagatcttcttgc

SEQ ID NO: 687870 - DNA, 25 bp, Mus musculus
gtcctggaatttgagatcttcttgc

SEQ ID NO: 687871 - DNA, 25 bp, Mus musculus
gtcctggacatcactgtatatactg

SEQ ID NO: 687872 - DNA, 25 bp, Mus musculus
gtcctggacatctctgtatatactg

SEQ ID NO: 687873 - DNA, 25 bp, Mus musculus
gtcctggacattcaacagttctcta

SEQ ID NO: 687874 - DNA, 25 bp, Mus musculus
gtcctggacattgaacagttctcta

SEQ ID NO: 687875 - DNA, 25 bp, Mus musculus
gtcctggacctcacaagaaaatact

SEQ ID NO: 687876 - DNA, 25 bp, Mus musculus
gtcctggacctcactatgattcaca

SEQ ID NO: 687877 - DNA, 25 bp, Mus musculus
gtcctggacctctcaagaaaatact

SEQ ID NO: 687878 - DNA, 25 bp, Mus musculus
gtcctggacctctctatgattcaca

SEQ ID NO: 687879 - DNA, 25 bp, Mus musculus
gtcctggacctgagtatacctgagt

SEQ ID NO: 687880 - DNA, 25 bp, Mus musculus
gtcctggacctgtgtatacctgagt

SEQ ID NO: 687881 - DNA, 25 bp, Mus musculus
gtcctggactatcaaatgaaattct

SEQ ID NO: 687882 - DNA, 25 bp, Mus musculus
gtcctggactatgaaatgaaattct

SEQ ID NO: 687883 - DNA, 25 bp, Mus musculus
gtcctggacttaatgctgcactttg

SEQ ID NO: 687884 - DNA, 25 bp, Mus musculus
gtcctggacttattgctgcactttg

SEQ ID NO: 687885 - DNA, 25 bp, Mus musculus
gtcctggaggagcttgagttacttc

SEQ ID NO: 687886 - DNA, 25 bp, Mus musculus
gtcctggaggaggttgagttacttc

SEQ ID NO: 687887 - DNA, 25 bp, Mus musculus
gtcctggaggcaccatgccagcaga

SEQ ID NO: 687888 - DNA, 25 bp, Mus musculus
gtcctggaggcagcatgccagcaga

SEQ ID NO: 687889 - DNA, 25 bp, Mus musculus
gtcctggatcccaaaataaactgtc

SEQ ID NO: 687890 - DNA, 25 bp, Mus musculus
gtcctggatccctaaataaactgtc

SEQ ID NO: 687891 - DNA, 25 bp, Mus musculus
gtcctggatgggattttctagaaat

SEQ ID NO: 687892 - DNA, 25 bp, Mus musculus
gtcctggatgggtttttctagaaat

SEQ ID NO: 687893 - DNA, 25 bp, Mus musculus
gtcctggattcaacctcttattttt

SEQ ID NO: 687894 - DNA, 25 bp, Mus musculus
gtcctggattcatcctcttattttt

SEQ ID NO: 687895 - DNA, 25 bp, Mus musculus
gtcctggcaaatctgtcttcacaag

SEQ ID NO: 687896 - DNA, 25 bp, Mus musculus
gtcctggcaaatgtgtcttcacaag

SEQ ID NO: 687897 - DNA, 25 bp, Mus musculus
gtcctggcagagatacataaagcac

SEQ ID NO: 687898 - DNA, 25 bp, Mus musculus
gtcctggcagagttacataaagcac

SEQ ID NO: 687899 - DNA, 25 bp, Mus musculus
gtcctggccttaaagttacagtgta

SEQ ID NO: 687900 - DNA, 25 bp, Mus musculus
gtcctggccttatagttacagtgta

SEQ ID NO: 687901 - DNA, 25 bp, Mus musculus
gtcctggctcagcaagaccctcgag

SEQ ID NO: 687902 - DNA, 25 bp, Mus musculus
gtcctggctcaggaagaccctcgag

SEQ ID NO: 687903 - DNA, 25 bp, Mus musculus
gtcctggctgtaattcgtggaccag

SEQ ID NO: 687904 - DNA, 25 bp, Mus musculus
gtcctggctgtatttcgtggaccag

SEQ ID NO: 687905 - DNA, 25 bp, Mus musculus
gtcctggctgtcattctggtgctca

SEQ ID NO: 687906 - DNA, 25 bp, Mus musculus
gtcctggctgtctttctggtgctca

SEQ ID NO: 687907 - DNA, 25 bp, Mus musculus
gtcctgggacaccaatttaaggtca

SEQ ID NO: 687908 - DNA, 25 bp, Mus musculus
gtcctgggacacgaatttaaggtca

SEQ ID NO: 687909 - DNA, 25 bp, Mus musculus
gtcctgggacttagatggcttttct

SEQ ID NO: 687910 - DNA, 25 bp, Mus musculus
gtcctgggactttgatggcttttct

SEQ ID NO: 687911 - DNA, 25 bp, Mus musculus
gtcctgggagagacgtgaacacctg

SEQ ID NO: 687912 - DNA, 25 bp, Mus musculus
gtcctgggagagtcgtgaacacctg

SEQ ID NO: 687913 - DNA, 25 bp, Mus musculus
gtcctgggccctcagctgtagaaag

SEQ ID NO: 687914 - DNA, 25 bp, Mus musculus
gtcctgggccctgagctgtagaaag

SEQ ID NO: 687915 - DNA, 25 bp, Mus musculus
gtcctgggcgacaccgagacaaggc

SEQ ID NO: 687916 - DNA, 25 bp, Mus musculus
gtcctgggcgactccgagacaaggc

SEQ ID NO: 687917 - DNA, 25 bp, Mus musculus
gtcctgggctgactgctctctaaag

SEQ ID NO: 687918 - DNA, 25 bp, Mus musculus
gtcctgggctgagtgctctctaaag

SEQ ID NO: 687919 - DNA, 25 bp, Mus musculus
gtcctgggcttgaacagtatgctat

SEQ ID NO: 687920 - DNA, 25 bp, Mus musculus
gtcctgggcttgtacagtatgctat

SEQ ID NO: 687921 - DNA, 25 bp, Mus musculus
gtcctggggattatagcacaaatgt

SEQ ID NO: 687922 - DNA, 25 bp, Mus musculus
gtcctggggattttagcacaaatgt

SEQ ID NO: 687923 - DNA, 25 bp, Mus musculus
gtcctgggtgacacagtgtgattaa

SEQ ID NO: 687924 - DNA, 25 bp, Mus musculus
gtcctgggtgactcagtgtgattaa

SEQ ID NO: 687925 - DNA, 25 bp, Mus musculus
gtcctggtaatgcaagcctgactcg

SEQ ID NO: 687926 - DNA, 25 bp, Mus musculus
gtcctggtaatggaagcctgactcg

SEQ ID NO: 687927 - DNA, 25 bp, Mus musculus
gtcctggtaattccacctactgaag

SEQ ID NO: 687928 - DNA, 25 bp, Mus musculus
gtcctggtaattgcacctactgaag

SEQ ID NO: 687929 - DNA, 25 bp, Mus musculus
gtcctggtaggcaaagaccggtcaa

SEQ ID NO: 687930 - DNA, 25 bp, Mus musculus
gtcctggtaggctaagaccggtcaa

SEQ ID NO: 687931 - DNA, 25 bp, Mus musculus
gtcctggtatcactcaaacttcttg

SEQ ID NO: 687932 - DNA, 25 bp, Mus musculus
gtcctggtatcagtcaaacttcttg

SEQ ID NO: 687933 - DNA, 25 bp, Mus musculus
gtcctggtatttatgttcgagtagc

SEQ ID NO: 687934 - DNA, 25 bp, Mus musculus
gtcctggtatttttgttcgagtagc

SEQ ID NO: 687935 - DNA, 25 bp, Mus musculus
gtcctggtcctgctctgagtactgt

SEQ ID NO: 687936 - DNA, 25 bp, Mus musculus
gtcctggtcctggtctgagtactgt

SEQ ID NO: 687937 - DNA, 25 bp, Mus musculus
gtcctggtcttgcagagcccagtga

SEQ ID NO: 687938 - DNA, 25 bp, Mus musculus
gtcctggtcttggagagcccagtga

SEQ ID NO: 687939 - DNA, 25 bp, Mus musculus
gtcctggtctttaacatcactgtga

SEQ ID NO: 687940 - DNA, 25 bp, Mus musculus
gtcctggtcttttacatcactgtga

SEQ ID NO: 687941 - DNA, 25 bp, Mus musculus
gtcctggtggatccaaatcagatga

SEQ ID NO: 687942 - DNA, 25 bp, Mus musculus
gtcctggtggatgcaaatcagatga

SEQ ID NO: 687943 - DNA, 25 bp, Mus musculus
gtcctggtgggcctcatcctggtcc

SEQ ID NO: 687944 - DNA, 25 bp, Mus musculus
gtcctggtgggcgtcatcctggtcc

SEQ ID NO: 687945 - DNA, 25 bp, Mus musculus
gtcctggtgttcctatgcaccacag

SEQ ID NO: 687946 - DNA, 25 bp, Mus musculus
gtcctggtgttcgtatgcaccacag

SEQ ID NO: 687947 - DNA, 25 bp, Mus musculus
gtcctggttgaaaccaaactgtaat

SEQ ID NO: 687948 - DNA, 25 bp, Mus musculus
gtcctggttgaatccaaactgtaat

SEQ ID NO: 687949 - DNA, 25 bp, Mus musculus
gtcctggttgagaatgggatccgat

SEQ ID NO: 687950 - DNA, 25 bp, Mus musculus
gtcctggttgagtatgggatccgat

SEQ ID NO: 687951 - DNA, 25 bp, Mus musculus
gtcctggttggccagatctttttct

SEQ ID NO: 687952 - DNA, 25 bp, Mus musculus
gtcctggttggcgagatctttttct

SEQ ID NO: 687953 - DNA, 25 bp, Mus musculus
gtcctggtttacactctgtacttta

SEQ ID NO: 687954 - DNA, 25 bp, Mus musculus
gtcctggtttactctctgtacttta

SEQ ID NO: 687955 - DNA, 25 bp, Mus musculus
gtcctggtttatagggatgctccct

SEQ ID NO: 687956 - DNA, 25 bp, Mus musculus
gtcctggtttattgggatgctccct

SEQ ID NO: 687957 - DNA, 25 bp, Mus musculus
gtcctggtttggatgaaatagaaat

SEQ ID NO: 687958 - DNA, 25 bp, Mus musculus
gtcctggtttggttgaaatagaaat

SEQ ID NO: 687959 - DNA, 25 bp, Mus musculus
gtcctgtaaataagctctggctgcc

SEQ ID NO: 687960 - DNA, 25 bp, Mus musculus
gtcctgtaaatatgctctggctgcc

SEQ ID NO: 687961 - DNA, 25 bp, Mus musculus
gtcctgtaatgcattctcttctgaa

SEQ ID NO: 687962 - DNA, 25 bp, Mus musculus
gtcctgtaatgctttctcttctgaa

SEQ ID NO: 687963 - DNA, 25 bp, Mus musculus
gtcctgtacattagtgatttctctc

SEQ ID NO: 687964 - DNA, 25 bp, Mus musculus
gtcctgtacatttgtgatttctctc

SEQ ID NO: 687965 - DNA, 25 bp, Mus musculus
gtcctgtaccaccaatcttggaaaa

SEQ ID NO: 687966 - DNA, 25 bp, Mus musculus
gtcctgtaccacgaatcttggaaaa

SEQ ID NO: 687967 - DNA, 25 bp, Mus musculus
gtcctgtagaccatacctcattaga

SEQ ID NO: 687968 - DNA, 25 bp, Mus musculus
gtcctgtagaccttacctcattaga

SEQ ID NO: 687969 - DNA, 25 bp, Mus musculus
gtcctgtagggtatcattagtggtc

SEQ ID NO: 687970 - DNA, 25 bp, Mus musculus
gtcctgtagggtttcattagtggtc

SEQ ID NO: 687971 - DNA, 25 bp, Mus musculus
gtcctgtcagcaacagtgcttcaca

SEQ ID NO: 687972 - DNA, 25 bp, Mus musculus
gtcctgtcagcatcagtgcttcaca

SEQ ID NO: 687973 - DNA, 25 bp, Mus musculus
gtcctgtcaggaataagtgcgtcca

SEQ ID NO: 687974 - DNA, 25 bp, Mus musculus
gtcctgtcaggattaagtgcgtcca

SEQ ID NO: 687975 - DNA, 25 bp, Mus musculus
gtcctgtcatgtcctttgagccttg

SEQ ID NO: 687976 - DNA, 25 bp, Mus musculus
gtcctgtcatgtgctttgagccttg

SEQ ID NO: 687977 - DNA, 25 bp, Mus musculus
gtcctgtcatttctcggatccaaga

SEQ ID NO: 687978 - DNA, 25 bp, Mus musculus
gtcctgtcatttgtcggatccaaga

SEQ ID NO: 687979 - DNA, 25 bp, Mus musculus
gtcctgtccattaaggtttgcttgt

SEQ ID NO: 687980 - DNA, 25 bp, Mus musculus
gtcctgtccatttaggtttgcttgt

SEQ ID NO: 687981 - DNA, 25 bp, Mus musculus
gtcctgtcccggatcactagaagaa

SEQ ID NO: 687982 - DNA, 25 bp, Mus musculus
gtcctgtcccggttcactagaagaa

SEQ ID NO: 687983 - DNA, 25 bp, Mus musculus
gtcctgtcctacacggtgctgttga

SEQ ID NO: 687984 - DNA, 25 bp, Mus musculus
gtcctgtcctactcggtgctgttga

SEQ ID NO: 687985 - DNA, 25 bp, Mus musculus
gtcctgtcctccagaagcgagtact

SEQ ID NO: 687986 - DNA, 25 bp, Mus musculus
gtcctgtcctcctgaagcgagtact

SEQ ID NO: 687987 - DNA, 25 bp, Mus musculus
gtcctgtcctcgattgttggaactg

SEQ ID NO: 687988 - DNA, 25 bp, Mus musculus
gtcctgtcctcgtttgttggaactg

SEQ ID NO: 687989 - DNA, 25 bp, Mus musculus
gtcctgtcctgtctcaaacacgata

SEQ ID NO: 687990 - DNA, 25 bp, Mus musculus
gtcctgtcctgtgtcaaacacgata

SEQ ID NO: 687991 - DNA, 25 bp, Mus musculus
gtcctgtcgtctagttagcatgatt

SEQ ID NO: 687992 - DNA, 25 bp, Mus musculus
gtcctgtcgtcttgttagcatgatt

SEQ ID NO: 687993 - DNA, 25 bp, Mus musculus
gtcctgtctaatctgagcttcacta

SEQ ID NO: 687994 - DNA, 25 bp, Mus musculus
gtcctgtctaatgtgagcttcacta

SEQ ID NO: 687995 - DNA, 25 bp, Mus musculus
gtcctgtctatgaaatgggctaagt

SEQ ID NO: 687996 - DNA, 25 bp, Mus musculus
gtcctgtctatgtaatgggctaagt

SEQ ID NO: 687997 - DNA, 25 bp, Mus musculus
gtcctgtctctgacagtggagaaga

SEQ ID NO: 687998 - DNA, 25 bp, Mus musculus
gtcctgtctctgtcagtggagaaga

SEQ ID NO: 687999 - DNA, 25 bp, Mus musculus
gtcctgtctgacctctaacttatag

SEQ ID NO: 688000 - DNA, 25 bp, Mus musculus
gtcctgtctgacgtctaacttatag

SEQ ID NO: 688001 - DNA, 25 bp, Mus musculus
gtcctgtctgggagactgtttcata

SEQ ID NO: 688002 - DNA, 25 bp, Mus musculus
gtcctgtctgggtgactgtttcata

SEQ ID NO: 688003 - DNA, 25 bp, Mus musculus
gtcctgtctgtgcttggtcaatagt

SEQ ID NO: 688004 - DNA, 25 bp, Mus musculus
gtcctgtctgtggttggtcaatagt

SEQ ID NO: 688005 - DNA, 25 bp, Mus musculus
gtcctgtcttctctgtatacttaca

SEQ ID NO: 688006 - DNA, 25 bp, Mus musculus
gtcctgtcttctgtgtatacttaca

SEQ ID NO: 688007 - DNA, 25 bp, Mus musculus
gtcctgtgaaccatgatctacttgc

SEQ ID NO: 688008 - DNA, 25 bp, Mus musculus
gtcctgtgaaccttgatctacttgc

SEQ ID NO: 688009 - DNA, 25 bp, Mus musculus
gtcctgtgacaaactggaacccgat

SEQ ID NO: 688010 - DNA, 25 bp, Mus musculus
gtcctgtgacaatctggaacccgat

SEQ ID NO: 688011 - DNA, 25 bp, Mus musculus
gtcctgtgaggtaaaaagcatctct

SEQ ID NO: 688012 - DNA, 25 bp, Mus musculus
gtcctgtgaggttaaaagcatctct

SEQ ID NO: 688013 - DNA, 25 bp, Mus musculus
gtcctgtgccttctagatctttgca

SEQ ID NO: 688014 - DNA, 25 bp, Mus musculus
gtcctgtgccttgtagatctttgca

SEQ ID NO: 688015 - DNA, 25 bp, Mus musculus
gtcctgtggaccaggatctgagatt

SEQ ID NO: 688016 - DNA, 25 bp, Mus musculus
gtcctgtggacctggatctgagatt

SEQ ID NO: 688017 - DNA, 25 bp, Mus musculus
gtcctgtggagaccttagaaaactt

SEQ ID NO: 688018 - DNA, 25 bp, Mus musculus
gtcctgtggagagcttagaaaactt

SEQ ID NO: 688019 - DNA, 25 bp, Mus musculus
gtcctgtggcccagggaaaattagg

SEQ ID NO: 688020 - DNA, 25 bp, Mus musculus
gtcctgtggcccatgaaaggtagtt

SEQ ID NO: 688021 - DNA, 25 bp, Mus musculus
gtcctgtggccctgggaaaattagg

SEQ ID NO: 688022 - DNA, 25 bp, Mus musculus
gtcctgtggcccttgaaaggtagtt

SEQ ID NO: 688023 - DNA, 25 bp, Mus musculus
gtcctgtggctaatatcttgtgtgt

SEQ ID NO: 688024 - DNA, 25 bp, Mus musculus
gtcctgtggctattatcttgtgtgt

SEQ ID NO: 688025 - DNA, 25 bp, Mus musculus
gtcctgtgggtacatgagtgcttta

SEQ ID NO: 688026 - DNA, 25 bp, Mus musculus
gtcctgtgggtagatgagtgcttta

SEQ ID NO: 688027 - DNA, 25 bp, Mus musculus
gtcctgtgggttcaatttaggtcat

SEQ ID NO: 688028 - DNA, 25 bp, Mus musculus
gtcctgtgggttgaatttaggtcat

SEQ ID NO: 688029 - DNA, 25 bp, Mus musculus
gtcctgtggtcacggtttcaggata

SEQ ID NO: 688030 - DNA, 25 bp, Mus musculus
gtcctgtggtcagggtttcaggata

SEQ ID NO: 688031 - DNA, 25 bp, Mus musculus
gtcctgtgtagcatgttcttttact

SEQ ID NO: 688032 - DNA, 25 bp, Mus musculus
gtcctgtgtagcttgttcttttact

SEQ ID NO: 688033 - DNA, 25 bp, Mus musculus
gtcctgtgtcctcacatcacttgta

SEQ ID NO: 688034 - DNA, 25 bp, Mus musculus
gtcctgtgtcctgacatcacttgta

SEQ ID NO: 688035 - DNA, 25 bp, Mus musculus
gtcctgtgtggaagaagcccttagt

SEQ ID NO: 688036 - DNA, 25 bp, Mus musculus
gtcctgtgtggatgaagcccttagt

SEQ ID NO: 688037 - DNA, 25 bp, Mus musculus
gtcctgtgtgtcatcgatgcattgc

SEQ ID NO: 688038 - DNA, 25 bp, Mus musculus
gtcctgtgtgtcttcgatgcattgc

SEQ ID NO: 688039 - DNA, 25 bp, Mus musculus
gtcctgtgttgcatctggaaggtca

SEQ ID NO: 688040 - DNA, 25 bp, Mus musculus
gtcctgtgttgcttctggaaggtca

SEQ ID NO: 688041 - DNA, 25 bp, Mus musculus
gtcctgtgttgtctcagaggaagca

SEQ ID NO: 688042 - DNA, 25 bp, Mus musculus
gtcctgtgttgtgtcagaggaagca

SEQ ID NO: 688043 - DNA, 25 bp, Mus musculus
gtcctgtgttttaatagcacccaaa

SEQ ID NO: 688044 - DNA, 25 bp, Mus musculus
gtcctgtgtttttatagcacccaaa

SEQ ID NO: 688045 - DNA, 25 bp, Mus musculus
gtcctgttaaagactgggaactcag

SEQ ID NO: 688046 - DNA, 25 bp, Mus musculus
gtcctgttaaagtctgggaactcag

SEQ ID NO: 688047 - DNA, 25 bp, Mus musculus
gtcctgttacaacatgcccactata

SEQ ID NO: 688048 - DNA, 25 bp, Mus musculus
gtcctgttacaagatgcccactata

SEQ ID NO: 688049 - DNA, 25 bp, Mus musculus
gtcctgttacacattaaaactattt

SEQ ID NO: 688050 - DNA, 25 bp, Mus musculus
gtcctgttacactttaaaactattt

SEQ ID NO: 688051 - DNA, 25 bp, Mus musculus
gtcctgttacccaggaaggaactgt

SEQ ID NO: 688052 - DNA, 25 bp, Mus musculus
gtcctgttaccctggaaggaactgt

SEQ ID NO: 688053 - DNA, 25 bp, Mus musculus
gtcctgttagcgctgatagctctta

SEQ ID NO: 688054 - DNA, 25 bp, Mus musculus
gtcctgttagcggtgatagctctta

SEQ ID NO: 688055 - DNA, 25 bp, Mus musculus
gtcctgttaggacattcccagttct

SEQ ID NO: 688056 - DNA, 25 bp, Mus musculus
gtcctgttaggagattcccagttct

SEQ ID NO: 688057 - DNA, 25 bp, Mus musculus
gtcctgttatgtattatctgtttgt

SEQ ID NO: 688058 - DNA, 25 bp, Mus musculus
gtcctgttatgttttatctgtttgt

SEQ ID NO: 688059 - DNA, 25 bp, Mus musculus
gtcctgttcaagaagccagacccat

SEQ ID NO: 688060 - DNA, 25 bp, Mus musculus
gtcctgttcaagtagccagacccat

SEQ ID NO: 688061 - DNA, 25 bp, Mus musculus
gtcctgttcagtaaaaaggatctgt

SEQ ID NO: 688062 - DNA, 25 bp, Mus musculus
gtcctgttcagttaaaaggatctgt

SEQ ID NO: 688063 - DNA, 25 bp, Mus musculus
gtcctgttccggctatttcatatat

SEQ ID NO: 688064 - DNA, 25 bp, Mus musculus
gtcctgttccgggtatttcatatat

SEQ ID NO: 688065 - DNA, 25 bp, Mus musculus
gtcctgttcgacaaagcgacatacg

SEQ ID NO: 688066 - DNA, 25 bp, Mus musculus
gtcctgttcgactaagcgacatacg

SEQ ID NO: 688067 - DNA, 25 bp, Mus musculus
gtcctgttctgaacttcagataatg

SEQ ID NO: 688068 - DNA, 25 bp, Mus musculus
gtcctgttctgatcttcagataatg

SEQ ID NO: 688069 - DNA, 25 bp, Mus musculus
gtcctgttcttaactctgagtccag

SEQ ID NO: 688070 - DNA, 25 bp, Mus musculus
gtcctgttcttatctctgagtccag

SEQ ID NO: 688071 - DNA, 25 bp, Mus musculus
gtcctgttgacactgtgctgcatga

SEQ ID NO: 688072 - DNA, 25 bp, Mus musculus
gtcctgttgacagtgtgctgcatga

SEQ ID NO: 688073 - DNA, 25 bp, Mus musculus
gtcctgttgactctgcctttcataa

SEQ ID NO: 688074 - DNA, 25 bp, Mus musculus
gtcctgttgactgtgcctttcataa

SEQ ID NO: 688075 - DNA, 25 bp, Mus musculus
gtcctgttggacctcatggtaccca

SEQ ID NO: 688076 - DNA, 25 bp, Mus musculus
gtcctgttggacgtcatggtaccca

SEQ ID NO: 688077 - DNA, 25 bp, Mus musculus
gtcctgttggtaattttgtcttctc

SEQ ID NO: 688078 - DNA, 25 bp, Mus musculus
gtcctgttggtatttttgtcttctc

SEQ ID NO: 688079 - DNA, 25 bp, Mus musculus
gtcctgttgtctaaatccgatctta

SEQ ID NO: 688080 - DNA, 25 bp, Mus musculus
gtcctgttgtcttaatccgatctta

SEQ ID NO: 688081 - DNA, 25 bp, Mus musculus
gtcctgtttaaaatggtccactgaa

SEQ ID NO: 688082 - DNA, 25 bp, Mus musculus
gtcctgtttaaattggtccactgaa

SEQ ID NO: 688083 - DNA, 25 bp, Mus musculus
gtcctgtttagtatggcagaaagca

SEQ ID NO: 688084 - DNA, 25 bp, Mus musculus
gtcctgtttagtttggcagaaagca

SEQ ID NO: 688085 - DNA, 25 bp, Mus musculus
gtcctgtttcttaatgtacctttca

SEQ ID NO: 688086 - DNA, 25 bp, Mus musculus
gtcctgtttctttatgtacctttca

SEQ ID NO: 688087 - DNA, 25 bp, Mus musculus
gtcctgtttggactgtctcgggcac

SEQ ID NO: 688088 - DNA, 25 bp, Mus musculus
gtcctgtttggagtgtctcgggcac

SEQ ID NO: 688089 - DNA, 25 bp, Mus musculus
gtcctgtttgggacaccaacacaag

SEQ ID NO: 688090 - DNA, 25 bp, Mus musculus
gtcctgtttgggtcaccaacacaag

SEQ ID NO: 688091 - DNA, 25 bp, Mus musculus
gtcctgttttgaaatttcaccatta

SEQ ID NO: 688092 - DNA, 25 bp, Mus musculus
gtcctgttttgatatttcaccatta

SEQ ID NO: 688093 - DNA, 25 bp, Mus musculus
gtcctgtttttaaaccttgaagcaa

SEQ ID NO: 688094 - DNA, 25 bp, Mus musculus
gtcctgtttttataccttgaagcaa

SEQ ID NO: 688095 - DNA, 25 bp, Mus musculus
gtccttaaacttattacatagccca

SEQ ID NO: 688096 - DNA, 25 bp, Mus musculus
gtccttaaactttttacatagccca

SEQ ID NO: 688097 - DNA, 25 bp, Mus musculus
gtccttaaaggaatgcagtcaccca

SEQ ID NO: 688098 - DNA, 25 bp, Mus musculus
gtccttaaaggattgcagtcaccca

SEQ ID NO: 688099 - DNA, 25 bp, Mus musculus
gtccttaaataacctgagctccaga

SEQ ID NO: 688100 - DNA, 25 bp, Mus musculus
gtccttaaataagctgagctccaga

SEQ ID NO: 688101 - DNA, 25 bp, Mus musculus
gtccttaaccttactgggtctcatt

SEQ ID NO: 688102 - DNA, 25 bp, Mus musculus
gtccttaacctttctgggtctcatt

SEQ ID NO: 688103 - DNA, 25 bp, Mus musculus
gtccttaagagacggagcttcacca

SEQ ID NO: 688104 - DNA, 25 bp, Mus musculus
gtccttaagagagggagcttcacca

SEQ ID NO: 688105 - DNA, 25 bp, Mus musculus
gtccttaagccgattccttattgtg

SEQ ID NO: 688106 - DNA, 25 bp, Mus musculus
gtccttaagccgtttccttattgtg

SEQ ID NO: 688107 - DNA, 25 bp, Mus musculus
gtccttaatgagcttgtcttgcaag

SEQ ID NO: 688108 - DNA, 25 bp, Mus musculus
gtccttaatgaggttgtcttgcaag

SEQ ID NO: 688109 - DNA, 25 bp, Mus musculus
gtccttacaatgattttgatcacct

SEQ ID NO: 688110 - DNA, 25 bp, Mus musculus
gtccttacaatgtttttgatcacct

SEQ ID NO: 688111 - DNA, 25 bp, Mus musculus
gtccttacacagcagaagggcccat

SEQ ID NO: 688112 - DNA, 25 bp, Mus musculus
gtccttacacaggagaagggcccat

SEQ ID NO: 688113 - DNA, 25 bp, Mus musculus
gtccttacagtcattaacagtttca

SEQ ID NO: 688114 - DNA, 25 bp, Mus musculus
gtccttacagtctttaacagtttca

SEQ ID NO: 688115 - DNA, 25 bp, Mus musculus
gtccttacataaaggaaccttccct

SEQ ID NO: 688116 - DNA, 25 bp, Mus musculus
gtccttacataatggaaccttccct

SEQ ID NO: 688117 - DNA, 25 bp, Mus musculus
gtccttacatgtcgatgctccttaa

SEQ ID NO: 688118 - DNA, 25 bp, Mus musculus
gtccttacatgtggatgctccttaa

SEQ ID NO: 688119 - DNA, 25 bp, Mus musculus
gtccttaccagaaatattcacgcct

SEQ ID NO: 688120 - DNA, 25 bp, Mus musculus
gtccttaccagatatattcacgcct

SEQ ID NO: 688121 - DNA, 25 bp, Mus musculus
gtccttaccagcattgacaacacag

SEQ ID NO: 688122 - DNA, 25 bp, Mus musculus
gtccttaccagctttgacaacacag

SEQ ID NO: 688123 - DNA, 25 bp, Mus musculus
gtccttacctttaacagatgcttat

SEQ ID NO: 688124 - DNA, 25 bp, Mus musculus
gtccttaccttttacagatgcttat

SEQ ID NO: 688125 - DNA, 25 bp, Mus musculus
gtccttacggacagtggatacctgt

SEQ ID NO: 688126 - DNA, 25 bp, Mus musculus
gtccttacggactgtggatacctgt

SEQ ID NO: 688127 - DNA, 25 bp, Mus musculus
gtccttactgtacaattaaaagcct

SEQ ID NO: 688128 - DNA, 25 bp, Mus musculus
gtccttactgtagaattaaaagcct

SEQ ID NO: 688129 - DNA, 25 bp, Mus musculus
gtccttacttctatgacatgtgtca

SEQ ID NO: 688130 - DNA, 25 bp, Mus musculus
gtccttacttctttgacatgtgtca

SEQ ID NO: 688131 - DNA, 25 bp, Mus musculus
gtccttactttgaaacctggctgat

SEQ ID NO: 688132 - DNA, 25 bp, Mus musculus
gtccttactttgtaacctggctgat

SEQ ID NO: 688133 - DNA, 25 bp, Mus musculus
gtccttagacttcctgagatcctga

SEQ ID NO: 688134 - DNA, 25 bp, Mus musculus
gtccttagacttgctgagatcctga

SEQ ID NO: 688135 - DNA, 25 bp, Mus musculus
gtccttagccgtcaccaatgtagca

SEQ ID NO: 688136 - DNA, 25 bp, Mus musculus
gtccttagccgtgaccaatgtagca

SEQ ID NO: 688137 - DNA, 25 bp, Mus musculus
gtccttagccttaacaattcactga

SEQ ID NO: 688138 - DNA, 25 bp, Mus musculus
gtccttagcctttacaattcactga

SEQ ID NO: 688139 - DNA, 25 bp, Mus musculus
gtccttagtaccatggcttgcgtta

SEQ ID NO: 688140 - DNA, 25 bp, Mus musculus
gtccttagtaccttggcttgcgtta

SEQ ID NO: 688141 - DNA, 25 bp, Mus musculus
gtccttagtgtccatcaatggcatt

SEQ ID NO: 688142 - DNA, 25 bp, Mus musculus
gtccttagtgtcgatcaatggcatt

SEQ ID NO: 688143 - DNA, 25 bp, Mus musculus
gtccttataaatcgtgtaccacttt

SEQ ID NO: 688144 - DNA, 25 bp, Mus musculus
gtccttataaatggtgtaccacttt

SEQ ID NO: 688145 - DNA, 25 bp, Mus musculus
gtccttataccgcaactcaaagacc

SEQ ID NO: 688146 - DNA, 25 bp, Mus musculus
gtccttataccggaactcaaagacc

SEQ ID NO: 688147 - DNA, 25 bp, Mus musculus
gtccttatagccattcttttgggtt

SEQ ID NO: 688148 - DNA, 25 bp, Mus musculus
gtccttatagcctttcttttgggtt

SEQ ID NO: 688149 - DNA, 25 bp, Mus musculus
gtccttataggaatcctgagtttgt

SEQ ID NO: 688150 - DNA, 25 bp, Mus musculus
gtccttataggattcctgagtttgt

SEQ ID NO: 688151 - DNA, 25 bp, Mus musculus
gtccttatagtgcagcttcctggca

SEQ ID NO: 688152 - DNA, 25 bp, Mus musculus
gtccttatagtggagcttcctggca

SEQ ID NO: 688153 - DNA, 25 bp, Mus musculus
gtccttatgggaagggaccaccatt

SEQ ID NO: 688154 - DNA, 25 bp, Mus musculus
gtccttatgggatgggaccaccatt

SEQ ID NO: 688155 - DNA, 25 bp, Mus musculus
gtccttatgtcccagtgataacatg

SEQ ID NO: 688156 - DNA, 25 bp, Mus musculus
gtccttatgtccgagtgataacatg

SEQ ID NO: 688157 - DNA, 25 bp, Mus musculus
gtccttattgaccaaccaatccaac

SEQ ID NO: 688158 - DNA, 25 bp, Mus musculus
gtccttattgacgaaccaatccaac

SEQ ID NO: 688159 - DNA, 25 bp, Mus musculus
gtccttattggacggtgtcgcaaca

SEQ ID NO: 688160 - DNA, 25 bp, Mus musculus
gtccttattggagggtgtcgcaaca

SEQ ID NO: 688161 - DNA, 25 bp, Mus musculus
gtccttattgggagacctgtctggc

SEQ ID NO: 688162 - DNA, 25 bp, Mus musculus
gtccttattgggtgacctgtctggc

SEQ ID NO: 688163 - DNA, 25 bp, Mus musculus
gtccttcaaaggatggccactgtga

SEQ ID NO: 688164 - DNA, 25 bp, Mus musculus
gtccttcaaaggttggccactgtga

SEQ ID NO: 688165 - DNA, 25 bp, Mus musculus
gtccttcacagcattgtgggctggg

SEQ ID NO: 688166 - DNA, 25 bp, Mus musculus
gtccttcacagctttgtgggctggg

SEQ ID NO: 688167 - DNA, 25 bp, Mus musculus
gtccttcagaaacccttgtcatatt

SEQ ID NO: 688168 - DNA, 25 bp, Mus musculus
gtccttcagaaagccttgtcatatt

SEQ ID NO: 688169 - DNA, 25 bp, Mus musculus
gtccttcagaggctcacagtctgga

SEQ ID NO: 688170 - DNA, 25 bp, Mus musculus
gtccttcagagggtcacagtctgga

SEQ ID NO: 688171 - DNA, 25 bp, Mus musculus
gtccttcagcttcctggcatggaac

SEQ ID NO: 688172 - DNA, 25 bp, Mus musculus
gtccttcagcttgctggcatggaac

SEQ ID NO: 688173 - DNA, 25 bp, Mus musculus
gtccttcatcttatctctgatttag

SEQ ID NO: 688174 - DNA, 25 bp, Mus musculus
gtccttcatcttttctctgatttag

SEQ ID NO: 688175 - DNA, 25 bp, Mus musculus
gtccttcatgatcagtgcagacatg

SEQ ID NO: 688176 - DNA, 25 bp, Mus musculus
gtccttcatgatgagtgcagacatg

SEQ ID NO: 688177 - DNA, 25 bp, Mus musculus
gtccttcattgcctttttacttatt

SEQ ID NO: 688178 - DNA, 25 bp, Mus musculus
gtccttcattgcgtttttacttatt

SEQ ID NO: 688179 - DNA, 25 bp, Mus musculus
gtccttccaaaactactgctgcttt

SEQ ID NO: 688180 - DNA, 25 bp, Mus musculus
gtccttccaaaagtactgctgcttt

SEQ ID NO: 688181 - DNA, 25 bp, Mus musculus
gtccttccaacacagagactgttag

SEQ ID NO: 688182 - DNA, 25 bp, Mus musculus
gtccttccaacagagagactgttag

SEQ ID NO: 688183 - DNA, 25 bp, Mus musculus
gtccttccaataactaatgccactc

SEQ ID NO: 688184 - DNA, 25 bp, Mus musculus
gtccttccaatatctaatgccactc

SEQ ID NO: 688185 - DNA, 25 bp, Mus musculus
gtccttccagccaggtaggactgga

SEQ ID NO: 688186 - DNA, 25 bp, Mus musculus
gtccttccagcctggtaggactgga

SEQ ID NO: 688187 - DNA, 25 bp, Mus musculus
gtccttccagtaatccattccaggg

SEQ ID NO: 688188 - DNA, 25 bp, Mus musculus
gtccttccagtattccattccaggg

SEQ ID NO: 688189 - DNA, 25 bp, Mus musculus
gtccttcccaacatagtaactgact

SEQ ID NO: 688190 - DNA, 25 bp, Mus musculus
gtccttcccaacttagtaactgact

SEQ ID NO: 688191 - DNA, 25 bp, Mus musculus
gtccttccggaacctcatggagcac

SEQ ID NO: 688192 - DNA, 25 bp, Mus musculus
gtccttccggaagctcatggagcac

SEQ ID NO: 688193 - DNA, 25 bp, Mus musculus
gtccttccggcaagaaaaaacgaag

SEQ ID NO: 688194 - DNA, 25 bp, Mus musculus
gtccttccggcatgaaaaaacgaag

SEQ ID NO: 688195 - DNA, 25 bp, Mus musculus
gtccttccgttacctctttaacaat

SEQ ID NO: 688196 - DNA, 25 bp, Mus musculus
gtccttccgttagctctttaacaat

SEQ ID NO: 688197 - DNA, 25 bp, Mus musculus
gtccttcctatcagcaagtcagtat

SEQ ID NO: 688198 - DNA, 25 bp, Mus musculus
gtccttcctatctgcaagtcagtat

SEQ ID NO: 688199 - DNA, 25 bp, Mus musculus
gtccttcctcagatggaatcaacga

SEQ ID NO: 688200 - DNA, 25 bp, Mus musculus
gtccttcctcagttggaatcaacga

SEQ ID NO: 688201 - DNA, 25 bp, Mus musculus
gtccttcctgaacccatggagcaaa

SEQ ID NO: 688202 - DNA, 25 bp, Mus musculus
gtccttcctgaagccatggagcaaa

SEQ ID NO: 688203 - DNA, 25 bp, Mus musculus
gtccttcctgacaatggcaagctga

SEQ ID NO: 688204 - DNA, 25 bp, Mus musculus
gtccttcctgactatggcaagctga

SEQ ID NO: 688205 - DNA, 25 bp, Mus musculus
gtccttcctgcgaagccctggctgg

SEQ ID NO: 688206 - DNA, 25 bp, Mus musculus
gtccttcctgcgtagccctggctgg

SEQ ID NO: 688207 - DNA, 25 bp, Mus musculus
gtccttcctggcctaatgcagatga

SEQ ID NO: 688208 - DNA, 25 bp, Mus musculus
gtccttcctggcgtaatgcagatga

SEQ ID NO: 688209 - DNA, 25 bp, Mus musculus
gtccttcctgtgctagtactttcag

SEQ ID NO: 688210 - DNA, 25 bp, Mus musculus
gtccttcctgtggtagtactttcag

SEQ ID NO: 688211 - DNA, 25 bp, Mus musculus
gtccttccttttcctgagtcactgc

SEQ ID NO: 688212 - DNA, 25 bp, Mus musculus
gtccttccttttgctgagtcactgc

SEQ ID NO: 688213 - DNA, 25 bp, Mus musculus
gtccttcgaggacatccatcagtac

SEQ ID NO: 688214 - DNA, 25 bp, Mus musculus
gtccttcgaggagatccatcagtac

SEQ ID NO: 688215 - DNA, 25 bp, Mus musculus
gtccttcgctctcacagtgttgaca

SEQ ID NO: 688216 - DNA, 25 bp, Mus musculus
gtccttcgctctgacagtgttgaca

SEQ ID NO: 688217 - DNA, 25 bp, Mus musculus
gtccttcgtcaccaatttctcttag

SEQ ID NO: 688218 - DNA, 25 bp, Mus musculus
gtccttcgtcacgaatttctcttag

SEQ ID NO: 688219 - DNA, 25 bp, Mus musculus
gtccttctaaccacaatgaccttaa

SEQ ID NO: 688220 - DNA, 25 bp, Mus musculus
gtccttctaacctcaatgaccttaa

SEQ ID NO: 688221 - DNA, 25 bp, Mus musculus
gtccttctaagaagaccccagctaa

SEQ ID NO: 688222 - DNA, 25 bp, Mus musculus
gtccttctaagatgaccccagctaa

SEQ ID NO: 688223 - DNA, 25 bp, Mus musculus
gtccttctaccaatatctgatctaa

SEQ ID NO: 688224 - DNA, 25 bp, Mus musculus
gtccttctaccattatctgatctaa

SEQ ID NO: 688225 - DNA, 25 bp, Mus musculus
gtccttctagcacagggccgtttac

SEQ ID NO: 688226 - DNA, 25 bp, Mus musculus
gtccttctagcagagggccgtttac

SEQ ID NO: 688227 - DNA, 25 bp, Mus musculus
gtccttctcaaaattaggtgtgaac

SEQ ID NO: 688228 - DNA, 25 bp, Mus musculus
gtccttctcaaatttaggtgtgaac

SEQ ID NO: 688229 - DNA, 25 bp, Mus musculus
gtccttctcagcacgaatctgttga

SEQ ID NO: 688230 - DNA, 25 bp, Mus musculus
gtccttctcagcatttacgaggtgt

SEQ ID NO: 688231 - DNA, 25 bp, Mus musculus
gtccttctcagctcgaatctgttga

SEQ ID NO: 688232 - DNA, 25 bp, Mus musculus
gtccttctcagcttttacgaggtgt

SEQ ID NO: 688233 - DNA, 25 bp, Mus musculus
gtccttctctgcactctataaaatg

SEQ ID NO: 688234 - DNA, 25 bp, Mus musculus
gtccttctctgctctctataaaatg

SEQ ID NO: 688235 - DNA, 25 bp, Mus musculus
gtccttctcttcatcatgttgcttt

SEQ ID NO: 688236 - DNA, 25 bp, Mus musculus
gtccttctcttcttcatgttgcttt

SEQ ID NO: 688237 - DNA, 25 bp, Mus musculus
gtccttctgaaactacaccatgtgg

SEQ ID NO: 688238 - DNA, 25 bp, Mus musculus
gtccttctgaaagtacaccatgtgg

SEQ ID NO: 688239 - DNA, 25 bp, Mus musculus
gtccttctgccaagtggtcagggaa

SEQ ID NO: 688240 - DNA, 25 bp, Mus musculus
gtccttctgccatgtggtcagggaa

SEQ ID NO: 688241 - DNA, 25 bp, Mus musculus
gtccttctggctaatggaaccctta

SEQ ID NO: 688242 - DNA, 25 bp, Mus musculus
gtccttctggcttatggaaccctta

SEQ ID NO: 688243 - DNA, 25 bp, Mus musculus
gtccttctgtgcagatcctggatat

SEQ ID NO: 688244 - DNA, 25 bp, Mus musculus
gtccttctgtgctgatcctggatat

SEQ ID NO: 688245 - DNA, 25 bp, Mus musculus
gtccttctgtttacccagggtagat

SEQ ID NO: 688246 - DNA, 25 bp, Mus musculus
gtccttctgttttcccagggtagat

SEQ ID NO: 688247 - DNA, 25 bp, Mus musculus
gtccttcttaacatctagctaacaa

SEQ ID NO: 688248 - DNA, 25 bp, Mus musculus
gtccttcttaacttctagctaacaa

SEQ ID NO: 688249 - DNA, 25 bp, Mus musculus
gtccttcttattcttgccttaactg

SEQ ID NO: 688250 - DNA, 25 bp, Mus musculus
gtccttcttattgttgccttaactg

SEQ ID NO: 688251 - DNA, 25 bp, Mus musculus
gtccttcttcacactgtttttgaga

SEQ ID NO: 688252 - DNA, 25 bp, Mus musculus
gtccttcttcactctgtttttgaga

SEQ ID NO: 688253 - DNA, 25 bp, Mus musculus
gtccttgaacttctgatggtctccc

SEQ ID NO: 688254 - DNA, 25 bp, Mus musculus
gtccttgaacttgtgatggtctccc

SEQ ID NO: 688255 - DNA, 25 bp, Mus musculus
gtccttgaagaaatgctcacggagc

SEQ ID NO: 688256 - DNA, 25 bp, Mus musculus
gtccttgaagaattgctcacggagc

SEQ ID NO: 688257 - DNA, 25 bp, Mus musculus
gtccttgaagatatatgcacagtta

SEQ ID NO: 688258 - DNA, 25 bp, Mus musculus
gtccttgaagatttatgcacagtta

SEQ ID NO: 688259 - DNA, 25 bp, Mus musculus
gtccttgaagcgctctgcaaatcag

SEQ ID NO: 688260 - DNA, 25 bp, Mus musculus
gtccttgaagcggtctgcaaatcag

SEQ ID NO: 688261 - DNA, 25 bp, Mus musculus
gtccttgaaggaagtcagcctccca

SEQ ID NO: 688262 - DNA, 25 bp, Mus musculus
gtccttgaaggatgtcagcctccca

SEQ ID NO: 688263 - DNA, 25 bp, Mus musculus
gtccttgaatatctgatcttacctt

SEQ ID NO: 688264 - DNA, 25 bp, Mus musculus
gtccttgaatatgtgatcttacctt

SEQ ID NO: 688265 - DNA, 25 bp, Mus musculus
gtccttgacaaacctcctgttgtaa

SEQ ID NO: 688266 - DNA, 25 bp, Mus musculus
gtccttgacaaagctcctgttgtaa

SEQ ID NO: 688267 - DNA, 25 bp, Mus musculus
gtccttgacctgcactatggcttag

SEQ ID NO: 688268 - DNA, 25 bp, Mus musculus
gtccttgacctggactatggcttag

SEQ ID NO: 688269 - DNA, 25 bp, Mus musculus
gtccttgaccttatggaaatactgt

SEQ ID NO: 688270 - DNA, 25 bp, Mus musculus
gtccttgaccttttggaaatactgt

SEQ ID NO: 688271 - DNA, 25 bp, Mus musculus
gtccttgacgagaccaaccttacag

SEQ ID NO: 688272 - DNA, 25 bp, Mus musculus
gtccttgacgagtccaaccttacag

SEQ ID NO: 688273 - DNA, 25 bp, Mus musculus
gtccttgagacaatgcagtttgagc

SEQ ID NO: 688274 - DNA, 25 bp, Mus musculus
gtccttgagacattgcagtttgagc

SEQ ID NO: 688275 - DNA, 25 bp, Mus musculus
gtccttgagcctagccccaagttcg

SEQ ID NO: 688276 - DNA, 25 bp, Mus musculus
gtccttgagccttgccccaagttcg

SEQ ID NO: 688277 - DNA, 25 bp, Mus musculus
gtccttgaggtgaccttgtggtcta

SEQ ID NO: 688278 - DNA, 25 bp, Mus musculus
gtccttgaggtgtccttgtggtcta

SEQ ID NO: 688279 - DNA, 25 bp, Mus musculus
gtccttgagtatatttgtgcctggc

SEQ ID NO: 688280 - DNA, 25 bp, Mus musculus
gtccttgagtatttttgtgcctggc

SEQ ID NO: 688281 - DNA, 25 bp, Mus musculus
gtccttgatgacactgtggatgtag

SEQ ID NO: 688282 - DNA, 25 bp, Mus musculus
gtccttgatgactctgtggatgtag

SEQ ID NO: 688283 - DNA, 25 bp, Mus musculus
gtccttgatgagcatgtagctactt

SEQ ID NO: 688284 - DNA, 25 bp, Mus musculus
gtccttgatgaggatgtagctactt

SEQ ID NO: 688285 - DNA, 25 bp, Mus musculus
gtccttgatgcaatgtacagctaca

SEQ ID NO: 688286 - DNA, 25 bp, Mus musculus
gtccttgatgcattgtacagctaca

SEQ ID NO: 688287 - DNA, 25 bp, Mus musculus
gtccttgcaacacaaaacgccgacg

SEQ ID NO: 688288 - DNA, 25 bp, Mus musculus
gtccttgcaacagaaaacgccgacg

SEQ ID NO: 688289 - DNA, 25 bp, Mus musculus
gtccttgcaagtagatattcggcat

SEQ ID NO: 688290 - DNA, 25 bp, Mus musculus
gtccttgcaagttgatattcggcat

SEQ ID NO: 688291 - DNA, 25 bp, Mus musculus
gtccttgcacagctagcagaacacg

SEQ ID NO: 688292 - DNA, 25 bp, Mus musculus
gtccttgcacaggtagcagaacacg

SEQ ID NO: 688293 - DNA, 25 bp, Mus musculus
gtccttgcagaacctcatcgtaaga

SEQ ID NO: 688294 - DNA, 25 bp, Mus musculus
gtccttgcagaagctcatcgtaaga

SEQ ID NO: 688295 - DNA, 25 bp, Mus musculus
gtccttgcagaccttccaaaagaca

SEQ ID NO: 688296 - DNA, 25 bp, Mus musculus
gtccttgcagacgttccaaaagaca

SEQ ID NO: 688297 - DNA, 25 bp, Mus musculus
gtccttgcatttacatcttggtcct

SEQ ID NO: 688298 - DNA, 25 bp, Mus musculus
gtccttgcattttcatcttggtcct

SEQ ID NO: 688299 - DNA, 25 bp, Mus musculus
gtccttgccaagattgtgtgactac

SEQ ID NO: 688300 - DNA, 25 bp, Mus musculus
gtccttgccaagtttgtgtgactac

SEQ ID NO: 688301 - DNA, 25 bp, Mus musculus
gtccttgcccaaagagatcgcgtat

SEQ ID NO: 688302 - DNA, 25 bp, Mus musculus
gtccttgcccaatgagatcgcgtat

SEQ ID NO: 688303 - DNA, 25 bp, Mus musculus
gtccttgccgtgatagagccatgta

SEQ ID NO: 688304 - DNA, 25 bp, Mus musculus
gtccttgccgtgttagagccatgta

SEQ ID NO: 688305 - DNA, 25 bp, Mus musculus
gtccttgcctatactgctcaattgg

SEQ ID NO: 688306 - DNA, 25 bp, Mus musculus
gtccttgcctattctgctcaattgg

SEQ ID NO: 688307 - DNA, 25 bp, Mus musculus
gtccttgcctgcatttagacttgga

SEQ ID NO: 688308 - DNA, 25 bp, Mus musculus
gtccttgcctgcttttagacttgga

SEQ ID NO: 688309 - DNA, 25 bp, Mus musculus
gtccttgctaacagcctatatttac

SEQ ID NO: 688310 - DNA, 25 bp, Mus musculus
gtccttgctaactgcctatatttac

SEQ ID NO: 688311 - DNA, 25 bp, Mus musculus
gtccttgctcttctaccccaagtga

SEQ ID NO: 688312 - DNA, 25 bp, Mus musculus
gtccttgctcttgtaccccaagtga

SEQ ID NO: 688313 - DNA, 25 bp, Mus musculus
gtccttgctgctcgcacagttcaca

SEQ ID NO: 688314 - DNA, 25 bp, Mus musculus
gtccttgctgctggcacagttcaca

SEQ ID NO: 688315 - DNA, 25 bp, Mus musculus
gtccttgctggcaggatggtctctg

SEQ ID NO: 688316 - DNA, 25 bp, Mus musculus
gtccttgctggctggatggtctctg

SEQ ID NO: 688317 - DNA, 25 bp, Mus musculus
gtccttgcttatacacttcagttct

SEQ ID NO: 688318 - DNA, 25 bp, Mus musculus
gtccttgcttattcacttcagttct

SEQ ID NO: 688319 - DNA, 25 bp, Mus musculus
gtccttggaacgcacagcatcacag

SEQ ID NO: 688320 - DNA, 25 bp, Mus musculus
gtccttggaacggacagcatcacag

SEQ ID NO: 688321 - DNA, 25 bp, Mus musculus
gtccttggacttacatgttctgtaa

SEQ ID NO: 688322 - DNA, 25 bp, Mus musculus
gtccttggacttctcatcgtttttg

SEQ ID NO: 688323 - DNA, 25 bp, Mus musculus
gtccttggacttgtcatcgtttttg

SEQ ID NO: 688324 - DNA, 25 bp, Mus musculus
gtccttggactttcatgttctgtaa

SEQ ID NO: 688325 - DNA, 25 bp, Mus musculus
gtccttggagaaagctgacaacctg

SEQ ID NO: 688326 - DNA, 25 bp, Mus musculus
gtccttggagaatgctgacaacctg

SEQ ID NO: 688327 - DNA, 25 bp, Mus musculus
gtccttggagatccgtgacccatgt

SEQ ID NO: 688328 - DNA, 25 bp, Mus musculus
gtccttggagatgcgtgacccatgt

SEQ ID NO: 688329 - DNA, 25 bp, Mus musculus
gtccttggagctccaatagtcactg

SEQ ID NO: 688330 - DNA, 25 bp, Mus musculus
gtccttggagctgcaatagtcactg

SEQ ID NO: 688331 - DNA, 25 bp, Mus musculus
gtccttggaggaccatctggttaga

SEQ ID NO: 688332 - DNA, 25 bp, Mus musculus
gtccttggaggagcatctggttaga

SEQ ID NO: 688333 - DNA, 25 bp, Mus musculus
gtccttggaggcagctagtctcttc

SEQ ID NO: 688334 - DNA, 25 bp, Mus musculus
gtccttggaggctgctagtctcttc

SEQ ID NO: 688335 - DNA, 25 bp, Mus musculus
gtccttggatttcagtttcccacaa

SEQ ID NO: 688336 - DNA, 25 bp, Mus musculus
gtccttggatttgagtttcccacaa

SEQ ID NO: 688337 - DNA, 25 bp, Mus musculus
gtccttgggagtatcccgtatgtga

SEQ ID NO: 688338 - DNA, 25 bp, Mus musculus
gtccttgggagtttcccgtatgtga

SEQ ID NO: 688339 - DNA, 25 bp, Mus musculus
gtccttgggcaacggccttacagtt

SEQ ID NO: 688340 - DNA, 25 bp, Mus musculus
gtccttgggcaagggccttacagtt

SEQ ID NO: 688341 - DNA, 25 bp, Mus musculus
gtccttgggccaacagagacaccta

SEQ ID NO: 688342 - DNA, 25 bp, Mus musculus
gtccttgggccatcagagacaccta

SEQ ID NO: 688343 - DNA, 25 bp, Mus musculus
gtccttggtagcaaatgtacacaga

SEQ ID NO: 688344 - DNA, 25 bp, Mus musculus
gtccttggtagctaatgtacacaga

SEQ ID NO: 688345 - DNA, 25 bp, Mus musculus
gtccttggtgacagccattgacctg

SEQ ID NO: 688346 - DNA, 25 bp, Mus musculus
gtccttggtgactgccattgacctg

SEQ ID NO: 688347 - DNA, 25 bp, Mus musculus
gtccttggttgaaaggttagaccct

SEQ ID NO: 688348 - DNA, 25 bp, Mus musculus
gtccttggttgataggttagaccct

SEQ ID NO: 688349 - DNA, 25 bp, Mus musculus
gtccttggttttaccttagctcata

SEQ ID NO: 688350 - DNA, 25 bp, Mus musculus
gtccttggtttttccttagctcata

SEQ ID NO: 688351 - DNA, 25 bp, Mus musculus
gtccttgtaaatattgttacgagca

SEQ ID NO: 688352 - DNA, 25 bp, Mus musculus
gtccttgtaaattttgttacgagca

SEQ ID NO: 688353 - DNA, 25 bp, Mus musculus
gtccttgtaacacaatgaatgcccc

SEQ ID NO: 688354 - DNA, 25 bp, Mus musculus
gtccttgtaacagaatgaatgcccc

SEQ ID NO: 688355 - DNA, 25 bp, Mus musculus
gtccttgtaagtatgtcagtgagag

SEQ ID NO: 688356 - DNA, 25 bp, Mus musculus
gtccttgtaagtttgtcagtgagag

SEQ ID NO: 688357 - DNA, 25 bp, Mus musculus
gtccttgtatctagaagaccctgcc

SEQ ID NO: 688358 - DNA, 25 bp, Mus musculus
gtccttgtatcttgaagaccctgcc

SEQ ID NO: 688359 - DNA, 25 bp, Mus musculus
gtccttgtcagcaattgctaatggg

SEQ ID NO: 688360 - DNA, 25 bp, Mus musculus
gtccttgtcagctattgctaatggg

SEQ ID NO: 688361 - DNA, 25 bp, Mus musculus
gtccttgtccatagacatcacatag

SEQ ID NO: 688362 - DNA, 25 bp, Mus musculus
gtccttgtccattgacatcacatag

SEQ ID NO: 688363 - DNA, 25 bp, Mus musculus
gtccttgtctatcaaaacgtcgtcc

SEQ ID NO: 688364 - DNA, 25 bp, Mus musculus
gtccttgtctatgaaaacgtcgtcc

SEQ ID NO: 688365 - DNA, 25 bp, Mus musculus
gtccttgtctggcatgagtctttag

SEQ ID NO: 688366 - DNA, 25 bp, Mus musculus
gtccttgtctgggatgagtctttag

SEQ ID NO: 688367 - DNA, 25 bp, Mus musculus
gtccttgtctgtcgtgcccaggcag

SEQ ID NO: 688368 - DNA, 25 bp, Mus musculus
gtccttgtctgtcgtttcagtttgt

SEQ ID NO: 688369 - DNA, 25 bp, Mus musculus
gtccttgtctgtggtgcccaggcag

SEQ ID NO: 688370 - DNA, 25 bp, Mus musculus
gtccttgtctgtggtttcagtttgt

SEQ ID NO: 688371 - DNA, 25 bp, Mus musculus
gtccttgtcttccatggtctgagaa

SEQ ID NO: 688372 - DNA, 25 bp, Mus musculus
gtccttgtcttcgatggtctgagaa

SEQ ID NO: 688373 - DNA, 25 bp, Mus musculus
gtccttgtgatcagcttggttgtaa

SEQ ID NO: 688374 - DNA, 25 bp, Mus musculus
gtccttgtgatctgcttggttgtaa

SEQ ID NO: 688375 - DNA, 25 bp, Mus musculus
gtccttgtgcaactgtgcgcataca

SEQ ID NO: 688376 - DNA, 25 bp, Mus musculus
gtccttgtgcaagtgtgcgcataca

SEQ ID NO: 688377 - DNA, 25 bp, Mus musculus
gtccttgtgcctctctgaagctaga

SEQ ID NO: 688378 - DNA, 25 bp, Mus musculus
gtccttgtgcctgtctgaagctaga

SEQ ID NO: 688379 - DNA, 25 bp, Mus musculus
gtccttgtgtacacagagtgcattt

SEQ ID NO: 688380 - DNA, 25 bp, Mus musculus
gtccttgtgtactcagagtgcattt

SEQ ID NO: 688381 - DNA, 25 bp, Mus musculus
gtccttgtgtctagtgctctgtaac

SEQ ID NO: 688382 - DNA, 25 bp, Mus musculus
gtccttgtgtcttgtgctctgtaac

SEQ ID NO: 688383 - DNA, 25 bp, Mus musculus
gtccttgtgtgtcacatcagcaaca

SEQ ID NO: 688384 - DNA, 25 bp, Mus musculus
gtccttgtgtgtgacatcagcaaca

SEQ ID NO: 688385 - DNA, 25 bp, Mus musculus
gtccttgtttacattgccattttag

SEQ ID NO: 688386 - DNA, 25 bp, Mus musculus
gtccttgtttactttgccattttag

SEQ ID NO: 688387 - DNA, 25 bp, Mus musculus
gtcctttaaaagagttctctctcat

SEQ ID NO: 688388 - DNA, 25 bp, Mus musculus
gtcctttaaaagtgttctctctcat

SEQ ID NO: 688389 - DNA, 25 bp, Mus musculus
gtcctttaaggcaagtgagatttat

SEQ ID NO: 688390 - DNA, 25 bp, Mus musculus
gtcctttaaggctagtgagatttat

SEQ ID NO: 688391 - DNA, 25 bp, Mus musculus
gtcctttacagtatggttcagctaa

SEQ ID NO: 688392 - DNA, 25 bp, Mus musculus
gtcctttacagtttggttcagctaa

SEQ ID NO: 688393 - DNA, 25 bp, Mus musculus
gtcctttacgagaccttacagcagt

SEQ ID NO: 688394 - DNA, 25 bp, Mus musculus
gtcctttacgagtccttacagcagt

SEQ ID NO: 688395 - DNA, 25 bp, Mus musculus
gtcctttagtatattgtctcttcaa

SEQ ID NO: 688396 - DNA, 25 bp, Mus musculus
gtcctttagtattttgtctcttcaa

SEQ ID NO: 688397 - DNA, 25 bp, Mus musculus
gtcctttatgtaatcttctctaccg

SEQ ID NO: 688398 - DNA, 25 bp, Mus musculus
gtcctttatgtattcttctctaccg

SEQ ID NO: 688399 - DNA, 25 bp, Mus musculus
gtcctttcacgcatgaaccttatta

SEQ ID NO: 688400 - DNA, 25 bp, Mus musculus
gtcctttcacgcttgaaccttatta

SEQ ID NO: 688401 - DNA, 25 bp, Mus musculus
gtcctttcagctactttaatgttca

SEQ ID NO: 688402 - DNA, 25 bp, Mus musculus
gtcctttcagcttctttaatgttca

SEQ ID NO: 688403 - DNA, 25 bp, Mus musculus
gtcctttcatttacaggcatcactg

SEQ ID NO: 688404 - DNA, 25 bp, Mus musculus
gtcctttcattttcaggcatcactg

SEQ ID NO: 688405 - DNA, 25 bp, Mus musculus
gtcctttcccacagatcattgggta

SEQ ID NO: 688406 - DNA, 25 bp, Mus musculus
gtcctttcccactgatcattgggta

SEQ ID NO: 688407 - DNA, 25 bp, Mus musculus
gtcctttcctgacaagttgaggagt

SEQ ID NO: 688408 - DNA, 25 bp, Mus musculus
gtcctttcctgaccccataagaaac

SEQ ID NO: 688409 - DNA, 25 bp, Mus musculus
gtcctttcctgacccgattctgtga

SEQ ID NO: 688410 - DNA, 25 bp, Mus musculus
gtcctttcctgagaagttgaggagt

SEQ ID NO: 688411 - DNA, 25 bp, Mus musculus
gtcctttcctgagcccataagaaac

SEQ ID NO: 688412 - DNA, 25 bp, Mus musculus
gtcctttcctgagccgattctgtga

SEQ ID NO: 688413 - DNA, 25 bp, Mus musculus
gtcctttctgctcggtgctactgat

SEQ ID NO: 688414 - DNA, 25 bp, Mus musculus
gtcctttctgctgggtgctactgat

SEQ ID NO: 688415 - DNA, 25 bp, Mus musculus
gtcctttcttgtagctggaacccta

SEQ ID NO: 688416 - DNA, 25 bp, Mus musculus
gtcctttcttgttgctggaacccta

SEQ ID NO: 688417 - DNA, 25 bp, Mus musculus
gtcctttctttgctgcaggtatctt

SEQ ID NO: 688418 - DNA, 25 bp, Mus musculus
gtcctttctttggtgcaggtatctt

SEQ ID NO: 688419 - DNA, 25 bp, Mus musculus
gtcctttgaaaacccatttcggatg

SEQ ID NO: 688420 - DNA, 25 bp, Mus musculus
gtcctttgaaaagccatttcggatg

SEQ ID NO: 688421 - DNA, 25 bp, Mus musculus
gtcctttgaagactaccactcaggt

SEQ ID NO: 688422 - DNA, 25 bp, Mus musculus
gtcctttgaagagtaccactcaggt

SEQ ID NO: 688423 - DNA, 25 bp, Mus musculus
gtcctttgaaggagacccagcccag

SEQ ID NO: 688424 - DNA, 25 bp, Mus musculus
gtcctttgaaggtgacccagcccag

SEQ ID NO: 688425 - DNA, 25 bp, Mus musculus
gtcctttgacatctgcctttaagac

SEQ ID NO: 688426 - DNA, 25 bp, Mus musculus
gtcctttgacatgtgcctttaagac

SEQ ID NO: 688427 - DNA, 25 bp, Mus musculus
gtcctttgaggaccacatcaagtca

SEQ ID NO: 688428 - DNA, 25 bp, Mus musculus
gtcctttgaggagcacatcaagtca

SEQ ID NO: 688429 - DNA, 25 bp, Mus musculus
gtcctttgccagcagctctttggga

SEQ ID NO: 688430 - DNA, 25 bp, Mus musculus
gtcctttgccaggagctctttggga

SEQ ID NO: 688431 - DNA, 25 bp, Mus musculus
gtcctttgccgcagtacaacaagca

SEQ ID NO: 688432 - DNA, 25 bp, Mus musculus
gtcctttgccgctgtacaacaagca

SEQ ID NO: 688433 - DNA, 25 bp, Mus musculus
gtcctttgctagatgcggcttgtaa

SEQ ID NO: 688434 - DNA, 25 bp, Mus musculus
gtcctttgctagttgcggcttgtaa

SEQ ID NO: 688435 - DNA, 25 bp, Mus musculus
gtcctttggctacttctttgaattc

SEQ ID NO: 688436 - DNA, 25 bp, Mus musculus
gtcctttggctagttctttgaattc

SEQ ID NO: 688437 - DNA, 25 bp, Mus musculus
gtcctttggtgccatcttcatataa

SEQ ID NO: 688438 - DNA, 25 bp, Mus musculus
gtcctttggtgcgatcttcatataa

SEQ ID NO: 688439 - DNA, 25 bp, Mus musculus
gtcctttgtaggaactgcacacttg

SEQ ID NO: 688440 - DNA, 25 bp, Mus musculus
gtcctttgtaggtactgcacacttg

SEQ ID NO: 688441 - DNA, 25 bp, Mus musculus
gtcctttgtgctaaaggcacgtgct

SEQ ID NO: 688442 - DNA, 25 bp, Mus musculus
gtcctttgtgcttaaggcacgtgct

SEQ ID NO: 688443 - DNA, 25 bp, Mus musculus
gtcctttgtggacagcttacttccc

SEQ ID NO: 688444 - DNA, 25 bp, Mus musculus
gtcctttgtggagagcttacttccc

SEQ ID NO: 688445 - DNA, 25 bp, Mus musculus
gtcctttgtggtatcttcagatttt

SEQ ID NO: 688446 - DNA, 25 bp, Mus musculus
gtcctttgtggtttcttcagatttt

SEQ ID NO: 688447 - DNA, 25 bp, Mus musculus
gtcctttgttaacttggaaattgct

SEQ ID NO: 688448 - DNA, 25 bp, Mus musculus
gtcctttgttaagttggaaattgct

SEQ ID NO: 688449 - DNA, 25 bp, Mus musculus
gtcctttgttttaaggaggctgttg

SEQ ID NO: 688450 - DNA, 25 bp, Mus musculus
gtcctttgtttttaggaggctgttg

SEQ ID NO: 688451 - DNA, 25 bp, Mus musculus
gtccttttaatgctcttattgcttt

SEQ ID NO: 688452 - DNA, 25 bp, Mus musculus
gtccttttaatggtcttattgcttt

SEQ ID NO: 688453 - DNA, 25 bp, Mus musculus
gtccttttacgaacggtcactacag

SEQ ID NO: 688454 - DNA, 25 bp, Mus musculus
gtccttttacgatcggtcactacag

SEQ ID NO: 688455 - DNA, 25 bp, Mus musculus
gtccttttacttagagagccatcat

SEQ ID NO: 688456 - DNA, 25 bp, Mus musculus
gtccttttactttgagagccatcat

SEQ ID NO: 688457 - DNA, 25 bp, Mus musculus
gtccttttatataggctgccaccag

SEQ ID NO: 688458 - DNA, 25 bp, Mus musculus
gtccttttatattggctgccaccag

SEQ ID NO: 688459 - DNA, 25 bp, Mus musculus
gtccttttatttaggagccttctct

SEQ ID NO: 688460 - DNA, 25 bp, Mus musculus
gtccttttattttggagccttctct

SEQ ID NO: 688461 - DNA, 25 bp, Mus musculus
gtccttttcattcaatcatggtaaa

SEQ ID NO: 688462 - DNA, 25 bp, Mus musculus
gtccttttcattgaatcatggtaaa

SEQ ID NO: 688463 - DNA, 25 bp, Mus musculus
gtccttttcttactgtatggccttg

SEQ ID NO: 688464 - DNA, 25 bp, Mus musculus
gtccttttcttagtgtatggccttg

SEQ ID NO: 688465 - DNA, 25 bp, Mus musculus
gtccttttgaagatacagtaacgtg

SEQ ID NO: 688466 - DNA, 25 bp, Mus musculus
gtccttttgaagttacagtaacgtg

SEQ ID NO: 688467 - DNA, 25 bp, Mus musculus
gtccttttgcctaagtccatgcata

SEQ ID NO: 688468 - DNA, 25 bp, Mus musculus
gtccttttgccttagtccatgcata

SEQ ID NO: 688469 - DNA, 25 bp, Mus musculus
gtccttttgtataatccatcctcag

SEQ ID NO: 688470 - DNA, 25 bp, Mus musculus
gtccttttgtattatccatcctcag

SEQ ID NO: 688471 - DNA, 25 bp, Mus musculus
gtccttttgttcctgagtcatctga

SEQ ID NO: 688472 - DNA, 25 bp, Mus musculus
gtccttttgttccttagagaaatct

SEQ ID NO: 688473 - DNA, 25 bp, Mus musculus
gtccttttgttcgtgagtcatctga

SEQ ID NO: 688474 - DNA, 25 bp, Mus musculus
gtccttttgttcgttagagaaatct

SEQ ID NO: 688475 - DNA, 25 bp, Mus musculus
gtcctttttgtactatgattcaccc

SEQ ID NO: 688476 - DNA, 25 bp, Mus musculus
gtcctttttgtagtatgattcaccc

SEQ ID NO: 688477 - DNA, 25 bp, Mus musculus
gtccttttttcaaccagcaggctag

SEQ ID NO: 688478 - DNA, 25 bp, Mus musculus
gtccttttttcatccagcaggctag

SEQ ID NO: 688479 - DNA, 25 bp, Mus musculus
gtcgaaagactaaagcaggcgctca

SEQ ID NO: 688480 - DNA, 25 bp, Mus musculus
gtcgaaagactatagcaggcgctca

SEQ ID NO: 688481 - DNA, 25 bp, Mus musculus
gtcgaaagcatgactgaagctcagt

SEQ ID NO: 688482 - DNA, 25 bp, Mus musculus
gtcgaaagcatgtctgaagctcagt

SEQ ID NO: 688483 - DNA, 25 bp, Mus musculus
gtcgaaagccgccagtgtcatcaac

SEQ ID NO: 688484 - DNA, 25 bp, Mus musculus
gtcgaaagccgcgagtgtcatcaac

SEQ ID NO: 688485 - DNA, 25 bp, Mus musculus
gtcgaaaggactattctttgaccat

SEQ ID NO: 688486 - DNA, 25 bp, Mus musculus
gtcgaaaggacttttctttgaccat

SEQ ID NO: 688487 - DNA, 25 bp, Mus musculus
gtcgaaatgagtctaagaatcatct

SEQ ID NO: 688488 - DNA, 25 bp, Mus musculus
gtcgaaatgagtgtaagaatcatct

SEQ ID NO: 688489 - DNA, 25 bp, Mus musculus
gtcgaaattgagcacttaccttcct

SEQ ID NO: 688490 - DNA, 25 bp, Mus musculus
gtcgaaattgaggacttaccttcct

SEQ ID NO: 688491 - DNA, 25 bp, Mus musculus
gtcgaacaccttcagacaggactgt

SEQ ID NO: 688492 - DNA, 25 bp, Mus musculus
gtcgaacaccttgagacaggactgt

SEQ ID NO: 688493 - DNA, 25 bp, Mus musculus
gtcgaaccaaggagtagtagtccct

SEQ ID NO: 688494 - DNA, 25 bp, Mus musculus
gtcgaaccaaggctgttggcaccat

SEQ ID NO: 688495 - DNA, 25 bp, Mus musculus
gtcgaaccaagggtgttggcaccat

SEQ ID NO: 688496 - DNA, 25 bp, Mus musculus
gtcgaaccaaggtgtagtagtccct

SEQ ID NO: 688497 - DNA, 25 bp, Mus musculus
gtcgaactacctccaaaggaaagag

SEQ ID NO: 688498 - DNA, 25 bp, Mus musculus
gtcgaactacctgcaaaggaaagag

SEQ ID NO: 688499 - DNA, 25 bp, Mus musculus
gtcgaagacactcagctgctgatgc

SEQ ID NO: 688500 - DNA, 25 bp, Mus musculus
gtcgaagacactgagctgctgatgc

SEQ ID NO: 688501 - DNA, 25 bp, Mus musculus
gtcgaagattggaaagacttgcttt

SEQ ID NO: 688502 - DNA, 25 bp, Mus musculus
gtcgaagattggtaagacttgcttt

SEQ ID NO: 688503 - DNA, 25 bp, Mus musculus
gtcgaagctcagaagggaacggctc

SEQ ID NO: 688504 - DNA, 25 bp, Mus musculus
gtcgaagctcagtagggaacggctc

SEQ ID NO: 688505 - DNA, 25 bp, Mus musculus
gtcgaaggtgcaagaactccaacaa

SEQ ID NO: 688506 - DNA, 25 bp, Mus musculus
gtcgaaggtgcatgaactccaacaa

SEQ ID NO: 688507 - DNA, 25 bp, Mus musculus
gtcgaatagctcaggtaccatctgc

SEQ ID NO: 688508 - DNA, 25 bp, Mus musculus
gtcgaatagctctggtaccatctgc

SEQ ID NO: 688509 - DNA, 25 bp, Mus musculus
gtcgaatcactaacagatgccgtgc

SEQ ID NO: 688510 - DNA, 25 bp, Mus musculus
gtcgaatcactatcagatgccgtgc

SEQ ID NO: 688511 - DNA, 25 bp, Mus musculus
gtcgaatgatagcaaagtactctgt

SEQ ID NO: 688512 - DNA, 25 bp, Mus musculus
gtcgaatgataggaaagtactctgt

SEQ ID NO: 688513 - DNA, 25 bp, Mus musculus
gtcgaattccccagtggctaagtca

SEQ ID NO: 688514 - DNA, 25 bp, Mus musculus
gtcgaattcccctgtggctaagtca

SEQ ID NO: 688515 - DNA, 25 bp, Mus musculus
gtcgaatttcgacctgtggtacaca

SEQ ID NO: 688516 - DNA, 25 bp, Mus musculus
gtcgaatttcgagctgtggtacaca

SEQ ID NO: 688517 - DNA, 25 bp, Mus musculus
gtcgacaacgtcatggattcaatcc

SEQ ID NO: 688518 - DNA, 25 bp, Mus musculus
gtcgacaacgtcttggattcaatcc

SEQ ID NO: 688519 - DNA, 25 bp, Mus musculus
gtcgacagcaatacgtgcaccgtaa

SEQ ID NO: 688520 - DNA, 25 bp, Mus musculus
gtcgacagcaattcgtgcaccgtaa

SEQ ID NO: 688521 - DNA, 25 bp, Mus musculus
gtcgacagctgacggatgaccccac

SEQ ID NO: 688522 - DNA, 25 bp, Mus musculus
gtcgacagctgagggatgaccccac

SEQ ID NO: 688523 - DNA, 25 bp, Mus musculus
gtcgacagtgacctcacacttgttt

SEQ ID NO: 688524 - DNA, 25 bp, Mus musculus
gtcgacagtgacgtcacacttgttt

SEQ ID NO: 688525 - DNA, 25 bp, Mus musculus
gtcgacatttagatgggcttctgta

SEQ ID NO: 688526 - DNA, 25 bp, Mus musculus
gtcgacatttagttgggcttctgta

SEQ ID NO: 688527 - DNA, 25 bp, Mus musculus
gtcgaccagccgcaagctaaagact

SEQ ID NO: 688528 - DNA, 25 bp, Mus musculus
gtcgaccagccggaagctaaagact

SEQ ID NO: 688529 - DNA, 25 bp, Mus musculus
gtcgacctgcagcatgggcctaaat

SEQ ID NO: 688530 - DNA, 25 bp, Mus musculus
gtcgacctgcaggatgggcctaaat

SEQ ID NO: 688531 - DNA, 25 bp, Mus musculus
gtcgacctttgcatacaggaagtaa

SEQ ID NO: 688532 - DNA, 25 bp, Mus musculus
gtcgacctttgcttacaggaagtaa

SEQ ID NO: 688533 - DNA, 25 bp, Mus musculus
gtcgacgaggcccaagacctggaaa

SEQ ID NO: 688534 - DNA, 25 bp, Mus musculus
gtcgacgaggccgaagacctggaaa

SEQ ID NO: 688535 - DNA, 25 bp, Mus musculus
gtcgactatagaagctatctccctt

SEQ ID NO: 688536 - DNA, 25 bp, Mus musculus
gtcgactatagatgctatctccctt

SEQ ID NO: 688537 - DNA, 25 bp, Mus musculus
gtcgactctgctacaaacaactcaa

SEQ ID NO: 688538 - DNA, 25 bp, Mus musculus
gtcgactctgcttcaaacaactcaa

SEQ ID NO: 688539 - DNA, 25 bp, Mus musculus
gtcgactgaaaaatcctaggctctt

SEQ ID NO: 688540 - DNA, 25 bp, Mus musculus
gtcgactgaaaattcctaggctctt

SEQ ID NO: 688541 - DNA, 25 bp, Mus musculus
gtcgactggccaacatatcagagtt

SEQ ID NO: 688542 - DNA, 25 bp, Mus musculus
gtcgactggccatcatatcagagtt

SEQ ID NO: 688543 - DNA, 25 bp, Mus musculus
gtcgactgtggactacctggagaaa

SEQ ID NO: 688544 - DNA, 25 bp, Mus musculus
gtcgactgtggagtacctggagaaa

SEQ ID NO: 688545 - DNA, 25 bp, Mus musculus
gtcgactgttttctttagtaggcta

SEQ ID NO: 688546 - DNA, 25 bp, Mus musculus
gtcgactgttttgtttagtaggcta

SEQ ID NO: 688547 - DNA, 25 bp, Mus musculus
gtcgagaaatggcaactggattaaa

SEQ ID NO: 688548 - DNA, 25 bp, Mus musculus
gtcgagaaatgggaactggattaaa

SEQ ID NO: 688549 - DNA, 25 bp, Mus musculus
gtcgagaaccagagagctaagtgat

SEQ ID NO: 688550 - DNA, 25 bp, Mus musculus
gtcgagaaccagtgagctaagtgat

SEQ ID NO: 688551 - DNA, 25 bp, Mus musculus
gtcgagacacctattttgattctaa

SEQ ID NO: 688552 - DNA, 25 bp, Mus musculus
gtcgagacaccttttttgattctaa

SEQ ID NO: 688553 - DNA, 25 bp, Mus musculus
gtcgagactatacctgtttggtaca

SEQ ID NO: 688554 - DNA, 25 bp, Mus musculus
gtcgagactatagctgtttggtaca

SEQ ID NO: 688555 - DNA, 25 bp, Mus musculus
gtcgagagacttactcagacatatc

SEQ ID NO: 688556 - DNA, 25 bp, Mus musculus
gtcgagagactttctcagacatatc

SEQ ID NO: 688557 - DNA, 25 bp, Mus musculus
gtcgagagcagactcttgacccacc

SEQ ID NO: 688558 - DNA, 25 bp, Mus musculus
gtcgagagcagagtcttgacccacc

SEQ ID NO: 688559 - DNA, 25 bp, Mus musculus
gtcgagaggccgactttggctcaga

SEQ ID NO: 688560 - DNA, 25 bp, Mus musculus
gtcgagaggccgagagtatctgtca

SEQ ID NO: 688561 - DNA, 25 bp, Mus musculus
gtcgagaggccgtctttggctcaga

SEQ ID NO: 688562 - DNA, 25 bp, Mus musculus
gtcgagaggccgtgagtatctgtca

SEQ ID NO: 688563 - DNA, 25 bp, Mus musculus
gtcgagatatttaacttttgccaaa

SEQ ID NO: 688564 - DNA, 25 bp, Mus musculus
gtcgagatattttacttttgccaaa

SEQ ID NO: 688565 - DNA, 25 bp, Mus musculus
gtcgagcaaaatcgtggtcttttca

SEQ ID NO: 688566 - DNA, 25 bp, Mus musculus
gtcgagcaaaatggtggtcttttca

SEQ ID NO: 688567 - DNA, 25 bp, Mus musculus
gtcgagcaacatacactgcagtatt

SEQ ID NO: 688568 - DNA, 25 bp, Mus musculus
gtcgagcaacattcactgcagtatt

SEQ ID NO: 688569 - DNA, 25 bp, Mus musculus
gtcgagcccaccaggcagaaggcaa

SEQ ID NO: 688570 - DNA, 25 bp, Mus musculus
gtcgagcccacctggcagaaggcaa

SEQ ID NO: 688571 - DNA, 25 bp, Mus musculus
gtcgagcccagtcttaccaccaaga

SEQ ID NO: 688572 - DNA, 25 bp, Mus musculus
gtcgagcccagtgttaccaccaaga

SEQ ID NO: 688573 - DNA, 25 bp, Mus musculus
gtcgagcgcttgagcataagggccc

SEQ ID NO: 688574 - DNA, 25 bp, Mus musculus
gtcgagcgcttgtgcataagggccc

SEQ ID NO: 688575 - DNA, 25 bp, Mus musculus
gtcgaggaaaccaattgtatacaat

SEQ ID NO: 688576 - DNA, 25 bp, Mus musculus
gtcgaggaaacctattgtatacaat

SEQ ID NO: 688577 - DNA, 25 bp, Mus musculus
gtcgaggaccatatggaggaatccc

SEQ ID NO: 688578 - DNA, 25 bp, Mus musculus
gtcgaggaccatttggaggaatccc

SEQ ID NO: 688579 - DNA, 25 bp, Mus musculus
gtcgaggatcctatggcatgcaagt

SEQ ID NO: 688580 - DNA, 25 bp, Mus musculus
gtcgaggatcctttggcatgcaagt

SEQ ID NO: 688581 - DNA, 25 bp, Mus musculus
gtcgaggcattaattctactcttct

SEQ ID NO: 688582 - DNA, 25 bp, Mus musculus
gtcgaggcattatttctactcttct

SEQ ID NO: 688583 - DNA, 25 bp, Mus musculus
gtcgaggcgatgaccgtccagacca

SEQ ID NO: 688584 - DNA, 25 bp, Mus musculus
gtcgaggcgatgtccgtccagacca

SEQ ID NO: 688585 - DNA, 25 bp, Mus musculus
gtcgagtagtcaccggctgttctaa

SEQ ID NO: 688586 - DNA, 25 bp, Mus musculus
gtcgagtagtcagcggctgttctaa

SEQ ID NO: 688587 - DNA, 25 bp, Mus musculus
gtcgagtggaacctgcatctgagca

SEQ ID NO: 688588 - DNA, 25 bp, Mus musculus
gtcgagtggaacgtgcatctgagca

SEQ ID NO: 688589 - DNA, 25 bp, Mus musculus
gtcgagtggacacttggcgaaattt

SEQ ID NO: 688590 - DNA, 25 bp, Mus musculus
gtcgagtggacagttggcgaaattt

SEQ ID NO: 688591 - DNA, 25 bp, Mus musculus
gtcgagtggctcacagtgcttggaa

SEQ ID NO: 688592 - DNA, 25 bp, Mus musculus
gtcgagtggctctcagtgcttggaa

SEQ ID NO: 688593 - DNA, 25 bp, Mus musculus
gtcgagtttgtcctcttaaagctgt

SEQ ID NO: 688594 - DNA, 25 bp, Mus musculus
gtcgagtttgtcgtcttaaagctgt

SEQ ID NO: 688595 - DNA, 25 bp, Mus musculus
gtcgataatgaaaaaccactagctt

SEQ ID NO: 688596 - DNA, 25 bp, Mus musculus
gtcgataatgaataaccactagctt

SEQ ID NO: 688597 - DNA, 25 bp, Mus musculus
gtcgatacagacaactaataagctt

SEQ ID NO: 688598 - DNA, 25 bp, Mus musculus
gtcgatacagactactaataagctt

SEQ ID NO: 688599 - DNA, 25 bp, Mus musculus
gtcgatacataccttcaattcccac

SEQ ID NO: 688600 - DNA, 25 bp, Mus musculus
gtcgatacatacgttcaattcccac

SEQ ID NO: 688601 - DNA, 25 bp, Mus musculus
gtcgataccaaacctccaatggcac

SEQ ID NO: 688602 - DNA, 25 bp, Mus musculus
gtcgataccaaagctccaatggcac

SEQ ID NO: 688603 - DNA, 25 bp, Mus musculus
gtcgatatttctaatacttcattat

SEQ ID NO: 688604 - DNA, 25 bp, Mus musculus
gtcgatatttcttatacttcattat

SEQ ID NO: 688605 - DNA, 25 bp, Mus musculus
gtcgatcaatgtattgcagtttatt

SEQ ID NO: 688606 - DNA, 25 bp, Mus musculus
gtcgatcaatgttttgcagtttatt

SEQ ID NO: 688607 - DNA, 25 bp, Mus musculus
gtcgatccaactactaacagagtgc

SEQ ID NO: 688608 - DNA, 25 bp, Mus musculus
gtcgatccaacttctaacagagtgc

SEQ ID NO: 688609 - DNA, 25 bp, Mus musculus
gtcgatccacaactttatctacact

SEQ ID NO: 688610 - DNA, 25 bp, Mus musculus
gtcgatccacaagtttatctacact

SEQ ID NO: 688611 - DNA, 25 bp, Mus musculus
gtcgatccatagagggacatccaaa

SEQ ID NO: 688612 - DNA, 25 bp, Mus musculus
gtcgatccatagtgggacatccaaa

SEQ ID NO: 688613 - DNA, 25 bp, Mus musculus
gtcgatctgtataaatgagcaccac

SEQ ID NO: 688614 - DNA, 25 bp, Mus musculus
gtcgatctgtattaatgagcaccac

SEQ ID NO: 688615 - DNA, 25 bp, Mus musculus
gtcgatgaacctaggctctgccata

SEQ ID NO: 688616 - DNA, 25 bp, Mus musculus
gtcgatgaaccttggctctgccata

SEQ ID NO: 688617 - DNA, 25 bp, Mus musculus
gtcgatgacccgagtctatggattt

SEQ ID NO: 688618 - DNA, 25 bp, Mus musculus
gtcgatgacccgtgtctatggattt

SEQ ID NO: 688619 - DNA, 25 bp, Mus musculus
gtcgatgatggtcacgactctgtcg

SEQ ID NO: 688620 - DNA, 25 bp, Mus musculus
gtcgatgatggtgacgactctgtcg

SEQ ID NO: 688621 - DNA, 25 bp, Mus musculus
gtcgatgcagtgcaactgtgccttc

SEQ ID NO: 688622 - DNA, 25 bp, Mus musculus
gtcgatgcagtggaactgtgccttc

SEQ ID NO: 688623 - DNA, 25 bp, Mus musculus
gtcgatgctgtcagccccaggttcc

SEQ ID NO: 688624 - DNA, 25 bp, Mus musculus
gtcgatgctgtctgccccaggttcc

SEQ ID NO: 688625 - DNA, 25 bp, Mus musculus
gtcgatggctcccagaaaggcaaaa

SEQ ID NO: 688626 - DNA, 25 bp, Mus musculus
gtcgatggctccgagaaaggcaaaa

SEQ ID NO: 688627 - DNA, 25 bp, Mus musculus
gtcgatgtctgacaggttttcctct

SEQ ID NO: 688628 - DNA, 25 bp, Mus musculus
gtcgatgtctgagaggttttcctct

SEQ ID NO: 688629 - DNA, 25 bp, Mus musculus
gtcgatgtgaacaagcttgtgacac

SEQ ID NO: 688630 - DNA, 25 bp, Mus musculus
gtcgatgtgaactagcttgtgacac

SEQ ID NO: 688631 - DNA, 25 bp, Mus musculus
gtcgatgtgttgagctgctgactaa

SEQ ID NO: 688632 - DNA, 25 bp, Mus musculus
gtcgatgtgttgtgctgctgactaa

SEQ ID NO: 688633 - DNA, 25 bp, Mus musculus
gtcgattcctgaaactttgccaaat

SEQ ID NO: 688634 - DNA, 25 bp, Mus musculus
gtcgattcctgatactttgccaaat

SEQ ID NO: 688635 - DNA, 25 bp, Mus musculus
gtcgattcgggaagccaccagcggt

SEQ ID NO: 688636 - DNA, 25 bp, Mus musculus
gtcgattcgggatgccaccagcggt

SEQ ID NO: 688637 - DNA, 25 bp, Mus musculus
gtcgattctacacgacatgggcatc

SEQ ID NO: 688638 - DNA, 25 bp, Mus musculus
gtcgattctacaggacatgggcatc

SEQ ID NO: 688639 - DNA, 25 bp, Mus musculus
gtcgatttcgccatcaacaagttca

SEQ ID NO: 688640 - DNA, 25 bp, Mus musculus
gtcgatttcgccttcaacaagttca

SEQ ID NO: 688641 - DNA, 25 bp, Mus musculus
gtcgatttctggagctcggagccgc

SEQ ID NO: 688642 - DNA, 25 bp, Mus musculus
gtcgatttctggtgctcggagccgc

SEQ ID NO: 688643 - DNA, 25 bp, Mus musculus
gtcgatttctgtatgaggtcatttg

SEQ ID NO: 688644 - DNA, 25 bp, Mus musculus
gtcgatttctgtttgaggtcatttg

SEQ ID NO: 688645 - DNA, 25 bp, Mus musculus
gtcgattttagaattccagggtcaa

SEQ ID NO: 688646 - DNA, 25 bp, Mus musculus
gtcgattttagatttccagggtcaa

SEQ ID NO: 688647 - DNA, 25 bp, Mus musculus
gtcgattttcatcaattcagggagc

SEQ ID NO: 688648 - DNA, 25 bp, Mus musculus
gtcgattttcatgaattcagggagc

SEQ ID NO: 688649 - DNA, 25 bp, Mus musculus
gtcgcaaattttccactactggcat

SEQ ID NO: 688650 - DNA, 25 bp, Mus musculus
gtcgcaaattttgcactactggcat

SEQ ID NO: 688651 - DNA, 25 bp, Mus musculus
gtcgcaacaagacgcacacgctgtg

SEQ ID NO: 688652 - DNA, 25 bp, Mus musculus
gtcgcaacaagaggcacacgctgtg

SEQ ID NO: 688653 - DNA, 25 bp, Mus musculus
gtcgcaacatcgactacctgctggg

SEQ ID NO: 688654 - DNA, 25 bp, Mus musculus
gtcgcaacatcgtctacctgctggg

SEQ ID NO: 688655 - DNA, 25 bp, Mus musculus
gtcgcaactcagagttccagcaggg

SEQ ID NO: 688656 - DNA, 25 bp, Mus musculus
gtcgcaactcagtgttccagcaggg

SEQ ID NO: 688657 - DNA, 25 bp, Mus musculus
gtcgcaagtaaaatcctactgtgta

SEQ ID NO: 688658 - DNA, 25 bp, Mus musculus
gtcgcaagtaaattcctactgtgta

SEQ ID NO: 688659 - DNA, 25 bp, Mus musculus
gtcgcaattcacatactgagttttt

SEQ ID NO: 688660 - DNA, 25 bp, Mus musculus
gtcgcaattcacttactgagttttt

SEQ ID NO: 688661 - DNA, 25 bp, Mus musculus
gtcgcacagtgaagggtcatttcct

SEQ ID NO: 688662 - DNA, 25 bp, Mus musculus
gtcgcacagtgatgggtcatttcct

SEQ ID NO: 688663 - DNA, 25 bp, Mus musculus
gtcgcaccaggcatttccatgacta

SEQ ID NO: 688664 - DNA, 25 bp, Mus musculus
gtcgcaccaggcttttccatgacta

SEQ ID NO: 688665 - DNA, 25 bp, Mus musculus
gtcgcacccaaaagatcacaaagtt

SEQ ID NO: 688666 - DNA, 25 bp, Mus musculus
gtcgcacccaaatgatcacaaagtt

SEQ ID NO: 688667 - DNA, 25 bp, Mus musculus
gtcgcacccagtcgtacctgaggat

SEQ ID NO: 688668 - DNA, 25 bp, Mus musculus
gtcgcacccagtggtacctgaggat

SEQ ID NO: 688669 - DNA, 25 bp, Mus musculus
gtcgcacctcctaaattcttgaagt

SEQ ID NO: 688670 - DNA, 25 bp, Mus musculus
gtcgcacctccttaattcttgaagt

SEQ ID NO: 688671 - DNA, 25 bp, Mus musculus
gtcgcacgtgttatacagtatatgg

SEQ ID NO: 688672 - DNA, 25 bp, Mus musculus
gtcgcacgtgttttacagtatatgg

SEQ ID NO: 688673 - DNA, 25 bp, Mus musculus
gtcgcactacaacactcactaatga

SEQ ID NO: 688674 - DNA, 25 bp, Mus musculus
gtcgcactacaagactcactaatga

SEQ ID NO: 688675 - DNA, 25 bp, Mus musculus
gtcgcagatattctccaggaccctg

SEQ ID NO: 688676 - DNA, 25 bp, Mus musculus
gtcgcagatattgtccaggaccctg

SEQ ID NO: 688677 - DNA, 25 bp, Mus musculus
gtcgcagcacatcataaaccactct

SEQ ID NO: 688678 - DNA, 25 bp, Mus musculus
gtcgcagcacatgataaaccactct

SEQ ID NO: 688679 - DNA, 25 bp, Mus musculus
gtcgcagcatctcaaccaaacagaa

SEQ ID NO: 688680 - DNA, 25 bp, Mus musculus
gtcgcagcatctgaaccaaacagaa

SEQ ID NO: 688681 - DNA, 25 bp, Mus musculus
gtcgcagccaaacaaaatagccaca

SEQ ID NO: 688682 - DNA, 25 bp, Mus musculus
gtcgcagccaaagaaaatagccaca

SEQ ID NO: 688683 - DNA, 25 bp, Mus musculus
gtcgcagccgggatgacctctatga

SEQ ID NO: 688684 - DNA, 25 bp, Mus musculus
gtcgcagccgggttgacctctatga

SEQ ID NO: 688685 - DNA, 25 bp, Mus musculus
gtcgcaggacctaattcagcacagc

SEQ ID NO: 688686 - DNA, 25 bp, Mus musculus
gtcgcaggaccttattcagcacagc

SEQ ID NO: 688687 - DNA, 25 bp, Mus musculus
gtcgcaggcagcagccgagcttttg

SEQ ID NO: 688688 - DNA, 25 bp, Mus musculus
gtcgcaggcagctgccgagcttttg

SEQ ID NO: 688689 - DNA, 25 bp, Mus musculus
gtcgcagtaaaccaacccgagtgaa

SEQ ID NO: 688690 - DNA, 25 bp, Mus musculus
gtcgcagtaaacgaacccgagtgaa

SEQ ID NO: 688691 - DNA, 25 bp, Mus musculus
gtcgcagtcgcgcaaggactctctg

SEQ ID NO: 688692 - DNA, 25 bp, Mus musculus
gtcgcagtcgcggaaggactctctg

SEQ ID NO: 688693 - DNA, 25 bp, Mus musculus
gtcgcagtctcaagcttggttagga

SEQ ID NO: 688694 - DNA, 25 bp, Mus musculus
gtcgcagtctcatgcttggttagga

SEQ ID NO: 688695 - DNA, 25 bp, Mus musculus
gtcgcagtttgcatctccttaatta

SEQ ID NO: 688696 - DNA, 25 bp, Mus musculus
gtcgcagtttgcttctccttaatta

SEQ ID NO: 688697 - DNA, 25 bp, Mus musculus
gtcgcatacagacgagttcttgttt

SEQ ID NO: 688698 - DNA, 25 bp, Mus musculus
gtcgcatacagaggagttcttgttt

SEQ ID NO: 688699 - DNA, 25 bp, Mus musculus
gtcgcattttatattgctgcccaca

SEQ ID NO: 688700 - DNA, 25 bp, Mus musculus
gtcgcattttattttgctgcccaca

SEQ ID NO: 688701 - DNA, 25 bp, Mus musculus
gtcgccaacgatataacccttgatc

SEQ ID NO: 688702 - DNA, 25 bp, Mus musculus
gtcgccaacgatttaacccttgatc

SEQ ID NO: 688703 - DNA, 25 bp, Mus musculus
gtcgccaagtggcaaatagactggt

SEQ ID NO: 688704 - DNA, 25 bp, Mus musculus
gtcgccaagtgggaaatagactggt

SEQ ID NO: 688705 - DNA, 25 bp, Mus musculus
gtcgccacatcgagggcccttgtgg

SEQ ID NO: 688706 - DNA, 25 bp, Mus musculus
gtcgccacatcgtgggcccttgtgg

SEQ ID NO: 688707 - DNA, 25 bp, Mus musculus
gtcgccagcggccagtttgatgcct

SEQ ID NO: 688708 - DNA, 25 bp, Mus musculus
gtcgccagcggcgagtttgatgcct

SEQ ID NO: 688709 - DNA, 25 bp, Mus musculus
gtcgccatcatccatcagtggatct

SEQ ID NO: 688710 - DNA, 25 bp, Mus musculus
gtcgccatcatcgatcagtggatct

SEQ ID NO: 688711 - DNA, 25 bp, Mus musculus
gtcgccatcgtcatagtgcacagag

SEQ ID NO: 688712 - DNA, 25 bp, Mus musculus
gtcgccatcgtcttagtgcacagag

SEQ ID NO: 688713 - DNA, 25 bp, Mus musculus
gtcgccatgcctcggaaaattgagg

SEQ ID NO: 688714 - DNA, 25 bp, Mus musculus
gtcgccatgcctgggaaaattgagg

SEQ ID NO: 688715 - DNA, 25 bp, Mus musculus
gtcgccatggtgaagctgagcaaag

SEQ ID NO: 688716 - DNA, 25 bp, Mus musculus
gtcgccatggtgtagctgagcaaag

SEQ ID NO: 688717 - DNA, 25 bp, Mus musculus
gtcgccattcacaatacgtggactt

SEQ ID NO: 688718 - DNA, 25 bp, Mus musculus
gtcgccattcactatacgtggactt

SEQ ID NO: 688719 - DNA, 25 bp, Mus musculus
gtcgccattggcatttacctgtatg

SEQ ID NO: 688720 - DNA, 25 bp, Mus musculus
gtcgccattggcttttacctgtatg

SEQ ID NO: 688721 - DNA, 25 bp, Mus musculus
gtcgccatttgcattttgagtcatc

SEQ ID NO: 688722 - DNA, 25 bp, Mus musculus
gtcgccatttgctttttgagtcatc

SEQ ID NO: 688723 - DNA, 25 bp, Mus musculus
gtcgcccacaagaaactcatttgat

SEQ ID NO: 688724 - DNA, 25 bp, Mus musculus
gtcgcccacaagtaactcatttgat

SEQ ID NO: 688725 - DNA, 25 bp, Mus musculus
gtcgcccaccatcaaacatgttagg

SEQ ID NO: 688726 - DNA, 25 bp, Mus musculus
gtcgcccaccatgaaacatgttagg

SEQ ID NO: 688727 - DNA, 25 bp, Mus musculus
gtcgcccatgacacagagctgcaag

SEQ ID NO: 688728 - DNA, 25 bp, Mus musculus
gtcgcccatgactcagagctgcaag

SEQ ID NO: 688729 - DNA, 25 bp, Mus musculus
gtcgcccgaaggatagatagtctat

SEQ ID NO: 688730 - DNA, 25 bp, Mus musculus
gtcgcccgaaggttagatagtctat

SEQ ID NO: 688731 - DNA, 25 bp, Mus musculus
gtcgccctcgtgatgtgcgctggaa

SEQ ID NO: 688732 - DNA, 25 bp, Mus musculus
gtcgccctcgtgttgtgcgctggaa

SEQ ID NO: 688733 - DNA, 25 bp, Mus musculus
gtcgccctcttcctggacagatcag

SEQ ID NO: 688734 - DNA, 25 bp, Mus musculus
gtcgccctcttcgtggacagatcag

SEQ ID NO: 688735 - DNA, 25 bp, Mus musculus
gtcgccctgaatataaacgtcctgg

SEQ ID NO: 688736 - DNA, 25 bp, Mus musculus
gtcgccctgaatttaaacgtcctgg

SEQ ID NO: 688737 - DNA, 25 bp, Mus musculus
gtcgccgaagccaggactggactta

SEQ ID NO: 688738 - DNA, 25 bp, Mus musculus
gtcgccgaagcctggactggactta

SEQ ID NO: 688739 - DNA, 25 bp, Mus musculus
gtcgccgatgctctggccaatgctg

SEQ ID NO: 688740 - DNA, 25 bp, Mus musculus
gtcgccgatgctgtggccaatgctg

SEQ ID NO: 688741 - DNA, 25 bp, Mus musculus
gtcgccggccaccaggacgtaagaa

SEQ ID NO: 688742 - DNA, 25 bp, Mus musculus
gtcgccggccacgaggacgtaagaa

SEQ ID NO: 688743 - DNA, 25 bp, Mus musculus
gtcgccggttacagatcggacttaa

SEQ ID NO: 688744 - DNA, 25 bp, Mus musculus
gtcgccggttactgatcggacttaa

SEQ ID NO: 688745 - DNA, 25 bp, Mus musculus
gtcgccgtgcacatctatatcgaga

SEQ ID NO: 688746 - DNA, 25 bp, Mus musculus
gtcgccgtgcacttctatatcgaga

SEQ ID NO: 688747 - DNA, 25 bp, Mus musculus
gtcgccgtgttccagttcatcatga

SEQ ID NO: 688748 - DNA, 25 bp, Mus musculus
gtcgccgtgttcgagttcatcatga

SEQ ID NO: 688749 - DNA, 25 bp, Mus musculus
gtcgccgttgtgcttcactgtggaa

SEQ ID NO: 688750 - DNA, 25 bp, Mus musculus
gtcgccgttgtggttcactgtggaa

SEQ ID NO: 688751 - DNA, 25 bp, Mus musculus
gtcgcctccgtgatgtagcatgcgg

SEQ ID NO: 688752 - DNA, 25 bp, Mus musculus
gtcgcctccgtgttgtagcatgcgg

SEQ ID NO: 688753 - DNA, 25 bp, Mus musculus
gtcgcctcggtaaggtttggaccca

SEQ ID NO: 688754 - DNA, 25 bp, Mus musculus
gtcgcctcggtatggtttggaccca

SEQ ID NO: 688755 - DNA, 25 bp, Mus musculus
gtcgcctctccacggcagtgacatt

SEQ ID NO: 688756 - DNA, 25 bp, Mus musculus
gtcgcctctccagggcagtgacatt

SEQ ID NO: 688757 - DNA, 25 bp, Mus musculus
gtcgcctgctgactgacagtgctga

SEQ ID NO: 688758 - DNA, 25 bp, Mus musculus
gtcgcctgctgagtgacagtgctga

SEQ ID NO: 688759 - DNA, 25 bp, Mus musculus
gtcgcctgggctctgtgacaaacga

SEQ ID NO: 688760 - DNA, 25 bp, Mus musculus
gtcgcctgggctgtgtgacaaacga

SEQ ID NO: 688761 - DNA, 25 bp, Mus musculus
gtcgcctgtcaaatgtccgggaaaa

SEQ ID NO: 688762 - DNA, 25 bp, Mus musculus
gtcgcctgtcaattgtccgggaaaa

SEQ ID NO: 688763 - DNA, 25 bp, Mus musculus
gtcgccttaacactgctattttctc

SEQ ID NO: 688764 - DNA, 25 bp, Mus musculus
gtcgccttaacagtgctattttctc

SEQ ID NO: 688765 - DNA, 25 bp, Mus musculus
gtcgccttagatcccatgaaaccct

SEQ ID NO: 688766 - DNA, 25 bp, Mus musculus
gtcgccttagatgccatgaaaccct

SEQ ID NO: 688767 - DNA, 25 bp, Mus musculus
gtcgccttcagaatatggacttcct

SEQ ID NO: 688768 - DNA, 25 bp, Mus musculus
gtcgccttcagattatggacttcct

SEQ ID NO: 688769 - DNA, 25 bp, Mus musculus
gtcgccttcttgaaaatgttgtata

SEQ ID NO: 688770 - DNA, 25 bp, Mus musculus
gtcgccttcttgtaaatgttgtata

SEQ ID NO: 688771 - DNA, 25 bp, Mus musculus
gtcgccttgtgcatcggtttctaag

SEQ ID NO: 688772 - DNA, 25 bp, Mus musculus
gtcgccttgtgcttcggtttctaag

SEQ ID NO: 688773 - DNA, 25 bp, Mus musculus
gtcgccttttccatctgtgatgtca

SEQ ID NO: 688774 - DNA, 25 bp, Mus musculus
gtcgccttttccttctgtgatgtca

SEQ ID NO: 688775 - DNA, 25 bp, Mus musculus
gtcgcgatgttgctgggtattctat

SEQ ID NO: 688776 - DNA, 25 bp, Mus musculus
gtcgcgatgttggtgggtattctat

SEQ ID NO: 688777 - DNA, 25 bp, Mus musculus
gtcgcgccaaaaagggccgcggcca

SEQ ID NO: 688778 - DNA, 25 bp, Mus musculus
gtcgcgccaaaatgggccgcggcca

SEQ ID NO: 688779 - DNA, 25 bp, Mus musculus
gtcgcgccggccactctggactggt

SEQ ID NO: 688780 - DNA, 25 bp, Mus musculus
gtcgcgccggcctctctggactggt

SEQ ID NO: 688781 - DNA, 25 bp, Mus musculus
gtcgcggaactccatgaggccctgc

SEQ ID NO: 688782 - DNA, 25 bp, Mus musculus
gtcgcggaactcgatgaggccctgc

SEQ ID NO: 688783 - DNA, 25 bp, Mus musculus
gtcgcgggtctcacccagcgggcag

SEQ ID NO: 688784 - DNA, 25 bp, Mus musculus
gtcgcgggtctctcccagcgggcag

SEQ ID NO: 688785 - DNA, 25 bp, Mus musculus
gtcgcggttacccagacaagtagta

SEQ ID NO: 688786 - DNA, 25 bp, Mus musculus
gtcgcggttaccgagacaagtagta

SEQ ID NO: 688787 - DNA, 25 bp, Mus musculus
gtcgcggttgcgctacttgtacatg

SEQ ID NO: 688788 - DNA, 25 bp, Mus musculus
gtcgcggttgcggtacttgtacatg

SEQ ID NO: 688789 - DNA, 25 bp, Mus musculus
gtcgcgtgagctcttctaaaatcca

SEQ ID NO: 688790 - DNA, 25 bp, Mus musculus
gtcgcgtgagctgttctaaaatcca

SEQ ID NO: 688791 - DNA, 25 bp, Mus musculus
gtcgctaagccacagtatttatgga

SEQ ID NO: 688792 - DNA, 25 bp, Mus musculus
gtcgctaagccagagtatttatgga

SEQ ID NO: 688793 - DNA, 25 bp, Mus musculus
gtcgctaatggcatctgtgctcttt

SEQ ID NO: 688794 - DNA, 25 bp, Mus musculus
gtcgctaatggcttctgtgctcttt

SEQ ID NO: 688795 - DNA, 25 bp, Mus musculus
gtcgctactacccattggatggttt

SEQ ID NO: 688796 - DNA, 25 bp, Mus musculus
gtcgctactaccgattggatggttt

SEQ ID NO: 688797 - DNA, 25 bp, Mus musculus
gtcgctactgaacccctctacaaag

SEQ ID NO: 688798 - DNA, 25 bp, Mus musculus
gtcgctactgaagccctctacaaag

SEQ ID NO: 688799 - DNA, 25 bp, Mus musculus
gtcgctacttggacagtgcgttgca

SEQ ID NO: 688800 - DNA, 25 bp, Mus musculus
gtcgctacttggtcagtgcgttgca

SEQ ID NO: 688801 - DNA, 25 bp, Mus musculus
gtcgctagagaaatccagtgaccaa

SEQ ID NO: 688802 - DNA, 25 bp, Mus musculus
gtcgctagagaattccagtgaccaa

SEQ ID NO: 688803 - DNA, 25 bp, Mus musculus
gtcgctagtcatcgttttgaccaag

SEQ ID NO: 688804 - DNA, 25 bp, Mus musculus
gtcgctagtcatggttttgaccaag

SEQ ID NO: 688805 - DNA, 25 bp, Mus musculus
gtcgctatacctaagcaccgtggga

SEQ ID NO: 688806 - DNA, 25 bp, Mus musculus
gtcgctataccttagcaccgtggga

SEQ ID NO: 688807 - DNA, 25 bp, Mus musculus
gtcgctcaagctcaaaacaattctg

SEQ ID NO: 688808 - DNA, 25 bp, Mus musculus
gtcgctcaagctgaaaacaattctg

SEQ ID NO: 688809 - DNA, 25 bp, Mus musculus
gtcgctcaccctctgacaaaagaag

SEQ ID NO: 688810 - DNA, 25 bp, Mus musculus
gtcgctcaccctgtgacaaaagaag

SEQ ID NO: 688811 - DNA, 25 bp, Mus musculus
gtcgctcaggataccttacattcaa

SEQ ID NO: 688812 - DNA, 25 bp, Mus musculus
gtcgctcaggattccttacattcaa

SEQ ID NO: 688813 - DNA, 25 bp, Mus musculus
gtcgctcagtgacttgtgataacgt

SEQ ID NO: 688814 - DNA, 25 bp, Mus musculus
gtcgctcagtgagttgtgataacgt

SEQ ID NO: 688815 - DNA, 25 bp, Mus musculus
gtcgctcatactatatgcaacatca

SEQ ID NO: 688816 - DNA, 25 bp, Mus musculus
gtcgctcatactttatgcaacatca

SEQ ID NO: 688817 - DNA, 25 bp, Mus musculus
gtcgctcatatcactggacttgatt

SEQ ID NO: 688818 - DNA, 25 bp, Mus musculus
gtcgctcatatctctggacttgatt

SEQ ID NO: 688819 - DNA, 25 bp, Mus musculus
gtcgctcatcagaaggcctagtcag

SEQ ID NO: 688820 - DNA, 25 bp, Mus musculus
gtcgctcatcagtaggcctagtcag

SEQ ID NO: 688821 - DNA, 25 bp, Mus musculus
gtcgctcatgagcaaatatgtgcac

SEQ ID NO: 688822 - DNA, 25 bp, Mus musculus
gtcgctcatgaggaaatatgtgcac

SEQ ID NO: 688823 - DNA, 25 bp, Mus musculus
gtcgctcatgcgaacaacagggtat

SEQ ID NO: 688824 - DNA, 25 bp, Mus musculus
gtcgctcatgcgtacaacagggtat

SEQ ID NO: 688825 - DNA, 25 bp, Mus musculus
gtcgctcccgcaccacgtgatggag

SEQ ID NO: 688826 - DNA, 25 bp, Mus musculus
gtcgctcccgcagcacgtgatggag

SEQ ID NO: 688827 - DNA, 25 bp, Mus musculus
gtcgctcctgcacattctggaaggg

SEQ ID NO: 688828 - DNA, 25 bp, Mus musculus
gtcgctcctgcagattctggaaggg

SEQ ID NO: 688829 - DNA, 25 bp, Mus musculus
gtcgctctagacacaaaagcctgtt

SEQ ID NO: 688830 - DNA, 25 bp, Mus musculus
gtcgctctagactcaaaagcctgtt

SEQ ID NO: 688831 - DNA, 25 bp, Mus musculus
gtcgctctcgaccattccgaaagac

SEQ ID NO: 688832 - DNA, 25 bp, Mus musculus
gtcgctctcgacgattccgaaagac

SEQ ID NO: 688833 - DNA, 25 bp, Mus musculus
gtcgctctctcactagcttagatga

SEQ ID NO: 688834 - DNA, 25 bp, Mus musculus
gtcgctctctcagtagcttagatga

SEQ ID NO: 688835 - DNA, 25 bp, Mus musculus
gtcgctcttcaaaagcaacctagtt

SEQ ID NO: 688836 - DNA, 25 bp, Mus musculus
gtcgctcttcaatagcaacctagtt

SEQ ID NO: 688837 - DNA, 25 bp, Mus musculus
gtcgctgaagtgaagagcccctgaa

SEQ ID NO: 688838 - DNA, 25 bp, Mus musculus
gtcgctgaagtgtagagcccctgaa

SEQ ID NO: 688839 - DNA, 25 bp, Mus musculus
gtcgctgccctacagttgcaaaaac

SEQ ID NO: 688840 - DNA, 25 bp, Mus musculus
gtcgctgccctagagttgcaaaaac

SEQ ID NO: 688841 - DNA, 25 bp, Mus musculus
gtcgctgctcaaccgcgtaagccag

SEQ ID NO: 688842 - DNA, 25 bp, Mus musculus
gtcgctgctcaagcgcgtaagccag

SEQ ID NO: 688843 - DNA, 25 bp, Mus musculus
gtcgctgtcacaaaatctgggttct

SEQ ID NO: 688844 - DNA, 25 bp, Mus musculus
gtcgctgtcacataatctgggttct

SEQ ID NO: 688845 - DNA, 25 bp, Mus musculus
gtcgctgtcagtcttacagatttct

SEQ ID NO: 688846 - DNA, 25 bp, Mus musculus
gtcgctgtcagtgttacagatttct

SEQ ID NO: 688847 - DNA, 25 bp, Mus musculus
gtcgctgtccgcacagctcttgcaa

SEQ ID NO: 688848 - DNA, 25 bp, Mus musculus
gtcgctgtccgctcagctcttgcaa

SEQ ID NO: 688849 - DNA, 25 bp, Mus musculus
gtcgctgtgtctcttttagggccgt

SEQ ID NO: 688850 - DNA, 25 bp, Mus musculus
gtcgctgtgtctgttttagggccgt

SEQ ID NO: 688851 - DNA, 25 bp, Mus musculus
gtcgctgttaatagcatgtgcttca

SEQ ID NO: 688852 - DNA, 25 bp, Mus musculus
gtcgctgttaattgcatgtgcttca

SEQ ID NO: 688853 - DNA, 25 bp, Mus musculus
gtcgctgttttgatgtctactaaaa

SEQ ID NO: 688854 - DNA, 25 bp, Mus musculus
gtcgctgttttgttgtctactaaaa

SEQ ID NO: 688855 - DNA, 25 bp, Mus musculus
gtcgcttaccttaagaccataggca

SEQ ID NO: 688856 - DNA, 25 bp, Mus musculus
gtcgcttacctttagaccataggca

SEQ ID NO: 688857 - DNA, 25 bp, Mus musculus
gtcgcttcaccaaggcctacaagaa

SEQ ID NO: 688858 - DNA, 25 bp, Mus musculus
gtcgcttcaccatggcctacaagaa

SEQ ID NO: 688859 - DNA, 25 bp, Mus musculus
gtcgcttcacggactggttagagta

SEQ ID NO: 688860 - DNA, 25 bp, Mus musculus
gtcgcttcacggtctggttagagta

SEQ ID NO: 688861 - DNA, 25 bp, Mus musculus
gtcgcttccacgaaagtcctatggt

SEQ ID NO: 688862 - DNA, 25 bp, Mus musculus
gtcgcttccacgtaagtcctatggt

SEQ ID NO: 688863 - DNA, 25 bp, Mus musculus
gtcgcttcgatgctgctttaagtca

SEQ ID NO: 688864 - DNA, 25 bp, Mus musculus
gtcgcttcgatggtgctttaagtca

SEQ ID NO: 688865 - DNA, 25 bp, Mus musculus
gtcgcttcgtcgagcgctgtcgtga

SEQ ID NO: 688866 - DNA, 25 bp, Mus musculus
gtcgcttcgtcgtgcgctgtcgtga

SEQ ID NO: 688867 - DNA, 25 bp, Mus musculus
gtcgcttctttacacctaactacag

SEQ ID NO: 688868 - DNA, 25 bp, Mus musculus
gtcgcttctttagacctaactacag

SEQ ID NO: 688869 - DNA, 25 bp, Mus musculus
gtcgcttgactcacagtgtgaggta

SEQ ID NO: 688870 - DNA, 25 bp, Mus musculus
gtcgcttgactctcagtgtgaggta

SEQ ID NO: 688871 - DNA, 25 bp, Mus musculus
gtcgcttgctgtaaatgtgaattcc

SEQ ID NO: 688872 - DNA, 25 bp, Mus musculus
gtcgcttgctgttaatgtgaattcc

SEQ ID NO: 688873 - DNA, 25 bp, Mus musculus
gtcgcttgtcgacaacagctttttg

SEQ ID NO: 688874 - DNA, 25 bp, Mus musculus
gtcgcttgtcgagaacagctttttg

SEQ ID NO: 688875 - DNA, 25 bp, Mus musculus
gtcgctttcataagacaaagtctga

SEQ ID NO: 688876 - DNA, 25 bp, Mus musculus
gtcgctttcatatgacaaagtctga

SEQ ID NO: 688877 - DNA, 25 bp, Mus musculus
gtcgctttctttccccttgtaaatg

SEQ ID NO: 688878 - DNA, 25 bp, Mus musculus
gtcgctttctttgcccttgtaaatg

SEQ ID NO: 688879 - DNA, 25 bp, Mus musculus
gtcgctttgctgatcgtgacatgag

SEQ ID NO: 688880 - DNA, 25 bp, Mus musculus
gtcgctttgctgttcgtgacatgag

SEQ ID NO: 688881 - DNA, 25 bp, Mus musculus
gtcgcttttcttacctaatcacagt

SEQ ID NO: 688882 - DNA, 25 bp, Mus musculus
gtcgcttttctttcctaatcacagt

SEQ ID NO: 688883 - DNA, 25 bp, Mus musculus
gtcgcttttttgcactagccggaag

SEQ ID NO: 688884 - DNA, 25 bp, Mus musculus
gtcgcttttttggactagccggaag

SEQ ID NO: 688885 - DNA, 25 bp, Mus musculus
gtcggaaaacctacatccagattgg

SEQ ID NO: 688886 - DNA, 25 bp, Mus musculus
gtcggaaaaccttcatccagattgg

SEQ ID NO: 688887 - DNA, 25 bp, Mus musculus
gtcggaaatcagaaccaggtcctct

SEQ ID NO: 688888 - DNA, 25 bp, Mus musculus
gtcggaaatcagtaccaggtcctct

SEQ ID NO: 688889 - DNA, 25 bp, Mus musculus
gtcggaacagctcccaatttgtagt

SEQ ID NO: 688890 - DNA, 25 bp, Mus musculus
gtcggaacagctgccaatttgtagt

SEQ ID NO: 688891 - DNA, 25 bp, Mus musculus
gtcggaatgctcattcccacacaag

SEQ ID NO: 688892 - DNA, 25 bp, Mus musculus
gtcggaatgctctttcccacacaag

SEQ ID NO: 688893 - DNA, 25 bp, Mus musculus
gtcggacaacacagatgaggcaaaa

SEQ ID NO: 688894 - DNA, 25 bp, Mus musculus
gtcggacaacactgatgaggcaaaa

SEQ ID NO: 688895 - DNA, 25 bp, Mus musculus
gtcggacaagagaatatgccttatt

SEQ ID NO: 688896 - DNA, 25 bp, Mus musculus
gtcggacaagagtatatgccttatt

SEQ ID NO: 688897 - DNA, 25 bp, Mus musculus
gtcggacaccagcaggatccgcaag

SEQ ID NO: 688898 - DNA, 25 bp, Mus musculus
gtcggacaccaggaggatccgcaag

SEQ ID NO: 688899 - DNA, 25 bp, Mus musculus
gtcggaccaggaagtcaacgccaag

SEQ ID NO: 688900 - DNA, 25 bp, Mus musculus
gtcggaccaggatgtcaacgccaag

SEQ ID NO: 688901 - DNA, 25 bp, Mus musculus
gtcggacctgcacaaacaaccttca

SEQ ID NO: 688902 - DNA, 25 bp, Mus musculus
gtcggacctgcagaaacaaccttca

SEQ ID NO: 688903 - DNA, 25 bp, Mus musculus
gtcggacctgccatgtttgaggcaa

SEQ ID NO: 688904 - DNA, 25 bp, Mus musculus
gtcggacctgccttgtttgaggcaa

SEQ ID NO: 688905 - DNA, 25 bp, Mus musculus
gtcggactcgcgagcctccacaggg

SEQ ID NO: 688906 - DNA, 25 bp, Mus musculus
gtcggactcgcgtgcctccacaggg

SEQ ID NO: 688907 - DNA, 25 bp, Mus musculus
gtcggactctcacaaagctgcctat

SEQ ID NO: 688908 - DNA, 25 bp, Mus musculus
gtcggactctcagaaagctgcctat

SEQ ID NO: 688909 - DNA, 25 bp, Mus musculus
gtcggactcttcatgggagcttttt

SEQ ID NO: 688910 - DNA, 25 bp, Mus musculus
gtcggactcttcttgggagcttttt

SEQ ID NO: 688911 - DNA, 25 bp, Mus musculus
gtcggagaccatcagctctgtgctc

SEQ ID NO: 688912 - DNA, 25 bp, Mus musculus
gtcggagaccatgagctctgtgctc

SEQ ID NO: 688913 - DNA, 25 bp, Mus musculus
gtcggagagcttcactctattgtct

SEQ ID NO: 688914 - DNA, 25 bp, Mus musculus
gtcggagagcttgactctattgtct

SEQ ID NO: 688915 - DNA, 25 bp, Mus musculus
gtcggagcagtcagccagcgagtct

SEQ ID NO: 688916 - DNA, 25 bp, Mus musculus
gtcggagcagtctgccagcgagtct

SEQ ID NO: 688917 - DNA, 25 bp, Mus musculus
gtcggaggacatatttgtgcactgt

SEQ ID NO: 688918 - DNA, 25 bp, Mus musculus
gtcggaggacatttttgtgcactgt

SEQ ID NO: 688919 - DNA, 25 bp, Mus musculus
gtcggaggagaaaaccttataccca

SEQ ID NO: 688920 - DNA, 25 bp, Mus musculus
gtcggaggagaataccttataccca

SEQ ID NO: 688921 - DNA, 25 bp, Mus musculus
gtcggaggcaacatctgtttccaat

SEQ ID NO: 688922 - DNA, 25 bp, Mus musculus
gtcggaggcaacttctgtttccaat

SEQ ID NO: 688923 - DNA, 25 bp, Mus musculus
gtcggagtcagacgcaaacagtaaa

SEQ ID NO: 688924 - DNA, 25 bp, Mus musculus
gtcggagtcagaggcaaacagtaaa

SEQ ID NO: 688925 - DNA, 25 bp, Mus musculus
gtcggagttccacactgtaggatat

SEQ ID NO: 688926 - DNA, 25 bp, Mus musculus
gtcggagttccagactgtaggatat

SEQ ID NO: 688927 - DNA, 25 bp, Mus musculus
gtcggatacaaaagctgccatcagt

SEQ ID NO: 688928 - DNA, 25 bp, Mus musculus
gtcggatacaaatgctgccatcagt

SEQ ID NO: 688929 - DNA, 25 bp, Mus musculus
gtcggatcagttctaggacaggaca

SEQ ID NO: 688930 - DNA, 25 bp, Mus musculus
gtcggatcagttgtaggacaggaca

SEQ ID NO: 688931 - DNA, 25 bp, Mus musculus
gtcggatcatccctaatttatgtgc

SEQ ID NO: 688932 - DNA, 25 bp, Mus musculus
gtcggatcatccgtaatttatgtgc

SEQ ID NO: 688933 - DNA, 25 bp, Mus musculus
gtcggatcggtcagatgaccgcctt

SEQ ID NO: 688934 - DNA, 25 bp, Mus musculus
gtcggatcggtctgatgaccgcctt

SEQ ID NO: 688935 - DNA, 25 bp, Mus musculus
gtcggatgaagaagactttgtgaaa

SEQ ID NO: 688936 - DNA, 25 bp, Mus musculus
gtcggatgaagatgactttgtgaaa

SEQ ID NO: 688937 - DNA, 25 bp, Mus musculus
gtcggattgggccttatcagacatc

SEQ ID NO: 688938 - DNA, 25 bp, Mus musculus
gtcggattgggcgttatcagacatc

SEQ ID NO: 688939 - DNA, 25 bp, Mus musculus
gtcggatttaccatgtatagtgtta

SEQ ID NO: 688940 - DNA, 25 bp, Mus musculus
gtcggatttaccttgtatagtgtta

SEQ ID NO: 688941 - DNA, 25 bp, Mus musculus
gtcggcaaaaatatgaagaccactt

SEQ ID NO: 688942 - DNA, 25 bp, Mus musculus
gtcggcaaaaatttgaagaccactt

SEQ ID NO: 688943 - DNA, 25 bp, Mus musculus
gtcggcaaagtgatcaatgctccag

SEQ ID NO: 688944 - DNA, 25 bp, Mus musculus
gtcggcaaagtgttcaatgctccag

SEQ ID NO: 688945 - DNA, 25 bp, Mus musculus
gtcggcatagaacaggagctccttg

SEQ ID NO: 688946 - DNA, 25 bp, Mus musculus
gtcggcatagaagaggagctccttg

SEQ ID NO: 688947 - DNA, 25 bp, Mus musculus
gtcggcatcatcattatcctcactg

SEQ ID NO: 688948 - DNA, 25 bp, Mus musculus
gtcggcatcatctttatcctcactg

SEQ ID NO: 688949 - DNA, 25 bp, Mus musculus
gtcggcatccaccataagcatttgt

SEQ ID NO: 688950 - DNA, 25 bp, Mus musculus
gtcggcatccacgataagcatttgt

SEQ ID NO: 688951 - DNA, 25 bp, Mus musculus
gtcggcatgggcaaagttgaaacag

SEQ ID NO: 688952 - DNA, 25 bp, Mus musculus
gtcggcatgggctaagttgaaacag

SEQ ID NO: 688953 - DNA, 25 bp, Mus musculus
gtcggccaaaggacgatgtcttata

SEQ ID NO: 688954 - DNA, 25 bp, Mus musculus
gtcggccaaaggtcgatgtcttata

SEQ ID NO: 688955 - DNA, 25 bp, Mus musculus
gtcggccagaagaacctctcggaga

SEQ ID NO: 688956 - DNA, 25 bp, Mus musculus
gtcggccagaagtacctctcggaga

SEQ ID NO: 688957 - DNA, 25 bp, Mus musculus
gtcggccagaggaggtgcatcctaa

SEQ ID NO: 688958 - DNA, 25 bp, Mus musculus
gtcggccagaggtggtgcatcctaa

SEQ ID NO: 688959 - DNA, 25 bp, Mus musculus
gtcggccgtgttaggatttcttaca

SEQ ID NO: 688960 - DNA, 25 bp, Mus musculus
gtcggccgtgtttggatttcttaca

SEQ ID NO: 688961 - DNA, 25 bp, Mus musculus
gtcggcctagatcctggttctgcag

SEQ ID NO: 688962 - DNA, 25 bp, Mus musculus
gtcggcctagatgctggttctgcag

SEQ ID NO: 688963 - DNA, 25 bp, Mus musculus
gtcggcctgtgcaaaagtcctgtga

SEQ ID NO: 688964 - DNA, 25 bp, Mus musculus
gtcggcctgtgctaaagtcctgtga

SEQ ID NO: 688965 - DNA, 25 bp, Mus musculus
gtcggccttgtacattaaaacgaag

SEQ ID NO: 688966 - DNA, 25 bp, Mus musculus
gtcggccttgtagattaaaacgaag

SEQ ID NO: 688967 - DNA, 25 bp, Mus musculus
gtcggcgccagtaggaaagaacctt

SEQ ID NO: 688968 - DNA, 25 bp, Mus musculus
gtcggcgccagttggaaagaacctt

SEQ ID NO: 688969 - DNA, 25 bp, Mus musculus
gtcggcgctgagcaacactgctttt

SEQ ID NO: 688970 - DNA, 25 bp, Mus musculus
gtcggcgctgaggaacactgctttt

SEQ ID NO: 688971 - DNA, 25 bp, Mus musculus
gtcggcgctttaaagtcggagtctt

SEQ ID NO: 688972 - DNA, 25 bp, Mus musculus
gtcggcgctttatagtcggagtctt

SEQ ID NO: 688973 - DNA, 25 bp, Mus musculus
gtcggcggtgcccacaatgccctag

SEQ ID NO: 688974 - DNA, 25 bp, Mus musculus
gtcggcggtgccgacaatgccctag

SEQ ID NO: 688975 - DNA, 25 bp, Mus musculus
gtcggcgtcgctaatggcttctgtg

SEQ ID NO: 688976 - DNA, 25 bp, Mus musculus
gtcggcgtcgcttatggcttctgtg

SEQ ID NO: 688977 - DNA, 25 bp, Mus musculus
gtcggctcaaagattgtcctgctga

SEQ ID NO: 688978 - DNA, 25 bp, Mus musculus
gtcggctcaaagtttgtcctgctga

SEQ ID NO: 688979 - DNA, 25 bp, Mus musculus
gtcggctcagttcttgagacacctc

SEQ ID NO: 688980 - DNA, 25 bp, Mus musculus
gtcggctcagttgttgagacacctc

SEQ ID NO: 688981 - DNA, 25 bp, Mus musculus
gtcggctcctgcagaaaagctttgg

SEQ ID NO: 688982 - DNA, 25 bp, Mus musculus
gtcggctcctgctgaaaagctttgg

SEQ ID NO: 688983 - DNA, 25 bp, Mus musculus
gtcggctctcacaagacagataact

SEQ ID NO: 688984 - DNA, 25 bp, Mus musculus
gtcggctctcactagacagataact

SEQ ID NO: 688985 - DNA, 25 bp, Mus musculus
gtcggctctccaaacagatctgtag

SEQ ID NO: 688986 - DNA, 25 bp, Mus musculus
gtcggctctccatacagatctgtag

SEQ ID NO: 688987 - DNA, 25 bp, Mus musculus
gtcggctctgtaaactatttctgct

SEQ ID NO: 688988 - DNA, 25 bp, Mus musculus
gtcggctctgtatactatttctgct

SEQ ID NO: 688989 - DNA, 25 bp, Mus musculus
gtcggctgctttagggacagacacg

SEQ ID NO: 688990 - DNA, 25 bp, Mus musculus
gtcggctgcttttgggacagacacg

SEQ ID NO: 688991 - DNA, 25 bp, Mus musculus
gtcgggacactcatcagcaagaact

SEQ ID NO: 688992 - DNA, 25 bp, Mus musculus
gtcgggacactcttcagcaagaact

SEQ ID NO: 688993 - DNA, 25 bp, Mus musculus
gtcgggacagccacgagcttctgct

SEQ ID NO: 688994 - DNA, 25 bp, Mus musculus
gtcgggacagcctcgagcttctgct

SEQ ID NO: 688995 - DNA, 25 bp, Mus musculus
gtcgggacgcatagatttgtacaaa

SEQ ID NO: 688996 - DNA, 25 bp, Mus musculus
gtcgggacgcattgatttgtacaaa

SEQ ID NO: 688997 - DNA, 25 bp, Mus musculus
gtcgggactcttcagctgaggcctt

SEQ ID NO: 688998 - DNA, 25 bp, Mus musculus
gtcgggactcttgagctgaggcctt

SEQ ID NO: 688999 - DNA, 25 bp, Mus musculus
gtcgggagagaaccttctgccccaa

SEQ ID NO: 689000 - DNA, 25 bp, Mus musculus
gtcgggagagaagcttctgccccaa

SEQ ID NO: 689001 - DNA, 25 bp, Mus musculus
gtcgggagatacaccaggactctct

SEQ ID NO: 689002 - DNA, 25 bp, Mus musculus
gtcgggagatactccaggactctct

SEQ ID NO: 689003 - DNA, 25 bp, Mus musculus
gtcgggagatggaaatgcaagcaac

SEQ ID NO: 689004 - DNA, 25 bp, Mus musculus
gtcgggagatggtaatgcaagcaac

SEQ ID NO: 689005 - DNA, 25 bp, Mus musculus
gtcgggagcaggatgcacgattttc

SEQ ID NO: 689006 - DNA, 25 bp, Mus musculus
gtcgggagcaggttgcacgattttc

SEQ ID NO: 689007 - DNA, 25 bp, Mus musculus
gtcgggagctccagttaaaggcttt

SEQ ID NO: 689008 - DNA, 25 bp, Mus musculus
gtcgggagctcctgttaaaggcttt

SEQ ID NO: 689009 - DNA, 25 bp, Mus musculus
gtcgggaggacacattacttcatat

SEQ ID NO: 689010 - DNA, 25 bp, Mus musculus
gtcgggaggacagattacttcatat

SEQ ID NO: 689011 - DNA, 25 bp, Mus musculus
gtcgggaggcccatgaacgttcaaa

SEQ ID NO: 689012 - DNA, 25 bp, Mus musculus
gtcgggaggcccttgaacgttcaaa

SEQ ID NO: 689013 - DNA, 25 bp, Mus musculus
gtcgggatatccatttttaacattt

SEQ ID NO: 689014 - DNA, 25 bp, Mus musculus
gtcgggatatccttttttaacattt

SEQ ID NO: 689015 - DNA, 25 bp, Mus musculus
gtcgggatgcgaatcgaagcaacaa

SEQ ID NO: 689016 - DNA, 25 bp, Mus musculus
gtcgggatgcgattcgaagcaacaa

SEQ ID NO: 689017 - DNA, 25 bp, Mus musculus
gtcgggcaacaaattatacccaatg

SEQ ID NO: 689018 - DNA, 25 bp, Mus musculus
gtcgggcaacaatttatacccaatg

SEQ ID NO: 689019 - DNA, 25 bp, Mus musculus
gtcgggcagccgcacactatgagca

SEQ ID NO: 689020 - DNA, 25 bp, Mus musculus
gtcgggcagccggacactatgagca

SEQ ID NO: 689021 - DNA, 25 bp, Mus musculus
gtcgggcagtgcataaatctgatca

SEQ ID NO: 689022 - DNA, 25 bp, Mus musculus
gtcgggcagtgcttaaatctgatca

SEQ ID NO: 689023 - DNA, 25 bp, Mus musculus
gtcgggcatgacacgaatattgctg

SEQ ID NO: 689024 - DNA, 25 bp, Mus musculus
gtcgggcatgactcgaatattgctg

SEQ ID NO: 689025 - DNA, 25 bp, Mus musculus
gtcgggcattttaacaagtacacca

SEQ ID NO: 689026 - DNA, 25 bp, Mus musculus
gtcgggcatttttacaagtacacca

SEQ ID NO: 689027 - DNA, 25 bp, Mus musculus
gtcgggccacaaataaaatctgctt

SEQ ID NO: 689028 - DNA, 25 bp, Mus musculus
gtcgggccacaattaaaatctgctt

SEQ ID NO: 689029 - DNA, 25 bp, Mus musculus
gtcgggccaccaactcattgagtga

SEQ ID NO: 689030 - DNA, 25 bp, Mus musculus
gtcgggccaccatctcattgagtga

SEQ ID NO: 689031 - DNA, 25 bp, Mus musculus
gtcgggcccagcagtggttgcacag

SEQ ID NO: 689032 - DNA, 25 bp, Mus musculus
gtcgggcccagctgtggttgcacag

SEQ ID NO: 689033 - DNA, 25 bp, Mus musculus
gtcgggcccgtacccgtcagtgttc

SEQ ID NO: 689034 - DNA, 25 bp, Mus musculus
gtcgggcccgtagccgtcagtgttc

SEQ ID NO: 689035 - DNA, 25 bp, Mus musculus
gtcgggccgcctagagctacagaat

SEQ ID NO: 689036 - DNA, 25 bp, Mus musculus
gtcgggccgccttgagctacagaat

SEQ ID NO: 689037 - DNA, 25 bp, Mus musculus
gtcgggcgaccaatctgatcagaaa

SEQ ID NO: 689038 - DNA, 25 bp, Mus musculus
gtcgggcgaccattctgatcagaaa

SEQ ID NO: 689039 - DNA, 25 bp, Mus musculus
gtcgggcgagttagagatttttgtt

SEQ ID NO: 689040 - DNA, 25 bp, Mus musculus
gtcgggcgagtttgagatttttgtt

SEQ ID NO: 689041 - DNA, 25 bp, Mus musculus
gtcgggctagctacacggagtaagc

SEQ ID NO: 689042 - DNA, 25 bp, Mus musculus
gtcgggctagcttcacggagtaagc

SEQ ID NO: 689043 - DNA, 25 bp, Mus musculus
gtcgggctcaacaatgcccaccagg

SEQ ID NO: 689044 - DNA, 25 bp, Mus musculus
gtcgggctcaactatgcccaccagg

SEQ ID NO: 689045 - DNA, 25 bp, Mus musculus
gtcgggcttctaatgccattttgtt

SEQ ID NO: 689046 - DNA, 25 bp, Mus musculus
gtcgggcttctattgccattttgtt

SEQ ID NO: 689047 - DNA, 25 bp, Mus musculus
gtcgggtacagacttcccagcaaag

SEQ ID NO: 689048 - DNA, 25 bp, Mus musculus
gtcgggtacagagttcccagcaaag

SEQ ID NO: 689049 - DNA, 25 bp, Mus musculus
gtcgggtcacatatctaggttttca

SEQ ID NO: 689050 - DNA, 25 bp, Mus musculus
gtcgggtcacatttctaggttttca

SEQ ID NO: 689051 - DNA, 25 bp, Mus musculus
gtcgggttttagattcacaatcact

SEQ ID NO: 689052 - DNA, 25 bp, Mus musculus
gtcgggttttagtttcacaatcact

SEQ ID NO: 689053 - DNA, 25 bp, Mus musculus
gtcggtaacaggatttctgcttagt

SEQ ID NO: 689054 - DNA, 25 bp, Mus musculus
gtcggtaacaggttttctgcttagt

SEQ ID NO: 689055 - DNA, 25 bp, Mus musculus
gtcggtaatactatggaatggctgg

SEQ ID NO: 689056 - DNA, 25 bp, Mus musculus
gtcggtaatactttggaatggctgg

SEQ ID NO: 689057 - DNA, 25 bp, Mus musculus
gtcggtacacagcagtaattatgcc

SEQ ID NO: 689058 - DNA, 25 bp, Mus musculus
gtcggtacacaggagtaattatgcc

SEQ ID NO: 689059 - DNA, 25 bp, Mus musculus
gtcggtacctctccaaggtcttgga

SEQ ID NO: 689060 - DNA, 25 bp, Mus musculus
gtcggtacctctgcaaggtcttgga

SEQ ID NO: 689061 - DNA, 25 bp, Mus musculus
gtcggtacttaccaagcatctgaga

SEQ ID NO: 689062 - DNA, 25 bp, Mus musculus
gtcggtacttacgaagcatctgaga

SEQ ID NO: 689063 - DNA, 25 bp, Mus musculus
gtcggtagtgtcatagtctgcagca

SEQ ID NO: 689064 - DNA, 25 bp, Mus musculus
gtcggtagtgtcttagtctgcagca

SEQ ID NO: 689065 - DNA, 25 bp, Mus musculus
gtcggtagttaacaggactccttat

SEQ ID NO: 689066 - DNA, 25 bp, Mus musculus
gtcggtagttaagaggactccttat

SEQ ID NO: 689067 - DNA, 25 bp, Mus musculus
gtcggtagttggcagtacttcaccc

SEQ ID NO: 689068 - DNA, 25 bp, Mus musculus
gtcggtagttgggagtacttcaccc

SEQ ID NO: 689069 - DNA, 25 bp, Mus musculus
gtcggtatcttgatatgttacttga

SEQ ID NO: 689070 - DNA, 25 bp, Mus musculus
gtcggtatcttgttatgttacttga

SEQ ID NO: 689071 - DNA, 25 bp, Mus musculus
gtcggtatggtaatcatcagtgcaa

SEQ ID NO: 689072 - DNA, 25 bp, Mus musculus
gtcggtatggtattcatcagtgcaa

SEQ ID NO: 689073 - DNA, 25 bp, Mus musculus
gtcggtcaaaaaagcgctcattcca

SEQ ID NO: 689074 - DNA, 25 bp, Mus musculus
gtcggtcaaaaatgcgctcattcca

SEQ ID NO: 689075 - DNA, 25 bp, Mus musculus
gtcggtcaaaagcactcactggctg

SEQ ID NO: 689076 - DNA, 25 bp, Mus musculus
gtcggtcaaaaggactcactggctg

SEQ ID NO: 689077 - DNA, 25 bp, Mus musculus
gtcggtcaaatcatgagtccttgta

SEQ ID NO: 689078 - DNA, 25 bp, Mus musculus
gtcggtcaaatcttgagtccttgta

SEQ ID NO: 689079 - DNA, 25 bp, Mus musculus
gtcggtcaagacagaggcttcagaa

SEQ ID NO: 689080 - DNA, 25 bp, Mus musculus
gtcggtcaagactgaggcttcagaa

SEQ ID NO: 689081 - DNA, 25 bp, Mus musculus
gtcggtcacagcatgattagtaagg

SEQ ID NO: 689082 - DNA, 25 bp, Mus musculus
gtcggtcacagcttgattagtaagg

SEQ ID NO: 689083 - DNA, 25 bp, Mus musculus
gtcggtcatgcaccacttgggctac

SEQ ID NO: 689084 - DNA, 25 bp, Mus musculus
gtcggtcatgcagcacttgggctac

SEQ ID NO: 689085 - DNA, 25 bp, Mus musculus
gtcggtccactgagtttagttgcaa

SEQ ID NO: 689086 - DNA, 25 bp, Mus musculus
gtcggtccactgtgtttagttgcaa

SEQ ID NO: 689087 - DNA, 25 bp, Mus musculus
gtcggtccctgacgtggtattactt

SEQ ID NO: 689088 - DNA, 25 bp, Mus musculus
gtcggtccctgaggtggtattactt

SEQ ID NO: 689089 - DNA, 25 bp, Mus musculus
gtcggtcctccccatgacgggtaag

SEQ ID NO: 689090 - DNA, 25 bp, Mus musculus
gtcggtcctcccgatgacgggtaag

SEQ ID NO: 689091 - DNA, 25 bp, Mus musculus
gtcggtcttgcgcttgaagtgtcac

SEQ ID NO: 689092 - DNA, 25 bp, Mus musculus
gtcggtcttgcggttgaagtgtcac

SEQ ID NO: 689093 - DNA, 25 bp, Mus musculus
gtcggtgaagccatgttcccgtcgt

SEQ ID NO: 689094 - DNA, 25 bp, Mus musculus
gtcggtgaagccttgttcccgtcgt

SEQ ID NO: 689095 - DNA, 25 bp, Mus musculus
gtcggtgacagaacccagcacggga

SEQ ID NO: 689096 - DNA, 25 bp, Mus musculus
gtcggtgacagatcccagcacggga

SEQ ID NO: 689097 - DNA, 25 bp, Mus musculus
gtcggtgacataagtgactggctct

SEQ ID NO: 689098 - DNA, 25 bp, Mus musculus
gtcggtgacatatgtgactggctct

SEQ ID NO: 689099 - DNA, 25 bp, Mus musculus
gtcggtgccacaatgtggttcactt

SEQ ID NO: 689100 - DNA, 25 bp, Mus musculus
gtcggtgccacattgtggttcactt

SEQ ID NO: 689101 - DNA, 25 bp, Mus musculus
gtcggtggccctcagttgtagatct

SEQ ID NO: 689102 - DNA, 25 bp, Mus musculus
gtcggtggccctgagttgtagatct

SEQ ID NO: 689103 - DNA, 25 bp, Mus musculus
gtcggtgtgcgaacgcctgaacctg

SEQ ID NO: 689104 - DNA, 25 bp, Mus musculus
gtcggtgtgcgatcgcctgaacctg

SEQ ID NO: 689105 - DNA, 25 bp, Mus musculus
gtcggtgtgtggataatttactcat

SEQ ID NO: 689106 - DNA, 25 bp, Mus musculus
gtcggtgtgtggttaatttactcat

SEQ ID NO: 689107 - DNA, 25 bp, Mus musculus
gtcggtgttctgactgaggacttct

SEQ ID NO: 689108 - DNA, 25 bp, Mus musculus
gtcggtgttctgtctgaggacttct

SEQ ID NO: 689109 - DNA, 25 bp, Mus musculus
gtcggtgtttataagcatatgctcc

SEQ ID NO: 689110 - DNA, 25 bp, Mus musculus
gtcggtgtttattagcatatgctcc

SEQ ID NO: 689111 - DNA, 25 bp, Mus musculus
gtcggtgtttcactcagggacatga

SEQ ID NO: 689112 - DNA, 25 bp, Mus musculus
gtcggtgtttcagtcagggacatga

SEQ ID NO: 689113 - DNA, 25 bp, Mus musculus
gtcggttcaacacctgactactgtg

SEQ ID NO: 689114 - DNA, 25 bp, Mus musculus
gtcggttcaacagctgactactgtg

SEQ ID NO: 689115 - DNA, 25 bp, Mus musculus
gtcggttcccagagcagggtagcta

SEQ ID NO: 689116 - DNA, 25 bp, Mus musculus
gtcggttcccagtgcagggtagcta

SEQ ID NO: 689117 - DNA, 25 bp, Mus musculus
gtcggttcttgccatgaatttctca

SEQ ID NO: 689118 - DNA, 25 bp, Mus musculus
gtcggttcttgcgatgaatttctca

SEQ ID NO: 689119 - DNA, 25 bp, Mus musculus
gtcggttgccgaatacaacatcttt

SEQ ID NO: 689120 - DNA, 25 bp, Mus musculus
gtcggttgccgattacaacatcttt

SEQ ID NO: 689121 - DNA, 25 bp, Mus musculus
gtcggttggcacacttgtacagtca

SEQ ID NO: 689122 - DNA, 25 bp, Mus musculus
gtcggttggcactcttgtacagtca

SEQ ID NO: 689123 - DNA, 25 bp, Mus musculus
gtcggtttcagtagcaccagcttca

SEQ ID NO: 689124 - DNA, 25 bp, Mus musculus
gtcggtttcagttgcaccagcttca

SEQ ID NO: 689125 - DNA, 25 bp, Mus musculus
gtcggtttgcccagatcgtacagaa

SEQ ID NO: 689126 - DNA, 25 bp, Mus musculus
gtcggtttgccctgatcgtacagaa

SEQ ID NO: 689127 - DNA, 25 bp, Mus musculus
gtcggttttgttacgcaacacgaag

SEQ ID NO: 689128 - DNA, 25 bp, Mus musculus
gtcggttttgtttcgcaacacgaag

SEQ ID NO: 689129 - DNA, 25 bp, Mus musculus
gtcgtaaagattctactgtccccaa

SEQ ID NO: 689130 - DNA, 25 bp, Mus musculus
gtcgtaaagattgtactgtccccaa

SEQ ID NO: 689131 - DNA, 25 bp, Mus musculus
gtcgtaactggcctactgctaaaga

SEQ ID NO: 689132 - DNA, 25 bp, Mus musculus
gtcgtaactggcgtactgctaaaga

SEQ ID NO: 689133 - DNA, 25 bp, Mus musculus
gtcgtacatcaacacaaaccatgaa

SEQ ID NO: 689134 - DNA, 25 bp, Mus musculus
gtcgtacatcaagacaaaccatgaa

SEQ ID NO: 689135 - DNA, 25 bp, Mus musculus
gtcgtaccacggccattgtgatgga

SEQ ID NO: 689136 - DNA, 25 bp, Mus musculus
gtcgtaccacgggcattgtgatgga

SEQ ID NO: 689137 - DNA, 25 bp, Mus musculus
gtcgtacggtacacaccaaaagtct

SEQ ID NO: 689138 - DNA, 25 bp, Mus musculus
gtcgtacggtactcaccaaaagtct

SEQ ID NO: 689139 - DNA, 25 bp, Mus musculus
gtcgtacttgtacttgcgagctaac

SEQ ID NO: 689140 - DNA, 25 bp, Mus musculus
gtcgtacttgtagttgcgagctaac

SEQ ID NO: 689141 - DNA, 25 bp, Mus musculus
gtcgtagacctcaatgtaacctgct

SEQ ID NO: 689142 - DNA, 25 bp, Mus musculus
gtcgtagacctctatgtaacctgct

SEQ ID NO: 689143 - DNA, 25 bp, Mus musculus
gtcgtagagtggactcaggctccaa

SEQ ID NO: 689144 - DNA, 25 bp, Mus musculus
gtcgtagagtggtctcaggctccaa

SEQ ID NO: 689145 - DNA, 25 bp, Mus musculus
gtcgtagagtttagccaccagtaat

SEQ ID NO: 689146 - DNA, 25 bp, Mus musculus
gtcgtagagttttgccaccagtaat

SEQ ID NO: 689147 - DNA, 25 bp, Mus musculus
gtcgtagcactccaagacttacctg

SEQ ID NO: 689148 - DNA, 25 bp, Mus musculus
gtcgtagcactcgaagacttacctg

SEQ ID NO: 689149 - DNA, 25 bp, Mus musculus
gtcgtagccccgagtcggacgccga

SEQ ID NO: 689150 - DNA, 25 bp, Mus musculus
gtcgtagccccgtgtcggacgccga

SEQ ID NO: 689151 - DNA, 25 bp, Mus musculus
gtcgtagtatacctgaacccgcgcc

SEQ ID NO: 689152 - DNA, 25 bp, Mus musculus
gtcgtagtatacgtgaacccgcgcc

SEQ ID NO: 689153 - DNA, 25 bp, Mus musculus
gtcgtagtccccagatgtgagcaga

SEQ ID NO: 689154 - DNA, 25 bp, Mus musculus
gtcgtagtcccctgatgtgagcaga

SEQ ID NO: 689155 - DNA, 25 bp, Mus musculus
gtcgtatattccctttgattcacct

SEQ ID NO: 689156 - DNA, 25 bp, Mus musculus
gtcgtatattccgtttgattcacct

SEQ ID NO: 689157 - DNA, 25 bp, Mus musculus
gtcgtatcacgaagtcatgaagaca

SEQ ID NO: 689158 - DNA, 25 bp, Mus musculus
gtcgtatcacgatgtcatgaagaca

SEQ ID NO: 689159 - DNA, 25 bp, Mus musculus
gtcgtatctggccatggcttcttgg

SEQ ID NO: 689160 - DNA, 25 bp, Mus musculus
gtcgtatctggcgatggcttcttgg

SEQ ID NO: 689161 - DNA, 25 bp, Mus musculus
gtcgtatcttagaatttcttttaca

SEQ ID NO: 689162 - DNA, 25 bp, Mus musculus
gtcgtatcttagtatttcttttaca

SEQ ID NO: 689163 - DNA, 25 bp, Mus musculus
gtcgtatgtactcaggccatggcag

SEQ ID NO: 689164 - DNA, 25 bp, Mus musculus
gtcgtatgtactgaggccatggcag

SEQ ID NO: 689165 - DNA, 25 bp, Mus musculus
gtcgtatgtcagcagtacctttgta

SEQ ID NO: 689166 - DNA, 25 bp, Mus musculus
gtcgtatgtcaggagtacctttgta

SEQ ID NO: 689167 - DNA, 25 bp, Mus musculus
gtcgtattgttcagagtcttactag

SEQ ID NO: 689168 - DNA, 25 bp, Mus musculus
gtcgtattgttctgagtcttactag

SEQ ID NO: 689169 - DNA, 25 bp, Mus musculus
gtcgtatttgtaattctgcttgtct

SEQ ID NO: 689170 - DNA, 25 bp, Mus musculus
gtcgtatttgtatttctgcttgtct

SEQ ID NO: 689171 - DNA, 25 bp, Mus musculus
gtcgtcaagatgctaccgttcagga

SEQ ID NO: 689172 - DNA, 25 bp, Mus musculus
gtcgtcaatgtcatgcagatgccag

SEQ ID NO: 689173 - DNA, 25 bp, Mus musculus
gtcgtcaatgtcttgcagatgccag

SEQ ID NO: 689174 - DNA, 25 bp, Mus musculus
gtcgtcacaacaagaggacctttat

SEQ ID NO: 689175 - DNA, 25 bp, Mus musculus
gtcgtcacaacatgaggacctttat

SEQ ID NO: 689176 - DNA, 25 bp, Mus musculus
gtcgtcaccggaccactgaagatgt

SEQ ID NO: 689177 - DNA, 25 bp, Mus musculus
gtcgtcaccggagcactgaagatgt

SEQ ID NO: 689178 - DNA, 25 bp, Mus musculus
gtcgtcacggtgcaactgtatccca

SEQ ID NO: 689179 - DNA, 25 bp, Mus musculus
gtcgtcacggtggaactgtatccca

SEQ ID NO: 689180 - DNA, 25 bp, Mus musculus
gtcgtcacttttatacatctggatt

SEQ ID NO: 689181 - DNA, 25 bp, Mus musculus
gtcgtcacttttttacatctggatt

SEQ ID NO: 689182 - DNA, 25 bp, Mus musculus
gtcgtcagatacattccttttggat

SEQ ID NO: 689183 - DNA, 25 bp, Mus musculus
gtcgtcagatactttccttttggat

SEQ ID NO: 689184 - DNA, 25 bp, Mus musculus
gtcgtcagcccgcaacagttcatga

SEQ ID NO: 689185 - DNA, 25 bp, Mus musculus
gtcgtcagcccggaacagttcatga

SEQ ID NO: 689186 - DNA, 25 bp, Mus musculus
gtcgtcatcatgctcatcgttgcta

SEQ ID NO: 689187 - DNA, 25 bp, Mus musculus
gtcgtcatcatggtcatcgttgcta

SEQ ID NO: 689188 - DNA, 25 bp, Mus musculus
gtcgtcatccagcagaatggctctt

SEQ ID NO: 689189 - DNA, 25 bp, Mus musculus
gtcgtcatccaggagaatggctctt

SEQ ID NO: 689190 - DNA, 25 bp, Mus musculus
gtcgtcatctggacattctggccaa

SEQ ID NO: 689191 - DNA, 25 bp, Mus musculus
gtcgtcatctggtcattctggccaa

SEQ ID NO: 689192 - DNA, 25 bp, Mus musculus
gtcgtcatggagaccatcgctgtgg

SEQ ID NO: 689193 - DNA, 25 bp, Mus musculus
gtcgtcatggagtccatcgctgtgg

SEQ ID NO: 689194 - DNA, 25 bp, Mus musculus
gtcgtcatgtcaatgatgttgtcct

SEQ ID NO: 689195 - DNA, 25 bp, Mus musculus
gtcgtcatgtcattgatgttgtcct

SEQ ID NO: 689196 - DNA, 25 bp, Mus musculus
gtcgtcatgtttcgctgaatccctt

SEQ ID NO: 689197 - DNA, 25 bp, Mus musculus
gtcgtcatgtttggctgaatccctt

SEQ ID NO: 689198 - DNA, 25 bp, Mus musculus
gtcgtcattctgactttaacttctc

SEQ ID NO: 689199 - DNA, 25 bp, Mus musculus
gtcgtcattctgtctttaacttctc

SEQ ID NO: 689200 - DNA, 25 bp, Mus musculus
gtcgtcccactgcagtgtcgggttt

SEQ ID NO: 689201 - DNA, 25 bp, Mus musculus
gtcgtcccactggagtgtcgggttt

SEQ ID NO: 689202 - DNA, 25 bp, Mus musculus
gtcgtcccatctaggacagggcagt

SEQ ID NO: 689203 - DNA, 25 bp, Mus musculus
gtcgtcccatcttggacagggcagt

SEQ ID NO: 689204 - DNA, 25 bp, Mus musculus
gtcgtccccgttatccatgggagct

SEQ ID NO: 689205 - DNA, 25 bp, Mus musculus
gtcgtccccgttttccatgggagct

SEQ ID NO: 689206 - DNA, 25 bp, Mus musculus
gtcgtccctggtcatctgaagaaac

SEQ ID NO: 689207 - DNA, 25 bp, Mus musculus
gtcgtccctggtgatctgaagaaac

SEQ ID NO: 689208 - DNA, 25 bp, Mus musculus
gtcgtcccttatctgtcatcgtaga

SEQ ID NO: 689209 - DNA, 25 bp, Mus musculus
gtcgtcccttatgtgtcatcgtaga

SEQ ID NO: 689210 - DNA, 25 bp, Mus musculus
gtcgtcctaaacactgtaggccagg

SEQ ID NO: 689211 - DNA, 25 bp, Mus musculus
gtcgtcctaaactctgtaggccagg

SEQ ID NO: 689212 - DNA, 25 bp, Mus musculus
gtcgtcctatggaaagtctggattt

SEQ ID NO: 689213 - DNA, 25 bp, Mus musculus
gtcgtcctatggtaagtctggattt

SEQ ID NO: 689214 - DNA, 25 bp, Mus musculus
gtcgtcctcagccagggtgtgtcca

SEQ ID NO: 689215 - DNA, 25 bp, Mus musculus
gtcgtcctcagcgagggtgtgtcca

SEQ ID NO: 689216 - DNA, 25 bp, Mus musculus
gtcgtcctggatctcagaaggccac

SEQ ID NO: 689217 - DNA, 25 bp, Mus musculus
gtcgtcctggatgtcagaaggccac

SEQ ID NO: 689218 - DNA, 25 bp, Mus musculus
gtcgtccttcttaggcatggacaga

SEQ ID NO: 689219 - DNA, 25 bp, Mus musculus
gtcgtccttctttggcatggacaga

SEQ ID NO: 689220 - DNA, 25 bp, Mus musculus
gtcgtcgaagtaaaaagtttattct

SEQ ID NO: 689221 - DNA, 25 bp, Mus musculus
gtcgtcgaagtataaagtttattct

SEQ ID NO: 689222 - DNA, 25 bp, Mus musculus
gtcgtcgatgctaaaatggtcttat

SEQ ID NO: 689223 - DNA, 25 bp, Mus musculus
gtcgtcgatgcttaaatggtcttat

SEQ ID NO: 689224 - DNA, 25 bp, Mus musculus
gtcgtcgccatgctgaagctgagca

SEQ ID NO: 689225 - DNA, 25 bp, Mus musculus
gtcgtcgccatggtgaagctgagca

SEQ ID NO: 689226 - DNA, 25 bp, Mus musculus
gtcgtcgtgctgacctctgagacag

SEQ ID NO: 689227 - DNA, 25 bp, Mus musculus
gtcgtcgtgctgtcctctgagacag

SEQ ID NO: 689228 - DNA, 25 bp, Mus musculus
gtcgtctccatgacaactgtaggct

SEQ ID NO: 689229 - DNA, 25 bp, Mus musculus
gtcgtctccatgtcaactgtaggct

SEQ ID NO: 689230 - DNA, 25 bp, Mus musculus
gtcgtctccgctccgatgcatgagt

SEQ ID NO: 689231 - DNA, 25 bp, Mus musculus
gtcgtctccgctgcgatgcatgagt

SEQ ID NO: 689232 - DNA, 25 bp, Mus musculus
gtcgtctgcgggagaagattcagtc

SEQ ID NO: 689233 - DNA, 25 bp, Mus musculus
gtcgtctgcgggtgaagattcagtc

SEQ ID NO: 689234 - DNA, 25 bp, Mus musculus
gtcgtctgctttattatacacattt

SEQ ID NO: 689235 - DNA, 25 bp, Mus musculus
gtcgtctgcttttttatacacattt

SEQ ID NO: 689236 - DNA, 25 bp, Mus musculus
gtcgtcttcgatatgccagaggagt

SEQ ID NO: 689237 - DNA, 25 bp, Mus musculus
gtcgtcttcgatttgccagaggagt

SEQ ID NO: 689238 - DNA, 25 bp, Mus musculus
gtcgtgacattaatatgcaattagc

SEQ ID NO: 689239 - DNA, 25 bp, Mus musculus
gtcgtgacattattatgcaattagc

SEQ ID NO: 689240 - DNA, 25 bp, Mus musculus
gtcgtgacccaaattactctggtaa

SEQ ID NO: 689241 - DNA, 25 bp, Mus musculus
gtcgtgacccaatttactctggtaa

SEQ ID NO: 689242 - DNA, 25 bp, Mus musculus
gtcgtgacggtcactgcagactttg

SEQ ID NO: 689243 - DNA, 25 bp, Mus musculus
gtcgtgacggtctctgcagactttg

SEQ ID NO: 689244 - DNA, 25 bp, Mus musculus
gtcgtgactcagaacttccaggacc

SEQ ID NO: 689245 - DNA, 25 bp, Mus musculus
gtcgtgactcagtacttccaggacc

SEQ ID NO: 689246 - DNA, 25 bp, Mus musculus
gtcgtgactcttctggttgctaaaa

SEQ ID NO: 689247 - DNA, 25 bp, Mus musculus
gtcgtgactcttgtggttgctaaaa

SEQ ID NO: 689248 - DNA, 25 bp, Mus musculus
gtcgtgagacccctggtttgaatgt

SEQ ID NO: 689249 - DNA, 25 bp, Mus musculus
gtcgtgagacccgtggtttgaatgt

SEQ ID NO: 689250 - DNA, 25 bp, Mus musculus
gtcgtgcaaacaagatacccaacta

SEQ ID NO: 689251 - DNA, 25 bp, Mus musculus
gtcgtgcaaacatgatacccaacta

SEQ ID NO: 689252 - DNA, 25 bp, Mus musculus
gtcgtgcatgataaggattgtgttt

SEQ ID NO: 689253 - DNA, 25 bp, Mus musculus
gtcgtgcatgattaggattgtgttt

SEQ ID NO: 689254 - DNA, 25 bp, Mus musculus
gtcgtgcatgggatctagtgtttca

SEQ ID NO: 689255 - DNA, 25 bp, Mus musculus
gtcgtgcatgggttctagtgtttca

SEQ ID NO: 689256 - DNA, 25 bp, Mus musculus
gtcgtgccagtccttcagaaagtga

SEQ ID NO: 689257 - DNA, 25 bp, Mus musculus
gtcgtgccagtcgttcagaaagtga

SEQ ID NO: 689258 - DNA, 25 bp, Mus musculus
gtcgtgccctgtacttttatatgga

SEQ ID NO: 689259 - DNA, 25 bp, Mus musculus
gtcgtgccctgttcttttatatgga

SEQ ID NO: 689260 - DNA, 25 bp, Mus musculus
gtcgtgccgggaaggagtcctccac

SEQ ID NO: 689261 - DNA, 25 bp, Mus musculus
gtcgtgccgggatggagtcctccac

SEQ ID NO: 689262 - DNA, 25 bp, Mus musculus
gtcgtgcctgggatgtgttagccaa

SEQ ID NO: 689263 - DNA, 25 bp, Mus musculus
gtcgtgcctgggttgtgttagccaa

SEQ ID NO: 689264 - DNA, 25 bp, Mus musculus
gtcgtgctgctcagctgggtcaagt

SEQ ID NO: 689265 - DNA, 25 bp, Mus musculus
gtcgtgctgctctgctgggtcaagt

SEQ ID NO: 689266 - DNA, 25 bp, Mus musculus
gtcgtgcttattaatggcggtagaa

SEQ ID NO: 689267 - DNA, 25 bp, Mus musculus
gtcgtgcttatttatggcggtagaa

SEQ ID NO: 689268 - DNA, 25 bp, Mus musculus
gtcgtggaactcaagaatgacctga

SEQ ID NO: 689269 - DNA, 25 bp, Mus musculus
gtcgtggaactctagaatgacctga

SEQ ID NO: 689270 - DNA, 25 bp, Mus musculus
gtcgtggactgcaagaaggaagctt

SEQ ID NO: 689271 - DNA, 25 bp, Mus musculus
gtcgtggactgctagaaggaagctt

SEQ ID NO: 689272 - DNA, 25 bp, Mus musculus
gtcgtggcttctatgtcgcctggga

SEQ ID NO: 689273 - DNA, 25 bp, Mus musculus
gtcgtggcttctttgtcgcctggga

SEQ ID NO: 689274 - DNA, 25 bp, Mus musculus
gtcgtgggcttcctgtttgcagtat

SEQ ID NO: 689275 - DNA, 25 bp, Mus musculus
gtcgtgggcttcgtgtttgcagtat

SEQ ID NO: 689276 - DNA, 25 bp, Mus musculus
gtcgtgtaatacctcacagccaata

SEQ ID NO: 689277 - DNA, 25 bp, Mus musculus
gtcgtgtaatacgtcacagccaata

SEQ ID NO: 689278 - DNA, 25 bp, Mus musculus
gtcgtgtaggagatttcctggacca

SEQ ID NO: 689279 - DNA, 25 bp, Mus musculus
gtcgtgtaggagttttcctggacca

SEQ ID NO: 689280 - DNA, 25 bp, Mus musculus
gtcgtgtccataacttttgttttga

SEQ ID NO: 689281 - DNA, 25 bp, Mus musculus
gtcgtgtccatatcttttgttttga

SEQ ID NO: 689282 - DNA, 25 bp, Mus musculus
gtcgtgtctcttaagttgcctttaa

SEQ ID NO: 689283 - DNA, 25 bp, Mus musculus
gtcgtgtctctttagttgcctttaa

SEQ ID NO: 689284 - DNA, 25 bp, Mus musculus
gtcgtgtgagcactataaaactaca

SEQ ID NO: 689285 - DNA, 25 bp, Mus musculus
gtcgtgtgagcagtataaaactaca

SEQ ID NO: 689286 - DNA, 25 bp, Mus musculus
gtcgtgtgtacgacacctggtgtag

SEQ ID NO: 689287 - DNA, 25 bp, Mus musculus
gtcgtgtgtacgtcacctggtgtag

SEQ ID NO: 689288 - DNA, 25 bp, Mus musculus
gtcgtgtgtgtaacatttttctcct

SEQ ID NO: 689289 - DNA, 25 bp, Mus musculus
gtcgtgtgtgtatcatttttctcct

SEQ ID NO: 689290 - DNA, 25 bp, Mus musculus
gtcgtgttggaaaccttggccttgc

SEQ ID NO: 689291 - DNA, 25 bp, Mus musculus
gtcgtgttggaatccttggccttgc

SEQ ID NO: 689292 - DNA, 25 bp, Mus musculus
gtcgtgtttccacccggtgcacgta

SEQ ID NO: 689293 - DNA, 25 bp, Mus musculus
gtcgtgtttccagccggtgcacgta

SEQ ID NO: 689294 - DNA, 25 bp, Mus musculus
gtcgtgtttccgcaacatgctgata

SEQ ID NO: 689295 - DNA, 25 bp, Mus musculus
gtcgtgtttccggaacatgctgata

SEQ ID NO: 689296 - DNA, 25 bp, Mus musculus
gtcgtgtttgggaacaagtgaccaa

SEQ ID NO: 689297 - DNA, 25 bp, Mus musculus
gtcgtgtttgggtacaagtgaccaa

SEQ ID NO: 689298 - DNA, 25 bp, Mus musculus
gtcgttaacaagaccatctttgcta

SEQ ID NO: 689299 - DNA, 25 bp, Mus musculus
gtcgttaacaagtccatctttgcta

SEQ ID NO: 689300 - DNA, 25 bp, Mus musculus
gtcgttacaatgcacagtatagaca

SEQ ID NO: 689301 - DNA, 25 bp, Mus musculus
gtcgttacaatggacagtatagaca

SEQ ID NO: 689302 - DNA, 25 bp, Mus musculus
gtcgttacagaccagaaaccatgtt

SEQ ID NO: 689303 - DNA, 25 bp, Mus musculus
gtcgttacagacgagaaaccatgtt

SEQ ID NO: 689304 - DNA, 25 bp, Mus musculus
gtcgttacagatctgacctcaaact

SEQ ID NO: 689305 - DNA, 25 bp, Mus musculus
gtcgttacagatgtgacctcaaact

SEQ ID NO: 689306 - DNA, 25 bp, Mus musculus
gtcgttacgcttagcataatgtata

SEQ ID NO: 689307 - DNA, 25 bp, Mus musculus
gtcgttacgctttgcataatgtata

SEQ ID NO: 689308 - DNA, 25 bp, Mus musculus
gtcgttagtcctcagtgacagataa

SEQ ID NO: 689309 - DNA, 25 bp, Mus musculus
gtcgttagtcctgagtgacagataa

SEQ ID NO: 689310 - DNA, 25 bp, Mus musculus
gtcgttattcgcacaaggttctcgt

SEQ ID NO: 689311 - DNA, 25 bp, Mus musculus
gtcgttattcgctcaaggttctcgt

SEQ ID NO: 689312 - DNA, 25 bp, Mus musculus
gtcgttatttggatatgtcttggtt

SEQ ID NO: 689313 - DNA, 25 bp, Mus musculus
gtcgttatttggttatgtcttggtt

SEQ ID NO: 689314 - DNA, 25 bp, Mus musculus
gtcgttcaacctctgtgcttcgaag

SEQ ID NO: 689315 - DNA, 25 bp, Mus musculus
gtcgttcaacctgtgtgcttcgaag

SEQ ID NO: 689316 - DNA, 25 bp, Mus musculus
gtcgttcacctgcttgttggatagc

SEQ ID NO: 689317 - DNA, 25 bp, Mus musculus
gtcgttcacctggttgttggatagc

SEQ ID NO: 689318 - DNA, 25 bp, Mus musculus
gtcgttcactgtaaattagtcctgt

SEQ ID NO: 689319 - DNA, 25 bp, Mus musculus
gtcgttcactgttaattagtcctgt

SEQ ID NO: 689320 - DNA, 25 bp, Mus musculus
gtcgttcagagccagcatgagcaca

SEQ ID NO: 689321 - DNA, 25 bp, Mus musculus
gtcgttcagagcgagcatgagcaca

SEQ ID NO: 689322 - DNA, 25 bp, Mus musculus
gtcgttccaaaacatgatgctcttt

SEQ ID NO: 689323 - DNA, 25 bp, Mus musculus
gtcgttccaaaagatgatgctcttt

SEQ ID NO: 689324 - DNA, 25 bp, Mus musculus
gtcgttccagcactctttcaaagga

SEQ ID NO: 689325 - DNA, 25 bp, Mus musculus
gtcgttccagcagtctttcaaagga

SEQ ID NO: 689326 - DNA, 25 bp, Mus musculus
gtcgttctcaccctagggagcaaat

SEQ ID NO: 689327 - DNA, 25 bp, Mus musculus
gtcgttctcaccgtagggagcaaat

SEQ ID NO: 689328 - DNA, 25 bp, Mus musculus
gtcgttctcggtattaccactgtaa

SEQ ID NO: 689329 - DNA, 25 bp, Mus musculus
gtcgttctcggttttaccactgtaa

SEQ ID NO: 689330 - DNA, 25 bp, Mus musculus
gtcgttgactaaccacttcactggg

SEQ ID NO: 689331 - DNA, 25 bp, Mus musculus
gtcgttgactaagcacttcactggg

SEQ ID NO: 689332 - DNA, 25 bp, Mus musculus
gtcgttgatgttaggttcggtattc

SEQ ID NO: 689333 - DNA, 25 bp, Mus musculus
gtcgttgatgtttggttcggtattc

SEQ ID NO: 689334 - DNA, 25 bp, Mus musculus
gtcgttgcactgcattcgctgcgtt

SEQ ID NO: 689335 - DNA, 25 bp, Mus musculus
gtcgttgcactggattcgctgcgtt

SEQ ID NO: 689336 - DNA, 25 bp, Mus musculus
gtcgttggcaaacctgggatatttc

SEQ ID NO: 689337 - DNA, 25 bp, Mus musculus
gtcgttggcaaagctgggatatttc

SEQ ID NO: 689338 - DNA, 25 bp, Mus musculus
gtcgttggtcacatttgtactgtat

SEQ ID NO: 689339 - DNA, 25 bp, Mus musculus
gtcgttggtcacttttgtactgtat

SEQ ID NO: 689340 - DNA, 25 bp, Mus musculus
gtcgttgtcatgatatcagaaccag

SEQ ID NO: 689341 - DNA, 25 bp, Mus musculus
gtcgttgtcatgttatcagaaccag

SEQ ID NO: 689342 - DNA, 25 bp, Mus musculus
gtcgtttacagacgcctccagggag

SEQ ID NO: 689343 - DNA, 25 bp, Mus musculus
gtcgtttacagaggcctccagggag

SEQ ID NO: 689344 - DNA, 25 bp, Mus musculus
gtcgtttatccgatccgaggataca

SEQ ID NO: 689345 - DNA, 25 bp, Mus musculus
gtcgtttatccgttccgaggataca

SEQ ID NO: 689346 - DNA, 25 bp, Mus musculus
gtcgtttctaatctgcttaactgta

SEQ ID NO: 689347 - DNA, 25 bp, Mus musculus
gtcgtttctaatgtgcttaactgta

SEQ ID NO: 689348 - DNA, 25 bp, Mus musculus
gtcgtttctcctaactttactgctt

SEQ ID NO: 689349 - DNA, 25 bp, Mus musculus
gtcgtttctccttactttactgctt

SEQ ID NO: 689350 - DNA, 25 bp, Mus musculus
gtcgtttgcatactctctgttgttc

SEQ ID NO: 689351 - DNA, 25 bp, Mus musculus
gtcgtttgcatagtctctgttgttc

SEQ ID NO: 689352 - DNA, 25 bp, Mus musculus
gtcgtttggaaaatcgggccagtct

SEQ ID NO: 689353 - DNA, 25 bp, Mus musculus
gtcgtttggaaattcgggccagtct

SEQ ID NO: 689354 - DNA, 25 bp, Mus musculus
gtcgttttggttcaattcaattcag

SEQ ID NO: 689355 - DNA, 25 bp, Mus musculus
gtcgttttggttgaattcaattcag

SEQ ID NO: 689356 - DNA, 25 bp, Mus musculus
gtcgtttttcagactatagtcagca

SEQ ID NO: 689357 - DNA, 25 bp, Mus musculus
gtcgtttttcagtctatagtcagca

SEQ ID NO: 689358 - DNA, 25 bp, Mus musculus
gtctaaaaaccacgatttcttggtg

SEQ ID NO: 689359 - DNA, 25 bp, Mus musculus
gtctaaaaaccaggatttcttggtg

SEQ ID NO: 689360 - DNA, 25 bp, Mus musculus
gtctaaaacagtcgtagcctttact

SEQ ID NO: 689361 - DNA, 25 bp, Mus musculus
gtctaaaacagtggtagcctttact

SEQ ID NO: 689362 - DNA, 25 bp, Mus musculus
gtctaaaagttacttaccatgctac

SEQ ID NO: 689363 - DNA, 25 bp, Mus musculus
gtctaaaagttagttaccatgctac

SEQ ID NO: 689364 - DNA, 25 bp, Mus musculus
gtctaaaatcacatggagtcctaaa

SEQ ID NO: 689365 - DNA, 25 bp, Mus musculus
gtctaaaatcacttggagtcctaaa

SEQ ID NO: 689366 - DNA, 25 bp, Mus musculus
gtctaaaatgccaccgtgtatttgt

SEQ ID NO: 689367 - DNA, 25 bp, Mus musculus
gtctaaaatgcctccgtgtatttgt

SEQ ID NO: 689368 - DNA, 25 bp, Mus musculus
gtctaaacaatacgacggactccgc

SEQ ID NO: 689369 - DNA, 25 bp, Mus musculus
gtctaaacaataggacggactccgc

SEQ ID NO: 689370 - DNA, 25 bp, Mus musculus
gtctaaacatgtagtgcgggctata

SEQ ID NO: 689371 - DNA, 25 bp, Mus musculus
gtctaaacatgttgtgcgggctata

SEQ ID NO: 689372 - DNA, 25 bp, Mus musculus
gtctaaacttaaagtggtgcaccac

SEQ ID NO: 689373 - DNA, 25 bp, Mus musculus
gtctaaacttaatgtggtgcaccac

SEQ ID NO: 689374 - DNA, 25 bp, Mus musculus
gtctaaagcaacatctgtgatcagt

SEQ ID NO: 689375 - DNA, 25 bp, Mus musculus
gtctaaagcaacttctgtgatcagt

SEQ ID NO: 689376 - DNA, 25 bp, Mus musculus
gtctaaaggtacagacttccaggtg

SEQ ID NO: 689377 - DNA, 25 bp, Mus musculus
gtctaaaggtactgacttccaggtg

SEQ ID NO: 689378 - DNA, 25 bp, Mus musculus
gtctaaagtgataatcttcccctcc

SEQ ID NO: 689379 - DNA, 25 bp, Mus musculus
gtctaaagtgattatcttcccctcc

SEQ ID NO: 689380 - DNA, 25 bp, Mus musculus
gtctaaagtggcagtgatgtctaca

SEQ ID NO: 689381 - DNA, 25 bp, Mus musculus
gtctaaagtggctgtgatgtctaca

SEQ ID NO: 689382 - DNA, 25 bp, Mus musculus
gtctaaatccccagttgacagctct

SEQ ID NO: 689383 - DNA, 25 bp, Mus musculus
gtctaaatcccctgttgacagctct

SEQ ID NO: 689384 - DNA, 25 bp, Mus musculus
gtctaaatctgaacaccgtgctagt

SEQ ID NO: 689385 - DNA, 25 bp, Mus musculus
gtctaaatctgatcaccgtgctagt

SEQ ID NO: 689386 - DNA, 25 bp, Mus musculus
gtctaaatgccaagaatgccccatc

SEQ ID NO: 689387 - DNA, 25 bp, Mus musculus
gtctaaatgccatgaatgccccatc

SEQ ID NO: 689388 - DNA, 25 bp, Mus musculus
gtctaaatgttgatgtacctgggta

SEQ ID NO: 689389 - DNA, 25 bp, Mus musculus
gtctaaatgttgttgtacctgggta

SEQ ID NO: 689390 - DNA, 25 bp, Mus musculus
gtctaacaacttatttctgagtgat

SEQ ID NO: 689391 - DNA, 25 bp, Mus musculus
gtctaacaacttttttctgagtgat

SEQ ID NO: 689392 - DNA, 25 bp, Mus musculus
gtctaacaggacactgtgccatcct

SEQ ID NO: 689393 - DNA, 25 bp, Mus musculus
gtctaacaggactctgtgccatcct

SEQ ID NO: 689394 - DNA, 25 bp, Mus musculus
gtctaacagttcaacacttcttgga

SEQ ID NO: 689395 - DNA, 25 bp, Mus musculus
gtctaacagttctacacttcttgga

SEQ ID NO: 689396 - DNA, 25 bp, Mus musculus
gtctaacatattacaaaggctgttt

SEQ ID NO: 689397 - DNA, 25 bp, Mus musculus
gtctaacatatttcaaaggctgttt

SEQ ID NO: 689398 - DNA, 25 bp, Mus musculus
gtctaacatgccaatatttggtgga

SEQ ID NO: 689399 - DNA, 25 bp, Mus musculus
gtctaacatgcctatatttggtgga

SEQ ID NO: 689400 - DNA, 25 bp, Mus musculus
gtctaacattttccctcctcttttt

SEQ ID NO: 689401 - DNA, 25 bp, Mus musculus
gtctaacattttgcctcctcttttt

SEQ ID NO: 689402 - DNA, 25 bp, Mus musculus
gtctaaccaaatccatcaatcctgt

SEQ ID NO: 689403 - DNA, 25 bp, Mus musculus
gtctaaccaaatgcatcaatcctgt

SEQ ID NO: 689404 - DNA, 25 bp, Mus musculus
gtctaaccagatctgagctccaggt

SEQ ID NO: 689405 - DNA, 25 bp, Mus musculus
gtctaaccagatgtgagctccaggt

SEQ ID NO: 689406 - DNA, 25 bp, Mus musculus
gtctaaccaggcatgccatcataaa

SEQ ID NO: 689407 - DNA, 25 bp, Mus musculus
gtctaaccaggcttgccatcataaa

SEQ ID NO: 689408 - DNA, 25 bp, Mus musculus
gtctaaccatacaccagcattgcat

SEQ ID NO: 689409 - DNA, 25 bp, Mus musculus
gtctaaccatactccagcattgcat

SEQ ID NO: 689410 - DNA, 25 bp, Mus musculus
gtctaaccatgcctgtgcttggtaa

SEQ ID NO: 689411 - DNA, 25 bp, Mus musculus
gtctaaccatgcgtgtgcttggtaa

SEQ ID NO: 689412 - DNA, 25 bp, Mus musculus
gtctaacctcagactgttagtccca

SEQ ID NO: 689413 - DNA, 25 bp, Mus musculus
gtctaacctcagtctgttagtccca

SEQ ID NO: 689414 - DNA, 25 bp, Mus musculus
gtctaacctcatagtccataactga

SEQ ID NO: 689415 - DNA, 25 bp, Mus musculus
gtctaacctcattgtccataactga

SEQ ID NO: 689416 - DNA, 25 bp, Mus musculus
gtctaacctgggaaaccagtgccca

SEQ ID NO: 689417 - DNA, 25 bp, Mus musculus
gtctaacctgggtaaccagtgccca

SEQ ID NO: 689418 - DNA, 25 bp, Mus musculus
gtctaaccttatcttggacccaaga

SEQ ID NO: 689419 - DNA, 25 bp, Mus musculus
gtctaaccttatgttggacccaaga

SEQ ID NO: 689420 - DNA, 25 bp, Mus musculus
gtctaacgagctcctgtaactggtt

SEQ ID NO: 689421 - DNA, 25 bp, Mus musculus
gtctaacgagctgctgtaactggtt

SEQ ID NO: 689422 - DNA, 25 bp, Mus musculus
gtctaacgagggaatcccagctaag

SEQ ID NO: 689423 - DNA, 25 bp, Mus musculus
gtctaacgagggtatcccagctaag

SEQ ID NO: 689424 - DNA, 25 bp, Mus musculus
gtctaacgggctacaaggcaactat

SEQ ID NO: 689425 - DNA, 25 bp, Mus musculus
gtctaacgggcttcaaggcaactat

SEQ ID NO: 689426 - DNA, 25 bp, Mus musculus
gtctaacgttacactgaaacccaga

SEQ ID NO: 689427 - DNA, 25 bp, Mus musculus
gtctaacgttactctgaaacccaga

SEQ ID NO: 689428 - DNA, 25 bp, Mus musculus
gtctaactaagcattaagggatcct

SEQ ID NO: 689429 - DNA, 25 bp, Mus musculus
gtctaactaagctttaagggatcct

SEQ ID NO: 689430 - DNA, 25 bp, Mus musculus
gtctaactagacatatgcaggctgt

SEQ ID NO: 689431 - DNA, 25 bp, Mus musculus
gtctaactagacttatgcaggctgt

SEQ ID NO: 689432 - DNA, 25 bp, Mus musculus
gtctaactcccacgagatcaaactc

SEQ ID NO: 689433 - DNA, 25 bp, Mus musculus
gtctaactcccaggagatcaaactc

SEQ ID NO: 689434 - DNA, 25 bp, Mus musculus
gtctaactcctgcactacagtggac

SEQ ID NO: 689435 - DNA, 25 bp, Mus musculus
gtctaactcctggactacagtggac

SEQ ID NO: 689436 - DNA, 25 bp, Mus musculus
gtctaactggtgaccctatgaccaa

SEQ ID NO: 689437 - DNA, 25 bp, Mus musculus
gtctaactggtgtccctatgaccaa

SEQ ID NO: 689438 - DNA, 25 bp, Mus musculus
gtctaacttcagaggtgaccatgtt

SEQ ID NO: 689439 - DNA, 25 bp, Mus musculus
gtctaacttcagtggtgaccatgtt

SEQ ID NO: 689440 - DNA, 25 bp, Mus musculus
gtctaacttcatcagcagcacaggg

SEQ ID NO: 689441 - DNA, 25 bp, Mus musculus
gtctaacttcatgagcagcacaggg

SEQ ID NO: 689442 - DNA, 25 bp, Mus musculus
gtctaagaactaagtccattccctt

SEQ ID NO: 689443 - DNA, 25 bp, Mus musculus
gtctaagaactatgtccattccctt

SEQ ID NO: 689444 - DNA, 25 bp, Mus musculus
gtctaagaatccacatcttcaccct

SEQ ID NO: 689445 - DNA, 25 bp, Mus musculus
gtctaagaatcctcatcttcaccct

SEQ ID NO: 689446 - DNA, 25 bp, Mus musculus
gtctaagaccggaatacctctcaat

SEQ ID NO: 689447 - DNA, 25 bp, Mus musculus
gtctaagaccggtatacctctcaat

SEQ ID NO: 689448 - DNA, 25 bp, Mus musculus
gtctaagactgaattgcatactcat

SEQ ID NO: 689449 - DNA, 25 bp, Mus musculus
gtctaagactgacatgcactcctct

SEQ ID NO: 689450 - DNA, 25 bp, Mus musculus
gtctaagactgagatgcactcctct

SEQ ID NO: 689451 - DNA, 25 bp, Mus musculus
gtctaagactgatttgcatactcat

SEQ ID NO: 689452 - DNA, 25 bp, Mus musculus
gtctaagaggatatccaggttattt

SEQ ID NO: 689453 - DNA, 25 bp, Mus musculus
gtctaagaggatttccaggttattt

SEQ ID NO: 689454 - DNA, 25 bp, Mus musculus
gtctaagcactcatgattttatact

SEQ ID NO: 689455 - DNA, 25 bp, Mus musculus
gtctaagcactcttgattttatact

SEQ ID NO: 689456 - DNA, 25 bp, Mus musculus
gtctaagcagcgatgggttcagtgt

SEQ ID NO: 689457 - DNA, 25 bp, Mus musculus
gtctaagcagcgttgggttcagtgt

SEQ ID NO: 689458 - DNA, 25 bp, Mus musculus
gtctaagcatttatcacggcacaag

SEQ ID NO: 689459 - DNA, 25 bp, Mus musculus
gtctaagcatttttcacggcacaag

SEQ ID NO: 689460 - DNA, 25 bp, Mus musculus
gtctaagccaagcatctttgacagt

SEQ ID NO: 689461 - DNA, 25 bp, Mus musculus
gtctaagccaaggatctttgacagt

SEQ ID NO: 689462 - DNA, 25 bp, Mus musculus
gtctaagcccagctccttcataaaa

SEQ ID NO: 689463 - DNA, 25 bp, Mus musculus
gtctaagcccaggtccttcataaaa

SEQ ID NO: 689464 - DNA, 25 bp, Mus musculus
gtctaagccgagcaggtgacagtta

SEQ ID NO: 689465 - DNA, 25 bp, Mus musculus
gtctaagccgaggaggtgacagtta

SEQ ID NO: 689466 - DNA, 25 bp, Mus musculus
gtctaagcgagaatcagccaccagc

SEQ ID NO: 689467 - DNA, 25 bp, Mus musculus
gtctaagcgagattcagccaccagc

SEQ ID NO: 689468 - DNA, 25 bp, Mus musculus
gtctaagctaaaccagcatgagcat

SEQ ID NO: 689469 - DNA, 25 bp, Mus musculus
gtctaagctaaagcagcatgagcat

SEQ ID NO: 689470 - DNA, 25 bp, Mus musculus
gtctaagcttacagcaaggcctatg

SEQ ID NO: 689471 - DNA, 25 bp, Mus musculus
gtctaagcttactgcaaggcctatg

SEQ ID NO: 689472 - DNA, 25 bp, Mus musculus
gtctaagggagcatgcctctatagc

SEQ ID NO: 689473 - DNA, 25 bp, Mus musculus
gtctaagggagcttgcctctatagc

SEQ ID NO: 689474 - DNA, 25 bp, Mus musculus
gtctaagggctaaggttttgtgaaa

SEQ ID NO: 689475 - DNA, 25 bp, Mus musculus
gtctaagggctatggttttgtgaaa

SEQ ID NO: 689476 - DNA, 25 bp, Mus musculus
gtctaagggctcattttccacatta

SEQ ID NO: 689477 - DNA, 25 bp, Mus musculus
gtctaagggctctttttccacatta

SEQ ID NO: 689478 - DNA, 25 bp, Mus musculus
gtctaagggctgcattatatatcca

SEQ ID NO: 689479 - DNA, 25 bp, Mus musculus
gtctaagggctggattatatatcca

SEQ ID NO: 689480 - DNA, 25 bp, Mus musculus
gtctaagggtcacaggagcttgaat

SEQ ID NO: 689481 - DNA, 25 bp, Mus musculus
gtctaagggtcagaggagcttgaat

SEQ ID NO: 689482 - DNA, 25 bp, Mus musculus
gtctaaggttgtacaggttttctga

SEQ ID NO: 689483 - DNA, 25 bp, Mus musculus
gtctaaggttgttcaggttttctga

SEQ ID NO: 689484 - DNA, 25 bp, Mus musculus
gtctaagtaagccagctgacctcta

SEQ ID NO: 689485 - DNA, 25 bp, Mus musculus
gtctaagtaagcgagctgacctcta

SEQ ID NO: 689486 - DNA, 25 bp, Mus musculus
gtctaagtactgaggactgtgtgac

SEQ ID NO: 689487 - DNA, 25 bp, Mus musculus
gtctaagtactgtggactgtgtgac

SEQ ID NO: 689488 - DNA, 25 bp, Mus musculus
gtctaagtatgcctcagtgggttga

SEQ ID NO: 689489 - DNA, 25 bp, Mus musculus
gtctaagtatgcgtcagtgggttga

SEQ ID NO: 689490 - DNA, 25 bp, Mus musculus
gtctaagtcagtcatggttcagtaa

SEQ ID NO: 689491 - DNA, 25 bp, Mus musculus
gtctaagtcagtgatggttcagtaa

SEQ ID NO: 689492 - DNA, 25 bp, Mus musculus
gtctaagtccagcttcttagtccta

SEQ ID NO: 689493 - DNA, 25 bp, Mus musculus
gtctaagtccaggttcttagtccta

SEQ ID NO: 689494 - DNA, 25 bp, Mus musculus
gtctaagtcccgatcaaggtagtat

SEQ ID NO: 689495 - DNA, 25 bp, Mus musculus
gtctaagtcccgttcaaggtagtat

SEQ ID NO: 689496 - DNA, 25 bp, Mus musculus
gtctaagttagcaagtgttttctgt

SEQ ID NO: 689497 - DNA, 25 bp, Mus musculus
gtctaagttagctagtgttttctgt

SEQ ID NO: 689498 - DNA, 25 bp, Mus musculus
gtctaataatcaacatgctctagat

SEQ ID NO: 689499 - DNA, 25 bp, Mus musculus
gtctaataatcatcatgctctagat

SEQ ID NO: 689500 - DNA, 25 bp, Mus musculus
gtctaatacagcagtttcacacctt

SEQ ID NO: 689501 - DNA, 25 bp, Mus musculus
gtctaatacagctgtttcacacctt

SEQ ID NO: 689502 - DNA, 25 bp, Mus musculus
gtctaatactatagacccatctggg

SEQ ID NO: 689503 - DNA, 25 bp, Mus musculus
gtctaatactattgacccatctggg

SEQ ID NO: 689504 - DNA, 25 bp, Mus musculus
gtctaatactgaaggcccagtctgg

SEQ ID NO: 689505 - DNA, 25 bp, Mus musculus
gtctaatactgatggcccagtctgg

SEQ ID NO: 689506 - DNA, 25 bp, Mus musculus
gtctaatagactcttttgcaataat

SEQ ID NO: 689507 - DNA, 25 bp, Mus musculus
gtctaatagactgttttgcaataat

SEQ ID NO: 689508 - DNA, 25 bp, Mus musculus
gtctaatatgtcatggcttagtgtt

SEQ ID NO: 689509 - DNA, 25 bp, Mus musculus
gtctaatatgtcttggcttagtgtt

SEQ ID NO: 689510 - DNA, 25 bp, Mus musculus
gtctaatattaacagacatgggacc

SEQ ID NO: 689511 - DNA, 25 bp, Mus musculus
gtctaatattaagagacatgggacc

SEQ ID NO: 689512 - DNA, 25 bp, Mus musculus
gtctaatcattgcacccaagcctgg

SEQ ID NO: 689513 - DNA, 25 bp, Mus musculus
gtctaatcattggacccaagcctgg

SEQ ID NO: 689514 - DNA, 25 bp, Mus musculus
gtctaatcccaccagcgagaaaact

SEQ ID NO: 689515 - DNA, 25 bp, Mus musculus
gtctaatcccacgagcgagaaaact

SEQ ID NO: 689516 - DNA, 25 bp, Mus musculus
gtctaatcctcaagcccattgtcag

SEQ ID NO: 689517 - DNA, 25 bp, Mus musculus
gtctaatcctcatgcccattgtcag

SEQ ID NO: 689518 - DNA, 25 bp, Mus musculus
gtctaatgaactccaaccatcagcg

SEQ ID NO: 689519 - DNA, 25 bp, Mus musculus
gtctaatgaactgcaaccatcagcg

SEQ ID NO: 689520 - DNA, 25 bp, Mus musculus
gtctaatgagcaatgttaagcatct

SEQ ID NO: 689521 - DNA, 25 bp, Mus musculus
gtctaatgagcattgttaagcatct

SEQ ID NO: 689522 - DNA, 25 bp, Mus musculus
gtctaatgcctgcaagagccctaat

SEQ ID NO: 689523 - DNA, 25 bp, Mus musculus
gtctaatgcctggaagagccctaat

SEQ ID NO: 689524 - DNA, 25 bp, Mus musculus
gtctaatgccttatttggtattgtt

SEQ ID NO: 689525 - DNA, 25 bp, Mus musculus
gtctaatgccttttttggtattgtt

SEQ ID NO: 689526 - DNA, 25 bp, Mus musculus
gtctaatggctgagatttaggacaa

SEQ ID NO: 689527 - DNA, 25 bp, Mus musculus
gtctaatggctgtgatttaggacaa

SEQ ID NO: 689528 - DNA, 25 bp, Mus musculus
gtctaatgggtcagtgtagcttcca

SEQ ID NO: 689529 - DNA, 25 bp, Mus musculus
gtctaatgggtctgtgtagcttcca

SEQ ID NO: 689530 - DNA, 25 bp, Mus musculus
gtctaatggtgaacgcccacctttg

SEQ ID NO: 689531 - DNA, 25 bp, Mus musculus
gtctaatggtgacctgggtgtccac

SEQ ID NO: 689532 - DNA, 25 bp, Mus musculus
gtctaatggtgagctgggtgtccac

SEQ ID NO: 689533 - DNA, 25 bp, Mus musculus
gtctaatggtgatcgcccacctttg

SEQ ID NO: 689534 - DNA, 25 bp, Mus musculus
gtctaatggttcatcgtcagccaag

SEQ ID NO: 689535 - DNA, 25 bp, Mus musculus
gtctaatggttcttcgtcagccaag

SEQ ID NO: 689536 - DNA, 25 bp, Mus musculus
gtctaatgtccaacaagcccatatg

SEQ ID NO: 689537 - DNA, 25 bp, Mus musculus
gtctaatgtccatcaagcccatatg

SEQ ID NO: 689538 - DNA, 25 bp, Mus musculus
gtctaattactgctgagactaatgg

SEQ ID NO: 689539 - DNA, 25 bp, Mus musculus
gtctaattactggtgagactaatgg

SEQ ID NO: 689540 - DNA, 25 bp, Mus musculus
gtctaattatttactcaaaggcata

SEQ ID NO: 689541 - DNA, 25 bp, Mus musculus
gtctaattattttctcaaaggcata

SEQ ID NO: 689542 - DNA, 25 bp, Mus musculus
gtctaattcattaactcaccatatt

SEQ ID NO: 689543 - DNA, 25 bp, Mus musculus
gtctaattcatttactcaccatatt

SEQ ID NO: 689544 - DNA, 25 bp, Mus musculus
gtctaattccccactggacaggagc

SEQ ID NO: 689545 - DNA, 25 bp, Mus musculus
gtctaattcccctctggacaggagc

SEQ ID NO: 689546 - DNA, 25 bp, Mus musculus
gtctaattctccataacacttcgtt

SEQ ID NO: 689547 - DNA, 25 bp, Mus musculus
gtctaattctccttaacacttcgtt

SEQ ID NO: 689548 - DNA, 25 bp, Mus musculus
gtctaattctttctcactggcggca

SEQ ID NO: 689549 - DNA, 25 bp, Mus musculus
gtctaattctttgtcactggcggca

SEQ ID NO: 689550 - DNA, 25 bp, Mus musculus
gtctaattgcataggagcaccccag

SEQ ID NO: 689551 - DNA, 25 bp, Mus musculus
gtctaattgcattggagcaccccag

SEQ ID NO: 689552 - DNA, 25 bp, Mus musculus
gtctaattgcccaatcagtgtttga

SEQ ID NO: 689553 - DNA, 25 bp, Mus musculus
gtctaattgccctatcagtgtttga

SEQ ID NO: 689554 - DNA, 25 bp, Mus musculus
gtctaatttattaactgtttcattt

SEQ ID NO: 689555 - DNA, 25 bp, Mus musculus
gtctaatttatttactgtttcattt

SEQ ID NO: 689556 - DNA, 25 bp, Mus musculus
gtctaatttcctcacggctttgata

SEQ ID NO: 689557 - DNA, 25 bp, Mus musculus
gtctaatttcctgacggctttgata

SEQ ID NO: 689558 - DNA, 25 bp, Mus musculus
gtctacaaaggaatgcgtggtcagc

SEQ ID NO: 689559 - DNA, 25 bp, Mus musculus
gtctacaaaggattgcgtggtcagc

SEQ ID NO: 689560 - DNA, 25 bp, Mus musculus
gtctacaaatgaaccctgtgtttcc

SEQ ID NO: 689561 - DNA, 25 bp, Mus musculus
gtctacaaatgatccctgtgtttcc

SEQ ID NO: 689562 - DNA, 25 bp, Mus musculus
gtctacaaatggcagtctgcaggaa

SEQ ID NO: 689563 - DNA, 25 bp, Mus musculus
gtctacaaatgggagtctgcaggaa

SEQ ID NO: 689564 - DNA, 25 bp, Mus musculus
gtctacaacaagcacaccaccatag

SEQ ID NO: 689565 - DNA, 25 bp, Mus musculus
gtctacaacaaggacaccaccatag

SEQ ID NO: 689566 - DNA, 25 bp, Mus musculus
gtctacaacattcatctggctgtca

SEQ ID NO: 689567 - DNA, 25 bp, Mus musculus
gtctacaacattgatctggctgtca

SEQ ID NO: 689568 - DNA, 25 bp, Mus musculus
gtctacaactacacctgtgaaccag

SEQ ID NO: 689569 - DNA, 25 bp, Mus musculus
gtctacaactactcctgtgaaccag

SEQ ID NO: 689570 - DNA, 25 bp, Mus musculus
gtctacaagcgcagtttagagagga

SEQ ID NO: 689571 - DNA, 25 bp, Mus musculus
gtctacaagcgctgtttagagagga

SEQ ID NO: 689572 - DNA, 25 bp, Mus musculus
gtctacaagttgatccttctgcatt

SEQ ID NO: 689573 - DNA, 25 bp, Mus musculus
gtctacaagttgttccttctgcatt

SEQ ID NO: 689574 - DNA, 25 bp, Mus musculus
gtctacaatcggatgacagaactgt

SEQ ID NO: 689575 - DNA, 25 bp, Mus musculus
gtctacaatcggttgacagaactgt

SEQ ID NO: 689576 - DNA, 25 bp, Mus musculus
gtctacaccaccagttccaaggaga

SEQ ID NO: 689577 - DNA, 25 bp, Mus musculus
gtctacaccacctgttccaaggaga

SEQ ID NO: 689578 - DNA, 25 bp, Mus musculus
gtctacacccggctcaagtcacggg

SEQ ID NO: 689579 - DNA, 25 bp, Mus musculus
gtctacacccgggtcaagtcacggg

SEQ ID NO: 689580 - DNA, 25 bp, Mus musculus
gtctacacgaagctccccaggaaca

SEQ ID NO: 689581 - DNA, 25 bp, Mus musculus
gtctacacgaaggtccccaggaaca

SEQ ID NO: 689582 - DNA, 25 bp, Mus musculus
gtctacactaaccatactagcagtt

SEQ ID NO: 689583 - DNA, 25 bp, Mus musculus
gtctacactaacgatactagcagtt

SEQ ID NO: 689584 - DNA, 25 bp, Mus musculus
gtctacactcagcagcaagctctaa

SEQ ID NO: 689585 - DNA, 25 bp, Mus musculus
gtctacactcaggagcaagctctaa

SEQ ID NO: 689586 - DNA, 25 bp, Mus musculus
gtctacactgagcatcttcctcaat

SEQ ID NO: 689587 - DNA, 25 bp, Mus musculus
gtctacactgaggatcttcctcaat

SEQ ID NO: 689588 - DNA, 25 bp, Mus musculus
gtctacactggaaacccactgagtc

SEQ ID NO: 689589 - DNA, 25 bp, Mus musculus
gtctacactggatacccactgagtc

SEQ ID NO: 689590 - DNA, 25 bp, Mus musculus
gtctacactgggagctgggttttct

SEQ ID NO: 689591 - DNA, 25 bp, Mus musculus
gtctacactgggtgctgggttttct

SEQ ID NO: 689592 - DNA, 25 bp, Mus musculus
gtctacacttcccaaaagccatgtc

SEQ ID NO: 689593 - DNA, 25 bp, Mus musculus
gtctacacttccgaaaagccatgtc

SEQ ID NO: 689594 - DNA, 25 bp, Mus musculus
gtctacacttctatttaccactgtc

SEQ ID NO: 689595 - DNA, 25 bp, Mus musculus
gtctacacttctttttaccactgtc

SEQ ID NO: 689596 - DNA, 25 bp, Mus musculus
gtctacagatcccacaaagttcttg

SEQ ID NO: 689597 - DNA, 25 bp, Mus musculus
gtctacagatccgacaaagttcttg

SEQ ID NO: 689598 - DNA, 25 bp, Mus musculus
gtctacagcacaatactgttcccag

SEQ ID NO: 689599 - DNA, 25 bp, Mus musculus
gtctacagcacattactgttcccag

SEQ ID NO: 689600 - DNA, 25 bp, Mus musculus
gtctacagctttcccctgagatgaa

SEQ ID NO: 689601 - DNA, 25 bp, Mus musculus
gtctacagctttgccctgagatgaa

SEQ ID NO: 689602 - DNA, 25 bp, Mus musculus
gtctacagggagcatcaaggcagtt

SEQ ID NO: 689603 - DNA, 25 bp, Mus musculus
gtctacagggaggatcaaggcagtt

SEQ ID NO: 689604 - DNA, 25 bp, Mus musculus
gtctacagtatgatcttgttctttc

SEQ ID NO: 689605 - DNA, 25 bp, Mus musculus
gtctacagtatgttcttgttctttc

SEQ ID NO: 689606 - DNA, 25 bp, Mus musculus
gtctacagtcagcaccgtgtacagg

SEQ ID NO: 689607 - DNA, 25 bp, Mus musculus
gtctacagtcaggaccgtgtacagg

SEQ ID NO: 689608 - DNA, 25 bp, Mus musculus
gtctacagtccacccatgggttaac

SEQ ID NO: 689609 - DNA, 25 bp, Mus musculus
gtctacagtccagccatgggttaac

SEQ ID NO: 689610 - DNA, 25 bp, Mus musculus
gtctacagttagattcaggtgagcc

SEQ ID NO: 689611 - DNA, 25 bp, Mus musculus
gtctacagttagtttcaggtgagcc

SEQ ID NO: 689612 - DNA, 25 bp, Mus musculus
gtctacagttgacgttgactatcct

SEQ ID NO: 689613 - DNA, 25 bp, Mus musculus
gtctacagttgaggttgactatcct

SEQ ID NO: 689614 - DNA, 25 bp, Mus musculus
gtctacataaacagctttatcttcc

SEQ ID NO: 689615 - DNA, 25 bp, Mus musculus
gtctacataaactgctttatcttcc

SEQ ID NO: 689616 - DNA, 25 bp, Mus musculus
gtctacataatgcttgctttcaagg

SEQ ID NO: 689617 - DNA, 25 bp, Mus musculus
gtctacataatggttgctttcaagg

SEQ ID NO: 689618 - DNA, 25 bp, Mus musculus
gtctacatcaagaaccatggcttcc

SEQ ID NO: 689619 - DNA, 25 bp, Mus musculus
gtctacatcaagtaccatggcttcc

SEQ ID NO: 689620 - DNA, 25 bp, Mus musculus
gtctacatcatcagtttagccacat

SEQ ID NO: 689621 - DNA, 25 bp, Mus musculus
gtctacatcatctgtttagccacat

SEQ ID NO: 689622 - DNA, 25 bp, Mus musculus
gtctacatccatctattactgctta

SEQ ID NO: 689623 - DNA, 25 bp, Mus musculus
gtctacatccatgtattactgctta

SEQ ID NO: 689624 - DNA, 25 bp, Mus musculus
gtctacatctgtcggctatttctaa

SEQ ID NO: 689625 - DNA, 25 bp, Mus musculus
gtctacatctgtgggctatttctaa

SEQ ID NO: 689626 - DNA, 25 bp, Mus musculus
gtctacatgcttatccacttatcaa

SEQ ID NO: 689627 - DNA, 25 bp, Mus musculus
gtctacatgcttttccacttatcaa

SEQ ID NO: 689628 - DNA, 25 bp, Mus musculus
gtctacatgggcatgttgggctact

SEQ ID NO: 689629 - DNA, 25 bp, Mus musculus
gtctacatgggcttgttgggctact

SEQ ID NO: 689630 - DNA, 25 bp, Mus musculus
gtctacatgtaaataaccaaggaaa

SEQ ID NO: 689631 - DNA, 25 bp, Mus musculus
gtctacatgtaattaaccaaggaaa

SEQ ID NO: 689632 - DNA, 25 bp, Mus musculus
gtctacatgtgtaccgagtctgttt

SEQ ID NO: 689633 - DNA, 25 bp, Mus musculus
gtctacatgtgttccgagtctgttt

SEQ ID NO: 689634 - DNA, 25 bp, Mus musculus
gtctacattggtaaagcctacataa

SEQ ID NO: 689635 - DNA, 25 bp, Mus musculus
gtctacattggttaagcctacataa

SEQ ID NO: 689636 - DNA, 25 bp, Mus musculus
gtctacatttggactatagtatcat

SEQ ID NO: 689637 - DNA, 25 bp, Mus musculus
gtctacatttggtctatagtatcat

SEQ ID NO: 689638 - DNA, 25 bp, Mus musculus
gtctacattttacacctgccaagtc

SEQ ID NO: 689639 - DNA, 25 bp, Mus musculus
gtctacattttagacctgccaagtc

SEQ ID NO: 689640 - DNA, 25 bp, Mus musculus
gtctaccaacgcctgtttgagtggg

SEQ ID NO: 689641 - DNA, 25 bp, Mus musculus
gtctaccaacgcgtgtttgagtggg

SEQ ID NO: 689642 - DNA, 25 bp, Mus musculus
gtctaccagactaactgagaacggg

SEQ ID NO: 689643 - DNA, 25 bp, Mus musculus
gtctaccagacttactgagaacggg

SEQ ID NO: 689644 - DNA, 25 bp, Mus musculus
gtctaccagagtcccagagcttgaa

SEQ ID NO: 689645 - DNA, 25 bp, Mus musculus
gtctaccagagtgccagagcttgaa

SEQ ID NO: 689646 - DNA, 25 bp, Mus musculus
gtctaccagcgaagctactgccgtc

SEQ ID NO: 689647 - DNA, 25 bp, Mus musculus
gtctaccagcgatgctactgccgtc

SEQ ID NO: 689648 - DNA, 25 bp, Mus musculus
gtctaccagctcctgagattttctg

SEQ ID NO: 689649 - DNA, 25 bp, Mus musculus
gtctaccagctcgtgagattttctg

SEQ ID NO: 689650 - DNA, 25 bp, Mus musculus
gtctaccagggtcgagcttgtacca

SEQ ID NO: 689651 - DNA, 25 bp, Mus musculus
gtctaccagggtggagcttgtacca

SEQ ID NO: 689652 - DNA, 25 bp, Mus musculus
gtctaccatacccaactggatgtct

SEQ ID NO: 689653 - DNA, 25 bp, Mus musculus
gtctaccataccgaactggatgtct

SEQ ID NO: 689654 - DNA, 25 bp, Mus musculus
gtctaccatagtagtggaatgccaa

SEQ ID NO: 689655 - DNA, 25 bp, Mus musculus
gtctaccatagttgtggaatgccaa

SEQ ID NO: 689656 - DNA, 25 bp, Mus musculus
gtctacccacaactacaagcattta

SEQ ID NO: 689657 - DNA, 25 bp, Mus musculus
gtctacccacaagtacaagcattta

SEQ ID NO: 689658 - DNA, 25 bp, Mus musculus
gtctacccacagcaggaggattttg

SEQ ID NO: 689659 - DNA, 25 bp, Mus musculus
gtctacccacaggaggaggattttg

SEQ ID NO: 689660 - DNA, 25 bp, Mus musculus
gtctaccccaacactagagtcttaa

SEQ ID NO: 689661 - DNA, 25 bp, Mus musculus
gtctaccccaactctagagtcttaa

SEQ ID NO: 689662 - DNA, 25 bp, Mus musculus
gtctaccccagactgtaaactgcct

SEQ ID NO: 689663 - DNA, 25 bp, Mus musculus
gtctaccccagagtgtaaactgcct

SEQ ID NO: 689664 - DNA, 25 bp, Mus musculus
gtctaccccaggatggcagagaact

SEQ ID NO: 689665 - DNA, 25 bp, Mus musculus
gtctaccccaggttggcagagaact

SEQ ID NO: 689666 - DNA, 25 bp, Mus musculus
gtctaccccggaccttatcatctat

SEQ ID NO: 689667 - DNA, 25 bp, Mus musculus
gtctaccccggagcttatcatctat

SEQ ID NO: 689668 - DNA, 25 bp, Mus musculus
gtctaccctaagaaccctgcatcct

SEQ ID NO: 689669 - DNA, 25 bp, Mus musculus
gtctaccctaagtaccctgcatcct

SEQ ID NO: 689670 - DNA, 25 bp, Mus musculus
gtctaccctctaatttgtggcattg

SEQ ID NO: 689671 - DNA, 25 bp, Mus musculus
gtctaccctctattttgtggcattg

SEQ ID NO: 689672 - DNA, 25 bp, Mus musculus
gtctaccctttgactgtcagcaagt

SEQ ID NO: 689673 - DNA, 25 bp, Mus musculus
gtctaccctttgtctgtcagcaagt

SEQ ID NO: 689674 - DNA, 25 bp, Mus musculus
gtctaccgtgagatccagaatctct

SEQ ID NO: 689675 - DNA, 25 bp, Mus musculus
gtctaccgtgagttccagaatctct

SEQ ID NO: 689676 - DNA, 25 bp, Mus musculus
gtctacctaactactcagggactac

SEQ ID NO: 689677 - DNA, 25 bp, Mus musculus
gtctacctaacttctcagggactac

SEQ ID NO: 689678 - DNA, 25 bp, Mus musculus
gtctacctaccaccgtcatttcata

SEQ ID NO: 689679 - DNA, 25 bp, Mus musculus
gtctacctaccagcgtcatttcata

SEQ ID NO: 689680 - DNA, 25 bp, Mus musculus
gtctacctacctatggagaaggctg

SEQ ID NO: 689681 - DNA, 25 bp, Mus musculus
gtctacctacctttggagaaggctg

SEQ ID NO: 689682 - DNA, 25 bp, Mus musculus
gtctacctagcaagtatctatcatc

SEQ ID NO: 689683 - DNA, 25 bp, Mus musculus
gtctacctagcatgtatctatcatc

SEQ ID NO: 689684 - DNA, 25 bp, Mus musculus
gtctacctatggcaagagcctggca

SEQ ID NO: 689685 - DNA, 25 bp, Mus musculus
gtctacctatgggaagagcctggca

SEQ ID NO: 689686 - DNA, 25 bp, Mus musculus
gtctacctcccacaaatcactattg

SEQ ID NO: 689687 - DNA, 25 bp, Mus musculus
gtctacctcccagaaatcactattg

SEQ ID NO: 689688 - DNA, 25 bp, Mus musculus
gtctacctccttactgcataacctt

SEQ ID NO: 689689 - DNA, 25 bp, Mus musculus
gtctacctccttatcacagttgtaa

SEQ ID NO: 689690 - DNA, 25 bp, Mus musculus
gtctacctcctttctgcataacctt

SEQ ID NO: 689691 - DNA, 25 bp, Mus musculus
gtctacctccttttcacagttgtaa

SEQ ID NO: 689692 - DNA, 25 bp, Mus musculus
gtctacctctatcaatacagcactc

SEQ ID NO: 689693 - DNA, 25 bp, Mus musculus
gtctacctctatgaatacagcactc

SEQ ID NO: 689694 - DNA, 25 bp, Mus musculus
gtctacctggatatcctaggctagg

SEQ ID NO: 689695 - DNA, 25 bp, Mus musculus
gtctacctggatttcctaggctagg

SEQ ID NO: 689696 - DNA, 25 bp, Mus musculus
gtctacctgtttaggtttcatccac

SEQ ID NO: 689697 - DNA, 25 bp, Mus musculus
gtctacctgttttggtttcatccac

SEQ ID NO: 689698 - DNA, 25 bp, Mus musculus
gtctaccttgtaaggaaggtgctaa

SEQ ID NO: 689699 - DNA, 25 bp, Mus musculus
gtctaccttgtatggaaggtgctaa

SEQ ID NO: 689700 - DNA, 25 bp, Mus musculus
gtctacgaagaaagcctgggttcat

SEQ ID NO: 689701 - DNA, 25 bp, Mus musculus
gtctacgaagaatgcctgggttcat

SEQ ID NO: 689702 - DNA, 25 bp, Mus musculus
gtctacgacattcctcaggtgaatc

SEQ ID NO: 689703 - DNA, 25 bp, Mus musculus
gtctacgacattgctcaggtgaatc

SEQ ID NO: 689704 - DNA, 25 bp, Mus musculus
gtctacgaccccaagaagtttgagt

SEQ ID NO: 689705 - DNA, 25 bp, Mus musculus
gtctacgacccctagaagtttgagt

SEQ ID NO: 689706 - DNA, 25 bp, Mus musculus
gtctacgaccggagaggcactcaaa

SEQ ID NO: 689707 - DNA, 25 bp, Mus musculus
gtctacgaccggtgaggcactcaaa

SEQ ID NO: 689708 - DNA, 25 bp, Mus musculus
gtctacgagcgaaggttacccggca

SEQ ID NO: 689709 - DNA, 25 bp, Mus musculus
gtctacgagcgatggttacccggca

SEQ ID NO: 689710 - DNA, 25 bp, Mus musculus
gtctacgcaagaagtggttcctcgg

SEQ ID NO: 689711 - DNA, 25 bp, Mus musculus
gtctacgcaagatgtggttcctcgg

SEQ ID NO: 689712 - DNA, 25 bp, Mus musculus
gtctacgctaataacagattgccac

SEQ ID NO: 689713 - DNA, 25 bp, Mus musculus
gtctacgctaattacagattgccac

SEQ ID NO: 689714 - DNA, 25 bp, Mus musculus
gtctacgcttcgagcataagctgta

SEQ ID NO: 689715 - DNA, 25 bp, Mus musculus
gtctacgcttcgtgcataagctgta

SEQ ID NO: 689716 - DNA, 25 bp, Mus musculus
gtctacggccatcacagaaacatct

SEQ ID NO: 689717 - DNA, 25 bp, Mus musculus
gtctacggccatgacagaaacatct

SEQ ID NO: 689718 - DNA, 25 bp, Mus musculus
gtctacgtcatgcaaggttgtgcaa

SEQ ID NO: 689719 - DNA, 25 bp, Mus musculus
gtctacgtcatggaaggttgtgcaa

SEQ ID NO: 689720 - DNA, 25 bp, Mus musculus
gtctacgtccgacagtgagtgccta

SEQ ID NO: 689721 - DNA, 25 bp, Mus musculus
gtctacgtccgagagtgagtgccta

SEQ ID NO: 689722 - DNA, 25 bp, Mus musculus
gtctacgtctatctatgcacaccaa

SEQ ID NO: 689723 - DNA, 25 bp, Mus musculus
gtctacgtctatgtatgcacaccaa

SEQ ID NO: 689724 - DNA, 25 bp, Mus musculus
gtctacgtgtaaatcaccttcagtt

SEQ ID NO: 689725 - DNA, 25 bp, Mus musculus
gtctacgtgtaattcaccttcagtt

SEQ ID NO: 689726 - DNA, 25 bp, Mus musculus
gtctacgtgttgaactttcatccaa

SEQ ID NO: 689727 - DNA, 25 bp, Mus musculus
gtctacgtgttgtactttcatccaa

SEQ ID NO: 689728 - DNA, 25 bp, Mus musculus
gtctactaatgacatcgatgacaga

SEQ ID NO: 689729 - DNA, 25 bp, Mus musculus
gtctactaatgagatcgatgacaga

SEQ ID NO: 689730 - DNA, 25 bp, Mus musculus
gtctactacaggaacacttactttg

SEQ ID NO: 689731 - DNA, 25 bp, Mus musculus
gtctactacaggtacacttactttg

SEQ ID NO: 689732 - DNA, 25 bp, Mus musculus
gtctactacttcagtccaagtggta

SEQ ID NO: 689733 - DNA, 25 bp, Mus musculus
gtctactacttctgtccaagtggta

SEQ ID NO: 689734 - DNA, 25 bp, Mus musculus
gtctactactttccttatcatgttc

SEQ ID NO: 689735 - DNA, 25 bp, Mus musculus
gtctactactttgcttatcatgttc

SEQ ID NO: 689736 - DNA, 25 bp, Mus musculus
gtctactagcgcagggatggtacac

SEQ ID NO: 689737 - DNA, 25 bp, Mus musculus
gtctactagcgctgggatggtacac

SEQ ID NO: 689738 - DNA, 25 bp, Mus musculus
gtctactattgtaagagttcttctg

SEQ ID NO: 689739 - DNA, 25 bp, Mus musculus
gtctactattgttagagttcttctg

SEQ ID NO: 689740 - DNA, 25 bp, Mus musculus
gtctactcacctcatttgattatca

SEQ ID NO: 689741 - DNA, 25 bp, Mus musculus
gtctactcacctgatttgattatca

SEQ ID NO: 689742 - DNA, 25 bp, Mus musculus
gtctactcatcccaaacaacgatgg

SEQ ID NO: 689743 - DNA, 25 bp, Mus musculus
gtctactcatccgaaacaacgatgg

SEQ ID NO: 689744 - DNA, 25 bp, Mus musculus
gtctactcccaaaagtcagcgatgt

SEQ ID NO: 689745 - DNA, 25 bp, Mus musculus
gtctactcccaatagtcagcgatgt

SEQ ID NO: 689746 - DNA, 25 bp, Mus musculus
gtctactctgtgacatgagtgtttt

SEQ ID NO: 689747 - DNA, 25 bp, Mus musculus
gtctactctgtgtcatgagtgtttt

SEQ ID NO: 689748 - DNA, 25 bp, Mus musculus
gtctactgacccatgttggagttga

SEQ ID NO: 689749 - DNA, 25 bp, Mus musculus
gtctactgacccttgttggagttga

SEQ ID NO: 689750 - DNA, 25 bp, Mus musculus
gtctactgcctgatttggtcttcct

SEQ ID NO: 689751 - DNA, 25 bp, Mus musculus
gtctactgcctgttttggtcttcct

SEQ ID NO: 689752 - DNA, 25 bp, Mus musculus
gtctactgggatcgagacatgtgat

SEQ ID NO: 689753 - DNA, 25 bp, Mus musculus
gtctactgggatggagacatgtgat

SEQ ID NO: 689754 - DNA, 25 bp, Mus musculus
gtctactgggctatctcctagaaaa

SEQ ID NO: 689755 - DNA, 25 bp, Mus musculus
gtctactgggctttctcctagaaaa

SEQ ID NO: 689756 - DNA, 25 bp, Mus musculus
gtctactgtctcctttgagggaaag

SEQ ID NO: 689757 - DNA, 25 bp, Mus musculus
gtctactgtctcgtttgagggaaag

SEQ ID NO: 689758 - DNA, 25 bp, Mus musculus
gtctactgtgctatcagacatagat

SEQ ID NO: 689759 - DNA, 25 bp, Mus musculus
gtctactgtgctttcagacatagat

SEQ ID NO: 689760 - DNA, 25 bp, Mus musculus
gtctactgtgtaaattatgtcccct

SEQ ID NO: 689761 - DNA, 25 bp, Mus musculus
gtctactgtgtatattatgtcccct

SEQ ID NO: 689762 - DNA, 25 bp, Mus musculus
gtctacttactacggaattcagtca

SEQ ID NO: 689763 - DNA, 25 bp, Mus musculus
gtctacttactagggaattcagtca

SEQ ID NO: 689764 - DNA, 25 bp, Mus musculus
gtctacttatctcagtgtaggcccc

SEQ ID NO: 689765 - DNA, 25 bp, Mus musculus
gtctacttatctgagtgtaggcccc

SEQ ID NO: 689766 - DNA, 25 bp, Mus musculus
gtctacttccggcacaacatgtatt

SEQ ID NO: 689767 - DNA, 25 bp, Mus musculus
gtctacttccgggacaacatgtatt

SEQ ID NO: 689768 - DNA, 25 bp, Mus musculus
gtctacttctccaaagggcaccatg

SEQ ID NO: 689769 - DNA, 25 bp, Mus musculus
gtctacttctcctaagggcaccatg

SEQ ID NO: 689770 - DNA, 25 bp, Mus musculus
gtctacttgcagagatggtactatg

SEQ ID NO: 689771 - DNA, 25 bp, Mus musculus
gtctacttgcagtgatggtactatg

SEQ ID NO: 689772 - DNA, 25 bp, Mus musculus
gtctacttgtgaaccttctagatgc

SEQ ID NO: 689773 - DNA, 25 bp, Mus musculus
gtctacttgtgatccttctagatgc

SEQ ID NO: 689774 - DNA, 25 bp, Mus musculus
gtctacttgtgtctgggtctccagg

SEQ ID NO: 689775 - DNA, 25 bp, Mus musculus
gtctacttgtgtgtgggtctccagg

SEQ ID NO: 689776 - DNA, 25 bp, Mus musculus
gtctagaaacagagcgtcgtcgtgc

SEQ ID NO: 689777 - DNA, 25 bp, Mus musculus
gtctagaaacagtgcgtcgtcgtgc

SEQ ID NO: 689778 - DNA, 25 bp, Mus musculus
gtctagaaacggcacagctctccag

SEQ ID NO: 689779 - DNA, 25 bp, Mus musculus
gtctagaaacgggacagctctccag

SEQ ID NO: 689780 - DNA, 25 bp, Mus musculus
gtctagaaggtacagcccctgagct

SEQ ID NO: 689781 - DNA, 25 bp, Mus musculus
gtctagaaggtagagcccctgagct

SEQ ID NO: 689782 - DNA, 25 bp, Mus musculus
gtctagaagtaacaaggccctgggt

SEQ ID NO: 689783 - DNA, 25 bp, Mus musculus
gtctagaagtaagaaggccctgggt

SEQ ID NO: 689784 - DNA, 25 bp, Mus musculus
gtctagaatgtaagcactttttcct

SEQ ID NO: 689785 - DNA, 25 bp, Mus musculus
gtctagaatgtatgcactttttcct

SEQ ID NO: 689786 - DNA, 25 bp, Mus musculus
gtctagaattctattgcagctcatg

SEQ ID NO: 689787 - DNA, 25 bp, Mus musculus
gtctagaattcttttgcagctcatg

SEQ ID NO: 689788 - DNA, 25 bp, Mus musculus
gtctagacacatacgcatagccaga

SEQ ID NO: 689789 - DNA, 25 bp, Mus musculus
gtctagacacattcgcatagccaga

SEQ ID NO: 689790 - DNA, 25 bp, Mus musculus
gtctagacacctctacagtactgtt

SEQ ID NO: 689791 - DNA, 25 bp, Mus musculus
gtctagacacctgtacagtactgtt

SEQ ID NO: 689792 - DNA, 25 bp, Mus musculus
gtctagacagaacctcatgtggcat

SEQ ID NO: 689793 - DNA, 25 bp, Mus musculus
gtctagacagaagctcatgtggcat

SEQ ID NO: 689794 - DNA, 25 bp, Mus musculus
gtctagaccaagctcaccgtcagta

SEQ ID NO: 689795 - DNA, 25 bp, Mus musculus
gtctagaccaaggtcaccgtcagta

SEQ ID NO: 689796 - DNA, 25 bp, Mus musculus
gtctagacctctacttacctattaa

SEQ ID NO: 689797 - DNA, 25 bp, Mus musculus
gtctagacctcttcttacctattaa

SEQ ID NO: 689798 - DNA, 25 bp, Mus musculus
gtctagacgccaattctgttgatga

SEQ ID NO: 689799 - DNA, 25 bp, Mus musculus
gtctagacgccatttctgttgatga

SEQ ID NO: 689800 - DNA, 25 bp, Mus musculus
gtctagactagtcagctaacctcaa

SEQ ID NO: 689801 - DNA, 25 bp, Mus musculus
gtctagactagtgagctaacctcaa

SEQ ID NO: 689802 - DNA, 25 bp, Mus musculus
gtctagactcccatgtgaagcacaa

SEQ ID NO: 689803 - DNA, 25 bp, Mus musculus
gtctagactcccttgtgaagcacaa

SEQ ID NO: 689804 - DNA, 25 bp, Mus musculus
gtctagatccatatatcttcaccag

SEQ ID NO: 689805 - DNA, 25 bp, Mus musculus
gtctagatccatttatcttcaccag

SEQ ID NO: 689806 - DNA, 25 bp, Mus musculus
gtctagatccggagaggcaggtctt

SEQ ID NO: 689807 - DNA, 25 bp, Mus musculus
gtctagatccggtgaggcaggtctt

SEQ ID NO: 689808 - DNA, 25 bp, Mus musculus
gtctagatctatacacatgcacaaa

SEQ ID NO: 689809 - DNA, 25 bp, Mus musculus
gtctagatctattcacatgcacaaa

SEQ ID NO: 689810 - DNA, 25 bp, Mus musculus
gtctagatgagtctgcacgttttcc

SEQ ID NO: 689811 - DNA, 25 bp, Mus musculus
gtctagatgagtgtgcacgttttcc

SEQ ID NO: 689812 - DNA, 25 bp, Mus musculus
gtctagatgccaatttgaacccaat

SEQ ID NO: 689813 - DNA, 25 bp, Mus musculus
gtctagatgccattttgaacccaat

SEQ ID NO: 689814 - DNA, 25 bp, Mus musculus
gtctagatgcgaattttgtgcctgc

SEQ ID NO: 689815 - DNA, 25 bp, Mus musculus
gtctagatgcgatttttgtgcctgc

SEQ ID NO: 689816 - DNA, 25 bp, Mus musculus
gtctagatgcttaaacactttgtta

SEQ ID NO: 689817 - DNA, 25 bp, Mus musculus
gtctagatgctttaacactttgtta

SEQ ID NO: 689818 - DNA, 25 bp, Mus musculus
gtctagatgttcctcagtgtactgt

SEQ ID NO: 689819 - DNA, 25 bp, Mus musculus
gtctagatgttcgtcagtgtactgt

SEQ ID NO: 689820 - DNA, 25 bp, Mus musculus
gtctagattcctaagtacctggttt

SEQ ID NO: 689821 - DNA, 25 bp, Mus musculus
gtctagattccttagtacctggttt

SEQ ID NO: 689822 - DNA, 25 bp, Mus musculus
gtctagattggcagaaataatttca

SEQ ID NO: 689823 - DNA, 25 bp, Mus musculus
gtctagattggctgaaataatttca

SEQ ID NO: 689824 - DNA, 25 bp, Mus musculus
gtctagattgtccttctcttgcttt

SEQ ID NO: 689825 - DNA, 25 bp, Mus musculus
gtctagattgtcgttctcttgcttt

SEQ ID NO: 689826 - DNA, 25 bp, Mus musculus
gtctagatttgccttgtggtcttta

SEQ ID NO: 689827 - DNA, 25 bp, Mus musculus
gtctagatttgcgttgtggtcttta

SEQ ID NO: 689828 - DNA, 25 bp, Mus musculus
gtctagcaatgcatggatttgtcga

SEQ ID NO: 689829 - DNA, 25 bp, Mus musculus
gtctagcaatgcttggatttgtcga

SEQ ID NO: 689830 - DNA, 25 bp, Mus musculus
gtctagcaccggctttatgcctctc

SEQ ID NO: 689831 - DNA, 25 bp, Mus musculus
gtctagcaccgggtttatgcctctc

SEQ ID NO: 689832 - DNA, 25 bp, Mus musculus
gtctagcagaggatctgttgggcca

SEQ ID NO: 689833 - DNA, 25 bp, Mus musculus
gtctagcagaggttctgttgggcca

SEQ ID NO: 689834 - DNA, 25 bp, Mus musculus
gtctagcagagtattcttcgcctcg

SEQ ID NO: 689835 - DNA, 25 bp, Mus musculus
gtctagcagagttttcttcgcctcg

SEQ ID NO: 689836 - DNA, 25 bp, Mus musculus
gtctagcagctcaaagttgacgttt

SEQ ID NO: 689837 - DNA, 25 bp, Mus musculus
gtctagcagctctaagttgacgttt

SEQ ID NO: 689838 - DNA, 25 bp, Mus musculus
gtctagcagtatatcccagtatctc

SEQ ID NO: 689839 - DNA, 25 bp, Mus musculus
gtctagcagtatttcccagtatctc

SEQ ID NO: 689840 - DNA, 25 bp, Mus musculus
gtctagcatgatctgcatggcctgt

SEQ ID NO: 689841 - DNA, 25 bp, Mus musculus
gtctagcatgatgtgcatggcctgt

SEQ ID NO: 689842 - DNA, 25 bp, Mus musculus
gtctagcatggcattgatgcaaccc

SEQ ID NO: 689843 - DNA, 25 bp, Mus musculus
gtctagcatggctttgatgcaaccc

SEQ ID NO: 689844 - DNA, 25 bp, Mus musculus
gtctagccaagacatgaccagctga

SEQ ID NO: 689845 - DNA, 25 bp, Mus musculus
gtctagccaagagatgaccagctga

SEQ ID NO: 689846 - DNA, 25 bp, Mus musculus
gtctagccaattaatgagatcaggt

SEQ ID NO: 689847 - DNA, 25 bp, Mus musculus
gtctagccaatttatgagatcaggt

SEQ ID NO: 689848 - DNA, 25 bp, Mus musculus
gtctagccacgaagcatgtaacctg

SEQ ID NO: 689849 - DNA, 25 bp, Mus musculus
gtctagccacgatgcatgtaacctg

SEQ ID NO: 689850 - DNA, 25 bp, Mus musculus
gtctagccactcaggtaataccatg

SEQ ID NO: 689851 - DNA, 25 bp, Mus musculus
gtctagccactctggtaataccatg

SEQ ID NO: 689852 - DNA, 25 bp, Mus musculus
gtctagcccaagcagactgatggat

SEQ ID NO: 689853 - DNA, 25 bp, Mus musculus
gtctagcccaaggagactgatggat

SEQ ID NO: 689854 - DNA, 25 bp, Mus musculus
gtctagcccagaacttggacagtca

SEQ ID NO: 689855 - DNA, 25 bp, Mus musculus
gtctagcccagatcttggacagtca

SEQ ID NO: 689856 - DNA, 25 bp, Mus musculus
gtctagcccattcttcagcctgctt

SEQ ID NO: 689857 - DNA, 25 bp, Mus musculus
gtctagcccattgttcagcctgctt

SEQ ID NO: 689858 - DNA, 25 bp, Mus musculus
gtctagcctagtatggtgaaattca

SEQ ID NO: 689859 - DNA, 25 bp, Mus musculus
gtctagcctagtttggtgaaattca

SEQ ID NO: 689860 - DNA, 25 bp, Mus musculus
gtctagcctgcaagcaaccttgaaa

SEQ ID NO: 689861 - DNA, 25 bp, Mus musculus
gtctagcctgcatgcaaccttgaaa

SEQ ID NO: 689862 - DNA, 25 bp, Mus musculus
gtctagcgacttacagtggaacctt

SEQ ID NO: 689863 - DNA, 25 bp, Mus musculus
gtctagcgactttcagtggaacctt

SEQ ID NO: 689864 - DNA, 25 bp, Mus musculus
gtctagcgagttacttttccatcac

SEQ ID NO: 689865 - DNA, 25 bp, Mus musculus
gtctagcgagtttcttttccatcac

SEQ ID NO: 689866 - DNA, 25 bp, Mus musculus
gtctagctagaacatgttttatttc

SEQ ID NO: 689867 - DNA, 25 bp, Mus musculus
gtctagctagaagatgttttatttc

SEQ ID NO: 689868 - DNA, 25 bp, Mus musculus
gtctagctagagaagtgtgtcacag

SEQ ID NO: 689869 - DNA, 25 bp, Mus musculus
gtctagctagagtagtgtgtcacag

SEQ ID NO: 689870 - DNA, 25 bp, Mus musculus
gtctagctatctcgcttccattgaa

SEQ ID NO: 689871 - DNA, 25 bp, Mus musculus
gtctagctatctggcttccattgaa

SEQ ID NO: 689872 - DNA, 25 bp, Mus musculus
gtctagctcagcatgtctaacatat

SEQ ID NO: 689873 - DNA, 25 bp, Mus musculus
gtctagctcagcttgtctaacatat

SEQ ID NO: 689874 - DNA, 25 bp, Mus musculus
gtctagctgatcctaactttcagta

SEQ ID NO: 689875 - DNA, 25 bp, Mus musculus
gtctagctgatcgtaactttcagta

SEQ ID NO: 689876 - DNA, 25 bp, Mus musculus
gtctagctgggtagataagtgctct

SEQ ID NO: 689877 - DNA, 25 bp, Mus musculus
gtctagctgggttgataagtgctct

SEQ ID NO: 689878 - DNA, 25 bp, Mus musculus
gtctagcttcacattgctttggtct

SEQ ID NO: 689879 - DNA, 25 bp, Mus musculus
gtctagcttcactttgctttggtct

SEQ ID NO: 689880 - DNA, 25 bp, Mus musculus
gtctagcttcgccgtcatggtctat

SEQ ID NO: 689881 - DNA, 25 bp, Mus musculus
gtctagcttcgcggtcatggtctat

SEQ ID NO: 689882 - DNA, 25 bp, Mus musculus
gtctagctttatccagaaagggcac

SEQ ID NO: 689883 - DNA, 25 bp, Mus musculus
gtctagctttatgcagaaagggcac

SEQ ID NO: 689884 - DNA, 25 bp, Mus musculus
gtctagctttctctacaacaaggtt

SEQ ID NO: 689885 - DNA, 25 bp, Mus musculus
gtctagctttctgtacaacaaggtt

SEQ ID NO: 689886 - DNA, 25 bp, Mus musculus
gtctaggaacagctcttgcatcaag

SEQ ID NO: 689887 - DNA, 25 bp, Mus musculus
gtctaggaacaggtcttgcatcaag

SEQ ID NO: 689888 - DNA, 25 bp, Mus musculus
gtctaggaatccagtggtctcagcc

SEQ ID NO: 689889 - DNA, 25 bp, Mus musculus
gtctaggaatcctgtggtctcagcc

SEQ ID NO: 689890 - DNA, 25 bp, Mus musculus
gtctaggaccttctgagccaccggg

SEQ ID NO: 689891 - DNA, 25 bp, Mus musculus
gtctaggaccttgtgagccaccggg

SEQ ID NO: 689892 - DNA, 25 bp, Mus musculus
gtctaggacgttacatttttatggt

SEQ ID NO: 689893 - DNA, 25 bp, Mus musculus
gtctaggacgtttcatttttatggt

SEQ ID NO: 689894 - DNA, 25 bp, Mus musculus
gtctaggactttaaggagtggaaat

SEQ ID NO: 689895 - DNA, 25 bp, Mus musculus
gtctaggacttttaggagtggaaat

SEQ ID NO: 689896 - DNA, 25 bp, Mus musculus
gtctaggagctaatgtcacgtgttc

SEQ ID NO: 689897 - DNA, 25 bp, Mus musculus
gtctaggagctattgtcacgtgttc

SEQ ID NO: 689898 - DNA, 25 bp, Mus musculus
gtctaggatagccaagtctctgttg

SEQ ID NO: 689899 - DNA, 25 bp, Mus musculus
gtctaggatagcgaagtctctgttg

SEQ ID NO: 689900 - DNA, 25 bp, Mus musculus
gtctaggatccgctcagtgaggaaa

SEQ ID NO: 689901 - DNA, 25 bp, Mus musculus
gtctaggatccggtcagtgaggaaa

SEQ ID NO: 689902 - DNA, 25 bp, Mus musculus
gtctaggccaatctatgcacaccat

SEQ ID NO: 689903 - DNA, 25 bp, Mus musculus
gtctaggccaatgtatgcacaccat

SEQ ID NO: 689904 - DNA, 25 bp, Mus musculus
gtctaggcctaaaccatggctctaa

SEQ ID NO: 689905 - DNA, 25 bp, Mus musculus
gtctaggcctaatccatggctctaa

SEQ ID NO: 689906 - DNA, 25 bp, Mus musculus
gtctagggctaacttcttgatattc

SEQ ID NO: 689907 - DNA, 25 bp, Mus musculus
gtctagggctaagttcttgatattc

SEQ ID NO: 689908 - DNA, 25 bp, Mus musculus
gtctaggtaaaaagcccaggcttgc

SEQ ID NO: 689909 - DNA, 25 bp, Mus musculus
gtctaggtaaaatgcccaggcttgc

SEQ ID NO: 689910 - DNA, 25 bp, Mus musculus
gtctaggtcaccagtttctgtcaga

SEQ ID NO: 689911 - DNA, 25 bp, Mus musculus
gtctaggtcacctgtttctgtcaga

SEQ ID NO: 689912 - DNA, 25 bp, Mus musculus
gtctaggtctacctccagagagcgg

SEQ ID NO: 689913 - DNA, 25 bp, Mus musculus
gtctaggtctacgtccagagagcgg

SEQ ID NO: 689914 - DNA, 25 bp, Mus musculus
gtctaggtgtctccctacggatgaa

SEQ ID NO: 689915 - DNA, 25 bp, Mus musculus
gtctaggtgtctgcctacggatgaa

SEQ ID NO: 689916 - DNA, 25 bp, Mus musculus
gtctaggttgaaaacctggctgctt

SEQ ID NO: 689917 - DNA, 25 bp, Mus musculus
gtctaggttgaaaccattttttata

SEQ ID NO: 689918 - DNA, 25 bp, Mus musculus
gtctaggttgaatacctggctgctt

SEQ ID NO: 689919 - DNA, 25 bp, Mus musculus
gtctaggttgaatccattttttata

SEQ ID NO: 689920 - DNA, 25 bp, Mus musculus
gtctagtaaaaaatgaggatcctcc

SEQ ID NO: 689921 - DNA, 25 bp, Mus musculus
gtctagtaaaaattgaggatcctcc

SEQ ID NO: 689922 - DNA, 25 bp, Mus musculus
gtctagtaaactctttcctcagtga

SEQ ID NO: 689923 - DNA, 25 bp, Mus musculus
gtctagtaaactgtttcctcagtga

SEQ ID NO: 689924 - DNA, 25 bp, Mus musculus
gtctagtaacagcttgtatttcttt

SEQ ID NO: 689925 - DNA, 25 bp, Mus musculus
gtctagtaacaggttgtatttcttt

SEQ ID NO: 689926 - DNA, 25 bp, Mus musculus
gtctagtaggttacattcgaaaaat

SEQ ID NO: 689927 - DNA, 25 bp, Mus musculus
gtctagtaggtttcattcgaaaaat

SEQ ID NO: 689928 - DNA, 25 bp, Mus musculus
gtctagtatgctcttaccagcgtat

SEQ ID NO: 689929 - DNA, 25 bp, Mus musculus
gtctagtatgctgttaccagcgtat

SEQ ID NO: 689930 - DNA, 25 bp, Mus musculus
gtctagtcacctcacctgggctcca

SEQ ID NO: 689931 - DNA, 25 bp, Mus musculus
gtctagtcacctgacctgggctcca

SEQ ID NO: 689932 - DNA, 25 bp, Mus musculus
gtctagtctagccttgatctcacag

SEQ ID NO: 689933 - DNA, 25 bp, Mus musculus
gtctagtctagcgttgatctcacag

SEQ ID NO: 689934 - DNA, 25 bp, Mus musculus
gtctagtcttagaagccagcttgct

SEQ ID NO: 689935 - DNA, 25 bp, Mus musculus
gtctagtcttagtagccagcttgct

SEQ ID NO: 689936 - DNA, 25 bp, Mus musculus
gtctagtgacaaacatctttggctt

SEQ ID NO: 689937 - DNA, 25 bp, Mus musculus
gtctagtgacaatcatctttggctt

SEQ ID NO: 689938 - DNA, 25 bp, Mus musculus
gtctagtgaccaccagcctagatgg

SEQ ID NO: 689939 - DNA, 25 bp, Mus musculus
gtctagtgaccagcagcctagatgg

SEQ ID NO: 689940 - DNA, 25 bp, Mus musculus
gtctagtgagatctggagttacaca

SEQ ID NO: 689941 - DNA, 25 bp, Mus musculus
gtctagtgagatgtggagttacaca

SEQ ID NO: 689942 - DNA, 25 bp, Mus musculus
gtctagtgatggaatgttacccttt

SEQ ID NO: 689943 - DNA, 25 bp, Mus musculus
gtctagtgatggtatgttacccttt

SEQ ID NO: 689944 - DNA, 25 bp, Mus musculus
gtctagtgcagacagttcgtgactc

SEQ ID NO: 689945 - DNA, 25 bp, Mus musculus
gtctagtgcagagagttcgtgactc

SEQ ID NO: 689946 - DNA, 25 bp, Mus musculus
gtctagtgctacaatgtttaaccct

SEQ ID NO: 689947 - DNA, 25 bp, Mus musculus
gtctagtgctactatgtttaaccct

SEQ ID NO: 689948 - DNA, 25 bp, Mus musculus
gtctagtgctccacatgaccctatg

SEQ ID NO: 689949 - DNA, 25 bp, Mus musculus
gtctagtgctcctcatgaccctatg

SEQ ID NO: 689950 - DNA, 25 bp, Mus musculus
gtctagtgctgaaaagcgtcccata

SEQ ID NO: 689951 - DNA, 25 bp, Mus musculus
gtctagtgctgataagcgtcccata

SEQ ID NO: 689952 - DNA, 25 bp, Mus musculus
gtctagtgtatcagagatagctaca

SEQ ID NO: 689953 - DNA, 25 bp, Mus musculus
gtctagtgtatccaaaactatttcc

SEQ ID NO: 689954 - DNA, 25 bp, Mus musculus
gtctagtgtatcgaaaactatttcc

SEQ ID NO: 689955 - DNA, 25 bp, Mus musculus
gtctagtgtatctgagatagctaca

SEQ ID NO: 689956 - DNA, 25 bp, Mus musculus
gtctagtgtcaaacctaggagctag

SEQ ID NO: 689957 - DNA, 25 bp, Mus musculus
gtctagtgtcaatcctaggagctag

SEQ ID NO: 689958 - DNA, 25 bp, Mus musculus
gtctagtgttgtcaccaatgacttc

SEQ ID NO: 689959 - DNA, 25 bp, Mus musculus
gtctagtgttgtgaccaatgacttc

SEQ ID NO: 689960 - DNA, 25 bp, Mus musculus
gtctagttaatgattcctcaatcag

SEQ ID NO: 689961 - DNA, 25 bp, Mus musculus
gtctagttaatgtttcctcaatcag

SEQ ID NO: 689962 - DNA, 25 bp, Mus musculus
gtctagttcatcataccaactctgg

SEQ ID NO: 689963 - DNA, 25 bp, Mus musculus
gtctagttcatcttaccaactctgg

SEQ ID NO: 689964 - DNA, 25 bp, Mus musculus
gtctagttcatgattacgagctgta

SEQ ID NO: 689965 - DNA, 25 bp, Mus musculus
gtctagttcatgtttacgagctgta

SEQ ID NO: 689966 - DNA, 25 bp, Mus musculus
gtctagttctatcgactctttttct

SEQ ID NO: 689967 - DNA, 25 bp, Mus musculus
gtctagttctatggactctttttct

SEQ ID NO: 689968 - DNA, 25 bp, Mus musculus
gtctagttgaaacggcatttgctgt

SEQ ID NO: 689969 - DNA, 25 bp, Mus musculus
gtctagttgaaagggcatttgctgt

SEQ ID NO: 689970 - DNA, 25 bp, Mus musculus
gtctagttgtgtcaggatccttcct

SEQ ID NO: 689971 - DNA, 25 bp, Mus musculus
gtctagttgtgtgaggatccttcct

SEQ ID NO: 689972 - DNA, 25 bp, Mus musculus
gtctagtttcgactcacaaatgtgt

SEQ ID NO: 689973 - DNA, 25 bp, Mus musculus
gtctagtttcgagtcacaaatgtgt

SEQ ID NO: 689974 - DNA, 25 bp, Mus musculus
gtctagtttctcacaagaagtcacg

SEQ ID NO: 689975 - DNA, 25 bp, Mus musculus
gtctagtttctctcaagaagtcacg

SEQ ID NO: 689976 - DNA, 25 bp, Mus musculus
gtctagtttctgatgagtgctctgg

SEQ ID NO: 689977 - DNA, 25 bp, Mus musculus
gtctagtttctgttgagtgctctgg

SEQ ID NO: 689978 - DNA, 25 bp, Mus musculus
gtctataaaagactgtcctgtctgg

SEQ ID NO: 689979 - DNA, 25 bp, Mus musculus
gtctataaaagagtgtcctgtctgg

SEQ ID NO: 689980 - DNA, 25 bp, Mus musculus
gtctataaatggacaggctgttcac

SEQ ID NO: 689981 - DNA, 25 bp, Mus musculus
gtctataaatggtcaggctgttcac

SEQ ID NO: 689982 - DNA, 25 bp, Mus musculus
gtctataatgaaagcacaccaggtg

SEQ ID NO: 689983 - DNA, 25 bp, Mus musculus
gtctataatgaatgcacaccaggtg

SEQ ID NO: 689984 - DNA, 25 bp, Mus musculus
gtctatacgtttcacgctggcaaca

SEQ ID NO: 689985 - DNA, 25 bp, Mus musculus
gtctatacgtttgacgctggcaaca

SEQ ID NO: 689986 - DNA, 25 bp, Mus musculus
gtctatactaccacattcggcaagt

SEQ ID NO: 689987 - DNA, 25 bp, Mus musculus
gtctatactacctcattcggcaagt

SEQ ID NO: 689988 - DNA, 25 bp, Mus musculus
gtctatactgatactgtgagggcca

SEQ ID NO: 689989 - DNA, 25 bp, Mus musculus
gtctatactgattctgtgagggcca

SEQ ID NO: 689990 - DNA, 25 bp, Mus musculus
gtctatactgtactggtaagatcca

SEQ ID NO: 689991 - DNA, 25 bp, Mus musculus
gtctatactgtagtggtaagatcca

SEQ ID NO: 689992 - DNA, 25 bp, Mus musculus
gtctatacttgaaacattcccactt

SEQ ID NO: 689993 - DNA, 25 bp, Mus musculus
gtctatacttgatacattcccactt

SEQ ID NO: 689994 - DNA, 25 bp, Mus musculus
gtctatagattcagtgcaatcccca

SEQ ID NO: 689995 - DNA, 25 bp, Mus musculus
gtctatagattctgtgcaatcccca

SEQ ID NO: 689996 - DNA, 25 bp, Mus musculus
gtctatatccacaccaagtctgtaa

SEQ ID NO: 689997 - DNA, 25 bp, Mus musculus
gtctatatccactccaagtctgtaa

SEQ ID NO: 689998 - DNA, 25 bp, Mus musculus
gtctatattaagatgcagtctacca

SEQ ID NO: 689999 - DNA, 25 bp, Mus musculus
gtctatattaagttgcagtctacca

SEQ ID NO: 690000 - DNA, 25 bp, Mus musculus
gtctatcaaattcaagttgtccctg

SEQ ID NO: 690001 - DNA, 25 bp, Mus musculus
gtctatcaaattgaagttgtccctg

SEQ ID NO: 690002 - DNA, 25 bp, Mus musculus
gtctatcactttactttgtaaaggt

SEQ ID NO: 690003 - DNA, 25 bp, Mus musculus
gtctatcacttttctttgtaaaggt

SEQ ID NO: 690004 - DNA, 25 bp, Mus musculus
gtctatcatccacggaagtccggca

SEQ ID NO: 690005 - DNA, 25 bp, Mus musculus
gtctatcatccagggaagtccggca

SEQ ID NO: 690006 - DNA, 25 bp, Mus musculus
gtctatcatctcagcatgccaaagg

SEQ ID NO: 690007 - DNA, 25 bp, Mus musculus
gtctatcatctctgcatgccaaagg

SEQ ID NO: 690008 - DNA, 25 bp, Mus musculus
gtctatcatgttcttagtgctgcaa

SEQ ID NO: 690009 - DNA, 25 bp, Mus musculus
gtctatcatgttgttagtgctgcaa

SEQ ID NO: 690010 - DNA, 25 bp, Mus musculus
gtctatccaactagaagctcttcag

SEQ ID NO: 690011 - DNA, 25 bp, Mus musculus
gtctatccaacttgaagctcttcag

SEQ ID NO: 690012 - DNA, 25 bp, Mus musculus
gtctatccaatcagtcataggccgt

SEQ ID NO: 690013 - DNA, 25 bp, Mus musculus
gtctatccaatctgtcataggccgt

SEQ ID NO: 690014 - DNA, 25 bp, Mus musculus
gtctatccacgaaccactttgtgat

SEQ ID NO: 690015 - DNA, 25 bp, Mus musculus
gtctatccacgatccactttgtgat

SEQ ID NO: 690016 - DNA, 25 bp, Mus musculus
gtctatccagacagctacccatgta

SEQ ID NO: 690017 - DNA, 25 bp, Mus musculus
gtctatccagactgctacccatgta

SEQ ID NO: 690018 - DNA, 25 bp, Mus musculus
gtctatccccgcagaactcaaagga

SEQ ID NO: 690019 - DNA, 25 bp, Mus musculus
gtctatccccgctgaactcaaagga

SEQ ID NO: 690020 - DNA, 25 bp, Mus musculus
gtctatccctttaacagttacttag

SEQ ID NO: 690021 - DNA, 25 bp, Mus musculus
gtctatcccttttacagttacttag

SEQ ID NO: 690022 - DNA, 25 bp, Mus musculus
gtctatcctactatctatttacatg

SEQ ID NO: 690023 - DNA, 25 bp, Mus musculus
gtctatcctactttctatttacatg

SEQ ID NO: 690024 - DNA, 25 bp, Mus musculus
gtctatcctgaacggagccagaccc

SEQ ID NO: 690025 - DNA, 25 bp, Mus musculus
gtctatcctgaagggagccagaccc

SEQ ID NO: 690026 - DNA, 25 bp, Mus musculus
gtctatcctggacgcggagtgcatt

SEQ ID NO: 690027 - DNA, 25 bp, Mus musculus
gtctatcctggaggcggagtgcatt

SEQ ID NO: 690028 - DNA, 25 bp, Mus musculus
gtctatcctttccagttcagcaaat

SEQ ID NO: 690029 - DNA, 25 bp, Mus musculus
gtctatcctttcgagttcagcaaat

SEQ ID NO: 690030 - DNA, 25 bp, Mus musculus
gtctatcgctggaggttacgacagt

SEQ ID NO: 690031 - DNA, 25 bp, Mus musculus
gtctatcgctggtggttacgacagt

SEQ ID NO: 690032 - DNA, 25 bp, Mus musculus
gtctatcggtctcagaaacttcaag

SEQ ID NO: 690033 - DNA, 25 bp, Mus musculus
gtctatcggtctgagaaacttcaag

SEQ ID NO: 690034 - DNA, 25 bp, Mus musculus
gtctatcgtgggatttacttagtca

SEQ ID NO: 690035 - DNA, 25 bp, Mus musculus
gtctatcgtgggttttacttagtca

SEQ ID NO: 690036 - DNA, 25 bp, Mus musculus
gtctatctagagctattttgggcaa

SEQ ID NO: 690037 - DNA, 25 bp, Mus musculus
gtctatctagaggtattttgggcaa

SEQ ID NO: 690038 - DNA, 25 bp, Mus musculus
gtctatctctatcgagtccctacaa

SEQ ID NO: 690039 - DNA, 25 bp, Mus musculus
gtctatctctatggagtccctacaa

SEQ ID NO: 690040 - DNA, 25 bp, Mus musculus
gtctatctctcaagttgtaaagtgg

SEQ ID NO: 690041 - DNA, 25 bp, Mus musculus
gtctatctctcatgttgtaaagtgg

SEQ ID NO: 690042 - DNA, 25 bp, Mus musculus
gtctatctctgtctctaggaagtca

SEQ ID NO: 690043 - DNA, 25 bp, Mus musculus
gtctatctctgtgtctaggaagtca

SEQ ID NO: 690044 - DNA, 25 bp, Mus musculus
gtctatctgaaaaccctttcttatc

SEQ ID NO: 690045 - DNA, 25 bp, Mus musculus
gtctatctgaaatccctttcttatc

SEQ ID NO: 690046 - DNA, 25 bp, Mus musculus
gtctatctgaacaaaaggtctggaa

SEQ ID NO: 690047 - DNA, 25 bp, Mus musculus
gtctatctgaactaaaggtctggaa

SEQ ID NO: 690048 - DNA, 25 bp, Mus musculus
gtctatctgatacctgtgacacccc

SEQ ID NO: 690049 - DNA, 25 bp, Mus musculus
gtctatctgatagctgtgacacccc

SEQ ID NO: 690050 - DNA, 25 bp, Mus musculus
gtctatctgcagatatgattgctgt

SEQ ID NO: 690051 - DNA, 25 bp, Mus musculus
gtctatctgcagttatgattgctgt

SEQ ID NO: 690052 - DNA, 25 bp, Mus musculus
gtctatctgcttaaaagtaatgatt

SEQ ID NO: 690053 - DNA, 25 bp, Mus musculus
gtctatctgctttaaagtaatgatt

SEQ ID NO: 690054 - DNA, 25 bp, Mus musculus
gtctatctgtttatgccatgccaac

SEQ ID NO: 690055 - DNA, 25 bp, Mus musculus
gtctatctgtttttgccatgccaac

SEQ ID NO: 690056 - DNA, 25 bp, Mus musculus
gtctatcttgctacattgtctttgt

SEQ ID NO: 690057 - DNA, 25 bp, Mus musculus
gtctatcttgcttcattgtctttgt

SEQ ID NO: 690058 - DNA, 25 bp, Mus musculus
gtctatcttgtaattagggcactgt

SEQ ID NO: 690059 - DNA, 25 bp, Mus musculus
gtctatcttgtatttagggcactgt

SEQ ID NO: 690060 - DNA, 25 bp, Mus musculus
gtctatgaaaccaccaacttttggc

SEQ ID NO: 690061 - DNA, 25 bp, Mus musculus
gtctatgaaacctccaacttttggc

SEQ ID NO: 690062 - DNA, 25 bp, Mus musculus
gtctatgaaaggcttgctcgcccca

SEQ ID NO: 690063 - DNA, 25 bp, Mus musculus
gtctatgaaagggttgctcgcccca

SEQ ID NO: 690064 - DNA, 25 bp, Mus musculus
gtctatgaagttctctggtgctttc

SEQ ID NO: 690065 - DNA, 25 bp, Mus musculus
gtctatgaagttgtctggtgctttc

SEQ ID NO: 690066 - DNA, 25 bp, Mus musculus
gtctatgacagtcttcttggatcaa

SEQ ID NO: 690067 - DNA, 25 bp, Mus musculus
gtctatgacagtgttcttggatcaa

SEQ ID NO: 690068 - DNA, 25 bp, Mus musculus
gtctatgacccgcagcaggatgatg

SEQ ID NO: 690069 - DNA, 25 bp, Mus musculus
gtctatgacccggagcaggatgatg

SEQ ID NO: 690070 - DNA, 25 bp, Mus musculus
gtctatgactttcgtgatgctcgga

SEQ ID NO: 690071 - DNA, 25 bp, Mus musculus
gtctatgactttggtgatgctcgga

SEQ ID NO: 690072 - DNA, 25 bp, Mus musculus
gtctatgagaatccttacgggaggt

SEQ ID NO: 690073 - DNA, 25 bp, Mus musculus
gtctatgagaatgcttacgggaggt

SEQ ID NO: 690074 - DNA, 25 bp, Mus musculus
gtctatgagcaacagatgccgtcct

SEQ ID NO: 690075 - DNA, 25 bp, Mus musculus
gtctatgagcaagagatgccgtcct

SEQ ID NO: 690076 - DNA, 25 bp, Mus musculus
gtctatgagccaagcttttgtaggg

SEQ ID NO: 690077 - DNA, 25 bp, Mus musculus
gtctatgagccatgcttttgtaggg

SEQ ID NO: 690078 - DNA, 25 bp, Mus musculus
gtctatgagcttcagtgttcttcct

SEQ ID NO: 690079 - DNA, 25 bp, Mus musculus
gtctatgagcttgagtgttcttcct

SEQ ID NO: 690080 - DNA, 25 bp, Mus musculus
gtctatgagggtaggcccagcgata

SEQ ID NO: 690081 - DNA, 25 bp, Mus musculus
gtctatgagggttggcccagcgata

SEQ ID NO: 690082 - DNA, 25 bp, Mus musculus
gtctatgaggtgctggacccatgaa

SEQ ID NO: 690083 - DNA, 25 bp, Mus musculus
gtctatgaggtggtggacccatgaa

SEQ ID NO: 690084 - DNA, 25 bp, Mus musculus
gtctatgagtaaacactgggcttat

SEQ ID NO: 690085 - DNA, 25 bp, Mus musculus
gtctatgagtaatcactgggcttat

SEQ ID NO: 690086 - DNA, 25 bp, Mus musculus
gtctatgcacggctctgcgacaaga

SEQ ID NO: 690087 - DNA, 25 bp, Mus musculus
gtctatgcacgggtctgcgacaaga

SEQ ID NO: 690088 - DNA, 25 bp, Mus musculus
gtctatgcagcaaaaccaggatcct

SEQ ID NO: 690089 - DNA, 25 bp, Mus musculus
gtctatgcagcataaccaggatcct

SEQ ID NO: 690090 - DNA, 25 bp, Mus musculus
gtctatgcatttacctgtaaaccct

SEQ ID NO: 690091 - DNA, 25 bp, Mus musculus
gtctatgcattttcctgtaaaccct

SEQ ID NO: 690092 - DNA, 25 bp, Mus musculus
gtctatgccatgctctctgggcaaa

SEQ ID NO: 690093 - DNA, 25 bp, Mus musculus
gtctatgccatggtctctgggcaaa

SEQ ID NO: 690094 - DNA, 25 bp, Mus musculus
gtctatgcgcttaggtgaccaagct

SEQ ID NO: 690095 - DNA, 25 bp, Mus musculus
gtctatgcgctttggtgaccaagct

SEQ ID NO: 690096 - DNA, 25 bp, Mus musculus
gtctatgctgccacagaaatctaat

SEQ ID NO: 690097 - DNA, 25 bp, Mus musculus
gtctatgctgcctcagaaatctaat

SEQ ID NO: 690098 - DNA, 25 bp, Mus musculus
gtctatgcttacacacaagtcggag

SEQ ID NO: 690099 - DNA, 25 bp, Mus musculus
gtctatgcttactcacaagtcggag

SEQ ID NO: 690100 - DNA, 25 bp, Mus musculus
gtctatggagacctattgtcctaat

SEQ ID NO: 690101 - DNA, 25 bp, Mus musculus
gtctatggagacgtattgtcctaat

SEQ ID NO: 690102 - DNA, 25 bp, Mus musculus
gtctatggagagctgtgctgaatcc

SEQ ID NO: 690103 - DNA, 25 bp, Mus musculus
gtctatggagaggtgtgctgaatcc

SEQ ID NO: 690104 - DNA, 25 bp, Mus musculus
gtctatggcaacaacaatctgctgt

SEQ ID NO: 690105 - DNA, 25 bp, Mus musculus
gtctatggcaactacaatctgctgt

SEQ ID NO: 690106 - DNA, 25 bp, Mus musculus
gtctatggctggaacttgctacaca

SEQ ID NO: 690107 - DNA, 25 bp, Mus musculus
gtctatggctggtacttgctacaca

SEQ ID NO: 690108 - DNA, 25 bp, Mus musculus
gtctatggctttaaacatcagtaca

SEQ ID NO: 690109 - DNA, 25 bp, Mus musculus
gtctatggcttttaacatcagtaca

SEQ ID NO: 690110 - DNA, 25 bp, Mus musculus
gtctatgggaaacgcatcaatcagc

SEQ ID NO: 690111 - DNA, 25 bp, Mus musculus
gtctatgggaaaggcatcaatcagc

SEQ ID NO: 690112 - DNA, 25 bp, Mus musculus
gtctatgggaacatcaagcctttat

SEQ ID NO: 690113 - DNA, 25 bp, Mus musculus
gtctatgggaacttcaagcctttat

SEQ ID NO: 690114 - DNA, 25 bp, Mus musculus
gtctatggttcaaggtcccactggg

SEQ ID NO: 690115 - DNA, 25 bp, Mus musculus
gtctatggttcatggtcccactggg

SEQ ID NO: 690116 - DNA, 25 bp, Mus musculus
gtctatgtaaccagggcggccctga

SEQ ID NO: 690117 - DNA, 25 bp, Mus musculus
gtctatgtaacctgggcggccctga

SEQ ID NO: 690118 - DNA, 25 bp, Mus musculus
gtctatgtaccgcaacaatctaaga

SEQ ID NO: 690119 - DNA, 25 bp, Mus musculus
gtctatgtaccggaacaatctaaga

SEQ ID NO: 690120 - DNA, 25 bp, Mus musculus
gtctatgtactgacctgaagctcca

SEQ ID NO: 690121 - DNA, 25 bp, Mus musculus
gtctatgtactgtcctgaagctcca

SEQ ID NO: 690122 - DNA, 25 bp, Mus musculus
gtctatgtacttctctgtagaggca

SEQ ID NO: 690123 - DNA, 25 bp, Mus musculus
gtctatgtacttgtctgtagaggca

SEQ ID NO: 690124 - DNA, 25 bp, Mus musculus
gtctatgtagacacaattcccaaaa

SEQ ID NO: 690125 - DNA, 25 bp, Mus musculus
gtctatgtagactcaattcccaaaa

SEQ ID NO: 690126 - DNA, 25 bp, Mus musculus
gtctatgtagataccctggacttca

SEQ ID NO: 690127 - DNA, 25 bp, Mus musculus
gtctatgtagattccctggacttca

SEQ ID NO: 690128 - DNA, 25 bp, Mus musculus
gtctatgtcaggcttcaagttacta

SEQ ID NO: 690129 - DNA, 25 bp, Mus musculus
gtctatgtcagggttcaagttacta

SEQ ID NO: 690130 - DNA, 25 bp, Mus musculus
gtctatgtcccaccatgctaagagg

SEQ ID NO: 690131 - DNA, 25 bp, Mus musculus
gtctatgtcccagcatgctaagagg

SEQ ID NO: 690132 - DNA, 25 bp, Mus musculus
gtctatgtcctgaggcaaagcaact

SEQ ID NO: 690133 - DNA, 25 bp, Mus musculus
gtctatgtcctgtggcaaagcaact

SEQ ID NO: 690134 - DNA, 25 bp, Mus musculus
gtctatgtctagatcatgagccatt

SEQ ID NO: 690135 - DNA, 25 bp, Mus musculus
gtctatgtctagctcaagtcacaat

SEQ ID NO: 690136 - DNA, 25 bp, Mus musculus
gtctatgtctaggtcaagtcacaat

SEQ ID NO: 690137 - DNA, 25 bp, Mus musculus
gtctatgtctagttcatgagccatt

SEQ ID NO: 690138 - DNA, 25 bp, Mus musculus
gtctatgtgatgacaaagtgcacct

SEQ ID NO: 690139 - DNA, 25 bp, Mus musculus
gtctatgtgatgtcaaagtgcacct

SEQ ID NO: 690140 - DNA, 25 bp, Mus musculus
gtctatgtggtaagttccaagccat

SEQ ID NO: 690141 - DNA, 25 bp, Mus musculus
gtctatgtggtatgttccaagccat

SEQ ID NO: 690142 - DNA, 25 bp, Mus musculus
gtctatgttatccaagcaattcact

SEQ ID NO: 690143 - DNA, 25 bp, Mus musculus
gtctatgttatcgaagcaattcact

SEQ ID NO: 690144 - DNA, 25 bp, Mus musculus
gtctatgttcttctgggtctccaag

SEQ ID NO: 690145 - DNA, 25 bp, Mus musculus
gtctatgttcttgtgggtctccaag

SEQ ID NO: 690146 - DNA, 25 bp, Mus musculus
gtctattaatttagtctttagctcg

SEQ ID NO: 690147 - DNA, 25 bp, Mus musculus
gtctattaattttgtctttagctcg

SEQ ID NO: 690148 - DNA, 25 bp, Mus musculus
gtctattactgtaatgcatatggta

SEQ ID NO: 690149 - DNA, 25 bp, Mus musculus
gtctattactgtacaagaaactccc

SEQ ID NO: 690150 - DNA, 25 bp, Mus musculus
gtctattactgtagtgcctatggtg

SEQ ID NO: 690151 - DNA, 25 bp, Mus musculus
gtctattactgttatgcatatggta

SEQ ID NO: 690152 - DNA, 25 bp, Mus musculus
gtctattactgttcaagaaactccc

SEQ ID NO: 690153 - DNA, 25 bp, Mus musculus
gtctattactgttgtgcctatggtg

SEQ ID NO: 690154 - DNA, 25 bp, Mus musculus
gtctattatggcacttggctcttac

SEQ ID NO: 690155 - DNA, 25 bp, Mus musculus
gtctattatggctcttggctcttac

SEQ ID NO: 690156 - DNA, 25 bp, Mus musculus
gtctattattccaatgacctctggg

SEQ ID NO: 690157 - DNA, 25 bp, Mus musculus
gtctattattcctatgacctctggg

SEQ ID NO: 690158 - DNA, 25 bp, Mus musculus
gtctattcaaatatccttcctggtc

SEQ ID NO: 690159 - DNA, 25 bp, Mus musculus
gtctattcaaatttccttcctggtc

SEQ ID NO: 690160 - DNA, 25 bp, Mus musculus
gtctattcactgctgtccttctgaa

SEQ ID NO: 690161 - DNA, 25 bp, Mus musculus
gtctattcactggtgtccttctgaa

SEQ ID NO: 690162 - DNA, 25 bp, Mus musculus
gtctattcaggaactcaccgtcaaa

SEQ ID NO: 690163 - DNA, 25 bp, Mus musculus
gtctattcaggatctcaccgtcaaa

SEQ ID NO: 690164 - DNA, 25 bp, Mus musculus
gtctattcattcacgttagctatat

SEQ ID NO: 690165 - DNA, 25 bp, Mus musculus
gtctattcattctcgttagctatat

SEQ ID NO: 690166 - DNA, 25 bp, Mus musculus
gtctattcctgcctagagggtttac

SEQ ID NO: 690167 - DNA, 25 bp, Mus musculus
gtctattcctgcgtagagggtttac

SEQ ID NO: 690168 - DNA, 25 bp, Mus musculus
gtctattccttcacttacattacaa

SEQ ID NO: 690169 - DNA, 25 bp, Mus musculus
gtctattccttctcttacattacaa

SEQ ID NO: 690170 - DNA, 25 bp, Mus musculus
gtctattcgtcaatcaattgctggg

SEQ ID NO: 690171 - DNA, 25 bp, Mus musculus
gtctattcgtcattcaattgctggg

SEQ ID NO: 690172 - DNA, 25 bp, Mus musculus
gtctattctcataatggcagggcat

SEQ ID NO: 690173 - DNA, 25 bp, Mus musculus
gtctattctcattatggcagggcat

SEQ ID NO: 690174 - DNA, 25 bp, Mus musculus
gtctattctgccagtccaatatttg

SEQ ID NO: 690175 - DNA, 25 bp, Mus musculus
gtctattctgcctgtccaatatttg

SEQ ID NO: 690176 - DNA, 25 bp, Mus musculus
gtctattctgttatctaaactgagt

SEQ ID NO: 690177 - DNA, 25 bp, Mus musculus
gtctattctgttttctaaactgagt

SEQ ID NO: 690178 - DNA, 25 bp, Mus musculus
gtctattcttttcctctggagtttg

SEQ ID NO: 690179 - DNA, 25 bp, Mus musculus
gtctattcttttgctctggagtttg

SEQ ID NO: 690180 - DNA, 25 bp, Mus musculus
gtctattgaagtcttgttgatacca

SEQ ID NO: 690181 - DNA, 25 bp, Mus musculus
gtctattgaagtgttgttgatacca

SEQ ID NO: 690182 - DNA, 25 bp, Mus musculus
gtctattgattcatggtccccaact

SEQ ID NO: 690183 - DNA, 25 bp, Mus musculus
gtctattgattcttggtccccaact

SEQ ID NO: 690184 - DNA, 25 bp, Mus musculus
gtctattgccatcaagaaccccaag

SEQ ID NO: 690185 - DNA, 25 bp, Mus musculus
gtctattgccatgaagaaccccaag

SEQ ID NO: 690186 - DNA, 25 bp, Mus musculus
gtctattgccctagattttgatatt

SEQ ID NO: 690187 - DNA, 25 bp, Mus musculus
gtctattgcccttgattttgatatt

SEQ ID NO: 690188 - DNA, 25 bp, Mus musculus
gtctattggtccattgacacgcaca

SEQ ID NO: 690189 - DNA, 25 bp, Mus musculus
gtctattggtcctttgacacgcaca

SEQ ID NO: 690190 - DNA, 25 bp, Mus musculus
gtctattgtttgaaggtgttgccta

SEQ ID NO: 690191 - DNA, 25 bp, Mus musculus
gtctattgtttgtaggtgttgccta

SEQ ID NO: 690192 - DNA, 25 bp, Mus musculus
gtctatttaattagcttccttctga

SEQ ID NO: 690193 - DNA, 25 bp, Mus musculus
gtctatttaatttgcttccttctga

SEQ ID NO: 690194 - DNA, 25 bp, Mus musculus
gtctatttagagaccttatggctct

SEQ ID NO: 690195 - DNA, 25 bp, Mus musculus
gtctatttagagtccttatggctct

SEQ ID NO: 690196 - DNA, 25 bp, Mus musculus
gtctatttcaccacatcgttctggg

SEQ ID NO: 690197 - DNA, 25 bp, Mus musculus
gtctatttcacctcatcgttctggg

SEQ ID NO: 690198 - DNA, 25 bp, Mus musculus
gtctatttcattaacatagcaccaa

SEQ ID NO: 690199 - DNA, 25 bp, Mus musculus
gtctatttcatttacatagcaccaa

SEQ ID NO: 690200 - DNA, 25 bp, Mus musculus
gtctatttctagatcctggtaacca

SEQ ID NO: 690201 - DNA, 25 bp, Mus musculus
gtctatttctagttcctggtaacca

SEQ ID NO: 690202 - DNA, 25 bp, Mus musculus
gtctatttctgacttgcccataact

SEQ ID NO: 690203 - DNA, 25 bp, Mus musculus
gtctatttctgagttgcccataact

SEQ ID NO: 690204 - DNA, 25 bp, Mus musculus
gtctatttgccacccagggaaccag

SEQ ID NO: 690205 - DNA, 25 bp, Mus musculus
gtctatttgccagccagggaaccag

SEQ ID NO: 690206 - DNA, 25 bp, Mus musculus
gtctatttgctaaagcatggccagg

SEQ ID NO: 690207 - DNA, 25 bp, Mus musculus
gtctatttgctatagcatggccagg

SEQ ID NO: 690208 - DNA, 25 bp, Mus musculus
gtctatttgggacctcaatcttcca

SEQ ID NO: 690209 - DNA, 25 bp, Mus musculus
gtctatttgggagctcaatcttcca

SEQ ID NO: 690210 - DNA, 25 bp, Mus musculus
gtctatttggtaattcagtctttat

SEQ ID NO: 690211 - DNA, 25 bp, Mus musculus
gtctatttggtatttcagtctttat

SEQ ID NO: 690212 - DNA, 25 bp, Mus musculus
gtctattttaccactgcttgtgaag

SEQ ID NO: 690213 - DNA, 25 bp, Mus musculus
gtctattttacctctgcttgtgaag

SEQ ID NO: 690214 - DNA, 25 bp, Mus musculus
gtctattttatcagcctgtgtgcac

SEQ ID NO: 690215 - DNA, 25 bp, Mus musculus
gtctattttatctgcctgtgtgcac

SEQ ID NO: 690216 - DNA, 25 bp, Mus musculus
gtctattttctactgagttctctgg

SEQ ID NO: 690217 - DNA, 25 bp, Mus musculus
gtctattttctagtgagttctctgg

SEQ ID NO: 690218 - DNA, 25 bp, Mus musculus
gtctattttgtaatgctgttgctcc

SEQ ID NO: 690219 - DNA, 25 bp, Mus musculus
gtctattttgtaatggccactggga

SEQ ID NO: 690220 - DNA, 25 bp, Mus musculus
gtctattttgtattgctgttgctcc

SEQ ID NO: 690221 - DNA, 25 bp, Mus musculus
gtctattttgtattggccactggga

SEQ ID NO: 690222 - DNA, 25 bp, Mus musculus
gtctatttttacaccgagtgtccaa

SEQ ID NO: 690223 - DNA, 25 bp, Mus musculus
gtctatttttactccgagtgtccaa

SEQ ID NO: 690224 - DNA, 25 bp, Mus musculus
gtctatttttctccggatccatttg

SEQ ID NO: 690225 - DNA, 25 bp, Mus musculus
gtctatttttctgcggatccatttg

SEQ ID NO: 690226 - DNA, 25 bp, Mus musculus
gtctcaaaatggctatggtccatta

SEQ ID NO: 690227 - DNA, 25 bp, Mus musculus
gtctcaaaatgggtatggtccatta

SEQ ID NO: 690228 - DNA, 25 bp, Mus musculus
gtctcaaacctcacacgggctatga

SEQ ID NO: 690229 - DNA, 25 bp, Mus musculus
gtctcaaacctctcacgggctatga

SEQ ID NO: 690230 - DNA, 25 bp, Mus musculus
gtctcaaactagcaacaaattctga

SEQ ID NO: 690231 - DNA, 25 bp, Mus musculus
gtctcaaactaggaacaaattctga

SEQ ID NO: 690232 - DNA, 25 bp, Mus musculus
gtctcaaactcaattgcatagctta

SEQ ID NO: 690233 - DNA, 25 bp, Mus musculus
gtctcaaactcatttgcatagctta

SEQ ID NO: 690234 - DNA, 25 bp, Mus musculus
gtctcaaactcccaacaatgttact

SEQ ID NO: 690235 - DNA, 25 bp, Mus musculus
gtctcaaactccgaacaatgttact

SEQ ID NO: 690236 - DNA, 25 bp, Mus musculus
gtctcaaacttaatgtttggctcta

SEQ ID NO: 690237 - DNA, 25 bp, Mus musculus
gtctcaaacttattgtttggctcta

SEQ ID NO: 690238 - DNA, 25 bp, Mus musculus
gtctcaaagaagacatctctggttg

SEQ ID NO: 690239 - DNA, 25 bp, Mus musculus
gtctcaaagaagtcatctctggttg

SEQ ID NO: 690240 - DNA, 25 bp, Mus musculus
gtctcaaagaatccagtgatgtaat

SEQ ID NO: 690241 - DNA, 25 bp, Mus musculus
gtctcaaagaatgcagtgatgtaat

SEQ ID NO: 690242 - DNA, 25 bp, Mus musculus
gtctcaaaggctctgggtaagctga

SEQ ID NO: 690243 - DNA, 25 bp, Mus musculus
gtctcaaaggctgtgggtaagctga

SEQ ID NO: 690244 - DNA, 25 bp, Mus musculus
gtctcaaatttaacgaatactctta

SEQ ID NO: 690245 - DNA, 25 bp, Mus musculus
gtctcaaatttatcgaatactctta

SEQ ID NO: 690246 - DNA, 25 bp, Mus musculus
gtctcaacactcaaccttgatgtgt

SEQ ID NO: 690247 - DNA, 25 bp, Mus musculus
gtctcaacactctaccttgatgtgt

SEQ ID NO: 690248 - DNA, 25 bp, Mus musculus
gtctcaacacttcggctcaagcagt

SEQ ID NO: 690249 - DNA, 25 bp, Mus musculus
gtctcaacacttgggctcaagcagt

SEQ ID NO: 690250 - DNA, 25 bp, Mus musculus
gtctcaacctttcactgacggaggg

SEQ ID NO: 690251 - DNA, 25 bp, Mus musculus
gtctcaacctttgactgacggaggg

SEQ ID NO: 690252 - DNA, 25 bp, Mus musculus
gtctcaactagaagtgtccttgctc

SEQ ID NO: 690253 - DNA, 25 bp, Mus musculus
gtctcaactagatgtgtccttgctc

SEQ ID NO: 690254 - DNA, 25 bp, Mus musculus
gtctcaactgaaatcttggtgcaat

SEQ ID NO: 690255 - DNA, 25 bp, Mus musculus
gtctcaactgaattcttggtgcaat

SEQ ID NO: 690256 - DNA, 25 bp, Mus musculus
gtctcaactgggattgtgtgactca

SEQ ID NO: 690257 - DNA, 25 bp, Mus musculus
gtctcaactgggtttgtgtgactca

SEQ ID NO: 690258 - DNA, 25 bp, Mus musculus
gtctcaactgtaactacccattcat

SEQ ID NO: 690259 - DNA, 25 bp, Mus musculus
gtctcaactgtatctacccattcat

SEQ ID NO: 690260 - DNA, 25 bp, Mus musculus
gtctcaagacctatgccactcagaa

SEQ ID NO: 690261 - DNA, 25 bp, Mus musculus
gtctcaagacctttgccactcagaa

SEQ ID NO: 690262 - DNA, 25 bp, Mus musculus
gtctcaagatacaagcgacactgaa

SEQ ID NO: 690263 - DNA, 25 bp, Mus musculus
gtctcaagatactagcgacactgaa

SEQ ID NO: 690264 - DNA, 25 bp, Mus musculus
gtctcaagcaagaaaccaaccaatc

SEQ ID NO: 690265 - DNA, 25 bp, Mus musculus
gtctcaagcaagcagcccagagcag

SEQ ID NO: 690266 - DNA, 25 bp, Mus musculus
gtctcaagcaaggagcccagagcag

SEQ ID NO: 690267 - DNA, 25 bp, Mus musculus
gtctcaagcaagtaaccaaccaatc

SEQ ID NO: 690268 - DNA, 25 bp, Mus musculus
gtctcaagccttacatgtgaactca

SEQ ID NO: 690269 - DNA, 25 bp, Mus musculus
gtctcaagcctttcatgtgaactca

SEQ ID NO: 690270 - DNA, 25 bp, Mus musculus
gtctcaagcgccagtaatgccagac

SEQ ID NO: 690271 - DNA, 25 bp, Mus musculus
gtctcaagcgccatcatactggata

SEQ ID NO: 690272 - DNA, 25 bp, Mus musculus
gtctcaagcgcctgtaatgccagac

SEQ ID NO: 690273 - DNA, 25 bp, Mus musculus
gtctcaagcgccttcatactggata

SEQ ID NO: 690274 - DNA, 25 bp, Mus musculus
gtctcaaggaaccagaaccagctag

SEQ ID NO: 690275 - DNA, 25 bp, Mus musculus
gtctcaaggaacgagaaccagctag

SEQ ID NO: 690276 - DNA, 25 bp, Mus musculus
gtctcaaggagacccactttcttta

SEQ ID NO: 690277 - DNA, 25 bp, Mus musculus
gtctcaaggagagccactttcttta

SEQ ID NO: 690278 - DNA, 25 bp, Mus musculus
gtctcaaggttgcagtcgtactcta

SEQ ID NO: 690279 - DNA, 25 bp, Mus musculus
gtctcaaggttggagtcgtactcta

SEQ ID NO: 690280 - DNA, 25 bp, Mus musculus
gtctcaagtcttcatcgaggcatga

SEQ ID NO: 690281 - DNA, 25 bp, Mus musculus
gtctcaagtcttgatcgaggcatga

SEQ ID NO: 690282 - DNA, 25 bp, Mus musculus
gtctcaagtgatcggctaatctaca

SEQ ID NO: 690283 - DNA, 25 bp, Mus musculus
gtctcaagtgatgggctaatctaca

SEQ ID NO: 690284 - DNA, 25 bp, Mus musculus
gtctcaagttggatgacctcattac

SEQ ID NO: 690285 - DNA, 25 bp, Mus musculus
gtctcaagttggttgacctcattac

SEQ ID NO: 690286 - DNA, 25 bp, Mus musculus
gtctcaatacctacagtttctctgc

SEQ ID NO: 690287 - DNA, 25 bp, Mus musculus
gtctcaataccttcagtttctctgc

SEQ ID NO: 690288 - DNA, 25 bp, Mus musculus
gtctcaatactcataaatcctgcta

SEQ ID NO: 690289 - DNA, 25 bp, Mus musculus
gtctcaatactcttaaatcctgcta

SEQ ID NO: 690290 - DNA, 25 bp, Mus musculus
gtctcaatgtacacagcccagtatt

SEQ ID NO: 690291 - DNA, 25 bp, Mus musculus
gtctcaatgtactcagcccagtatt

SEQ ID NO: 690292 - DNA, 25 bp, Mus musculus
gtctcacaaaatccctaatgtcctg

SEQ ID NO: 690293 - DNA, 25 bp, Mus musculus
gtctcacaaaatgcctaatgtcctg

SEQ ID NO: 690294 - DNA, 25 bp, Mus musculus
gtctcacaagggaactcttcctgta

SEQ ID NO: 690295 - DNA, 25 bp, Mus musculus
gtctcacaagggtactcttcctgta

SEQ ID NO: 690296 - DNA, 25 bp, Mus musculus
gtctcacacagaatgctgccttggg

SEQ ID NO: 690297 - DNA, 25 bp, Mus musculus
gtctcacacagattgctgccttggg

SEQ ID NO: 690298 - DNA, 25 bp, Mus musculus
gtctcacacagcctcttctaatggg

SEQ ID NO: 690299 - DNA, 25 bp, Mus musculus
gtctcacacagcgtcttctaatggg

SEQ ID NO: 690300 - DNA, 25 bp, Mus musculus
gtctcacactggagtagaagttttt

SEQ ID NO: 690301 - DNA, 25 bp, Mus musculus
gtctcacactggtgtagaagttttt

SEQ ID NO: 690302 - DNA, 25 bp, Mus musculus
gtctcacagaagagtcaaacttgct

SEQ ID NO: 690303 - DNA, 25 bp, Mus musculus
gtctcacagaagtgtcaaacttgct

SEQ ID NO: 690304 - DNA, 25 bp, Mus musculus
gtctcacagactatcatggttttcc

SEQ ID NO: 690305 - DNA, 25 bp, Mus musculus
gtctcacagactttcatggttttcc

SEQ ID NO: 690306 - DNA, 25 bp, Mus musculus
gtctcacaggccctttaatcaaacc

SEQ ID NO: 690307 - DNA, 25 bp, Mus musculus
gtctcacaggccgtttaatcaaacc

SEQ ID NO: 690308 - DNA, 25 bp, Mus musculus
gtctcacagttcaaggcaggcaaga

SEQ ID NO: 690309 - DNA, 25 bp, Mus musculus
gtctcacagttctaggcaggcaaga

SEQ ID NO: 690310 - DNA, 25 bp, Mus musculus
gtctcacagttgcttgtagctctgc

SEQ ID NO: 690311 - DNA, 25 bp, Mus musculus
gtctcacagttggttgtagctctgc

SEQ ID NO: 690312 - DNA, 25 bp, Mus musculus
gtctcacagtttctttgcattgtgg

SEQ ID NO: 690313 - DNA, 25 bp, Mus musculus
gtctcacagtttgtttgcattgtgg

SEQ ID NO: 690314 - DNA, 25 bp, Mus musculus
gtctcacataggctgtaagctctct

SEQ ID NO: 690315 - DNA, 25 bp, Mus musculus
gtctcacatagggtgtaagctctct

SEQ ID NO: 690316 - DNA, 25 bp, Mus musculus
gtctcaccaatgatcagagccatga

SEQ ID NO: 690317 - DNA, 25 bp, Mus musculus
gtctcaccaatgttcagagccatga

SEQ ID NO: 690318 - DNA, 25 bp, Mus musculus
gtctcaccacacattggaggaatgc

SEQ ID NO: 690319 - DNA, 25 bp, Mus musculus
gtctcaccacactttggaggaatgc

SEQ ID NO: 690320 - DNA, 25 bp, Mus musculus
gtctcaccactgaagccagatgttt

SEQ ID NO: 690321 - DNA, 25 bp, Mus musculus
gtctcaccactgtagccagatgttt

SEQ ID NO: 690322 - DNA, 25 bp, Mus musculus
gtctcaccgagacttcacagaactg

SEQ ID NO: 690323 - DNA, 25 bp, Mus musculus
gtctcaccgagagttcacagaactg

SEQ ID NO: 690324 - DNA, 25 bp, Mus musculus
gtctcacctcaacgaccacgagaga

SEQ ID NO: 690325 - DNA, 25 bp, Mus musculus
gtctcacctcaaggaccacgagaga

SEQ ID NO: 690326 - DNA, 25 bp, Mus musculus
gtctcacctcagacttattcatttg

SEQ ID NO: 690327 - DNA, 25 bp, Mus musculus
gtctcacctcagtcttattcatttg

SEQ ID NO: 690328 - DNA, 25 bp, Mus musculus
gtctcacctgcgcttttgaaagcag

SEQ ID NO: 690329 - DNA, 25 bp, Mus musculus
gtctcacctgcggttttgaaagcag

SEQ ID NO: 690330 - DNA, 25 bp, Mus musculus
gtctcacctggtatcttcaaatatc

SEQ ID NO: 690331 - DNA, 25 bp, Mus musculus
gtctcacctggtttcttcaaatatc

SEQ ID NO: 690332 - DNA, 25 bp, Mus musculus
gtctcacgagagacagaacatctgt

SEQ ID NO: 690333 - DNA, 25 bp, Mus musculus
gtctcacgagagtcagaacatctgt

SEQ ID NO: 690334 - DNA, 25 bp, Mus musculus
gtctcacggaagaagcgggagcatt

SEQ ID NO: 690335 - DNA, 25 bp, Mus musculus
gtctcacggaagtagcgggagcatt

SEQ ID NO: 690336 - DNA, 25 bp, Mus musculus
gtctcacggaggcacaggatgctat

SEQ ID NO: 690337 - DNA, 25 bp, Mus musculus
gtctcacggagggacaggatgctat

SEQ ID NO: 690338 - DNA, 25 bp, Mus musculus
gtctcacgtgccctttgaaaattgt

SEQ ID NO: 690339 - DNA, 25 bp, Mus musculus
gtctcacgtgccgtttgaaaattgt

SEQ ID NO: 690340 - DNA, 25 bp, Mus musculus
gtctcacgttttactttgttacagt

SEQ ID NO: 690341 - DNA, 25 bp, Mus musculus
gtctcacgtttttctttgttacagt

SEQ ID NO: 690342 - DNA, 25 bp, Mus musculus
gtctcactaaacagggacccatcta

SEQ ID NO: 690343 - DNA, 25 bp, Mus musculus
gtctcactaaactgggacccatcta

SEQ ID NO: 690344 - DNA, 25 bp, Mus musculus
gtctcactaatcaacttacgcagtt

SEQ ID NO: 690345 - DNA, 25 bp, Mus musculus
gtctcactaatctacttacgcagtt

SEQ ID NO: 690346 - DNA, 25 bp, Mus musculus
gtctcactagtgactggataaccta

SEQ ID NO: 690347 - DNA, 25 bp, Mus musculus
gtctcactagtgtctggataaccta

SEQ ID NO: 690348 - DNA, 25 bp, Mus musculus
gtctcactatatcaagcagtctttg

SEQ ID NO: 690349 - DNA, 25 bp, Mus musculus
gtctcactatatgaagcagtctttg

SEQ ID NO: 690350 - DNA, 25 bp, Mus musculus
gtctcactattgaagttcccgctgt

SEQ ID NO: 690351 - DNA, 25 bp, Mus musculus
gtctcactattgtagttcccgctgt

SEQ ID NO: 690352 - DNA, 25 bp, Mus musculus
gtctcactctttctcaatgagaggt

SEQ ID NO: 690353 - DNA, 25 bp, Mus musculus
gtctcactctttgtcaatgagaggt

SEQ ID NO: 690354 - DNA, 25 bp, Mus musculus
gtctcactgagccaacttaactctg

SEQ ID NO: 690355 - DNA, 25 bp, Mus musculus
gtctcactgagcgaacttaactctg

SEQ ID NO: 690356 - DNA, 25 bp, Mus musculus
gtctcactgcctcggaagagccctg

SEQ ID NO: 690357 - DNA, 25 bp, Mus musculus
gtctcactgcctgggaagagccctg

SEQ ID NO: 690358 - DNA, 25 bp, Mus musculus
gtctcactgcggactatgtatgtgt

SEQ ID NO: 690359 - DNA, 25 bp, Mus musculus
gtctcactgcggtctatgtatgtgt

SEQ ID NO: 690360 - DNA, 25 bp, Mus musculus
gtctcactggctagatgtcctgcag

SEQ ID NO: 690361 - DNA, 25 bp, Mus musculus
gtctcactggcttgatgtcctgcag

SEQ ID NO: 690362 - DNA, 25 bp, Mus musculus
gtctcactgttcaaaaacacctgtc

SEQ ID NO: 690363 - DNA, 25 bp, Mus musculus
gtctcactgttctaaaacacctgtc

SEQ ID NO: 690364 - DNA, 25 bp, Mus musculus
gtctcactgttgacatatttaatgt

SEQ ID NO: 690365 - DNA, 25 bp, Mus musculus
gtctcactgttgtcatatttaatgt

SEQ ID NO: 690366 - DNA, 25 bp, Mus musculus
gtctcacttagtagcagcgtcattt

SEQ ID NO: 690367 - DNA, 25 bp, Mus musculus
gtctcacttagttgcagcgtcattt

SEQ ID NO: 690368 - DNA, 25 bp, Mus musculus
gtctcacttcaacaagtgcccagat

SEQ ID NO: 690369 - DNA, 25 bp, Mus musculus
gtctcacttcaagaagtgcccagat

SEQ ID NO: 690370 - DNA, 25 bp, Mus musculus
gtctcacttgaacgtcaggaggcca

SEQ ID NO: 690371 - DNA, 25 bp, Mus musculus
gtctcacttgaaggtcaggaggcca

SEQ ID NO: 690372 - DNA, 25 bp, Mus musculus
gtctcacttggaccgttaaggtttc

SEQ ID NO: 690373 - DNA, 25 bp, Mus musculus
gtctcacttggagcgttaaggtttc

SEQ ID NO: 690374 - DNA, 25 bp, Mus musculus
gtctcacttggcctgatgaagcagt

SEQ ID NO: 690375 - DNA, 25 bp, Mus musculus
gtctcacttggcgtgatgaagcagt

SEQ ID NO: 690376 - DNA, 25 bp, Mus musculus
gtctcacttgtgcatacaatctaaa

SEQ ID NO: 690377 - DNA, 25 bp, Mus musculus
gtctcacttgtggatacaatctaaa

SEQ ID NO: 690378 - DNA, 25 bp, Mus musculus
gtctcactttagaccatcctgtgta

SEQ ID NO: 690379 - DNA, 25 bp, Mus musculus
gtctcactttagtccatcctgtgta

SEQ ID NO: 690380 - DNA, 25 bp, Mus musculus
gtctcagaagggacaaaggagcact

SEQ ID NO: 690381 - DNA, 25 bp, Mus musculus
gtctcagaagggtcaaaggagcact

SEQ ID NO: 690382 - DNA, 25 bp, Mus musculus
gtctcagacagcaccacttgtgaat

SEQ ID NO: 690383 - DNA, 25 bp, Mus musculus
gtctcagacagctccacttgtgaat

SEQ ID NO: 690384 - DNA, 25 bp, Mus musculus
gtctcagacatacagaccaggtcag

SEQ ID NO: 690385 - DNA, 25 bp, Mus musculus
gtctcagacatagagaccaggtcag

SEQ ID NO: 690386 - DNA, 25 bp, Mus musculus
gtctcagacgccctgctggaaaaga

SEQ ID NO: 690387 - DNA, 25 bp, Mus musculus
gtctcagacgccgtgctggaaaaga

SEQ ID NO: 690388 - DNA, 25 bp, Mus musculus
gtctcagactaacttcagaagtatt

SEQ ID NO: 690389 - DNA, 25 bp, Mus musculus
gtctcagactaagttcagaagtatt

SEQ ID NO: 690390 - DNA, 25 bp, Mus musculus
gtctcagagaatagccctaggttca

SEQ ID NO: 690391 - DNA, 25 bp, Mus musculus
gtctcagagaattgccctaggttca

SEQ ID NO: 690392 - DNA, 25 bp, Mus musculus
gtctcagagactctaagctcccgga

SEQ ID NO: 690393 - DNA, 25 bp, Mus musculus
gtctcagagactgtaagctcccgga

SEQ ID NO: 690394 - DNA, 25 bp, Mus musculus
gtctcagagcaaaggtttccaacta

SEQ ID NO: 690395 - DNA, 25 bp, Mus musculus
gtctcagagcaatggtttccaacta

SEQ ID NO: 690396 - DNA, 25 bp, Mus musculus
gtctcagagctacagtcctgtcaga

SEQ ID NO: 690397 - DNA, 25 bp, Mus musculus
gtctcagagctacctgttccaacca

SEQ ID NO: 690398 - DNA, 25 bp, Mus musculus
gtctcagagctagagtcctgtcaga

SEQ ID NO: 690399 - DNA, 25 bp, Mus musculus
gtctcagagctagctgttccaacca

SEQ ID NO: 690400 - DNA, 25 bp, Mus musculus
gtctcagaggccagagcggcactag

SEQ ID NO: 690401 - DNA, 25 bp, Mus musculus
gtctcagaggcctgagcggcactag

SEQ ID NO: 690402 - DNA, 25 bp, Mus musculus
gtctcagagtggcttctgggccaaa

SEQ ID NO: 690403 - DNA, 25 bp, Mus musculus
gtctcagagtgggttctgggccaaa

SEQ ID NO: 690404 - DNA, 25 bp, Mus musculus
gtctcagatattatgctgcaggttt

SEQ ID NO: 690405 - DNA, 25 bp, Mus musculus
gtctcagatattttgctgcaggttt

SEQ ID NO: 690406 - DNA, 25 bp, Mus musculus
gtctcagatcagcatttggcttttt

SEQ ID NO: 690407 - DNA, 25 bp, Mus musculus
gtctcagatcaggatttggcttttt

SEQ ID NO: 690408 - DNA, 25 bp, Mus musculus
gtctcagatctactccaggtaaggg

SEQ ID NO: 690409 - DNA, 25 bp, Mus musculus
gtctcagatctagtccaggtaaggg

SEQ ID NO: 690410 - DNA, 25 bp, Mus musculus
gtctcagatgatcatccactccaag

SEQ ID NO: 690411 - DNA, 25 bp, Mus musculus
gtctcagatgatgatccactccaag

SEQ ID NO: 690412 - DNA, 25 bp, Mus musculus
gtctcagatggccacaacagtcttt

SEQ ID NO: 690413 - DNA, 25 bp, Mus musculus
gtctcagatggccttcagcttatgc

SEQ ID NO: 690414 - DNA, 25 bp, Mus musculus
gtctcagatggcgacaacagtcttt

SEQ ID NO: 690415 - DNA, 25 bp, Mus musculus
gtctcagatggcgttcagcttatgc

SEQ ID NO: 690416 - DNA, 25 bp, Mus musculus
gtctcagattgcagcatttgaatcc

SEQ ID NO: 690417 - DNA, 25 bp, Mus musculus
gtctcagattgctgcatttgaatcc

SEQ ID NO: 690418 - DNA, 25 bp, Mus musculus
gtctcagcaaaaacacatcatctag

SEQ ID NO: 690419 - DNA, 25 bp, Mus musculus
gtctcagcaaaatcacatcatctag

SEQ ID NO: 690420 - DNA, 25 bp, Mus musculus
gtctcagcaaacatcattcgcgttg

SEQ ID NO: 690421 - DNA, 25 bp, Mus musculus
gtctcagcaaacttcattcgcgttg

SEQ ID NO: 690422 - DNA, 25 bp, Mus musculus
gtctcagcaaggagtaagcttgttt

SEQ ID NO: 690423 - DNA, 25 bp, Mus musculus
gtctcagcaaggtgtaagcttgttt

SEQ ID NO: 690424 - DNA, 25 bp, Mus musculus
gtctcagcactaagaacaactgtgt

SEQ ID NO: 690425 - DNA, 25 bp, Mus musculus
gtctcagcactatgaacaactgtgt

SEQ ID NO: 690426 - DNA, 25 bp, Mus musculus
gtctcagcagccaatcaacttacag

SEQ ID NO: 690427 - DNA, 25 bp, Mus musculus
gtctcagcagcctatcaacttacag

SEQ ID NO: 690428 - DNA, 25 bp, Mus musculus
gtctcagccacacagaacaaggatc

SEQ ID NO: 690429 - DNA, 25 bp, Mus musculus
gtctcagccacagagaacaaggatc

SEQ ID NO: 690430 - DNA, 25 bp, Mus musculus
gtctcagccatcattgtttaaaatg

SEQ ID NO: 690431 - DNA, 25 bp, Mus musculus
gtctcagccatctttgtttaaaatg

SEQ ID NO: 690432 - DNA, 25 bp, Mus musculus
gtctcagcctcacagcaacatgtgg

SEQ ID NO: 690433 - DNA, 25 bp, Mus musculus
gtctcagcctcagagcaacatgtgg

SEQ ID NO: 690434 - DNA, 25 bp, Mus musculus
gtctcagcctggcaaccttagagga

SEQ ID NO: 690435 - DNA, 25 bp, Mus musculus
gtctcagcctgggaaccttagagga

SEQ ID NO: 690436 - DNA, 25 bp, Mus musculus
gtctcagccttactcataggaacca

SEQ ID NO: 690437 - DNA, 25 bp, Mus musculus
gtctcagccttagtcataggaacca

SEQ ID NO: 690438 - DNA, 25 bp, Mus musculus
gtctcagcctttctcatggcataca

SEQ ID NO: 690439 - DNA, 25 bp, Mus musculus
gtctcagcctttgtcatggcataca

SEQ ID NO: 690440 - DNA, 25 bp, Mus musculus
gtctcagcgacacttggcactggag

SEQ ID NO: 690441 - DNA, 25 bp, Mus musculus
gtctcagcgacagttggcactggag

SEQ ID NO: 690442 - DNA, 25 bp, Mus musculus
gtctcagcggctagtcggtgctgct

SEQ ID NO: 690443 - DNA, 25 bp, Mus musculus
gtctcagcggcttgtcggtgctgct

SEQ ID NO: 690444 - DNA, 25 bp, Mus musculus
gtctcagctcccagagtaccaagta

SEQ ID NO: 690445 - DNA, 25 bp, Mus musculus
gtctcagctccctgagtaccaagta

SEQ ID NO: 690446 - DNA, 25 bp, Mus musculus
gtctcagctggccttcaattcacta

SEQ ID NO: 690447 - DNA, 25 bp, Mus musculus
gtctcagctggcgttcaattcacta

SEQ ID NO: 690448 - DNA, 25 bp, Mus musculus
gtctcagctgtccacaagtctgtta

SEQ ID NO: 690449 - DNA, 25 bp, Mus musculus
gtctcagctgtcgacaagtctgtta

SEQ ID NO: 690450 - DNA, 25 bp, Mus musculus
gtctcagcttagatccagaagatcc

SEQ ID NO: 690451 - DNA, 25 bp, Mus musculus
gtctcagcttagttccagaagatcc

SEQ ID NO: 690452 - DNA, 25 bp, Mus musculus
gtctcaggacatatccagcatgtgg

SEQ ID NO: 690453 - DNA, 25 bp, Mus musculus
gtctcaggacatttccagcatgtgg

SEQ ID NO: 690454 - DNA, 25 bp, Mus musculus
gtctcaggaccaccggagcgaaaat

SEQ ID NO: 690455 - DNA, 25 bp, Mus musculus
gtctcaggaccagcggagcgaaaat

SEQ ID NO: 690456 - DNA, 25 bp, Mus musculus
gtctcaggacggacagatgccaccc

SEQ ID NO: 690457 - DNA, 25 bp, Mus musculus
gtctcaggacggtcagatgccaccc

SEQ ID NO: 690458 - DNA, 25 bp, Mus musculus
gtctcaggactgataagtgctctac

SEQ ID NO: 690459 - DNA, 25 bp, Mus musculus
gtctcaggactgttaagtgctctac

SEQ ID NO: 690460 - DNA, 25 bp, Mus musculus
gtctcaggagacaacagtatctcat

SEQ ID NO: 690461 - DNA, 25 bp, Mus musculus
gtctcaggagacaaggactctacgg

SEQ ID NO: 690462 - DNA, 25 bp, Mus musculus
gtctcaggagactacagtatctcat

SEQ ID NO: 690463 - DNA, 25 bp, Mus musculus
gtctcaggagactaggactctacgg

SEQ ID NO: 690464 - DNA, 25 bp, Mus musculus
gtctcaggatatctgggaggcccac

SEQ ID NO: 690465 - DNA, 25 bp, Mus musculus
gtctcaggatatgtgggaggcccac

SEQ ID NO: 690466 - DNA, 25 bp, Mus musculus
gtctcaggcacaatcaaatacggtc

SEQ ID NO: 690467 - DNA, 25 bp, Mus musculus
gtctcaggcacattcaaatacggtc

SEQ ID NO: 690468 - DNA, 25 bp, Mus musculus
gtctcaggcttaaggcaaagctccc

SEQ ID NO: 690469 - DNA, 25 bp, Mus musculus
gtctcaggcttatggcaaagctccc

SEQ ID NO: 690470 - DNA, 25 bp, Mus musculus
gtctcagggagtctacttccagtgt

SEQ ID NO: 690471 - DNA, 25 bp, Mus musculus
gtctcagggagtgtacttccagtgt

SEQ ID NO: 690472 - DNA, 25 bp, Mus musculus
gtctcagggcagagatcatcttgat

SEQ ID NO: 690473 - DNA, 25 bp, Mus musculus
gtctcagggcagtgatcatcttgat

SEQ ID NO: 690474 - DNA, 25 bp, Mus musculus
gtctcagggccccaacacgagcaat

SEQ ID NO: 690475 - DNA, 25 bp, Mus musculus
gtctcagggcccgaacacgagcaat

SEQ ID NO: 690476 - DNA, 25 bp, Mus musculus
gtctcaggggctccagaaatcttca

SEQ ID NO: 690477 - DNA, 25 bp, Mus musculus
gtctcaggggctgcagaaatcttca

SEQ ID NO: 690478 - DNA, 25 bp, Mus musculus
gtctcaggtgggaccaatccatgtt

SEQ ID NO: 690479 - DNA, 25 bp, Mus musculus
gtctcaggtgggtccaatccatgtt

SEQ ID NO: 690480 - DNA, 25 bp, Mus musculus
gtctcaggttctcttgaaaaggcaa

SEQ ID NO: 690481 - DNA, 25 bp, Mus musculus
gtctcaggttctgttgaaaaggcaa

SEQ ID NO: 690482 - DNA, 25 bp, Mus musculus
gtctcagtagcaccttcacaaggta

SEQ ID NO: 690483 - DNA, 25 bp, Mus musculus
gtctcagtagcagcttcacaaggta

SEQ ID NO: 690484 - DNA, 25 bp, Mus musculus
gtctcagtatagagttcagttgctc

SEQ ID NO: 690485 - DNA, 25 bp, Mus musculus
gtctcagtatagtgttcagttgctc

SEQ ID NO: 690486 - DNA, 25 bp, Mus musculus
gtctcagtcaccaggccttgactct

SEQ ID NO: 690487 - DNA, 25 bp, Mus musculus
gtctcagtcacctggccttgactct

SEQ ID NO: 690488 - DNA, 25 bp, Mus musculus
gtctcagtcactatgcagttgccaa

SEQ ID NO: 690489 - DNA, 25 bp, Mus musculus
gtctcagtcactttgcagttgccaa

SEQ ID NO: 690490 - DNA, 25 bp, Mus musculus
gtctcagtccctcaagcagttggga

SEQ ID NO: 690491 - DNA, 25 bp, Mus musculus
gtctcagtccctgaagcagttggga

SEQ ID NO: 690492 - DNA, 25 bp, Mus musculus
gtctcagtctgtctaaataaccagt

SEQ ID NO: 690493 - DNA, 25 bp, Mus musculus
gtctcagtctgtgtaaataaccagt

SEQ ID NO: 690494 - DNA, 25 bp, Mus musculus
gtctcagtctttccacatgtacacc

SEQ ID NO: 690495 - DNA, 25 bp, Mus musculus
gtctcagtctttgcacatgtacacc

SEQ ID NO: 690496 - DNA, 25 bp, Mus musculus
gtctcagtgaacatgggtctcttgc

SEQ ID NO: 690497 - DNA, 25 bp, Mus musculus
gtctcagtgaacttgggtctcttgc

SEQ ID NO: 690498 - DNA, 25 bp, Mus musculus
gtctcagtgagacctagtcctctgg

SEQ ID NO: 690499 - DNA, 25 bp, Mus musculus
gtctcagtgagagctagtcctctgg

SEQ ID NO: 690500 - DNA, 25 bp, Mus musculus
gtctcagtggagaccgcagctagaa

SEQ ID NO: 690501 - DNA, 25 bp, Mus musculus
gtctcagtggagtccgcagctagaa

SEQ ID NO: 690502 - DNA, 25 bp, Mus musculus
gtctcagtgggcaccaaatttacag

SEQ ID NO: 690503 - DNA, 25 bp, Mus musculus
gtctcagtgggctccaaatttacag

SEQ ID NO: 690504 - DNA, 25 bp, Mus musculus
gtctcagtgtgactccaggctcgct

SEQ ID NO: 690505 - DNA, 25 bp, Mus musculus
gtctcagtgtgagtccaggctcgct

SEQ ID NO: 690506 - DNA, 25 bp, Mus musculus
gtctcagtgtgtaaagtgcctgact

SEQ ID NO: 690507 - DNA, 25 bp, Mus musculus
gtctcagtgtgttaagtgcctgact

SEQ ID NO: 690508 - DNA, 25 bp, Mus musculus
gtctcagttcagctcaaaattcagc

SEQ ID NO: 690509 - DNA, 25 bp, Mus musculus
gtctcagttcaggtcaaaattcagc

SEQ ID NO: 690510 - DNA, 25 bp, Mus musculus
gtctcagttgagcagtaatcccacc

SEQ ID NO: 690511 - DNA, 25 bp, Mus musculus
gtctcagttgaggagtaatcccacc

SEQ ID NO: 690512 - DNA, 25 bp, Mus musculus
gtctcagttggccactctggtgata

SEQ ID NO: 690513 - DNA, 25 bp, Mus musculus
gtctcagttggcgactctggtgata

SEQ ID NO: 690514 - DNA, 25 bp, Mus musculus
gtctcagttgtgaaggtctattcct

SEQ ID NO: 690515 - DNA, 25 bp, Mus musculus
gtctcagttgtgtaggtctattcct

SEQ ID NO: 690516 - DNA, 25 bp, Mus musculus
gtctcagtttcccagaagtcatgaa

SEQ ID NO: 690517 - DNA, 25 bp, Mus musculus
gtctcagtttccgagaagtcatgaa

SEQ ID NO: 690518 - DNA, 25 bp, Mus musculus
gtctcagtttgcactcaaattgcct

SEQ ID NO: 690519 - DNA, 25 bp, Mus musculus
gtctcagtttgctctcaaattgcct

SEQ ID NO: 690520 - DNA, 25 bp, Mus musculus
gtctcagttttgctttgtagggttc

SEQ ID NO: 690521 - DNA, 25 bp, Mus musculus
gtctcagttttggtttgtagggttc

SEQ ID NO: 690522 - DNA, 25 bp, Mus musculus
gtctcataaatcctaagcacgtgct

SEQ ID NO: 690523 - DNA, 25 bp, Mus musculus
gtctcataaatcgtaagcacgtgct

SEQ ID NO: 690524 - DNA, 25 bp, Mus musculus
gtctcatacttcatttcagcattgt

SEQ ID NO: 690525 - DNA, 25 bp, Mus musculus
gtctcatacttcttttcagcattgt

SEQ ID NO: 690526 - DNA, 25 bp, Mus musculus
gtctcatagaaactgtcactcctct

SEQ ID NO: 690527 - DNA, 25 bp, Mus musculus
gtctcatagaaagtgtcactcctct

SEQ ID NO: 690528 - DNA, 25 bp, Mus musculus
gtctcatatagcaaccagtggtcaa

SEQ ID NO: 690529 - DNA, 25 bp, Mus musculus
gtctcatatagcacaatctggcatc

SEQ ID NO: 690530 - DNA, 25 bp, Mus musculus
gtctcatatagctaccagtggtcaa

SEQ ID NO: 690531 - DNA, 25 bp, Mus musculus
gtctcatatagctcaatctggcatc

SEQ ID NO: 690532 - DNA, 25 bp, Mus musculus
gtctcatatgctcaatctcagccta

SEQ ID NO: 690533 - DNA, 25 bp, Mus musculus
gtctcatatgctgaatctcagccta

SEQ ID NO: 690534 - DNA, 25 bp, Mus musculus
gtctcatatgggattctgtcaacag

SEQ ID NO: 690535 - DNA, 25 bp, Mus musculus
gtctcatatgggtttctgtcaacag

SEQ ID NO: 690536 - DNA, 25 bp, Mus musculus
gtctcatattcactaggctggtctt

SEQ ID NO: 690537 - DNA, 25 bp, Mus musculus
gtctcatattcagtaggctggtctt

SEQ ID NO: 690538 - DNA, 25 bp, Mus musculus
gtctcatatttaagcctctcgtaga

SEQ ID NO: 690539 - DNA, 25 bp, Mus musculus
gtctcatatttatgcctctcgtaga

SEQ ID NO: 690540 - DNA, 25 bp, Mus musculus
gtctcatcaagcatttcttcctgta

SEQ ID NO: 690541 - DNA, 25 bp, Mus musculus
gtctcatcaagcttttcttcctgta

SEQ ID NO: 690542 - DNA, 25 bp, Mus musculus
gtctcatcacacatgatctctggat

SEQ ID NO: 690543 - DNA, 25 bp, Mus musculus
gtctcatcacacttgatctctggat

SEQ ID NO: 690544 - DNA, 25 bp, Mus musculus
gtctcatcaggcctgggacttgctc

SEQ ID NO: 690545 - DNA, 25 bp, Mus musculus
gtctcatcaggcgtgggacttgctc

SEQ ID NO: 690546 - DNA, 25 bp, Mus musculus
gtctcatcagttaaagcaccttgtg

SEQ ID NO: 690547 - DNA, 25 bp, Mus musculus
gtctcatcagtttaagcaccttgtg

SEQ ID NO: 690548 - DNA, 25 bp, Mus musculus
gtctcatccacccaggagcttaaat

SEQ ID NO: 690549 - DNA, 25 bp, Mus musculus
gtctcatccaccgaggagcttaaat

SEQ ID NO: 690550 - DNA, 25 bp, Mus musculus
gtctcatcctaacatgctcagtagt

SEQ ID NO: 690551 - DNA, 25 bp, Mus musculus
gtctcatcctaagatgctcagtagt

SEQ ID NO: 690552 - DNA, 25 bp, Mus musculus
gtctcatcctgacctacagcagata

SEQ ID NO: 690553 - DNA, 25 bp, Mus musculus
gtctcatcctgagctacagcagata

SEQ ID NO: 690554 - DNA, 25 bp, Mus musculus
gtctcatccttcagcgagaaggtgg

SEQ ID NO: 690555 - DNA, 25 bp, Mus musculus
gtctcatccttctgcgagaaggtgg

SEQ ID NO: 690556 - DNA, 25 bp, Mus musculus
gtctcatccttgatcatggcttgaa

SEQ ID NO: 690557 - DNA, 25 bp, Mus musculus
gtctcatccttgttcatggcttgaa

SEQ ID NO: 690558 - DNA, 25 bp, Mus musculus
gtctcatcggaaccttctctttata

SEQ ID NO: 690559 - DNA, 25 bp, Mus musculus
gtctcatcggaagcttctctttata

SEQ ID NO: 690560 - DNA, 25 bp, Mus musculus
gtctcatctattcaactcctgtcta

SEQ ID NO: 690561 - DNA, 25 bp, Mus musculus
gtctcatctattgaactcctgtcta

SEQ ID NO: 690562 - DNA, 25 bp, Mus musculus
gtctcatctctaatgttctatgcaa

SEQ ID NO: 690563 - DNA, 25 bp, Mus musculus
gtctcatctctattgttctatgcaa

SEQ ID NO: 690564 - DNA, 25 bp, Mus musculus
gtctcatctggacgaggttgctctc

SEQ ID NO: 690565 - DNA, 25 bp, Mus musculus
gtctcatctggaggaggttgctctc

SEQ ID NO: 690566 - DNA, 25 bp, Mus musculus
gtctcatgacttaatagccctacta

SEQ ID NO: 690567 - DNA, 25 bp, Mus musculus
gtctcatgactttatagccctacta

SEQ ID NO: 690568 - DNA, 25 bp, Mus musculus
gtctcatgagcccagtcgtgatgtg

SEQ ID NO: 690569 - DNA, 25 bp, Mus musculus
gtctcatgagccgagtcgtgatgtg

SEQ ID NO: 690570 - DNA, 25 bp, Mus musculus
gtctcatgaggcacagtgtcgtgca

SEQ ID NO: 690571 - DNA, 25 bp, Mus musculus
gtctcatgaggctcagtgtcgtgca

SEQ ID NO: 690572 - DNA, 25 bp, Mus musculus
gtctcatgagtcatcttttgtcctc

SEQ ID NO: 690573 - DNA, 25 bp, Mus musculus
gtctcatgagtcttcttttgtcctc

SEQ ID NO: 690574 - DNA, 25 bp, Mus musculus
gtctcatgcttaccgttggcagacc

SEQ ID NO: 690575 - DNA, 25 bp, Mus musculus
gtctcatgcttagcgttggcagacc

SEQ ID NO: 690576 - DNA, 25 bp, Mus musculus
gtctcatgggcaaagctcaaggtct

SEQ ID NO: 690577 - DNA, 25 bp, Mus musculus
gtctcatgggcatagctcaaggtct

SEQ ID NO: 690578 - DNA, 25 bp, Mus musculus
gtctcatgttataacctaaacaggg

SEQ ID NO: 690579 - DNA, 25 bp, Mus musculus
gtctcatgttattacctaaacaggg

SEQ ID NO: 690580 - DNA, 25 bp, Mus musculus
gtctcattaaagcatggctctgttg

SEQ ID NO: 690581 - DNA, 25 bp, Mus musculus
gtctcattaaaggatggctctgttg

SEQ ID NO: 690582 - DNA, 25 bp, Mus musculus
gtctcattaatccagctggtggtca

SEQ ID NO: 690583 - DNA, 25 bp, Mus musculus
gtctcattaatcgagctggtggtca

SEQ ID NO: 690584 - DNA, 25 bp, Mus musculus
gtctcattatctatatgacccgtgg

SEQ ID NO: 690585 - DNA, 25 bp, Mus musculus
gtctcattatctttatgacccgtgg

SEQ ID NO: 690586 - DNA, 25 bp, Mus musculus
gtctcattatgactcttgacaattt

SEQ ID NO: 690587 - DNA, 25 bp, Mus musculus
gtctcattatgagtcttgacaattt

SEQ ID NO: 690588 - DNA, 25 bp, Mus musculus
gtctcattctcaaggacttttgtcc

SEQ ID NO: 690589 - DNA, 25 bp, Mus musculus
gtctcattctcatggacttttgtcc

SEQ ID NO: 690590 - DNA, 25 bp, Mus musculus
gtctcattgaaactatttctcaggg

SEQ ID NO: 690591 - DNA, 25 bp, Mus musculus
gtctcattgaaagtatttctcaggg

SEQ ID NO: 690592 - DNA, 25 bp, Mus musculus
gtctcattgatgctacttgacttgt

SEQ ID NO: 690593 - DNA, 25 bp, Mus musculus
gtctcattgatggtacttgacttgt

SEQ ID NO: 690594 - DNA, 25 bp, Mus musculus
gtctcatttacaaacactgtggctt

SEQ ID NO: 690595 - DNA, 25 bp, Mus musculus
gtctcatttacatacactgtggctt

SEQ ID NO: 690596 - DNA, 25 bp, Mus musculus
gtctcatttcatatcttctgaggaa

SEQ ID NO: 690597 - DNA, 25 bp, Mus musculus
gtctcatttcatttcttctgaggaa

SEQ ID NO: 690598 - DNA, 25 bp, Mus musculus
gtctcatttcccagtgtgacattga

SEQ ID NO: 690599 - DNA, 25 bp, Mus musculus
gtctcatttccctgtgtgacattga

SEQ ID NO: 690600 - DNA, 25 bp, Mus musculus
gtctcatttctgaaaaagatttttt

SEQ ID NO: 690601 - DNA, 25 bp, Mus musculus
gtctcatttctgtaaaagatttttt

SEQ ID NO: 690602 - DNA, 25 bp, Mus musculus
gtctcatttgaacactgcccagtct

SEQ ID NO: 690603 - DNA, 25 bp, Mus musculus
gtctcatttgaagactgcccagtct

SEQ ID NO: 690604 - DNA, 25 bp, Mus musculus
gtctcatttgtgacttgatgcgcca

SEQ ID NO: 690605 - DNA, 25 bp, Mus musculus
gtctcatttgtgtcttgatgcgcca

SEQ ID NO: 690606 - DNA, 25 bp, Mus musculus
gtctccaaaaaacgcaccgtgtgca

SEQ ID NO: 690607 - DNA, 25 bp, Mus musculus
gtctccaaaaaaggcaccgtgtgca

SEQ ID NO: 690608 - DNA, 25 bp, Mus musculus
gtctccaaacctcacgtttataccg

SEQ ID NO: 690609 - DNA, 25 bp, Mus musculus
gtctccaaacctgacgtttataccg

SEQ ID NO: 690610 - DNA, 25 bp, Mus musculus
gtctccaaagagaaccaggcatgaa

SEQ ID NO: 690611 - DNA, 25 bp, Mus musculus
gtctccaaagagtaccaggcatgaa

SEQ ID NO: 690612 - DNA, 25 bp, Mus musculus
gtctccaaatacataccaacgcatt

SEQ ID NO: 690613 - DNA, 25 bp, Mus musculus
gtctccaaatacttaccaacgcatt

SEQ ID NO: 690614 - DNA, 25 bp, Mus musculus
gtctccaacaatcctcatgaggtcc

SEQ ID NO: 690615 - DNA, 25 bp, Mus musculus
gtctccaacaatgctcatgaggtcc

SEQ ID NO: 690616 - DNA, 25 bp, Mus musculus
gtctccaacaccacaaaccataggt

SEQ ID NO: 690617 - DNA, 25 bp, Mus musculus
gtctccaacacctcaaaccataggt

SEQ ID NO: 690618 - DNA, 25 bp, Mus musculus
gtctccaacagaaggagcccagcca

SEQ ID NO: 690619 - DNA, 25 bp, Mus musculus
gtctccaacagatggagcccagcca

SEQ ID NO: 690620 - DNA, 25 bp, Mus musculus
gtctccaaccgcatttgtttatctt

SEQ ID NO: 690621 - DNA, 25 bp, Mus musculus
gtctccaaccgcttttgtttatctt

SEQ ID NO: 690622 - DNA, 25 bp, Mus musculus
gtctccaagactcggaatggttgcc

SEQ ID NO: 690623 - DNA, 25 bp, Mus musculus
gtctccaagactgggaatggttgcc

SEQ ID NO: 690624 - DNA, 25 bp, Mus musculus
gtctccaagcatagggtcttgtact

SEQ ID NO: 690625 - DNA, 25 bp, Mus musculus
gtctccaagcattgggtcttgtact

SEQ ID NO: 690626 - DNA, 25 bp, Mus musculus
gtctccaagccaatgtatggtgccg

SEQ ID NO: 690627 - DNA, 25 bp, Mus musculus
gtctccaagccattgtatggtgccg

SEQ ID NO: 690628 - DNA, 25 bp, Mus musculus
gtctccaagcccatctggtttttta

SEQ ID NO: 690629 - DNA, 25 bp, Mus musculus
gtctccaagcccttctggtttttta

SEQ ID NO: 690630 - DNA, 25 bp, Mus musculus
gtctccaagcctcatatctcttgaa

SEQ ID NO: 690631 - DNA, 25 bp, Mus musculus
gtctccaagcctgatatctcttgaa

SEQ ID NO: 690632 - DNA, 25 bp, Mus musculus
gtctccaagtggcagcgagtcagta

SEQ ID NO: 690633 - DNA, 25 bp, Mus musculus
gtctccaagtgggagcgagtcagta

SEQ ID NO: 690634 - DNA, 25 bp, Mus musculus
gtctccaatactaagtgaatgtcca

SEQ ID NO: 690635 - DNA, 25 bp, Mus musculus
gtctccaatacttagtgaatgtcca

SEQ ID NO: 690636 - DNA, 25 bp, Mus musculus
gtctccacagggaaattgtgtagca

SEQ ID NO: 690637 - DNA, 25 bp, Mus musculus
gtctccacagggtaattgtgtagca

SEQ ID NO: 690638 - DNA, 25 bp, Mus musculus
gtctccacatccagtgttactattt

SEQ ID NO: 690639 - DNA, 25 bp, Mus musculus
gtctccacatcctgtgttactattt

SEQ ID NO: 690640 - DNA, 25 bp, Mus musculus
gtctccacatgaactaaccttgctt

SEQ ID NO: 690641 - DNA, 25 bp, Mus musculus
gtctccacatgaataagccacacct

SEQ ID NO: 690642 - DNA, 25 bp, Mus musculus
gtctccacatgatctaaccttgctt

SEQ ID NO: 690643 - DNA, 25 bp, Mus musculus
gtctccacatgattaagccacacct

SEQ ID NO: 690644 - DNA, 25 bp, Mus musculus
gtctccacatggagctggccccgtg

SEQ ID NO: 690645 - DNA, 25 bp, Mus musculus
gtctccacatggctgctgttcgaag

SEQ ID NO: 690646 - DNA, 25 bp, Mus musculus
gtctccacatgggtgctgttcgaag

SEQ ID NO: 690647 - DNA, 25 bp, Mus musculus
gtctccacatggtgctggccccgtg

SEQ ID NO: 690648 - DNA, 25 bp, Mus musculus
gtctccacattcattcagtttataa

SEQ ID NO: 690649 - DNA, 25 bp, Mus musculus
gtctccacattctttcagtttataa

SEQ ID NO: 690650 - DNA, 25 bp, Mus musculus
gtctccaccaaaatggattcgccag

SEQ ID NO: 690651 - DNA, 25 bp, Mus musculus
gtctccaccaaattggattcgccag

SEQ ID NO: 690652 - DNA, 25 bp, Mus musculus
gtctccacctcactatgctgttgag

SEQ ID NO: 690653 - DNA, 25 bp, Mus musculus
gtctccacctcagtatgctgttgag

SEQ ID NO: 690654 - DNA, 25 bp, Mus musculus
gtctccacctccaaaatgcaaagat

SEQ ID NO: 690655 - DNA, 25 bp, Mus musculus
gtctccacctcctaaatgcaaagat

SEQ ID NO: 690656 - DNA, 25 bp, Mus musculus
gtctccacctctacatagagtgctg

SEQ ID NO: 690657 - DNA, 25 bp, Mus musculus
gtctccacctctagtctgtgtgaga

SEQ ID NO: 690658 - DNA, 25 bp, Mus musculus
gtctccacctcttcatagagtgctg

SEQ ID NO: 690659 - DNA, 25 bp, Mus musculus
gtctccacctcttgtctgtgtgaga

SEQ ID NO: 690660 - DNA, 25 bp, Mus musculus
gtctccactaaaatactttcttcct

SEQ ID NO: 690661 - DNA, 25 bp, Mus musculus
gtctccactaaattactttcttcct

SEQ ID NO: 690662 - DNA, 25 bp, Mus musculus
gtctccactacacgaagcccaggtg

SEQ ID NO: 690663 - DNA, 25 bp, Mus musculus
gtctccactacaggaagcccaggtg

SEQ ID NO: 690664 - DNA, 25 bp, Mus musculus
gtctccactaccctgttgagaacag

SEQ ID NO: 690665 - DNA, 25 bp, Mus musculus
gtctccactaccgtgttgagaacag

SEQ ID NO: 690666 - DNA, 25 bp, Mus musculus
gtctccactcagatattccacagaa

SEQ ID NO: 690667 - DNA, 25 bp, Mus musculus
gtctccactcagattgtaagcgtct

SEQ ID NO: 690668 - DNA, 25 bp, Mus musculus
gtctccactcagttattccacagaa

SEQ ID NO: 690669 - DNA, 25 bp, Mus musculus
gtctccactcagtttgtaagcgtct

SEQ ID NO: 690670 - DNA, 25 bp, Mus musculus
gtctccactcttccatgagttatgg

SEQ ID NO: 690671 - DNA, 25 bp, Mus musculus
gtctccactcttgcatgagttatgg

SEQ ID NO: 690672 - DNA, 25 bp, Mus musculus
gtctccactgagcaggctgtcagat

SEQ ID NO: 690673 - DNA, 25 bp, Mus musculus
gtctccactgaggaggctgtcagat

SEQ ID NO: 690674 - DNA, 25 bp, Mus musculus
gtctccactgctcaaagcacttgta

SEQ ID NO: 690675 - DNA, 25 bp, Mus musculus
gtctccactgctgaaagcacttgta

SEQ ID NO: 690676 - DNA, 25 bp, Mus musculus
gtctccactggccatattcaactag

SEQ ID NO: 690677 - DNA, 25 bp, Mus musculus
gtctccactggcgatattcaactag

SEQ ID NO: 690678 - DNA, 25 bp, Mus musculus
gtctccactggtatctaatttttag

SEQ ID NO: 690679 - DNA, 25 bp, Mus musculus
gtctccactggtttctaatttttag

SEQ ID NO: 690680 - DNA, 25 bp, Mus musculus
gtctccactttcactctacaatgaa

SEQ ID NO: 690681 - DNA, 25 bp, Mus musculus
gtctccactttctctctacaatgaa

SEQ ID NO: 690682 - DNA, 25 bp, Mus musculus
gtctccactttgaagccggcaggtt

SEQ ID NO: 690683 - DNA, 25 bp, Mus musculus
gtctccactttgtagccggcaggtt

SEQ ID NO: 690684 - DNA, 25 bp, Mus musculus
gtctccagaaatagccttgaaccga

SEQ ID NO: 690685 - DNA, 25 bp, Mus musculus
gtctccagaaattgccttgaaccga

SEQ ID NO: 690686 - DNA, 25 bp, Mus musculus
gtctccagacaaaaagccttatagt

SEQ ID NO: 690687 - DNA, 25 bp, Mus musculus
gtctccagacaataagccttatagt

SEQ ID NO: 690688 - DNA, 25 bp, Mus musculus
gtctccagacagaaaaccgcgagtt

SEQ ID NO: 690689 - DNA, 25 bp, Mus musculus
gtctccagacagtaaaccgcgagtt

SEQ ID NO: 690690 - DNA, 25 bp, Mus musculus
gtctccagacatcctatgcttcata

SEQ ID NO: 690691 - DNA, 25 bp, Mus musculus
gtctccagacatgctatgcttcata

SEQ ID NO: 690692 - DNA, 25 bp, Mus musculus
gtctccagagacaaggtttacatcc

SEQ ID NO: 690693 - DNA, 25 bp, Mus musculus
gtctccagagactaggtttacatcc

SEQ ID NO: 690694 - DNA, 25 bp, Mus musculus
gtctccagagctatcgaaggctttc

SEQ ID NO: 690695 - DNA, 25 bp, Mus musculus
gtctccagagctttcgaaggctttc

SEQ ID NO: 690696 - DNA, 25 bp, Mus musculus
gtctccagagtcctcaacaagctgg

SEQ ID NO: 690697 - DNA, 25 bp, Mus musculus
gtctccagagtcgtcaacaagctgg

SEQ ID NO: 690698 - DNA, 25 bp, Mus musculus
gtctccagcacaagtacatttttca

SEQ ID NO: 690699 - DNA, 25 bp, Mus musculus
gtctccagcacatgtacatttttca

SEQ ID NO: 690700 - DNA, 25 bp, Mus musculus
gtctccagcaccacaaagcaacaaa

SEQ ID NO: 690701 - DNA, 25 bp, Mus musculus
gtctccagcacctcaaagcaacaaa

SEQ ID NO: 690702 - DNA, 25 bp, Mus musculus
gtctccagcagccatcagggtaata

SEQ ID NO: 690703 - DNA, 25 bp, Mus musculus
gtctccagcagcgatcagggtaata

SEQ ID NO: 690704 - DNA, 25 bp, Mus musculus
gtctccagcaggagagttcccaaag

SEQ ID NO: 690705 - DNA, 25 bp, Mus musculus
gtctccagcaggtgagttcccaaag

SEQ ID NO: 690706 - DNA, 25 bp, Mus musculus
gtctccagccttccttagttagcat

SEQ ID NO: 690707 - DNA, 25 bp, Mus musculus
gtctccagccttgcttagttagcat

SEQ ID NO: 690708 - DNA, 25 bp, Mus musculus
gtctccagcgttatgattttactct

SEQ ID NO: 690709 - DNA, 25 bp, Mus musculus
gtctccagcgttttgattttactct

SEQ ID NO: 690710 - DNA, 25 bp, Mus musculus
gtctccagctagagaggtccgaaaa

SEQ ID NO: 690711 - DNA, 25 bp, Mus musculus
gtctccagctagtgaggtccgaaaa

SEQ ID NO: 690712 - DNA, 25 bp, Mus musculus
gtctccagctggcaatattacgcat

SEQ ID NO: 690713 - DNA, 25 bp, Mus musculus
gtctccagctgggaatattacgcat

SEQ ID NO: 690714 - DNA, 25 bp, Mus musculus
gtctccagcttgaccccaaggtaga

SEQ ID NO: 690715 - DNA, 25 bp, Mus musculus
gtctccagcttgactgtcagagcca

SEQ ID NO: 690716 - DNA, 25 bp, Mus musculus
gtctccagcttgtccccaaggtaga

SEQ ID NO: 690717 - DNA, 25 bp, Mus musculus
gtctccagcttgtctgtcagagcca

SEQ ID NO: 690718 - DNA, 25 bp, Mus musculus
gtctccaggcagctgagcgatgacc

SEQ ID NO: 690719 - DNA, 25 bp, Mus musculus
gtctccaggcaggtgagcgatgacc

SEQ ID NO: 690720 - DNA, 25 bp, Mus musculus
gtctccaggccaagggatttgtgaa

SEQ ID NO: 690721 - DNA, 25 bp, Mus musculus
gtctccaggccatgggatttgtgaa

SEQ ID NO: 690722 - DNA, 25 bp, Mus musculus
gtctccaggtcaataagcattttac

SEQ ID NO: 690723 - DNA, 25 bp, Mus musculus
gtctccaggtcattaagcattttac

SEQ ID NO: 690724 - DNA, 25 bp, Mus musculus
gtctccagtacacttttcaggcttc

SEQ ID NO: 690725 - DNA, 25 bp, Mus musculus
gtctccagtacagttttcaggcttc

SEQ ID NO: 690726 - DNA, 25 bp, Mus musculus
gtctccagtctaaagcctgcagtag

SEQ ID NO: 690727 - DNA, 25 bp, Mus musculus
gtctccagtctatagcctgcagtag

SEQ ID NO: 690728 - DNA, 25 bp, Mus musculus
gtctccagtgacagttccttaagca

SEQ ID NO: 690729 - DNA, 25 bp, Mus musculus
gtctccagtgactgttccttaagca

SEQ ID NO: 690730 - DNA, 25 bp, Mus musculus
gtctccagttaaaaagtcacatcga

SEQ ID NO: 690731 - DNA, 25 bp, Mus musculus
gtctccagttaataagtcacatcga

SEQ ID NO: 690732 - DNA, 25 bp, Mus musculus
gtctccagttcaactgacaaaagtg

SEQ ID NO: 690733 - DNA, 25 bp, Mus musculus
gtctccagttcatctgacaaaagtg

SEQ ID NO: 690734 - DNA, 25 bp, Mus musculus
gtctccagttggctactgttacata

SEQ ID NO: 690735 - DNA, 25 bp, Mus musculus
gtctccagttgggtactgttacata

SEQ ID NO: 690736 - DNA, 25 bp, Mus musculus
gtctccagtttcattgccggcggat

SEQ ID NO: 690737 - DNA, 25 bp, Mus musculus
gtctccagtttctttgccggcggat

SEQ ID NO: 690738 - DNA, 25 bp, Mus musculus
gtctccataagacaggcccactaga

SEQ ID NO: 690739 - DNA, 25 bp, Mus musculus
gtctccataagagaggcccactaga

SEQ ID NO: 690740 - DNA, 25 bp, Mus musculus
gtctccatagccaaaaacagttccg

SEQ ID NO: 690741 - DNA, 25 bp, Mus musculus
gtctccatagcctaaaacagttccg

SEQ ID NO: 690742 - DNA, 25 bp, Mus musculus
gtctccatatcactcttgaaagcct

SEQ ID NO: 690743 - DNA, 25 bp, Mus musculus
gtctccatatcagtcttgaaagcct

SEQ ID NO: 690744 - DNA, 25 bp, Mus musculus
gtctccatatccagtcaactattag

SEQ ID NO: 690745 - DNA, 25 bp, Mus musculus
gtctccatatcctgtcaactattag

SEQ ID NO: 690746 - DNA, 25 bp, Mus musculus
gtctccatatgtatattatttccta

SEQ ID NO: 690747 - DNA, 25 bp, Mus musculus
gtctccatatgtctgcacgcatcca

SEQ ID NO: 690748 - DNA, 25 bp, Mus musculus
gtctccatatgtgtgcacgcatcca

SEQ ID NO: 690749 - DNA, 25 bp, Mus musculus
gtctccatatgtttattatttccta

SEQ ID NO: 690750 - DNA, 25 bp, Mus musculus
gtctccatatttcctcctgtgagta

SEQ ID NO: 690751 - DNA, 25 bp, Mus musculus
gtctccatatttgctcctgtgagta

SEQ ID NO: 690752 - DNA, 25 bp, Mus musculus
gtctccatcctaaccatacttttga

SEQ ID NO: 690753 - DNA, 25 bp, Mus musculus
gtctccatcctatccatacttttga

SEQ ID NO: 690754 - DNA, 25 bp, Mus musculus
gtctccatcgttaagcactcagtta

SEQ ID NO: 690755 - DNA, 25 bp, Mus musculus
gtctccatcgtttagcactcagtta

SEQ ID NO: 690756 - DNA, 25 bp, Mus musculus
gtctccatctggattgtccatacag

SEQ ID NO: 690757 - DNA, 25 bp, Mus musculus
gtctccatctggtttgtccatacag

SEQ ID NO: 690758 - DNA, 25 bp, Mus musculus
gtctccatgaggacacacacatttc

SEQ ID NO: 690759 - DNA, 25 bp, Mus musculus
gtctccatgaggtcacacacatttc

SEQ ID NO: 690760 - DNA, 25 bp, Mus musculus
gtctccatgagtataagtgcttcag

SEQ ID NO: 690761 - DNA, 25 bp, Mus musculus
gtctccatgagtttaagtgcttcag

SEQ ID NO: 690762 - DNA, 25 bp, Mus musculus
gtctccatgatgattcttagccaga

SEQ ID NO: 690763 - DNA, 25 bp, Mus musculus
gtctccatgatgtttcttagccaga

SEQ ID NO: 690764 - DNA, 25 bp, Mus musculus
gtctccatgccaacatccttatttc

SEQ ID NO: 690765 - DNA, 25 bp, Mus musculus
gtctccatgccatcatccttatttc

SEQ ID NO: 690766 - DNA, 25 bp, Mus musculus
gtctccatggagcattgcctggcat

SEQ ID NO: 690767 - DNA, 25 bp, Mus musculus
gtctccatggaggattgcctggcat

SEQ ID NO: 690768 - DNA, 25 bp, Mus musculus
gtctccatgtacacgtgcacaaatg

SEQ ID NO: 690769 - DNA, 25 bp, Mus musculus
gtctccatgtactcgtgcacaaatg

SEQ ID NO: 690770 - DNA, 25 bp, Mus musculus
gtctccattacaaacattttattga

SEQ ID NO: 690771 - DNA, 25 bp, Mus musculus
gtctccattacatacattttattga

SEQ ID NO: 690772 - DNA, 25 bp, Mus musculus
gtctccattataagcttggtcgagt

SEQ ID NO: 690773 - DNA, 25 bp, Mus musculus
gtctccattatatgcttggtcgagt

SEQ ID NO: 690774 - DNA, 25 bp, Mus musculus
gtctccattgtcaggttccccgtag

SEQ ID NO: 690775 - DNA, 25 bp, Mus musculus
gtctccattgtctggttccccgtag

SEQ ID NO: 690776 - DNA, 25 bp, Mus musculus
gtctccattgttcgtggcattgcaa

SEQ ID NO: 690777 - DNA, 25 bp, Mus musculus
gtctccattgttggtggcattgcaa

SEQ ID NO: 690778 - DNA, 25 bp, Mus musculus
gtctccatttccagtgtggcagcaa

SEQ ID NO: 690779 - DNA, 25 bp, Mus musculus
gtctccatttcctgtgtggcagcaa

SEQ ID NO: 690780 - DNA, 25 bp, Mus musculus
gtctccatttgaacatcttaacaga

SEQ ID NO: 690781 - DNA, 25 bp, Mus musculus
gtctccatttgatcatcttaacaga

SEQ ID NO: 690782 - DNA, 25 bp, Mus musculus
gtctcccaacacagaatgtccaaga

SEQ ID NO: 690783 - DNA, 25 bp, Mus musculus
gtctcccaacactgaatgtccaaga

SEQ ID NO: 690784 - DNA, 25 bp, Mus musculus
gtctcccacactctctggagtagga

SEQ ID NO: 690785 - DNA, 25 bp, Mus musculus
gtctcccacactgtctggagtagga

SEQ ID NO: 690786 - DNA, 25 bp, Mus musculus
gtctcccacattaagtacagtgcct

SEQ ID NO: 690787 - DNA, 25 bp, Mus musculus
gtctcccacatttagtacagtgcct

SEQ ID NO: 690788 - DNA, 25 bp, Mus musculus
gtctcccacctgaatatagccacag

SEQ ID NO: 690789 - DNA, 25 bp, Mus musculus
gtctcccacctgtatatagccacag

SEQ ID NO: 690790 - DNA, 25 bp, Mus musculus
gtctcccacgtcactgatattgtcg

SEQ ID NO: 690791 - DNA, 25 bp, Mus musculus
gtctcccacgtctctgatattgtcg

SEQ ID NO: 690792 - DNA, 25 bp, Mus musculus
gtctcccagactcagaaagaactag

SEQ ID NO: 690793 - DNA, 25 bp, Mus musculus
gtctcccagactgagaaagaactag

SEQ ID NO: 690794 - DNA, 25 bp, Mus musculus
gtctcccagagacacgtggtcctta

SEQ ID NO: 690795 - DNA, 25 bp, Mus musculus
gtctcccagagagacgtggtcctta

SEQ ID NO: 690796 - DNA, 25 bp, Mus musculus
gtctcccagatcacagcttacaata

SEQ ID NO: 690797 - DNA, 25 bp, Mus musculus
gtctcccagatctcagcttacaata

SEQ ID NO: 690798 - DNA, 25 bp, Mus musculus
gtctcccagcgacctgtagtgctga

SEQ ID NO: 690799 - DNA, 25 bp, Mus musculus
gtctcccagcgagctgtagtgctga

SEQ ID NO: 690800 - DNA, 25 bp, Mus musculus
gtctcccaggagaattctgtgtttt

SEQ ID NO: 690801 - DNA, 25 bp, Mus musculus
gtctcccaggagagccaacacataa

SEQ ID NO: 690802 - DNA, 25 bp, Mus musculus
gtctcccaggagtattctgtgtttt

SEQ ID NO: 690803 - DNA, 25 bp, Mus musculus
gtctcccaggagtgccaacacataa

SEQ ID NO: 690804 - DNA, 25 bp, Mus musculus
gtctcccataatataaaactcattg

SEQ ID NO: 690805 - DNA, 25 bp, Mus musculus
gtctcccataatttaaaactcattg

SEQ ID NO: 690806 - DNA, 25 bp, Mus musculus
gtctcccatggaaagttgggtacat

SEQ ID NO: 690807 - DNA, 25 bp, Mus musculus
gtctcccatggatagttgggtacat

SEQ ID NO: 690808 - DNA, 25 bp, Mus musculus
gtctcccattacctgtgcttagtat

SEQ ID NO: 690809 - DNA, 25 bp, Mus musculus
gtctcccattacgtgtgcttagtat

SEQ ID NO: 690810 - DNA, 25 bp, Mus musculus
gtctcccattggaagattcaaatac

SEQ ID NO: 690811 - DNA, 25 bp, Mus musculus
gtctcccattggtagattcaaatac

SEQ ID NO: 690812 - DNA, 25 bp, Mus musculus
gtctccccaaggctgggactgcaag

SEQ ID NO: 690813 - DNA, 25 bp, Mus musculus
gtctccccaagggtgggactgcaag

SEQ ID NO: 690814 - DNA, 25 bp, Mus musculus
gtctccccagctaaagataaactgt

SEQ ID NO: 690815 - DNA, 25 bp, Mus musculus
gtctccccagcttaagataaactgt

SEQ ID NO: 690816 - DNA, 25 bp, Mus musculus
gtctccccaggaaaagaactcacgc

SEQ ID NO: 690817 - DNA, 25 bp, Mus musculus
gtctccccaggataagaactcacgc

SEQ ID NO: 690818 - DNA, 25 bp, Mus musculus
gtctccccagtcacgttagaaatga

SEQ ID NO: 690819 - DNA, 25 bp, Mus musculus
gtctccccagtctcgttagaaatga

SEQ ID NO: 690820 - DNA, 25 bp, Mus musculus
gtctccccagtgctggtaatatagg

SEQ ID NO: 690821 - DNA, 25 bp, Mus musculus
gtctccccagtggtggtaatatagg

SEQ ID NO: 690822 - DNA, 25 bp, Mus musculus
gtctccccgaacaaagtatcagcaa

SEQ ID NO: 690823 - DNA, 25 bp, Mus musculus
gtctccccgaactaagtatcagcaa

SEQ ID NO: 690824 - DNA, 25 bp, Mus musculus
gtctccccgggcatgtgtaactctg

SEQ ID NO: 690825 - DNA, 25 bp, Mus musculus
gtctccccgggcttgtgtaactctg

SEQ ID NO: 690826 - DNA, 25 bp, Mus musculus
gtctcccctaataactatgttgctc

SEQ ID NO: 690827 - DNA, 25 bp, Mus musculus
gtctcccctaattactatgttgctc

SEQ ID NO: 690828 - DNA, 25 bp, Mus musculus
gtctcccgggcccaaggaggaagat

SEQ ID NO: 690829 - DNA, 25 bp, Mus musculus
gtctcccgggccgaaggaggaagat

SEQ ID NO: 690830 - DNA, 25 bp, Mus musculus
gtctccctaagacctcagctgaggg

SEQ ID NO: 690831 - DNA, 25 bp, Mus musculus
gtctccctaagagctcagctgaggg

SEQ ID NO: 690832 - DNA, 25 bp, Mus musculus
gtctccctaagtactgtttttccat

SEQ ID NO: 690833 - DNA, 25 bp, Mus musculus
gtctccctaagttctgtttttccat

SEQ ID NO: 690834 - DNA, 25 bp, Mus musculus
gtctccctacagaaaatccaatagt

SEQ ID NO: 690835 - DNA, 25 bp, Mus musculus
gtctccctacagtaaatccaatagt

SEQ ID NO: 690836 - DNA, 25 bp, Mus musculus
gtctccctagggaggaatgaagaat

SEQ ID NO: 690837 - DNA, 25 bp, Mus musculus
gtctccctagggtggaatgaagaat

SEQ ID NO: 690838 - DNA, 25 bp, Mus musculus
gtctccctagtgctatatactacca

SEQ ID NO: 690839 - DNA, 25 bp, Mus musculus
gtctccctagtggtatatactacca

SEQ ID NO: 690840 - DNA, 25 bp, Mus musculus
gtctccctccctagttagtatttat

SEQ ID NO: 690841 - DNA, 25 bp, Mus musculus
gtctccctcccttgttagtatttat

SEQ ID NO: 690842 - DNA, 25 bp, Mus musculus
gtctccctgattacagacagccagt

SEQ ID NO: 690843 - DNA, 25 bp, Mus musculus
gtctccctgatttcagacagccagt

SEQ ID NO: 690844 - DNA, 25 bp, Mus musculus
gtctccctgcctagatagtgatttc

SEQ ID NO: 690845 - DNA, 25 bp, Mus musculus
gtctccctgccttgatagtgatttc

SEQ ID NO: 690846 - DNA, 25 bp, Mus musculus
gtctccctgtaaccttagagcagtg

SEQ ID NO: 690847 - DNA, 25 bp, Mus musculus
gtctccctgtaagcttagagcagtg

SEQ ID NO: 690848 - DNA, 25 bp, Mus musculus
gtctcccttcagaagtttatcacat

SEQ ID NO: 690849 - DNA, 25 bp, Mus musculus
gtctcccttcagtagtttatcacat

SEQ ID NO: 690850 - DNA, 25 bp, Mus musculus
gtctcccttgaaagtggacctcatg

SEQ ID NO: 690851 - DNA, 25 bp, Mus musculus
gtctcccttgaatgtggacctcatg

SEQ ID NO: 690852 - DNA, 25 bp, Mus musculus
gtctccctttcgaagggctaaggag

SEQ ID NO: 690853 - DNA, 25 bp, Mus musculus
gtctccctttcgtagggctaaggag

SEQ ID NO: 690854 - DNA, 25 bp, Mus musculus
gtctccctttgtcaataggtctttc

SEQ ID NO: 690855 - DNA, 25 bp, Mus musculus
gtctccctttgtgaataggtctttc

SEQ ID NO: 690856 - DNA, 25 bp, Mus musculus
gtctccgagagaactatgggtcctg

SEQ ID NO: 690857 - DNA, 25 bp, Mus musculus
gtctccgagagatctatgggtcctg

SEQ ID NO: 690858 - DNA, 25 bp, Mus musculus
gtctccgagtacaggttctgagggc

SEQ ID NO: 690859 - DNA, 25 bp, Mus musculus
gtctccgagtactggttctgagggc

SEQ ID NO: 690860 - DNA, 25 bp, Mus musculus
gtctccgatgtcagcgtcattaatg

SEQ ID NO: 690861 - DNA, 25 bp, Mus musculus
gtctccgatgtctgcgtcattaatg

SEQ ID NO: 690862 - DNA, 25 bp, Mus musculus
gtctccgcagtgagttgttccatgg

SEQ ID NO: 690863 - DNA, 25 bp, Mus musculus
gtctccgcagtgtgttgttccatgg

SEQ ID NO: 690864 - DNA, 25 bp, Mus musculus
gtctccgcagttcatcgaagaagct

SEQ ID NO: 690865 - DNA, 25 bp, Mus musculus
gtctccgcagttgatcgaagaagct

SEQ ID NO: 690866 - DNA, 25 bp, Mus musculus
gtctccggagatagcttcctggtta

SEQ ID NO: 690867 - DNA, 25 bp, Mus musculus
gtctccggagattgcttcctggtta

SEQ ID NO: 690868 - DNA, 25 bp, Mus musculus
gtctccggcagcacgttgtggtcga

SEQ ID NO: 690869 - DNA, 25 bp, Mus musculus
gtctccggcagctcgttgtggtcga

SEQ ID NO: 690870 - DNA, 25 bp, Mus musculus
gtctccggcaggaggtcctacattg

SEQ ID NO: 690871 - DNA, 25 bp, Mus musculus
gtctccggcaggtggtcctacattg

SEQ ID NO: 690872 - DNA, 25 bp, Mus musculus
gtctccgtctttccctatgatgcat

SEQ ID NO: 690873 - DNA, 25 bp, Mus musculus
gtctccgtctttgcctatgatgcat

SEQ ID NO: 690874 - DNA, 25 bp, Mus musculus
gtctccgttttgagcccttgttatt

SEQ ID NO: 690875 - DNA, 25 bp, Mus musculus
gtctccgttttgtgcccttgttatt

SEQ ID NO: 690876 - DNA, 25 bp, Mus musculus
gtctcctaacaaactagtactggac

SEQ ID NO: 690877 - DNA, 25 bp, Mus musculus
gtctcctaacaaactgcgtatcatc

SEQ ID NO: 690878 - DNA, 25 bp, Mus musculus
gtctcctaacaacggacctcgttct

SEQ ID NO: 690879 - DNA, 25 bp, Mus musculus
gtctcctaacaagggacctcgttct

SEQ ID NO: 690880 - DNA, 25 bp, Mus musculus
gtctcctaacaatctagtactggac

SEQ ID NO: 690881 - DNA, 25 bp, Mus musculus
gtctcctaacaatctgcgtatcatc

SEQ ID NO: 690882 - DNA, 25 bp, Mus musculus
gtctcctaagacagtccaggctggg

SEQ ID NO: 690883 - DNA, 25 bp, Mus musculus
gtctcctaagactgtccaggctggg

SEQ ID NO: 690884 - DNA, 25 bp, Mus musculus
gtctcctaagctaataggccttctg

SEQ ID NO: 690885 - DNA, 25 bp, Mus musculus
gtctcctaagcttataggccttctg

SEQ ID NO: 690886 - DNA, 25 bp, Mus musculus
gtctcctaccacatagatattgcaa

SEQ ID NO: 690887 - DNA, 25 bp, Mus musculus
gtctcctaccacttagatattgcaa

SEQ ID NO: 690888 - DNA, 25 bp, Mus musculus
gtctcctaccataatgtaacgtatt

SEQ ID NO: 690889 - DNA, 25 bp, Mus musculus
gtctcctaccattatgtaacgtatt

SEQ ID NO: 690890 - DNA, 25 bp, Mus musculus
gtctcctacccaaagcataggaaag

SEQ ID NO: 690891 - DNA, 25 bp, Mus musculus
gtctcctacccatagcataggaaag

SEQ ID NO: 690892 - DNA, 25 bp, Mus musculus
gtctcctactaacagccagtgtggt

SEQ ID NO: 690893 - DNA, 25 bp, Mus musculus
gtctcctactaagagccagtgtggt

SEQ ID NO: 690894 - DNA, 25 bp, Mus musculus
gtctcctactttactgactggatca

SEQ ID NO: 690895 - DNA, 25 bp, Mus musculus
gtctcctacttttctgactggatca

SEQ ID NO: 690896 - DNA, 25 bp, Mus musculus
gtctcctagacacttgggtttcaca

SEQ ID NO: 690897 - DNA, 25 bp, Mus musculus
gtctcctagacagttgggtttcaca

SEQ ID NO: 690898 - DNA, 25 bp, Mus musculus
gtctcctagcagatttgctgaattt

SEQ ID NO: 690899 - DNA, 25 bp, Mus musculus
gtctcctagcagttttgctgaattt

SEQ ID NO: 690900 - DNA, 25 bp, Mus musculus
gtctcctatccgctatactaaaaca

SEQ ID NO: 690901 - DNA, 25 bp, Mus musculus
gtctcctatccggtatactaaaaca

SEQ ID NO: 690902 - DNA, 25 bp, Mus musculus
gtctcctatgtcactgttctacagt

SEQ ID NO: 690903 - DNA, 25 bp, Mus musculus
gtctcctatgtctctgttctacagt

SEQ ID NO: 690904 - DNA, 25 bp, Mus musculus
gtctcctcaagaatctaaagcattg

SEQ ID NO: 690905 - DNA, 25 bp, Mus musculus
gtctcctcaagattctaaagcattg

SEQ ID NO: 690906 - DNA, 25 bp, Mus musculus
gtctcctcaagtagcagaacgaacg

SEQ ID NO: 690907 - DNA, 25 bp, Mus musculus
gtctcctcaagttgcagaacgaacg

SEQ ID NO: 690908 - DNA, 25 bp, Mus musculus
gtctcctcacacagggatggatcca

SEQ ID NO: 690909 - DNA, 25 bp, Mus musculus
gtctcctcacactgggatggatcca

SEQ ID NO: 690910 - DNA, 25 bp, Mus musculus
gtctcctcactactgtttttctgta

SEQ ID NO: 690911 - DNA, 25 bp, Mus musculus
gtctcctcactagtgtttttctgta

SEQ ID NO: 690912 - DNA, 25 bp, Mus musculus
gtctcctcactcaggacatctagtt

SEQ ID NO: 690913 - DNA, 25 bp, Mus musculus
gtctcctcactctggacatctagtt

SEQ ID NO: 690914 - DNA, 25 bp, Mus musculus
gtctcctcactgataggtcacagta

SEQ ID NO: 690915 - DNA, 25 bp, Mus musculus
gtctcctcactgttaggtcacagta

SEQ ID NO: 690916 - DNA, 25 bp, Mus musculus
gtctcctcagccatgaaatgtcaca

SEQ ID NO: 690917 - DNA, 25 bp, Mus musculus
gtctcctcagccttgaaatgtcaca

SEQ ID NO: 690918 - DNA, 25 bp, Mus musculus
gtctcctcagttcattttgtgaaca

SEQ ID NO: 690919 - DNA, 25 bp, Mus musculus
gtctcctcagttgattttgtgaaca

SEQ ID NO: 690920 - DNA, 25 bp, Mus musculus
gtctcctcatggattgaaggcttta

SEQ ID NO: 690921 - DNA, 25 bp, Mus musculus
gtctcctcatggtttgaaggcttta

SEQ ID NO: 690922 - DNA, 25 bp, Mus musculus
gtctcctcatttagtttacacactg

SEQ ID NO: 690923 - DNA, 25 bp, Mus musculus
gtctcctcattttgtttacacactg

SEQ ID NO: 690924 - DNA, 25 bp, Mus musculus
gtctcctccaagatatcgtctggtt

SEQ ID NO: 690925 - DNA, 25 bp, Mus musculus
gtctcctccaagttatcgtctggtt

SEQ ID NO: 690926 - DNA, 25 bp, Mus musculus
gtctcctccagcatagattccagga

SEQ ID NO: 690927 - DNA, 25 bp, Mus musculus
gtctcctccagcttagattccagga

SEQ ID NO: 690928 - DNA, 25 bp, Mus musculus
gtctcctcccacaagtgcaaagtca

SEQ ID NO: 690929 - DNA, 25 bp, Mus musculus
gtctcctcccacagtatattttcat

SEQ ID NO: 690930 - DNA, 25 bp, Mus musculus
gtctcctcccactagtgcaaagtca

SEQ ID NO: 690931 - DNA, 25 bp, Mus musculus
gtctcctcccactgtatattttcat

SEQ ID NO: 690932 - DNA, 25 bp, Mus musculus
gtctcctcccatcgctaggaagttt

SEQ ID NO: 690933 - DNA, 25 bp, Mus musculus
gtctcctcccatggctaggaagttt

SEQ ID NO: 690934 - DNA, 25 bp, Mus musculus
gtctcctcctatctgggtatcagaa

SEQ ID NO: 690935 - DNA, 25 bp, Mus musculus
gtctcctcctatgtgggtatcagaa

SEQ ID NO: 690936 - DNA, 25 bp, Mus musculus
gtctcctcctcaagagctatgttct

SEQ ID NO: 690937 - DNA, 25 bp, Mus musculus
gtctcctcctcactcatagagcaat

SEQ ID NO: 690938 - DNA, 25 bp, Mus musculus
gtctcctcctcagtcatagagcaat

SEQ ID NO: 690939 - DNA, 25 bp, Mus musculus
gtctcctcctcatgagctatgttct

SEQ ID NO: 690940 - DNA, 25 bp, Mus musculus
gtctcctcctttaagctacaatggg

SEQ ID NO: 690941 - DNA, 25 bp, Mus musculus
gtctcctccttttagctacaatggg

SEQ ID NO: 690942 - DNA, 25 bp, Mus musculus
gtctcctcgattatactctcttaag

SEQ ID NO: 690943 - DNA, 25 bp, Mus musculus
gtctcctcgattttactctcttaag

SEQ ID NO: 690944 - DNA, 25 bp, Mus musculus
gtctcctcgtagagctcacttgagc

SEQ ID NO: 690945 - DNA, 25 bp, Mus musculus
gtctcctcgtagtgctcacttgagc

SEQ ID NO: 690946 - DNA, 25 bp, Mus musculus
gtctcctctactctaggaagttcat

SEQ ID NO: 690947 - DNA, 25 bp, Mus musculus
gtctcctctactgtaggaagttcat

SEQ ID NO: 690948 - DNA, 25 bp, Mus musculus
gtctcctctagcatatttggcgtct

SEQ ID NO: 690949 - DNA, 25 bp, Mus musculus
gtctcctctagcttatttggcgtct

SEQ ID NO: 690950 - DNA, 25 bp, Mus musculus
gtctcctctaggctccaacagtgtg

SEQ ID NO: 690951 - DNA, 25 bp, Mus musculus
gtctcctctagggtccaacagtgtg

SEQ ID NO: 690952 - DNA, 25 bp, Mus musculus
gtctcctctataaccaccaaagttt

SEQ ID NO: 690953 - DNA, 25 bp, Mus musculus
gtctcctctataatctttagtccac

SEQ ID NO: 690954 - DNA, 25 bp, Mus musculus
gtctcctctatatccaccaaagttt

SEQ ID NO: 690955 - DNA, 25 bp, Mus musculus
gtctcctctatattctttagtccac

SEQ ID NO: 690956 - DNA, 25 bp, Mus musculus
gtctcctctcggatatggctggctt

SEQ ID NO: 690957 - DNA, 25 bp, Mus musculus
gtctcctctcggttatggctggctt

SEQ ID NO: 690958 - DNA, 25 bp, Mus musculus
gtctcctctgaaagcacacggcaag

SEQ ID NO: 690959 - DNA, 25 bp, Mus musculus
gtctcctctgaatgcacacggcaag

SEQ ID NO: 690960 - DNA, 25 bp, Mus musculus
gtctcctcttcaactaatctacatt

SEQ ID NO: 690961 - DNA, 25 bp, Mus musculus
gtctcctcttcatctaatctacatt

SEQ ID NO: 690962 - DNA, 25 bp, Mus musculus
gtctcctgacatagggaacacatgt

SEQ ID NO: 690963 - DNA, 25 bp, Mus musculus
gtctcctgacattgggaacacatgt

SEQ ID NO: 690964 - DNA, 25 bp, Mus musculus
gtctcctgagagatctgtgagccaa

SEQ ID NO: 690965 - DNA, 25 bp, Mus musculus
gtctcctgagagttctgtgagccaa

SEQ ID NO: 690966 - DNA, 25 bp, Mus musculus
gtctcctgagcaattcgcaaatgtg

SEQ ID NO: 690967 - DNA, 25 bp, Mus musculus
gtctcctgagcatttcgcaaatgtg

SEQ ID NO: 690968 - DNA, 25 bp, Mus musculus
gtctcctgaggtactgctaggacat

SEQ ID NO: 690969 - DNA, 25 bp, Mus musculus
gtctcctgaggttctgctaggacat

SEQ ID NO: 690970 - DNA, 25 bp, Mus musculus
gtctcctgatcaagaaccacattgc

SEQ ID NO: 690971 - DNA, 25 bp, Mus musculus
gtctcctgatcatgaaccacattgc

SEQ ID NO: 690972 - DNA, 25 bp, Mus musculus
gtctcctgatttccacagcagctga

SEQ ID NO: 690973 - DNA, 25 bp, Mus musculus
gtctcctgatttgcacagcagctga

SEQ ID NO: 690974 - DNA, 25 bp, Mus musculus
gtctcctgcagaagacacagccagg

SEQ ID NO: 690975 - DNA, 25 bp, Mus musculus
gtctcctgcagatgacacagccagg

SEQ ID NO: 690976 - DNA, 25 bp, Mus musculus
gtctcctgcaggaggcaagtctgat

SEQ ID NO: 690977 - DNA, 25 bp, Mus musculus
gtctcctgcaggtggcaagtctgat

SEQ ID NO: 690978 - DNA, 25 bp, Mus musculus
gtctcctgcgacatcaacagcaact

SEQ ID NO: 690979 - DNA, 25 bp, Mus musculus
gtctcctgcgacttcaacagcaact

SEQ ID NO: 690980 - DNA, 25 bp, Mus musculus
gtctcctgctagagttctacagctg

SEQ ID NO: 690981 - DNA, 25 bp, Mus musculus
gtctcctgctagtgttctacagctg

SEQ ID NO: 690982 - DNA, 25 bp, Mus musculus
gtctcctgctctccactgctgtgtt

SEQ ID NO: 690983 - DNA, 25 bp, Mus musculus
gtctcctgctctgcactgctgtgtt

SEQ ID NO: 690984 - DNA, 25 bp, Mus musculus
gtctcctgctgtacatgcagacatt

SEQ ID NO: 690985 - DNA, 25 bp, Mus musculus
gtctcctgctgttcatgcagacatt

SEQ ID NO: 690986 - DNA, 25 bp, Mus musculus
gtctcctggagcacaaagccttgaa

SEQ ID NO: 690987 - DNA, 25 bp, Mus musculus
gtctcctggagctcaaagccttgaa

SEQ ID NO: 690988 - DNA, 25 bp, Mus musculus
gtctcctggcgtatgccatctccgg

SEQ ID NO: 690989 - DNA, 25 bp, Mus musculus
gtctcctggcgtttgccatctccgg

SEQ ID NO: 690990 - DNA, 25 bp, Mus musculus
gtctcctgggtcatcatgcataaaa

SEQ ID NO: 690991 - DNA, 25 bp, Mus musculus
gtctcctgggtcttcatgcataaaa

SEQ ID NO: 690992 - DNA, 25 bp, Mus musculus
gtctcctgggttaactaagcttaca

SEQ ID NO: 690993 - DNA, 25 bp, Mus musculus
gtctcctgggttacagattctttgt

SEQ ID NO: 690994 - DNA, 25 bp, Mus musculus
gtctcctgggtttactaagcttaca

SEQ ID NO: 690995 - DNA, 25 bp, Mus musculus
gtctcctgggtttcagattctttgt

SEQ ID NO: 690996 - DNA, 25 bp, Mus musculus
gtctcctggtagcttattaagctct

SEQ ID NO: 690997 - DNA, 25 bp, Mus musculus
gtctcctggtaggttattaagctct

SEQ ID NO: 690998 - DNA, 25 bp, Mus musculus
gtctcctggtatcctaccctggtaa

SEQ ID NO: 690999 - DNA, 25 bp, Mus musculus
gtctcctggtatgctaccctggtaa

SEQ ID NO: 691000 - DNA, 25 bp, Mus musculus
gtctcctgtaacagttggttcaggc

SEQ ID NO: 691001 - DNA, 25 bp, Mus musculus
gtctcctgtaactgttggttcaggc

SEQ ID NO: 691002 - DNA, 25 bp, Mus musculus
gtctcctgtactagcgtggaaggca

SEQ ID NO: 691003 - DNA, 25 bp, Mus musculus
gtctcctgtacttgcgtggaaggca

SEQ ID NO: 691004 - DNA, 25 bp, Mus musculus
gtctcctgtagacccagtggaatct

SEQ ID NO: 691005 - DNA, 25 bp, Mus musculus
gtctcctgtagagccagtggaatct

SEQ ID NO: 691006 - DNA, 25 bp, Mus musculus
gtctcctgtcatcaatatttccatc

SEQ ID NO: 691007 - DNA, 25 bp, Mus musculus
gtctcctgtcatgaatatttccatc

SEQ ID NO: 691008 - DNA, 25 bp, Mus musculus
gtctcctgtcctatgcagcgtgacc

SEQ ID NO: 691009 - DNA, 25 bp, Mus musculus
gtctcctgtcctttgcagcgtgacc

SEQ ID NO: 691010 - DNA, 25 bp, Mus musculus
gtctcctgtgctctgagctgataaa

SEQ ID NO: 691011 - DNA, 25 bp, Mus musculus
gtctcctgtgctgtgagctgataaa

SEQ ID NO: 691012 - DNA, 25 bp, Mus musculus
gtctcctgtgtacgtgaaccaagtc

SEQ ID NO: 691013 - DNA, 25 bp, Mus musculus
gtctcctgtgtaggtgaaccaagtc

SEQ ID NO: 691014 - DNA, 25 bp, Mus musculus
gtctcctgttctcctgttttacaaa

SEQ ID NO: 691015 - DNA, 25 bp, Mus musculus
gtctcctgttctgctgttttacaaa

SEQ ID NO: 691016 - DNA, 25 bp, Mus musculus
gtctccttacagaacaccacacaag

SEQ ID NO: 691017 - DNA, 25 bp, Mus musculus
gtctccttacagtacaccacacaag

SEQ ID NO: 691018 - DNA, 25 bp, Mus musculus
gtctccttacatattcctgggcgga

SEQ ID NO: 691019 - DNA, 25 bp, Mus musculus
gtctccttacattttcctgggcgga

SEQ ID NO: 691020 - DNA, 25 bp, Mus musculus
gtctccttatataaatggcaggtat

SEQ ID NO: 691021 - DNA, 25 bp, Mus musculus
gtctccttatattaatggcaggtat

SEQ ID NO: 691022 - DNA, 25 bp, Mus musculus
gtctccttattactcttttatccct

SEQ ID NO: 691023 - DNA, 25 bp, Mus musculus
gtctccttattagtcttttatccct

SEQ ID NO: 691024 - DNA, 25 bp, Mus musculus
gtctccttcaaacatttctctggta

SEQ ID NO: 691025 - DNA, 25 bp, Mus musculus
gtctccttcaaagatttctctggta

SEQ ID NO: 691026 - DNA, 25 bp, Mus musculus
gtctccttcaggagttaacgtgggc

SEQ ID NO: 691027 - DNA, 25 bp, Mus musculus
gtctccttcaggtgttaacgtgggc

SEQ ID NO: 691028 - DNA, 25 bp, Mus musculus
gtctccttcatgcacgtgaacagca

SEQ ID NO: 691029 - DNA, 25 bp, Mus musculus
gtctccttcatggacgtgaacagca

SEQ ID NO: 691030 - DNA, 25 bp, Mus musculus
gtctccttccagaatgaccagctca

SEQ ID NO: 691031 - DNA, 25 bp, Mus musculus
gtctccttccagtatgaccagctca

SEQ ID NO: 691032 - DNA, 25 bp, Mus musculus
gtctccttctgacgaagccatggtt

SEQ ID NO: 691033 - DNA, 25 bp, Mus musculus
gtctccttctgaggaagccatggtt

SEQ ID NO: 691034 - DNA, 25 bp, Mus musculus
gtctccttcttacctatgttcaaaa

SEQ ID NO: 691035 - DNA, 25 bp, Mus musculus
gtctccttcttagctatgttcaaaa

SEQ ID NO: 691036 - DNA, 25 bp, Mus musculus
gtctccttgaatagttccctttggg

SEQ ID NO: 691037 - DNA, 25 bp, Mus musculus
gtctccttgaatcctttcacactta

SEQ ID NO: 691038 - DNA, 25 bp, Mus musculus
gtctccttgaatgctttcacactta

SEQ ID NO: 691039 - DNA, 25 bp, Mus musculus
gtctccttgaattgttccctttggg

SEQ ID NO: 691040 - DNA, 25 bp, Mus musculus
gtctccttgaggcacggactctggt

SEQ ID NO: 691041 - DNA, 25 bp, Mus musculus
gtctccttgagggacggactctggt

SEQ ID NO: 691042 - DNA, 25 bp, Mus musculus
gtctccttgcgtcaactgtgtgaaa

SEQ ID NO: 691043 - DNA, 25 bp, Mus musculus
gtctccttgcgtgaactgtgtgaaa

SEQ ID NO: 691044 - DNA, 25 bp, Mus musculus
gtctccttggcgagggtgtttgtcc

SEQ ID NO: 691045 - DNA, 25 bp, Mus musculus
gtctccttggcgtgggtgtttgtcc

SEQ ID NO: 691046 - DNA, 25 bp, Mus musculus
gtctccttggttaatgagccctaaa

SEQ ID NO: 691047 - DNA, 25 bp, Mus musculus
gtctccttggttactctagtccaga

SEQ ID NO: 691048 - DNA, 25 bp, Mus musculus
gtctccttggtttatgagccctaaa

SEQ ID NO: 691049 - DNA, 25 bp, Mus musculus
gtctccttggtttctctagtccaga

SEQ ID NO: 691050 - DNA, 25 bp, Mus musculus
gtctccttgtgaagtgggccagtaa

SEQ ID NO: 691051 - DNA, 25 bp, Mus musculus
gtctccttgtgatgtgggccagtaa

SEQ ID NO: 691052 - DNA, 25 bp, Mus musculus
gtctccttgtgccttggcttgtaag

SEQ ID NO: 691053 - DNA, 25 bp, Mus musculus
gtctccttgtgcgttggcttgtaag

SEQ ID NO: 691054 - DNA, 25 bp, Mus musculus
gtctccttgttacgcttcaaatttc

SEQ ID NO: 691055 - DNA, 25 bp, Mus musculus
gtctccttgttaggcttcaaatttc

SEQ ID NO: 691056 - DNA, 25 bp, Mus musculus
gtctcctttaataatgtatcccctt

SEQ ID NO: 691057 - DNA, 25 bp, Mus musculus
gtctcctttaattatgtatcccctt

SEQ ID NO: 691058 - DNA, 25 bp, Mus musculus
gtctcctttactacatgggctctat

SEQ ID NO: 691059 - DNA, 25 bp, Mus musculus
gtctcctttacttcatgggctctat

SEQ ID NO: 691060 - DNA, 25 bp, Mus musculus
gtctcctttgcaaatcatgtatagt

SEQ ID NO: 691061 - DNA, 25 bp, Mus musculus
gtctcctttgcatatcatgtatagt

SEQ ID NO: 691062 - DNA, 25 bp, Mus musculus
gtctccttttaaactccaacaattg

SEQ ID NO: 691063 - DNA, 25 bp, Mus musculus
gtctccttttaatctccaacaattg

SEQ ID NO: 691064 - DNA, 25 bp, Mus musculus
gtctccttttcaaattttagacata

SEQ ID NO: 691065 - DNA, 25 bp, Mus musculus
gtctccttttcatattttagacata

SEQ ID NO: 691066 - DNA, 25 bp, Mus musculus
gtctccttttctccttgagaagggt

SEQ ID NO: 691067 - DNA, 25 bp, Mus musculus
gtctccttttctgcttgagaagggt

SEQ ID NO: 691068 - DNA, 25 bp, Mus musculus
gtctccttttggcacctaaactatg

SEQ ID NO: 691069 - DNA, 25 bp, Mus musculus
gtctccttttgggacctaaactatg

SEQ ID NO: 691070 - DNA, 25 bp, Mus musculus
gtctcctttttgagtatgtcttgtt

SEQ ID NO: 691071 - DNA, 25 bp, Mus musculus
gtctcctttttgtgtatgtcttgtt

SEQ ID NO: 691072 - DNA, 25 bp, Mus musculus
gtctcgaacattctgtcctaatcat

SEQ ID NO: 691073 - DNA, 25 bp, Mus musculus
gtctcgaacattgtgtcctaatcat

SEQ ID NO: 691074 - DNA, 25 bp, Mus musculus
gtctcgaactcccatcaagcagaga

SEQ ID NO: 691075 - DNA, 25 bp, Mus musculus
gtctcgaactccgatcaagcagaga

SEQ ID NO: 691076 - DNA, 25 bp, Mus musculus
gtctcgacctttcgctgacaaaggg

SEQ ID NO: 691077 - DNA, 25 bp, Mus musculus
gtctcgacctttggctgacaaaggg

SEQ ID NO: 691078 - DNA, 25 bp, Mus musculus
gtctcgagacgtaccagaaagtcct

SEQ ID NO: 691079 - DNA, 25 bp, Mus musculus
gtctcgagacgttccagaaagtcct

SEQ ID NO: 691080 - DNA, 25 bp, Mus musculus
gtctcgagccgaccggtttatgaaa

SEQ ID NO: 691081 - DNA, 25 bp, Mus musculus
gtctcgagccgagcggtttatgaaa

SEQ ID NO: 691082 - DNA, 25 bp, Mus musculus
gtctcgatacatcagtggatttgtt

SEQ ID NO: 691083 - DNA, 25 bp, Mus musculus
gtctcgatacatgagtggatttgtt

SEQ ID NO: 691084 - DNA, 25 bp, Mus musculus
gtctcgattgccagagtgtgctatg

SEQ ID NO: 691085 - DNA, 25 bp, Mus musculus
gtctcgattgcctgagtgtgctatg

SEQ ID NO: 691086 - DNA, 25 bp, Mus musculus
gtctcgcaaataactatactgtcag

SEQ ID NO: 691087 - DNA, 25 bp, Mus musculus
gtctcgcaaatatctatactgtcag

SEQ ID NO: 691088 - DNA, 25 bp, Mus musculus
gtctcgcaatggcagcaactttgta

SEQ ID NO: 691089 - DNA, 25 bp, Mus musculus
gtctcgcaatggctgtggttcactt

SEQ ID NO: 691090 - DNA, 25 bp, Mus musculus
gtctcgcaatgggagcaactttgta

SEQ ID NO: 691091 - DNA, 25 bp, Mus musculus
gtctcgcaatgggtgtggttcactt

SEQ ID NO: 691092 - DNA, 25 bp, Mus musculus
gtctcgcccgatattggaactaaag

SEQ ID NO: 691093 - DNA, 25 bp, Mus musculus
gtctcgcccgattttggaactaaag

SEQ ID NO: 691094 - DNA, 25 bp, Mus musculus
gtctcgccgccaacaatgatgtatg

SEQ ID NO: 691095 - DNA, 25 bp, Mus musculus
gtctcgccgccatcaatgatgtatg

SEQ ID NO: 691096 - DNA, 25 bp, Mus musculus
gtctcgctacagaggtcatgcctac

SEQ ID NO: 691097 - DNA, 25 bp, Mus musculus
gtctcgctacagtggtcatgcctac

SEQ ID NO: 691098 - DNA, 25 bp, Mus musculus
gtctcgctccccaggtaaatgagaa

SEQ ID NO: 691099 - DNA, 25 bp, Mus musculus
gtctcgctcccctggtaaatgagaa

SEQ ID NO: 691100 - DNA, 25 bp, Mus musculus
gtctcgcttgtgcaagaattccaaa

SEQ ID NO: 691101 - DNA, 25 bp, Mus musculus
gtctcgcttgtggaagaattccaaa

SEQ ID NO: 691102 - DNA, 25 bp, Mus musculus
gtctcggatggaatcttgacagcca

SEQ ID NO: 691103 - DNA, 25 bp, Mus musculus
gtctcggatggattcttgacagcca

SEQ ID NO: 691104 - DNA, 25 bp, Mus musculus
gtctcggcaagcactaaattctgta

SEQ ID NO: 691105 - DNA, 25 bp, Mus musculus
gtctcggcaagctctaaattctgta

SEQ ID NO: 691106 - DNA, 25 bp, Mus musculus
gtctcggcaccactgtatactatta

SEQ ID NO: 691107 - DNA, 25 bp, Mus musculus
gtctcggcaccagtgtatactatta

SEQ ID NO: 691108 - DNA, 25 bp, Mus musculus
gtctcggcactcagttcttggtaaa

SEQ ID NO: 691109 - DNA, 25 bp, Mus musculus
gtctcggcactctgttcttggtaaa

SEQ ID NO: 691110 - DNA, 25 bp, Mus musculus
gtctcggcaggcaatgggtcaacag

SEQ ID NO: 691111 - DNA, 25 bp, Mus musculus
gtctcggcaggctatgggtcaacag

SEQ ID NO: 691112 - DNA, 25 bp, Mus musculus
gtctcggctactccagagcactgac

SEQ ID NO: 691113 - DNA, 25 bp, Mus musculus
gtctcggctactgcagagcactgac

SEQ ID NO: 691114 - DNA, 25 bp, Mus musculus
gtctcggcttccagttgctagaaga

SEQ ID NO: 691115 - DNA, 25 bp, Mus musculus
gtctcggcttcctgttgctagaaga

SEQ ID NO: 691116 - DNA, 25 bp, Mus musculus
gtctcgggactcagtagcctaagaa

SEQ ID NO: 691117 - DNA, 25 bp, Mus musculus
gtctcgggactctgtagcctaagaa

SEQ ID NO: 691118 - DNA, 25 bp, Mus musculus
gtctcgggagctcgatgccgttcat

SEQ ID NO: 691119 - DNA, 25 bp, Mus musculus
gtctcgggagctggatgccgttcat

SEQ ID NO: 691120 - DNA, 25 bp, Mus musculus
gtctcgggattgagtttgactcctg

SEQ ID NO: 691121 - DNA, 25 bp, Mus musculus
gtctcgggattgtgtttgactcctg

SEQ ID NO: 691122 - DNA, 25 bp, Mus musculus
gtctcgggccctagtgtaggattca

SEQ ID NO: 691123 - DNA, 25 bp, Mus musculus
gtctcgggcccttgtgtaggattca

SEQ ID NO: 691124 - DNA, 25 bp, Mus musculus
gtctcgtactctaggagcaacacta

SEQ ID NO: 691125 - DNA, 25 bp, Mus musculus
gtctcgtactcttggagcaacacta

SEQ ID NO: 691126 - DNA, 25 bp, Mus musculus
gtctcgtcgggcacttgaactggaa

SEQ ID NO: 691127 - DNA, 25 bp, Mus musculus
gtctcgtcgggctcttgaactggaa

SEQ ID NO: 691128 - DNA, 25 bp, Mus musculus
gtctcgtcgtcacggcttagactga

SEQ ID NO: 691129 - DNA, 25 bp, Mus musculus
gtctcgtcgtcagggcttagactga

SEQ ID NO: 691130 - DNA, 25 bp, Mus musculus
gtctcgtctatactgcatactctga

SEQ ID NO: 691131 - DNA, 25 bp, Mus musculus
gtctcgtctatagtgcatactctga

SEQ ID NO: 691132 - DNA, 25 bp, Mus musculus
gtctcgtctcaactcagcaacattt

SEQ ID NO: 691133 - DNA, 25 bp, Mus musculus
gtctcgtctcaagtcagcaacattt

SEQ ID NO: 691134 - DNA, 25 bp, Mus musculus
gtctcgtctgccaatttgggtggaa

SEQ ID NO: 691135 - DNA, 25 bp, Mus musculus
gtctcgtctgcctatttgggtggaa

SEQ ID NO: 691136 - DNA, 25 bp, Mus musculus
gtctcgtcttgtacgcagttggtac

SEQ ID NO: 691137 - DNA, 25 bp, Mus musculus
gtctcgtcttgttcgcagttggtac

SEQ ID NO: 691138 - DNA, 25 bp, Mus musculus
gtctcgtctttaaccagcatatcat

SEQ ID NO: 691139 - DNA, 25 bp, Mus musculus
gtctcgtctttatccagcatatcat

SEQ ID NO: 691140 - DNA, 25 bp, Mus musculus
gtctcgtgagtgagcgatcgtcaga

SEQ ID NO: 691141 - DNA, 25 bp, Mus musculus
gtctcgtgagtgtgcgatcgtcaga

SEQ ID NO: 691142 - DNA, 25 bp, Mus musculus
gtctcgtgcattagaccgtccaaaa

SEQ ID NO: 691143 - DNA, 25 bp, Mus musculus
gtctcgtgcatttgaccgtccaaaa

SEQ ID NO: 691144 - DNA, 25 bp, Mus musculus
gtctcgtgttcccaagatagccagg

SEQ ID NO: 691145 - DNA, 25 bp, Mus musculus
gtctcgtgttccgaagatagccagg

SEQ ID NO: 691146 - DNA, 25 bp, Mus musculus
gtctcgttgcatactccagagaggg

SEQ ID NO: 691147 - DNA, 25 bp, Mus musculus
gtctcgttgcattctccagagaggg

SEQ ID NO: 691148 - DNA, 25 bp, Mus musculus
gtctcgtttaaaaagcttgtctaca

SEQ ID NO: 691149 - DNA, 25 bp, Mus musculus
gtctcgtttaaatagcttgtctaca

SEQ ID NO: 691150 - DNA, 25 bp, Mus musculus
gtctcgtttgggatcagtttacata

SEQ ID NO: 691151 - DNA, 25 bp, Mus musculus
gtctcgtttgggttcagtttacata

SEQ ID NO: 691152 - DNA, 25 bp, Mus musculus
gtctcgtttttgcttgagcgttagc

SEQ ID NO: 691153 - DNA, 25 bp, Mus musculus
gtctcgtttttggttgagcgttagc

SEQ ID NO: 691154 - DNA, 25 bp, Mus musculus
gtctctaaacttcgaatgcagcttc

SEQ ID NO: 691155 - DNA, 25 bp, Mus musculus
gtctctaaacttggaatgcagcttc

SEQ ID NO: 691156 - DNA, 25 bp, Mus musculus
gtctctaaatggacacagggccctg

SEQ ID NO: 691157 - DNA, 25 bp, Mus musculus
gtctctaaatggtcacagggccctg

SEQ ID NO: 691158 - DNA, 25 bp, Mus musculus
gtctctaacacaataacttgcagtt

SEQ ID NO: 691159 - DNA, 25 bp, Mus musculus
gtctctaacacattaacttgcagtt

SEQ ID NO: 691160 - DNA, 25 bp, Mus musculus
gtctctaacctcacttcaatatttc

SEQ ID NO: 691161 - DNA, 25 bp, Mus musculus
gtctctaacctctcttcaatatttc

SEQ ID NO: 691162 - DNA, 25 bp, Mus musculus
gtctctaagggcatgccttgtgcta

SEQ ID NO: 691163 - DNA, 25 bp, Mus musculus
gtctctaagggcttgccttgtgcta

SEQ ID NO: 691164 - DNA, 25 bp, Mus musculus
gtctctaagtctatagaacgaatct

SEQ ID NO: 691165 - DNA, 25 bp, Mus musculus
gtctctaagtctttagaacgaatct

SEQ ID NO: 691166 - DNA, 25 bp, Mus musculus
gtctctaataaacctcttccacatg

SEQ ID NO: 691167 - DNA, 25 bp, Mus musculus
gtctctaataaagctcttccacatg

SEQ ID NO: 691168 - DNA, 25 bp, Mus musculus
gtctctaatcacacatgttcttgct

SEQ ID NO: 691169 - DNA, 25 bp, Mus musculus
gtctctaatcactcatgttcttgct

SEQ ID NO: 691170 - DNA, 25 bp, Mus musculus
gtctctaattgtacactgtccatat

SEQ ID NO: 691171 - DNA, 25 bp, Mus musculus
gtctctaattgttcactgtccatat

SEQ ID NO: 691172 - DNA, 25 bp, Mus musculus
gtctctaccatacggatgcggtgct

SEQ ID NO: 691173 - DNA, 25 bp, Mus musculus
gtctctaccatagggatgcggtgct

SEQ ID NO: 691174 - DNA, 25 bp, Mus musculus
gtctctaccgagatattcttaaggc

SEQ ID NO: 691175 - DNA, 25 bp, Mus musculus
gtctctaccgagttattcttaaggc

SEQ ID NO: 691176 - DNA, 25 bp, Mus musculus
gtctctacctctaagtagtctccaa

SEQ ID NO: 691177 - DNA, 25 bp, Mus musculus
gtctctacctcttagtagtctccaa

SEQ ID NO: 691178 - DNA, 25 bp, Mus musculus
gtctctacctgtataattcacttaa

SEQ ID NO: 691179 - DNA, 25 bp, Mus musculus
gtctctacctgtttaattcacttaa

SEQ ID NO: 691180 - DNA, 25 bp, Mus musculus
gtctctaccttcagctggagcatgt

SEQ ID NO: 691181 - DNA, 25 bp, Mus musculus
gtctctaccttctgctggagcatgt

SEQ ID NO: 691182 - DNA, 25 bp, Mus musculus
gtctctacggacatgcttcctggag

SEQ ID NO: 691183 - DNA, 25 bp, Mus musculus
gtctctacggacttgcttcctggag

SEQ ID NO: 691184 - DNA, 25 bp, Mus musculus
gtctctactgctctcgagtggaaat

SEQ ID NO: 691185 - DNA, 25 bp, Mus musculus
gtctctactgctgtcgagtggaaat

SEQ ID NO: 691186 - DNA, 25 bp, Mus musculus
gtctctactttgatctaagtcatga

SEQ ID NO: 691187 - DNA, 25 bp, Mus musculus
gtctctactttgttctaagtcatga

SEQ ID NO: 691188 - DNA, 25 bp, Mus musculus
gtctctagaactacctggcacacag

SEQ ID NO: 691189 - DNA, 25 bp, Mus musculus
gtctctagaacttcctggcacacag

SEQ ID NO: 691190 - DNA, 25 bp, Mus musculus
gtctctagacaaagtcgtgacccaa

SEQ ID NO: 691191 - DNA, 25 bp, Mus musculus
gtctctagacaatgtcgtgacccaa

SEQ ID NO: 691192 - DNA, 25 bp, Mus musculus
gtctctagagagcttactgtggcca

SEQ ID NO: 691193 - DNA, 25 bp, Mus musculus
gtctctagagaggttactgtggcca

SEQ ID NO: 691194 - DNA, 25 bp, Mus musculus
gtctctagatccctgaacctgcgag

SEQ ID NO: 691195 - DNA, 25 bp, Mus musculus
gtctctagatccgtgaacctgcgag

SEQ ID NO: 691196 - DNA, 25 bp, Mus musculus
gtctctagccgcatcttttatttaa

SEQ ID NO: 691197 - DNA, 25 bp, Mus musculus
gtctctagccgcttcttttatttaa

SEQ ID NO: 691198 - DNA, 25 bp, Mus musculus
gtctctagctggacgtttcacggtg

SEQ ID NO: 691199 - DNA, 25 bp, Mus musculus
gtctctagctggcaaatacacactg

SEQ ID NO: 691200 - DNA, 25 bp, Mus musculus
gtctctagctgggaaatacacactg

SEQ ID NO: 691201 - DNA, 25 bp, Mus musculus
gtctctagctggtcgtttcacggtg

SEQ ID NO: 691202 - DNA, 25 bp, Mus musculus
gtctctaggctgatagcgtagcgct

SEQ ID NO: 691203 - DNA, 25 bp, Mus musculus
gtctctaggctgttagcgtagcgct

SEQ ID NO: 691204 - DNA, 25 bp, Mus musculus
gtctctaggtcaaccatctggtgag

SEQ ID NO: 691205 - DNA, 25 bp, Mus musculus
gtctctaggtcatccatctggtgag

SEQ ID NO: 691206 - DNA, 25 bp, Mus musculus
gtctctagtaagatcctggcacagc

SEQ ID NO: 691207 - DNA, 25 bp, Mus musculus
gtctctagtaagttcctggcacagc

SEQ ID NO: 691208 - DNA, 25 bp, Mus musculus
gtctctagtcacctgcatattgatg

SEQ ID NO: 691209 - DNA, 25 bp, Mus musculus
gtctctagtcacgtgcatattgatg

SEQ ID NO: 691210 - DNA, 25 bp, Mus musculus
gtctctataacacgaccatgtctca

SEQ ID NO: 691211 - DNA, 25 bp, Mus musculus
gtctctataacaggaccatgtctca

SEQ ID NO: 691212 - DNA, 25 bp, Mus musculus
gtctctataactactgtgattgttt

SEQ ID NO: 691213 - DNA, 25 bp, Mus musculus
gtctctataacttctgtgattgttt

SEQ ID NO: 691214 - DNA, 25 bp, Mus musculus
gtctctataccacgctgtcctataa

SEQ ID NO: 691215 - DNA, 25 bp, Mus musculus
gtctctataccaggctgtcctataa

SEQ ID NO: 691216 - DNA, 25 bp, Mus musculus
gtctctatacttcgccttaaacata

SEQ ID NO: 691217 - DNA, 25 bp, Mus musculus
gtctctatacttggccttaaacata

SEQ ID NO: 691218 - DNA, 25 bp, Mus musculus
gtctctatatctaccacttcggatt

SEQ ID NO: 691219 - DNA, 25 bp, Mus musculus
gtctctatatcttccacttcggatt

SEQ ID NO: 691220 - DNA, 25 bp, Mus musculus
gtctctatcatccaggcctgttcaa

SEQ ID NO: 691221 - DNA, 25 bp, Mus musculus
gtctctatcatcgaggcctgttcaa

SEQ ID NO: 691222 - DNA, 25 bp, Mus musculus
gtctctatcctcaaattctcgagtt

SEQ ID NO: 691223 - DNA, 25 bp, Mus musculus
gtctctatcctctaattctcgagtt

SEQ ID NO: 691224 - DNA, 25 bp, Mus musculus
gtctctatcgcacatgttctggctg

SEQ ID NO: 691225 - DNA, 25 bp, Mus musculus
gtctctatcgcagatgttctggctg

SEQ ID NO: 691226 - DNA, 25 bp, Mus musculus
gtctctatctttatagctggttccg

SEQ ID NO: 691227 - DNA, 25 bp, Mus musculus
gtctctatctttttagctggttccg

SEQ ID NO: 691228 - DNA, 25 bp, Mus musculus
gtctctatgcgtccgtgtgcaagca

SEQ ID NO: 691229 - DNA, 25 bp, Mus musculus
gtctctatgcgtgcgtgtgcaagca

SEQ ID NO: 691230 - DNA, 25 bp, Mus musculus
gtctctatggataccgacaggagat

SEQ ID NO: 691231 - DNA, 25 bp, Mus musculus
gtctctatggattccgacaggagat

SEQ ID NO: 691232 - DNA, 25 bp, Mus musculus
gtctctatggcaaccactacacagc

SEQ ID NO: 691233 - DNA, 25 bp, Mus musculus
gtctctatggcatccactacacagc

SEQ ID NO: 691234 - DNA, 25 bp, Mus musculus
gtctctatgtctcaatgtgccttaa

SEQ ID NO: 691235 - DNA, 25 bp, Mus musculus
gtctctatgtctgaatgtgccttaa

SEQ ID NO: 691236 - DNA, 25 bp, Mus musculus
gtctctatgtgaccaatgtgagctg

SEQ ID NO: 691237 - DNA, 25 bp, Mus musculus
gtctctatgtgagcaatgtgagctg

SEQ ID NO: 691238 - DNA, 25 bp, Mus musculus
gtctctattcaaagttgacctctgg

SEQ ID NO: 691239 - DNA, 25 bp, Mus musculus
gtctctattcaatgttgacctctgg

SEQ ID NO: 691240 - DNA, 25 bp, Mus musculus
gtctctcaagtcacgaggctacgtg

SEQ ID NO: 691241 - DNA, 25 bp, Mus musculus
gtctctcaagtctcgaggctacgtg

SEQ ID NO: 691242 - DNA, 25 bp, Mus musculus
gtctctcacctaaatagttccactt

SEQ ID NO: 691243 - DNA, 25 bp, Mus musculus
gtctctcacctatatagttccactt

SEQ ID NO: 691244 - DNA, 25 bp, Mus musculus
gtctctcagacaacacttgaccaag

SEQ ID NO: 691245 - DNA, 25 bp, Mus musculus
gtctctcagacatcacttgaccaag

SEQ ID NO: 691246 - DNA, 25 bp, Mus musculus
gtctctcagatcatattttcctatt

SEQ ID NO: 691247 - DNA, 25 bp, Mus musculus
gtctctcagatcttattttcctatt

SEQ ID NO: 691248 - DNA, 25 bp, Mus musculus
gtctctcagcctcgacaggacatga

SEQ ID NO: 691249 - DNA, 25 bp, Mus musculus
gtctctcagcctggacaggacatga

SEQ ID NO: 691250 - DNA, 25 bp, Mus musculus
gtctctcaggaaagtatgaccacag

SEQ ID NO: 691251 - DNA, 25 bp, Mus musculus
gtctctcaggaatgtatgaccacag

SEQ ID NO: 691252 - DNA, 25 bp, Mus musculus
gtctctcaggacaatagtggccagc

SEQ ID NO: 691253 - DNA, 25 bp, Mus musculus
gtctctcaggactatagtggccagc

SEQ ID NO: 691254 - DNA, 25 bp, Mus musculus
gtctctcatgaaaattgagcggccc

SEQ ID NO: 691255 - DNA, 25 bp, Mus musculus
gtctctcatgaatattgagcggccc

SEQ ID NO: 691256 - DNA, 25 bp, Mus musculus
gtctctcattcacaaatcccgggaa

SEQ ID NO: 691257 - DNA, 25 bp, Mus musculus
gtctctcattcagaaatcccgggaa

SEQ ID NO: 691258 - DNA, 25 bp, Mus musculus
gtctctccaaacagcaatccagcaa

SEQ ID NO: 691259 - DNA, 25 bp, Mus musculus
gtctctccaaactgcaatccagcaa

SEQ ID NO: 691260 - DNA, 25 bp, Mus musculus
gtctctccacacagcaagtgagatc

SEQ ID NO: 691261 - DNA, 25 bp, Mus musculus
gtctctccacactgcaagtgagatc

SEQ ID NO: 691262 - DNA, 25 bp, Mus musculus
gtctctccacagatgaaatctatct

SEQ ID NO: 691263 - DNA, 25 bp, Mus musculus
gtctctccacagttgaaatctatct

SEQ ID NO: 691264 - DNA, 25 bp, Mus musculus
gtctctccacttcctaggatggtga

SEQ ID NO: 691265 - DNA, 25 bp, Mus musculus
gtctctccacttgctaggatggtga

SEQ ID NO: 691266 - DNA, 25 bp, Mus musculus
gtctctccataaatgattctttagt

SEQ ID NO: 691267 - DNA, 25 bp, Mus musculus
gtctctccataattgattctttagt

SEQ ID NO: 691268 - DNA, 25 bp, Mus musculus
gtctctccccatacctaatcttgtt

SEQ ID NO: 691269 - DNA, 25 bp, Mus musculus
gtctctccccattcctaatcttgtt

SEQ ID NO: 691270 - DNA, 25 bp, Mus musculus
gtctctccccggaaagcatggcaag

SEQ ID NO: 691271 - DNA, 25 bp, Mus musculus
gtctctccccggtaagcatggcaag

SEQ ID NO: 691272 - DNA, 25 bp, Mus musculus
gtctctcctcttattagagcagggt

SEQ ID NO: 691273 - DNA, 25 bp, Mus musculus
gtctctcctctttttagagcagggt

SEQ ID NO: 691274 - DNA, 25 bp, Mus musculus
gtctctcctgagaaccgagagctgt

SEQ ID NO: 691275 - DNA, 25 bp, Mus musculus
gtctctcctgagtaccgagagctgt

SEQ ID NO: 691276 - DNA, 25 bp, Mus musculus
gtctctcctggaaggtttgaagcct

SEQ ID NO: 691277 - DNA, 25 bp, Mus musculus
gtctctcctggatggtttgaagcct

SEQ ID NO: 691278 - DNA, 25 bp, Mus musculus
gtctctcctgtgaaattatgttctt

SEQ ID NO: 691279 - DNA, 25 bp, Mus musculus
gtctctcctgtgtaattatgttctt

SEQ ID NO: 691280 - DNA, 25 bp, Mus musculus
gtctctcgctggatggaaccaatta

SEQ ID NO: 691281 - DNA, 25 bp, Mus musculus
gtctctcgctggttggaaccaatta

SEQ ID NO: 691282 - DNA, 25 bp, Mus musculus
gtctctcgctttaagatgatacagt

SEQ ID NO: 691283 - DNA, 25 bp, Mus musculus
gtctctcgcttttagatgatacagt

SEQ ID NO: 691284 - DNA, 25 bp, Mus musculus
gtctctcggatcagctgttcctggt

SEQ ID NO: 691285 - DNA, 25 bp, Mus musculus
gtctctcggatctgctgttcctggt

SEQ ID NO: 691286 - DNA, 25 bp, Mus musculus
gtctctcggtctcgatggtgagtta

SEQ ID NO: 691287 - DNA, 25 bp, Mus musculus
gtctctcggtctggatggtgagtta

SEQ ID NO: 691288 - DNA, 25 bp, Mus musculus
gtctctctaagaatatcaagtgctc

SEQ ID NO: 691289 - DNA, 25 bp, Mus musculus
gtctctctaagattatcaagtgctc

SEQ ID NO: 691290 - DNA, 25 bp, Mus musculus
gtctctctaatcagtttgctgtttg

SEQ ID NO: 691291 - DNA, 25 bp, Mus musculus
gtctctctaatctgtttgctgtttg

SEQ ID NO: 691292 - DNA, 25 bp, Mus musculus
gtctctctacctaaatccaagaaaa

SEQ ID NO: 691293 - DNA, 25 bp, Mus musculus
gtctctctaccttaatccaagaaaa

SEQ ID NO: 691294 - DNA, 25 bp, Mus musculus
gtctctctatatatcatgccctgaa

SEQ ID NO: 691295 - DNA, 25 bp, Mus musculus
gtctctctatatttcatgccctgaa

SEQ ID NO: 691296 - DNA, 25 bp, Mus musculus
gtctctctatgcagcacaggactgt

SEQ ID NO: 691297 - DNA, 25 bp, Mus musculus
gtctctctatgctgcacaggactgt

SEQ ID NO: 691298 - DNA, 25 bp, Mus musculus
gtctctctcattaccttatggacag

SEQ ID NO: 691299 - DNA, 25 bp, Mus musculus
gtctctctcatttccttatggacag

SEQ ID NO: 691300 - DNA, 25 bp, Mus musculus
gtctctctccatattaacttcgttt

SEQ ID NO: 691301 - DNA, 25 bp, Mus musculus
gtctctctccattttaacttcgttt

SEQ ID NO: 691302 - DNA, 25 bp, Mus musculus
gtctctctcctcaacaacttagaaa

SEQ ID NO: 691303 - DNA, 25 bp, Mus musculus
gtctctctcctctacaacttagaaa

SEQ ID NO: 691304 - DNA, 25 bp, Mus musculus
gtctctctctaccacatgaatcttg

SEQ ID NO: 691305 - DNA, 25 bp, Mus musculus
gtctctctctacgacatgaatcttg

SEQ ID NO: 691306 - DNA, 25 bp, Mus musculus
gtctctctctagcaacagctgcttc

SEQ ID NO: 691307 - DNA, 25 bp, Mus musculus
gtctctctctaggaacagctgcttc

SEQ ID NO: 691308 - DNA, 25 bp, Mus musculus
gtctctctctatctacttatcccat

SEQ ID NO: 691309 - DNA, 25 bp, Mus musculus
gtctctctctatgtacttatcccat

SEQ ID NO: 691310 - DNA, 25 bp, Mus musculus
gtctctctctgaattgtgggtagca

SEQ ID NO: 691311 - DNA, 25 bp, Mus musculus
gtctctctctgatttgtgggtagca

SEQ ID NO: 691312 - DNA, 25 bp, Mus musculus
gtctctctcttaaaccaggaagctg

SEQ ID NO: 691313 - DNA, 25 bp, Mus musculus
gtctctctcttataccaggaagctg

SEQ ID NO: 691314 - DNA, 25 bp, Mus musculus
gtctctctcttgagatgtcttgaag

SEQ ID NO: 691315 - DNA, 25 bp, Mus musculus
gtctctctcttgtgatgtcttgaag

SEQ ID NO: 691316 - DNA, 25 bp, Mus musculus
gtctctctgactcctgttgtaagga

SEQ ID NO: 691317 - DNA, 25 bp, Mus musculus
gtctctctgactctaggaaacctct

SEQ ID NO: 691318 - DNA, 25 bp, Mus musculus
gtctctctgactgctgttgtaagga

SEQ ID NO: 691319 - DNA, 25 bp, Mus musculus
gtctctctgactgtaggaaacctct

SEQ ID NO: 691320 - DNA, 25 bp, Mus musculus
gtctctctgatgatgaaatcacaat

SEQ ID NO: 691321 - DNA, 25 bp, Mus musculus
gtctctctgatgatgggtttaatga

SEQ ID NO: 691322 - DNA, 25 bp, Mus musculus
gtctctctgatgttgaaatcacaat

SEQ ID NO: 691323 - DNA, 25 bp, Mus musculus
gtctctctgatgttgggtttaatga

SEQ ID NO: 691324 - DNA, 25 bp, Mus musculus
gtctctctgcatagttacttttgtt

SEQ ID NO: 691325 - DNA, 25 bp, Mus musculus
gtctctctgcattgttacttttgtt

SEQ ID NO: 691326 - DNA, 25 bp, Mus musculus
gtctctctgggaaccacatatcttg

SEQ ID NO: 691327 - DNA, 25 bp, Mus musculus
gtctctctgggatccacatatcttg

SEQ ID NO: 691328 - DNA, 25 bp, Mus musculus
gtctctctggttctgatgatagttt

SEQ ID NO: 691329 - DNA, 25 bp, Mus musculus
gtctctctggttgtgatgatagttt

SEQ ID NO: 691330 - DNA, 25 bp, Mus musculus
gtctctctgtctacacttgaatgtc

SEQ ID NO: 691331 - DNA, 25 bp, Mus musculus
gtctctctgtctacctaatgtgagg

SEQ ID NO: 691332 - DNA, 25 bp, Mus musculus
gtctctctgtcttcacttgaatgtc

SEQ ID NO: 691333 - DNA, 25 bp, Mus musculus
gtctctctgtcttcctaatgtgagg

SEQ ID NO: 691334 - DNA, 25 bp, Mus musculus
gtctctctgttgaccgtcactgata

SEQ ID NO: 691335 - DNA, 25 bp, Mus musculus
gtctctctgttgtccgtcactgata

SEQ ID NO: 691336 - DNA, 25 bp, Mus musculus
gtctctcttcagatcaaagtctcca

SEQ ID NO: 691337 - DNA, 25 bp, Mus musculus
gtctctcttcagttcaaagtctcca

SEQ ID NO: 691338 - DNA, 25 bp, Mus musculus
gtctctcttcgcatctctatgaagt

SEQ ID NO: 691339 - DNA, 25 bp, Mus musculus
gtctctcttcgcttctctatgaagt

SEQ ID NO: 691340 - DNA, 25 bp, Mus musculus
gtctctcttctcaggaaactctagt

SEQ ID NO: 691341 - DNA, 25 bp, Mus musculus
gtctctcttctctggaaactctagt

SEQ ID NO: 691342 - DNA, 25 bp, Mus musculus
gtctctcttgggacaactagggcta

SEQ ID NO: 691343 - DNA, 25 bp, Mus musculus
gtctctcttgggtcaactagggcta

SEQ ID NO: 691344 - DNA, 25 bp, Mus musculus
gtctctcttgtccttgcaggtatca

SEQ ID NO: 691345 - DNA, 25 bp, Mus musculus
gtctctcttgtcgttgcaggtatca

SEQ ID NO: 691346 - DNA, 25 bp, Mus musculus
gtctctctttttcaaaccatggtgc

SEQ ID NO: 691347 - DNA, 25 bp, Mus musculus
gtctctctttttgaaaccatggtgc

SEQ ID NO: 691348 - DNA, 25 bp, Mus musculus
gtctctgaaaccaccatgttctgtt

SEQ ID NO: 691349 - DNA, 25 bp, Mus musculus
gtctctgaaacctccatgttctgtt

SEQ ID NO: 691350 - DNA, 25 bp, Mus musculus
gtctctgaacatcaagctactgcag

SEQ ID NO: 691351 - DNA, 25 bp, Mus musculus
gtctctgaacatgaagctactgcag

SEQ ID NO: 691352 - DNA, 25 bp, Mus musculus
gtctctgaagagctaatgcccattc

SEQ ID NO: 691353 - DNA, 25 bp, Mus musculus
gtctctgaagaggtaatgcccattc

SEQ ID NO: 691354 - DNA, 25 bp, Mus musculus
gtctctgaagtaattgcctttgctt

SEQ ID NO: 691355 - DNA, 25 bp, Mus musculus
gtctctgaagtatttgcctttgctt

SEQ ID NO: 691356 - DNA, 25 bp, Mus musculus
gtctctgaatgaaggatctgattgg

SEQ ID NO: 691357 - DNA, 25 bp, Mus musculus
gtctctgaatgatggatctgattgg

SEQ ID NO: 691358 - DNA, 25 bp, Mus musculus
gtctctgacacaatggctttatcct

SEQ ID NO: 691359 - DNA, 25 bp, Mus musculus
gtctctgacacattggctttatcct

SEQ ID NO: 691360 - DNA, 25 bp, Mus musculus
gtctctgacactctctcaaatacaa

SEQ ID NO: 691361 - DNA, 25 bp, Mus musculus
gtctctgacactgtctcaaatacaa

SEQ ID NO: 691362 - DNA, 25 bp, Mus musculus
gtctctgacaggattgagcatggca

SEQ ID NO: 691363 - DNA, 25 bp, Mus musculus
gtctctgacaggtttgagcatggca

SEQ ID NO: 691364 - DNA, 25 bp, Mus musculus
gtctctgacattcacttaatctgca

SEQ ID NO: 691365 - DNA, 25 bp, Mus musculus
gtctctgacattgacttaatctgca

SEQ ID NO: 691366 - DNA, 25 bp, Mus musculus
gtctctgaccatcatgcttagctgc

SEQ ID NO: 691367 - DNA, 25 bp, Mus musculus
gtctctgaccatctgctgtttaaat

SEQ ID NO: 691368 - DNA, 25 bp, Mus musculus
gtctctgaccatgatgcttagctgc

SEQ ID NO: 691369 - DNA, 25 bp, Mus musculus
gtctctgaccatgtgctgtttaaat

SEQ ID NO: 691370 - DNA, 25 bp, Mus musculus
gtctctgaccctcgatggactgaca

SEQ ID NO: 691371 - DNA, 25 bp, Mus musculus
gtctctgaccctggatggactgaca

SEQ ID NO: 691372 - DNA, 25 bp, Mus musculus
gtctctgactcgcttgaggtccatg

SEQ ID NO: 691373 - DNA, 25 bp, Mus musculus
gtctctgactcggttgaggtccatg

SEQ ID NO: 691374 - DNA, 25 bp, Mus musculus
gtctctgactctcagtgctggcaga

SEQ ID NO: 691375 - DNA, 25 bp, Mus musculus
gtctctgactctgagtgctggcaga

SEQ ID NO: 691376 - DNA, 25 bp, Mus musculus
gtctctgagccaattttcatttcct

SEQ ID NO: 691377 - DNA, 25 bp, Mus musculus
gtctctgagccatttttcatttcct

SEQ ID NO: 691378 - DNA, 25 bp, Mus musculus
gtctctgagctgctgttgttccttc

SEQ ID NO: 691379 - DNA, 25 bp, Mus musculus
gtctctgagctggtgttgttccttc

SEQ ID NO: 691380 - DNA, 25 bp, Mus musculus
gtctctgagggaaccaggacccaat

SEQ ID NO: 691381 - DNA, 25 bp, Mus musculus
gtctctgagggaatggcttgattaa

SEQ ID NO: 691382 - DNA, 25 bp, Mus musculus
gtctctgagggatccaggacccaat

SEQ ID NO: 691383 - DNA, 25 bp, Mus musculus
gtctctgagggattggcttgattaa

SEQ ID NO: 691384 - DNA, 25 bp, Mus musculus
gtctctgagtcacgagcaggacgct

SEQ ID NO: 691385 - DNA, 25 bp, Mus musculus
gtctctgagtcaggagcaggacgct

SEQ ID NO: 691386 - DNA, 25 bp, Mus musculus
gtctctgatcttacagtgagcatcg

SEQ ID NO: 691387 - DNA, 25 bp, Mus musculus
gtctctgatctttcagtgagcatcg

SEQ ID NO: 691388 - DNA, 25 bp, Mus musculus
gtctctgatgaaagtatccgcctcg

SEQ ID NO: 691389 - DNA, 25 bp, Mus musculus
gtctctgatgaatgtatccgcctcg

SEQ ID NO: 691390 - DNA, 25 bp, Mus musculus
gtctctgatgtgaagcatgactgtt

SEQ ID NO: 691391 - DNA, 25 bp, Mus musculus
gtctctgatgtgtagcatgactgtt

SEQ ID NO: 691392 - DNA, 25 bp, Mus musculus
gtctctgcaagaaagtccagcatgt

SEQ ID NO: 691393 - DNA, 25 bp, Mus musculus
gtctctgcaagatagtccagcatgt

SEQ ID NO: 691394 - DNA, 25 bp, Mus musculus
gtctctgcaagtcttttctgcactg

SEQ ID NO: 691395 - DNA, 25 bp, Mus musculus
gtctctgcaagtgttttctgcactg

SEQ ID NO: 691396 - DNA, 25 bp, Mus musculus
gtctctgcaatccacgtggtaaaag

SEQ ID NO: 691397 - DNA, 25 bp, Mus musculus
gtctctgcaatcgacgtggtaaaag

SEQ ID NO: 691398 - DNA, 25 bp, Mus musculus
gtctctgcacttaaggcgtacatag

SEQ ID NO: 691399 - DNA, 25 bp, Mus musculus
gtctctgcactttaggcgtacatag

SEQ ID NO: 691400 - DNA, 25 bp, Mus musculus
gtctctgcagccactaatgactagt

SEQ ID NO: 691401 - DNA, 25 bp, Mus musculus
gtctctgcagcctctaatgactagt

SEQ ID NO: 691402 - DNA, 25 bp, Mus musculus
gtctctgcaggcctgcctcggcggg

SEQ ID NO: 691403 - DNA, 25 bp, Mus musculus
gtctctgcaggcgtgcctcggcggg

SEQ ID NO: 691404 - DNA, 25 bp, Mus musculus
gtctctgcagttcgcatggctgtca

SEQ ID NO: 691405 - DNA, 25 bp, Mus musculus
gtctctgcagttggcatggctgtca

SEQ ID NO: 691406 - DNA, 25 bp, Mus musculus
gtctctgcattacccatggtctaaa

SEQ ID NO: 691407 - DNA, 25 bp, Mus musculus
gtctctgcattagccatggtctaaa

SEQ ID NO: 691408 - DNA, 25 bp, Mus musculus
gtctctgcattgatctgaggctcac

SEQ ID NO: 691409 - DNA, 25 bp, Mus musculus
gtctctgcattgttctgaggctcac

SEQ ID NO: 691410 - DNA, 25 bp, Mus musculus
gtctctgccaaaagaatttacgctg

SEQ ID NO: 691411 - DNA, 25 bp, Mus musculus
gtctctgccaaactttttgtggacc

SEQ ID NO: 691412 - DNA, 25 bp, Mus musculus
gtctctgccaaagtttttgtggacc

SEQ ID NO: 691413 - DNA, 25 bp, Mus musculus
gtctctgccaaatgaatttacgctg

SEQ ID NO: 691414 - DNA, 25 bp, Mus musculus
gtctctgccaatactgtaccatgta

SEQ ID NO: 691415 - DNA, 25 bp, Mus musculus
gtctctgccaattctgtaccatgta

SEQ ID NO: 691416 - DNA, 25 bp, Mus musculus
gtctctgccatcaggcaaatcactt

SEQ ID NO: 691417 - DNA, 25 bp, Mus musculus
gtctctgccatctggcaaatcactt

SEQ ID NO: 691418 - DNA, 25 bp, Mus musculus
gtctctgccattcttccaaaggaaa

SEQ ID NO: 691419 - DNA, 25 bp, Mus musculus
gtctctgccattgttccaaaggaaa

SEQ ID NO: 691420 - DNA, 25 bp, Mus musculus
gtctctgccgtcagttagaggttga

SEQ ID NO: 691421 - DNA, 25 bp, Mus musculus
gtctctgccgtctgttagaggttga

SEQ ID NO: 691422 - DNA, 25 bp, Mus musculus
gtctctgcctaaagcctttggaagc

SEQ ID NO: 691423 - DNA, 25 bp, Mus musculus
gtctctgcctaatgcctttggaagc

SEQ ID NO: 691424 - DNA, 25 bp, Mus musculus
gtctctgctaccatctggcacaatc

SEQ ID NO: 691425 - DNA, 25 bp, Mus musculus
gtctctgctaccttctggcacaatc

SEQ ID NO: 691426 - DNA, 25 bp, Mus musculus
gtctctgctcctaggatacgtaatt

SEQ ID NO: 691427 - DNA, 25 bp, Mus musculus
gtctctgctccttggatacgtaatt

SEQ ID NO: 691428 - DNA, 25 bp, Mus musculus
gtctctgctcttcttcttgaaaacg

SEQ ID NO: 691429 - DNA, 25 bp, Mus musculus
gtctctgctcttgttcttgaaaacg

SEQ ID NO: 691430 - DNA, 25 bp, Mus musculus
gtctctgctgctcacatgagctggt

SEQ ID NO: 691431 - DNA, 25 bp, Mus musculus
gtctctgctgctgacatgagctggt

SEQ ID NO: 691432 - DNA, 25 bp, Mus musculus
gtctctgctgtcagtttctgtacca

SEQ ID NO: 691433 - DNA, 25 bp, Mus musculus
gtctctgctgtctgtttctgtacca

SEQ ID NO: 691434 - DNA, 25 bp, Mus musculus
gtctctgctgtgagctatttctgaa

SEQ ID NO: 691435 - DNA, 25 bp, Mus musculus
gtctctgctgtgtgctatttctgaa

SEQ ID NO: 691436 - DNA, 25 bp, Mus musculus
gtctctgcttagcttgcctgtaaga

SEQ ID NO: 691437 - DNA, 25 bp, Mus musculus
gtctctgcttaggttgcctgtaaga

SEQ ID NO: 691438 - DNA, 25 bp, Mus musculus
gtctctgcttcaattttaggtgcct

SEQ ID NO: 691439 - DNA, 25 bp, Mus musculus
gtctctgcttcactgacttgtgaga

SEQ ID NO: 691440 - DNA, 25 bp, Mus musculus
gtctctgcttcagtgacttgtgaga

SEQ ID NO: 691441 - DNA, 25 bp, Mus musculus
gtctctgcttcatttttaggtgcct

SEQ ID NO: 691442 - DNA, 25 bp, Mus musculus
gtctctgcttggcaagtatcttttt

SEQ ID NO: 691443 - DNA, 25 bp, Mus musculus
gtctctgcttgggaagtatcttttt

SEQ ID NO: 691444 - DNA, 25 bp, Mus musculus
gtctctggaaccaaaatcctagctg

SEQ ID NO: 691445 - DNA, 25 bp, Mus musculus
gtctctggaacctaaatcctagctg

SEQ ID NO: 691446 - DNA, 25 bp, Mus musculus
gtctctggaagcactgttgcttgtg

SEQ ID NO: 691447 - DNA, 25 bp, Mus musculus
gtctctggaagctctgttgcttgtg

SEQ ID NO: 691448 - DNA, 25 bp, Mus musculus
gtctctggaagtccctttgtatgtg

SEQ ID NO: 691449 - DNA, 25 bp, Mus musculus
gtctctggaagtgcctttgtatgtg

SEQ ID NO: 691450 - DNA, 25 bp, Mus musculus
gtctctggacacactcgtgcaggtg

SEQ ID NO: 691451 - DNA, 25 bp, Mus musculus
gtctctggacactctcgtgcaggtg

SEQ ID NO: 691452 - DNA, 25 bp, Mus musculus
gtctctggacctagaagggaccatt

SEQ ID NO: 691453 - DNA, 25 bp, Mus musculus
gtctctggaccttgaagggaccatt

SEQ ID NO: 691454 - DNA, 25 bp, Mus musculus
gtctctggagatagtgggcttcccc

SEQ ID NO: 691455 - DNA, 25 bp, Mus musculus
gtctctggagattgtgggcttcccc

SEQ ID NO: 691456 - DNA, 25 bp, Mus musculus
gtctctggatgaagatttccttctg

SEQ ID NO: 691457 - DNA, 25 bp, Mus musculus
gtctctggatgaccttgctgggttt

SEQ ID NO: 691458 - DNA, 25 bp, Mus musculus
gtctctggatgagcttgctgggttt

SEQ ID NO: 691459 - DNA, 25 bp, Mus musculus
gtctctggatgatgatttccttctg

SEQ ID NO: 691460 - DNA, 25 bp, Mus musculus
gtctctggatttactctttgcaggc

SEQ ID NO: 691461 - DNA, 25 bp, Mus musculus
gtctctggattttctctttgcaggc

SEQ ID NO: 691462 - DNA, 25 bp, Mus musculus
gtctctggcaccagagcatgatgtg

SEQ ID NO: 691463 - DNA, 25 bp, Mus musculus
gtctctggcacctgagcatgatgtg

SEQ ID NO: 691464 - DNA, 25 bp, Mus musculus
gtctctggcagaattacaccgcctg

SEQ ID NO: 691465 - DNA, 25 bp, Mus musculus
gtctctggcagatttacaccgcctg

SEQ ID NO: 691466 - DNA, 25 bp, Mus musculus
gtctctggccctctagagtcaaaag

SEQ ID NO: 691467 - DNA, 25 bp, Mus musculus
gtctctggccctgtagagtcaaaag

SEQ ID NO: 691468 - DNA, 25 bp, Mus musculus
gtctctggctgaagcactcattatt

SEQ ID NO: 691469 - DNA, 25 bp, Mus musculus
gtctctggctgacacaggtacattg

SEQ ID NO: 691470 - DNA, 25 bp, Mus musculus
gtctctggctgagacaggtacattg

SEQ ID NO: 691471 - DNA, 25 bp, Mus musculus
gtctctggctgatgcactcattatt

SEQ ID NO: 691472 - DNA, 25 bp, Mus musculus
gtctctgggaatcgtgttacgtgaa

SEQ ID NO: 691473 - DNA, 25 bp, Mus musculus
gtctctgggaatggtgttacgtgaa

SEQ ID NO: 691474 - DNA, 25 bp, Mus musculus
gtctctgggagcaccgaagggtcca

SEQ ID NO: 691475 - DNA, 25 bp, Mus musculus
gtctctgggagctccgaagggtcca

SEQ ID NO: 691476 - DNA, 25 bp, Mus musculus
gtctctgggtaaatctaacactgtc

SEQ ID NO: 691477 - DNA, 25 bp, Mus musculus
gtctctgggtaattctaacactgtc

SEQ ID NO: 691478 - DNA, 25 bp, Mus musculus
gtctctgggtttcacatggtaccat

SEQ ID NO: 691479 - DNA, 25 bp, Mus musculus
gtctctgggtttgacatggtaccat

SEQ ID NO: 691480 - DNA, 25 bp, Mus musculus
gtctctggtcagcaatatattatag

SEQ ID NO: 691481 - DNA, 25 bp, Mus musculus
gtctctggtcaggaatatattatag

SEQ ID NO: 691482 - DNA, 25 bp, Mus musculus
gtctctggtgggacgaggcttcctc

SEQ ID NO: 691483 - DNA, 25 bp, Mus musculus
gtctctggtgggtcgaggcttcctc

SEQ ID NO: 691484 - DNA, 25 bp, Mus musculus
gtctctggtgtacctgatgatccga

SEQ ID NO: 691485 - DNA, 25 bp, Mus musculus
gtctctggtgtagctgatgatccga

SEQ ID NO: 691486 - DNA, 25 bp, Mus musculus
gtctctggtttgatacccagggaac

SEQ ID NO: 691487 - DNA, 25 bp, Mus musculus
gtctctggtttgctccagtgacact

SEQ ID NO: 691488 - DNA, 25 bp, Mus musculus
gtctctggtttggtccagtgacact

SEQ ID NO: 691489 - DNA, 25 bp, Mus musculus
gtctctggtttgttacccagggaac

SEQ ID NO: 691490 - DNA, 25 bp, Mus musculus
gtctctggttttacagtctatcaca

SEQ ID NO: 691491 - DNA, 25 bp, Mus musculus
gtctctggtttttcagtctatcaca

SEQ ID NO: 691492 - DNA, 25 bp, Mus musculus
gtctctgtaagacccgagtaccgcg

SEQ ID NO: 691493 - DNA, 25 bp, Mus musculus
gtctctgtaagagccgagtaccgcg

SEQ ID NO: 691494 - DNA, 25 bp, Mus musculus
gtctctgtaagcatagctgctccac

SEQ ID NO: 691495 - DNA, 25 bp, Mus musculus
gtctctgtaagcttagctgctccac

SEQ ID NO: 691496 - DNA, 25 bp, Mus musculus
gtctctgtacctccagacacttgag

SEQ ID NO: 691497 - DNA, 25 bp, Mus musculus
gtctctgtacctgcagacacttgag

SEQ ID NO: 691498 - DNA, 25 bp, Mus musculus
gtctctgtagcgacgtgcggcaata

SEQ ID NO: 691499 - DNA, 25 bp, Mus musculus
gtctctgtagcgtcgtgcggcaata

SEQ ID NO: 691500 - DNA, 25 bp, Mus musculus
gtctctgtatgtccagtcggtggaa

SEQ ID NO: 691501 - DNA, 25 bp, Mus musculus
gtctctgtatgtgcagtcggtggaa

SEQ ID NO: 691502 - DNA, 25 bp, Mus musculus
gtctctgtcagaaaagtcctttatt

SEQ ID NO: 691503 - DNA, 25 bp, Mus musculus
gtctctgtcagataagtcctttatt

SEQ ID NO: 691504 - DNA, 25 bp, Mus musculus
gtctctgtccagaaaataagccatg

SEQ ID NO: 691505 - DNA, 25 bp, Mus musculus
gtctctgtccagtaaataagccatg

SEQ ID NO: 691506 - DNA, 25 bp, Mus musculus
gtctctgtccgaaggagcagtctta

SEQ ID NO: 691507 - DNA, 25 bp, Mus musculus
gtctctgtccgatggagcagtctta

SEQ ID NO: 691508 - DNA, 25 bp, Mus musculus
gtctctgtccgtcacggtaagttta

SEQ ID NO: 691509 - DNA, 25 bp, Mus musculus
gtctctgtccgtgacggtaagttta

SEQ ID NO: 691510 - DNA, 25 bp, Mus musculus
gtctctgtcctcagatataccagaa

SEQ ID NO: 691511 - DNA, 25 bp, Mus musculus
gtctctgtcctctgatataccagaa

SEQ ID NO: 691512 - DNA, 25 bp, Mus musculus
gtctctgtcgccagcatacaggcag

SEQ ID NO: 691513 - DNA, 25 bp, Mus musculus
gtctctgtcgcctgcatacaggcag

SEQ ID NO: 691514 - DNA, 25 bp, Mus musculus
gtctctgtctttatgtacttaatgc

SEQ ID NO: 691515 - DNA, 25 bp, Mus musculus
gtctctgtctttttgtacttaatgc

SEQ ID NO: 691516 - DNA, 25 bp, Mus musculus
gtctctgtgaagacaaactcctcct

SEQ ID NO: 691517 - DNA, 25 bp, Mus musculus
gtctctgtgaagtcaaactcctcct

SEQ ID NO: 691518 - DNA, 25 bp, Mus musculus
gtctctgtgactagtatgggctccc

SEQ ID NO: 691519 - DNA, 25 bp, Mus musculus
gtctctgtgactctccaaacaaggt

SEQ ID NO: 691520 - DNA, 25 bp, Mus musculus
gtctctgtgactgtccaaacaaggt

SEQ ID NO: 691521 - DNA, 25 bp, Mus musculus
gtctctgtgacttgtatgggctccc

SEQ ID NO: 691522 - DNA, 25 bp, Mus musculus
gtctctgtggagaatttgtatgata

SEQ ID NO: 691523 - DNA, 25 bp, Mus musculus
gtctctgtggagtatttgtatgata

SEQ ID NO: 691524 - DNA, 25 bp, Mus musculus
gtctctgtgtcaatgtgtcatccta

SEQ ID NO: 691525 - DNA, 25 bp, Mus musculus
gtctctgtgtcattgtgtcatccta

SEQ ID NO: 691526 - DNA, 25 bp, Mus musculus
gtctctgtgtctatcagaatgagct

SEQ ID NO: 691527 - DNA, 25 bp, Mus musculus
gtctctgtgtctttcagaatgagct

SEQ ID NO: 691528 - DNA, 25 bp, Mus musculus
gtctctgtgtgtatatcatctactg

SEQ ID NO: 691529 - DNA, 25 bp, Mus musculus
gtctctgtgtgtttatcatctactg

SEQ ID NO: 691530 - DNA, 25 bp, Mus musculus
gtctctgtgttcactgtatcttaaa

SEQ ID NO: 691531 - DNA, 25 bp, Mus musculus
gtctctgtgttctctgtatcttaaa

SEQ ID NO: 691532 - DNA, 25 bp, Mus musculus
gtctctgttaaaaaacaatgtgatc

SEQ ID NO: 691533 - DNA, 25 bp, Mus musculus
gtctctgttaaataacaatgtgatc

SEQ ID NO: 691534 - DNA, 25 bp, Mus musculus
gtctctgttacaatgctgatgttac

SEQ ID NO: 691535 - DNA, 25 bp, Mus musculus
gtctctgttacattgctgatgttac

SEQ ID NO: 691536 - DNA, 25 bp, Mus musculus
gtctctgttctcactagtagattgc

SEQ ID NO: 691537 - DNA, 25 bp, Mus musculus
gtctctgttctcacttacacatgac

SEQ ID NO: 691538 - DNA, 25 bp, Mus musculus
gtctctgttctctctagtagattgc

SEQ ID NO: 691539 - DNA, 25 bp, Mus musculus
gtctctgttctctcttacacatgac

SEQ ID NO: 691540 - DNA, 25 bp, Mus musculus
gtctctgttcttagactgtcttccc

SEQ ID NO: 691541 - DNA, 25 bp, Mus musculus
gtctctgttctttgactgtcttccc

SEQ ID NO: 691542 - DNA, 25 bp, Mus musculus
gtctctgttgctatacttacctgtt

SEQ ID NO: 691543 - DNA, 25 bp, Mus musculus
gtctctgttgctttacttacctgtt

SEQ ID NO: 691544 - DNA, 25 bp, Mus musculus
gtctctgttgggacctgtaaatctc

SEQ ID NO: 691545 - DNA, 25 bp, Mus musculus
gtctctgttgggtcctgtaaatctc

SEQ ID NO: 691546 - DNA, 25 bp, Mus musculus
gtctctgttggtcttgtcaacctac

SEQ ID NO: 691547 - DNA, 25 bp, Mus musculus
gtctctgttggtgttgtcaacctac

SEQ ID NO: 691548 - DNA, 25 bp, Mus musculus
gtctcttaaggtacatgtttgtggg

SEQ ID NO: 691549 - DNA, 25 bp, Mus musculus
gtctcttaaggttcatgtttgtggg

SEQ ID NO: 691550 - DNA, 25 bp, Mus musculus
gtctcttacctcctttctcaatgag

SEQ ID NO: 691551 - DNA, 25 bp, Mus musculus
gtctcttacctcgtttctcaatgag

SEQ ID NO: 691552 - DNA, 25 bp, Mus musculus
gtctcttacgttaaaggccttgctg

SEQ ID NO: 691553 - DNA, 25 bp, Mus musculus
gtctcttacgtttaaggccttgctg

SEQ ID NO: 691554 - DNA, 25 bp, Mus musculus
gtctcttactttagttctctaacct

SEQ ID NO: 691555 - DNA, 25 bp, Mus musculus
gtctcttacttttgttctctaacct

SEQ ID NO: 691556 - DNA, 25 bp, Mus musculus
gtctcttagagaatctggttccatc

SEQ ID NO: 691557 - DNA, 25 bp, Mus musculus
gtctcttagagattctggttccatc

SEQ ID NO: 691558 - DNA, 25 bp, Mus musculus
gtctcttagcacattgcattgagaa

SEQ ID NO: 691559 - DNA, 25 bp, Mus musculus
gtctcttagcactttgcattgagaa

SEQ ID NO: 691560 - DNA, 25 bp, Mus musculus
gtctcttagcagagaactcttatcg

SEQ ID NO: 691561 - DNA, 25 bp, Mus musculus
gtctcttagcagtgaactcttatcg

SEQ ID NO: 691562 - DNA, 25 bp, Mus musculus
gtctcttcacacactgaattctggg

SEQ ID NO: 691563 - DNA, 25 bp, Mus musculus
gtctcttcacactctgaattctggg

SEQ ID NO: 691564 - DNA, 25 bp, Mus musculus
gtctcttcactccttgcgtttggta

SEQ ID NO: 691565 - DNA, 25 bp, Mus musculus
gtctcttcactcgttgcgtttggta

SEQ ID NO: 691566 - DNA, 25 bp, Mus musculus
gtctcttcagacattagggaacgct

SEQ ID NO: 691567 - DNA, 25 bp, Mus musculus
gtctcttcagactttagggaacgct

SEQ ID NO: 691568 - DNA, 25 bp, Mus musculus
gtctcttcagagagtcagcacctta

SEQ ID NO: 691569 - DNA, 25 bp, Mus musculus
gtctcttcagagtgtcagcacctta

SEQ ID NO: 691570 - DNA, 25 bp, Mus musculus
gtctcttcagccaaaacaacggttg

SEQ ID NO: 691571 - DNA, 25 bp, Mus musculus
gtctcttcagcctaaacaacggttg

SEQ ID NO: 691572 - DNA, 25 bp, Mus musculus
gtctcttcagctctgggtggcagac

SEQ ID NO: 691573 - DNA, 25 bp, Mus musculus
gtctcttcagctgtgggtggcagac

SEQ ID NO: 691574 - DNA, 25 bp, Mus musculus
gtctcttcatgtacagtttacacct

SEQ ID NO: 691575 - DNA, 25 bp, Mus musculus
gtctcttcatgttcagtttacacct

SEQ ID NO: 691576 - DNA, 25 bp, Mus musculus
gtctcttccatgagtccagaaagtt

SEQ ID NO: 691577 - DNA, 25 bp, Mus musculus
gtctcttccatgtgtccagaaagtt

SEQ ID NO: 691578 - DNA, 25 bp, Mus musculus
gtctcttccctgacattgctaaagg

SEQ ID NO: 691579 - DNA, 25 bp, Mus musculus
gtctcttccctgtcattgctaaagg

SEQ ID NO: 691580 - DNA, 25 bp, Mus musculus
gtctcttcctgcactaaaagtcatt

SEQ ID NO: 691581 - DNA, 25 bp, Mus musculus
gtctcttcctgctctaaaagtcatt

SEQ ID NO: 691582 - DNA, 25 bp, Mus musculus
gtctcttccttaatagtctcttgca

SEQ ID NO: 691583 - DNA, 25 bp, Mus musculus
gtctcttccttattagtctcttgca

SEQ ID NO: 691584 - DNA, 25 bp, Mus musculus
gtctcttcgtggactcggtaccata

SEQ ID NO: 691585 - DNA, 25 bp, Mus musculus
gtctcttcgtggtctcggtaccata

SEQ ID NO: 691586 - DNA, 25 bp, Mus musculus
gtctcttctatgattacgtcgtcta

SEQ ID NO: 691587 - DNA, 25 bp, Mus musculus
gtctcttctatgtttacgtcgtcta

SEQ ID NO: 691588 - DNA, 25 bp, Mus musculus
gtctcttctcctaattttctggcta

SEQ ID NO: 691589 - DNA, 25 bp, Mus musculus
gtctcttctccttattttctggcta

SEQ ID NO: 691590 - DNA, 25 bp, Mus musculus
gtctcttctcgcacgggacagagac

SEQ ID NO: 691591 - DNA, 25 bp, Mus musculus
gtctcttctcgctcgggacagagac

SEQ ID NO: 691592 - DNA, 25 bp, Mus musculus
gtctcttctctgctcagccaggatg

SEQ ID NO: 691593 - DNA, 25 bp, Mus musculus
gtctcttctctggtcagccaggatg

SEQ ID NO: 691594 - DNA, 25 bp, Mus musculus
gtctcttctcttcagttatctccag

SEQ ID NO: 691595 - DNA, 25 bp, Mus musculus
gtctcttctcttgagttatctccag

SEQ ID NO: 691596 - DNA, 25 bp, Mus musculus
gtctcttctgcaccaatgtggcctt

SEQ ID NO: 691597 - DNA, 25 bp, Mus musculus
gtctcttctgcagcaatgtggcctt

SEQ ID NO: 691598 - DNA, 25 bp, Mus musculus
gtctcttctgggcttgcattcctgt

SEQ ID NO: 691599 - DNA, 25 bp, Mus musculus
gtctcttctggggttgcattcctgt

SEQ ID NO: 691600 - DNA, 25 bp, Mus musculus
gtctcttctgtacacaagacctggg

SEQ ID NO: 691601 - DNA, 25 bp, Mus musculus
gtctcttctgtagacaagacctggg

SEQ ID NO: 691602 - DNA, 25 bp, Mus musculus
gtctcttctgtgcatatgtttcctg

SEQ ID NO: 691603 - DNA, 25 bp, Mus musculus
gtctcttctgtggatatgtttcctg

SEQ ID NO: 691604 - DNA, 25 bp, Mus musculus
gtctcttcttatatccaagtatggg

SEQ ID NO: 691605 - DNA, 25 bp, Mus musculus
gtctcttcttatctgcagcattgca

SEQ ID NO: 691606 - DNA, 25 bp, Mus musculus
gtctcttcttatgtgcagcattgca

SEQ ID NO: 691607 - DNA, 25 bp, Mus musculus
gtctcttcttatttccaagtatggg

SEQ ID NO: 691608 - DNA, 25 bp, Mus musculus
gtctcttcttccaatgttgatctta

SEQ ID NO: 691609 - DNA, 25 bp, Mus musculus
gtctcttcttcctatgttgatctta

SEQ ID NO: 691610 - DNA, 25 bp, Mus musculus
gtctcttgaagacctgaagcgatca

SEQ ID NO: 691611 - DNA, 25 bp, Mus musculus
gtctcttgaagagctgaagcgatca

SEQ ID NO: 691612 - DNA, 25 bp, Mus musculus
gtctcttgacttcgttggaatttta

SEQ ID NO: 691613 - DNA, 25 bp, Mus musculus
gtctcttgacttggttggaatttta

SEQ ID NO: 691614 - DNA, 25 bp, Mus musculus
gtctcttgagataggcttacatact

SEQ ID NO: 691615 - DNA, 25 bp, Mus musculus
gtctcttgagattggcttacatact

SEQ ID NO: 691616 - DNA, 25 bp, Mus musculus
gtctcttgcagacgtataaactgac

SEQ ID NO: 691617 - DNA, 25 bp, Mus musculus
gtctcttgcagaggtataaactgac

SEQ ID NO: 691618 - DNA, 25 bp, Mus musculus
gtctcttgcagcaccattaggttta

SEQ ID NO: 691619 - DNA, 25 bp, Mus musculus
gtctcttgcagctccattaggttta

SEQ ID NO: 691620 - DNA, 25 bp, Mus musculus
gtctcttgcagtatttctctgagtc

SEQ ID NO: 691621 - DNA, 25 bp, Mus musculus
gtctcttgcagtttttctctgagtc

SEQ ID NO: 691622 - DNA, 25 bp, Mus musculus
gtctcttgctcaaatggctctcgtg

SEQ ID NO: 691623 - DNA, 25 bp, Mus musculus
gtctcttgctcatatggctctcgtg

SEQ ID NO: 691624 - DNA, 25 bp, Mus musculus
gtctcttgctccagaacttcaatag

SEQ ID NO: 691625 - DNA, 25 bp, Mus musculus
gtctcttgctcctgaacttcaatag

SEQ ID NO: 691626 - DNA, 25 bp, Mus musculus
gtctcttggaaaacactaagttgga

SEQ ID NO: 691627 - DNA, 25 bp, Mus musculus
gtctcttggaaatcactaagttgga

SEQ ID NO: 691628 - DNA, 25 bp, Mus musculus
gtctcttggaataaggcatttacag

SEQ ID NO: 691629 - DNA, 25 bp, Mus musculus
gtctcttggaattaggcatttacag

SEQ ID NO: 691630 - DNA, 25 bp, Mus musculus
gtctcttggacactattagtctaca

SEQ ID NO: 691631 - DNA, 25 bp, Mus musculus
gtctcttggacagtattagtctaca

SEQ ID NO: 691632 - DNA, 25 bp, Mus musculus
gtctcttggatgacgtggaagctct

SEQ ID NO: 691633 - DNA, 25 bp, Mus musculus
gtctcttggatgtcgtggaagctct

SEQ ID NO: 691634 - DNA, 25 bp, Mus musculus
gtctcttgggatatggccttgggaa

SEQ ID NO: 691635 - DNA, 25 bp, Mus musculus
gtctcttgggatttggccttgggaa

SEQ ID NO: 691636 - DNA, 25 bp, Mus musculus
gtctcttgtcagatctaagctcagc

SEQ ID NO: 691637 - DNA, 25 bp, Mus musculus
gtctcttgtcagttctaagctcagc

SEQ ID NO: 691638 - DNA, 25 bp, Mus musculus
gtctcttgtctccagtttgtacttt

SEQ ID NO: 691639 - DNA, 25 bp, Mus musculus
gtctcttgtctcgagtttgtacttt

SEQ ID NO: 691640 - DNA, 25 bp, Mus musculus
gtctcttgtgaaagactgacccaga

SEQ ID NO: 691641 - DNA, 25 bp, Mus musculus
gtctcttgtgaatgactgacccaga

SEQ ID NO: 691642 - DNA, 25 bp, Mus musculus
gtctcttgtgttcagtgtcatctca

SEQ ID NO: 691643 - DNA, 25 bp, Mus musculus
gtctcttgtgttgagtgtcatctca

SEQ ID NO: 691644 - DNA, 25 bp, Mus musculus
gtctcttgttcaaaatatcttgtca

SEQ ID NO: 691645 - DNA, 25 bp, Mus musculus
gtctcttgttcataatatcttgtca

SEQ ID NO: 691646 - DNA, 25 bp, Mus musculus
gtctcttgttgacttgtctgtcaaa

SEQ ID NO: 691647 - DNA, 25 bp, Mus musculus
gtctcttgttgagttgtctgtcaaa

SEQ ID NO: 691648 - DNA, 25 bp, Mus musculus
gtctctttaaagacaccctcgatta

SEQ ID NO: 691649 - DNA, 25 bp, Mus musculus
gtctctttaaagtcaccctcgatta

SEQ ID NO: 691650 - DNA, 25 bp, Mus musculus
gtctctttagagcattaccaaattt

SEQ ID NO: 691651 - DNA, 25 bp, Mus musculus
gtctctttagaggattaccaaattt

SEQ ID NO: 691652 - DNA, 25 bp, Mus musculus
gtctctttatgccttgattcaccaa

SEQ ID NO: 691653 - DNA, 25 bp, Mus musculus
gtctctttatgcgttgattcaccaa

SEQ ID NO: 691654 - DNA, 25 bp, Mus musculus
gtctctttcaaacctcttgtcagat

SEQ ID NO: 691655 - DNA, 25 bp, Mus musculus
gtctctttcaaactagatcttcttg

SEQ ID NO: 691656 - DNA, 25 bp, Mus musculus
gtctctttcaaagctcttgtcagat

SEQ ID NO: 691657 - DNA, 25 bp, Mus musculus
gtctctttcaaagtagatcttcttg

SEQ ID NO: 691658 - DNA, 25 bp, Mus musculus
gtctctttcaagaactttggtcacg

SEQ ID NO: 691659 - DNA, 25 bp, Mus musculus
gtctctttcaagtactttggtcacg

SEQ ID NO: 691660 - DNA, 25 bp, Mus musculus
gtctctttcataaatcttccttgta

SEQ ID NO: 691661 - DNA, 25 bp, Mus musculus
gtctctttcatatatcttccttgta

SEQ ID NO: 691662 - DNA, 25 bp, Mus musculus
gtctctttccctcgtgatggaagca

SEQ ID NO: 691663 - DNA, 25 bp, Mus musculus
gtctctttccctggtgatggaagca

SEQ ID NO: 691664 - DNA, 25 bp, Mus musculus
gtctctttctctctcaaggtgaggt

SEQ ID NO: 691665 - DNA, 25 bp, Mus musculus
gtctctttctctgtcaaggtgaggt

SEQ ID NO: 691666 - DNA, 25 bp, Mus musculus
gtctctttctgactaaccaagtaca

SEQ ID NO: 691667 - DNA, 25 bp, Mus musculus
gtctctttctgagtaaccaagtaca

SEQ ID NO: 691668 - DNA, 25 bp, Mus musculus
gtctctttctggcttatatatcctt

SEQ ID NO: 691669 - DNA, 25 bp, Mus musculus
gtctctttctgggttatatatcctt

SEQ ID NO: 691670 - DNA, 25 bp, Mus musculus
gtctctttgaagcattccccaggag

SEQ ID NO: 691671 - DNA, 25 bp, Mus musculus
gtctctttgaagctgcatgtgggcc

SEQ ID NO: 691672 - DNA, 25 bp, Mus musculus
gtctctttgaaggattccccaggag

SEQ ID NO: 691673 - DNA, 25 bp, Mus musculus
gtctctttgaaggtgcatgtgggcc

SEQ ID NO: 691674 - DNA, 25 bp, Mus musculus
gtctctttgctgacatcttgcttta

SEQ ID NO: 691675 - DNA, 25 bp, Mus musculus
gtctctttgctgtcatcttgcttta

SEQ ID NO: 691676 - DNA, 25 bp, Mus musculus
gtctctttggccctttctcaataaa

SEQ ID NO: 691677 - DNA, 25 bp, Mus musculus
gtctctttggccgtttctcaataaa

SEQ ID NO: 691678 - DNA, 25 bp, Mus musculus
gtctctttgtctaatcagtgctatg

SEQ ID NO: 691679 - DNA, 25 bp, Mus musculus
gtctctttgtcttatcagtgctatg

SEQ ID NO: 691680 - DNA, 25 bp, Mus musculus
gtctctttgtgtattaatctcgcgg

SEQ ID NO: 691681 - DNA, 25 bp, Mus musculus
gtctctttgtgttttaatctcgcgg

SEQ ID NO: 691682 - DNA, 25 bp, Mus musculus
gtctctttgttacatgtcatatagc

SEQ ID NO: 691683 - DNA, 25 bp, Mus musculus
gtctctttgttagatgtcatatagc

SEQ ID NO: 691684 - DNA, 25 bp, Mus musculus
gtctcttttctactaacttgtgtga

SEQ ID NO: 691685 - DNA, 25 bp, Mus musculus
gtctcttttctagtaacttgtgtga

SEQ ID NO: 691686 - DNA, 25 bp, Mus musculus
gtctcttttgagagtatagtcagtt

SEQ ID NO: 691687 - DNA, 25 bp, Mus musculus
gtctcttttgagtgtatagtcagtt

SEQ ID NO: 691688 - DNA, 25 bp, Mus musculus
gtctctttttctaggtgctttatta

SEQ ID NO: 691689 - DNA, 25 bp, Mus musculus
gtctctttttcttggtgctttatta

SEQ ID NO: 691690 - DNA, 25 bp, Mus musculus
gtctgaaaacctcctttactgctgt

SEQ ID NO: 691691 - DNA, 25 bp, Mus musculus
gtctgaaaacctgctttactgctgt

SEQ ID NO: 691692 - DNA, 25 bp, Mus musculus
gtctgaaaagccatttgtcccgtgt

SEQ ID NO: 691693 - DNA, 25 bp, Mus musculus
gtctgaaaagccttttgtcccgtgt

SEQ ID NO: 691694 - DNA, 25 bp, Mus musculus
gtctgaaaatacaggttctcttgga

SEQ ID NO: 691695 - DNA, 25 bp, Mus musculus
gtctgaaaatactggttctcttgga

SEQ ID NO: 691696 - DNA, 25 bp, Mus musculus
gtctgaaaatagcttctccttatgt

SEQ ID NO: 691697 - DNA, 25 bp, Mus musculus
gtctgaaaataggttctccttatgt

SEQ ID NO: 691698 - DNA, 25 bp, Mus musculus
gtctgaaacacaacaaccttgctca

SEQ ID NO: 691699 - DNA, 25 bp, Mus musculus
gtctgaaacacatcaaccttgctca

SEQ ID NO: 691700 - DNA, 25 bp, Mus musculus
gtctgaaacactccaagatggtggc

SEQ ID NO: 691701 - DNA, 25 bp, Mus musculus
gtctgaaacactgcaagatggtggc

SEQ ID NO: 691702 - DNA, 25 bp, Mus musculus
gtctgaaacttgacttctcacagcc

SEQ ID NO: 691703 - DNA, 25 bp, Mus musculus
gtctgaaacttgtcttctcacagcc

SEQ ID NO: 691704 - DNA, 25 bp, Mus musculus
gtctgaaagactcatcccaggctcc

SEQ ID NO: 691705 - DNA, 25 bp, Mus musculus
gtctgaaagactgatcccaggctcc

SEQ ID NO: 691706 - DNA, 25 bp, Mus musculus
gtctgaaagcagaccagcattccga

SEQ ID NO: 691707 - DNA, 25 bp, Mus musculus
gtctgaaagcagtccagcattccga

SEQ ID NO: 691708 - DNA, 25 bp, Mus musculus
gtctgaaagctactttcccgcagga

SEQ ID NO: 691709 - DNA, 25 bp, Mus musculus
gtctgaaagctagtttcccgcagga

SEQ ID NO: 691710 - DNA, 25 bp, Mus musculus
gtctgaaagtgtcactgtggccacc

SEQ ID NO: 691711 - DNA, 25 bp, Mus musculus
gtctgaaagtgtgactgtggccacc

SEQ ID NO: 691712 - DNA, 25 bp, Mus musculus
gtctgaaatctaactatccgtccac

SEQ ID NO: 691713 - DNA, 25 bp, Mus musculus
gtctgaaatctatctatccgtccac

SEQ ID NO: 691714 - DNA, 25 bp, Mus musculus
gtctgaacaattcgctgtgtccaca

SEQ ID NO: 691715 - DNA, 25 bp, Mus musculus
gtctgaacaattggctgtgtccaca

SEQ ID NO: 691716 - DNA, 25 bp, Mus musculus
gtctgaacactcagaaagctgagaa

SEQ ID NO: 691717 - DNA, 25 bp, Mus musculus
gtctgaacactctgaaagctgagaa

SEQ ID NO: 691718 - DNA, 25 bp, Mus musculus
gtctgaaccctgcaactgctttgga

SEQ ID NO: 691719 - DNA, 25 bp, Mus musculus
gtctgaaccctggaactgctttgga

SEQ ID NO: 691720 - DNA, 25 bp, Mus musculus
gtctgaaccgttccttgtggattta

SEQ ID NO: 691721 - DNA, 25 bp, Mus musculus
gtctgaaccgttgcttgtggattta

SEQ ID NO: 691722 - DNA, 25 bp, Mus musculus
gtctgaactataaatggaacccttg

SEQ ID NO: 691723 - DNA, 25 bp, Mus musculus
gtctgaactatatatggaacccttg

SEQ ID NO: 691724 - DNA, 25 bp, Mus musculus
gtctgaactctactgcacttatcat

SEQ ID NO: 691725 - DNA, 25 bp, Mus musculus
gtctgaactctagtgcacttatcat

SEQ ID NO: 691726 - DNA, 25 bp, Mus musculus
gtctgaactgaacagtgaatctgct

SEQ ID NO: 691727 - DNA, 25 bp, Mus musculus
gtctgaactgaagagtgaatctgct

SEQ ID NO: 691728 - DNA, 25 bp, Mus musculus
gtctgaactgtactgtgagagcttg

SEQ ID NO: 691729 - DNA, 25 bp, Mus musculus
gtctgaactgtagtgtgagagcttg

SEQ ID NO: 691730 - DNA, 25 bp, Mus musculus
gtctgaagattccaccaaagccctg

SEQ ID NO: 691731 - DNA, 25 bp, Mus musculus
gtctgaagattcgaccaaagccctg

SEQ ID NO: 691732 - DNA, 25 bp, Mus musculus
gtctgaagccaaaatacacacaata

SEQ ID NO: 691733 - DNA, 25 bp, Mus musculus
gtctgaagccaatatacacacaata

SEQ ID NO: 691734 - DNA, 25 bp, Mus musculus
gtctgaagctcgacaggtggaacaa

SEQ ID NO: 691735 - DNA, 25 bp, Mus musculus
gtctgaagctcgtcaggtggaacaa

SEQ ID NO: 691736 - DNA, 25 bp, Mus musculus
gtctgaagcttaccctgagggatac

SEQ ID NO: 691737 - DNA, 25 bp, Mus musculus
gtctgaagcttagcctgagggatac

SEQ ID NO: 691738 - DNA, 25 bp, Mus musculus
gtctgaaggaccatctgctaaatct

SEQ ID NO: 691739 - DNA, 25 bp, Mus musculus
gtctgaaggaccttctgctaaatct

SEQ ID NO: 691740 - DNA, 25 bp, Mus musculus
gtctgaaggactatctactactgtt

SEQ ID NO: 691741 - DNA, 25 bp, Mus musculus
gtctgaaggactttctactactgtt

SEQ ID NO: 691742 - DNA, 25 bp, Mus musculus
gtctgaaggtggaaatcactgctct

SEQ ID NO: 691743 - DNA, 25 bp, Mus musculus
gtctgaaggtggtaatcactgctct

SEQ ID NO: 691744 - DNA, 25 bp, Mus musculus
gtctgaagtgtgacttggtggcatc

SEQ ID NO: 691745 - DNA, 25 bp, Mus musculus
gtctgaagtgtgtcttggtggcatc

SEQ ID NO: 691746 - DNA, 25 bp, Mus musculus
gtctgaataacaatctctcctgctg

SEQ ID NO: 691747 - DNA, 25 bp, Mus musculus
gtctgaataacattctctcctgctg

SEQ ID NO: 691748 - DNA, 25 bp, Mus musculus
gtctgaatagatatcttcttggaac

SEQ ID NO: 691749 - DNA, 25 bp, Mus musculus
gtctgaatagatttcttcttggaac

SEQ ID NO: 691750 - DNA, 25 bp, Mus musculus
gtctgaatatgaatggcactgcctt

SEQ ID NO: 691751 - DNA, 25 bp, Mus musculus
gtctgaatatgattggcactgcctt

SEQ ID NO: 691752 - DNA, 25 bp, Mus musculus
gtctgaatcagcagtatcagatgtg

SEQ ID NO: 691753 - DNA, 25 bp, Mus musculus
gtctgaatcagctgtatcagatgtg

SEQ ID NO: 691754 - DNA, 25 bp, Mus musculus
gtctgaatcataataagtagccact

SEQ ID NO: 691755 - DNA, 25 bp, Mus musculus
gtctgaatcatattaagtagccact

SEQ ID NO: 691756 - DNA, 25 bp, Mus musculus
gtctgaatgaggctcggtcaccacg

SEQ ID NO: 691757 - DNA, 25 bp, Mus musculus
gtctgaatgagggtcggtcaccacg

SEQ ID NO: 691758 - DNA, 25 bp, Mus musculus
gtctgaatgccacgaaagctcccca

SEQ ID NO: 691759 - DNA, 25 bp, Mus musculus
gtctgaatgccaggaaagctcccca

SEQ ID NO: 691760 - DNA, 25 bp, Mus musculus
gtctgaatgcctcaatacgggagtg

SEQ ID NO: 691761 - DNA, 25 bp, Mus musculus
gtctgaatgcctgaatacgggagtg

SEQ ID NO: 691762 - DNA, 25 bp, Mus musculus
gtctgaatggctaccgctaatctga

SEQ ID NO: 691763 - DNA, 25 bp, Mus musculus
gtctgaatggcttccgctaatctga

SEQ ID NO: 691764 - DNA, 25 bp, Mus musculus
gtctgaatgtttccatagttttcca

SEQ ID NO: 691765 - DNA, 25 bp, Mus musculus
gtctgaatgtttgcatagttttcca

SEQ ID NO: 691766 - DNA, 25 bp, Mus musculus
gtctgaattagtcttccgagccatt

SEQ ID NO: 691767 - DNA, 25 bp, Mus musculus
gtctgaattagtgttccgagccatt

SEQ ID NO: 691768 - DNA, 25 bp, Mus musculus
gtctgaattatgatttcctggctga

SEQ ID NO: 691769 - DNA, 25 bp, Mus musculus
gtctgaattatgttttcctggctga

SEQ ID NO: 691770 - DNA, 25 bp, Mus musculus
gtctgaattgtaacagctccctgtt

SEQ ID NO: 691771 - DNA, 25 bp, Mus musculus
gtctgaattgtatcagctccctgtt

SEQ ID NO: 691772 - DNA, 25 bp, Mus musculus
gtctgacaactcagacgtggaagtt

SEQ ID NO: 691773 - DNA, 25 bp, Mus musculus
gtctgacaactctgacgtggaagtt

SEQ ID NO: 691774 - DNA, 25 bp, Mus musculus
gtctgacaagacatcgtaggcttcg

SEQ ID NO: 691775 - DNA, 25 bp, Mus musculus
gtctgacaagacttcgtaggcttcg

SEQ ID NO: 691776 - DNA, 25 bp, Mus musculus
gtctgacaatgaacccacctttgtt

SEQ ID NO: 691777 - DNA, 25 bp, Mus musculus
gtctgacaatgatcccacctttgtt

SEQ ID NO: 691778 - DNA, 25 bp, Mus musculus
gtctgacacctgagggcagccggca

SEQ ID NO: 691779 - DNA, 25 bp, Mus musculus
gtctgacacctgtgggcagccggca

SEQ ID NO: 691780 - DNA, 25 bp, Mus musculus
gtctgacacgctctgaaacttgaag

SEQ ID NO: 691781 - DNA, 25 bp, Mus musculus
gtctgacacgctgtgaaacttgaag

SEQ ID NO: 691782 - DNA, 25 bp, Mus musculus
gtctgacactacagtctccaaaggg

SEQ ID NO: 691783 - DNA, 25 bp, Mus musculus
gtctgacactactgtctccaaaggg

SEQ ID NO: 691784 - DNA, 25 bp, Mus musculus
gtctgacagcttatcccagtaatgt

SEQ ID NO: 691785 - DNA, 25 bp, Mus musculus
gtctgacagcttttcccagtaatgt

SEQ ID NO: 691786 - DNA, 25 bp, Mus musculus
gtctgacagtgaaactcaaacttgc

SEQ ID NO: 691787 - DNA, 25 bp, Mus musculus
gtctgacagtgatactcaaacttgc

SEQ ID NO: 691788 - DNA, 25 bp, Mus musculus
gtctgacatagtcttccaattctgt

SEQ ID NO: 691789 - DNA, 25 bp, Mus musculus
gtctgacatagtgttccaattctgt

SEQ ID NO: 691790 - DNA, 25 bp, Mus musculus
gtctgacatatgatctatgccatag

SEQ ID NO: 691791 - DNA, 25 bp, Mus musculus
gtctgacatatgttctatgccatag

SEQ ID NO: 691792 - DNA, 25 bp, Mus musculus
gtctgacatcgaattcctcattgag

SEQ ID NO: 691793 - DNA, 25 bp, Mus musculus
gtctgacatcgatttcctcattgag

SEQ ID NO: 691794 - DNA, 25 bp, Mus musculus
gtctgacatgaaccgtgaatgatct

SEQ ID NO: 691795 - DNA, 25 bp, Mus musculus
gtctgacatgaagcgtgaatgatct

SEQ ID NO: 691796 - DNA, 25 bp, Mus musculus
gtctgacattgacttgtgtttgaca

SEQ ID NO: 691797 - DNA, 25 bp, Mus musculus
gtctgacattgagttgtgtttgaca

SEQ ID NO: 691798 - DNA, 25 bp, Mus musculus
gtctgaccaagaccatctgtagcct

SEQ ID NO: 691799 - DNA, 25 bp, Mus musculus
gtctgaccaagagcatctgtagcct

SEQ ID NO: 691800 - DNA, 25 bp, Mus musculus
gtctgaccagccagggtccttctga

SEQ ID NO: 691801 - DNA, 25 bp, Mus musculus
gtctgaccagcctgggtccttctga

SEQ ID NO: 691802 - DNA, 25 bp, Mus musculus
gtctgaccagtgctctcaatgggca

SEQ ID NO: 691803 - DNA, 25 bp, Mus musculus
gtctgaccagtggtctcaatgggca

SEQ ID NO: 691804 - DNA, 25 bp, Mus musculus
gtctgaccatagagagcactgccgg

SEQ ID NO: 691805 - DNA, 25 bp, Mus musculus
gtctgaccatagtgagcactgccgg

SEQ ID NO: 691806 - DNA, 25 bp, Mus musculus
gtctgaccattgatgccactgaact

SEQ ID NO: 691807 - DNA, 25 bp, Mus musculus
gtctgaccattgttgccactgaact

SEQ ID NO: 691808 - DNA, 25 bp, Mus musculus
gtctgacccctgagctgatgaataa

SEQ ID NO: 691809 - DNA, 25 bp, Mus musculus
gtctgacccctgtgctgatgaataa

SEQ ID NO: 691810 - DNA, 25 bp, Mus musculus
gtctgaccgtgcacatgggtcttac

SEQ ID NO: 691811 - DNA, 25 bp, Mus musculus
gtctgaccgtgctcatgggtcttac

SEQ ID NO: 691812 - DNA, 25 bp, Mus musculus
gtctgacctcacaactttggtgctg

SEQ ID NO: 691813 - DNA, 25 bp, Mus musculus
gtctgacctcactactttggtgctg

SEQ ID NO: 691814 - DNA, 25 bp, Mus musculus
gtctgacctcataggaaatcctttt

SEQ ID NO: 691815 - DNA, 25 bp, Mus musculus
gtctgacctcattggaaatcctttt

SEQ ID NO: 691816 - DNA, 25 bp, Mus musculus
gtctgacctctcatgaagtcactag

SEQ ID NO: 691817 - DNA, 25 bp, Mus musculus
gtctgacctctccagcaggatgcag

SEQ ID NO: 691818 - DNA, 25 bp, Mus musculus
gtctgacctctcgagcaggatgcag

SEQ ID NO: 691819 - DNA, 25 bp, Mus musculus
gtctgacctctcttgaagtcactag

SEQ ID NO: 691820 - DNA, 25 bp, Mus musculus
gtctgacctggcatgccttattatt

SEQ ID NO: 691821 - DNA, 25 bp, Mus musculus
gtctgacctggcttgccttattatt

SEQ ID NO: 691822 - DNA, 25 bp, Mus musculus
gtctgacctgggatacacagcgaag

SEQ ID NO: 691823 - DNA, 25 bp, Mus musculus
gtctgacctgggttacacagcgaag

SEQ ID NO: 691824 - DNA, 25 bp, Mus musculus
gtctgacctggtagcttttgggatg

SEQ ID NO: 691825 - DNA, 25 bp, Mus musculus
gtctgacctggttgcttttgggatg

SEQ ID NO: 691826 - DNA, 25 bp, Mus musculus
gtctgacctgtgacaaaatgcggca

SEQ ID NO: 691827 - DNA, 25 bp, Mus musculus
gtctgacctgtgtcaaaatgcggca

SEQ ID NO: 691828 - DNA, 25 bp, Mus musculus
gtctgacctgttcagtttttctcca

SEQ ID NO: 691829 - DNA, 25 bp, Mus musculus
gtctgacctgttgagtttttctcca

SEQ ID NO: 691830 - DNA, 25 bp, Mus musculus
gtctgaccttggattcactatgtag

SEQ ID NO: 691831 - DNA, 25 bp, Mus musculus
gtctgaccttggtttcactatgtag

SEQ ID NO: 691832 - DNA, 25 bp, Mus musculus
gtctgaccttttaagatactaagaa

SEQ ID NO: 691833 - DNA, 25 bp, Mus musculus
gtctgacctttttagatactaagaa

SEQ ID NO: 691834 - DNA, 25 bp, Mus musculus
gtctgacgatctataacgggcttcc

SEQ ID NO: 691835 - DNA, 25 bp, Mus musculus
gtctgacgatctttaacgggcttcc

SEQ ID NO: 691836 - DNA, 25 bp, Mus musculus
gtctgacgtgcgaagcttgagctgc

SEQ ID NO: 691837 - DNA, 25 bp, Mus musculus
gtctgacgtgcgtagcttgagctgc

SEQ ID NO: 691838 - DNA, 25 bp, Mus musculus
gtctgacgttcaattgtatgtctgc

SEQ ID NO: 691839 - DNA, 25 bp, Mus musculus
gtctgacgttcatttgtatgtctgc

SEQ ID NO: 691840 - DNA, 25 bp, Mus musculus
gtctgacgttggacacgttgaacat

SEQ ID NO: 691841 - DNA, 25 bp, Mus musculus
gtctgacgttggtcacgttgaacat

SEQ ID NO: 691842 - DNA, 25 bp, Mus musculus
gtctgactacagataagcatttctc

SEQ ID NO: 691843 - DNA, 25 bp, Mus musculus
gtctgactacagttaagcatttctc

SEQ ID NO: 691844 - DNA, 25 bp, Mus musculus
gtctgactatggatatctcctaagc

SEQ ID NO: 691845 - DNA, 25 bp, Mus musculus
gtctgactatggttatctcctaagc

SEQ ID NO: 691846 - DNA, 25 bp, Mus musculus
gtctgactcaggaaacgtgttggca

SEQ ID NO: 691847 - DNA, 25 bp, Mus musculus
gtctgactcaggtaacgtgttggca

SEQ ID NO: 691848 - DNA, 25 bp, Mus musculus
gtctgactcagtaacaaaggcctct

SEQ ID NO: 691849 - DNA, 25 bp, Mus musculus
gtctgactcagttacaaaggcctct

SEQ ID NO: 691850 - DNA, 25 bp, Mus musculus
gtctgactcatgaggcggaagcgat

SEQ ID NO: 691851 - DNA, 25 bp, Mus musculus
gtctgactcatgtggcggaagcgat

SEQ ID NO: 691852 - DNA, 25 bp, Mus musculus
gtctgactcctcacacacataaaga

SEQ ID NO: 691853 - DNA, 25 bp, Mus musculus
gtctgactcctcatacttgtgagaa

SEQ ID NO: 691854 - DNA, 25 bp, Mus musculus
gtctgactcctctcacacataaaga

SEQ ID NO: 691855 - DNA, 25 bp, Mus musculus
gtctgactcctcttacttgtgagaa

SEQ ID NO: 691856 - DNA, 25 bp, Mus musculus
gtctgactctagacactgccgttag

SEQ ID NO: 691857 - DNA, 25 bp, Mus musculus
gtctgactctagtcactgccgttag

SEQ ID NO: 691858 - DNA, 25 bp, Mus musculus
gtctgactctccataagttttgggt

SEQ ID NO: 691859 - DNA, 25 bp, Mus musculus
gtctgactctccttaagttttgggt

SEQ ID NO: 691860 - DNA, 25 bp, Mus musculus
gtctgactgcacaagcaagcctgag

SEQ ID NO: 691861 - DNA, 25 bp, Mus musculus
gtctgactgcactagcaagcctgag

SEQ ID NO: 691862 - DNA, 25 bp, Mus musculus
gtctgactgccaaccttcaaaaagg

SEQ ID NO: 691863 - DNA, 25 bp, Mus musculus
gtctgactgccatccttcaaaaagg

SEQ ID NO: 691864 - DNA, 25 bp, Mus musculus
gtctgactggacacacttcctgaaa

SEQ ID NO: 691865 - DNA, 25 bp, Mus musculus
gtctgactggacatttttacactgt

SEQ ID NO: 691866 - DNA, 25 bp, Mus musculus
gtctgactggactcacttcctgaaa

SEQ ID NO: 691867 - DNA, 25 bp, Mus musculus
gtctgactggacttttttacactgt

SEQ ID NO: 691868 - DNA, 25 bp, Mus musculus
gtctgactggagcatcagggataac

SEQ ID NO: 691869 - DNA, 25 bp, Mus musculus
gtctgactggaggatcagggataac

SEQ ID NO: 691870 - DNA, 25 bp, Mus musculus
gtctgactggttagttctgataaca

SEQ ID NO: 691871 - DNA, 25 bp, Mus musculus
gtctgactggtttgttctgataaca

SEQ ID NO: 691872 - DNA, 25 bp, Mus musculus
gtctgactgtgaagagcagctcctt

SEQ ID NO: 691873 - DNA, 25 bp, Mus musculus
gtctgactgtgatgagcagctcctt

SEQ ID NO: 691874 - DNA, 25 bp, Mus musculus
gtctgacttaccacaggactgttca

SEQ ID NO: 691875 - DNA, 25 bp, Mus musculus
gtctgacttaccagtaccttgttct

SEQ ID NO: 691876 - DNA, 25 bp, Mus musculus
gtctgacttacctcaggactgttca

SEQ ID NO: 691877 - DNA, 25 bp, Mus musculus
gtctgacttacctgtaccttgttct

SEQ ID NO: 691878 - DNA, 25 bp, Mus musculus
gtctgacttcataaacgtaggttcc

SEQ ID NO: 691879 - DNA, 25 bp, Mus musculus
gtctgacttcattaacgtaggttcc

SEQ ID NO: 691880 - DNA, 25 bp, Mus musculus
gtctgacttctactctttttcatca

SEQ ID NO: 691881 - DNA, 25 bp, Mus musculus
gtctgacttctagtctttttcatca

SEQ ID NO: 691882 - DNA, 25 bp, Mus musculus
gtctgacttcttctcatcatcatca

SEQ ID NO: 691883 - DNA, 25 bp, Mus musculus
gtctgacttcttgtcatcatcatca

SEQ ID NO: 691884 - DNA, 25 bp, Mus musculus
gtctgacttgtcatagtgggtttct

SEQ ID NO: 691885 - DNA, 25 bp, Mus musculus
gtctgacttgtcttagtgggtttct

SEQ ID NO: 691886 - DNA, 25 bp, Mus musculus
gtctgactttgacgcaccgggaggc

SEQ ID NO: 691887 - DNA, 25 bp, Mus musculus
gtctgactttgaggcaccgggaggc

SEQ ID NO: 691888 - DNA, 25 bp, Mus musculus
gtctgagaaactctctgagcaagaa

SEQ ID NO: 691889 - DNA, 25 bp, Mus musculus
gtctgagaaactgtctgagcaagaa

SEQ ID NO: 691890 - DNA, 25 bp, Mus musculus
gtctgagaaattccagcgcttcacg

SEQ ID NO: 691891 - DNA, 25 bp, Mus musculus
gtctgagaaattgcagcgcttcacg

SEQ ID NO: 691892 - DNA, 25 bp, Mus musculus
gtctgagaagacctgctcggagcac

SEQ ID NO: 691893 - DNA, 25 bp, Mus musculus
gtctgagaagacgtgctcggagcac

SEQ ID NO: 691894 - DNA, 25 bp, Mus musculus
gtctgagaagctcaggctgacccct

SEQ ID NO: 691895 - DNA, 25 bp, Mus musculus
gtctgagaagctgaggctgacccct

SEQ ID NO: 691896 - DNA, 25 bp, Mus musculus
gtctgagacactattcttagagaaa

SEQ ID NO: 691897 - DNA, 25 bp, Mus musculus
gtctgagacacttttcttagagaaa

SEQ ID NO: 691898 - DNA, 25 bp, Mus musculus
gtctgagaccgaagtgatgctgttc

SEQ ID NO: 691899 - DNA, 25 bp, Mus musculus
gtctgagaccgatgtgatgctgttc

SEQ ID NO: 691900 - DNA, 25 bp, Mus musculus
gtctgagacggtactagattctttt

SEQ ID NO: 691901 - DNA, 25 bp, Mus musculus
gtctgagacggttctagattctttt

SEQ ID NO: 691902 - DNA, 25 bp, Mus musculus
gtctgagacttgatcctagagtggt

SEQ ID NO: 691903 - DNA, 25 bp, Mus musculus
gtctgagacttgttcctagagtggt

SEQ ID NO: 691904 - DNA, 25 bp, Mus musculus
gtctgagagagtataatttcctttc

SEQ ID NO: 691905 - DNA, 25 bp, Mus musculus
gtctgagagagtttaatttcctttc

SEQ ID NO: 691906 - DNA, 25 bp, Mus musculus
gtctgagagcaacttgagccactta

SEQ ID NO: 691907 - DNA, 25 bp, Mus musculus
gtctgagagcaagttgagccactta

SEQ ID NO: 691908 - DNA, 25 bp, Mus musculus
gtctgagagctcagcacgggcacag

SEQ ID NO: 691909 - DNA, 25 bp, Mus musculus
gtctgagagctctgcacgggcacag

SEQ ID NO: 691910 - DNA, 25 bp, Mus musculus
gtctgagagggtattagatcctgta

SEQ ID NO: 691911 - DNA, 25 bp, Mus musculus
gtctgagagggttttagatcctgta

SEQ ID NO: 691912 - DNA, 25 bp, Mus musculus
gtctgagagtctcctgcacggtgac

SEQ ID NO: 691913 - DNA, 25 bp, Mus musculus
gtctgagagtctgctgcacggtgac

SEQ ID NO: 691914 - DNA, 25 bp, Mus musculus
gtctgagatcaaccgcagctacaag

SEQ ID NO: 691915 - DNA, 25 bp, Mus musculus
gtctgagatcaagcgcagctacaag

SEQ ID NO: 691916 - DNA, 25 bp, Mus musculus
gtctgagatcgaaaggccccgctac

SEQ ID NO: 691917 - DNA, 25 bp, Mus musculus
gtctgagatcgataggccccgctac

SEQ ID NO: 691918 - DNA, 25 bp, Mus musculus
gtctgagatcttcaacactgttgct

SEQ ID NO: 691919 - DNA, 25 bp, Mus musculus
gtctgagatcttgaacactgttgct

SEQ ID NO: 691920 - DNA, 25 bp, Mus musculus
gtctgagatgtcatcctcaatacct

SEQ ID NO: 691921 - DNA, 25 bp, Mus musculus
gtctgagatgtcttcctcaatacct

SEQ ID NO: 691922 - DNA, 25 bp, Mus musculus
gtctgagattatatccctaggcagc

SEQ ID NO: 691923 - DNA, 25 bp, Mus musculus
gtctgagattatttccctaggcagc

SEQ ID NO: 691924 - DNA, 25 bp, Mus musculus
gtctgagattttcttgtctgtctga

SEQ ID NO: 691925 - DNA, 25 bp, Mus musculus
gtctgagattttgttgtctgtctga

SEQ ID NO: 691926 - DNA, 25 bp, Mus musculus
gtctgagcaattacagtggatcact

SEQ ID NO: 691927 - DNA, 25 bp, Mus musculus
gtctgagcaatttcagtggatcact

SEQ ID NO: 691928 - DNA, 25 bp, Mus musculus
gtctgagcagctcagtagcgtccat

SEQ ID NO: 691929 - DNA, 25 bp, Mus musculus
gtctgagcagctgagtagcgtccat

SEQ ID NO: 691930 - DNA, 25 bp, Mus musculus
gtctgagcatacagaaagcactcgt

SEQ ID NO: 691931 - DNA, 25 bp, Mus musculus
gtctgagcatactgaaagcactcgt

SEQ ID NO: 691932 - DNA, 25 bp, Mus musculus
gtctgagccacacggatgcatccta

SEQ ID NO: 691933 - DNA, 25 bp, Mus musculus
gtctgagccacagggatgcatccta

SEQ ID NO: 691934 - DNA, 25 bp, Mus musculus
gtctgagccatgctgcccctggttt

SEQ ID NO: 691935 - DNA, 25 bp, Mus musculus
gtctgagccatggtgcccctggttt

SEQ ID NO: 691936 - DNA, 25 bp, Mus musculus
gtctgagcccagctaaacactctgt

SEQ ID NO: 691937 - DNA, 25 bp, Mus musculus
gtctgagcccaggtaaacactctgt

SEQ ID NO: 691938 - DNA, 25 bp, Mus musculus
gtctgagcctctatgagcctgtagg

SEQ ID NO: 691939 - DNA, 25 bp, Mus musculus
gtctgagcctctttgagcctgtagg

SEQ ID NO: 691940 - DNA, 25 bp, Mus musculus
gtctgagccttgactttaggctgtt

SEQ ID NO: 691941 - DNA, 25 bp, Mus musculus
gtctgagccttgtctttaggctgtt

SEQ ID NO: 691942 - DNA, 25 bp, Mus musculus
gtctgagctaccaacgatgttcaaa

SEQ ID NO: 691943 - DNA, 25 bp, Mus musculus
gtctgagctacctacgatgttcaaa

SEQ ID NO: 691944 - DNA, 25 bp, Mus musculus
gtctgagctagacctggactgacta

SEQ ID NO: 691945 - DNA, 25 bp, Mus musculus
gtctgagctagagctggactgacta

SEQ ID NO: 691946 - DNA, 25 bp, Mus musculus
gtctgagctgacagtttttggaaac

SEQ ID NO: 691947 - DNA, 25 bp, Mus musculus
gtctgagctgactgtttttggaaac

SEQ ID NO: 691948 - DNA, 25 bp, Mus musculus
gtctgagctgtacatattttccacc

SEQ ID NO: 691949 - DNA, 25 bp, Mus musculus
gtctgagctgtagatattttccacc

SEQ ID NO: 691950 - DNA, 25 bp, Mus musculus
gtctgagctgtgcacctattgggta

SEQ ID NO: 691951 - DNA, 25 bp, Mus musculus
gtctgagctgtggacctattgggta

SEQ ID NO: 691952 - DNA, 25 bp, Mus musculus
gtctgagcttgtctttgtgtagtgc

SEQ ID NO: 691953 - DNA, 25 bp, Mus musculus
gtctgagcttgtgtttgtgtagtgc

SEQ ID NO: 691954 - DNA, 25 bp, Mus musculus
gtctgaggagaacatggccacccat

SEQ ID NO: 691955 - DNA, 25 bp, Mus musculus
gtctgaggagaagatggccacccat

SEQ ID NO: 691956 - DNA, 25 bp, Mus musculus
gtctgaggatatattgatgttctaa

SEQ ID NO: 691957 - DNA, 25 bp, Mus musculus
gtctgaggatattttgatgttctaa

SEQ ID NO: 691958 - DNA, 25 bp, Mus musculus
gtctgaggcagcctgcgccacagta

SEQ ID NO: 691959 - DNA, 25 bp, Mus musculus
gtctgaggcagcgtgcgccacagta

SEQ ID NO: 691960 - DNA, 25 bp, Mus musculus
gtctgagggcaaagctctgatagtt

SEQ ID NO: 691961 - DNA, 25 bp, Mus musculus
gtctgagggcaatgctctgatagtt

SEQ ID NO: 691962 - DNA, 25 bp, Mus musculus
gtctgagggcacatcctcaagagag

SEQ ID NO: 691963 - DNA, 25 bp, Mus musculus
gtctgagggcacttcctcaagagag

SEQ ID NO: 691964 - DNA, 25 bp, Mus musculus
gtctgagggtcacagtttagatccc

SEQ ID NO: 691965 - DNA, 25 bp, Mus musculus
gtctgagggtcagagtttagatccc

SEQ ID NO: 691966 - DNA, 25 bp, Mus musculus
gtctgaggtgtcaaattaccccttc

SEQ ID NO: 691967 - DNA, 25 bp, Mus musculus
gtctgaggtgtctaattaccccttc

SEQ ID NO: 691968 - DNA, 25 bp, Mus musculus
gtctgaggttcccacttgcgaagaa

SEQ ID NO: 691969 - DNA, 25 bp, Mus musculus
gtctgaggttccgacttgcgaagaa

SEQ ID NO: 691970 - DNA, 25 bp, Mus musculus
gtctgagtagaccaggcctcggcca

SEQ ID NO: 691971 - DNA, 25 bp, Mus musculus
gtctgagtagacgaggcctcggcca

SEQ ID NO: 691972 - DNA, 25 bp, Mus musculus
gtctgagtcaaaattcttccttctg

SEQ ID NO: 691973 - DNA, 25 bp, Mus musculus
gtctgagtcaaatttcttccttctg

SEQ ID NO: 691974 - DNA, 25 bp, Mus musculus
gtctgagtcagaagctccatacaaa

SEQ ID NO: 691975 - DNA, 25 bp, Mus musculus
gtctgagtcagatgctccatacaaa

SEQ ID NO: 691976 - DNA, 25 bp, Mus musculus
gtctgagtcagcattaccagcttat

SEQ ID NO: 691977 - DNA, 25 bp, Mus musculus
gtctgagtcagctttaccagcttat

SEQ ID NO: 691978 - DNA, 25 bp, Mus musculus
gtctgagtcaggctttcactgtagc

SEQ ID NO: 691979 - DNA, 25 bp, Mus musculus
gtctgagtcagggtttcactgtagc

SEQ ID NO: 691980 - DNA, 25 bp, Mus musculus
gtctgagtccaacaggagccaacat

SEQ ID NO: 691981 - DNA, 25 bp, Mus musculus
gtctgagtccaagaggagccaacat

SEQ ID NO: 691982 - DNA, 25 bp, Mus musculus
gtctgagtccagacaaaaatgagtc

SEQ ID NO: 691983 - DNA, 25 bp, Mus musculus
gtctgagtccagtcaaaaatgagtc

SEQ ID NO: 691984 - DNA, 25 bp, Mus musculus
gtctgagtctctcaaaggagccctt

SEQ ID NO: 691985 - DNA, 25 bp, Mus musculus
gtctgagtctctgaaaggagccctt

SEQ ID NO: 691986 - DNA, 25 bp, Mus musculus
gtctgagtgtgtaaaattgttaagc

SEQ ID NO: 691987 - DNA, 25 bp, Mus musculus
gtctgagtgtgttaaattgttaagc

SEQ ID NO: 691988 - DNA, 25 bp, Mus musculus
gtctgagttgaaagccttccggact

SEQ ID NO: 691989 - DNA, 25 bp, Mus musculus
gtctgagttgaatgccttccggact

SEQ ID NO: 691990 - DNA, 25 bp, Mus musculus
gtctgagtttaaaatggcatcccaa

SEQ ID NO: 691991 - DNA, 25 bp, Mus musculus
gtctgagtttaatatggcatcccaa

SEQ ID NO: 691992 - DNA, 25 bp, Mus musculus
gtctgagttttaccaagttatttat

SEQ ID NO: 691993 - DNA, 25 bp, Mus musculus
gtctgagttttagcaagttatttat

SEQ ID NO: 691994 - DNA, 25 bp, Mus musculus
gtctgataatgcctttacctccatg

SEQ ID NO: 691995 - DNA, 25 bp, Mus musculus
gtctgataatgcgtttacctccatg

SEQ ID NO: 691996 - DNA, 25 bp, Mus musculus
gtctgatacagaccctggtcctcaa

SEQ ID NO: 691997 - DNA, 25 bp, Mus musculus
gtctgatacagagcctggtcctcaa

SEQ ID NO: 691998 - DNA, 25 bp, Mus musculus
gtctgatacctgagaatttcctttc

SEQ ID NO: 691999 - DNA, 25 bp, Mus musculus
gtctgatacctgtgaatttcctttc

SEQ ID NO: 692000 - DNA, 25 bp, Mus musculus
gtctgatactagatgggctttttat

SEQ ID NO: 692001 - DNA, 25 bp, Mus musculus
gtctgatactagttgggctttttat

SEQ ID NO: 692002 - DNA, 25 bp, Mus musculus
gtctgatactgaaactgcaccactt

SEQ ID NO: 692003 - DNA, 25 bp, Mus musculus
gtctgatactgaactgtttgagaag

SEQ ID NO: 692004 - DNA, 25 bp, Mus musculus
gtctgatactgaatgctgttctccc

SEQ ID NO: 692005 - DNA, 25 bp, Mus musculus
gtctgatactgatactgcaccactt

SEQ ID NO: 692006 - DNA, 25 bp, Mus musculus
gtctgatactgatctgtttgagaag

SEQ ID NO: 692007 - DNA, 25 bp, Mus musculus
gtctgatactgattgctgttctccc

SEQ ID NO: 692008 - DNA, 25 bp, Mus musculus
gtctgatagaagatgccaccatgct

SEQ ID NO: 692009 - DNA, 25 bp, Mus musculus
gtctgatagaagttgccaccatgct

SEQ ID NO: 692010 - DNA, 25 bp, Mus musculus
gtctgatagattattcaactcctag

SEQ ID NO: 692011 - DNA, 25 bp, Mus musculus
gtctgatagatttttcaactcctag

SEQ ID NO: 692012 - DNA, 25 bp, Mus musculus
gtctgatagcctagaattttctttg

SEQ ID NO: 692013 - DNA, 25 bp, Mus musculus
gtctgatagccttgaattttctttg

SEQ ID NO: 692014 - DNA, 25 bp, Mus musculus
gtctgatagctgatttctgtgatac

SEQ ID NO: 692015 - DNA, 25 bp, Mus musculus
gtctgatagctgttttctgtgatac

SEQ ID NO: 692016 - DNA, 25 bp, Mus musculus
gtctgataggtgcagctgttagtct

SEQ ID NO: 692017 - DNA, 25 bp, Mus musculus
gtctgataggtggagctgttagtct

SEQ ID NO: 692018 - DNA, 25 bp, Mus musculus
gtctgatattgcacctaagttccat

SEQ ID NO: 692019 - DNA, 25 bp, Mus musculus
gtctgatattgctcctaagttccat

SEQ ID NO: 692020 - DNA, 25 bp, Mus musculus
gtctgatcatcaacattgtaatagg

SEQ ID NO: 692021 - DNA, 25 bp, Mus musculus
gtctgatcatcatcattgtaatagg

SEQ ID NO: 692022 - DNA, 25 bp, Mus musculus
gtctgatccaggatttcctaaactt

SEQ ID NO: 692023 - DNA, 25 bp, Mus musculus
gtctgatccaggttttcctaaactt

SEQ ID NO: 692024 - DNA, 25 bp, Mus musculus
gtctgatccgttctagaagcaccaa

SEQ ID NO: 692025 - DNA, 25 bp, Mus musculus
gtctgatccgttgtagaagcaccaa

SEQ ID NO: 692026 - DNA, 25 bp, Mus musculus
gtctgatcctgaataataccacaca

SEQ ID NO: 692027 - DNA, 25 bp, Mus musculus
gtctgatcctgattaataccacaca

SEQ ID NO: 692028 - DNA, 25 bp, Mus musculus
gtctgatcctggaagtgtgttgttt

SEQ ID NO: 692029 - DNA, 25 bp, Mus musculus
gtctgatcctggtagtgtgttgttt

SEQ ID NO: 692030 - DNA, 25 bp, Mus musculus
gtctgatcggaaatgtacccacttc

SEQ ID NO: 692031 - DNA, 25 bp, Mus musculus
gtctgatcggaattgtacccacttc

SEQ ID NO: 692032 - DNA, 25 bp, Mus musculus
gtctgatctctgattacatccctaa

SEQ ID NO: 692033 - DNA, 25 bp, Mus musculus
gtctgatctctgtttacatccctaa

SEQ ID NO: 692034 - DNA, 25 bp, Mus musculus
gtctgatgaccaccatgggctggtc

SEQ ID NO: 692035 - DNA, 25 bp, Mus musculus
gtctgatgaccagcatgggctggtc

SEQ ID NO: 692036 - DNA, 25 bp, Mus musculus
gtctgatgacctcctgggtcaggca

SEQ ID NO: 692037 - DNA, 25 bp, Mus musculus
gtctgatgacctgctgggtcaggca

SEQ ID NO: 692038 - DNA, 25 bp, Mus musculus
gtctgatgactgcatggatgctgat

SEQ ID NO: 692039 - DNA, 25 bp, Mus musculus
gtctgatgactggatggatgctgat

SEQ ID NO: 692040 - DNA, 25 bp, Mus musculus
gtctgatgccctcaggaagttacat

SEQ ID NO: 692041 - DNA, 25 bp, Mus musculus
gtctgatgccctgaggaagttacat

SEQ ID NO: 692042 - DNA, 25 bp, Mus musculus
gtctgatgcttcagagtcctatgga

SEQ ID NO: 692043 - DNA, 25 bp, Mus musculus
gtctgatgcttctgagtcctatgga

SEQ ID NO: 692044 - DNA, 25 bp, Mus musculus
gtctgatggagcaggcacctttatg

SEQ ID NO: 692045 - DNA, 25 bp, Mus musculus
gtctgatggagctggcacctttatg

SEQ ID NO: 692046 - DNA, 25 bp, Mus musculus
gtctgatggccactttgatttccca

SEQ ID NO: 692047 - DNA, 25 bp, Mus musculus
gtctgatggccagtttgatttccca

SEQ ID NO: 692048 - DNA, 25 bp, Mus musculus
gtctgatggctgatcgaagcggaat

SEQ ID NO: 692049 - DNA, 25 bp, Mus musculus
gtctgatggctgttcgaagcggaat

SEQ ID NO: 692050 - DNA, 25 bp, Mus musculus
gtctgatggttcataagcctgataa

SEQ ID NO: 692051 - DNA, 25 bp, Mus musculus
gtctgatggttcttaagcctgataa

SEQ ID NO: 692052 - DNA, 25 bp, Mus musculus
gtctgatgtactccctagaactagg

SEQ ID NO: 692053 - DNA, 25 bp, Mus musculus
gtctgatgtactgcctagaactagg

SEQ ID NO: 692054 - DNA, 25 bp, Mus musculus
gtctgatgtccactatacagcctat

SEQ ID NO: 692055 - DNA, 25 bp, Mus musculus
gtctgatgtccagtatacagcctat

SEQ ID NO: 692056 - DNA, 25 bp, Mus musculus
gtctgatgtctgaggacaactacag

SEQ ID NO: 692057 - DNA, 25 bp, Mus musculus
gtctgatgtctgtggacaactacag

SEQ ID NO: 692058 - DNA, 25 bp, Mus musculus
gtctgatgttggatctgtgatgaca

SEQ ID NO: 692059 - DNA, 25 bp, Mus musculus
gtctgatgttggttctgtgatgaca

SEQ ID NO: 692060 - DNA, 25 bp, Mus musculus
gtctgattacatcctacctgcataa

SEQ ID NO: 692061 - DNA, 25 bp, Mus musculus
gtctgattacatgctacctgcataa

SEQ ID NO: 692062 - DNA, 25 bp, Mus musculus
gtctgattcattaacacttaactca

SEQ ID NO: 692063 - DNA, 25 bp, Mus musculus
gtctgattcatttacacttaactca

SEQ ID NO: 692064 - DNA, 25 bp, Mus musculus
gtctgattccccaatcaggattcaa

SEQ ID NO: 692065 - DNA, 25 bp, Mus musculus
gtctgattcccctatcaggattcaa

SEQ ID NO: 692066 - DNA, 25 bp, Mus musculus
gtctgattcctcctttatctgggtt

SEQ ID NO: 692067 - DNA, 25 bp, Mus musculus
gtctgattcctcgtttatctgggtt

SEQ ID NO: 692068 - DNA, 25 bp, Mus musculus
gtctgattctgtactatccattgga

SEQ ID NO: 692069 - DNA, 25 bp, Mus musculus
gtctgattctgttctatccattgga

SEQ ID NO: 692070 - DNA, 25 bp, Mus musculus
gtctgattcttgaagctttcctctg

SEQ ID NO: 692071 - DNA, 25 bp, Mus musculus
gtctgattcttgtagctttcctctg

SEQ ID NO: 692072 - DNA, 25 bp, Mus musculus
gtctgattggtcaggagccatgtta

SEQ ID NO: 692073 - DNA, 25 bp, Mus musculus
gtctgattggtctggagccatgtta

SEQ ID NO: 692074 - DNA, 25 bp, Mus musculus
gtctgatttacaaccctgttcatag

SEQ ID NO: 692075 - DNA, 25 bp, Mus musculus
gtctgatttacatccctgttcatag

SEQ ID NO: 692076 - DNA, 25 bp, Mus musculus
gtctgatttagtcgaggctgacccc

SEQ ID NO: 692077 - DNA, 25 bp, Mus musculus
gtctgatttagtggaggctgacccc

SEQ ID NO: 692078 - DNA, 25 bp, Mus musculus
gtctgatttatgaactggtcgctat

SEQ ID NO: 692079 - DNA, 25 bp, Mus musculus
gtctgatttatgtactggtcgctat

SEQ ID NO: 692080 - DNA, 25 bp, Mus musculus
gtctgatttcaacgctcacacatgt

SEQ ID NO: 692081 - DNA, 25 bp, Mus musculus
gtctgatttcaaggctcacacatgt

SEQ ID NO: 692082 - DNA, 25 bp, Mus musculus
gtctgatttctaatccagtgtgaat

SEQ ID NO: 692083 - DNA, 25 bp, Mus musculus
gtctgatttctattccagtgtgaat

SEQ ID NO: 692084 - DNA, 25 bp, Mus musculus
gtctgatttgcgagggttttgtgaa

SEQ ID NO: 692085 - DNA, 25 bp, Mus musculus
gtctgatttgcgtgggttttgtgaa

SEQ ID NO: 692086 - DNA, 25 bp, Mus musculus
gtctgcaaagctcgcttcacgcgca

SEQ ID NO: 692087 - DNA, 25 bp, Mus musculus
gtctgcaaagctggcttcacgcgca

SEQ ID NO: 692088 - DNA, 25 bp, Mus musculus
gtctgcaaataaaagtcctcctccc

SEQ ID NO: 692089 - DNA, 25 bp, Mus musculus
gtctgcaaataatagtcctcctccc

SEQ ID NO: 692090 - DNA, 25 bp, Mus musculus
gtctgcaacaagctaggcttcctga

SEQ ID NO: 692091 - DNA, 25 bp, Mus musculus
gtctgcaacaaggtaggcttcctga

SEQ ID NO: 692092 - DNA, 25 bp, Mus musculus
gtctgcaaccaaattagagcgaact

SEQ ID NO: 692093 - DNA, 25 bp, Mus musculus
gtctgcaaccaatttagagcgaact

SEQ ID NO: 692094 - DNA, 25 bp, Mus musculus
gtctgcaactacagtacactgccaa

SEQ ID NO: 692095 - DNA, 25 bp, Mus musculus
gtctgcaactactgtacactgccaa

SEQ ID NO: 692096 - DNA, 25 bp, Mus musculus
gtctgcaagcaaaacccatgagccc

SEQ ID NO: 692097 - DNA, 25 bp, Mus musculus
gtctgcaagcaatacccatgagccc

SEQ ID NO: 692098 - DNA, 25 bp, Mus musculus
gtctgcaagcctctcacctgtagca

SEQ ID NO: 692099 - DNA, 25 bp, Mus musculus
gtctgcaagcctgtcacctgtagca

SEQ ID NO: 692100 - DNA, 25 bp, Mus musculus
gtctgcaagctgatgacactgccat

SEQ ID NO: 692101 - DNA, 25 bp, Mus musculus
gtctgcaagctgttgacactgccat

SEQ ID NO: 692102 - DNA, 25 bp, Mus musculus
gtctgcaaggccagctccaaggaga

SEQ ID NO: 692103 - DNA, 25 bp, Mus musculus
gtctgcaaggcctgctccaaggaga

SEQ ID NO: 692104 - DNA, 25 bp, Mus musculus
gtctgcaatagactcagccttctgt

SEQ ID NO: 692105 - DNA, 25 bp, Mus musculus
gtctgcaatagagtcagccttctgt

SEQ ID NO: 692106 - DNA, 25 bp, Mus musculus
gtctgcaatctcagggcgtgggcta

SEQ ID NO: 692107 - DNA, 25 bp, Mus musculus
gtctgcaatctctgggcgtgggcta

SEQ ID NO: 692108 - DNA, 25 bp, Mus musculus
gtctgcacaacaaactgggtctctt

SEQ ID NO: 692109 - DNA, 25 bp, Mus musculus
gtctgcacaacatactgggtctctt

SEQ ID NO: 692110 - DNA, 25 bp, Mus musculus
gtctgcacaacgatttacttctgtc

SEQ ID NO: 692111 - DNA, 25 bp, Mus musculus
gtctgcacaacgttttacttctgtc

SEQ ID NO: 692112 - DNA, 25 bp, Mus musculus
gtctgcacaaggatcttctttgtat

SEQ ID NO: 692113 - DNA, 25 bp, Mus musculus
gtctgcacaaggttcttctttgtat

SEQ ID NO: 692114 - DNA, 25 bp, Mus musculus
gtctgcacacacagttcttttgaac

SEQ ID NO: 692115 - DNA, 25 bp, Mus musculus
gtctgcacacactgttcttttgaac

SEQ ID NO: 692116 - DNA, 25 bp, Mus musculus
gtctgcacacctcagggcaagggca

SEQ ID NO: 692117 - DNA, 25 bp, Mus musculus
gtctgcacacctgagggcaagggca

SEQ ID NO: 692118 - DNA, 25 bp, Mus musculus
gtctgcacagaaaggtggcacccgg

SEQ ID NO: 692119 - DNA, 25 bp, Mus musculus
gtctgcacagaatggtggcacccgg

SEQ ID NO: 692120 - DNA, 25 bp, Mus musculus
gtctgcacagcacccacacataagt

SEQ ID NO: 692121 - DNA, 25 bp, Mus musculus
gtctgcacagcagccacacataagt

SEQ ID NO: 692122 - DNA, 25 bp, Mus musculus
gtctgcacagtactgcaatcctagt

SEQ ID NO: 692123 - DNA, 25 bp, Mus musculus
gtctgcacagtagtgcaatcctagt

SEQ ID NO: 692124 - DNA, 25 bp, Mus musculus
gtctgcacatgcaggtgtccaccag

SEQ ID NO: 692125 - DNA, 25 bp, Mus musculus
gtctgcacatgctggtgtccaccag

SEQ ID NO: 692126 - DNA, 25 bp, Mus musculus
gtctgcaccatgctcaggattatgg

SEQ ID NO: 692127 - DNA, 25 bp, Mus musculus
gtctgcaccatggtcaggattatgg

SEQ ID NO: 692128 - DNA, 25 bp, Mus musculus
gtctgcacctgcagttttgaaaacc

SEQ ID NO: 692129 - DNA, 25 bp, Mus musculus
gtctgcacctgctgttttgaaaacc

SEQ ID NO: 692130 - DNA, 25 bp, Mus musculus
gtctgcacctgtcttgcttataatt

SEQ ID NO: 692131 - DNA, 25 bp, Mus musculus
gtctgcacctgtgttgcttataatt

SEQ ID NO: 692132 - DNA, 25 bp, Mus musculus
gtctgcactaagaagggttgatttg

SEQ ID NO: 692133 - DNA, 25 bp, Mus musculus
gtctgcactaagtagggttgatttg

SEQ ID NO: 692134 - DNA, 25 bp, Mus musculus
gtctgcactccaacatttagagaga

SEQ ID NO: 692135 - DNA, 25 bp, Mus musculus
gtctgcactccactgtttcgggaaa

SEQ ID NO: 692136 - DNA, 25 bp, Mus musculus
gtctgcactccagtgtttcgggaaa

SEQ ID NO: 692137 - DNA, 25 bp, Mus musculus
gtctgcactccatcatttagagaga

SEQ ID NO: 692138 - DNA, 25 bp, Mus musculus
gtctgcactgaaactaaaaccgctg

SEQ ID NO: 692139 - DNA, 25 bp, Mus musculus
gtctgcactgaatctaaaaccgctg

SEQ ID NO: 692140 - DNA, 25 bp, Mus musculus
gtctgcactgggatgttaggaacat

SEQ ID NO: 692141 - DNA, 25 bp, Mus musculus
gtctgcactgggttgttaggaacat

SEQ ID NO: 692142 - DNA, 25 bp, Mus musculus
gtctgcacttaaaacatctccacat

SEQ ID NO: 692143 - DNA, 25 bp, Mus musculus
gtctgcacttaatacatctccacat

SEQ ID NO: 692144 - DNA, 25 bp, Mus musculus
gtctgcacttggaatcctttacctc

SEQ ID NO: 692145 - DNA, 25 bp, Mus musculus
gtctgcacttggcttcacttgagtt

SEQ ID NO: 692146 - DNA, 25 bp, Mus musculus
gtctgcacttgggttcacttgagtt

SEQ ID NO: 692147 - DNA, 25 bp, Mus musculus
gtctgcacttggtatcctttacctc

SEQ ID NO: 692148 - DNA, 25 bp, Mus musculus
gtctgcagacatagctctggttgct

SEQ ID NO: 692149 - DNA, 25 bp, Mus musculus
gtctgcagacatatgggcttggcgc

SEQ ID NO: 692150 - DNA, 25 bp, Mus musculus
gtctgcagacatcagaagcccagcg

SEQ ID NO: 692151 - DNA, 25 bp, Mus musculus
gtctgcagacatgagaagcccagcg

SEQ ID NO: 692152 - DNA, 25 bp, Mus musculus
gtctgcagacattgctctggttgct

SEQ ID NO: 692153 - DNA, 25 bp, Mus musculus
gtctgcagacatttgggcttggcgc

SEQ ID NO: 692154 - DNA, 25 bp, Mus musculus
gtctgcagcacaacttttcttttaa

SEQ ID NO: 692155 - DNA, 25 bp, Mus musculus
gtctgcagcacacaaactctcaagt

SEQ ID NO: 692156 - DNA, 25 bp, Mus musculus
gtctgcagcacagaaactctcaagt

SEQ ID NO: 692157 - DNA, 25 bp, Mus musculus
gtctgcagcacatcttttcttttaa

SEQ ID NO: 692158 - DNA, 25 bp, Mus musculus
gtctgcagcagtcaatagcgtcatt

SEQ ID NO: 692159 - DNA, 25 bp, Mus musculus
gtctgcagcagtgaatagcgtcatt

SEQ ID NO: 692160 - DNA, 25 bp, Mus musculus
gtctgcagctctataggaggaacaa

SEQ ID NO: 692161 - DNA, 25 bp, Mus musculus
gtctgcagctctttaggaggaacaa

SEQ ID NO: 692162 - DNA, 25 bp, Mus musculus
gtctgcaggacactttgaatcaagt

SEQ ID NO: 692163 - DNA, 25 bp, Mus musculus
gtctgcaggacagtttgaatcaagt

SEQ ID NO: 692164 - DNA, 25 bp, Mus musculus
gtctgcaggaccacagattgtacct

SEQ ID NO: 692165 - DNA, 25 bp, Mus musculus
gtctgcaggacctcagattgtacct

SEQ ID NO: 692166 - DNA, 25 bp, Mus musculus
gtctgcaggctcattgatttggatt

SEQ ID NO: 692167 - DNA, 25 bp, Mus musculus
gtctgcaggctctttgatttggatt

SEQ ID NO: 692168 - DNA, 25 bp, Mus musculus
gtctgcagggccctcgaacatgcca

SEQ ID NO: 692169 - DNA, 25 bp, Mus musculus
gtctgcagggccgtcgaacatgcca

SEQ ID NO: 692170 - DNA, 25 bp, Mus musculus
gtctgcaggtatcagtcagtgtgct

SEQ ID NO: 692171 - DNA, 25 bp, Mus musculus
gtctgcaggtatgagtcagtgtgct

SEQ ID NO: 692172 - DNA, 25 bp, Mus musculus
gtctgcaggtctcatttgatgcctt

SEQ ID NO: 692173 - DNA, 25 bp, Mus musculus
gtctgcaggtctgatttgatgcctt

SEQ ID NO: 692174 - DNA, 25 bp, Mus musculus
gtctgcagtagaccagtcacctttg

SEQ ID NO: 692175 - DNA, 25 bp, Mus musculus
gtctgcagtagagcagtcacctttg

SEQ ID NO: 692176 - DNA, 25 bp, Mus musculus
gtctgcagtggaaactaagggttct

SEQ ID NO: 692177 - DNA, 25 bp, Mus musculus
gtctgcagtggatactaagggttct

SEQ ID NO: 692178 - DNA, 25 bp, Mus musculus
gtctgcagttctatttgaatgtgaa

SEQ ID NO: 692179 - DNA, 25 bp, Mus musculus
gtctgcagttctttttgaatgtgaa

SEQ ID NO: 692180 - DNA, 25 bp, Mus musculus
gtctgcagttgtctcacagtgacca

SEQ ID NO: 692181 - DNA, 25 bp, Mus musculus
gtctgcagttgtgtcacagtgacca

SEQ ID NO: 692182 - DNA, 25 bp, Mus musculus
gtctgcatatccctcatcaggaatg

SEQ ID NO: 692183 - DNA, 25 bp, Mus musculus
gtctgcatatccgtcatcaggaatg

SEQ ID NO: 692184 - DNA, 25 bp, Mus musculus
gtctgcatcactctatcttttattt

SEQ ID NO: 692185 - DNA, 25 bp, Mus musculus
gtctgcatcactgtatcttttattt

SEQ ID NO: 692186 - DNA, 25 bp, Mus musculus
gtctgcatcattcctcgctaaagag

SEQ ID NO: 692187 - DNA, 25 bp, Mus musculus
gtctgcatcattgctcgctaaagag

SEQ ID NO: 692188 - DNA, 25 bp, Mus musculus
gtctgcatccctaggagacacaatt

SEQ ID NO: 692189 - DNA, 25 bp, Mus musculus
gtctgcatcccttggagacacaatt

SEQ ID NO: 692190 - DNA, 25 bp, Mus musculus
gtctgcatcctcaagtacatggagt

SEQ ID NO: 692191 - DNA, 25 bp, Mus musculus
gtctgcatcctctagtacatggagt

SEQ ID NO: 692192 - DNA, 25 bp, Mus musculus
gtctgcatcgcgctcaatagtagga

SEQ ID NO: 692193 - DNA, 25 bp, Mus musculus
gtctgcatcgcggtcaatagtagga

SEQ ID NO: 692194 - DNA, 25 bp, Mus musculus
gtctgcatgaagcattcgggaaact

SEQ ID NO: 692195 - DNA, 25 bp, Mus musculus
gtctgcatgaaggattcgggaaact

SEQ ID NO: 692196 - DNA, 25 bp, Mus musculus
gtctgcatgcggatttaatctcata

SEQ ID NO: 692197 - DNA, 25 bp, Mus musculus
gtctgcatgcggttttaatctcata

SEQ ID NO: 692198 - DNA, 25 bp, Mus musculus
gtctgcatggaaccctcagttctgg

SEQ ID NO: 692199 - DNA, 25 bp, Mus musculus
gtctgcatggaagcctcagttctgg

SEQ ID NO: 692200 - DNA, 25 bp, Mus musculus
gtctgcatgggaattctgggattac

SEQ ID NO: 692201 - DNA, 25 bp, Mus musculus
gtctgcatgggatttctgggattac

SEQ ID NO: 692202 - DNA, 25 bp, Mus musculus
gtctgcatgtgaagactggctgcct

SEQ ID NO: 692203 - DNA, 25 bp, Mus musculus
gtctgcatgtgatgactggctgcct

SEQ ID NO: 692204 - DNA, 25 bp, Mus musculus
gtctgcatgtgccttgattctgtag

SEQ ID NO: 692205 - DNA, 25 bp, Mus musculus
gtctgcatgtgcgttgattctgtag

SEQ ID NO: 692206 - DNA, 25 bp, Mus musculus
gtctgcattcccagtgggcagtgat

SEQ ID NO: 692207 - DNA, 25 bp, Mus musculus
gtctgcattccctgtgggcagtgat

SEQ ID NO: 692208 - DNA, 25 bp, Mus musculus
gtctgcattttcatggagaaattta

SEQ ID NO: 692209 - DNA, 25 bp, Mus musculus
gtctgcattttcttggagaaattta

SEQ ID NO: 692210 - DNA, 25 bp, Mus musculus
gtctgccaaagccttgatatctgga

SEQ ID NO: 692211 - DNA, 25 bp, Mus musculus
gtctgccaaagcgttgatatctgga

SEQ ID NO: 692212 - DNA, 25 bp, Mus musculus
gtctgccaagaaatatacctctcct

SEQ ID NO: 692213 - DNA, 25 bp, Mus musculus
gtctgccaagaattatacctctcct

SEQ ID NO: 692214 - DNA, 25 bp, Mus musculus
gtctgccaatgtattgaccgttcct

SEQ ID NO: 692215 - DNA, 25 bp, Mus musculus
gtctgccaatgtctcattcgatttc

SEQ ID NO: 692216 - DNA, 25 bp, Mus musculus
gtctgccaatgtgtcattcgatttc

SEQ ID NO: 692217 - DNA, 25 bp, Mus musculus
gtctgccaatgttttgaccgttcct

SEQ ID NO: 692218 - DNA, 25 bp, Mus musculus
gtctgccacaatcccactgtgataa

SEQ ID NO: 692219 - DNA, 25 bp, Mus musculus
gtctgccacaatgccactgtgataa

SEQ ID NO: 692220 - DNA, 25 bp, Mus musculus
gtctgccacagacacttgttggtta

SEQ ID NO: 692221 - DNA, 25 bp, Mus musculus
gtctgccacagagacttgttggtta

SEQ ID NO: 692222 - DNA, 25 bp, Mus musculus
gtctgccacaggaagactgtcttgt

SEQ ID NO: 692223 - DNA, 25 bp, Mus musculus
gtctgccacaggtagactgtcttgt

SEQ ID NO: 692224 - DNA, 25 bp, Mus musculus
gtctgccagaacataccttctcata

SEQ ID NO: 692225 - DNA, 25 bp, Mus musculus
gtctgccagaacttaccttctcata

SEQ ID NO: 692226 - DNA, 25 bp, Mus musculus
gtctgccagagtcagaaatcagctc

SEQ ID NO: 692227 - DNA, 25 bp, Mus musculus
gtctgccagagtgagaaatcagctc

SEQ ID NO: 692228 - DNA, 25 bp, Mus musculus
gtctgccagtgtcacaggagctcag

SEQ ID NO: 692229 - DNA, 25 bp, Mus musculus
gtctgccagtgtgacaggagctcag

SEQ ID NO: 692230 - DNA, 25 bp, Mus musculus
gtctgccataacaaatgccatcaat

SEQ ID NO: 692231 - DNA, 25 bp, Mus musculus
gtctgccataactaatgccatcaat

SEQ ID NO: 692232 - DNA, 25 bp, Mus musculus
gtctgccatagaaccacttcgggaa

SEQ ID NO: 692233 - DNA, 25 bp, Mus musculus
gtctgccatagatccacttcgggaa

SEQ ID NO: 692234 - DNA, 25 bp, Mus musculus
gtctgccattctatgacacctggaa

SEQ ID NO: 692235 - DNA, 25 bp, Mus musculus
gtctgccattctttgacacctggaa

SEQ ID NO: 692236 - DNA, 25 bp, Mus musculus
gtctgccattttctgaacggtgtaa

SEQ ID NO: 692237 - DNA, 25 bp, Mus musculus
gtctgccattttgtgaacggtgtaa

SEQ ID NO: 692238 - DNA, 25 bp, Mus musculus
gtctgcccaggaagcatacaaatcc

SEQ ID NO: 692239 - DNA, 25 bp, Mus musculus
gtctgcccaggatgcatacaaatcc

SEQ ID NO: 692240 - DNA, 25 bp, Mus musculus
gtctgcccatttcgtgtccagagag

SEQ ID NO: 692241 - DNA, 25 bp, Mus musculus
gtctgcccatttggtgtccagagag

SEQ ID NO: 692242 - DNA, 25 bp, Mus musculus
gtctgccccatcagatggaatcatt

SEQ ID NO: 692243 - DNA, 25 bp, Mus musculus
gtctgccccatctgatggaatcatt

SEQ ID NO: 692244 - DNA, 25 bp, Mus musculus
gtctgcccgcaaacttgcctgtaag

SEQ ID NO: 692245 - DNA, 25 bp, Mus musculus
gtctgcccgcaatcttgcctgtaag

SEQ ID NO: 692246 - DNA, 25 bp, Mus musculus
gtctgccctcagaaattgactgcaa

SEQ ID NO: 692247 - DNA, 25 bp, Mus musculus
gtctgccctcagtaattgactgcaa

SEQ ID NO: 692248 - DNA, 25 bp, Mus musculus
gtctgccctcttagattcaggtcag

SEQ ID NO: 692249 - DNA, 25 bp, Mus musculus
gtctgccctcttctaattttaactg

SEQ ID NO: 692250 - DNA, 25 bp, Mus musculus
gtctgccctcttgtaattttaactg

SEQ ID NO: 692251 - DNA, 25 bp, Mus musculus
gtctgccctctttgattcaggtcag

SEQ ID NO: 692252 - DNA, 25 bp, Mus musculus
gtctgccctgaactgctggaacgat

SEQ ID NO: 692253 - DNA, 25 bp, Mus musculus
gtctgccctgaagtgctggaacgat

SEQ ID NO: 692254 - DNA, 25 bp, Mus musculus
gtctgccctgctataaaagccttcc

SEQ ID NO: 692255 - DNA, 25 bp, Mus musculus
gtctgccctgctttaaaagccttcc

SEQ ID NO: 692256 - DNA, 25 bp, Mus musculus
gtctgccctttacttgtgctattaa

SEQ ID NO: 692257 - DNA, 25 bp, Mus musculus
gtctgccctttagttgtgctattaa

SEQ ID NO: 692258 - DNA, 25 bp, Mus musculus
gtctgccgcaggaccacgagatgca

SEQ ID NO: 692259 - DNA, 25 bp, Mus musculus
gtctgccgcaggtccacgagatgca

SEQ ID NO: 692260 - DNA, 25 bp, Mus musculus
gtctgcctaggcaacataatgagta

SEQ ID NO: 692261 - DNA, 25 bp, Mus musculus
gtctgcctaggctacataatgagta

SEQ ID NO: 692262 - DNA, 25 bp, Mus musculus
gtctgcctagtacctacttgtaagt

SEQ ID NO: 692263 - DNA, 25 bp, Mus musculus
gtctgcctagtagctacttgtaagt

SEQ ID NO: 692264 - DNA, 25 bp, Mus musculus
gtctgcctcaggctattcagatgac

SEQ ID NO: 692265 - DNA, 25 bp, Mus musculus
gtctgcctcagggtattcagatgac

SEQ ID NO: 692266 - DNA, 25 bp, Mus musculus
gtctgcctcatacttctatacaatg

SEQ ID NO: 692267 - DNA, 25 bp, Mus musculus
gtctgcctcatagttctatacaatg

SEQ ID NO: 692268 - DNA, 25 bp, Mus musculus
gtctgcctccaacttggcttctctt

SEQ ID NO: 692269 - DNA, 25 bp, Mus musculus
gtctgcctccaagttggcttctctt

SEQ ID NO: 692270 - DNA, 25 bp, Mus musculus
gtctgcctgagaccacggtgacatg

SEQ ID NO: 692271 - DNA, 25 bp, Mus musculus
gtctgcctgagagcacggtgacatg

SEQ ID NO: 692272 - DNA, 25 bp, Mus musculus
gtctgcctgcctatatgcagtgaca

SEQ ID NO: 692273 - DNA, 25 bp, Mus musculus
gtctgcctgcctttatgcagtgaca

SEQ ID NO: 692274 - DNA, 25 bp, Mus musculus
gtctgcctgctcagtgtttagcgca

SEQ ID NO: 692275 - DNA, 25 bp, Mus musculus
gtctgcctgctctgtgtttagcgca

SEQ ID NO: 692276 - DNA, 25 bp, Mus musculus
gtctgcctggatctactttcttagt

SEQ ID NO: 692277 - DNA, 25 bp, Mus musculus
gtctgcctggatgtactttcttagt

SEQ ID NO: 692278 - DNA, 25 bp, Mus musculus
gtctgcctggttcgttagtctctaa

SEQ ID NO: 692279 - DNA, 25 bp, Mus musculus
gtctgcctggttggttagtctctaa

SEQ ID NO: 692280 - DNA, 25 bp, Mus musculus
gtctgccttagacccatgactgaaa

SEQ ID NO: 692281 - DNA, 25 bp, Mus musculus
gtctgccttagagccatgactgaaa

SEQ ID NO: 692282 - DNA, 25 bp, Mus musculus
gtctgccttccaatgtggaccagtc

SEQ ID NO: 692283 - DNA, 25 bp, Mus musculus
gtctgccttccattgtggaccagtc

SEQ ID NO: 692284 - DNA, 25 bp, Mus musculus
gtctgccttcccctaaaagaattga

SEQ ID NO: 692285 - DNA, 25 bp, Mus musculus
gtctgccttcccgtaaaagaattga

SEQ ID NO: 692286 - DNA, 25 bp, Mus musculus
gtctgccttgatcttcttggattaa

SEQ ID NO: 692287 - DNA, 25 bp, Mus musculus
gtctgccttgatgttcttggattaa

SEQ ID NO: 692288 - DNA, 25 bp, Mus musculus
gtctgccttgccagccgaagatgaa

SEQ ID NO: 692289 - DNA, 25 bp, Mus musculus
gtctgccttgcctgccgaagatgaa

SEQ ID NO: 692290 - DNA, 25 bp, Mus musculus
gtctgccttggtctttttgcttatc

SEQ ID NO: 692291 - DNA, 25 bp, Mus musculus
gtctgccttggtgtttttgcttatc

SEQ ID NO: 692292 - DNA, 25 bp, Mus musculus
gtctgcctttaaagagtttttcttt

SEQ ID NO: 692293 - DNA, 25 bp, Mus musculus
gtctgcctttaatgagtttttcttt

SEQ ID NO: 692294 - DNA, 25 bp, Mus musculus
gtctgcctttccacagactcttata

SEQ ID NO: 692295 - DNA, 25 bp, Mus musculus
gtctgcctttcctcagactcttata

SEQ ID NO: 692296 - DNA, 25 bp, Mus musculus
gtctgcctttctaagattccttgag

SEQ ID NO: 692297 - DNA, 25 bp, Mus musculus
gtctgcctttctactctggaatata

SEQ ID NO: 692298 - DNA, 25 bp, Mus musculus
gtctgcctttcttagattccttgag

SEQ ID NO: 692299 - DNA, 25 bp, Mus musculus
gtctgcctttcttctctggaatata

SEQ ID NO: 692300 - DNA, 25 bp, Mus musculus
gtctgcctttggatcctaacagctg

SEQ ID NO: 692301 - DNA, 25 bp, Mus musculus
gtctgcctttggttcctaacagctg

SEQ ID NO: 692302 - DNA, 25 bp, Mus musculus
gtctgccttttactgttgatgccaa

SEQ ID NO: 692303 - DNA, 25 bp, Mus musculus
gtctgccttttagtgttgatgccaa

SEQ ID NO: 692304 - DNA, 25 bp, Mus musculus
gtctgcgacataaaaccattctgaa

SEQ ID NO: 692305 - DNA, 25 bp, Mus musculus
gtctgcgacatataaccattctgaa

SEQ ID NO: 692306 - DNA, 25 bp, Mus musculus
gtctgcgagtgtaaccctacaacta

SEQ ID NO: 692307 - DNA, 25 bp, Mus musculus
gtctgcgagtgtacctacactacct

SEQ ID NO: 692308 - DNA, 25 bp, Mus musculus
gtctgcgagtgttaccctacaacta

SEQ ID NO: 692309 - DNA, 25 bp, Mus musculus
gtctgcgagtgttcctacactacct

SEQ ID NO: 692310 - DNA, 25 bp, Mus musculus
gtctgcgcacacacaggtactgact

SEQ ID NO: 692311 - DNA, 25 bp, Mus musculus
gtctgcgcacactcaggtactgact

SEQ ID NO: 692312 - DNA, 25 bp, Mus musculus
gtctgcgcagcaaccaggttcagaa

SEQ ID NO: 692313 - DNA, 25 bp, Mus musculus
gtctgcgcagcatccaggttcagaa

SEQ ID NO: 692314 - DNA, 25 bp, Mus musculus
gtctgcgcgggaaggactactgcac

SEQ ID NO: 692315 - DNA, 25 bp, Mus musculus
gtctgcgcgggatggactactgcac

SEQ ID NO: 692316 - DNA, 25 bp, Mus musculus
gtctgcggatgcagttacatccaca

SEQ ID NO: 692317 - DNA, 25 bp, Mus musculus
gtctgcggatgctgttacatccaca

SEQ ID NO: 692318 - DNA, 25 bp, Mus musculus
gtctgcggcctgctgatgtgatctt

SEQ ID NO: 692319 - DNA, 25 bp, Mus musculus
gtctgcggcctggtgatgtgatctt

SEQ ID NO: 692320 - DNA, 25 bp, Mus musculus
gtctgcgggctcaaagtgaagaact

SEQ ID NO: 692321 - DNA, 25 bp, Mus musculus
gtctgcgggctctaagtgaagaact

SEQ ID NO: 692322 - DNA, 25 bp, Mus musculus
gtctgcgggtggagtttgtactttt

SEQ ID NO: 692323 - DNA, 25 bp, Mus musculus
gtctgcgggtggtgtttgtactttt

SEQ ID NO: 692324 - DNA, 25 bp, Mus musculus
gtctgcgtacatcctgtggcttaat

SEQ ID NO: 692325 - DNA, 25 bp, Mus musculus
gtctgcgtacatgctgtggcttaat

SEQ ID NO: 692326 - DNA, 25 bp, Mus musculus
gtctgcgtcagactcggctgaagca

SEQ ID NO: 692327 - DNA, 25 bp, Mus musculus
gtctgcgtcagagtcggctgaagca

SEQ ID NO: 692328 - DNA, 25 bp, Mus musculus
gtctgcgtgagccttactatgttct

SEQ ID NO: 692329 - DNA, 25 bp, Mus musculus
gtctgcgtgagcgttactatgttct

SEQ ID NO: 692330 - DNA, 25 bp, Mus musculus
gtctgcgtgcagcaattgtcatcct

SEQ ID NO: 692331 - DNA, 25 bp, Mus musculus
gtctgcgtgcaggaattgtcatcct

SEQ ID NO: 692332 - DNA, 25 bp, Mus musculus
gtctgcgtgcctaaagagaaacact

SEQ ID NO: 692333 - DNA, 25 bp, Mus musculus
gtctgcgtgccttaagagaaacact

SEQ ID NO: 692334 - DNA, 25 bp, Mus musculus
gtctgcgttgggatgggattctcac

SEQ ID NO: 692335 - DNA, 25 bp, Mus musculus
gtctgcgttgggttgggattctcac

SEQ ID NO: 692336 - DNA, 25 bp, Mus musculus
gtctgcgttggtatgtatacttttc

SEQ ID NO: 692337 - DNA, 25 bp, Mus musculus
gtctgcgttggtttgtatacttttc

SEQ ID NO: 692338 - DNA, 25 bp, Mus musculus
gtctgctaaaatatttgtggcacct

SEQ ID NO: 692339 - DNA, 25 bp, Mus musculus
gtctgctaaaatttttgtggcacct

SEQ ID NO: 692340 - DNA, 25 bp, Mus musculus
gtctgctaacacatcttgattaagg

SEQ ID NO: 692341 - DNA, 25 bp, Mus musculus
gtctgctaacacttcttgattaagg

SEQ ID NO: 692342 - DNA, 25 bp, Mus musculus
gtctgctaactcaggtctagtctta

SEQ ID NO: 692343 - DNA, 25 bp, Mus musculus
gtctgctaactctggtctagtctta

SEQ ID NO: 692344 - DNA, 25 bp, Mus musculus
gtctgctaagagatccgagcctgaa

SEQ ID NO: 692345 - DNA, 25 bp, Mus musculus
gtctgctaagagttccgagcctgaa

SEQ ID NO: 692346 - DNA, 25 bp, Mus musculus
gtctgctaaggactcccagtcccaa

SEQ ID NO: 692347 - DNA, 25 bp, Mus musculus
gtctgctaaggagtcccagtcccaa

SEQ ID NO: 692348 - DNA, 25 bp, Mus musculus
gtctgctacaatcccttctgatgtc

SEQ ID NO: 692349 - DNA, 25 bp, Mus musculus
gtctgctacaatgccttctgatgtc

SEQ ID NO: 692350 - DNA, 25 bp, Mus musculus
gtctgctacacaaggtcaatctact

SEQ ID NO: 692351 - DNA, 25 bp, Mus musculus
gtctgctacacatggtcaatctact

SEQ ID NO: 692352 - DNA, 25 bp, Mus musculus
gtctgctactggatggcaaagcctc

SEQ ID NO: 692353 - DNA, 25 bp, Mus musculus
gtctgctactggttggcaaagcctc

SEQ ID NO: 692354 - DNA, 25 bp, Mus musculus
gtctgctacttgattttaccctgga

SEQ ID NO: 692355 - DNA, 25 bp, Mus musculus
gtctgctacttgcaatgcaactctc

SEQ ID NO: 692356 - DNA, 25 bp, Mus musculus
gtctgctacttggaatgcaactctc

SEQ ID NO: 692357 - DNA, 25 bp, Mus musculus
gtctgctacttgtttttaccctgga

SEQ ID NO: 692358 - DNA, 25 bp, Mus musculus
gtctgctagcagctcatttttattt

SEQ ID NO: 692359 - DNA, 25 bp, Mus musculus
gtctgctagcaggtcatttttattt

SEQ ID NO: 692360 - DNA, 25 bp, Mus musculus
gtctgctataagacagcacctgtgc

SEQ ID NO: 692361 - DNA, 25 bp, Mus musculus
gtctgctataagtcagcacctgtgc

SEQ ID NO: 692362 - DNA, 25 bp, Mus musculus
gtctgctcaagtcccatgaatcatt

SEQ ID NO: 692363 - DNA, 25 bp, Mus musculus
gtctgctcaagtgccatgaatcatt

SEQ ID NO: 692364 - DNA, 25 bp, Mus musculus
gtctgctcaggacacggaactggca

SEQ ID NO: 692365 - DNA, 25 bp, Mus musculus
gtctgctcaggagacggaactggca

SEQ ID NO: 692366 - DNA, 25 bp, Mus musculus
gtctgctcatagagtcagtccttca

SEQ ID NO: 692367 - DNA, 25 bp, Mus musculus
gtctgctcatagtgtcagtccttca

SEQ ID NO: 692368 - DNA, 25 bp, Mus musculus
gtctgctcatgtattgtagctgtat

SEQ ID NO: 692369 - DNA, 25 bp, Mus musculus
gtctgctcatgttttgtagctgtat

SEQ ID NO: 692370 - DNA, 25 bp, Mus musculus
gtctgctcatttccagaggagaagt

SEQ ID NO: 692371 - DNA, 25 bp, Mus musculus
gtctgctcatttgcagaggagaagt

SEQ ID NO: 692372 - DNA, 25 bp, Mus musculus
gtctgctcctttatgtagtcatcta

SEQ ID NO: 692373 - DNA, 25 bp, Mus musculus
gtctgctcctttttgtagtcatcta

SEQ ID NO: 692374 - DNA, 25 bp, Mus musculus
gtctgctctaaccaccaacatgaac

SEQ ID NO: 692375 - DNA, 25 bp, Mus musculus
gtctgctctaacgaccaacatgaac

SEQ ID NO: 692376 - DNA, 25 bp, Mus musculus
gtctgctctacgaacttgcaatcca

SEQ ID NO: 692377 - DNA, 25 bp, Mus musculus
gtctgctctacgtacttgcaatcca

SEQ ID NO: 692378 - DNA, 25 bp, Mus musculus
gtctgctctcacaaagttctgaaca

SEQ ID NO: 692379 - DNA, 25 bp, Mus musculus
gtctgctctcactaagttctgaaca

SEQ ID NO: 692380 - DNA, 25 bp, Mus musculus
gtctgctctccacaggaacacatct

SEQ ID NO: 692381 - DNA, 25 bp, Mus musculus
gtctgctctccagaggaacacatct

SEQ ID NO: 692382 - DNA, 25 bp, Mus musculus
gtctgctctgatatatcgttcatct

SEQ ID NO: 692383 - DNA, 25 bp, Mus musculus
gtctgctctgatttatcgttcatct

SEQ ID NO: 692384 - DNA, 25 bp, Mus musculus
gtctgctctgctaattctccagaaa

SEQ ID NO: 692385 - DNA, 25 bp, Mus musculus
gtctgctctgcttattctccagaaa

SEQ ID NO: 692386 - DNA, 25 bp, Mus musculus
gtctgctctggtactatgatcttat

SEQ ID NO: 692387 - DNA, 25 bp, Mus musculus
gtctgctctggttctatgatcttat

SEQ ID NO: 692388 - DNA, 25 bp, Mus musculus
gtctgctcttcaaactgttactatt

SEQ ID NO: 692389 - DNA, 25 bp, Mus musculus
gtctgctcttcatactgttactatt

SEQ ID NO: 692390 - DNA, 25 bp, Mus musculus
gtctgctcttccatttatccaatta

SEQ ID NO: 692391 - DNA, 25 bp, Mus musculus
gtctgctcttcccaaagatactgac

SEQ ID NO: 692392 - DNA, 25 bp, Mus musculus
gtctgctcttccgaaagatactgac

SEQ ID NO: 692393 - DNA, 25 bp, Mus musculus
gtctgctcttccttttatccaatta

SEQ ID NO: 692394 - DNA, 25 bp, Mus musculus
gtctgctcttgacggaatggcttcc

SEQ ID NO: 692395 - DNA, 25 bp, Mus musculus
gtctgctcttgagggaatggcttcc

SEQ ID NO: 692396 - DNA, 25 bp, Mus musculus
gtctgctgacacattgacttgtgaa

SEQ ID NO: 692397 - DNA, 25 bp, Mus musculus
gtctgctgacaccaacactaaaggc

SEQ ID NO: 692398 - DNA, 25 bp, Mus musculus
gtctgctgacacgaacactaaaggc

SEQ ID NO: 692399 - DNA, 25 bp, Mus musculus
gtctgctgacactttgacttgtgaa

SEQ ID NO: 692400 - DNA, 25 bp, Mus musculus
gtctgctgacagagctatttatata

SEQ ID NO: 692401 - DNA, 25 bp, Mus musculus
gtctgctgacagtgctatttatata

SEQ ID NO: 692402 - DNA, 25 bp, Mus musculus
gtctgctgagagacaccccaggaag

SEQ ID NO: 692403 - DNA, 25 bp, Mus musculus
gtctgctgagagtcaccccaggaag

SEQ ID NO: 692404 - DNA, 25 bp, Mus musculus
gtctgctgagataagaacacccctt

SEQ ID NO: 692405 - DNA, 25 bp, Mus musculus
gtctgctgagattagaacacccctt

SEQ ID NO: 692406 - DNA, 25 bp, Mus musculus
gtctgctgcacacatcgttgaagct

SEQ ID NO: 692407 - DNA, 25 bp, Mus musculus
gtctgctgcacagatcgttgaagct

SEQ ID NO: 692408 - DNA, 25 bp, Mus musculus
gtctgctgctttcctacaatttttt

SEQ ID NO: 692409 - DNA, 25 bp, Mus musculus
gtctgctgctttgctacaatttttt

SEQ ID NO: 692410 - DNA, 25 bp, Mus musculus
gtctgctggagtctactgtgtgtat

SEQ ID NO: 692411 - DNA, 25 bp, Mus musculus
gtctgctggagtgtactgtgtgtat

SEQ ID NO: 692412 - DNA, 25 bp, Mus musculus
gtctgctggcagatatcaggtaata

SEQ ID NO: 692413 - DNA, 25 bp, Mus musculus
gtctgctggcagatttcctggccta

SEQ ID NO: 692414 - DNA, 25 bp, Mus musculus
gtctgctggcagttatcaggtaata

SEQ ID NO: 692415 - DNA, 25 bp, Mus musculus
gtctgctggcagttttcctggccta

SEQ ID NO: 692416 - DNA, 25 bp, Mus musculus
gtctgctggcatcggcggcatcggc

SEQ ID NO: 692417 - DNA, 25 bp, Mus musculus
gtctgctggcatgggcggcatcggc

SEQ ID NO: 692418 - DNA, 25 bp, Mus musculus
gtctgctggttgcttccatttccat

SEQ ID NO: 692419 - DNA, 25 bp, Mus musculus
gtctgctggttggttccatttccat

SEQ ID NO: 692420 - DNA, 25 bp, Mus musculus
gtctgctgtactcaagtttgctgtt

SEQ ID NO: 692421 - DNA, 25 bp, Mus musculus
gtctgctgtactgaagtttgctgtt

SEQ ID NO: 692422 - DNA, 25 bp, Mus musculus
gtctgctgtaggaccatgagatgta

SEQ ID NO: 692423 - DNA, 25 bp, Mus musculus
gtctgctgtaggtccatgagatgta

SEQ ID NO: 692424 - DNA, 25 bp, Mus musculus
gtctgctgtattagttctctgtctt

SEQ ID NO: 692425 - DNA, 25 bp, Mus musculus
gtctgctgtatttgttctctgtctt

SEQ ID NO: 692426 - DNA, 25 bp, Mus musculus
gtctgctgtcagaatgatggtcctc

SEQ ID NO: 692427 - DNA, 25 bp, Mus musculus
gtctgctgtcagtatgatggtcctc

SEQ ID NO: 692428 - DNA, 25 bp, Mus musculus
gtctgctgtctgaaccactatgaag

SEQ ID NO: 692429 - DNA, 25 bp, Mus musculus
gtctgctgtctgaatgacttccatg

SEQ ID NO: 692430 - DNA, 25 bp, Mus musculus
gtctgctgtctgtaccactatgaag

SEQ ID NO: 692431 - DNA, 25 bp, Mus musculus
gtctgctgtctgtatgacttccatg

SEQ ID NO: 692432 - DNA, 25 bp, Mus musculus
gtctgctgtgacaaaattgcctcca

SEQ ID NO: 692433 - DNA, 25 bp, Mus musculus
gtctgctgtgactaaattgcctcca

SEQ ID NO: 692434 - DNA, 25 bp, Mus musculus
gtctgctgttggagagctctgatta

SEQ ID NO: 692435 - DNA, 25 bp, Mus musculus
gtctgctgttggtgagctctgatta

SEQ ID NO: 692436 - DNA, 25 bp, Mus musculus
gtctgcttcagaatcaatccttaca

SEQ ID NO: 692437 - DNA, 25 bp, Mus musculus
gtctgcttcagattcaatccttaca

SEQ ID NO: 692438 - DNA, 25 bp, Mus musculus
gtctgcttcagcaacttcagttatt

SEQ ID NO: 692439 - DNA, 25 bp, Mus musculus
gtctgcttcagctacttcagttatt

SEQ ID NO: 692440 - DNA, 25 bp, Mus musculus
gtctgcttcattactctggagtggt

SEQ ID NO: 692441 - DNA, 25 bp, Mus musculus
gtctgcttcatttctctggagtggt

SEQ ID NO: 692442 - DNA, 25 bp, Mus musculus
gtctgcttccagaaccccaaaagat

SEQ ID NO: 692443 - DNA, 25 bp, Mus musculus
gtctgcttccagtaccccaaaagat

SEQ ID NO: 692444 - DNA, 25 bp, Mus musculus
gtctgcttccttatatacaacacag

SEQ ID NO: 692445 - DNA, 25 bp, Mus musculus
gtctgcttccttttatacaacacag

SEQ ID NO: 692446 - DNA, 25 bp, Mus musculus
gtctgcttcggtcacagatttctac

SEQ ID NO: 692447 - DNA, 25 bp, Mus musculus
gtctgcttcggtgacagatttctac

SEQ ID NO: 692448 - DNA, 25 bp, Mus musculus
gtctgcttctctcattccagtggca

SEQ ID NO: 692449 - DNA, 25 bp, Mus musculus
gtctgcttctctgattccagtggca

SEQ ID NO: 692450 - DNA, 25 bp, Mus musculus
gtctgcttctgtcgtctatgcatat

SEQ ID NO: 692451 - DNA, 25 bp, Mus musculus
gtctgcttctgtggtctatgcatat

SEQ ID NO: 692452 - DNA, 25 bp, Mus musculus
gtctgcttgactctcagcctattaa

SEQ ID NO: 692453 - DNA, 25 bp, Mus musculus
gtctgcttgactgtcagcctattaa

SEQ ID NO: 692454 - DNA, 25 bp, Mus musculus
gtctgcttgcaaacaccattgcgaa

SEQ ID NO: 692455 - DNA, 25 bp, Mus musculus
gtctgcttgcaatcaccattgcgaa

SEQ ID NO: 692456 - DNA, 25 bp, Mus musculus
gtctgcttgtgccaattgacaagta

SEQ ID NO: 692457 - DNA, 25 bp, Mus musculus
gtctgcttgtgcgaattgacaagta

SEQ ID NO: 692458 - DNA, 25 bp, Mus musculus
gtctgcttgtggcttccaggctaac

SEQ ID NO: 692459 - DNA, 25 bp, Mus musculus
gtctgcttgtgggttccaggctaac

SEQ ID NO: 692460 - DNA, 25 bp, Mus musculus
gtctgctttcacagaagggacatcc

SEQ ID NO: 692461 - DNA, 25 bp, Mus musculus
gtctgctttcactgaagggacatcc

SEQ ID NO: 692462 - DNA, 25 bp, Mus musculus
gtctgctttccccaaggtacttgaa

SEQ ID NO: 692463 - DNA, 25 bp, Mus musculus
gtctgctttcccgaaggtacttgaa

SEQ ID NO: 692464 - DNA, 25 bp, Mus musculus
gtctgctttcgaaggcgtgtctgcc

SEQ ID NO: 692465 - DNA, 25 bp, Mus musculus
gtctgctttcgatggcgtgtctgcc

SEQ ID NO: 692466 - DNA, 25 bp, Mus musculus
gtctgctttgcaagcccgaggacct

SEQ ID NO: 692467 - DNA, 25 bp, Mus musculus
gtctgctttgcatgcccgaggacct

SEQ ID NO: 692468 - DNA, 25 bp, Mus musculus
gtctgctttgctattagcactacca

SEQ ID NO: 692469 - DNA, 25 bp, Mus musculus
gtctgctttgcttttagcactacca

SEQ ID NO: 692470 - DNA, 25 bp, Mus musculus
gtctgctttggcaggtgatagaaac

SEQ ID NO: 692471 - DNA, 25 bp, Mus musculus
gtctgctttggctggtgatagaaac

SEQ ID NO: 692472 - DNA, 25 bp, Mus musculus
gtctgctttgtacctgttggatact

SEQ ID NO: 692473 - DNA, 25 bp, Mus musculus
gtctgctttgtagctgttggatact

SEQ ID NO: 692474 - DNA, 25 bp, Mus musculus
gtctgcttttcaatcactagtacag

SEQ ID NO: 692475 - DNA, 25 bp, Mus musculus
gtctgcttttcattcactagtacag

SEQ ID NO: 692476 - DNA, 25 bp, Mus musculus
gtctgctttttaatgggacaggcca

SEQ ID NO: 692477 - DNA, 25 bp, Mus musculus
gtctgctttttattgggacaggcca

SEQ ID NO: 692478 - DNA, 25 bp, Mus musculus
gtctgctttttgactttatctttca

SEQ ID NO: 692479 - DNA, 25 bp, Mus musculus
gtctgctttttgtctttatctttca

SEQ ID NO: 692480 - DNA, 25 bp, Mus musculus
gtctggaaaacacagggatattcct

SEQ ID NO: 692481 - DNA, 25 bp, Mus musculus
gtctggaaaacagagggatattcct

SEQ ID NO: 692482 - DNA, 25 bp, Mus musculus
gtctggaaaactcacccgtggctga

SEQ ID NO: 692483 - DNA, 25 bp, Mus musculus
gtctggaaaactgacccgtggctga

SEQ ID NO: 692484 - DNA, 25 bp, Mus musculus
gtctggaaacttagaaggccctggt

SEQ ID NO: 692485 - DNA, 25 bp, Mus musculus
gtctggaaactttgaaggccctggt

SEQ ID NO: 692486 - DNA, 25 bp, Mus musculus
gtctggaaagcgatctgctcctgga

SEQ ID NO: 692487 - DNA, 25 bp, Mus musculus
gtctggaaagcgttctgctcctgga

SEQ ID NO: 692488 - DNA, 25 bp, Mus musculus
gtctggaaatccaagaatcattttc

SEQ ID NO: 692489 - DNA, 25 bp, Mus musculus
gtctggaaatcctagaatcattttc

SEQ ID NO: 692490 - DNA, 25 bp, Mus musculus
gtctggaacagactcgatgcccaat

SEQ ID NO: 692491 - DNA, 25 bp, Mus musculus
gtctggaacagagtcgatgcccaat

SEQ ID NO: 692492 - DNA, 25 bp, Mus musculus
gtctggaacaggctgatgcacccac

SEQ ID NO: 692493 - DNA, 25 bp, Mus musculus
gtctggaacagggtgatgcacccac

SEQ ID NO: 692494 - DNA, 25 bp, Mus musculus
gtctggaacataatcttctactgca

SEQ ID NO: 692495 - DNA, 25 bp, Mus musculus
gtctggaacatattcttctactgca

SEQ ID NO: 692496 - DNA, 25 bp, Mus musculus
gtctggaacattctaaatggctatc

SEQ ID NO: 692497 - DNA, 25 bp, Mus musculus
gtctggaacattgtaaatggctatc

SEQ ID NO: 692498 - DNA, 25 bp, Mus musculus
gtctggaactcaattcactgaccat

SEQ ID NO: 692499 - DNA, 25 bp, Mus musculus
gtctggaactcatttcactgaccat

SEQ ID NO: 692500 - DNA, 25 bp, Mus musculus
gtctggaagaaacttcctttccaca

SEQ ID NO: 692501 - DNA, 25 bp, Mus musculus
gtctggaagaaagttcctttccaca

SEQ ID NO: 692502 - DNA, 25 bp, Mus musculus
gtctggaagactccggacttttaag

SEQ ID NO: 692503 - DNA, 25 bp, Mus musculus
gtctggaagactgcggacttttaag

SEQ ID NO: 692504 - DNA, 25 bp, Mus musculus
gtctggaagcccagggtgccctcca

SEQ ID NO: 692505 - DNA, 25 bp, Mus musculus
gtctggaagccctgggtgccctcca

SEQ ID NO: 692506 - DNA, 25 bp, Mus musculus
gtctggaagcctaaagcagcagcct

SEQ ID NO: 692507 - DNA, 25 bp, Mus musculus
gtctggaagccttaagcagcagcct

SEQ ID NO: 692508 - DNA, 25 bp, Mus musculus
gtctggaatacccacgccgactttg

SEQ ID NO: 692509 - DNA, 25 bp, Mus musculus
gtctggaataccgacgccgactttg

SEQ ID NO: 692510 - DNA, 25 bp, Mus musculus
gtctggaatcagatgcggcatcaca

SEQ ID NO: 692511 - DNA, 25 bp, Mus musculus
gtctggaatcagttgcggcatcaca

SEQ ID NO: 692512 - DNA, 25 bp, Mus musculus
gtctggaattgactcttccactagc

SEQ ID NO: 692513 - DNA, 25 bp, Mus musculus
gtctggaattgagtcttccactagc

SEQ ID NO: 692514 - DNA, 25 bp, Mus musculus
gtctggaatttcctgtgcagcttag

SEQ ID NO: 692515 - DNA, 25 bp, Mus musculus
gtctggaatttcgtgtgcagcttag

SEQ ID NO: 692516 - DNA, 25 bp, Mus musculus
gtctggacatccacaacatgtctgt

SEQ ID NO: 692517 - DNA, 25 bp, Mus musculus
gtctggacatcctcaacatgtctgt

SEQ ID NO: 692518 - DNA, 25 bp, Mus musculus
gtctggacccagacaaggaactgat

SEQ ID NO: 692519 - DNA, 25 bp, Mus musculus
gtctggacccagtcaaggaactgat

SEQ ID NO: 692520 - DNA, 25 bp, Mus musculus
gtctggaccctcacatgtgtatgcg

SEQ ID NO: 692521 - DNA, 25 bp, Mus musculus
gtctggaccctctcatgtgtatgcg

SEQ ID NO: 692522 - DNA, 25 bp, Mus musculus
gtctggacgcaaaggaactgatatc

SEQ ID NO: 692523 - DNA, 25 bp, Mus musculus
gtctggacgcaatggaactgatatc

SEQ ID NO: 692524 - DNA, 25 bp, Mus musculus
gtctggacggacaagagttcactct

SEQ ID NO: 692525 - DNA, 25 bp, Mus musculus
gtctggacggactagagttcactct

SEQ ID NO: 692526 - DNA, 25 bp, Mus musculus
gtctggactcccctgccaaggttag

SEQ ID NO: 692527 - DNA, 25 bp, Mus musculus
gtctggactcccgtgccaaggttag

SEQ ID NO: 692528 - DNA, 25 bp, Mus musculus
gtctggactctacccgatgcctctg

SEQ ID NO: 692529 - DNA, 25 bp, Mus musculus
gtctggactctagccgatgcctctg

SEQ ID NO: 692530 - DNA, 25 bp, Mus musculus
gtctggactgctatttacagtttct

SEQ ID NO: 692531 - DNA, 25 bp, Mus musculus
gtctggactgctttttacagtttct

SEQ ID NO: 692532 - DNA, 25 bp, Mus musculus
gtctggagaaacacttctgggaagg

SEQ ID NO: 692533 - DNA, 25 bp, Mus musculus
gtctggagaaactcttctgggaagg

SEQ ID NO: 692534 - DNA, 25 bp, Mus musculus
gtctggagaagaccctctagtgaag

SEQ ID NO: 692535 - DNA, 25 bp, Mus musculus
gtctggagaagagcctctagtgaag

SEQ ID NO: 692536 - DNA, 25 bp, Mus musculus
gtctggagaagtcttgtgtctgtct

SEQ ID NO: 692537 - DNA, 25 bp, Mus musculus
gtctggagaagtgttgtgtctgtct

SEQ ID NO: 692538 - DNA, 25 bp, Mus musculus
gtctggagactgatacttcaaatgt

SEQ ID NO: 692539 - DNA, 25 bp, Mus musculus
gtctggagactgttacttcaaatgt

SEQ ID NO: 692540 - DNA, 25 bp, Mus musculus
gtctggagagtgctctgcagggatc

SEQ ID NO: 692541 - DNA, 25 bp, Mus musculus
gtctggagagtggtctgcagggatc

SEQ ID NO: 692542 - DNA, 25 bp, Mus musculus
gtctggagatataggctatgccgat

SEQ ID NO: 692543 - DNA, 25 bp, Mus musculus
gtctggagatattggctatgccgat

SEQ ID NO: 692544 - DNA, 25 bp, Mus musculus
gtctggagatccctgccatggacga

SEQ ID NO: 692545 - DNA, 25 bp, Mus musculus
gtctggagatccgtgccatggacga

SEQ ID NO: 692546 - DNA, 25 bp, Mus musculus
gtctggagatctagactctggtcct

SEQ ID NO: 692547 - DNA, 25 bp, Mus musculus
gtctggagatcttgactctggtcct

SEQ ID NO: 692548 - DNA, 25 bp, Mus musculus
gtctggagcattaatgttaatttta

SEQ ID NO: 692549 - DNA, 25 bp, Mus musculus
gtctggagcatttatgttaatttta

SEQ ID NO: 692550 - DNA, 25 bp, Mus musculus
gtctggagctttcgtgcactgatgt

SEQ ID NO: 692551 - DNA, 25 bp, Mus musculus
gtctggagctttggtgcactgatgt

SEQ ID NO: 692552 - DNA, 25 bp, Mus musculus
gtctggaggcttccagatcagcttc

SEQ ID NO: 692553 - DNA, 25 bp, Mus musculus
gtctggaggcttgcagatcagcttc

SEQ ID NO: 692554 - DNA, 25 bp, Mus musculus
gtctggagtactaatcaccgtgccg

SEQ ID NO: 692555 - DNA, 25 bp, Mus musculus
gtctggagtacttatcaccgtgccg

SEQ ID NO: 692556 - DNA, 25 bp, Mus musculus
gtctggagtcatcgccattgcacag

SEQ ID NO: 692557 - DNA, 25 bp, Mus musculus
gtctggagtcatggccattgcacag

SEQ ID NO: 692558 - DNA, 25 bp, Mus musculus
gtctggagtgggattcgctcaagtt

SEQ ID NO: 692559 - DNA, 25 bp, Mus musculus
gtctggagtgggtttcgctcaagtt

SEQ ID NO: 692560 - DNA, 25 bp, Mus musculus
gtctggatcaaaatcacaagcttaa

SEQ ID NO: 692561 - DNA, 25 bp, Mus musculus
gtctggatcaaattcacaagcttaa

SEQ ID NO: 692562 - DNA, 25 bp, Mus musculus
gtctggatccagcaaaagtctgttc

SEQ ID NO: 692563 - DNA, 25 bp, Mus musculus
gtctggatccaggaaaagtctgttc

SEQ ID NO: 692564 - DNA, 25 bp, Mus musculus
gtctggatcccaacagggtggcctt

SEQ ID NO: 692565 - DNA, 25 bp, Mus musculus
gtctggatcccatcagggtggcctt

SEQ ID NO: 692566 - DNA, 25 bp, Mus musculus
gtctggatccccagagtacttgaca

SEQ ID NO: 692567 - DNA, 25 bp, Mus musculus
gtctggatcccctgagtacttgaca

SEQ ID NO: 692568 - DNA, 25 bp, Mus musculus
gtctggatcctgatctcacattcta

SEQ ID NO: 692569 - DNA, 25 bp, Mus musculus
gtctggatcctgttctcacattcta

SEQ ID NO: 692570 - DNA, 25 bp, Mus musculus
gtctggatctacatcattcttacat

SEQ ID NO: 692571 - DNA, 25 bp, Mus musculus
gtctggatctacttcattcttacat

SEQ ID NO: 692572 - DNA, 25 bp, Mus musculus
gtctggatctgcaggtgattgacac

SEQ ID NO: 692573 - DNA, 25 bp, Mus musculus
gtctggatctgctggtgattgacac

SEQ ID NO: 692574 - DNA, 25 bp, Mus musculus
gtctggatctggctctgttggaaat

SEQ ID NO: 692575 - DNA, 25 bp, Mus musculus
gtctggatctgggtctgttggaaat

SEQ ID NO: 692576 - DNA, 25 bp, Mus musculus
gtctggatgccacaggtgttaaagt

SEQ ID NO: 692577 - DNA, 25 bp, Mus musculus
gtctggatgccagaggtgttaaagt

SEQ ID NO: 692578 - DNA, 25 bp, Mus musculus
gtctggatggacacccatcatgcat

SEQ ID NO: 692579 - DNA, 25 bp, Mus musculus
gtctggatggactcccatcatgcat

SEQ ID NO: 692580 - DNA, 25 bp, Mus musculus
gtctggattgttctggcccaggtcc

SEQ ID NO: 692581 - DNA, 25 bp, Mus musculus
gtctggattgttgtggcccaggtcc

SEQ ID NO: 692582 - DNA, 25 bp, Mus musculus
gtctggcaaaaaatacctccgttat

SEQ ID NO: 692583 - DNA, 25 bp, Mus musculus
gtctggcaaaaattacctccgttat

SEQ ID NO: 692584 - DNA, 25 bp, Mus musculus
gtctggcaactcaacagcgattgtt

SEQ ID NO: 692585 - DNA, 25 bp, Mus musculus
gtctggcaactccgacgtgtatgag

SEQ ID NO: 692586 - DNA, 25 bp, Mus musculus
gtctggcaactcggacgtgtatgag

SEQ ID NO: 692587 - DNA, 25 bp, Mus musculus
gtctggcaactctacagcgattgtt

SEQ ID NO: 692588 - DNA, 25 bp, Mus musculus
gtctggcacagtctaggccactgca

SEQ ID NO: 692589 - DNA, 25 bp, Mus musculus
gtctggcacagtgtaggccactgca

SEQ ID NO: 692590 - DNA, 25 bp, Mus musculus
gtctggcacttgctgggcatcacaa

SEQ ID NO: 692591 - DNA, 25 bp, Mus musculus
gtctggcacttggtgggcatcacaa

SEQ ID NO: 692592 - DNA, 25 bp, Mus musculus
gtctggcagacaacaccttcaggag

SEQ ID NO: 692593 - DNA, 25 bp, Mus musculus
gtctggcagacatcaccttcaggag

SEQ ID NO: 692594 - DNA, 25 bp, Mus musculus
gtctggcaggcaaagttactacaca

SEQ ID NO: 692595 - DNA, 25 bp, Mus musculus
gtctggcaggcatagttactacaca

SEQ ID NO: 692596 - DNA, 25 bp, Mus musculus
gtctggcatcaaagaccttatctgt

SEQ ID NO: 692597 - DNA, 25 bp, Mus musculus
gtctggcatcaatgaccttatctgt

SEQ ID NO: 692598 - DNA, 25 bp, Mus musculus
gtctggcattgcctcattcagatgc

SEQ ID NO: 692599 - DNA, 25 bp, Mus musculus
gtctggcattgcgtcattcagatgc

SEQ ID NO: 692600 - DNA, 25 bp, Mus musculus
gtctggccagaaattaatgttttat

SEQ ID NO: 692601 - DNA, 25 bp, Mus musculus
gtctggccagaatttaatgttttat

SEQ ID NO: 692602 - DNA, 25 bp, Mus musculus
gtctggccagatcttattattttgc

SEQ ID NO: 692603 - DNA, 25 bp, Mus musculus
gtctggccagatgttattattttgc

SEQ ID NO: 692604 - DNA, 25 bp, Mus musculus
gtctggcctagaactttgaatccta

SEQ ID NO: 692605 - DNA, 25 bp, Mus musculus
gtctggcctagaagacgacgcatga

SEQ ID NO: 692606 - DNA, 25 bp, Mus musculus
gtctggcctagatctttgaatccta

SEQ ID NO: 692607 - DNA, 25 bp, Mus musculus
gtctggcctagatgacgacgcatga

SEQ ID NO: 692608 - DNA, 25 bp, Mus musculus
gtctggcctatgagaacccttgaat

SEQ ID NO: 692609 - DNA, 25 bp, Mus musculus
gtctggcctatgtgaacccttgaat

SEQ ID NO: 692610 - DNA, 25 bp, Mus musculus
gtctggcctcaacatatatctcaag

SEQ ID NO: 692611 - DNA, 25 bp, Mus musculus
gtctggcctcaagatatatctcaag

SEQ ID NO: 692612 - DNA, 25 bp, Mus musculus
gtctggcctcagatttgcttcatag

SEQ ID NO: 692613 - DNA, 25 bp, Mus musculus
gtctggcctcagttttgcttcatag

SEQ ID NO: 692614 - DNA, 25 bp, Mus musculus
gtctggcctgatactcatcactggg

SEQ ID NO: 692615 - DNA, 25 bp, Mus musculus
gtctggcctgattctcatcactggg

SEQ ID NO: 692616 - DNA, 25 bp, Mus musculus
gtctggcgagatcaacactatgtga

SEQ ID NO: 692617 - DNA, 25 bp, Mus musculus
gtctggcgagatgaacactatgtga

SEQ ID NO: 692618 - DNA, 25 bp, Mus musculus
gtctggctaatacatattcctgaca

SEQ ID NO: 692619 - DNA, 25 bp, Mus musculus
gtctggctaatagatattcctgaca

SEQ ID NO: 692620 - DNA, 25 bp, Mus musculus
gtctggctacttagcatactttatg

SEQ ID NO: 692621 - DNA, 25 bp, Mus musculus
gtctggctactttgcatactttatg

SEQ ID NO: 692622 - DNA, 25 bp, Mus musculus
gtctggctagtaattgcaacggagg

SEQ ID NO: 692623 - DNA, 25 bp, Mus musculus
gtctggctagtatttgcaacggagg

SEQ ID NO: 692624 - DNA, 25 bp, Mus musculus
gtctggctataacacaggacacctt

SEQ ID NO: 692625 - DNA, 25 bp, Mus musculus
gtctggctataagacaggacacctt

SEQ ID NO: 692626 - DNA, 25 bp, Mus musculus
gtctggctcaagatggcatggtatc

SEQ ID NO: 692627 - DNA, 25 bp, Mus musculus
gtctggctcaagttggcatggtatc

SEQ ID NO: 692628 - DNA, 25 bp, Mus musculus
gtctggctcatcaggacatttttta

SEQ ID NO: 692629 - DNA, 25 bp, Mus musculus
gtctggctcatctggacatttttta

SEQ ID NO: 692630 - DNA, 25 bp, Mus musculus
gtctggctccagaaggcacacaatg

SEQ ID NO: 692631 - DNA, 25 bp, Mus musculus
gtctggctccagtaggcacacaatg

SEQ ID NO: 692632 - DNA, 25 bp, Mus musculus
gtctggctctcaactgactcagtat

SEQ ID NO: 692633 - DNA, 25 bp, Mus musculus
gtctggctctcatctgactcagtat

SEQ ID NO: 692634 - DNA, 25 bp, Mus musculus
gtctggctgctgagcattatttcat

SEQ ID NO: 692635 - DNA, 25 bp, Mus musculus
gtctggctgctgtgcattatttcat

SEQ ID NO: 692636 - DNA, 25 bp, Mus musculus
gtctggctgcttaactgtagggcag

SEQ ID NO: 692637 - DNA, 25 bp, Mus musculus
gtctggctgctttactgtagggcag

SEQ ID NO: 692638 - DNA, 25 bp, Mus musculus
gtctggcttattatgtcctgtccat

SEQ ID NO: 692639 - DNA, 25 bp, Mus musculus
gtctggcttattttgtcctgtccat

SEQ ID NO: 692640 - DNA, 25 bp, Mus musculus
gtctggcttctgcataaactttgta

SEQ ID NO: 692641 - DNA, 25 bp, Mus musculus
gtctggcttctggataaactttgta

SEQ ID NO: 692642 - DNA, 25 bp, Mus musculus
gtctggctttggcactaaaatcatg

SEQ ID NO: 692643 - DNA, 25 bp, Mus musculus
gtctggctttggctccaatgagatc

SEQ ID NO: 692644 - DNA, 25 bp, Mus musculus
gtctggctttgggactaaaatcatg

SEQ ID NO: 692645 - DNA, 25 bp, Mus musculus
gtctggctttgggtccaatgagatc

SEQ ID NO: 692646 - DNA, 25 bp, Mus musculus
gtctgggaaccaacatctgagctga

SEQ ID NO: 692647 - DNA, 25 bp, Mus musculus
gtctgggaaccatcatctgagctga

SEQ ID NO: 692648 - DNA, 25 bp, Mus musculus
gtctgggaagacatgcctattcctg

SEQ ID NO: 692649 - DNA, 25 bp, Mus musculus
gtctgggaagacttgcctattcctg

SEQ ID NO: 692650 - DNA, 25 bp, Mus musculus
gtctgggaagccaacgaacggttga

SEQ ID NO: 692651 - DNA, 25 bp, Mus musculus
gtctgggaagcctacgaacggttga

SEQ ID NO: 692652 - DNA, 25 bp, Mus musculus
gtctgggaatgaactaacctgggtt

SEQ ID NO: 692653 - DNA, 25 bp, Mus musculus
gtctgggaatgatctaacctgggtt

SEQ ID NO: 692654 - DNA, 25 bp, Mus musculus
gtctgggacaccctctttaaacaga

SEQ ID NO: 692655 - DNA, 25 bp, Mus musculus
gtctgggacaccgtctttaaacaga

SEQ ID NO: 692656 - DNA, 25 bp, Mus musculus
gtctgggacctcctgactacaaaag

SEQ ID NO: 692657 - DNA, 25 bp, Mus musculus
gtctgggacctcgtgactacaaaag

SEQ ID NO: 692658 - DNA, 25 bp, Mus musculus
gtctgggactgaccaacgttacatt

SEQ ID NO: 692659 - DNA, 25 bp, Mus musculus
gtctgggactgagcaacgttacatt

SEQ ID NO: 692660 - DNA, 25 bp, Mus musculus
gtctgggactgcacactgtcagtat

SEQ ID NO: 692661 - DNA, 25 bp, Mus musculus
gtctgggactgctcactgtcagtat

SEQ ID NO: 692662 - DNA, 25 bp, Mus musculus
gtctgggacttccacaagtgacact

SEQ ID NO: 692663 - DNA, 25 bp, Mus musculus
gtctgggacttcgacaagtgacact

SEQ ID NO: 692664 - DNA, 25 bp, Mus musculus
gtctgggagacaccacatcagttgt

SEQ ID NO: 692665 - DNA, 25 bp, Mus musculus
gtctgggagacagcacatcagttgt

SEQ ID NO: 692666 - DNA, 25 bp, Mus musculus
gtctgggagaccagtgataccacta

SEQ ID NO: 692667 - DNA, 25 bp, Mus musculus
gtctgggagacctgtgataccacta

SEQ ID NO: 692668 - DNA, 25 bp, Mus musculus
gtctgggagggtctcaccacctaaa

SEQ ID NO: 692669 - DNA, 25 bp, Mus musculus
gtctgggagggtgtcaccacctaaa

SEQ ID NO: 692670 - DNA, 25 bp, Mus musculus
gtctgggagtctcatctgctaaaaa

SEQ ID NO: 692671 - DNA, 25 bp, Mus musculus
gtctgggagtctgatctgctaaaaa

SEQ ID NO: 692672 - DNA, 25 bp, Mus musculus
gtctgggatagtcaagccctgcaga

SEQ ID NO: 692673 - DNA, 25 bp, Mus musculus
gtctgggatagtgaagccctgcaga

SEQ ID NO: 692674 - DNA, 25 bp, Mus musculus
gtctgggatcaactgactctagctc

SEQ ID NO: 692675 - DNA, 25 bp, Mus musculus
gtctgggatcaagtgactctagctc

SEQ ID NO: 692676 - DNA, 25 bp, Mus musculus
gtctgggcaccacgtattcatgtgg

SEQ ID NO: 692677 - DNA, 25 bp, Mus musculus
gtctgggcaccaggtattcatgtgg

SEQ ID NO: 692678 - DNA, 25 bp, Mus musculus
gtctgggcagttaatgtcctattaa

SEQ ID NO: 692679 - DNA, 25 bp, Mus musculus
gtctgggcagtttatgtcctattaa

SEQ ID NO: 692680 - DNA, 25 bp, Mus musculus
gtctgggccataaatgcttcaggca

SEQ ID NO: 692681 - DNA, 25 bp, Mus musculus
gtctgggccatatatgcttcaggca

SEQ ID NO: 692682 - DNA, 25 bp, Mus musculus
gtctgggcctggattttatggagaa

SEQ ID NO: 692683 - DNA, 25 bp, Mus musculus
gtctgggcctggtttttatggagaa

SEQ ID NO: 692684 - DNA, 25 bp, Mus musculus
gtctgggcgagtctctttgcatgtt

SEQ ID NO: 692685 - DNA, 25 bp, Mus musculus
gtctgggcgagtgtctttgcatgtt

SEQ ID NO: 692686 - DNA, 25 bp, Mus musculus
gtctgggctagacatgtggctatct

SEQ ID NO: 692687 - DNA, 25 bp, Mus musculus
gtctgggctagagatgtggctatct

SEQ ID NO: 692688 - DNA, 25 bp, Mus musculus
gtctgggctataattatggctggca

SEQ ID NO: 692689 - DNA, 25 bp, Mus musculus
gtctgggctatatttatggctggca

SEQ ID NO: 692690 - DNA, 25 bp, Mus musculus
gtctgggctgacatacctggcttgg

SEQ ID NO: 692691 - DNA, 25 bp, Mus musculus
gtctgggctgacttacctggcttgg

SEQ ID NO: 692692 - DNA, 25 bp, Mus musculus
gtctgggcttggagagttcttcaca

SEQ ID NO: 692693 - DNA, 25 bp, Mus musculus
gtctgggcttggtgagttcttcaca

SEQ ID NO: 692694 - DNA, 25 bp, Mus musculus
gtctgggctttgaaactgagtgaaa

SEQ ID NO: 692695 - DNA, 25 bp, Mus musculus
gtctgggctttgtaactgagtgaaa

SEQ ID NO: 692696 - DNA, 25 bp, Mus musculus
gtctgggtacccagcaggaaactat

SEQ ID NO: 692697 - DNA, 25 bp, Mus musculus
gtctgggtaccctgcaggaaactat

SEQ ID NO: 692698 - DNA, 25 bp, Mus musculus
gtctgggtactaaagcatgctgcgt

SEQ ID NO: 692699 - DNA, 25 bp, Mus musculus
gtctgggtactatagcatgctgcgt

SEQ ID NO: 692700 - DNA, 25 bp, Mus musculus
gtctgggtcaccacaagatgatttc

SEQ ID NO: 692701 - DNA, 25 bp, Mus musculus
gtctgggtcacctcaagatgatttc

SEQ ID NO: 692702 - DNA, 25 bp, Mus musculus
gtctgggtcaggatgtgcacaagtc

SEQ ID NO: 692703 - DNA, 25 bp, Mus musculus
gtctgggtcaggttgtgcacaagtc

SEQ ID NO: 692704 - DNA, 25 bp, Mus musculus
gtctgggtcatgatgagacctcatc

SEQ ID NO: 692705 - DNA, 25 bp, Mus musculus
gtctgggtcatgttgagacctcatc

SEQ ID NO: 692706 - DNA, 25 bp, Mus musculus
gtctgggtccctctgtcatgaagag

SEQ ID NO: 692707 - DNA, 25 bp, Mus musculus
gtctgggtccctgtgtcatgaagag

SEQ ID NO: 692708 - DNA, 25 bp, Mus musculus
gtctgggtctccagtacatatacgc

SEQ ID NO: 692709 - DNA, 25 bp, Mus musculus
gtctgggtctcctgtacatatacgc

SEQ ID NO: 692710 - DNA, 25 bp, Mus musculus
gtctgggtgataaatcttttctgaa

SEQ ID NO: 692711 - DNA, 25 bp, Mus musculus
gtctgggtgatatatcttttctgaa

SEQ ID NO: 692712 - DNA, 25 bp, Mus musculus
gtctgggtggagcaatagcccctaa

SEQ ID NO: 692713 - DNA, 25 bp, Mus musculus
gtctgggtggaggaatagcccctaa

SEQ ID NO: 692714 - DNA, 25 bp, Mus musculus
gtctgggtggccatttacatcttgc

SEQ ID NO: 692715 - DNA, 25 bp, Mus musculus
gtctgggtggccttttacatcttgc

SEQ ID NO: 692716 - DNA, 25 bp, Mus musculus
gtctgggtgggaccagacaggccac

SEQ ID NO: 692717 - DNA, 25 bp, Mus musculus
gtctgggtgggagcagacaggccac

SEQ ID NO: 692718 - DNA, 25 bp, Mus musculus
gtctgggtgggcaccaacaaccata

SEQ ID NO: 692719 - DNA, 25 bp, Mus musculus
gtctgggtgggctccaacaaccata

SEQ ID NO: 692720 - DNA, 25 bp, Mus musculus
gtctgggtgtcgattgatttgctct

SEQ ID NO: 692721 - DNA, 25 bp, Mus musculus
gtctgggtgtcgtttgatttgctct

SEQ ID NO: 692722 - DNA, 25 bp, Mus musculus
gtctgggttagaaagcggtgcctcc

SEQ ID NO: 692723 - DNA, 25 bp, Mus musculus
gtctgggttagatagcggtgcctcc

SEQ ID NO: 692724 - DNA, 25 bp, Mus musculus
gtctgggttcagctgatacactgct

SEQ ID NO: 692725 - DNA, 25 bp, Mus musculus
gtctgggttcaggtgatacactgct

SEQ ID NO: 692726 - DNA, 25 bp, Mus musculus
gtctgggtttatctattcctggaaa

SEQ ID NO: 692727 - DNA, 25 bp, Mus musculus
gtctgggtttatgtattcctggaaa

SEQ ID NO: 692728 - DNA, 25 bp, Mus musculus
gtctgggtttttcttccattgaaca

SEQ ID NO: 692729 - DNA, 25 bp, Mus musculus
gtctgggtttttgttccattgaaca

SEQ ID NO: 692730 - DNA, 25 bp, Mus musculus
gtctggtaagccaggcccatgcaat

SEQ ID NO: 692731 - DNA, 25 bp, Mus musculus
gtctggtaagcctggcccatgcaat

SEQ ID NO: 692732 - DNA, 25 bp, Mus musculus
gtctggtacaggctttacttctcaa

SEQ ID NO: 692733 - DNA, 25 bp, Mus musculus
gtctggtacagggtttacttctcaa

SEQ ID NO: 692734 - DNA, 25 bp, Mus musculus
gtctggtagcctatgcgtttaacaa

SEQ ID NO: 692735 - DNA, 25 bp, Mus musculus
gtctggtagcctttgcgtttaacaa

SEQ ID NO: 692736 - DNA, 25 bp, Mus musculus
gtctggtagctgagacagaacccaa

SEQ ID NO: 692737 - DNA, 25 bp, Mus musculus
gtctggtagctgctgaaacgcacaa

SEQ ID NO: 692738 - DNA, 25 bp, Mus musculus
gtctggtagctggtgaaacgcacaa

SEQ ID NO: 692739 - DNA, 25 bp, Mus musculus
gtctggtagctgtgacagaacccaa

SEQ ID NO: 692740 - DNA, 25 bp, Mus musculus
gtctggtatattcctcctgttttct

SEQ ID NO: 692741 - DNA, 25 bp, Mus musculus
gtctggtatattgctcctgttttct

SEQ ID NO: 692742 - DNA, 25 bp, Mus musculus
gtctggtcacctacagagatacttc

SEQ ID NO: 692743 - DNA, 25 bp, Mus musculus
gtctggtcaccttcagagatacttc

SEQ ID NO: 692744 - DNA, 25 bp, Mus musculus
gtctggtcacttaaggttgttttat

SEQ ID NO: 692745 - DNA, 25 bp, Mus musculus
gtctggtcactttaggttgttttat

SEQ ID NO: 692746 - DNA, 25 bp, Mus musculus
gtctggtcagaacggttgcctgcaa

SEQ ID NO: 692747 - DNA, 25 bp, Mus musculus
gtctggtcagaagggttgcctgcaa

SEQ ID NO: 692748 - DNA, 25 bp, Mus musculus
gtctggtcattgaaagccttagctc

SEQ ID NO: 692749 - DNA, 25 bp, Mus musculus
gtctggtcattgtaagccttagctc

SEQ ID NO: 692750 - DNA, 25 bp, Mus musculus
gtctggtccagtctgaagccgagta

SEQ ID NO: 692751 - DNA, 25 bp, Mus musculus
gtctggtccagtgtgaagccgagta

SEQ ID NO: 692752 - DNA, 25 bp, Mus musculus
gtctggtcccagcacaacttctgag

SEQ ID NO: 692753 - DNA, 25 bp, Mus musculus
gtctggtcccaggacaacttctgag

SEQ ID NO: 692754 - DNA, 25 bp, Mus musculus
gtctggtccgacaatgagtttggca

SEQ ID NO: 692755 - DNA, 25 bp, Mus musculus
gtctggtccgactatgagtttggca

SEQ ID NO: 692756 - DNA, 25 bp, Mus musculus
gtctggtcctagctgattttgacaa

SEQ ID NO: 692757 - DNA, 25 bp, Mus musculus
gtctggtcctaggtgattttgacaa

SEQ ID NO: 692758 - DNA, 25 bp, Mus musculus
gtctggtcctgcaggacagagccag

SEQ ID NO: 692759 - DNA, 25 bp, Mus musculus
gtctggtcctgctggacagagccag

SEQ ID NO: 692760 - DNA, 25 bp, Mus musculus
gtctggtcgacaacacttaagcttc

SEQ ID NO: 692761 - DNA, 25 bp, Mus musculus
gtctggtcgacatcacttaagcttc

SEQ ID NO: 692762 - DNA, 25 bp, Mus musculus
gtctggtcgcctacaacttcgtcgg

SEQ ID NO: 692763 - DNA, 25 bp, Mus musculus
gtctggtcgccttcaacttcgtcgg

SEQ ID NO: 692764 - DNA, 25 bp, Mus musculus
gtctggtctaatagagcctggccga

SEQ ID NO: 692765 - DNA, 25 bp, Mus musculus
gtctggtctaattgagcctggccga

SEQ ID NO: 692766 - DNA, 25 bp, Mus musculus
gtctggtctcacaggagagggcact

SEQ ID NO: 692767 - DNA, 25 bp, Mus musculus
gtctggtctcactggagagggcact

SEQ ID NO: 692768 - DNA, 25 bp, Mus musculus
gtctggtctgtgaaacacatgccta

SEQ ID NO: 692769 - DNA, 25 bp, Mus musculus
gtctggtctgtgtaacacatgccta

SEQ ID NO: 692770 - DNA, 25 bp, Mus musculus
gtctggtcttctatgtgtgctgggc

SEQ ID NO: 692771 - DNA, 25 bp, Mus musculus
gtctggtcttctttgtgtgctgggc

SEQ ID NO: 692772 - DNA, 25 bp, Mus musculus
gtctggtgaaatcccaactccacgc

SEQ ID NO: 692773 - DNA, 25 bp, Mus musculus
gtctggtgaaatgccaactccacgc

SEQ ID NO: 692774 - DNA, 25 bp, Mus musculus
gtctggtgaagtcagcttaggctac

SEQ ID NO: 692775 - DNA, 25 bp, Mus musculus
gtctggtgaagtgagcttaggctac

SEQ ID NO: 692776 - DNA, 25 bp, Mus musculus
gtctggtgacagaacattccgggat

SEQ ID NO: 692777 - DNA, 25 bp, Mus musculus
gtctggtgacagtacattccgggat

SEQ ID NO: 692778 - DNA, 25 bp, Mus musculus
gtctggtgcaagctatcttctatca

SEQ ID NO: 692779 - DNA, 25 bp, Mus musculus
gtctggtgcaaggtatcttctatca

SEQ ID NO: 692780 - DNA, 25 bp, Mus musculus
gtctggtgcccaatttgtttttccg

SEQ ID NO: 692781 - DNA, 25 bp, Mus musculus
gtctggtgcccattttgtttttccg

SEQ ID NO: 692782 - DNA, 25 bp, Mus musculus
gtctggtgcgcaatctgcagatctg

SEQ ID NO: 692783 - DNA, 25 bp, Mus musculus
gtctggtgcgcattctgcagatctg

SEQ ID NO: 692784 - DNA, 25 bp, Mus musculus
gtctggtgcttgactctggagaact

SEQ ID NO: 692785 - DNA, 25 bp, Mus musculus
gtctggtgcttgtctctggagaact

SEQ ID NO: 692786 - DNA, 25 bp, Mus musculus
gtctggtgtgttacagtgtgtccat

SEQ ID NO: 692787 - DNA, 25 bp, Mus musculus
gtctggtgtgtttcagtgtgtccat

SEQ ID NO: 692788 - DNA, 25 bp, Mus musculus
gtctggttacagatttgcatttcct

SEQ ID NO: 692789 - DNA, 25 bp, Mus musculus
gtctggttacagttttgcatttcct

SEQ ID NO: 692790 - DNA, 25 bp, Mus musculus
gtctggttcagtatttgagggcaaa

SEQ ID NO: 692791 - DNA, 25 bp, Mus musculus
gtctggttcagtttttgagggcaaa

SEQ ID NO: 692792 - DNA, 25 bp, Mus musculus
gtctggttccacatcacatacagtg

SEQ ID NO: 692793 - DNA, 25 bp, Mus musculus
gtctggttccacttcacatacagtg

SEQ ID NO: 692794 - DNA, 25 bp, Mus musculus
gtctggttccatagttcttaaagcc

SEQ ID NO: 692795 - DNA, 25 bp, Mus musculus
gtctggttccattgttcttaaagcc

SEQ ID NO: 692796 - DNA, 25 bp, Mus musculus
gtctggttcctaattctttgctgtc

SEQ ID NO: 692797 - DNA, 25 bp, Mus musculus
gtctggttcctatttctttgctgtc

SEQ ID NO: 692798 - DNA, 25 bp, Mus musculus
gtctggttgcctccggtgtgccaca

SEQ ID NO: 692799 - DNA, 25 bp, Mus musculus
gtctggttgcctgcggtgtgccaca

SEQ ID NO: 692800 - DNA, 25 bp, Mus musculus
gtctggttggccctgattcacaatc

SEQ ID NO: 692801 - DNA, 25 bp, Mus musculus
gtctggttggccgtgattcacaatc

SEQ ID NO: 692802 - DNA, 25 bp, Mus musculus
gtctggttggtgatttgacacacac

SEQ ID NO: 692803 - DNA, 25 bp, Mus musculus
gtctggttggtgttttgacacacac

SEQ ID NO: 692804 - DNA, 25 bp, Mus musculus
gtctggtttaagcaacatgtgaaag

SEQ ID NO: 692805 - DNA, 25 bp, Mus musculus
gtctggtttaaggaacatgtgaaag

SEQ ID NO: 692806 - DNA, 25 bp, Mus musculus
gtctggtttacccagctgatacaca

SEQ ID NO: 692807 - DNA, 25 bp, Mus musculus
gtctggtttaccgagctgatacaca

SEQ ID NO: 692808 - DNA, 25 bp, Mus musculus
gtctggtttcagatagggtttgttt

SEQ ID NO: 692809 - DNA, 25 bp, Mus musculus
gtctggtttcagttagggtttgttt

SEQ ID NO: 692810 - DNA, 25 bp, Mus musculus
gtctggtttcccaaagcgcctaaga

SEQ ID NO: 692811 - DNA, 25 bp, Mus musculus
gtctggtttccctaagcgcctaaga

SEQ ID NO: 692812 - DNA, 25 bp, Mus musculus
gtctgtaaactactctttttgccaa

SEQ ID NO: 692813 - DNA, 25 bp, Mus musculus
gtctgtaaactagtctttttgccaa

SEQ ID NO: 692814 - DNA, 25 bp, Mus musculus
gtctgtaaacttcagcacttgcaca

SEQ ID NO: 692815 - DNA, 25 bp, Mus musculus
gtctgtaaacttgagcacttgcaca

SEQ ID NO: 692816 - DNA, 25 bp, Mus musculus
gtctgtaaagatatctcctctggtt

SEQ ID NO: 692817 - DNA, 25 bp, Mus musculus
gtctgtaaagatttctcctctggtt

SEQ ID NO: 692818 - DNA, 25 bp, Mus musculus
gtctgtaaatatacttcctcactga

SEQ ID NO: 692819 - DNA, 25 bp, Mus musculus
gtctgtaaatattcttcctcactga

SEQ ID NO: 692820 - DNA, 25 bp, Mus musculus
gtctgtaacacaatccgaggctctg

SEQ ID NO: 692821 - DNA, 25 bp, Mus musculus
gtctgtaacacattccgaggctctg

SEQ ID NO: 692822 - DNA, 25 bp, Mus musculus
gtctgtaaccagctgtggagcacgt

SEQ ID NO: 692823 - DNA, 25 bp, Mus musculus
gtctgtaaccaggtgtggagcacgt

SEQ ID NO: 692824 - DNA, 25 bp, Mus musculus
gtctgtaaccccaacggagatggat

SEQ ID NO: 692825 - DNA, 25 bp, Mus musculus
gtctgtaacccctacggagatggat

SEQ ID NO: 692826 - DNA, 25 bp, Mus musculus
gtctgtaagagcaagaatcctctgt

SEQ ID NO: 692827 - DNA, 25 bp, Mus musculus
gtctgtaagagctagaatcctctgt

SEQ ID NO: 692828 - DNA, 25 bp, Mus musculus
gtctgtaagcacaacggttcgttgt

SEQ ID NO: 692829 - DNA, 25 bp, Mus musculus
gtctgtaagcactacggttcgttgt

SEQ ID NO: 692830 - DNA, 25 bp, Mus musculus
gtctgtaagtttctacataacccta

SEQ ID NO: 692831 - DNA, 25 bp, Mus musculus
gtctgtaagtttgtacataacccta

SEQ ID NO: 692832 - DNA, 25 bp, Mus musculus
gtctgtaataaccatagcttgtttt

SEQ ID NO: 692833 - DNA, 25 bp, Mus musculus
gtctgtaataacgatagcttgtttt

SEQ ID NO: 692834 - DNA, 25 bp, Mus musculus
gtctgtaatacaatctccagtacca

SEQ ID NO: 692835 - DNA, 25 bp, Mus musculus
gtctgtaatacattctccagtacca

SEQ ID NO: 692836 - DNA, 25 bp, Mus musculus
gtctgtaatcttcgcactagggagt

SEQ ID NO: 692837 - DNA, 25 bp, Mus musculus
gtctgtaatcttctatcaactggtt

SEQ ID NO: 692838 - DNA, 25 bp, Mus musculus
gtctgtaatcttggcactagggagt

SEQ ID NO: 692839 - DNA, 25 bp, Mus musculus
gtctgtaatcttgtatcaactggtt

SEQ ID NO: 692840 - DNA, 25 bp, Mus musculus
gtctgtacaatgatggattccacca

SEQ ID NO: 692841 - DNA, 25 bp, Mus musculus
gtctgtacaatgttggattccacca

SEQ ID NO: 692842 - DNA, 25 bp, Mus musculus
gtctgtacagcgagaccatcgccaa

SEQ ID NO: 692843 - DNA, 25 bp, Mus musculus
gtctgtacagcgtgaccatcgccaa

SEQ ID NO: 692844 - DNA, 25 bp, Mus musculus
gtctgtacaggtaatcatctaatta

SEQ ID NO: 692845 - DNA, 25 bp, Mus musculus
gtctgtacaggttatcatctaatta

SEQ ID NO: 692846 - DNA, 25 bp, Mus musculus
gtctgtacatacaggatctcttttc

SEQ ID NO: 692847 - DNA, 25 bp, Mus musculus
gtctgtacataccatgtatcactta

SEQ ID NO: 692848 - DNA, 25 bp, Mus musculus
gtctgtacatacgatgtatcactta

SEQ ID NO: 692849 - DNA, 25 bp, Mus musculus
gtctgtacatactggatctcttttc

SEQ ID NO: 692850 - DNA, 25 bp, Mus musculus
gtctgtaccaagagtctgtctctgt

SEQ ID NO: 692851 - DNA, 25 bp, Mus musculus
gtctgtaccaagtgtctgtctctgt

SEQ ID NO: 692852 - DNA, 25 bp, Mus musculus
gtctgtaccacccaggcattcatat

SEQ ID NO: 692853 - DNA, 25 bp, Mus musculus
gtctgtaccaccgaggcattcatat

SEQ ID NO: 692854 - DNA, 25 bp, Mus musculus
gtctgtaccagcatcattaaaataa

SEQ ID NO: 692855 - DNA, 25 bp, Mus musculus
gtctgtaccagcttcattaaaataa

SEQ ID NO: 692856 - DNA, 25 bp, Mus musculus
gtctgtaccccaagtttattagcat

SEQ ID NO: 692857 - DNA, 25 bp, Mus musculus
gtctgtaccccatgtttattagcat

SEQ ID NO: 692858 - DNA, 25 bp, Mus musculus
gtctgtaccctgcagctgaatttgt

SEQ ID NO: 692859 - DNA, 25 bp, Mus musculus
gtctgtaccctggagctgaatttgt

SEQ ID NO: 692860 - DNA, 25 bp, Mus musculus
gtctgtaccttcagactttatgtaa

SEQ ID NO: 692861 - DNA, 25 bp, Mus musculus
gtctgtaccttctgactttatgtaa

SEQ ID NO: 692862 - DNA, 25 bp, Mus musculus
gtctgtaccttgaaagctgctgctg

SEQ ID NO: 692863 - DNA, 25 bp, Mus musculus
gtctgtaccttgtaagctgctgctg

SEQ ID NO: 692864 - DNA, 25 bp, Mus musculus
gtctgtacctttcattagtgtccca

SEQ ID NO: 692865 - DNA, 25 bp, Mus musculus
gtctgtacctttgattagtgtccca

SEQ ID NO: 692866 - DNA, 25 bp, Mus musculus
gtctgtacgcctagggagatcgtgt

SEQ ID NO: 692867 - DNA, 25 bp, Mus musculus
gtctgtacgccttgggagatcgtgt

SEQ ID NO: 692868 - DNA, 25 bp, Mus musculus
gtctgtacgttgctattaggcccat

SEQ ID NO: 692869 - DNA, 25 bp, Mus musculus
gtctgtacgttggtattaggcccat

SEQ ID NO: 692870 - DNA, 25 bp, Mus musculus
gtctgtactactcaagcacgagcat

SEQ ID NO: 692871 - DNA, 25 bp, Mus musculus
gtctgtactactgaagcacgagcat

SEQ ID NO: 692872 - DNA, 25 bp, Mus musculus
gtctgtacttaaatttggtagcatt

SEQ ID NO: 692873 - DNA, 25 bp, Mus musculus
gtctgtacttaattttggtagcatt

SEQ ID NO: 692874 - DNA, 25 bp, Mus musculus
gtctgtacttgtcttgcttatctta

SEQ ID NO: 692875 - DNA, 25 bp, Mus musculus
gtctgtacttgtgttgcttatctta

SEQ ID NO: 692876 - DNA, 25 bp, Mus musculus
gtctgtagaactagaactgactcta

SEQ ID NO: 692877 - DNA, 25 bp, Mus musculus
gtctgtagaacttgaactgactcta

SEQ ID NO: 692878 - DNA, 25 bp, Mus musculus
gtctgtagaagtagctgttcctagc

SEQ ID NO: 692879 - DNA, 25 bp, Mus musculus
gtctgtagaagttgctgttcctagc

SEQ ID NO: 692880 - DNA, 25 bp, Mus musculus
gtctgtagaatccatgtagaaccaa

SEQ ID NO: 692881 - DNA, 25 bp, Mus musculus
gtctgtagaatcgatgtagaaccaa

SEQ ID NO: 692882 - DNA, 25 bp, Mus musculus
gtctgtagacctacaatcaccaaaa

SEQ ID NO: 692883 - DNA, 25 bp, Mus musculus
gtctgtagaccttcaatcaccaaaa

SEQ ID NO: 692884 - DNA, 25 bp, Mus musculus
gtctgtagagagattccacgttctt

SEQ ID NO: 692885 - DNA, 25 bp, Mus musculus
gtctgtagagagtttccacgttctt

SEQ ID NO: 692886 - DNA, 25 bp, Mus musculus
gtctgtagagttccatccaggttgt

SEQ ID NO: 692887 - DNA, 25 bp, Mus musculus
gtctgtagagttgcatccaggttgt

SEQ ID NO: 692888 - DNA, 25 bp, Mus musculus
gtctgtagcacaagcgtgtcatttt

SEQ ID NO: 692889 - DNA, 25 bp, Mus musculus
gtctgtagcacacgaagctccacct

SEQ ID NO: 692890 - DNA, 25 bp, Mus musculus
gtctgtagcacaggaagctccacct

SEQ ID NO: 692891 - DNA, 25 bp, Mus musculus
gtctgtagcacatgcgtgtcatttt

SEQ ID NO: 692892 - DNA, 25 bp, Mus musculus
gtctgtagcactctctggatgtttc

SEQ ID NO: 692893 - DNA, 25 bp, Mus musculus
gtctgtagcactgtctggatgtttc

SEQ ID NO: 692894 - DNA, 25 bp, Mus musculus
gtctgtagccataacgaaggcggtg

SEQ ID NO: 692895 - DNA, 25 bp, Mus musculus
gtctgtagccattacgaaggcggtg

SEQ ID NO: 692896 - DNA, 25 bp, Mus musculus
gtctgtagctctattgacatatgac

SEQ ID NO: 692897 - DNA, 25 bp, Mus musculus
gtctgtagctcttttgacatatgac

SEQ ID NO: 692898 - DNA, 25 bp, Mus musculus
gtctgtaggctacttttctcagtag

SEQ ID NO: 692899 - DNA, 25 bp, Mus musculus
gtctgtaggctagttttctcagtag

SEQ ID NO: 692900 - DNA, 25 bp, Mus musculus
gtctgtagggtcatgactgttgtct

SEQ ID NO: 692901 - DNA, 25 bp, Mus musculus
gtctgtagggtcttgactgttgtct

SEQ ID NO: 692902 - DNA, 25 bp, Mus musculus
gtctgtaggtgtctgggcttacttc

SEQ ID NO: 692903 - DNA, 25 bp, Mus musculus
gtctgtaggtgtgtgggcttacttc

SEQ ID NO: 692904 - DNA, 25 bp, Mus musculus
gtctgtagtactaattcagtttttg

SEQ ID NO: 692905 - DNA, 25 bp, Mus musculus
gtctgtagtacttattcagtttttg

SEQ ID NO: 692906 - DNA, 25 bp, Mus musculus
gtctgtagtataacccttctgaagt

SEQ ID NO: 692907 - DNA, 25 bp, Mus musculus
gtctgtagtatatcccttctgaagt

SEQ ID NO: 692908 - DNA, 25 bp, Mus musculus
gtctgtagtgagacgcattggccaa

SEQ ID NO: 692909 - DNA, 25 bp, Mus musculus
gtctgtagtgagtcgcattggccaa

SEQ ID NO: 692910 - DNA, 25 bp, Mus musculus
gtctgtataaacagctcctgagctc

SEQ ID NO: 692911 - DNA, 25 bp, Mus musculus
gtctgtataaactgctcctgagctc

SEQ ID NO: 692912 - DNA, 25 bp, Mus musculus
gtctgtatattacttggaattggta

SEQ ID NO: 692913 - DNA, 25 bp, Mus musculus
gtctgtatattagttggaattggta

SEQ ID NO: 692914 - DNA, 25 bp, Mus musculus
gtctgtatattcagttcatccatcg

SEQ ID NO: 692915 - DNA, 25 bp, Mus musculus
gtctgtatattctgttcatccatcg

SEQ ID NO: 692916 - DNA, 25 bp, Mus musculus
gtctgtatccagattactgtactgt

SEQ ID NO: 692917 - DNA, 25 bp, Mus musculus
gtctgtatccagtttactgtactgt

SEQ ID NO: 692918 - DNA, 25 bp, Mus musculus
gtctgtatcgcaagtgtgcctggtg

SEQ ID NO: 692919 - DNA, 25 bp, Mus musculus
gtctgtatcgcatgtgtgcctggtg

SEQ ID NO: 692920 - DNA, 25 bp, Mus musculus
gtctgtatgtacacgtgtcactgaa

SEQ ID NO: 692921 - DNA, 25 bp, Mus musculus
gtctgtatgtactcgtgtcactgaa

SEQ ID NO: 692922 - DNA, 25 bp, Mus musculus
gtctgtatgtgacagttttcctttt

SEQ ID NO: 692923 - DNA, 25 bp, Mus musculus
gtctgtatgtgagagttttcctttt

SEQ ID NO: 692924 - DNA, 25 bp, Mus musculus
gtctgtatgtgcattccagctaatt

SEQ ID NO: 692925 - DNA, 25 bp, Mus musculus
gtctgtatgtgctttccagctaatt

SEQ ID NO: 692926 - DNA, 25 bp, Mus musculus
gtctgtattcccaggacataggctg

SEQ ID NO: 692927 - DNA, 25 bp, Mus musculus
gtctgtattccctggacataggctg

SEQ ID NO: 692928 - DNA, 25 bp, Mus musculus
gtctgtattctgatacaacccaaaa

SEQ ID NO: 692929 - DNA, 25 bp, Mus musculus
gtctgtattctgttacaacccaaaa

SEQ ID NO: 692930 - DNA, 25 bp, Mus musculus
gtctgtattgcaccccatactggac

SEQ ID NO: 692931 - DNA, 25 bp, Mus musculus
gtctgtattgcagcccatactggac

SEQ ID NO: 692932 - DNA, 25 bp, Mus musculus
gtctgtattgtacagagctcctccc

SEQ ID NO: 692933 - DNA, 25 bp, Mus musculus
gtctgtattgtagagagctcctccc

SEQ ID NO: 692934 - DNA, 25 bp, Mus musculus
gtctgtattgttctcagctcacagg

SEQ ID NO: 692935 - DNA, 25 bp, Mus musculus
gtctgtattgttgtcagctcacagg

SEQ ID NO: 692936 - DNA, 25 bp, Mus musculus
gtctgtatttaccttcatgccacag

SEQ ID NO: 692937 - DNA, 25 bp, Mus musculus
gtctgtatttacgttcatgccacag

SEQ ID NO: 692938 - DNA, 25 bp, Mus musculus
gtctgtatttcaatgttgctggcat

SEQ ID NO: 692939 - DNA, 25 bp, Mus musculus
gtctgtatttcattgttgctggcat

SEQ ID NO: 692940 - DNA, 25 bp, Mus musculus
gtctgtatttgactctggcacacat

SEQ ID NO: 692941 - DNA, 25 bp, Mus musculus
gtctgtatttgagtctggcacacat

SEQ ID NO: 692942 - DNA, 25 bp, Mus musculus
gtctgtattttgcttgctttggcta

SEQ ID NO: 692943 - DNA, 25 bp, Mus musculus
gtctgtattttggttgctttggcta

SEQ ID NO: 692944 - DNA, 25 bp, Mus musculus
gtctgtcaaaacaaccatactggtt

SEQ ID NO: 692945 - DNA, 25 bp, Mus musculus
gtctgtcaaaactaccatactggtt

SEQ ID NO: 692946 - DNA, 25 bp, Mus musculus
gtctgtcaacacaaacatagatcat

SEQ ID NO: 692947 - DNA, 25 bp, Mus musculus
gtctgtcaacactaacatagatcat

SEQ ID NO: 692948 - DNA, 25 bp, Mus musculus
gtctgtcaactcaaaattctccaaa

SEQ ID NO: 692949 - DNA, 25 bp, Mus musculus
gtctgtcaactctaaattctccaaa

SEQ ID NO: 692950 - DNA, 25 bp, Mus musculus
gtctgtcaaggactactggaccttc

SEQ ID NO: 692951 - DNA, 25 bp, Mus musculus
gtctgtcaaggagtactggaccttc

SEQ ID NO: 692952 - DNA, 25 bp, Mus musculus
gtctgtcaattgacactggtggtaa

SEQ ID NO: 692953 - DNA, 25 bp, Mus musculus
gtctgtcaattgtcactggtggtaa

SEQ ID NO: 692954 - DNA, 25 bp, Mus musculus
gtctgtcacaacatagcaaatgctg

SEQ ID NO: 692955 - DNA, 25 bp, Mus musculus
gtctgtcacaacttagcaaatgctg

SEQ ID NO: 692956 - DNA, 25 bp, Mus musculus
gtctgtcacaatatgctgttttatc

SEQ ID NO: 692957 - DNA, 25 bp, Mus musculus
gtctgtcacaatttgctgttttatc

SEQ ID NO: 692958 - DNA, 25 bp, Mus musculus
gtctgtcacatgacccaacaggtgg

SEQ ID NO: 692959 - DNA, 25 bp, Mus musculus
gtctgtcacatgctccttagagtta

SEQ ID NO: 692960 - DNA, 25 bp, Mus musculus
gtctgtcacatggtccttagagtta

SEQ ID NO: 692961 - DNA, 25 bp, Mus musculus
gtctgtcacatgtcccaacaggtgg

SEQ ID NO: 692962 - DNA, 25 bp, Mus musculus
gtctgtcacattagtattgacccaa

SEQ ID NO: 692963 - DNA, 25 bp, Mus musculus
gtctgtcacattctaagagcctacc

SEQ ID NO: 692964 - DNA, 25 bp, Mus musculus
gtctgtcacattgtaagagcctacc

SEQ ID NO: 692965 - DNA, 25 bp, Mus musculus
gtctgtcacatttgtattgacccaa

SEQ ID NO: 692966 - DNA, 25 bp, Mus musculus
gtctgtcacctaacctggccgtaga

SEQ ID NO: 692967 - DNA, 25 bp, Mus musculus
gtctgtcacctatcctggccgtaga

SEQ ID NO: 692968 - DNA, 25 bp, Mus musculus
gtctgtcacgtcacaagtagtcatt

SEQ ID NO: 692969 - DNA, 25 bp, Mus musculus
gtctgtcacgtctcaagtagtcatt

SEQ ID NO: 692970 - DNA, 25 bp, Mus musculus
gtctgtcactatagacacacgtgtt

SEQ ID NO: 692971 - DNA, 25 bp, Mus musculus
gtctgtcactattgacacacgtgtt

SEQ ID NO: 692972 - DNA, 25 bp, Mus musculus
gtctgtcacttgaggcctagcacag

SEQ ID NO: 692973 - DNA, 25 bp, Mus musculus
gtctgtcacttgtggcctagcacag

SEQ ID NO: 692974 - DNA, 25 bp, Mus musculus
gtctgtcagaaaagccaagctctag

SEQ ID NO: 692975 - DNA, 25 bp, Mus musculus
gtctgtcagaaatgccaagctctag

SEQ ID NO: 692976 - DNA, 25 bp, Mus musculus
gtctgtcagagtatatttgcttcaa

SEQ ID NO: 692977 - DNA, 25 bp, Mus musculus
gtctgtcagagtttatttgcttcaa

SEQ ID NO: 692978 - DNA, 25 bp, Mus musculus
gtctgtcagcgcactaaggaggatc

SEQ ID NO: 692979 - DNA, 25 bp, Mus musculus
gtctgtcagcgctctaaggaggatc

SEQ ID NO: 692980 - DNA, 25 bp, Mus musculus
gtctgtcaggtaccgaaggcctcgc

SEQ ID NO: 692981 - DNA, 25 bp, Mus musculus
gtctgtcaggtagcgaaggcctcgc

SEQ ID NO: 692982 - DNA, 25 bp, Mus musculus
gtctgtcagtctaggaaatctgtct

SEQ ID NO: 692983 - DNA, 25 bp, Mus musculus
gtctgtcagtcttggaaatctgtct

SEQ ID NO: 692984 - DNA, 25 bp, Mus musculus
gtctgtcatctacctatctagggtg

SEQ ID NO: 692985 - DNA, 25 bp, Mus musculus
gtctgtcatctagctatctagggtg

SEQ ID NO: 692986 - DNA, 25 bp, Mus musculus
gtctgtcatgccaagtttagcttaa

SEQ ID NO: 692987 - DNA, 25 bp, Mus musculus
gtctgtcatgcctagtttagcttaa

SEQ ID NO: 692988 - DNA, 25 bp, Mus musculus
gtctgtcatgtcacttaagttattg

SEQ ID NO: 692989 - DNA, 25 bp, Mus musculus
gtctgtcatgtctcttaagttattg

SEQ ID NO: 692990 - DNA, 25 bp, Mus musculus
gtctgtcattcacctactttgtaga

SEQ ID NO: 692991 - DNA, 25 bp, Mus musculus
gtctgtcattcagctactttgtaga

SEQ ID NO: 692992 - DNA, 25 bp, Mus musculus
gtctgtccacagatgagctcggatg

SEQ ID NO: 692993 - DNA, 25 bp, Mus musculus
gtctgtccacagttgagctcggatg

SEQ ID NO: 692994 - DNA, 25 bp, Mus musculus
gtctgtccactcaagagcaggtata

SEQ ID NO: 692995 - DNA, 25 bp, Mus musculus
gtctgtccactctagagcaggtata

SEQ ID NO: 692996 - DNA, 25 bp, Mus musculus
gtctgtccagaccagcaggtctcaa

SEQ ID NO: 692997 - DNA, 25 bp, Mus musculus
gtctgtccagacgagcaggtctcaa

SEQ ID NO: 692998 - DNA, 25 bp, Mus musculus
gtctgtccagcaaaccgggtggtca

SEQ ID NO: 692999 - DNA, 25 bp, Mus musculus
gtctgtccagcataccgggtggtca

SEQ ID NO: 693000 - DNA, 25 bp, Mus musculus
gtctgtccaggacgtagttcatggt

SEQ ID NO: 693001 - DNA, 25 bp, Mus musculus
gtctgtccaggaggtagttcatggt

SEQ ID NO: 693002 - DNA, 25 bp, Mus musculus
gtctgtccagtaagcaggtaatggt

SEQ ID NO: 693003 - DNA, 25 bp, Mus musculus
gtctgtccagtatgcaggtaatggt

SEQ ID NO: 693004 - DNA, 25 bp, Mus musculus
gtctgtccagttagctcagaaacct

SEQ ID NO: 693005 - DNA, 25 bp, Mus musculus
gtctgtccagtttgctcagaaacct

SEQ ID NO: 693006 - DNA, 25 bp, Mus musculus
gtctgtcccaggcttgactaaaaat

SEQ ID NO: 693007 - DNA, 25 bp, Mus musculus
gtctgtcccagggttgactaaaaat

SEQ ID NO: 693008 - DNA, 25 bp, Mus musculus
gtctgtcccatcacagtttgcaaaa

SEQ ID NO: 693009 - DNA, 25 bp, Mus musculus
gtctgtcccatctcagtttgcaaaa

SEQ ID NO: 693010 - DNA, 25 bp, Mus musculus
gtctgtccccaacatcatctcaaag

SEQ ID NO: 693011 - DNA, 25 bp, Mus musculus
gtctgtccccaagatcatctcaaag

SEQ ID NO: 693012 - DNA, 25 bp, Mus musculus
gtctgtccccagaccttgagaaagg

SEQ ID NO: 693013 - DNA, 25 bp, Mus musculus
gtctgtccccagtccttgagaaagg

SEQ ID NO: 693014 - DNA, 25 bp, Mus musculus
gtctgtcccctactgtatttgtatg

SEQ ID NO: 693015 - DNA, 25 bp, Mus musculus
gtctgtcccctagtgtatttgtatg

SEQ ID NO: 693016 - DNA, 25 bp, Mus musculus
gtctgtccccttagctgataagctg

SEQ ID NO: 693017 - DNA, 25 bp, Mus musculus
gtctgtcccctttgctgataagctg

SEQ ID NO: 693018 - DNA, 25 bp, Mus musculus
gtctgtccctggcaaactacagaaa

SEQ ID NO: 693019 - DNA, 25 bp, Mus musculus
gtctgtccctgggaaactacagaaa

SEQ ID NO: 693020 - DNA, 25 bp, Mus musculus
gtctgtccctgtagttgtgtcttaa

SEQ ID NO: 693021 - DNA, 25 bp, Mus musculus
gtctgtccctgttgttgtgtcttaa

SEQ ID NO: 693022 - DNA, 25 bp, Mus musculus
gtctgtcctactagcccgcgttcat

SEQ ID NO: 693023 - DNA, 25 bp, Mus musculus
gtctgtcctacttgcccgcgttcat

SEQ ID NO: 693024 - DNA, 25 bp, Mus musculus
gtctgtcctatcactcactgggagt

SEQ ID NO: 693025 - DNA, 25 bp, Mus musculus
gtctgtcctatctctcactgggagt

SEQ ID NO: 693026 - DNA, 25 bp, Mus musculus
gtctgtcctgttaatgtccatatga

SEQ ID NO: 693027 - DNA, 25 bp, Mus musculus
gtctgtcctgtttatgtccatatga

SEQ ID NO: 693028 - DNA, 25 bp, Mus musculus
gtctgtcctttgaatgccccgagaa

SEQ ID NO: 693029 - DNA, 25 bp, Mus musculus
gtctgtcctttgaggttacctctgg

SEQ ID NO: 693030 - DNA, 25 bp, Mus musculus
gtctgtcctttgtatgccccgagaa

SEQ ID NO: 693031 - DNA, 25 bp, Mus musculus
gtctgtcctttgtggttacctctgg

SEQ ID NO: 693032 - DNA, 25 bp, Mus musculus
gtctgtccttttccaattacaaaga

SEQ ID NO: 693033 - DNA, 25 bp, Mus musculus
gtctgtccttttgcaattacaaaga

SEQ ID NO: 693034 - DNA, 25 bp, Mus musculus
gtctgtcgtataatccgtttgattc

SEQ ID NO: 693035 - DNA, 25 bp, Mus musculus
gtctgtcgtatattccgtttgattc

SEQ ID NO: 693036 - DNA, 25 bp, Mus musculus
gtctgtcgtgtccagtctggactcc

SEQ ID NO: 693037 - DNA, 25 bp, Mus musculus
gtctgtcgtgtcgagtctggactcc

SEQ ID NO: 693038 - DNA, 25 bp, Mus musculus
gtctgtctaaggcagcttgcctcta

SEQ ID NO: 693039 - DNA, 25 bp, Mus musculus
gtctgtctaagggagcttgcctcta

SEQ ID NO: 693040 - DNA, 25 bp, Mus musculus
gtctgtctacatcaattccaatttg

SEQ ID NO: 693041 - DNA, 25 bp, Mus musculus
gtctgtctacatgaattccaatttg

SEQ ID NO: 693042 - DNA, 25 bp, Mus musculus
gtctgtctactacacactctggttt

SEQ ID NO: 693043 - DNA, 25 bp, Mus musculus
gtctgtctactagacactctggttt

SEQ ID NO: 693044 - DNA, 25 bp, Mus musculus
gtctgtctaggactgtaactggata

SEQ ID NO: 693045 - DNA, 25 bp, Mus musculus
gtctgtctaggagtgtaactggata

SEQ ID NO: 693046 - DNA, 25 bp, Mus musculus
gtctgtctatctcctatggtagctg

SEQ ID NO: 693047 - DNA, 25 bp, Mus musculus
gtctgtctatctctcatttcttcct

SEQ ID NO: 693048 - DNA, 25 bp, Mus musculus
gtctgtctatctgctatggtagctg

SEQ ID NO: 693049 - DNA, 25 bp, Mus musculus
gtctgtctatctgtcatttcttcct

SEQ ID NO: 693050 - DNA, 25 bp, Mus musculus
gtctgtctatgactgtagtcccagt

SEQ ID NO: 693051 - DNA, 25 bp, Mus musculus
gtctgtctatgagtgtagtcccagt

SEQ ID NO: 693052 - DNA, 25 bp, Mus musculus
gtctgtctatgtctgctcacgtttc

SEQ ID NO: 693053 - DNA, 25 bp, Mus musculus
gtctgtctatgtgtgctcacgtttc

SEQ ID NO: 693054 - DNA, 25 bp, Mus musculus
gtctgtctcagacgtagcagttcct

SEQ ID NO: 693055 - DNA, 25 bp, Mus musculus
gtctgtctcagaggtagcagttcct

SEQ ID NO: 693056 - DNA, 25 bp, Mus musculus
gtctgtctcagtagtcttttgctct

SEQ ID NO: 693057 - DNA, 25 bp, Mus musculus
gtctgtctcagttgtcttttgctct

SEQ ID NO: 693058 - DNA, 25 bp, Mus musculus
gtctgtctcccaagtttatattcct

SEQ ID NO: 693059 - DNA, 25 bp, Mus musculus
gtctgtctcccatgtttatattcct

SEQ ID NO: 693060 - DNA, 25 bp, Mus musculus
gtctgtctccgaagaaagttggcga

SEQ ID NO: 693061 - DNA, 25 bp, Mus musculus
gtctgtctccgatgaaagttggcga

SEQ ID NO: 693062 - DNA, 25 bp, Mus musculus
gtctgtctctgcaaatacctctatt

SEQ ID NO: 693063 - DNA, 25 bp, Mus musculus
gtctgtctctgctaatacctctatt

SEQ ID NO: 693064 - DNA, 25 bp, Mus musculus
gtctgtctctgtcgcttcagggaag

SEQ ID NO: 693065 - DNA, 25 bp, Mus musculus
gtctgtctctgtggcttcagggaag

SEQ ID NO: 693066 - DNA, 25 bp, Mus musculus
gtctgtctgagaaaccacctgcgat

SEQ ID NO: 693067 - DNA, 25 bp, Mus musculus
gtctgtctgagataccacctgcgat

SEQ ID NO: 693068 - DNA, 25 bp, Mus musculus
gtctgtctgcctattaaacttgttg

SEQ ID NO: 693069 - DNA, 25 bp, Mus musculus
gtctgtctgccttttaaacttgttg

SEQ ID NO: 693070 - DNA, 25 bp, Mus musculus
gtctgtctgctgagttattgtaaaa

SEQ ID NO: 693071 - DNA, 25 bp, Mus musculus
gtctgtctgctgtgttattgtaaaa

SEQ ID NO: 693072 - DNA, 25 bp, Mus musculus
gtctgtctggcaaagttctatttgt

SEQ ID NO: 693073 - DNA, 25 bp, Mus musculus
gtctgtctggcatagttctatttgt

SEQ ID NO: 693074 - DNA, 25 bp, Mus musculus
gtctgtctgggcatttctgaagttt

SEQ ID NO: 693075 - DNA, 25 bp, Mus musculus
gtctgtctgggcttttctgaagttt

SEQ ID NO: 693076 - DNA, 25 bp, Mus musculus
gtctgtctgtacatggtgaaccgtg

SEQ ID NO: 693077 - DNA, 25 bp, Mus musculus
gtctgtctgtacttggtgaaccgtg

SEQ ID NO: 693078 - DNA, 25 bp, Mus musculus
gtctgtctgtataactagctggcct

SEQ ID NO: 693079 - DNA, 25 bp, Mus musculus
gtctgtctgtatagcagcccatact

SEQ ID NO: 693080 - DNA, 25 bp, Mus musculus
gtctgtctgtattactagctggcct

SEQ ID NO: 693081 - DNA, 25 bp, Mus musculus
gtctgtctgtattgcagcccatact

SEQ ID NO: 693082 - DNA, 25 bp, Mus musculus
gtctgtctgtgaaatccattaccct

SEQ ID NO: 693083 - DNA, 25 bp, Mus musculus
gtctgtctgtgatatccattaccct

SEQ ID NO: 693084 - DNA, 25 bp, Mus musculus
gtctgtctgttaactaggagtcacc

SEQ ID NO: 693085 - DNA, 25 bp, Mus musculus
gtctgtctgttatctaggagtcacc

SEQ ID NO: 693086 - DNA, 25 bp, Mus musculus
gtctgtctgttgacattgttctatg

SEQ ID NO: 693087 - DNA, 25 bp, Mus musculus
gtctgtctgttgtcattgttctatg

SEQ ID NO: 693088 - DNA, 25 bp, Mus musculus
gtctgtcttaagaagctttggccaa

SEQ ID NO: 693089 - DNA, 25 bp, Mus musculus
gtctgtcttaagactgaaatggtac

SEQ ID NO: 693090 - DNA, 25 bp, Mus musculus
gtctgtcttaagtagctttggccaa

SEQ ID NO: 693091 - DNA, 25 bp, Mus musculus
gtctgtcttaagtctgaaatggtac

SEQ ID NO: 693092 - DNA, 25 bp, Mus musculus
gtctgtcttcttacgttttttaatg

SEQ ID NO: 693093 - DNA, 25 bp, Mus musculus
gtctgtcttcttactgagatgctac

SEQ ID NO: 693094 - DNA, 25 bp, Mus musculus
gtctgtcttcttctggaaagtcccc

SEQ ID NO: 693095 - DNA, 25 bp, Mus musculus
gtctgtcttcttgtggaaagtcccc

SEQ ID NO: 693096 - DNA, 25 bp, Mus musculus
gtctgtcttctttcgttttttaatg

SEQ ID NO: 693097 - DNA, 25 bp, Mus musculus
gtctgtcttctttctgagatgctac

SEQ ID NO: 693098 - DNA, 25 bp, Mus musculus
gtctgtcttgaaagtctcagtgtca

SEQ ID NO: 693099 - DNA, 25 bp, Mus musculus
gtctgtcttgaaatcctttagtggc

SEQ ID NO: 693100 - DNA, 25 bp, Mus musculus
gtctgtcttgaatgtctcagtgtca

SEQ ID NO: 693101 - DNA, 25 bp, Mus musculus
gtctgtcttgaattcctttagtggc

SEQ ID NO: 693102 - DNA, 25 bp, Mus musculus
gtctgtcttgatatatgcttctggt

SEQ ID NO: 693103 - DNA, 25 bp, Mus musculus
gtctgtcttgatttatgcttctggt

SEQ ID NO: 693104 - DNA, 25 bp, Mus musculus
gtctgtcttgttcgtgacccagttg

SEQ ID NO: 693105 - DNA, 25 bp, Mus musculus
gtctgtcttgttggtgacccagttg

SEQ ID NO: 693106 - DNA, 25 bp, Mus musculus
gtctgtctttatcgtcctctggaaa

SEQ ID NO: 693107 - DNA, 25 bp, Mus musculus
gtctgtctttatggtcctctggaaa

SEQ ID NO: 693108 - DNA, 25 bp, Mus musculus
gtctgtgaaaaaccccatttggtat

SEQ ID NO: 693109 - DNA, 25 bp, Mus musculus
gtctgtgaaaaagcccatttggtat

SEQ ID NO: 693110 - DNA, 25 bp, Mus musculus
gtctgtgaaactatacgtccgctca

SEQ ID NO: 693111 - DNA, 25 bp, Mus musculus
gtctgtgaaactttacgtccgctca

SEQ ID NO: 693112 - DNA, 25 bp, Mus musculus
gtctgtgaagagaccacggctgctg

SEQ ID NO: 693113 - DNA, 25 bp, Mus musculus
gtctgtgaagagtccacggctgctg

SEQ ID NO: 693114 - DNA, 25 bp, Mus musculus
gtctgtgaatgcacacttcgagtga

SEQ ID NO: 693115 - DNA, 25 bp, Mus musculus
gtctgtgaatgctcacttcgagtga

SEQ ID NO: 693116 - DNA, 25 bp, Mus musculus
gtctgtgacaagctcttccatatcc

SEQ ID NO: 693117 - DNA, 25 bp, Mus musculus
gtctgtgacaaggtcttccatatcc

SEQ ID NO: 693118 - DNA, 25 bp, Mus musculus
gtctgtgacagcctcctgtgggcta

SEQ ID NO: 693119 - DNA, 25 bp, Mus musculus
gtctgtgacagcgtcctgtgggcta

SEQ ID NO: 693120 - DNA, 25 bp, Mus musculus
gtctgtgacagtccgtttgtataaa

SEQ ID NO: 693121 - DNA, 25 bp, Mus musculus
gtctgtgacagtgcgtttgtataaa

SEQ ID NO: 693122 - DNA, 25 bp, Mus musculus
gtctgtgacatccttggatactaac

SEQ ID NO: 693123 - DNA, 25 bp, Mus musculus
gtctgtgacatcgttggatactaac

SEQ ID NO: 693124 - DNA, 25 bp, Mus musculus
gtctgtgaccctcatttcagtcaga

SEQ ID NO: 693125 - DNA, 25 bp, Mus musculus
gtctgtgaccctgatttcagtcaga

SEQ ID NO: 693126 - DNA, 25 bp, Mus musculus
gtctgtgacctaatctctaacatag

SEQ ID NO: 693127 - DNA, 25 bp, Mus musculus
gtctgtgacctattctctaacatag

SEQ ID NO: 693128 - DNA, 25 bp, Mus musculus
gtctgtgacctcctttgaaattaac

SEQ ID NO: 693129 - DNA, 25 bp, Mus musculus
gtctgtgacctcgtttgaaattaac

SEQ ID NO: 693130 - DNA, 25 bp, Mus musculus
gtctgtgacttaatgtaactgttat

SEQ ID NO: 693131 - DNA, 25 bp, Mus musculus
gtctgtgacttacctatgtttctga

SEQ ID NO: 693132 - DNA, 25 bp, Mus musculus
gtctgtgacttagctatgtttctga

SEQ ID NO: 693133 - DNA, 25 bp, Mus musculus
gtctgtgacttattgtaactgttat

SEQ ID NO: 693134 - DNA, 25 bp, Mus musculus
gtctgtgagagaaaccccggtgctt

SEQ ID NO: 693135 - DNA, 25 bp, Mus musculus
gtctgtgagagataccccggtgctt

SEQ ID NO: 693136 - DNA, 25 bp, Mus musculus
gtctgtgagatgatttcaagcttat

SEQ ID NO: 693137 - DNA, 25 bp, Mus musculus
gtctgtgagatgttttcaagcttat

SEQ ID NO: 693138 - DNA, 25 bp, Mus musculus
gtctgtgagcacacaggtgggtcca

SEQ ID NO: 693139 - DNA, 25 bp, Mus musculus
gtctgtgagcacatccgtaattcat

SEQ ID NO: 693140 - DNA, 25 bp, Mus musculus
gtctgtgagcactcaggtgggtcca

SEQ ID NO: 693141 - DNA, 25 bp, Mus musculus
gtctgtgagcacttccgtaattcat

SEQ ID NO: 693142 - DNA, 25 bp, Mus musculus
gtctgtgagctgagcatacctggtg

SEQ ID NO: 693143 - DNA, 25 bp, Mus musculus
gtctgtgagctgtgcatacctggtg

SEQ ID NO: 693144 - DNA, 25 bp, Mus musculus
gtctgtgaggagagagcatttttca

SEQ ID NO: 693145 - DNA, 25 bp, Mus musculus
gtctgtgaggagtgagcatttttca

SEQ ID NO: 693146 - DNA, 25 bp, Mus musculus
gtctgtgaggcaatcgatgcaacta

SEQ ID NO: 693147 - DNA, 25 bp, Mus musculus
gtctgtgaggcattcgatgcaacta

SEQ ID NO: 693148 - DNA, 25 bp, Mus musculus
gtctgtgaggtactgccggcaatat

SEQ ID NO: 693149 - DNA, 25 bp, Mus musculus
gtctgtgaggtagtgccggcaatat

SEQ ID NO: 693150 - DNA, 25 bp, Mus musculus
gtctgtgataagctattactctgga

SEQ ID NO: 693151 - DNA, 25 bp, Mus musculus
gtctgtgataaggtattactctgga

SEQ ID NO: 693152 - DNA, 25 bp, Mus musculus
gtctgtgataatccctgatgcctcc

SEQ ID NO: 693153 - DNA, 25 bp, Mus musculus
gtctgtgataatgcctgatgcctcc

SEQ ID NO: 693154 - DNA, 25 bp, Mus musculus
gtctgtgatacacttgataccctgt

SEQ ID NO: 693155 - DNA, 25 bp, Mus musculus
gtctgtgatacagttgataccctgt

SEQ ID NO: 693156 - DNA, 25 bp, Mus musculus
gtctgtgatgttaccgctgcaagaa

SEQ ID NO: 693157 - DNA, 25 bp, Mus musculus
gtctgtgatgttaggcagtcattat

SEQ ID NO: 693158 - DNA, 25 bp, Mus musculus
gtctgtgatgttccttagcaaccaa

SEQ ID NO: 693159 - DNA, 25 bp, Mus musculus
gtctgtgatgttgcttagcaaccaa

SEQ ID NO: 693160 - DNA, 25 bp, Mus musculus
gtctgtgatgtttccgctgcaagaa

SEQ ID NO: 693161 - DNA, 25 bp, Mus musculus
gtctgtgatgtttggcagtcattat

SEQ ID NO: 693162 - DNA, 25 bp, Mus musculus
gtctgtgcaaacaacaacatacgtt

SEQ ID NO: 693163 - DNA, 25 bp, Mus musculus
gtctgtgcaaactacaacatacgtt

SEQ ID NO: 693164 - DNA, 25 bp, Mus musculus
gtctgtgcaaccaggtctcctacgg

SEQ ID NO: 693165 - DNA, 25 bp, Mus musculus
gtctgtgcaacctggtctcctacgg

SEQ ID NO: 693166 - DNA, 25 bp, Mus musculus
gtctgtgcaagtaaacatataatac

SEQ ID NO: 693167 - DNA, 25 bp, Mus musculus
gtctgtgcaagttaacatataatac

SEQ ID NO: 693168 - DNA, 25 bp, Mus musculus
gtctgtgccaagacttattgtatct

SEQ ID NO: 693169 - DNA, 25 bp, Mus musculus
gtctgtgccaagtcttattgtatct

SEQ ID NO: 693170 - DNA, 25 bp, Mus musculus
gtctgtgccagaattgcacctgcgg

SEQ ID NO: 693171 - DNA, 25 bp, Mus musculus
gtctgtgccagatttgcacctgcgg

SEQ ID NO: 693172 - DNA, 25 bp, Mus musculus
gtctgtgcctgaactcccaatggat

SEQ ID NO: 693173 - DNA, 25 bp, Mus musculus
gtctgtgcctgatctcccaatggat

SEQ ID NO: 693174 - DNA, 25 bp, Mus musculus
gtctgtgcctgcagacaccagaaaa

SEQ ID NO: 693175 - DNA, 25 bp, Mus musculus
gtctgtgcctgctgacaccagaaaa

SEQ ID NO: 693176 - DNA, 25 bp, Mus musculus
gtctgtgcggtcagtttggcgccaa

SEQ ID NO: 693177 - DNA, 25 bp, Mus musculus
gtctgtgcggtctgtttggcgccaa

SEQ ID NO: 693178 - DNA, 25 bp, Mus musculus
gtctgtgctagcaagacacctgtat

SEQ ID NO: 693179 - DNA, 25 bp, Mus musculus
gtctgtgctagctagacacctgtat

SEQ ID NO: 693180 - DNA, 25 bp, Mus musculus
gtctgtgctcagctatggacttcca

SEQ ID NO: 693181 - DNA, 25 bp, Mus musculus
gtctgtgctcaggtatggacttcca

SEQ ID NO: 693182 - DNA, 25 bp, Mus musculus
gtctgtgctcatcagagcgatgctt

SEQ ID NO: 693183 - DNA, 25 bp, Mus musculus
gtctgtgctcatgagagcgatgctt

SEQ ID NO: 693184 - DNA, 25 bp, Mus musculus
gtctgtgctgacaagtttcttatgt

SEQ ID NO: 693185 - DNA, 25 bp, Mus musculus
gtctgtgctgactagtttcttatgt

SEQ ID NO: 693186 - DNA, 25 bp, Mus musculus
gtctgtgctgatctcttgctgctca

SEQ ID NO: 693187 - DNA, 25 bp, Mus musculus
gtctgtgctgatgtcttgctgctca

SEQ ID NO: 693188 - DNA, 25 bp, Mus musculus
gtctgtgctggcatcctagagggag

SEQ ID NO: 693189 - DNA, 25 bp, Mus musculus
gtctgtgctggcatctgaacccagg

SEQ ID NO: 693190 - DNA, 25 bp, Mus musculus
gtctgtgctggcttcctagagggag

SEQ ID NO: 693191 - DNA, 25 bp, Mus musculus
gtctgtgctggcttctgaacccagg

SEQ ID NO: 693192 - DNA, 25 bp, Mus musculus
gtctgtgctgggaaaggtgttccta

SEQ ID NO: 693193 - DNA, 25 bp, Mus musculus
gtctgtgctgggtaaggtgttccta

SEQ ID NO: 693194 - DNA, 25 bp, Mus musculus
gtctgtgctgtaaccttgcatcaaa

SEQ ID NO: 693195 - DNA, 25 bp, Mus musculus
gtctgtgctgtactcaacttttcaa

SEQ ID NO: 693196 - DNA, 25 bp, Mus musculus
gtctgtgctgtagtcaacttttcaa

SEQ ID NO: 693197 - DNA, 25 bp, Mus musculus
gtctgtgctgtatccttgcatcaaa

SEQ ID NO: 693198 - DNA, 25 bp, Mus musculus
gtctgtgcttagaaggtggcgttct

SEQ ID NO: 693199 - DNA, 25 bp, Mus musculus
gtctgtgcttagcatacaccttcgc

SEQ ID NO: 693200 - DNA, 25 bp, Mus musculus
gtctgtgcttaggatacaccttcgc

SEQ ID NO: 693201 - DNA, 25 bp, Mus musculus
gtctgtgcttagtaggtggcgttct

SEQ ID NO: 693202 - DNA, 25 bp, Mus musculus
gtctgtgcttttaatgactacgaca

SEQ ID NO: 693203 - DNA, 25 bp, Mus musculus
gtctgtgctttttatgactacgaca

SEQ ID NO: 693204 - DNA, 25 bp, Mus musculus
gtctgtggacgaagctgcactacat

SEQ ID NO: 693205 - DNA, 25 bp, Mus musculus
gtctgtggacgatgctgcactacat

SEQ ID NO: 693206 - DNA, 25 bp, Mus musculus
gtctgtggagaaaactgagctagct

SEQ ID NO: 693207 - DNA, 25 bp, Mus musculus
gtctgtggagaacatttaccttcct

SEQ ID NO: 693208 - DNA, 25 bp, Mus musculus
gtctgtggagaagatttaccttcct

SEQ ID NO: 693209 - DNA, 25 bp, Mus musculus
gtctgtggagaatactgagctagct

SEQ ID NO: 693210 - DNA, 25 bp, Mus musculus
gtctgtggagccaggtactgacctg

SEQ ID NO: 693211 - DNA, 25 bp, Mus musculus
gtctgtggagcctggtactgacctg

SEQ ID NO: 693212 - DNA, 25 bp, Mus musculus
gtctgtggagtcctcatcctctgag

SEQ ID NO: 693213 - DNA, 25 bp, Mus musculus
gtctgtggagtcgtcatcctctgag

SEQ ID NO: 693214 - DNA, 25 bp, Mus musculus
gtctgtggcacactgacataaacca

SEQ ID NO: 693215 - DNA, 25 bp, Mus musculus
gtctgtggcacagtgacataaacca

SEQ ID NO: 693216 - DNA, 25 bp, Mus musculus
gtctgtggcacgaggcttttgatac

SEQ ID NO: 693217 - DNA, 25 bp, Mus musculus
gtctgtggcacgtggcttttgatac

SEQ ID NO: 693218 - DNA, 25 bp, Mus musculus
gtctgtggcaggagctttccgtaaa

SEQ ID NO: 693219 - DNA, 25 bp, Mus musculus
gtctgtggcaggtgctttccgtaaa

SEQ ID NO: 693220 - DNA, 25 bp, Mus musculus
gtctgtggccatacgattgctgaaa

SEQ ID NO: 693221 - DNA, 25 bp, Mus musculus
gtctgtggccattcgattgctgaaa

SEQ ID NO: 693222 - DNA, 25 bp, Mus musculus
gtctgtggcccaagaagaaacattg

SEQ ID NO: 693223 - DNA, 25 bp, Mus musculus
gtctgtggcccatgaagaaacattg

SEQ ID NO: 693224 - DNA, 25 bp, Mus musculus
gtctgtggccccaagtaggtgatag

SEQ ID NO: 693225 - DNA, 25 bp, Mus musculus
gtctgtggcccctagtaggtgatag

SEQ ID NO: 693226 - DNA, 25 bp, Mus musculus
gtctgtggcctccagcatcaaaggg

SEQ ID NO: 693227 - DNA, 25 bp, Mus musculus
gtctgtggcctcgagcatcaaaggg

SEQ ID NO: 693228 - DNA, 25 bp, Mus musculus
gtctgtggcctgagaaatgtccttt

SEQ ID NO: 693229 - DNA, 25 bp, Mus musculus
gtctgtggcctgtgaaatgtccttt

SEQ ID NO: 693230 - DNA, 25 bp, Mus musculus
gtctgtggctagatttgtgctacaa

SEQ ID NO: 693231 - DNA, 25 bp, Mus musculus
gtctgtggctagttttgtgctacaa

SEQ ID NO: 693232 - DNA, 25 bp, Mus musculus
gtctgtggctctcatttgcctcctc

SEQ ID NO: 693233 - DNA, 25 bp, Mus musculus
gtctgtggctctgatttgcctcctc

SEQ ID NO: 693234 - DNA, 25 bp, Mus musculus
gtctgtgggataattccttgattga

SEQ ID NO: 693235 - DNA, 25 bp, Mus musculus
gtctgtgggatatttccttgattga

SEQ ID NO: 693236 - DNA, 25 bp, Mus musculus
gtctgtgggattccagtctgcgtac

SEQ ID NO: 693237 - DNA, 25 bp, Mus musculus
gtctgtgggattgcagtctgcgtac

SEQ ID NO: 693238 - DNA, 25 bp, Mus musculus
gtctgtggtagaattcaagttactg

SEQ ID NO: 693239 - DNA, 25 bp, Mus musculus
gtctgtggtagatttcaagttactg

SEQ ID NO: 693240 - DNA, 25 bp, Mus musculus
gtctgtggtataaacatgtgcgtgt

SEQ ID NO: 693241 - DNA, 25 bp, Mus musculus
gtctgtggtatatacatgtgcgtgt

SEQ ID NO: 693242 - DNA, 25 bp, Mus musculus
gtctgtggtcaaagggactccctat

SEQ ID NO: 693243 - DNA, 25 bp, Mus musculus
gtctgtggtcaactggcttttaggt

SEQ ID NO: 693244 - DNA, 25 bp, Mus musculus
gtctgtggtcaagtggcttttaggt

SEQ ID NO: 693245 - DNA, 25 bp, Mus musculus
gtctgtggtcaatgggactccctat

SEQ ID NO: 693246 - DNA, 25 bp, Mus musculus
gtctgtggtcatatataaaagtccc

SEQ ID NO: 693247 - DNA, 25 bp, Mus musculus
gtctgtggtcatttataaaagtccc

SEQ ID NO: 693248 - DNA, 25 bp, Mus musculus
gtctgtggtcgaacctgctgtgact

SEQ ID NO: 693249 - DNA, 25 bp, Mus musculus
gtctgtggtcgatcctgctgtgact

SEQ ID NO: 693250 - DNA, 25 bp, Mus musculus
gtctgtggtgtaaggacaactcaaa

SEQ ID NO: 693251 - DNA, 25 bp, Mus musculus
gtctgtggtgtatggacaactcaaa

SEQ ID NO: 693252 - DNA, 25 bp, Mus musculus
gtctgtggttccaaagtaaactcat

SEQ ID NO: 693253 - DNA, 25 bp, Mus musculus
gtctgtggttcctaagtaaactcat

SEQ ID NO: 693254 - DNA, 25 bp, Mus musculus
gtctgtggtttaattattcctccta

SEQ ID NO: 693255 - DNA, 25 bp, Mus musculus
gtctgtggtttatttattcctccta

SEQ ID NO: 693256 - DNA, 25 bp, Mus musculus
gtctgtgtaaatctctcataaaatt

SEQ ID NO: 693257 - DNA, 25 bp, Mus musculus
gtctgtgtaaatgtctcataaaatt

SEQ ID NO: 693258 - DNA, 25 bp, Mus musculus
gtctgtgtacagcttgtctttgcac

SEQ ID NO: 693259 - DNA, 25 bp, Mus musculus
gtctgtgtacaggttgtctttgcac

SEQ ID NO: 693260 - DNA, 25 bp, Mus musculus
gtctgtgtagaacctgtccgtggca

SEQ ID NO: 693261 - DNA, 25 bp, Mus musculus
gtctgtgtagaagctgtccgtggca

SEQ ID NO: 693262 - DNA, 25 bp, Mus musculus
gtctgtgtagagcttcatctggtgc

SEQ ID NO: 693263 - DNA, 25 bp, Mus musculus
gtctgtgtagaggttcatctggtgc

SEQ ID NO: 693264 - DNA, 25 bp, Mus musculus
gtctgtgtagatcaaacctcctgct

SEQ ID NO: 693265 - DNA, 25 bp, Mus musculus
gtctgtgtagatgaaacctcctgct

SEQ ID NO: 693266 - DNA, 25 bp, Mus musculus
gtctgtgtagtaatacccactgtga

SEQ ID NO: 693267 - DNA, 25 bp, Mus musculus
gtctgtgtagtattacccactgtga

SEQ ID NO: 693268 - DNA, 25 bp, Mus musculus
gtctgtgtcactcttaaactgctct

SEQ ID NO: 693269 - DNA, 25 bp, Mus musculus
gtctgtgtcactgttaaactgctct

SEQ ID NO: 693270 - DNA, 25 bp, Mus musculus
gtctgtgtccagcaaactgaaccaa

SEQ ID NO: 693271 - DNA, 25 bp, Mus musculus
gtctgtgtccagcaacttctgtttt

SEQ ID NO: 693272 - DNA, 25 bp, Mus musculus
gtctgtgtccaggaaactgaaccaa

SEQ ID NO: 693273 - DNA, 25 bp, Mus musculus
gtctgtgtccaggaacttctgtttt

SEQ ID NO: 693274 - DNA, 25 bp, Mus musculus
gtctgtgtcctgcttcctaaggaag

SEQ ID NO: 693275 - DNA, 25 bp, Mus musculus
gtctgtgtcctggttcctaaggaag

SEQ ID NO: 693276 - DNA, 25 bp, Mus musculus
gtctgtgtccttacttgaactgtct

SEQ ID NO: 693277 - DNA, 25 bp, Mus musculus
gtctgtgtcctttcttgaactgtct

SEQ ID NO: 693278 - DNA, 25 bp, Mus musculus
gtctgtgtcgccatcttgtaaatgt

SEQ ID NO: 693279 - DNA, 25 bp, Mus musculus
gtctgtgtcgccttcttgtaaatgt

SEQ ID NO: 693280 - DNA, 25 bp, Mus musculus
gtctgtgtcgttatcagtttgtgta

SEQ ID NO: 693281 - DNA, 25 bp, Mus musculus
gtctgtgtcgttttcagtttgtgta

SEQ ID NO: 693282 - DNA, 25 bp, Mus musculus
gtctgtgtctgcaggtgagggatga

SEQ ID NO: 693283 - DNA, 25 bp, Mus musculus
gtctgtgtctgctggtgagggatga

SEQ ID NO: 693284 - DNA, 25 bp, Mus musculus
gtctgtgtctgtcaattgtaaacca

SEQ ID NO: 693285 - DNA, 25 bp, Mus musculus
gtctgtgtctgtgaattgtaaacca

SEQ ID NO: 693286 - DNA, 25 bp, Mus musculus
gtctgtgtctttcggaccattggca

SEQ ID NO: 693287 - DNA, 25 bp, Mus musculus
gtctgtgtctttgggaccattggca

SEQ ID NO: 693288 - DNA, 25 bp, Mus musculus
gtctgtgtgactaaggattctcctc

SEQ ID NO: 693289 - DNA, 25 bp, Mus musculus
gtctgtgtgacttaggattctcctc

SEQ ID NO: 693290 - DNA, 25 bp, Mus musculus
gtctgtgtgaggatgttggatctcc

SEQ ID NO: 693291 - DNA, 25 bp, Mus musculus
gtctgtgtgaggttgttggatctcc

SEQ ID NO: 693292 - DNA, 25 bp, Mus musculus
gtctgtgtgcacattgcctctgagg

SEQ ID NO: 693293 - DNA, 25 bp, Mus musculus
gtctgtgtgcactttgcctctgagg

SEQ ID NO: 693294 - DNA, 25 bp, Mus musculus
gtctgtgtgccgcagacagaacgaa

SEQ ID NO: 693295 - DNA, 25 bp, Mus musculus
gtctgtgtgccggagacagaacgaa

SEQ ID NO: 693296 - DNA, 25 bp, Mus musculus
gtctgtgtgcctataggaagagcct

SEQ ID NO: 693297 - DNA, 25 bp, Mus musculus
gtctgtgtgcctttaggaagagcct

SEQ ID NO: 693298 - DNA, 25 bp, Mus musculus
gtctgtgtgctcatagggtaatgct

SEQ ID NO: 693299 - DNA, 25 bp, Mus musculus
gtctgtgtgctcttagggtaatgct

SEQ ID NO: 693300 - DNA, 25 bp, Mus musculus
gtctgtgtggctaatttcttagtgg

SEQ ID NO: 693301 - DNA, 25 bp, Mus musculus
gtctgtgtggcttatttcttagtgg

SEQ ID NO: 693302 - DNA, 25 bp, Mus musculus
gtctgtgtgggaatggtagtctctc

SEQ ID NO: 693303 - DNA, 25 bp, Mus musculus
gtctgtgtgggattggtagtctctc

SEQ ID NO: 693304 - DNA, 25 bp, Mus musculus
gtctgtgtggtcaggcttaaacaca

SEQ ID NO: 693305 - DNA, 25 bp, Mus musculus
gtctgtgtggtctggcttaaacaca

SEQ ID NO: 693306 - DNA, 25 bp, Mus musculus
gtctgtgtgtacagtagcatctacc

SEQ ID NO: 693307 - DNA, 25 bp, Mus musculus
gtctgtgtgtaccagctgcttgcac

SEQ ID NO: 693308 - DNA, 25 bp, Mus musculus
gtctgtgtgtacgagctgcttgcac

SEQ ID NO: 693309 - DNA, 25 bp, Mus musculus
gtctgtgtgtactgtagcatctacc

SEQ ID NO: 693310 - DNA, 25 bp, Mus musculus
gtctgtgtgtcaagatcggagcttc

SEQ ID NO: 693311 - DNA, 25 bp, Mus musculus
gtctgtgtgtcatgatcggagcttc

SEQ ID NO: 693312 - DNA, 25 bp, Mus musculus
gtctgtgtgtctcgaccgatgtgta

SEQ ID NO: 693313 - DNA, 25 bp, Mus musculus
gtctgtgtgtctggaccgatgtgta

SEQ ID NO: 693314 - DNA, 25 bp, Mus musculus
gtctgtgtgtggctcgtgccccaca

SEQ ID NO: 693315 - DNA, 25 bp, Mus musculus
gtctgtgtgtgggtcgtgccccaca

SEQ ID NO: 693316 - DNA, 25 bp, Mus musculus
gtctgtgtgtgtctaacactaccat

SEQ ID NO: 693317 - DNA, 25 bp, Mus musculus
gtctgtgtgtgtgtaacactaccat

SEQ ID NO: 693318 - DNA, 25 bp, Mus musculus
gtctgtgtgttgactcaggtcagat

SEQ ID NO: 693319 - DNA, 25 bp, Mus musculus
gtctgtgtgttgtctcaggtcagat

SEQ ID NO: 693320 - DNA, 25 bp, Mus musculus
gtctgtgttaatccggtgctggcaa

SEQ ID NO: 693321 - DNA, 25 bp, Mus musculus
gtctgtgttaatgcggtgctggcaa

SEQ ID NO: 693322 - DNA, 25 bp, Mus musculus
gtctgtgttatgactgctctgatga

SEQ ID NO: 693323 - DNA, 25 bp, Mus musculus
gtctgtgttatgtctgctctgatga

SEQ ID NO: 693324 - DNA, 25 bp, Mus musculus
gtctgtgttcaactacctcatgggc

SEQ ID NO: 693325 - DNA, 25 bp, Mus musculus
gtctgtgttcaagtacctcatgggc

SEQ ID NO: 693326 - DNA, 25 bp, Mus musculus
gtctgtgttgtcattgtctactgcc

SEQ ID NO: 693327 - DNA, 25 bp, Mus musculus
gtctgtgttgtctttgtctactgcc

SEQ ID NO: 693328 - DNA, 25 bp, Mus musculus
gtctgtgtttccacgcgtgctttga

SEQ ID NO: 693329 - DNA, 25 bp, Mus musculus
gtctgtgtttcctcgcgtgctttga

SEQ ID NO: 693330 - DNA, 25 bp, Mus musculus
gtctgtgtttgccaatacataccca

SEQ ID NO: 693331 - DNA, 25 bp, Mus musculus
gtctgtgtttgcgaatacataccca

SEQ ID NO: 693332 - DNA, 25 bp, Mus musculus
gtctgttaacacactgccttctgag

SEQ ID NO: 693333 - DNA, 25 bp, Mus musculus
gtctgttaacactctgccttctgag

SEQ ID NO: 693334 - DNA, 25 bp, Mus musculus
gtctgttaactgagtctgctttgta

SEQ ID NO: 693335 - DNA, 25 bp, Mus musculus
gtctgttaactgtgtctgctttgta

SEQ ID NO: 693336 - DNA, 25 bp, Mus musculus
gtctgttaagtcaggatgcttttca

SEQ ID NO: 693337 - DNA, 25 bp, Mus musculus
gtctgttaagtctggatgcttttca

SEQ ID NO: 693338 - DNA, 25 bp, Mus musculus
gtctgttaattcaggatttgtcggg

SEQ ID NO: 693339 - DNA, 25 bp, Mus musculus
gtctgttaattctggatttgtcggg

SEQ ID NO: 693340 - DNA, 25 bp, Mus musculus
gtctgttacaggagagccttgttaa

SEQ ID NO: 693341 - DNA, 25 bp, Mus musculus
gtctgttacaggtgagccttgttaa

SEQ ID NO: 693342 - DNA, 25 bp, Mus musculus
gtctgttacattcttggtacttcag

SEQ ID NO: 693343 - DNA, 25 bp, Mus musculus
gtctgttacattgttggtacttcag

SEQ ID NO: 693344 - DNA, 25 bp, Mus musculus
gtctgttactgaagtgtgggtccaa

SEQ ID NO: 693345 - DNA, 25 bp, Mus musculus
gtctgttactgatgtgtgggtccaa

SEQ ID NO: 693346 - DNA, 25 bp, Mus musculus
gtctgttagcatatgaagtcacctt

SEQ ID NO: 693347 - DNA, 25 bp, Mus musculus
gtctgttagcatatgggttgtctct

SEQ ID NO: 693348 - DNA, 25 bp, Mus musculus
gtctgttagcatttgaagtcacctt

SEQ ID NO: 693349 - DNA, 25 bp, Mus musculus
gtctgttagcatttgggttgtctct

SEQ ID NO: 693350 - DNA, 25 bp, Mus musculus
gtctgttagccaaacagtctgttat

SEQ ID NO: 693351 - DNA, 25 bp, Mus musculus
gtctgttagccatacagtctgttat

SEQ ID NO: 693352 - DNA, 25 bp, Mus musculus
gtctgttaggttagttttctcttca

SEQ ID NO: 693353 - DNA, 25 bp, Mus musculus
gtctgttaggtttgttttctcttca

SEQ ID NO: 693354 - DNA, 25 bp, Mus musculus
gtctgttagttacctggatatttta

SEQ ID NO: 693355 - DNA, 25 bp, Mus musculus
gtctgttagttagctggatatttta

SEQ ID NO: 693356 - DNA, 25 bp, Mus musculus
gtctgttatatgatctctgctctga

SEQ ID NO: 693357 - DNA, 25 bp, Mus musculus
gtctgttatatgttctctgctctga

SEQ ID NO: 693358 - DNA, 25 bp, Mus musculus
gtctgttatcttacatcctcattca

SEQ ID NO: 693359 - DNA, 25 bp, Mus musculus
gtctgttatctttcatcctcattca

SEQ ID NO: 693360 - DNA, 25 bp, Mus musculus
gtctgttatgtgcacgtactctcct

SEQ ID NO: 693361 - DNA, 25 bp, Mus musculus
gtctgttatgtggacgtactctcct

SEQ ID NO: 693362 - DNA, 25 bp, Mus musculus
gtctgttattaccagcctttagctg

SEQ ID NO: 693363 - DNA, 25 bp, Mus musculus
gtctgttattacgagcctttagctg

SEQ ID NO: 693364 - DNA, 25 bp, Mus musculus
gtctgttcaagacattgtgtttaaa

SEQ ID NO: 693365 - DNA, 25 bp, Mus musculus
gtctgttcaagagattgtgtttaaa

SEQ ID NO: 693366 - DNA, 25 bp, Mus musculus
gtctgttcacaaactcaagtaatat

SEQ ID NO: 693367 - DNA, 25 bp, Mus musculus
gtctgttcacaatctcaagtaatat

SEQ ID NO: 693368 - DNA, 25 bp, Mus musculus
gtctgttcacagcattaaaacgtta

SEQ ID NO: 693369 - DNA, 25 bp, Mus musculus
gtctgttcacaggattaaaacgtta

SEQ ID NO: 693370 - DNA, 25 bp, Mus musculus
gtctgttcagctcttctactgagag

SEQ ID NO: 693371 - DNA, 25 bp, Mus musculus
gtctgttcagctgttctactgagag

SEQ ID NO: 693372 - DNA, 25 bp, Mus musculus
gtctgttcaggcccactgaagaagt

SEQ ID NO: 693373 - DNA, 25 bp, Mus musculus
gtctgttcaggcgcactgaagaagt

SEQ ID NO: 693374 - DNA, 25 bp, Mus musculus
gtctgttcatgtaagctaagcggct

SEQ ID NO: 693375 - DNA, 25 bp, Mus musculus
gtctgttcatgttagctaagcggct

SEQ ID NO: 693376 - DNA, 25 bp, Mus musculus
gtctgttccatcacttaacacttac

SEQ ID NO: 693377 - DNA, 25 bp, Mus musculus
gtctgttccatctcttaacacttac

SEQ ID NO: 693378 - DNA, 25 bp, Mus musculus
gtctgttcccagctaaaggattctt

SEQ ID NO: 693379 - DNA, 25 bp, Mus musculus
gtctgttcccaggtaaaggattctt

SEQ ID NO: 693380 - DNA, 25 bp, Mus musculus
gtctgttccctaaaatgggttatga

SEQ ID NO: 693381 - DNA, 25 bp, Mus musculus
gtctgttccctataatgggttatga

SEQ ID NO: 693382 - DNA, 25 bp, Mus musculus
gtctgttccgatatcacctgagtgc

SEQ ID NO: 693383 - DNA, 25 bp, Mus musculus
gtctgttccgatttcacctgagtgc

SEQ ID NO: 693384 - DNA, 25 bp, Mus musculus
gtctgttccgtgatcgtgtgtctcg

SEQ ID NO: 693385 - DNA, 25 bp, Mus musculus
gtctgttccgtgttcgtgtgtctcg

SEQ ID NO: 693386 - DNA, 25 bp, Mus musculus
gtctgttcctacaattcattctctt

SEQ ID NO: 693387 - DNA, 25 bp, Mus musculus
gtctgttcctactattcattctctt

SEQ ID NO: 693388 - DNA, 25 bp, Mus musculus
gtctgttcctcaagagtgcctggtc

SEQ ID NO: 693389 - DNA, 25 bp, Mus musculus
gtctgttcctcatgagtgcctggtc

SEQ ID NO: 693390 - DNA, 25 bp, Mus musculus
gtctgttcctttatggagcccttag

SEQ ID NO: 693391 - DNA, 25 bp, Mus musculus
gtctgttcctttttggagcccttag

SEQ ID NO: 693392 - DNA, 25 bp, Mus musculus
gtctgttctaagctatgttgctata

SEQ ID NO: 693393 - DNA, 25 bp, Mus musculus
gtctgttctaaggtatgttgctata

SEQ ID NO: 693394 - DNA, 25 bp, Mus musculus
gtctgttctagaccgtacaaccgta

SEQ ID NO: 693395 - DNA, 25 bp, Mus musculus
gtctgttctagagcgtacaaccgta

SEQ ID NO: 693396 - DNA, 25 bp, Mus musculus
gtctgttctatcacctcgtggcggg

SEQ ID NO: 693397 - DNA, 25 bp, Mus musculus
gtctgttctatctcctcgtggcggg

SEQ ID NO: 693398 - DNA, 25 bp, Mus musculus
gtctgttgaatgaatgttgaaccca

SEQ ID NO: 693399 - DNA, 25 bp, Mus musculus
gtctgttgaatgtatgttgaaccca

SEQ ID NO: 693400 - DNA, 25 bp, Mus musculus
gtctgttgacagattcagcatgact

SEQ ID NO: 693401 - DNA, 25 bp, Mus musculus
gtctgttgacagtttcagcatgact

SEQ ID NO: 693402 - DNA, 25 bp, Mus musculus
gtctgttgagatcacacctctgtgc

SEQ ID NO: 693403 - DNA, 25 bp, Mus musculus
gtctgttgagatgacacctctgtgc

SEQ ID NO: 693404 - DNA, 25 bp, Mus musculus
gtctgttgatctctagcaaatccag

SEQ ID NO: 693405 - DNA, 25 bp, Mus musculus
gtctgttgatctgtagcaaatccag

SEQ ID NO: 693406 - DNA, 25 bp, Mus musculus
gtctgttgcatgcaagcttcttggc

SEQ ID NO: 693407 - DNA, 25 bp, Mus musculus
gtctgttgcatggaagcttcttggc

SEQ ID NO: 693408 - DNA, 25 bp, Mus musculus
gtctgttggcctcatactgtgtttg

SEQ ID NO: 693409 - DNA, 25 bp, Mus musculus
gtctgttggcctgatactgtgtttg

SEQ ID NO: 693410 - DNA, 25 bp, Mus musculus
gtctgttgggacacttggtggtcaa

SEQ ID NO: 693411 - DNA, 25 bp, Mus musculus
gtctgttgggactcttggtggtcaa

SEQ ID NO: 693412 - DNA, 25 bp, Mus musculus
gtctgttgtatgatgttttccttgt

SEQ ID NO: 693413 - DNA, 25 bp, Mus musculus
gtctgttgtatgcttgagctgagca

SEQ ID NO: 693414 - DNA, 25 bp, Mus musculus
gtctgttgtatggttgagctgagca

SEQ ID NO: 693415 - DNA, 25 bp, Mus musculus
gtctgttgtatgttgttttccttgt

SEQ ID NO: 693416 - DNA, 25 bp, Mus musculus
gtctgttgtctgacaccaaggcagg

SEQ ID NO: 693417 - DNA, 25 bp, Mus musculus
gtctgttgtctgtcaccaaggcagg

SEQ ID NO: 693418 - DNA, 25 bp, Mus musculus
gtctgttgtgcccagcaagtagata

SEQ ID NO: 693419 - DNA, 25 bp, Mus musculus
gtctgttgtgccgagcaagtagata

SEQ ID NO: 693420 - DNA, 25 bp, Mus musculus
gtctgtttacatcgtatttcccttg

SEQ ID NO: 693421 - DNA, 25 bp, Mus musculus
gtctgtttacatggtatttcccttg

SEQ ID NO: 693422 - DNA, 25 bp, Mus musculus
gtctgtttactaacttagcctggtg

SEQ ID NO: 693423 - DNA, 25 bp, Mus musculus
gtctgtttactatcttagcctggtg

SEQ ID NO: 693424 - DNA, 25 bp, Mus musculus
gtctgtttaggtacattgctgattt

SEQ ID NO: 693425 - DNA, 25 bp, Mus musculus
gtctgtttaggttcattgctgattt

SEQ ID NO: 693426 - DNA, 25 bp, Mus musculus
gtctgtttatggctgctccattcat

SEQ ID NO: 693427 - DNA, 25 bp, Mus musculus
gtctgtttatgggtgctccattcat

SEQ ID NO: 693428 - DNA, 25 bp, Mus musculus
gtctgtttcaggaagtaggactaaa

SEQ ID NO: 693429 - DNA, 25 bp, Mus musculus
gtctgtttcaggtagtaggactaaa

SEQ ID NO: 693430 - DNA, 25 bp, Mus musculus
gtctgtttccatagtaacccaaccg

SEQ ID NO: 693431 - DNA, 25 bp, Mus musculus
gtctgtttccattgtaacccaaccg

SEQ ID NO: 693432 - DNA, 25 bp, Mus musculus
gtctgtttcccacctgtttgagaca

SEQ ID NO: 693433 - DNA, 25 bp, Mus musculus
gtctgtttcccagctgtttgagaca

SEQ ID NO: 693434 - DNA, 25 bp, Mus musculus
gtctgtttcctaaaggccacttgtt

SEQ ID NO: 693435 - DNA, 25 bp, Mus musculus
gtctgtttcctataggccacttgtt

SEQ ID NO: 693436 - DNA, 25 bp, Mus musculus
gtctgtttccttacttgtcttcttt

SEQ ID NO: 693437 - DNA, 25 bp, Mus musculus
gtctgtttcctttcttgtcttcttt

SEQ ID NO: 693438 - DNA, 25 bp, Mus musculus
gtctgtttcgcaatcagtgaatttt

SEQ ID NO: 693439 - DNA, 25 bp, Mus musculus
gtctgtttcgcattcagtgaatttt

SEQ ID NO: 693440 - DNA, 25 bp, Mus musculus
gtctgtttctacactgtcatcttag

SEQ ID NO: 693441 - DNA, 25 bp, Mus musculus
gtctgtttctactctgtcatcttag

SEQ ID NO: 693442 - DNA, 25 bp, Mus musculus
gtctgtttctgactcctttacatca

SEQ ID NO: 693443 - DNA, 25 bp, Mus musculus
gtctgtttctgagtcctttacatca

SEQ ID NO: 693444 - DNA, 25 bp, Mus musculus
gtctgtttctggaacattccacaaa

SEQ ID NO: 693445 - DNA, 25 bp, Mus musculus
gtctgtttctggaatatgcattgca

SEQ ID NO: 693446 - DNA, 25 bp, Mus musculus
gtctgtttctggtacattccacaaa

SEQ ID NO: 693447 - DNA, 25 bp, Mus musculus
gtctgtttctggtatatgcattgca

SEQ ID NO: 693448 - DNA, 25 bp, Mus musculus
gtctgtttcttgcagcactactgtt

SEQ ID NO: 693449 - DNA, 25 bp, Mus musculus
gtctgtttcttggagcactactgtt

SEQ ID NO: 693450 - DNA, 25 bp, Mus musculus
gtctgtttgaaacacccccgaggtg

SEQ ID NO: 693451 - DNA, 25 bp, Mus musculus
gtctgtttgaaacttcaaggccttt

SEQ ID NO: 693452 - DNA, 25 bp, Mus musculus
gtctgtttgaaagacccccgaggtg

SEQ ID NO: 693453 - DNA, 25 bp, Mus musculus
gtctgtttgaaagttcaaggccttt

SEQ ID NO: 693454 - DNA, 25 bp, Mus musculus
gtctgtttgcatcgtgagacctctg

SEQ ID NO: 693455 - DNA, 25 bp, Mus musculus
gtctgtttgcatctatgtaaagccc

SEQ ID NO: 693456 - DNA, 25 bp, Mus musculus
gtctgtttgcatggtgagacctctg

SEQ ID NO: 693457 - DNA, 25 bp, Mus musculus
gtctgtttgcatgtatgtaaagccc

SEQ ID NO: 693458 - DNA, 25 bp, Mus musculus
gtctgtttgcccaaaattgcttcta

SEQ ID NO: 693459 - DNA, 25 bp, Mus musculus
gtctgtttgccccacaaatatgcac

SEQ ID NO: 693460 - DNA, 25 bp, Mus musculus
gtctgtttgcccgacaaatatgcac

SEQ ID NO: 693461 - DNA, 25 bp, Mus musculus
gtctgtttgccctaaattgcttcta

SEQ ID NO: 693462 - DNA, 25 bp, Mus musculus
gtctgtttgcgcattcgtgatgtcc

SEQ ID NO: 693463 - DNA, 25 bp, Mus musculus
gtctgtttgcgctttcgtgatgtcc

SEQ ID NO: 693464 - DNA, 25 bp, Mus musculus
gtctgtttggagctctgtgaccaag

SEQ ID NO: 693465 - DNA, 25 bp, Mus musculus
gtctgtttggaggtctgtgaccaag

SEQ ID NO: 693466 - DNA, 25 bp, Mus musculus
gtctgtttgtagaaacatgcttttc

SEQ ID NO: 693467 - DNA, 25 bp, Mus musculus
gtctgtttgtagtaacatgcttttc

SEQ ID NO: 693468 - DNA, 25 bp, Mus musculus
gtctgtttgttcctattggactacc

SEQ ID NO: 693469 - DNA, 25 bp, Mus musculus
gtctgtttgttcgtattggactacc

SEQ ID NO: 693470 - DNA, 25 bp, Mus musculus
gtctgttttatgaactcaactaagg

SEQ ID NO: 693471 - DNA, 25 bp, Mus musculus
gtctgttttatgtactcaactaagg

SEQ ID NO: 693472 - DNA, 25 bp, Mus musculus
gtctgttttattcttcattcttcta

SEQ ID NO: 693473 - DNA, 25 bp, Mus musculus
gtctgttttattgttcattcttcta

SEQ ID NO: 693474 - DNA, 25 bp, Mus musculus
gtctgttttcttatatcatggtggt

SEQ ID NO: 693475 - DNA, 25 bp, Mus musculus
gtctgttttcttttatcatggtggt

SEQ ID NO: 693476 - DNA, 25 bp, Mus musculus
gtctgttttgatatctggagtccac

SEQ ID NO: 693477 - DNA, 25 bp, Mus musculus
gtctgttttgatttctggagtccac

SEQ ID NO: 693478 - DNA, 25 bp, Mus musculus
gtctgtttttcaccaacttttcgag

SEQ ID NO: 693479 - DNA, 25 bp, Mus musculus
gtctgtttttcagcaacttttcgag

SEQ ID NO: 693480 - DNA, 25 bp, Mus musculus
gtctgtttttccatcactttcgtga

SEQ ID NO: 693481 - DNA, 25 bp, Mus musculus
gtctgtttttccttcactttcgtga

SEQ ID NO: 693482 - DNA, 25 bp, Mus musculus
gtcttaaactgtcctgagcttctac

SEQ ID NO: 693483 - DNA, 25 bp, Mus musculus
gtcttaaactgtgctgagcttctac

SEQ ID NO: 693484 - DNA, 25 bp, Mus musculus
gtcttaaagccacgtctgtatgcag

SEQ ID NO: 693485 - DNA, 25 bp, Mus musculus
gtcttaaagccaggtctgtatgcag

SEQ ID NO: 693486 - DNA, 25 bp, Mus musculus
gtcttaacaccaccagatcagctgg

SEQ ID NO: 693487 - DNA, 25 bp, Mus musculus
gtcttaacaccagcagatcagctgg

SEQ ID NO: 693488 - DNA, 25 bp, Mus musculus
gtcttaactacgatgctcaatgatt

SEQ ID NO: 693489 - DNA, 25 bp, Mus musculus
gtcttaactacgttgctcaatgatt

SEQ ID NO: 693490 - DNA, 25 bp, Mus musculus
gtcttaagaaacacttccacgtatt

SEQ ID NO: 693491 - DNA, 25 bp, Mus musculus
gtcttaagaaactcttccacgtatt

SEQ ID NO: 693492 - DNA, 25 bp, Mus musculus
gtcttaagaatcatgcgtagccagg

SEQ ID NO: 693493 - DNA, 25 bp, Mus musculus
gtcttaagaatcttgcgtagccagg

SEQ ID NO: 693494 - DNA, 25 bp, Mus musculus
gtcttaagccagatacagtttacca

SEQ ID NO: 693495 - DNA, 25 bp, Mus musculus
gtcttaagccagttacagtttacca

SEQ ID NO: 693496 - DNA, 25 bp, Mus musculus
gtcttaagccccatgcaagtgaaca

SEQ ID NO: 693497 - DNA, 25 bp, Mus musculus
gtcttaagccccttgcaagtgaaca

SEQ ID NO: 693498 - DNA, 25 bp, Mus musculus
gtcttaagtatgattgctccctctc

SEQ ID NO: 693499 - DNA, 25 bp, Mus musculus
gtcttaagtatgtttgctccctctc

SEQ ID NO: 693500 - DNA, 25 bp, Mus musculus
gtcttaagtcccactaaggcctgcc

SEQ ID NO: 693501 - DNA, 25 bp, Mus musculus
gtcttaagtccctctaaggcctgcc

SEQ ID NO: 693502 - DNA, 25 bp, Mus musculus
gtcttaatacacacacagccaggat

SEQ ID NO: 693503 - DNA, 25 bp, Mus musculus
gtcttaatacactcacagccaggat

SEQ ID NO: 693504 - DNA, 25 bp, Mus musculus
gtcttaatcgctcctggaacagcag

SEQ ID NO: 693505 - DNA, 25 bp, Mus musculus
gtcttaatcgctgctggaacagcag

SEQ ID NO: 693506 - DNA, 25 bp, Mus musculus
gtcttaatgctcactatgggaggcg

SEQ ID NO: 693507 - DNA, 25 bp, Mus musculus
gtcttaatgctctctatgggaggcg

SEQ ID NO: 693508 - DNA, 25 bp, Mus musculus
gtcttaatggtaacctactgagcat

SEQ ID NO: 693509 - DNA, 25 bp, Mus musculus
gtcttaatggtatcctactgagcat

SEQ ID NO: 693510 - DNA, 25 bp, Mus musculus
gtcttaattaacatggagtagtgta

SEQ ID NO: 693511 - DNA, 25 bp, Mus musculus
gtcttaattaacttggagtagtgta

SEQ ID NO: 693512 - DNA, 25 bp, Mus musculus
gtcttaattaatctcctgtggctat

SEQ ID NO: 693513 - DNA, 25 bp, Mus musculus
gtcttaattaatgtcctgtggctat

SEQ ID NO: 693514 - DNA, 25 bp, Mus musculus
gtcttaattcatcagttagtgaact

SEQ ID NO: 693515 - DNA, 25 bp, Mus musculus
gtcttaattcatgagttagtgaact

SEQ ID NO: 693516 - DNA, 25 bp, Mus musculus
gtcttaattttcattgccacagtct

SEQ ID NO: 693517 - DNA, 25 bp, Mus musculus
gtcttaattttctttgccacagtct

SEQ ID NO: 693518 - DNA, 25 bp, Mus musculus
gtcttacaaatgcttcctatgtcta

SEQ ID NO: 693519 - DNA, 25 bp, Mus musculus
gtcttacaaatggttcctatgtcta

SEQ ID NO: 693520 - DNA, 25 bp, Mus musculus
gtcttacaagtacggcaattaataa

SEQ ID NO: 693521 - DNA, 25 bp, Mus musculus
gtcttacaagtagggcaattaataa

SEQ ID NO: 693522 - DNA, 25 bp, Mus musculus
gtcttacaccagacttgggtgcaat

SEQ ID NO: 693523 - DNA, 25 bp, Mus musculus
gtcttacaccagtcttgggtgcaat

SEQ ID NO: 693524 - DNA, 25 bp, Mus musculus
gtcttacacctaatgtaggatccaa

SEQ ID NO: 693525 - DNA, 25 bp, Mus musculus
gtcttacacctattgtaggatccaa

SEQ ID NO: 693526 - DNA, 25 bp, Mus musculus
gtcttacacgtcactcagggaaaaa

SEQ ID NO: 693527 - DNA, 25 bp, Mus musculus
gtcttacacgtctctcagggaaaaa

SEQ ID NO: 693528 - DNA, 25 bp, Mus musculus
gtcttacagttcagtccactagcta

SEQ ID NO: 693529 - DNA, 25 bp, Mus musculus
gtcttacagttctgtccactagcta

SEQ ID NO: 693530 - DNA, 25 bp, Mus musculus
gtcttacatataaactctgcaccat

SEQ ID NO: 693531 - DNA, 25 bp, Mus musculus
gtcttacatatatactctgcaccat

SEQ ID NO: 693532 - DNA, 25 bp, Mus musculus
gtcttacatcgtctcttgttaccat

SEQ ID NO: 693533 - DNA, 25 bp, Mus musculus
gtcttacatcgtgtcttgttaccat

SEQ ID NO: 693534 - DNA, 25 bp, Mus musculus
gtcttaccaacgactgcttttgaac

SEQ ID NO: 693535 - DNA, 25 bp, Mus musculus
gtcttaccaacgtctgcttttgaac

SEQ ID NO: 693536 - DNA, 25 bp, Mus musculus
gtcttaccacttcagatgatctaaa

SEQ ID NO: 693537 - DNA, 25 bp, Mus musculus
gtcttaccacttgagatgatctaaa

SEQ ID NO: 693538 - DNA, 25 bp, Mus musculus
gtcttaccatttatctgctttgcta

SEQ ID NO: 693539 - DNA, 25 bp, Mus musculus
gtcttaccatttttctgctttgcta

SEQ ID NO: 693540 - DNA, 25 bp, Mus musculus
gtcttacccagcactttctgaagat

SEQ ID NO: 693541 - DNA, 25 bp, Mus musculus
gtcttacccagctctttctgaagat

SEQ ID NO: 693542 - DNA, 25 bp, Mus musculus
gtcttacccatgagtttattagcag

SEQ ID NO: 693543 - DNA, 25 bp, Mus musculus
gtcttacccatgtgtttattagcag

SEQ ID NO: 693544 - DNA, 25 bp, Mus musculus
gtcttacctaagaaaggcctcacag

SEQ ID NO: 693545 - DNA, 25 bp, Mus musculus
gtcttacctaagtaaggcctcacag

SEQ ID NO: 693546 - DNA, 25 bp, Mus musculus
gtcttacctcgtcacgtctgtttaa

SEQ ID NO: 693547 - DNA, 25 bp, Mus musculus
gtcttacctcgtgacgtctgtttaa

SEQ ID NO: 693548 - DNA, 25 bp, Mus musculus
gtcttacctggccatttgttttaat

SEQ ID NO: 693549 - DNA, 25 bp, Mus musculus
gtcttacctggcgatttgttttaat

SEQ ID NO: 693550 - DNA, 25 bp, Mus musculus
gtcttacctggtcatgtgtagccat

SEQ ID NO: 693551 - DNA, 25 bp, Mus musculus
gtcttacctggtccaattgtccaag

SEQ ID NO: 693552 - DNA, 25 bp, Mus musculus
gtcttacctggtgatgtgtagccat

SEQ ID NO: 693553 - DNA, 25 bp, Mus musculus
gtcttacctggtgcaattgtccaag

SEQ ID NO: 693554 - DNA, 25 bp, Mus musculus
gtcttacctgtcacgttataggaac

SEQ ID NO: 693555 - DNA, 25 bp, Mus musculus
gtcttacctgtctcgttataggaac

SEQ ID NO: 693556 - DNA, 25 bp, Mus musculus
gtcttacgttttatatcctgctgaa

SEQ ID NO: 693557 - DNA, 25 bp, Mus musculus
gtcttacgttttttatcctgctgaa

SEQ ID NO: 693558 - DNA, 25 bp, Mus musculus
gtcttactacatcgccctagatggc

SEQ ID NO: 693559 - DNA, 25 bp, Mus musculus
gtcttactacatggccctagatggc

SEQ ID NO: 693560 - DNA, 25 bp, Mus musculus
gtcttactagcccttccttattcta

SEQ ID NO: 693561 - DNA, 25 bp, Mus musculus
gtcttactagccgttccttattcta

SEQ ID NO: 693562 - DNA, 25 bp, Mus musculus
gtcttactcatcacttcattcagga

SEQ ID NO: 693563 - DNA, 25 bp, Mus musculus
gtcttactcatctcttcattcagga

SEQ ID NO: 693564 - DNA, 25 bp, Mus musculus
gtcttactccaacatcaagcatctg

SEQ ID NO: 693565 - DNA, 25 bp, Mus musculus
gtcttactccaagatcaagcatctg

SEQ ID NO: 693566 - DNA, 25 bp, Mus musculus
gtcttactcccactaatagccaagg

SEQ ID NO: 693567 - DNA, 25 bp, Mus musculus
gtcttactcccagtaatagccaagg

SEQ ID NO: 693568 - DNA, 25 bp, Mus musculus
gtcttactgagactccgacttctaa

SEQ ID NO: 693569 - DNA, 25 bp, Mus musculus
gtcttactgagagtccgacttctaa

SEQ ID NO: 693570 - DNA, 25 bp, Mus musculus
gtcttactgcaacttcatagccagg

SEQ ID NO: 693571 - DNA, 25 bp, Mus musculus
gtcttactgcaagttcatagccagg

SEQ ID NO: 693572 - DNA, 25 bp, Mus musculus
gtcttactgcccagagtgtatgttt

SEQ ID NO: 693573 - DNA, 25 bp, Mus musculus
gtcttactgccctgagtgtatgttt

SEQ ID NO: 693574 - DNA, 25 bp, Mus musculus
gtcttactgctgaaacacatgaaaa

SEQ ID NO: 693575 - DNA, 25 bp, Mus musculus
gtcttactgctgtaacacatgaaaa

SEQ ID NO: 693576 - DNA, 25 bp, Mus musculus
gtcttactggctcactagaggacac

SEQ ID NO: 693577 - DNA, 25 bp, Mus musculus
gtcttactggctccacccagcaaga

SEQ ID NO: 693578 - DNA, 25 bp, Mus musculus
gtcttactggctgactagaggacac

SEQ ID NO: 693579 - DNA, 25 bp, Mus musculus
gtcttactggctgcacccagcaaga

SEQ ID NO: 693580 - DNA, 25 bp, Mus musculus
gtcttactggtgcatgggtctccat

SEQ ID NO: 693581 - DNA, 25 bp, Mus musculus
gtcttactggtggatgggtctccat

SEQ ID NO: 693582 - DNA, 25 bp, Mus musculus
gtcttactgtataacctggcaatcc

SEQ ID NO: 693583 - DNA, 25 bp, Mus musculus
gtcttactgtattacctggcaatcc

SEQ ID NO: 693584 - DNA, 25 bp, Mus musculus
gtcttactgttaattgttggcttga

SEQ ID NO: 693585 - DNA, 25 bp, Mus musculus
gtcttactgttatttgttggcttga

SEQ ID NO: 693586 - DNA, 25 bp, Mus musculus
gtcttacttattcaagcaccctttc

SEQ ID NO: 693587 - DNA, 25 bp, Mus musculus
gtcttacttattgaagcaccctttc

SEQ ID NO: 693588 - DNA, 25 bp, Mus musculus
gtcttacttcaaaacttcatttctg

SEQ ID NO: 693589 - DNA, 25 bp, Mus musculus
gtcttacttcaatacttcatttctg

SEQ ID NO: 693590 - DNA, 25 bp, Mus musculus
gtcttacttgaaatcccaccattgg

SEQ ID NO: 693591 - DNA, 25 bp, Mus musculus
gtcttacttgaattcccaccattgg

SEQ ID NO: 693592 - DNA, 25 bp, Mus musculus
gtcttactttccaatctcttgtgag

SEQ ID NO: 693593 - DNA, 25 bp, Mus musculus
gtcttactttcctatctcttgtgag

SEQ ID NO: 693594 - DNA, 25 bp, Mus musculus
gtcttagaaacactcagcaccctgg

SEQ ID NO: 693595 - DNA, 25 bp, Mus musculus
gtcttagaaacagtcagcaccctgg

SEQ ID NO: 693596 - DNA, 25 bp, Mus musculus
gtcttagaacgactttctcagctga

SEQ ID NO: 693597 - DNA, 25 bp, Mus musculus
gtcttagaacgagtttctcagctga

SEQ ID NO: 693598 - DNA, 25 bp, Mus musculus
gtcttagaagcaagtattctcccta

SEQ ID NO: 693599 - DNA, 25 bp, Mus musculus
gtcttagaagcatgtattctcccta

SEQ ID NO: 693600 - DNA, 25 bp, Mus musculus
gtcttagaagccaagaactggaatt

SEQ ID NO: 693601 - DNA, 25 bp, Mus musculus
gtcttagaagcctagaactggaatt

SEQ ID NO: 693602 - DNA, 25 bp, Mus musculus
gtcttagacattccacactctttgt

SEQ ID NO: 693603 - DNA, 25 bp, Mus musculus
gtcttagacattgcacactctttgt

SEQ ID NO: 693604 - DNA, 25 bp, Mus musculus
gtcttagagctcattgagacccata

SEQ ID NO: 693605 - DNA, 25 bp, Mus musculus
gtcttagagctctttgagacccata

SEQ ID NO: 693606 - DNA, 25 bp, Mus musculus
gtcttagatacgcagctgcggtaca

SEQ ID NO: 693607 - DNA, 25 bp, Mus musculus
gtcttagatacggagctgcggtaca

SEQ ID NO: 693608 - DNA, 25 bp, Mus musculus
gtcttagatgacagctgggcaactt

SEQ ID NO: 693609 - DNA, 25 bp, Mus musculus
gtcttagatgactgctgggcaactt

SEQ ID NO: 693610 - DNA, 25 bp, Mus musculus
gtcttagatgttcactgtccaattt

SEQ ID NO: 693611 - DNA, 25 bp, Mus musculus
gtcttagatgttgactgtccaattt

SEQ ID NO: 693612 - DNA, 25 bp, Mus musculus
gtcttagcctttaatgtgaacttca

SEQ ID NO: 693613 - DNA, 25 bp, Mus musculus
gtcttagccttttatgtgaacttca

SEQ ID NO: 693614 - DNA, 25 bp, Mus musculus
gtcttagctcataggtaacctgttt

SEQ ID NO: 693615 - DNA, 25 bp, Mus musculus
gtcttagctcattggtaacctgttt

SEQ ID NO: 693616 - DNA, 25 bp, Mus musculus
gtcttagctgtcctgtttgagaaca

SEQ ID NO: 693617 - DNA, 25 bp, Mus musculus
gtcttagctgtcgtgtttgagaaca

SEQ ID NO: 693618 - DNA, 25 bp, Mus musculus
gtcttaggaccaacgcagaaagtct

SEQ ID NO: 693619 - DNA, 25 bp, Mus musculus
gtcttaggaccatcgcagaaagtct

SEQ ID NO: 693620 - DNA, 25 bp, Mus musculus
gtcttaggcaggagggacacttccc

SEQ ID NO: 693621 - DNA, 25 bp, Mus musculus
gtcttaggcaggtgggacacttccc

SEQ ID NO: 693622 - DNA, 25 bp, Mus musculus
gtcttaggcatactactggagcagc

SEQ ID NO: 693623 - DNA, 25 bp, Mus musculus
gtcttaggcatagtactggagcagc

SEQ ID NO: 693624 - DNA, 25 bp, Mus musculus
gtcttaggccaactagtcctgacct

SEQ ID NO: 693625 - DNA, 25 bp, Mus musculus
gtcttaggccaagtagtcctgacct

SEQ ID NO: 693626 - DNA, 25 bp, Mus musculus
gtcttaggcctacattgagttcggt

SEQ ID NO: 693627 - DNA, 25 bp, Mus musculus
gtcttaggcctagattgagttcggt

SEQ ID NO: 693628 - DNA, 25 bp, Mus musculus
gtcttaggccttcgtgtatatcaca

SEQ ID NO: 693629 - DNA, 25 bp, Mus musculus
gtcttaggccttggtgtatatcaca

SEQ ID NO: 693630 - DNA, 25 bp, Mus musculus
gtcttagtaaatcctcactctctga

SEQ ID NO: 693631 - DNA, 25 bp, Mus musculus
gtcttagtaaatgctcactctctga

SEQ ID NO: 693632 - DNA, 25 bp, Mus musculus
gtcttagtatagagtttatgatcct

SEQ ID NO: 693633 - DNA, 25 bp, Mus musculus
gtcttagtatagtgtttatgatcct

SEQ ID NO: 693634 - DNA, 25 bp, Mus musculus
gtcttagtcccacagtgtgtcacac

SEQ ID NO: 693635 - DNA, 25 bp, Mus musculus
gtcttagtcccagagtgtgtcacac

SEQ ID NO: 693636 - DNA, 25 bp, Mus musculus
gtcttagtctagcagctggtaccat

SEQ ID NO: 693637 - DNA, 25 bp, Mus musculus
gtcttagtctaggagctggtaccat

SEQ ID NO: 693638 - DNA, 25 bp, Mus musculus
gtcttagtgactatcctgttgtaca

SEQ ID NO: 693639 - DNA, 25 bp, Mus musculus
gtcttagtgactttcctgttgtaca

SEQ ID NO: 693640 - DNA, 25 bp, Mus musculus
gtcttagtgccaattgttcgtcctc

SEQ ID NO: 693641 - DNA, 25 bp, Mus musculus
gtcttagtgccatttgttcgtcctc

SEQ ID NO: 693642 - DNA, 25 bp, Mus musculus
gtcttagtgcctctccatgttagaa

SEQ ID NO: 693643 - DNA, 25 bp, Mus musculus
gtcttagtgcctgtccatgttagaa

SEQ ID NO: 693644 - DNA, 25 bp, Mus musculus
gtcttagtggacatgctttgagttt

SEQ ID NO: 693645 - DNA, 25 bp, Mus musculus
gtcttagtggacttgctttgagttt

SEQ ID NO: 693646 - DNA, 25 bp, Mus musculus
gtcttagttccgaacaaatggcaga

SEQ ID NO: 693647 - DNA, 25 bp, Mus musculus
gtcttagttccgtacaaatggcaga

SEQ ID NO: 693648 - DNA, 25 bp, Mus musculus
gtcttagttctgaatttgtcctttt

SEQ ID NO: 693649 - DNA, 25 bp, Mus musculus
gtcttagttctgtatttgtcctttt

SEQ ID NO: 693650 - DNA, 25 bp, Mus musculus
gtcttatacaaaatctctgccctga

SEQ ID NO: 693651 - DNA, 25 bp, Mus musculus
gtcttatacaaattctctgccctga

SEQ ID NO: 693652 - DNA, 25 bp, Mus musculus
gtcttatacacccagtctgcttagg

SEQ ID NO: 693653 - DNA, 25 bp, Mus musculus
gtcttatacaccgagtctgcttagg

SEQ ID NO: 693654 - DNA, 25 bp, Mus musculus
gtcttatacacgagtggacttgaca

SEQ ID NO: 693655 - DNA, 25 bp, Mus musculus
gtcttatacacgtgtggacttgaca

SEQ ID NO: 693656 - DNA, 25 bp, Mus musculus
gtcttatagctaacttcatggtcaa

SEQ ID NO: 693657 - DNA, 25 bp, Mus musculus
gtcttatagctatcttcatggtcaa

SEQ ID NO: 693658 - DNA, 25 bp, Mus musculus
gtcttatatacactgagcctcgcac

SEQ ID NO: 693659 - DNA, 25 bp, Mus musculus
gtcttatatacagtgagcctcgcac

SEQ ID NO: 693660 - DNA, 25 bp, Mus musculus
gtcttatatatcaaagtatgctgta

SEQ ID NO: 693661 - DNA, 25 bp, Mus musculus
gtcttatatatctaagtatgctgta

SEQ ID NO: 693662 - DNA, 25 bp, Mus musculus
gtcttatatgtgacccctgagggtg

SEQ ID NO: 693663 - DNA, 25 bp, Mus musculus
gtcttatatgtgtcccctgagggtg

SEQ ID NO: 693664 - DNA, 25 bp, Mus musculus
gtcttatcctatcgttttctctttc

SEQ ID NO: 693665 - DNA, 25 bp, Mus musculus
gtcttatcctatggttttctctttc

SEQ ID NO: 693666 - DNA, 25 bp, Mus musculus
gtcttatctagactttgtcccttgg

SEQ ID NO: 693667 - DNA, 25 bp, Mus musculus
gtcttatctagagtttgtcccttgg

SEQ ID NO: 693668 - DNA, 25 bp, Mus musculus
gtcttatctatcagcatttagcatt

SEQ ID NO: 693669 - DNA, 25 bp, Mus musculus
gtcttatctatctgcatttagcatt

SEQ ID NO: 693670 - DNA, 25 bp, Mus musculus
gtcttatctccaaaactatagctga

SEQ ID NO: 693671 - DNA, 25 bp, Mus musculus
gtcttatctccataactatagctga

SEQ ID NO: 693672 - DNA, 25 bp, Mus musculus
gtcttatctcccacgtgtgttgaac

SEQ ID NO: 693673 - DNA, 25 bp, Mus musculus
gtcttatctccctcgtgtgttgaac

SEQ ID NO: 693674 - DNA, 25 bp, Mus musculus
gtcttatctcttaagaagcccatat

SEQ ID NO: 693675 - DNA, 25 bp, Mus musculus
gtcttatctcttacatcatttacta

SEQ ID NO: 693676 - DNA, 25 bp, Mus musculus
gtcttatctctttagaagcccatat

SEQ ID NO: 693677 - DNA, 25 bp, Mus musculus
gtcttatctctttcatcatttacta

SEQ ID NO: 693678 - DNA, 25 bp, Mus musculus
gtcttatctgccattgcagttagta

SEQ ID NO: 693679 - DNA, 25 bp, Mus musculus
gtcttatctgcctttgcagttagta

SEQ ID NO: 693680 - DNA, 25 bp, Mus musculus
gtcttatgaactcttctgacgtcag

SEQ ID NO: 693681 - DNA, 25 bp, Mus musculus
gtcttatgaactgttctgacgtcag

SEQ ID NO: 693682 - DNA, 25 bp, Mus musculus
gtcttatggataaagctatcactta

SEQ ID NO: 693683 - DNA, 25 bp, Mus musculus
gtcttatggatatagctatcactta

SEQ ID NO: 693684 - DNA, 25 bp, Mus musculus
gtcttatgggtgactctggatgcaa

SEQ ID NO: 693685 - DNA, 25 bp, Mus musculus
gtcttatgggtgtctctggatgcaa

SEQ ID NO: 693686 - DNA, 25 bp, Mus musculus
gtcttatgtgaaagtattcagtcct

SEQ ID NO: 693687 - DNA, 25 bp, Mus musculus
gtcttatgtgaatgtattcagtcct

SEQ ID NO: 693688 - DNA, 25 bp, Mus musculus
gtcttatgtgctagtttctttgtgt

SEQ ID NO: 693689 - DNA, 25 bp, Mus musculus
gtcttatgtgcttgtttctttgtgt

SEQ ID NO: 693690 - DNA, 25 bp, Mus musculus
gtcttatgtgtgattagtctgggaa

SEQ ID NO: 693691 - DNA, 25 bp, Mus musculus
gtcttatgtgtgtttagtctgggaa

SEQ ID NO: 693692 - DNA, 25 bp, Mus musculus
gtcttattaacccaacaacttcatt

SEQ ID NO: 693693 - DNA, 25 bp, Mus musculus
gtcttattaaccgaacaacttcatt

SEQ ID NO: 693694 - DNA, 25 bp, Mus musculus
gtcttattactacaggttcgcttgt

SEQ ID NO: 693695 - DNA, 25 bp, Mus musculus
gtcttattactagaggttcgcttgt

SEQ ID NO: 693696 - DNA, 25 bp, Mus musculus
gtcttattactcacagttctgtgtg

SEQ ID NO: 693697 - DNA, 25 bp, Mus musculus
gtcttattactctcagttctgtgtg

SEQ ID NO: 693698 - DNA, 25 bp, Mus musculus
gtcttattactgatccttctttcta

SEQ ID NO: 693699 - DNA, 25 bp, Mus musculus
gtcttattactgttccttctttcta

SEQ ID NO: 693700 - DNA, 25 bp, Mus musculus
gtcttattcaaaacgtgtcgcgatc

SEQ ID NO: 693701 - DNA, 25 bp, Mus musculus
gtcttattcaaatcgtgtcgcgatc

SEQ ID NO: 693702 - DNA, 25 bp, Mus musculus
gtcttattcattcttagccacgtgt

SEQ ID NO: 693703 - DNA, 25 bp, Mus musculus
gtcttattcattgttagccacgtgt

SEQ ID NO: 693704 - DNA, 25 bp, Mus musculus
gtcttattctggcttcatcatcctc

SEQ ID NO: 693705 - DNA, 25 bp, Mus musculus
gtcttattctgggttcatcatcctc

SEQ ID NO: 693706 - DNA, 25 bp, Mus musculus
gtcttattgtggctgtactagcaca

SEQ ID NO: 693707 - DNA, 25 bp, Mus musculus
gtcttattgtgggtgtactagcaca

SEQ ID NO: 693708 - DNA, 25 bp, Mus musculus
gtcttatttagtcttcttgggctca

SEQ ID NO: 693709 - DNA, 25 bp, Mus musculus
gtcttatttagtgttcttgggctca

SEQ ID NO: 693710 - DNA, 25 bp, Mus musculus
gtcttattttcaatgattctggctc

SEQ ID NO: 693711 - DNA, 25 bp, Mus musculus
gtcttattttcattgattctggctc

SEQ ID NO: 693712 - DNA, 25 bp, Mus musculus
gtcttattttccatatgtctcattt

SEQ ID NO: 693713 - DNA, 25 bp, Mus musculus
gtcttattttccatggctctactaa

SEQ ID NO: 693714 - DNA, 25 bp, Mus musculus
gtcttattttccttatgtctcattt

SEQ ID NO: 693715 - DNA, 25 bp, Mus musculus
gtcttattttccttggctctactaa

SEQ ID NO: 693716 - DNA, 25 bp, Mus musculus
gtcttcaaacatatcgttgctcgtt

SEQ ID NO: 693717 - DNA, 25 bp, Mus musculus
gtcttcaaacatttcgttgctcgtt

SEQ ID NO: 693718 - DNA, 25 bp, Mus musculus
gtcttcaaagtccaccgaaatcaaa

SEQ ID NO: 693719 - DNA, 25 bp, Mus musculus
gtcttcaaagtcgaccgaaatcaaa

SEQ ID NO: 693720 - DNA, 25 bp, Mus musculus
gtcttcaacaacaagttccacatca

SEQ ID NO: 693721 - DNA, 25 bp, Mus musculus
gtcttcaacaactagttccacatca

SEQ ID NO: 693722 - DNA, 25 bp, Mus musculus
gtcttcaacagtacatgagcctttt

SEQ ID NO: 693723 - DNA, 25 bp, Mus musculus
gtcttcaacagttcatgagcctttt

SEQ ID NO: 693724 - DNA, 25 bp, Mus musculus
gtcttcaagattcctccaatgctca

SEQ ID NO: 693725 - DNA, 25 bp, Mus musculus
gtcttcaagattgctccaatgctca

SEQ ID NO: 693726 - DNA, 25 bp, Mus musculus
gtcttcaagcgtacctagttcagta

SEQ ID NO: 693727 - DNA, 25 bp, Mus musculus
gtcttcaagcgttcctagttcagta

SEQ ID NO: 693728 - DNA, 25 bp, Mus musculus
gtcttcaagcttacctgacaagcgt

SEQ ID NO: 693729 - DNA, 25 bp, Mus musculus
gtcttcaagctttcctgacaagcgt

SEQ ID NO: 693730 - DNA, 25 bp, Mus musculus
gtcttcaagggccaagtgtacatcc

SEQ ID NO: 693731 - DNA, 25 bp, Mus musculus
gtcttcaagggcgaagtgtacatcc

SEQ ID NO: 693732 - DNA, 25 bp, Mus musculus
gtcttcaagtgtcatttgtgcctca

SEQ ID NO: 693733 - DNA, 25 bp, Mus musculus
gtcttcaagtgtgatttgtgcctca

SEQ ID NO: 693734 - DNA, 25 bp, Mus musculus
gtcttcaatgctctgtgagaggcct

SEQ ID NO: 693735 - DNA, 25 bp, Mus musculus
gtcttcaatgctgtgtgagaggcct

SEQ ID NO: 693736 - DNA, 25 bp, Mus musculus
gtcttcaatggacctactggaaaag

SEQ ID NO: 693737 - DNA, 25 bp, Mus musculus
gtcttcaatggagctactggaaaag

SEQ ID NO: 693738 - DNA, 25 bp, Mus musculus
gtcttcaattgcaactagatgcccc

SEQ ID NO: 693739 - DNA, 25 bp, Mus musculus
gtcttcaattgctactagatgcccc

SEQ ID NO: 693740 - DNA, 25 bp, Mus musculus
gtcttcacaaacacttagtcgttca

SEQ ID NO: 693741 - DNA, 25 bp, Mus musculus
gtcttcacaaactcttagtcgttca

SEQ ID NO: 693742 - DNA, 25 bp, Mus musculus
gtcttcacaactagctaatatattt

SEQ ID NO: 693743 - DNA, 25 bp, Mus musculus
gtcttcacaacttgctaatatattt

SEQ ID NO: 693744 - DNA, 25 bp, Mus musculus
gtcttcacagatctttccacaccag

SEQ ID NO: 693745 - DNA, 25 bp, Mus musculus
gtcttcacagatgtttccacaccag

SEQ ID NO: 693746 - DNA, 25 bp, Mus musculus
gtcttcaccatcatggacctttgga

SEQ ID NO: 693747 - DNA, 25 bp, Mus musculus
gtcttcaccatcttggacctttgga

SEQ ID NO: 693748 - DNA, 25 bp, Mus musculus
gtcttcaccatgaacaattagaact

SEQ ID NO: 693749 - DNA, 25 bp, Mus musculus
gtcttcaccatgtacaattagaact

SEQ ID NO: 693750 - DNA, 25 bp, Mus musculus
gtcttcacccgtcgattggttaaca

SEQ ID NO: 693751 - DNA, 25 bp, Mus musculus
gtcttcacccgtggattggttaaca

SEQ ID NO: 693752 - DNA, 25 bp, Mus musculus
gtcttcacctgtcctgagagctgta

SEQ ID NO: 693753 - DNA, 25 bp, Mus musculus
gtcttcacctgtgctgagagctgta

SEQ ID NO: 693754 - DNA, 25 bp, Mus musculus
gtcttcacgagtactcaaacgctca

SEQ ID NO: 693755 - DNA, 25 bp, Mus musculus
gtcttcacgagttctcaaacgctca

SEQ ID NO: 693756 - DNA, 25 bp, Mus musculus
gtcttcacgggcagttgctggtact

SEQ ID NO: 693757 - DNA, 25 bp, Mus musculus
gtcttcacgggctgttgctggtact

SEQ ID NO: 693758 - DNA, 25 bp, Mus musculus
gtcttcactgaacgccaatggctcc

SEQ ID NO: 693759 - DNA, 25 bp, Mus musculus
gtcttcactgaaggccaatggctcc

SEQ ID NO: 693760 - DNA, 25 bp, Mus musculus
gtcttcactgctaattgttgacttt

SEQ ID NO: 693761 - DNA, 25 bp, Mus musculus
gtcttcactgcttattgttgacttt

SEQ ID NO: 693762 - DNA, 25 bp, Mus musculus
gtcttcactgttcttctaaactatt

SEQ ID NO: 693763 - DNA, 25 bp, Mus musculus
gtcttcactgttgttctaaactatt

SEQ ID NO: 693764 - DNA, 25 bp, Mus musculus
gtcttcagaactacttcaccttgta

SEQ ID NO: 693765 - DNA, 25 bp, Mus musculus
gtcttcagaacttcttcaccttgta

SEQ ID NO: 693766 - DNA, 25 bp, Mus musculus
gtcttcagacacaattaagctgatt

SEQ ID NO: 693767 - DNA, 25 bp, Mus musculus
gtcttcagacactattaagctgatt

SEQ ID NO: 693768 - DNA, 25 bp, Mus musculus
gtcttcagagacagtaggtgagttt

SEQ ID NO: 693769 - DNA, 25 bp, Mus musculus
gtcttcagagactgtaggtgagttt

SEQ ID NO: 693770 - DNA, 25 bp, Mus musculus
gtcttcagagctaatgccattgcaa

SEQ ID NO: 693771 - DNA, 25 bp, Mus musculus
gtcttcagagcttatgccattgcaa

SEQ ID NO: 693772 - DNA, 25 bp, Mus musculus
gtcttcagaggtacatgaggtcagt

SEQ ID NO: 693773 - DNA, 25 bp, Mus musculus
gtcttcagaggttcatgaggtcagt

SEQ ID NO: 693774 - DNA, 25 bp, Mus musculus
gtcttcagcagtcgtgcagttgtat

SEQ ID NO: 693775 - DNA, 25 bp, Mus musculus
gtcttcagcagtggtgcagttgtat

SEQ ID NO: 693776 - DNA, 25 bp, Mus musculus
gtcttcagccacacagtgtattcta

SEQ ID NO: 693777 - DNA, 25 bp, Mus musculus
gtcttcagccacagttgtgatggtt

SEQ ID NO: 693778 - DNA, 25 bp, Mus musculus
gtcttcagccactcagtgtattcta

SEQ ID NO: 693779 - DNA, 25 bp, Mus musculus
gtcttcagccactgttgtgatggtt

SEQ ID NO: 693780 - DNA, 25 bp, Mus musculus
gtcttcagccagaaagtgtgactat

SEQ ID NO: 693781 - DNA, 25 bp, Mus musculus
gtcttcagccagtaagtgtgactat

SEQ ID NO: 693782 - DNA, 25 bp, Mus musculus
gtcttcaggctcatggagcagtgct

SEQ ID NO: 693783 - DNA, 25 bp, Mus musculus
gtcttcaggctcttggagcagtgct

SEQ ID NO: 693784 - DNA, 25 bp, Mus musculus
gtcttcagtaaaacccaacacttct

SEQ ID NO: 693785 - DNA, 25 bp, Mus musculus
gtcttcagtaaatcccaacacttct

SEQ ID NO: 693786 - DNA, 25 bp, Mus musculus
gtcttcagtagtcaggagtacccaa

SEQ ID NO: 693787 - DNA, 25 bp, Mus musculus
gtcttcagtagtgaggagtacccaa

SEQ ID NO: 693788 - DNA, 25 bp, Mus musculus
gtcttcagtctgagttactcgaaag

SEQ ID NO: 693789 - DNA, 25 bp, Mus musculus
gtcttcagtctgtgttactcgaaag

SEQ ID NO: 693790 - DNA, 25 bp, Mus musculus
gtcttcagtgagctcattgttcctg

SEQ ID NO: 693791 - DNA, 25 bp, Mus musculus
gtcttcagtgaggtcattgttcctg

SEQ ID NO: 693792 - DNA, 25 bp, Mus musculus
gtcttcagtgatcttagctttttga

SEQ ID NO: 693793 - DNA, 25 bp, Mus musculus
gtcttcagtgatgttagctttttga

SEQ ID NO: 693794 - DNA, 25 bp, Mus musculus
gtcttcagtggcagataggcctttt

SEQ ID NO: 693795 - DNA, 25 bp, Mus musculus
gtcttcagtggctgataggcctttt

SEQ ID NO: 693796 - DNA, 25 bp, Mus musculus
gtcttcagtgtacagcgtggtttta

SEQ ID NO: 693797 - DNA, 25 bp, Mus musculus
gtcttcagtgtagagcgtggtttta

SEQ ID NO: 693798 - DNA, 25 bp, Mus musculus
gtcttcagtgtcaacaggcaaccaa

SEQ ID NO: 693799 - DNA, 25 bp, Mus musculus
gtcttcagtgtctacaggcaaccaa

SEQ ID NO: 693800 - DNA, 25 bp, Mus musculus
gtcttcatacaaaatgcagctcctg

SEQ ID NO: 693801 - DNA, 25 bp, Mus musculus
gtcttcatacaatatgcagctcctg

SEQ ID NO: 693802 - DNA, 25 bp, Mus musculus
gtcttcatagtcatcattgtctggt

SEQ ID NO: 693803 - DNA, 25 bp, Mus musculus
gtcttcatagtcttcattgtctggt

SEQ ID NO: 693804 - DNA, 25 bp, Mus musculus
gtcttcatatgtcgagtggcttgca

SEQ ID NO: 693805 - DNA, 25 bp, Mus musculus
gtcttcatatgtggagtggcttgca

SEQ ID NO: 693806 - DNA, 25 bp, Mus musculus
gtcttcatatttcgcctcacatgta

SEQ ID NO: 693807 - DNA, 25 bp, Mus musculus
gtcttcatatttggcctcacatgta

SEQ ID NO: 693808 - DNA, 25 bp, Mus musculus
gtcttcatcatactccttagtcagg

SEQ ID NO: 693809 - DNA, 25 bp, Mus musculus
gtcttcatcatagtccttagtcagg

SEQ ID NO: 693810 - DNA, 25 bp, Mus musculus
gtcttcatcattattgcggtcttcg

SEQ ID NO: 693811 - DNA, 25 bp, Mus musculus
gtcttcatcatttttgcggtcttcg

SEQ ID NO: 693812 - DNA, 25 bp, Mus musculus
gtcttcatccccacttgaacaaaag

SEQ ID NO: 693813 - DNA, 25 bp, Mus musculus
gtcttcatcccctcttgaacaaaag

SEQ ID NO: 693814 - DNA, 25 bp, Mus musculus
gtcttcatccgtcgtgagcagcctt

SEQ ID NO: 693815 - DNA, 25 bp, Mus musculus
gtcttcatccgtggtgagcagcctt

SEQ ID NO: 693816 - DNA, 25 bp, Mus musculus
gtcttcatctgtcggacaccataca

SEQ ID NO: 693817 - DNA, 25 bp, Mus musculus
gtcttcatctgtgggacaccataca

SEQ ID NO: 693818 - DNA, 25 bp, Mus musculus
gtcttcatgccgcaggcaatcctat

SEQ ID NO: 693819 - DNA, 25 bp, Mus musculus
gtcttcatgccggaggcaatcctat

SEQ ID NO: 693820 - DNA, 25 bp, Mus musculus
gtcttcatgctgaccaatgagctgc

SEQ ID NO: 693821 - DNA, 25 bp, Mus musculus
gtcttcatgctgtccaatgagctgc

SEQ ID NO: 693822 - DNA, 25 bp, Mus musculus
gtcttcatgcttctaaccgtggtta

SEQ ID NO: 693823 - DNA, 25 bp, Mus musculus
gtcttcatgcttgtaaccgtggtta

SEQ ID NO: 693824 - DNA, 25 bp, Mus musculus
gtcttcatgtgactcgctcatactc

SEQ ID NO: 693825 - DNA, 25 bp, Mus musculus
gtcttcatgtgagtcgctcatactc

SEQ ID NO: 693826 - DNA, 25 bp, Mus musculus
gtcttcatgtggcaagccccagcag

SEQ ID NO: 693827 - DNA, 25 bp, Mus musculus
gtcttcatgtgggaagccccagcag

SEQ ID NO: 693828 - DNA, 25 bp, Mus musculus
gtcttcatgtgtctaaaggtcttca

SEQ ID NO: 693829 - DNA, 25 bp, Mus musculus
gtcttcatgtgtgtaaaggtcttca

SEQ ID NO: 693830 - DNA, 25 bp, Mus musculus
gtcttcattaccagggtgagggaca

SEQ ID NO: 693831 - DNA, 25 bp, Mus musculus
gtcttcattacctgggtgagggaca

SEQ ID NO: 693832 - DNA, 25 bp, Mus musculus
gtcttcattggcaagtgagcctcac

SEQ ID NO: 693833 - DNA, 25 bp, Mus musculus
gtcttcattggctagtgagcctcac

SEQ ID NO: 693834 - DNA, 25 bp, Mus musculus
gtcttcattgttacttcataacgat

SEQ ID NO: 693835 - DNA, 25 bp, Mus musculus
gtcttcattgtttcttcataacgat

SEQ ID NO: 693836 - DNA, 25 bp, Mus musculus
gtcttcattttaagagttgttgccc

SEQ ID NO: 693837 - DNA, 25 bp, Mus musculus
gtcttcattttatgagttgttgccc

SEQ ID NO: 693838 - DNA, 25 bp, Mus musculus
gtcttccaacacagtttcctatatt

SEQ ID NO: 693839 - DNA, 25 bp, Mus musculus
gtcttccaacactgtttcctatatt

SEQ ID NO: 693840 - DNA, 25 bp, Mus musculus
gtcttccaactcaaaatgggtgcta

SEQ ID NO: 693841 - DNA, 25 bp, Mus musculus
gtcttccaactctaaatgggtgcta

SEQ ID NO: 693842 - DNA, 25 bp, Mus musculus
gtcttccaacttattgtgagctccg

SEQ ID NO: 693843 - DNA, 25 bp, Mus musculus
gtcttccaactttttgtgagctccg

SEQ ID NO: 693844 - DNA, 25 bp, Mus musculus
gtcttccaaggacatgtcactcagc

SEQ ID NO: 693845 - DNA, 25 bp, Mus musculus
gtcttccaaggagatgtcactcagc

SEQ ID NO: 693846 - DNA, 25 bp, Mus musculus
gtcttccaagttcaatgacatcgta

SEQ ID NO: 693847 - DNA, 25 bp, Mus musculus
gtcttccaagttgaatgacatcgta

SEQ ID NO: 693848 - DNA, 25 bp, Mus musculus
gtcttccactcgaagccttaagagg

SEQ ID NO: 693849 - DNA, 25 bp, Mus musculus
gtcttccactcgtagccttaagagg

SEQ ID NO: 693850 - DNA, 25 bp, Mus musculus
gtcttccactgccacattgtgatat

SEQ ID NO: 693851 - DNA, 25 bp, Mus musculus
gtcttccactgcgacattgtgatat

SEQ ID NO: 693852 - DNA, 25 bp, Mus musculus
gtcttccactgtccgtactaaggca

SEQ ID NO: 693853 - DNA, 25 bp, Mus musculus
gtcttccactgtgcgtactaaggca

SEQ ID NO: 693854 - DNA, 25 bp, Mus musculus
gtcttccagaaaaaacaaggctctc

SEQ ID NO: 693855 - DNA, 25 bp, Mus musculus
gtcttccagaaataacaaggctctc

SEQ ID NO: 693856 - DNA, 25 bp, Mus musculus
gtcttccagaacaacattatgatct

SEQ ID NO: 693857 - DNA, 25 bp, Mus musculus
gtcttccagaactacattatgatct

SEQ ID NO: 693858 - DNA, 25 bp, Mus musculus
gtcttccagagcaaagggaggacca

SEQ ID NO: 693859 - DNA, 25 bp, Mus musculus
gtcttccagagctaagggaggacca

SEQ ID NO: 693860 - DNA, 25 bp, Mus musculus
gtcttccagattatgtaggcaccta

SEQ ID NO: 693861 - DNA, 25 bp, Mus musculus
gtcttccagattttgtaggcaccta

SEQ ID NO: 693862 - DNA, 25 bp, Mus musculus
gtcttccaggcactgctcacatgag

SEQ ID NO: 693863 - DNA, 25 bp, Mus musculus
gtcttccaggcagtgctcacatgag

SEQ ID NO: 693864 - DNA, 25 bp, Mus musculus
gtcttccatgcacacagcatagtta

SEQ ID NO: 693865 - DNA, 25 bp, Mus musculus
gtcttccatgcagacagcatagtta

SEQ ID NO: 693866 - DNA, 25 bp, Mus musculus
gtcttccattttctggtactccctc

SEQ ID NO: 693867 - DNA, 25 bp, Mus musculus
gtcttccattttgtggtactccctc

SEQ ID NO: 693868 - DNA, 25 bp, Mus musculus
gtcttcccaacaactggtactacat

SEQ ID NO: 693869 - DNA, 25 bp, Mus musculus
gtcttcccaacatctggtactacat

SEQ ID NO: 693870 - DNA, 25 bp, Mus musculus
gtcttcccatatcagccacaattat

SEQ ID NO: 693871 - DNA, 25 bp, Mus musculus
gtcttcccatatgagccacaattat

SEQ ID NO: 693872 - DNA, 25 bp, Mus musculus
gtcttcccatggcagcacgctggac

SEQ ID NO: 693873 - DNA, 25 bp, Mus musculus
gtcttcccatgggagcacgctggac

SEQ ID NO: 693874 - DNA, 25 bp, Mus musculus
gtcttccccgtgagccggctgcgag

SEQ ID NO: 693875 - DNA, 25 bp, Mus musculus
gtcttccccgtgtgccggctgcgag

SEQ ID NO: 693876 - DNA, 25 bp, Mus musculus
gtcttcccgaggacacagattcagt

SEQ ID NO: 693877 - DNA, 25 bp, Mus musculus
gtcttcccgaggtcacagattcagt

SEQ ID NO: 693878 - DNA, 25 bp, Mus musculus
gtcttcccgtttcacagtgctagga

SEQ ID NO: 693879 - DNA, 25 bp, Mus musculus
gtcttcccgtttgacagtgctagga

SEQ ID NO: 693880 - DNA, 25 bp, Mus musculus
gtcttccctcaactacgtgtgatga

SEQ ID NO: 693881 - DNA, 25 bp, Mus musculus
gtcttccctcaagtacgtgtgatga

SEQ ID NO: 693882 - DNA, 25 bp, Mus musculus
gtcttccctgaaaaaacatggcgtt

SEQ ID NO: 693883 - DNA, 25 bp, Mus musculus
gtcttccctgaataaacatggcgtt

SEQ ID NO: 693884 - DNA, 25 bp, Mus musculus
gtcttccctgcaattgtttaataaa

SEQ ID NO: 693885 - DNA, 25 bp, Mus musculus
gtcttccctgcatttgtttaataaa

SEQ ID NO: 693886 - DNA, 25 bp, Mus musculus
gtcttccctgtacctttatgtaaag

SEQ ID NO: 693887 - DNA, 25 bp, Mus musculus
gtcttccctgtagctttatgtaaag

SEQ ID NO: 693888 - DNA, 25 bp, Mus musculus
gtcttcccttgtctccatatttaat

SEQ ID NO: 693889 - DNA, 25 bp, Mus musculus
gtcttcccttgtgtccatatttaat

SEQ ID NO: 693890 - DNA, 25 bp, Mus musculus
gtcttccgggacatcacagatgaaa

SEQ ID NO: 693891 - DNA, 25 bp, Mus musculus
gtcttccgggacttcacagatgaaa

SEQ ID NO: 693892 - DNA, 25 bp, Mus musculus
gtcttccggtataaactacccatct

SEQ ID NO: 693893 - DNA, 25 bp, Mus musculus
gtcttccggtattaactacccatct

SEQ ID NO: 693894 - DNA, 25 bp, Mus musculus
gtcttccggtgccaggacgttactg

SEQ ID NO: 693895 - DNA, 25 bp, Mus musculus
gtcttccggtgcgaggacgttactg

SEQ ID NO: 693896 - DNA, 25 bp, Mus musculus
gtcttcctaaagaatgggctggact

SEQ ID NO: 693897 - DNA, 25 bp, Mus musculus
gtcttcctaaagtatgggctggact

SEQ ID NO: 693898 - DNA, 25 bp, Mus musculus
gtcttcctaagtacctaagcactgt

SEQ ID NO: 693899 - DNA, 25 bp, Mus musculus
gtcttcctaagttcctaagcactgt

SEQ ID NO: 693900 - DNA, 25 bp, Mus musculus
gtcttcctaatgagaggaggctcca

SEQ ID NO: 693901 - DNA, 25 bp, Mus musculus
gtcttcctaatgtgaggaggctcca

SEQ ID NO: 693902 - DNA, 25 bp, Mus musculus
gtcttcctacaccaagtctgtgagg

SEQ ID NO: 693903 - DNA, 25 bp, Mus musculus
gtcttcctacacgaagtctgtgagg

SEQ ID NO: 693904 - DNA, 25 bp, Mus musculus
gtcttcctactcatacattctaaac

SEQ ID NO: 693905 - DNA, 25 bp, Mus musculus
gtcttcctactcttacattctaaac

SEQ ID NO: 693906 - DNA, 25 bp, Mus musculus
gtcttcctaggactgtttgggctcc

SEQ ID NO: 693907 - DNA, 25 bp, Mus musculus
gtcttcctaggagtgtttgggctcc

SEQ ID NO: 693908 - DNA, 25 bp, Mus musculus
gtcttcctagttactacgtggacca

SEQ ID NO: 693909 - DNA, 25 bp, Mus musculus
gtcttcctagtttctacgtggacca

SEQ ID NO: 693910 - DNA, 25 bp, Mus musculus
gtcttcctatcccatgattcactca

SEQ ID NO: 693911 - DNA, 25 bp, Mus musculus
gtcttcctatccgatgattcactca

SEQ ID NO: 693912 - DNA, 25 bp, Mus musculus
gtcttcctcaaaagacttcttcatg

SEQ ID NO: 693913 - DNA, 25 bp, Mus musculus
gtcttcctcaaatgacttcttcatg

SEQ ID NO: 693914 - DNA, 25 bp, Mus musculus
gtcttcctcaacactactactttgt

SEQ ID NO: 693915 - DNA, 25 bp, Mus musculus
gtcttcctcaactctactactttgt

SEQ ID NO: 693916 - DNA, 25 bp, Mus musculus
gtcttcctcatccttctctgtagga

SEQ ID NO: 693917 - DNA, 25 bp, Mus musculus
gtcttcctcatcgttctctgtagga

SEQ ID NO: 693918 - DNA, 25 bp, Mus musculus
gtcttcctgagccacccaatgggaa

SEQ ID NO: 693919 - DNA, 25 bp, Mus musculus
gtcttcctgagcgacccaatgggaa

SEQ ID NO: 693920 - DNA, 25 bp, Mus musculus
gtcttcctgcatcagtttagcttat

SEQ ID NO: 693921 - DNA, 25 bp, Mus musculus
gtcttcctgcatgagtttagcttat

SEQ ID NO: 693922 - DNA, 25 bp, Mus musculus
gtcttcctgcccatagctataagcg

SEQ ID NO: 693923 - DNA, 25 bp, Mus musculus
gtcttcctgcccttagctataagcg

SEQ ID NO: 693924 - DNA, 25 bp, Mus musculus
gtcttcctggaaacacttgctaatc

SEQ ID NO: 693925 - DNA, 25 bp, Mus musculus
gtcttcctggaatcacttgctaatc

SEQ ID NO: 693926 - DNA, 25 bp, Mus musculus
gtcttcctggcaccatttgtggtat

SEQ ID NO: 693927 - DNA, 25 bp, Mus musculus
gtcttcctggcagcatttgtggtat

SEQ ID NO: 693928 - DNA, 25 bp, Mus musculus
gtcttcctggctaaatattttggta

SEQ ID NO: 693929 - DNA, 25 bp, Mus musculus
gtcttcctggcttaatattttggta

SEQ ID NO: 693930 - DNA, 25 bp, Mus musculus
gtcttcctggttatgattgctcagt

SEQ ID NO: 693931 - DNA, 25 bp, Mus musculus
gtcttcctggttttgattgctcagt

SEQ ID NO: 693932 - DNA, 25 bp, Mus musculus
gtcttccttataaatggtgaaccca

SEQ ID NO: 693933 - DNA, 25 bp, Mus musculus
gtcttccttatatatggtgaaccca

SEQ ID NO: 693934 - DNA, 25 bp, Mus musculus
gtcttccttcagaacgttttttgca

SEQ ID NO: 693935 - DNA, 25 bp, Mus musculus
gtcttccttcagtacgttttttgca

SEQ ID NO: 693936 - DNA, 25 bp, Mus musculus
gtcttccttctgaaaaactcgagca

SEQ ID NO: 693937 - DNA, 25 bp, Mus musculus
gtcttccttctgtaaaactcgagca

SEQ ID NO: 693938 - DNA, 25 bp, Mus musculus
gtcttccttgatctggacacactga

SEQ ID NO: 693939 - DNA, 25 bp, Mus musculus
gtcttccttgatgtggacacactga

SEQ ID NO: 693940 - DNA, 25 bp, Mus musculus
gtcttccttggtcccatgggacata

SEQ ID NO: 693941 - DNA, 25 bp, Mus musculus
gtcttccttggtgccatgggacata

SEQ ID NO: 693942 - DNA, 25 bp, Mus musculus
gtcttccttgtaaatgtttgtcata

SEQ ID NO: 693943 - DNA, 25 bp, Mus musculus
gtcttccttgtatatgtttgtcata

SEQ ID NO: 693944 - DNA, 25 bp, Mus musculus
gtcttccttgtgaaaactgcatttt

SEQ ID NO: 693945 - DNA, 25 bp, Mus musculus
gtcttccttgtgtaaactgcatttt

SEQ ID NO: 693946 - DNA, 25 bp, Mus musculus
gtcttcctttgtactgatctctaaa

SEQ ID NO: 693947 - DNA, 25 bp, Mus musculus
gtcttcctttgttctgatctctaaa

SEQ ID NO: 693948 - DNA, 25 bp, Mus musculus
gtcttccttttgagatggcttctgc

SEQ ID NO: 693949 - DNA, 25 bp, Mus musculus
gtcttccttttgataactcatgttg

SEQ ID NO: 693950 - DNA, 25 bp, Mus musculus
gtcttccttttgtgatggcttctgc

SEQ ID NO: 693951 - DNA, 25 bp, Mus musculus
gtcttccttttgttaactcatgttg

SEQ ID NO: 693952 - DNA, 25 bp, Mus musculus
gtcttcgaacagaagagtatctctc

SEQ ID NO: 693953 - DNA, 25 bp, Mus musculus
gtcttcgaacagtagagtatctctc

SEQ ID NO: 693954 - DNA, 25 bp, Mus musculus
gtcttcgaagacacatcacaccaga

SEQ ID NO: 693955 - DNA, 25 bp, Mus musculus
gtcttcgaagactcatcacaccaga

SEQ ID NO: 693956 - DNA, 25 bp, Mus musculus
gtcttcgaccgacacaagatgctca

SEQ ID NO: 693957 - DNA, 25 bp, Mus musculus
gtcttcgaccgagacaagatgctca

SEQ ID NO: 693958 - DNA, 25 bp, Mus musculus
gtcttcgactatcccatcagtgtga

SEQ ID NO: 693959 - DNA, 25 bp, Mus musculus
gtcttcgactatgccatcagtgtga

SEQ ID NO: 693960 - DNA, 25 bp, Mus musculus
gtcttcgagattcatcttcactggc

SEQ ID NO: 693961 - DNA, 25 bp, Mus musculus
gtcttcgagattgatcttcactggc

SEQ ID NO: 693962 - DNA, 25 bp, Mus musculus
gtcttcgagccaacacagttgtggt

SEQ ID NO: 693963 - DNA, 25 bp, Mus musculus
gtcttcgagccatcacagttgtggt

SEQ ID NO: 693964 - DNA, 25 bp, Mus musculus
gtcttcgataaacagacactctgtg

SEQ ID NO: 693965 - DNA, 25 bp, Mus musculus
gtcttcgataaagagacactctgtg

SEQ ID NO: 693966 - DNA, 25 bp, Mus musculus
gtcttcgattcaacacgcacattag

SEQ ID NO: 693967 - DNA, 25 bp, Mus musculus
gtcttcgattcatcacgcacattag

SEQ ID NO: 693968 - DNA, 25 bp, Mus musculus
gtcttcgattccaaactgaccatcc

SEQ ID NO: 693969 - DNA, 25 bp, Mus musculus
gtcttcgattcctaactgaccatcc

SEQ ID NO: 693970 - DNA, 25 bp, Mus musculus
gtcttcgcagaacgcagtcttccaa

SEQ ID NO: 693971 - DNA, 25 bp, Mus musculus
gtcttcgcagaaggcagtcttccaa

SEQ ID NO: 693972 - DNA, 25 bp, Mus musculus
gtcttcgcattgacagatgccgtta

SEQ ID NO: 693973 - DNA, 25 bp, Mus musculus
gtcttcgcattgtcagatgccgtta

SEQ ID NO: 693974 - DNA, 25 bp, Mus musculus
gtcttcggagcgactgagtttcaac

SEQ ID NO: 693975 - DNA, 25 bp, Mus musculus
gtcttcggagcgtctgagtttcaac

SEQ ID NO: 693976 - DNA, 25 bp, Mus musculus
gtcttcgtaagcacgagcgcagagt

SEQ ID NO: 693977 - DNA, 25 bp, Mus musculus
gtcttcgtaagctcgagcgcagagt

SEQ ID NO: 693978 - DNA, 25 bp, Mus musculus
gtcttcgtgggcaccggggacctct

SEQ ID NO: 693979 - DNA, 25 bp, Mus musculus
gtcttcgtgggctccggggacctct

SEQ ID NO: 693980 - DNA, 25 bp, Mus musculus
gtcttcgttagacctagttctctac

SEQ ID NO: 693981 - DNA, 25 bp, Mus musculus
gtcttcgttagagctagttctctac

SEQ ID NO: 693982 - DNA, 25 bp, Mus musculus
gtcttcgttcttctgagcttagtca

SEQ ID NO: 693983 - DNA, 25 bp, Mus musculus
gtcttcgttcttgtgagcttagtca

SEQ ID NO: 693984 - DNA, 25 bp, Mus musculus
gtcttctaaacacaataaatgcctg

SEQ ID NO: 693985 - DNA, 25 bp, Mus musculus
gtcttctaaacagaataaatgcctg

SEQ ID NO: 693986 - DNA, 25 bp, Mus musculus
gtcttctaagcacattagttttgcc

SEQ ID NO: 693987 - DNA, 25 bp, Mus musculus
gtcttctaagcagattagttttgcc

SEQ ID NO: 693988 - DNA, 25 bp, Mus musculus
gtcttctaagctagggccagttcat

SEQ ID NO: 693989 - DNA, 25 bp, Mus musculus
gtcttctaagcttgggccagttcat

SEQ ID NO: 693990 - DNA, 25 bp, Mus musculus
gtcttctaagggaatcatcccaaga

SEQ ID NO: 693991 - DNA, 25 bp, Mus musculus
gtcttctaagggtatcatcccaaga

SEQ ID NO: 693992 - DNA, 25 bp, Mus musculus
gtcttctaatcgcagccaattctgg

SEQ ID NO: 693993 - DNA, 25 bp, Mus musculus
gtcttctaatcggagccaattctgg

SEQ ID NO: 693994 - DNA, 25 bp, Mus musculus
gtcttctaatctatatgacagcaga

SEQ ID NO: 693995 - DNA, 25 bp, Mus musculus
gtcttctaatctttatgacagcaga

SEQ ID NO: 693996 - DNA, 25 bp, Mus musculus
gtcttctacatgataaatctttggg

SEQ ID NO: 693997 - DNA, 25 bp, Mus musculus
gtcttctacatgttaaatctttggg

SEQ ID NO: 693998 - DNA, 25 bp, Mus musculus
gtcttctacattctggttggcggct

SEQ ID NO: 693999 - DNA, 25 bp, Mus musculus
gtcttctacattgtggttggcggct

SEQ ID NO: 694000 - DNA, 25 bp, Mus musculus
gtcttctaccacaggagtcacttca

SEQ ID NO: 694001 - DNA, 25 bp, Mus musculus
gtcttctaccactggagtcacttca

SEQ ID NO: 694002 - DNA, 25 bp, Mus musculus
gtcttctacctgattgatctgccaa

SEQ ID NO: 694003 - DNA, 25 bp, Mus musculus
gtcttctacctgtttgatctgccaa

SEQ ID NO: 694004 - DNA, 25 bp, Mus musculus
gtcttctacgctatgagcccagctg

SEQ ID NO: 694005 - DNA, 25 bp, Mus musculus
gtcttctacgctttgagcccagctg

SEQ ID NO: 694006 - DNA, 25 bp, Mus musculus
gtcttctagcctatccttaattcaa

SEQ ID NO: 694007 - DNA, 25 bp, Mus musculus
gtcttctagcctttccttaattcaa

SEQ ID NO: 694008 - DNA, 25 bp, Mus musculus
gtcttctatatgaaagtgtcctgta

SEQ ID NO: 694009 - DNA, 25 bp, Mus musculus
gtcttctatatgtaagtgtcctgta

SEQ ID NO: 694010 - DNA, 25 bp, Mus musculus
gtcttctatgacaatccacaaataa

SEQ ID NO: 694011 - DNA, 25 bp, Mus musculus
gtcttctatgactatccacaaataa

SEQ ID NO: 694012 - DNA, 25 bp, Mus musculus
gtcttctatgctattactgtcctaa

SEQ ID NO: 694013 - DNA, 25 bp, Mus musculus
gtcttctatgcttttactgtcctaa

SEQ ID NO: 694014 - DNA, 25 bp, Mus musculus
gtcttctatgtaactcatttaccac

SEQ ID NO: 694015 - DNA, 25 bp, Mus musculus
gtcttctatgtatctcatttaccac

SEQ ID NO: 694016 - DNA, 25 bp, Mus musculus
gtcttctattcgagtaaataagagt

SEQ ID NO: 694017 - DNA, 25 bp, Mus musculus
gtcttctattcgtgtaaataagagt

SEQ ID NO: 694018 - DNA, 25 bp, Mus musculus
gtcttctattttcccatgactgaat

SEQ ID NO: 694019 - DNA, 25 bp, Mus musculus
gtcttctattttgccatgactgaat

SEQ ID NO: 694020 - DNA, 25 bp, Mus musculus
gtcttctcagaaagtgtgtgcatac

SEQ ID NO: 694021 - DNA, 25 bp, Mus musculus
gtcttctcagaaccctgttggacct

SEQ ID NO: 694022 - DNA, 25 bp, Mus musculus
gtcttctcagaagcctgttggacct

SEQ ID NO: 694023 - DNA, 25 bp, Mus musculus
gtcttctcagaatgtgtgtgcatac

SEQ ID NO: 694024 - DNA, 25 bp, Mus musculus
gtcttctcaggtaaacctaaagctg

SEQ ID NO: 694025 - DNA, 25 bp, Mus musculus
gtcttctcaggttaacctaaagctg

SEQ ID NO: 694026 - DNA, 25 bp, Mus musculus
gtcttctcatcaacacatttgtctt

SEQ ID NO: 694027 - DNA, 25 bp, Mus musculus
gtcttctcatcatcacatttgtctt

SEQ ID NO: 694028 - DNA, 25 bp, Mus musculus
gtcttctcatttcttgatgccttca

SEQ ID NO: 694029 - DNA, 25 bp, Mus musculus
gtcttctcatttgttgatgccttca

SEQ ID NO: 694030 - DNA, 25 bp, Mus musculus
gtcttctccaaaagcaccactaaga

SEQ ID NO: 694031 - DNA, 25 bp, Mus musculus
gtcttctccaaatgcaccactaaga

SEQ ID NO: 694032 - DNA, 25 bp, Mus musculus
gtcttctccaagatgaagggccgtg

SEQ ID NO: 694033 - DNA, 25 bp, Mus musculus
gtcttctccaagttgaagggccgtg

SEQ ID NO: 694034 - DNA, 25 bp, Mus musculus
gtcttctccagcagcttaaagcaga

SEQ ID NO: 694035 - DNA, 25 bp, Mus musculus
gtcttctccagctgcttaaagcaga

SEQ ID NO: 694036 - DNA, 25 bp, Mus musculus
gtcttctcccttctaacgcaggaaa

SEQ ID NO: 694037 - DNA, 25 bp, Mus musculus
gtcttctcccttgtaacgcaggaaa

SEQ ID NO: 694038 - DNA, 25 bp, Mus musculus
gtcttctcctggaacccgctatgta

SEQ ID NO: 694039 - DNA, 25 bp, Mus musculus
gtcttctcctggtacccgctatgta

SEQ ID NO: 694040 - DNA, 25 bp, Mus musculus
gtcttctcgagcagctggaagctaa

SEQ ID NO: 694041 - DNA, 25 bp, Mus musculus
gtcttctcgagctgctggaagctaa

SEQ ID NO: 694042 - DNA, 25 bp, Mus musculus
gtcttctcgggcaagggctccggta

SEQ ID NO: 694043 - DNA, 25 bp, Mus musculus
gtcttctcgggctagggctccggta

SEQ ID NO: 694044 - DNA, 25 bp, Mus musculus
gtcttctcggtgctctacacggtac

SEQ ID NO: 694045 - DNA, 25 bp, Mus musculus
gtcttctcggtggtctacacggtac

SEQ ID NO: 694046 - DNA, 25 bp, Mus musculus
gtcttctcgtgaatagagctcaagt

SEQ ID NO: 694047 - DNA, 25 bp, Mus musculus
gtcttctcgtgattagagctcaagt

SEQ ID NO: 694048 - DNA, 25 bp, Mus musculus
gtcttctcgttcacaaaccttagta

SEQ ID NO: 694049 - DNA, 25 bp, Mus musculus
gtcttctcgttctcaaaccttagta

SEQ ID NO: 694050 - DNA, 25 bp, Mus musculus
gtcttctctaagcacagtgccacaa

SEQ ID NO: 694051 - DNA, 25 bp, Mus musculus
gtcttctctaaggacagtgccacaa

SEQ ID NO: 694052 - DNA, 25 bp, Mus musculus
gtcttctctcaaatgctacttggca

SEQ ID NO: 694053 - DNA, 25 bp, Mus musculus
gtcttctctcaattgctacttggca

SEQ ID NO: 694054 - DNA, 25 bp, Mus musculus
gtcttctctggtcgcagcaacgagg

SEQ ID NO: 694055 - DNA, 25 bp, Mus musculus
gtcttctctggtggcagcaacgagg

SEQ ID NO: 694056 - DNA, 25 bp, Mus musculus
gtcttctctgtgctcctggtataaa

SEQ ID NO: 694057 - DNA, 25 bp, Mus musculus
gtcttctctgtggtcctggtataaa

SEQ ID NO: 694058 - DNA, 25 bp, Mus musculus
gtcttctcttatcgaagagccccat

SEQ ID NO: 694059 - DNA, 25 bp, Mus musculus
gtcttctcttatggaagagccccat

SEQ ID NO: 694060 - DNA, 25 bp, Mus musculus
gtcttctcttgacagtcgtgagcat

SEQ ID NO: 694061 - DNA, 25 bp, Mus musculus
gtcttctcttgagagtcgtgagcat

SEQ ID NO: 694062 - DNA, 25 bp, Mus musculus
gtcttctctttgctcaagatgaact

SEQ ID NO: 694063 - DNA, 25 bp, Mus musculus
gtcttctctttggtcaagatgaact

SEQ ID NO: 694064 - DNA, 25 bp, Mus musculus
gtcttctgaaggatgagggtcttat

SEQ ID NO: 694065 - DNA, 25 bp, Mus musculus
gtcttctgaaggttgagggtcttat

SEQ ID NO: 694066 - DNA, 25 bp, Mus musculus
gtcttctgacaaccctctgtgtata

SEQ ID NO: 694067 - DNA, 25 bp, Mus musculus
gtcttctgacaagcctctgtgtata

SEQ ID NO: 694068 - DNA, 25 bp, Mus musculus
gtcttctgaccgcagccagggttgc

SEQ ID NO: 694069 - DNA, 25 bp, Mus musculus
gtcttctgaccggagccagggttgc

SEQ ID NO: 694070 - DNA, 25 bp, Mus musculus
gtcttctgacgtagcacagctgtca

SEQ ID NO: 694071 - DNA, 25 bp, Mus musculus
gtcttctgacgttgcacagctgtca

SEQ ID NO: 694072 - DNA, 25 bp, Mus musculus
gtcttctgacttaaaaatgtgcacc

SEQ ID NO: 694073 - DNA, 25 bp, Mus musculus
gtcttctgactttaaaatgtgcacc

SEQ ID NO: 694074 - DNA, 25 bp, Mus musculus
gtcttctgagacaagctgcaactga

SEQ ID NO: 694075 - DNA, 25 bp, Mus musculus
gtcttctgagactagctgcaactga

SEQ ID NO: 694076 - DNA, 25 bp, Mus musculus
gtcttctgagatcaacgctgtggtt

SEQ ID NO: 694077 - DNA, 25 bp, Mus musculus
gtcttctgagatgaacgctgtggtt

SEQ ID NO: 694078 - DNA, 25 bp, Mus musculus
gtcttctgattcagaggagttgggc

SEQ ID NO: 694079 - DNA, 25 bp, Mus musculus
gtcttctgattctgaggagttgggc

SEQ ID NO: 694080 - DNA, 25 bp, Mus musculus
gtcttctgcactcacacttaaaatt

SEQ ID NO: 694081 - DNA, 25 bp, Mus musculus
gtcttctgcactgacacttaaaatt

SEQ ID NO: 694082 - DNA, 25 bp, Mus musculus
gtcttctgcagtccggacctaaata

SEQ ID NO: 694083 - DNA, 25 bp, Mus musculus
gtcttctgcagtgcggacctaaata

SEQ ID NO: 694084 - DNA, 25 bp, Mus musculus
gtcttctgccagcaaacccaaagct

SEQ ID NO: 694085 - DNA, 25 bp, Mus musculus
gtcttctgccaggaaacccaaagct

SEQ ID NO: 694086 - DNA, 25 bp, Mus musculus
gtcttctgccccaacaaggtggaat

SEQ ID NO: 694087 - DNA, 25 bp, Mus musculus
gtcttctgcccctacaaggtggaat

SEQ ID NO: 694088 - DNA, 25 bp, Mus musculus
gtcttctgcttgatttctggaactg

SEQ ID NO: 694089 - DNA, 25 bp, Mus musculus
gtcttctgcttgttttctggaactg

SEQ ID NO: 694090 - DNA, 25 bp, Mus musculus
gtcttctggcctatgatggatctga

SEQ ID NO: 694091 - DNA, 25 bp, Mus musculus
gtcttctggcctttgatggatctga

SEQ ID NO: 694092 - DNA, 25 bp, Mus musculus
gtcttctgtaagacagttcattcta

SEQ ID NO: 694093 - DNA, 25 bp, Mus musculus
gtcttctgtaagtcagttcattcta

SEQ ID NO: 694094 - DNA, 25 bp, Mus musculus
gtcttctgtagacacagctggtcaa

SEQ ID NO: 694095 - DNA, 25 bp, Mus musculus
gtcttctgtagagacagctggtcaa

SEQ ID NO: 694096 - DNA, 25 bp, Mus musculus
gtcttctgtatcagctggaatcatg

SEQ ID NO: 694097 - DNA, 25 bp, Mus musculus
gtcttctgtatctgctggaatcatg

SEQ ID NO: 694098 - DNA, 25 bp, Mus musculus
gtcttctgtcagctttatgtacgtg

SEQ ID NO: 694099 - DNA, 25 bp, Mus musculus
gtcttctgtcaggtttatgtacgtg

SEQ ID NO: 694100 - DNA, 25 bp, Mus musculus
gtcttctgtgaaagtttatcctagt

SEQ ID NO: 694101 - DNA, 25 bp, Mus musculus
gtcttctgtgaacggccactacatg

SEQ ID NO: 694102 - DNA, 25 bp, Mus musculus
gtcttctgtgaagggccactacatg

SEQ ID NO: 694103 - DNA, 25 bp, Mus musculus
gtcttctgtgaatgtttatcctagt

SEQ ID NO: 694104 - DNA, 25 bp, Mus musculus
gtcttctgtgacattatctgttttt

SEQ ID NO: 694105 - DNA, 25 bp, Mus musculus
gtcttctgtgactttatctgttttt

SEQ ID NO: 694106 - DNA, 25 bp, Mus musculus
gtcttctgtgtaactactcttgggt

SEQ ID NO: 694107 - DNA, 25 bp, Mus musculus
gtcttctgtgtatctactcttgggt

SEQ ID NO: 694108 - DNA, 25 bp, Mus musculus
gtcttctgtgttaacatgaactgtt

SEQ ID NO: 694109 - DNA, 25 bp, Mus musculus
gtcttctgtgtttacatgaactgtt

SEQ ID NO: 694110 - DNA, 25 bp, Mus musculus
gtcttctgtttcaattgtgggatgt

SEQ ID NO: 694111 - DNA, 25 bp, Mus musculus
gtcttctgtttctattgtgggatgt

SEQ ID NO: 694112 - DNA, 25 bp, Mus musculus
gtcttctgtttgagggacatctatg

SEQ ID NO: 694113 - DNA, 25 bp, Mus musculus
gtcttctgtttgtgggacatctatg

SEQ ID NO: 694114 - DNA, 25 bp, Mus musculus
gtcttctgttttctacatcccttat

SEQ ID NO: 694115 - DNA, 25 bp, Mus musculus
gtcttctgttttgtacatcccttat

SEQ ID NO: 694116 - DNA, 25 bp, Mus musculus
gtcttcttagggagtcaggctgcat

SEQ ID NO: 694117 - DNA, 25 bp, Mus musculus
gtcttcttagggtgtcaggctgcat

SEQ ID NO: 694118 - DNA, 25 bp, Mus musculus
gtcttcttcctcatgctgtgaggga

SEQ ID NO: 694119 - DNA, 25 bp, Mus musculus
gtcttcttcctcttgctgtgaggga

SEQ ID NO: 694120 - DNA, 25 bp, Mus musculus
gtcttcttcgctcgacagttgtaaa

SEQ ID NO: 694121 - DNA, 25 bp, Mus musculus
gtcttcttcgctggacagttgtaaa

SEQ ID NO: 694122 - DNA, 25 bp, Mus musculus
gtcttcttcggaccagatttcatca

SEQ ID NO: 694123 - DNA, 25 bp, Mus musculus
gtcttcttcggagcagatttcatca

SEQ ID NO: 694124 - DNA, 25 bp, Mus musculus
gtcttcttctggactgatgggtcca

SEQ ID NO: 694125 - DNA, 25 bp, Mus musculus
gtcttcttctggtctgatgggtcca

SEQ ID NO: 694126 - DNA, 25 bp, Mus musculus
gtcttcttcttcattggattcacgg

SEQ ID NO: 694127 - DNA, 25 bp, Mus musculus
gtcttcttcttctttggattcacgg

SEQ ID NO: 694128 - DNA, 25 bp, Mus musculus
gtcttcttgagtcacgagtccagtg

SEQ ID NO: 694129 - DNA, 25 bp, Mus musculus
gtcttcttgagtgacgagtccagtg

SEQ ID NO: 694130 - DNA, 25 bp, Mus musculus
gtcttcttggtgagcttggagaaca

SEQ ID NO: 694131 - DNA, 25 bp, Mus musculus
gtcttcttggtgtgcttggagaaca

SEQ ID NO: 694132 - DNA, 25 bp, Mus musculus
gtcttctttcaaatgtacatgtcaa

SEQ ID NO: 694133 - DNA, 25 bp, Mus musculus
gtcttctttcaattgtacatgtcaa

SEQ ID NO: 694134 - DNA, 25 bp, Mus musculus
gtcttctttcagattggttcaggtc

SEQ ID NO: 694135 - DNA, 25 bp, Mus musculus
gtcttctttcagtttggttcaggtc

SEQ ID NO: 694136 - DNA, 25 bp, Mus musculus
gtcttctttggtcagctgactgatg

SEQ ID NO: 694137 - DNA, 25 bp, Mus musculus
gtcttctttggtgagctgactgatg

SEQ ID NO: 694138 - DNA, 25 bp, Mus musculus
gtcttctttgtcacctgttcataga

SEQ ID NO: 694139 - DNA, 25 bp, Mus musculus
gtcttctttgtcagcactggatgga

SEQ ID NO: 694140 - DNA, 25 bp, Mus musculus
gtcttctttgtcatttgatactttg

SEQ ID NO: 694141 - DNA, 25 bp, Mus musculus
gtcttctttgtctcctgttcataga

SEQ ID NO: 694142 - DNA, 25 bp, Mus musculus
gtcttctttgtctgcactggatgga

SEQ ID NO: 694143 - DNA, 25 bp, Mus musculus
gtcttctttgtcttttgatactttg

SEQ ID NO: 694144 - DNA, 25 bp, Mus musculus
gtcttctttgttcatttagtctgtt

SEQ ID NO: 694145 - DNA, 25 bp, Mus musculus
gtcttctttgttgatttagtctgtt

SEQ ID NO: 694146 - DNA, 25 bp, Mus musculus
gtcttcttttatagatcatagagtg

SEQ ID NO: 694147 - DNA, 25 bp, Mus musculus
gtcttcttttattgatcatagagtg

SEQ ID NO: 694148 - DNA, 25 bp, Mus musculus
gtcttcttttggagacccaggagtg

SEQ ID NO: 694149 - DNA, 25 bp, Mus musculus
gtcttcttttggtgacccaggagtg

SEQ ID NO: 694150 - DNA, 25 bp, Mus musculus
gtcttctttttacctgggttcaaca

SEQ ID NO: 694151 - DNA, 25 bp, Mus musculus
gtcttctttttagctgggttcaaca

SEQ ID NO: 694152 - DNA, 25 bp, Mus musculus
gtcttctttttcaggtttctcactt

SEQ ID NO: 694153 - DNA, 25 bp, Mus musculus
gtcttctttttctggtttctcactt

SEQ ID NO: 694154 - DNA, 25 bp, Mus musculus
gtcttgaaaaagactacacctgttc

SEQ ID NO: 694155 - DNA, 25 bp, Mus musculus
gtcttgaaaaagtctacacctgttc

SEQ ID NO: 694156 - DNA, 25 bp, Mus musculus
gtcttgaaaaatctcccattcggga

SEQ ID NO: 694157 - DNA, 25 bp, Mus musculus
gtcttgaaaaatgtcccattcggga

SEQ ID NO: 694158 - DNA, 25 bp, Mus musculus
gtcttgaaagccagtcttcattccc

SEQ ID NO: 694159 - DNA, 25 bp, Mus musculus
gtcttgaaagccattctgtgtgtat

SEQ ID NO: 694160 - DNA, 25 bp, Mus musculus
gtcttgaaagcctgtcttcattccc

SEQ ID NO: 694161 - DNA, 25 bp, Mus musculus
gtcttgaaagcctttctgtgtgtat

SEQ ID NO: 694162 - DNA, 25 bp, Mus musculus
gtcttgaaatgtcagctgtcagctg

SEQ ID NO: 694163 - DNA, 25 bp, Mus musculus
gtcttgaaatgtgagctgtcagctg

SEQ ID NO: 694164 - DNA, 25 bp, Mus musculus
gtcttgaaccccagacctcctgtgt

SEQ ID NO: 694165 - DNA, 25 bp, Mus musculus
gtcttgaacccctgacctcctgtgt

SEQ ID NO: 694166 - DNA, 25 bp, Mus musculus
gtcttgaactcacaactgtgtcttt

SEQ ID NO: 694167 - DNA, 25 bp, Mus musculus
gtcttgaactcagaactgtgtcttt

SEQ ID NO: 694168 - DNA, 25 bp, Mus musculus
gtcttgaagcgcaaacaccactgga

SEQ ID NO: 694169 - DNA, 25 bp, Mus musculus
gtcttgaagcgctaacaccactgga

SEQ ID NO: 694170 - DNA, 25 bp, Mus musculus
gtcttgaaggccacctggactgctt

SEQ ID NO: 694171 - DNA, 25 bp, Mus musculus
gtcttgaaggcctcctggactgctt

SEQ ID NO: 694172 - DNA, 25 bp, Mus musculus
gtcttgaagtcgctacacaggagta

SEQ ID NO: 694173 - DNA, 25 bp, Mus musculus
gtcttgaagtcggtacacaggagta

SEQ ID NO: 694174 - DNA, 25 bp, Mus musculus
gtcttgaagtctcctgccttggatt

SEQ ID NO: 694175 - DNA, 25 bp, Mus musculus
gtcttgaagtctgctgccttggatt

SEQ ID NO: 694176 - DNA, 25 bp, Mus musculus
gtcttgacactccttgtgacttcac

SEQ ID NO: 694177 - DNA, 25 bp, Mus musculus
gtcttgacactcgttgtgacttcac

SEQ ID NO: 694178 - DNA, 25 bp, Mus musculus
gtcttgacacttaggctgctatgca

SEQ ID NO: 694179 - DNA, 25 bp, Mus musculus
gtcttgacactttggctgctatgca

SEQ ID NO: 694180 - DNA, 25 bp, Mus musculus
gtcttgacataaacatccagcctca

SEQ ID NO: 694181 - DNA, 25 bp, Mus musculus
gtcttgacataatcatccagcctca

SEQ ID NO: 694182 - DNA, 25 bp, Mus musculus
gtcttgaccagacataaaccctatt

SEQ ID NO: 694183 - DNA, 25 bp, Mus musculus
gtcttgaccagagataaaccctatt

SEQ ID NO: 694184 - DNA, 25 bp, Mus musculus
gtcttgaccttgaaacttgccatgg

SEQ ID NO: 694185 - DNA, 25 bp, Mus musculus
gtcttgaccttgtaacttgccatgg

SEQ ID NO: 694186 - DNA, 25 bp, Mus musculus
gtcttgactgcacttttatgtaaca

SEQ ID NO: 694187 - DNA, 25 bp, Mus musculus
gtcttgactgcagttttatgtaaca

SEQ ID NO: 694188 - DNA, 25 bp, Mus musculus
gtcttgacttatatactctgtacca

SEQ ID NO: 694189 - DNA, 25 bp, Mus musculus
gtcttgacttatttactctgtacca

SEQ ID NO: 694190 - DNA, 25 bp, Mus musculus
gtcttgagacacatctctcatctgg

SEQ ID NO: 694191 - DNA, 25 bp, Mus musculus
gtcttgagacacttctctcatctgg

SEQ ID NO: 694192 - DNA, 25 bp, Mus musculus
gtcttgagctacaaaaggatgcaat

SEQ ID NO: 694193 - DNA, 25 bp, Mus musculus
gtcttgagctactaaaggatgcaat

SEQ ID NO: 694194 - DNA, 25 bp, Mus musculus
gtcttgagtgccctaagttgtcagc

SEQ ID NO: 694195 - DNA, 25 bp, Mus musculus
gtcttgagtgccgtaagttgtcagc

SEQ ID NO: 694196 - DNA, 25 bp, Mus musculus
gtcttgagtttgcatacctaacctt

SEQ ID NO: 694197 - DNA, 25 bp, Mus musculus
gtcttgagtttggatacctaacctt

SEQ ID NO: 694198 - DNA, 25 bp, Mus musculus
gtcttgatggtcagccatagtccag

SEQ ID NO: 694199 - DNA, 25 bp, Mus musculus
gtcttgatggtctgccatagtccag

SEQ ID NO: 694200 - DNA, 25 bp, Mus musculus
gtcttgattgcgaaggtttgacctg

SEQ ID NO: 694201 - DNA, 25 bp, Mus musculus
gtcttgattgcgtaggtttgacctg

SEQ ID NO: 694202 - DNA, 25 bp, Mus musculus
gtcttgattgttctcctccgcttag

SEQ ID NO: 694203 - DNA, 25 bp, Mus musculus
gtcttgattgttgtcctccgcttag

SEQ ID NO: 694204 - DNA, 25 bp, Mus musculus
gtcttgcaaaagaatcattaacata

SEQ ID NO: 694205 - DNA, 25 bp, Mus musculus
gtcttgcaaaagtatcattaacata

SEQ ID NO: 694206 - DNA, 25 bp, Mus musculus
gtcttgcaacagatttaaagcctct

SEQ ID NO: 694207 - DNA, 25 bp, Mus musculus
gtcttgcaacagttttaaagcctct

SEQ ID NO: 694208 - DNA, 25 bp, Mus musculus
gtcttgcaactaactctgtagaaca

SEQ ID NO: 694209 - DNA, 25 bp, Mus musculus
gtcttgcaactatctctgtagaaca

SEQ ID NO: 694210 - DNA, 25 bp, Mus musculus
gtcttgcacatcagaccttgcagaa

SEQ ID NO: 694211 - DNA, 25 bp, Mus musculus
gtcttgcacatctgaccttgcagaa

SEQ ID NO: 694212 - DNA, 25 bp, Mus musculus
gtcttgcactgcaaaccagggacta

SEQ ID NO: 694213 - DNA, 25 bp, Mus musculus
gtcttgcactgctaaccagggacta

SEQ ID NO: 694214 - DNA, 25 bp, Mus musculus
gtcttgcagacccatgaacttgcca

SEQ ID NO: 694215 - DNA, 25 bp, Mus musculus
gtcttgcagaccgatgaacttgcca

SEQ ID NO: 694216 - DNA, 25 bp, Mus musculus
gtcttgcagctgacaacatcttgag

SEQ ID NO: 694217 - DNA, 25 bp, Mus musculus
gtcttgcagctgtcaacatcttgag

SEQ ID NO: 694218 - DNA, 25 bp, Mus musculus
gtcttgcatcctcttttagtttctt

SEQ ID NO: 694219 - DNA, 25 bp, Mus musculus
gtcttgcatcctgttttagtttctt

SEQ ID NO: 694220 - DNA, 25 bp, Mus musculus
gtcttgcatttacaggattttcagc

SEQ ID NO: 694221 - DNA, 25 bp, Mus musculus
gtcttgcatttagaggattttcagc

SEQ ID NO: 694222 - DNA, 25 bp, Mus musculus
gtcttgccaaagcttcctgaaaaca

SEQ ID NO: 694223 - DNA, 25 bp, Mus musculus
gtcttgccaaaggttcctgaaaaca

SEQ ID NO: 694224 - DNA, 25 bp, Mus musculus
gtcttgccaccactgtagcacagta

SEQ ID NO: 694225 - DNA, 25 bp, Mus musculus
gtcttgccaccagtgtagcacagta

SEQ ID NO: 694226 - DNA, 25 bp, Mus musculus
gtcttgccacttctgattcctaaca

SEQ ID NO: 694227 - DNA, 25 bp, Mus musculus
gtcttgccacttgtgattcctaaca

SEQ ID NO: 694228 - DNA, 25 bp, Mus musculus
gtcttgccatacaagcatgatgact

SEQ ID NO: 694229 - DNA, 25 bp, Mus musculus
gtcttgccatactagcatgatgact

SEQ ID NO: 694230 - DNA, 25 bp, Mus musculus
gtcttgccatccatatttccagaaa

SEQ ID NO: 694231 - DNA, 25 bp, Mus musculus
gtcttgccatccttatttccagaaa

SEQ ID NO: 694232 - DNA, 25 bp, Mus musculus
gtcttgccgccaccatgtgatataa

SEQ ID NO: 694233 - DNA, 25 bp, Mus musculus
gtcttgccgccagcatgtgatataa

SEQ ID NO: 694234 - DNA, 25 bp, Mus musculus
gtcttgcctgaaaagactgtgggtg

SEQ ID NO: 694235 - DNA, 25 bp, Mus musculus
gtcttgcctgaatagactgtgggtg

SEQ ID NO: 694236 - DNA, 25 bp, Mus musculus
gtcttgccttatctcatttaactga

SEQ ID NO: 694237 - DNA, 25 bp, Mus musculus
gtcttgccttatgtcatttaactga

SEQ ID NO: 694238 - DNA, 25 bp, Mus musculus
gtcttgccttcgatcttttgtctca

SEQ ID NO: 694239 - DNA, 25 bp, Mus musculus
gtcttgccttcgttcttttgtctca

SEQ ID NO: 694240 - DNA, 25 bp, Mus musculus
gtcttgccttggctataagctttta

SEQ ID NO: 694241 - DNA, 25 bp, Mus musculus
gtcttgccttgggtataagctttta

SEQ ID NO: 694242 - DNA, 25 bp, Mus musculus
gtcttgcgcaaaattgacccgtcct

SEQ ID NO: 694243 - DNA, 25 bp, Mus musculus
gtcttgcgcaaatttgacccgtcct

SEQ ID NO: 694244 - DNA, 25 bp, Mus musculus
gtcttgcgcttgctatgagatcatt

SEQ ID NO: 694245 - DNA, 25 bp, Mus musculus
gtcttgcgcttggtatgagatcatt

SEQ ID NO: 694246 - DNA, 25 bp, Mus musculus
gtcttgctatatagcctcatactgt

SEQ ID NO: 694247 - DNA, 25 bp, Mus musculus
gtcttgctatattgcctcatactgt

SEQ ID NO: 694248 - DNA, 25 bp, Mus musculus
gtcttgctcaacaccacagtgggaa

SEQ ID NO: 694249 - DNA, 25 bp, Mus musculus
gtcttgctcaactccacagtgggaa

SEQ ID NO: 694250 - DNA, 25 bp, Mus musculus
gtcttgctcaggcattaaacccagg

SEQ ID NO: 694251 - DNA, 25 bp, Mus musculus
gtcttgctcagggattaaacccagg

SEQ ID NO: 694252 - DNA, 25 bp, Mus musculus
gtcttgctgactagggcttgggcta

SEQ ID NO: 694253 - DNA, 25 bp, Mus musculus
gtcttgctgactctggcttatttgg

SEQ ID NO: 694254 - DNA, 25 bp, Mus musculus
gtcttgctgactgtggcttatttgg

SEQ ID NO: 694255 - DNA, 25 bp, Mus musculus
gtcttgctgacttgggcttgggcta

SEQ ID NO: 694256 - DNA, 25 bp, Mus musculus
gtcttgctgctaagacgttggcaga

SEQ ID NO: 694257 - DNA, 25 bp, Mus musculus
gtcttgctgctatgacgttggcaga

SEQ ID NO: 694258 - DNA, 25 bp, Mus musculus
gtcttgctgtttagcagttctttgc

SEQ ID NO: 694259 - DNA, 25 bp, Mus musculus
gtcttgctgttttgcagttctttgc

SEQ ID NO: 694260 - DNA, 25 bp, Mus musculus
gtcttgcttaaaagagcctgccggt

SEQ ID NO: 694261 - DNA, 25 bp, Mus musculus
gtcttgcttaaatgagcctgccggt

SEQ ID NO: 694262 - DNA, 25 bp, Mus musculus
gtcttgcttatgattttgagcactg

SEQ ID NO: 694263 - DNA, 25 bp, Mus musculus
gtcttgcttatgtttttgagcactg

SEQ ID NO: 694264 - DNA, 25 bp, Mus musculus
gtcttgcttggcatcattcatagta

SEQ ID NO: 694265 - DNA, 25 bp, Mus musculus
gtcttgcttggcttcattcatagta

SEQ ID NO: 694266 - DNA, 25 bp, Mus musculus
gtcttgcttgtaattgttgtataaa

SEQ ID NO: 694267 - DNA, 25 bp, Mus musculus
gtcttgcttgtatttgttgtataaa

SEQ ID NO: 694268 - DNA, 25 bp, Mus musculus
gtcttgctttgaacctttagagttt

SEQ ID NO: 694269 - DNA, 25 bp, Mus musculus
gtcttgctttgatcctttagagttt

SEQ ID NO: 694270 - DNA, 25 bp, Mus musculus
gtcttgctttgtcaatgggcaccag

SEQ ID NO: 694271 - DNA, 25 bp, Mus musculus
gtcttgctttgtgaatgggcaccag

SEQ ID NO: 694272 - DNA, 25 bp, Mus musculus
gtcttggaaacgcagtccatctgtt

SEQ ID NO: 694273 - DNA, 25 bp, Mus musculus
gtcttggaaacggagtccatctgtt

SEQ ID NO: 694274 - DNA, 25 bp, Mus musculus
gtcttggaaatgctccttccccttg

SEQ ID NO: 694275 - DNA, 25 bp, Mus musculus
gtcttggaaatggtccttccccttg

SEQ ID NO: 694276 - DNA, 25 bp, Mus musculus
gtcttggaacctctctatgtagaac

SEQ ID NO: 694277 - DNA, 25 bp, Mus musculus
gtcttggaacctgtctatgtagaac

SEQ ID NO: 694278 - DNA, 25 bp, Mus musculus
gtcttggaagaccactgatcactaa

SEQ ID NO: 694279 - DNA, 25 bp, Mus musculus
gtcttggaagacgactgatcactaa

SEQ ID NO: 694280 - DNA, 25 bp, Mus musculus
gtcttggaagggaggtctttataca

SEQ ID NO: 694281 - DNA, 25 bp, Mus musculus
gtcttggaagggtggtctttataca

SEQ ID NO: 694282 - DNA, 25 bp, Mus musculus
gtcttggaattccagtagccatcca

SEQ ID NO: 694283 - DNA, 25 bp, Mus musculus
gtcttggaattcgagtagccatcca

SEQ ID NO: 694284 - DNA, 25 bp, Mus musculus
gtcttggacatcatggatccgcaaa

SEQ ID NO: 694285 - DNA, 25 bp, Mus musculus
gtcttggacatcttggatccgcaaa

SEQ ID NO: 694286 - DNA, 25 bp, Mus musculus
gtcttggaccaaataattacaggag

SEQ ID NO: 694287 - DNA, 25 bp, Mus musculus
gtcttggaccaattaattacaggag

SEQ ID NO: 694288 - DNA, 25 bp, Mus musculus
gtcttggactttcatttttcctctt

SEQ ID NO: 694289 - DNA, 25 bp, Mus musculus
gtcttggactttgatttttcctctt

SEQ ID NO: 694290 - DNA, 25 bp, Mus musculus
gtcttggagagaacctgctcactca

SEQ ID NO: 694291 - DNA, 25 bp, Mus musculus
gtcttggagagatcctgctcactca

SEQ ID NO: 694292 - DNA, 25 bp, Mus musculus
gtcttggagcttcacatccctggaa

SEQ ID NO: 694293 - DNA, 25 bp, Mus musculus
gtcttggagcttgacatccctggaa

SEQ ID NO: 694294 - DNA, 25 bp, Mus musculus
gtcttggaggctaccccacaagcga

SEQ ID NO: 694295 - DNA, 25 bp, Mus musculus
gtcttggaggctagggactgatatt

SEQ ID NO: 694296 - DNA, 25 bp, Mus musculus
gtcttggaggcttccccacaagcga

SEQ ID NO: 694297 - DNA, 25 bp, Mus musculus
gtcttggaggcttgggactgatatt

SEQ ID NO: 694298 - DNA, 25 bp, Mus musculus
gtcttggatcaacggcaggacactt

SEQ ID NO: 694299 - DNA, 25 bp, Mus musculus
gtcttggatcaagggcaggacactt

SEQ ID NO: 694300 - DNA, 25 bp, Mus musculus
gtcttggatccccaaatctttctta

SEQ ID NO: 694301 - DNA, 25 bp, Mus musculus
gtcttggatcccgaaatctttctta

SEQ ID NO: 694302 - DNA, 25 bp, Mus musculus
gtcttggatctcagctaagtctata

SEQ ID NO: 694303 - DNA, 25 bp, Mus musculus
gtcttggatctctgctaagtctata

SEQ ID NO: 694304 - DNA, 25 bp, Mus musculus
gtcttggatgttatcctgtaaggga

SEQ ID NO: 694305 - DNA, 25 bp, Mus musculus
gtcttggatgttttcctgtaaggga

SEQ ID NO: 694306 - DNA, 25 bp, Mus musculus
gtcttggattttctcacaccgactc

SEQ ID NO: 694307 - DNA, 25 bp, Mus musculus
gtcttggattttgtcacaccgactc

SEQ ID NO: 694308 - DNA, 25 bp, Mus musculus
gtcttggcactacctgaaaaacatg

SEQ ID NO: 694309 - DNA, 25 bp, Mus musculus
gtcttggcactagctgaaaaacatg

SEQ ID NO: 694310 - DNA, 25 bp, Mus musculus
gtcttggcagctcactcttgcacag

SEQ ID NO: 694311 - DNA, 25 bp, Mus musculus
gtcttggcagctgactcttgcacag

SEQ ID NO: 694312 - DNA, 25 bp, Mus musculus
gtcttggctaaaaagcaagtcccaa

SEQ ID NO: 694313 - DNA, 25 bp, Mus musculus
gtcttggctaaatagcaagtcccaa

SEQ ID NO: 694314 - DNA, 25 bp, Mus musculus
gtcttggctacactaaacctctttt

SEQ ID NO: 694315 - DNA, 25 bp, Mus musculus
gtcttggctacagtaaacctctttt

SEQ ID NO: 694316 - DNA, 25 bp, Mus musculus
gtcttggctccaattatttcctgtg

SEQ ID NO: 694317 - DNA, 25 bp, Mus musculus
gtcttggctccatttatttcctgtg

SEQ ID NO: 694318 - DNA, 25 bp, Mus musculus
gtcttggctggtaagtttctactac

SEQ ID NO: 694319 - DNA, 25 bp, Mus musculus
gtcttggctggttagtttctactac

SEQ ID NO: 694320 - DNA, 25 bp, Mus musculus
gtcttgggaaataagctcaggtgaa

SEQ ID NO: 694321 - DNA, 25 bp, Mus musculus
gtcttgggaaattagctcaggtgaa

SEQ ID NO: 694322 - DNA, 25 bp, Mus musculus
gtcttgggacagcatgaaatcagaa

SEQ ID NO: 694323 - DNA, 25 bp, Mus musculus
gtcttgggacaggatgaaatcagaa

SEQ ID NO: 694324 - DNA, 25 bp, Mus musculus
gtcttgggactgaaccatagccata

SEQ ID NO: 694325 - DNA, 25 bp, Mus musculus
gtcttgggactgtaccatagccata

SEQ ID NO: 694326 - DNA, 25 bp, Mus musculus
gtcttgggattgacagtacaactgt

SEQ ID NO: 694327 - DNA, 25 bp, Mus musculus
gtcttgggattgtcagtacaactgt

SEQ ID NO: 694328 - DNA, 25 bp, Mus musculus
gtcttgggcaaaagtcactcttgct

SEQ ID NO: 694329 - DNA, 25 bp, Mus musculus
gtcttgggcaaatgtcactcttgct

SEQ ID NO: 694330 - DNA, 25 bp, Mus musculus
gtcttgggcttcctattgattcgat

SEQ ID NO: 694331 - DNA, 25 bp, Mus musculus
gtcttgggcttcgtattgattcgat

SEQ ID NO: 694332 - DNA, 25 bp, Mus musculus
gtcttgggctttagacaacatctgg

SEQ ID NO: 694333 - DNA, 25 bp, Mus musculus
gtcttgggcttttgacaacatctgg

SEQ ID NO: 694334 - DNA, 25 bp, Mus musculus
gtcttgggtgtccttattcttcaaa

SEQ ID NO: 694335 - DNA, 25 bp, Mus musculus
gtcttgggtgtcgttattcttcaaa

SEQ ID NO: 694336 - DNA, 25 bp, Mus musculus
gtcttggtaacgacaacccagctga

SEQ ID NO: 694337 - DNA, 25 bp, Mus musculus
gtcttggtaacgtcaacccagctga

SEQ ID NO: 694338 - DNA, 25 bp, Mus musculus
gtcttggtctctcctcagtgaaatt

SEQ ID NO: 694339 - DNA, 25 bp, Mus musculus
gtcttggtctctgctcagtgaaatt

SEQ ID NO: 694340 - DNA, 25 bp, Mus musculus
gtcttggtctgaattccaactgcct

SEQ ID NO: 694341 - DNA, 25 bp, Mus musculus
gtcttggtctgatttccaactgcct

SEQ ID NO: 694342 - DNA, 25 bp, Mus musculus
gtcttggtgacgaccttatctggga

SEQ ID NO: 694343 - DNA, 25 bp, Mus musculus
gtcttggtgacgtccttatctggga

SEQ ID NO: 694344 - DNA, 25 bp, Mus musculus
gtcttggtgcttactgttcctaaac

SEQ ID NO: 694345 - DNA, 25 bp, Mus musculus
gtcttggtgctttctgttcctaaac

SEQ ID NO: 694346 - DNA, 25 bp, Mus musculus
gtcttggtggagaaaccctcgctga

SEQ ID NO: 694347 - DNA, 25 bp, Mus musculus
gtcttggtggagtaaccctcgctga

SEQ ID NO: 694348 - DNA, 25 bp, Mus musculus
gtcttggtgtgcattctgtagtata

SEQ ID NO: 694349 - DNA, 25 bp, Mus musculus
gtcttggtgtgctttctgtagtata

SEQ ID NO: 694350 - DNA, 25 bp, Mus musculus
gtcttggttcaacaggagcctttca

SEQ ID NO: 694351 - DNA, 25 bp, Mus musculus
gtcttggttcaagaggagcctttca

SEQ ID NO: 694352 - DNA, 25 bp, Mus musculus
gtcttggttggactcccagtttcaa

SEQ ID NO: 694353 - DNA, 25 bp, Mus musculus
gtcttggttggagtcccagtttcaa

SEQ ID NO: 694354 - DNA, 25 bp, Mus musculus
gtcttgtaaattctcgtctccccat

SEQ ID NO: 694355 - DNA, 25 bp, Mus musculus
gtcttgtaaattgtcgtctccccat

SEQ ID NO: 694356 - DNA, 25 bp, Mus musculus
gtcttgtacttgatctttcaccttt

SEQ ID NO: 694357 - DNA, 25 bp, Mus musculus
gtcttgtacttgttctttcaccttt

SEQ ID NO: 694358 - DNA, 25 bp, Mus musculus
gtcttgtatactcattttctcttat

SEQ ID NO: 694359 - DNA, 25 bp, Mus musculus
gtcttgtatactgattttctcttat

SEQ ID NO: 694360 - DNA, 25 bp, Mus musculus
gtcttgtatatgcttctttgggcct

SEQ ID NO: 694361 - DNA, 25 bp, Mus musculus
gtcttgtatatggttctttgggcct

SEQ ID NO: 694362 - DNA, 25 bp, Mus musculus
gtcttgtcaatcagccagatagcac

SEQ ID NO: 694363 - DNA, 25 bp, Mus musculus
gtcttgtcaatctgccagatagcac

SEQ ID NO: 694364 - DNA, 25 bp, Mus musculus
gtcttgtcatacaataccatcattt

SEQ ID NO: 694365 - DNA, 25 bp, Mus musculus
gtcttgtcatactataccatcattt

SEQ ID NO: 694366 - DNA, 25 bp, Mus musculus
gtcttgtcattcacacctaggaaac

SEQ ID NO: 694367 - DNA, 25 bp, Mus musculus
gtcttgtcattctcacctaggaaac

SEQ ID NO: 694368 - DNA, 25 bp, Mus musculus
gtcttgtcatttcccaactgggtga

SEQ ID NO: 694369 - DNA, 25 bp, Mus musculus
gtcttgtcatttgccaactgggtga

SEQ ID NO: 694370 - DNA, 25 bp, Mus musculus
gtcttgtccaaaagtgtagccagca

SEQ ID NO: 694371 - DNA, 25 bp, Mus musculus
gtcttgtccaaatgtgtagccagca

SEQ ID NO: 694372 - DNA, 25 bp, Mus musculus
gtcttgtcccctcaattttatctgt

SEQ ID NO: 694373 - DNA, 25 bp, Mus musculus
gtcttgtcccctgaattttatctgt

SEQ ID NO: 694374 - DNA, 25 bp, Mus musculus
gtcttgtcgcgacaaccagaaccgt

SEQ ID NO: 694375 - DNA, 25 bp, Mus musculus
gtcttgtcgcgagaaccagaaccgt

SEQ ID NO: 694376 - DNA, 25 bp, Mus musculus
gtcttgtcgtgtcctagttgagctg

SEQ ID NO: 694377 - DNA, 25 bp, Mus musculus
gtcttgtcgtgtgctagttgagctg

SEQ ID NO: 694378 - DNA, 25 bp, Mus musculus
gtcttgtctaagctgaaatgtgtgc

SEQ ID NO: 694379 - DNA, 25 bp, Mus musculus
gtcttgtctaaggtgaaatgtgtgc

SEQ ID NO: 694380 - DNA, 25 bp, Mus musculus
gtcttgtctactattagcttcattc

SEQ ID NO: 694381 - DNA, 25 bp, Mus musculus
gtcttgtctacttttagcttcattc

SEQ ID NO: 694382 - DNA, 25 bp, Mus musculus
gtcttgtctcagattttattatgta

SEQ ID NO: 694383 - DNA, 25 bp, Mus musculus
gtcttgtctcagtttttattatgta

SEQ ID NO: 694384 - DNA, 25 bp, Mus musculus
gtcttgtctcgtaacttctgatgta

SEQ ID NO: 694385 - DNA, 25 bp, Mus musculus
gtcttgtctcgttacttctgatgta

SEQ ID NO: 694386 - DNA, 25 bp, Mus musculus
gtcttgtctgagacactattcttag

SEQ ID NO: 694387 - DNA, 25 bp, Mus musculus
gtcttgtctgagtcactattcttag

SEQ ID NO: 694388 - DNA, 25 bp, Mus musculus
gtcttgtctgccagtaagtctgtgc

SEQ ID NO: 694389 - DNA, 25 bp, Mus musculus
gtcttgtctgcctgtaagtctgtgc

SEQ ID NO: 694390 - DNA, 25 bp, Mus musculus
gtcttgtcttcaaatgctcttgata

SEQ ID NO: 694391 - DNA, 25 bp, Mus musculus
gtcttgtcttcatatgctcttgata

SEQ ID NO: 694392 - DNA, 25 bp, Mus musculus
gtcttgtcttccagttaactgacca

SEQ ID NO: 694393 - DNA, 25 bp, Mus musculus
gtcttgtcttcctgttaactgacca

SEQ ID NO: 694394 - DNA, 25 bp, Mus musculus
gtcttgtgaaaacctaggtggacat

SEQ ID NO: 694395 - DNA, 25 bp, Mus musculus
gtcttgtgaaaagctaggtggacat

SEQ ID NO: 694396 - DNA, 25 bp, Mus musculus
gtcttgtgaagaacccagaaatcca

SEQ ID NO: 694397 - DNA, 25 bp, Mus musculus
gtcttgtgaagatcccagaaatcca

SEQ ID NO: 694398 - DNA, 25 bp, Mus musculus
gtcttgtgatacagtggctaggccc

SEQ ID NO: 694399 - DNA, 25 bp, Mus musculus
gtcttgtgatactgtggctaggccc

SEQ ID NO: 694400 - DNA, 25 bp, Mus musculus
gtcttgtgatcaaccttgtaaactc

SEQ ID NO: 694401 - DNA, 25 bp, Mus musculus
gtcttgtgatcatccttgtaaactc

SEQ ID NO: 694402 - DNA, 25 bp, Mus musculus
gtcttgtgctctagtgtttaagtct

SEQ ID NO: 694403 - DNA, 25 bp, Mus musculus
gtcttgtgctcttgtgtttaagtct

SEQ ID NO: 694404 - DNA, 25 bp, Mus musculus
gtcttgtgtcttagaagccaatcct

SEQ ID NO: 694405 - DNA, 25 bp, Mus musculus
gtcttgtgtctttgaagccaatcct

SEQ ID NO: 694406 - DNA, 25 bp, Mus musculus
gtcttgtgttatctgtgtccacttg

SEQ ID NO: 694407 - DNA, 25 bp, Mus musculus
gtcttgtgttatgtgtgtccacttg

SEQ ID NO: 694408 - DNA, 25 bp, Mus musculus
gtcttgttagatatactttccgtga

SEQ ID NO: 694409 - DNA, 25 bp, Mus musculus
gtcttgttagatttactttccgtga

SEQ ID NO: 694410 - DNA, 25 bp, Mus musculus
gtcttgttagttagctattaatcga

SEQ ID NO: 694411 - DNA, 25 bp, Mus musculus
gtcttgttagtttgctattaatcga

SEQ ID NO: 694412 - DNA, 25 bp, Mus musculus
gtcttgttccagataaatttcatat

SEQ ID NO: 694413 - DNA, 25 bp, Mus musculus
gtcttgttccagatccattagaata

SEQ ID NO: 694414 - DNA, 25 bp, Mus musculus
gtcttgttccagttaaatttcatat

SEQ ID NO: 694415 - DNA, 25 bp, Mus musculus
gtcttgttccagttccattagaata

SEQ ID NO: 694416 - DNA, 25 bp, Mus musculus
gtcttgttcctaagatatacttctt

SEQ ID NO: 694417 - DNA, 25 bp, Mus musculus
gtcttgttcctatgatatacttctt

SEQ ID NO: 694418 - DNA, 25 bp, Mus musculus
gtcttgttcgggagatgcccctcaa

SEQ ID NO: 694419 - DNA, 25 bp, Mus musculus
gtcttgttcgggtgatgcccctcaa

SEQ ID NO: 694420 - DNA, 25 bp, Mus musculus
gtcttgttctgtcctggctcagaaa

SEQ ID NO: 694421 - DNA, 25 bp, Mus musculus
gtcttgttctgtgctggctcagaaa

SEQ ID NO: 694422 - DNA, 25 bp, Mus musculus
gtcttgtttccaatggtgaccatct

SEQ ID NO: 694423 - DNA, 25 bp, Mus musculus
gtcttgtttccattggtgaccatct

SEQ ID NO: 694424 - DNA, 25 bp, Mus musculus
gtcttgtttcctctcatatttacca

SEQ ID NO: 694425 - DNA, 25 bp, Mus musculus
gtcttgtttcctgtcatatttacca

SEQ ID NO: 694426 - DNA, 25 bp, Mus musculus
gtcttgtttctaagaggtactttta

SEQ ID NO: 694427 - DNA, 25 bp, Mus musculus
gtcttgtttctaaggagtgggccag

SEQ ID NO: 694428 - DNA, 25 bp, Mus musculus
gtcttgtttctatgaggtactttta

SEQ ID NO: 694429 - DNA, 25 bp, Mus musculus
gtcttgtttctatggagtgggccag

SEQ ID NO: 694430 - DNA, 25 bp, Mus musculus
gtcttgtttctccaagtttctgatc

SEQ ID NO: 694431 - DNA, 25 bp, Mus musculus
gtcttgtttctcgaagtttctgatc

SEQ ID NO: 694432 - DNA, 25 bp, Mus musculus
gtcttgtttcttcagggtttgtcct

SEQ ID NO: 694433 - DNA, 25 bp, Mus musculus
gtcttgtttcttgagggtttgtcct

SEQ ID NO: 694434 - DNA, 25 bp, Mus musculus
gtcttgttttgcatctcatggacat

SEQ ID NO: 694435 - DNA, 25 bp, Mus musculus
gtcttgttttgcttctcatggacat

SEQ ID NO: 694436 - DNA, 25 bp, Mus musculus
gtctttaaagaaatgctggctgccg

SEQ ID NO: 694437 - DNA, 25 bp, Mus musculus
gtctttaaagaattgctggctgccg

SEQ ID NO: 694438 - DNA, 25 bp, Mus musculus
gtctttaacaggctcctcattttct

SEQ ID NO: 694439 - DNA, 25 bp, Mus musculus
gtctttaacagggtcctcattttct

SEQ ID NO: 694440 - DNA, 25 bp, Mus musculus
gtctttaaccacatctgaatctcat

SEQ ID NO: 694441 - DNA, 25 bp, Mus musculus
gtctttaaccacttctgaatctcat

SEQ ID NO: 694442 - DNA, 25 bp, Mus musculus
gtctttaactgacaggccacagctg

SEQ ID NO: 694443 - DNA, 25 bp, Mus musculus
gtctttaactgagaggccacagctg

SEQ ID NO: 694444 - DNA, 25 bp, Mus musculus
gtctttaagactacacagtgaggag

SEQ ID NO: 694445 - DNA, 25 bp, Mus musculus
gtctttaagacttcacagtgaggag

SEQ ID NO: 694446 - DNA, 25 bp, Mus musculus
gtctttaagcctcccaacaatggat

SEQ ID NO: 694447 - DNA, 25 bp, Mus musculus
gtctttaagcctgccaacaatggat

SEQ ID NO: 694448 - DNA, 25 bp, Mus musculus
gtctttaagggaaatcttgtcctgt

SEQ ID NO: 694449 - DNA, 25 bp, Mus musculus
gtctttaagggatatcttgtcctgt

SEQ ID NO: 694450 - DNA, 25 bp, Mus musculus
gtctttaagttgacagaactgaaat

SEQ ID NO: 694451 - DNA, 25 bp, Mus musculus
gtctttaagttgtcagaactgaaat

SEQ ID NO: 694452 - DNA, 25 bp, Mus musculus
gtctttaatgatccacttgtgtctg

SEQ ID NO: 694453 - DNA, 25 bp, Mus musculus
gtctttaatgatgcacttgtgtctg

SEQ ID NO: 694454 - DNA, 25 bp, Mus musculus
gtctttaatgctcattctcaccctg

SEQ ID NO: 694455 - DNA, 25 bp, Mus musculus
gtctttaatgctgattctcaccctg

SEQ ID NO: 694456 - DNA, 25 bp, Mus musculus
gtctttaatgtgaatatgcctctgc

SEQ ID NO: 694457 - DNA, 25 bp, Mus musculus
gtctttaatgtgtatatgcctctgc

SEQ ID NO: 694458 - DNA, 25 bp, Mus musculus
gtctttacacatacatatactggat

SEQ ID NO: 694459 - DNA, 25 bp, Mus musculus
gtctttacacattcatatactggat

SEQ ID NO: 694460 - DNA, 25 bp, Mus musculus
gtctttaccatgagctaggatatca

SEQ ID NO: 694461 - DNA, 25 bp, Mus musculus
gtctttaccatgtgctaggatatca

SEQ ID NO: 694462 - DNA, 25 bp, Mus musculus
gtctttactccaaactaatgctaag

SEQ ID NO: 694463 - DNA, 25 bp, Mus musculus
gtctttactccatactaatgctaag

SEQ ID NO: 694464 - DNA, 25 bp, Mus musculus
gtctttactttcaaaccccatgtat

SEQ ID NO: 694465 - DNA, 25 bp, Mus musculus
gtctttactttctaaccccatgtat

SEQ ID NO: 694466 - DNA, 25 bp, Mus musculus
gtctttagacccatagaactcttgt

SEQ ID NO: 694467 - DNA, 25 bp, Mus musculus
gtctttagacccttagaactcttgt

SEQ ID NO: 694468 - DNA, 25 bp, Mus musculus
gtctttagagacatatgcggtttaa

SEQ ID NO: 694469 - DNA, 25 bp, Mus musculus
gtctttagagacttatgcggtttaa

SEQ ID NO: 694470 - DNA, 25 bp, Mus musculus
gtctttagagtgaactgctaccctg

SEQ ID NO: 694471 - DNA, 25 bp, Mus musculus
gtctttagagtgtactgctaccctg

SEQ ID NO: 694472 - DNA, 25 bp, Mus musculus
gtctttagagttcatcattgtttgt

SEQ ID NO: 694473 - DNA, 25 bp, Mus musculus
gtctttagagttgatcattgtttgt

SEQ ID NO: 694474 - DNA, 25 bp, Mus musculus
gtctttagatgcattaatcaccgag

SEQ ID NO: 694475 - DNA, 25 bp, Mus musculus
gtctttagatgctttaatcaccgag

SEQ ID NO: 694476 - DNA, 25 bp, Mus musculus
gtctttagcaaaatgttcaaactca

SEQ ID NO: 694477 - DNA, 25 bp, Mus musculus
gtctttagcaaattgttcaaactca

SEQ ID NO: 694478 - DNA, 25 bp, Mus musculus
gtctttagctcgatttttggcagaa

SEQ ID NO: 694479 - DNA, 25 bp, Mus musculus
gtctttagctcgttttttggcagaa

SEQ ID NO: 694480 - DNA, 25 bp, Mus musculus
gtctttaggactcctttatcagaat

SEQ ID NO: 694481 - DNA, 25 bp, Mus musculus
gtctttaggactgctttatcagaat

SEQ ID NO: 694482 - DNA, 25 bp, Mus musculus
gtctttaggatcaagtcatttacca

SEQ ID NO: 694483 - DNA, 25 bp, Mus musculus
gtctttaggatctagtcatttacca

SEQ ID NO: 694484 - DNA, 25 bp, Mus musculus
gtctttaggcacaggttttctatct

SEQ ID NO: 694485 - DNA, 25 bp, Mus musculus
gtctttaggcactggttttctatct

SEQ ID NO: 694486 - DNA, 25 bp, Mus musculus
gtctttaggtctcgtctgtgtatca

SEQ ID NO: 694487 - DNA, 25 bp, Mus musculus
gtctttaggtctggtctgtgtatca

SEQ ID NO: 694488 - DNA, 25 bp, Mus musculus
gtctttagtcagacttatcccacaa

SEQ ID NO: 694489 - DNA, 25 bp, Mus musculus
gtctttagtcagtcttatcccacaa

SEQ ID NO: 694490 - DNA, 25 bp, Mus musculus
gtctttatctatccacgtggacatg

SEQ ID NO: 694491 - DNA, 25 bp, Mus musculus
gtctttatctatgcacgtggacatg

SEQ ID NO: 694492 - DNA, 25 bp, Mus musculus
gtctttatctcaaggagatccagct

SEQ ID NO: 694493 - DNA, 25 bp, Mus musculus
gtctttatctcatggagatccagct

SEQ ID NO: 694494 - DNA, 25 bp, Mus musculus
gtctttatgaccagatgattgcctt

SEQ ID NO: 694495 - DNA, 25 bp, Mus musculus
gtctttatgacctgatgattgcctt

SEQ ID NO: 694496 - DNA, 25 bp, Mus musculus
gtctttatgatgctcaccacctcca

SEQ ID NO: 694497 - DNA, 25 bp, Mus musculus
gtctttatgatggtcaccacctcca

SEQ ID NO: 694498 - DNA, 25 bp, Mus musculus
gtctttatggacatggttcgcaatg

SEQ ID NO: 694499 - DNA, 25 bp, Mus musculus
gtctttatggacttggttcgcaatg

SEQ ID NO: 694500 - DNA, 25 bp, Mus musculus
gtctttattactagagttcattggt

SEQ ID NO: 694501 - DNA, 25 bp, Mus musculus
gtctttattacttgagttcattggt

SEQ ID NO: 694502 - DNA, 25 bp, Mus musculus
gtctttatttcaatctcgtcttctc

SEQ ID NO: 694503 - DNA, 25 bp, Mus musculus
gtctttatttcattctcgtcttctc

SEQ ID NO: 694504 - DNA, 25 bp, Mus musculus
gtctttatttctagcacctgaggat

SEQ ID NO: 694505 - DNA, 25 bp, Mus musculus
gtctttatttcttgcacctgaggat

SEQ ID NO: 694506 - DNA, 25 bp, Mus musculus
gtctttattttcactacagaatcta

SEQ ID NO: 694507 - DNA, 25 bp, Mus musculus
gtctttattttctctacagaatcta

SEQ ID NO: 694508 - DNA, 25 bp, Mus musculus
gtctttcaacacaggtagtgcggta

SEQ ID NO: 694509 - DNA, 25 bp, Mus musculus
gtctttcaacactggtagtgcggta

SEQ ID NO: 694510 - DNA, 25 bp, Mus musculus
gtctttcaattcacatgttcaggga

SEQ ID NO: 694511 - DNA, 25 bp, Mus musculus
gtctttcaattctcatgttcaggga

SEQ ID NO: 694512 - DNA, 25 bp, Mus musculus
gtctttcacctcaataagcctattt

SEQ ID NO: 694513 - DNA, 25 bp, Mus musculus
gtctttcacctctataagcctattt

SEQ ID NO: 694514 - DNA, 25 bp, Mus musculus
gtctttcaccttccttggagttaca

SEQ ID NO: 694515 - DNA, 25 bp, Mus musculus
gtctttcaccttgcttggagttaca

SEQ ID NO: 694516 - DNA, 25 bp, Mus musculus
gtctttcactaactaacctctattc

SEQ ID NO: 694517 - DNA, 25 bp, Mus musculus
gtctttcactaagtaacctctattc

SEQ ID NO: 694518 - DNA, 25 bp, Mus musculus
gtctttcacttgcttagctagagtt

SEQ ID NO: 694519 - DNA, 25 bp, Mus musculus
gtctttcacttggttagctagagtt

SEQ ID NO: 694520 - DNA, 25 bp, Mus musculus
gtctttcaggacagtcctgtgcagc

SEQ ID NO: 694521 - DNA, 25 bp, Mus musculus
gtctttcaggactgtcctgtgcagc

SEQ ID NO: 694522 - DNA, 25 bp, Mus musculus
gtctttcagtcaactaatggaatgt

SEQ ID NO: 694523 - DNA, 25 bp, Mus musculus
gtctttcagtcatctaatggaatgt

SEQ ID NO: 694524 - DNA, 25 bp, Mus musculus
gtctttcagtgccactctgggaagt

SEQ ID NO: 694525 - DNA, 25 bp, Mus musculus
gtctttcagtgcgactctgggaagt

SEQ ID NO: 694526 - DNA, 25 bp, Mus musculus
gtctttcataatacaacttctttcc

SEQ ID NO: 694527 - DNA, 25 bp, Mus musculus
gtctttcataattcaacttctttcc

SEQ ID NO: 694528 - DNA, 25 bp, Mus musculus
gtctttcatgttcttttagttgtac

SEQ ID NO: 694529 - DNA, 25 bp, Mus musculus
gtctttcatgttgttttagttgtac

SEQ ID NO: 694530 - DNA, 25 bp, Mus musculus
gtctttcattgtctaaatcattact

SEQ ID NO: 694531 - DNA, 25 bp, Mus musculus
gtctttcattgtgtaaatcattact

SEQ ID NO: 694532 - DNA, 25 bp, Mus musculus
gtctttcatttcattccaacacttg

SEQ ID NO: 694533 - DNA, 25 bp, Mus musculus
gtctttcatttctttccaacacttg

SEQ ID NO: 694534 - DNA, 25 bp, Mus musculus
gtctttccaaagcacctaggcagtg

SEQ ID NO: 694535 - DNA, 25 bp, Mus musculus
gtctttccaaaggacctaggcagtg

SEQ ID NO: 694536 - DNA, 25 bp, Mus musculus
gtctttccactccaaatgagctctt

SEQ ID NO: 694537 - DNA, 25 bp, Mus musculus
gtctttccactcgaaatgagctctt

SEQ ID NO: 694538 - DNA, 25 bp, Mus musculus
gtctttccatgcacaacctaaatgt

SEQ ID NO: 694539 - DNA, 25 bp, Mus musculus
gtctttccatgctcaacctaaatgt

SEQ ID NO: 694540 - DNA, 25 bp, Mus musculus
gtctttccattgcactttgtatttc

SEQ ID NO: 694541 - DNA, 25 bp, Mus musculus
gtctttccattggactttgtatttc

SEQ ID NO: 694542 - DNA, 25 bp, Mus musculus
gtctttccatttacactacttagca

SEQ ID NO: 694543 - DNA, 25 bp, Mus musculus
gtctttccattttcactacttagca

SEQ ID NO: 694544 - DNA, 25 bp, Mus musculus
gtctttcccaacattcaagtgggtt

SEQ ID NO: 694545 - DNA, 25 bp, Mus musculus
gtctttcccaactttcaagtgggtt

SEQ ID NO: 694546 - DNA, 25 bp, Mus musculus
gtctttcccacacactttggaatgt

SEQ ID NO: 694547 - DNA, 25 bp, Mus musculus
gtctttcccacagactttggaatgt

SEQ ID NO: 694548 - DNA, 25 bp, Mus musculus
gtctttccccatatacacttatgtg

SEQ ID NO: 694549 - DNA, 25 bp, Mus musculus
gtctttccccatttacacttatgtg

SEQ ID NO: 694550 - DNA, 25 bp, Mus musculus
gtctttcccctcaatgttgacagat

SEQ ID NO: 694551 - DNA, 25 bp, Mus musculus
gtctttcccctctatgttgacagat

SEQ ID NO: 694552 - DNA, 25 bp, Mus musculus
gtctttccctatacttaaactggtg

SEQ ID NO: 694553 - DNA, 25 bp, Mus musculus
gtctttccctattcttaaactggtg

SEQ ID NO: 694554 - DNA, 25 bp, Mus musculus
gtctttccctcaaactggattactt

SEQ ID NO: 694555 - DNA, 25 bp, Mus musculus
gtctttccctcatactggattactt

SEQ ID NO: 694556 - DNA, 25 bp, Mus musculus
gtctttccctccatagcaatatatt

SEQ ID NO: 694557 - DNA, 25 bp, Mus musculus
gtctttccctccttagcaatatatt

SEQ ID NO: 694558 - DNA, 25 bp, Mus musculus
gtctttccctggaccgtgtgtgatg

SEQ ID NO: 694559 - DNA, 25 bp, Mus musculus
gtctttccctggtccgtgtgtgatg

SEQ ID NO: 694560 - DNA, 25 bp, Mus musculus
gtctttccctttccaaactgagcta

SEQ ID NO: 694561 - DNA, 25 bp, Mus musculus
gtctttccctttgcaaactgagcta

SEQ ID NO: 694562 - DNA, 25 bp, Mus musculus
gtctttccgcgtagtggatcaacag

SEQ ID NO: 694563 - DNA, 25 bp, Mus musculus
gtctttccgcgttgtggatcaacag

SEQ ID NO: 694564 - DNA, 25 bp, Mus musculus
gtctttccgctaatattcggactga

SEQ ID NO: 694565 - DNA, 25 bp, Mus musculus
gtctttccgctattattcggactga

SEQ ID NO: 694566 - DNA, 25 bp, Mus musculus
gtctttcctaacagacttcttctgg

SEQ ID NO: 694567 - DNA, 25 bp, Mus musculus
gtctttcctaactgacttcttctgg

SEQ ID NO: 694568 - DNA, 25 bp, Mus musculus
gtctttcctcaaaattctctttcta

SEQ ID NO: 694569 - DNA, 25 bp, Mus musculus
gtctttcctcaaacatggttactat

SEQ ID NO: 694570 - DNA, 25 bp, Mus musculus
gtctttcctcaatattctctttcta

SEQ ID NO: 694571 - DNA, 25 bp, Mus musculus
gtctttcctcaatcatggttactat

SEQ ID NO: 694572 - DNA, 25 bp, Mus musculus
gtctttccttgtcgcttagatgcaa

SEQ ID NO: 694573 - DNA, 25 bp, Mus musculus
gtctttccttgtggcttagatgcaa

SEQ ID NO: 694574 - DNA, 25 bp, Mus musculus
gtctttcgacataggagacccatgt

SEQ ID NO: 694575 - DNA, 25 bp, Mus musculus
gtctttcgacattggagacccatgt

SEQ ID NO: 694576 - DNA, 25 bp, Mus musculus
gtctttcgatctcaactgcacttat

SEQ ID NO: 694577 - DNA, 25 bp, Mus musculus
gtctttcgatctgaactgcacttat

SEQ ID NO: 694578 - DNA, 25 bp, Mus musculus
gtctttcgcaagcaggctttcgagt

SEQ ID NO: 694579 - DNA, 25 bp, Mus musculus
gtctttcgcaaggaggctttcgagt

SEQ ID NO: 694580 - DNA, 25 bp, Mus musculus
gtctttctaaatccattacttccaa

SEQ ID NO: 694581 - DNA, 25 bp, Mus musculus
gtctttctaaatgcattacttccaa

SEQ ID NO: 694582 - DNA, 25 bp, Mus musculus
gtctttctatatagctttggccgtc

SEQ ID NO: 694583 - DNA, 25 bp, Mus musculus
gtctttctatattgctttggccgtc

SEQ ID NO: 694584 - DNA, 25 bp, Mus musculus
gtctttctatctacagtctgtgcta

SEQ ID NO: 694585 - DNA, 25 bp, Mus musculus
gtctttctatcttcagtctgtgcta

SEQ ID NO: 694586 - DNA, 25 bp, Mus musculus
gtctttctatgtacgaacccacaaa

SEQ ID NO: 694587 - DNA, 25 bp, Mus musculus
gtctttctatgttcgaacccacaaa

SEQ ID NO: 694588 - DNA, 25 bp, Mus musculus
gtctttctatttacattcatccaag

SEQ ID NO: 694589 - DNA, 25 bp, Mus musculus
gtctttctattttcattcatccaag

SEQ ID NO: 694590 - DNA, 25 bp, Mus musculus
gtctttctcacacagaggcggcctt

SEQ ID NO: 694591 - DNA, 25 bp, Mus musculus
gtctttctcacagagaggcggcctt

SEQ ID NO: 694592 - DNA, 25 bp, Mus musculus
gtctttctcttccacataatctagt

SEQ ID NO: 694593 - DNA, 25 bp, Mus musculus
gtctttctcttcgacataatctagt

SEQ ID NO: 694594 - DNA, 25 bp, Mus musculus
gtctttctgacaaatgtttgatctt

SEQ ID NO: 694595 - DNA, 25 bp, Mus musculus
gtctttctgacatatgtttgatctt

SEQ ID NO: 694596 - DNA, 25 bp, Mus musculus
gtctttctgactcacatatctatgc

SEQ ID NO: 694597 - DNA, 25 bp, Mus musculus
gtctttctgactgacatatctatgc

SEQ ID NO: 694598 - DNA, 25 bp, Mus musculus
gtctttctgatcaccattgtctact

SEQ ID NO: 694599 - DNA, 25 bp, Mus musculus
gtctttctgatctccattgtctact

SEQ ID NO: 694600 - DNA, 25 bp, Mus musculus
gtctttctgcagctatggcggagca

SEQ ID NO: 694601 - DNA, 25 bp, Mus musculus
gtctttctgcaggtatggcggagca

SEQ ID NO: 694602 - DNA, 25 bp, Mus musculus
gtctttctgcttaacaaagtgcttc

SEQ ID NO: 694603 - DNA, 25 bp, Mus musculus
gtctttctgcttcgaatttattcgt

SEQ ID NO: 694604 - DNA, 25 bp, Mus musculus
gtctttctgcttggaatttattcgt

SEQ ID NO: 694605 - DNA, 25 bp, Mus musculus
gtctttctgctttacaaagtgcttc

SEQ ID NO: 694606 - DNA, 25 bp, Mus musculus
gtctttctggaactaaggcctggtc

SEQ ID NO: 694607 - DNA, 25 bp, Mus musculus
gtctttctggaagtaaggcctggtc

SEQ ID NO: 694608 - DNA, 25 bp, Mus musculus
gtctttctggccctataaattcagt

SEQ ID NO: 694609 - DNA, 25 bp, Mus musculus
gtctttctggccgtataaattcagt

SEQ ID NO: 694610 - DNA, 25 bp, Mus musculus
gtctttctgtctatggctagagggt

SEQ ID NO: 694611 - DNA, 25 bp, Mus musculus
gtctttctgtctttggctagagggt

SEQ ID NO: 694612 - DNA, 25 bp, Mus musculus
gtctttcttagtctattgctgtggt

SEQ ID NO: 694613 - DNA, 25 bp, Mus musculus
gtctttcttagtgtattgctgtggt

SEQ ID NO: 694614 - DNA, 25 bp, Mus musculus
gtctttcttcacaaagtactccacc

SEQ ID NO: 694615 - DNA, 25 bp, Mus musculus
gtctttcttcactaagtactccacc

SEQ ID NO: 694616 - DNA, 25 bp, Mus musculus
gtctttcttcctcggaggcaggagt

SEQ ID NO: 694617 - DNA, 25 bp, Mus musculus
gtctttcttcctgggaggcaggagt

SEQ ID NO: 694618 - DNA, 25 bp, Mus musculus
gtctttcttctacgctcgcaggcag

SEQ ID NO: 694619 - DNA, 25 bp, Mus musculus
gtctttcttctaggctcgcaggcag

SEQ ID NO: 694620 - DNA, 25 bp, Mus musculus
gtctttcttgttcctttgtggtgaa

SEQ ID NO: 694621 - DNA, 25 bp, Mus musculus
gtctttcttgttgctttgtggtgaa

SEQ ID NO: 694622 - DNA, 25 bp, Mus musculus
gtctttctttatatcgatctcctca

SEQ ID NO: 694623 - DNA, 25 bp, Mus musculus
gtctttctttatcggtgtcagcagt

SEQ ID NO: 694624 - DNA, 25 bp, Mus musculus
gtctttctttatgggtgtcagcagt

SEQ ID NO: 694625 - DNA, 25 bp, Mus musculus
gtctttctttatttcgatctcctca

SEQ ID NO: 694626 - DNA, 25 bp, Mus musculus
gtctttctttcaaggtcagtgtctt

SEQ ID NO: 694627 - DNA, 25 bp, Mus musculus
gtctttctttcatggtcagtgtctt

SEQ ID NO: 694628 - DNA, 25 bp, Mus musculus
gtctttctttccatcttgtacaatt

SEQ ID NO: 694629 - DNA, 25 bp, Mus musculus
gtctttctttccttcttgtacaatt

SEQ ID NO: 694630 - DNA, 25 bp, Mus musculus
gtctttctttgaatggagattccga

SEQ ID NO: 694631 - DNA, 25 bp, Mus musculus
gtctttctttgattggagattccga

SEQ ID NO: 694632 - DNA, 25 bp, Mus musculus
gtctttcttttccttgggtgatgta

SEQ ID NO: 694633 - DNA, 25 bp, Mus musculus
gtctttcttttcgttgggtgatgta

SEQ ID NO: 694634 - DNA, 25 bp, Mus musculus
gtctttgaaaacaccgtacccattg

SEQ ID NO: 694635 - DNA, 25 bp, Mus musculus
gtctttgaaaactccgtacccattg

SEQ ID NO: 694636 - DNA, 25 bp, Mus musculus
gtctttgaaagcctcattgtctcct

SEQ ID NO: 694637 - DNA, 25 bp, Mus musculus
gtctttgaaagcgtcattgtctcct

SEQ ID NO: 694638 - DNA, 25 bp, Mus musculus
gtctttgaacaaatttacacttatt

SEQ ID NO: 694639 - DNA, 25 bp, Mus musculus
gtctttgaacaattttacacttatt

SEQ ID NO: 694640 - DNA, 25 bp, Mus musculus
gtctttgaacatattgctacacaat

SEQ ID NO: 694641 - DNA, 25 bp, Mus musculus
gtctttgaacattttgctacacaat

SEQ ID NO: 694642 - DNA, 25 bp, Mus musculus
gtctttgaactcatgcatctcattt

SEQ ID NO: 694643 - DNA, 25 bp, Mus musculus
gtctttgaactcttgcatctcattt

SEQ ID NO: 694644 - DNA, 25 bp, Mus musculus
gtctttgaactgagcatggtgtctt

SEQ ID NO: 694645 - DNA, 25 bp, Mus musculus
gtctttgaactgtgcatggtgtctt

SEQ ID NO: 694646 - DNA, 25 bp, Mus musculus
gtctttgaagcccttcctatgtcta

SEQ ID NO: 694647 - DNA, 25 bp, Mus musculus
gtctttgaagccgttcctatgtcta

SEQ ID NO: 694648 - DNA, 25 bp, Mus musculus
gtctttgacaagaccccgcagagaa

SEQ ID NO: 694649 - DNA, 25 bp, Mus musculus
gtctttgacaagtccccgcagagaa

SEQ ID NO: 694650 - DNA, 25 bp, Mus musculus
gtctttgaccacaatagtttgatgc

SEQ ID NO: 694651 - DNA, 25 bp, Mus musculus
gtctttgaccactatagtttgatgc

SEQ ID NO: 694652 - DNA, 25 bp, Mus musculus
gtctttgagccaagcagtcaggttc

SEQ ID NO: 694653 - DNA, 25 bp, Mus musculus
gtctttgagccatgcagtcaggttc

SEQ ID NO: 694654 - DNA, 25 bp, Mus musculus
gtctttgagcggacacattacccgg

SEQ ID NO: 694655 - DNA, 25 bp, Mus musculus
gtctttgagcggtcacattacccgg

SEQ ID NO: 694656 - DNA, 25 bp, Mus musculus
gtctttgagtttcacgtcttcacca

SEQ ID NO: 694657 - DNA, 25 bp, Mus musculus
gtctttgagtttgacgtcttcacca

SEQ ID NO: 694658 - DNA, 25 bp, Mus musculus
gtctttgataatcaccactgctcag

SEQ ID NO: 694659 - DNA, 25 bp, Mus musculus
gtctttgataatgaccactgctcag

SEQ ID NO: 694660 - DNA, 25 bp, Mus musculus
gtctttgatcacataatcctttcct

SEQ ID NO: 694661 - DNA, 25 bp, Mus musculus
gtctttgatcacttaatcctttcct

SEQ ID NO: 694662 - DNA, 25 bp, Mus musculus
gtctttgatcataggaccagagcaa

SEQ ID NO: 694663 - DNA, 25 bp, Mus musculus
gtctttgatcattggaccagagcaa

SEQ ID NO: 694664 - DNA, 25 bp, Mus musculus
gtctttgcacctacttgttcctgca

SEQ ID NO: 694665 - DNA, 25 bp, Mus musculus
gtctttgcaccttcttgttcctgca

SEQ ID NO: 694666 - DNA, 25 bp, Mus musculus
gtctttgcagacaacgaagcctatg

SEQ ID NO: 694667 - DNA, 25 bp, Mus musculus
gtctttgcagactacgaagcctatg

SEQ ID NO: 694668 - DNA, 25 bp, Mus musculus
gtctttgcatctcttaactttgcct

SEQ ID NO: 694669 - DNA, 25 bp, Mus musculus
gtctttgcatctgttaactttgcct

SEQ ID NO: 694670 - DNA, 25 bp, Mus musculus
gtctttgcattacctgtctgttgaa

SEQ ID NO: 694671 - DNA, 25 bp, Mus musculus
gtctttgcattagctgtctgttgaa

SEQ ID NO: 694672 - DNA, 25 bp, Mus musculus
gtctttgccactctatacaaataat

SEQ ID NO: 694673 - DNA, 25 bp, Mus musculus
gtctttgccactgtatacaaataat

SEQ ID NO: 694674 - DNA, 25 bp, Mus musculus
gtctttgcccctaatgtgctatggg

SEQ ID NO: 694675 - DNA, 25 bp, Mus musculus
gtctttgccccttatgtgctatggg

SEQ ID NO: 694676 - DNA, 25 bp, Mus musculus
gtctttgcccttcggagagtcgctg

SEQ ID NO: 694677 - DNA, 25 bp, Mus musculus
gtctttgcccttgggagagtcgctg

SEQ ID NO: 694678 - DNA, 25 bp, Mus musculus
gtctttgccttgagactctagttag

SEQ ID NO: 694679 - DNA, 25 bp, Mus musculus
gtctttgccttgtgactctagttag

SEQ ID NO: 694680 - DNA, 25 bp, Mus musculus
gtctttgcgacaaacagccaattgg

SEQ ID NO: 694681 - DNA, 25 bp, Mus musculus
gtctttgcgacatacagccaattgg

SEQ ID NO: 694682 - DNA, 25 bp, Mus musculus
gtctttgctaagagctccctctgaa

SEQ ID NO: 694683 - DNA, 25 bp, Mus musculus
gtctttgctaagtgctccctctgaa

SEQ ID NO: 694684 - DNA, 25 bp, Mus musculus
gtctttgctaatattaccttcacta

SEQ ID NO: 694685 - DNA, 25 bp, Mus musculus
gtctttgctaattttaccttcacta

SEQ ID NO: 694686 - DNA, 25 bp, Mus musculus
gtctttgctcaaacattgttggtta

SEQ ID NO: 694687 - DNA, 25 bp, Mus musculus
gtctttgctcaatcattgttggtta

SEQ ID NO: 694688 - DNA, 25 bp, Mus musculus
gtctttgctcacatctcttcagaca

SEQ ID NO: 694689 - DNA, 25 bp, Mus musculus
gtctttgctcacttctcttcagaca

SEQ ID NO: 694690 - DNA, 25 bp, Mus musculus
gtctttgctgccataacttttagtt

SEQ ID NO: 694691 - DNA, 25 bp, Mus musculus
gtctttgctgccttaacttttagtt

SEQ ID NO: 694692 - DNA, 25 bp, Mus musculus
gtctttgctgtaactaggcttcacc

SEQ ID NO: 694693 - DNA, 25 bp, Mus musculus
gtctttgctgtatctaggcttcacc

SEQ ID NO: 694694 - DNA, 25 bp, Mus musculus
gtctttgctgtcctgatcagtccaa

SEQ ID NO: 694695 - DNA, 25 bp, Mus musculus
gtctttgctgtcgtgatcagtccaa

SEQ ID NO: 694696 - DNA, 25 bp, Mus musculus
gtctttgctgttattgtcttagaaa

SEQ ID NO: 694697 - DNA, 25 bp, Mus musculus
gtctttgctgtttttgtcttagaaa

SEQ ID NO: 694698 - DNA, 25 bp, Mus musculus
gtctttgctttcattccgcgccagt

SEQ ID NO: 694699 - DNA, 25 bp, Mus musculus
gtctttgctttctttccgcgccagt

SEQ ID NO: 694700 - DNA, 25 bp, Mus musculus
gtctttggaaacatagcatcgtcat

SEQ ID NO: 694701 - DNA, 25 bp, Mus musculus
gtctttggaaacttagcatcgtcat

SEQ ID NO: 694702 - DNA, 25 bp, Mus musculus
gtctttggaccgagatgcttgtttc

SEQ ID NO: 694703 - DNA, 25 bp, Mus musculus
gtctttggaccgtgatgcttgtttc

SEQ ID NO: 694704 - DNA, 25 bp, Mus musculus
gtctttggagtaagtcgtgtgcatc

SEQ ID NO: 694705 - DNA, 25 bp, Mus musculus
gtctttggagtatgtcgtgtgcatc

SEQ ID NO: 694706 - DNA, 25 bp, Mus musculus
gtctttggagttcacacagcacaca

SEQ ID NO: 694707 - DNA, 25 bp, Mus musculus
gtctttggagttgacacagcacaca

SEQ ID NO: 694708 - DNA, 25 bp, Mus musculus
gtctttggcagtcttatcattggtt

SEQ ID NO: 694709 - DNA, 25 bp, Mus musculus
gtctttggcagtgttatcattggtt

SEQ ID NO: 694710 - DNA, 25 bp, Mus musculus
gtctttggcatccacttaggaccaa

SEQ ID NO: 694711 - DNA, 25 bp, Mus musculus
gtctttggcatcgacttaggaccaa

SEQ ID NO: 694712 - DNA, 25 bp, Mus musculus
gtctttggctacctctagctgaaca

SEQ ID NO: 694713 - DNA, 25 bp, Mus musculus
gtctttggctacgtctagctgaaca

SEQ ID NO: 694714 - DNA, 25 bp, Mus musculus
gtctttggtcctatgatttgacggt

SEQ ID NO: 694715 - DNA, 25 bp, Mus musculus
gtctttggtcctttgatttgacggt

SEQ ID NO: 694716 - DNA, 25 bp, Mus musculus
gtctttggttatattgtgagctctt

SEQ ID NO: 694717 - DNA, 25 bp, Mus musculus
gtctttggttattttgtgagctctt

SEQ ID NO: 694718 - DNA, 25 bp, Mus musculus
gtctttgtaacaagtgcctccgatg

SEQ ID NO: 694719 - DNA, 25 bp, Mus musculus
gtctttgtaacacaatcttgcctct

SEQ ID NO: 694720 - DNA, 25 bp, Mus musculus
gtctttgtaacagaatcttgcctct

SEQ ID NO: 694721 - DNA, 25 bp, Mus musculus
gtctttgtaacatgtgcctccgatg

SEQ ID NO: 694722 - DNA, 25 bp, Mus musculus
gtctttgtaaggaccccaacagtgt

SEQ ID NO: 694723 - DNA, 25 bp, Mus musculus
gtctttgtaaggtccccaacagtgt

SEQ ID NO: 694724 - DNA, 25 bp, Mus musculus
gtctttgtaattccttgttgaccac

SEQ ID NO: 694725 - DNA, 25 bp, Mus musculus
gtctttgtaattgcttgttgaccac

SEQ ID NO: 694726 - DNA, 25 bp, Mus musculus
gtctttgtagagaggcactaggttt

SEQ ID NO: 694727 - DNA, 25 bp, Mus musculus
gtctttgtagagtggcactaggttt

SEQ ID NO: 694728 - DNA, 25 bp, Mus musculus
gtctttgtagccaccaacttcctga

SEQ ID NO: 694729 - DNA, 25 bp, Mus musculus
gtctttgtagcctccaacttcctga

SEQ ID NO: 694730 - DNA, 25 bp, Mus musculus
gtctttgtatggatgacagcatgca

SEQ ID NO: 694731 - DNA, 25 bp, Mus musculus
gtctttgtatggttgacagcatgca

SEQ ID NO: 694732 - DNA, 25 bp, Mus musculus
gtctttgtatttactctaagcgatg

SEQ ID NO: 694733 - DNA, 25 bp, Mus musculus
gtctttgtattttctctaagcgatg

SEQ ID NO: 694734 - DNA, 25 bp, Mus musculus
gtctttgtcaagatccgtgtggagt

SEQ ID NO: 694735 - DNA, 25 bp, Mus musculus
gtctttgtcaagttccgtgtggagt

SEQ ID NO: 694736 - DNA, 25 bp, Mus musculus
gtctttgtcagcactaagcttgcag

SEQ ID NO: 694737 - DNA, 25 bp, Mus musculus
gtctttgtcagctctaagcttgcag

SEQ ID NO: 694738 - DNA, 25 bp, Mus musculus
gtctttgtcctacgagtgactgcta

SEQ ID NO: 694739 - DNA, 25 bp, Mus musculus
gtctttgtcctaggagtgactgcta

SEQ ID NO: 694740 - DNA, 25 bp, Mus musculus
gtctttgtcgttactgcacctcctg

SEQ ID NO: 694741 - DNA, 25 bp, Mus musculus
gtctttgtcgtttctgcacctcctg

SEQ ID NO: 694742 - DNA, 25 bp, Mus musculus
gtctttgtcttactggtttaccttg

SEQ ID NO: 694743 - DNA, 25 bp, Mus musculus
gtctttgtcttagtggtttaccttg

SEQ ID NO: 694744 - DNA, 25 bp, Mus musculus
gtctttgtcttcaaagagcaacccc

SEQ ID NO: 694745 - DNA, 25 bp, Mus musculus
gtctttgtcttctaagagcaacccc

SEQ ID NO: 694746 - DNA, 25 bp, Mus musculus
gtctttgtgactccctgtaattatc

SEQ ID NO: 694747 - DNA, 25 bp, Mus musculus
gtctttgtgactctatagctttgtg

SEQ ID NO: 694748 - DNA, 25 bp, Mus musculus
gtctttgtgactgcctgtaattatc

SEQ ID NO: 694749 - DNA, 25 bp, Mus musculus
gtctttgtgactgtatagctttgtg

SEQ ID NO: 694750 - DNA, 25 bp, Mus musculus
gtctttgtgctgatgcaagctttag

SEQ ID NO: 694751 - DNA, 25 bp, Mus musculus
gtctttgtgctgttgcaagctttag

SEQ ID NO: 694752 - DNA, 25 bp, Mus musculus
gtctttgtggctatgaattggtttc

SEQ ID NO: 694753 - DNA, 25 bp, Mus musculus
gtctttgtggctttgaattggtttc

SEQ ID NO: 694754 - DNA, 25 bp, Mus musculus
gtctttgtgggaatacttcgcacca

SEQ ID NO: 694755 - DNA, 25 bp, Mus musculus
gtctttgtgggactatatctcaaca

SEQ ID NO: 694756 - DNA, 25 bp, Mus musculus
gtctttgtgggagtatatctcaaca

SEQ ID NO: 694757 - DNA, 25 bp, Mus musculus
gtctttgtgggattacttcgcacca

SEQ ID NO: 694758 - DNA, 25 bp, Mus musculus
gtctttgtgtgaaaactccgatggg

SEQ ID NO: 694759 - DNA, 25 bp, Mus musculus
gtctttgtgtgataactccgatggg

SEQ ID NO: 694760 - DNA, 25 bp, Mus musculus
gtctttgtgtgtcctctaactgtcc

SEQ ID NO: 694761 - DNA, 25 bp, Mus musculus
gtctttgtgtgtgctctaactgtcc

SEQ ID NO: 694762 - DNA, 25 bp, Mus musculus
gtctttgttgcaaggtctcggcaat

SEQ ID NO: 694763 - DNA, 25 bp, Mus musculus
gtctttgttgcatggtctcggcaat

SEQ ID NO: 694764 - DNA, 25 bp, Mus musculus
gtctttgttggaagcttggtggaat

SEQ ID NO: 694765 - DNA, 25 bp, Mus musculus
gtctttgttggatgcttggtggaat

SEQ ID NO: 694766 - DNA, 25 bp, Mus musculus
gtctttgtttcacaccaccaagaag

SEQ ID NO: 694767 - DNA, 25 bp, Mus musculus
gtctttgtttcagaccaccaagaag

SEQ ID NO: 694768 - DNA, 25 bp, Mus musculus
gtcttttaaattagatgccatcagc

SEQ ID NO: 694769 - DNA, 25 bp, Mus musculus
gtcttttaaattccctctgtatccc

SEQ ID NO: 694770 - DNA, 25 bp, Mus musculus
gtcttttaaattgcctctgtatccc

SEQ ID NO: 694771 - DNA, 25 bp, Mus musculus
gtcttttaaatttgatgccatcagc

SEQ ID NO: 694772 - DNA, 25 bp, Mus musculus
gtcttttaagacacacacctccatg

SEQ ID NO: 694773 - DNA, 25 bp, Mus musculus
gtcttttaagactcacacctccatg

SEQ ID NO: 694774 - DNA, 25 bp, Mus musculus
gtcttttaatccaagtctctctgct

SEQ ID NO: 694775 - DNA, 25 bp, Mus musculus
gtcttttaatcctagtctctctgct

SEQ ID NO: 694776 - DNA, 25 bp, Mus musculus
gtcttttaccatcctctttagtgtg

SEQ ID NO: 694777 - DNA, 25 bp, Mus musculus
gtcttttaccatgctctttagtgtg

SEQ ID NO: 694778 - DNA, 25 bp, Mus musculus
gtcttttaccgcaatgtcttatgtg

SEQ ID NO: 694779 - DNA, 25 bp, Mus musculus
gtcttttaccgctatgtcttatgtg

SEQ ID NO: 694780 - DNA, 25 bp, Mus musculus
gtcttttacgacagctggagtttag

SEQ ID NO: 694781 - DNA, 25 bp, Mus musculus
gtcttttacgactgctggagtttag

SEQ ID NO: 694782 - DNA, 25 bp, Mus musculus
gtcttttagcacctcttggctgtaa

SEQ ID NO: 694783 - DNA, 25 bp, Mus musculus
gtcttttagcacgtcttggctgtaa

SEQ ID NO: 694784 - DNA, 25 bp, Mus musculus
gtcttttataggcactaggaaactg

SEQ ID NO: 694785 - DNA, 25 bp, Mus musculus
gtcttttatagggactaggaaactg

SEQ ID NO: 694786 - DNA, 25 bp, Mus musculus
gtcttttatatcctggctgtcttca

SEQ ID NO: 694787 - DNA, 25 bp, Mus musculus
gtcttttatatcgtggctgtcttca

SEQ ID NO: 694788 - DNA, 25 bp, Mus musculus
gtcttttatccacctactcagaaaa

SEQ ID NO: 694789 - DNA, 25 bp, Mus musculus
gtcttttatccagctactcagaaaa

SEQ ID NO: 694790 - DNA, 25 bp, Mus musculus
gtcttttatgcaaggcctttagctt

SEQ ID NO: 694791 - DNA, 25 bp, Mus musculus
gtcttttatgcatggcctttagctt

SEQ ID NO: 694792 - DNA, 25 bp, Mus musculus
gtcttttcaagactgtttgaccacc

SEQ ID NO: 694793 - DNA, 25 bp, Mus musculus
gtcttttcaagagtgtttgaccacc

SEQ ID NO: 694794 - DNA, 25 bp, Mus musculus
gtcttttcagccactggacagcata

SEQ ID NO: 694795 - DNA, 25 bp, Mus musculus
gtcttttcagcctctggacagcata

SEQ ID NO: 694796 - DNA, 25 bp, Mus musculus
gtcttttcaggaatgcttcatggat

SEQ ID NO: 694797 - DNA, 25 bp, Mus musculus
gtcttttcaggattgcttcatggat

SEQ ID NO: 694798 - DNA, 25 bp, Mus musculus
gtcttttcaggcctcatgcatgttt

SEQ ID NO: 694799 - DNA, 25 bp, Mus musculus
gtcttttcaggcgtcatgcatgttt

SEQ ID NO: 694800 - DNA, 25 bp, Mus musculus
gtcttttcagggatggatgccctcc

SEQ ID NO: 694801 - DNA, 25 bp, Mus musculus
gtcttttcagggttggatgccctcc

SEQ ID NO: 694802 - DNA, 25 bp, Mus musculus
gtcttttcagtgctctcaggagtga

SEQ ID NO: 694803 - DNA, 25 bp, Mus musculus
gtcttttcagtggtctcaggagtga

SEQ ID NO: 694804 - DNA, 25 bp, Mus musculus
gtcttttcatccatctttccattat

SEQ ID NO: 694805 - DNA, 25 bp, Mus musculus
gtcttttcatccttctttccattat

SEQ ID NO: 694806 - DNA, 25 bp, Mus musculus
gtcttttcatgactgactgtccctt

SEQ ID NO: 694807 - DNA, 25 bp, Mus musculus
gtcttttcatgagtgactgtccctt

SEQ ID NO: 694808 - DNA, 25 bp, Mus musculus
gtcttttcccaactaagtgctcgta

SEQ ID NO: 694809 - DNA, 25 bp, Mus musculus
gtcttttcccaagtaagtgctcgta

SEQ ID NO: 694810 - DNA, 25 bp, Mus musculus
gtcttttccggaccatgcttcagaa

SEQ ID NO: 694811 - DNA, 25 bp, Mus musculus
gtcttttccggagcatgcttcagaa

SEQ ID NO: 694812 - DNA, 25 bp, Mus musculus
gtcttttccggtcgcagcagagtca

SEQ ID NO: 694813 - DNA, 25 bp, Mus musculus
gtcttttccggtggcagcagagtca

SEQ ID NO: 694814 - DNA, 25 bp, Mus musculus
gtcttttccgttacaattctcagga

SEQ ID NO: 694815 - DNA, 25 bp, Mus musculus
gtcttttccgtttcaattctcagga

SEQ ID NO: 694816 - DNA, 25 bp, Mus musculus
gtcttttcctgtcttgtgtgagctg

SEQ ID NO: 694817 - DNA, 25 bp, Mus musculus
gtcttttcctgtgttgtgtgagctg

SEQ ID NO: 694818 - DNA, 25 bp, Mus musculus
gtcttttccttcaatcttagcgttt

SEQ ID NO: 694819 - DNA, 25 bp, Mus musculus
gtcttttccttctatcttagcgttt

SEQ ID NO: 694820 - DNA, 25 bp, Mus musculus
gtcttttctagtacttacacacgtg

SEQ ID NO: 694821 - DNA, 25 bp, Mus musculus
gtcttttctagttcttacacacgtg

SEQ ID NO: 694822 - DNA, 25 bp, Mus musculus
gtcttttctgctaatgttctgctat

SEQ ID NO: 694823 - DNA, 25 bp, Mus musculus
gtcttttctgctctcattgaattcg

SEQ ID NO: 694824 - DNA, 25 bp, Mus musculus
gtcttttctgctgtcattgaattcg

SEQ ID NO: 694825 - DNA, 25 bp, Mus musculus
gtcttttctgcttatgttctgctat

SEQ ID NO: 694826 - DNA, 25 bp, Mus musculus
gtcttttctgtaatctgtgagaagc

SEQ ID NO: 694827 - DNA, 25 bp, Mus musculus
gtcttttctgtattctgtgagaagc

SEQ ID NO: 694828 - DNA, 25 bp, Mus musculus
gtcttttctgtcagtattaatttat

SEQ ID NO: 694829 - DNA, 25 bp, Mus musculus
gtcttttctgtctgtattaatttat

SEQ ID NO: 694830 - DNA, 25 bp, Mus musculus
gtcttttcttagatgtgggtggctt

SEQ ID NO: 694831 - DNA, 25 bp, Mus musculus
gtcttttcttagttgtgggtggctt

SEQ ID NO: 694832 - DNA, 25 bp, Mus musculus
gtcttttcttccatgggtcatggaa

SEQ ID NO: 694833 - DNA, 25 bp, Mus musculus
gtcttttcttccttgggtcatggaa

SEQ ID NO: 694834 - DNA, 25 bp, Mus musculus
gtcttttcttgaaatgttgtgctct

SEQ ID NO: 694835 - DNA, 25 bp, Mus musculus
gtcttttcttgatatgttgtgctct

SEQ ID NO: 694836 - DNA, 25 bp, Mus musculus
gtcttttctttactgtctccaatcg

SEQ ID NO: 694837 - DNA, 25 bp, Mus musculus
gtcttttctttagtgtctccaatcg

SEQ ID NO: 694838 - DNA, 25 bp, Mus musculus
gtcttttctttgagcttccttgtgt

SEQ ID NO: 694839 - DNA, 25 bp, Mus musculus
gtcttttctttgtgcttccttgtgt

SEQ ID NO: 694840 - DNA, 25 bp, Mus musculus
gtcttttgaagtcggcggtcccgca

SEQ ID NO: 694841 - DNA, 25 bp, Mus musculus
gtcttttgaagtgggcggtcccgca

SEQ ID NO: 694842 - DNA, 25 bp, Mus musculus
gtcttttgacttctctctcagtaga

SEQ ID NO: 694843 - DNA, 25 bp, Mus musculus
gtcttttgacttgtctctcagtaga

SEQ ID NO: 694844 - DNA, 25 bp, Mus musculus
gtcttttgataactggcaaggccgt

SEQ ID NO: 694845 - DNA, 25 bp, Mus musculus
gtcttttgataagtggcaaggccgt

SEQ ID NO: 694846 - DNA, 25 bp, Mus musculus
gtcttttgcatacacattcatcaaa

SEQ ID NO: 694847 - DNA, 25 bp, Mus musculus
gtcttttgcatagacattcatcaaa

SEQ ID NO: 694848 - DNA, 25 bp, Mus musculus
gtcttttgccgcagccctgggaaat

SEQ ID NO: 694849 - DNA, 25 bp, Mus musculus
gtcttttgccgctgccctgggaaat

SEQ ID NO: 694850 - DNA, 25 bp, Mus musculus
gtcttttgctttactctgcattcct

SEQ ID NO: 694851 - DNA, 25 bp, Mus musculus
gtcttttgcttttctctgcattcct

SEQ ID NO: 694852 - DNA, 25 bp, Mus musculus
gtcttttgtaaaaacctccgtggag

SEQ ID NO: 694853 - DNA, 25 bp, Mus musculus
gtcttttgtaaatacctccgtggag

SEQ ID NO: 694854 - DNA, 25 bp, Mus musculus
gtcttttgtactctgaaccctgtca

SEQ ID NO: 694855 - DNA, 25 bp, Mus musculus
gtcttttgtactgtgaaccctgtca

SEQ ID NO: 694856 - DNA, 25 bp, Mus musculus
gtcttttgtggtatctagccaaaca

SEQ ID NO: 694857 - DNA, 25 bp, Mus musculus
gtcttttgtggtttctagccaaaca

SEQ ID NO: 694858 - DNA, 25 bp, Mus musculus
gtctttttaaagaactgcaccaaca

SEQ ID NO: 694859 - DNA, 25 bp, Mus musculus
gtctttttaaagtactgcaccaaca

SEQ ID NO: 694860 - DNA, 25 bp, Mus musculus
gtctttttatagaaagcttcctcca

SEQ ID NO: 694861 - DNA, 25 bp, Mus musculus
gtctttttatagtaagcttcctcca

SEQ ID NO: 694862 - DNA, 25 bp, Mus musculus
gtctttttattactatgtccattta

SEQ ID NO: 694863 - DNA, 25 bp, Mus musculus
gtctttttattagtatgtccattta

SEQ ID NO: 694864 - DNA, 25 bp, Mus musculus
gtctttttcaagctgtggtcccact

SEQ ID NO: 694865 - DNA, 25 bp, Mus musculus
gtctttttcaaggtgtggtcccact

SEQ ID NO: 694866 - DNA, 25 bp, Mus musculus
gtctttttcacaagtactggcctta

SEQ ID NO: 694867 - DNA, 25 bp, Mus musculus
gtctttttcacatgtactggcctta

SEQ ID NO: 694868 - DNA, 25 bp, Mus musculus
gtctttttcagccatgcaggctttt

SEQ ID NO: 694869 - DNA, 25 bp, Mus musculus
gtctttttcagcgatgcaggctttt

SEQ ID NO: 694870 - DNA, 25 bp, Mus musculus
gtctttttcagtatggcttcttttt

SEQ ID NO: 694871 - DNA, 25 bp, Mus musculus
gtctttttcagtttggcttcttttt

SEQ ID NO: 694872 - DNA, 25 bp, Mus musculus
gtctttttcatcacagtcatagcca

SEQ ID NO: 694873 - DNA, 25 bp, Mus musculus
gtctttttcatctcagtcatagcca

SEQ ID NO: 694874 - DNA, 25 bp, Mus musculus
gtctttttccctccttgtatataag

SEQ ID NO: 694875 - DNA, 25 bp, Mus musculus
gtctttttccctgcttgtatataag

SEQ ID NO: 694876 - DNA, 25 bp, Mus musculus
gtctttttctagctctccatgcata

SEQ ID NO: 694877 - DNA, 25 bp, Mus musculus
gtctttttctaggtctccatgcata

SEQ ID NO: 694878 - DNA, 25 bp, Mus musculus
gtctttttctctatcggaatccgat

SEQ ID NO: 694879 - DNA, 25 bp, Mus musculus
gtctttttctctttcggaatccgat

SEQ ID NO: 694880 - DNA, 25 bp, Mus musculus
gtctttttcttacaggagcctcaaa

SEQ ID NO: 694881 - DNA, 25 bp, Mus musculus
gtctttttcttagaggagcctcaaa

SEQ ID NO: 694882 - DNA, 25 bp, Mus musculus
gtctttttgaagcaattgaaaccct

SEQ ID NO: 694883 - DNA, 25 bp, Mus musculus
gtctttttgaaggaattgaaaccct

SEQ ID NO: 694884 - DNA, 25 bp, Mus musculus
gtctttttgcagattagccttcatg

SEQ ID NO: 694885 - DNA, 25 bp, Mus musculus
gtctttttgcagtttagccttcatg

SEQ ID NO: 694886 - DNA, 25 bp, Mus musculus
gtctttttgcttagagccctagcta

SEQ ID NO: 694887 - DNA, 25 bp, Mus musculus
gtctttttgcttcgactggagcaca

SEQ ID NO: 694888 - DNA, 25 bp, Mus musculus
gtctttttgcttggactggagcaca

SEQ ID NO: 694889 - DNA, 25 bp, Mus musculus
gtctttttgctttgagccctagcta

SEQ ID NO: 694890 - DNA, 25 bp, Mus musculus
gtcttttttcatagtgacatgcaga

SEQ ID NO: 694891 - DNA, 25 bp, Mus musculus
gtcttttttcattgtgacatgcaga

SEQ ID NO: 694892 - DNA, 25 bp, Mus musculus
gtgaaaaacacacactgagcccctt

SEQ ID NO: 694893 - DNA, 25 bp, Mus musculus
gtgaaaaacacagactgagcccctt

SEQ ID NO: 694894 - DNA, 25 bp, Mus musculus
gtgaaaaaccttccatgaataactg

SEQ ID NO: 694895 - DNA, 25 bp, Mus musculus
gtgaaaaaccttgcatgaataactg

SEQ ID NO: 694896 - DNA, 25 bp, Mus musculus
gtgaaaaagatcaggccactttgtg

SEQ ID NO: 694897 - DNA, 25 bp, Mus musculus
gtgaaaaagatctggccactttgtg

SEQ ID NO: 694898 - DNA, 25 bp, Mus musculus
gtgaaaaagggtccccgggtcatca

SEQ ID NO: 694899 - DNA, 25 bp, Mus musculus
gtgaaaaagggtgcccgggtcatca

SEQ ID NO: 694900 - DNA, 25 bp, Mus musculus
gtgaaaacactgaataccaaagaaa

SEQ ID NO: 694901 - DNA, 25 bp, Mus musculus
gtgaaaacactgtataccaaagaaa

SEQ ID NO: 694902 - DNA, 25 bp, Mus musculus
gtgaaaacagttccattctccttca

SEQ ID NO: 694903 - DNA, 25 bp, Mus musculus
gtgaaaacagttgcattctccttca

SEQ ID NO: 694904 - DNA, 25 bp, Mus musculus
gtgaaaaccatcagaactcctcaat

SEQ ID NO: 694905 - DNA, 25 bp, Mus musculus
gtgaaaaccatctgaactcctcaat

SEQ ID NO: 694906 - DNA, 25 bp, Mus musculus
gtgaaaaccattatctgatcctcag

SEQ ID NO: 694907 - DNA, 25 bp, Mus musculus
gtgaaaaccattttctgatcctcag

SEQ ID NO: 694908 - DNA, 25 bp, Mus musculus
gtgaaaacccacattcatggtttaa

SEQ ID NO: 694909 - DNA, 25 bp, Mus musculus
gtgaaaacccactttcatggtttaa

SEQ ID NO: 694910 - DNA, 25 bp, Mus musculus
gtgaaaacccagcacagtggtgtga

SEQ ID NO: 694911 - DNA, 25 bp, Mus musculus
gtgaaaacccaggacagtggtgtga

SEQ ID NO: 694912 - DNA, 25 bp, Mus musculus
gtgaaaacccttccagacacctgaa

SEQ ID NO: 694913 - DNA, 25 bp, Mus musculus
gtgaaaacccttgcagacacctgaa

SEQ ID NO: 694914 - DNA, 25 bp, Mus musculus
gtgaaaacctgaatgtcctgcgtta

SEQ ID NO: 694915 - DNA, 25 bp, Mus musculus
gtgaaaacctgattgtcctgcgtta

SEQ ID NO: 694916 - DNA, 25 bp, Mus musculus
gtgaaaaccttaaactgttccagaa

SEQ ID NO: 694917 - DNA, 25 bp, Mus musculus
gtgaaaaccttatactgttccagaa

SEQ ID NO: 694918 - DNA, 25 bp, Mus musculus
gtgaaaacggatccagggcttaaag

SEQ ID NO: 694919 - DNA, 25 bp, Mus musculus
gtgaaaacggatgcagggcttaaag

SEQ ID NO: 694920 - DNA, 25 bp, Mus musculus
gtgaaaactaccacagttccagcca

SEQ ID NO: 694921 - DNA, 25 bp, Mus musculus
gtgaaaactacctcagttccagcca

SEQ ID NO: 694922 - DNA, 25 bp, Mus musculus
gtgaaaactagcctggcatgtggta

SEQ ID NO: 694923 - DNA, 25 bp, Mus musculus
gtgaaaactagcgtggcatgtggta

SEQ ID NO: 694924 - DNA, 25 bp, Mus musculus
gtgaaaacttccatgattgcaggaa

SEQ ID NO: 694925 - DNA, 25 bp, Mus musculus
gtgaaaacttccttgattgcaggaa

SEQ ID NO: 694926 - DNA, 25 bp, Mus musculus
gtgaaaacttgactcttgtattgac

SEQ ID NO: 694927 - DNA, 25 bp, Mus musculus
gtgaaaacttgagtcttgtattgac

SEQ ID NO: 694928 - DNA, 25 bp, Mus musculus
gtgaaaagacgactcaccctcagcc

SEQ ID NO: 694929 - DNA, 25 bp, Mus musculus
gtgaaaagacgagtcaccctcagcc

SEQ ID NO: 694930 - DNA, 25 bp, Mus musculus
gtgaaaagcgtcatcttcggaccag

SEQ ID NO: 694931 - DNA, 25 bp, Mus musculus
gtgaaaagcgtcttcttcggaccag

SEQ ID NO: 694932 - DNA, 25 bp, Mus musculus
gtgaaaaggactccaggcctggcca

SEQ ID NO: 694933 - DNA, 25 bp, Mus musculus
gtgaaaaggactgcaggcctggcca

SEQ ID NO: 694934 - DNA, 25 bp, Mus musculus
gtgaaaagggatagccccaccacta

SEQ ID NO: 694935 - DNA, 25 bp, Mus musculus
gtgaaaagggattgccccaccacta

SEQ ID NO: 694936 - DNA, 25 bp, Mus musculus
gtgaaaaggtccaagttgctacctt

SEQ ID NO: 694937 - DNA, 25 bp, Mus musculus
gtgaaaaggtcctagttgctacctt

SEQ ID NO: 694938 - DNA, 25 bp, Mus musculus
gtgaaaatagttcttggccaaacat

SEQ ID NO: 694939 - DNA, 25 bp, Mus musculus
gtgaaaatagttgttggccaaacat

SEQ ID NO: 694940 - DNA, 25 bp, Mus musculus
gtgaaaatcccacaccgttccgtgg

SEQ ID NO: 694941 - DNA, 25 bp, Mus musculus
gtgaaaatcccagaccgttccgtgg

SEQ ID NO: 694942 - DNA, 25 bp, Mus musculus
gtgaaaatccctaccccatatgata

SEQ ID NO: 694943 - DNA, 25 bp, Mus musculus
gtgaaaatcccttccccatatgata

SEQ ID NO: 694944 - DNA, 25 bp, Mus musculus
gtgaaaatctacacgactgccttta

SEQ ID NO: 694945 - DNA, 25 bp, Mus musculus
gtgaaaatctactcgactgccttta

SEQ ID NO: 694946 - DNA, 25 bp, Mus musculus
gtgaaaatgactactcccaaaccag

SEQ ID NO: 694947 - DNA, 25 bp, Mus musculus
gtgaaaatgacttctcccaaaccag

SEQ ID NO: 694948 - DNA, 25 bp, Mus musculus
gtgaaaatgcaccagctgttccttt

SEQ ID NO: 694949 - DNA, 25 bp, Mus musculus
gtgaaaatgcacgagctgttccttt

SEQ ID NO: 694950 - DNA, 25 bp, Mus musculus
gtgaaaatgggtatcccatccctag

SEQ ID NO: 694951 - DNA, 25 bp, Mus musculus
gtgaaaatgggtttcccatccctag

SEQ ID NO: 694952 - DNA, 25 bp, Mus musculus
gtgaaaattagtactccggtcccag

SEQ ID NO: 694953 - DNA, 25 bp, Mus musculus
gtgaaaattagttctccggtcccag

SEQ ID NO: 694954 - DNA, 25 bp, Mus musculus
gtgaaaattgtaagcctctcctttg

SEQ ID NO: 694955 - DNA, 25 bp, Mus musculus
gtgaaaattgtatgcctctcctttg

SEQ ID NO: 694956 - DNA, 25 bp, Mus musculus
gtgaaacaaatccacccattgaagg

SEQ ID NO: 694957 - DNA, 25 bp, Mus musculus
gtgaaacaaatcgacccattgaagg

SEQ ID NO: 694958 - DNA, 25 bp, Mus musculus
gtgaaacacagcaacatttcagtgt

SEQ ID NO: 694959 - DNA, 25 bp, Mus musculus
gtgaaacacagctacatttcagtgt

SEQ ID NO: 694960 - DNA, 25 bp, Mus musculus
gtgaaacactccatcacatgtctgt

SEQ ID NO: 694961 - DNA, 25 bp, Mus musculus
gtgaaacactccttcacatgtctgt

SEQ ID NO: 694962 - DNA, 25 bp, Mus musculus
gtgaaacactctattccagatgtaa

SEQ ID NO: 694963 - DNA, 25 bp, Mus musculus
gtgaaacactcttttccagatgtaa

SEQ ID NO: 694964 - DNA, 25 bp, Mus musculus
gtgaaacacttgcttgccaactgga

SEQ ID NO: 694965 - DNA, 25 bp, Mus musculus
gtgaaacacttggttgccaactgga

SEQ ID NO: 694966 - DNA, 25 bp, Mus musculus
gtgaaacagcttaaagacaggacct

SEQ ID NO: 694967 - DNA, 25 bp, Mus musculus
gtgaaacagctttaagacaggacct

SEQ ID NO: 694968 - DNA, 25 bp, Mus musculus
gtgaaacagggaagtcgccctctca

SEQ ID NO: 694969 - DNA, 25 bp, Mus musculus
gtgaaacagggatgtcgccctctca

SEQ ID NO: 694970 - DNA, 25 bp, Mus musculus
gtgaaacagtttactgtagtgatat

SEQ ID NO: 694971 - DNA, 25 bp, Mus musculus
gtgaaacagttttctgtagtgatat

SEQ ID NO: 694972 - DNA, 25 bp, Mus musculus
gtgaaacatctaactttgccagtgt

SEQ ID NO: 694973 - DNA, 25 bp, Mus musculus
gtgaaacatctatctttgccagtgt

SEQ ID NO: 694974 - DNA, 25 bp, Mus musculus
gtgaaacatgtcatgagggtgtgaa

SEQ ID NO: 694975 - DNA, 25 bp, Mus musculus
gtgaaacatgtcttgagggtgtgaa

SEQ ID NO: 694976 - DNA, 25 bp, Mus musculus
gtgaaaccacgacctgaatctggca

SEQ ID NO: 694977 - DNA, 25 bp, Mus musculus
gtgaaaccacgagctgaatctggca

SEQ ID NO: 694978 - DNA, 25 bp, Mus musculus
gtgaaaccagaaagctaaatccagc

SEQ ID NO: 694979 - DNA, 25 bp, Mus musculus
gtgaaaccagaatgctaaatccagc

SEQ ID NO: 694980 - DNA, 25 bp, Mus musculus
gtgaaaccaggtacctgcacacatt

SEQ ID NO: 694981 - DNA, 25 bp, Mus musculus
gtgaaaccaggtagagggtccttca

SEQ ID NO: 694982 - DNA, 25 bp, Mus musculus
gtgaaaccaggttcctgcacacatt

SEQ ID NO: 694983 - DNA, 25 bp, Mus musculus
gtgaaaccaggttgagggtccttca

SEQ ID NO: 694984 - DNA, 25 bp, Mus musculus
gtgaaaccagttcccttgagtttta

SEQ ID NO: 694985 - DNA, 25 bp, Mus musculus
gtgaaaccagttgccttgagtttta

SEQ ID NO: 694986 - DNA, 25 bp, Mus musculus
gtgaaaccatacaccttcaccaggt

SEQ ID NO: 694987 - DNA, 25 bp, Mus musculus
gtgaaaccatactccttcaccaggt

SEQ ID NO: 694988 - DNA, 25 bp, Mus musculus
gtgaaacccaacaccacatttttat

SEQ ID NO: 694989 - DNA, 25 bp, Mus musculus
gtgaaacccaactccacatttttat

SEQ ID NO: 694990 - DNA, 25 bp, Mus musculus
gtgaaacccagcacctccaaatagt

SEQ ID NO: 694991 - DNA, 25 bp, Mus musculus
gtgaaacccagctcctccaaatagt

SEQ ID NO: 694992 - DNA, 25 bp, Mus musculus
gtgaaacccatgctccagaacggag

SEQ ID NO: 694993 - DNA, 25 bp, Mus musculus
gtgaaacccatggtccagaacggag

SEQ ID NO: 694994 - DNA, 25 bp, Mus musculus
gtgaaaccctgacgatcaagcaccc

SEQ ID NO: 694995 - DNA, 25 bp, Mus musculus
gtgaaaccctgaggatcaagcaccc

SEQ ID NO: 694996 - DNA, 25 bp, Mus musculus
gtgaaaccgaaaccatgcacacgtt

SEQ ID NO: 694997 - DNA, 25 bp, Mus musculus
gtgaaaccgaaagcatgcacacgtt

SEQ ID NO: 694998 - DNA, 25 bp, Mus musculus
gtgaaacctacaatctgagtctggc

SEQ ID NO: 694999 - DNA, 25 bp, Mus musculus
gtgaaacctacattctgagtctggc

SEQ ID NO: 695000 - DNA, 25 bp, Mus musculus
gtgaaacctcagatctacgaaaagt

SEQ ID NO: 695001 - DNA, 25 bp, Mus musculus
gtgaaacctcagttctacgaaaagt

SEQ ID NO: 695002 - DNA, 25 bp, Mus musculus
gtgaaacctctcagttctcagatac

SEQ ID NO: 695003 - DNA, 25 bp, Mus musculus
gtgaaacctctctgttctcagatac

SEQ ID NO: 695004 - DNA, 25 bp, Mus musculus
gtgaaaccttaccatatgccagtat

SEQ ID NO: 695005 - DNA, 25 bp, Mus musculus
gtgaaaccttacgatatgccagtat

SEQ ID NO: 695006 - DNA, 25 bp, Mus musculus
gtgaaaccttatagcgtccttgaaa

SEQ ID NO: 695007 - DNA, 25 bp, Mus musculus
gtgaaaccttattgcgtccttgaaa

SEQ ID NO: 695008 - DNA, 25 bp, Mus musculus
gtgaaactactaatggaggcccata

SEQ ID NO: 695009 - DNA, 25 bp, Mus musculus
gtgaaactactattggaggcccata

SEQ ID NO: 695010 - DNA, 25 bp, Mus musculus
gtgaaactagataccacatagcttg

SEQ ID NO: 695011 - DNA, 25 bp, Mus musculus
gtgaaactagattccacatagcttg

SEQ ID NO: 695012 - DNA, 25 bp, Mus musculus
gtgaaactccaaagctgaacgtatt

SEQ ID NO: 695013 - DNA, 25 bp, Mus musculus
gtgaaactccaatgctgaacgtatt

SEQ ID NO: 695014 - DNA, 25 bp, Mus musculus
gtgaaactgcttaatcgggagaggt

SEQ ID NO: 695015 - DNA, 25 bp, Mus musculus
gtgaaactgctttatcgggagaggt

SEQ ID NO: 695016 - DNA, 25 bp, Mus musculus
gtgaaactggagagccatgttctct

SEQ ID NO: 695017 - DNA, 25 bp, Mus musculus
gtgaaactggagtgccatgttctct

SEQ ID NO: 695018 - DNA, 25 bp, Mus musculus
gtgaaactgggcactagtgaacctt

SEQ ID NO: 695019 - DNA, 25 bp, Mus musculus
gtgaaactgggctctagtgaacctt

SEQ ID NO: 695020 - DNA, 25 bp, Mus musculus
gtgaaactggtgctgcgctacactc

SEQ ID NO: 695021 - DNA, 25 bp, Mus musculus
gtgaaactggtggtgcgctacactc

SEQ ID NO: 695022 - DNA, 25 bp, Mus musculus
gtgaaactgtcccaggcatgcaaat

SEQ ID NO: 695023 - DNA, 25 bp, Mus musculus
gtgaaactgtccctggcgtcccgag

SEQ ID NO: 695024 - DNA, 25 bp, Mus musculus
gtgaaactgtccgaggcatgcaaat

SEQ ID NO: 695025 - DNA, 25 bp, Mus musculus
gtgaaactgtccgtggcgtcccgag

SEQ ID NO: 695026 - DNA, 25 bp, Mus musculus
gtgaaactgtggaggcgcttctgca

SEQ ID NO: 695027 - DNA, 25 bp, Mus musculus
gtgaaactgtggtggcgcttctgca

SEQ ID NO: 695028 - DNA, 25 bp, Mus musculus
gtgaaactgttgatcctgaaaactg

SEQ ID NO: 695029 - DNA, 25 bp, Mus musculus
gtgaaactgttgttcctgaaaactg

SEQ ID NO: 695030 - DNA, 25 bp, Mus musculus
gtgaaacttcatattttgcagcatc

SEQ ID NO: 695031 - DNA, 25 bp, Mus musculus
gtgaaacttcattttttgcagcatc

SEQ ID NO: 695032 - DNA, 25 bp, Mus musculus
gtgaaacttggaccattctacgaaa

SEQ ID NO: 695033 - DNA, 25 bp, Mus musculus
gtgaaacttggagcattctacgaaa

SEQ ID NO: 695034 - DNA, 25 bp, Mus musculus
gtgaaactttgaacaaaacttccat

SEQ ID NO: 695035 - DNA, 25 bp, Mus musculus
gtgaaactttgatcaaaacttccat

SEQ ID NO: 695036 - DNA, 25 bp, Mus musculus
gtgaaacttttcagtgccttctcag

SEQ ID NO: 695037 - DNA, 25 bp, Mus musculus
gtgaaacttttctgtgccttctcag

SEQ ID NO: 695038 - DNA, 25 bp, Mus musculus
gtgaaagaccccagtgttcttgaaa

SEQ ID NO: 695039 - DNA, 25 bp, Mus musculus
gtgaaagacccctgtgttcttgaaa

SEQ ID NO: 695040 - DNA, 25 bp, Mus musculus
gtgaaagactcacacttcttggaaa

SEQ ID NO: 695041 - DNA, 25 bp, Mus musculus
gtgaaagactcagacttcttggaaa

SEQ ID NO: 695042 - DNA, 25 bp, Mus musculus
gtgaaagactcccatcattggacct

SEQ ID NO: 695043 - DNA, 25 bp, Mus musculus
gtgaaagactccgatcattggacct

SEQ ID NO: 695044 - DNA, 25 bp, Mus musculus
gtgaaagagaccagtcaggcctcca

SEQ ID NO: 695045 - DNA, 25 bp, Mus musculus
gtgaaagagacctgtcaggcctcca

SEQ ID NO: 695046 - DNA, 25 bp, Mus musculus
gtgaaagattgaccgcaacctactg

SEQ ID NO: 695047 - DNA, 25 bp, Mus musculus
gtgaaagattgagcgcaacctactg

SEQ ID NO: 695048 - DNA, 25 bp, Mus musculus
gtgaaagattttcccagctgccacc

SEQ ID NO: 695049 - DNA, 25 bp, Mus musculus
gtgaaagattttgccagctgccacc

SEQ ID NO: 695050 - DNA, 25 bp, Mus musculus
gtgaaagccaagcacctaactccta

SEQ ID NO: 695051 - DNA, 25 bp, Mus musculus
gtgaaagccaaggacctaactccta

SEQ ID NO: 695052 - DNA, 25 bp, Mus musculus
gtgaaagccagcatcacttgcactt

SEQ ID NO: 695053 - DNA, 25 bp, Mus musculus
gtgaaagccagcttcacttgcactt

SEQ ID NO: 695054 - DNA, 25 bp, Mus musculus
gtgaaagccctccaagacatcataa

SEQ ID NO: 695055 - DNA, 25 bp, Mus musculus
gtgaaagccctcgaagacatcataa

SEQ ID NO: 695056 - DNA, 25 bp, Mus musculus
gtgaaagccttaactgtcagctgtt

SEQ ID NO: 695057 - DNA, 25 bp, Mus musculus
gtgaaagccttatctgtcagctgtt

SEQ ID NO: 695058 - DNA, 25 bp, Mus musculus
gtgaaagccttgatagctatagata

SEQ ID NO: 695059 - DNA, 25 bp, Mus musculus
gtgaaagccttgttagctatagata

SEQ ID NO: 695060 - DNA, 25 bp, Mus musculus
gtgaaagcgatcctagagcacttga

SEQ ID NO: 695061 - DNA, 25 bp, Mus musculus
gtgaaagcgatcgtagagcacttga

SEQ ID NO: 695062 - DNA, 25 bp, Mus musculus
gtgaaagctacactgtccgagacct

SEQ ID NO: 695063 - DNA, 25 bp, Mus musculus
gtgaaagctacagtgtccgagacct

SEQ ID NO: 695064 - DNA, 25 bp, Mus musculus
gtgaaagctagacttcataatgacc

SEQ ID NO: 695065 - DNA, 25 bp, Mus musculus
gtgaaagctagagttcataatgacc

SEQ ID NO: 695066 - DNA, 25 bp, Mus musculus
gtgaaagctgaaccacctctggaag

SEQ ID NO: 695067 - DNA, 25 bp, Mus musculus
gtgaaagctgaagcacctctggaag

SEQ ID NO: 695068 - DNA, 25 bp, Mus musculus
gtgaaaggaatcaaccacttggttc

SEQ ID NO: 695069 - DNA, 25 bp, Mus musculus
gtgaaaggaatcagtttgtttgtga

SEQ ID NO: 695070 - DNA, 25 bp, Mus musculus
gtgaaaggaatctaccacttggttc

SEQ ID NO: 695071 - DNA, 25 bp, Mus musculus
gtgaaaggaatctgtttgtttgtga

SEQ ID NO: 695072 - DNA, 25 bp, Mus musculus
gtgaaaggaccgctgtgcacaccta

SEQ ID NO: 695073 - DNA, 25 bp, Mus musculus
gtgaaaggaccggtgtgcacaccta

SEQ ID NO: 695074 - DNA, 25 bp, Mus musculus
gtgaaaggcatcctcaaacttgagt

SEQ ID NO: 695075 - DNA, 25 bp, Mus musculus
gtgaaaggcatcgtcaaacttgagt

SEQ ID NO: 695076 - DNA, 25 bp, Mus musculus
gtgaaaggccacctgtttggaataa

SEQ ID NO: 695077 - DNA, 25 bp, Mus musculus
gtgaaaggccacgtgtttggaataa

SEQ ID NO: 695078 - DNA, 25 bp, Mus musculus
gtgaaagggcgcatgatggattctt

SEQ ID NO: 695079 - DNA, 25 bp, Mus musculus
gtgaaagggcgcttgatggattctt

SEQ ID NO: 695080 - DNA, 25 bp, Mus musculus
gtgaaaggtacaatctcagaggtcg

SEQ ID NO: 695081 - DNA, 25 bp, Mus musculus
gtgaaaggtacattctcagaggtcg

SEQ ID NO: 695082 - DNA, 25 bp, Mus musculus
gtgaaaggtcttaatggtccaggaa

SEQ ID NO: 695083 - DNA, 25 bp, Mus musculus
gtgaaaggtctttatggtccaggaa

SEQ ID NO: 695084 - DNA, 25 bp, Mus musculus
gtgaaagtcccgcagatcaggtttt

SEQ ID NO: 695085 - DNA, 25 bp, Mus musculus
gtgaaagtcccggagatcaggtttt

SEQ ID NO: 695086 - DNA, 25 bp, Mus musculus
gtgaaagtcgacctgctccggcaaa

SEQ ID NO: 695087 - DNA, 25 bp, Mus musculus
gtgaaagtcgacgtgctccggcaaa

SEQ ID NO: 695088 - DNA, 25 bp, Mus musculus
gtgaaagtctctagttatcttccca

SEQ ID NO: 695089 - DNA, 25 bp, Mus musculus
gtgaaagtctcttgttatcttccca

SEQ ID NO: 695090 - DNA, 25 bp, Mus musculus
gtgaaagtgctaatgcaactccaaa

SEQ ID NO: 695091 - DNA, 25 bp, Mus musculus
gtgaaagtgctattgcaactccaaa

SEQ ID NO: 695092 - DNA, 25 bp, Mus musculus
gtgaaagttcctatgttccaataga

SEQ ID NO: 695093 - DNA, 25 bp, Mus musculus
gtgaaagttcctttgttccaataga

SEQ ID NO: 695094 - DNA, 25 bp, Mus musculus
gtgaaataaactctccccaaggatg

SEQ ID NO: 695095 - DNA, 25 bp, Mus musculus
gtgaaataaactgtccccaaggatg

SEQ ID NO: 695096 - DNA, 25 bp, Mus musculus
gtgaaatacaacatactctcatttg

SEQ ID NO: 695097 - DNA, 25 bp, Mus musculus
gtgaaatacaacttactctcatttg

SEQ ID NO: 695098 - DNA, 25 bp, Mus musculus
gtgaaatacactcgtggtgtccttc

SEQ ID NO: 695099 - DNA, 25 bp, Mus musculus
gtgaaatacactggtggtgtccttc

SEQ ID NO: 695100 - DNA, 25 bp, Mus musculus
gtgaaatacagaatgcagcagcatt

SEQ ID NO: 695101 - DNA, 25 bp, Mus musculus
gtgaaatacagattgcagcagcatt

SEQ ID NO: 695102 - DNA, 25 bp, Mus musculus
gtgaaataggaactccagcccactc

SEQ ID NO: 695103 - DNA, 25 bp, Mus musculus
gtgaaataggaagtccagcccactc

SEQ ID NO: 695104 - DNA, 25 bp, Mus musculus
gtgaaataggctatacccacccaca

SEQ ID NO: 695105 - DNA, 25 bp, Mus musculus
gtgaaataggctttacccacccaca

SEQ ID NO: 695106 - DNA, 25 bp, Mus musculus
gtgaaatatacaccaggacatctgg

SEQ ID NO: 695107 - DNA, 25 bp, Mus musculus
gtgaaatatacagcaggacatctgg

SEQ ID NO: 695108 - DNA, 25 bp, Mus musculus
gtgaaatatgccactttactgttta

SEQ ID NO: 695109 - DNA, 25 bp, Mus musculus
gtgaaatatgcctctttactgttta

SEQ ID NO: 695110 - DNA, 25 bp, Mus musculus
gtgaaatatggccactcaggctgaa

SEQ ID NO: 695111 - DNA, 25 bp, Mus musculus
gtgaaatatggcgactcaggctgaa

SEQ ID NO: 695112 - DNA, 25 bp, Mus musculus
gtgaaatatgtcagtcggaggcaat

SEQ ID NO: 695113 - DNA, 25 bp, Mus musculus
gtgaaatatgtctgtcggaggcaat

SEQ ID NO: 695114 - DNA, 25 bp, Mus musculus
gtgaaatattggaactgtttctctc

SEQ ID NO: 695115 - DNA, 25 bp, Mus musculus
gtgaaatattggtactgtttctctc

SEQ ID NO: 695116 - DNA, 25 bp, Mus musculus
gtgaaatcaaacactgagatacagt

SEQ ID NO: 695117 - DNA, 25 bp, Mus musculus
gtgaaatcaaactctgagatacagt

SEQ ID NO: 695118 - DNA, 25 bp, Mus musculus
gtgaaatcaaggatgcccagcccaa

SEQ ID NO: 695119 - DNA, 25 bp, Mus musculus
gtgaaatcaaggttgcccagcccaa

SEQ ID NO: 695120 - DNA, 25 bp, Mus musculus
gtgaaatcaatgagctctgagtcaa

SEQ ID NO: 695121 - DNA, 25 bp, Mus musculus
gtgaaatcaatgtgctctgagtcaa

SEQ ID NO: 695122 - DNA, 25 bp, Mus musculus
gtgaaatcagaacagagcccagggt

SEQ ID NO: 695123 - DNA, 25 bp, Mus musculus
gtgaaatcagaagagagcccagggt

SEQ ID NO: 695124 - DNA, 25 bp, Mus musculus
gtgaaatcagcacaatccctttata

SEQ ID NO: 695125 - DNA, 25 bp, Mus musculus
gtgaaatcagcagaatccctttata

SEQ ID NO: 695126 - DNA, 25 bp, Mus musculus
gtgaaatcagttaaggaaatagtac

SEQ ID NO: 695127 - DNA, 25 bp, Mus musculus
gtgaaatcagtttaggaaatagtac

SEQ ID NO: 695128 - DNA, 25 bp, Mus musculus
gtgaaatccctaaaccaaggagact

SEQ ID NO: 695129 - DNA, 25 bp, Mus musculus
gtgaaatccctataccaaggagact

SEQ ID NO: 695130 - DNA, 25 bp, Mus musculus
gtgaaatcctccaccgtccaacatt

SEQ ID NO: 695131 - DNA, 25 bp, Mus musculus
gtgaaatcctccattgtccaacatt

SEQ ID NO: 695132 - DNA, 25 bp, Mus musculus
gtgaaatcctcctccgtccaacatt

SEQ ID NO: 695133 - DNA, 25 bp, Mus musculus
gtgaaatcctcctttgtccaacatt

SEQ ID NO: 695134 - DNA, 25 bp, Mus musculus
gtgaaatccttgactgtttagtgag

SEQ ID NO: 695135 - DNA, 25 bp, Mus musculus
gtgaaatccttgatgtctgagatca

SEQ ID NO: 695136 - DNA, 25 bp, Mus musculus
gtgaaatccttgtctgtttagtgag

SEQ ID NO: 695137 - DNA, 25 bp, Mus musculus
gtgaaatccttgttgtctgagatca

SEQ ID NO: 695138 - DNA, 25 bp, Mus musculus
gtgaaatctacccttgtccaacgct

SEQ ID NO: 695139 - DNA, 25 bp, Mus musculus
gtgaaatctaccgttgtccaacgct

SEQ ID NO: 695140 - DNA, 25 bp, Mus musculus
gtgaaatctagccagctgcctctga

SEQ ID NO: 695141 - DNA, 25 bp, Mus musculus
gtgaaatctagcgagctgcctctga

SEQ ID NO: 695142 - DNA, 25 bp, Mus musculus
gtgaaatctcacagataatgctctc

SEQ ID NO: 695143 - DNA, 25 bp, Mus musculus
gtgaaatctcactgataatgctctc

SEQ ID NO: 695144 - DNA, 25 bp, Mus musculus
gtgaaatctcatccaatttgcttgc

SEQ ID NO: 695145 - DNA, 25 bp, Mus musculus
gtgaaatctcatgcaatttgcttgc

SEQ ID NO: 695146 - DNA, 25 bp, Mus musculus
gtgaaatctctaaacagctgattca

SEQ ID NO: 695147 - DNA, 25 bp, Mus musculus
gtgaaatctctatacagctgattca

SEQ ID NO: 695148 - DNA, 25 bp, Mus musculus
gtgaaatctggtatcgctgtgctta

SEQ ID NO: 695149 - DNA, 25 bp, Mus musculus
gtgaaatctggtttcgctgtgctta

SEQ ID NO: 695150 - DNA, 25 bp, Mus musculus
gtgaaatctgtgctaccaagtgcct

SEQ ID NO: 695151 - DNA, 25 bp, Mus musculus
gtgaaatctgtggtaccaagtgcct

SEQ ID NO: 695152 - DNA, 25 bp, Mus musculus
gtgaaatgacacacgtctgtgttct

SEQ ID NO: 695153 - DNA, 25 bp, Mus musculus
gtgaaatgacactcgtctgtgttct

SEQ ID NO: 695154 - DNA, 25 bp, Mus musculus
gtgaaatgatccatcaggcctcaga

SEQ ID NO: 695155 - DNA, 25 bp, Mus musculus
gtgaaatgatccattgaccctcaac

SEQ ID NO: 695156 - DNA, 25 bp, Mus musculus
gtgaaatgatccttcaggcctcaga

SEQ ID NO: 695157 - DNA, 25 bp, Mus musculus
gtgaaatgatcctttgaccctcaac

SEQ ID NO: 695158 - DNA, 25 bp, Mus musculus
gtgaaatgcacccagttagtaagag

SEQ ID NO: 695159 - DNA, 25 bp, Mus musculus
gtgaaatgcaccgagttagtaagag

SEQ ID NO: 695160 - DNA, 25 bp, Mus musculus
gtgaaatgcacgcagccagggactt

SEQ ID NO: 695161 - DNA, 25 bp, Mus musculus
gtgaaatgcacggagccagggactt

SEQ ID NO: 695162 - DNA, 25 bp, Mus musculus
gtgaaatgctccagagatcttccga

SEQ ID NO: 695163 - DNA, 25 bp, Mus musculus
gtgaaatgctcctgagatcttccga

SEQ ID NO: 695164 - DNA, 25 bp, Mus musculus
gtgaaatgctgtagccccaaagtga

SEQ ID NO: 695165 - DNA, 25 bp, Mus musculus
gtgaaatgctgttgccccaaagtga

SEQ ID NO: 695166 - DNA, 25 bp, Mus musculus
gtgaaatgggtaagatgctgccaag

SEQ ID NO: 695167 - DNA, 25 bp, Mus musculus
gtgaaatgggtatgatgctgccaag

SEQ ID NO: 695168 - DNA, 25 bp, Mus musculus
gtgaaatgggtgcagcattcctttg

SEQ ID NO: 695169 - DNA, 25 bp, Mus musculus
gtgaaatgggtggagcattcctttg

SEQ ID NO: 695170 - DNA, 25 bp, Mus musculus
gtgaaatggtttagatggagacact

SEQ ID NO: 695171 - DNA, 25 bp, Mus musculus
gtgaaatggttttgatggagacact

SEQ ID NO: 695172 - DNA, 25 bp, Mus musculus
gtgaaatgtccacgttgctacaaga

SEQ ID NO: 695173 - DNA, 25 bp, Mus musculus
gtgaaatgtccaggttgctacaaga

SEQ ID NO: 695174 - DNA, 25 bp, Mus musculus
gtgaaatgtcccaccatgatgttct

SEQ ID NO: 695175 - DNA, 25 bp, Mus musculus
gtgaaatgtccctccatgatgttct

SEQ ID NO: 695176 - DNA, 25 bp, Mus musculus
gtgaaatgtcctaacaagaaacaat

SEQ ID NO: 695177 - DNA, 25 bp, Mus musculus
gtgaaatgtccttacaagaaacaat

SEQ ID NO: 695178 - DNA, 25 bp, Mus musculus
gtgaaatgtgtcacaccaagggata

SEQ ID NO: 695179 - DNA, 25 bp, Mus musculus
gtgaaatgtgtctcaccaagggata

SEQ ID NO: 695180 - DNA, 25 bp, Mus musculus
gtgaaatgttatctcaggtttactc

SEQ ID NO: 695181 - DNA, 25 bp, Mus musculus
gtgaaatgttatgtcaggtttactc

SEQ ID NO: 695182 - DNA, 25 bp, Mus musculus
gtgaaatgtttgcactagcaacaaa

SEQ ID NO: 695183 - DNA, 25 bp, Mus musculus
gtgaaatgtttggactagcaacaaa

SEQ ID NO: 695184 - DNA, 25 bp, Mus musculus
gtgaaattacccacgctgcaaatta

SEQ ID NO: 695185 - DNA, 25 bp, Mus musculus
gtgaaattaccctcgctgcaaatta

SEQ ID NO: 695186 - DNA, 25 bp, Mus musculus
gtgaaattatatctacctgtggcta

SEQ ID NO: 695187 - DNA, 25 bp, Mus musculus
gtgaaattatatgtacctgtggcta

SEQ ID NO: 695188 - DNA, 25 bp, Mus musculus
gtgaaattatcccagcagctgtaat

SEQ ID NO: 695189 - DNA, 25 bp, Mus musculus
gtgaaattatccgagcagctgtaat

SEQ ID NO: 695190 - DNA, 25 bp, Mus musculus
gtgaaattcattactgggttcatgg

SEQ ID NO: 695191 - DNA, 25 bp, Mus musculus
gtgaaattcatttctgggttcatgg

SEQ ID NO: 695192 - DNA, 25 bp, Mus musculus
gtgaaattctacattgagggctctg

SEQ ID NO: 695193 - DNA, 25 bp, Mus musculus
gtgaaattctactttgagggctctg

SEQ ID NO: 695194 - DNA, 25 bp, Mus musculus
gtgaaattctcacccggagactcga

SEQ ID NO: 695195 - DNA, 25 bp, Mus musculus
gtgaaattctcagccggagactcga

SEQ ID NO: 695196 - DNA, 25 bp, Mus musculus
gtgaaattgcctatacttttagaag

SEQ ID NO: 695197 - DNA, 25 bp, Mus musculus
gtgaaattgcctttacttttagaag

SEQ ID NO: 695198 - DNA, 25 bp, Mus musculus
gtgaaatttatgattcccctcgttg

SEQ ID NO: 695199 - DNA, 25 bp, Mus musculus
gtgaaatttatgtttcccctcgttg

SEQ ID NO: 695200 - DNA, 25 bp, Mus musculus
gtgaaatttcaccacgctgaggcaa

SEQ ID NO: 695201 - DNA, 25 bp, Mus musculus
gtgaaatttcacgacgctgaggcaa

SEQ ID NO: 695202 - DNA, 25 bp, Mus musculus
gtgaaatttctgagctcactatagc

SEQ ID NO: 695203 - DNA, 25 bp, Mus musculus
gtgaaatttctgtgctcactatagc

SEQ ID NO: 695204 - DNA, 25 bp, Mus musculus
gtgaaatttgcccaattccaggaaa

SEQ ID NO: 695205 - DNA, 25 bp, Mus musculus
gtgaaatttgccgaattccaggaaa

SEQ ID NO: 695206 - DNA, 25 bp, Mus musculus
gtgaaatttgttccatctgtccctg

SEQ ID NO: 695207 - DNA, 25 bp, Mus musculus
gtgaaatttgttgcatctgtccctg

SEQ ID NO: 695208 - DNA, 25 bp, Mus musculus
gtgaaattttgtatctgccagcaac

SEQ ID NO: 695209 - DNA, 25 bp, Mus musculus
gtgaaattttgtttctgccagcaac

SEQ ID NO: 695210 - DNA, 25 bp, Mus musculus
gtgaaatttttcagtggtgtttatt

SEQ ID NO: 695211 - DNA, 25 bp, Mus musculus
gtgaaatttttctgtggtgtttatt

SEQ ID NO: 695212 - DNA, 25 bp, Mus musculus
gtgaacaaatacatagtgcttccaa

SEQ ID NO: 695213 - DNA, 25 bp, Mus musculus
gtgaacaaatacttagtgcttccaa

SEQ ID NO: 695214 - DNA, 25 bp, Mus musculus
gtgaacaaatagaccctgaaaatct

SEQ ID NO: 695215 - DNA, 25 bp, Mus musculus
gtgaacaaatagtccctgaaaatct

SEQ ID NO: 695216 - DNA, 25 bp, Mus musculus
gtgaacaacagactcctagactaaa

SEQ ID NO: 695217 - DNA, 25 bp, Mus musculus
gtgaacaacagagtcctagactaaa

SEQ ID NO: 695218 - DNA, 25 bp, Mus musculus
gtgaacaacatacctttttctccat

SEQ ID NO: 695219 - DNA, 25 bp, Mus musculus
gtgaacaacatagctttttctccat

SEQ ID NO: 695220 - DNA, 25 bp, Mus musculus
gtgaacaacatcattttacccatgg

SEQ ID NO: 695221 - DNA, 25 bp, Mus musculus
gtgaacaacatctttttacccatgg

SEQ ID NO: 695222 - DNA, 25 bp, Mus musculus
gtgaacaactcacccagggcttgaa

SEQ ID NO: 695223 - DNA, 25 bp, Mus musculus
gtgaacaactcagccagggcttgaa

SEQ ID NO: 695224 - DNA, 25 bp, Mus musculus
gtgaacaagaccatcgcctatggct

SEQ ID NO: 695225 - DNA, 25 bp, Mus musculus
gtgaacaagaccttcgcctatggct

SEQ ID NO: 695226 - DNA, 25 bp, Mus musculus
gtgaacaaggcacaccacaatgtcc

SEQ ID NO: 695227 - DNA, 25 bp, Mus musculus
gtgaacaaggcaccagtggctgtct

SEQ ID NO: 695228 - DNA, 25 bp, Mus musculus
gtgaacaaggcagaccacaatgtcc

SEQ ID NO: 695229 - DNA, 25 bp, Mus musculus
gtgaacaaggcagcagtggctgtct

SEQ ID NO: 695230 - DNA, 25 bp, Mus musculus
gtgaacaagttcaacgtcctctacg

SEQ ID NO: 695231 - DNA, 25 bp, Mus musculus
gtgaacaagttctacgtcctctacg

SEQ ID NO: 695232 - DNA, 25 bp, Mus musculus
gtgaacaagttgactccatcttcat

SEQ ID NO: 695233 - DNA, 25 bp, Mus musculus
gtgaacaagttgtctccatcttcat

SEQ ID NO: 695234 - DNA, 25 bp, Mus musculus
gtgaacaattaacttgccccttcct

SEQ ID NO: 695235 - DNA, 25 bp, Mus musculus
gtgaacaattaagttgccccttcct

SEQ ID NO: 695236 - DNA, 25 bp, Mus musculus
gtgaacacacctaattaccatgctg

SEQ ID NO: 695237 - DNA, 25 bp, Mus musculus
gtgaacacaccttattaccatgctg

SEQ ID NO: 695238 - DNA, 25 bp, Mus musculus
gtgaacacactactgtaatcttcca

SEQ ID NO: 695239 - DNA, 25 bp, Mus musculus
gtgaacacactagtgtaatcttcca

SEQ ID NO: 695240 - DNA, 25 bp, Mus musculus
gtgaacacactgaatggcaaggatg

SEQ ID NO: 695241 - DNA, 25 bp, Mus musculus
gtgaacacactgtatggcaaggatg

SEQ ID NO: 695242 - DNA, 25 bp, Mus musculus
gtgaacacagaacagctcgcttttc

SEQ ID NO: 695243 - DNA, 25 bp, Mus musculus
gtgaacacagaagagctcgcttttc

SEQ ID NO: 695244 - DNA, 25 bp, Mus musculus
gtgaacacagatcgcgtcaaatcag

SEQ ID NO: 695245 - DNA, 25 bp, Mus musculus
gtgaacacagatggcgtcaaatcag

SEQ ID NO: 695246 - DNA, 25 bp, Mus musculus
gtgaacacatacactgtttcatttt

SEQ ID NO: 695247 - DNA, 25 bp, Mus musculus
gtgaacacatactctgtttcatttt

SEQ ID NO: 695248 - DNA, 25 bp, Mus musculus
gtgaacacattcaacattccaaagg

SEQ ID NO: 695249 - DNA, 25 bp, Mus musculus
gtgaacacattctacattccaaagg

SEQ ID NO: 695250 - DNA, 25 bp, Mus musculus
gtgaacacatttattgttaccagtg

SEQ ID NO: 695251 - DNA, 25 bp, Mus musculus
gtgaacacatttccttagctttgtt

SEQ ID NO: 695252 - DNA, 25 bp, Mus musculus
gtgaacacatttgcttagctttgtt

SEQ ID NO: 695253 - DNA, 25 bp, Mus musculus
gtgaacacattttttgttaccagtg

SEQ ID NO: 695254 - DNA, 25 bp, Mus musculus
gtgaacaccacccatcacagtgtga

SEQ ID NO: 695255 - DNA, 25 bp, Mus musculus
gtgaacaccaccgatcacagtgtga

SEQ ID NO: 695256 - DNA, 25 bp, Mus musculus
gtgaacaccactcaggatgtgacaa

SEQ ID NO: 695257 - DNA, 25 bp, Mus musculus
gtgaacaccactgaggatgtgacaa

SEQ ID NO: 695258 - DNA, 25 bp, Mus musculus
gtgaacaccatcaacgacaatgcgg

SEQ ID NO: 695259 - DNA, 25 bp, Mus musculus
gtgaacaccatctacgacaatgcgg

SEQ ID NO: 695260 - DNA, 25 bp, Mus musculus
gtgaacaccgaactgtttctgagct

SEQ ID NO: 695261 - DNA, 25 bp, Mus musculus
gtgaacaccgaagtgtttctgagct

SEQ ID NO: 695262 - DNA, 25 bp, Mus musculus
gtgaacacctgcattacgattattg

SEQ ID NO: 695263 - DNA, 25 bp, Mus musculus
gtgaacacctgctttacgattattg

SEQ ID NO: 695264 - DNA, 25 bp, Mus musculus
gtgaacaccttcctgcatgagccct

SEQ ID NO: 695265 - DNA, 25 bp, Mus musculus
gtgaacaccttcgtgcatgagccct

SEQ ID NO: 695266 - DNA, 25 bp, Mus musculus
gtgaacacctttagccagagctgta

SEQ ID NO: 695267 - DNA, 25 bp, Mus musculus
gtgaacaccttttgccagagctgta

SEQ ID NO: 695268 - DNA, 25 bp, Mus musculus
gtgaacacgcacatgagacctacag

SEQ ID NO: 695269 - DNA, 25 bp, Mus musculus
gtgaacacgcacttgagacctacag

SEQ ID NO: 695270 - DNA, 25 bp, Mus musculus
gtgaacacgcagaggcttgacagct

SEQ ID NO: 695271 - DNA, 25 bp, Mus musculus
gtgaacacgcagtggcttgacagct

SEQ ID NO: 695272 - DNA, 25 bp, Mus musculus
gtgaacacgcgcaggaggccatccc

SEQ ID NO: 695273 - DNA, 25 bp, Mus musculus
gtgaacacgcgctggaggccatccc

SEQ ID NO: 695274 - DNA, 25 bp, Mus musculus
gtgaacactaacaggacagcaaggg

SEQ ID NO: 695275 - DNA, 25 bp, Mus musculus
gtgaacactaactggacagcaaggg

SEQ ID NO: 695276 - DNA, 25 bp, Mus musculus
gtgaacactactagctggccaggtt

SEQ ID NO: 695277 - DNA, 25 bp, Mus musculus
gtgaacactacttgctggccaggtt

SEQ ID NO: 695278 - DNA, 25 bp, Mus musculus
gtgaacactgaacgaatttgcctgc

SEQ ID NO: 695279 - DNA, 25 bp, Mus musculus
gtgaacactgaaggaatttgcctgc

SEQ ID NO: 695280 - DNA, 25 bp, Mus musculus
gtgaacactgccagtgaatcatcct

SEQ ID NO: 695281 - DNA, 25 bp, Mus musculus
gtgaacactgcctgtgaatcatcct

SEQ ID NO: 695282 - DNA, 25 bp, Mus musculus
gtgaacactggaatgttttagctct

SEQ ID NO: 695283 - DNA, 25 bp, Mus musculus
gtgaacactggattgttttagctct

SEQ ID NO: 695284 - DNA, 25 bp, Mus musculus
gtgaacacttagcatctttcgcatc

SEQ ID NO: 695285 - DNA, 25 bp, Mus musculus
gtgaacacttaggatctttcgcatc

SEQ ID NO: 695286 - DNA, 25 bp, Mus musculus
gtgaacacttataacctgtgcccac

SEQ ID NO: 695287 - DNA, 25 bp, Mus musculus
gtgaacacttattacctgtgcccac

SEQ ID NO: 695288 - DNA, 25 bp, Mus musculus
gtgaacacttcactggaacacgccc

SEQ ID NO: 695289 - DNA, 25 bp, Mus musculus
gtgaacacttcagtggaacacgccc

SEQ ID NO: 695290 - DNA, 25 bp, Mus musculus
gtgaacacttgaagacttgcctgtc

SEQ ID NO: 695291 - DNA, 25 bp, Mus musculus
gtgaacacttgatgacttgcctgtc

SEQ ID NO: 695292 - DNA, 25 bp, Mus musculus
gtgaacactttacaacctggcctga

SEQ ID NO: 695293 - DNA, 25 bp, Mus musculus
gtgaacactttagaacctggcctga

SEQ ID NO: 695294 - DNA, 25 bp, Mus musculus
gtgaacactttgcagtccactttaa

SEQ ID NO: 695295 - DNA, 25 bp, Mus musculus
gtgaacactttggagtccactttaa

SEQ ID NO: 695296 - DNA, 25 bp, Mus musculus
gtgaacagaaaaacccactgctctc

SEQ ID NO: 695297 - DNA, 25 bp, Mus musculus
gtgaacagaaaatcccactgctctc

SEQ ID NO: 695298 - DNA, 25 bp, Mus musculus
gtgaacagacacatctggccagaaa

SEQ ID NO: 695299 - DNA, 25 bp, Mus musculus
gtgaacagacacctttgccaaacag

SEQ ID NO: 695300 - DNA, 25 bp, Mus musculus
gtgaacagacacgtttgccaaacag

SEQ ID NO: 695301 - DNA, 25 bp, Mus musculus
gtgaacagacacttctggccagaaa

SEQ ID NO: 695302 - DNA, 25 bp, Mus musculus
gtgaacagaccccataaccaaagaa

SEQ ID NO: 695303 - DNA, 25 bp, Mus musculus
gtgaacagacccgataaccaaagaa

SEQ ID NO: 695304 - DNA, 25 bp, Mus musculus
gtgaacagagatcagcaaccccaga

SEQ ID NO: 695305 - DNA, 25 bp, Mus musculus
gtgaacagagatgagcaaccccaga

SEQ ID NO: 695306 - DNA, 25 bp, Mus musculus
gtgaacagagccatgtgcattaaaa

SEQ ID NO: 695307 - DNA, 25 bp, Mus musculus
gtgaacagagccttgtgcattaaaa

SEQ ID NO: 695308 - DNA, 25 bp, Mus musculus
gtgaacagatgaaacagtggcctac

SEQ ID NO: 695309 - DNA, 25 bp, Mus musculus
gtgaacagatgatacagtggcctac

SEQ ID NO: 695310 - DNA, 25 bp, Mus musculus
gtgaacagcaagataggaatgcttc

SEQ ID NO: 695311 - DNA, 25 bp, Mus musculus
gtgaacagcaagttaggaatgcttc

SEQ ID NO: 695312 - DNA, 25 bp, Mus musculus
gtgaacagcactaggccgggtgaca

SEQ ID NO: 695313 - DNA, 25 bp, Mus musculus
gtgaacagcacttggccgggtgaca

SEQ ID NO: 695314 - DNA, 25 bp, Mus musculus
gtgaacagcatgcaccacgcgttcc

SEQ ID NO: 695315 - DNA, 25 bp, Mus musculus
gtgaacagcatggaccacgcgttcc

SEQ ID NO: 695316 - DNA, 25 bp, Mus musculus
gtgaacagcgccacctctaggcatg

SEQ ID NO: 695317 - DNA, 25 bp, Mus musculus
gtgaacagcgcctcctctaggcatg

SEQ ID NO: 695318 - DNA, 25 bp, Mus musculus
gtgaacagctctaacacttttccaa

SEQ ID NO: 695319 - DNA, 25 bp, Mus musculus
gtgaacagctcttacacttttccaa

SEQ ID NO: 695320 - DNA, 25 bp, Mus musculus
gtgaacagctgacaggccccaggat

SEQ ID NO: 695321 - DNA, 25 bp, Mus musculus
gtgaacagctgagaggccccaggat

SEQ ID NO: 695322 - DNA, 25 bp, Mus musculus
gtgaacagcttcctacaaacagagt

SEQ ID NO: 695323 - DNA, 25 bp, Mus musculus
gtgaacagcttcgtacaaacagagt

SEQ ID NO: 695324 - DNA, 25 bp, Mus musculus
gtgaacaggactaccgagcacacac

SEQ ID NO: 695325 - DNA, 25 bp, Mus musculus
gtgaacaggacttccgagcacacac

SEQ ID NO: 695326 - DNA, 25 bp, Mus musculus
gtgaacaggctaatttgtacatcaa

SEQ ID NO: 695327 - DNA, 25 bp, Mus musculus
gtgaacaggctattttgtacatcaa

SEQ ID NO: 695328 - DNA, 25 bp, Mus musculus
gtgaacagggtgagcaagtcgtcct

SEQ ID NO: 695329 - DNA, 25 bp, Mus musculus
gtgaacagggtgtgcaagtcgtcct

SEQ ID NO: 695330 - DNA, 25 bp, Mus musculus
gtgaacagtgtgacctcactctaga

SEQ ID NO: 695331 - DNA, 25 bp, Mus musculus
gtgaacagtgtgtcctcactctaga

SEQ ID NO: 695332 - DNA, 25 bp, Mus musculus
gtgaacagtgttaactcatgaagag

SEQ ID NO: 695333 - DNA, 25 bp, Mus musculus
gtgaacagtgttaccttgttaagat

SEQ ID NO: 695334 - DNA, 25 bp, Mus musculus
gtgaacagtgtttactcatgaagag

SEQ ID NO: 695335 - DNA, 25 bp, Mus musculus
gtgaacagtgtttccttgttaagat

SEQ ID NO: 695336 - DNA, 25 bp, Mus musculus
gtgaacataaatcagttttcctgcc

SEQ ID NO: 695337 - DNA, 25 bp, Mus musculus
gtgaacataaatgagttttcctgcc

SEQ ID NO: 695338 - DNA, 25 bp, Mus musculus
gtgaacatacacaagctaccaaatg

SEQ ID NO: 695339 - DNA, 25 bp, Mus musculus
gtgaacatacactagctaccaaatg

SEQ ID NO: 695340 - DNA, 25 bp, Mus musculus
gtgaacataggcaccaatggctctt

SEQ ID NO: 695341 - DNA, 25 bp, Mus musculus
gtgaacataggctccaatggctctt

SEQ ID NO: 695342 - DNA, 25 bp, Mus musculus
gtgaacatcatcaccgtgtacaagc

SEQ ID NO: 695343 - DNA, 25 bp, Mus musculus
gtgaacatcatctccgtgtacaagc

SEQ ID NO: 695344 - DNA, 25 bp, Mus musculus
gtgaacatccccagtagtgtactga

SEQ ID NO: 695345 - DNA, 25 bp, Mus musculus
gtgaacatcccctgtagtgtactga

SEQ ID NO: 695346 - DNA, 25 bp, Mus musculus
gtgaacatcttcatcagtgacgtgt

SEQ ID NO: 695347 - DNA, 25 bp, Mus musculus
gtgaacatcttcttcagtgacgtgt

SEQ ID NO: 695348 - DNA, 25 bp, Mus musculus
gtgaacatggatacagaacttctgc

SEQ ID NO: 695349 - DNA, 25 bp, Mus musculus
gtgaacatggattcagaacttctgc

SEQ ID NO: 695350 - DNA, 25 bp, Mus musculus
gtgaacatggccaagcattcatccc

SEQ ID NO: 695351 - DNA, 25 bp, Mus musculus
gtgaacatggcctagcattcatccc

SEQ ID NO: 695352 - DNA, 25 bp, Mus musculus
gtgaacatggctatcctcattaaga

SEQ ID NO: 695353 - DNA, 25 bp, Mus musculus
gtgaacatggctttcctcattaaga

SEQ ID NO: 695354 - DNA, 25 bp, Mus musculus
gtgaacatgtgcaattgacactagc

SEQ ID NO: 695355 - DNA, 25 bp, Mus musculus
gtgaacatgtgctattgacactagc

SEQ ID NO: 695356 - DNA, 25 bp, Mus musculus
gtgaacattaacactaccctgaagt

SEQ ID NO: 695357 - DNA, 25 bp, Mus musculus
gtgaacattaactctaccctgaagt

SEQ ID NO: 695358 - DNA, 25 bp, Mus musculus
gtgaacattcacaggatttctaact

SEQ ID NO: 695359 - DNA, 25 bp, Mus musculus
gtgaacattcactggatttctaact

SEQ ID NO: 695360 - DNA, 25 bp, Mus musculus
gtgaacattccaactgtttttctga

SEQ ID NO: 695361 - DNA, 25 bp, Mus musculus
gtgaacattccatctgtttttctga

SEQ ID NO: 695362 - DNA, 25 bp, Mus musculus
gtgaacattcccaccattgatggcc

SEQ ID NO: 695363 - DNA, 25 bp, Mus musculus
gtgaacattcccattgatgctgtgg

SEQ ID NO: 695364 - DNA, 25 bp, Mus musculus
gtgaacattccctccattgatggcc

SEQ ID NO: 695365 - DNA, 25 bp, Mus musculus
gtgaacattccctttgatgctgtgg

SEQ ID NO: 695366 - DNA, 25 bp, Mus musculus
gtgaacattcggctgctctatgttc

SEQ ID NO: 695367 - DNA, 25 bp, Mus musculus
gtgaacattcgggtgctctatgttc

SEQ ID NO: 695368 - DNA, 25 bp, Mus musculus
gtgaacattggccatggaaatccat

SEQ ID NO: 695369 - DNA, 25 bp, Mus musculus
gtgaacattggcgatggaaatccat

SEQ ID NO: 695370 - DNA, 25 bp, Mus musculus
gtgaacattttacacacccttttct

SEQ ID NO: 695371 - DNA, 25 bp, Mus musculus
gtgaacattttagacacccttttct

SEQ ID NO: 695372 - DNA, 25 bp, Mus musculus
gtgaaccaagctccttacaaggtga

SEQ ID NO: 695373 - DNA, 25 bp, Mus musculus
gtgaaccaagctgcttacaaggtga

SEQ ID NO: 695374 - DNA, 25 bp, Mus musculus
gtgaaccacaccaaaataccgagga

SEQ ID NO: 695375 - DNA, 25 bp, Mus musculus
gtgaaccacacctaaataccgagga

SEQ ID NO: 695376 - DNA, 25 bp, Mus musculus
gtgaaccacataaaaaactcttctt

SEQ ID NO: 695377 - DNA, 25 bp, Mus musculus
gtgaaccacatataaaactcttctt

SEQ ID NO: 695378 - DNA, 25 bp, Mus musculus
gtgaaccaccatagagggcgtttaa

SEQ ID NO: 695379 - DNA, 25 bp, Mus musculus
gtgaaccaccattgagggcgtttaa

SEQ ID NO: 695380 - DNA, 25 bp, Mus musculus
gtgaaccacctgagtcttgtacagg

SEQ ID NO: 695381 - DNA, 25 bp, Mus musculus
gtgaaccacctgagttttagaagtt

SEQ ID NO: 695382 - DNA, 25 bp, Mus musculus
gtgaaccacctgtgtcttgtacagg

SEQ ID NO: 695383 - DNA, 25 bp, Mus musculus
gtgaaccacctgtgttttagaagtt

SEQ ID NO: 695384 - DNA, 25 bp, Mus musculus
gtgaaccacgccaggagagccaacc

SEQ ID NO: 695385 - DNA, 25 bp, Mus musculus
gtgaaccacgcctggagagccaacc

SEQ ID NO: 695386 - DNA, 25 bp, Mus musculus
gtgaaccacgggatcgagaccgtgt

SEQ ID NO: 695387 - DNA, 25 bp, Mus musculus
gtgaaccacgggttcgagaccgtgt

SEQ ID NO: 695388 - DNA, 25 bp, Mus musculus
gtgaaccacttacacactatcaagt

SEQ ID NO: 695389 - DNA, 25 bp, Mus musculus
gtgaaccacttagacactatcaagt

SEQ ID NO: 695390 - DNA, 25 bp, Mus musculus
gtgaaccagacacttgtttcatatg

SEQ ID NO: 695391 - DNA, 25 bp, Mus musculus
gtgaaccagacagttgtttcatatg

SEQ ID NO: 695392 - DNA, 25 bp, Mus musculus
gtgaaccagatactgagtaatatac

SEQ ID NO: 695393 - DNA, 25 bp, Mus musculus
gtgaaccagatagtgagtaatatac

SEQ ID NO: 695394 - DNA, 25 bp, Mus musculus
gtgaaccagcatcagcataccatcg

SEQ ID NO: 695395 - DNA, 25 bp, Mus musculus
gtgaaccagcatgagcataccatcg

SEQ ID NO: 695396 - DNA, 25 bp, Mus musculus
gtgaaccagcggcatgctctgatcc

SEQ ID NO: 695397 - DNA, 25 bp, Mus musculus
gtgaaccagcgggatgctctgatcc

SEQ ID NO: 695398 - DNA, 25 bp, Mus musculus
gtgaaccaggagatctacaacttaa

SEQ ID NO: 695399 - DNA, 25 bp, Mus musculus
gtgaaccaggagttctacaacttaa

SEQ ID NO: 695400 - DNA, 25 bp, Mus musculus
gtgaaccagtacagtgtcctttaaa

SEQ ID NO: 695401 - DNA, 25 bp, Mus musculus
gtgaaccagtactgtgtcctttaaa

SEQ ID NO: 695402 - DNA, 25 bp, Mus musculus
gtgaaccagtttcgagttgccagtt

SEQ ID NO: 695403 - DNA, 25 bp, Mus musculus
gtgaaccagtttggagttgccagtt

SEQ ID NO: 695404 - DNA, 25 bp, Mus musculus
gtgaaccataaccaaattcagatgt

SEQ ID NO: 695405 - DNA, 25 bp, Mus musculus
gtgaaccataacgaaattcagatgt

SEQ ID NO: 695406 - DNA, 25 bp, Mus musculus
gtgaaccatacaaataaccaatagg

SEQ ID NO: 695407 - DNA, 25 bp, Mus musculus
gtgaaccatacatataaccaatagg

SEQ ID NO: 695408 - DNA, 25 bp, Mus musculus
gtgaaccattcaccctcaggtgttt

SEQ ID NO: 695409 - DNA, 25 bp, Mus musculus
gtgaaccattcagcctcaggtgttt

SEQ ID NO: 695410 - DNA, 25 bp, Mus musculus
gtgaacccaaagctcccataattaa

SEQ ID NO: 695411 - DNA, 25 bp, Mus musculus
gtgaacccaaaggtcccataattaa

SEQ ID NO: 695412 - DNA, 25 bp, Mus musculus
gtgaacccaactatggtgcgacata

SEQ ID NO: 695413 - DNA, 25 bp, Mus musculus
gtgaacccaactttggtgcgacata

SEQ ID NO: 695414 - DNA, 25 bp, Mus musculus
gtgaacccacaaacaagtgccaagg

SEQ ID NO: 695415 - DNA, 25 bp, Mus musculus
gtgaacccacaatcaagtgccaagg

SEQ ID NO: 695416 - DNA, 25 bp, Mus musculus
gtgaacccaccactgaggattactg

SEQ ID NO: 695417 - DNA, 25 bp, Mus musculus
gtgaacccaccagtgaggattactg

SEQ ID NO: 695418 - DNA, 25 bp, Mus musculus
gtgaaccccacaaacgatgttgcag

SEQ ID NO: 695419 - DNA, 25 bp, Mus musculus
gtgaaccccacatacgatgttgcag

SEQ ID NO: 695420 - DNA, 25 bp, Mus musculus
gtgaaccccgctctgatgtgaaaat

SEQ ID NO: 695421 - DNA, 25 bp, Mus musculus
gtgaaccccgctgtgatgtgaaaat

SEQ ID NO: 695422 - DNA, 25 bp, Mus musculus
gtgaaccctatcatccagagccaca

SEQ ID NO: 695423 - DNA, 25 bp, Mus musculus
gtgaaccctatcttccagagccaca

SEQ ID NO: 695424 - DNA, 25 bp, Mus musculus
gtgaaccctcagcaaaactaatttt

SEQ ID NO: 695425 - DNA, 25 bp, Mus musculus
gtgaaccctcaggaaaactaatttt

SEQ ID NO: 695426 - DNA, 25 bp, Mus musculus
gtgaaccctgaaccgaacacagcct

SEQ ID NO: 695427 - DNA, 25 bp, Mus musculus
gtgaaccctgaagcgaacacagcct

SEQ ID NO: 695428 - DNA, 25 bp, Mus musculus
gtgaaccctggcaaccctgtgtttt

SEQ ID NO: 695429 - DNA, 25 bp, Mus musculus
gtgaaccctggctaccctgtgtttt

SEQ ID NO: 695430 - DNA, 25 bp, Mus musculus
gtgaacccttccaggtatgaggcaa

SEQ ID NO: 695431 - DNA, 25 bp, Mus musculus
gtgaacccttcctggtatgaggcaa

SEQ ID NO: 695432 - DNA, 25 bp, Mus musculus
gtgaacccttgaaaaaatctttctt

SEQ ID NO: 695433 - DNA, 25 bp, Mus musculus
gtgaacccttgataaaatctttctt

SEQ ID NO: 695434 - DNA, 25 bp, Mus musculus
gtgaaccgagaaatcagcaccagcc

SEQ ID NO: 695435 - DNA, 25 bp, Mus musculus
gtgaaccgagaattcagcaccagcc

SEQ ID NO: 695436 - DNA, 25 bp, Mus musculus
gtgaaccgcaccaataaacatctcc

SEQ ID NO: 695437 - DNA, 25 bp, Mus musculus
gtgaaccgcacctataaacatctcc

SEQ ID NO: 695438 - DNA, 25 bp, Mus musculus
gtgaaccgcctgaacaatgctggga

SEQ ID NO: 695439 - DNA, 25 bp, Mus musculus
gtgaaccgcctgtacaatgctggga

SEQ ID NO: 695440 - DNA, 25 bp, Mus musculus
gtgaaccggctcagtgggacagcat

SEQ ID NO: 695441 - DNA, 25 bp, Mus musculus
gtgaaccggctctgtgggacagcat

SEQ ID NO: 695442 - DNA, 25 bp, Mus musculus
gtgaaccgtgaacacacgtgagttt

SEQ ID NO: 695443 - DNA, 25 bp, Mus musculus
gtgaaccgtgaagacacgtgagttt

SEQ ID NO: 695444 - DNA, 25 bp, Mus musculus
gtgaaccgtgagaggcctcatcatt

SEQ ID NO: 695445 - DNA, 25 bp, Mus musculus
gtgaaccgtgagtggcctcatcatt

SEQ ID NO: 695446 - DNA, 25 bp, Mus musculus
gtgaacctaaagacctgagcttgat

SEQ ID NO: 695447 - DNA, 25 bp, Mus musculus
gtgaacctaaagtcctgagcttgat

SEQ ID NO: 695448 - DNA, 25 bp, Mus musculus
gtgaacctaatcaccttcctgaggt

SEQ ID NO: 695449 - DNA, 25 bp, Mus musculus
gtgaacctaatctccttcctgaggt

SEQ ID NO: 695450 - DNA, 25 bp, Mus musculus
gtgaacctacctcaatgtgtcacat

SEQ ID NO: 695451 - DNA, 25 bp, Mus musculus
gtgaacctacctgaatgtgtcacat

SEQ ID NO: 695452 - DNA, 25 bp, Mus musculus
gtgaacctatgaacggactagctcc

SEQ ID NO: 695453 - DNA, 25 bp, Mus musculus
gtgaacctatgatcggactagctcc

SEQ ID NO: 695454 - DNA, 25 bp, Mus musculus
gtgaacctcaaaatcttctccttga

SEQ ID NO: 695455 - DNA, 25 bp, Mus musculus
gtgaacctcaaattcttctccttga

SEQ ID NO: 695456 - DNA, 25 bp, Mus musculus
gtgaacctccacatttgctcgtaat

SEQ ID NO: 695457 - DNA, 25 bp, Mus musculus
gtgaacctccacttttgctcgtaat

SEQ ID NO: 695458 - DNA, 25 bp, Mus musculus
gtgaacctcctgataggcaaaggca

SEQ ID NO: 695459 - DNA, 25 bp, Mus musculus
gtgaacctcctgttaggcaaaggca

SEQ ID NO: 695460 - DNA, 25 bp, Mus musculus
gtgaacctgcagaactgtagtgcca

SEQ ID NO: 695461 - DNA, 25 bp, Mus musculus
gtgaacctgcagtactgtagtgcca

SEQ ID NO: 695462 - DNA, 25 bp, Mus musculus
gtgaacctgcggcaactatacctca

SEQ ID NO: 695463 - DNA, 25 bp, Mus musculus
gtgaacctgcgggaactatacctca

SEQ ID NO: 695464 - DNA, 25 bp, Mus musculus
gtgaacctggaaacgactgccttgt

SEQ ID NO: 695465 - DNA, 25 bp, Mus musculus
gtgaacctggaatcgactgccttgt

SEQ ID NO: 695466 - DNA, 25 bp, Mus musculus
gtgaacctggacaccttgcaagctc

SEQ ID NO: 695467 - DNA, 25 bp, Mus musculus
gtgaacctggactccttgcaagctc

SEQ ID NO: 695468 - DNA, 25 bp, Mus musculus
gtgaacctgtcacttttcagattca

SEQ ID NO: 695469 - DNA, 25 bp, Mus musculus
gtgaacctgtcagttttcagattca

SEQ ID NO: 695470 - DNA, 25 bp, Mus musculus
gtgaacctgtgaagggaaccccgca

SEQ ID NO: 695471 - DNA, 25 bp, Mus musculus
gtgaacctgtgatgggaaccccgca

SEQ ID NO: 695472 - DNA, 25 bp, Mus musculus
gtgaacctgttgaaactcaacccaa

SEQ ID NO: 695473 - DNA, 25 bp, Mus musculus
gtgaacctgttgtaactcaacccaa

SEQ ID NO: 695474 - DNA, 25 bp, Mus musculus
gtgaaccttgatctacttgctacca

SEQ ID NO: 695475 - DNA, 25 bp, Mus musculus
gtgaaccttgatgtacttgctacca

SEQ ID NO: 695476 - DNA, 25 bp, Mus musculus
gtgaacctttgaatgtgactgccaa

SEQ ID NO: 695477 - DNA, 25 bp, Mus musculus
gtgaacctttgactcatctcatatc

SEQ ID NO: 695478 - DNA, 25 bp, Mus musculus
gtgaacctttgagtcatctcatatc

SEQ ID NO: 695479 - DNA, 25 bp, Mus musculus
gtgaacctttgattgtgactgccaa

SEQ ID NO: 695480 - DNA, 25 bp, Mus musculus
gtgaacgaacacaaacaggctgatg

SEQ ID NO: 695481 - DNA, 25 bp, Mus musculus
gtgaacgaacactaacaggctgatg

SEQ ID NO: 695482 - DNA, 25 bp, Mus musculus
gtgaacgacttacacatctctgctc

SEQ ID NO: 695483 - DNA, 25 bp, Mus musculus
gtgaacgacttagacatctctgctc

SEQ ID NO: 695484 - DNA, 25 bp, Mus musculus
gtgaacgagcccactgacggagctg

SEQ ID NO: 695485 - DNA, 25 bp, Mus musculus
gtgaacgagccctctgacggagctg

SEQ ID NO: 695486 - DNA, 25 bp, Mus musculus
gtgaacgatcccactacagacgata

SEQ ID NO: 695487 - DNA, 25 bp, Mus musculus
gtgaacgatccctctacagacgata

SEQ ID NO: 695488 - DNA, 25 bp, Mus musculus
gtgaacgcaacacacaggcctatgt

SEQ ID NO: 695489 - DNA, 25 bp, Mus musculus
gtgaacgcaacagacaggcctatgt

SEQ ID NO: 695490 - DNA, 25 bp, Mus musculus
gtgaacgcaacgaactgactcagac

SEQ ID NO: 695491 - DNA, 25 bp, Mus musculus
gtgaacgcaacgtactgactcagac

SEQ ID NO: 695492 - DNA, 25 bp, Mus musculus
gtgaacgcattcatgtttatcttat

SEQ ID NO: 695493 - DNA, 25 bp, Mus musculus
gtgaacgcattcttgtttatcttat

SEQ ID NO: 695494 - DNA, 25 bp, Mus musculus
gtgaacgccagcaacagttgtacat

SEQ ID NO: 695495 - DNA, 25 bp, Mus musculus
gtgaacgccagctacagttgtacat

SEQ ID NO: 695496 - DNA, 25 bp, Mus musculus
gtgaacgcctggcaagccaaggcaa

SEQ ID NO: 695497 - DNA, 25 bp, Mus musculus
gtgaacgcctgggaagccaaggcaa

SEQ ID NO: 695498 - DNA, 25 bp, Mus musculus
gtgaacgccttcagtcatgctatgg

SEQ ID NO: 695499 - DNA, 25 bp, Mus musculus
gtgaacgccttctgtcatgctatgg

SEQ ID NO: 695500 - DNA, 25 bp, Mus musculus
gtgaacgcgacactctgaccatagt

SEQ ID NO: 695501 - DNA, 25 bp, Mus musculus
gtgaacgcgacagtctgaccatagt

SEQ ID NO: 695502 - DNA, 25 bp, Mus musculus
gtgaacgctacgctctacttttgta

SEQ ID NO: 695503 - DNA, 25 bp, Mus musculus
gtgaacgctacggtctacttttgta

SEQ ID NO: 695504 - DNA, 25 bp, Mus musculus
gtgaacgctgcactggtgtgaacct

SEQ ID NO: 695505 - DNA, 25 bp, Mus musculus
gtgaacgctgcagtggtgtgaacct

SEQ ID NO: 695506 - DNA, 25 bp, Mus musculus
gtgaacgctgggacagattttcttg

SEQ ID NO: 695507 - DNA, 25 bp, Mus musculus
gtgaacgctgggtcagattttcttg

SEQ ID NO: 695508 - DNA, 25 bp, Mus musculus
gtgaacggaaagaaccaacgctata

SEQ ID NO: 695509 - DNA, 25 bp, Mus musculus
gtgaacggaaagtaccaacgctata

SEQ ID NO: 695510 - DNA, 25 bp, Mus musculus
gtgaacggagagctcttctgctgaa

SEQ ID NO: 695511 - DNA, 25 bp, Mus musculus
gtgaacggagaggtcttctgctgaa

SEQ ID NO: 695512 - DNA, 25 bp, Mus musculus
gtgaacggatctcttctcactgtga

SEQ ID NO: 695513 - DNA, 25 bp, Mus musculus
gtgaacggatctgttctcactgtga

SEQ ID NO: 695514 - DNA, 25 bp, Mus musculus
gtgaacggcaggacaaatctagatt

SEQ ID NO: 695515 - DNA, 25 bp, Mus musculus
gtgaacggcaggtcaaatctagatt

SEQ ID NO: 695516 - DNA, 25 bp, Mus musculus
gtgaacgtagctcagctctgactga

SEQ ID NO: 695517 - DNA, 25 bp, Mus musculus
gtgaacgtagctgagctctgactga

SEQ ID NO: 695518 - DNA, 25 bp, Mus musculus
gtgaacgtgaggactcctatggcga

SEQ ID NO: 695519 - DNA, 25 bp, Mus musculus
gtgaacgtgaggtctcctatggcga

SEQ ID NO: 695520 - DNA, 25 bp, Mus musculus
gtgaacgtgctgaccaagcaacttt

SEQ ID NO: 695521 - DNA, 25 bp, Mus musculus
gtgaacgtgctgtccaagcaacttt

SEQ ID NO: 695522 - DNA, 25 bp, Mus musculus
gtgaacgttcacctgcaattccagt

SEQ ID NO: 695523 - DNA, 25 bp, Mus musculus
gtgaacgttcacgtgcaattccagt

SEQ ID NO: 695524 - DNA, 25 bp, Mus musculus
gtgaacgttggcatcagtgtcgaaa

SEQ ID NO: 695525 - DNA, 25 bp, Mus musculus
gtgaacgttggcttcagtgtcgaaa

SEQ ID NO: 695526 - DNA, 25 bp, Mus musculus
gtgaacgttgtcaattgtttacatt

SEQ ID NO: 695527 - DNA, 25 bp, Mus musculus
gtgaacgttgtctattgtttacatt

SEQ ID NO: 695528 - DNA, 25 bp, Mus musculus
gtgaactaacatcttagccctgaga

SEQ ID NO: 695529 - DNA, 25 bp, Mus musculus
gtgaactaacatgttagccctgaga

SEQ ID NO: 695530 - DNA, 25 bp, Mus musculus
gtgaactaagaccattcccttaagt

SEQ ID NO: 695531 - DNA, 25 bp, Mus musculus
gtgaactaagacgattcccttaagt

SEQ ID NO: 695532 - DNA, 25 bp, Mus musculus
gtgaactaatgaactgcatactcag

SEQ ID NO: 695533 - DNA, 25 bp, Mus musculus
gtgaactaatgatctgcatactcag

SEQ ID NO: 695534 - DNA, 25 bp, Mus musculus
gtgaactacacaaagcaggacagca

SEQ ID NO: 695535 - DNA, 25 bp, Mus musculus
gtgaactacacaatccagggaggtt

SEQ ID NO: 695536 - DNA, 25 bp, Mus musculus
gtgaactacacatagcaggacagca

SEQ ID NO: 695537 - DNA, 25 bp, Mus musculus
gtgaactacacattccagggaggtt

SEQ ID NO: 695538 - DNA, 25 bp, Mus musculus
gtgaactacagcaacacttggcaat

SEQ ID NO: 695539 - DNA, 25 bp, Mus musculus
gtgaactacagctacacttggcaat

SEQ ID NO: 695540 - DNA, 25 bp, Mus musculus
gtgaactaccaaatcaaatgccaat

SEQ ID NO: 695541 - DNA, 25 bp, Mus musculus
gtgaactaccaattcaaatgccaat

SEQ ID NO: 695542 - DNA, 25 bp, Mus musculus
gtgaactaccataaccagcagactg

SEQ ID NO: 695543 - DNA, 25 bp, Mus musculus
gtgaactaccattaccagcagactg

SEQ ID NO: 695544 - DNA, 25 bp, Mus musculus
gtgaactaggaacccatgtggcttt

SEQ ID NO: 695545 - DNA, 25 bp, Mus musculus
gtgaactaggaagccatgtggcttt

SEQ ID NO: 695546 - DNA, 25 bp, Mus musculus
gtgaactaggctagttacctcccct

SEQ ID NO: 695547 - DNA, 25 bp, Mus musculus
gtgaactaggcttgttacctcccct

SEQ ID NO: 695548 - DNA, 25 bp, Mus musculus
gtgaactatagaacatcaactctgc

SEQ ID NO: 695549 - DNA, 25 bp, Mus musculus
gtgaactatagatcatcaactctgc

SEQ ID NO: 695550 - DNA, 25 bp, Mus musculus
gtgaactatatcatcaagacactgt

SEQ ID NO: 695551 - DNA, 25 bp, Mus musculus
gtgaactatatcttcaagacactgt

SEQ ID NO: 695552 - DNA, 25 bp, Mus musculus
gtgaactcaaacaacttctgaatga

SEQ ID NO: 695553 - DNA, 25 bp, Mus musculus
gtgaactcaaactacttctgaatga

SEQ ID NO: 695554 - DNA, 25 bp, Mus musculus
gtgaactcacagaggcctgcacagc

SEQ ID NO: 695555 - DNA, 25 bp, Mus musculus
gtgaactcacagtggcctgcacagc

SEQ ID NO: 695556 - DNA, 25 bp, Mus musculus
gtgaactcacgccatgaaatctgta

SEQ ID NO: 695557 - DNA, 25 bp, Mus musculus
gtgaactcacgcgatgaaatctgta

SEQ ID NO: 695558 - DNA, 25 bp, Mus musculus
gtgaactcactcaaccaagtgcaaa

SEQ ID NO: 695559 - DNA, 25 bp, Mus musculus
gtgaactcactctaccaagtgcaaa

SEQ ID NO: 695560 - DNA, 25 bp, Mus musculus
gtgaactcagcacgactcagggtgt

SEQ ID NO: 695561 - DNA, 25 bp, Mus musculus
gtgaactcagcaggactcagggtgt

SEQ ID NO: 695562 - DNA, 25 bp, Mus musculus
gtgaactcagtgagcaagttttaca

SEQ ID NO: 695563 - DNA, 25 bp, Mus musculus
gtgaactcagtgcttttctatgaat

SEQ ID NO: 695564 - DNA, 25 bp, Mus musculus
gtgaactcagtggttttctatgaat

SEQ ID NO: 695565 - DNA, 25 bp, Mus musculus
gtgaactcagtgtgcaagttttaca

SEQ ID NO: 695566 - DNA, 25 bp, Mus musculus
gtgaactcagttctaattttaagga

SEQ ID NO: 695567 - DNA, 25 bp, Mus musculus
gtgaactcagttgtaattttaagga

SEQ ID NO: 695568 - DNA, 25 bp, Mus musculus
gtgaactccaacaactctgaaaaga

SEQ ID NO: 695569 - DNA, 25 bp, Mus musculus
gtgaactccaactactctgaaaaga

SEQ ID NO: 695570 - DNA, 25 bp, Mus musculus
gtgaactccagacgtgtcactcttg

SEQ ID NO: 695571 - DNA, 25 bp, Mus musculus
gtgaactccagaggtgtcactcttg

SEQ ID NO: 695572 - DNA, 25 bp, Mus musculus
gtgaactccaggcatttaaactgaa

SEQ ID NO: 695573 - DNA, 25 bp, Mus musculus
gtgaactccagggatttaaactgaa

SEQ ID NO: 695574 - DNA, 25 bp, Mus musculus
gtgaactccatcaggacgagcattt

SEQ ID NO: 695575 - DNA, 25 bp, Mus musculus
gtgaactccatctggacgagcattt

SEQ ID NO: 695576 - DNA, 25 bp, Mus musculus
gtgaactcccagagggcatgcagct

SEQ ID NO: 695577 - DNA, 25 bp, Mus musculus
gtgaactcccagtgggcatgcagct

SEQ ID NO: 695578 - DNA, 25 bp, Mus musculus
gtgaactctactactaccaagccag

SEQ ID NO: 695579 - DNA, 25 bp, Mus musculus
gtgaactctacttctaccaagccag

SEQ ID NO: 695580 - DNA, 25 bp, Mus musculus
gtgaactctaggagacgggccaagt

SEQ ID NO: 695581 - DNA, 25 bp, Mus musculus
gtgaactctaggtgacgggccaagt

SEQ ID NO: 695582 - DNA, 25 bp, Mus musculus
gtgaactctatcaacaattgctttg

SEQ ID NO: 695583 - DNA, 25 bp, Mus musculus
gtgaactctatctacaattgctttg

SEQ ID NO: 695584 - DNA, 25 bp, Mus musculus
gtgaactctcacctagaaaacctag

SEQ ID NO: 695585 - DNA, 25 bp, Mus musculus
gtgaactctcacgtagaaaacctag

SEQ ID NO: 695586 - DNA, 25 bp, Mus musculus
gtgaactctctcagtaatcgtgggc

SEQ ID NO: 695587 - DNA, 25 bp, Mus musculus
gtgaactctctctgtaatcgtgggc

SEQ ID NO: 695588 - DNA, 25 bp, Mus musculus
gtgaactctgataaccatggtcaat

SEQ ID NO: 695589 - DNA, 25 bp, Mus musculus
gtgaactctgatctctggacatggg

SEQ ID NO: 695590 - DNA, 25 bp, Mus musculus
gtgaactctgatgtctggacatggg

SEQ ID NO: 695591 - DNA, 25 bp, Mus musculus
gtgaactctgattaccatggtcaat

SEQ ID NO: 695592 - DNA, 25 bp, Mus musculus
gtgaactctgccactggagacagat

SEQ ID NO: 695593 - DNA, 25 bp, Mus musculus
gtgaactctgcctctggagacagat

SEQ ID NO: 695594 - DNA, 25 bp, Mus musculus
gtgaactctgtactggtccctccaa

SEQ ID NO: 695595 - DNA, 25 bp, Mus musculus
gtgaactctgtagtggtccctccaa

SEQ ID NO: 695596 - DNA, 25 bp, Mus musculus
gtgaactctgtcctgaggaggaacc

SEQ ID NO: 695597 - DNA, 25 bp, Mus musculus
gtgaactctgtcgtgaggaggaacc

SEQ ID NO: 695598 - DNA, 25 bp, Mus musculus
gtgaactcttatccagtgtgatctt

SEQ ID NO: 695599 - DNA, 25 bp, Mus musculus
gtgaactcttatgcagtgtgatctt

SEQ ID NO: 695600 - DNA, 25 bp, Mus musculus
gtgaactgaactcttttttgcaatg

SEQ ID NO: 695601 - DNA, 25 bp, Mus musculus
gtgaactgaactgttttttgcaatg

SEQ ID NO: 695602 - DNA, 25 bp, Mus musculus
gtgaactgacagaaatacatgatta

SEQ ID NO: 695603 - DNA, 25 bp, Mus musculus
gtgaactgacagtaatacatgatta

SEQ ID NO: 695604 - DNA, 25 bp, Mus musculus
gtgaactgactacatcgcctggctg

SEQ ID NO: 695605 - DNA, 25 bp, Mus musculus
gtgaactgactagatcgcctggctg

SEQ ID NO: 695606 - DNA, 25 bp, Mus musculus
gtgaactgagtgctccatgtgcttc

SEQ ID NO: 695607 - DNA, 25 bp, Mus musculus
gtgaactgagtggtccatgtgcttc

SEQ ID NO: 695608 - DNA, 25 bp, Mus musculus
gtgaactgatatactcctttctttc

SEQ ID NO: 695609 - DNA, 25 bp, Mus musculus
gtgaactgatattctcctttctttc

SEQ ID NO: 695610 - DNA, 25 bp, Mus musculus
gtgaactgattgctcactcagagtt

SEQ ID NO: 695611 - DNA, 25 bp, Mus musculus
gtgaactgattggtcactcagagtt

SEQ ID NO: 695612 - DNA, 25 bp, Mus musculus
gtgaactgcatgcagtttcgtgtaa

SEQ ID NO: 695613 - DNA, 25 bp, Mus musculus
gtgaactgcatggagtttcgtgtaa

SEQ ID NO: 695614 - DNA, 25 bp, Mus musculus
gtgaactgctcaccttcagggatct

SEQ ID NO: 695615 - DNA, 25 bp, Mus musculus
gtgaactgctcagcttcagggatct

SEQ ID NO: 695616 - DNA, 25 bp, Mus musculus
gtgaactgctgaccccaggagctgt

SEQ ID NO: 695617 - DNA, 25 bp, Mus musculus
gtgaactgctgagcccaggagctgt

SEQ ID NO: 695618 - DNA, 25 bp, Mus musculus
gtgaactgctggactcactcatcag

SEQ ID NO: 695619 - DNA, 25 bp, Mus musculus
gtgaactgctggtctcactcatcag

SEQ ID NO: 695620 - DNA, 25 bp, Mus musculus
gtgaactgcttgctcgttttagtaa

SEQ ID NO: 695621 - DNA, 25 bp, Mus musculus
gtgaactgcttggtcgttttagtaa

SEQ ID NO: 695622 - DNA, 25 bp, Mus musculus
gtgaactggaatcgagtctagcaaa

SEQ ID NO: 695623 - DNA, 25 bp, Mus musculus
gtgaactggaatggagtctagcaaa

SEQ ID NO: 695624 - DNA, 25 bp, Mus musculus
gtgaactggcccaataatgcccagg

SEQ ID NO: 695625 - DNA, 25 bp, Mus musculus
gtgaactggccctataatgcccagg

SEQ ID NO: 695626 - DNA, 25 bp, Mus musculus
gtgaactggcttctacattttgaat

SEQ ID NO: 695627 - DNA, 25 bp, Mus musculus
gtgaactggcttgtacattttgaat

SEQ ID NO: 695628 - DNA, 25 bp, Mus musculus
gtgaactgggccatgtattttacat

SEQ ID NO: 695629 - DNA, 25 bp, Mus musculus
gtgaactgggccttgtattttacat

SEQ ID NO: 695630 - DNA, 25 bp, Mus musculus
gtgaactgggcgataacctgaagat

SEQ ID NO: 695631 - DNA, 25 bp, Mus musculus
gtgaactgggcgttaacctgaagat

SEQ ID NO: 695632 - DNA, 25 bp, Mus musculus
gtgaactggtgtctcagtagctaac

SEQ ID NO: 695633 - DNA, 25 bp, Mus musculus
gtgaactggtgtgtcagtagctaac

SEQ ID NO: 695634 - DNA, 25 bp, Mus musculus
gtgaactgtacaacataccgtagaa

SEQ ID NO: 695635 - DNA, 25 bp, Mus musculus
gtgaactgtacatcataccgtagaa

SEQ ID NO: 695636 - DNA, 25 bp, Mus musculus
gtgaactgtactcttctcaaaggaa

SEQ ID NO: 695637 - DNA, 25 bp, Mus musculus
gtgaactgtactgttctcaaaggaa

SEQ ID NO: 695638 - DNA, 25 bp, Mus musculus
gtgaactgtcaactgcaatttgcaa

SEQ ID NO: 695639 - DNA, 25 bp, Mus musculus
gtgaactgtcaagtgcaatttgcaa

SEQ ID NO: 695640 - DNA, 25 bp, Mus musculus
gtgaactgtcacagccatggagcca

SEQ ID NO: 695641 - DNA, 25 bp, Mus musculus
gtgaactgtcactgccatggagcca

SEQ ID NO: 695642 - DNA, 25 bp, Mus musculus
gtgaactgtcgacgctgtctgtcaa

SEQ ID NO: 695643 - DNA, 25 bp, Mus musculus
gtgaactgtcgaggctgtctgtcaa

SEQ ID NO: 695644 - DNA, 25 bp, Mus musculus
gtgaactgtgctctgatggttagaa

SEQ ID NO: 695645 - DNA, 25 bp, Mus musculus
gtgaactgtgctgtgatggttagaa

SEQ ID NO: 695646 - DNA, 25 bp, Mus musculus
gtgaactgtgtcagtcctcgcttgt

SEQ ID NO: 695647 - DNA, 25 bp, Mus musculus
gtgaactgtgtctgtcctcgcttgt

SEQ ID NO: 695648 - DNA, 25 bp, Mus musculus
gtgaacttatatatacgcttgtgat

SEQ ID NO: 695649 - DNA, 25 bp, Mus musculus
gtgaacttatatttacgcttgtgat

SEQ ID NO: 695650 - DNA, 25 bp, Mus musculus
gtgaacttcacgattgcaggaacag

SEQ ID NO: 695651 - DNA, 25 bp, Mus musculus
gtgaacttcacgtttgcaggaacag

SEQ ID NO: 695652 - DNA, 25 bp, Mus musculus
gtgaacttcagtcccatcttgtcag

SEQ ID NO: 695653 - DNA, 25 bp, Mus musculus
gtgaacttcagtgccatcttgtcag

SEQ ID NO: 695654 - DNA, 25 bp, Mus musculus
gtgaacttcatgagcagacctacag

SEQ ID NO: 695655 - DNA, 25 bp, Mus musculus
gtgaacttcatgatagactctggag

SEQ ID NO: 695656 - DNA, 25 bp, Mus musculus
gtgaacttcatgtgcagacctacag

SEQ ID NO: 695657 - DNA, 25 bp, Mus musculus
gtgaacttcatgttagactctggag

SEQ ID NO: 695658 - DNA, 25 bp, Mus musculus
gtgaacttcgatcaaaccttctgat

SEQ ID NO: 695659 - DNA, 25 bp, Mus musculus
gtgaacttcgatgaaaccttctgat

SEQ ID NO: 695660 - DNA, 25 bp, Mus musculus
gtgaacttcttcagtaattttggat

SEQ ID NO: 695661 - DNA, 25 bp, Mus musculus
gtgaacttcttctgtaattttggat

SEQ ID NO: 695662 - DNA, 25 bp, Mus musculus
gtgaacttgaatcaccactgctcaa

SEQ ID NO: 695663 - DNA, 25 bp, Mus musculus
gtgaacttgaatgaccactgctcaa

SEQ ID NO: 695664 - DNA, 25 bp, Mus musculus
gtgaacttgaccactgaggactggg

SEQ ID NO: 695665 - DNA, 25 bp, Mus musculus
gtgaacttgacctctgaggactggg

SEQ ID NO: 695666 - DNA, 25 bp, Mus musculus
gtgaacttgagtcttggccgctcat

SEQ ID NO: 695667 - DNA, 25 bp, Mus musculus
gtgaacttgagtgttggccgctcat

SEQ ID NO: 695668 - DNA, 25 bp, Mus musculus
gtgaacttgggtagttttcctcctg

SEQ ID NO: 695669 - DNA, 25 bp, Mus musculus
gtgaacttgggttgttttcctcctg

SEQ ID NO: 695670 - DNA, 25 bp, Mus musculus
gtgaactttaagagtaatgtattcc

SEQ ID NO: 695671 - DNA, 25 bp, Mus musculus
gtgaactttaagtgtaatgtattcc

SEQ ID NO: 695672 - DNA, 25 bp, Mus musculus
gtgaactttaatcttggttacctga

SEQ ID NO: 695673 - DNA, 25 bp, Mus musculus
gtgaactttaatgttggttacctga

SEQ ID NO: 695674 - DNA, 25 bp, Mus musculus
gtgaactttacgactattatgccat

SEQ ID NO: 695675 - DNA, 25 bp, Mus musculus
gtgaactttacgtctattatgccat

SEQ ID NO: 695676 - DNA, 25 bp, Mus musculus
gtgaactttagaccacgttctaatt

SEQ ID NO: 695677 - DNA, 25 bp, Mus musculus
gtgaactttagagcacgttctaatt

SEQ ID NO: 695678 - DNA, 25 bp, Mus musculus
gtgaactttatgcacttagctgaca

SEQ ID NO: 695679 - DNA, 25 bp, Mus musculus
gtgaactttatggacttagctgaca

SEQ ID NO: 695680 - DNA, 25 bp, Mus musculus
gtgaactttcctacagtcatgtttc

SEQ ID NO: 695681 - DNA, 25 bp, Mus musculus
gtgaactttccttcagtcatgtttc

SEQ ID NO: 695682 - DNA, 25 bp, Mus musculus
gtgaactttggacaagcctcagtct

SEQ ID NO: 695683 - DNA, 25 bp, Mus musculus
gtgaactttggagaagcctcagtct

SEQ ID NO: 695684 - DNA, 25 bp, Mus musculus
gtgaactttgggatccgtggaagat

SEQ ID NO: 695685 - DNA, 25 bp, Mus musculus
gtgaactttgggttccgtggaagat

SEQ ID NO: 695686 - DNA, 25 bp, Mus musculus
gtgaagaaaacaaaattgccaattt

SEQ ID NO: 695687 - DNA, 25 bp, Mus musculus
gtgaagaaaacataattgccaattt

SEQ ID NO: 695688 - DNA, 25 bp, Mus musculus
gtgaagaaaagaatgcttgacactt

SEQ ID NO: 695689 - DNA, 25 bp, Mus musculus
gtgaagaaaagattgcttgacactt

SEQ ID NO: 695690 - DNA, 25 bp, Mus musculus
gtgaagaaagcccaacagtcctaaa

SEQ ID NO: 695691 - DNA, 25 bp, Mus musculus
gtgaagaaagccgaacagtcctaaa

SEQ ID NO: 695692 - DNA, 25 bp, Mus musculus
gtgaagaaatacacacttgcccgag

SEQ ID NO: 695693 - DNA, 25 bp, Mus musculus
gtgaagaaatactcacttgcccgag

SEQ ID NO: 695694 - DNA, 25 bp, Mus musculus
gtgaagaaatggacacgtatacttt

SEQ ID NO: 695695 - DNA, 25 bp, Mus musculus
gtgaagaaatggtcacgtatacttt

SEQ ID NO: 695696 - DNA, 25 bp, Mus musculus
gtgaagaaatgtctccgctttcgga

SEQ ID NO: 695697 - DNA, 25 bp, Mus musculus
gtgaagaaatgtgtccgctttcgga

SEQ ID NO: 695698 - DNA, 25 bp, Mus musculus
gtgaagaacattacagcctgtgact

SEQ ID NO: 695699 - DNA, 25 bp, Mus musculus
gtgaagaacatttcagcctgtgact

SEQ ID NO: 695700 - DNA, 25 bp, Mus musculus
gtgaagaaccatattacacaggcca

SEQ ID NO: 695701 - DNA, 25 bp, Mus musculus
gtgaagaaccattttacacaggcca

SEQ ID NO: 695702 - DNA, 25 bp, Mus musculus
gtgaagaacccacattccaaaatga

SEQ ID NO: 695703 - DNA, 25 bp, Mus musculus
gtgaagaacccagattccaaaatga

SEQ ID NO: 695704 - DNA, 25 bp, Mus musculus
gtgaagaacgacctgactgccaaga

SEQ ID NO: 695705 - DNA, 25 bp, Mus musculus
gtgaagaacgacgtgactgccaaga

SEQ ID NO: 695706 - DNA, 25 bp, Mus musculus
gtgaagaactagaccagccctgttt

SEQ ID NO: 695707 - DNA, 25 bp, Mus musculus
gtgaagaactagactgtgggaaaat

SEQ ID NO: 695708 - DNA, 25 bp, Mus musculus
gtgaagaactagtccagccctgttt

SEQ ID NO: 695709 - DNA, 25 bp, Mus musculus
gtgaagaactagtctgtgggaaaat

SEQ ID NO: 695710 - DNA, 25 bp, Mus musculus
gtgaagaactgtaagctgcttgtca

SEQ ID NO: 695711 - DNA, 25 bp, Mus musculus
gtgaagaactgttagctgcttgtca

SEQ ID NO: 695712 - DNA, 25 bp, Mus musculus
gtgaagaagacaaccagtcccttct

SEQ ID NO: 695713 - DNA, 25 bp, Mus musculus
gtgaagaagacatccagtcccttct

SEQ ID NO: 695714 - DNA, 25 bp, Mus musculus
gtgaagaagccaagcgactcctggg

SEQ ID NO: 695715 - DNA, 25 bp, Mus musculus
gtgaagaagccatgcgactcctggg

SEQ ID NO: 695716 - DNA, 25 bp, Mus musculus
gtgaagaaggctatgctgactctat

SEQ ID NO: 695717 - DNA, 25 bp, Mus musculus
gtgaagaaggctttgctgactctat

SEQ ID NO: 695718 - DNA, 25 bp, Mus musculus
gtgaagaatcctcctgagtgatgaa

SEQ ID NO: 695719 - DNA, 25 bp, Mus musculus
gtgaagaatcctgctgagtgatgaa

SEQ ID NO: 695720 - DNA, 25 bp, Mus musculus
gtgaagaatcttctgccagtcatcc

SEQ ID NO: 695721 - DNA, 25 bp, Mus musculus
gtgaagaatcttgtgccagtcatcc

SEQ ID NO: 695722 - DNA, 25 bp, Mus musculus
gtgaagaatgatccacaaagggaca

SEQ ID NO: 695723 - DNA, 25 bp, Mus musculus
gtgaagaatgatgcacaaagggaca

SEQ ID NO: 695724 - DNA, 25 bp, Mus musculus
gtgaagaattgtatccggatgactg

SEQ ID NO: 695725 - DNA, 25 bp, Mus musculus
gtgaagaattgtttccggatgactg

SEQ ID NO: 695726 - DNA, 25 bp, Mus musculus
gtgaagacacaacttttctccctat

SEQ ID NO: 695727 - DNA, 25 bp, Mus musculus
gtgaagacacaagttttctccctat

SEQ ID NO: 695728 - DNA, 25 bp, Mus musculus
gtgaagacactacagaccctggaca

SEQ ID NO: 695729 - DNA, 25 bp, Mus musculus
gtgaagacactagagaccctggaca

SEQ ID NO: 695730 - DNA, 25 bp, Mus musculus
gtgaagacagcacaccagccagtat

SEQ ID NO: 695731 - DNA, 25 bp, Mus musculus
gtgaagacagcagaccagccagtat

SEQ ID NO: 695732 - DNA, 25 bp, Mus musculus
gtgaagacagctacaaagccacagg

SEQ ID NO: 695733 - DNA, 25 bp, Mus musculus
gtgaagacagcttcaaagccacagg

SEQ ID NO: 695734 - DNA, 25 bp, Mus musculus
gtgaagacaggaaccagcttctgtt

SEQ ID NO: 695735 - DNA, 25 bp, Mus musculus
gtgaagacaggatccagcttctgtt

SEQ ID NO: 695736 - DNA, 25 bp, Mus musculus
gtgaagaccataatcttttgcttct

SEQ ID NO: 695737 - DNA, 25 bp, Mus musculus
gtgaagaccatattcttttgcttct

SEQ ID NO: 695738 - DNA, 25 bp, Mus musculus
gtgaagacccttcattagctcttaa

SEQ ID NO: 695739 - DNA, 25 bp, Mus musculus
gtgaagacccttgattagctcttaa

SEQ ID NO: 695740 - DNA, 25 bp, Mus musculus
gtgaagacctatattagcactgaat

SEQ ID NO: 695741 - DNA, 25 bp, Mus musculus
gtgaagacctatccttttttgtaag

SEQ ID NO: 695742 - DNA, 25 bp, Mus musculus
gtgaagacctatgcttttttgtaag

SEQ ID NO: 695743 - DNA, 25 bp, Mus musculus
gtgaagacctattttagcactgaat

SEQ ID NO: 695744 - DNA, 25 bp, Mus musculus
gtgaagacgcaaagctcctgcagtc

SEQ ID NO: 695745 - DNA, 25 bp, Mus musculus
gtgaagacgcaatgctcctgcagtc

SEQ ID NO: 695746 - DNA, 25 bp, Mus musculus
gtgaagactcaaatagatcctcatt

SEQ ID NO: 695747 - DNA, 25 bp, Mus musculus
gtgaagactcaattagatcctcatt

SEQ ID NO: 695748 - DNA, 25 bp, Mus musculus
gtgaagactcacctagaaaaagcat

SEQ ID NO: 695749 - DNA, 25 bp, Mus musculus
gtgaagactcacgtagaaaaagcat

SEQ ID NO: 695750 - DNA, 25 bp, Mus musculus
gtgaagactcttcatgaccggctgc

SEQ ID NO: 695751 - DNA, 25 bp, Mus musculus
gtgaagactcttgatgaccggctgc

SEQ ID NO: 695752 - DNA, 25 bp, Mus musculus
gtgaagactgccatagcacacgagg

SEQ ID NO: 695753 - DNA, 25 bp, Mus musculus
gtgaagactgccttagcacacgagg

SEQ ID NO: 695754 - DNA, 25 bp, Mus musculus
gtgaagactgtccacggatcgtgtc

SEQ ID NO: 695755 - DNA, 25 bp, Mus musculus
gtgaagactgtcgacggatcgtgtc

SEQ ID NO: 695756 - DNA, 25 bp, Mus musculus
gtgaagacttacatactgggcaaat

SEQ ID NO: 695757 - DNA, 25 bp, Mus musculus
gtgaagacttacttactgggcaaat

SEQ ID NO: 695758 - DNA, 25 bp, Mus musculus
gtgaagacttcaacagctttgtgtt

SEQ ID NO: 695759 - DNA, 25 bp, Mus musculus
gtgaagacttcaatctacttagcag

SEQ ID NO: 695760 - DNA, 25 bp, Mus musculus
gtgaagacttcatcagctttgtgtt

SEQ ID NO: 695761 - DNA, 25 bp, Mus musculus
gtgaagacttcattctacttagcag

SEQ ID NO: 695762 - DNA, 25 bp, Mus musculus
gtgaagacttccaggtggctcggaa

SEQ ID NO: 695763 - DNA, 25 bp, Mus musculus
gtgaagacttcctggtggctcggaa

SEQ ID NO: 695764 - DNA, 25 bp, Mus musculus
gtgaagagaaatctctaccagagat

SEQ ID NO: 695765 - DNA, 25 bp, Mus musculus
gtgaagagaaatgtctaccagagat

SEQ ID NO: 695766 - DNA, 25 bp, Mus musculus
gtgaagagacaccagtgcctctgct

SEQ ID NO: 695767 - DNA, 25 bp, Mus musculus
gtgaagagacacgagtgcctctgct

SEQ ID NO: 695768 - DNA, 25 bp, Mus musculus
gtgaagagatcgaatggcaaggcct

SEQ ID NO: 695769 - DNA, 25 bp, Mus musculus
gtgaagagatcgtatggcaaggcct

SEQ ID NO: 695770 - DNA, 25 bp, Mus musculus
gtgaagagatctcgccttaacttaa

SEQ ID NO: 695771 - DNA, 25 bp, Mus musculus
gtgaagagatctggccttaacttaa

SEQ ID NO: 695772 - DNA, 25 bp, Mus musculus
gtgaagagcgtaactgttcccattc

SEQ ID NO: 695773 - DNA, 25 bp, Mus musculus
gtgaagagcgtatctgttcccattc

SEQ ID NO: 695774 - DNA, 25 bp, Mus musculus
gtgaagagctaactccaccatgaga

SEQ ID NO: 695775 - DNA, 25 bp, Mus musculus
gtgaagagctaagtccaccatgaga

SEQ ID NO: 695776 - DNA, 25 bp, Mus musculus
gtgaagagctccagtgtttcgatga

SEQ ID NO: 695777 - DNA, 25 bp, Mus musculus
gtgaagagctcctgtgtttcgatga

SEQ ID NO: 695778 - DNA, 25 bp, Mus musculus
gtgaagaggaacacagtcatagatc

SEQ ID NO: 695779 - DNA, 25 bp, Mus musculus
gtgaagaggaactcagtcatagatc

SEQ ID NO: 695780 - DNA, 25 bp, Mus musculus
gtgaagaggtccagcatgacatgca

SEQ ID NO: 695781 - DNA, 25 bp, Mus musculus
gtgaagaggtcctgcatgacatgca

SEQ ID NO: 695782 - DNA, 25 bp, Mus musculus
gtgaagatacagcactgcctgccat

SEQ ID NO: 695783 - DNA, 25 bp, Mus musculus
gtgaagatacaggactgcctgccat

SEQ ID NO: 695784 - DNA, 25 bp, Mus musculus
gtgaagatagtcagaccccaatcct

SEQ ID NO: 695785 - DNA, 25 bp, Mus musculus
gtgaagatagtctgaccccaatcct

SEQ ID NO: 695786 - DNA, 25 bp, Mus musculus
gtgaagatcacccaactgcacagtt

SEQ ID NO: 695787 - DNA, 25 bp, Mus musculus
gtgaagatcaccgaactgcacagtt

SEQ ID NO: 695788 - DNA, 25 bp, Mus musculus
gtgaagatccaccagcttaataaga

SEQ ID NO: 695789 - DNA, 25 bp, Mus musculus
gtgaagatccacgagcttaataaga

SEQ ID NO: 695790 - DNA, 25 bp, Mus musculus
gtgaagatcctcaaggacgcggccg

SEQ ID NO: 695791 - DNA, 25 bp, Mus musculus
gtgaagatcctctaggacgcggccg

SEQ ID NO: 695792 - DNA, 25 bp, Mus musculus
gtgaagatccttctggaccacaacg

SEQ ID NO: 695793 - DNA, 25 bp, Mus musculus
gtgaagatccttgtggaccacaacg

SEQ ID NO: 695794 - DNA, 25 bp, Mus musculus
gtgaagatctccaggtcctaaaccc

SEQ ID NO: 695795 - DNA, 25 bp, Mus musculus
gtgaagatctcctggtcctaaaccc

SEQ ID NO: 695796 - DNA, 25 bp, Mus musculus
gtgaagatctgtcagcccatccatc

SEQ ID NO: 695797 - DNA, 25 bp, Mus musculus
gtgaagatctgtgagcccatccatc

SEQ ID NO: 695798 - DNA, 25 bp, Mus musculus
gtgaagatggatccaggcttcatct

SEQ ID NO: 695799 - DNA, 25 bp, Mus musculus
gtgaagatggatgcaggcttcatct

SEQ ID NO: 695800 - DNA, 25 bp, Mus musculus
gtgaagatggcaattctttcttgta

SEQ ID NO: 695801 - DNA, 25 bp, Mus musculus
gtgaagatggcatttctttcttgta

SEQ ID NO: 695802 - DNA, 25 bp, Mus musculus
gtgaagatggctacgggccccacga

SEQ ID NO: 695803 - DNA, 25 bp, Mus musculus
gtgaagatggcttcgggccccacga

SEQ ID NO: 695804 - DNA, 25 bp, Mus musculus
gtgaagatgtctccctaattaaagt

SEQ ID NO: 695805 - DNA, 25 bp, Mus musculus
gtgaagatgtctgcctaattaaagt

SEQ ID NO: 695806 - DNA, 25 bp, Mus musculus
gtgaagattccaacaactgagtttt

SEQ ID NO: 695807 - DNA, 25 bp, Mus musculus
gtgaagattccatcaactgagtttt

SEQ ID NO: 695808 - DNA, 25 bp, Mus musculus
gtgaagattcctaacctgacttaat

SEQ ID NO: 695809 - DNA, 25 bp, Mus musculus
gtgaagattccttacctgacttaat

SEQ ID NO: 695810 - DNA, 25 bp, Mus musculus
gtgaagatttacctatcccaggcac

SEQ ID NO: 695811 - DNA, 25 bp, Mus musculus
gtgaagatttacgtatcccaggcac

SEQ ID NO: 695812 - DNA, 25 bp, Mus musculus
gtgaagcaaaccatcgagcgcctcg

SEQ ID NO: 695813 - DNA, 25 bp, Mus musculus
gtgaagcaaaccttcgagcgcctcg

SEQ ID NO: 695814 - DNA, 25 bp, Mus musculus
gtgaagcaactaagattcctctcgt

SEQ ID NO: 695815 - DNA, 25 bp, Mus musculus
gtgaagcaactatgattcctctcgt

SEQ ID NO: 695816 - DNA, 25 bp, Mus musculus
gtgaagcaactcatttggacaaaca

SEQ ID NO: 695817 - DNA, 25 bp, Mus musculus
gtgaagcaactcttttggacaaaca

SEQ ID NO: 695818 - DNA, 25 bp, Mus musculus
gtgaagcaagcactctgcattgtct

SEQ ID NO: 695819 - DNA, 25 bp, Mus musculus
gtgaagcaagcagtctgcattgtct

SEQ ID NO: 695820 - DNA, 25 bp, Mus musculus
gtgaagcaagtgattgtccctgccc

SEQ ID NO: 695821 - DNA, 25 bp, Mus musculus
gtgaagcaagtgtttgtccctgccc

SEQ ID NO: 695822 - DNA, 25 bp, Mus musculus
gtgaagcacacaagtagtcttatat

SEQ ID NO: 695823 - DNA, 25 bp, Mus musculus
gtgaagcacacatgtagtcttatat

SEQ ID NO: 695824 - DNA, 25 bp, Mus musculus
gtgaagcacagtccagaattgaggt

SEQ ID NO: 695825 - DNA, 25 bp, Mus musculus
gtgaagcacagtgcagaattgaggt

SEQ ID NO: 695826 - DNA, 25 bp, Mus musculus
gtgaagcaccggagagtatcctgga

SEQ ID NO: 695827 - DNA, 25 bp, Mus musculus
gtgaagcaccggtgagtatcctgga

SEQ ID NO: 695828 - DNA, 25 bp, Mus musculus
gtgaagcaccttacatgcaaggcat

SEQ ID NO: 695829 - DNA, 25 bp, Mus musculus
gtgaagcacctttcatgcaaggcat

SEQ ID NO: 695830 - DNA, 25 bp, Mus musculus
gtgaagcactacactgtgtcacctg

SEQ ID NO: 695831 - DNA, 25 bp, Mus musculus
gtgaagcactactctgtgtcacctg

SEQ ID NO: 695832 - DNA, 25 bp, Mus musculus
gtgaagcactggacggtgttcccat

SEQ ID NO: 695833 - DNA, 25 bp, Mus musculus
gtgaagcactggtcggtgttcccat

SEQ ID NO: 695834 - DNA, 25 bp, Mus musculus
gtgaagcacttccaggccaggtcct

SEQ ID NO: 695835 - DNA, 25 bp, Mus musculus
gtgaagcacttcgaggccaggtcct

SEQ ID NO: 695836 - DNA, 25 bp, Mus musculus
gtgaagcagcaaactgttagtaaca

SEQ ID NO: 695837 - DNA, 25 bp, Mus musculus
gtgaagcagcaatctgttagtaaca

SEQ ID NO: 695838 - DNA, 25 bp, Mus musculus
gtgaagcagccccagagccctactg

SEQ ID NO: 695839 - DNA, 25 bp, Mus musculus
gtgaagcagcccgagagccctactg

SEQ ID NO: 695840 - DNA, 25 bp, Mus musculus
gtgaagcatagaccatctcgcccat

SEQ ID NO: 695841 - DNA, 25 bp, Mus musculus
gtgaagcatagagcatctcgcccat

SEQ ID NO: 695842 - DNA, 25 bp, Mus musculus
gtgaagccacacctagaacattctc

SEQ ID NO: 695843 - DNA, 25 bp, Mus musculus
gtgaagccacacgtagaacattctc

SEQ ID NO: 695844 - DNA, 25 bp, Mus musculus
gtgaagccacagaacctcattttaa

SEQ ID NO: 695845 - DNA, 25 bp, Mus musculus
gtgaagccacagtacctcattttaa

SEQ ID NO: 695846 - DNA, 25 bp, Mus musculus
gtgaagccaggcattgcgctgagat

SEQ ID NO: 695847 - DNA, 25 bp, Mus musculus
gtgaagccaggctttgcgctgagat

SEQ ID NO: 695848 - DNA, 25 bp, Mus musculus
gtgaagccatttagatcatctggac

SEQ ID NO: 695849 - DNA, 25 bp, Mus musculus
gtgaagccattttgatcatctggac

SEQ ID NO: 695850 - DNA, 25 bp, Mus musculus
gtgaagcccaagatcgtcaaaaaga

SEQ ID NO: 695851 - DNA, 25 bp, Mus musculus
gtgaagcccaagttcgtcaaaaaga

SEQ ID NO: 695852 - DNA, 25 bp, Mus musculus
gtgaagcccatacgcggtaaccaga

SEQ ID NO: 695853 - DNA, 25 bp, Mus musculus
gtgaagcccataggcggtaaccaga

SEQ ID NO: 695854 - DNA, 25 bp, Mus musculus
gtgaagcccatccaggacatccaag

SEQ ID NO: 695855 - DNA, 25 bp, Mus musculus
gtgaagcccatcgaggacatccaag

SEQ ID NO: 695856 - DNA, 25 bp, Mus musculus
gtgaagccccatcaagaatatcagg

SEQ ID NO: 695857 - DNA, 25 bp, Mus musculus
gtgaagccccatgaagaatatcagg

SEQ ID NO: 695858 - DNA, 25 bp, Mus musculus
gtgaagccccgcaacagtggtcctg

SEQ ID NO: 695859 - DNA, 25 bp, Mus musculus
gtgaagccccgctacagtggtcctg

SEQ ID NO: 695860 - DNA, 25 bp, Mus musculus
gtgaagcccttacccgtggaacaga

SEQ ID NO: 695861 - DNA, 25 bp, Mus musculus
gtgaagcccttagccgtggaacaga

SEQ ID NO: 695862 - DNA, 25 bp, Mus musculus
gtgaagcccttgagaacacaggaaa

SEQ ID NO: 695863 - DNA, 25 bp, Mus musculus
gtgaagcccttgtgaacacaggaaa

SEQ ID NO: 695864 - DNA, 25 bp, Mus musculus
gtgaagcctaagaggattcttgata

SEQ ID NO: 695865 - DNA, 25 bp, Mus musculus
gtgaagcctaagtggattcttgata

SEQ ID NO: 695866 - DNA, 25 bp, Mus musculus
gtgaagcctacaaatctaatccctg

SEQ ID NO: 695867 - DNA, 25 bp, Mus musculus
gtgaagcctacatatctaatccctg

SEQ ID NO: 695868 - DNA, 25 bp, Mus musculus
gtgaagcctcatatgggccatgtcc

SEQ ID NO: 695869 - DNA, 25 bp, Mus musculus
gtgaagcctcatttgggccatgtcc

SEQ ID NO: 695870 - DNA, 25 bp, Mus musculus
gtgaagcctcggctggcaacggtct

SEQ ID NO: 695871 - DNA, 25 bp, Mus musculus
gtgaagcctcgggtggcaacggtct

SEQ ID NO: 695872 - DNA, 25 bp, Mus musculus
gtgaagcctcttacgcaagttcaga

SEQ ID NO: 695873 - DNA, 25 bp, Mus musculus
gtgaagcctctttcgcaagttcaga

SEQ ID NO: 695874 - DNA, 25 bp, Mus musculus
gtgaagcctgcacccattgaccagg

SEQ ID NO: 695875 - DNA, 25 bp, Mus musculus
gtgaagcctgcagccattgaccagg

SEQ ID NO: 695876 - DNA, 25 bp, Mus musculus
gtgaagcctgccattgaggaattct

SEQ ID NO: 695877 - DNA, 25 bp, Mus musculus
gtgaagcctgcctttgaggaattct

SEQ ID NO: 695878 - DNA, 25 bp, Mus musculus
gtgaagcctgtgaaggtctctgccc

SEQ ID NO: 695879 - DNA, 25 bp, Mus musculus
gtgaagcctgtgtaggtctctgccc

SEQ ID NO: 695880 - DNA, 25 bp, Mus musculus
gtgaagccttgtacatgggtcccag

SEQ ID NO: 695881 - DNA, 25 bp, Mus musculus
gtgaagccttgttcatgggtcccag

SEQ ID NO: 695882 - DNA, 25 bp, Mus musculus
gtgaagcctttcattgcatgttttc

SEQ ID NO: 695883 - DNA, 25 bp, Mus musculus
gtgaagcctttctttgcatgttttc

SEQ ID NO: 695884 - DNA, 25 bp, Mus musculus
gtgaagctaaaaacttttcctgaag

SEQ ID NO: 695885 - DNA, 25 bp, Mus musculus
gtgaagctaaaatcttttcctgaag

SEQ ID NO: 695886 - DNA, 25 bp, Mus musculus
gtgaagctactaaaccccatgttgg

SEQ ID NO: 695887 - DNA, 25 bp, Mus musculus
gtgaagctactataccccatgttgg

SEQ ID NO: 695888 - DNA, 25 bp, Mus musculus
gtgaagctagacattgtggccccag

SEQ ID NO: 695889 - DNA, 25 bp, Mus musculus
gtgaagctagactttgtggccccag

SEQ ID NO: 695890 - DNA, 25 bp, Mus musculus
gtgaagctccacagctttcattgag

SEQ ID NO: 695891 - DNA, 25 bp, Mus musculus
gtgaagctccactgctttcattgag

SEQ ID NO: 695892 - DNA, 25 bp, Mus musculus
gtgaagctccagagaatctcaatgg

SEQ ID NO: 695893 - DNA, 25 bp, Mus musculus
gtgaagctccagtgaatctcaatgg

SEQ ID NO: 695894 - DNA, 25 bp, Mus musculus
gtgaagctccctcagtggatgagat

SEQ ID NO: 695895 - DNA, 25 bp, Mus musculus
gtgaagctccctgagtggatgagat

SEQ ID NO: 695896 - DNA, 25 bp, Mus musculus
gtgaagctgaatacagactgacttt

SEQ ID NO: 695897 - DNA, 25 bp, Mus musculus
gtgaagctgaattcagactgacttt

SEQ ID NO: 695898 - DNA, 25 bp, Mus musculus
gtgaagctgaccagctcgcgacctc

SEQ ID NO: 695899 - DNA, 25 bp, Mus musculus
gtgaagctgacctgctcgcgacctc

SEQ ID NO: 695900 - DNA, 25 bp, Mus musculus
gtgaagctgagtcctttaccttcga

SEQ ID NO: 695901 - DNA, 25 bp, Mus musculus
gtgaagctgagtgctttaccttcga

SEQ ID NO: 695902 - DNA, 25 bp, Mus musculus
gtgaagcttcagacttcttacctgc

SEQ ID NO: 695903 - DNA, 25 bp, Mus musculus
gtgaagcttcagtcttcttacctgc

SEQ ID NO: 695904 - DNA, 25 bp, Mus musculus
gtgaagcttttaaccttaacacaca

SEQ ID NO: 695905 - DNA, 25 bp, Mus musculus
gtgaagcttttacaccaaggacctt

SEQ ID NO: 695906 - DNA, 25 bp, Mus musculus
gtgaagcttttagaccaaggacctt

SEQ ID NO: 695907 - DNA, 25 bp, Mus musculus
gtgaagcttttatccttaacacaca

SEQ ID NO: 695908 - DNA, 25 bp, Mus musculus
gtgaaggaacatcgcattctctgtc

SEQ ID NO: 695909 - DNA, 25 bp, Mus musculus
gtgaaggaacatggcattctctgtc

SEQ ID NO: 695910 - DNA, 25 bp, Mus musculus
gtgaaggaactcacacttccatggc

SEQ ID NO: 695911 - DNA, 25 bp, Mus musculus
gtgaaggaactctcacttccatggc

SEQ ID NO: 695912 - DNA, 25 bp, Mus musculus
gtgaaggacagcacaccaatcccaa

SEQ ID NO: 695913 - DNA, 25 bp, Mus musculus
gtgaaggacagctcaccaatcccaa

SEQ ID NO: 695914 - DNA, 25 bp, Mus musculus
gtgaaggaccaaacagaccacttaa

SEQ ID NO: 695915 - DNA, 25 bp, Mus musculus
gtgaaggaccaatcagaccacttaa

SEQ ID NO: 695916 - DNA, 25 bp, Mus musculus
gtgaaggaccacaacatcatatact

SEQ ID NO: 695917 - DNA, 25 bp, Mus musculus
gtgaaggaccactacatcatatact

SEQ ID NO: 695918 - DNA, 25 bp, Mus musculus
gtgaaggacctacacaaggtttctt

SEQ ID NO: 695919 - DNA, 25 bp, Mus musculus
gtgaaggacctagacaaggtttctt

SEQ ID NO: 695920 - DNA, 25 bp, Mus musculus
gtgaaggacgtcatccgccagcaag

SEQ ID NO: 695921 - DNA, 25 bp, Mus musculus
gtgaaggacgtcttccgccagcaag

SEQ ID NO: 695922 - DNA, 25 bp, Mus musculus
gtgaaggagacccatgtccctggcc

SEQ ID NO: 695923 - DNA, 25 bp, Mus musculus
gtgaaggagaccgatgtccctggcc

SEQ ID NO: 695924 - DNA, 25 bp, Mus musculus
gtgaaggagtgcactaactctcccc

SEQ ID NO: 695925 - DNA, 25 bp, Mus musculus
gtgaaggagtgctctaactctcccc

SEQ ID NO: 695926 - DNA, 25 bp, Mus musculus
gtgaaggatgttcaaccccaggaga

SEQ ID NO: 695927 - DNA, 25 bp, Mus musculus
gtgaaggatgttgaaccccaggaga

SEQ ID NO: 695928 - DNA, 25 bp, Mus musculus
gtgaaggccataaaactgctggact

SEQ ID NO: 695929 - DNA, 25 bp, Mus musculus
gtgaaggccatataactgctggact

SEQ ID NO: 695930 - DNA, 25 bp, Mus musculus
gtgaaggcccagagcatcttacgaa

SEQ ID NO: 695931 - DNA, 25 bp, Mus musculus
gtgaaggcccagtgcatcttacgaa

SEQ ID NO: 695932 - DNA, 25 bp, Mus musculus
gtgaaggccccaaagctgttgcagc

SEQ ID NO: 695933 - DNA, 25 bp, Mus musculus
gtgaaggccccatagctgttgcagc

SEQ ID NO: 695934 - DNA, 25 bp, Mus musculus
gtgaaggcctatacgggttcccaga

SEQ ID NO: 695935 - DNA, 25 bp, Mus musculus
gtgaaggcctattcgggttcccaga

SEQ ID NO: 695936 - DNA, 25 bp, Mus musculus
gtgaaggccttacagttcccagttg

SEQ ID NO: 695937 - DNA, 25 bp, Mus musculus
gtgaaggccttagagttcccagttg

SEQ ID NO: 695938 - DNA, 25 bp, Mus musculus
gtgaaggcgataaagtgaagtgctt

SEQ ID NO: 695939 - DNA, 25 bp, Mus musculus
gtgaaggcgatatagtgaagtgctt

SEQ ID NO: 695940 - DNA, 25 bp, Mus musculus
gtgaaggctctgaagatcgtcatcc

SEQ ID NO: 695941 - DNA, 25 bp, Mus musculus
gtgaaggctctgtagatcgtcatcc

SEQ ID NO: 695942 - DNA, 25 bp, Mus musculus
gtgaaggctgtcagcccagagaaat

SEQ ID NO: 695943 - DNA, 25 bp, Mus musculus
gtgaaggctgtctgcccagagaaat

SEQ ID NO: 695944 - DNA, 25 bp, Mus musculus
gtgaagggatgcagcaccgataata

SEQ ID NO: 695945 - DNA, 25 bp, Mus musculus
gtgaagggatgctgcaccgataata

SEQ ID NO: 695946 - DNA, 25 bp, Mus musculus
gtgaagggcaccactaacacaacct

SEQ ID NO: 695947 - DNA, 25 bp, Mus musculus
gtgaagggcacctctaacacaacct

SEQ ID NO: 695948 - DNA, 25 bp, Mus musculus
gtgaagggcactagaccaatactgt

SEQ ID NO: 695949 - DNA, 25 bp, Mus musculus
gtgaagggcacttgaccaatactgt

SEQ ID NO: 695950 - DNA, 25 bp, Mus musculus
gtgaagggccaacgaccctgagctt

SEQ ID NO: 695951 - DNA, 25 bp, Mus musculus
gtgaagggccaaggaccctgagctt

SEQ ID NO: 695952 - DNA, 25 bp, Mus musculus
gtgaagggccagacgggcttcctaa

SEQ ID NO: 695953 - DNA, 25 bp, Mus musculus
gtgaagggccagtcgggcttcctaa

SEQ ID NO: 695954 - DNA, 25 bp, Mus musculus
gtgaagggctagaaccaggctctgc

SEQ ID NO: 695955 - DNA, 25 bp, Mus musculus
gtgaagggctagtaccaggctctgc

SEQ ID NO: 695956 - DNA, 25 bp, Mus musculus
gtgaagggctgtccaccttgtacta

SEQ ID NO: 695957 - DNA, 25 bp, Mus musculus
gtgaagggctgtgcaccttgtacta

SEQ ID NO: 695958 - DNA, 25 bp, Mus musculus
gtgaagggcttcaacaccctgccgt

SEQ ID NO: 695959 - DNA, 25 bp, Mus musculus
gtgaagggcttcatcttaatctgca

SEQ ID NO: 695960 - DNA, 25 bp, Mus musculus
gtgaagggcttctacaccctgccgt

SEQ ID NO: 695961 - DNA, 25 bp, Mus musculus
gtgaagggcttcttcttaatctgca

SEQ ID NO: 695962 - DNA, 25 bp, Mus musculus
gtgaagggtactcgttctcttgtgc

SEQ ID NO: 695963 - DNA, 25 bp, Mus musculus
gtgaagggtactggttctcttgtgc

SEQ ID NO: 695964 - DNA, 25 bp, Mus musculus
gtgaagggtcccatacaggtgtatc

SEQ ID NO: 695965 - DNA, 25 bp, Mus musculus
gtgaagggtcccttacaggtgtatc

SEQ ID NO: 695966 - DNA, 25 bp, Mus musculus
gtgaagggtctgagttttaccaagt

SEQ ID NO: 695967 - DNA, 25 bp, Mus musculus
gtgaagggtctgtgttttaccaagt

SEQ ID NO: 695968 - DNA, 25 bp, Mus musculus
gtgaagggtgtgagtttaaatccca

SEQ ID NO: 695969 - DNA, 25 bp, Mus musculus
gtgaagggtgtgtgtttaaatccca

SEQ ID NO: 695970 - DNA, 25 bp, Mus musculus
gtgaaggtcagaatgcaagcccaga

SEQ ID NO: 695971 - DNA, 25 bp, Mus musculus
gtgaaggtcagattgcaagcccaga

SEQ ID NO: 695972 - DNA, 25 bp, Mus musculus
gtgaaggtcattaaaaactcggcta

SEQ ID NO: 695973 - DNA, 25 bp, Mus musculus
gtgaaggtcattctactgcctgtgc

SEQ ID NO: 695974 - DNA, 25 bp, Mus musculus
gtgaaggtcattgtactgcctgtgc

SEQ ID NO: 695975 - DNA, 25 bp, Mus musculus
gtgaaggtcatttaaaactcggcta

SEQ ID NO: 695976 - DNA, 25 bp, Mus musculus
gtgaaggtcgttacgccacatggaa

SEQ ID NO: 695977 - DNA, 25 bp, Mus musculus
gtgaaggtcgtttcgccacatggaa

SEQ ID NO: 695978 - DNA, 25 bp, Mus musculus
gtgaaggtctatacctggctgcaca

SEQ ID NO: 695979 - DNA, 25 bp, Mus musculus
gtgaaggtctattcctggctgcaca

SEQ ID NO: 695980 - DNA, 25 bp, Mus musculus
gtgaaggtctgacagtagctcttag

SEQ ID NO: 695981 - DNA, 25 bp, Mus musculus
gtgaaggtctgagagtagctcttag

SEQ ID NO: 695982 - DNA, 25 bp, Mus musculus
gtgaaggtctggattcccaggccac

SEQ ID NO: 695983 - DNA, 25 bp, Mus musculus
gtgaaggtctggtttcccaggccac

SEQ ID NO: 695984 - DNA, 25 bp, Mus musculus
gtgaaggtgactatccgcctagaca

SEQ ID NO: 695985 - DNA, 25 bp, Mus musculus
gtgaaggtgactttccgcctagaca

SEQ ID NO: 695986 - DNA, 25 bp, Mus musculus
gtgaaggtgcacaggatctaccgtg

SEQ ID NO: 695987 - DNA, 25 bp, Mus musculus
gtgaaggtgcactggatctaccgtg

SEQ ID NO: 695988 - DNA, 25 bp, Mus musculus
gtgaaggtggctcgcaacagttcct

SEQ ID NO: 695989 - DNA, 25 bp, Mus musculus
gtgaaggtggctggcaacagttcct

SEQ ID NO: 695990 - DNA, 25 bp, Mus musculus
gtgaaggttcagacattccagatga

SEQ ID NO: 695991 - DNA, 25 bp, Mus musculus
gtgaaggttcagtcattccagatga

SEQ ID NO: 695992 - DNA, 25 bp, Mus musculus
gtgaaggtttcgaccatgccactgt

SEQ ID NO: 695993 - DNA, 25 bp, Mus musculus
gtgaaggtttcgtccatgccactgt

SEQ ID NO: 695994 - DNA, 25 bp, Mus musculus
gtgaagtacacccagtttactgtgt

SEQ ID NO: 695995 - DNA, 25 bp, Mus musculus
gtgaagtacaccgagtttactgtgt

SEQ ID NO: 695996 - DNA, 25 bp, Mus musculus
gtgaagtacggtcaccttcttccag

SEQ ID NO: 695997 - DNA, 25 bp, Mus musculus
gtgaagtacggtgaccttcttccag

SEQ ID NO: 695998 - DNA, 25 bp, Mus musculus
gtgaagtacgttcttcctggccctt

SEQ ID NO: 695999 - DNA, 25 bp, Mus musculus
gtgaagtacgttgttcctggccctt

SEQ ID NO: 696000 - DNA, 25 bp, Mus musculus
gtgaagtactgtcctgtccatgatc

SEQ ID NO: 696001 - DNA, 25 bp, Mus musculus
gtgaagtactgtgctgtccatgatc

SEQ ID NO: 696002 - DNA, 25 bp, Mus musculus
gtgaagtatcaaacatccaagatgc

SEQ ID NO: 696003 - DNA, 25 bp, Mus musculus
gtgaagtatcaatcatccaagatgc

SEQ ID NO: 696004 - DNA, 25 bp, Mus musculus
gtgaagtatcctatccctaagtaca

SEQ ID NO: 696005 - DNA, 25 bp, Mus musculus
gtgaagtatcctttccctaagtaca

SEQ ID NO: 696006 - DNA, 25 bp, Mus musculus
gtgaagtcaaacctgattgtccatc

SEQ ID NO: 696007 - DNA, 25 bp, Mus musculus
gtgaagtcaaacgtgattgtccatc

SEQ ID NO: 696008 - DNA, 25 bp, Mus musculus
gtgaagtcaaatccatgccgacctt

SEQ ID NO: 696009 - DNA, 25 bp, Mus musculus
gtgaagtcaaatgcatgccgacctt

SEQ ID NO: 696010 - DNA, 25 bp, Mus musculus
gtgaagtcaccacctgcgaggaaca

SEQ ID NO: 696011 - DNA, 25 bp, Mus musculus
gtgaagtcaccacgttttcagtttt

SEQ ID NO: 696012 - DNA, 25 bp, Mus musculus
gtgaagtcaccagctgcgaggaaca

SEQ ID NO: 696013 - DNA, 25 bp, Mus musculus
gtgaagtcaccaggttttcagtttt

SEQ ID NO: 696014 - DNA, 25 bp, Mus musculus
gtgaagtcacctctttacgaaacca

SEQ ID NO: 696015 - DNA, 25 bp, Mus musculus
gtgaagtcacctgtttacgaaacca

SEQ ID NO: 696016 - DNA, 25 bp, Mus musculus
gtgaagtcagcgctccgactgagca

SEQ ID NO: 696017 - DNA, 25 bp, Mus musculus
gtgaagtcagcggtccgactgagca

SEQ ID NO: 696018 - DNA, 25 bp, Mus musculus
gtgaagtcagtcaaggacagccact

SEQ ID NO: 696019 - DNA, 25 bp, Mus musculus
gtgaagtcagtcaccttgagtccaa

SEQ ID NO: 696020 - DNA, 25 bp, Mus musculus
gtgaagtcagtctaggacagccact

SEQ ID NO: 696021 - DNA, 25 bp, Mus musculus
gtgaagtcagtctccttgagtccaa

SEQ ID NO: 696022 - DNA, 25 bp, Mus musculus
gtgaagtcatctcgttggacacttt

SEQ ID NO: 696023 - DNA, 25 bp, Mus musculus
gtgaagtcatctggttggacacttt

SEQ ID NO: 696024 - DNA, 25 bp, Mus musculus
gtgaagtccacaaactgcattccat

SEQ ID NO: 696025 - DNA, 25 bp, Mus musculus
gtgaagtccacatactgcattccat

SEQ ID NO: 696026 - DNA, 25 bp, Mus musculus
gtgaagtccagcaggcccttagcca

SEQ ID NO: 696027 - DNA, 25 bp, Mus musculus
gtgaagtccagctggcccttagcca

SEQ ID NO: 696028 - DNA, 25 bp, Mus musculus
gtgaagtccagtcaagcaggtacaa

SEQ ID NO: 696029 - DNA, 25 bp, Mus musculus
gtgaagtccagtgaagcaggtacaa

SEQ ID NO: 696030 - DNA, 25 bp, Mus musculus
gtgaagtccatcaccatggtcatta

SEQ ID NO: 696031 - DNA, 25 bp, Mus musculus
gtgaagtccatctccatggtcatta

SEQ ID NO: 696032 - DNA, 25 bp, Mus musculus
gtgaagtcccggcaaacacaatggg

SEQ ID NO: 696033 - DNA, 25 bp, Mus musculus
gtgaagtcccgggaaacacaatggg

SEQ ID NO: 696034 - DNA, 25 bp, Mus musculus
gtgaagtccgagctgtcttggaact

SEQ ID NO: 696035 - DNA, 25 bp, Mus musculus
gtgaagtccgaggtgtcttggaact

SEQ ID NO: 696036 - DNA, 25 bp, Mus musculus
gtgaagtcgaccactgtgtacattt

SEQ ID NO: 696037 - DNA, 25 bp, Mus musculus
gtgaagtcgaccagagcacaccaca

SEQ ID NO: 696038 - DNA, 25 bp, Mus musculus
gtgaagtcgacctctgtgtacattt

SEQ ID NO: 696039 - DNA, 25 bp, Mus musculus
gtgaagtcgacctgagcacaccaca

SEQ ID NO: 696040 - DNA, 25 bp, Mus musculus
gtgaagtcgtagacgggttcatcta

SEQ ID NO: 696041 - DNA, 25 bp, Mus musculus
gtgaagtcgtagtcgggttcatcta

SEQ ID NO: 696042 - DNA, 25 bp, Mus musculus
gtgaagtcttaacttgtctcctaag

SEQ ID NO: 696043 - DNA, 25 bp, Mus musculus
gtgaagtcttaagttgtctcctaag

SEQ ID NO: 696044 - DNA, 25 bp, Mus musculus
gtgaagtcttgtacatatatggcct

SEQ ID NO: 696045 - DNA, 25 bp, Mus musculus
gtgaagtcttgttcatatatggcct

SEQ ID NO: 696046 - DNA, 25 bp, Mus musculus
gtgaagtcttttagtcttgtagctt

SEQ ID NO: 696047 - DNA, 25 bp, Mus musculus
gtgaagtctttttgtcttgtagctt

SEQ ID NO: 696048 - DNA, 25 bp, Mus musculus
gtgaagtgaattcctgtgctctgaa

SEQ ID NO: 696049 - DNA, 25 bp, Mus musculus
gtgaagtgaattgctgtgctctgaa

SEQ ID NO: 696050 - DNA, 25 bp, Mus musculus
gtgaagtgcttcctgctacatagag

SEQ ID NO: 696051 - DNA, 25 bp, Mus musculus
gtgaagtgcttcgtgctacatagag

SEQ ID NO: 696052 - DNA, 25 bp, Mus musculus
gtgaagtggaaaccttaccttttct

SEQ ID NO: 696053 - DNA, 25 bp, Mus musculus
gtgaagtggaaagcttaccttttct

SEQ ID NO: 696054 - DNA, 25 bp, Mus musculus
gtgaagtggccacacaatatagtga

SEQ ID NO: 696055 - DNA, 25 bp, Mus musculus
gtgaagtggccagacaatatagtga

SEQ ID NO: 696056 - DNA, 25 bp, Mus musculus
gtgaagtggcctctgaagccctacc

SEQ ID NO: 696057 - DNA, 25 bp, Mus musculus
gtgaagtggcctgtgaagccctacc

SEQ ID NO: 696058 - DNA, 25 bp, Mus musculus
gtgaagtggctcaatactgttttat

SEQ ID NO: 696059 - DNA, 25 bp, Mus musculus
gtgaagtggctctatactgttttat

SEQ ID NO: 696060 - DNA, 25 bp, Mus musculus
gtgaagtgtactatagacagtctag

SEQ ID NO: 696061 - DNA, 25 bp, Mus musculus
gtgaagtgtactttagacagtctag

SEQ ID NO: 696062 - DNA, 25 bp, Mus musculus
gtgaagtgtgccacccttatatggt

SEQ ID NO: 696063 - DNA, 25 bp, Mus musculus
gtgaagtgtgcctcccttatatggt

SEQ ID NO: 696064 - DNA, 25 bp, Mus musculus
gtgaagtgtgctctgtttcctttac

SEQ ID NO: 696065 - DNA, 25 bp, Mus musculus
gtgaagtgtgctgtgtttcctttac

SEQ ID NO: 696066 - DNA, 25 bp, Mus musculus
gtgaagtgttgccaatttccccgta

SEQ ID NO: 696067 - DNA, 25 bp, Mus musculus
gtgaagtgttgcgaatttccccgta

SEQ ID NO: 696068 - DNA, 25 bp, Mus musculus
gtgaagtgtttaaagccttgcttaa

SEQ ID NO: 696069 - DNA, 25 bp, Mus musculus
gtgaagtgtttatagccttgcttaa

SEQ ID NO: 696070 - DNA, 25 bp, Mus musculus
gtgaagttaaacacccagagactat

SEQ ID NO: 696071 - DNA, 25 bp, Mus musculus
gtgaagttaaactcccagagactat

SEQ ID NO: 696072 - DNA, 25 bp, Mus musculus
gtgaagttacgtctacatttcttta

SEQ ID NO: 696073 - DNA, 25 bp, Mus musculus
gtgaagttacgtgtacatttcttta

SEQ ID NO: 696074 - DNA, 25 bp, Mus musculus
gtgaagttactaatttgaccatgat

SEQ ID NO: 696075 - DNA, 25 bp, Mus musculus
gtgaagttactattttgaccatgat

SEQ ID NO: 696076 - DNA, 25 bp, Mus musculus
gtgaagttagtcacataatgtaggt

SEQ ID NO: 696077 - DNA, 25 bp, Mus musculus
gtgaagttagtctcataatgtaggt

SEQ ID NO: 696078 - DNA, 25 bp, Mus musculus
gtgaagttatcccaaggttagcata

SEQ ID NO: 696079 - DNA, 25 bp, Mus musculus
gtgaagttatccgaaggttagcata

SEQ ID NO: 696080 - DNA, 25 bp, Mus musculus
gtgaagttatctctttcttaccgaa

SEQ ID NO: 696081 - DNA, 25 bp, Mus musculus
gtgaagttatctgtttcttaccgaa

SEQ ID NO: 696082 - DNA, 25 bp, Mus musculus
gtgaagttatgtcggctgtttcttt

SEQ ID NO: 696083 - DNA, 25 bp, Mus musculus
gtgaagttatgtgggctgtttcttt

SEQ ID NO: 696084 - DNA, 25 bp, Mus musculus
gtgaagttcactaccatttgtcaag

SEQ ID NO: 696085 - DNA, 25 bp, Mus musculus
gtgaagttcacttccatttgtcaag

SEQ ID NO: 696086 - DNA, 25 bp, Mus musculus
gtgaagttcagccagtgtcttaaga

SEQ ID NO: 696087 - DNA, 25 bp, Mus musculus
gtgaagttcagcgagtgtcttaaga

SEQ ID NO: 696088 - DNA, 25 bp, Mus musculus
gtgaagttgacaactactgatttgt

SEQ ID NO: 696089 - DNA, 25 bp, Mus musculus
gtgaagttgacatctactgatttgt

SEQ ID NO: 696090 - DNA, 25 bp, Mus musculus
gtgaagttgcgcagtcggaccagcc

SEQ ID NO: 696091 - DNA, 25 bp, Mus musculus
gtgaagttgcgctgtcggaccagcc

SEQ ID NO: 696092 - DNA, 25 bp, Mus musculus
gtgaagttgctgagttggtctgaaa

SEQ ID NO: 696093 - DNA, 25 bp, Mus musculus
gtgaagttgctgtgttggtctgaaa

SEQ ID NO: 696094 - DNA, 25 bp, Mus musculus
gtgaagttgcttctagattccccac

SEQ ID NO: 696095 - DNA, 25 bp, Mus musculus
gtgaagttgcttgtagattccccac

SEQ ID NO: 696096 - DNA, 25 bp, Mus musculus
gtgaagttggcgagtttttctaaat

SEQ ID NO: 696097 - DNA, 25 bp, Mus musculus
gtgaagttggcgtgtttttctaaat

SEQ ID NO: 696098 - DNA, 25 bp, Mus musculus
gtgaagtttataacatgtaccccaa

SEQ ID NO: 696099 - DNA, 25 bp, Mus musculus
gtgaagtttatatcatgtaccccaa

SEQ ID NO: 696100 - DNA, 25 bp, Mus musculus
gtgaagtttccactctacagtcatc

SEQ ID NO: 696101 - DNA, 25 bp, Mus musculus
gtgaagtttccagtctacagtcatc

SEQ ID NO: 696102 - DNA, 25 bp, Mus musculus
gtgaagttttgaagtcatttctttt

SEQ ID NO: 696103 - DNA, 25 bp, Mus musculus
gtgaagttttgatgtcatttctttt

SEQ ID NO: 696104 - DNA, 25 bp, Mus musculus
gtgaataaacttatgagggacagcg

SEQ ID NO: 696105 - DNA, 25 bp, Mus musculus
gtgaataaacttttgagggacagcg

SEQ ID NO: 696106 - DNA, 25 bp, Mus musculus
gtgaataacacccaggaacacttag

SEQ ID NO: 696107 - DNA, 25 bp, Mus musculus
gtgaataacaccgaggaacacttag

SEQ ID NO: 696108 - DNA, 25 bp, Mus musculus
gtgaataacgccctggtcccagtgg

SEQ ID NO: 696109 - DNA, 25 bp, Mus musculus
gtgaataacgccgtggtcccagtgg

SEQ ID NO: 696110 - DNA, 25 bp, Mus musculus
gtgaataacttgacttgcgttgatc

SEQ ID NO: 696111 - DNA, 25 bp, Mus musculus
gtgaataacttgtcttgcgttgatc

SEQ ID NO: 696112 - DNA, 25 bp, Mus musculus
gtgaataaggccagaaccccaggat

SEQ ID NO: 696113 - DNA, 25 bp, Mus musculus
gtgaataaggcctgaaccccaggat

SEQ ID NO: 696114 - DNA, 25 bp, Mus musculus
gtgaataatctcctgtaaatgtgtt

SEQ ID NO: 696115 - DNA, 25 bp, Mus musculus
gtgaataatctcgtgtaaatgtgtt

SEQ ID NO: 696116 - DNA, 25 bp, Mus musculus
gtgaataatgctatatttccctgta

SEQ ID NO: 696117 - DNA, 25 bp, Mus musculus
gtgaataatgctttatttccctgta

SEQ ID NO: 696118 - DNA, 25 bp, Mus musculus
gtgaataattaacggcaagcagata

SEQ ID NO: 696119 - DNA, 25 bp, Mus musculus
gtgaataattaagggcaagcagata

SEQ ID NO: 696120 - DNA, 25 bp, Mus musculus
gtgaatacacatacatactaatcta

SEQ ID NO: 696121 - DNA, 25 bp, Mus musculus
gtgaatacacattcatactaatcta

SEQ ID NO: 696122 - DNA, 25 bp, Mus musculus
gtgaatacaccgacactgtctttag

SEQ ID NO: 696123 - DNA, 25 bp, Mus musculus
gtgaatacaccgtcactgtctttag

SEQ ID NO: 696124 - DNA, 25 bp, Mus musculus
gtgaatacacgcaacccaaaggaac

SEQ ID NO: 696125 - DNA, 25 bp, Mus musculus
gtgaatacacgctacccaaaggaac

SEQ ID NO: 696126 - DNA, 25 bp, Mus musculus
gtgaatacaggtcatgagccatctt

SEQ ID NO: 696127 - DNA, 25 bp, Mus musculus
gtgaatacaggtgatgagccatctt

SEQ ID NO: 696128 - DNA, 25 bp, Mus musculus
gtgaatacatatatgctcagctgat

SEQ ID NO: 696129 - DNA, 25 bp, Mus musculus
gtgaatacatatttgctcagctgat

SEQ ID NO: 696130 - DNA, 25 bp, Mus musculus
gtgaataccagaactcgcgtttgca

SEQ ID NO: 696131 - DNA, 25 bp, Mus musculus
gtgaataccagatctcgcgtttgca

SEQ ID NO: 696132 - DNA, 25 bp, Mus musculus
gtgaatacccagacgccataaaaag

SEQ ID NO: 696133 - DNA, 25 bp, Mus musculus
gtgaatacccagtcgccataaaaag

SEQ ID NO: 696134 - DNA, 25 bp, Mus musculus
gtgaatactcaacaaactgcccttc

SEQ ID NO: 696135 - DNA, 25 bp, Mus musculus
gtgaatactcaagaaactgcccttc

SEQ ID NO: 696136 - DNA, 25 bp, Mus musculus
gtgaatactgcaagctcgagtccac

SEQ ID NO: 696137 - DNA, 25 bp, Mus musculus
gtgaatactgcatgctcgagtccac

SEQ ID NO: 696138 - DNA, 25 bp, Mus musculus
gtgaatactgtaaccaccctgaagt

SEQ ID NO: 696139 - DNA, 25 bp, Mus musculus
gtgaatactgtatccaccctgaagt

SEQ ID NO: 696140 - DNA, 25 bp, Mus musculus
gtgaatactgtgacaccagttctga

SEQ ID NO: 696141 - DNA, 25 bp, Mus musculus
gtgaatactgtgtcaccagttctga

SEQ ID NO: 696142 - DNA, 25 bp, Mus musculus
gtgaatacttaaccttacatggcaa

SEQ ID NO: 696143 - DNA, 25 bp, Mus musculus
gtgaatacttaagcttacatggcaa

SEQ ID NO: 696144 - DNA, 25 bp, Mus musculus
gtgaatacttgcatgtctttggaca

SEQ ID NO: 696145 - DNA, 25 bp, Mus musculus
gtgaatacttgcttgtctttggaca

SEQ ID NO: 696146 - DNA, 25 bp, Mus musculus
gtgaatagacagcttcgcaccacac

SEQ ID NO: 696147 - DNA, 25 bp, Mus musculus
gtgaatagacaggttcgcaccacac

SEQ ID NO: 696148 - DNA, 25 bp, Mus musculus
gtgaatagctccaaaccacttggtg

SEQ ID NO: 696149 - DNA, 25 bp, Mus musculus
gtgaatagctcctaaccacttggtg

SEQ ID NO: 696150 - DNA, 25 bp, Mus musculus
gtgaatagctggagtgcacaacccc

SEQ ID NO: 696151 - DNA, 25 bp, Mus musculus
gtgaatagctggtgtgcacaacccc

SEQ ID NO: 696152 - DNA, 25 bp, Mus musculus
gtgaatagtggtctcctcaaaattt

SEQ ID NO: 696153 - DNA, 25 bp, Mus musculus
gtgaatagtggtgtcctcaaaattt

SEQ ID NO: 696154 - DNA, 25 bp, Mus musculus
gtgaatagttctacccaggactggg

SEQ ID NO: 696155 - DNA, 25 bp, Mus musculus
gtgaatagttcttcccaggactggg

SEQ ID NO: 696156 - DNA, 25 bp, Mus musculus
gtgaatatcagtccagaagcccatg

SEQ ID NO: 696157 - DNA, 25 bp, Mus musculus
gtgaatatcagtgcagaagcccatg

SEQ ID NO: 696158 - DNA, 25 bp, Mus musculus
gtgaatatcgttatgttcctccgat

SEQ ID NO: 696159 - DNA, 25 bp, Mus musculus
gtgaatatcgttttgttcctccgat

SEQ ID NO: 696160 - DNA, 25 bp, Mus musculus
gtgaatatctataaccttcagcagg

SEQ ID NO: 696161 - DNA, 25 bp, Mus musculus
gtgaatatctattaccttcagcagg

SEQ ID NO: 696162 - DNA, 25 bp, Mus musculus
gtgaatatctctaattagtctgctt

SEQ ID NO: 696163 - DNA, 25 bp, Mus musculus
gtgaatatctcttattagtctgctt

SEQ ID NO: 696164 - DNA, 25 bp, Mus musculus
gtgaatatcttcaacgggagcggct

SEQ ID NO: 696165 - DNA, 25 bp, Mus musculus
gtgaatatcttcaactcaggacatc

SEQ ID NO: 696166 - DNA, 25 bp, Mus musculus
gtgaatatcttcaccaggtcatatt

SEQ ID NO: 696167 - DNA, 25 bp, Mus musculus
gtgaatatcttcaggaagcaccttc

SEQ ID NO: 696168 - DNA, 25 bp, Mus musculus
gtgaatatcttctacgggagcggct

SEQ ID NO: 696169 - DNA, 25 bp, Mus musculus
gtgaatatcttctactcaggacatc

SEQ ID NO: 696170 - DNA, 25 bp, Mus musculus
gtgaatatcttctccaggtcatatt

SEQ ID NO: 696171 - DNA, 25 bp, Mus musculus
gtgaatatcttctggaagcaccttc

SEQ ID NO: 696172 - DNA, 25 bp, Mus musculus
gtgaatatctttatccttctcttaa

SEQ ID NO: 696173 - DNA, 25 bp, Mus musculus
gtgaatatctttttccttctcttaa

SEQ ID NO: 696174 - DNA, 25 bp, Mus musculus
gtgaatatgactaccagcattacct

SEQ ID NO: 696175 - DNA, 25 bp, Mus musculus
gtgaatatgacttccagcattacct

SEQ ID NO: 696176 - DNA, 25 bp, Mus musculus
gtgaatatgcaaatgcgtgtttaca

SEQ ID NO: 696177 - DNA, 25 bp, Mus musculus
gtgaatatgcaattgcgtgtttaca

SEQ ID NO: 696178 - DNA, 25 bp, Mus musculus
gtgaatatgctcaaggaccttaaaa

SEQ ID NO: 696179 - DNA, 25 bp, Mus musculus
gtgaatatgctctaggaccttaaaa

SEQ ID NO: 696180 - DNA, 25 bp, Mus musculus
gtgaatattcacaaccttattgcaa

SEQ ID NO: 696181 - DNA, 25 bp, Mus musculus
gtgaatattcactaccttattgcaa

SEQ ID NO: 696182 - DNA, 25 bp, Mus musculus
gtgaatattgcccatctagtgaaat

SEQ ID NO: 696183 - DNA, 25 bp, Mus musculus
gtgaatattgccgatctagtgaaat

SEQ ID NO: 696184 - DNA, 25 bp, Mus musculus
gtgaatatttcaccaaagctgggaa

SEQ ID NO: 696185 - DNA, 25 bp, Mus musculus
gtgaatatttcagcaaagctgggaa

SEQ ID NO: 696186 - DNA, 25 bp, Mus musculus
gtgaatcaacccatggagtacctgg

SEQ ID NO: 696187 - DNA, 25 bp, Mus musculus
gtgaatcaacccttggagtacctgg

SEQ ID NO: 696188 - DNA, 25 bp, Mus musculus
gtgaatcaaggacccgcttttccgc

SEQ ID NO: 696189 - DNA, 25 bp, Mus musculus
gtgaatcaaggagccgcttttccgc

SEQ ID NO: 696190 - DNA, 25 bp, Mus musculus
gtgaatcaatgtattacctgtgtgt

SEQ ID NO: 696191 - DNA, 25 bp, Mus musculus
gtgaatcaatgttttacctgtgtgt

SEQ ID NO: 696192 - DNA, 25 bp, Mus musculus
gtgaatcacaacagttatcacttgt

SEQ ID NO: 696193 - DNA, 25 bp, Mus musculus
gtgaatcacaactgttatcacttgt

SEQ ID NO: 696194 - DNA, 25 bp, Mus musculus
gtgaatcacagtctacctcagcctt

SEQ ID NO: 696195 - DNA, 25 bp, Mus musculus
gtgaatcacagtgtacctcagcctt

SEQ ID NO: 696196 - DNA, 25 bp, Mus musculus
gtgaatcaccagaccatgacaacgt

SEQ ID NO: 696197 - DNA, 25 bp, Mus musculus
gtgaatcaccagtccatgacaacgt

SEQ ID NO: 696198 - DNA, 25 bp, Mus musculus
gtgaatcagaatagtcctctcttcc

SEQ ID NO: 696199 - DNA, 25 bp, Mus musculus
gtgaatcagaattgtcctctcttcc

SEQ ID NO: 696200 - DNA, 25 bp, Mus musculus
gtgaatcaggtgaactggccgtcct

SEQ ID NO: 696201 - DNA, 25 bp, Mus musculus
gtgaatcaggtgtactggccgtcct

SEQ ID NO: 696202 - DNA, 25 bp, Mus musculus
gtgaatcatagtagactcagtcatg

SEQ ID NO: 696203 - DNA, 25 bp, Mus musculus
gtgaatcatagttgactcagtcatg

SEQ ID NO: 696204 - DNA, 25 bp, Mus musculus
gtgaatcattacactagctgctcag

SEQ ID NO: 696205 - DNA, 25 bp, Mus musculus
gtgaatcattacagactccctagtc

SEQ ID NO: 696206 - DNA, 25 bp, Mus musculus
gtgaatcattactctagctgctcag

SEQ ID NO: 696207 - DNA, 25 bp, Mus musculus
gtgaatcattactgactccctagtc

SEQ ID NO: 696208 - DNA, 25 bp, Mus musculus
gtgaatcattgcctttttgttttta

SEQ ID NO: 696209 - DNA, 25 bp, Mus musculus
gtgaatcattgcgtttttgttttta

SEQ ID NO: 696210 - DNA, 25 bp, Mus musculus
gtgaatccaatgacacactgggcat

SEQ ID NO: 696211 - DNA, 25 bp, Mus musculus
gtgaatccaatgtcacactgggcat

SEQ ID NO: 696212 - DNA, 25 bp, Mus musculus
gtgaatccacatatggaatttctga

SEQ ID NO: 696213 - DNA, 25 bp, Mus musculus
gtgaatccacatttggaatttctga

SEQ ID NO: 696214 - DNA, 25 bp, Mus musculus
gtgaatccagcacttcagtgtcatt

SEQ ID NO: 696215 - DNA, 25 bp, Mus musculus
gtgaatccagcagttcagtgtcatt

SEQ ID NO: 696216 - DNA, 25 bp, Mus musculus
gtgaatcccaacaaaaggctagcct

SEQ ID NO: 696217 - DNA, 25 bp, Mus musculus
gtgaatcccaactaaaggctagcct

SEQ ID NO: 696218 - DNA, 25 bp, Mus musculus
gtgaatcctgacaatttacatcctt

SEQ ID NO: 696219 - DNA, 25 bp, Mus musculus
gtgaatcctgactatttacatcctt

SEQ ID NO: 696220 - DNA, 25 bp, Mus musculus
gtgaatcctgcacatgtaagcgttc

SEQ ID NO: 696221 - DNA, 25 bp, Mus musculus
gtgaatcctgcagatgtaagcgttc

SEQ ID NO: 696222 - DNA, 25 bp, Mus musculus
gtgaatcgagttctttttagtcctt

SEQ ID NO: 696223 - DNA, 25 bp, Mus musculus
gtgaatcgagttgtttttagtcctt

SEQ ID NO: 696224 - DNA, 25 bp, Mus musculus
gtgaatcgccatcaagatcctagaa

SEQ ID NO: 696225 - DNA, 25 bp, Mus musculus
gtgaatcgccatgaagatcctagaa

SEQ ID NO: 696226 - DNA, 25 bp, Mus musculus
gtgaatcgtcacagtccattagtta

SEQ ID NO: 696227 - DNA, 25 bp, Mus musculus
gtgaatcgtcactgtccattagtta

SEQ ID NO: 696228 - DNA, 25 bp, Mus musculus
gtgaatctaagcaacaggaggctca

SEQ ID NO: 696229 - DNA, 25 bp, Mus musculus
gtgaatctaagctacaggaggctca

SEQ ID NO: 696230 - DNA, 25 bp, Mus musculus
gtgaatctacctcacaaccaagctg

SEQ ID NO: 696231 - DNA, 25 bp, Mus musculus
gtgaatctacctgacaaccaagctg

SEQ ID NO: 696232 - DNA, 25 bp, Mus musculus
gtgaatctagacactggccatcctg

SEQ ID NO: 696233 - DNA, 25 bp, Mus musculus
gtgaatctagactctggccatcctg

SEQ ID NO: 696234 - DNA, 25 bp, Mus musculus
gtgaatctatccaaaccagaaaaat

SEQ ID NO: 696235 - DNA, 25 bp, Mus musculus
gtgaatctatcctaaccagaaaaat

SEQ ID NO: 696236 - DNA, 25 bp, Mus musculus
gtgaatctcagaaccattgggcctt

SEQ ID NO: 696237 - DNA, 25 bp, Mus musculus
gtgaatctcagactattataaacgt

SEQ ID NO: 696238 - DNA, 25 bp, Mus musculus
gtgaatctcagagtattataaacgt

SEQ ID NO: 696239 - DNA, 25 bp, Mus musculus
gtgaatctcagatccattgggcctt

SEQ ID NO: 696240 - DNA, 25 bp, Mus musculus
gtgaatctcaggctccatgtcagtt

SEQ ID NO: 696241 - DNA, 25 bp, Mus musculus
gtgaatctcagggtccatgtcagtt

SEQ ID NO: 696242 - DNA, 25 bp, Mus musculus
gtgaatctcctaatatcttacaaaa

SEQ ID NO: 696243 - DNA, 25 bp, Mus musculus
gtgaatctcctattatcttacaaaa

SEQ ID NO: 696244 - DNA, 25 bp, Mus musculus
gtgaatctctatatgtcattttgta

SEQ ID NO: 696245 - DNA, 25 bp, Mus musculus
gtgaatctctatttgtcattttgta

SEQ ID NO: 696246 - DNA, 25 bp, Mus musculus
gtgaatctctctacatctctaacca

SEQ ID NO: 696247 - DNA, 25 bp, Mus musculus
gtgaatctctctcccgtggtatggc

SEQ ID NO: 696248 - DNA, 25 bp, Mus musculus
gtgaatctctctgccgtggtatggc

SEQ ID NO: 696249 - DNA, 25 bp, Mus musculus
gtgaatctctcttcatctctaacca

SEQ ID NO: 696250 - DNA, 25 bp, Mus musculus
gtgaatctgaatcaggcaactgcca

SEQ ID NO: 696251 - DNA, 25 bp, Mus musculus
gtgaatctgaatgaggcaactgcca

SEQ ID NO: 696252 - DNA, 25 bp, Mus musculus
gtgaatctgattagatccttgccct

SEQ ID NO: 696253 - DNA, 25 bp, Mus musculus
gtgaatctgatttgatccttgccct

SEQ ID NO: 696254 - DNA, 25 bp, Mus musculus
gtgaatctgtacagcattttccctt

SEQ ID NO: 696255 - DNA, 25 bp, Mus musculus
gtgaatctgtactgcattttccctt

SEQ ID NO: 696256 - DNA, 25 bp, Mus musculus
gtgaatctgtcaattctcatcagag

SEQ ID NO: 696257 - DNA, 25 bp, Mus musculus
gtgaatctgtcatttctcatcagag

SEQ ID NO: 696258 - DNA, 25 bp, Mus musculus
gtgaatctgtgtaggagtccaccga

SEQ ID NO: 696259 - DNA, 25 bp, Mus musculus
gtgaatctgtgttggagtccaccga

SEQ ID NO: 696260 - DNA, 25 bp, Mus musculus
gtgaatcttaaaaatgtactccctt

SEQ ID NO: 696261 - DNA, 25 bp, Mus musculus
gtgaatcttaaatatgtactccctt

SEQ ID NO: 696262 - DNA, 25 bp, Mus musculus
gtgaatcttcacacagtcctcagcg

SEQ ID NO: 696263 - DNA, 25 bp, Mus musculus
gtgaatcttcactcagtcctcagcg

SEQ ID NO: 696264 - DNA, 25 bp, Mus musculus
gtgaatcttttcatgcgtgatcagg

SEQ ID NO: 696265 - DNA, 25 bp, Mus musculus
gtgaatcttttcttgcgtgatcagg

SEQ ID NO: 696266 - DNA, 25 bp, Mus musculus
gtgaatgaaccccagctgtcatcgc

SEQ ID NO: 696267 - DNA, 25 bp, Mus musculus
gtgaatgaacccgagctgtcatcgc

SEQ ID NO: 696268 - DNA, 25 bp, Mus musculus
gtgaatgaactcaagctgctccagg

SEQ ID NO: 696269 - DNA, 25 bp, Mus musculus
gtgaatgaactctagctgctccagg

SEQ ID NO: 696270 - DNA, 25 bp, Mus musculus
gtgaatgaagatctggtggcctcca

SEQ ID NO: 696271 - DNA, 25 bp, Mus musculus
gtgaatgaagatgtggtggcctcca

SEQ ID NO: 696272 - DNA, 25 bp, Mus musculus
gtgaatgaataaaccttgaagaatg

SEQ ID NO: 696273 - DNA, 25 bp, Mus musculus
gtgaatgaataatccttgaagaatg

SEQ ID NO: 696274 - DNA, 25 bp, Mus musculus
gtgaatgaatgtaccatctgcaaga

SEQ ID NO: 696275 - DNA, 25 bp, Mus musculus
gtgaatgaatgttccatctgcaaga

SEQ ID NO: 696276 - DNA, 25 bp, Mus musculus
gtgaatgacaagacctggtccccta

SEQ ID NO: 696277 - DNA, 25 bp, Mus musculus
gtgaatgacaagtcctggtccccta

SEQ ID NO: 696278 - DNA, 25 bp, Mus musculus
gtgaatgacctgcacttgctaagaa

SEQ ID NO: 696279 - DNA, 25 bp, Mus musculus
gtgaatgacctggacttgctaagaa

SEQ ID NO: 696280 - DNA, 25 bp, Mus musculus
gtgaatgaccttcttctacggttct

SEQ ID NO: 696281 - DNA, 25 bp, Mus musculus
gtgaatgaccttgttctacggttct

SEQ ID NO: 696282 - DNA, 25 bp, Mus musculus
gtgaatgactccaattgtgaccagg

SEQ ID NO: 696283 - DNA, 25 bp, Mus musculus
gtgaatgactcctattgtgaccagg

SEQ ID NO: 696284 - DNA, 25 bp, Mus musculus
gtgaatgagacaagatcctgggctg

SEQ ID NO: 696285 - DNA, 25 bp, Mus musculus
gtgaatgagacatgatcctgggctg

SEQ ID NO: 696286 - DNA, 25 bp, Mus musculus
gtgaatgagccgctaactgctacca

SEQ ID NO: 696287 - DNA, 25 bp, Mus musculus
gtgaatgagccggtaactgctacca

SEQ ID NO: 696288 - DNA, 25 bp, Mus musculus
gtgaatgagtaaaaaagttgtgtct

SEQ ID NO: 696289 - DNA, 25 bp, Mus musculus
gtgaatgagtaataaagttgtgtct

SEQ ID NO: 696290 - DNA, 25 bp, Mus musculus
gtgaatgatcacaacccaaatggaa

SEQ ID NO: 696291 - DNA, 25 bp, Mus musculus
gtgaatgatcactacccaaatggaa

SEQ ID NO: 696292 - DNA, 25 bp, Mus musculus
gtgaatgatcccataaagccggagt

SEQ ID NO: 696293 - DNA, 25 bp, Mus musculus
gtgaatgatcccttaaagccggagt

SEQ ID NO: 696294 - DNA, 25 bp, Mus musculus
gtgaatgcaagactctcaaacctga

SEQ ID NO: 696295 - DNA, 25 bp, Mus musculus
gtgaatgcaagagtctcaaacctga

SEQ ID NO: 696296 - DNA, 25 bp, Mus musculus
gtgaatgcacagagaaccccttcct

SEQ ID NO: 696297 - DNA, 25 bp, Mus musculus
gtgaatgcacagtgaaccccttcct

SEQ ID NO: 696298 - DNA, 25 bp, Mus musculus
gtgaatgcagccacgctagcagtga

SEQ ID NO: 696299 - DNA, 25 bp, Mus musculus
gtgaatgcagcctcgctagcagtga

SEQ ID NO: 696300 - DNA, 25 bp, Mus musculus
gtgaatgcattcaaaactggttgtg

SEQ ID NO: 696301 - DNA, 25 bp, Mus musculus
gtgaatgcattctaaactggttgtg

SEQ ID NO: 696302 - DNA, 25 bp, Mus musculus
gtgaatgccagcagggtcggccttt

SEQ ID NO: 696303 - DNA, 25 bp, Mus musculus
gtgaatgccagctgggtcggccttt

SEQ ID NO: 696304 - DNA, 25 bp, Mus musculus
gtgaatgccaggacgcctaggaaac

SEQ ID NO: 696305 - DNA, 25 bp, Mus musculus
gtgaatgccaggtcgcctaggaaac

SEQ ID NO: 696306 - DNA, 25 bp, Mus musculus
gtgaatgcccaaagggcctactcat

SEQ ID NO: 696307 - DNA, 25 bp, Mus musculus
gtgaatgcccaatgggcctactcat

SEQ ID NO: 696308 - DNA, 25 bp, Mus musculus
gtgaatgccctaagaactgtcctgg

SEQ ID NO: 696309 - DNA, 25 bp, Mus musculus
gtgaatgccctatgaactgtcctgg

SEQ ID NO: 696310 - DNA, 25 bp, Mus musculus
gtgaatgcctttccttcattttcat

SEQ ID NO: 696311 - DNA, 25 bp, Mus musculus
gtgaatgcctttgcttcattttcat

SEQ ID NO: 696312 - DNA, 25 bp, Mus musculus
gtgaatgctcatccagccgccggtg

SEQ ID NO: 696313 - DNA, 25 bp, Mus musculus
gtgaatgctcatgcagccgccggtg

SEQ ID NO: 696314 - DNA, 25 bp, Mus musculus
gtgaatgctgcacactgcacacact

SEQ ID NO: 696315 - DNA, 25 bp, Mus musculus
gtgaatgctgcacctcatctaggaa

SEQ ID NO: 696316 - DNA, 25 bp, Mus musculus
gtgaatgctgcagactgcacacact

SEQ ID NO: 696317 - DNA, 25 bp, Mus musculus
gtgaatgctgcagctcatctaggaa

SEQ ID NO: 696318 - DNA, 25 bp, Mus musculus
gtgaatgctgctcacacgagccaaa

SEQ ID NO: 696319 - DNA, 25 bp, Mus musculus
gtgaatgctgctgacacgagccaaa

SEQ ID NO: 696320 - DNA, 25 bp, Mus musculus
gtgaatgctggtattgtgagccatg

SEQ ID NO: 696321 - DNA, 25 bp, Mus musculus
gtgaatgctggttttgtgagccatg

SEQ ID NO: 696322 - DNA, 25 bp, Mus musculus
gtgaatgcttacacttgccacacag

SEQ ID NO: 696323 - DNA, 25 bp, Mus musculus
gtgaatgcttactcttgccacacag

SEQ ID NO: 696324 - DNA, 25 bp, Mus musculus
gtgaatggacagatgcagctcccaa

SEQ ID NO: 696325 - DNA, 25 bp, Mus musculus
gtgaatggacagttgcagctcccaa

SEQ ID NO: 696326 - DNA, 25 bp, Mus musculus
gtgaatggatggctacttttgaaca

SEQ ID NO: 696327 - DNA, 25 bp, Mus musculus
gtgaatggatgggtacttttgaaca

SEQ ID NO: 696328 - DNA, 25 bp, Mus musculus
gtgaatggcctacagaacctatttt

SEQ ID NO: 696329 - DNA, 25 bp, Mus musculus
gtgaatggcctagagaacctatttt

SEQ ID NO: 696330 - DNA, 25 bp, Mus musculus
gtgaatggcgggaacagaactgccc

SEQ ID NO: 696331 - DNA, 25 bp, Mus musculus
gtgaatggcgggtacagaactgccc

SEQ ID NO: 696332 - DNA, 25 bp, Mus musculus
gtgaatggctatctggctcaaccag

SEQ ID NO: 696333 - DNA, 25 bp, Mus musculus
gtgaatggctatgtggctcaaccag

SEQ ID NO: 696334 - DNA, 25 bp, Mus musculus
gtgaatgggcatcctttaaaggctt

SEQ ID NO: 696335 - DNA, 25 bp, Mus musculus
gtgaatgggcatgctttaaaggctt

SEQ ID NO: 696336 - DNA, 25 bp, Mus musculus
gtgaatggtctcagaatttagtggt

SEQ ID NO: 696337 - DNA, 25 bp, Mus musculus
gtgaatggtctctgaatttagtggt

SEQ ID NO: 696338 - DNA, 25 bp, Mus musculus
gtgaatggtctgctctctgtgagaa

SEQ ID NO: 696339 - DNA, 25 bp, Mus musculus
gtgaatggtctggtctctgtgagaa

SEQ ID NO: 696340 - DNA, 25 bp, Mus musculus
gtgaatgtaattcctctgcctcgtc

SEQ ID NO: 696341 - DNA, 25 bp, Mus musculus
gtgaatgtaattgctctgcctcgtc

SEQ ID NO: 696342 - DNA, 25 bp, Mus musculus
gtgaatgtacaaattccagtgcagt

SEQ ID NO: 696343 - DNA, 25 bp, Mus musculus
gtgaatgtacaatttccagtgcagt

SEQ ID NO: 696344 - DNA, 25 bp, Mus musculus
gtgaatgtagcacaaccccaccagg

SEQ ID NO: 696345 - DNA, 25 bp, Mus musculus
gtgaatgtagcagaaccccaccagg

SEQ ID NO: 696346 - DNA, 25 bp, Mus musculus
gtgaatgtagctcagcttccagagg

SEQ ID NO: 696347 - DNA, 25 bp, Mus musculus
gtgaatgtagctgagcttccagagg

SEQ ID NO: 696348 - DNA, 25 bp, Mus musculus
gtgaatgtatggctgacccactcca

SEQ ID NO: 696349 - DNA, 25 bp, Mus musculus
gtgaatgtatgggtgacccactcca

SEQ ID NO: 696350 - DNA, 25 bp, Mus musculus
gtgaatgtatttctgacacccaggt

SEQ ID NO: 696351 - DNA, 25 bp, Mus musculus
gtgaatgtatttgtgacacccaggt

SEQ ID NO: 696352 - DNA, 25 bp, Mus musculus
gtgaatgtcatgaagttgtctcgct

SEQ ID NO: 696353 - DNA, 25 bp, Mus musculus
gtgaatgtcatgtagttgtctcgct

SEQ ID NO: 696354 - DNA, 25 bp, Mus musculus
gtgaatgtcgacagaccaatccttg

SEQ ID NO: 696355 - DNA, 25 bp, Mus musculus
gtgaatgtcgactgaccaatccttg

SEQ ID NO: 696356 - DNA, 25 bp, Mus musculus
gtgaatgtgagtatgcccagcggca

SEQ ID NO: 696357 - DNA, 25 bp, Mus musculus
gtgaatgtgagtttgcccagcggca

SEQ ID NO: 696358 - DNA, 25 bp, Mus musculus
gtgaatgtgcatatctgatcagctg

SEQ ID NO: 696359 - DNA, 25 bp, Mus musculus
gtgaatgtgcatttctgatcagctg

SEQ ID NO: 696360 - DNA, 25 bp, Mus musculus
gtgaatgtgcttcccgcaagccctg

SEQ ID NO: 696361 - DNA, 25 bp, Mus musculus
gtgaatgtgcttgccgcaagccctg

SEQ ID NO: 696362 - DNA, 25 bp, Mus musculus
gtgaatgtgtccacaaatcccaccc

SEQ ID NO: 696363 - DNA, 25 bp, Mus musculus
gtgaatgtgtcctcaaatcccaccc

SEQ ID NO: 696364 - DNA, 25 bp, Mus musculus
gtgaatgtgtctacttacatccatt

SEQ ID NO: 696365 - DNA, 25 bp, Mus musculus
gtgaatgtgtcttcttacatccatt

SEQ ID NO: 696366 - DNA, 25 bp, Mus musculus
gtgaatgttgacaacctgaggttta

SEQ ID NO: 696367 - DNA, 25 bp, Mus musculus
gtgaatgttgactacctgaggttta

SEQ ID NO: 696368 - DNA, 25 bp, Mus musculus
gtgaatgtttacctgatgatgcaaa

SEQ ID NO: 696369 - DNA, 25 bp, Mus musculus
gtgaatgtttacgtgatgatgcaaa

SEQ ID NO: 696370 - DNA, 25 bp, Mus musculus
gtgaatgtttctacagtttcttgtt

SEQ ID NO: 696371 - DNA, 25 bp, Mus musculus
gtgaatgtttcttcagtttcttgtt

SEQ ID NO: 696372 - DNA, 25 bp, Mus musculus
gtgaatgtttgcacatgtgaccagc

SEQ ID NO: 696373 - DNA, 25 bp, Mus musculus
gtgaatgtttgctcatgtgaccagc

SEQ ID NO: 696374 - DNA, 25 bp, Mus musculus
gtgaatgttttaagcaccaacgtta

SEQ ID NO: 696375 - DNA, 25 bp, Mus musculus
gtgaatgttttatgcaccaacgtta

SEQ ID NO: 696376 - DNA, 25 bp, Mus musculus
gtgaatgtttttctagctaaattgt

SEQ ID NO: 696377 - DNA, 25 bp, Mus musculus
gtgaatgtttttgtagctaaattgt

SEQ ID NO: 696378 - DNA, 25 bp, Mus musculus
gtgaattaaataaccatgtcctctg

SEQ ID NO: 696379 - DNA, 25 bp, Mus musculus
gtgaattaaatatccatgtcctctg

SEQ ID NO: 696380 - DNA, 25 bp, Mus musculus
gtgaattaagcaacccatctgcgtt

SEQ ID NO: 696381 - DNA, 25 bp, Mus musculus
gtgaattaagcatcccatctgcgtt

SEQ ID NO: 696382 - DNA, 25 bp, Mus musculus
gtgaattaatctactcctcgtatgg

SEQ ID NO: 696383 - DNA, 25 bp, Mus musculus
gtgaattaatcttctcctcgtatgg

SEQ ID NO: 696384 - DNA, 25 bp, Mus musculus
gtgaattacataacactcaaatttt

SEQ ID NO: 696385 - DNA, 25 bp, Mus musculus
gtgaattacatatcactcaaatttt

SEQ ID NO: 696386 - DNA, 25 bp, Mus musculus
gtgaattaccatctttttgaaccga

SEQ ID NO: 696387 - DNA, 25 bp, Mus musculus
gtgaattaccatgtttttgaaccga

SEQ ID NO: 696388 - DNA, 25 bp, Mus musculus
gtgaattactggaactccaacgtga

SEQ ID NO: 696389 - DNA, 25 bp, Mus musculus
gtgaattactggtactccaacgtga

SEQ ID NO: 696390 - DNA, 25 bp, Mus musculus
gtgaattagacacagaccatcataa

SEQ ID NO: 696391 - DNA, 25 bp, Mus musculus
gtgaattagacagagaccatcataa

SEQ ID NO: 696392 - DNA, 25 bp, Mus musculus
gtgaattagtaaaccagtaggctaa

SEQ ID NO: 696393 - DNA, 25 bp, Mus musculus
gtgaattagtaaaggtcactaccaa

SEQ ID NO: 696394 - DNA, 25 bp, Mus musculus
gtgaattagtaatccagtaggctaa

SEQ ID NO: 696395 - DNA, 25 bp, Mus musculus
gtgaattagtaatggtcactaccaa

SEQ ID NO: 696396 - DNA, 25 bp, Mus musculus
gtgaattagtgaccccaagtctgag

SEQ ID NO: 696397 - DNA, 25 bp, Mus musculus
gtgaattagtgagcccaagtctgag

SEQ ID NO: 696398 - DNA, 25 bp, Mus musculus
gtgaattattatacttccctccttg

SEQ ID NO: 696399 - DNA, 25 bp, Mus musculus
gtgaattattattcttccctccttg

SEQ ID NO: 696400 - DNA, 25 bp, Mus musculus
gtgaattattggacagttagcttat

SEQ ID NO: 696401 - DNA, 25 bp, Mus musculus
gtgaattattggtcagttagcttat

SEQ ID NO: 696402 - DNA, 25 bp, Mus musculus
gtgaattcaagtacgcataatgcct

SEQ ID NO: 696403 - DNA, 25 bp, Mus musculus
gtgaattcaagttcgcataatgcct

SEQ ID NO: 696404 - DNA, 25 bp, Mus musculus
gtgaattcacacaatttctcgtcaa

SEQ ID NO: 696405 - DNA, 25 bp, Mus musculus
gtgaattcacactatttctcgtcaa

SEQ ID NO: 696406 - DNA, 25 bp, Mus musculus
gtgaattcactcattggttcttcct

SEQ ID NO: 696407 - DNA, 25 bp, Mus musculus
gtgaattcactctttggttcttcct

SEQ ID NO: 696408 - DNA, 25 bp, Mus musculus
gtgaattcagatatacctcaatact

SEQ ID NO: 696409 - DNA, 25 bp, Mus musculus
gtgaattcagatttacctcaatact

SEQ ID NO: 696410 - DNA, 25 bp, Mus musculus
gtgaattcagtaatggccaagtcca

SEQ ID NO: 696411 - DNA, 25 bp, Mus musculus
gtgaattcagtattggccaagtcca

SEQ ID NO: 696412 - DNA, 25 bp, Mus musculus
gtgaattcattacttccgtctatta

SEQ ID NO: 696413 - DNA, 25 bp, Mus musculus
gtgaattcattagttccgtctatta

SEQ ID NO: 696414 - DNA, 25 bp, Mus musculus
gtgaattccaacatggctcagccat

SEQ ID NO: 696415 - DNA, 25 bp, Mus musculus
gtgaattccaacttggctcagccat

SEQ ID NO: 696416 - DNA, 25 bp, Mus musculus
gtgaattccatccaggttcttgctt

SEQ ID NO: 696417 - DNA, 25 bp, Mus musculus
gtgaattccatcgaggttcttgctt

SEQ ID NO: 696418 - DNA, 25 bp, Mus musculus
gtgaattccatgatgaagccagata

SEQ ID NO: 696419 - DNA, 25 bp, Mus musculus
gtgaattccatgttgaagccagata

SEQ ID NO: 696420 - DNA, 25 bp, Mus musculus
gtgaattcccagacagacaggacta

SEQ ID NO: 696421 - DNA, 25 bp, Mus musculus
gtgaattcccagtcagacaggacta

SEQ ID NO: 696422 - DNA, 25 bp, Mus musculus
gtgaattcccttatattcatgagaa

SEQ ID NO: 696423 - DNA, 25 bp, Mus musculus
gtgaattcccttcatccgatgagtc

SEQ ID NO: 696424 - DNA, 25 bp, Mus musculus
gtgaattcccttgatccgatgagtc

SEQ ID NO: 696425 - DNA, 25 bp, Mus musculus
gtgaattcccttttattcatgagaa

SEQ ID NO: 696426 - DNA, 25 bp, Mus musculus
gtgaattcctcaaggtggccgagta

SEQ ID NO: 696427 - DNA, 25 bp, Mus musculus
gtgaattcctcatggtggccgagta

SEQ ID NO: 696428 - DNA, 25 bp, Mus musculus
gtgaattctattactggtacttaag

SEQ ID NO: 696429 - DNA, 25 bp, Mus musculus
gtgaattctatttctggtacttaag

SEQ ID NO: 696430 - DNA, 25 bp, Mus musculus
gtgaattctgctcaccaagtgctgg

SEQ ID NO: 696431 - DNA, 25 bp, Mus musculus
gtgaattctgctgaccaagtgctgg

SEQ ID NO: 696432 - DNA, 25 bp, Mus musculus
gtgaattctgtaagatgcctgccct

SEQ ID NO: 696433 - DNA, 25 bp, Mus musculus
gtgaattctgtatgatgcctgccct

SEQ ID NO: 696434 - DNA, 25 bp, Mus musculus
gtgaattctgtgctcgatctttccg

SEQ ID NO: 696435 - DNA, 25 bp, Mus musculus
gtgaattctgtggtcgatctttccg

SEQ ID NO: 696436 - DNA, 25 bp, Mus musculus
gtgaattcttacagtattctgtgaa

SEQ ID NO: 696437 - DNA, 25 bp, Mus musculus
gtgaattcttactgtattctgtgaa

SEQ ID NO: 696438 - DNA, 25 bp, Mus musculus
gtgaattcttcaagtgatgctcttc

SEQ ID NO: 696439 - DNA, 25 bp, Mus musculus
gtgaattcttcatgtgatgctcttc

SEQ ID NO: 696440 - DNA, 25 bp, Mus musculus
gtgaattcttgcatgtgatgtcaaa

SEQ ID NO: 696441 - DNA, 25 bp, Mus musculus
gtgaattcttgcttgtgatgtcaaa

SEQ ID NO: 696442 - DNA, 25 bp, Mus musculus
gtgaattctttgcaatcatatcttc

SEQ ID NO: 696443 - DNA, 25 bp, Mus musculus
gtgaattctttggaatcatatcttc

SEQ ID NO: 696444 - DNA, 25 bp, Mus musculus
gtgaattcttttccctgagatgcta

SEQ ID NO: 696445 - DNA, 25 bp, Mus musculus
gtgaattcttttgcctgagatgcta

SEQ ID NO: 696446 - DNA, 25 bp, Mus musculus
gtgaattgcaaaacaagcatcgctt

SEQ ID NO: 696447 - DNA, 25 bp, Mus musculus
gtgaattgcaaatcaagcatcgctt

SEQ ID NO: 696448 - DNA, 25 bp, Mus musculus
gtgaattgctggagatgcaccttaa

SEQ ID NO: 696449 - DNA, 25 bp, Mus musculus
gtgaattgctggtgatgcaccttaa

SEQ ID NO: 696450 - DNA, 25 bp, Mus musculus
gtgaattgtaggcactgcaaacctt

SEQ ID NO: 696451 - DNA, 25 bp, Mus musculus
gtgaattgtagggactgcaaacctt

SEQ ID NO: 696452 - DNA, 25 bp, Mus musculus
gtgaattgtatgctttcccaggtga

SEQ ID NO: 696453 - DNA, 25 bp, Mus musculus
gtgaattgtatggtttcccaggtga

SEQ ID NO: 696454 - DNA, 25 bp, Mus musculus
gtgaattgtcccagcatgacctaaa

SEQ ID NO: 696455 - DNA, 25 bp, Mus musculus
gtgaattgtccctgcatgacctaaa

SEQ ID NO: 696456 - DNA, 25 bp, Mus musculus
gtgaatttaagtatctaagtccaat

SEQ ID NO: 696457 - DNA, 25 bp, Mus musculus
gtgaatttaagtttctaagtccaat

SEQ ID NO: 696458 - DNA, 25 bp, Mus musculus
gtgaatttaatcacaggatggtgaa

SEQ ID NO: 696459 - DNA, 25 bp, Mus musculus
gtgaatttaatctcaggatggtgaa

SEQ ID NO: 696460 - DNA, 25 bp, Mus musculus
gtgaatttacacaccagcattgaca

SEQ ID NO: 696461 - DNA, 25 bp, Mus musculus
gtgaatttacactccagcattgaca

SEQ ID NO: 696462 - DNA, 25 bp, Mus musculus
gtgaatttacttccaagaaaatcaa

SEQ ID NO: 696463 - DNA, 25 bp, Mus musculus
gtgaatttacttgcaagaaaatcaa

SEQ ID NO: 696464 - DNA, 25 bp, Mus musculus
gtgaatttcactcccttatattatt

SEQ ID NO: 696465 - DNA, 25 bp, Mus musculus
gtgaatttcactgccttatattatt

SEQ ID NO: 696466 - DNA, 25 bp, Mus musculus
gtgaatttcataatggccagagcta

SEQ ID NO: 696467 - DNA, 25 bp, Mus musculus
gtgaatttcatattggccagagcta

SEQ ID NO: 696468 - DNA, 25 bp, Mus musculus
gtgaatttccagctctacaactaag

SEQ ID NO: 696469 - DNA, 25 bp, Mus musculus
gtgaatttccaggtctacaactaag

SEQ ID NO: 696470 - DNA, 25 bp, Mus musculus
gtgaatttcccactaagagacctgg

SEQ ID NO: 696471 - DNA, 25 bp, Mus musculus
gtgaatttcccagtaagagacctgg

SEQ ID NO: 696472 - DNA, 25 bp, Mus musculus
gtgaatttcctaccgaaacctaatg

SEQ ID NO: 696473 - DNA, 25 bp, Mus musculus
gtgaatttcctagcgaaacctaatg

SEQ ID NO: 696474 - DNA, 25 bp, Mus musculus
gtgaatttcttaatgagcctacagt

SEQ ID NO: 696475 - DNA, 25 bp, Mus musculus
gtgaatttcttattgagcctacagt

SEQ ID NO: 696476 - DNA, 25 bp, Mus musculus
gtgaatttcttgatgctttgcataa

SEQ ID NO: 696477 - DNA, 25 bp, Mus musculus
gtgaatttcttgttgctttgcataa

SEQ ID NO: 696478 - DNA, 25 bp, Mus musculus
gtgaatttgacaatgtgcactccaa

SEQ ID NO: 696479 - DNA, 25 bp, Mus musculus
gtgaatttgacattgtgcactccaa

SEQ ID NO: 696480 - DNA, 25 bp, Mus musculus
gtgaatttgattcgctgcatcctct

SEQ ID NO: 696481 - DNA, 25 bp, Mus musculus
gtgaatttgattggctgcatcctct

SEQ ID NO: 696482 - DNA, 25 bp, Mus musculus
gtgaatttgcatctagagcagaaga

SEQ ID NO: 696483 - DNA, 25 bp, Mus musculus
gtgaatttgcatgtagagcagaaga

SEQ ID NO: 696484 - DNA, 25 bp, Mus musculus
gtgaatttgctgacgtgttttttac

SEQ ID NO: 696485 - DNA, 25 bp, Mus musculus
gtgaatttgctgtcgtgttttttac

SEQ ID NO: 696486 - DNA, 25 bp, Mus musculus
gtgaattttcacaaatccggtacga

SEQ ID NO: 696487 - DNA, 25 bp, Mus musculus
gtgaattttcactaatccggtacga

SEQ ID NO: 696488 - DNA, 25 bp, Mus musculus
gtgaattttcatacctcaagggcag

SEQ ID NO: 696489 - DNA, 25 bp, Mus musculus
gtgaattttcattcctcaagggcag

SEQ ID NO: 696490 - DNA, 25 bp, Mus musculus
gtgaattttggccacctgctaggtg

SEQ ID NO: 696491 - DNA, 25 bp, Mus musculus
gtgaattttggcgacctgctaggtg

SEQ ID NO: 696492 - DNA, 25 bp, Mus musculus
gtgaattttgttaacagcatccaat

SEQ ID NO: 696493 - DNA, 25 bp, Mus musculus
gtgaattttgtttacagcatccaat

SEQ ID NO: 696494 - DNA, 25 bp, Mus musculus
gtgacaaaaggacagtattctacag

SEQ ID NO: 696495 - DNA, 25 bp, Mus musculus
gtgacaaaaggagagtattctacag

SEQ ID NO: 696496 - DNA, 25 bp, Mus musculus
gtgacaaacactaggtcggcctgct

SEQ ID NO: 696497 - DNA, 25 bp, Mus musculus
gtgacaaacacttggtcggcctgct

SEQ ID NO: 696498 - DNA, 25 bp, Mus musculus
gtgacaaacagcagaggtgataaag

SEQ ID NO: 696499 - DNA, 25 bp, Mus musculus
gtgacaaacagctgaggtgataaag

SEQ ID NO: 696500 - DNA, 25 bp, Mus musculus
gtgacaaacgttactctgtctaaca

SEQ ID NO: 696501 - DNA, 25 bp, Mus musculus
gtgacaaacgtttctctgtctaaca

SEQ ID NO: 696502 - DNA, 25 bp, Mus musculus
gtgacaaagaaaaccctgaaatggc

SEQ ID NO: 696503 - DNA, 25 bp, Mus musculus
gtgacaaagaaatccctgaaatggc

SEQ ID NO: 696504 - DNA, 25 bp, Mus musculus
gtgacaaagatcatcacattttgct

SEQ ID NO: 696505 - DNA, 25 bp, Mus musculus
gtgacaaagatcttcacattttgct

SEQ ID NO: 696506 - DNA, 25 bp, Mus musculus
gtgacaaaggagaccatgccccgtt

SEQ ID NO: 696507 - DNA, 25 bp, Mus musculus
gtgacaaaggagtccatgccccgtt

SEQ ID NO: 696508 - DNA, 25 bp, Mus musculus
gtgacaaaggttcagccagccctgt

SEQ ID NO: 696509 - DNA, 25 bp, Mus musculus
gtgacaaaggttgagccagccctgt

SEQ ID NO: 696510 - DNA, 25 bp, Mus musculus
gtgacaaataacatagccttctttt

SEQ ID NO: 696511 - DNA, 25 bp, Mus musculus
gtgacaaataacttagccttctttt

SEQ ID NO: 696512 - DNA, 25 bp, Mus musculus
gtgacaaatcaaccagttctgccca

SEQ ID NO: 696513 - DNA, 25 bp, Mus musculus
gtgacaaatcaagcagttctgccca

SEQ ID NO: 696514 - DNA, 25 bp, Mus musculus
gtgacaaatcccaagtttgtggacc

SEQ ID NO: 696515 - DNA, 25 bp, Mus musculus
gtgacaaatccctagtttgtggacc

SEQ ID NO: 696516 - DNA, 25 bp, Mus musculus
gtgacaaatcctatatccagcgttc

SEQ ID NO: 696517 - DNA, 25 bp, Mus musculus
gtgacaaatcctttatccagcgttc

SEQ ID NO: 696518 - DNA, 25 bp, Mus musculus
gtgacaaatcttattataagtgctt

SEQ ID NO: 696519 - DNA, 25 bp, Mus musculus
gtgacaaatctttttataagtgctt

SEQ ID NO: 696520 - DNA, 25 bp, Mus musculus
gtgacaaattagataatccaagcag

SEQ ID NO: 696521 - DNA, 25 bp, Mus musculus
gtgacaaattagttaatccaagcag

SEQ ID NO: 696522 - DNA, 25 bp, Mus musculus
gtgacaacaattatattttgctatt

SEQ ID NO: 696523 - DNA, 25 bp, Mus musculus
gtgacaacaattttattttgctatt

SEQ ID NO: 696524 - DNA, 25 bp, Mus musculus
gtgacaacacacagagactatcctt

SEQ ID NO: 696525 - DNA, 25 bp, Mus musculus
gtgacaacacactgagactatcctt

SEQ ID NO: 696526 - DNA, 25 bp, Mus musculus
gtgacaacacccctatacacaggtg

SEQ ID NO: 696527 - DNA, 25 bp, Mus musculus
gtgacaacacccgtatacacaggtg

SEQ ID NO: 696528 - DNA, 25 bp, Mus musculus
gtgacaacacctatatctattggat

SEQ ID NO: 696529 - DNA, 25 bp, Mus musculus
gtgacaacacctttatctattggat

SEQ ID NO: 696530 - DNA, 25 bp, Mus musculus
gtgacaacactgatgcgggcgtgtt

SEQ ID NO: 696531 - DNA, 25 bp, Mus musculus
gtgacaacactgttgcgggcgtgtt

SEQ ID NO: 696532 - DNA, 25 bp, Mus musculus
gtgacaacacttctttctcagcaaa

SEQ ID NO: 696533 - DNA, 25 bp, Mus musculus
gtgacaacacttgtttctcagcaaa

SEQ ID NO: 696534 - DNA, 25 bp, Mus musculus
gtgacaacagggagtttccttatgc

SEQ ID NO: 696535 - DNA, 25 bp, Mus musculus
gtgacaacagggtgtttccttatgc

SEQ ID NO: 696536 - DNA, 25 bp, Mus musculus
gtgacaacatcaactgtggcagcta

SEQ ID NO: 696537 - DNA, 25 bp, Mus musculus
gtgacaacatcatctgtggcagcta

SEQ ID NO: 696538 - DNA, 25 bp, Mus musculus
gtgacaaccattcggttttcttcct

SEQ ID NO: 696539 - DNA, 25 bp, Mus musculus
gtgacaaccattgggttttcttcct

SEQ ID NO: 696540 - DNA, 25 bp, Mus musculus
gtgacaacccacatcagatgcatgt

SEQ ID NO: 696541 - DNA, 25 bp, Mus musculus
gtgacaacccacttcagatgcatgt

SEQ ID NO: 696542 - DNA, 25 bp, Mus musculus
gtgacaaccgcaccgagcacagcta

SEQ ID NO: 696543 - DNA, 25 bp, Mus musculus
gtgacaaccgcagcgagcacagcta

SEQ ID NO: 696544 - DNA, 25 bp, Mus musculus
gtgacaacctgcctttcaagttaca

SEQ ID NO: 696545 - DNA, 25 bp, Mus musculus
gtgacaacctgcgtttcaagttaca

SEQ ID NO: 696546 - DNA, 25 bp, Mus musculus
gtgacaacgtcaactgacatctctg

SEQ ID NO: 696547 - DNA, 25 bp, Mus musculus
gtgacaacgtcatctgacatctctg

SEQ ID NO: 696548 - DNA, 25 bp, Mus musculus
gtgacaactaccaccttctgtggga

SEQ ID NO: 696549 - DNA, 25 bp, Mus musculus
gtgacaactacctccttctgtggga

SEQ ID NO: 696550 - DNA, 25 bp, Mus musculus
gtgacaactctcaggaatcagtcct

SEQ ID NO: 696551 - DNA, 25 bp, Mus musculus
gtgacaactctctggaatcagtcct

SEQ ID NO: 696552 - DNA, 25 bp, Mus musculus
gtgacaactgtcctgagattctact

SEQ ID NO: 696553 - DNA, 25 bp, Mus musculus
gtgacaactgtcgtgagattctact

SEQ ID NO: 696554 - DNA, 25 bp, Mus musculus
gtgacaacttccaggaccaaggctt

SEQ ID NO: 696555 - DNA, 25 bp, Mus musculus
gtgacaacttcctggaccaaggctt

SEQ ID NO: 696556 - DNA, 25 bp, Mus musculus
gtgacaagaacaatattaatctgaa

SEQ ID NO: 696557 - DNA, 25 bp, Mus musculus
gtgacaagaacattattaatctgaa

SEQ ID NO: 696558 - DNA, 25 bp, Mus musculus
gtgacaagaaccacatcgactctat

SEQ ID NO: 696559 - DNA, 25 bp, Mus musculus
gtgacaagaacctcatcgactctat

SEQ ID NO: 696560 - DNA, 25 bp, Mus musculus
gtgacaagacgtattcaaatccttc

SEQ ID NO: 696561 - DNA, 25 bp, Mus musculus
gtgacaagacgttttcaaatccttc

SEQ ID NO: 696562 - DNA, 25 bp, Mus musculus
gtgacaagcagaaaccatgtctagg

SEQ ID NO: 696563 - DNA, 25 bp, Mus musculus
gtgacaagcagataccatgtctagg

SEQ ID NO: 696564 - DNA, 25 bp, Mus musculus
gtgacaagcagtaaagttggctgga

SEQ ID NO: 696565 - DNA, 25 bp, Mus musculus
gtgacaagcagttaagttggctgga

SEQ ID NO: 696566 - DNA, 25 bp, Mus musculus
gtgacaagcattagtggttcgatct

SEQ ID NO: 696567 - DNA, 25 bp, Mus musculus
gtgacaagcatttgtggttcgatct

SEQ ID NO: 696568 - DNA, 25 bp, Mus musculus
gtgacaagccatccagcattgctga

SEQ ID NO: 696569 - DNA, 25 bp, Mus musculus
gtgacaagccatgcagcattgctga

SEQ ID NO: 696570 - DNA, 25 bp, Mus musculus
gtgacaagcctcataccataaacag

SEQ ID NO: 696571 - DNA, 25 bp, Mus musculus
gtgacaagcctcttaccataaacag

SEQ ID NO: 696572 - DNA, 25 bp, Mus musculus
gtgacaagcgtgcactatacttctg

SEQ ID NO: 696573 - DNA, 25 bp, Mus musculus
gtgacaagcgtggactatacttctg

SEQ ID NO: 696574 - DNA, 25 bp, Mus musculus
gtgacaagctgtccaaagatcccgt

SEQ ID NO: 696575 - DNA, 25 bp, Mus musculus
gtgacaagctgtgcaaagatcccgt

SEQ ID NO: 696576 - DNA, 25 bp, Mus musculus
gtgacaagctttctcgggtacctct

SEQ ID NO: 696577 - DNA, 25 bp, Mus musculus
gtgacaagctttctctaagcaggat

SEQ ID NO: 696578 - DNA, 25 bp, Mus musculus
gtgacaagctttgtcgggtacctct

SEQ ID NO: 696579 - DNA, 25 bp, Mus musculus
gtgacaagctttgtctaagcaggat

SEQ ID NO: 696580 - DNA, 25 bp, Mus musculus
gtgacaaggacaagggactcctccc

SEQ ID NO: 696581 - DNA, 25 bp, Mus musculus
gtgacaaggacatgggactcctccc

SEQ ID NO: 696582 - DNA, 25 bp, Mus musculus
gtgacaaggctcaagacctgcttgg

SEQ ID NO: 696583 - DNA, 25 bp, Mus musculus
gtgacaaggctctagacctgcttgg

SEQ ID NO: 696584 - DNA, 25 bp, Mus musculus
gtgacaagggcccttacctactgag

SEQ ID NO: 696585 - DNA, 25 bp, Mus musculus
gtgacaagggccgttacctactgag

SEQ ID NO: 696586 - DNA, 25 bp, Mus musculus
gtgacaaggtcaaagtccgccacag

SEQ ID NO: 696587 - DNA, 25 bp, Mus musculus
gtgacaaggtcatagtccgccacag

SEQ ID NO: 696588 - DNA, 25 bp, Mus musculus
gtgacaaggtgtagccaaactcagt

SEQ ID NO: 696589 - DNA, 25 bp, Mus musculus
gtgacaaggtgttgccaaactcagt

SEQ ID NO: 696590 - DNA, 25 bp, Mus musculus
gtgacaaggtttcaccctgccataa

SEQ ID NO: 696591 - DNA, 25 bp, Mus musculus
gtgacaaggtttgaccctgccataa

SEQ ID NO: 696592 - DNA, 25 bp, Mus musculus
gtgacaagtaagaaggacttggtct

SEQ ID NO: 696593 - DNA, 25 bp, Mus musculus
gtgacaagtaagtaggacttggtct

SEQ ID NO: 696594 - DNA, 25 bp, Mus musculus
gtgacaagtcacagccttatggtgt

SEQ ID NO: 696595 - DNA, 25 bp, Mus musculus
gtgacaagtcactgccttatggtgt

SEQ ID NO: 696596 - DNA, 25 bp, Mus musculus
gtgacaagtgcaccctgagccctca

SEQ ID NO: 696597 - DNA, 25 bp, Mus musculus
gtgacaagtgcagcctgagccctca

SEQ ID NO: 696598 - DNA, 25 bp, Mus musculus
gtgacaagtgccacgacccactgag

SEQ ID NO: 696599 - DNA, 25 bp, Mus musculus
gtgacaagtgcctcgacccactgag

SEQ ID NO: 696600 - DNA, 25 bp, Mus musculus
gtgacaagtgttacacgcaccccag

SEQ ID NO: 696601 - DNA, 25 bp, Mus musculus
gtgacaagtgttctgctgtttggtc

SEQ ID NO: 696602 - DNA, 25 bp, Mus musculus
gtgacaagtgttgtgctgtttggtc

SEQ ID NO: 696603 - DNA, 25 bp, Mus musculus
gtgacaagtgtttcacgcaccccag

SEQ ID NO: 696604 - DNA, 25 bp, Mus musculus
gtgacaagtttaacgaggccctggg

SEQ ID NO: 696605 - DNA, 25 bp, Mus musculus
gtgacaagtttatcgaggccctggg

SEQ ID NO: 696606 - DNA, 25 bp, Mus musculus
gtgacaagtttgaccaatcttggtt

SEQ ID NO: 696607 - DNA, 25 bp, Mus musculus
gtgacaagtttgtccaatcttggtt

SEQ ID NO: 696608 - DNA, 25 bp, Mus musculus
gtgacaatacataccaccacagatg

SEQ ID NO: 696609 - DNA, 25 bp, Mus musculus
gtgacaatacatcaggctaatccca

SEQ ID NO: 696610 - DNA, 25 bp, Mus musculus
gtgacaatacatgaggctaatccca

SEQ ID NO: 696611 - DNA, 25 bp, Mus musculus
gtgacaatacattccaccacagatg

SEQ ID NO: 696612 - DNA, 25 bp, Mus musculus
gtgacaatatctccttatggtagca

SEQ ID NO: 696613 - DNA, 25 bp, Mus musculus
gtgacaatatctgcttatggtagca

SEQ ID NO: 696614 - DNA, 25 bp, Mus musculus
gtgacaatcagtaacccttcttcag

SEQ ID NO: 696615 - DNA, 25 bp, Mus musculus
gtgacaatcagttacccttcttcag

SEQ ID NO: 696616 - DNA, 25 bp, Mus musculus
gtgacaatgcagacctcagagagaa

SEQ ID NO: 696617 - DNA, 25 bp, Mus musculus
gtgacaatgcagtcctcagagagaa

SEQ ID NO: 696618 - DNA, 25 bp, Mus musculus
gtgacaatgccacatacgccagcga

SEQ ID NO: 696619 - DNA, 25 bp, Mus musculus
gtgacaatgccagatacgccagcga

SEQ ID NO: 696620 - DNA, 25 bp, Mus musculus
gtgacaatgtccctgggccacactt

SEQ ID NO: 696621 - DNA, 25 bp, Mus musculus
gtgacaatgtccgtgggccacactt

SEQ ID NO: 696622 - DNA, 25 bp, Mus musculus
gtgacaattccaactatgcggttac

SEQ ID NO: 696623 - DNA, 25 bp, Mus musculus
gtgacaattccatctatgcggttac

SEQ ID NO: 696624 - DNA, 25 bp, Mus musculus
gtgacaattgcacactatatgaaga

SEQ ID NO: 696625 - DNA, 25 bp, Mus musculus
gtgacaattgcagactatatgaaga

SEQ ID NO: 696626 - DNA, 25 bp, Mus musculus
gtgacaattgcgatgcatacctaca

SEQ ID NO: 696627 - DNA, 25 bp, Mus musculus
gtgacaattgcgttgcatacctaca

SEQ ID NO: 696628 - DNA, 25 bp, Mus musculus
gtgacaatttaactcaagcctgtgt

SEQ ID NO: 696629 - DNA, 25 bp, Mus musculus
gtgacaatttaagtcaagcctgtgt

SEQ ID NO: 696630 - DNA, 25 bp, Mus musculus
gtgacaatttgtactttgatgtgat

SEQ ID NO: 696631 - DNA, 25 bp, Mus musculus
gtgacaatttgttctttgatgtgat

SEQ ID NO: 696632 - DNA, 25 bp, Mus musculus
gtgacacaacggagacaggtagctg

SEQ ID NO: 696633 - DNA, 25 bp, Mus musculus
gtgacacaacggtgacaggtagctg

SEQ ID NO: 696634 - DNA, 25 bp, Mus musculus
gtgacacaagatcatatctacatgt

SEQ ID NO: 696635 - DNA, 25 bp, Mus musculus
gtgacacaagatgatatctacatgt

SEQ ID NO: 696636 - DNA, 25 bp, Mus musculus
gtgacacacagtagggtgaacaaag

SEQ ID NO: 696637 - DNA, 25 bp, Mus musculus
gtgacacacagttgggtgaacaaag

SEQ ID NO: 696638 - DNA, 25 bp, Mus musculus
gtgacacacattagactcagaactt

SEQ ID NO: 696639 - DNA, 25 bp, Mus musculus
gtgacacacatttgactcagaactt

SEQ ID NO: 696640 - DNA, 25 bp, Mus musculus
gtgacacaccagagcccattattag

SEQ ID NO: 696641 - DNA, 25 bp, Mus musculus
gtgacacaccagtgcccattattag

SEQ ID NO: 696642 - DNA, 25 bp, Mus musculus
gtgacacacctgatagcataccttg

SEQ ID NO: 696643 - DNA, 25 bp, Mus musculus
gtgacacacctgttagcataccttg

SEQ ID NO: 696644 - DNA, 25 bp, Mus musculus
gtgacacacgtcagtaatgtaattc

SEQ ID NO: 696645 - DNA, 25 bp, Mus musculus
gtgacacacgtctgtaatgtaattc

SEQ ID NO: 696646 - DNA, 25 bp, Mus musculus
gtgacacactcccaatgatacatag

SEQ ID NO: 696647 - DNA, 25 bp, Mus musculus
gtgacacactccgaatgatacatag

SEQ ID NO: 696648 - DNA, 25 bp, Mus musculus
gtgacacactcgattaatcctagat

SEQ ID NO: 696649 - DNA, 25 bp, Mus musculus
gtgacacactcgtttaatcctagat

SEQ ID NO: 696650 - DNA, 25 bp, Mus musculus
gtgacacactgtacagttccagctt

SEQ ID NO: 696651 - DNA, 25 bp, Mus musculus
gtgacacactgttcagttccagctt

SEQ ID NO: 696652 - DNA, 25 bp, Mus musculus
gtgacacagagaccactgaggtgca

SEQ ID NO: 696653 - DNA, 25 bp, Mus musculus
gtgacacagagaccccgctcaaggt

SEQ ID NO: 696654 - DNA, 25 bp, Mus musculus
gtgacacagagagcactgaggtgca

SEQ ID NO: 696655 - DNA, 25 bp, Mus musculus
gtgacacagagagcccgctcaaggt

SEQ ID NO: 696656 - DNA, 25 bp, Mus musculus
gtgacacagatcagtagtccagcta

SEQ ID NO: 696657 - DNA, 25 bp, Mus musculus
gtgacacagatctgtagtccagcta

SEQ ID NO: 696658 - DNA, 25 bp, Mus musculus
gtgacacagcaccactgtggtactt

SEQ ID NO: 696659 - DNA, 25 bp, Mus musculus
gtgacacagcaccagagttgcagct

SEQ ID NO: 696660 - DNA, 25 bp, Mus musculus
gtgacacagcacgactgtggtactt

SEQ ID NO: 696661 - DNA, 25 bp, Mus musculus
gtgacacagcacgagagttgcagct

SEQ ID NO: 696662 - DNA, 25 bp, Mus musculus
gtgacacagggtattggaattcttc

SEQ ID NO: 696663 - DNA, 25 bp, Mus musculus
gtgacacagggttttggaattcttc

SEQ ID NO: 696664 - DNA, 25 bp, Mus musculus
gtgacacatcccaacatagtggagg

SEQ ID NO: 696665 - DNA, 25 bp, Mus musculus
gtgacacatccctacatagtggagg

SEQ ID NO: 696666 - DNA, 25 bp, Mus musculus
gtgacacattgtatgttgctggctg

SEQ ID NO: 696667 - DNA, 25 bp, Mus musculus
gtgacacattgtttgttgctggctg

SEQ ID NO: 696668 - DNA, 25 bp, Mus musculus
gtgacacattttcacgtcgtggctt

SEQ ID NO: 696669 - DNA, 25 bp, Mus musculus
gtgacacattttcaggtcctgagtt

SEQ ID NO: 696670 - DNA, 25 bp, Mus musculus
gtgacacattttgacgtcgtggctt

SEQ ID NO: 696671 - DNA, 25 bp, Mus musculus
gtgacacattttgaggtcctgagtt

SEQ ID NO: 696672 - DNA, 25 bp, Mus musculus
gtgacaccaaatcgctaagcagtct

SEQ ID NO: 696673 - DNA, 25 bp, Mus musculus
gtgacaccaaatggctaagcagtct

SEQ ID NO: 696674 - DNA, 25 bp, Mus musculus
gtgacaccaagtacaggccatttag

SEQ ID NO: 696675 - DNA, 25 bp, Mus musculus
gtgacaccaagtctgagacaccctg

SEQ ID NO: 696676 - DNA, 25 bp, Mus musculus
gtgacaccaagtgtgagacaccctg

SEQ ID NO: 696677 - DNA, 25 bp, Mus musculus
gtgacaccaagttcaggccatttag

SEQ ID NO: 696678 - DNA, 25 bp, Mus musculus
gtgacaccaatgaacaaggcgccct

SEQ ID NO: 696679 - DNA, 25 bp, Mus musculus
gtgacaccaatgtacaaggcgccct

SEQ ID NO: 696680 - DNA, 25 bp, Mus musculus
gtgacaccagtgaatcgctccaagt

SEQ ID NO: 696681 - DNA, 25 bp, Mus musculus
gtgacaccagtgtatcgctccaagt

SEQ ID NO: 696682 - DNA, 25 bp, Mus musculus
gtgacaccatctctcatcattcatc

SEQ ID NO: 696683 - DNA, 25 bp, Mus musculus
gtgacaccatctgtcatcattcatc

SEQ ID NO: 696684 - DNA, 25 bp, Mus musculus
gtgacacccatgacctacaagaagc

SEQ ID NO: 696685 - DNA, 25 bp, Mus musculus
gtgacacccatgtcctacaagaagc

SEQ ID NO: 696686 - DNA, 25 bp, Mus musculus
gtgacacccctaatcacatagtctt

SEQ ID NO: 696687 - DNA, 25 bp, Mus musculus
gtgacacccctattcacatagtctt

SEQ ID NO: 696688 - DNA, 25 bp, Mus musculus
gtgacacccgaacgcgaatctttaa

SEQ ID NO: 696689 - DNA, 25 bp, Mus musculus
gtgacacccgaaggcgaatctttaa

SEQ ID NO: 696690 - DNA, 25 bp, Mus musculus
gtgacacccttgcttcagtcaagtt

SEQ ID NO: 696691 - DNA, 25 bp, Mus musculus
gtgacacccttggttcagtcaagtt

SEQ ID NO: 696692 - DNA, 25 bp, Mus musculus
gtgacaccggagagctgattgttga

SEQ ID NO: 696693 - DNA, 25 bp, Mus musculus
gtgacaccggagtgctgattgttga

SEQ ID NO: 696694 - DNA, 25 bp, Mus musculus
gtgacaccgggacacctaggagatc

SEQ ID NO: 696695 - DNA, 25 bp, Mus musculus
gtgacaccgggagacctaggagatc

SEQ ID NO: 696696 - DNA, 25 bp, Mus musculus
gtgacacctattcaaccaagaatgg

SEQ ID NO: 696697 - DNA, 25 bp, Mus musculus
gtgacacctattgaaccaagaatgg

SEQ ID NO: 696698 - DNA, 25 bp, Mus musculus
gtgacacctctaatcctagtgtact

SEQ ID NO: 696699 - DNA, 25 bp, Mus musculus
gtgacacctctaatcttaacgacct

SEQ ID NO: 696700 - DNA, 25 bp, Mus musculus
gtgacacctctattcctagtgtact

SEQ ID NO: 696701 - DNA, 25 bp, Mus musculus
gtgacacctctattcttaacgacct

SEQ ID NO: 696702 - DNA, 25 bp, Mus musculus
gtgacacctgccaactacgaatgaa

SEQ ID NO: 696703 - DNA, 25 bp, Mus musculus
gtgacacctgcctactacgaatgaa

SEQ ID NO: 696704 - DNA, 25 bp, Mus musculus
gtgacacctgtactctctggaagag

SEQ ID NO: 696705 - DNA, 25 bp, Mus musculus
gtgacacctgtagtctctggaagag

SEQ ID NO: 696706 - DNA, 25 bp, Mus musculus
gtgacacctgtgaatttgtatttcc

SEQ ID NO: 696707 - DNA, 25 bp, Mus musculus
gtgacacctgtgtatttgtatttcc

SEQ ID NO: 696708 - DNA, 25 bp, Mus musculus
gtgacaccttctaactgagttctga

SEQ ID NO: 696709 - DNA, 25 bp, Mus musculus
gtgacaccttcttactgagttctga

SEQ ID NO: 696710 - DNA, 25 bp, Mus musculus
gtgacacctttaacatgttctctat

SEQ ID NO: 696711 - DNA, 25 bp, Mus musculus
gtgacacctttatcatgttctctat

SEQ ID NO: 696712 - DNA, 25 bp, Mus musculus
gtgacacgattcagggtgagcactt

SEQ ID NO: 696713 - DNA, 25 bp, Mus musculus
gtgacacgattctgggtgagcactt

SEQ ID NO: 696714 - DNA, 25 bp, Mus musculus
gtgacacggaccctggacagagaaa

SEQ ID NO: 696715 - DNA, 25 bp, Mus musculus
gtgacacggaccgtggacagagaaa

SEQ ID NO: 696716 - DNA, 25 bp, Mus musculus
gtgacacggctgagctgacttggat

SEQ ID NO: 696717 - DNA, 25 bp, Mus musculus
gtgacacggctgtgctgacttggat

SEQ ID NO: 696718 - DNA, 25 bp, Mus musculus
gtgacacggcttctgaatactctga

SEQ ID NO: 696719 - DNA, 25 bp, Mus musculus
gtgacacggcttgtgaatactctga

SEQ ID NO: 696720 - DNA, 25 bp, Mus musculus
gtgacacgggccatgaaaactactg

SEQ ID NO: 696721 - DNA, 25 bp, Mus musculus
gtgacacgggccttgaaaactactg

SEQ ID NO: 696722 - DNA, 25 bp, Mus musculus
gtgacacgtaaaatttatctcaata

SEQ ID NO: 696723 - DNA, 25 bp, Mus musculus
gtgacacgtaaattttatctcaata

SEQ ID NO: 696724 - DNA, 25 bp, Mus musculus
gtgacacgtgcacatgtggttttct

SEQ ID NO: 696725 - DNA, 25 bp, Mus musculus
gtgacacgtgcagatgtggttttct

SEQ ID NO: 696726 - DNA, 25 bp, Mus musculus
gtgacactaaatcagcaaggcccct

SEQ ID NO: 696727 - DNA, 25 bp, Mus musculus
gtgacactaaatgagcaaggcccct

SEQ ID NO: 696728 - DNA, 25 bp, Mus musculus
gtgacactagatctaccagctgagt

SEQ ID NO: 696729 - DNA, 25 bp, Mus musculus
gtgacactagatgtaccagctgagt

SEQ ID NO: 696730 - DNA, 25 bp, Mus musculus
gtgacactaggcctgctgacacatg

SEQ ID NO: 696731 - DNA, 25 bp, Mus musculus
gtgacactaggcgtgctgacacatg

SEQ ID NO: 696732 - DNA, 25 bp, Mus musculus
gtgacactatggattgatgcagcag

SEQ ID NO: 696733 - DNA, 25 bp, Mus musculus
gtgacactatggtttgatgcagcag

SEQ ID NO: 696734 - DNA, 25 bp, Mus musculus
gtgacactcacaaatctgtccatgg

SEQ ID NO: 696735 - DNA, 25 bp, Mus musculus
gtgacactcacaatgaatctattcc

SEQ ID NO: 696736 - DNA, 25 bp, Mus musculus
gtgacactcacatatctgtccatgg

SEQ ID NO: 696737 - DNA, 25 bp, Mus musculus
gtgacactcacattgaatctattcc

SEQ ID NO: 696738 - DNA, 25 bp, Mus musculus
gtgacactcactctttgtggacgga

SEQ ID NO: 696739 - DNA, 25 bp, Mus musculus
gtgacactcactgtttgtggacgga

SEQ ID NO: 696740 - DNA, 25 bp, Mus musculus
gtgacactcatactagcagacctaa

SEQ ID NO: 696741 - DNA, 25 bp, Mus musculus
gtgacactcatagtagcagacctaa

SEQ ID NO: 696742 - DNA, 25 bp, Mus musculus
gtgacactcatcattgggcaaccgg

SEQ ID NO: 696743 - DNA, 25 bp, Mus musculus
gtgacactcatctttgggcaaccgg

SEQ ID NO: 696744 - DNA, 25 bp, Mus musculus
gtgacactctgaccggatggtataa

SEQ ID NO: 696745 - DNA, 25 bp, Mus musculus
gtgacactctgagcggatggtataa

SEQ ID NO: 696746 - DNA, 25 bp, Mus musculus
gtgacactgagtctagcaacaagtc

SEQ ID NO: 696747 - DNA, 25 bp, Mus musculus
gtgacactgagtgtagcaacaagtc

SEQ ID NO: 696748 - DNA, 25 bp, Mus musculus
gtgacactgcagaggtcctggaaca

SEQ ID NO: 696749 - DNA, 25 bp, Mus musculus
gtgacactgcagtggtcctggaaca

SEQ ID NO: 696750 - DNA, 25 bp, Mus musculus
gtgacactggaaaatgggcagcccc

SEQ ID NO: 696751 - DNA, 25 bp, Mus musculus
gtgacactggaatatgggcagcccc

SEQ ID NO: 696752 - DNA, 25 bp, Mus musculus
gtgacactggacatgctggacctgg

SEQ ID NO: 696753 - DNA, 25 bp, Mus musculus
gtgacactggacttgctggacctgg

SEQ ID NO: 696754 - DNA, 25 bp, Mus musculus
gtgacactggcaagaggtgacctgt

SEQ ID NO: 696755 - DNA, 25 bp, Mus musculus
gtgacactggcatgaggtgacctgt

SEQ ID NO: 696756 - DNA, 25 bp, Mus musculus
gtgacactggccagtgtatctcaag

SEQ ID NO: 696757 - DNA, 25 bp, Mus musculus
gtgacactggcctgtgtatctcaag

SEQ ID NO: 696758 - DNA, 25 bp, Mus musculus
gtgacactgtacaggcgcaaagcat

SEQ ID NO: 696759 - DNA, 25 bp, Mus musculus
gtgacactgtactggcgcaaagcat

SEQ ID NO: 696760 - DNA, 25 bp, Mus musculus
gtgacactgtcaagtggcagacctt

SEQ ID NO: 696761 - DNA, 25 bp, Mus musculus
gtgacactgtcatgtggcagacctt

SEQ ID NO: 696762 - DNA, 25 bp, Mus musculus
gtgacactgtctatcagtacgtcgg

SEQ ID NO: 696763 - DNA, 25 bp, Mus musculus
gtgacactgtctttcagtacgtcgg

SEQ ID NO: 696764 - DNA, 25 bp, Mus musculus
gtgacactgtggacaatgagcatat

SEQ ID NO: 696765 - DNA, 25 bp, Mus musculus
gtgacactgtggacctcggtcacct

SEQ ID NO: 696766 - DNA, 25 bp, Mus musculus
gtgacactgtggtcaatgagcatat

SEQ ID NO: 696767 - DNA, 25 bp, Mus musculus
gtgacactgtggtcctcggtcacct

SEQ ID NO: 696768 - DNA, 25 bp, Mus musculus
gtgacactgtgtcaccaggttagat

SEQ ID NO: 696769 - DNA, 25 bp, Mus musculus
gtgacactgtgtgaccaggttagat

SEQ ID NO: 696770 - DNA, 25 bp, Mus musculus
gtgacactgttgctttaggctcatt

SEQ ID NO: 696771 - DNA, 25 bp, Mus musculus
gtgacactgttggtttaggctcatt

SEQ ID NO: 696772 - DNA, 25 bp, Mus musculus
gtgacacttattaaaagcttaccag

SEQ ID NO: 696773 - DNA, 25 bp, Mus musculus
gtgacacttatttaaagcttaccag

SEQ ID NO: 696774 - DNA, 25 bp, Mus musculus
gtgacacttcacatacagggtttgg

SEQ ID NO: 696775 - DNA, 25 bp, Mus musculus
gtgacacttcacttacagggtttgg

SEQ ID NO: 696776 - DNA, 25 bp, Mus musculus
gtgacacttcctatcatcctataaa

SEQ ID NO: 696777 - DNA, 25 bp, Mus musculus
gtgacacttcctttcatcctataaa

SEQ ID NO: 696778 - DNA, 25 bp, Mus musculus
gtgacacttgacctctcacataaaa

SEQ ID NO: 696779 - DNA, 25 bp, Mus musculus
gtgacacttgacgtctcacataaaa

SEQ ID NO: 696780 - DNA, 25 bp, Mus musculus
gtgacactttttctagaacccatgt

SEQ ID NO: 696781 - DNA, 25 bp, Mus musculus
gtgacactttttgtagaacccatgt

SEQ ID NO: 696782 - DNA, 25 bp, Mus musculus
gtgacagaaagaagcgcctcgccat

SEQ ID NO: 696783 - DNA, 25 bp, Mus musculus
gtgacagaaagatgcgcctcgccat

SEQ ID NO: 696784 - DNA, 25 bp, Mus musculus
gtgacagaactcagtgctttgccag

SEQ ID NO: 696785 - DNA, 25 bp, Mus musculus
gtgacagaactccatgtctggccat

SEQ ID NO: 696786 - DNA, 25 bp, Mus musculus
gtgacagaactcgatgtctggccat

SEQ ID NO: 696787 - DNA, 25 bp, Mus musculus
gtgacagaactctgtgctttgccag

SEQ ID NO: 696788 - DNA, 25 bp, Mus musculus
gtgacagaagttatacaacctatgg

SEQ ID NO: 696789 - DNA, 25 bp, Mus musculus
gtgacagaagttttacaacctatgg

SEQ ID NO: 696790 - DNA, 25 bp, Mus musculus
gtgacagaatgtacatctaacttga

SEQ ID NO: 696791 - DNA, 25 bp, Mus musculus
gtgacagaatgttcatctaacttga

SEQ ID NO: 696792 - DNA, 25 bp, Mus musculus
gtgacagacaagaggcctcatactg

SEQ ID NO: 696793 - DNA, 25 bp, Mus musculus
gtgacagacaagaggtccccgtgga

SEQ ID NO: 696794 - DNA, 25 bp, Mus musculus
gtgacagacaagtggcctcatactg

SEQ ID NO: 696795 - DNA, 25 bp, Mus musculus
gtgacagacaagtggtccccgtgga

SEQ ID NO: 696796 - DNA, 25 bp, Mus musculus
gtgacagacacacgacttaccagct

SEQ ID NO: 696797 - DNA, 25 bp, Mus musculus
gtgacagacacaggacttaccagct

SEQ ID NO: 696798 - DNA, 25 bp, Mus musculus
gtgacagacactaaagggacctcca

SEQ ID NO: 696799 - DNA, 25 bp, Mus musculus
gtgacagacacttaagggacctcca

SEQ ID NO: 696800 - DNA, 25 bp, Mus musculus
gtgacagacagaatggtagacagcc

SEQ ID NO: 696801 - DNA, 25 bp, Mus musculus
gtgacagacagattggtagacagcc

SEQ ID NO: 696802 - DNA, 25 bp, Mus musculus
gtgacagaccttattggtcctagga

SEQ ID NO: 696803 - DNA, 25 bp, Mus musculus
gtgacagacctttttggtcctagga

SEQ ID NO: 696804 - DNA, 25 bp, Mus musculus
gtgacagacgaaacccttgcgtagg

SEQ ID NO: 696805 - DNA, 25 bp, Mus musculus
gtgacagacgaatcccttgcgtagg

SEQ ID NO: 696806 - DNA, 25 bp, Mus musculus
gtgacagactacactcaggcctagc

SEQ ID NO: 696807 - DNA, 25 bp, Mus musculus
gtgacagactactctcaggcctagc

SEQ ID NO: 696808 - DNA, 25 bp, Mus musculus
gtgacagactatagaccatgcttaa

SEQ ID NO: 696809 - DNA, 25 bp, Mus musculus
gtgacagactattgaccatgcttaa

SEQ ID NO: 696810 - DNA, 25 bp, Mus musculus
gtgacagactcaatttatgcagtgg

SEQ ID NO: 696811 - DNA, 25 bp, Mus musculus
gtgacagactcattttatgcagtgg

SEQ ID NO: 696812 - DNA, 25 bp, Mus musculus
gtgacagactgacaagccttgagat

SEQ ID NO: 696813 - DNA, 25 bp, Mus musculus
gtgacagactgagaagccttgagat

SEQ ID NO: 696814 - DNA, 25 bp, Mus musculus
gtgacagactgcactccaggatggg

SEQ ID NO: 696815 - DNA, 25 bp, Mus musculus
gtgacagactgctctccaggatggg

SEQ ID NO: 696816 - DNA, 25 bp, Mus musculus
gtgacagagatgaggcaagtgacaa

SEQ ID NO: 696817 - DNA, 25 bp, Mus musculus
gtgacagagatgtggcaagtgacaa

SEQ ID NO: 696818 - DNA, 25 bp, Mus musculus
gtgacagagcccatgcccagcaggc

SEQ ID NO: 696819 - DNA, 25 bp, Mus musculus
gtgacagagcccttgcccagcaggc

SEQ ID NO: 696820 - DNA, 25 bp, Mus musculus
gtgacagagctccacattttcttta

SEQ ID NO: 696821 - DNA, 25 bp, Mus musculus
gtgacagagctcgacattttcttta

SEQ ID NO: 696822 - DNA, 25 bp, Mus musculus
gtgacagaggctattttaccgaaat

SEQ ID NO: 696823 - DNA, 25 bp, Mus musculus
gtgacagaggcttttttaccgaaat

SEQ ID NO: 696824 - DNA, 25 bp, Mus musculus
gtgacagagtcacggttgacacagt

SEQ ID NO: 696825 - DNA, 25 bp, Mus musculus
gtgacagagtcagggttgacacagt

SEQ ID NO: 696826 - DNA, 25 bp, Mus musculus
gtgacagatcctatatccaatactc

SEQ ID NO: 696827 - DNA, 25 bp, Mus musculus
gtgacagatcctttatccaatactc

SEQ ID NO: 696828 - DNA, 25 bp, Mus musculus
gtgacagatttcaacccagccaaga

SEQ ID NO: 696829 - DNA, 25 bp, Mus musculus
gtgacagatttctacccagccaaga

SEQ ID NO: 696830 - DNA, 25 bp, Mus musculus
gtgacagatttgactttgccaaaac

SEQ ID NO: 696831 - DNA, 25 bp, Mus musculus
gtgacagatttgtctttgccaaaac

SEQ ID NO: 696832 - DNA, 25 bp, Mus musculus
gtgacagcaaaaccagagcatcctt

SEQ ID NO: 696833 - DNA, 25 bp, Mus musculus
gtgacagcaaaagcagagcatcctt

SEQ ID NO: 696834 - DNA, 25 bp, Mus musculus
gtgacagcaatcactccgtgtttat

SEQ ID NO: 696835 - DNA, 25 bp, Mus musculus
gtgacagcaatctctccgtgtttat

SEQ ID NO: 696836 - DNA, 25 bp, Mus musculus
gtgacagcaatgacaaacgccgttt

SEQ ID NO: 696837 - DNA, 25 bp, Mus musculus
gtgacagcaatgtcaaacgccgttt

SEQ ID NO: 696838 - DNA, 25 bp, Mus musculus
gtgacagcacatacatccctaaaga

SEQ ID NO: 696839 - DNA, 25 bp, Mus musculus
gtgacagcacattcatccctaaaga

SEQ ID NO: 696840 - DNA, 25 bp, Mus musculus
gtgacagcaccaaggtgacccgtca

SEQ ID NO: 696841 - DNA, 25 bp, Mus musculus
gtgacagcaccatggtgacccgtca

SEQ ID NO: 696842 - DNA, 25 bp, Mus musculus
gtgacagcagagacccatgagtcca

SEQ ID NO: 696843 - DNA, 25 bp, Mus musculus
gtgacagcagagtcccatgagtcca

SEQ ID NO: 696844 - DNA, 25 bp, Mus musculus
gtgacagcagcgagcagcccctgtt

SEQ ID NO: 696845 - DNA, 25 bp, Mus musculus
gtgacagcagcgtgcagcccctgtt

SEQ ID NO: 696846 - DNA, 25 bp, Mus musculus
gtgacagcaggtctctgaactgtaa

SEQ ID NO: 696847 - DNA, 25 bp, Mus musculus
gtgacagcaggtgtctgaactgtaa

SEQ ID NO: 696848 - DNA, 25 bp, Mus musculus
gtgacagcagtacagattacagcta

SEQ ID NO: 696849 - DNA, 25 bp, Mus musculus
gtgacagcagtagagattacagcta

SEQ ID NO: 696850 - DNA, 25 bp, Mus musculus
gtgacagcatgtacctgagatccag

SEQ ID NO: 696851 - DNA, 25 bp, Mus musculus
gtgacagcatgttcctgagatccag

SEQ ID NO: 696852 - DNA, 25 bp, Mus musculus
gtgacagcattaaactctttcgaag

SEQ ID NO: 696853 - DNA, 25 bp, Mus musculus
gtgacagcattatactctttcgaag

SEQ ID NO: 696854 - DNA, 25 bp, Mus musculus
gtgacagccaccatgtcaaaactct

SEQ ID NO: 696855 - DNA, 25 bp, Mus musculus
gtgacagccaccttgtcaaaactct

SEQ ID NO: 696856 - DNA, 25 bp, Mus musculus
gtgacagccagaattcactgactcc

SEQ ID NO: 696857 - DNA, 25 bp, Mus musculus
gtgacagccagatttcactgactcc

SEQ ID NO: 696858 - DNA, 25 bp, Mus musculus
gtgacagcccagaatccagagacaa

SEQ ID NO: 696859 - DNA, 25 bp, Mus musculus
gtgacagcccagtatccagagacaa

SEQ ID NO: 696860 - DNA, 25 bp, Mus musculus
gtgacagccgctctattagatttct

SEQ ID NO: 696861 - DNA, 25 bp, Mus musculus
gtgacagccgctgtattagatttct

SEQ ID NO: 696862 - DNA, 25 bp, Mus musculus
gtgacagccgggacatgccaacctt

SEQ ID NO: 696863 - DNA, 25 bp, Mus musculus
gtgacagccgggtcatgccaacctt

SEQ ID NO: 696864 - DNA, 25 bp, Mus musculus
gtgacagcctaaataattccaaact

SEQ ID NO: 696865 - DNA, 25 bp, Mus musculus
gtgacagcctaattaattccaaact

SEQ ID NO: 696866 - DNA, 25 bp, Mus musculus
gtgacagcctatacctcagaaaaac

SEQ ID NO: 696867 - DNA, 25 bp, Mus musculus
gtgacagcctattcctcagaaaaac

SEQ ID NO: 696868 - DNA, 25 bp, Mus musculus
gtgacagcctccagtgggctagccc

SEQ ID NO: 696869 - DNA, 25 bp, Mus musculus
gtgacagcctcctgtgggctagccc

SEQ ID NO: 696870 - DNA, 25 bp, Mus musculus
gtgacagcctgcacaccgtgtacag

SEQ ID NO: 696871 - DNA, 25 bp, Mus musculus
gtgacagcctgctcaccgtgtacag

SEQ ID NO: 696872 - DNA, 25 bp, Mus musculus
gtgacagccttactctggaaccaga

SEQ ID NO: 696873 - DNA, 25 bp, Mus musculus
gtgacagccttagtctggaaccaga

SEQ ID NO: 696874 - DNA, 25 bp, Mus musculus
gtgacagcgaccacctcctaataaa

SEQ ID NO: 696875 - DNA, 25 bp, Mus musculus
gtgacagcgacctcctcctaataaa

SEQ ID NO: 696876 - DNA, 25 bp, Mus musculus
gtgacagctaagagcccatccagga

SEQ ID NO: 696877 - DNA, 25 bp, Mus musculus
gtgacagctaagtgcccatccagga

SEQ ID NO: 696878 - DNA, 25 bp, Mus musculus
gtgacagctaatcgtgcagttctaa

SEQ ID NO: 696879 - DNA, 25 bp, Mus musculus
gtgacagctaatggtgcagttctaa

SEQ ID NO: 696880 - DNA, 25 bp, Mus musculus
gtgacagctatcaagcgtgcggcca

SEQ ID NO: 696881 - DNA, 25 bp, Mus musculus
gtgacagctatcacaatttttattg

SEQ ID NO: 696882 - DNA, 25 bp, Mus musculus
gtgacagctatctagcgtgcggcca

SEQ ID NO: 696883 - DNA, 25 bp, Mus musculus
gtgacagctatctcaatttttattg

SEQ ID NO: 696884 - DNA, 25 bp, Mus musculus
gtgacagctgacaaaaggcatgatg

SEQ ID NO: 696885 - DNA, 25 bp, Mus musculus
gtgacagctgactaaaggcatgatg

SEQ ID NO: 696886 - DNA, 25 bp, Mus musculus
gtgacagctgctattacgtccattt

SEQ ID NO: 696887 - DNA, 25 bp, Mus musculus
gtgacagctgcttttacgtccattt

SEQ ID NO: 696888 - DNA, 25 bp, Mus musculus
gtgacagcttggacgcagtctgtga

SEQ ID NO: 696889 - DNA, 25 bp, Mus musculus
gtgacagcttggtcgcagtctgtga

SEQ ID NO: 696890 - DNA, 25 bp, Mus musculus
gtgacagctttcattcagcagaatt

SEQ ID NO: 696891 - DNA, 25 bp, Mus musculus
gtgacagctttctttcagcagaatt

SEQ ID NO: 696892 - DNA, 25 bp, Mus musculus
gtgacagctttgataccttctctgg

SEQ ID NO: 696893 - DNA, 25 bp, Mus musculus
gtgacagctttgttaccttctctgg

SEQ ID NO: 696894 - DNA, 25 bp, Mus musculus
gtgacaggaaataccaccacttcag

SEQ ID NO: 696895 - DNA, 25 bp, Mus musculus
gtgacaggaaattccaccacttcag

SEQ ID NO: 696896 - DNA, 25 bp, Mus musculus
gtgacaggacacaggcgccagagtc

SEQ ID NO: 696897 - DNA, 25 bp, Mus musculus
gtgacaggacactggcgccagagtc

SEQ ID NO: 696898 - DNA, 25 bp, Mus musculus
gtgacaggaggtatctttccctact

SEQ ID NO: 696899 - DNA, 25 bp, Mus musculus
gtgacaggaggtttctttccctact

SEQ ID NO: 696900 - DNA, 25 bp, Mus musculus
gtgacaggcactacaactctccatg

SEQ ID NO: 696901 - DNA, 25 bp, Mus musculus
gtgacaggcacttcaactctccatg

SEQ ID NO: 696902 - DNA, 25 bp, Mus musculus
gtgacaggcctcaatcctgccgagg

SEQ ID NO: 696903 - DNA, 25 bp, Mus musculus
gtgacaggcctctatcctgccgagg

SEQ ID NO: 696904 - DNA, 25 bp, Mus musculus
gtgacaggctcaagaggcagtgcaa

SEQ ID NO: 696905 - DNA, 25 bp, Mus musculus
gtgacaggctcatgaggcagtgcaa

SEQ ID NO: 696906 - DNA, 25 bp, Mus musculus
gtgacaggctgtctttactgcgaga

SEQ ID NO: 696907 - DNA, 25 bp, Mus musculus
gtgacaggctgtgtttactgcgaga

SEQ ID NO: 696908 - DNA, 25 bp, Mus musculus
gtgacagggaacatccccatgtgaa

SEQ ID NO: 696909 - DNA, 25 bp, Mus musculus
gtgacagggaacttccccatgtgaa

SEQ ID NO: 696910 - DNA, 25 bp, Mus musculus
gtgacagggactccaccactgtgca

SEQ ID NO: 696911 - DNA, 25 bp, Mus musculus
gtgacagggactgcaccactgtgca

SEQ ID NO: 696912 - DNA, 25 bp, Mus musculus
gtgacagggattagtttcacttttt

SEQ ID NO: 696913 - DNA, 25 bp, Mus musculus
gtgacagggatttgtttcacttttt

SEQ ID NO: 696914 - DNA, 25 bp, Mus musculus
gtgacagggcggaagacctgcctca

SEQ ID NO: 696915 - DNA, 25 bp, Mus musculus
gtgacagggcggtagacctgcctca

SEQ ID NO: 696916 - DNA, 25 bp, Mus musculus
gtgacaggtcctcgcctacgtaagc

SEQ ID NO: 696917 - DNA, 25 bp, Mus musculus
gtgacaggtcctggcctacgtaagc

SEQ ID NO: 696918 - DNA, 25 bp, Mus musculus
gtgacagtagccacatgggtgttct

SEQ ID NO: 696919 - DNA, 25 bp, Mus musculus
gtgacagtagcctcatgggtgttct

SEQ ID NO: 696920 - DNA, 25 bp, Mus musculus
gtgacagtagtcatgggttttcctc

SEQ ID NO: 696921 - DNA, 25 bp, Mus musculus
gtgacagtagtcttgggttttcctc

SEQ ID NO: 696922 - DNA, 25 bp, Mus musculus
gtgacagtatctagatgtacagtgt

SEQ ID NO: 696923 - DNA, 25 bp, Mus musculus
gtgacagtatcttgatgtacagtgt

SEQ ID NO: 696924 - DNA, 25 bp, Mus musculus
gtgacagtcaggcaagaaagccttt

SEQ ID NO: 696925 - DNA, 25 bp, Mus musculus
gtgacagtcagggaagaaagccttt

SEQ ID NO: 696926 - DNA, 25 bp, Mus musculus
gtgacagtcccaaacatcatacata

SEQ ID NO: 696927 - DNA, 25 bp, Mus musculus
gtgacagtcccaagtagataacctc

SEQ ID NO: 696928 - DNA, 25 bp, Mus musculus
gtgacagtcccatacatcatacata

SEQ ID NO: 696929 - DNA, 25 bp, Mus musculus
gtgacagtcccatgtagataacctc

SEQ ID NO: 696930 - DNA, 25 bp, Mus musculus
gtgacagtccgtatgtataaataaa

SEQ ID NO: 696931 - DNA, 25 bp, Mus musculus
gtgacagtccgtttgtataaataaa

SEQ ID NO: 696932 - DNA, 25 bp, Mus musculus
gtgacagtcctgaaagcgcttcttt

SEQ ID NO: 696933 - DNA, 25 bp, Mus musculus
gtgacagtcctgtaagcgcttcttt

SEQ ID NO: 696934 - DNA, 25 bp, Mus musculus
gtgacagtctacatctcaatgggtg

SEQ ID NO: 696935 - DNA, 25 bp, Mus musculus
gtgacagtctacttctcaatgggtg

SEQ ID NO: 696936 - DNA, 25 bp, Mus musculus
gtgacagtcttaacctttgtggcat

SEQ ID NO: 696937 - DNA, 25 bp, Mus musculus
gtgacagtcttatcctttgtggcat

SEQ ID NO: 696938 - DNA, 25 bp, Mus musculus
gtgacagtgaagacctcggtgactt

SEQ ID NO: 696939 - DNA, 25 bp, Mus musculus
gtgacagtgaagtcctcggtgactt

SEQ ID NO: 696940 - DNA, 25 bp, Mus musculus
gtgacagtgacaaagagtccagtat

SEQ ID NO: 696941 - DNA, 25 bp, Mus musculus
gtgacagtgacactttcccagagtt

SEQ ID NO: 696942 - DNA, 25 bp, Mus musculus
gtgacagtgacagtttcccagagtt

SEQ ID NO: 696943 - DNA, 25 bp, Mus musculus
gtgacagtgacatagagtccagtat

SEQ ID NO: 696944 - DNA, 25 bp, Mus musculus
gtgacagtgcacctgagacctctga

SEQ ID NO: 696945 - DNA, 25 bp, Mus musculus
gtgacagtgcacgtgagacctctga

SEQ ID NO: 696946 - DNA, 25 bp, Mus musculus
gtgacagtgccccaggaaggttttc

SEQ ID NO: 696947 - DNA, 25 bp, Mus musculus
gtgacagtgcccgaggaaggttttc

SEQ ID NO: 696948 - DNA, 25 bp, Mus musculus
gtgacagtgcttcacaccaagccca

SEQ ID NO: 696949 - DNA, 25 bp, Mus musculus
gtgacagtgcttgacaccaagccca

SEQ ID NO: 696950 - DNA, 25 bp, Mus musculus
gtgacagtggacctttccagtgcag

SEQ ID NO: 696951 - DNA, 25 bp, Mus musculus
gtgacagtggacgtttccagtgcag

SEQ ID NO: 696952 - DNA, 25 bp, Mus musculus
gtgacagtgggtcctaattgttttt

SEQ ID NO: 696953 - DNA, 25 bp, Mus musculus
gtgacagtgggtgctaattgttttt

SEQ ID NO: 696954 - DNA, 25 bp, Mus musculus
gtgacagtgtacaggtgaggtttta

SEQ ID NO: 696955 - DNA, 25 bp, Mus musculus
gtgacagtgtactggtgaggtttta

SEQ ID NO: 696956 - DNA, 25 bp, Mus musculus
gtgacagtgtagagccacacccctt

SEQ ID NO: 696957 - DNA, 25 bp, Mus musculus
gtgacagtgtagtgccacacccctt

SEQ ID NO: 696958 - DNA, 25 bp, Mus musculus
gtgacagtgtccacacaaacacatt

SEQ ID NO: 696959 - DNA, 25 bp, Mus musculus
gtgacagtgtcctcacaaacacatt

SEQ ID NO: 696960 - DNA, 25 bp, Mus musculus
gtgacagtgtctcatctctaccagg

SEQ ID NO: 696961 - DNA, 25 bp, Mus musculus
gtgacagtgtctgatctctaccagg

SEQ ID NO: 696962 - DNA, 25 bp, Mus musculus
gtgacagtgtggaagaccagctctc

SEQ ID NO: 696963 - DNA, 25 bp, Mus musculus
gtgacagtgtggatcgcaacagctt

SEQ ID NO: 696964 - DNA, 25 bp, Mus musculus
gtgacagtgtggtagaccagctctc

SEQ ID NO: 696965 - DNA, 25 bp, Mus musculus
gtgacagtgtggttcgcaacagctt

SEQ ID NO: 696966 - DNA, 25 bp, Mus musculus
gtgacagttacacaggacaggacct

SEQ ID NO: 696967 - DNA, 25 bp, Mus musculus
gtgacagttacagaggacaggacct

SEQ ID NO: 696968 - DNA, 25 bp, Mus musculus
gtgacagttactccccagggtccag

SEQ ID NO: 696969 - DNA, 25 bp, Mus musculus
gtgacagttactgcccagggtccag

SEQ ID NO: 696970 - DNA, 25 bp, Mus musculus
gtgacagttagaaacccagcagctt

SEQ ID NO: 696971 - DNA, 25 bp, Mus musculus
gtgacagttagatacccagcagctt

SEQ ID NO: 696972 - DNA, 25 bp, Mus musculus
gtgacagttgctcctccaaaggtgc

SEQ ID NO: 696973 - DNA, 25 bp, Mus musculus
gtgacagttgctgctccaaaggtgc

SEQ ID NO: 696974 - DNA, 25 bp, Mus musculus
gtgacataacatatatctggtattc

SEQ ID NO: 696975 - DNA, 25 bp, Mus musculus
gtgacataacatttatctggtattc

SEQ ID NO: 696976 - DNA, 25 bp, Mus musculus
gtgacataactcaaagtgctgaagc

SEQ ID NO: 696977 - DNA, 25 bp, Mus musculus
gtgacataactctaagtgctgaagc

SEQ ID NO: 696978 - DNA, 25 bp, Mus musculus
gtgacataagtacagtccctggaaa

SEQ ID NO: 696979 - DNA, 25 bp, Mus musculus
gtgacataagtagagtccctggaaa

SEQ ID NO: 696980 - DNA, 25 bp, Mus musculus
gtgacataatcacttcaaatgcata

SEQ ID NO: 696981 - DNA, 25 bp, Mus musculus
gtgacataatcagttcaaatgcata

SEQ ID NO: 696982 - DNA, 25 bp, Mus musculus
gtgacataccacagtcttaactata

SEQ ID NO: 696983 - DNA, 25 bp, Mus musculus
gtgacataccactgtcttaactata

SEQ ID NO: 696984 - DNA, 25 bp, Mus musculus
gtgacatactgccatggcctgcctg

SEQ ID NO: 696985 - DNA, 25 bp, Mus musculus
gtgacatactgcgatggcctgcctg

SEQ ID NO: 696986 - DNA, 25 bp, Mus musculus
gtgacatactgtatctacttttcca

SEQ ID NO: 696987 - DNA, 25 bp, Mus musculus
gtgacatactgtttctacttttcca

SEQ ID NO: 696988 - DNA, 25 bp, Mus musculus
gtgacatagcttatgtctattgaga

SEQ ID NO: 696989 - DNA, 25 bp, Mus musculus
gtgacatagcttttgtctattgaga

SEQ ID NO: 696990 - DNA, 25 bp, Mus musculus
gtgacatagtacctgcagggtgctt

SEQ ID NO: 696991 - DNA, 25 bp, Mus musculus
gtgacatagtacgtgcagggtgctt

SEQ ID NO: 696992 - DNA, 25 bp, Mus musculus
gtgacatatacaaacacatctgata

SEQ ID NO: 696993 - DNA, 25 bp, Mus musculus
gtgacatatacatacacatctgata

SEQ ID NO: 696994 - DNA, 25 bp, Mus musculus
gtgacatatcagaatgacaagaact

SEQ ID NO: 696995 - DNA, 25 bp, Mus musculus
gtgacatatcagtatgacaagaact

SEQ ID NO: 696996 - DNA, 25 bp, Mus musculus
gtgacatatctaaacttgacttaac

SEQ ID NO: 696997 - DNA, 25 bp, Mus musculus
gtgacatatctatacttgacttaac

SEQ ID NO: 696998 - DNA, 25 bp, Mus musculus
gtgacatatgtgaccaggcatttca

SEQ ID NO: 696999 - DNA, 25 bp, Mus musculus
gtgacatatgtgtccaggcatttca

SEQ ID NO: 697000 - DNA, 25 bp, Mus musculus
gtgacatcacagaacctggtgtccc

SEQ ID NO: 697001 - DNA, 25 bp, Mus musculus
gtgacatcacagtacctggtgtccc

SEQ ID NO: 697002 - DNA, 25 bp, Mus musculus
gtgacatcacgccagtttattttcc

SEQ ID NO: 697003 - DNA, 25 bp, Mus musculus
gtgacatcacgcgagtttattttcc

SEQ ID NO: 697004 - DNA, 25 bp, Mus musculus
gtgacatcactaacattcaagcaaa

SEQ ID NO: 697005 - DNA, 25 bp, Mus musculus
gtgacatcactatcattcaagcaaa

SEQ ID NO: 697006 - DNA, 25 bp, Mus musculus
gtgacatcattcctatcatttcatt

SEQ ID NO: 697007 - DNA, 25 bp, Mus musculus
gtgacatcattcgtatcatttcatt

SEQ ID NO: 697008 - DNA, 25 bp, Mus musculus
gtgacatccaaaagtggctctctaa

SEQ ID NO: 697009 - DNA, 25 bp, Mus musculus
gtgacatccaaatgtggctctctaa

SEQ ID NO: 697010 - DNA, 25 bp, Mus musculus
gtgacatccagaaattaagagtttt

SEQ ID NO: 697011 - DNA, 25 bp, Mus musculus
gtgacatccagatattaagagtttt

SEQ ID NO: 697012 - DNA, 25 bp, Mus musculus
gtgacatccagtataaaccctagaa

SEQ ID NO: 697013 - DNA, 25 bp, Mus musculus
gtgacatccagtttaaaccctagaa

SEQ ID NO: 697014 - DNA, 25 bp, Mus musculus
gtgacatccattagtacttttagaa

SEQ ID NO: 697015 - DNA, 25 bp, Mus musculus
gtgacatccatttgtacttttagaa

SEQ ID NO: 697016 - DNA, 25 bp, Mus musculus
gtgacatccccaaaatgcttgaatt

SEQ ID NO: 697017 - DNA, 25 bp, Mus musculus
gtgacatccccaaagttgcctgagg

SEQ ID NO: 697018 - DNA, 25 bp, Mus musculus
gtgacatccccataatgcttgaatt

SEQ ID NO: 697019 - DNA, 25 bp, Mus musculus
gtgacatccccatagttgcctgagg

SEQ ID NO: 697020 - DNA, 25 bp, Mus musculus
gtgacatccgagcttgaatcgtaca

SEQ ID NO: 697021 - DNA, 25 bp, Mus musculus
gtgacatccgaggttgaatcgtaca

SEQ ID NO: 697022 - DNA, 25 bp, Mus musculus
gtgacatccgttatccacagagcca

SEQ ID NO: 697023 - DNA, 25 bp, Mus musculus
gtgacatccgttttccacagagcca

SEQ ID NO: 697024 - DNA, 25 bp, Mus musculus
gtgacatcctcacgagatacctgga

SEQ ID NO: 697025 - DNA, 25 bp, Mus musculus
gtgacatcctcaggagatacctgga

SEQ ID NO: 697026 - DNA, 25 bp, Mus musculus
gtgacatccttcatgattagaatat

SEQ ID NO: 697027 - DNA, 25 bp, Mus musculus
gtgacatccttcttgattagaatat

SEQ ID NO: 697028 - DNA, 25 bp, Mus musculus
gtgacatcggccatctgttcagtta

SEQ ID NO: 697029 - DNA, 25 bp, Mus musculus
gtgacatcggccatgggcataggaa

SEQ ID NO: 697030 - DNA, 25 bp, Mus musculus
gtgacatcggccttctgttcagtta

SEQ ID NO: 697031 - DNA, 25 bp, Mus musculus
gtgacatcggccttgggcataggaa

SEQ ID NO: 697032 - DNA, 25 bp, Mus musculus
gtgacatcggtgataaaggccactc

SEQ ID NO: 697033 - DNA, 25 bp, Mus musculus
gtgacatcggtgttaaaggccactc

SEQ ID NO: 697034 - DNA, 25 bp, Mus musculus
gtgacatctataattatccccaaat

SEQ ID NO: 697035 - DNA, 25 bp, Mus musculus
gtgacatctatatttatccccaaat

SEQ ID NO: 697036 - DNA, 25 bp, Mus musculus
gtgacatctgcaaaagacttgtaat

SEQ ID NO: 697037 - DNA, 25 bp, Mus musculus
gtgacatctgcataagacttgtaat

SEQ ID NO: 697038 - DNA, 25 bp, Mus musculus
gtgacatctgtcagcatggtggatt

SEQ ID NO: 697039 - DNA, 25 bp, Mus musculus
gtgacatctgtctgcatggtggatt

SEQ ID NO: 697040 - DNA, 25 bp, Mus musculus
gtgacatcttgacttttctgagtgg

SEQ ID NO: 697041 - DNA, 25 bp, Mus musculus
gtgacatcttgagttttctgagtgg

SEQ ID NO: 697042 - DNA, 25 bp, Mus musculus
gtgacatgaaaacttcctgtatttt

SEQ ID NO: 697043 - DNA, 25 bp, Mus musculus
gtgacatgaaaagttcctgtatttt

SEQ ID NO: 697044 - DNA, 25 bp, Mus musculus
gtgacatgaatgctttgctttttta

SEQ ID NO: 697045 - DNA, 25 bp, Mus musculus
gtgacatgaatggtttgctttttta

SEQ ID NO: 697046 - DNA, 25 bp, Mus musculus
gtgacatgacagactctagccagaa

SEQ ID NO: 697047 - DNA, 25 bp, Mus musculus
gtgacatgacagtctctagccagaa

SEQ ID NO: 697048 - DNA, 25 bp, Mus musculus
gtgacatgagctccacttggtggct

SEQ ID NO: 697049 - DNA, 25 bp, Mus musculus
gtgacatgagctgcacttggtggct

SEQ ID NO: 697050 - DNA, 25 bp, Mus musculus
gtgacatgatcaaactactggtggt

SEQ ID NO: 697051 - DNA, 25 bp, Mus musculus
gtgacatgatcatactactggtggt

SEQ ID NO: 697052 - DNA, 25 bp, Mus musculus
gtgacatgatctacttccattccta

SEQ ID NO: 697053 - DNA, 25 bp, Mus musculus
gtgacatgatcttcttccattccta

SEQ ID NO: 697054 - DNA, 25 bp, Mus musculus
gtgacatgatggctgacccctggaa

SEQ ID NO: 697055 - DNA, 25 bp, Mus musculus
gtgacatgatgggtgacccctggaa

SEQ ID NO: 697056 - DNA, 25 bp, Mus musculus
gtgacatgctgcactttgggagtct

SEQ ID NO: 697057 - DNA, 25 bp, Mus musculus
gtgacatgctgctctttgggagtct

SEQ ID NO: 697058 - DNA, 25 bp, Mus musculus
gtgacatgggtaaatccgtgctgcc

SEQ ID NO: 697059 - DNA, 25 bp, Mus musculus
gtgacatgggtatatccgtgctgcc

SEQ ID NO: 697060 - DNA, 25 bp, Mus musculus
gtgacatgggtccaccttctgattt

SEQ ID NO: 697061 - DNA, 25 bp, Mus musculus
gtgacatgggtcgaccttctgattt

SEQ ID NO: 697062 - DNA, 25 bp, Mus musculus
gtgacatgggttccatatttgagat

SEQ ID NO: 697063 - DNA, 25 bp, Mus musculus
gtgacatgggttgcatatttgagat

SEQ ID NO: 697064 - DNA, 25 bp, Mus musculus
gtgacatggtacaaatctacaactt

SEQ ID NO: 697065 - DNA, 25 bp, Mus musculus
gtgacatggtactaatctacaactt

SEQ ID NO: 697066 - DNA, 25 bp, Mus musculus
gtgacatggtagagttcagccagct

SEQ ID NO: 697067 - DNA, 25 bp, Mus musculus
gtgacatggtagtgttcagccagct

SEQ ID NO: 697068 - DNA, 25 bp, Mus musculus
gtgacatggttgcacctgaggttcc

SEQ ID NO: 697069 - DNA, 25 bp, Mus musculus
gtgacatggttggacctgaggttcc

SEQ ID NO: 697070 - DNA, 25 bp, Mus musculus
gtgacatggtttagagttggcctct

SEQ ID NO: 697071 - DNA, 25 bp, Mus musculus
gtgacatggttttgagttggcctct

SEQ ID NO: 697072 - DNA, 25 bp, Mus musculus
gtgacatgtaggacatgcctcccca

SEQ ID NO: 697073 - DNA, 25 bp, Mus musculus
gtgacatgtaggtcatgcctcccca

SEQ ID NO: 697074 - DNA, 25 bp, Mus musculus
gtgacatgtcagctcactgtcccag

SEQ ID NO: 697075 - DNA, 25 bp, Mus musculus
gtgacatgtcaggtcactgtcccag

SEQ ID NO: 697076 - DNA, 25 bp, Mus musculus
gtgacatgtgaaaccttttttaaga

SEQ ID NO: 697077 - DNA, 25 bp, Mus musculus
gtgacatgtgaatccttttttaaga

SEQ ID NO: 697078 - DNA, 25 bp, Mus musculus
gtgacatgtgagaccagattactgt

SEQ ID NO: 697079 - DNA, 25 bp, Mus musculus
gtgacatgtgagtccagattactgt

SEQ ID NO: 697080 - DNA, 25 bp, Mus musculus
gtgacattatccatccactgaggag

SEQ ID NO: 697081 - DNA, 25 bp, Mus musculus
gtgacattatccttccactgaggag

SEQ ID NO: 697082 - DNA, 25 bp, Mus musculus
gtgacattatttacagtagccccat

SEQ ID NO: 697083 - DNA, 25 bp, Mus musculus
gtgacattattttcagtagccccat

SEQ ID NO: 697084 - DNA, 25 bp, Mus musculus
gtgacattcacaacagagatccgca

SEQ ID NO: 697085 - DNA, 25 bp, Mus musculus
gtgacattcacatcagagatccgca

SEQ ID NO: 697086 - DNA, 25 bp, Mus musculus
gtgacattcagtccacaactgcagt

SEQ ID NO: 697087 - DNA, 25 bp, Mus musculus
gtgacattcagtgcacaactgcagt

SEQ ID NO: 697088 - DNA, 25 bp, Mus musculus
gtgacattcattctagccctcattg

SEQ ID NO: 697089 - DNA, 25 bp, Mus musculus
gtgacattcattgtagccctcattg

SEQ ID NO: 697090 - DNA, 25 bp, Mus musculus
gtgacattcgctactgcactcagga

SEQ ID NO: 697091 - DNA, 25 bp, Mus musculus
gtgacattcgcttctgcactcagga

SEQ ID NO: 697092 - DNA, 25 bp, Mus musculus
gtgacattgaatcccctggaactgg

SEQ ID NO: 697093 - DNA, 25 bp, Mus musculus
gtgacattgaatgccctggaactgg

SEQ ID NO: 697094 - DNA, 25 bp, Mus musculus
gtgacattgctactgcagctgagcc

SEQ ID NO: 697095 - DNA, 25 bp, Mus musculus
gtgacattgctagtgcagctgagcc

SEQ ID NO: 697096 - DNA, 25 bp, Mus musculus
gtgacattggagctgagacctgaat

SEQ ID NO: 697097 - DNA, 25 bp, Mus musculus
gtgacattggaggtgagacctgaat

SEQ ID NO: 697098 - DNA, 25 bp, Mus musculus
gtgacattgggtctgctctgattta

SEQ ID NO: 697099 - DNA, 25 bp, Mus musculus
gtgacattgggtgtgctctgattta

SEQ ID NO: 697100 - DNA, 25 bp, Mus musculus
gtgacattgtaccactggtgagttc

SEQ ID NO: 697101 - DNA, 25 bp, Mus musculus
gtgacattgtacgactggtgagttc

SEQ ID NO: 697102 - DNA, 25 bp, Mus musculus
gtgacattgtccagtttgtgccctt

SEQ ID NO: 697103 - DNA, 25 bp, Mus musculus
gtgacattgtcctgtttgtgccctt

SEQ ID NO: 697104 - DNA, 25 bp, Mus musculus
gtgacatttaatatggtccaattgc

SEQ ID NO: 697105 - DNA, 25 bp, Mus musculus
gtgacatttaatttggtccaattgc

SEQ ID NO: 697106 - DNA, 25 bp, Mus musculus
gtgacatttacaaccaagtgattca

SEQ ID NO: 697107 - DNA, 25 bp, Mus musculus
gtgacatttacatccaagtgattca

SEQ ID NO: 697108 - DNA, 25 bp, Mus musculus
gtgacatttcacagtttaccaagat

SEQ ID NO: 697109 - DNA, 25 bp, Mus musculus
gtgacatttcacatagctgttatag

SEQ ID NO: 697110 - DNA, 25 bp, Mus musculus
gtgacatttcactgtttaccaagat

SEQ ID NO: 697111 - DNA, 25 bp, Mus musculus
gtgacatttcacttagctgttatag

SEQ ID NO: 697112 - DNA, 25 bp, Mus musculus
gtgacatttcctacagagcttttat

SEQ ID NO: 697113 - DNA, 25 bp, Mus musculus
gtgacatttcctcacattgtactgc

SEQ ID NO: 697114 - DNA, 25 bp, Mus musculus
gtgacatttcctgacattgtactgc

SEQ ID NO: 697115 - DNA, 25 bp, Mus musculus
gtgacatttccttcagagcttttat

SEQ ID NO: 697116 - DNA, 25 bp, Mus musculus
gtgacatttctgacatggagttacc

SEQ ID NO: 697117 - DNA, 25 bp, Mus musculus
gtgacatttctgtcatggagttacc

SEQ ID NO: 697118 - DNA, 25 bp, Mus musculus
gtgacatttcttcccatcattttgc

SEQ ID NO: 697119 - DNA, 25 bp, Mus musculus
gtgacatttcttgccatcattttgc

SEQ ID NO: 697120 - DNA, 25 bp, Mus musculus
gtgacatttgatacaactgttgagc

SEQ ID NO: 697121 - DNA, 25 bp, Mus musculus
gtgacatttgattcaactgttgagc

SEQ ID NO: 697122 - DNA, 25 bp, Mus musculus
gtgacatttgccaacaacacgtagg

SEQ ID NO: 697123 - DNA, 25 bp, Mus musculus
gtgacatttgccatcattatctcaa

SEQ ID NO: 697124 - DNA, 25 bp, Mus musculus
gtgacatttgcctacaacacgtagg

SEQ ID NO: 697125 - DNA, 25 bp, Mus musculus
gtgacatttgccttcattatctcaa

SEQ ID NO: 697126 - DNA, 25 bp, Mus musculus
gtgacatttggcaagcatcagacgc

SEQ ID NO: 697127 - DNA, 25 bp, Mus musculus
gtgacatttggctagcatcagacgc

SEQ ID NO: 697128 - DNA, 25 bp, Mus musculus
gtgacatttgtgactctgaaagacc

SEQ ID NO: 697129 - DNA, 25 bp, Mus musculus
gtgacatttgtgtctctgaaagacc

SEQ ID NO: 697130 - DNA, 25 bp, Mus musculus
gtgacattttagagactgaccgaaa

SEQ ID NO: 697131 - DNA, 25 bp, Mus musculus
gtgacattttagtgactgaccgaaa

SEQ ID NO: 697132 - DNA, 25 bp, Mus musculus
gtgacattttctaactattcagttg

SEQ ID NO: 697133 - DNA, 25 bp, Mus musculus
gtgacattttctcgaagggactctg

SEQ ID NO: 697134 - DNA, 25 bp, Mus musculus
gtgacattttctggaagggactctg

SEQ ID NO: 697135 - DNA, 25 bp, Mus musculus
gtgacattttcttactattcagttg

SEQ ID NO: 697136 - DNA, 25 bp, Mus musculus
gtgacattttgcactcaagacccaa

SEQ ID NO: 697137 - DNA, 25 bp, Mus musculus
gtgacattttgctctcaagacccaa

SEQ ID NO: 697138 - DNA, 25 bp, Mus musculus
gtgacattttgtaagccagcctgac

SEQ ID NO: 697139 - DNA, 25 bp, Mus musculus
gtgacattttgtacatccatttaat

SEQ ID NO: 697140 - DNA, 25 bp, Mus musculus
gtgacattttgttagccagcctgac

SEQ ID NO: 697141 - DNA, 25 bp, Mus musculus
gtgacattttgttcatccatttaat

SEQ ID NO: 697142 - DNA, 25 bp, Mus musculus
gtgacatttttaatgtttctatttc

SEQ ID NO: 697143 - DNA, 25 bp, Mus musculus
gtgacatttttattgtttctatttc

SEQ ID NO: 697144 - DNA, 25 bp, Mus musculus
gtgaccaaaacactagcttgctttt

SEQ ID NO: 697145 - DNA, 25 bp, Mus musculus
gtgaccaaaacagtagcttgctttt

SEQ ID NO: 697146 - DNA, 25 bp, Mus musculus
gtgaccaaaaccaaagacggccatg

SEQ ID NO: 697147 - DNA, 25 bp, Mus musculus
gtgaccaaaacctaagacggccatg

SEQ ID NO: 697148 - DNA, 25 bp, Mus musculus
gtgaccaaaagcatacggcctcagg

SEQ ID NO: 697149 - DNA, 25 bp, Mus musculus
gtgaccaaaagcttacggcctcagg

SEQ ID NO: 697150 - DNA, 25 bp, Mus musculus
gtgaccaaacagatccttttaaccg

SEQ ID NO: 697151 - DNA, 25 bp, Mus musculus
gtgaccaaacagttccttttaaccg

SEQ ID NO: 697152 - DNA, 25 bp, Mus musculus
gtgaccaaacgtcaccttctgggag

SEQ ID NO: 697153 - DNA, 25 bp, Mus musculus
gtgaccaaacgtgaccttctgggag

SEQ ID NO: 697154 - DNA, 25 bp, Mus musculus
gtgaccaaagagatgagcaaaatgt

SEQ ID NO: 697155 - DNA, 25 bp, Mus musculus
gtgaccaaagagttgagcaaaatgt

SEQ ID NO: 697156 - DNA, 25 bp, Mus musculus
gtgaccaaagggagcattaagtctt

SEQ ID NO: 697157 - DNA, 25 bp, Mus musculus
gtgaccaaagggtgcattaagtctt

SEQ ID NO: 697158 - DNA, 25 bp, Mus musculus
gtgaccaaatgaacgtttgtttagt

SEQ ID NO: 697159 - DNA, 25 bp, Mus musculus
gtgaccaaatgatcgtttgtttagt

SEQ ID NO: 697160 - DNA, 25 bp, Mus musculus
gtgaccaaattaactgtgcatttaa

SEQ ID NO: 697161 - DNA, 25 bp, Mus musculus
gtgaccaaattatctgtgcatttaa

SEQ ID NO: 697162 - DNA, 25 bp, Mus musculus
gtgaccaaccacatgactcgagatt

SEQ ID NO: 697163 - DNA, 25 bp, Mus musculus
gtgaccaaccacatgccaaaatgat

SEQ ID NO: 697164 - DNA, 25 bp, Mus musculus
gtgaccaaccacttgactcgagatt

SEQ ID NO: 697165 - DNA, 25 bp, Mus musculus
gtgaccaaccacttgccaaaatgat

SEQ ID NO: 697166 - DNA, 25 bp, Mus musculus
gtgaccaaccagattttgcctaact

SEQ ID NO: 697167 - DNA, 25 bp, Mus musculus
gtgaccaaccagtttttgcctaact

SEQ ID NO: 697168 - DNA, 25 bp, Mus musculus
gtgaccaaccgccttagatctgagt

SEQ ID NO: 697169 - DNA, 25 bp, Mus musculus
gtgaccaaccgcgttagatctgagt

SEQ ID NO: 697170 - DNA, 25 bp, Mus musculus
gtgaccaactctagggacactcagg

SEQ ID NO: 697171 - DNA, 25 bp, Mus musculus
gtgaccaactcttgggacactcagg

SEQ ID NO: 697172 - DNA, 25 bp, Mus musculus
gtgaccaagactaccgatgtggctg

SEQ ID NO: 697173 - DNA, 25 bp, Mus musculus
gtgaccaagacttccgatgtggctg

SEQ ID NO: 697174 - DNA, 25 bp, Mus musculus
gtgaccaagatgagctttgaccttc

SEQ ID NO: 697175 - DNA, 25 bp, Mus musculus
gtgaccaagatgtgctttgaccttc

SEQ ID NO: 697176 - DNA, 25 bp, Mus musculus
gtgaccaagcaaccatacctgagta

SEQ ID NO: 697177 - DNA, 25 bp, Mus musculus
gtgaccaagcaagcatacctgagta

SEQ ID NO: 697178 - DNA, 25 bp, Mus musculus
gtgaccaagcacaagggttccccag

SEQ ID NO: 697179 - DNA, 25 bp, Mus musculus
gtgaccaagcacagactgtgcagtt

SEQ ID NO: 697180 - DNA, 25 bp, Mus musculus
gtgaccaagcactagggttccccag

SEQ ID NO: 697181 - DNA, 25 bp, Mus musculus
gtgaccaagcactgactgtgcagtt

SEQ ID NO: 697182 - DNA, 25 bp, Mus musculus
gtgaccaagcagataactgttcctg

SEQ ID NO: 697183 - DNA, 25 bp, Mus musculus
gtgaccaagcagttaactgttcctg

SEQ ID NO: 697184 - DNA, 25 bp, Mus musculus
gtgaccaaggagaagcatccggtta

SEQ ID NO: 697185 - DNA, 25 bp, Mus musculus
gtgaccaaggagtagcatccggtta

SEQ ID NO: 697186 - DNA, 25 bp, Mus musculus
gtgaccaaggcaagactgaagcatt

SEQ ID NO: 697187 - DNA, 25 bp, Mus musculus
gtgaccaaggcatgactgaagcatt

SEQ ID NO: 697188 - DNA, 25 bp, Mus musculus
gtgaccaagggcagacttcctatga

SEQ ID NO: 697189 - DNA, 25 bp, Mus musculus
gtgaccaagggctgacttcctatga

SEQ ID NO: 697190 - DNA, 25 bp, Mus musculus
gtgaccaagtctcgagacccttttg

SEQ ID NO: 697191 - DNA, 25 bp, Mus musculus
gtgaccaagtctggagacccttttg

SEQ ID NO: 697192 - DNA, 25 bp, Mus musculus
gtgaccaataccaaacagtgagggc

SEQ ID NO: 697193 - DNA, 25 bp, Mus musculus
gtgaccaatacctaacagtgagggc

SEQ ID NO: 697194 - DNA, 25 bp, Mus musculus
gtgaccaatgccattcaattctttt

SEQ ID NO: 697195 - DNA, 25 bp, Mus musculus
gtgaccaatgcctttcaattctttt

SEQ ID NO: 697196 - DNA, 25 bp, Mus musculus
gtgaccacaaatatctcagctccaa

SEQ ID NO: 697197 - DNA, 25 bp, Mus musculus
gtgaccacaaatccttgcttgaact

SEQ ID NO: 697198 - DNA, 25 bp, Mus musculus
gtgaccacaaatgcttgcttgaact

SEQ ID NO: 697199 - DNA, 25 bp, Mus musculus
gtgaccacaaatttctcagctccaa

SEQ ID NO: 697200 - DNA, 25 bp, Mus musculus
gtgaccacaactcggccatgggctg

SEQ ID NO: 697201 - DNA, 25 bp, Mus musculus
gtgaccacaactgggccatgggctg

SEQ ID NO: 697202 - DNA, 25 bp, Mus musculus
gtgaccacaaggacagtacgccagg

SEQ ID NO: 697203 - DNA, 25 bp, Mus musculus
gtgaccacaaggtcagtacgccagg

SEQ ID NO: 697204 - DNA, 25 bp, Mus musculus
gtgaccacaagtctgaaatcacagt

SEQ ID NO: 697205 - DNA, 25 bp, Mus musculus
gtgaccacaagtgtgaaatcacagt

SEQ ID NO: 697206 - DNA, 25 bp, Mus musculus
gtgaccacacaaagagaagttccta

SEQ ID NO: 697207 - DNA, 25 bp, Mus musculus
gtgaccacacaatgagaagttccta

SEQ ID NO: 697208 - DNA, 25 bp, Mus musculus
gtgaccacacacaaagcataggctc

SEQ ID NO: 697209 - DNA, 25 bp, Mus musculus
gtgaccacacactaagcataggctc

SEQ ID NO: 697210 - DNA, 25 bp, Mus musculus
gtgaccacagcccaggcaacaggca

SEQ ID NO: 697211 - DNA, 25 bp, Mus musculus
gtgaccacagccgaggcaacaggca

SEQ ID NO: 697212 - DNA, 25 bp, Mus musculus
gtgaccacagctcgttacacaatat

SEQ ID NO: 697213 - DNA, 25 bp, Mus musculus
gtgaccacagctggttacacaatat

SEQ ID NO: 697214 - DNA, 25 bp, Mus musculus
gtgaccacaggtatggcttaagctg

SEQ ID NO: 697215 - DNA, 25 bp, Mus musculus
gtgaccacaggtttggcttaagctg

SEQ ID NO: 697216 - DNA, 25 bp, Mus musculus
gtgaccacatgcattctgtaccatt

SEQ ID NO: 697217 - DNA, 25 bp, Mus musculus
gtgaccacatgctttctgtaccatt

SEQ ID NO: 697218 - DNA, 25 bp, Mus musculus
gtgaccacatgtagtttatttcttt

SEQ ID NO: 697219 - DNA, 25 bp, Mus musculus
gtgaccacatgttgtttatttcttt

SEQ ID NO: 697220 - DNA, 25 bp, Mus musculus
gtgaccacattcactgcctgggcaa

SEQ ID NO: 697221 - DNA, 25 bp, Mus musculus
gtgaccacattctctgcctgggcaa

SEQ ID NO: 697222 - DNA, 25 bp, Mus musculus
gtgaccaccaatcctcaggagctga

SEQ ID NO: 697223 - DNA, 25 bp, Mus musculus
gtgaccaccaatgctcaggagctga

SEQ ID NO: 697224 - DNA, 25 bp, Mus musculus
gtgaccaccagaaacaataatagct

SEQ ID NO: 697225 - DNA, 25 bp, Mus musculus
gtgaccaccagatacaataatagct

SEQ ID NO: 697226 - DNA, 25 bp, Mus musculus
gtgaccaccaggatctaagaccttg

SEQ ID NO: 697227 - DNA, 25 bp, Mus musculus
gtgaccaccaggttctaagaccttg

SEQ ID NO: 697228 - DNA, 25 bp, Mus musculus
gtgaccaccccaaaaactgttaata

SEQ ID NO: 697229 - DNA, 25 bp, Mus musculus
gtgaccaccccataaactgttaata

SEQ ID NO: 697230 - DNA, 25 bp, Mus musculus
gtgaccaccgcacgagagtttctct

SEQ ID NO: 697231 - DNA, 25 bp, Mus musculus
gtgaccaccgcaggagagtttctct

SEQ ID NO: 697232 - DNA, 25 bp, Mus musculus
gtgaccaccgtgatattggaagttc

SEQ ID NO: 697233 - DNA, 25 bp, Mus musculus
gtgaccaccgtgttattggaagttc

SEQ ID NO: 697234 - DNA, 25 bp, Mus musculus
gtgaccacctgcatcatttataggg

SEQ ID NO: 697235 - DNA, 25 bp, Mus musculus
gtgaccacctgcttcatttataggg

SEQ ID NO: 697236 - DNA, 25 bp, Mus musculus
gtgaccaccttgattgttaatcaga

SEQ ID NO: 697237 - DNA, 25 bp, Mus musculus
gtgaccaccttgtttgttaatcaga

SEQ ID NO: 697238 - DNA, 25 bp, Mus musculus
gtgaccacggtacatccatgaagac

SEQ ID NO: 697239 - DNA, 25 bp, Mus musculus
gtgaccacggtagatccatgaagac

SEQ ID NO: 697240 - DNA, 25 bp, Mus musculus
gtgaccacgtgaccacaatcatttt

SEQ ID NO: 697241 - DNA, 25 bp, Mus musculus
gtgaccacgtgagcacaatcatttt

SEQ ID NO: 697242 - DNA, 25 bp, Mus musculus
gtgaccactaccaggccaaatgata

SEQ ID NO: 697243 - DNA, 25 bp, Mus musculus
gtgaccactacctggccaaatgata

SEQ ID NO: 697244 - DNA, 25 bp, Mus musculus
gtgaccactcaaaccatcagcaggg

SEQ ID NO: 697245 - DNA, 25 bp, Mus musculus
gtgaccactcaaagtttctgttatg

SEQ ID NO: 697246 - DNA, 25 bp, Mus musculus
gtgaccactcaatccatcagcaggg

SEQ ID NO: 697247 - DNA, 25 bp, Mus musculus
gtgaccactcaatgtttctgttatg

SEQ ID NO: 697248 - DNA, 25 bp, Mus musculus
gtgaccactgcaaaggctaactaat

SEQ ID NO: 697249 - DNA, 25 bp, Mus musculus
gtgaccactgcataggctaactaat

SEQ ID NO: 697250 - DNA, 25 bp, Mus musculus
gtgaccactggtatctgtacccaga

SEQ ID NO: 697251 - DNA, 25 bp, Mus musculus
gtgaccactggtttctgtacccaga

SEQ ID NO: 697252 - DNA, 25 bp, Mus musculus
gtgaccactgtaactgagctctttt

SEQ ID NO: 697253 - DNA, 25 bp, Mus musculus
gtgaccactgtatctgagctctttt

SEQ ID NO: 697254 - DNA, 25 bp, Mus musculus
gtgaccacttcaattgtaaaccgag

SEQ ID NO: 697255 - DNA, 25 bp, Mus musculus
gtgaccacttcatttgtaaaccgag

SEQ ID NO: 697256 - DNA, 25 bp, Mus musculus
gtgaccacttccagttcactttttt

SEQ ID NO: 697257 - DNA, 25 bp, Mus musculus
gtgaccacttcctgttcactttttt

SEQ ID NO: 697258 - DNA, 25 bp, Mus musculus
gtgaccacttttaatgcaggacttg

SEQ ID NO: 697259 - DNA, 25 bp, Mus musculus
gtgaccactttttatgcaggacttg

SEQ ID NO: 697260 - DNA, 25 bp, Mus musculus
gtgaccagaacaagagctgctcgga

SEQ ID NO: 697261 - DNA, 25 bp, Mus musculus
gtgaccagaacatgagctgctcgga

SEQ ID NO: 697262 - DNA, 25 bp, Mus musculus
gtgaccagaactacctcatactctt

SEQ ID NO: 697263 - DNA, 25 bp, Mus musculus
gtgaccagaacttcctcatactctt

SEQ ID NO: 697264 - DNA, 25 bp, Mus musculus
gtgaccagacaaaagaaaaggcata

SEQ ID NO: 697265 - DNA, 25 bp, Mus musculus
gtgaccagacaatagaaaaggcata

SEQ ID NO: 697266 - DNA, 25 bp, Mus musculus
gtgaccagaccactgcagctgtcat

SEQ ID NO: 697267 - DNA, 25 bp, Mus musculus
gtgaccagaccactggtgaccttgg

SEQ ID NO: 697268 - DNA, 25 bp, Mus musculus
gtgaccagaccagtgcagctgtcat

SEQ ID NO: 697269 - DNA, 25 bp, Mus musculus
gtgaccagaccagtggtgaccttgg

SEQ ID NO: 697270 - DNA, 25 bp, Mus musculus
gtgaccagatctctttcgcggacta

SEQ ID NO: 697271 - DNA, 25 bp, Mus musculus
gtgaccagatctgtttcgcggacta

SEQ ID NO: 697272 - DNA, 25 bp, Mus musculus
gtgaccagattcacggtgacacaca

SEQ ID NO: 697273 - DNA, 25 bp, Mus musculus
gtgaccagattctcggtgacacaca

SEQ ID NO: 697274 - DNA, 25 bp, Mus musculus
gtgaccagcaccaacaagggaggca

SEQ ID NO: 697275 - DNA, 25 bp, Mus musculus
gtgaccagcacctacaagggaggca

SEQ ID NO: 697276 - DNA, 25 bp, Mus musculus
gtgaccagcaggaatgcctggcgaa

SEQ ID NO: 697277 - DNA, 25 bp, Mus musculus
gtgaccagcaggtatgcctggcgaa

SEQ ID NO: 697278 - DNA, 25 bp, Mus musculus
gtgaccagcattctcaacaaacctg

SEQ ID NO: 697279 - DNA, 25 bp, Mus musculus
gtgaccagcattgtcaacaaacctg

SEQ ID NO: 697280 - DNA, 25 bp, Mus musculus
gtgaccagccggatgaactgtcctt

SEQ ID NO: 697281 - DNA, 25 bp, Mus musculus
gtgaccagccggttgaactgtcctt

SEQ ID NO: 697282 - DNA, 25 bp, Mus musculus
gtgaccagctaactcagcagcagca

SEQ ID NO: 697283 - DNA, 25 bp, Mus musculus
gtgaccagctaagtcagcagcagca

SEQ ID NO: 697284 - DNA, 25 bp, Mus musculus
gtgaccaggagcacccgggatgtcc

SEQ ID NO: 697285 - DNA, 25 bp, Mus musculus
gtgaccaggagctcccgggatgtcc

SEQ ID NO: 697286 - DNA, 25 bp, Mus musculus
gtgaccaggcaccagaaggttgcca

SEQ ID NO: 697287 - DNA, 25 bp, Mus musculus
gtgaccaggcacgagaaggttgcca

SEQ ID NO: 697288 - DNA, 25 bp, Mus musculus
gtgaccaggcagaaccttggcctgg

SEQ ID NO: 697289 - DNA, 25 bp, Mus musculus
gtgaccaggcagtaccttggcctgg

SEQ ID NO: 697290 - DNA, 25 bp, Mus musculus
gtgaccaggcatatcatgttccatc

SEQ ID NO: 697291 - DNA, 25 bp, Mus musculus
gtgaccaggcatttcatgttccatc

SEQ ID NO: 697292 - DNA, 25 bp, Mus musculus
gtgaccaggccactgtagagaagca

SEQ ID NO: 697293 - DNA, 25 bp, Mus musculus
gtgaccaggccagtgtagagaagca

SEQ ID NO: 697294 - DNA, 25 bp, Mus musculus
gtgaccagggcaccgagcattagct

SEQ ID NO: 697295 - DNA, 25 bp, Mus musculus
gtgaccagggcagcgagcattagct

SEQ ID NO: 697296 - DNA, 25 bp, Mus musculus
gtgaccaggtgcagaaagtccaggt

SEQ ID NO: 697297 - DNA, 25 bp, Mus musculus
gtgaccaggtgctgaaagtccaggt

SEQ ID NO: 697298 - DNA, 25 bp, Mus musculus
gtgaccagtaatcccactaccagtt

SEQ ID NO: 697299 - DNA, 25 bp, Mus musculus
gtgaccagtaatgccactaccagtt

SEQ ID NO: 697300 - DNA, 25 bp, Mus musculus
gtgaccagtatgactgcctagtcat

SEQ ID NO: 697301 - DNA, 25 bp, Mus musculus
gtgaccagtatgtctgcctagtcat

SEQ ID NO: 697302 - DNA, 25 bp, Mus musculus
gtgaccagtcctaagaagagtgtta

SEQ ID NO: 697303 - DNA, 25 bp, Mus musculus
gtgaccagtcctatgtgatcagttt

SEQ ID NO: 697304 - DNA, 25 bp, Mus musculus
gtgaccagtccttagaagagtgtta

SEQ ID NO: 697305 - DNA, 25 bp, Mus musculus
gtgaccagtcctttgtgatcagttt

SEQ ID NO: 697306 - DNA, 25 bp, Mus musculus
gtgaccagtctcagagctgtgcgtt

SEQ ID NO: 697307 - DNA, 25 bp, Mus musculus
gtgaccagtctctgagctgtgcgtt

SEQ ID NO: 697308 - DNA, 25 bp, Mus musculus
gtgaccagtgataagcgtcccgtgt

SEQ ID NO: 697309 - DNA, 25 bp, Mus musculus
gtgaccagtgattagcgtcccgtgt

SEQ ID NO: 697310 - DNA, 25 bp, Mus musculus
gtgaccagttcaaattatgactcag

SEQ ID NO: 697311 - DNA, 25 bp, Mus musculus
gtgaccagttcatattatgactcag

SEQ ID NO: 697312 - DNA, 25 bp, Mus musculus
gtgaccagttgacttcagggaccca

SEQ ID NO: 697313 - DNA, 25 bp, Mus musculus
gtgaccagttgagttcagggaccca

SEQ ID NO: 697314 - DNA, 25 bp, Mus musculus
gtgaccataaccatgtcaggccgtt

SEQ ID NO: 697315 - DNA, 25 bp, Mus musculus
gtgaccataaccttgtcaggccgtt

SEQ ID NO: 697316 - DNA, 25 bp, Mus musculus
gtgaccatattacatctcttcgcct

SEQ ID NO: 697317 - DNA, 25 bp, Mus musculus
gtgaccatattagatctcttcgcct

SEQ ID NO: 697318 - DNA, 25 bp, Mus musculus
gtgaccatcacccagtaacggaatg

SEQ ID NO: 697319 - DNA, 25 bp, Mus musculus
gtgaccatcaccgagtaacggaatg

SEQ ID NO: 697320 - DNA, 25 bp, Mus musculus
gtgaccatcagaagcacttaaccct

SEQ ID NO: 697321 - DNA, 25 bp, Mus musculus
gtgaccatcagatgcacttaaccct

SEQ ID NO: 697322 - DNA, 25 bp, Mus musculus
gtgaccatcatcattaactactgtg

SEQ ID NO: 697323 - DNA, 25 bp, Mus musculus
gtgaccatcatctttaactactgtg

SEQ ID NO: 697324 - DNA, 25 bp, Mus musculus
gtgaccatcctgagttaagagggtg

SEQ ID NO: 697325 - DNA, 25 bp, Mus musculus
gtgaccatcctgtgttaagagggtg

SEQ ID NO: 697326 - DNA, 25 bp, Mus musculus
gtgaccatccttattgtggctgttt

SEQ ID NO: 697327 - DNA, 25 bp, Mus musculus
gtgaccatcctttttgtggctgttt

SEQ ID NO: 697328 - DNA, 25 bp, Mus musculus
gtgaccatctaaacttgtagctagg

SEQ ID NO: 697329 - DNA, 25 bp, Mus musculus
gtgaccatctaatcttgtagctagg

SEQ ID NO: 697330 - DNA, 25 bp, Mus musculus
gtgaccatctggagcagattcctct

SEQ ID NO: 697331 - DNA, 25 bp, Mus musculus
gtgaccatctggtgcagattcctct

SEQ ID NO: 697332 - DNA, 25 bp, Mus musculus
gtgaccatcttacttagggtgctgt

SEQ ID NO: 697333 - DNA, 25 bp, Mus musculus
gtgaccatcttagttagggtgctgt

SEQ ID NO: 697334 - DNA, 25 bp, Mus musculus
gtgaccatgaacaaaagcctctaaa

SEQ ID NO: 697335 - DNA, 25 bp, Mus musculus
gtgaccatgaactaaagcctctaaa

SEQ ID NO: 697336 - DNA, 25 bp, Mus musculus
gtgaccatgcaccaaaaacatcaat

SEQ ID NO: 697337 - DNA, 25 bp, Mus musculus
gtgaccatgcacgaaaaacatcaat

SEQ ID NO: 697338 - DNA, 25 bp, Mus musculus
gtgaccatggtcaactaactgttga

SEQ ID NO: 697339 - DNA, 25 bp, Mus musculus
gtgaccatggtctactaactgttga

SEQ ID NO: 697340 - DNA, 25 bp, Mus musculus
gtgaccatgtttaatatcttgcttg

SEQ ID NO: 697341 - DNA, 25 bp, Mus musculus
gtgaccatgttttatatcttgcttg

SEQ ID NO: 697342 - DNA, 25 bp, Mus musculus
gtgaccattcaaattaacagtatta

SEQ ID NO: 697343 - DNA, 25 bp, Mus musculus
gtgaccattcaatttaacagtatta

SEQ ID NO: 697344 - DNA, 25 bp, Mus musculus
gtgaccattctgctttgctgtaaca

SEQ ID NO: 697345 - DNA, 25 bp, Mus musculus
gtgaccattctggtttgctgtaaca

SEQ ID NO: 697346 - DNA, 25 bp, Mus musculus
gtgaccattgaaaaccatcctcatc

SEQ ID NO: 697347 - DNA, 25 bp, Mus musculus
gtgaccattgaaatgtgcaacgccc

SEQ ID NO: 697348 - DNA, 25 bp, Mus musculus
gtgaccattgaataccatcctcatc

SEQ ID NO: 697349 - DNA, 25 bp, Mus musculus
gtgaccattgaattgtgcaacgccc

SEQ ID NO: 697350 - DNA, 25 bp, Mus musculus
gtgaccatttgtcacatttagtaca

SEQ ID NO: 697351 - DNA, 25 bp, Mus musculus
gtgaccatttgtgacatttagtaca

SEQ ID NO: 697352 - DNA, 25 bp, Mus musculus
gtgaccatttttagagctgatacca

SEQ ID NO: 697353 - DNA, 25 bp, Mus musculus
gtgaccattttttgagctgatacca

SEQ ID NO: 697354 - DNA, 25 bp, Mus musculus
gtgacccaaaccacaaggcgttatt

SEQ ID NO: 697355 - DNA, 25 bp, Mus musculus
gtgacccaaacctcaaggcgttatt

SEQ ID NO: 697356 - DNA, 25 bp, Mus musculus
gtgacccaagtgaggatttggcaca

SEQ ID NO: 697357 - DNA, 25 bp, Mus musculus
gtgacccaagtgtggatttggcaca

SEQ ID NO: 697358 - DNA, 25 bp, Mus musculus
gtgacccaatttactctggtaaggg

SEQ ID NO: 697359 - DNA, 25 bp, Mus musculus
gtgacccaattttctctggtaaggg

SEQ ID NO: 697360 - DNA, 25 bp, Mus musculus
gtgacccacatacatggtacggtta

SEQ ID NO: 697361 - DNA, 25 bp, Mus musculus
gtgacccacatagatggtacggtta

SEQ ID NO: 697362 - DNA, 25 bp, Mus musculus
gtgacccaccatctaagacctgaag

SEQ ID NO: 697363 - DNA, 25 bp, Mus musculus
gtgacccaccatgtaagacctgaag

SEQ ID NO: 697364 - DNA, 25 bp, Mus musculus
gtgacccacttgaatgactgatcta

SEQ ID NO: 697365 - DNA, 25 bp, Mus musculus
gtgacccacttgtatgactgatcta

SEQ ID NO: 697366 - DNA, 25 bp, Mus musculus
gtgacccagaatattttggtgctta

SEQ ID NO: 697367 - DNA, 25 bp, Mus musculus
gtgacccagaatcccgctcagtaga

SEQ ID NO: 697368 - DNA, 25 bp, Mus musculus
gtgacccagaatgccgctcagtaga

SEQ ID NO: 697369 - DNA, 25 bp, Mus musculus
gtgacccagaattttttggtgctta

SEQ ID NO: 697370 - DNA, 25 bp, Mus musculus
gtgacccagctgcttgccactcatg

SEQ ID NO: 697371 - DNA, 25 bp, Mus musculus
gtgacccagctggttgccactcatg

SEQ ID NO: 697372 - DNA, 25 bp, Mus musculus
gtgacccagcttcacagcattgtgt

SEQ ID NO: 697373 - DNA, 25 bp, Mus musculus
gtgacccagcttgacagcattgtgt

SEQ ID NO: 697374 - DNA, 25 bp, Mus musculus
gtgacccagggaagcagacgcaaaa

SEQ ID NO: 697375 - DNA, 25 bp, Mus musculus
gtgacccagggatgcagacgcaaaa

SEQ ID NO: 697376 - DNA, 25 bp, Mus musculus
gtgacccagggtatgctgtatattt

SEQ ID NO: 697377 - DNA, 25 bp, Mus musculus
gtgacccagggtttgctgtatattt

SEQ ID NO: 697378 - DNA, 25 bp, Mus musculus
gtgacccagtatcactccaggctcg

SEQ ID NO: 697379 - DNA, 25 bp, Mus musculus
gtgacccagtatgactccaggctcg

SEQ ID NO: 697380 - DNA, 25 bp, Mus musculus
gtgacccagtctcgaaatgccaaaa

SEQ ID NO: 697381 - DNA, 25 bp, Mus musculus
gtgacccagtctggaaatgccaaaa

SEQ ID NO: 697382 - DNA, 25 bp, Mus musculus
gtgacccagtgacatgcatcatact

SEQ ID NO: 697383 - DNA, 25 bp, Mus musculus
gtgacccagtgagatgcatcatact

SEQ ID NO: 697384 - DNA, 25 bp, Mus musculus
gtgacccataggagattgtccttaa

SEQ ID NO: 697385 - DNA, 25 bp, Mus musculus
gtgacccataggtgattgtccttaa

SEQ ID NO: 697386 - DNA, 25 bp, Mus musculus
gtgacccatcaaacctaagctatta

SEQ ID NO: 697387 - DNA, 25 bp, Mus musculus
gtgacccatcaatcctaagctatta

SEQ ID NO: 697388 - DNA, 25 bp, Mus musculus
gtgacccatccaaggatgcgccgct

SEQ ID NO: 697389 - DNA, 25 bp, Mus musculus
gtgacccatccatggatgcgccgct

SEQ ID NO: 697390 - DNA, 25 bp, Mus musculus
gtgacccatctgcactaatttgcaa

SEQ ID NO: 697391 - DNA, 25 bp, Mus musculus
gtgacccatctggactaatttgcaa

SEQ ID NO: 697392 - DNA, 25 bp, Mus musculus
gtgacccattctattggggtagact

SEQ ID NO: 697393 - DNA, 25 bp, Mus musculus
gtgacccattcttttggggtagact

SEQ ID NO: 697394 - DNA, 25 bp, Mus musculus
gtgacccattgaagctatagctctt

SEQ ID NO: 697395 - DNA, 25 bp, Mus musculus
gtgacccattgatgctatagctctt

SEQ ID NO: 697396 - DNA, 25 bp, Mus musculus
gtgaccccaaacatcgaatgcacat

SEQ ID NO: 697397 - DNA, 25 bp, Mus musculus
gtgaccccaaacttcgaatgcacat

SEQ ID NO: 697398 - DNA, 25 bp, Mus musculus
gtgaccccacagacctgcttaagtt

SEQ ID NO: 697399 - DNA, 25 bp, Mus musculus
gtgaccccacagtcctgcttaagtt

SEQ ID NO: 697400 - DNA, 25 bp, Mus musculus
gtgaccccagaaaagaggcttgtgc

SEQ ID NO: 697401 - DNA, 25 bp, Mus musculus
gtgaccccagaatagaggcttgtgc

SEQ ID NO: 697402 - DNA, 25 bp, Mus musculus
gtgaccccaggacaactacagaagc

SEQ ID NO: 697403 - DNA, 25 bp, Mus musculus
gtgaccccaggagaactacagaagc

SEQ ID NO: 697404 - DNA, 25 bp, Mus musculus
gtgacccctatcatgtgtacatcaa

SEQ ID NO: 697405 - DNA, 25 bp, Mus musculus
gtgacccctatcttgtgtacatcaa

SEQ ID NO: 697406 - DNA, 25 bp, Mus musculus
gtgacccctattattagtggcaagt

SEQ ID NO: 697407 - DNA, 25 bp, Mus musculus
gtgacccctatttttagtggcaagt

SEQ ID NO: 697408 - DNA, 25 bp, Mus musculus
gtgacccctgtaccaaagaattttt

SEQ ID NO: 697409 - DNA, 25 bp, Mus musculus
gtgacccctgtagcaaagaattttt

SEQ ID NO: 697410 - DNA, 25 bp, Mus musculus
gtgacccctgtcaaagatgacttaa

SEQ ID NO: 697411 - DNA, 25 bp, Mus musculus
gtgacccctgtctaagatgacttaa

SEQ ID NO: 697412 - DNA, 25 bp, Mus musculus
gtgacccgacccagagtggctagct

SEQ ID NO: 697413 - DNA, 25 bp, Mus musculus
gtgacccgaccctgagtggctagct

SEQ ID NO: 697414 - DNA, 25 bp, Mus musculus
gtgacccgaccgcagatgacatctt

SEQ ID NO: 697415 - DNA, 25 bp, Mus musculus
gtgacccgaccggagatgacatctt

SEQ ID NO: 697416 - DNA, 25 bp, Mus musculus
gtgacccgagacaagcactttcatt

SEQ ID NO: 697417 - DNA, 25 bp, Mus musculus
gtgacccgagactagcactttcatt

SEQ ID NO: 697418 - DNA, 25 bp, Mus musculus
gtgacccgagataatttctatctca

SEQ ID NO: 697419 - DNA, 25 bp, Mus musculus
gtgacccgagattatttctatctca

SEQ ID NO: 697420 - DNA, 25 bp, Mus musculus
gtgacccgctccatggcttctggag

SEQ ID NO: 697421 - DNA, 25 bp, Mus musculus
gtgacccgctccttggcttctggag

SEQ ID NO: 697422 - DNA, 25 bp, Mus musculus
gtgacccggacaaggtgcagcgaat

SEQ ID NO: 697423 - DNA, 25 bp, Mus musculus
gtgacccggacatggtgcagcgaat

SEQ ID NO: 697424 - DNA, 25 bp, Mus musculus
gtgacccggaccataacggccagtg

SEQ ID NO: 697425 - DNA, 25 bp, Mus musculus
gtgacccggaccttaacggccagtg

SEQ ID NO: 697426 - DNA, 25 bp, Mus musculus
gtgacccgggccaagtacttcattc

SEQ ID NO: 697427 - DNA, 25 bp, Mus musculus
gtgacccgggcctagtacttcattc

SEQ ID NO: 697428 - DNA, 25 bp, Mus musculus
gtgacccggtttcgagaagtcgcca

SEQ ID NO: 697429 - DNA, 25 bp, Mus musculus
gtgacccggtttggagaagtcgcca

SEQ ID NO: 697430 - DNA, 25 bp, Mus musculus
gtgacccgtcaactgtctgagacaa

SEQ ID NO: 697431 - DNA, 25 bp, Mus musculus
gtgacccgtcaagtgtctgagacaa

SEQ ID NO: 697432 - DNA, 25 bp, Mus musculus
gtgaccctaaacatcgcttcaggaa

SEQ ID NO: 697433 - DNA, 25 bp, Mus musculus
gtgaccctaaacttcgcttcaggaa

SEQ ID NO: 697434 - DNA, 25 bp, Mus musculus
gtgaccctacatcttaactgctgat

SEQ ID NO: 697435 - DNA, 25 bp, Mus musculus
gtgaccctacatgttaactgctgat

SEQ ID NO: 697436 - DNA, 25 bp, Mus musculus
gtgaccctcagactacactgcacag

SEQ ID NO: 697437 - DNA, 25 bp, Mus musculus
gtgaccctcagagtacactgcacag

SEQ ID NO: 697438 - DNA, 25 bp, Mus musculus
gtgaccctcagcatagctcgtggca

SEQ ID NO: 697439 - DNA, 25 bp, Mus musculus
gtgaccctcagcttagctcgtggca

SEQ ID NO: 697440 - DNA, 25 bp, Mus musculus
gtgaccctcctgacatttcagtggg

SEQ ID NO: 697441 - DNA, 25 bp, Mus musculus
gtgaccctcctgtcatttcagtggg

SEQ ID NO: 697442 - DNA, 25 bp, Mus musculus
gtgaccctcgtcatacagcaaatgg

SEQ ID NO: 697443 - DNA, 25 bp, Mus musculus
gtgaccctcgtcttacagcaaatgg

SEQ ID NO: 697444 - DNA, 25 bp, Mus musculus
gtgaccctctgacatggtatctgtt

SEQ ID NO: 697445 - DNA, 25 bp, Mus musculus
gtgaccctctgagatggtatctgtt

SEQ ID NO: 697446 - DNA, 25 bp, Mus musculus
gtgaccctcttacctgaattctttt

SEQ ID NO: 697447 - DNA, 25 bp, Mus musculus
gtgaccctcttagctgaattctttt

SEQ ID NO: 697448 - DNA, 25 bp, Mus musculus
gtgaccctgaaaattcacttgtgtt

SEQ ID NO: 697449 - DNA, 25 bp, Mus musculus
gtgaccctgaaatttcacttgtgtt

SEQ ID NO: 697450 - DNA, 25 bp, Mus musculus
gtgaccctgaagaatactaacctga

SEQ ID NO: 697451 - DNA, 25 bp, Mus musculus
gtgaccctgaagtatactaacctga

SEQ ID NO: 697452 - DNA, 25 bp, Mus musculus
gtgaccctgacacatgacttcgctg

SEQ ID NO: 697453 - DNA, 25 bp, Mus musculus
gtgaccctgacagatgacttcgctg

SEQ ID NO: 697454 - DNA, 25 bp, Mus musculus
gtgaccctgactaaggcacttctta

SEQ ID NO: 697455 - DNA, 25 bp, Mus musculus
gtgaccctgacttaggcacttctta

SEQ ID NO: 697456 - DNA, 25 bp, Mus musculus
gtgaccctgccaagaagcagttctt

SEQ ID NO: 697457 - DNA, 25 bp, Mus musculus
gtgaccctgccatgaagcagttctt

SEQ ID NO: 697458 - DNA, 25 bp, Mus musculus
gtgaccctgctgactgactatgaag

SEQ ID NO: 697459 - DNA, 25 bp, Mus musculus
gtgaccctgctgtctgactatgaag

SEQ ID NO: 697460 - DNA, 25 bp, Mus musculus
gtgaccctgcttaaggctggcacct

SEQ ID NO: 697461 - DNA, 25 bp, Mus musculus
gtgaccctgctttaggctggcacct

SEQ ID NO: 697462 - DNA, 25 bp, Mus musculus
gtgaccctggaaaggcctggctgcc

SEQ ID NO: 697463 - DNA, 25 bp, Mus musculus
gtgaccctggaacttgtaatctttc

SEQ ID NO: 697464 - DNA, 25 bp, Mus musculus
gtgaccctggaagttgtaatctttc

SEQ ID NO: 697465 - DNA, 25 bp, Mus musculus
gtgaccctggaatggcctggctgcc

SEQ ID NO: 697466 - DNA, 25 bp, Mus musculus
gtgaccctggagacaaagctattct

SEQ ID NO: 697467 - DNA, 25 bp, Mus musculus
gtgaccctggagtcaaagctattct

SEQ ID NO: 697468 - DNA, 25 bp, Mus musculus
gtgaccctggctcaaaggttacctc

SEQ ID NO: 697469 - DNA, 25 bp, Mus musculus
gtgaccctggctgaaaggttacctc

SEQ ID NO: 697470 - DNA, 25 bp, Mus musculus
gtgaccctgggaaggcggtccatca

SEQ ID NO: 697471 - DNA, 25 bp, Mus musculus
gtgaccctgggatggcggtccatca

SEQ ID NO: 697472 - DNA, 25 bp, Mus musculus
gtgaccctgggcattgttaagataa

SEQ ID NO: 697473 - DNA, 25 bp, Mus musculus
gtgaccctgggctttgttaagataa

SEQ ID NO: 697474 - DNA, 25 bp, Mus musculus
gtgaccctgggtattcattgaaaaa

SEQ ID NO: 697475 - DNA, 25 bp, Mus musculus
gtgaccctgggttttcattgaaaaa

SEQ ID NO: 697476 - DNA, 25 bp, Mus musculus
gtgaccctggtgagactaagcatca

SEQ ID NO: 697477 - DNA, 25 bp, Mus musculus
gtgaccctggtgtgactaagcatca

SEQ ID NO: 697478 - DNA, 25 bp, Mus musculus
gtgaccctgtagaacccaacctagg

SEQ ID NO: 697479 - DNA, 25 bp, Mus musculus
gtgaccctgtagtacccaacctagg

SEQ ID NO: 697480 - DNA, 25 bp, Mus musculus
gtgaccctgtgaaatcctcctttgt

SEQ ID NO: 697481 - DNA, 25 bp, Mus musculus
gtgaccctgtgatatcctcctttgt

SEQ ID NO: 697482 - DNA, 25 bp, Mus musculus
gtgaccctgtgcaatgaagcagaat

SEQ ID NO: 697483 - DNA, 25 bp, Mus musculus
gtgaccctgtgctatgaagcagaat

SEQ ID NO: 697484 - DNA, 25 bp, Mus musculus
gtgaccctgtttcattctccatgac

SEQ ID NO: 697485 - DNA, 25 bp, Mus musculus
gtgaccctgtttgattctccatgac

SEQ ID NO: 697486 - DNA, 25 bp, Mus musculus
gtgacccttaaaccctagcaaactg

SEQ ID NO: 697487 - DNA, 25 bp, Mus musculus
gtgacccttaaagcctagcaaactg

SEQ ID NO: 697488 - DNA, 25 bp, Mus musculus
gtgacccttagtacatgtgtgtaca

SEQ ID NO: 697489 - DNA, 25 bp, Mus musculus
gtgacccttagttcatgtgtgtaca

SEQ ID NO: 697490 - DNA, 25 bp, Mus musculus
gtgacccttgagcactggaaagaca

SEQ ID NO: 697491 - DNA, 25 bp, Mus musculus
gtgacccttgaggactggaaagaca

SEQ ID NO: 697492 - DNA, 25 bp, Mus musculus
gtgaccgaagatccaatagcagctc

SEQ ID NO: 697493 - DNA, 25 bp, Mus musculus
gtgaccgaagatgcaatagcagctc

SEQ ID NO: 697494 - DNA, 25 bp, Mus musculus
gtgaccgacagacgtgcgtgagacg

SEQ ID NO: 697495 - DNA, 25 bp, Mus musculus
gtgaccgacagaggtgcgtgagacg

SEQ ID NO: 697496 - DNA, 25 bp, Mus musculus
gtgaccgagaataaccttgagcttt

SEQ ID NO: 697497 - DNA, 25 bp, Mus musculus
gtgaccgagaattaccttgagcttt

SEQ ID NO: 697498 - DNA, 25 bp, Mus musculus
gtgaccgagaccatgatgaagctac

SEQ ID NO: 697499 - DNA, 25 bp, Mus musculus
gtgaccgagaccttgatgaagctac

SEQ ID NO: 697500 - DNA, 25 bp, Mus musculus
gtgaccgagacgattctgaatacat

SEQ ID NO: 697501 - DNA, 25 bp, Mus musculus
gtgaccgagacgtttctgaatacat

SEQ ID NO: 697502 - DNA, 25 bp, Mus musculus
gtgaccgaggaacacctgggattcc

SEQ ID NO: 697503 - DNA, 25 bp, Mus musculus
gtgaccgaggaagacctgggattcc

SEQ ID NO: 697504 - DNA, 25 bp, Mus musculus
gtgaccgattgaaatccaccgtgtt

SEQ ID NO: 697505 - DNA, 25 bp, Mus musculus
gtgaccgattgatatccaccgtgtt

SEQ ID NO: 697506 - DNA, 25 bp, Mus musculus
gtgaccgcaacacaaacctcctgaa

SEQ ID NO: 697507 - DNA, 25 bp, Mus musculus
gtgaccgcaacagaaacctcctgaa

SEQ ID NO: 697508 - DNA, 25 bp, Mus musculus
gtgaccgcaagtacggctttgctga

SEQ ID NO: 697509 - DNA, 25 bp, Mus musculus
gtgaccgcaagttcggctttgctga

SEQ ID NO: 697510 - DNA, 25 bp, Mus musculus
gtgaccgcagtgaagactgttcctg

SEQ ID NO: 697511 - DNA, 25 bp, Mus musculus
gtgaccgcagtgtagactgttcctg

SEQ ID NO: 697512 - DNA, 25 bp, Mus musculus
gtgaccgcattcatctccgttgccg

SEQ ID NO: 697513 - DNA, 25 bp, Mus musculus
gtgaccgcattcttctccgttgccg

SEQ ID NO: 697514 - DNA, 25 bp, Mus musculus
gtgaccgcattgagccagtggacat

SEQ ID NO: 697515 - DNA, 25 bp, Mus musculus
gtgaccgcattgtgccagtggacat

SEQ ID NO: 697516 - DNA, 25 bp, Mus musculus
gtgaccgccgttacagccgctcaga

SEQ ID NO: 697517 - DNA, 25 bp, Mus musculus
gtgaccgccgtttcagccgctcaga

SEQ ID NO: 697518 - DNA, 25 bp, Mus musculus
gtgaccgctgatatctgagtgatga

SEQ ID NO: 697519 - DNA, 25 bp, Mus musculus
gtgaccgctgatttctgagtgatga

SEQ ID NO: 697520 - DNA, 25 bp, Mus musculus
gtgaccgctgtgagcaccggttcga

SEQ ID NO: 697521 - DNA, 25 bp, Mus musculus
gtgaccgctgtgtgcaccggttcga

SEQ ID NO: 697522 - DNA, 25 bp, Mus musculus
gtgaccggaaatcccagtgccgaac

SEQ ID NO: 697523 - DNA, 25 bp, Mus musculus
gtgaccggaaatgccagtgccgaac

SEQ ID NO: 697524 - DNA, 25 bp, Mus musculus
gtgaccggctctcctgcttgggtct

SEQ ID NO: 697525 - DNA, 25 bp, Mus musculus
gtgaccggctctgctgcttgggtct

SEQ ID NO: 697526 - DNA, 25 bp, Mus musculus
gtgaccggctggaagcccaagcctg

SEQ ID NO: 697527 - DNA, 25 bp, Mus musculus
gtgaccggctggtagcccaagcctg

SEQ ID NO: 697528 - DNA, 25 bp, Mus musculus
gtgaccgggtaactacgcatttgaa

SEQ ID NO: 697529 - DNA, 25 bp, Mus musculus
gtgaccgggtaagtacgcatttgaa

SEQ ID NO: 697530 - DNA, 25 bp, Mus musculus
gtgaccgtaacccagaaaatgtaat

SEQ ID NO: 697531 - DNA, 25 bp, Mus musculus
gtgaccgtaaccgagaaaatgtaat

SEQ ID NO: 697532 - DNA, 25 bp, Mus musculus
gtgaccgtagttctgagggataatc

SEQ ID NO: 697533 - DNA, 25 bp, Mus musculus
gtgaccgtagttgtgagggataatc

SEQ ID NO: 697534 - DNA, 25 bp, Mus musculus
gtgaccgtctttctgctatgctgga

SEQ ID NO: 697535 - DNA, 25 bp, Mus musculus
gtgaccgtctttgtgctatgctgga

SEQ ID NO: 697536 - DNA, 25 bp, Mus musculus
gtgaccgtgaaacaccatactgcca

SEQ ID NO: 697537 - DNA, 25 bp, Mus musculus
gtgaccgtgaaagaccatactgcca

SEQ ID NO: 697538 - DNA, 25 bp, Mus musculus
gtgaccgtgcagaactacttcattg

SEQ ID NO: 697539 - DNA, 25 bp, Mus musculus
gtgaccgtgcagtactacttcattg

SEQ ID NO: 697540 - DNA, 25 bp, Mus musculus
gtgaccgtgctgacctcaacaagga

SEQ ID NO: 697541 - DNA, 25 bp, Mus musculus
gtgaccgtgctgtcctcaacaagga

SEQ ID NO: 697542 - DNA, 25 bp, Mus musculus
gtgaccgtgcttaatcagagctgtt

SEQ ID NO: 697543 - DNA, 25 bp, Mus musculus
gtgaccgtgctttatcagagctgtt

SEQ ID NO: 697544 - DNA, 25 bp, Mus musculus
gtgaccgtggtgacaaaccttctgt

SEQ ID NO: 697545 - DNA, 25 bp, Mus musculus
gtgaccgtggtgtcaaaccttctgt

SEQ ID NO: 697546 - DNA, 25 bp, Mus musculus
gtgacctaaggtaggcggcaagtaa

SEQ ID NO: 697547 - DNA, 25 bp, Mus musculus
gtgacctaaggttggcggcaagtaa

SEQ ID NO: 697548 - DNA, 25 bp, Mus musculus
gtgacctaagtcatattggcctgat

SEQ ID NO: 697549 - DNA, 25 bp, Mus musculus
gtgacctaagtcttattggcctgat

SEQ ID NO: 697550 - DNA, 25 bp, Mus musculus
gtgacctaatacagaggctttagct

SEQ ID NO: 697551 - DNA, 25 bp, Mus musculus
gtgacctaatactgaggctttagct

SEQ ID NO: 697552 - DNA, 25 bp, Mus musculus
gtgacctaatatatctgagcctgtg

SEQ ID NO: 697553 - DNA, 25 bp, Mus musculus
gtgacctaatatttctgagcctgtg

SEQ ID NO: 697554 - DNA, 25 bp, Mus musculus
gtgacctaatgcacgtgaagcctca

SEQ ID NO: 697555 - DNA, 25 bp, Mus musculus
gtgacctaatgctcgtgaagcctca

SEQ ID NO: 697556 - DNA, 25 bp, Mus musculus
gtgacctacaaaatgactgcgcctg

SEQ ID NO: 697557 - DNA, 25 bp, Mus musculus
gtgacctacaaattgactgcgcctg

SEQ ID NO: 697558 - DNA, 25 bp, Mus musculus
gtgacctacagcatccggtaaagac

SEQ ID NO: 697559 - DNA, 25 bp, Mus musculus
gtgacctacagcttccggtaaagac

SEQ ID NO: 697560 - DNA, 25 bp, Mus musculus
gtgacctaccccaagctttgtgatg

SEQ ID NO: 697561 - DNA, 25 bp, Mus musculus
gtgacctacccctagctttgtgatg

SEQ ID NO: 697562 - DNA, 25 bp, Mus musculus
gtgacctaccctaggctcagacaag

SEQ ID NO: 697563 - DNA, 25 bp, Mus musculus
gtgacctacccttggctcagacaag

SEQ ID NO: 697564 - DNA, 25 bp, Mus musculus
gtgacctacgccattgtgaaatttg

SEQ ID NO: 697565 - DNA, 25 bp, Mus musculus
gtgacctacgcctttgtgaaatttg

SEQ ID NO: 697566 - DNA, 25 bp, Mus musculus
gtgacctacgtcagtattctcagca

SEQ ID NO: 697567 - DNA, 25 bp, Mus musculus
gtgacctacgtctgtattctcagca

SEQ ID NO: 697568 - DNA, 25 bp, Mus musculus
gtgacctagaacctacagctgagac

SEQ ID NO: 697569 - DNA, 25 bp, Mus musculus
gtgacctagaacgtacagctgagac

SEQ ID NO: 697570 - DNA, 25 bp, Mus musculus
gtgacctagattctccctggactca

SEQ ID NO: 697571 - DNA, 25 bp, Mus musculus
gtgacctagattgtccctggactca

SEQ ID NO: 697572 - DNA, 25 bp, Mus musculus
gtgacctagcacagtgaacccagga

SEQ ID NO: 697573 - DNA, 25 bp, Mus musculus
gtgacctagcactgtgaacccagga

SEQ ID NO: 697574 - DNA, 25 bp, Mus musculus
gtgacctataaacacattcagcatg

SEQ ID NO: 697575 - DNA, 25 bp, Mus musculus
gtgacctataaagacattcagcatg

SEQ ID NO: 697576 - DNA, 25 bp, Mus musculus
gtgacctatagacgacaaccctggg

SEQ ID NO: 697577 - DNA, 25 bp, Mus musculus
gtgacctatagaggacaaccctggg

SEQ ID NO: 697578 - DNA, 25 bp, Mus musculus
gtgacctattttcagtcagtgcccc

SEQ ID NO: 697579 - DNA, 25 bp, Mus musculus
gtgacctattttgagtcagtgcccc

SEQ ID NO: 697580 - DNA, 25 bp, Mus musculus
gtgacctcaactccctagctgaagg

SEQ ID NO: 697581 - DNA, 25 bp, Mus musculus
gtgacctcaactgcctagctgaagg

SEQ ID NO: 697582 - DNA, 25 bp, Mus musculus
gtgacctcacagatccttctgtatt

SEQ ID NO: 697583 - DNA, 25 bp, Mus musculus
gtgacctcacagatgctcgtggctt

SEQ ID NO: 697584 - DNA, 25 bp, Mus musculus
gtgacctcacagttccttctgtatt

SEQ ID NO: 697585 - DNA, 25 bp, Mus musculus
gtgacctcacagttgctcgtggctt

SEQ ID NO: 697586 - DNA, 25 bp, Mus musculus
gtgacctcagaaactcagtgttgct

SEQ ID NO: 697587 - DNA, 25 bp, Mus musculus
gtgacctcagaatctcagtgttgct

SEQ ID NO: 697588 - DNA, 25 bp, Mus musculus
gtgacctcagacaccagaaggtgag

SEQ ID NO: 697589 - DNA, 25 bp, Mus musculus
gtgacctcagactccagaaggtgag

SEQ ID NO: 697590 - DNA, 25 bp, Mus musculus
gtgacctcagatccacctgttttca

SEQ ID NO: 697591 - DNA, 25 bp, Mus musculus
gtgacctcagatgcacctgttttca

SEQ ID NO: 697592 - DNA, 25 bp, Mus musculus
gtgacctcagcaatggctagcctag

SEQ ID NO: 697593 - DNA, 25 bp, Mus musculus
gtgacctcagcattggctagcctag

SEQ ID NO: 697594 - DNA, 25 bp, Mus musculus
gtgacctcatacctttcctgataga

SEQ ID NO: 697595 - DNA, 25 bp, Mus musculus
gtgacctcatacgtttcctgataga

SEQ ID NO: 697596 - DNA, 25 bp, Mus musculus
gtgacctcatggatcgaatccagcg

SEQ ID NO: 697597 - DNA, 25 bp, Mus musculus
gtgacctcatggttcgaatccagcg

SEQ ID NO: 697598 - DNA, 25 bp, Mus musculus
gtgacctcatttctctagactacga

SEQ ID NO: 697599 - DNA, 25 bp, Mus musculus
gtgacctcatttgtctagactacga

SEQ ID NO: 697600 - DNA, 25 bp, Mus musculus
gtgacctccaagatttagccactgg

SEQ ID NO: 697601 - DNA, 25 bp, Mus musculus
gtgacctccaagttttagccactgg

SEQ ID NO: 697602 - DNA, 25 bp, Mus musculus
gtgacctccagcatgattaccaatc

SEQ ID NO: 697603 - DNA, 25 bp, Mus musculus
gtgacctccagcttgattaccaatc

SEQ ID NO: 697604 - DNA, 25 bp, Mus musculus
gtgacctccagtcaataggccacca

SEQ ID NO: 697605 - DNA, 25 bp, Mus musculus
gtgacctccagtgaataggccacca

SEQ ID NO: 697606 - DNA, 25 bp, Mus musculus
gtgacctcccaaccgatcgttggtt

SEQ ID NO: 697607 - DNA, 25 bp, Mus musculus
gtgacctcccaagcgatcgttggtt

SEQ ID NO: 697608 - DNA, 25 bp, Mus musculus
gtgacctccccaactgagatagaag

SEQ ID NO: 697609 - DNA, 25 bp, Mus musculus
gtgacctccccatctgagatagaag

SEQ ID NO: 697610 - DNA, 25 bp, Mus musculus
gtgacctccctaatatgtgccaaga

SEQ ID NO: 697611 - DNA, 25 bp, Mus musculus
gtgacctccctattatgtgccaaga

SEQ ID NO: 697612 - DNA, 25 bp, Mus musculus
gtgacctccggcaagatcatcgagt

SEQ ID NO: 697613 - DNA, 25 bp, Mus musculus
gtgacctccggctagatcatcgagt

SEQ ID NO: 697614 - DNA, 25 bp, Mus musculus
gtgacctccgtgcttgtttgcattg

SEQ ID NO: 697615 - DNA, 25 bp, Mus musculus
gtgacctccgtggttgtttgcattg

SEQ ID NO: 697616 - DNA, 25 bp, Mus musculus
gtgacctcctaactctcacaaggaa

SEQ ID NO: 697617 - DNA, 25 bp, Mus musculus
gtgacctcctaagtctcacaaggaa

SEQ ID NO: 697618 - DNA, 25 bp, Mus musculus
gtgacctcctacaggactccatgga

SEQ ID NO: 697619 - DNA, 25 bp, Mus musculus
gtgacctcctactggactccatgga

SEQ ID NO: 697620 - DNA, 25 bp, Mus musculus
gtgacctcctgtcacgaacgtggct

SEQ ID NO: 697621 - DNA, 25 bp, Mus musculus
gtgacctcctgtgacgaacgtggct

SEQ ID NO: 697622 - DNA, 25 bp, Mus musculus
gtgacctccttgaaccaaaagactt

SEQ ID NO: 697623 - DNA, 25 bp, Mus musculus
gtgacctccttgtaccaaaagactt

SEQ ID NO: 697624 - DNA, 25 bp, Mus musculus
gtgacctcgagcatatcttttcaga

SEQ ID NO: 697625 - DNA, 25 bp, Mus musculus
gtgacctcgagcttatcttttcaga

SEQ ID NO: 697626 - DNA, 25 bp, Mus musculus
gtgacctcgccaaaggcgcctgcga

SEQ ID NO: 697627 - DNA, 25 bp, Mus musculus
gtgacctcgccacaagcatcgactt

SEQ ID NO: 697628 - DNA, 25 bp, Mus musculus
gtgacctcgccagaagcatcgactt

SEQ ID NO: 697629 - DNA, 25 bp, Mus musculus
gtgacctcgccataggcgcctgcga

SEQ ID NO: 697630 - DNA, 25 bp, Mus musculus
gtgacctcgggcaagcaactggacc

SEQ ID NO: 697631 - DNA, 25 bp, Mus musculus
gtgacctcgggctagcaactggacc

SEQ ID NO: 697632 - DNA, 25 bp, Mus musculus
gtgacctctaatattcttatcccat

SEQ ID NO: 697633 - DNA, 25 bp, Mus musculus
gtgacctctaattttcttatcccat

SEQ ID NO: 697634 - DNA, 25 bp, Mus musculus
gtgacctctactacctacagagtgc

SEQ ID NO: 697635 - DNA, 25 bp, Mus musculus
gtgacctctactatagtttctttgt

SEQ ID NO: 697636 - DNA, 25 bp, Mus musculus
gtgacctctacttcctacagagtgc

SEQ ID NO: 697637 - DNA, 25 bp, Mus musculus
gtgacctctactttagtttctttgt

SEQ ID NO: 697638 - DNA, 25 bp, Mus musculus
gtgacctctagtatcctgtgtgata

SEQ ID NO: 697639 - DNA, 25 bp, Mus musculus
gtgacctctagtcgcagtgggtaca

SEQ ID NO: 697640 - DNA, 25 bp, Mus musculus
gtgacctctagtggcagtgggtaca

SEQ ID NO: 697641 - DNA, 25 bp, Mus musculus
gtgacctctagtttcctgtgtgata

SEQ ID NO: 697642 - DNA, 25 bp, Mus musculus
gtgacctctgcgaggcacggcgtca

SEQ ID NO: 697643 - DNA, 25 bp, Mus musculus
gtgacctctgcgtggcacggcgtca

SEQ ID NO: 697644 - DNA, 25 bp, Mus musculus
gtgacctctgctatactggtgataa

SEQ ID NO: 697645 - DNA, 25 bp, Mus musculus
gtgacctctgctttactggtgataa

SEQ ID NO: 697646 - DNA, 25 bp, Mus musculus
gtgacctctgtcagtgtaaattgac

SEQ ID NO: 697647 - DNA, 25 bp, Mus musculus
gtgacctctgtctgtgtaaattgac

SEQ ID NO: 697648 - DNA, 25 bp, Mus musculus
gtgacctgaacaagatccctaggac

SEQ ID NO: 697649 - DNA, 25 bp, Mus musculus
gtgacctgaacatgatccctaggac

SEQ ID NO: 697650 - DNA, 25 bp, Mus musculus
gtgacctgacagataggagaagcat

SEQ ID NO: 697651 - DNA, 25 bp, Mus musculus
gtgacctgacagttaggagaagcat

SEQ ID NO: 697652 - DNA, 25 bp, Mus musculus
gtgacctgaccaagccattgctcca

SEQ ID NO: 697653 - DNA, 25 bp, Mus musculus
gtgacctgaccatgccattgctcca

SEQ ID NO: 697654 - DNA, 25 bp, Mus musculus
gtgacctgacttaacctagctgtat

SEQ ID NO: 697655 - DNA, 25 bp, Mus musculus
gtgacctgactttacctagctgtat

SEQ ID NO: 697656 - DNA, 25 bp, Mus musculus
gtgacctgagcacctcagagtgata

SEQ ID NO: 697657 - DNA, 25 bp, Mus musculus
gtgacctgagcagctcagagtgata

SEQ ID NO: 697658 - DNA, 25 bp, Mus musculus
gtgacctgagcgattgcatacatac

SEQ ID NO: 697659 - DNA, 25 bp, Mus musculus
gtgacctgagcgtttgcatacatac

SEQ ID NO: 697660 - DNA, 25 bp, Mus musculus
gtgacctgagggagtccgtgactaa

SEQ ID NO: 697661 - DNA, 25 bp, Mus musculus
gtgacctgagggtgtccgtgactaa

SEQ ID NO: 697662 - DNA, 25 bp, Mus musculus
gtgacctgataaattctcttatctc

SEQ ID NO: 697663 - DNA, 25 bp, Mus musculus
gtgacctgataatttctcttatctc

SEQ ID NO: 697664 - DNA, 25 bp, Mus musculus
gtgacctgatcacattcatggcttt

SEQ ID NO: 697665 - DNA, 25 bp, Mus musculus
gtgacctgatcagattcatggcttt

SEQ ID NO: 697666 - DNA, 25 bp, Mus musculus
gtgacctgctgcaactgtatgtgga

SEQ ID NO: 697667 - DNA, 25 bp, Mus musculus
gtgacctgctgctactgtatgtgga

SEQ ID NO: 697668 - DNA, 25 bp, Mus musculus
gtgacctgcttgcatggcatcctgt

SEQ ID NO: 697669 - DNA, 25 bp, Mus musculus
gtgacctgcttggatggcatcctgt

SEQ ID NO: 697670 - DNA, 25 bp, Mus musculus
gtgacctggcagcacagatttaaca

SEQ ID NO: 697671 - DNA, 25 bp, Mus musculus
gtgacctggcagctttaaaatcatc

SEQ ID NO: 697672 - DNA, 25 bp, Mus musculus
gtgacctggcaggacagatttaaca

SEQ ID NO: 697673 - DNA, 25 bp, Mus musculus
gtgacctggcaggtttaaaatcatc

SEQ ID NO: 697674 - DNA, 25 bp, Mus musculus
gtgacctgtatgaagagtacccaaa

SEQ ID NO: 697675 - DNA, 25 bp, Mus musculus
gtgacctgtatgagaacattttatt

SEQ ID NO: 697676 - DNA, 25 bp, Mus musculus
gtgacctgtatgtagagtacccaaa

SEQ ID NO: 697677 - DNA, 25 bp, Mus musculus
gtgacctgtatgtgaacattttatt

SEQ ID NO: 697678 - DNA, 25 bp, Mus musculus
gtgacctgtcttacttagagctgcc

SEQ ID NO: 697679 - DNA, 25 bp, Mus musculus
gtgacctgtctttcttagagctgcc

SEQ ID NO: 697680 - DNA, 25 bp, Mus musculus
gtgacctgtgaaatcgggagccgca

SEQ ID NO: 697681 - DNA, 25 bp, Mus musculus
gtgacctgtgaacggtatacctaat

SEQ ID NO: 697682 - DNA, 25 bp, Mus musculus
gtgacctgtgaagggtatacctaat

SEQ ID NO: 697683 - DNA, 25 bp, Mus musculus
gtgacctgtgaattcgggagccgca

SEQ ID NO: 697684 - DNA, 25 bp, Mus musculus
gtgacctgtgcgcagacactagttc

SEQ ID NO: 697685 - DNA, 25 bp, Mus musculus
gtgacctgtgcggagacactagttc

SEQ ID NO: 697686 - DNA, 25 bp, Mus musculus
gtgacctgtgttcctgtgacactca

SEQ ID NO: 697687 - DNA, 25 bp, Mus musculus
gtgacctgtgttgctgtgacactca

SEQ ID NO: 697688 - DNA, 25 bp, Mus musculus
gtgacctgttgcctctgaggatact

SEQ ID NO: 697689 - DNA, 25 bp, Mus musculus
gtgacctgttgcgtctgaggatact

SEQ ID NO: 697690 - DNA, 25 bp, Mus musculus
gtgacctgtttgaagacttggctgc

SEQ ID NO: 697691 - DNA, 25 bp, Mus musculus
gtgacctgtttgtagacttggctgc

SEQ ID NO: 697692 - DNA, 25 bp, Mus musculus
gtgaccttaaagcagccagcaacat

SEQ ID NO: 697693 - DNA, 25 bp, Mus musculus
gtgaccttaaaggagccagcaacat

SEQ ID NO: 697694 - DNA, 25 bp, Mus musculus
gtgaccttacttcctagtacgtgaa

SEQ ID NO: 697695 - DNA, 25 bp, Mus musculus
gtgaccttacttgctagtacgtgaa

SEQ ID NO: 697696 - DNA, 25 bp, Mus musculus
gtgaccttagccaaagaagcccatg

SEQ ID NO: 697697 - DNA, 25 bp, Mus musculus
gtgaccttagcctaagaagcccatg

SEQ ID NO: 697698 - DNA, 25 bp, Mus musculus
gtgaccttaggtcagctccagacag

SEQ ID NO: 697699 - DNA, 25 bp, Mus musculus
gtgaccttaggtgagctccagacag

SEQ ID NO: 697700 - DNA, 25 bp, Mus musculus
gtgaccttatgcacctgtgcagcaa

SEQ ID NO: 697701 - DNA, 25 bp, Mus musculus
gtgaccttatgctcctgtgcagcaa

SEQ ID NO: 697702 - DNA, 25 bp, Mus musculus
gtgaccttattcaagtttgtaattc

SEQ ID NO: 697703 - DNA, 25 bp, Mus musculus
gtgaccttattctagtttgtaattc

SEQ ID NO: 697704 - DNA, 25 bp, Mus musculus
gtgaccttcactcttaaataccgat

SEQ ID NO: 697705 - DNA, 25 bp, Mus musculus
gtgaccttcactcttgaacctgatt

SEQ ID NO: 697706 - DNA, 25 bp, Mus musculus
gtgaccttcactgttaaataccgat

SEQ ID NO: 697707 - DNA, 25 bp, Mus musculus
gtgaccttcactgttgaacctgatt

SEQ ID NO: 697708 - DNA, 25 bp, Mus musculus
gtgaccttcagacggcagcagccat

SEQ ID NO: 697709 - DNA, 25 bp, Mus musculus
gtgaccttcagactatgggcagttt

SEQ ID NO: 697710 - DNA, 25 bp, Mus musculus
gtgaccttcagagggcagcagccat

SEQ ID NO: 697711 - DNA, 25 bp, Mus musculus
gtgaccttcagagtatgggcagttt

SEQ ID NO: 697712 - DNA, 25 bp, Mus musculus
gtgaccttcagccagacacgagaaa

SEQ ID NO: 697713 - DNA, 25 bp, Mus musculus
gtgaccttcagcgagacacgagaaa

SEQ ID NO: 697714 - DNA, 25 bp, Mus musculus
gtgaccttcatcatgcacatacaac

SEQ ID NO: 697715 - DNA, 25 bp, Mus musculus
gtgaccttcatcttgcacatacaac

SEQ ID NO: 697716 - DNA, 25 bp, Mus musculus
gtgaccttccaaacagaaagcaaag

SEQ ID NO: 697717 - DNA, 25 bp, Mus musculus
gtgaccttccaacgatggaggccag

SEQ ID NO: 697718 - DNA, 25 bp, Mus musculus
gtgaccttccaaggatggaggccag

SEQ ID NO: 697719 - DNA, 25 bp, Mus musculus
gtgaccttccaatcagaaagcaaag

SEQ ID NO: 697720 - DNA, 25 bp, Mus musculus
gtgaccttcgccaccaagggtagag

SEQ ID NO: 697721 - DNA, 25 bp, Mus musculus
gtgaccttcgcctccaagggtagag

SEQ ID NO: 697722 - DNA, 25 bp, Mus musculus
gtgaccttctccattagatagagat

SEQ ID NO: 697723 - DNA, 25 bp, Mus musculus
gtgaccttctcctttagatagagat

SEQ ID NO: 697724 - DNA, 25 bp, Mus musculus
gtgaccttctgtacggatttgccct

SEQ ID NO: 697725 - DNA, 25 bp, Mus musculus
gtgaccttctgtagtatttgtgtag

SEQ ID NO: 697726 - DNA, 25 bp, Mus musculus
gtgaccttctgttcggatttgccct

SEQ ID NO: 697727 - DNA, 25 bp, Mus musculus
gtgaccttctgttgtatttgtgtag

SEQ ID NO: 697728 - DNA, 25 bp, Mus musculus
gtgaccttcttcctgaggatgtcca

SEQ ID NO: 697729 - DNA, 25 bp, Mus musculus
gtgaccttcttcgtgaggatgtcca

SEQ ID NO: 697730 - DNA, 25 bp, Mus musculus
gtgaccttgaacaagccctgtgctc

SEQ ID NO: 697731 - DNA, 25 bp, Mus musculus
gtgaccttgaactagccctgtgctc

SEQ ID NO: 697732 - DNA, 25 bp, Mus musculus
gtgaccttgcaactgcctgagtgaa

SEQ ID NO: 697733 - DNA, 25 bp, Mus musculus
gtgaccttgcaagtgcctgagtgaa

SEQ ID NO: 697734 - DNA, 25 bp, Mus musculus
gtgaccttgcagaaagtctaactaa

SEQ ID NO: 697735 - DNA, 25 bp, Mus musculus
gtgaccttgcagtaagtctaactaa

SEQ ID NO: 697736 - DNA, 25 bp, Mus musculus
gtgaccttggacaagttgctccttc

SEQ ID NO: 697737 - DNA, 25 bp, Mus musculus
gtgaccttggactagttgctccttc

SEQ ID NO: 697738 - DNA, 25 bp, Mus musculus
gtgaccttggagagagtagtttttc

SEQ ID NO: 697739 - DNA, 25 bp, Mus musculus
gtgaccttggagtgagtagtttttc

SEQ ID NO: 697740 - DNA, 25 bp, Mus musculus
gtgaccttggctatgtgctctgggt

SEQ ID NO: 697741 - DNA, 25 bp, Mus musculus
gtgaccttggctttgtgctctgggt

SEQ ID NO: 697742 - DNA, 25 bp, Mus musculus
gtgaccttgggcagggcatcactcc

SEQ ID NO: 697743 - DNA, 25 bp, Mus musculus
gtgaccttgggctgggcatcactcc

SEQ ID NO: 697744 - DNA, 25 bp, Mus musculus
gtgaccttggtgatcatggactaga

SEQ ID NO: 697745 - DNA, 25 bp, Mus musculus
gtgaccttggtgttcatggactaga

SEQ ID NO: 697746 - DNA, 25 bp, Mus musculus
gtgaccttgtgtcggctggaaactc

SEQ ID NO: 697747 - DNA, 25 bp, Mus musculus
gtgaccttgtgtgggctggaaactc

SEQ ID NO: 697748 - DNA, 25 bp, Mus musculus
gtgacctttatacggactttcagcc

SEQ ID NO: 697749 - DNA, 25 bp, Mus musculus
gtgacctttatagggactttcagcc

SEQ ID NO: 697750 - DNA, 25 bp, Mus musculus
gtgacctttcccatgctgaattatt

SEQ ID NO: 697751 - DNA, 25 bp, Mus musculus
gtgacctttcccttgctgaattatt

SEQ ID NO: 697752 - DNA, 25 bp, Mus musculus
gtgacctttcctctgagtatatctg

SEQ ID NO: 697753 - DNA, 25 bp, Mus musculus
gtgacctttcctgtgagtatatctg

SEQ ID NO: 697754 - DNA, 25 bp, Mus musculus
gtgacctttctcaagtctcaattct

SEQ ID NO: 697755 - DNA, 25 bp, Mus musculus
gtgacctttctctagtctcaattct

SEQ ID NO: 697756 - DNA, 25 bp, Mus musculus
gtgacctttgcactcatggtgcagt

SEQ ID NO: 697757 - DNA, 25 bp, Mus musculus
gtgacctttgcagtcatggtgcagt

SEQ ID NO: 697758 - DNA, 25 bp, Mus musculus
gtgacctttgtcaagtgctgattgc

SEQ ID NO: 697759 - DNA, 25 bp, Mus musculus
gtgacctttgtctagtgctgattgc

SEQ ID NO: 697760 - DNA, 25 bp, Mus musculus
gtgaccttttacctcattgttttgt

SEQ ID NO: 697761 - DNA, 25 bp, Mus musculus
gtgaccttttacgtcattgttttgt

SEQ ID NO: 697762 - DNA, 25 bp, Mus musculus
gtgaccttttagaacagttcttaat

SEQ ID NO: 697763 - DNA, 25 bp, Mus musculus
gtgaccttttagtacagttcttaat

SEQ ID NO: 697764 - DNA, 25 bp, Mus musculus
gtgaccttttatccacataagcaca

SEQ ID NO: 697765 - DNA, 25 bp, Mus musculus
gtgaccttttatgcacataagcaca

SEQ ID NO: 697766 - DNA, 25 bp, Mus musculus
gtgaccttttgtatttatatctaat

SEQ ID NO: 697767 - DNA, 25 bp, Mus musculus
gtgaccttttgtttttatatctaat

SEQ ID NO: 697768 - DNA, 25 bp, Mus musculus
gtgacgaaaactctgactcccagcg

SEQ ID NO: 697769 - DNA, 25 bp, Mus musculus
gtgacgaaaactgtgactcccagcg

SEQ ID NO: 697770 - DNA, 25 bp, Mus musculus
gtgacgaacaccaaagaccttggcc

SEQ ID NO: 697771 - DNA, 25 bp, Mus musculus
gtgacgaacacctaagaccttggcc

SEQ ID NO: 697772 - DNA, 25 bp, Mus musculus
gtgacgaacgctcgctgcttttgaa

SEQ ID NO: 697773 - DNA, 25 bp, Mus musculus
gtgacgaacgctggctgcttttgaa

SEQ ID NO: 697774 - DNA, 25 bp, Mus musculus
gtgacgaactgtcacgatgctgctg

SEQ ID NO: 697775 - DNA, 25 bp, Mus musculus
gtgacgaactgtgacgatgctgctg

SEQ ID NO: 697776 - DNA, 25 bp, Mus musculus
gtgacgaagttccaaccattgctca

SEQ ID NO: 697777 - DNA, 25 bp, Mus musculus
gtgacgaagttcgaaccattgctca

SEQ ID NO: 697778 - DNA, 25 bp, Mus musculus
gtgacgaatggcctggtggtaccga

SEQ ID NO: 697779 - DNA, 25 bp, Mus musculus
gtgacgaatggcgtggtggtaccga

SEQ ID NO: 697780 - DNA, 25 bp, Mus musculus
gtgacgacaacaccttctgtgcaat

SEQ ID NO: 697781 - DNA, 25 bp, Mus musculus
gtgacgacaacagcttctgtgcaat

SEQ ID NO: 697782 - DNA, 25 bp, Mus musculus
gtgacgacacataaggaccaggcta

SEQ ID NO: 697783 - DNA, 25 bp, Mus musculus
gtgacgacacattaggaccaggcta

SEQ ID NO: 697784 - DNA, 25 bp, Mus musculus
gtgacgaccgagaaatacagtttga

SEQ ID NO: 697785 - DNA, 25 bp, Mus musculus
gtgacgaccgagtaatacagtttga

SEQ ID NO: 697786 - DNA, 25 bp, Mus musculus
gtgacgacgctccagaaggaactgt

SEQ ID NO: 697787 - DNA, 25 bp, Mus musculus
gtgacgacgctcgagaaggaactgt

SEQ ID NO: 697788 - DNA, 25 bp, Mus musculus
gtgacgactttactgttcaccagct

SEQ ID NO: 697789 - DNA, 25 bp, Mus musculus
gtgacgactttagtgttcaccagct

SEQ ID NO: 697790 - DNA, 25 bp, Mus musculus
gtgacgagctacatttccattgaca

SEQ ID NO: 697791 - DNA, 25 bp, Mus musculus
gtgacgagctacttttccattgaca

SEQ ID NO: 697792 - DNA, 25 bp, Mus musculus
gtgacgaggagaataactacagatt

SEQ ID NO: 697793 - DNA, 25 bp, Mus musculus
gtgacgaggagattaactacagatt

SEQ ID NO: 697794 - DNA, 25 bp, Mus musculus
gtgacgaggagtaccagtactgcct

SEQ ID NO: 697795 - DNA, 25 bp, Mus musculus
gtgacgaggagttccagtactgcct

SEQ ID NO: 697796 - DNA, 25 bp, Mus musculus
gtgacgagggctactccagtgccac

SEQ ID NO: 697797 - DNA, 25 bp, Mus musculus
gtgacgagggcttctccagtgccac

SEQ ID NO: 697798 - DNA, 25 bp, Mus musculus
gtgacgagggttattccagtgccag

SEQ ID NO: 697799 - DNA, 25 bp, Mus musculus
gtgacgagggtttttccagtgccag

SEQ ID NO: 697800 - DNA, 25 bp, Mus musculus
gtgacgagtatcacctagagacctc

SEQ ID NO: 697801 - DNA, 25 bp, Mus musculus
gtgacgagtatctcctagagacctc

SEQ ID NO: 697802 - DNA, 25 bp, Mus musculus
gtgacgatatctcggttgggaccta

SEQ ID NO: 697803 - DNA, 25 bp, Mus musculus
gtgacgatatctgggttgggaccta

SEQ ID NO: 697804 - DNA, 25 bp, Mus musculus
gtgacgatcacacaccttcgataaa

SEQ ID NO: 697805 - DNA, 25 bp, Mus musculus
gtgacgatcacagaccttcgataaa

SEQ ID NO: 697806 - DNA, 25 bp, Mus musculus
gtgacgatcacccaagccaaggtct

SEQ ID NO: 697807 - DNA, 25 bp, Mus musculus
gtgacgatcaccgaagccaaggtct

SEQ ID NO: 697808 - DNA, 25 bp, Mus musculus
gtgacgatcactctattggaagagc

SEQ ID NO: 697809 - DNA, 25 bp, Mus musculus
gtgacgatcactgtattggaagagc

SEQ ID NO: 697810 - DNA, 25 bp, Mus musculus
gtgacgatcattactggtatctgtt

SEQ ID NO: 697811 - DNA, 25 bp, Mus musculus
gtgacgatcatttctggtatctgtt

SEQ ID NO: 697812 - DNA, 25 bp, Mus musculus
gtgacgatccacaggcagcacaaac

SEQ ID NO: 697813 - DNA, 25 bp, Mus musculus
gtgacgatccactggcagcacaaac

SEQ ID NO: 697814 - DNA, 25 bp, Mus musculus
gtgacgatgcacatttctgtatagt

SEQ ID NO: 697815 - DNA, 25 bp, Mus musculus
gtgacgatgcacttttctgtatagt

SEQ ID NO: 697816 - DNA, 25 bp, Mus musculus
gtgacgatggcactcaaggttgtat

SEQ ID NO: 697817 - DNA, 25 bp, Mus musculus
gtgacgatggcagtcaaggttgtat

SEQ ID NO: 697818 - DNA, 25 bp, Mus musculus
gtgacgcacactacaataggcactt

SEQ ID NO: 697819 - DNA, 25 bp, Mus musculus
gtgacgcacacttcaataggcactt

SEQ ID NO: 697820 - DNA, 25 bp, Mus musculus
gtgacgcacataaactggcacatgt

SEQ ID NO: 697821 - DNA, 25 bp, Mus musculus
gtgacgcacatatactggcacatgt

SEQ ID NO: 697822 - DNA, 25 bp, Mus musculus
gtgacgcaccacacaaggcaagttg

SEQ ID NO: 697823 - DNA, 25 bp, Mus musculus
gtgacgcaccactcaaggcaagttg

SEQ ID NO: 697824 - DNA, 25 bp, Mus musculus
gtgacgccacctattaatcttttgt

SEQ ID NO: 697825 - DNA, 25 bp, Mus musculus
gtgacgccaccttttaatcttttgt

SEQ ID NO: 697826 - DNA, 25 bp, Mus musculus
gtgacgccaggcaaaggccacatgc

SEQ ID NO: 697827 - DNA, 25 bp, Mus musculus
gtgacgccaggctaaggccacatgc

SEQ ID NO: 697828 - DNA, 25 bp, Mus musculus
gtgacgccatcacgtatacaggaga

SEQ ID NO: 697829 - DNA, 25 bp, Mus musculus
gtgacgccatcaggtatacaggaga

SEQ ID NO: 697830 - DNA, 25 bp, Mus musculus
gtgacgccatggagatctgctctga

SEQ ID NO: 697831 - DNA, 25 bp, Mus musculus
gtgacgccatggtgatctgctctga

SEQ ID NO: 697832 - DNA, 25 bp, Mus musculus
gtgacgcccaagacggtgactccag

SEQ ID NO: 697833 - DNA, 25 bp, Mus musculus
gtgacgcccaagtcggtgactccag

SEQ ID NO: 697834 - DNA, 25 bp, Mus musculus
gtgacgccgcccagagaagattcct

SEQ ID NO: 697835 - DNA, 25 bp, Mus musculus
gtgacgccgccctgagaagattcct

SEQ ID NO: 697836 - DNA, 25 bp, Mus musculus
gtgacgcctgtacaacactcagcat

SEQ ID NO: 697837 - DNA, 25 bp, Mus musculus
gtgacgcctgtagaacactcagcat

SEQ ID NO: 697838 - DNA, 25 bp, Mus musculus
gtgacgcgacacaggaatgaggttt

SEQ ID NO: 697839 - DNA, 25 bp, Mus musculus
gtgacgcgacactggaatgaggttt

SEQ ID NO: 697840 - DNA, 25 bp, Mus musculus
gtgacgcgcactcgaaacaactaca

SEQ ID NO: 697841 - DNA, 25 bp, Mus musculus
gtgacgcgcactggaaacaactaca

SEQ ID NO: 697842 - DNA, 25 bp, Mus musculus
gtgacgcgttggaaggctaaccgaa

SEQ ID NO: 697843 - DNA, 25 bp, Mus musculus
gtgacgcgttggtaggctaaccgaa

SEQ ID NO: 697844 - DNA, 25 bp, Mus musculus
gtgacgcgtttaaccattgtctgta

SEQ ID NO: 697845 - DNA, 25 bp, Mus musculus
gtgacgcgtttatccattgtctgta

SEQ ID NO: 697846 - DNA, 25 bp, Mus musculus
gtgacgctcagaaattcatctacga

SEQ ID NO: 697847 - DNA, 25 bp, Mus musculus
gtgacgctcagatattcatctacga

SEQ ID NO: 697848 - DNA, 25 bp, Mus musculus
gtgacgctcagcatgggcaattgac

SEQ ID NO: 697849 - DNA, 25 bp, Mus musculus
gtgacgctcagcttgggcaattgac

SEQ ID NO: 697850 - DNA, 25 bp, Mus musculus
gtgacgctctctccagttactgtaa

SEQ ID NO: 697851 - DNA, 25 bp, Mus musculus
gtgacgctctctgcagttactgtaa

SEQ ID NO: 697852 - DNA, 25 bp, Mus musculus
gtgacgctgaaacacacgagccaga

SEQ ID NO: 697853 - DNA, 25 bp, Mus musculus
gtgacgctgaaagacacgagccaga

SEQ ID NO: 697854 - DNA, 25 bp, Mus musculus
gtgacgctgcctatttatacactgt

SEQ ID NO: 697855 - DNA, 25 bp, Mus musculus
gtgacgctgcctttttatacactgt

SEQ ID NO: 697856 - DNA, 25 bp, Mus musculus
gtgacgctggatacagctattcctg

SEQ ID NO: 697857 - DNA, 25 bp, Mus musculus
gtgacgctggattcagctattcctg

SEQ ID NO: 697858 - DNA, 25 bp, Mus musculus
gtgacgcttccgacgtggccgttag

SEQ ID NO: 697859 - DNA, 25 bp, Mus musculus
gtgacgcttccgtcgtggccgttag

SEQ ID NO: 697860 - DNA, 25 bp, Mus musculus
gtgacgcttgtccagcagtttgctt

SEQ ID NO: 697861 - DNA, 25 bp, Mus musculus
gtgacgcttgtcgagcagtttgctt

SEQ ID NO: 697862 - DNA, 25 bp, Mus musculus
gtgacgctttcaatgcacgctttcc

SEQ ID NO: 697863 - DNA, 25 bp, Mus musculus
gtgacgctttcattgcacgctttcc

SEQ ID NO: 697864 - DNA, 25 bp, Mus musculus
gtgacggaacgcaggatgtgactat

SEQ ID NO: 697865 - DNA, 25 bp, Mus musculus
gtgacggaacgctggatgtgactat

SEQ ID NO: 697866 - DNA, 25 bp, Mus musculus
gtgacggaagtgacagattgcatat

SEQ ID NO: 697867 - DNA, 25 bp, Mus musculus
gtgacggaagtgtcagattgcatat

SEQ ID NO: 697868 - DNA, 25 bp, Mus musculus
gtgacggacaagatcctaccagcta

SEQ ID NO: 697869 - DNA, 25 bp, Mus musculus
gtgacggacaagttcctaccagcta

SEQ ID NO: 697870 - DNA, 25 bp, Mus musculus
gtgacggacctactgcgagcagagc

SEQ ID NO: 697871 - DNA, 25 bp, Mus musculus
gtgacggacctagtgcgagcagagc

SEQ ID NO: 697872 - DNA, 25 bp, Mus musculus
gtgacggagcacatttaacttttgg

SEQ ID NO: 697873 - DNA, 25 bp, Mus musculus
gtgacggagcacttttaacttttgg

SEQ ID NO: 697874 - DNA, 25 bp, Mus musculus
gtgacggcaagaacacccgagtgga

SEQ ID NO: 697875 - DNA, 25 bp, Mus musculus
gtgacggcaagatcacccgagtgga

SEQ ID NO: 697876 - DNA, 25 bp, Mus musculus
gtgacggcactgacgtacctagatg

SEQ ID NO: 697877 - DNA, 25 bp, Mus musculus
gtgacggcactgtcgtacctagatg

SEQ ID NO: 697878 - DNA, 25 bp, Mus musculus
gtgacggcccgtctggtgttcattt

SEQ ID NO: 697879 - DNA, 25 bp, Mus musculus
gtgacggcccgtgtggtgttcattt

SEQ ID NO: 697880 - DNA, 25 bp, Mus musculus
gtgacggcgtgtcttaactgaagac

SEQ ID NO: 697881 - DNA, 25 bp, Mus musculus
gtgacggcgtgtgttaactgaagac

SEQ ID NO: 697882 - DNA, 25 bp, Mus musculus
gtgacgggaaagcactgccctcata

SEQ ID NO: 697883 - DNA, 25 bp, Mus musculus
gtgacgggaaaggactgccctcata

SEQ ID NO: 697884 - DNA, 25 bp, Mus musculus
gtgacgggagacatctcactcggtg

SEQ ID NO: 697885 - DNA, 25 bp, Mus musculus
gtgacgggagacttctcactcggtg

SEQ ID NO: 697886 - DNA, 25 bp, Mus musculus
gtgacgggtctcactatctgctact

SEQ ID NO: 697887 - DNA, 25 bp, Mus musculus
gtgacgggtctctctatctgctact

SEQ ID NO: 697888 - DNA, 25 bp, Mus musculus
gtgacgggtgtaagtctgtctcaga

SEQ ID NO: 697889 - DNA, 25 bp, Mus musculus
gtgacgggtgtatgtctgtctcaga

SEQ ID NO: 697890 - DNA, 25 bp, Mus musculus
gtgacggtacctcttgctactactt

SEQ ID NO: 697891 - DNA, 25 bp, Mus musculus
gtgacggtacctgttgctactactt

SEQ ID NO: 697892 - DNA, 25 bp, Mus musculus
gtgacggtcctccatctgaacagat

SEQ ID NO: 697893 - DNA, 25 bp, Mus musculus
gtgacggtcctcgatctgaacagat

SEQ ID NO: 697894 - DNA, 25 bp, Mus musculus
gtgacggtcgctaagccgccagcga

SEQ ID NO: 697895 - DNA, 25 bp, Mus musculus
gtgacggtcgctctctcaggaataa

SEQ ID NO: 697896 - DNA, 25 bp, Mus musculus
gtgacggtcgctgtctcaggaataa

SEQ ID NO: 697897 - DNA, 25 bp, Mus musculus
gtgacggtcgcttagccgccagcga

SEQ ID NO: 697898 - DNA, 25 bp, Mus musculus
gtgacggtcgtcattagccatttgt

SEQ ID NO: 697899 - DNA, 25 bp, Mus musculus
gtgacggtcgtctttagccatttgt

SEQ ID NO: 697900 - DNA, 25 bp, Mus musculus
gtgacggtgctgaaccctgcataga

SEQ ID NO: 697901 - DNA, 25 bp, Mus musculus
gtgacggtgctgtaccctgcataga

SEQ ID NO: 697902 - DNA, 25 bp, Mus musculus
gtgacggtgtcaactctgcctgtaa

SEQ ID NO: 697903 - DNA, 25 bp, Mus musculus
gtgacggtgtcatctctgcctgtaa

SEQ ID NO: 697904 - DNA, 25 bp, Mus musculus
gtgacggttgcaacagtggctctgt

SEQ ID NO: 697905 - DNA, 25 bp, Mus musculus
gtgacggttgcatcagtggctctgt

SEQ ID NO: 697906 - DNA, 25 bp, Mus musculus
gtgacggttggaagtgttagcactt

SEQ ID NO: 697907 - DNA, 25 bp, Mus musculus
gtgacggttggatgtgttagcactt

SEQ ID NO: 697908 - DNA, 25 bp, Mus musculus
gtgacgtcacaccatgcatatgtct

SEQ ID NO: 697909 - DNA, 25 bp, Mus musculus
gtgacgtcacacgatgcatatgtct

SEQ ID NO: 697910 - DNA, 25 bp, Mus musculus
gtgacgtcaccacagggctaaacca

SEQ ID NO: 697911 - DNA, 25 bp, Mus musculus
gtgacgtcaccagagggctaaacca

SEQ ID NO: 697912 - DNA, 25 bp, Mus musculus
gtgacgtcactgcagacaggtcctc

SEQ ID NO: 697913 - DNA, 25 bp, Mus musculus
gtgacgtcactggagacaggtcctc

SEQ ID NO: 697914 - DNA, 25 bp, Mus musculus
gtgacgtcagatagggtactgtccc

SEQ ID NO: 697915 - DNA, 25 bp, Mus musculus
gtgacgtcagattgggtactgtccc

SEQ ID NO: 697916 - DNA, 25 bp, Mus musculus
gtgacgtcaggaaaacatagttaaa

SEQ ID NO: 697917 - DNA, 25 bp, Mus musculus
gtgacgtcaggataacatagttaaa

SEQ ID NO: 697918 - DNA, 25 bp, Mus musculus
gtgacgtcatagacctctactgtat

SEQ ID NO: 697919 - DNA, 25 bp, Mus musculus
gtgacgtcatagtcctctactgtat

SEQ ID NO: 697920 - DNA, 25 bp, Mus musculus
gtgacgtcatccactaccgtgtttt

SEQ ID NO: 697921 - DNA, 25 bp, Mus musculus
gtgacgtcatcctctaccgtgtttt

SEQ ID NO: 697922 - DNA, 25 bp, Mus musculus
gtgacgtccccaaggatggaatgtc

SEQ ID NO: 697923 - DNA, 25 bp, Mus musculus
gtgacgtccccatggatggaatgtc

SEQ ID NO: 697924 - DNA, 25 bp, Mus musculus
gtgacgtcctttcttacatgtgtgc

SEQ ID NO: 697925 - DNA, 25 bp, Mus musculus
gtgacgtcctttgttacatgtgtgc

SEQ ID NO: 697926 - DNA, 25 bp, Mus musculus
gtgacgtctcctatacactgatgta

SEQ ID NO: 697927 - DNA, 25 bp, Mus musculus
gtgacgtctcctttacactgatgta

SEQ ID NO: 697928 - DNA, 25 bp, Mus musculus
gtgacgtgatggcattctgcgaaat

SEQ ID NO: 697929 - DNA, 25 bp, Mus musculus
gtgacgtgatgggattctgcgaaat

SEQ ID NO: 697930 - DNA, 25 bp, Mus musculus
gtgacgtgcagcagcctccagaaga

SEQ ID NO: 697931 - DNA, 25 bp, Mus musculus
gtgacgtgcagctgcctccagaaga

SEQ ID NO: 697932 - DNA, 25 bp, Mus musculus
gtgacgtgctgtcattttctaccat

SEQ ID NO: 697933 - DNA, 25 bp, Mus musculus
gtgacgtgctgtgattttctaccat

SEQ ID NO: 697934 - DNA, 25 bp, Mus musculus
gtgacgtgtactagtaatcccagtg

SEQ ID NO: 697935 - DNA, 25 bp, Mus musculus
gtgacgtgtacttgtaatcccagtg

SEQ ID NO: 697936 - DNA, 25 bp, Mus musculus
gtgacgtgtgttcttccgtttgata

SEQ ID NO: 697937 - DNA, 25 bp, Mus musculus
gtgacgtgtgttgttccgtttgata

SEQ ID NO: 697938 - DNA, 25 bp, Mus musculus
gtgacgttatatatccatagctttg

SEQ ID NO: 697939 - DNA, 25 bp, Mus musculus
gtgacgttatatttccatagctttg

SEQ ID NO: 697940 - DNA, 25 bp, Mus musculus
gtgacgtttcagagcataactggtg

SEQ ID NO: 697941 - DNA, 25 bp, Mus musculus
gtgacgtttcagtgcataactggtg

SEQ ID NO: 697942 - DNA, 25 bp, Mus musculus
gtgactaaatgtatagattgtctca

SEQ ID NO: 697943 - DNA, 25 bp, Mus musculus
gtgactaaatgtttagattgtctca

SEQ ID NO: 697944 - DNA, 25 bp, Mus musculus
gtgactaacactaccaatgctctgc

SEQ ID NO: 697945 - DNA, 25 bp, Mus musculus
gtgactaacacttccaatgctctgc

SEQ ID NO: 697946 - DNA, 25 bp, Mus musculus
gtgactaacgggatgactgtggata

SEQ ID NO: 697947 - DNA, 25 bp, Mus musculus
gtgactaacgggttgactgtggata

SEQ ID NO: 697948 - DNA, 25 bp, Mus musculus
gtgactaacggtatcttcagtgtag

SEQ ID NO: 697949 - DNA, 25 bp, Mus musculus
gtgactaacggtttcttcagtgtag

SEQ ID NO: 697950 - DNA, 25 bp, Mus musculus
gtgactaagcttatgacaactcttt

SEQ ID NO: 697951 - DNA, 25 bp, Mus musculus
gtgactaagcttttgacaactcttt

SEQ ID NO: 697952 - DNA, 25 bp, Mus musculus
gtgactaataccatgcatctgtgat

SEQ ID NO: 697953 - DNA, 25 bp, Mus musculus
gtgactaataccttgcatctgtgat

SEQ ID NO: 697954 - DNA, 25 bp, Mus musculus
gtgactacacgtcacaacacatata

SEQ ID NO: 697955 - DNA, 25 bp, Mus musculus
gtgactacacgtgacaacacatata

SEQ ID NO: 697956 - DNA, 25 bp, Mus musculus
gtgactacactaaggtagctcctcc

SEQ ID NO: 697957 - DNA, 25 bp, Mus musculus
gtgactacactatggtagctcctcc

SEQ ID NO: 697958 - DNA, 25 bp, Mus musculus
gtgactacagagatcgtacgactac

SEQ ID NO: 697959 - DNA, 25 bp, Mus musculus
gtgactacagagttcgtacgactac

SEQ ID NO: 697960 - DNA, 25 bp, Mus musculus
gtgactacagtcaagaggctatggg

SEQ ID NO: 697961 - DNA, 25 bp, Mus musculus
gtgactacagtctagaggctatggg

SEQ ID NO: 697962 - DNA, 25 bp, Mus musculus
gtgactacagtgcttcaacaagaat

SEQ ID NO: 697963 - DNA, 25 bp, Mus musculus
gtgactacagtggttcaacaagaat

SEQ ID NO: 697964 - DNA, 25 bp, Mus musculus
gtgactacagttccccgggttctaa

SEQ ID NO: 697965 - DNA, 25 bp, Mus musculus
gtgactacagttgcccgggttctaa

SEQ ID NO: 697966 - DNA, 25 bp, Mus musculus
gtgactacatcccatccaattttga

SEQ ID NO: 697967 - DNA, 25 bp, Mus musculus
gtgactacatccgatccaattttga

SEQ ID NO: 697968 - DNA, 25 bp, Mus musculus
gtgactacatgaccaagccctcttt

SEQ ID NO: 697969 - DNA, 25 bp, Mus musculus
gtgactacatgagcaagccctcttt

SEQ ID NO: 697970 - DNA, 25 bp, Mus musculus
gtgactaccactcgcttcccaaggg

SEQ ID NO: 697971 - DNA, 25 bp, Mus musculus
gtgactaccactggcttcccaaggg

SEQ ID NO: 697972 - DNA, 25 bp, Mus musculus
gtgactaccagcacttccaggtcct

SEQ ID NO: 697973 - DNA, 25 bp, Mus musculus
gtgactaccagctcttccaggtcct

SEQ ID NO: 697974 - DNA, 25 bp, Mus musculus
gtgactacccacagattatccattg

SEQ ID NO: 697975 - DNA, 25 bp, Mus musculus
gtgactacccactgattatccattg

SEQ ID NO: 697976 - DNA, 25 bp, Mus musculus
gtgactacccttagaggatagcatt

SEQ ID NO: 697977 - DNA, 25 bp, Mus musculus
gtgactaccctttgaggatagcatt

SEQ ID NO: 697978 - DNA, 25 bp, Mus musculus
gtgactaccggcagctgtgcagcca

SEQ ID NO: 697979 - DNA, 25 bp, Mus musculus
gtgactaccggctgctgtgcagcca

SEQ ID NO: 697980 - DNA, 25 bp, Mus musculus
gtgactacgcggcttctaagaagtg

SEQ ID NO: 697981 - DNA, 25 bp, Mus musculus
gtgactacgcgggttctaagaagtg

SEQ ID NO: 697982 - DNA, 25 bp, Mus musculus
gtgactacggctcgcatcctaagac

SEQ ID NO: 697983 - DNA, 25 bp, Mus musculus
gtgactacggctggcatcctaagac

SEQ ID NO: 697984 - DNA, 25 bp, Mus musculus
gtgactactacaactttgtgaaatt

SEQ ID NO: 697985 - DNA, 25 bp, Mus musculus
gtgactactacatctttgtgaaatt

SEQ ID NO: 697986 - DNA, 25 bp, Mus musculus
gtgactactagacaataggcaattc

SEQ ID NO: 697987 - DNA, 25 bp, Mus musculus
gtgactactagagaataggcaattc

SEQ ID NO: 697988 - DNA, 25 bp, Mus musculus
gtgactactatgaacagactgattt

SEQ ID NO: 697989 - DNA, 25 bp, Mus musculus
gtgactactatgtacagactgattt

SEQ ID NO: 697990 - DNA, 25 bp, Mus musculus
gtgactactcagcttatgcccagac

SEQ ID NO: 697991 - DNA, 25 bp, Mus musculus
gtgactactcaggttatgcccagac

SEQ ID NO: 697992 - DNA, 25 bp, Mus musculus
gtgactactgaaccttagaccctca

SEQ ID NO: 697993 - DNA, 25 bp, Mus musculus
gtgactactgaagcttagaccctca

SEQ ID NO: 697994 - DNA, 25 bp, Mus musculus
gtgactactgacagaacatttgttt

SEQ ID NO: 697995 - DNA, 25 bp, Mus musculus
gtgactactgacagctgaggaattc

SEQ ID NO: 697996 - DNA, 25 bp, Mus musculus
gtgactactgactgaacatttgttt

SEQ ID NO: 697997 - DNA, 25 bp, Mus musculus
gtgactactgactgctgaggaattc

SEQ ID NO: 697998 - DNA, 25 bp, Mus musculus
gtgactactgatatcctggatggac

SEQ ID NO: 697999 - DNA, 25 bp, Mus musculus
gtgactactgatttcctggatggac

SEQ ID NO: 698000 - DNA, 25 bp, Mus musculus
gtgactactgctagagcctggtggc

SEQ ID NO: 698001 - DNA, 25 bp, Mus musculus
gtgactactgcttgagcctggtggc

SEQ ID NO: 698002 - DNA, 25 bp, Mus musculus
gtgactacttaaacagttcccatag

SEQ ID NO: 698003 - DNA, 25 bp, Mus musculus
gtgactacttaaacctttgcaccac

SEQ ID NO: 698004 - DNA, 25 bp, Mus musculus
gtgactacttaatcagttcccatag

SEQ ID NO: 698005 - DNA, 25 bp, Mus musculus
gtgactacttaatcctttgcaccac

SEQ ID NO: 698006 - DNA, 25 bp, Mus musculus
gtgactacttggagtacgctcctgt

SEQ ID NO: 698007 - DNA, 25 bp, Mus musculus
gtgactacttggtgtacgctcctgt

SEQ ID NO: 698008 - DNA, 25 bp, Mus musculus
gtgactagaagtaggcggcactaca

SEQ ID NO: 698009 - DNA, 25 bp, Mus musculus
gtgactagaagttggcggcactaca

SEQ ID NO: 698010 - DNA, 25 bp, Mus musculus
gtgactagacacacgttttgacatc

SEQ ID NO: 698011 - DNA, 25 bp, Mus musculus
gtgactagacactcgttttgacatc

SEQ ID NO: 698012 - DNA, 25 bp, Mus musculus
gtgactagacagaatatagccctta

SEQ ID NO: 698013 - DNA, 25 bp, Mus musculus
gtgactagacagtatatagccctta

SEQ ID NO: 698014 - DNA, 25 bp, Mus musculus
gtgactagatgtattgtcaacaatt

SEQ ID NO: 698015 - DNA, 25 bp, Mus musculus
gtgactagatgttttgtcaacaatt

SEQ ID NO: 698016 - DNA, 25 bp, Mus musculus
gtgactagatttagtgcctggcatt

SEQ ID NO: 698017 - DNA, 25 bp, Mus musculus
gtgactagattttgtgcctggcatt

SEQ ID NO: 698018 - DNA, 25 bp, Mus musculus
gtgactagcaagagacctagagcaa

SEQ ID NO: 698019 - DNA, 25 bp, Mus musculus
gtgactagcaagtgacctagagcaa

SEQ ID NO: 698020 - DNA, 25 bp, Mus musculus
gtgactagcatgacttacagattct

SEQ ID NO: 698021 - DNA, 25 bp, Mus musculus
gtgactagcatgtcttacagattct

SEQ ID NO: 698022 - DNA, 25 bp, Mus musculus
gtgactagcctcctaagtgagagta

SEQ ID NO: 698023 - DNA, 25 bp, Mus musculus
gtgactagcctcgtaagtgagagta

SEQ ID NO: 698024 - DNA, 25 bp, Mus musculus
gtgactagctagcttcaggagatac

SEQ ID NO: 698025 - DNA, 25 bp, Mus musculus
gtgactagctaggttcaggagatac

SEQ ID NO: 698026 - DNA, 25 bp, Mus musculus
gtgactaggcacacgttttatgctt

SEQ ID NO: 698027 - DNA, 25 bp, Mus musculus
gtgactaggcactcgttttatgctt

SEQ ID NO: 698028 - DNA, 25 bp, Mus musculus
gtgactaggtatagcctgacacaaa

SEQ ID NO: 698029 - DNA, 25 bp, Mus musculus
gtgactaggtattgcctgacacaaa

SEQ ID NO: 698030 - DNA, 25 bp, Mus musculus
gtgactaggtgtatcgaatctgctt

SEQ ID NO: 698031 - DNA, 25 bp, Mus musculus
gtgactaggtgtttcgaatctgctt

SEQ ID NO: 698032 - DNA, 25 bp, Mus musculus
gtgactagtgctaaagttcctgcct

SEQ ID NO: 698033 - DNA, 25 bp, Mus musculus
gtgactagtgcttaagttcctgcct

SEQ ID NO: 698034 - DNA, 25 bp, Mus musculus
gtgactataggtccccactaccaag

SEQ ID NO: 698035 - DNA, 25 bp, Mus musculus
gtgactataggtgcccactaccaag

SEQ ID NO: 698036 - DNA, 25 bp, Mus musculus
gtgactatatcactccccactagat

SEQ ID NO: 698037 - DNA, 25 bp, Mus musculus
gtgactatatcagtccccactagat

SEQ ID NO: 698038 - DNA, 25 bp, Mus musculus
gtgactatattaatcatctttttgg

SEQ ID NO: 698039 - DNA, 25 bp, Mus musculus
gtgactatattattcatctttttgg

SEQ ID NO: 698040 - DNA, 25 bp, Mus musculus
gtgactatcaacattgctgagacca

SEQ ID NO: 698041 - DNA, 25 bp, Mus musculus
gtgactatcaactttgctgagacca

SEQ ID NO: 698042 - DNA, 25 bp, Mus musculus
gtgactatcactatcttgtttctgt

SEQ ID NO: 698043 - DNA, 25 bp, Mus musculus
gtgactatcactttcttgtttctgt

SEQ ID NO: 698044 - DNA, 25 bp, Mus musculus
gtgactatcggcaccttagctatga

SEQ ID NO: 698045 - DNA, 25 bp, Mus musculus
gtgactatcggcagctggtgcacga

SEQ ID NO: 698046 - DNA, 25 bp, Mus musculus
gtgactatcggctccttagctatga

SEQ ID NO: 698047 - DNA, 25 bp, Mus musculus
gtgactatcggctgctggtgcacga

SEQ ID NO: 698048 - DNA, 25 bp, Mus musculus
gtgactatctgacgtgctaagtatt

SEQ ID NO: 698049 - DNA, 25 bp, Mus musculus
gtgactatctgaggtgctaagtatt

SEQ ID NO: 698050 - DNA, 25 bp, Mus musculus
gtgactatgactcctaagacttcca

SEQ ID NO: 698051 - DNA, 25 bp, Mus musculus
gtgactatgactgctaagacttcca

SEQ ID NO: 698052 - DNA, 25 bp, Mus musculus
gtgactatgcagcttttcatcgaac

SEQ ID NO: 698053 - DNA, 25 bp, Mus musculus
gtgactatgcaggttttcatcgaac

SEQ ID NO: 698054 - DNA, 25 bp, Mus musculus
gtgactatggaaaaaagtctgcatt

SEQ ID NO: 698055 - DNA, 25 bp, Mus musculus
gtgactatggaataaagtctgcatt

SEQ ID NO: 698056 - DNA, 25 bp, Mus musculus
gtgactatggtcactgtgtggcata

SEQ ID NO: 698057 - DNA, 25 bp, Mus musculus
gtgactatggtctctgtgtggcata

SEQ ID NO: 698058 - DNA, 25 bp, Mus musculus
gtgactattaacacgaaagacttgc

SEQ ID NO: 698059 - DNA, 25 bp, Mus musculus
gtgactattaactcgaaagacttgc

SEQ ID NO: 698060 - DNA, 25 bp, Mus musculus
gtgactattccacctattccaacaa

SEQ ID NO: 698061 - DNA, 25 bp, Mus musculus
gtgactattccagctattccaacaa

SEQ ID NO: 698062 - DNA, 25 bp, Mus musculus
gtgactattggtatgcagactcgca

SEQ ID NO: 698063 - DNA, 25 bp, Mus musculus
gtgactattggtttgcagactcgca

SEQ ID NO: 698064 - DNA, 25 bp, Mus musculus
gtgactatttcaaggcgttttctgc

SEQ ID NO: 698065 - DNA, 25 bp, Mus musculus
gtgactatttcacccagcagggaga

SEQ ID NO: 698066 - DNA, 25 bp, Mus musculus
gtgactatttcagccagcagggaga

SEQ ID NO: 698067 - DNA, 25 bp, Mus musculus
gtgactatttcatggcgttttctgc

SEQ ID NO: 698068 - DNA, 25 bp, Mus musculus
gtgactcaaaatcctgtcaggttga

SEQ ID NO: 698069 - DNA, 25 bp, Mus musculus
gtgactcaaaatgctgtcaggttga

SEQ ID NO: 698070 - DNA, 25 bp, Mus musculus
gtgactcaaaccatctgtgtagcct

SEQ ID NO: 698071 - DNA, 25 bp, Mus musculus
gtgactcaaaccttctgtgtagcct

SEQ ID NO: 698072 - DNA, 25 bp, Mus musculus
gtgactcaaagcctgccaagacaca

SEQ ID NO: 698073 - DNA, 25 bp, Mus musculus
gtgactcaaagcgtgccaagacaca

SEQ ID NO: 698074 - DNA, 25 bp, Mus musculus
gtgactcaaatgctcgcctagctag

SEQ ID NO: 698075 - DNA, 25 bp, Mus musculus
gtgactcaaatggtcgcctagctag

SEQ ID NO: 698076 - DNA, 25 bp, Mus musculus
gtgactcaagcaaaaggactttctc

SEQ ID NO: 698077 - DNA, 25 bp, Mus musculus
gtgactcaagcataaggactttctc

SEQ ID NO: 698078 - DNA, 25 bp, Mus musculus
gtgactcaagccctagccaagcaat

SEQ ID NO: 698079 - DNA, 25 bp, Mus musculus
gtgactcaagccgtagccaagcaat

SEQ ID NO: 698080 - DNA, 25 bp, Mus musculus
gtgactcaatagctaagggttcttt

SEQ ID NO: 698081 - DNA, 25 bp, Mus musculus
gtgactcaataggtaagggttcttt

SEQ ID NO: 698082 - DNA, 25 bp, Mus musculus
gtgactcaatggatacgcgcacttg

SEQ ID NO: 698083 - DNA, 25 bp, Mus musculus
gtgactcaatggttacgcgcacttg

SEQ ID NO: 698084 - DNA, 25 bp, Mus musculus
gtgactcacactcactgtttagttc

SEQ ID NO: 698085 - DNA, 25 bp, Mus musculus
gtgactcacactgactgtttagttc

SEQ ID NO: 698086 - DNA, 25 bp, Mus musculus
gtgactcactacatcagtgctggta

SEQ ID NO: 698087 - DNA, 25 bp, Mus musculus
gtgactcactacttcagtgctggta

SEQ ID NO: 698088 - DNA, 25 bp, Mus musculus
gtgactcactatctgctgctgtgac

SEQ ID NO: 698089 - DNA, 25 bp, Mus musculus
gtgactcactatgtgctgctgtgac

SEQ ID NO: 698090 - DNA, 25 bp, Mus musculus
gtgactcactccatgattggtggaa

SEQ ID NO: 698091 - DNA, 25 bp, Mus musculus
gtgactcactccttgattggtggaa

SEQ ID NO: 698092 - DNA, 25 bp, Mus musculus
gtgactcactgacaggtgaccctgg

SEQ ID NO: 698093 - DNA, 25 bp, Mus musculus
gtgactcactgagaggtgaccctgg

SEQ ID NO: 698094 - DNA, 25 bp, Mus musculus
gtgactcactgtaaattgtacccga

SEQ ID NO: 698095 - DNA, 25 bp, Mus musculus
gtgactcactgttaattgtacccga

SEQ ID NO: 698096 - DNA, 25 bp, Mus musculus
gtgactcactttctggtcctacaac

SEQ ID NO: 698097 - DNA, 25 bp, Mus musculus
gtgactcactttgtggtcctacaac

SEQ ID NO: 698098 - DNA, 25 bp, Mus musculus
gtgactcagaccatcaacacggttg

SEQ ID NO: 698099 - DNA, 25 bp, Mus musculus
gtgactcagaccttcaacacggttg

SEQ ID NO: 698100 - DNA, 25 bp, Mus musculus
gtgactcagactataggcctagaat

SEQ ID NO: 698101 - DNA, 25 bp, Mus musculus
gtgactcagactttaggcctagaat

SEQ ID NO: 698102 - DNA, 25 bp, Mus musculus
gtgactcagagtcttttgactcagt

SEQ ID NO: 698103 - DNA, 25 bp, Mus musculus
gtgactcagagtgttttgactcagt

SEQ ID NO: 698104 - DNA, 25 bp, Mus musculus
gtgactcagcataactccccagtga

SEQ ID NO: 698105 - DNA, 25 bp, Mus musculus
gtgactcagcattactccccagtga

SEQ ID NO: 698106 - DNA, 25 bp, Mus musculus
gtgactcagcctctgggaatccaca

SEQ ID NO: 698107 - DNA, 25 bp, Mus musculus
gtgactcagcctgtgggaatccaca

SEQ ID NO: 698108 - DNA, 25 bp, Mus musculus
gtgactcagctcacagcttgtaatg

SEQ ID NO: 698109 - DNA, 25 bp, Mus musculus
gtgactcagctctcagcttgtaatg

SEQ ID NO: 698110 - DNA, 25 bp, Mus musculus
gtgactcagcttaggtctggtcggt

SEQ ID NO: 698111 - DNA, 25 bp, Mus musculus
gtgactcagctttggtctggtcggt

SEQ ID NO: 698112 - DNA, 25 bp, Mus musculus
gtgactcaggaaactgcactcacca

SEQ ID NO: 698113 - DNA, 25 bp, Mus musculus
gtgactcaggaatctgcactcacca

SEQ ID NO: 698114 - DNA, 25 bp, Mus musculus
gtgactcaggacctacggattcatc

SEQ ID NO: 698115 - DNA, 25 bp, Mus musculus
gtgactcaggacgtacggattcatc

SEQ ID NO: 698116 - DNA, 25 bp, Mus musculus
gtgactcaggatctgccctgggtct

SEQ ID NO: 698117 - DNA, 25 bp, Mus musculus
gtgactcaggatgtgccctgggtct

SEQ ID NO: 698118 - DNA, 25 bp, Mus musculus
gtgactcagggaccccactttttca

SEQ ID NO: 698119 - DNA, 25 bp, Mus musculus
gtgactcagggagcccactttttca

SEQ ID NO: 698120 - DNA, 25 bp, Mus musculus
gtgactcagggcaccaatctggtat

SEQ ID NO: 698121 - DNA, 25 bp, Mus musculus
gtgactcagggctccaatctggtat

SEQ ID NO: 698122 - DNA, 25 bp, Mus musculus
gtgactcagtttcttcagtggacag

SEQ ID NO: 698123 - DNA, 25 bp, Mus musculus
gtgactcagtttgttcagtggacag

SEQ ID NO: 698124 - DNA, 25 bp, Mus musculus
gtgactcatagtatactgttctctt

SEQ ID NO: 698125 - DNA, 25 bp, Mus musculus
gtgactcatagtttactgttctctt

SEQ ID NO: 698126 - DNA, 25 bp, Mus musculus
gtgactcatatcacctgagaaaagg

SEQ ID NO: 698127 - DNA, 25 bp, Mus musculus
gtgactcatatctcctgagaaaagg

SEQ ID NO: 698128 - DNA, 25 bp, Mus musculus
gtgactcatcctcattccaggataa

SEQ ID NO: 698129 - DNA, 25 bp, Mus musculus
gtgactcatcctgattccaggataa

SEQ ID NO: 698130 - DNA, 25 bp, Mus musculus
gtgactcatgcaacctgtcttcaaa

SEQ ID NO: 698131 - DNA, 25 bp, Mus musculus
gtgactcatgcacacagtaagtgat

SEQ ID NO: 698132 - DNA, 25 bp, Mus musculus
gtgactcatgcagacagtaagtgat

SEQ ID NO: 698133 - DNA, 25 bp, Mus musculus
gtgactcatgcatcctgtcttcaaa

SEQ ID NO: 698134 - DNA, 25 bp, Mus musculus
gtgactcatggcaagagaatgtgtc

SEQ ID NO: 698135 - DNA, 25 bp, Mus musculus
gtgactcatggctagagaatgtgtc

SEQ ID NO: 698136 - DNA, 25 bp, Mus musculus
gtgactcatggtactgctgctggat

SEQ ID NO: 698137 - DNA, 25 bp, Mus musculus
gtgactcatggttctgctgctggat

SEQ ID NO: 698138 - DNA, 25 bp, Mus musculus
gtgactcattaccacggcgagtgtg

SEQ ID NO: 698139 - DNA, 25 bp, Mus musculus
gtgactcattacgacggcgagtgtg

SEQ ID NO: 698140 - DNA, 25 bp, Mus musculus
gtgactcattcacagaggcatgttt

SEQ ID NO: 698141 - DNA, 25 bp, Mus musculus
gtgactcattcagagaggcatgttt

SEQ ID NO: 698142 - DNA, 25 bp, Mus musculus
gtgactcattctaaaggtgtttccc

SEQ ID NO: 698143 - DNA, 25 bp, Mus musculus
gtgactcattcttaaggtgtttccc

SEQ ID NO: 698144 - DNA, 25 bp, Mus musculus
gtgactcattggcatttaaacagct

SEQ ID NO: 698145 - DNA, 25 bp, Mus musculus
gtgactcattgggatttaaacagct

SEQ ID NO: 698146 - DNA, 25 bp, Mus musculus
gtgactccacacaggctgatacttt

SEQ ID NO: 698147 - DNA, 25 bp, Mus musculus
gtgactccacactggctgatacttt

SEQ ID NO: 698148 - DNA, 25 bp, Mus musculus
gtgactccacagcagtatacaatat

SEQ ID NO: 698149 - DNA, 25 bp, Mus musculus
gtgactccacaggagtatacaatat

SEQ ID NO: 698150 - DNA, 25 bp, Mus musculus
gtgactccagctatgagacagccct

SEQ ID NO: 698151 - DNA, 25 bp, Mus musculus
gtgactccagctttgagacagccct

SEQ ID NO: 698152 - DNA, 25 bp, Mus musculus
gtgactccaggtccaaaacacaggt

SEQ ID NO: 698153 - DNA, 25 bp, Mus musculus
gtgactccaggtgcaaaacacaggt

SEQ ID NO: 698154 - DNA, 25 bp, Mus musculus
gtgactccagtaaatctcacctgta

SEQ ID NO: 698155 - DNA, 25 bp, Mus musculus
gtgactccagtatatctcacctgta

SEQ ID NO: 698156 - DNA, 25 bp, Mus musculus
gtgactccatagaaaccatctaccg

SEQ ID NO: 698157 - DNA, 25 bp, Mus musculus
gtgactccatagtaaccatctaccg

SEQ ID NO: 698158 - DNA, 25 bp, Mus musculus
gtgactccatgaaacttcagggtga

SEQ ID NO: 698159 - DNA, 25 bp, Mus musculus
gtgactccatgatacttcagggtga

SEQ ID NO: 698160 - DNA, 25 bp, Mus musculus
gtgactccattgacaaaggcccatt

SEQ ID NO: 698161 - DNA, 25 bp, Mus musculus
gtgactccattgtcaaaggcccatt

SEQ ID NO: 698162 - DNA, 25 bp, Mus musculus
gtgactcccaagagtgactgtagga

SEQ ID NO: 698163 - DNA, 25 bp, Mus musculus
gtgactcccaagtgtgactgtagga

SEQ ID NO: 698164 - DNA, 25 bp, Mus musculus
gtgactcccacaaatcatgttcctg

SEQ ID NO: 698165 - DNA, 25 bp, Mus musculus
gtgactcccacatatcatgttcctg

SEQ ID NO: 698166 - DNA, 25 bp, Mus musculus
gtgactccccagacagattctgatt

SEQ ID NO: 698167 - DNA, 25 bp, Mus musculus
gtgactccccagtcagattctgatt

SEQ ID NO: 698168 - DNA, 25 bp, Mus musculus
gtgactccctgaaataccatgtaaa

SEQ ID NO: 698169 - DNA, 25 bp, Mus musculus
gtgactccctgatataccatgtaaa

SEQ ID NO: 698170 - DNA, 25 bp, Mus musculus
gtgactcccttacctggtggctttg

SEQ ID NO: 698171 - DNA, 25 bp, Mus musculus
gtgactcccttagctggtggctttg

SEQ ID NO: 698172 - DNA, 25 bp, Mus musculus
gtgactcccttcagtactcccttag

SEQ ID NO: 698173 - DNA, 25 bp, Mus musculus
gtgactcccttctgtactcccttag

SEQ ID NO: 698174 - DNA, 25 bp, Mus musculus
gtgactccgagactcactcaatgaa

SEQ ID NO: 698175 - DNA, 25 bp, Mus musculus
gtgactccgagagtcactcaatgaa

SEQ ID NO: 698176 - DNA, 25 bp, Mus musculus
gtgactccgagtactgacccagaag

SEQ ID NO: 698177 - DNA, 25 bp, Mus musculus
gtgactccgagttctgacccagaag

SEQ ID NO: 698178 - DNA, 25 bp, Mus musculus
gtgactccgcagactaggacttagt

SEQ ID NO: 698179 - DNA, 25 bp, Mus musculus
gtgactccgcagtctaggacttagt

SEQ ID NO: 698180 - DNA, 25 bp, Mus musculus
gtgactcctgccaactaagaatctt

SEQ ID NO: 698181 - DNA, 25 bp, Mus musculus
gtgactcctgccagcaaaagtccag

SEQ ID NO: 698182 - DNA, 25 bp, Mus musculus
gtgactcctgcctactaagaatctt

SEQ ID NO: 698183 - DNA, 25 bp, Mus musculus
gtgactcctgcctgcaaaagtccag

SEQ ID NO: 698184 - DNA, 25 bp, Mus musculus
gtgactcctggacctgcaacagaat

SEQ ID NO: 698185 - DNA, 25 bp, Mus musculus
gtgactcctggagctgcaacagaat

SEQ ID NO: 698186 - DNA, 25 bp, Mus musculus
gtgactcctggcactggctataata

SEQ ID NO: 698187 - DNA, 25 bp, Mus musculus
gtgactcctggctctggctataata

SEQ ID NO: 698188 - DNA, 25 bp, Mus musculus
gtgactcctgtccaaactgttgtat

SEQ ID NO: 698189 - DNA, 25 bp, Mus musculus
gtgactcctgtcgaaactgttgtat

SEQ ID NO: 698190 - DNA, 25 bp, Mus musculus
gtgactccttgcaattccagaaact

SEQ ID NO: 698191 - DNA, 25 bp, Mus musculus
gtgactccttgctattccagaaact

SEQ ID NO: 698192 - DNA, 25 bp, Mus musculus
gtgactcgcagtacagttctgttta

SEQ ID NO: 698193 - DNA, 25 bp, Mus musculus
gtgactcgcagttcagttctgttta

SEQ ID NO: 698194 - DNA, 25 bp, Mus musculus
gtgactcggaacatcagcatgccaa

SEQ ID NO: 698195 - DNA, 25 bp, Mus musculus
gtgactcggaacttcagcatgccaa

SEQ ID NO: 698196 - DNA, 25 bp, Mus musculus
gtgactcgggccagtgcagagggcc

SEQ ID NO: 698197 - DNA, 25 bp, Mus musculus
gtgactcgggcctgtgcagagggcc

SEQ ID NO: 698198 - DNA, 25 bp, Mus musculus
gtgactcgtacaatgatccaagctt

SEQ ID NO: 698199 - DNA, 25 bp, Mus musculus
gtgactcgtacattgatccaagctt

SEQ ID NO: 698200 - DNA, 25 bp, Mus musculus
gtgactcgtgtcattagctttttag

SEQ ID NO: 698201 - DNA, 25 bp, Mus musculus
gtgactcgtgtctttagctttttag

SEQ ID NO: 698202 - DNA, 25 bp, Mus musculus
gtgactctaaaccatgcccaaggca

SEQ ID NO: 698203 - DNA, 25 bp, Mus musculus
gtgactctaaacgatgcccaaggca

SEQ ID NO: 698204 - DNA, 25 bp, Mus musculus
gtgactctaaataactgccaggatt

SEQ ID NO: 698205 - DNA, 25 bp, Mus musculus
gtgactctaaattactgccaggatt

SEQ ID NO: 698206 - DNA, 25 bp, Mus musculus
gtgactctacacaggaaagcaaatt

SEQ ID NO: 698207 - DNA, 25 bp, Mus musculus
gtgactctacactggaaagcaaatt

SEQ ID NO: 698208 - DNA, 25 bp, Mus musculus
gtgactctacatcatactttttgac

SEQ ID NO: 698209 - DNA, 25 bp, Mus musculus
gtgactctacatgatactttttgac

SEQ ID NO: 698210 - DNA, 25 bp, Mus musculus
gtgactctaccaccaagtcttagca

SEQ ID NO: 698211 - DNA, 25 bp, Mus musculus
gtgactctaccagcaagtcttagca

SEQ ID NO: 698212 - DNA, 25 bp, Mus musculus
gtgactctaccccagcagggaagca

SEQ ID NO: 698213 - DNA, 25 bp, Mus musculus
gtgactctacccgagcagggaagca

SEQ ID NO: 698214 - DNA, 25 bp, Mus musculus
gtgactctagtcaagttggcattga

SEQ ID NO: 698215 - DNA, 25 bp, Mus musculus
gtgactctagtctagttggcattga

SEQ ID NO: 698216 - DNA, 25 bp, Mus musculus
gtgactctatcaagtacagtttcct

SEQ ID NO: 698217 - DNA, 25 bp, Mus musculus
gtgactctatcatgtacagtttcct

SEQ ID NO: 698218 - DNA, 25 bp, Mus musculus
gtgactctattgaaaaggccagttt

SEQ ID NO: 698219 - DNA, 25 bp, Mus musculus
gtgactctattgtaaaggccagttt

SEQ ID NO: 698220 - DNA, 25 bp, Mus musculus
gtgactctatttactatcctcttgg

SEQ ID NO: 698221 - DNA, 25 bp, Mus musculus
gtgactctattttctatcctcttgg

SEQ ID NO: 698222 - DNA, 25 bp, Mus musculus
gtgactctcactattcttatgaccg

SEQ ID NO: 698223 - DNA, 25 bp, Mus musculus
gtgactctcacttttcttatgaccg

SEQ ID NO: 698224 - DNA, 25 bp, Mus musculus
gtgactctccacaaatggcagggcc

SEQ ID NO: 698225 - DNA, 25 bp, Mus musculus
gtgactctccactaatggcagggcc

SEQ ID NO: 698226 - DNA, 25 bp, Mus musculus
gtgactctctagaatgttgctatca

SEQ ID NO: 698227 - DNA, 25 bp, Mus musculus
gtgactctctagatctgctgtcgaa

SEQ ID NO: 698228 - DNA, 25 bp, Mus musculus
gtgactctctagtatgttgctatca

SEQ ID NO: 698229 - DNA, 25 bp, Mus musculus
gtgactctctagttctgctgtcgaa

SEQ ID NO: 698230 - DNA, 25 bp, Mus musculus
gtgactctctgactattcaggacag

SEQ ID NO: 698231 - DNA, 25 bp, Mus musculus
gtgactctctgagtattcaggacag

SEQ ID NO: 698232 - DNA, 25 bp, Mus musculus
gtgactctgaccctcattttgagat

SEQ ID NO: 698233 - DNA, 25 bp, Mus musculus
gtgactctgaccgtcattttgagat

SEQ ID NO: 698234 - DNA, 25 bp, Mus musculus
gtgactctgattctcttgtgatctg

SEQ ID NO: 698235 - DNA, 25 bp, Mus musculus
gtgactctgattgtcttgtgatctg

SEQ ID NO: 698236 - DNA, 25 bp, Mus musculus
gtgactctgccaccattgttacaat

SEQ ID NO: 698237 - DNA, 25 bp, Mus musculus
gtgactctgccagcattgttacaat

SEQ ID NO: 698238 - DNA, 25 bp, Mus musculus
gtgactctgcttctcactagcaaac

SEQ ID NO: 698239 - DNA, 25 bp, Mus musculus
gtgactctgcttgtcactagcaaac

SEQ ID NO: 698240 - DNA, 25 bp, Mus musculus
gtgactctggtaatagttttgtgtt

SEQ ID NO: 698241 - DNA, 25 bp, Mus musculus
gtgactctggtattagttttgtgtt

SEQ ID NO: 698242 - DNA, 25 bp, Mus musculus
gtgactctgtgcaagcttcccctaa

SEQ ID NO: 698243 - DNA, 25 bp, Mus musculus
gtgactctgtgctagcttcccctaa

SEQ ID NO: 698244 - DNA, 25 bp, Mus musculus
gtgactcttaacaggtatctttggt

SEQ ID NO: 698245 - DNA, 25 bp, Mus musculus
gtgactcttaactggtatctttggt

SEQ ID NO: 698246 - DNA, 25 bp, Mus musculus
gtgactcttcccatgtttaattaac

SEQ ID NO: 698247 - DNA, 25 bp, Mus musculus
gtgactcttcccttgtttaattaac

SEQ ID NO: 698248 - DNA, 25 bp, Mus musculus
gtgactcttcctaaatgttaatgat

SEQ ID NO: 698249 - DNA, 25 bp, Mus musculus
gtgactcttccttaatgttaatgat

SEQ ID NO: 698250 - DNA, 25 bp, Mus musculus
gtgactcttctgatagagccctact

SEQ ID NO: 698251 - DNA, 25 bp, Mus musculus
gtgactcttctgcactttaaagtat

SEQ ID NO: 698252 - DNA, 25 bp, Mus musculus
gtgactcttctggactttaaagtat

SEQ ID NO: 698253 - DNA, 25 bp, Mus musculus
gtgactcttctgttagagccctact

SEQ ID NO: 698254 - DNA, 25 bp, Mus musculus
gtgactcttgtaaagggacattagt

SEQ ID NO: 698255 - DNA, 25 bp, Mus musculus
gtgactcttgtatagggacattagt

SEQ ID NO: 698256 - DNA, 25 bp, Mus musculus
gtgactctttctagaggtgttctca

SEQ ID NO: 698257 - DNA, 25 bp, Mus musculus
gtgactctttcttgaggtgttctca

SEQ ID NO: 698258 - DNA, 25 bp, Mus musculus
gtgactctttttcaaactgtccttc

SEQ ID NO: 698259 - DNA, 25 bp, Mus musculus
gtgactctttttgaaactgtccttc

SEQ ID NO: 698260 - DNA, 25 bp, Mus musculus
gtgactgaaaccattttcccatcat

SEQ ID NO: 698261 - DNA, 25 bp, Mus musculus
gtgactgaaacctttttcccatcat

SEQ ID NO: 698262 - DNA, 25 bp, Mus musculus
gtgactgaaagtcctcaggctgaca

SEQ ID NO: 698263 - DNA, 25 bp, Mus musculus
gtgactgaaagtgctcaggctgaca

SEQ ID NO: 698264 - DNA, 25 bp, Mus musculus
gtgactgaacttacccttgagtgtg

SEQ ID NO: 698265 - DNA, 25 bp, Mus musculus
gtgactgaactttcccttgagtgtg

SEQ ID NO: 698266 - DNA, 25 bp, Mus musculus
gtgactgaagatacacctgaactgt

SEQ ID NO: 698267 - DNA, 25 bp, Mus musculus
gtgactgaagattcacctgaactgt

SEQ ID NO: 698268 - DNA, 25 bp, Mus musculus
gtgactgaagttacagctgtgcact

SEQ ID NO: 698269 - DNA, 25 bp, Mus musculus
gtgactgaagtttcagctgtgcact

SEQ ID NO: 698270 - DNA, 25 bp, Mus musculus
gtgactgacaagaacagaagcagat

SEQ ID NO: 698271 - DNA, 25 bp, Mus musculus
gtgactgacaagaagttactcccaa

SEQ ID NO: 698272 - DNA, 25 bp, Mus musculus
gtgactgacaagtacagaagcagat

SEQ ID NO: 698273 - DNA, 25 bp, Mus musculus
gtgactgacaagtagttactcccaa

SEQ ID NO: 698274 - DNA, 25 bp, Mus musculus
gtgactgacatcatcttggacctac

SEQ ID NO: 698275 - DNA, 25 bp, Mus musculus
gtgactgacatcatttgtcttaatt

SEQ ID NO: 698276 - DNA, 25 bp, Mus musculus
gtgactgacatcttcttggacctac

SEQ ID NO: 698277 - DNA, 25 bp, Mus musculus
gtgactgacatcttttgtcttaatt

SEQ ID NO: 698278 - DNA, 25 bp, Mus musculus
gtgactgaccaactgtactatcctt

SEQ ID NO: 698279 - DNA, 25 bp, Mus musculus
gtgactgaccaagtgtactatcctt

SEQ ID NO: 698280 - DNA, 25 bp, Mus musculus
gtgactgaccacaggactcttctag

SEQ ID NO: 698281 - DNA, 25 bp, Mus musculus
gtgactgaccacagtctaccaagag

SEQ ID NO: 698282 - DNA, 25 bp, Mus musculus
gtgactgaccactggactcttctag

SEQ ID NO: 698283 - DNA, 25 bp, Mus musculus
gtgactgaccactgtctaccaagag

SEQ ID NO: 698284 - DNA, 25 bp, Mus musculus
gtgactgaccagaggcacaagacca

SEQ ID NO: 698285 - DNA, 25 bp, Mus musculus
gtgactgaccagtggcacaagacca

SEQ ID NO: 698286 - DNA, 25 bp, Mus musculus
gtgactgacccacattcaggcctgt

SEQ ID NO: 698287 - DNA, 25 bp, Mus musculus
gtgactgacccagattcaggcctgt

SEQ ID NO: 698288 - DNA, 25 bp, Mus musculus
gtgactgacccgagtgttgccaaaa

SEQ ID NO: 698289 - DNA, 25 bp, Mus musculus
gtgactgacccgtgtgttgccaaaa

SEQ ID NO: 698290 - DNA, 25 bp, Mus musculus
gtgactgaccgcaagccagtgcttg

SEQ ID NO: 698291 - DNA, 25 bp, Mus musculus
gtgactgaccgctagccagtgcttg

SEQ ID NO: 698292 - DNA, 25 bp, Mus musculus
gtgactgaccgtcacattgaccgtt

SEQ ID NO: 698293 - DNA, 25 bp, Mus musculus
gtgactgaccgtgacattgaccgtt

SEQ ID NO: 698294 - DNA, 25 bp, Mus musculus
gtgactgacctgcagacccagtttg

SEQ ID NO: 698295 - DNA, 25 bp, Mus musculus
gtgactgacctgcatgtgcctgtaa

SEQ ID NO: 698296 - DNA, 25 bp, Mus musculus
gtgactgacctggagacccagtttg

SEQ ID NO: 698297 - DNA, 25 bp, Mus musculus
gtgactgacctggatgtgcctgtaa

SEQ ID NO: 698298 - DNA, 25 bp, Mus musculus
gtgactgaccttcagatctttccat

SEQ ID NO: 698299 - DNA, 25 bp, Mus musculus
gtgactgaccttgagatctttccat

SEQ ID NO: 698300 - DNA, 25 bp, Mus musculus
gtgactgactacagtacatacaact

SEQ ID NO: 698301 - DNA, 25 bp, Mus musculus
gtgactgactactgtacatacaact

SEQ ID NO: 698302 - DNA, 25 bp, Mus musculus
gtgactgactgtacacagacctcag

SEQ ID NO: 698303 - DNA, 25 bp, Mus musculus
gtgactgactgttcacagacctcag

SEQ ID NO: 698304 - DNA, 25 bp, Mus musculus
gtgactgacttcatggttcatccta

SEQ ID NO: 698305 - DNA, 25 bp, Mus musculus
gtgactgacttcttggttcatccta

SEQ ID NO: 698306 - DNA, 25 bp, Mus musculus
gtgactgactttccctatatatctt

SEQ ID NO: 698307 - DNA, 25 bp, Mus musculus
gtgactgactttgcctatatatctt

SEQ ID NO: 698308 - DNA, 25 bp, Mus musculus
gtgactgagacacactgacttgact

SEQ ID NO: 698309 - DNA, 25 bp, Mus musculus
gtgactgagacagactgacttgact

SEQ ID NO: 698310 - DNA, 25 bp, Mus musculus
gtgactgagaccatacgtggcctat

SEQ ID NO: 698311 - DNA, 25 bp, Mus musculus
gtgactgagaccttacgtggcctat

SEQ ID NO: 698312 - DNA, 25 bp, Mus musculus
gtgactgagactatcatttgtccaa

SEQ ID NO: 698313 - DNA, 25 bp, Mus musculus
gtgactgagactttcatttgtccaa

SEQ ID NO: 698314 - DNA, 25 bp, Mus musculus
gtgactgagagtagttccccgtgga

SEQ ID NO: 698315 - DNA, 25 bp, Mus musculus
gtgactgagagttgttccccgtgga

SEQ ID NO: 698316 - DNA, 25 bp, Mus musculus
gtgactgagataatggcggacatcc

SEQ ID NO: 698317 - DNA, 25 bp, Mus musculus
gtgactgagatattggcggacatcc

SEQ ID NO: 698318 - DNA, 25 bp, Mus musculus
gtgactgagcacaagtcctgcagct

SEQ ID NO: 698319 - DNA, 25 bp, Mus musculus
gtgactgagcactagtcctgcagct

SEQ ID NO: 698320 - DNA, 25 bp, Mus musculus
gtgactgagctcctcatgatgagtt

SEQ ID NO: 698321 - DNA, 25 bp, Mus musculus
gtgactgagctcgtcatgatgagtt

SEQ ID NO: 698322 - DNA, 25 bp, Mus musculus
gtgactgaggaacacacccatcatt

SEQ ID NO: 698323 - DNA, 25 bp, Mus musculus
gtgactgaggaagacacccatcatt

SEQ ID NO: 698324 - DNA, 25 bp, Mus musculus
gtgactgaggcaccaaagacaggca

SEQ ID NO: 698325 - DNA, 25 bp, Mus musculus
gtgactgaggcagcaaagacaggca

SEQ ID NO: 698326 - DNA, 25 bp, Mus musculus
gtgactgagggactaaattgctgac

SEQ ID NO: 698327 - DNA, 25 bp, Mus musculus
gtgactgagggagtaaattgctgac

SEQ ID NO: 698328 - DNA, 25 bp, Mus musculus
gtgactgagggtcgtcaaactgcca

SEQ ID NO: 698329 - DNA, 25 bp, Mus musculus
gtgactgagggtggtcaaactgcca

SEQ ID NO: 698330 - DNA, 25 bp, Mus musculus
gtgactgagttacagcctagctgtt

SEQ ID NO: 698331 - DNA, 25 bp, Mus musculus
gtgactgagttactaaccgtaggaa

SEQ ID NO: 698332 - DNA, 25 bp, Mus musculus
gtgactgagttagagcctagctgtt

SEQ ID NO: 698333 - DNA, 25 bp, Mus musculus
gtgactgagttagtaaccgtaggaa

SEQ ID NO: 698334 - DNA, 25 bp, Mus musculus
gtgactgagtttatctgcctagaaa

SEQ ID NO: 698335 - DNA, 25 bp, Mus musculus
gtgactgagtttttctgcctagaaa

SEQ ID NO: 698336 - DNA, 25 bp, Mus musculus
gtgactgataccagtgtgaagcctt

SEQ ID NO: 698337 - DNA, 25 bp, Mus musculus
gtgactgatacctgtgtgaagcctt

SEQ ID NO: 698338 - DNA, 25 bp, Mus musculus
gtgactgatcacctccaaatggtac

SEQ ID NO: 698339 - DNA, 25 bp, Mus musculus
gtgactgatcacgtccaaatggtac

SEQ ID NO: 698340 - DNA, 25 bp, Mus musculus
gtgactgatgagctcattcactgct

SEQ ID NO: 698341 - DNA, 25 bp, Mus musculus
gtgactgatgaggtcattcactgct

SEQ ID NO: 698342 - DNA, 25 bp, Mus musculus
gtgactgatggtatggtttcctctc

SEQ ID NO: 698343 - DNA, 25 bp, Mus musculus
gtgactgatggtttggtttcctctc

SEQ ID NO: 698344 - DNA, 25 bp, Mus musculus
gtgactgcaagactctcatctccct

SEQ ID NO: 698345 - DNA, 25 bp, Mus musculus
gtgactgcaagagtctcatctccct

SEQ ID NO: 698346 - DNA, 25 bp, Mus musculus
gtgactgcacacaggattctgggaa

SEQ ID NO: 698347 - DNA, 25 bp, Mus musculus
gtgactgcacacatgtatttaagta

SEQ ID NO: 698348 - DNA, 25 bp, Mus musculus
gtgactgcacactggattctgggaa

SEQ ID NO: 698349 - DNA, 25 bp, Mus musculus
gtgactgcacacttgtatttaagta

SEQ ID NO: 698350 - DNA, 25 bp, Mus musculus
gtgactgcagccagctagaagccat

SEQ ID NO: 698351 - DNA, 25 bp, Mus musculus
gtgactgcagcctgctagaagccat

SEQ ID NO: 698352 - DNA, 25 bp, Mus musculus
gtgactgcatcacagaggacgcttc

SEQ ID NO: 698353 - DNA, 25 bp, Mus musculus
gtgactgcatcagagaggacgcttc

SEQ ID NO: 698354 - DNA, 25 bp, Mus musculus
gtgactgcatgccttcagatcagga

SEQ ID NO: 698355 - DNA, 25 bp, Mus musculus
gtgactgcatgcgttcagatcagga

SEQ ID NO: 698356 - DNA, 25 bp, Mus musculus
gtgactgccaatataaacctgggtt

SEQ ID NO: 698357 - DNA, 25 bp, Mus musculus
gtgactgccaatttaaacctgggtt

SEQ ID NO: 698358 - DNA, 25 bp, Mus musculus
gtgactgccactcaaattaactgga

SEQ ID NO: 698359 - DNA, 25 bp, Mus musculus
gtgactgccactgaaattaactgga

SEQ ID NO: 698360 - DNA, 25 bp, Mus musculus
gtgactgcccatacttgagtccaaa

SEQ ID NO: 698361 - DNA, 25 bp, Mus musculus
gtgactgcccattcttgagtccaaa

SEQ ID NO: 698362 - DNA, 25 bp, Mus musculus
gtgactgccccgagctgtaaaactg

SEQ ID NO: 698363 - DNA, 25 bp, Mus musculus
gtgactgccccgtgctgtaaaactg

SEQ ID NO: 698364 - DNA, 25 bp, Mus musculus
gtgactgccttgacccttagtactg

SEQ ID NO: 698365 - DNA, 25 bp, Mus musculus
gtgactgccttgtcccttagtactg

SEQ ID NO: 698366 - DNA, 25 bp, Mus musculus
gtgactgcgacaaagttcaactgaa

SEQ ID NO: 698367 - DNA, 25 bp, Mus musculus
gtgactgcgacatagttcaactgaa

SEQ ID NO: 698368 - DNA, 25 bp, Mus musculus
gtgactgcgggcatttgtggctata

SEQ ID NO: 698369 - DNA, 25 bp, Mus musculus
gtgactgcgggcttttgtggctata

SEQ ID NO: 698370 - DNA, 25 bp, Mus musculus
gtgactgctattctctgatcaagct

SEQ ID NO: 698371 - DNA, 25 bp, Mus musculus
gtgactgctattgtctgatcaagct

SEQ ID NO: 698372 - DNA, 25 bp, Mus musculus
gtgactgctctgacgattttactga

SEQ ID NO: 698373 - DNA, 25 bp, Mus musculus
gtgactgctctgtcgattttactga

SEQ ID NO: 698374 - DNA, 25 bp, Mus musculus
gtgactgctcttaagaatcactttg

SEQ ID NO: 698375 - DNA, 25 bp, Mus musculus
gtgactgctctttagaatcactttg

SEQ ID NO: 698376 - DNA, 25 bp, Mus musculus
gtgactgctgaaccagagatttgca

SEQ ID NO: 698377 - DNA, 25 bp, Mus musculus
gtgactgctgaagcagagatttgca

SEQ ID NO: 698378 - DNA, 25 bp, Mus musculus
gtgactgctgatactatcttgtgaa

SEQ ID NO: 698379 - DNA, 25 bp, Mus musculus
gtgactgctgattctatcttgtgaa

SEQ ID NO: 698380 - DNA, 25 bp, Mus musculus
gtgactgctggaactacaagtggga

SEQ ID NO: 698381 - DNA, 25 bp, Mus musculus
gtgactgctggatctacaagtggga

SEQ ID NO: 698382 - DNA, 25 bp, Mus musculus
gtgactgctttcactacaaagcttg

SEQ ID NO: 698383 - DNA, 25 bp, Mus musculus
gtgactgctttctctacaaagcttg

SEQ ID NO: 698384 - DNA, 25 bp, Mus musculus
gtgactggaacactgcgcatgcgca

SEQ ID NO: 698385 - DNA, 25 bp, Mus musculus
gtgactggaacagtgcgcatgcgca

SEQ ID NO: 698386 - DNA, 25 bp, Mus musculus
gtgactggacttatctaagccatgg

SEQ ID NO: 698387 - DNA, 25 bp, Mus musculus
gtgactggacttcgacatttcttgg

SEQ ID NO: 698388 - DNA, 25 bp, Mus musculus
gtgactggacttggacatttcttgg

SEQ ID NO: 698389 - DNA, 25 bp, Mus musculus
gtgactggacttttctaagccatgg

SEQ ID NO: 698390 - DNA, 25 bp, Mus musculus
gtgactggagcacactggcagcctt

SEQ ID NO: 698391 - DNA, 25 bp, Mus musculus
gtgactggagcagactggcagcctt

SEQ ID NO: 698392 - DNA, 25 bp, Mus musculus
gtgactggagggacaccactgacca

SEQ ID NO: 698393 - DNA, 25 bp, Mus musculus
gtgactggagggtcaccactgacca

SEQ ID NO: 698394 - DNA, 25 bp, Mus musculus
gtgactggaggtacgctcgctcaga

SEQ ID NO: 698395 - DNA, 25 bp, Mus musculus
gtgactggaggttcgctcgctcaga

SEQ ID NO: 698396 - DNA, 25 bp, Mus musculus
gtgactggcagcatattgtggagct

SEQ ID NO: 698397 - DNA, 25 bp, Mus musculus
gtgactggcagcttattgtggagct

SEQ ID NO: 698398 - DNA, 25 bp, Mus musculus
gtgactggcaggataagtagcattt

SEQ ID NO: 698399 - DNA, 25 bp, Mus musculus
gtgactggcaggttaagtagcattt

SEQ ID NO: 698400 - DNA, 25 bp, Mus musculus
gtgactggcatgaagatctgatatc

SEQ ID NO: 698401 - DNA, 25 bp, Mus musculus
gtgactggcatgatttactctgtat

SEQ ID NO: 698402 - DNA, 25 bp, Mus musculus
gtgactggcatgtagatctgatatc

SEQ ID NO: 698403 - DNA, 25 bp, Mus musculus
gtgactggcatgttttactctgtat

SEQ ID NO: 698404 - DNA, 25 bp, Mus musculus
gtgactggcgcacccgagacgctta

SEQ ID NO: 698405 - DNA, 25 bp, Mus musculus
gtgactggcgcagccgagacgctta

SEQ ID NO: 698406 - DNA, 25 bp, Mus musculus
gtgactggctcacaactgaccccag

SEQ ID NO: 698407 - DNA, 25 bp, Mus musculus
gtgactggctcagaactgaccccag

SEQ ID NO: 698408 - DNA, 25 bp, Mus musculus
gtgactggctgcacgatggttaatc

SEQ ID NO: 698409 - DNA, 25 bp, Mus musculus
gtgactggctgctcgatggttaatc

SEQ ID NO: 698410 - DNA, 25 bp, Mus musculus
gtgactgggacaacttatctctaag

SEQ ID NO: 698411 - DNA, 25 bp, Mus musculus
gtgactgggacatcttatctctaag

SEQ ID NO: 698412 - DNA, 25 bp, Mus musculus
gtgactgggactctaacggacaatt

SEQ ID NO: 698413 - DNA, 25 bp, Mus musculus
gtgactgggactgtaacggacaatt

SEQ ID NO: 698414 - DNA, 25 bp, Mus musculus
gtgactgggcatctgatcgccgatt

SEQ ID NO: 698415 - DNA, 25 bp, Mus musculus
gtgactgggcatgtgatcgccgatt

SEQ ID NO: 698416 - DNA, 25 bp, Mus musculus
gtgactggtaacagcagtgccttac

SEQ ID NO: 698417 - DNA, 25 bp, Mus musculus
gtgactggtaactgcagtgccttac

SEQ ID NO: 698418 - DNA, 25 bp, Mus musculus
gtgactggtaccatatctattgtaa

SEQ ID NO: 698419 - DNA, 25 bp, Mus musculus
gtgactggtaccttatctattgtaa

SEQ ID NO: 698420 - DNA, 25 bp, Mus musculus
gtgactggtatgacccagcacacgt

SEQ ID NO: 698421 - DNA, 25 bp, Mus musculus
gtgactggtatgtcccagcacacgt

SEQ ID NO: 698422 - DNA, 25 bp, Mus musculus
gtgactggtcatccactttgatttc

SEQ ID NO: 698423 - DNA, 25 bp, Mus musculus
gtgactggtcatgcactttgatttc

SEQ ID NO: 698424 - DNA, 25 bp, Mus musculus
gtgactggtccacgtagtttccctc

SEQ ID NO: 698425 - DNA, 25 bp, Mus musculus
gtgactggtccaggtagtttccctc

SEQ ID NO: 698426 - DNA, 25 bp, Mus musculus
gtgactggttggcttttgcattcta

SEQ ID NO: 698427 - DNA, 25 bp, Mus musculus
gtgactggttgggttttgcattcta

SEQ ID NO: 698428 - DNA, 25 bp, Mus musculus
gtgactggtttcatactgagtacta

SEQ ID NO: 698429 - DNA, 25 bp, Mus musculus
gtgactggtttcttactgagtacta

SEQ ID NO: 698430 - DNA, 25 bp, Mus musculus
gtgactgtaagcactcgacctgata

SEQ ID NO: 698431 - DNA, 25 bp, Mus musculus
gtgactgtaagcagatgcctggctg

SEQ ID NO: 698432 - DNA, 25 bp, Mus musculus
gtgactgtaagctctcgacctgata

SEQ ID NO: 698433 - DNA, 25 bp, Mus musculus
gtgactgtaagctgatgcctggctg

SEQ ID NO: 698434 - DNA, 25 bp, Mus musculus
gtgactgtaccacgtagtccttgta

SEQ ID NO: 698435 - DNA, 25 bp, Mus musculus
gtgactgtaccaggtagtccttgta

SEQ ID NO: 698436 - DNA, 25 bp, Mus musculus
gtgactgtatataccctcctggcag

SEQ ID NO: 698437 - DNA, 25 bp, Mus musculus
gtgactgtatattccctcctggcag

SEQ ID NO: 698438 - DNA, 25 bp, Mus musculus
gtgactgtcagcagcaatggcctct

SEQ ID NO: 698439 - DNA, 25 bp, Mus musculus
gtgactgtcagctgcaatggcctct

SEQ ID NO: 698440 - DNA, 25 bp, Mus musculus
gtgactgtcccaaccacattgaggg

SEQ ID NO: 698441 - DNA, 25 bp, Mus musculus
gtgactgtcccatccacattgaggg

SEQ ID NO: 698442 - DNA, 25 bp, Mus musculus
gtgactgtccctcctgatgtatttt

SEQ ID NO: 698443 - DNA, 25 bp, Mus musculus
gtgactgtccctgctgatgtatttt

SEQ ID NO: 698444 - DNA, 25 bp, Mus musculus
gtgactgtcctaagatatatccctt

SEQ ID NO: 698445 - DNA, 25 bp, Mus musculus
gtgactgtcctatgatatatccctt

SEQ ID NO: 698446 - DNA, 25 bp, Mus musculus
gtgactgtcgttatctacatgtaga

SEQ ID NO: 698447 - DNA, 25 bp, Mus musculus
gtgactgtcgttttctacatgtaga

SEQ ID NO: 698448 - DNA, 25 bp, Mus musculus
gtgactgtctcaatgagcccagcca

SEQ ID NO: 698449 - DNA, 25 bp, Mus musculus
gtgactgtctcattgagcccagcca

SEQ ID NO: 698450 - DNA, 25 bp, Mus musculus
gtgactgtctctattaactttcttt

SEQ ID NO: 698451 - DNA, 25 bp, Mus musculus
gtgactgtctcttttaactttcttt

SEQ ID NO: 698452 - DNA, 25 bp, Mus musculus
gtgactgtctgcctatatatatatt

SEQ ID NO: 698453 - DNA, 25 bp, Mus musculus
gtgactgtctgcgtatatatatatt

SEQ ID NO: 698454 - DNA, 25 bp, Mus musculus
gtgactgtcttgaaggctggcatga

SEQ ID NO: 698455 - DNA, 25 bp, Mus musculus
gtgactgtcttgtaggctggcatga

SEQ ID NO: 698456 - DNA, 25 bp, Mus musculus
gtgactgtgagtacatcatcagggt

SEQ ID NO: 698457 - DNA, 25 bp, Mus musculus
gtgactgtgagttcatcatcagggt

SEQ ID NO: 698458 - DNA, 25 bp, Mus musculus
gtgactgtgatcctgatcctccggc

SEQ ID NO: 698459 - DNA, 25 bp, Mus musculus
gtgactgtgatcgtgatcctccggc

SEQ ID NO: 698460 - DNA, 25 bp, Mus musculus
gtgactgtgcaacctggacagactt

SEQ ID NO: 698461 - DNA, 25 bp, Mus musculus
gtgactgtgcaacttaacactcaca

SEQ ID NO: 698462 - DNA, 25 bp, Mus musculus
gtgactgtgcaagctggacagactt

SEQ ID NO: 698463 - DNA, 25 bp, Mus musculus
gtgactgtgcaagttaacactcaca

SEQ ID NO: 698464 - DNA, 25 bp, Mus musculus
gtgactgtgcacaagggcaccgtat

SEQ ID NO: 698465 - DNA, 25 bp, Mus musculus
gtgactgtgcactagggcaccgtat

SEQ ID NO: 698466 - DNA, 25 bp, Mus musculus
gtgactgtgcccagcatggttaaga

SEQ ID NO: 698467 - DNA, 25 bp, Mus musculus
gtgactgtgccctgcatggttaaga

SEQ ID NO: 698468 - DNA, 25 bp, Mus musculus
gtgactgtgcggaccattttgagca

SEQ ID NO: 698469 - DNA, 25 bp, Mus musculus
gtgactgtgcggtccattttgagca

SEQ ID NO: 698470 - DNA, 25 bp, Mus musculus
gtgactgtgctaccatagctgggca

SEQ ID NO: 698471 - DNA, 25 bp, Mus musculus
gtgactgtgctagcatagctgggca

SEQ ID NO: 698472 - DNA, 25 bp, Mus musculus
gtgactgtgctcctgttgacaaaaa

SEQ ID NO: 698473 - DNA, 25 bp, Mus musculus
gtgactgtgctcgtgttgacaaaaa

SEQ ID NO: 698474 - DNA, 25 bp, Mus musculus
gtgactgtggtcattgtgaagcctg

SEQ ID NO: 698475 - DNA, 25 bp, Mus musculus
gtgactgtggtctttgtgaagcctg

SEQ ID NO: 698476 - DNA, 25 bp, Mus musculus
gtgactgtgtacagctgtgcacctg

SEQ ID NO: 698477 - DNA, 25 bp, Mus musculus
gtgactgtgtactgctgtgcacctg

SEQ ID NO: 698478 - DNA, 25 bp, Mus musculus
gtgactgtgtgcatatcctattgac

SEQ ID NO: 698479 - DNA, 25 bp, Mus musculus
gtgactgtgtgcttatcctattgac

SEQ ID NO: 698480 - DNA, 25 bp, Mus musculus
gtgactgttaagcttaagttaccag

SEQ ID NO: 698481 - DNA, 25 bp, Mus musculus
gtgactgttaaggttaagttaccag

SEQ ID NO: 698482 - DNA, 25 bp, Mus musculus
gtgactgttcacatgcccaaagttg

SEQ ID NO: 698483 - DNA, 25 bp, Mus musculus
gtgactgttcacttgcccaaagttg

SEQ ID NO: 698484 - DNA, 25 bp, Mus musculus
gtgactgttccacagctttaactgg

SEQ ID NO: 698485 - DNA, 25 bp, Mus musculus
gtgactgttccagagctttaactgg

SEQ ID NO: 698486 - DNA, 25 bp, Mus musculus
gtgactgtttaaatttagccactgc

SEQ ID NO: 698487 - DNA, 25 bp, Mus musculus
gtgactgtttaattttagccactgc

SEQ ID NO: 698488 - DNA, 25 bp, Mus musculus
gtgactgtttcaagccatactttgt

SEQ ID NO: 698489 - DNA, 25 bp, Mus musculus
gtgactgtttcatgccatactttgt

SEQ ID NO: 698490 - DNA, 25 bp, Mus musculus
gtgactgtttcgaggaagcctggaa

SEQ ID NO: 698491 - DNA, 25 bp, Mus musculus
gtgactgtttcgtggaagcctggaa

SEQ ID NO: 698492 - DNA, 25 bp, Mus musculus
gtgactgtttgactcttggtattca

SEQ ID NO: 698493 - DNA, 25 bp, Mus musculus
gtgactgtttgagtcttggtattca

SEQ ID NO: 698494 - DNA, 25 bp, Mus musculus
gtgactgtttgccatgaattttgtt

SEQ ID NO: 698495 - DNA, 25 bp, Mus musculus
gtgactgtttgcgatgaattttgtt

SEQ ID NO: 698496 - DNA, 25 bp, Mus musculus
gtgactgtttggatcgcaacagcta

SEQ ID NO: 698497 - DNA, 25 bp, Mus musculus
gtgactgtttggttcgcaacagcta

SEQ ID NO: 698498 - DNA, 25 bp, Mus musculus
gtgactgtttttcattgacaccaat

SEQ ID NO: 698499 - DNA, 25 bp, Mus musculus
gtgactgtttttgattgacaccaat

SEQ ID NO: 698500 - DNA, 25 bp, Mus musculus
gtgacttaaagcagtgggaataacc

SEQ ID NO: 698501 - DNA, 25 bp, Mus musculus
gtgacttaaagctgtgggaataacc

SEQ ID NO: 698502 - DNA, 25 bp, Mus musculus
gtgacttaaagtctggatcctgttc

SEQ ID NO: 698503 - DNA, 25 bp, Mus musculus
gtgacttaaagtgtggatcctgttc

SEQ ID NO: 698504 - DNA, 25 bp, Mus musculus
gtgacttaatgtacaggaccacagc

SEQ ID NO: 698505 - DNA, 25 bp, Mus musculus
gtgacttaatgttcaggaccacagc

SEQ ID NO: 698506 - DNA, 25 bp, Mus musculus
gtgacttaattcagtgtgatatcaa

SEQ ID NO: 698507 - DNA, 25 bp, Mus musculus
gtgacttaattctgtgtgatatcaa

SEQ ID NO: 698508 - DNA, 25 bp, Mus musculus
gtgacttacaagcatacatacccat

SEQ ID NO: 698509 - DNA, 25 bp, Mus musculus
gtgacttacaaggatacatacccat

SEQ ID NO: 698510 - DNA, 25 bp, Mus musculus
gtgacttacaccatgacgatggcag

SEQ ID NO: 698511 - DNA, 25 bp, Mus musculus
gtgacttacaccttgacgatggcag

SEQ ID NO: 698512 - DNA, 25 bp, Mus musculus
gtgacttacactaccaatatacagt

SEQ ID NO: 698513 - DNA, 25 bp, Mus musculus
gtgacttacacttccaatatacagt

SEQ ID NO: 698514 - DNA, 25 bp, Mus musculus
gtgacttacagcctttatgattgat

SEQ ID NO: 698515 - DNA, 25 bp, Mus musculus
gtgacttacagcgtttatgattgat

SEQ ID NO: 698516 - DNA, 25 bp, Mus musculus
gtgacttacgcactattcaaacctt

SEQ ID NO: 698517 - DNA, 25 bp, Mus musculus
gtgacttacgcagtattcaaacctt

SEQ ID NO: 698518 - DNA, 25 bp, Mus musculus
gtgacttactcgaagcctcgattgg

SEQ ID NO: 698519 - DNA, 25 bp, Mus musculus
gtgacttactcgtagcctcgattgg

SEQ ID NO: 698520 - DNA, 25 bp, Mus musculus
gtgacttagagtacaaggccttgct

SEQ ID NO: 698521 - DNA, 25 bp, Mus musculus
gtgacttagagttcaaggccttgct

SEQ ID NO: 698522 - DNA, 25 bp, Mus musculus
gtgacttagcacacaacacgtttgt

SEQ ID NO: 698523 - DNA, 25 bp, Mus musculus
gtgacttagcacatttattattcca

SEQ ID NO: 698524 - DNA, 25 bp, Mus musculus
gtgacttagcactcaacacgtttgt

SEQ ID NO: 698525 - DNA, 25 bp, Mus musculus
gtgacttagcacttttattattcca

SEQ ID NO: 698526 - DNA, 25 bp, Mus musculus
gtgacttagcctcgtttgtagcctc

SEQ ID NO: 698527 - DNA, 25 bp, Mus musculus
gtgacttagcctggtttgtagcctc

SEQ ID NO: 698528 - DNA, 25 bp, Mus musculus
gtgacttaggcgaatgcagcccaca

SEQ ID NO: 698529 - DNA, 25 bp, Mus musculus
gtgacttaggcgtatgcagcccaca

SEQ ID NO: 698530 - DNA, 25 bp, Mus musculus
gtgacttattttctctgccatggta

SEQ ID NO: 698531 - DNA, 25 bp, Mus musculus
gtgacttattttgtctgccatggta

SEQ ID NO: 698532 - DNA, 25 bp, Mus musculus
gtgacttcaagtatggaccctggaa

SEQ ID NO: 698533 - DNA, 25 bp, Mus musculus
gtgacttcaagtatggttcttagct

SEQ ID NO: 698534 - DNA, 25 bp, Mus musculus
gtgacttcaagtttggaccctggaa

SEQ ID NO: 698535 - DNA, 25 bp, Mus musculus
gtgacttcaagtttggttcttagct

SEQ ID NO: 698536 - DNA, 25 bp, Mus musculus
gtgacttcacaaaaatcctagagga

SEQ ID NO: 698537 - DNA, 25 bp, Mus musculus
gtgacttcacaataatcctagagga

SEQ ID NO: 698538 - DNA, 25 bp, Mus musculus
gtgacttcaccacagaatgttctct

SEQ ID NO: 698539 - DNA, 25 bp, Mus musculus
gtgacttcaccagagaatgttctct

SEQ ID NO: 698540 - DNA, 25 bp, Mus musculus
gtgacttcactcactctgaattaat

SEQ ID NO: 698541 - DNA, 25 bp, Mus musculus
gtgacttcactctctctgaattaat

SEQ ID NO: 698542 - DNA, 25 bp, Mus musculus
gtgacttcaggtacaccacgatagg

SEQ ID NO: 698543 - DNA, 25 bp, Mus musculus
gtgacttcaggttcaccacgatagg

SEQ ID NO: 698544 - DNA, 25 bp, Mus musculus
gtgacttcagtccagatagttgctc

SEQ ID NO: 698545 - DNA, 25 bp, Mus musculus
gtgacttcagtcgagatagttgctc

SEQ ID NO: 698546 - DNA, 25 bp, Mus musculus
gtgacttcatgactggtgtacctgc

SEQ ID NO: 698547 - DNA, 25 bp, Mus musculus
gtgacttcatgagtggtgtacctgc

SEQ ID NO: 698548 - DNA, 25 bp, Mus musculus
gtgacttcattgagtgttctcaaaa

SEQ ID NO: 698549 - DNA, 25 bp, Mus musculus
gtgacttcattgtgtgttctcaaaa

SEQ ID NO: 698550 - DNA, 25 bp, Mus musculus
gtgacttcatttaccgagcttgcga

SEQ ID NO: 698551 - DNA, 25 bp, Mus musculus
gtgacttcatttacgtttacaccaa

SEQ ID NO: 698552 - DNA, 25 bp, Mus musculus
gtgacttcattttccgagcttgcga

SEQ ID NO: 698553 - DNA, 25 bp, Mus musculus
gtgacttcattttcgtttacaccaa

SEQ ID NO: 698554 - DNA, 25 bp, Mus musculus
gtgacttccatgatgatccaggtgt

SEQ ID NO: 698555 - DNA, 25 bp, Mus musculus
gtgacttccatgttgatccaggtgt

SEQ ID NO: 698556 - DNA, 25 bp, Mus musculus
gtgacttcccacagtactttgcggt

SEQ ID NO: 698557 - DNA, 25 bp, Mus musculus
gtgacttcccactgtactttgcggt

SEQ ID NO: 698558 - DNA, 25 bp, Mus musculus
gtgacttcccagaaagaccttgagt

SEQ ID NO: 698559 - DNA, 25 bp, Mus musculus
gtgacttcccagtaagaccttgagt

SEQ ID NO: 698560 - DNA, 25 bp, Mus musculus
gtgacttcccatataacggtggcgg

SEQ ID NO: 698561 - DNA, 25 bp, Mus musculus
gtgacttcccatttaacggtggcgg

SEQ ID NO: 698562 - DNA, 25 bp, Mus musculus
gtgacttcccgaaatgcaaggtgtc

SEQ ID NO: 698563 - DNA, 25 bp, Mus musculus
gtgacttcccgatatgcaaggtgtc

SEQ ID NO: 698564 - DNA, 25 bp, Mus musculus
gtgacttccctgatcatcttttggg

SEQ ID NO: 698565 - DNA, 25 bp, Mus musculus
gtgacttccctgttcatcttttggg

SEQ ID NO: 698566 - DNA, 25 bp, Mus musculus
gtgacttcctatctaagtggcgatt

SEQ ID NO: 698567 - DNA, 25 bp, Mus musculus
gtgacttcctatgtaagtggcgatt

SEQ ID NO: 698568 - DNA, 25 bp, Mus musculus
gtgacttcctggatctgatcaaaac

SEQ ID NO: 698569 - DNA, 25 bp, Mus musculus
gtgacttcctggttctgatcaaaac

SEQ ID NO: 698570 - DNA, 25 bp, Mus musculus
gtgacttccttacacttgcagtact

SEQ ID NO: 698571 - DNA, 25 bp, Mus musculus
gtgacttccttagacttgcagtact

SEQ ID NO: 698572 - DNA, 25 bp, Mus musculus
gtgacttccttgagagcagagggca

SEQ ID NO: 698573 - DNA, 25 bp, Mus musculus
gtgacttccttgtgagcagagggca

SEQ ID NO: 698574 - DNA, 25 bp, Mus musculus
gtgacttcgcatacccagatgaatt

SEQ ID NO: 698575 - DNA, 25 bp, Mus musculus
gtgacttcgcattcccagatgaatt

SEQ ID NO: 698576 - DNA, 25 bp, Mus musculus
gtgacttcggtaattcagtgtgtcc

SEQ ID NO: 698577 - DNA, 25 bp, Mus musculus
gtgacttcggtatttcagtgtgtcc

SEQ ID NO: 698578 - DNA, 25 bp, Mus musculus
gtgacttcgtgcagcaagccctgga

SEQ ID NO: 698579 - DNA, 25 bp, Mus musculus
gtgacttcgtgctgcaagccctgga

SEQ ID NO: 698580 - DNA, 25 bp, Mus musculus
gtgacttctaccaaagtcggccgca

SEQ ID NO: 698581 - DNA, 25 bp, Mus musculus
gtgacttctacctaagtcggccgca

SEQ ID NO: 698582 - DNA, 25 bp, Mus musculus
gtgacttctcatcagctaatgccat

SEQ ID NO: 698583 - DNA, 25 bp, Mus musculus
gtgacttctcatgagctaatgccat

SEQ ID NO: 698584 - DNA, 25 bp, Mus musculus
gtgacttctctccaggctgtgtgtt

SEQ ID NO: 698585 - DNA, 25 bp, Mus musculus
gtgacttctctcgaggctgtgtgtt

SEQ ID NO: 698586 - DNA, 25 bp, Mus musculus
gtgacttctgatcattctgtacaac

SEQ ID NO: 698587 - DNA, 25 bp, Mus musculus
gtgacttctgatgattctgtacaac

SEQ ID NO: 698588 - DNA, 25 bp, Mus musculus
gtgacttctgcgaagttcctggtca

SEQ ID NO: 698589 - DNA, 25 bp, Mus musculus
gtgacttctgcgtagttcctggtca

SEQ ID NO: 698590 - DNA, 25 bp, Mus musculus
gtgacttctgtaccaatacctgtat

SEQ ID NO: 698591 - DNA, 25 bp, Mus musculus
gtgacttctgtagcaatacctgtat

SEQ ID NO: 698592 - DNA, 25 bp, Mus musculus
gtgacttctgtgaattcagctccac

SEQ ID NO: 698593 - DNA, 25 bp, Mus musculus
gtgacttctgtgtattcagctccac

SEQ ID NO: 698594 - DNA, 25 bp, Mus musculus
gtgacttcttgactaatattttaac

SEQ ID NO: 698595 - DNA, 25 bp, Mus musculus
gtgacttcttgagtaatattttaac

SEQ ID NO: 698596 - DNA, 25 bp, Mus musculus
gtgacttcttgcatcgtcggaaaga

SEQ ID NO: 698597 - DNA, 25 bp, Mus musculus
gtgacttcttgcttcgtcggaaaga

SEQ ID NO: 698598 - DNA, 25 bp, Mus musculus
gtgacttcttgtccttgttgagata

SEQ ID NO: 698599 - DNA, 25 bp, Mus musculus
gtgacttcttgtgcttgttgagata

SEQ ID NO: 698600 - DNA, 25 bp, Mus musculus
gtgacttgaaaaatctgtcttctat

SEQ ID NO: 698601 - DNA, 25 bp, Mus musculus
gtgacttgaaaattctgtcttctat

SEQ ID NO: 698602 - DNA, 25 bp, Mus musculus
gtgacttgagacataatctctggaa

SEQ ID NO: 698603 - DNA, 25 bp, Mus musculus
gtgacttgagacttaatctctggaa

SEQ ID NO: 698604 - DNA, 25 bp, Mus musculus
gtgacttgagcacagacaaccagga

SEQ ID NO: 698605 - DNA, 25 bp, Mus musculus
gtgacttgagcagagacaaccagga

SEQ ID NO: 698606 - DNA, 25 bp, Mus musculus
gtgacttgatctatggatttcctga

SEQ ID NO: 698607 - DNA, 25 bp, Mus musculus
gtgacttgatctttggatttcctga

SEQ ID NO: 698608 - DNA, 25 bp, Mus musculus
gtgacttgcataagccataggatct

SEQ ID NO: 698609 - DNA, 25 bp, Mus musculus
gtgacttgcatatgccataggatct

SEQ ID NO: 698610 - DNA, 25 bp, Mus musculus
gtgacttgctagatcttctacatgg

SEQ ID NO: 698611 - DNA, 25 bp, Mus musculus
gtgacttgctagttcttctacatgg

SEQ ID NO: 698612 - DNA, 25 bp, Mus musculus
gtgacttgcttgacttcaacttgaa

SEQ ID NO: 698613 - DNA, 25 bp, Mus musculus
gtgacttgcttgtcttcaacttgaa

SEQ ID NO: 698614 - DNA, 25 bp, Mus musculus
gtgacttggagcacagcttgtcttt

SEQ ID NO: 698615 - DNA, 25 bp, Mus musculus
gtgacttggagctcagcttgtcttt

SEQ ID NO: 698616 - DNA, 25 bp, Mus musculus
gtgacttggcatcgctttctgccct

SEQ ID NO: 698617 - DNA, 25 bp, Mus musculus
gtgacttggcatggctttctgccct

SEQ ID NO: 698618 - DNA, 25 bp, Mus musculus
gtgacttggcctattaacatggtaa

SEQ ID NO: 698619 - DNA, 25 bp, Mus musculus
gtgacttggccttttaacatggtaa

SEQ ID NO: 698620 - DNA, 25 bp, Mus musculus
gtgacttggctcacattcacaatga

SEQ ID NO: 698621 - DNA, 25 bp, Mus musculus
gtgacttggctctcattcacaatga

SEQ ID NO: 698622 - DNA, 25 bp, Mus musculus
gtgacttgggcaaatgtttcctctc

SEQ ID NO: 698623 - DNA, 25 bp, Mus musculus
gtgacttgggcatatgtttcctctc

SEQ ID NO: 698624 - DNA, 25 bp, Mus musculus
gtgacttgggccatgctgagttgct

SEQ ID NO: 698625 - DNA, 25 bp, Mus musculus
gtgacttgggccttgctgagttgct

SEQ ID NO: 698626 - DNA, 25 bp, Mus musculus
gtgacttggtaccacaggatttttt

SEQ ID NO: 698627 - DNA, 25 bp, Mus musculus
gtgacttggtacgacaggatttttt

SEQ ID NO: 698628 - DNA, 25 bp, Mus musculus
gtgacttggtgcaacttggtgctag

SEQ ID NO: 698629 - DNA, 25 bp, Mus musculus
gtgacttggtgctacttggtgctag

SEQ ID NO: 698630 - DNA, 25 bp, Mus musculus
gtgacttggttaattccaccatatg

SEQ ID NO: 698631 - DNA, 25 bp, Mus musculus
gtgacttggttatttccaccatatg

SEQ ID NO: 698632 - DNA, 25 bp, Mus musculus
gtgacttgtattatcgggttcagat

SEQ ID NO: 698633 - DNA, 25 bp, Mus musculus
gtgacttgtattttcgggttcagat

SEQ ID NO: 698634 - DNA, 25 bp, Mus musculus
gtgacttgtcacattatagagttgt

SEQ ID NO: 698635 - DNA, 25 bp, Mus musculus
gtgacttgtcactttatagagttgt

SEQ ID NO: 698636 - DNA, 25 bp, Mus musculus
gtgacttgtccaagacttctctagg

SEQ ID NO: 698637 - DNA, 25 bp, Mus musculus
gtgacttgtccatgacttctctagg

SEQ ID NO: 698638 - DNA, 25 bp, Mus musculus
gtgacttgttcacgaccacatttta

SEQ ID NO: 698639 - DNA, 25 bp, Mus musculus
gtgacttgttcaggaccacatttta

SEQ ID NO: 698640 - DNA, 25 bp, Mus musculus
gtgactttacacctagatgctccga

SEQ ID NO: 698641 - DNA, 25 bp, Mus musculus
gtgactttacacgtagatgctccga

SEQ ID NO: 698642 - DNA, 25 bp, Mus musculus
gtgactttaccacctgtgatctagg

SEQ ID NO: 698643 - DNA, 25 bp, Mus musculus
gtgactttaccagctgtgatctagg

SEQ ID NO: 698644 - DNA, 25 bp, Mus musculus
gtgactttactaaccagcttggtaa

SEQ ID NO: 698645 - DNA, 25 bp, Mus musculus
gtgactttactatccagcttggtaa

SEQ ID NO: 698646 - DNA, 25 bp, Mus musculus
gtgactttatagataatctgctgag

SEQ ID NO: 698647 - DNA, 25 bp, Mus musculus
gtgactttatagctcttcttattaa

SEQ ID NO: 698648 - DNA, 25 bp, Mus musculus
gtgactttataggtcttcttattaa

SEQ ID NO: 698649 - DNA, 25 bp, Mus musculus
gtgactttatagttaatctgctgag

SEQ ID NO: 698650 - DNA, 25 bp, Mus musculus
gtgactttcaagactcactgagagc

SEQ ID NO: 698651 - DNA, 25 bp, Mus musculus
gtgactttcaagtctcactgagagc

SEQ ID NO: 698652 - DNA, 25 bp, Mus musculus
gtgactttcaccaagggcagctgtt

SEQ ID NO: 698653 - DNA, 25 bp, Mus musculus
gtgactttcacctagggcagctgtt

SEQ ID NO: 698654 - DNA, 25 bp, Mus musculus
gtgactttcagcacagtagcctgct

SEQ ID NO: 698655 - DNA, 25 bp, Mus musculus
gtgactttcagctcagtagcctgct

SEQ ID NO: 698656 - DNA, 25 bp, Mus musculus
gtgactttcagtacttgggtgttta

SEQ ID NO: 698657 - DNA, 25 bp, Mus musculus
gtgactttcagttcttgggtgttta

SEQ ID NO: 698658 - DNA, 25 bp, Mus musculus
gtgactttcatcagggtgttctttt

SEQ ID NO: 698659 - DNA, 25 bp, Mus musculus
gtgactttcatctgggtgttctttt

SEQ ID NO: 698660 - DNA, 25 bp, Mus musculus
gtgactttccagcttatcccaaaac

SEQ ID NO: 698661 - DNA, 25 bp, Mus musculus
gtgactttccaggttatcccaaaac

SEQ ID NO: 698662 - DNA, 25 bp, Mus musculus
gtgactttccccagagtgtgaatta

SEQ ID NO: 698663 - DNA, 25 bp, Mus musculus
gtgactttccccatcaatgtaaaat

SEQ ID NO: 698664 - DNA, 25 bp, Mus musculus
gtgactttcccctgagtgtgaatta

SEQ ID NO: 698665 - DNA, 25 bp, Mus musculus
gtgactttccccttcaatgtaaaat

SEQ ID NO: 698666 - DNA, 25 bp, Mus musculus
gtgactttccttacagtttgactgt

SEQ ID NO: 698667 - DNA, 25 bp, Mus musculus
gtgactttccttcttatagactagc

SEQ ID NO: 698668 - DNA, 25 bp, Mus musculus
gtgactttccttgttatagactagc

SEQ ID NO: 698669 - DNA, 25 bp, Mus musculus
gtgactttcctttcagtttgactgt

SEQ ID NO: 698670 - DNA, 25 bp, Mus musculus
gtgactttctggacacagtcccttg

SEQ ID NO: 698671 - DNA, 25 bp, Mus musculus
gtgactttctggtcacagtcccttg

SEQ ID NO: 698672 - DNA, 25 bp, Mus musculus
gtgactttgacaagtgctcctgttt

SEQ ID NO: 698673 - DNA, 25 bp, Mus musculus
gtgactttgacatgtgctcctgttt

SEQ ID NO: 698674 - DNA, 25 bp, Mus musculus
gtgactttgcataaaggtattccca

SEQ ID NO: 698675 - DNA, 25 bp, Mus musculus
gtgactttgcattaaggtattccca

SEQ ID NO: 698676 - DNA, 25 bp, Mus musculus
gtgactttgcctccctgatgttcaa

SEQ ID NO: 698677 - DNA, 25 bp, Mus musculus
gtgactttgcctgcctgatgttcaa

SEQ ID NO: 698678 - DNA, 25 bp, Mus musculus
gtgactttgctgatccacctgtcag

SEQ ID NO: 698679 - DNA, 25 bp, Mus musculus
gtgactttgctgttccacctgtcag

SEQ ID NO: 698680 - DNA, 25 bp, Mus musculus
gtgactttggaaaaactatggactt

SEQ ID NO: 698681 - DNA, 25 bp, Mus musculus
gtgactttggaaagtctcggcaaga

SEQ ID NO: 698682 - DNA, 25 bp, Mus musculus
gtgactttggaataactatggactt

SEQ ID NO: 698683 - DNA, 25 bp, Mus musculus
gtgactttggaatgtctcggcaaga

SEQ ID NO: 698684 - DNA, 25 bp, Mus musculus
gtgactttggacaggcattagcttt

SEQ ID NO: 698685 - DNA, 25 bp, Mus musculus
gtgactttggactggcattagcttt

SEQ ID NO: 698686 - DNA, 25 bp, Mus musculus
gtgactttggcaagttcttacaatg

SEQ ID NO: 698687 - DNA, 25 bp, Mus musculus
gtgactttggcatgttcttacaatg

SEQ ID NO: 698688 - DNA, 25 bp, Mus musculus
gtgactttgtttcccgagatactgt

SEQ ID NO: 698689 - DNA, 25 bp, Mus musculus
gtgactttgtttgccgagatactgt

SEQ ID NO: 698690 - DNA, 25 bp, Mus musculus
gtgacttttactacacccgtgcaaa

SEQ ID NO: 698691 - DNA, 25 bp, Mus musculus
gtgacttttactacggaggagcctt

SEQ ID NO: 698692 - DNA, 25 bp, Mus musculus
gtgacttttacttcacccgtgcaaa

SEQ ID NO: 698693 - DNA, 25 bp, Mus musculus
gtgacttttacttcggaggagcctt

SEQ ID NO: 698694 - DNA, 25 bp, Mus musculus
gtgacttttataatctgactccaag

SEQ ID NO: 698695 - DNA, 25 bp, Mus musculus
gtgacttttatattctgactccaag

SEQ ID NO: 698696 - DNA, 25 bp, Mus musculus
gtgacttttatgacgtatgctatgt

SEQ ID NO: 698697 - DNA, 25 bp, Mus musculus
gtgacttttatgcatgtgcatgtga

SEQ ID NO: 698698 - DNA, 25 bp, Mus musculus
gtgacttttatggatgtgcatgtga

SEQ ID NO: 698699 - DNA, 25 bp, Mus musculus
gtgacttttatgtcgtatgctatgt

SEQ ID NO: 698700 - DNA, 25 bp, Mus musculus
gtgacttttcagaaatccactgcta

SEQ ID NO: 698701 - DNA, 25 bp, Mus musculus
gtgacttttcagtaatccactgcta

SEQ ID NO: 698702 - DNA, 25 bp, Mus musculus
gtgacttttcttaaggcgtactcaa

SEQ ID NO: 698703 - DNA, 25 bp, Mus musculus
gtgacttttctttaggcgtactcaa

SEQ ID NO: 698704 - DNA, 25 bp, Mus musculus
gtgacttttgatacgggttggtgca

SEQ ID NO: 698705 - DNA, 25 bp, Mus musculus
gtgacttttgattcgggttggtgca

SEQ ID NO: 698706 - DNA, 25 bp, Mus musculus
gtgacttttgctaccttgttaatac

SEQ ID NO: 698707 - DNA, 25 bp, Mus musculus
gtgacttttgctcggaaattgggct

SEQ ID NO: 698708 - DNA, 25 bp, Mus musculus
gtgacttttgctgggaaattgggct

SEQ ID NO: 698709 - DNA, 25 bp, Mus musculus
gtgacttttgcttccttgttaatac

SEQ ID NO: 698710 - DNA, 25 bp, Mus musculus
gtgacttttgtgaagcatccaatgt

SEQ ID NO: 698711 - DNA, 25 bp, Mus musculus
gtgacttttgtgtagcatccaatgt

SEQ ID NO: 698712 - DNA, 25 bp, Mus musculus
gtgactttttacatgacccatataa

SEQ ID NO: 698713 - DNA, 25 bp, Mus musculus
gtgactttttacttgacccatataa

SEQ ID NO: 698714 - DNA, 25 bp, Mus musculus
gtgactttttagaccagggctcggc

SEQ ID NO: 698715 - DNA, 25 bp, Mus musculus
gtgactttttagtccagggctcggc

SEQ ID NO: 698716 - DNA, 25 bp, Mus musculus
gtgactttttgactattccttttgc

SEQ ID NO: 698717 - DNA, 25 bp, Mus musculus
gtgactttttgagtattccttttgc

SEQ ID NO: 698718 - DNA, 25 bp, Mus musculus
gtgacttttttcagtgacacatttt

SEQ ID NO: 698719 - DNA, 25 bp, Mus musculus
gtgacttttttctgtgacacatttt

SEQ ID NO: 698720 - DNA, 25 bp, Mus musculus
gtgagaaaagagatacatgcgaata

SEQ ID NO: 698721 - DNA, 25 bp, Mus musculus
gtgagaaaagagttacatgcgaata

SEQ ID NO: 698722 - DNA, 25 bp, Mus musculus
gtgagaaaatctacttgtgtgcttt

SEQ ID NO: 698723 - DNA, 25 bp, Mus musculus
gtgagaaaatcttcttgtgtgcttt

SEQ ID NO: 698724 - DNA, 25 bp, Mus musculus
gtgagaaacctaacctttgcctaag

SEQ ID NO: 698725 - DNA, 25 bp, Mus musculus
gtgagaaacctatcctttgcctaag

SEQ ID NO: 698726 - DNA, 25 bp, Mus musculus
gtgagaaactgacctcttggacgaa

SEQ ID NO: 698727 - DNA, 25 bp, Mus musculus
gtgagaaactgagctcttggacgaa

SEQ ID NO: 698728 - DNA, 25 bp, Mus musculus
gtgagaaagataccacctctataaa

SEQ ID NO: 698729 - DNA, 25 bp, Mus musculus
gtgagaaagatagcacctctataaa

SEQ ID NO: 698730 - DNA, 25 bp, Mus musculus
gtgagaaagctcatcctgaagggca

SEQ ID NO: 698731 - DNA, 25 bp, Mus musculus
gtgagaaagctcttcctgaagggca

SEQ ID NO: 698732 - DNA, 25 bp, Mus musculus
gtgagaaaggcactaagaactgtgt

SEQ ID NO: 698733 - DNA, 25 bp, Mus musculus
gtgagaaaggcagtaagaactgtgt

SEQ ID NO: 698734 - DNA, 25 bp, Mus musculus
gtgagaaagtatcccgttgagtaag

SEQ ID NO: 698735 - DNA, 25 bp, Mus musculus
gtgagaaagtatgccgttgagtaag

SEQ ID NO: 698736 - DNA, 25 bp, Mus musculus
gtgagaaatcctccattaacttgta

SEQ ID NO: 698737 - DNA, 25 bp, Mus musculus
gtgagaaatcctgcattaacttgta

SEQ ID NO: 698738 - DNA, 25 bp, Mus musculus
gtgagaaatcttcagaactctacag

SEQ ID NO: 698739 - DNA, 25 bp, Mus musculus
gtgagaaatcttgagaactctacag

SEQ ID NO: 698740 - DNA, 25 bp, Mus musculus
gtgagaaatgtgaccttgtgcccgt

SEQ ID NO: 698741 - DNA, 25 bp, Mus musculus
gtgagaaatgtgtccttgtgcccgt

SEQ ID NO: 698742 - DNA, 25 bp, Mus musculus
gtgagaacacaccactgtaccccat

SEQ ID NO: 698743 - DNA, 25 bp, Mus musculus
gtgagaacacacgactgtaccccat

SEQ ID NO: 698744 - DNA, 25 bp, Mus musculus
gtgagaacacatataagcatttcaa

SEQ ID NO: 698745 - DNA, 25 bp, Mus musculus
gtgagaacacatttaagcatttcaa

SEQ ID NO: 698746 - DNA, 25 bp, Mus musculus
gtgagaacacttcagaagcaccgtg

SEQ ID NO: 698747 - DNA, 25 bp, Mus musculus
gtgagaacacttgagaagcaccgtg

SEQ ID NO: 698748 - DNA, 25 bp, Mus musculus
gtgagaacattgcaggaacctggaa

SEQ ID NO: 698749 - DNA, 25 bp, Mus musculus
gtgagaacattggaggaacctggaa

SEQ ID NO: 698750 - DNA, 25 bp, Mus musculus
gtgagaaccacaatgagagacagac

SEQ ID NO: 698751 - DNA, 25 bp, Mus musculus
gtgagaaccacattgagagacagac

SEQ ID NO: 698752 - DNA, 25 bp, Mus musculus
gtgagaaccagccaatgcttcctat

SEQ ID NO: 698753 - DNA, 25 bp, Mus musculus
gtgagaaccagcgaatgcttcctat

SEQ ID NO: 698754 - DNA, 25 bp, Mus musculus
gtgagaaccccaccatgataccaat

SEQ ID NO: 698755 - DNA, 25 bp, Mus musculus
gtgagaaccccagcatgataccaat

SEQ ID NO: 698756 - DNA, 25 bp, Mus musculus
gtgagaacctgcagccatcatggag

SEQ ID NO: 698757 - DNA, 25 bp, Mus musculus
gtgagaacctgctgccatcatggag

SEQ ID NO: 698758 - DNA, 25 bp, Mus musculus
gtgagaacgcatctctccgagagaa

SEQ ID NO: 698759 - DNA, 25 bp, Mus musculus
gtgagaacgcatgtctccgagagaa

SEQ ID NO: 698760 - DNA, 25 bp, Mus musculus
gtgagaactatactgttttactgaa

SEQ ID NO: 698761 - DNA, 25 bp, Mus musculus
gtgagaactatagtgttttactgaa

SEQ ID NO: 698762 - DNA, 25 bp, Mus musculus
gtgagaactctcaggcccctgaggt

SEQ ID NO: 698763 - DNA, 25 bp, Mus musculus
gtgagaactctctggcccctgaggt

SEQ ID NO: 698764 - DNA, 25 bp, Mus musculus
gtgagaactctgattttagcacccc

SEQ ID NO: 698765 - DNA, 25 bp, Mus musculus
gtgagaactctgtttttagcacccc

SEQ ID NO: 698766 - DNA, 25 bp, Mus musculus
gtgagaactgtgaactaacctaata

SEQ ID NO: 698767 - DNA, 25 bp, Mus musculus
gtgagaactgtgtactaacctaata

SEQ ID NO: 698768 - DNA, 25 bp, Mus musculus
gtgagaagacatctctttctgctca

SEQ ID NO: 698769 - DNA, 25 bp, Mus musculus
gtgagaagacatgtctttctgctca

SEQ ID NO: 698770 - DNA, 25 bp, Mus musculus
gtgagaagatcaaccatctcttgga

SEQ ID NO: 698771 - DNA, 25 bp, Mus musculus
gtgagaagatcatccatctcttgga

SEQ ID NO: 698772 - DNA, 25 bp, Mus musculus
gtgagaagatgtccgtccttcacaa

SEQ ID NO: 698773 - DNA, 25 bp, Mus musculus
gtgagaagatgtgcgtccttcacaa

SEQ ID NO: 698774 - DNA, 25 bp, Mus musculus
gtgagaagcccaaccctttaagaca

SEQ ID NO: 698775 - DNA, 25 bp, Mus musculus
gtgagaagcccatccctttaagaca

SEQ ID NO: 698776 - DNA, 25 bp, Mus musculus
gtgagaagccctatacctgttctca

SEQ ID NO: 698777 - DNA, 25 bp, Mus musculus
gtgagaagccctttacctgttctca

SEQ ID NO: 698778 - DNA, 25 bp, Mus musculus
gtgagaagctcgaatttccagaaag

SEQ ID NO: 698779 - DNA, 25 bp, Mus musculus
gtgagaagctcgtatttccagaaag

SEQ ID NO: 698780 - DNA, 25 bp, Mus musculus
gtgagaagctgaatgccctccagct

SEQ ID NO: 698781 - DNA, 25 bp, Mus musculus
gtgagaagctgattgccctccagct

SEQ ID NO: 698782 - DNA, 25 bp, Mus musculus
gtgagaagctgccatgccttccggt

SEQ ID NO: 698783 - DNA, 25 bp, Mus musculus
gtgagaagctgcgatgccttccggt

SEQ ID NO: 698784 - DNA, 25 bp, Mus musculus
gtgagaaggactaccacagcctctt

SEQ ID NO: 698785 - DNA, 25 bp, Mus musculus
gtgagaaggacttccacagcctctt

SEQ ID NO: 698786 - DNA, 25 bp, Mus musculus
gtgagaaggcctacccgggcaacat

SEQ ID NO: 698787 - DNA, 25 bp, Mus musculus
gtgagaaggccttcccgggcaacat

SEQ ID NO: 698788 - DNA, 25 bp, Mus musculus
gtgagaagggcaacatccccggcag

SEQ ID NO: 698789 - DNA, 25 bp, Mus musculus
gtgagaagggcatcatccccggcag

SEQ ID NO: 698790 - DNA, 25 bp, Mus musculus
gtgagaagtcaaaaccctgccataa

SEQ ID NO: 698791 - DNA, 25 bp, Mus musculus
gtgagaagtcaataccctgccataa

SEQ ID NO: 698792 - DNA, 25 bp, Mus musculus
gtgagaagtccaacggcactgccaa

SEQ ID NO: 698793 - DNA, 25 bp, Mus musculus
gtgagaagtccatcggcactgccaa

SEQ ID NO: 698794 - DNA, 25 bp, Mus musculus
gtgagaagtccgaaggccttcctgt

SEQ ID NO: 698795 - DNA, 25 bp, Mus musculus
gtgagaagtccgtaggccttcctgt

SEQ ID NO: 698796 - DNA, 25 bp, Mus musculus
gtgagaagtgcccatgttgtgttat

SEQ ID NO: 698797 - DNA, 25 bp, Mus musculus
gtgagaagtgccgatgttgtgttat

SEQ ID NO: 698798 - DNA, 25 bp, Mus musculus
gtgagaataaccaaccactcgctgg

SEQ ID NO: 698799 - DNA, 25 bp, Mus musculus
gtgagaataacctaccactcgctgg

SEQ ID NO: 698800 - DNA, 25 bp, Mus musculus
gtgagaatcagcctgggaccactta

SEQ ID NO: 698801 - DNA, 25 bp, Mus musculus
gtgagaatcagcgtgggaccactta

SEQ ID NO: 698802 - DNA, 25 bp, Mus musculus
gtgagaatcatgacaatccccaacc

SEQ ID NO: 698803 - DNA, 25 bp, Mus musculus
gtgagaatcatgtcaatccccaacc

SEQ ID NO: 698804 - DNA, 25 bp, Mus musculus
gtgagaatcctgagggttcccagca

SEQ ID NO: 698805 - DNA, 25 bp, Mus musculus
gtgagaatcctgtgggttcccagca

SEQ ID NO: 698806 - DNA, 25 bp, Mus musculus
gtgagaatgttcagggccgttgctc

SEQ ID NO: 698807 - DNA, 25 bp, Mus musculus
gtgagaatgttctgggccgttgctc

SEQ ID NO: 698808 - DNA, 25 bp, Mus musculus
gtgagaatgtttccctgcatgaatt

SEQ ID NO: 698809 - DNA, 25 bp, Mus musculus
gtgagaatgtttgcctgcatgaatt

SEQ ID NO: 698810 - DNA, 25 bp, Mus musculus
gtgagaattagtctttagtaagtaa

SEQ ID NO: 698811 - DNA, 25 bp, Mus musculus
gtgagaattagtgtttagtaagtaa

SEQ ID NO: 698812 - DNA, 25 bp, Mus musculus
gtgagaattttaccagacttcaaga

SEQ ID NO: 698813 - DNA, 25 bp, Mus musculus
gtgagaattttagcagacttcaaga

SEQ ID NO: 698814 - DNA, 25 bp, Mus musculus
gtgagacaaactaaaatttccatcc

SEQ ID NO: 698815 - DNA, 25 bp, Mus musculus
gtgagacaaacttaaatttccatcc

SEQ ID NO: 698816 - DNA, 25 bp, Mus musculus
gtgagacaacggaggagctcctctt

SEQ ID NO: 698817 - DNA, 25 bp, Mus musculus
gtgagacaacggtggagctcctctt

SEQ ID NO: 698818 - DNA, 25 bp, Mus musculus
gtgagacaagccatccacgtgggaa

SEQ ID NO: 698819 - DNA, 25 bp, Mus musculus
gtgagacaagccttccacgtgggaa

SEQ ID NO: 698820 - DNA, 25 bp, Mus musculus
gtgagacaatatcatcctgctcatc

SEQ ID NO: 698821 - DNA, 25 bp, Mus musculus
gtgagacaatatgatcctgctcatc

SEQ ID NO: 698822 - DNA, 25 bp, Mus musculus
gtgagacacccaaggctacggcatt

SEQ ID NO: 698823 - DNA, 25 bp, Mus musculus
gtgagacacccatggctacggcatt

SEQ ID NO: 698824 - DNA, 25 bp, Mus musculus
gtgagacacctcaacagatttcttt

SEQ ID NO: 698825 - DNA, 25 bp, Mus musculus
gtgagacacctctacagatttcttt

SEQ ID NO: 698826 - DNA, 25 bp, Mus musculus
gtgagacagacgatccgactttttt

SEQ ID NO: 698827 - DNA, 25 bp, Mus musculus
gtgagacagacgttccgactttttt

SEQ ID NO: 698828 - DNA, 25 bp, Mus musculus
gtgagacagaggactgcctgcctgc

SEQ ID NO: 698829 - DNA, 25 bp, Mus musculus
gtgagacagaggtctgcctgcctgc

SEQ ID NO: 698830 - DNA, 25 bp, Mus musculus
gtgagacagattacgttttcctgat

SEQ ID NO: 698831 - DNA, 25 bp, Mus musculus
gtgagacagatttcgttttcctgat

SEQ ID NO: 698832 - DNA, 25 bp, Mus musculus
gtgagacagcatatccacagtaatg

SEQ ID NO: 698833 - DNA, 25 bp, Mus musculus
gtgagacagcatttccacagtaatg

SEQ ID NO: 698834 - DNA, 25 bp, Mus musculus
gtgagacatcacctatttttgattt

SEQ ID NO: 698835 - DNA, 25 bp, Mus musculus
gtgagacatcacgtatttttgattt

SEQ ID NO: 698836 - DNA, 25 bp, Mus musculus
gtgagacatcggaggcccaaacctt

SEQ ID NO: 698837 - DNA, 25 bp, Mus musculus
gtgagacatcggtggcccaaacctt

SEQ ID NO: 698838 - DNA, 25 bp, Mus musculus
gtgagacatctcaactgtccttgaa

SEQ ID NO: 698839 - DNA, 25 bp, Mus musculus
gtgagacatctctactgtccttgaa

SEQ ID NO: 698840 - DNA, 25 bp, Mus musculus
gtgagacatgaactatccactgtgc

SEQ ID NO: 698841 - DNA, 25 bp, Mus musculus
gtgagacatgaagtatccactgtgc

SEQ ID NO: 698842 - DNA, 25 bp, Mus musculus
gtgagacattagattgaggcagtac

SEQ ID NO: 698843 - DNA, 25 bp, Mus musculus
gtgagacattagtttgaggcagtac

SEQ ID NO: 698844 - DNA, 25 bp, Mus musculus
gtgagaccaaaactagggctgtttc

SEQ ID NO: 698845 - DNA, 25 bp, Mus musculus
gtgagaccaaaagtagggctgtttc

SEQ ID NO: 698846 - DNA, 25 bp, Mus musculus
gtgagaccaaataattactaggcct

SEQ ID NO: 698847 - DNA, 25 bp, Mus musculus
gtgagaccaaattattactaggcct

SEQ ID NO: 698848 - DNA, 25 bp, Mus musculus
gtgagaccacagctactcatccctt

SEQ ID NO: 698849 - DNA, 25 bp, Mus musculus
gtgagaccacaggtactcatccctt

SEQ ID NO: 698850 - DNA, 25 bp, Mus musculus
gtgagaccactgcatattgtgaact

SEQ ID NO: 698851 - DNA, 25 bp, Mus musculus
gtgagaccactggatattgtgaact

SEQ ID NO: 698852 - DNA, 25 bp, Mus musculus
gtgagacccaccagacaggaacggt

SEQ ID NO: 698853 - DNA, 25 bp, Mus musculus
gtgagacccaccattagacaccaag

SEQ ID NO: 698854 - DNA, 25 bp, Mus musculus
gtgagacccacctgacaggaacggt

SEQ ID NO: 698855 - DNA, 25 bp, Mus musculus
gtgagacccacctttagacaccaag

SEQ ID NO: 698856 - DNA, 25 bp, Mus musculus
gtgagacccagccaaagcgtgagaa

SEQ ID NO: 698857 - DNA, 25 bp, Mus musculus
gtgagacccagcgaaagcgtgagaa

SEQ ID NO: 698858 - DNA, 25 bp, Mus musculus
gtgagacccaggaatcaaactcagg

SEQ ID NO: 698859 - DNA, 25 bp, Mus musculus
gtgagacccaggtatcaaactcagg

SEQ ID NO: 698860 - DNA, 25 bp, Mus musculus
gtgagacccgttaaatatccaagaa

SEQ ID NO: 698861 - DNA, 25 bp, Mus musculus
gtgagacccgtttaatatccaagaa

SEQ ID NO: 698862 - DNA, 25 bp, Mus musculus
gtgagaccctatctcgaatgaatga

SEQ ID NO: 698863 - DNA, 25 bp, Mus musculus
gtgagaccctatgtcgaatgaatga

SEQ ID NO: 698864 - DNA, 25 bp, Mus musculus
gtgagaccctcgctactggacgcct

SEQ ID NO: 698865 - DNA, 25 bp, Mus musculus
gtgagaccctcggtactggacgcct

SEQ ID NO: 698866 - DNA, 25 bp, Mus musculus
gtgagaccctggatcaaaacggcga

SEQ ID NO: 698867 - DNA, 25 bp, Mus musculus
gtgagaccctggttcaaaacggcga

SEQ ID NO: 698868 - DNA, 25 bp, Mus musculus
gtgagaccctgtcgcaaattacatt

SEQ ID NO: 698869 - DNA, 25 bp, Mus musculus
gtgagaccctgtggcaaattacatt

SEQ ID NO: 698870 - DNA, 25 bp, Mus musculus
gtgagaccgaccatgatgtagagac

SEQ ID NO: 698871 - DNA, 25 bp, Mus musculus
gtgagaccgaccttgatgtagagac

SEQ ID NO: 698872 - DNA, 25 bp, Mus musculus
gtgagacctagacagaagcttccct

SEQ ID NO: 698873 - DNA, 25 bp, Mus musculus
gtgagacctagagagaagcttccct

SEQ ID NO: 698874 - DNA, 25 bp, Mus musculus
gtgagacctaggctccagccactct

SEQ ID NO: 698875 - DNA, 25 bp, Mus musculus
gtgagacctagggtccagccactct

SEQ ID NO: 698876 - DNA, 25 bp, Mus musculus
gtgagacctcatctttagcccggcg

SEQ ID NO: 698877 - DNA, 25 bp, Mus musculus
gtgagacctcatgtttagcccggcg

SEQ ID NO: 698878 - DNA, 25 bp, Mus musculus
gtgagacctctcagggttacaagat

SEQ ID NO: 698879 - DNA, 25 bp, Mus musculus
gtgagacctctctgggttacaagat

SEQ ID NO: 698880 - DNA, 25 bp, Mus musculus
gtgagacctcttcgacatgttgtca

SEQ ID NO: 698881 - DNA, 25 bp, Mus musculus
gtgagacctcttggacatgttgtca

SEQ ID NO: 698882 - DNA, 25 bp, Mus musculus
gtgagacctgtgcacatacactaag

SEQ ID NO: 698883 - DNA, 25 bp, Mus musculus
gtgagacctgtgcactgcagcattt

SEQ ID NO: 698884 - DNA, 25 bp, Mus musculus
gtgagacctgtggacatacactaag

SEQ ID NO: 698885 - DNA, 25 bp, Mus musculus
gtgagacctgtggactgcagcattt

SEQ ID NO: 698886 - DNA, 25 bp, Mus musculus
gtgagacgctcacggcgcattcaag

SEQ ID NO: 698887 - DNA, 25 bp, Mus musculus
gtgagacgctcagggcgcattcaag

SEQ ID NO: 698888 - DNA, 25 bp, Mus musculus
gtgagacgctccactgagctctgag

SEQ ID NO: 698889 - DNA, 25 bp, Mus musculus
gtgagacgctcctctgagctctgag

SEQ ID NO: 698890 - DNA, 25 bp, Mus musculus
gtgagacggcgcatcccttatggaa

SEQ ID NO: 698891 - DNA, 25 bp, Mus musculus
gtgagacggcgcttcccttatggaa

SEQ ID NO: 698892 - DNA, 25 bp, Mus musculus
gtgagacgttccatgtctgaaaaca

SEQ ID NO: 698893 - DNA, 25 bp, Mus musculus
gtgagacgttccttgtctgaaaaca

SEQ ID NO: 698894 - DNA, 25 bp, Mus musculus
gtgagactaaacagccccaggaaca

SEQ ID NO: 698895 - DNA, 25 bp, Mus musculus
gtgagactaaactgccccaggaaca

SEQ ID NO: 698896 - DNA, 25 bp, Mus musculus
gtgagactactgaatccacaccatc

SEQ ID NO: 698897 - DNA, 25 bp, Mus musculus
gtgagactactgtatccacaccatc

SEQ ID NO: 698898 - DNA, 25 bp, Mus musculus
gtgagactagtgctttcctggattg

SEQ ID NO: 698899 - DNA, 25 bp, Mus musculus
gtgagactagtggtttcctggattg

SEQ ID NO: 698900 - DNA, 25 bp, Mus musculus
gtgagactcagtatacccatttgtt

SEQ ID NO: 698901 - DNA, 25 bp, Mus musculus
gtgagactcagtatatacacttatt

SEQ ID NO: 698902 - DNA, 25 bp, Mus musculus
gtgagactcagtttacccatttgtt

SEQ ID NO: 698903 - DNA, 25 bp, Mus musculus
gtgagactcagtttatacacttatt

SEQ ID NO: 698904 - DNA, 25 bp, Mus musculus
gtgagactcccgagcagatcgcaaa

SEQ ID NO: 698905 - DNA, 25 bp, Mus musculus
gtgagactcccgtgcagatcgcaaa

SEQ ID NO: 698906 - DNA, 25 bp, Mus musculus
gtgagactcggtagttagcctatgt

SEQ ID NO: 698907 - DNA, 25 bp, Mus musculus
gtgagactcggttgttagcctatgt

SEQ ID NO: 698908 - DNA, 25 bp, Mus musculus
gtgagactctgcctttaaatatagt

SEQ ID NO: 698909 - DNA, 25 bp, Mus musculus
gtgagactctgcgtttaaatatagt

SEQ ID NO: 698910 - DNA, 25 bp, Mus musculus
gtgagactcttaccacaaacagtaa

SEQ ID NO: 698911 - DNA, 25 bp, Mus musculus
gtgagactcttagcacaaacagtaa

SEQ ID NO: 698912 - DNA, 25 bp, Mus musculus
gtgagactgaacatttcatgagctc

SEQ ID NO: 698913 - DNA, 25 bp, Mus musculus
gtgagactgaacttttcatgagctc

SEQ ID NO: 698914 - DNA, 25 bp, Mus musculus
gtgagactgagacctatcaaccttc

SEQ ID NO: 698915 - DNA, 25 bp, Mus musculus
gtgagactgagagctatcaaccttc

SEQ ID NO: 698916 - DNA, 25 bp, Mus musculus
gtgagactgcaaatccgagatatac

SEQ ID NO: 698917 - DNA, 25 bp, Mus musculus
gtgagactgcaattccgagatatac

SEQ ID NO: 698918 - DNA, 25 bp, Mus musculus
gtgagactgctgcaatggctcgtca

SEQ ID NO: 698919 - DNA, 25 bp, Mus musculus
gtgagactgctgctgaactggataa

SEQ ID NO: 698920 - DNA, 25 bp, Mus musculus
gtgagactgctggaatggctcgtca

SEQ ID NO: 698921 - DNA, 25 bp, Mus musculus
gtgagactgctggtgaactggataa

SEQ ID NO: 698922 - DNA, 25 bp, Mus musculus
gtgagactggtaccttggtggacat

SEQ ID NO: 698923 - DNA, 25 bp, Mus musculus
gtgagactggtagcttggtggacat

SEQ ID NO: 698924 - DNA, 25 bp, Mus musculus
gtgagactgtacagcccatatatct

SEQ ID NO: 698925 - DNA, 25 bp, Mus musculus
gtgagactgtactgcccatatatct

SEQ ID NO: 698926 - DNA, 25 bp, Mus musculus
gtgagactgtcaacgggaacaaatt

SEQ ID NO: 698927 - DNA, 25 bp, Mus musculus
gtgagactgtcatcgggaacaaatt

SEQ ID NO: 698928 - DNA, 25 bp, Mus musculus
gtgagactgtctcccaatgtcacag

SEQ ID NO: 698929 - DNA, 25 bp, Mus musculus
gtgagactgtctgccaatgtcacag

SEQ ID NO: 698930 - DNA, 25 bp, Mus musculus
gtgagactgtgactactctgaccag

SEQ ID NO: 698931 - DNA, 25 bp, Mus musculus
gtgagactgtgagtactctgaccag

SEQ ID NO: 698932 - DNA, 25 bp, Mus musculus
gtgagactgtgcacttcactgacta

SEQ ID NO: 698933 - DNA, 25 bp, Mus musculus
gtgagactgtgctcttcactgacta

SEQ ID NO: 698934 - DNA, 25 bp, Mus musculus
gtgagactgtttatcaagaagcccc

SEQ ID NO: 698935 - DNA, 25 bp, Mus musculus
gtgagactgtttttcaagaagcccc

SEQ ID NO: 698936 - DNA, 25 bp, Mus musculus
gtgagacttaaaacatggtgcctat

SEQ ID NO: 698937 - DNA, 25 bp, Mus musculus
gtgagacttaaatcatggtgcctat

SEQ ID NO: 698938 - DNA, 25 bp, Mus musculus
gtgagacttaatcccagtctctgct

SEQ ID NO: 698939 - DNA, 25 bp, Mus musculus
gtgagacttaatgccagtctctgct

SEQ ID NO: 698940 - DNA, 25 bp, Mus musculus
gtgagacttctcagtggttgttaag

SEQ ID NO: 698941 - DNA, 25 bp, Mus musculus
gtgagacttctctgtggttgttaag

SEQ ID NO: 698942 - DNA, 25 bp, Mus musculus
gtgagagacaagatgtccatccatg

SEQ ID NO: 698943 - DNA, 25 bp, Mus musculus
gtgagagacaagttgtccatccatg

SEQ ID NO: 698944 - DNA, 25 bp, Mus musculus
gtgagagacacaaaagcatactcag

SEQ ID NO: 698945 - DNA, 25 bp, Mus musculus
gtgagagacacataagcatactcag

SEQ ID NO: 698946 - DNA, 25 bp, Mus musculus
gtgagagaccatatgtgtgcatcaa

SEQ ID NO: 698947 - DNA, 25 bp, Mus musculus
gtgagagaccatttgtgtgcatcaa

SEQ ID NO: 698948 - DNA, 25 bp, Mus musculus
gtgagagaccttcagacctagtgag

SEQ ID NO: 698949 - DNA, 25 bp, Mus musculus
gtgagagaccttgagacctagtgag

SEQ ID NO: 698950 - DNA, 25 bp, Mus musculus
gtgagagagctcctggcatctaaga

SEQ ID NO: 698951 - DNA, 25 bp, Mus musculus
gtgagagagctcgtggcatctaaga

SEQ ID NO: 698952 - DNA, 25 bp, Mus musculus
gtgagagagtaacgacaggcaaaca

SEQ ID NO: 698953 - DNA, 25 bp, Mus musculus
gtgagagagtaaggacaggcaaaca

SEQ ID NO: 698954 - DNA, 25 bp, Mus musculus
gtgagagatgcccagaatccctcgt

SEQ ID NO: 698955 - DNA, 25 bp, Mus musculus
gtgagagatgccgagaatccctcgt

SEQ ID NO: 698956 - DNA, 25 bp, Mus musculus
gtgagagatgctctacttggaatta

SEQ ID NO: 698957 - DNA, 25 bp, Mus musculus
gtgagagatgctgtacttggaatta

SEQ ID NO: 698958 - DNA, 25 bp, Mus musculus
gtgagagatgtgcaccccagtactc

SEQ ID NO: 698959 - DNA, 25 bp, Mus musculus
gtgagagatgtggaccccagtactc

SEQ ID NO: 698960 - DNA, 25 bp, Mus musculus
gtgagagattttaccagctactgtt

SEQ ID NO: 698961 - DNA, 25 bp, Mus musculus
gtgagagatttttccagctactgtt

SEQ ID NO: 698962 - DNA, 25 bp, Mus musculus
gtgagagcaaacctgagatgagccc

SEQ ID NO: 698963 - DNA, 25 bp, Mus musculus
gtgagagcaaacgtgagatgagccc

SEQ ID NO: 698964 - DNA, 25 bp, Mus musculus
gtgagagcaccaccatgtccggcag

SEQ ID NO: 698965 - DNA, 25 bp, Mus musculus
gtgagagcaccagcatgtccggcag

SEQ ID NO: 698966 - DNA, 25 bp, Mus musculus
gtgagagcactgctgttcgtacact

SEQ ID NO: 698967 - DNA, 25 bp, Mus musculus
gtgagagcactggtgttcgtacact

SEQ ID NO: 698968 - DNA, 25 bp, Mus musculus
gtgagagcaggtccaccataatgct

SEQ ID NO: 698969 - DNA, 25 bp, Mus musculus
gtgagagcaggtgcaccataatgct

SEQ ID NO: 698970 - DNA, 25 bp, Mus musculus
gtgagagcatccatagacagcatgt

SEQ ID NO: 698971 - DNA, 25 bp, Mus musculus
gtgagagcatccttagacagcatgt

SEQ ID NO: 698972 - DNA, 25 bp, Mus musculus
gtgagagcctctatgagatctgaaa

SEQ ID NO: 698973 - DNA, 25 bp, Mus musculus
gtgagagcctctttgagatctgaaa

SEQ ID NO: 698974 - DNA, 25 bp, Mus musculus
gtgagagcctgactttgcatcttca

SEQ ID NO: 698975 - DNA, 25 bp, Mus musculus
gtgagagcctgagtttgcatcttca

SEQ ID NO: 698976 - DNA, 25 bp, Mus musculus
gtgagagcgttgagctttatcagct

SEQ ID NO: 698977 - DNA, 25 bp, Mus musculus
gtgagagcgttgtgctttatcagct

SEQ ID NO: 698978 - DNA, 25 bp, Mus musculus
gtgagagctatgctcttctaccgcc

SEQ ID NO: 698979 - DNA, 25 bp, Mus musculus
gtgagagctatggtcttctaccgcc

SEQ ID NO: 698980 - DNA, 25 bp, Mus musculus
gtgagagctgaactagtgtccccat

SEQ ID NO: 698981 - DNA, 25 bp, Mus musculus
gtgagagctgaagtagtgtccccat

SEQ ID NO: 698982 - DNA, 25 bp, Mus musculus
gtgagagctgccagtcgactctgtg

SEQ ID NO: 698983 - DNA, 25 bp, Mus musculus
gtgagagctgcctgtcgactctgtg

SEQ ID NO: 698984 - DNA, 25 bp, Mus musculus
gtgagagcttgcagatcccttcgtc

SEQ ID NO: 698985 - DNA, 25 bp, Mus musculus
gtgagagcttgctgatcccttcgtc

SEQ ID NO: 698986 - DNA, 25 bp, Mus musculus
gtgagaggatcaagctttctccccg

SEQ ID NO: 698987 - DNA, 25 bp, Mus musculus
gtgagaggatcatgctttctccccg

SEQ ID NO: 698988 - DNA, 25 bp, Mus musculus
gtgagaggcacaactatctaattgt

SEQ ID NO: 698989 - DNA, 25 bp, Mus musculus
gtgagaggcacatctatctaattgt

SEQ ID NO: 698990 - DNA, 25 bp, Mus musculus
gtgagaggcaccatccgtgcaatag

SEQ ID NO: 698991 - DNA, 25 bp, Mus musculus
gtgagaggcacccagttataaggaa

SEQ ID NO: 698992 - DNA, 25 bp, Mus musculus
gtgagaggcaccgagttataaggaa

SEQ ID NO: 698993 - DNA, 25 bp, Mus musculus
gtgagaggcaccttccgtgcaatag

SEQ ID NO: 698994 - DNA, 25 bp, Mus musculus
gtgagaggcaggcaaccatttcaat

SEQ ID NO: 698995 - DNA, 25 bp, Mus musculus
gtgagaggcagggaaccatttcaat

SEQ ID NO: 698996 - DNA, 25 bp, Mus musculus
gtgagaggcatcatggctccatgct

SEQ ID NO: 698997 - DNA, 25 bp, Mus musculus
gtgagaggcatcttggctccatgct

SEQ ID NO: 698998 - DNA, 25 bp, Mus musculus
gtgagaggccacagcctgctccgtg

SEQ ID NO: 698999 - DNA, 25 bp, Mus musculus
gtgagaggccactgcctgctccgtg

SEQ ID NO: 699000 - DNA, 25 bp, Mus musculus
gtgagaggccttacgcctgcagctg

SEQ ID NO: 699001 - DNA, 25 bp, Mus musculus
gtgagaggcctttcgcctgcagctg

SEQ ID NO: 699002 - DNA, 25 bp, Mus musculus
gtgagaggcgttacgccaacagcag

SEQ ID NO: 699003 - DNA, 25 bp, Mus musculus
gtgagaggcgtttcgccaacagcag

SEQ ID NO: 699004 - DNA, 25 bp, Mus musculus
gtgagaggctgtatttcatcgccct

SEQ ID NO: 699005 - DNA, 25 bp, Mus musculus
gtgagaggctgtttttcatcgccct

SEQ ID NO: 699006 - DNA, 25 bp, Mus musculus
gtgagagggagcctactttctctgt

SEQ ID NO: 699007 - DNA, 25 bp, Mus musculus
gtgagagggagcgtactttctctgt

SEQ ID NO: 699008 - DNA, 25 bp, Mus musculus
gtgagaggtgacaacaaactcccta

SEQ ID NO: 699009 - DNA, 25 bp, Mus musculus
gtgagaggtgactacaaactcccta

SEQ ID NO: 699010 - DNA, 25 bp, Mus musculus
gtgagagtatccactacgcgctcat

SEQ ID NO: 699011 - DNA, 25 bp, Mus musculus
gtgagagtatcctctacgcgctcat

SEQ ID NO: 699012 - DNA, 25 bp, Mus musculus
gtgagagtctaactatcctgccctg

SEQ ID NO: 699013 - DNA, 25 bp, Mus musculus
gtgagagtctaagtatcctgccctg

SEQ ID NO: 699014 - DNA, 25 bp, Mus musculus
gtgagagtctctccttgatatccaa

SEQ ID NO: 699015 - DNA, 25 bp, Mus musculus
gtgagagtctctgcttgatatccaa

SEQ ID NO: 699016 - DNA, 25 bp, Mus musculus
gtgagagtcttcctgttaacctaat

SEQ ID NO: 699017 - DNA, 25 bp, Mus musculus
gtgagagtcttcgtgttaacctaat

SEQ ID NO: 699018 - DNA, 25 bp, Mus musculus
gtgagagtgatccaggactgcttct

SEQ ID NO: 699019 - DNA, 25 bp, Mus musculus
gtgagagtgatcgaggactgcttct

SEQ ID NO: 699020 - DNA, 25 bp, Mus musculus
gtgagagtgctcagactcggacctc

SEQ ID NO: 699021 - DNA, 25 bp, Mus musculus
gtgagagtgctctgactcggacctc

SEQ ID NO: 699022 - DNA, 25 bp, Mus musculus
gtgagagtggccagacgattgctaa

SEQ ID NO: 699023 - DNA, 25 bp, Mus musculus
gtgagagtggcctgacgattgctaa

SEQ ID NO: 699024 - DNA, 25 bp, Mus musculus
gtgagagttaccctttactccttca

SEQ ID NO: 699025 - DNA, 25 bp, Mus musculus
gtgagagttaccgtttactccttca

SEQ ID NO: 699026 - DNA, 25 bp, Mus musculus
gtgagagttacgcagccccaagagt

SEQ ID NO: 699027 - DNA, 25 bp, Mus musculus
gtgagagttacggagccccaagagt

SEQ ID NO: 699028 - DNA, 25 bp, Mus musculus
gtgagagttcagaccacagctgtct

SEQ ID NO: 699029 - DNA, 25 bp, Mus musculus
gtgagagttcagtccacagctgtct

SEQ ID NO: 699030 - DNA, 25 bp, Mus musculus
gtgagagttcctcccgctttctgag

SEQ ID NO: 699031 - DNA, 25 bp, Mus musculus
gtgagagttcctgccgctttctgag

SEQ ID NO: 699032 - DNA, 25 bp, Mus musculus
gtgagagttgtaacagcacatgtcc

SEQ ID NO: 699033 - DNA, 25 bp, Mus musculus
gtgagagttgtatcagcacatgtcc

SEQ ID NO: 699034 - DNA, 25 bp, Mus musculus
gtgagagttgttaccaatccactgg

SEQ ID NO: 699035 - DNA, 25 bp, Mus musculus
gtgagagttgtttccaatccactgg

SEQ ID NO: 699036 - DNA, 25 bp, Mus musculus
gtgagagtttgtatgctacatagca

SEQ ID NO: 699037 - DNA, 25 bp, Mus musculus
gtgagagtttgtttgctacatagca

SEQ ID NO: 699038 - DNA, 25 bp, Mus musculus
gtgagataactcatcaggacctgct

SEQ ID NO: 699039 - DNA, 25 bp, Mus musculus
gtgagataactcttcaggacctgct

SEQ ID NO: 699040 - DNA, 25 bp, Mus musculus
gtgagataatccagaccctaaaaga

SEQ ID NO: 699041 - DNA, 25 bp, Mus musculus
gtgagataatcctgaccctaaaaga

SEQ ID NO: 699042 - DNA, 25 bp, Mus musculus
gtgagatacaccagattttccttat

SEQ ID NO: 699043 - DNA, 25 bp, Mus musculus
gtgagatacacctgattttccttat

SEQ ID NO: 699044 - DNA, 25 bp, Mus musculus
gtgagatacatactaccgatccttt

SEQ ID NO: 699045 - DNA, 25 bp, Mus musculus
gtgagatacatagtaccgatccttt

SEQ ID NO: 699046 - DNA, 25 bp, Mus musculus
gtgagataccacaccaaggtccggg

SEQ ID NO: 699047 - DNA, 25 bp, Mus musculus
gtgagataccactccaaggtccggg

SEQ ID NO: 699048 - DNA, 25 bp, Mus musculus
gtgagatacctgcaggcaatgcctt

SEQ ID NO: 699049 - DNA, 25 bp, Mus musculus
gtgagatacctggaggcaatgcctt

SEQ ID NO: 699050 - DNA, 25 bp, Mus musculus
gtgagatagaacaccaaccctggac

SEQ ID NO: 699051 - DNA, 25 bp, Mus musculus
gtgagatagaactccaaccctggac

SEQ ID NO: 699052 - DNA, 25 bp, Mus musculus
gtgagatagtatccacttcataact

SEQ ID NO: 699053 - DNA, 25 bp, Mus musculus
gtgagatagtatgcacttcataact

SEQ ID NO: 699054 - DNA, 25 bp, Mus musculus
gtgagatatagaaacattgaccttg

SEQ ID NO: 699055 - DNA, 25 bp, Mus musculus
gtgagatatagatacattgaccttg

SEQ ID NO: 699056 - DNA, 25 bp, Mus musculus
gtgagatatcatatagtttctgccc

SEQ ID NO: 699057 - DNA, 25 bp, Mus musculus
gtgagatatcatttagtttctgccc

SEQ ID NO: 699058 - DNA, 25 bp, Mus musculus
gtgagatatccccttcactgagtgg

SEQ ID NO: 699059 - DNA, 25 bp, Mus musculus
gtgagatatcccgttcactgagtgg

SEQ ID NO: 699060 - DNA, 25 bp, Mus musculus
gtgagatcaacaaccgaccagtctg

SEQ ID NO: 699061 - DNA, 25 bp, Mus musculus
gtgagatcaacatccgaccagtctg

SEQ ID NO: 699062 - DNA, 25 bp, Mus musculus
gtgagatcaagtatgccgtccatgt

SEQ ID NO: 699063 - DNA, 25 bp, Mus musculus
gtgagatcaagtttgccgtccatgt

SEQ ID NO: 699064 - DNA, 25 bp, Mus musculus
gtgagatcacgcagttagctgggtt

SEQ ID NO: 699065 - DNA, 25 bp, Mus musculus
gtgagatcacgctgttagctgggtt

SEQ ID NO: 699066 - DNA, 25 bp, Mus musculus
gtgagatccagaaggactccccaat

SEQ ID NO: 699067 - DNA, 25 bp, Mus musculus
gtgagatccagatggactccccaat

SEQ ID NO: 699068 - DNA, 25 bp, Mus musculus
gtgagatcctgcaaagtagctgata

SEQ ID NO: 699069 - DNA, 25 bp, Mus musculus
gtgagatcctgctaagtagctgata

SEQ ID NO: 699070 - DNA, 25 bp, Mus musculus
gtgagatcgcatcggaaccatcgga

SEQ ID NO: 699071 - DNA, 25 bp, Mus musculus
gtgagatcgcatgggaaccatcgga

SEQ ID NO: 699072 - DNA, 25 bp, Mus musculus
gtgagatctaatactactgtcagtt

SEQ ID NO: 699073 - DNA, 25 bp, Mus musculus
gtgagatctaattctactgtcagtt

SEQ ID NO: 699074 - DNA, 25 bp, Mus musculus
gtgagatctcagagctagcaccaga

SEQ ID NO: 699075 - DNA, 25 bp, Mus musculus
gtgagatctcagtgctagcaccaga

SEQ ID NO: 699076 - DNA, 25 bp, Mus musculus
gtgagatctggaaccatctttgata

SEQ ID NO: 699077 - DNA, 25 bp, Mus musculus
gtgagatctggatccatctttgata

SEQ ID NO: 699078 - DNA, 25 bp, Mus musculus
gtgagatctgtgatttcatttgcat

SEQ ID NO: 699079 - DNA, 25 bp, Mus musculus
gtgagatctgtgttttcatttgcat

SEQ ID NO: 699080 - DNA, 25 bp, Mus musculus
gtgagatgaagcctccggcacgtac

SEQ ID NO: 699081 - DNA, 25 bp, Mus musculus
gtgagatgaagcgtccggcacgtac

SEQ ID NO: 699082 - DNA, 25 bp, Mus musculus
gtgagatgacccctcagctggaact

SEQ ID NO: 699083 - DNA, 25 bp, Mus musculus
gtgagatgacccgtcagctggaact

SEQ ID NO: 699084 - DNA, 25 bp, Mus musculus
gtgagatgacctaatgtttgtactt

SEQ ID NO: 699085 - DNA, 25 bp, Mus musculus
gtgagatgaccttatgtttgtactt

SEQ ID NO: 699086 - DNA, 25 bp, Mus musculus
gtgagatgactgatttgatcctaaa

SEQ ID NO: 699087 - DNA, 25 bp, Mus musculus
gtgagatgactgttttgatcctaaa

SEQ ID NO: 699088 - DNA, 25 bp, Mus musculus
gtgagatgagctcaattgctttcat

SEQ ID NO: 699089 - DNA, 25 bp, Mus musculus
gtgagatgagctgaattgctttcat

SEQ ID NO: 699090 - DNA, 25 bp, Mus musculus
gtgagatgctaacggtgtgcgtgtt

SEQ ID NO: 699091 - DNA, 25 bp, Mus musculus
gtgagatgctaagggtgtgcgtgtt

SEQ ID NO: 699092 - DNA, 25 bp, Mus musculus
gtgagatgctctatgaacatggtat

SEQ ID NO: 699093 - DNA, 25 bp, Mus musculus
gtgagatgctctttgaacatggtat

SEQ ID NO: 699094 - DNA, 25 bp, Mus musculus
gtgagatggaccacccctggaactg

SEQ ID NO: 699095 - DNA, 25 bp, Mus musculus
gtgagatggacctcccctggaactg

SEQ ID NO: 699096 - DNA, 25 bp, Mus musculus
gtgagatggcttcgccggtaagagc

SEQ ID NO: 699097 - DNA, 25 bp, Mus musculus
gtgagatggcttggccggtaagagc

SEQ ID NO: 699098 - DNA, 25 bp, Mus musculus
gtgagatgtccccttttgaaggacc

SEQ ID NO: 699099 - DNA, 25 bp, Mus musculus
gtgagatgtcccgttttgaaggacc

SEQ ID NO: 699100 - DNA, 25 bp, Mus musculus
gtgagatgtctaagtctcccaacct

SEQ ID NO: 699101 - DNA, 25 bp, Mus musculus
gtgagatgtctatgtctcccaacct

SEQ ID NO: 699102 - DNA, 25 bp, Mus musculus
gtgagatgttcccttcaccccggtg

SEQ ID NO: 699103 - DNA, 25 bp, Mus musculus
gtgagatgttccgttcaccccggtg

SEQ ID NO: 699104 - DNA, 25 bp, Mus musculus
gtgagattaactcagtggcatcaat

SEQ ID NO: 699105 - DNA, 25 bp, Mus musculus
gtgagattaactgagtggcatcaat

SEQ ID NO: 699106 - DNA, 25 bp, Mus musculus
gtgagattcaaacctccatcaacta

SEQ ID NO: 699107 - DNA, 25 bp, Mus musculus
gtgagattcaaagctccatcaacta

SEQ ID NO: 699108 - DNA, 25 bp, Mus musculus
gtgagattctaaaacgggtcagaac

SEQ ID NO: 699109 - DNA, 25 bp, Mus musculus
gtgagattctaatacgggtcagaac

SEQ ID NO: 699110 - DNA, 25 bp, Mus musculus
gtgagattgaagaacttggtgtcat

SEQ ID NO: 699111 - DNA, 25 bp, Mus musculus
gtgagattgaagtacttggtgtcat

SEQ ID NO: 699112 - DNA, 25 bp, Mus musculus
gtgagattgttcaagaagctgcttc

SEQ ID NO: 699113 - DNA, 25 bp, Mus musculus
gtgagattgttcatgcttatgtcat

SEQ ID NO: 699114 - DNA, 25 bp, Mus musculus
gtgagattgttctagaagctgcttc

SEQ ID NO: 699115 - DNA, 25 bp, Mus musculus
gtgagattgttcttgcttatgtcat

SEQ ID NO: 699116 - DNA, 25 bp, Mus musculus
gtgagatttagccactccttcctga

SEQ ID NO: 699117 - DNA, 25 bp, Mus musculus
gtgagatttagcgactccttcctga

SEQ ID NO: 699118 - DNA, 25 bp, Mus musculus
gtgagatttcataattcaactgctg

SEQ ID NO: 699119 - DNA, 25 bp, Mus musculus
gtgagatttcattattcaactgctg

SEQ ID NO: 699120 - DNA, 25 bp, Mus musculus
gtgagatttcccctatttatgttgg

SEQ ID NO: 699121 - DNA, 25 bp, Mus musculus
gtgagatttcccgtatttatgttgg

SEQ ID NO: 699122 - DNA, 25 bp, Mus musculus
gtgagatttcgtagctcatcgtctc

SEQ ID NO: 699123 - DNA, 25 bp, Mus musculus
gtgagatttcgttgctcatcgtctc

SEQ ID NO: 699124 - DNA, 25 bp, Mus musculus
gtgagatttggaacacaaccatgtg

SEQ ID NO: 699125 - DNA, 25 bp, Mus musculus
gtgagatttggatcacaaccatgtg

SEQ ID NO: 699126 - DNA, 25 bp, Mus musculus
gtgagcaaaccacccatctaaaggc

SEQ ID NO: 699127 - DNA, 25 bp, Mus musculus
gtgagcaaaccagccatctaaaggc

SEQ ID NO: 699128 - DNA, 25 bp, Mus musculus
gtgagcaaaggcacaacacctctgg

SEQ ID NO: 699129 - DNA, 25 bp, Mus musculus
gtgagcaaaggctcaacacctctgg

SEQ ID NO: 699130 - DNA, 25 bp, Mus musculus
gtgagcaacaacaggctgaccacca

SEQ ID NO: 699131 - DNA, 25 bp, Mus musculus
gtgagcaacaactggctgaccacca

SEQ ID NO: 699132 - DNA, 25 bp, Mus musculus
gtgagcaacacactatgtacctctc

SEQ ID NO: 699133 - DNA, 25 bp, Mus musculus
gtgagcaacacagtatgtacctctc

SEQ ID NO: 699134 - DNA, 25 bp, Mus musculus
gtgagcaacatacacaaattctttg

SEQ ID NO: 699135 - DNA, 25 bp, Mus musculus
gtgagcaacatagacaaattctttg

SEQ ID NO: 699136 - DNA, 25 bp, Mus musculus
gtgagcaaccatagttcataacaag

SEQ ID NO: 699137 - DNA, 25 bp, Mus musculus
gtgagcaaccattgttcataacaag

SEQ ID NO: 699138 - DNA, 25 bp, Mus musculus
gtgagcaaccttcgctacttgcagt

SEQ ID NO: 699139 - DNA, 25 bp, Mus musculus
gtgagcaaccttggctacttgcagt

SEQ ID NO: 699140 - DNA, 25 bp, Mus musculus
gtgagcaagagacccatgttccact

SEQ ID NO: 699141 - DNA, 25 bp, Mus musculus
gtgagcaagagagccatgttccact

SEQ ID NO: 699142 - DNA, 25 bp, Mus musculus
gtgagcaagcgccttcctgacagaa

SEQ ID NO: 699143 - DNA, 25 bp, Mus musculus
gtgagcaagcgcgttcctgacagaa

SEQ ID NO: 699144 - DNA, 25 bp, Mus musculus
gtgagcaagttacctattactgaat

SEQ ID NO: 699145 - DNA, 25 bp, Mus musculus
gtgagcaagttagctattactgaat

SEQ ID NO: 699146 - DNA, 25 bp, Mus musculus
gtgagcaatattacctaccatactt

SEQ ID NO: 699147 - DNA, 25 bp, Mus musculus
gtgagcaatatttcctaccatactt

SEQ ID NO: 699148 - DNA, 25 bp, Mus musculus
gtgagcaatgtcacctcttcaggaa

SEQ ID NO: 699149 - DNA, 25 bp, Mus musculus
gtgagcaatgtctcctcttcaggaa

SEQ ID NO: 699150 - DNA, 25 bp, Mus musculus
gtgagcaatttcaccccaaaaataa

SEQ ID NO: 699151 - DNA, 25 bp, Mus musculus
gtgagcaatttcatgcccgaactaa

SEQ ID NO: 699152 - DNA, 25 bp, Mus musculus
gtgagcaatttctccccaaaaataa

SEQ ID NO: 699153 - DNA, 25 bp, Mus musculus
gtgagcaatttcttgcccgaactaa

SEQ ID NO: 699154 - DNA, 25 bp, Mus musculus
gtgagcaattttccctgtgttctgt

SEQ ID NO: 699155 - DNA, 25 bp, Mus musculus
gtgagcaattttgcctgtgttctgt

SEQ ID NO: 699156 - DNA, 25 bp, Mus musculus
gtgagcacaattaagaccaacaaaa

SEQ ID NO: 699157 - DNA, 25 bp, Mus musculus
gtgagcacaatttagaccaacaaaa

SEQ ID NO: 699158 - DNA, 25 bp, Mus musculus
gtgagcacacacaggtcgctgcctc

SEQ ID NO: 699159 - DNA, 25 bp, Mus musculus
gtgagcacacactggtcgctgcctc

SEQ ID NO: 699160 - DNA, 25 bp, Mus musculus
gtgagcacacgaccaggcttggcat

SEQ ID NO: 699161 - DNA, 25 bp, Mus musculus
gtgagcacacgagcaggcttggcat

SEQ ID NO: 699162 - DNA, 25 bp, Mus musculus
gtgagcacagaactgaactttctct

SEQ ID NO: 699163 - DNA, 25 bp, Mus musculus
gtgagcacagaagtgaactttctct

SEQ ID NO: 699164 - DNA, 25 bp, Mus musculus
gtgagcacattgattgagccttttt

SEQ ID NO: 699165 - DNA, 25 bp, Mus musculus
gtgagcacattgtttgagccttttt

SEQ ID NO: 699166 - DNA, 25 bp, Mus musculus
gtgagcaccaggcaagtccttcatc

SEQ ID NO: 699167 - DNA, 25 bp, Mus musculus
gtgagcaccagggaagtccttcatc

SEQ ID NO: 699168 - DNA, 25 bp, Mus musculus
gtgagcacccaaaactgctggtcag

SEQ ID NO: 699169 - DNA, 25 bp, Mus musculus
gtgagcacccaatactgctggtcag

SEQ ID NO: 699170 - DNA, 25 bp, Mus musculus
gtgagcaccctcaatttcagtttct

SEQ ID NO: 699171 - DNA, 25 bp, Mus musculus
gtgagcaccctctatttcagtttct

SEQ ID NO: 699172 - DNA, 25 bp, Mus musculus
gtgagcacctaaaaatggagattat

SEQ ID NO: 699173 - DNA, 25 bp, Mus musculus
gtgagcacctaataatggagattat

SEQ ID NO: 699174 - DNA, 25 bp, Mus musculus
gtgagcacggaaacatagcctcttt

SEQ ID NO: 699175 - DNA, 25 bp, Mus musculus
gtgagcacggaatcatagcctcttt

SEQ ID NO: 699176 - DNA, 25 bp, Mus musculus
gtgagcacggctagggtagcgggcc

SEQ ID NO: 699177 - DNA, 25 bp, Mus musculus
gtgagcacggcttgggtagcgggcc

SEQ ID NO: 699178 - DNA, 25 bp, Mus musculus
gtgagcacgtctactaccgcctggt

SEQ ID NO: 699179 - DNA, 25 bp, Mus musculus
gtgagcacgtcttctaccgcctggt

SEQ ID NO: 699180 - DNA, 25 bp, Mus musculus
gtgagcactaaaattttgtctctgt

SEQ ID NO: 699181 - DNA, 25 bp, Mus musculus
gtgagcactaaatttttgtctctgt

SEQ ID NO: 699182 - DNA, 25 bp, Mus musculus
gtgagcagaattctcaaccaacctg

SEQ ID NO: 699183 - DNA, 25 bp, Mus musculus
gtgagcagaattgtcaaccaacctg

SEQ ID NO: 699184 - DNA, 25 bp, Mus musculus
gtgagcagacccaagtgttaaagct

SEQ ID NO: 699185 - DNA, 25 bp, Mus musculus
gtgagcagacccagacatagagcca

SEQ ID NO: 699186 - DNA, 25 bp, Mus musculus
gtgagcagaccctagtgttaaagct

SEQ ID NO: 699187 - DNA, 25 bp, Mus musculus
gtgagcagaccctgacatagagcca

SEQ ID NO: 699188 - DNA, 25 bp, Mus musculus
gtgagcagacctcttcgtgttccca

SEQ ID NO: 699189 - DNA, 25 bp, Mus musculus
gtgagcagacctgttcgtgttccca

SEQ ID NO: 699190 - DNA, 25 bp, Mus musculus
gtgagcagactacgctctgcgtgca

SEQ ID NO: 699191 - DNA, 25 bp, Mus musculus
gtgagcagactaggctctgcgtgca

SEQ ID NO: 699192 - DNA, 25 bp, Mus musculus
gtgagcagaggacccgcaccgacac

SEQ ID NO: 699193 - DNA, 25 bp, Mus musculus
gtgagcagaggagccgcaccgacac

SEQ ID NO: 699194 - DNA, 25 bp, Mus musculus
gtgagcagaggcatgccgccaagac

SEQ ID NO: 699195 - DNA, 25 bp, Mus musculus
gtgagcagaggcttgccgccaagac

SEQ ID NO: 699196 - DNA, 25 bp, Mus musculus
gtgagcagatacacaaccctgttaa

SEQ ID NO: 699197 - DNA, 25 bp, Mus musculus
gtgagcagatactcaaccctgttaa

SEQ ID NO: 699198 - DNA, 25 bp, Mus musculus
gtgagcagatgacttatgggatatc

SEQ ID NO: 699199 - DNA, 25 bp, Mus musculus
gtgagcagatgagttatgggatatc

SEQ ID NO: 699200 - DNA, 25 bp, Mus musculus
gtgagcagcatgatcagcagacaca

SEQ ID NO: 699201 - DNA, 25 bp, Mus musculus
gtgagcagcatgttcagcagacaca

SEQ ID NO: 699202 - DNA, 25 bp, Mus musculus
gtgagcagcattaaaaccctagtat

SEQ ID NO: 699203 - DNA, 25 bp, Mus musculus
gtgagcagcatttaaaccctagtat

SEQ ID NO: 699204 - DNA, 25 bp, Mus musculus
gtgagcagccagagcatccgtgcag

SEQ ID NO: 699205 - DNA, 25 bp, Mus musculus
gtgagcagccagtgcatccgtgcag

SEQ ID NO: 699206 - DNA, 25 bp, Mus musculus
gtgagcagccgcacgtcgccgttga

SEQ ID NO: 699207 - DNA, 25 bp, Mus musculus
gtgagcagccgctcgtcgccgttga

SEQ ID NO: 699208 - DNA, 25 bp, Mus musculus
gtgagcagcctgaacagagacgcgt

SEQ ID NO: 699209 - DNA, 25 bp, Mus musculus
gtgagcagcctgtacagagacgcgt

SEQ ID NO: 699210 - DNA, 25 bp, Mus musculus
gtgagcagctcaataagaccctgtt

SEQ ID NO: 699211 - DNA, 25 bp, Mus musculus
gtgagcagctcattaagaccctgtt

SEQ ID NO: 699212 - DNA, 25 bp, Mus musculus
gtgagcaggacaattttgattacat

SEQ ID NO: 699213 - DNA, 25 bp, Mus musculus
gtgagcaggacatttttgattacat

SEQ ID NO: 699214 - DNA, 25 bp, Mus musculus
gtgagcaggactccctaggtttcct

SEQ ID NO: 699215 - DNA, 25 bp, Mus musculus
gtgagcaggactgcctaggtttcct

SEQ ID NO: 699216 - DNA, 25 bp, Mus musculus
gtgagcaggcatccccttaaaacat

SEQ ID NO: 699217 - DNA, 25 bp, Mus musculus
gtgagcaggcatgcccttaaaacat

SEQ ID NO: 699218 - DNA, 25 bp, Mus musculus
gtgagcaggcttaaggctccagctt

SEQ ID NO: 699219 - DNA, 25 bp, Mus musculus
gtgagcaggctttaggctccagctt

SEQ ID NO: 699220 - DNA, 25 bp, Mus musculus
gtgagcagggaccatcacactccca

SEQ ID NO: 699221 - DNA, 25 bp, Mus musculus
gtgagcagggacgatcacactccca

SEQ ID NO: 699222 - DNA, 25 bp, Mus musculus
gtgagcagggtcaccaatccagggc

SEQ ID NO: 699223 - DNA, 25 bp, Mus musculus
gtgagcagggtctccaatccagggc

SEQ ID NO: 699224 - DNA, 25 bp, Mus musculus
gtgagcaggtatattcttactgaaa

SEQ ID NO: 699225 - DNA, 25 bp, Mus musculus
gtgagcaggtattttcttactgaaa

SEQ ID NO: 699226 - DNA, 25 bp, Mus musculus
gtgagcagtctgcacttctcactac

SEQ ID NO: 699227 - DNA, 25 bp, Mus musculus
gtgagcagtctggacttctcactac

SEQ ID NO: 699228 - DNA, 25 bp, Mus musculus
gtgagcagtttaaacacatcatagg

SEQ ID NO: 699229 - DNA, 25 bp, Mus musculus
gtgagcagtttatacacatcatagg

SEQ ID NO: 699230 - DNA, 25 bp, Mus musculus
gtgagcataatcagtccgtctgtcc

SEQ ID NO: 699231 - DNA, 25 bp, Mus musculus
gtgagcataatctgtccgtctgtcc

SEQ ID NO: 699232 - DNA, 25 bp, Mus musculus
gtgagcatacacaagcatctggccg

SEQ ID NO: 699233 - DNA, 25 bp, Mus musculus
gtgagcatacaccataccaggagca

SEQ ID NO: 699234 - DNA, 25 bp, Mus musculus
gtgagcatacacgataccaggagca

SEQ ID NO: 699235 - DNA, 25 bp, Mus musculus
gtgagcatacactagcatctggccg

SEQ ID NO: 699236 - DNA, 25 bp, Mus musculus
gtgagcatagcaaagcctgcacctt

SEQ ID NO: 699237 - DNA, 25 bp, Mus musculus
gtgagcatagcaacacacagcctgc

SEQ ID NO: 699238 - DNA, 25 bp, Mus musculus
gtgagcatagcatagcctgcacctt

SEQ ID NO: 699239 - DNA, 25 bp, Mus musculus
gtgagcatagcatcacacagcctgc

SEQ ID NO: 699240 - DNA, 25 bp, Mus musculus
gtgagcatagtcagcactgtacagt

SEQ ID NO: 699241 - DNA, 25 bp, Mus musculus
gtgagcatagtctgcactgtacagt

SEQ ID NO: 699242 - DNA, 25 bp, Mus musculus
gtgagcatcaagaaccaccagataa

SEQ ID NO: 699243 - DNA, 25 bp, Mus musculus
gtgagcatcaagtaccaccagataa

SEQ ID NO: 699244 - DNA, 25 bp, Mus musculus
gtgagcatcatgcagcccaatccca

SEQ ID NO: 699245 - DNA, 25 bp, Mus musculus
gtgagcatcatggagcccaatccca

SEQ ID NO: 699246 - DNA, 25 bp, Mus musculus
gtgagcatcctacccagatccttag

SEQ ID NO: 699247 - DNA, 25 bp, Mus musculus
gtgagcatcctagccagatccttag

SEQ ID NO: 699248 - DNA, 25 bp, Mus musculus
gtgagcatccttcatactttgaaga

SEQ ID NO: 699249 - DNA, 25 bp, Mus musculus
gtgagcatccttcctacagagggct

SEQ ID NO: 699250 - DNA, 25 bp, Mus musculus
gtgagcatccttgatactttgaaga

SEQ ID NO: 699251 - DNA, 25 bp, Mus musculus
gtgagcatccttgctacagagggct

SEQ ID NO: 699252 - DNA, 25 bp, Mus musculus
gtgagcatctgtcatctcagatcga

SEQ ID NO: 699253 - DNA, 25 bp, Mus musculus
gtgagcatctgtgatctcagatcga

SEQ ID NO: 699254 - DNA, 25 bp, Mus musculus
gtgagcatctttagcatgccattta

SEQ ID NO: 699255 - DNA, 25 bp, Mus musculus
gtgagcatcttttgcatgccattta

SEQ ID NO: 699256 - DNA, 25 bp, Mus musculus
gtgagcatgaccacttgggacaagc

SEQ ID NO: 699257 - DNA, 25 bp, Mus musculus
gtgagcatgacctcttgggacaagc

SEQ ID NO: 699258 - DNA, 25 bp, Mus musculus
gtgagcatgagcagtcttccaggac

SEQ ID NO: 699259 - DNA, 25 bp, Mus musculus
gtgagcatgagctgtcttccaggac

SEQ ID NO: 699260 - DNA, 25 bp, Mus musculus
gtgagcatgctcagtatcattgtgg

SEQ ID NO: 699261 - DNA, 25 bp, Mus musculus
gtgagcatgctcattgctaacttcc

SEQ ID NO: 699262 - DNA, 25 bp, Mus musculus
gtgagcatgctctgtatcattgtgg

SEQ ID NO: 699263 - DNA, 25 bp, Mus musculus
gtgagcatgctctttgctaacttcc

SEQ ID NO: 699264 - DNA, 25 bp, Mus musculus
gtgagcattacaccttatcccttct

SEQ ID NO: 699265 - DNA, 25 bp, Mus musculus
gtgagcattacagcttatcccttct

SEQ ID NO: 699266 - DNA, 25 bp, Mus musculus
gtgagcattcaacccattcctttgt

SEQ ID NO: 699267 - DNA, 25 bp, Mus musculus
gtgagcattcaagccattcctttgt

SEQ ID NO: 699268 - DNA, 25 bp, Mus musculus
gtgagcattccacctaagtcaccgc

SEQ ID NO: 699269 - DNA, 25 bp, Mus musculus
gtgagcattccagctaagtcaccgc

SEQ ID NO: 699270 - DNA, 25 bp, Mus musculus
gtgagccaaaagacagtgcctcgcc

SEQ ID NO: 699271 - DNA, 25 bp, Mus musculus
gtgagccaaaagtcagtgcctcgcc

SEQ ID NO: 699272 - DNA, 25 bp, Mus musculus
gtgagccaactgatgcaggacagaa

SEQ ID NO: 699273 - DNA, 25 bp, Mus musculus
gtgagccaactgttgcaggacagaa

SEQ ID NO: 699274 - DNA, 25 bp, Mus musculus
gtgagccaagacacaactcttttgc

SEQ ID NO: 699275 - DNA, 25 bp, Mus musculus
gtgagccaagactcaactcttttgc

SEQ ID NO: 699276 - DNA, 25 bp, Mus musculus
gtgagccaagctatgcaagcaccat

SEQ ID NO: 699277 - DNA, 25 bp, Mus musculus
gtgagccaagctttgcaagcaccat

SEQ ID NO: 699278 - DNA, 25 bp, Mus musculus
gtgagccaagttaaggtcctccttc

SEQ ID NO: 699279 - DNA, 25 bp, Mus musculus
gtgagccaagtttaggtcctccttc

SEQ ID NO: 699280 - DNA, 25 bp, Mus musculus
gtgagccacagactctacgagagat

SEQ ID NO: 699281 - DNA, 25 bp, Mus musculus
gtgagccacagagtctacgagagat

SEQ ID NO: 699282 - DNA, 25 bp, Mus musculus
gtgagccacagcagcaaaattgcac

SEQ ID NO: 699283 - DNA, 25 bp, Mus musculus
gtgagccacagctgcaaaattgcac

SEQ ID NO: 699284 - DNA, 25 bp, Mus musculus
gtgagccacaggcactacatgccta

SEQ ID NO: 699285 - DNA, 25 bp, Mus musculus
gtgagccacagggactacatgccta

SEQ ID NO: 699286 - DNA, 25 bp, Mus musculus
gtgagccacgagcagtgcattgtta

SEQ ID NO: 699287 - DNA, 25 bp, Mus musculus
gtgagccacgaggagtgcattgtta

SEQ ID NO: 699288 - DNA, 25 bp, Mus musculus
gtgagccacggacccacggagtcaa

SEQ ID NO: 699289 - DNA, 25 bp, Mus musculus
gtgagccacggagccacggagtcaa

SEQ ID NO: 699290 - DNA, 25 bp, Mus musculus
gtgagccactacctttatttaccaa

SEQ ID NO: 699291 - DNA, 25 bp, Mus musculus
gtgagccactacgtttatttaccaa

SEQ ID NO: 699292 - DNA, 25 bp, Mus musculus
gtgagccactagcaaaaacaactga

SEQ ID NO: 699293 - DNA, 25 bp, Mus musculus
gtgagccactaggaaaaacaactga

SEQ ID NO: 699294 - DNA, 25 bp, Mus musculus
gtgagccagaatccatgtcgtcaaa

SEQ ID NO: 699295 - DNA, 25 bp, Mus musculus
gtgagccagaatgcatgtcgtcaaa

SEQ ID NO: 699296 - DNA, 25 bp, Mus musculus
gtgagccagctgatatttgtcctta

SEQ ID NO: 699297 - DNA, 25 bp, Mus musculus
gtgagccagctgttatttgtcctta

SEQ ID NO: 699298 - DNA, 25 bp, Mus musculus
gtgagccaggtgatgggctctattt

SEQ ID NO: 699299 - DNA, 25 bp, Mus musculus
gtgagccaggtgttgggctctattt

SEQ ID NO: 699300 - DNA, 25 bp, Mus musculus
gtgagccagtctaatgttgagtaaa

SEQ ID NO: 699301 - DNA, 25 bp, Mus musculus
gtgagccagtcttatgttgagtaaa

SEQ ID NO: 699302 - DNA, 25 bp, Mus musculus
gtgagccagtttagatggcacacac

SEQ ID NO: 699303 - DNA, 25 bp, Mus musculus
gtgagccagtttcatgcacgattca

SEQ ID NO: 699304 - DNA, 25 bp, Mus musculus
gtgagccagtttgatgcacgattca

SEQ ID NO: 699305 - DNA, 25 bp, Mus musculus
gtgagccagttttgatggcacacac

SEQ ID NO: 699306 - DNA, 25 bp, Mus musculus
gtgagccatccgcagagagcagtat

SEQ ID NO: 699307 - DNA, 25 bp, Mus musculus
gtgagccatccggagagagcagtat

SEQ ID NO: 699308 - DNA, 25 bp, Mus musculus
gtgagccatgttctcatggtgtcct

SEQ ID NO: 699309 - DNA, 25 bp, Mus musculus
gtgagccatgttgtcatggtgtcct

SEQ ID NO: 699310 - DNA, 25 bp, Mus musculus
gtgagccattctactcttagaagca

SEQ ID NO: 699311 - DNA, 25 bp, Mus musculus
gtgagccattcttctcttagaagca

SEQ ID NO: 699312 - DNA, 25 bp, Mus musculus
gtgagccattgcattatgtgggtgc

SEQ ID NO: 699313 - DNA, 25 bp, Mus musculus
gtgagccattgctttatgtgggtgc

SEQ ID NO: 699314 - DNA, 25 bp, Mus musculus
gtgagccattgtacagctaccatca

SEQ ID NO: 699315 - DNA, 25 bp, Mus musculus
gtgagccattgttcagctaccatca

SEQ ID NO: 699316 - DNA, 25 bp, Mus musculus
gtgagcccaactcttcaaggcagca

SEQ ID NO: 699317 - DNA, 25 bp, Mus musculus
gtgagcccaactgttcaaggcagca

SEQ ID NO: 699318 - DNA, 25 bp, Mus musculus
gtgagcccactaccaagggcctgga

SEQ ID NO: 699319 - DNA, 25 bp, Mus musculus
gtgagcccactagcaagggcctgga

SEQ ID NO: 699320 - DNA, 25 bp, Mus musculus
gtgagcccagatcttttaaaagtaa

SEQ ID NO: 699321 - DNA, 25 bp, Mus musculus
gtgagcccagatgttttaaaagtaa

SEQ ID NO: 699322 - DNA, 25 bp, Mus musculus
gtgagcccagctaaagctttcggaa

SEQ ID NO: 699323 - DNA, 25 bp, Mus musculus
gtgagcccagcttaagctttcggaa

SEQ ID NO: 699324 - DNA, 25 bp, Mus musculus
gtgagcccagtgctgtcaacaaagg

SEQ ID NO: 699325 - DNA, 25 bp, Mus musculus
gtgagcccagtggtgtcaacaaagg

SEQ ID NO: 699326 - DNA, 25 bp, Mus musculus
gtgagccccagaagaattcaaaaca

SEQ ID NO: 699327 - DNA, 25 bp, Mus musculus
gtgagccccagatgaattcaaaaca

SEQ ID NO: 699328 - DNA, 25 bp, Mus musculus
gtgagccccaggaggtggttcctac

SEQ ID NO: 699329 - DNA, 25 bp, Mus musculus
gtgagccccaggtggtggttcctac

SEQ ID NO: 699330 - DNA, 25 bp, Mus musculus
gtgagccccatgcataaacacatca

SEQ ID NO: 699331 - DNA, 25 bp, Mus musculus
gtgagccccatggataaacacatca

SEQ ID NO: 699332 - DNA, 25 bp, Mus musculus
gtgagccccattagctacactgtag

SEQ ID NO: 699333 - DNA, 25 bp, Mus musculus
gtgagccccatttgctacactgtag

SEQ ID NO: 699334 - DNA, 25 bp, Mus musculus
gtgagcccctctaatgccaagggag

SEQ ID NO: 699335 - DNA, 25 bp, Mus musculus
gtgagcccctcttatgccaagggag

SEQ ID NO: 699336 - DNA, 25 bp, Mus musculus
gtgagcccgctaagggccccatgcg

SEQ ID NO: 699337 - DNA, 25 bp, Mus musculus
gtgagcccgctatgggccccatgcg

SEQ ID NO: 699338 - DNA, 25 bp, Mus musculus
gtgagcccggttattcttctgaaca

SEQ ID NO: 699339 - DNA, 25 bp, Mus musculus
gtgagcccggtttttcttctgaaca

SEQ ID NO: 699340 - DNA, 25 bp, Mus musculus
gtgagccctccaataagaactctgt

SEQ ID NO: 699341 - DNA, 25 bp, Mus musculus
gtgagccctccattaagaactctgt

SEQ ID NO: 699342 - DNA, 25 bp, Mus musculus
gtgagccctcctaggcatgaggtag

SEQ ID NO: 699343 - DNA, 25 bp, Mus musculus
gtgagccctccttggcatgaggtag

SEQ ID NO: 699344 - DNA, 25 bp, Mus musculus
gtgagccctggtaaaagatcagcaa

SEQ ID NO: 699345 - DNA, 25 bp, Mus musculus
gtgagccctggttaaagatcagcaa

SEQ ID NO: 699346 - DNA, 25 bp, Mus musculus
gtgagccctgtcagtattggcattg

SEQ ID NO: 699347 - DNA, 25 bp, Mus musculus
gtgagccctgtccagtatgactgat

SEQ ID NO: 699348 - DNA, 25 bp, Mus musculus
gtgagccctgtcgagtatgactgat

SEQ ID NO: 699349 - DNA, 25 bp, Mus musculus
gtgagccctgtctgtattggcattg

SEQ ID NO: 699350 - DNA, 25 bp, Mus musculus
gtgagcccttatcccacacaattaa

SEQ ID NO: 699351 - DNA, 25 bp, Mus musculus
gtgagcccttatgccacacaattaa

SEQ ID NO: 699352 - DNA, 25 bp, Mus musculus
gtgagccgattgacctatctccagc

SEQ ID NO: 699353 - DNA, 25 bp, Mus musculus
gtgagccgattgtcctatctccagc

SEQ ID NO: 699354 - DNA, 25 bp, Mus musculus
gtgagccgcaggactgtggatccat

SEQ ID NO: 699355 - DNA, 25 bp, Mus musculus
gtgagccgcaggtctgtggatccat

SEQ ID NO: 699356 - DNA, 25 bp, Mus musculus
gtgagccgccatcgccgattgttat

SEQ ID NO: 699357 - DNA, 25 bp, Mus musculus
gtgagccgccatggccgattgttat

SEQ ID NO: 699358 - DNA, 25 bp, Mus musculus
gtgagccgccttcccaaaaacaggt

SEQ ID NO: 699359 - DNA, 25 bp, Mus musculus
gtgagccgccttgccaaaaacaggt

SEQ ID NO: 699360 - DNA, 25 bp, Mus musculus
gtgagccggtttctactgtatttac

SEQ ID NO: 699361 - DNA, 25 bp, Mus musculus
gtgagccggtttgtactgtatttac

SEQ ID NO: 699362 - DNA, 25 bp, Mus musculus
gtgagccgtaacatggtaacagtac

SEQ ID NO: 699363 - DNA, 25 bp, Mus musculus
gtgagccgtaacttggtaacagtac

SEQ ID NO: 699364 - DNA, 25 bp, Mus musculus
gtgagccgtaataaaacaagccctt

SEQ ID NO: 699365 - DNA, 25 bp, Mus musculus
gtgagccgtaattaaacaagccctt

SEQ ID NO: 699366 - DNA, 25 bp, Mus musculus
gtgagcctaacaatacatacagaga

SEQ ID NO: 699367 - DNA, 25 bp, Mus musculus
gtgagcctaacattacatacagaga

SEQ ID NO: 699368 - DNA, 25 bp, Mus musculus
gtgagcctaaggagccagcttctga

SEQ ID NO: 699369 - DNA, 25 bp, Mus musculus
gtgagcctaaggtgccagcttctga

SEQ ID NO: 699370 - DNA, 25 bp, Mus musculus
gtgagcctacttactcagatgagaa

SEQ ID NO: 699371 - DNA, 25 bp, Mus musculus
gtgagcctactttctcagatgagaa

SEQ ID NO: 699372 - DNA, 25 bp, Mus musculus
gtgagcctagttactctgcttgaaa

SEQ ID NO: 699373 - DNA, 25 bp, Mus musculus
gtgagcctagtttctctgcttgaaa

SEQ ID NO: 699374 - DNA, 25 bp, Mus musculus
gtgagcctatatcagtttgaaacca

SEQ ID NO: 699375 - DNA, 25 bp, Mus musculus
gtgagcctatatgagtttgaaacca

SEQ ID NO: 699376 - DNA, 25 bp, Mus musculus
gtgagcctatcaatcgtaagttaca

SEQ ID NO: 699377 - DNA, 25 bp, Mus musculus
gtgagcctatcattcgtaagttaca

SEQ ID NO: 699378 - DNA, 25 bp, Mus musculus
gtgagcctatttatgaaccttgagt

SEQ ID NO: 699379 - DNA, 25 bp, Mus musculus
gtgagcctatttttgaaccttgagt

SEQ ID NO: 699380 - DNA, 25 bp, Mus musculus
gtgagcctcaagaagggtctcgccc

SEQ ID NO: 699381 - DNA, 25 bp, Mus musculus
gtgagcctcaagtagggtctcgccc

SEQ ID NO: 699382 - DNA, 25 bp, Mus musculus
gtgagcctccatatgctaggactga

SEQ ID NO: 699383 - DNA, 25 bp, Mus musculus
gtgagcctccatttgctaggactga

SEQ ID NO: 699384 - DNA, 25 bp, Mus musculus
gtgagcctctagacagtaggtctgc

SEQ ID NO: 699385 - DNA, 25 bp, Mus musculus
gtgagcctctagtcagtaggtctgc

SEQ ID NO: 699386 - DNA, 25 bp, Mus musculus
gtgagcctggcaaacgtgctggatt

SEQ ID NO: 699387 - DNA, 25 bp, Mus musculus
gtgagcctggcatacgtgctggatt

SEQ ID NO: 699388 - DNA, 25 bp, Mus musculus
gtgagcctgggactatacagcctct

SEQ ID NO: 699389 - DNA, 25 bp, Mus musculus
gtgagcctgggagtatacagcctct

SEQ ID NO: 699390 - DNA, 25 bp, Mus musculus
gtgagcctgtgactatcagccacac

SEQ ID NO: 699391 - DNA, 25 bp, Mus musculus
gtgagcctgtgagtatcagccacac

SEQ ID NO: 699392 - DNA, 25 bp, Mus musculus
gtgagcctgttcagtttcagaagaa

SEQ ID NO: 699393 - DNA, 25 bp, Mus musculus
gtgagcctgttctgtttcagaagaa

SEQ ID NO: 699394 - DNA, 25 bp, Mus musculus
gtgagccttcctcatacagcacaag

SEQ ID NO: 699395 - DNA, 25 bp, Mus musculus
gtgagccttcctgatacagcacaag

SEQ ID NO: 699396 - DNA, 25 bp, Mus musculus
gtgagccttctaatactgcagtata

SEQ ID NO: 699397 - DNA, 25 bp, Mus musculus
gtgagccttctattactgcagtata

SEQ ID NO: 699398 - DNA, 25 bp, Mus musculus
gtgagccttcttcgctactacagaa

SEQ ID NO: 699399 - DNA, 25 bp, Mus musculus
gtgagccttcttggctactacagaa

SEQ ID NO: 699400 - DNA, 25 bp, Mus musculus
gtgagccttgctaaacctggacaga

SEQ ID NO: 699401 - DNA, 25 bp, Mus musculus
gtgagccttgcttaacctggacaga

SEQ ID NO: 699402 - DNA, 25 bp, Mus musculus
gtgagcctttagcaaatctaacttg

SEQ ID NO: 699403 - DNA, 25 bp, Mus musculus
gtgagcctttaggaaatctaacttg

SEQ ID NO: 699404 - DNA, 25 bp, Mus musculus
gtgagcctttcaaagttgacattgt

SEQ ID NO: 699405 - DNA, 25 bp, Mus musculus
gtgagcctttcatagttgacattgt

SEQ ID NO: 699406 - DNA, 25 bp, Mus musculus
gtgagcctttggatactgacctagg

SEQ ID NO: 699407 - DNA, 25 bp, Mus musculus
gtgagcctttggttactgacctagg

SEQ ID NO: 699408 - DNA, 25 bp, Mus musculus
gtgagcctttttcccaagaggaaat

SEQ ID NO: 699409 - DNA, 25 bp, Mus musculus
gtgagcctttttgccaagaggaaat

SEQ ID NO: 699410 - DNA, 25 bp, Mus musculus
gtgagcgaaatgacccttactgact

SEQ ID NO: 699411 - DNA, 25 bp, Mus musculus
gtgagcgaaatgtcccttactgact

SEQ ID NO: 699412 - DNA, 25 bp, Mus musculus
gtgagcgacaggaacaaggtttttg

SEQ ID NO: 699413 - DNA, 25 bp, Mus musculus
gtgagcgacaggtacaaggtttttg

SEQ ID NO: 699414 - DNA, 25 bp, Mus musculus
gtgagcgaccacaggccaaccagaa

SEQ ID NO: 699415 - DNA, 25 bp, Mus musculus
gtgagcgaccactggccaaccagaa

SEQ ID NO: 699416 - DNA, 25 bp, Mus musculus
gtgagcgaccagagtcattgaccca

SEQ ID NO: 699417 - DNA, 25 bp, Mus musculus
gtgagcgaccagtgtcattgaccca

SEQ ID NO: 699418 - DNA, 25 bp, Mus musculus
gtgagcgacctgcaagattcacaag

SEQ ID NO: 699419 - DNA, 25 bp, Mus musculus
gtgagcgacctggaagattcacaag

SEQ ID NO: 699420 - DNA, 25 bp, Mus musculus
gtgagcgcaaacctatgccatttgt

SEQ ID NO: 699421 - DNA, 25 bp, Mus musculus
gtgagcgcaaacgtatgccatttgt

SEQ ID NO: 699422 - DNA, 25 bp, Mus musculus
gtgagcgcagctcctgtgtttctgt

SEQ ID NO: 699423 - DNA, 25 bp, Mus musculus
gtgagcgcagctgctgtgtttctgt

SEQ ID NO: 699424 - DNA, 25 bp, Mus musculus
gtgagcgcagtgagttctctcctga

SEQ ID NO: 699425 - DNA, 25 bp, Mus musculus
gtgagcgcagtgtgttctctcctga

SEQ ID NO: 699426 - DNA, 25 bp, Mus musculus
gtgagcgcgaagcacaactgttagt

SEQ ID NO: 699427 - DNA, 25 bp, Mus musculus
gtgagcgcgaaggacaactgttagt

SEQ ID NO: 699428 - DNA, 25 bp, Mus musculus
gtgagcgctcacaaggatgtcttac

SEQ ID NO: 699429 - DNA, 25 bp, Mus musculus
gtgagcgctcactaggatgtcttac

SEQ ID NO: 699430 - DNA, 25 bp, Mus musculus
gtgagcgctgcgagaactccagaga

SEQ ID NO: 699431 - DNA, 25 bp, Mus musculus
gtgagcgctgcgtgaactccagaga

SEQ ID NO: 699432 - DNA, 25 bp, Mus musculus
gtgagcgctgttagtataaacccta

SEQ ID NO: 699433 - DNA, 25 bp, Mus musculus
gtgagcgctgtttgtataaacccta

SEQ ID NO: 699434 - DNA, 25 bp, Mus musculus
gtgagcggaccacgacatctgtgct

SEQ ID NO: 699435 - DNA, 25 bp, Mus musculus
gtgagcggaccaggacatctgtgct

SEQ ID NO: 699436 - DNA, 25 bp, Mus musculus
gtgagcggatttcttatccagactt

SEQ ID NO: 699437 - DNA, 25 bp, Mus musculus
gtgagcggatttgttatccagactt

SEQ ID NO: 699438 - DNA, 25 bp, Mus musculus
gtgagcggcctgactgtagaacagt

SEQ ID NO: 699439 - DNA, 25 bp, Mus musculus
gtgagcggcctgtctgtagaacagt

SEQ ID NO: 699440 - DNA, 25 bp, Mus musculus
gtgagcggcgacagctccaaaggaa

SEQ ID NO: 699441 - DNA, 25 bp, Mus musculus
gtgagcggcgactgctccaaaggaa

SEQ ID NO: 699442 - DNA, 25 bp, Mus musculus
gtgagcgtagcacttacgacttttt

SEQ ID NO: 699443 - DNA, 25 bp, Mus musculus
gtgagcgtagcagttacgacttttt

SEQ ID NO: 699444 - DNA, 25 bp, Mus musculus
gtgagcgtatctcctgtccttctgc

SEQ ID NO: 699445 - DNA, 25 bp, Mus musculus
gtgagcgtatctgctgtccttctgc

SEQ ID NO: 699446 - DNA, 25 bp, Mus musculus
gtgagcgtattgcttacttctctgt

SEQ ID NO: 699447 - DNA, 25 bp, Mus musculus
gtgagcgtattggttacttctctgt

SEQ ID NO: 699448 - DNA, 25 bp, Mus musculus
gtgagcgtcacacacgatagatctt

SEQ ID NO: 699449 - DNA, 25 bp, Mus musculus
gtgagcgtcacagacgatagatctt

SEQ ID NO: 699450 - DNA, 25 bp, Mus musculus
gtgagcgtgattatgccacagcact

SEQ ID NO: 699451 - DNA, 25 bp, Mus musculus
gtgagcgtgattttgccacagcact

SEQ ID NO: 699452 - DNA, 25 bp, Mus musculus
gtgagcgtgttcaaacaggatctct

SEQ ID NO: 699453 - DNA, 25 bp, Mus musculus
gtgagcgtgttctaacaggatctct

SEQ ID NO: 699454 - DNA, 25 bp, Mus musculus
gtgagcgttcacagttgataccaca

SEQ ID NO: 699455 - DNA, 25 bp, Mus musculus
gtgagcgttcactgttgataccaca

SEQ ID NO: 699456 - DNA, 25 bp, Mus musculus
gtgagcgttctgcatccggctgcaa

SEQ ID NO: 699457 - DNA, 25 bp, Mus musculus
gtgagcgttctggatccggctgcaa

SEQ ID NO: 699458 - DNA, 25 bp, Mus musculus
gtgagcgtttcacacactgtcaagc

SEQ ID NO: 699459 - DNA, 25 bp, Mus musculus
gtgagcgtttcagacactgtcaagc

SEQ ID NO: 699460 - DNA, 25 bp, Mus musculus
gtgagctaaagcatctacatacctt

SEQ ID NO: 699461 - DNA, 25 bp, Mus musculus
gtgagctaaagcttctacatacctt

SEQ ID NO: 699462 - DNA, 25 bp, Mus musculus
gtgagctaatctcaggagcttttct

SEQ ID NO: 699463 - DNA, 25 bp, Mus musculus
gtgagctaatctgaggagcttttct

SEQ ID NO: 699464 - DNA, 25 bp, Mus musculus
gtgagctacacactcaagcatctga

SEQ ID NO: 699465 - DNA, 25 bp, Mus musculus
gtgagctacacagtcaagcatctga

SEQ ID NO: 699466 - DNA, 25 bp, Mus musculus
gtgagctacagcctgcacagtgcaa

SEQ ID NO: 699467 - DNA, 25 bp, Mus musculus
gtgagctacagcgtgcacagtgcaa

SEQ ID NO: 699468 - DNA, 25 bp, Mus musculus
gtgagctacataatccgtctcttcc

SEQ ID NO: 699469 - DNA, 25 bp, Mus musculus
gtgagctacatattccgtctcttcc

SEQ ID NO: 699470 - DNA, 25 bp, Mus musculus
gtgagctacctgacatggatactag

SEQ ID NO: 699471 - DNA, 25 bp, Mus musculus
gtgagctacctgtcatggatactag

SEQ ID NO: 699472 - DNA, 25 bp, Mus musculus
gtgagctacgccattgattctttaa

SEQ ID NO: 699473 - DNA, 25 bp, Mus musculus
gtgagctacgcctttgattctttaa

SEQ ID NO: 699474 - DNA, 25 bp, Mus musculus
gtgagctactatatttacatccatt

SEQ ID NO: 699475 - DNA, 25 bp, Mus musculus
gtgagctactatttttacatccatt

SEQ ID NO: 699476 - DNA, 25 bp, Mus musculus
gtgagctactgacctttacagccat

SEQ ID NO: 699477 - DNA, 25 bp, Mus musculus
gtgagctactgagctttacagccat

SEQ ID NO: 699478 - DNA, 25 bp, Mus musculus
gtgagctagctcaacaggaagcttt

SEQ ID NO: 699479 - DNA, 25 bp, Mus musculus
gtgagctagctctacaggaagcttt

SEQ ID NO: 699480 - DNA, 25 bp, Mus musculus
gtgagctaggaacaaacagccagaa

SEQ ID NO: 699481 - DNA, 25 bp, Mus musculus
gtgagctaggaagaaacagccagaa

SEQ ID NO: 699482 - DNA, 25 bp, Mus musculus
gtgagctaggccagagtgattgttt

SEQ ID NO: 699483 - DNA, 25 bp, Mus musculus
gtgagctaggcctgagtgattgttt

SEQ ID NO: 699484 - DNA, 25 bp, Mus musculus
gtgagctagtacaattacctgctgg

SEQ ID NO: 699485 - DNA, 25 bp, Mus musculus
gtgagctagtactattacctgctgg

SEQ ID NO: 699486 - DNA, 25 bp, Mus musculus
gtgagctatagcataactcctccag

SEQ ID NO: 699487 - DNA, 25 bp, Mus musculus
gtgagctatagcttaactcctccag

SEQ ID NO: 699488 - DNA, 25 bp, Mus musculus
gtgagctatcgcaattgccatgctg

SEQ ID NO: 699489 - DNA, 25 bp, Mus musculus
gtgagctatcgctattgccatgctg

SEQ ID NO: 699490 - DNA, 25 bp, Mus musculus
gtgagctatcttcactgttggatca

SEQ ID NO: 699491 - DNA, 25 bp, Mus musculus
gtgagctatcttgactgttggatca

SEQ ID NO: 699492 - DNA, 25 bp, Mus musculus
gtgagctcaagtaccactacatggt

SEQ ID NO: 699493 - DNA, 25 bp, Mus musculus
gtgagctcaagttccactacatggt

SEQ ID NO: 699494 - DNA, 25 bp, Mus musculus
gtgagctcaataacacagcttctca

SEQ ID NO: 699495 - DNA, 25 bp, Mus musculus
gtgagctcaatatcacagcttctca

SEQ ID NO: 699496 - DNA, 25 bp, Mus musculus
gtgagctcacggagtctctacagga

SEQ ID NO: 699497 - DNA, 25 bp, Mus musculus
gtgagctcacggtgtctctacagga

SEQ ID NO: 699498 - DNA, 25 bp, Mus musculus
gtgagctcactgatgtccaggatct

SEQ ID NO: 699499 - DNA, 25 bp, Mus musculus
gtgagctcactgttgtccaggatct

SEQ ID NO: 699500 - DNA, 25 bp, Mus musculus
gtgagctcagaccagatggccaagc

SEQ ID NO: 699501 - DNA, 25 bp, Mus musculus
gtgagctcagacgagatggccaagc

SEQ ID NO: 699502 - DNA, 25 bp, Mus musculus
gtgagctcagctaatgttgtttttc

SEQ ID NO: 699503 - DNA, 25 bp, Mus musculus
gtgagctcagcttatgttgtttttc

SEQ ID NO: 699504 - DNA, 25 bp, Mus musculus
gtgagctccaacatgagtgttcatg

SEQ ID NO: 699505 - DNA, 25 bp, Mus musculus
gtgagctccaacttgagtgttcatg

SEQ ID NO: 699506 - DNA, 25 bp, Mus musculus
gtgagctccagaataggaaaacact

SEQ ID NO: 699507 - DNA, 25 bp, Mus musculus
gtgagctccagattaggaaaacact

SEQ ID NO: 699508 - DNA, 25 bp, Mus musculus
gtgagctccccaacacgggaggaaa

SEQ ID NO: 699509 - DNA, 25 bp, Mus musculus
gtgagctccccaaggtgaatgtgta

SEQ ID NO: 699510 - DNA, 25 bp, Mus musculus
gtgagctccccatcacgggaggaaa

SEQ ID NO: 699511 - DNA, 25 bp, Mus musculus
gtgagctccccatggtgaatgtgta

SEQ ID NO: 699512 - DNA, 25 bp, Mus musculus
gtgagctccctaactactagactga

SEQ ID NO: 699513 - DNA, 25 bp, Mus musculus
gtgagctccctatctactagactga

SEQ ID NO: 699514 - DNA, 25 bp, Mus musculus
gtgagctcctagaaagggcctctgt

SEQ ID NO: 699515 - DNA, 25 bp, Mus musculus
gtgagctcctagtaagggcctctgt

SEQ ID NO: 699516 - DNA, 25 bp, Mus musculus
gtgagctcgggtatatgactaggca

SEQ ID NO: 699517 - DNA, 25 bp, Mus musculus
gtgagctcgggtttatgactaggca

SEQ ID NO: 699518 - DNA, 25 bp, Mus musculus
gtgagctcggtgcagacaactcttc

SEQ ID NO: 699519 - DNA, 25 bp, Mus musculus
gtgagctcggtggagacaactcttc

SEQ ID NO: 699520 - DNA, 25 bp, Mus musculus
gtgagctcgtgcagacggcagacat

SEQ ID NO: 699521 - DNA, 25 bp, Mus musculus
gtgagctcgtgctgacggcagacat

SEQ ID NO: 699522 - DNA, 25 bp, Mus musculus
gtgagctctatgaggcaaggaccca

SEQ ID NO: 699523 - DNA, 25 bp, Mus musculus
gtgagctctatgtggcaaggaccca

SEQ ID NO: 699524 - DNA, 25 bp, Mus musculus
gtgagctctcaaacatcaacacctt

SEQ ID NO: 699525 - DNA, 25 bp, Mus musculus
gtgagctctcaatcatcaacacctt

SEQ ID NO: 699526 - DNA, 25 bp, Mus musculus
gtgagctctccgatttagtattcta

SEQ ID NO: 699527 - DNA, 25 bp, Mus musculus
gtgagctctccgttttagtattcta

SEQ ID NO: 699528 - DNA, 25 bp, Mus musculus
gtgagctctcgacatgtccatgtat

SEQ ID NO: 699529 - DNA, 25 bp, Mus musculus
gtgagctctcgagatgtccatgtat

SEQ ID NO: 699530 - DNA, 25 bp, Mus musculus
gtgagctctgaacctagttttacaa

SEQ ID NO: 699531 - DNA, 25 bp, Mus musculus
gtgagctctgaagctagttttacaa

SEQ ID NO: 699532 - DNA, 25 bp, Mus musculus
gtgagctctgacacctatttatcat

SEQ ID NO: 699533 - DNA, 25 bp, Mus musculus
gtgagctctgactcctatttatcat

SEQ ID NO: 699534 - DNA, 25 bp, Mus musculus
gtgagctctgatcaagccatgtgat

SEQ ID NO: 699535 - DNA, 25 bp, Mus musculus
gtgagctctgatgaagccatgtgat

SEQ ID NO: 699536 - DNA, 25 bp, Mus musculus
gtgagctctgtcacatacaaattga

SEQ ID NO: 699537 - DNA, 25 bp, Mus musculus
gtgagctctgtctcatacaaattga

SEQ ID NO: 699538 - DNA, 25 bp, Mus musculus
gtgagctctgttacagacattcagt

SEQ ID NO: 699539 - DNA, 25 bp, Mus musculus
gtgagctctgtttcagacattcagt

SEQ ID NO: 699540 - DNA, 25 bp, Mus musculus
gtgagctgacccaatcagtccagat

SEQ ID NO: 699541 - DNA, 25 bp, Mus musculus
gtgagctgaccctatcagtccagat

SEQ ID NO: 699542 - DNA, 25 bp, Mus musculus
gtgagctgaccgctagtattttact

SEQ ID NO: 699543 - DNA, 25 bp, Mus musculus
gtgagctgaccggtagtattttact

SEQ ID NO: 699544 - DNA, 25 bp, Mus musculus
gtgagctgactgactctgctcggtg

SEQ ID NO: 699545 - DNA, 25 bp, Mus musculus
gtgagctgactgtctctgctcggtg

SEQ ID NO: 699546 - DNA, 25 bp, Mus musculus
gtgagctgcaggagatcgcctctga

SEQ ID NO: 699547 - DNA, 25 bp, Mus musculus
gtgagctgcaggtgatcgcctctga

SEQ ID NO: 699548 - DNA, 25 bp, Mus musculus
gtgagctgcatgactgaatccacat

SEQ ID NO: 699549 - DNA, 25 bp, Mus musculus
gtgagctgcatgtctgaatccacat

SEQ ID NO: 699550 - DNA, 25 bp, Mus musculus
gtgagctgccagcaaattagccatg

SEQ ID NO: 699551 - DNA, 25 bp, Mus musculus
gtgagctgccaggaaattagccatg

SEQ ID NO: 699552 - DNA, 25 bp, Mus musculus
gtgagctgcgaaatattcctaggaa

SEQ ID NO: 699553 - DNA, 25 bp, Mus musculus
gtgagctgcgaattattcctaggaa

SEQ ID NO: 699554 - DNA, 25 bp, Mus musculus
gtgagctgctaactacatctagact

SEQ ID NO: 699555 - DNA, 25 bp, Mus musculus
gtgagctgctaagtacatctagact

SEQ ID NO: 699556 - DNA, 25 bp, Mus musculus
gtgagctgctccacgcgctgatgca

SEQ ID NO: 699557 - DNA, 25 bp, Mus musculus
gtgagctgctcctcgcgctgatgca

SEQ ID NO: 699558 - DNA, 25 bp, Mus musculus
gtgagctggaaaaaagccttgaatt

SEQ ID NO: 699559 - DNA, 25 bp, Mus musculus
gtgagctggaaaactcggatttgga

SEQ ID NO: 699560 - DNA, 25 bp, Mus musculus
gtgagctggaaataagccttgaatt

SEQ ID NO: 699561 - DNA, 25 bp, Mus musculus
gtgagctggaaatctcggatttgga

SEQ ID NO: 699562 - DNA, 25 bp, Mus musculus
gtgagctgggcaacattagcctctt

SEQ ID NO: 699563 - DNA, 25 bp, Mus musculus
gtgagctgggcatcattagcctctt

SEQ ID NO: 699564 - DNA, 25 bp, Mus musculus
gtgagctgtaaaaccaaggccgttc

SEQ ID NO: 699565 - DNA, 25 bp, Mus musculus
gtgagctgtaaaactgtactttatt

SEQ ID NO: 699566 - DNA, 25 bp, Mus musculus
gtgagctgtaaatccaaggccgttc

SEQ ID NO: 699567 - DNA, 25 bp, Mus musculus
gtgagctgtaaatctgtactttatt

SEQ ID NO: 699568 - DNA, 25 bp, Mus musculus
gtgagctgtaccacctgaccacaaa

SEQ ID NO: 699569 - DNA, 25 bp, Mus musculus
gtgagctgtacctcctgaccacaaa

SEQ ID NO: 699570 - DNA, 25 bp, Mus musculus
gtgagctgtcatcccagtctggaaa

SEQ ID NO: 699571 - DNA, 25 bp, Mus musculus
gtgagctgtcatgccagtctggaaa

SEQ ID NO: 699572 - DNA, 25 bp, Mus musculus
gtgagctgtcccattctgagttaaa

SEQ ID NO: 699573 - DNA, 25 bp, Mus musculus
gtgagctgtccctttctgagttaaa

SEQ ID NO: 699574 - DNA, 25 bp, Mus musculus
gtgagctgtgaacggctaaataaac

SEQ ID NO: 699575 - DNA, 25 bp, Mus musculus
gtgagctgtgaagggctaaataaac

SEQ ID NO: 699576 - DNA, 25 bp, Mus musculus
gtgagctgtgtgcagaatcccatcc

SEQ ID NO: 699577 - DNA, 25 bp, Mus musculus
gtgagctgtgtgcatacaactgagt

SEQ ID NO: 699578 - DNA, 25 bp, Mus musculus
gtgagctgtgtggagaatcccatcc

SEQ ID NO: 699579 - DNA, 25 bp, Mus musculus
gtgagctgtgtggatacaactgagt

SEQ ID NO: 699580 - DNA, 25 bp, Mus musculus
gtgagctgtttaaatcctgagcctt

SEQ ID NO: 699581 - DNA, 25 bp, Mus musculus
gtgagctgtttatatcctgagcctt

SEQ ID NO: 699582 - DNA, 25 bp, Mus musculus
gtgagcttaaataccttcatacaag

SEQ ID NO: 699583 - DNA, 25 bp, Mus musculus
gtgagcttaaattccttcatacaag

SEQ ID NO: 699584 - DNA, 25 bp, Mus musculus
gtgagcttaaccagtgtgattccca

SEQ ID NO: 699585 - DNA, 25 bp, Mus musculus
gtgagcttaacctgtgtgattccca

SEQ ID NO: 699586 - DNA, 25 bp, Mus musculus
gtgagcttaagactccatctgctat

SEQ ID NO: 699587 - DNA, 25 bp, Mus musculus
gtgagcttaagagtccatctgctat

SEQ ID NO: 699588 - DNA, 25 bp, Mus musculus
gtgagcttacctatctctacatgaa

SEQ ID NO: 699589 - DNA, 25 bp, Mus musculus
gtgagcttacctttctctacatgaa

SEQ ID NO: 699590 - DNA, 25 bp, Mus musculus
gtgagcttcactcctgagctttctc

SEQ ID NO: 699591 - DNA, 25 bp, Mus musculus
gtgagcttcactgctgagctttctc

SEQ ID NO: 699592 - DNA, 25 bp, Mus musculus
gtgagcttcaggatcatggacactt

SEQ ID NO: 699593 - DNA, 25 bp, Mus musculus
gtgagcttcaggttcatggacactt

SEQ ID NO: 699594 - DNA, 25 bp, Mus musculus
gtgagcttcataagatacccatgtg

SEQ ID NO: 699595 - DNA, 25 bp, Mus musculus
gtgagcttcatatgatacccatgtg

SEQ ID NO: 699596 - DNA, 25 bp, Mus musculus
gtgagcttccatctgtcagatcctc

SEQ ID NO: 699597 - DNA, 25 bp, Mus musculus
gtgagcttccatgtgtcagatcctc

SEQ ID NO: 699598 - DNA, 25 bp, Mus musculus
gtgagcttcccacaaatatggttat

SEQ ID NO: 699599 - DNA, 25 bp, Mus musculus
gtgagcttcccagaaatatggttat

SEQ ID NO: 699600 - DNA, 25 bp, Mus musculus
gtgagcttctgcacagactcggacc

SEQ ID NO: 699601 - DNA, 25 bp, Mus musculus
gtgagcttctgctcagactcggacc

SEQ ID NO: 699602 - DNA, 25 bp, Mus musculus
gtgagcttgaccagctcaggccctt

SEQ ID NO: 699603 - DNA, 25 bp, Mus musculus
gtgagcttgacctgctcaggccctt

SEQ ID NO: 699604 - DNA, 25 bp, Mus musculus
gtgagcttgagaacagacctctgat

SEQ ID NO: 699605 - DNA, 25 bp, Mus musculus
gtgagcttgagatcagacctctgat

SEQ ID NO: 699606 - DNA, 25 bp, Mus musculus
gtgagcttgattcttgtaacttcta

SEQ ID NO: 699607 - DNA, 25 bp, Mus musculus
gtgagcttgattgttgtaacttcta

SEQ ID NO: 699608 - DNA, 25 bp, Mus musculus
gtgagcttgctcatattttgaattt

SEQ ID NO: 699609 - DNA, 25 bp, Mus musculus
gtgagcttgctcttattttgaattt

SEQ ID NO: 699610 - DNA, 25 bp, Mus musculus
gtgagcttggaaccataccgacctt

SEQ ID NO: 699611 - DNA, 25 bp, Mus musculus
gtgagcttggaagcataccgacctt

SEQ ID NO: 699612 - DNA, 25 bp, Mus musculus
gtgagcttggaccaggtctgtacca

SEQ ID NO: 699613 - DNA, 25 bp, Mus musculus
gtgagcttggacgaggtctgtacca

SEQ ID NO: 699614 - DNA, 25 bp, Mus musculus
gtgagcttggtaacaagtccaggta

SEQ ID NO: 699615 - DNA, 25 bp, Mus musculus
gtgagcttggtatcaagtccaggta

SEQ ID NO: 699616 - DNA, 25 bp, Mus musculus
gtgagcttggtgctaaatccttctc

SEQ ID NO: 699617 - DNA, 25 bp, Mus musculus
gtgagcttggtggtaaatccttctc

SEQ ID NO: 699618 - DNA, 25 bp, Mus musculus
gtgagcttgtataacttttctattc

SEQ ID NO: 699619 - DNA, 25 bp, Mus musculus
gtgagcttgtattacttttctattc

SEQ ID NO: 699620 - DNA, 25 bp, Mus musculus
gtgagcttgtcacccaaagagtgtg

SEQ ID NO: 699621 - DNA, 25 bp, Mus musculus
gtgagcttgtcagccaaagagtgtg

SEQ ID NO: 699622 - DNA, 25 bp, Mus musculus
gtgagcttgttgactttagtcctta

SEQ ID NO: 699623 - DNA, 25 bp, Mus musculus
gtgagcttgttgtctttagtcctta

SEQ ID NO: 699624 - DNA, 25 bp, Mus musculus
gtgagctttaccctcctctaatcaa

SEQ ID NO: 699625 - DNA, 25 bp, Mus musculus
gtgagctttaccgtcctctaatcaa

SEQ ID NO: 699626 - DNA, 25 bp, Mus musculus
gtgagctttattatacatacaacag

SEQ ID NO: 699627 - DNA, 25 bp, Mus musculus
gtgagctttattttacatacaacag

SEQ ID NO: 699628 - DNA, 25 bp, Mus musculus
gtgagctttcaaactctctttaaaa

SEQ ID NO: 699629 - DNA, 25 bp, Mus musculus
gtgagctttcaacagttttcaacaa

SEQ ID NO: 699630 - DNA, 25 bp, Mus musculus
gtgagctttcaagagttttcaacaa

SEQ ID NO: 699631 - DNA, 25 bp, Mus musculus
gtgagctttcaatctctctttaaaa

SEQ ID NO: 699632 - DNA, 25 bp, Mus musculus
gtgagctttcacatggtctgttact

SEQ ID NO: 699633 - DNA, 25 bp, Mus musculus
gtgagctttcacttggtctgttact

SEQ ID NO: 699634 - DNA, 25 bp, Mus musculus
gtgagctttctacatcggagctgtt

SEQ ID NO: 699635 - DNA, 25 bp, Mus musculus
gtgagctttctagatcggagctgtt

SEQ ID NO: 699636 - DNA, 25 bp, Mus musculus
gtgagctttgcaagttccactaacc

SEQ ID NO: 699637 - DNA, 25 bp, Mus musculus
gtgagctttgcatgttccactaacc

SEQ ID NO: 699638 - DNA, 25 bp, Mus musculus
gtgagctttgctcttctgaatagaa

SEQ ID NO: 699639 - DNA, 25 bp, Mus musculus
gtgagctttgctgttctgaatagaa

SEQ ID NO: 699640 - DNA, 25 bp, Mus musculus
gtgagctttgtcatttcctgaaaat

SEQ ID NO: 699641 - DNA, 25 bp, Mus musculus
gtgagctttgtcttttcctgaaaat

SEQ ID NO: 699642 - DNA, 25 bp, Mus musculus
gtgagcttttgacatctccagtttc

SEQ ID NO: 699643 - DNA, 25 bp, Mus musculus
gtgagcttttgagatctccagtttc

SEQ ID NO: 699644 - DNA, 25 bp, Mus musculus
gtgaggaaaggtccccttccacaga

SEQ ID NO: 699645 - DNA, 25 bp, Mus musculus
gtgaggaaaggtgcccttccacaga

SEQ ID NO: 699646 - DNA, 25 bp, Mus musculus
gtgaggaacagaccaatgccgtgtt

SEQ ID NO: 699647 - DNA, 25 bp, Mus musculus
gtgaggaacagagcaatgccgtgtt

SEQ ID NO: 699648 - DNA, 25 bp, Mus musculus
gtgaggaactgaagagatgatgtat

SEQ ID NO: 699649 - DNA, 25 bp, Mus musculus
gtgaggaactgatgagatgatgtat

SEQ ID NO: 699650 - DNA, 25 bp, Mus musculus
gtgaggaagcacacttcattctccc

SEQ ID NO: 699651 - DNA, 25 bp, Mus musculus
gtgaggaagcactcttcattctccc

SEQ ID NO: 699652 - DNA, 25 bp, Mus musculus
gtgaggaagcatctacgtttggtac

SEQ ID NO: 699653 - DNA, 25 bp, Mus musculus
gtgaggaagcatgtacgtttggtac

SEQ ID NO: 699654 - DNA, 25 bp, Mus musculus
gtgaggaagttaccgcaaacccatt

SEQ ID NO: 699655 - DNA, 25 bp, Mus musculus
gtgaggaagttagcgcaaacccatt

SEQ ID NO: 699656 - DNA, 25 bp, Mus musculus
gtgaggaatccaagctctgaagaga

SEQ ID NO: 699657 - DNA, 25 bp, Mus musculus
gtgaggaatccatgctctgaagaga

SEQ ID NO: 699658 - DNA, 25 bp, Mus musculus
gtgaggaatctgctttcctacaacg

SEQ ID NO: 699659 - DNA, 25 bp, Mus musculus
gtgaggaatctggtttcctacaacg

SEQ ID NO: 699660 - DNA, 25 bp, Mus musculus
gtgaggaatgtcacctgcctagtga

SEQ ID NO: 699661 - DNA, 25 bp, Mus musculus
gtgaggaatgtctcctgcctagtga

SEQ ID NO: 699662 - DNA, 25 bp, Mus musculus
gtgaggacagcaagctaccctgtaa

SEQ ID NO: 699663 - DNA, 25 bp, Mus musculus
gtgaggacagcatgctaccctgtaa

SEQ ID NO: 699664 - DNA, 25 bp, Mus musculus
gtgaggacagctcccgcatcgagca

SEQ ID NO: 699665 - DNA, 25 bp, Mus musculus
gtgaggacagctgccgcatcgagca

SEQ ID NO: 699666 - DNA, 25 bp, Mus musculus
gtgaggacagggaggcatgaggcca

SEQ ID NO: 699667 - DNA, 25 bp, Mus musculus
gtgaggacagggtggcatgaggcca

SEQ ID NO: 699668 - DNA, 25 bp, Mus musculus
gtgaggaccaaacagcaggcccaga

SEQ ID NO: 699669 - DNA, 25 bp, Mus musculus
gtgaggaccaaacatctgtcatcca

SEQ ID NO: 699670 - DNA, 25 bp, Mus musculus
gtgaggaccaaagagcaggcccaga

SEQ ID NO: 699671 - DNA, 25 bp, Mus musculus
gtgaggaccaaagatctgtcatcca

SEQ ID NO: 699672 - DNA, 25 bp, Mus musculus
gtgaggaccaagaacgagctgctgc

SEQ ID NO: 699673 - DNA, 25 bp, Mus musculus
gtgaggaccaagtacgagctgctgc

SEQ ID NO: 699674 - DNA, 25 bp, Mus musculus
gtgaggaccactattctaatacttt

SEQ ID NO: 699675 - DNA, 25 bp, Mus musculus
gtgaggaccacttttctaatacttt

SEQ ID NO: 699676 - DNA, 25 bp, Mus musculus
gtgaggaccattaccaccaggtcaa

SEQ ID NO: 699677 - DNA, 25 bp, Mus musculus
gtgaggaccattattggcattccga

SEQ ID NO: 699678 - DNA, 25 bp, Mus musculus
gtgaggaccatttccaccaggtcaa

SEQ ID NO: 699679 - DNA, 25 bp, Mus musculus
gtgaggaccatttttggcattccga

SEQ ID NO: 699680 - DNA, 25 bp, Mus musculus
gtgaggacctatagatggaatctgt

SEQ ID NO: 699681 - DNA, 25 bp, Mus musculus
gtgaggacctattgatggaatctgt

SEQ ID NO: 699682 - DNA, 25 bp, Mus musculus
gtgaggacctgacctccctgtccgg

SEQ ID NO: 699683 - DNA, 25 bp, Mus musculus
gtgaggacctgagctccctgtccgg

SEQ ID NO: 699684 - DNA, 25 bp, Mus musculus
gtgaggacctttaattcctgtcctt

SEQ ID NO: 699685 - DNA, 25 bp, Mus musculus
gtgaggaccttttattcctgtcctt

SEQ ID NO: 699686 - DNA, 25 bp, Mus musculus
gtgaggactacgaattttccctgct

SEQ ID NO: 699687 - DNA, 25 bp, Mus musculus
gtgaggactacgtattttccctgct

SEQ ID NO: 699688 - DNA, 25 bp, Mus musculus
gtgaggactcagatcctgggatgat

SEQ ID NO: 699689 - DNA, 25 bp, Mus musculus
gtgaggactcagttcctgggatgat

SEQ ID NO: 699690 - DNA, 25 bp, Mus musculus
gtgaggactcatagacttacagaat

SEQ ID NO: 699691 - DNA, 25 bp, Mus musculus
gtgaggactcatcactgtggataaa

SEQ ID NO: 699692 - DNA, 25 bp, Mus musculus
gtgaggactcatgactgtggataaa

SEQ ID NO: 699693 - DNA, 25 bp, Mus musculus
gtgaggactcattgacttacagaat

SEQ ID NO: 699694 - DNA, 25 bp, Mus musculus
gtgaggactccccagacatttgata

SEQ ID NO: 699695 - DNA, 25 bp, Mus musculus
gtgaggactcccgagacatttgata

SEQ ID NO: 699696 - DNA, 25 bp, Mus musculus
gtgaggactgcaaacatccggactt

SEQ ID NO: 699697 - DNA, 25 bp, Mus musculus
gtgaggactgcatacatccggactt

SEQ ID NO: 699698 - DNA, 25 bp, Mus musculus
gtgaggagggtgatcccacgttctt

SEQ ID NO: 699699 - DNA, 25 bp, Mus musculus
gtgaggagggtgttcccacgttctt

SEQ ID NO: 699700 - DNA, 25 bp, Mus musculus
gtgaggagttctagtaccactgaac

SEQ ID NO: 699701 - DNA, 25 bp, Mus musculus
gtgaggagttcttgtaccactgaac

SEQ ID NO: 699702 - DNA, 25 bp, Mus musculus
gtgaggagtttcctaccagttcact

SEQ ID NO: 699703 - DNA, 25 bp, Mus musculus
gtgaggagtttcgtaccagttcact

SEQ ID NO: 699704 - DNA, 25 bp, Mus musculus
gtgaggataactcttccgtccacct

SEQ ID NO: 699705 - DNA, 25 bp, Mus musculus
gtgaggataactgttccgtccacct

SEQ ID NO: 699706 - DNA, 25 bp, Mus musculus
gtgaggatacagctgcctccaggat

SEQ ID NO: 699707 - DNA, 25 bp, Mus musculus
gtgaggatacaggtgcctccaggat

SEQ ID NO: 699708 - DNA, 25 bp, Mus musculus
gtgaggatatccaaatggctgctgt

SEQ ID NO: 699709 - DNA, 25 bp, Mus musculus
gtgaggatatcctaatggctgctgt

SEQ ID NO: 699710 - DNA, 25 bp, Mus musculus
gtgaggatattgcaggccactttaa

SEQ ID NO: 699711 - DNA, 25 bp, Mus musculus
gtgaggatattggaggccactttaa

SEQ ID NO: 699712 - DNA, 25 bp, Mus musculus
gtgaggatgcataggctgatgctaa

SEQ ID NO: 699713 - DNA, 25 bp, Mus musculus
gtgaggatgcattggctgatgctaa

SEQ ID NO: 699714 - DNA, 25 bp, Mus musculus
gtgaggatgcccctctcaacatcac

SEQ ID NO: 699715 - DNA, 25 bp, Mus musculus
gtgaggatgcccgtctcaacatcac

SEQ ID NO: 699716 - DNA, 25 bp, Mus musculus
gtgaggattcctacaacttaaagaa

SEQ ID NO: 699717 - DNA, 25 bp, Mus musculus
gtgaggattccttcaacttaaagaa

SEQ ID NO: 699718 - DNA, 25 bp, Mus musculus
gtgaggattctgacccaacttggga

SEQ ID NO: 699719 - DNA, 25 bp, Mus musculus
gtgaggattctgtcccaacttggga

SEQ ID NO: 699720 - DNA, 25 bp, Mus musculus
gtgaggatttccatgcaatgagtag

SEQ ID NO: 699721 - DNA, 25 bp, Mus musculus
gtgaggatttccttgcaatgagtag

SEQ ID NO: 699722 - DNA, 25 bp, Mus musculus
gtgaggcaactcaggaacctttcct

SEQ ID NO: 699723 - DNA, 25 bp, Mus musculus
gtgaggcaactctggaacctttcct

SEQ ID NO: 699724 - DNA, 25 bp, Mus musculus
gtgaggcaattcagggtcgaccact

SEQ ID NO: 699725 - DNA, 25 bp, Mus musculus
gtgaggcaattctgggtcgaccact

SEQ ID NO: 699726 - DNA, 25 bp, Mus musculus
gtgaggcaccatcggcaacactcca

SEQ ID NO: 699727 - DNA, 25 bp, Mus musculus
gtgaggcaccatgggcaacactcca

SEQ ID NO: 699728 - DNA, 25 bp, Mus musculus
gtgaggcacggtcgctcttctctac

SEQ ID NO: 699729 - DNA, 25 bp, Mus musculus
gtgaggcacggtggctcttctctac

SEQ ID NO: 699730 - DNA, 25 bp, Mus musculus
gtgaggcactgaacgcgacatttat

SEQ ID NO: 699731 - DNA, 25 bp, Mus musculus
gtgaggcactgatcgcgacatttat

SEQ ID NO: 699732 - DNA, 25 bp, Mus musculus
gtgaggcacttgaacacacttcgac

SEQ ID NO: 699733 - DNA, 25 bp, Mus musculus
gtgaggcacttgtacacacttcgac

SEQ ID NO: 699734 - DNA, 25 bp, Mus musculus
gtgaggcagaaaaccctcaacccat

SEQ ID NO: 699735 - DNA, 25 bp, Mus musculus
gtgaggcagaaatccctcaacccat

SEQ ID NO: 699736 - DNA, 25 bp, Mus musculus
gtgaggcagagcacactggttgctt

SEQ ID NO: 699737 - DNA, 25 bp, Mus musculus
gtgaggcagagctcactggttgctt

SEQ ID NO: 699738 - DNA, 25 bp, Mus musculus
gtgaggcagcttccagaggatttcc

SEQ ID NO: 699739 - DNA, 25 bp, Mus musculus
gtgaggcagcttgcagaggatttcc

SEQ ID NO: 699740 - DNA, 25 bp, Mus musculus
gtgaggcaggccatctgcctgagtc

SEQ ID NO: 699741 - DNA, 25 bp, Mus musculus
gtgaggcaggccttctgcctgagtc

SEQ ID NO: 699742 - DNA, 25 bp, Mus musculus
gtgaggcaggtgatcatcagtcaat

SEQ ID NO: 699743 - DNA, 25 bp, Mus musculus
gtgaggcaggtgttcatcagtcaat

SEQ ID NO: 699744 - DNA, 25 bp, Mus musculus
gtgaggcaggttaacaacactacac

SEQ ID NO: 699745 - DNA, 25 bp, Mus musculus
gtgaggcaggtttacaacactacac

SEQ ID NO: 699746 - DNA, 25 bp, Mus musculus
gtgaggcagttccagttcactgact

SEQ ID NO: 699747 - DNA, 25 bp, Mus musculus
gtgaggcagttcgagttcactgact

SEQ ID NO: 699748 - DNA, 25 bp, Mus musculus
gtgaggcagtttcttgactgagttt

SEQ ID NO: 699749 - DNA, 25 bp, Mus musculus
gtgaggcagtttgttgactgagttt

SEQ ID NO: 699750 - DNA, 25 bp, Mus musculus
gtgaggcatacactggaggtcccca

SEQ ID NO: 699751 - DNA, 25 bp, Mus musculus
gtgaggcatacagtggaggtcccca

SEQ ID NO: 699752 - DNA, 25 bp, Mus musculus
gtgaggcatcagagacttcagtaga

SEQ ID NO: 699753 - DNA, 25 bp, Mus musculus
gtgaggcatcagtgacttcagtaga

SEQ ID NO: 699754 - DNA, 25 bp, Mus musculus
gtgaggcatgtcaaaagttacagtt

SEQ ID NO: 699755 - DNA, 25 bp, Mus musculus
gtgaggcatgtcatcagcagagctt

SEQ ID NO: 699756 - DNA, 25 bp, Mus musculus
gtgaggcatgtctaaagttacagtt

SEQ ID NO: 699757 - DNA, 25 bp, Mus musculus
gtgaggcatgtcttcagcagagctt

SEQ ID NO: 699758 - DNA, 25 bp, Mus musculus
gtgaggccacagaacaaatagtgtt

SEQ ID NO: 699759 - DNA, 25 bp, Mus musculus
gtgaggccacagatcaccatgacta

SEQ ID NO: 699760 - DNA, 25 bp, Mus musculus
gtgaggccacagtacaaatagtgtt

SEQ ID NO: 699761 - DNA, 25 bp, Mus musculus
gtgaggccacagttcaccatgacta

SEQ ID NO: 699762 - DNA, 25 bp, Mus musculus
gtgaggccctacatctacctgggag

SEQ ID NO: 699763 - DNA, 25 bp, Mus musculus
gtgaggccctacttctacctgggag

SEQ ID NO: 699764 - DNA, 25 bp, Mus musculus
gtgaggccctcacttcatccggcga

SEQ ID NO: 699765 - DNA, 25 bp, Mus musculus
gtgaggccctcagttcatccggcga

SEQ ID NO: 699766 - DNA, 25 bp, Mus musculus
gtgaggccctgaccgtgaccttttt

SEQ ID NO: 699767 - DNA, 25 bp, Mus musculus
gtgaggccctgagcgtgaccttttt

SEQ ID NO: 699768 - DNA, 25 bp, Mus musculus
gtgaggccctgtaccaaatgctgct

SEQ ID NO: 699769 - DNA, 25 bp, Mus musculus
gtgaggccctgttccaaatgctgct

SEQ ID NO: 699770 - DNA, 25 bp, Mus musculus
gtgaggcccttgagccagcaggcac

SEQ ID NO: 699771 - DNA, 25 bp, Mus musculus
gtgaggcccttgtgccagcaggcac

SEQ ID NO: 699772 - DNA, 25 bp, Mus musculus
gtgaggccctttattctgaaagtgc

SEQ ID NO: 699773 - DNA, 25 bp, Mus musculus
gtgaggcccttttttctgaaagtgc

SEQ ID NO: 699774 - DNA, 25 bp, Mus musculus
gtgaggccgaccagatctcatacaa

SEQ ID NO: 699775 - DNA, 25 bp, Mus musculus
gtgaggccgacctgatctcatacaa

SEQ ID NO: 699776 - DNA, 25 bp, Mus musculus
gtgaggcctaaacaagaagtcttcc

SEQ ID NO: 699777 - DNA, 25 bp, Mus musculus
gtgaggcctaaagaagaagtcttcc

SEQ ID NO: 699778 - DNA, 25 bp, Mus musculus
gtgaggcctaatacctggtcaacta

SEQ ID NO: 699779 - DNA, 25 bp, Mus musculus
gtgaggcctaattcctggtcaacta

SEQ ID NO: 699780 - DNA, 25 bp, Mus musculus
gtgaggcctagcagtatgtttagct

SEQ ID NO: 699781 - DNA, 25 bp, Mus musculus
gtgaggcctagctgtatgtttagct

SEQ ID NO: 699782 - DNA, 25 bp, Mus musculus
gtgaggcctgccagttgccagaacc

SEQ ID NO: 699783 - DNA, 25 bp, Mus musculus
gtgaggcctgcctgttgccagaacc

SEQ ID NO: 699784 - DNA, 25 bp, Mus musculus
gtgaggcctgctcttttatgaagga

SEQ ID NO: 699785 - DNA, 25 bp, Mus musculus
gtgaggcctgctgttttatgaagga

SEQ ID NO: 699786 - DNA, 25 bp, Mus musculus
gtgaggcctggaagtagcattgtaa

SEQ ID NO: 699787 - DNA, 25 bp, Mus musculus
gtgaggcctggatgtagcattgtaa

SEQ ID NO: 699788 - DNA, 25 bp, Mus musculus
gtgaggcgagaactaccaacctcca

SEQ ID NO: 699789 - DNA, 25 bp, Mus musculus
gtgaggcgagaagtaccaacctcca

SEQ ID NO: 699790 - DNA, 25 bp, Mus musculus
gtgaggcgagctccccagtgaactc

SEQ ID NO: 699791 - DNA, 25 bp, Mus musculus
gtgaggcgagctgcccagtgaactc

SEQ ID NO: 699792 - DNA, 25 bp, Mus musculus
gtgaggcgctcactcaaccaataag

SEQ ID NO: 699793 - DNA, 25 bp, Mus musculus
gtgaggcgctcagtcaaccaataag

SEQ ID NO: 699794 - DNA, 25 bp, Mus musculus
gtgaggcgggcactcttctctgcca

SEQ ID NO: 699795 - DNA, 25 bp, Mus musculus
gtgaggcgggcagtcttctctgcca

SEQ ID NO: 699796 - DNA, 25 bp, Mus musculus
gtgaggcgttctattctctatgaag

SEQ ID NO: 699797 - DNA, 25 bp, Mus musculus
gtgaggcgttcttttctctatgaag

SEQ ID NO: 699798 - DNA, 25 bp, Mus musculus
gtgaggctaacactaggttctttaa

SEQ ID NO: 699799 - DNA, 25 bp, Mus musculus
gtgaggctaacagtaggttctttaa

SEQ ID NO: 699800 - DNA, 25 bp, Mus musculus
gtgaggctatatacgcaacaataaa

SEQ ID NO: 699801 - DNA, 25 bp, Mus musculus
gtgaggctatattcgcaacaataaa

SEQ ID NO: 699802 - DNA, 25 bp, Mus musculus
gtgaggctatgtatacaaccccacc

SEQ ID NO: 699803 - DNA, 25 bp, Mus musculus
gtgaggctatgtttacaaccccacc

SEQ ID NO: 699804 - DNA, 25 bp, Mus musculus
gtgaggctattgctggcctacaact

SEQ ID NO: 699805 - DNA, 25 bp, Mus musculus
gtgaggctattggtggcctacaact

SEQ ID NO: 699806 - DNA, 25 bp, Mus musculus
gtgaggctcaaacctctctgagaaa

SEQ ID NO: 699807 - DNA, 25 bp, Mus musculus
gtgaggctcaaagctctctgagaaa

SEQ ID NO: 699808 - DNA, 25 bp, Mus musculus
gtgaggctcaagcttcagtttctag

SEQ ID NO: 699809 - DNA, 25 bp, Mus musculus
gtgaggctcaaggttcagtttctag

SEQ ID NO: 699810 - DNA, 25 bp, Mus musculus
gtgaggctcagcagttctttaaaca

SEQ ID NO: 699811 - DNA, 25 bp, Mus musculus
gtgaggctcagctgttctttaaaca

SEQ ID NO: 699812 - DNA, 25 bp, Mus musculus
gtgaggctccgaattaaatccctaa

SEQ ID NO: 699813 - DNA, 25 bp, Mus musculus
gtgaggctccgatttaaatccctaa

SEQ ID NO: 699814 - DNA, 25 bp, Mus musculus
gtgaggctcctcaaagggcaaacag

SEQ ID NO: 699815 - DNA, 25 bp, Mus musculus
gtgaggctcctctaagggcaaacag

SEQ ID NO: 699816 - DNA, 25 bp, Mus musculus
gtgaggctccttaattgtcttagtc

SEQ ID NO: 699817 - DNA, 25 bp, Mus musculus
gtgaggctcctttattgtcttagtc

SEQ ID NO: 699818 - DNA, 25 bp, Mus musculus
gtgaggctgaacagtgacttctttt

SEQ ID NO: 699819 - DNA, 25 bp, Mus musculus
gtgaggctgaactgtgacttctttt

SEQ ID NO: 699820 - DNA, 25 bp, Mus musculus
gtgaggctgaccattgagttttctt

SEQ ID NO: 699821 - DNA, 25 bp, Mus musculus
gtgaggctgacctttgagttttctt

SEQ ID NO: 699822 - DNA, 25 bp, Mus musculus
gtgaggctgagtcccacggaaactc

SEQ ID NO: 699823 - DNA, 25 bp, Mus musculus
gtgaggctgagtgccacggaaactc

SEQ ID NO: 699824 - DNA, 25 bp, Mus musculus
gtgaggctgcggctttatttcccct

SEQ ID NO: 699825 - DNA, 25 bp, Mus musculus
gtgaggctgcgggtttatttcccct

SEQ ID NO: 699826 - DNA, 25 bp, Mus musculus
gtgaggctgctcaaggaatccaaca

SEQ ID NO: 699827 - DNA, 25 bp, Mus musculus
gtgaggctgctctaggaatccaaca

SEQ ID NO: 699828 - DNA, 25 bp, Mus musculus
gtgaggctgctgatatctgtcggat

SEQ ID NO: 699829 - DNA, 25 bp, Mus musculus
gtgaggctgctgttatctgtcggat

SEQ ID NO: 699830 - DNA, 25 bp, Mus musculus
gtgaggctgcttaccggaacatcaa

SEQ ID NO: 699831 - DNA, 25 bp, Mus musculus
gtgaggctgctttccggaacatcaa

SEQ ID NO: 699832 - DNA, 25 bp, Mus musculus
gtgaggctgtgaaggctcagatcct

SEQ ID NO: 699833 - DNA, 25 bp, Mus musculus
gtgaggctgtgatggctcagatcct

SEQ ID NO: 699834 - DNA, 25 bp, Mus musculus
gtgaggcttcacatccaaaaaatgt

SEQ ID NO: 699835 - DNA, 25 bp, Mus musculus
gtgaggcttcacttccaaaaaatgt

SEQ ID NO: 699836 - DNA, 25 bp, Mus musculus
gtgaggcttcagaactgtgacctga

SEQ ID NO: 699837 - DNA, 25 bp, Mus musculus
gtgaggcttcagtactgtgacctga

SEQ ID NO: 699838 - DNA, 25 bp, Mus musculus
gtgaggcttcccaaagatctggaca

SEQ ID NO: 699839 - DNA, 25 bp, Mus musculus
gtgaggcttccctaagatctggaca

SEQ ID NO: 699840 - DNA, 25 bp, Mus musculus
gtgaggcttctcaggcatggacata

SEQ ID NO: 699841 - DNA, 25 bp, Mus musculus
gtgaggcttctctggcatggacata

SEQ ID NO: 699842 - DNA, 25 bp, Mus musculus
gtgaggcttttcatgcatgtgctgt

SEQ ID NO: 699843 - DNA, 25 bp, Mus musculus
gtgaggcttttcttgcatgtgctgt

SEQ ID NO: 699844 - DNA, 25 bp, Mus musculus
gtgagggaacgcagaacacctggct

SEQ ID NO: 699845 - DNA, 25 bp, Mus musculus
gtgagggaacgctgaacacctggct

SEQ ID NO: 699846 - DNA, 25 bp, Mus musculus
gtgagggacacccatggtctttctc

SEQ ID NO: 699847 - DNA, 25 bp, Mus musculus
gtgagggacaccgatggtctttctc

SEQ ID NO: 699848 - DNA, 25 bp, Mus musculus
gtgagggacagaagcctgcctttta

SEQ ID NO: 699849 - DNA, 25 bp, Mus musculus
gtgagggacagatgcctgcctttta

SEQ ID NO: 699850 - DNA, 25 bp, Mus musculus
gtgagggacattcctttagacagga

SEQ ID NO: 699851 - DNA, 25 bp, Mus musculus
gtgagggacattgctttagacagga

SEQ ID NO: 699852 - DNA, 25 bp, Mus musculus
gtgagggacccaaagctacagctgc

SEQ ID NO: 699853 - DNA, 25 bp, Mus musculus
gtgagggacccatagctacagctgc

SEQ ID NO: 699854 - DNA, 25 bp, Mus musculus
gtgagggactacattttccaccttt

SEQ ID NO: 699855 - DNA, 25 bp, Mus musculus
gtgagggactactttttccaccttt

SEQ ID NO: 699856 - DNA, 25 bp, Mus musculus
gtgagggagcctcgcttgcccacca

SEQ ID NO: 699857 - DNA, 25 bp, Mus musculus
gtgagggagcctggcttgcccacca

SEQ ID NO: 699858 - DNA, 25 bp, Mus musculus
gtgagggcaatcaggttttaacatc

SEQ ID NO: 699859 - DNA, 25 bp, Mus musculus
gtgagggcaatctggttttaacatc

SEQ ID NO: 699860 - DNA, 25 bp, Mus musculus
gtgagggccaccagcctgctgcaaa

SEQ ID NO: 699861 - DNA, 25 bp, Mus musculus
gtgagggccacctgcctgctgcaaa

SEQ ID NO: 699862 - DNA, 25 bp, Mus musculus
gtgagggccatgacttggtcacata

SEQ ID NO: 699863 - DNA, 25 bp, Mus musculus
gtgagggccatgtcttggtcacata

SEQ ID NO: 699864 - DNA, 25 bp, Mus musculus
gtgagggcccacactgtgaagtgca

SEQ ID NO: 699865 - DNA, 25 bp, Mus musculus
gtgagggcccactctgtgaagtgca

SEQ ID NO: 699866 - DNA, 25 bp, Mus musculus
gtgagggccccaaaaatgccaggtt

SEQ ID NO: 699867 - DNA, 25 bp, Mus musculus
gtgagggccccataaatgccaggtt

SEQ ID NO: 699868 - DNA, 25 bp, Mus musculus
gtgagggccttcaggctgtgctaca

SEQ ID NO: 699869 - DNA, 25 bp, Mus musculus
gtgagggccttctggctgtgctaca

SEQ ID NO: 699870 - DNA, 25 bp, Mus musculus
gtgagggctgctacaaagtctttac

SEQ ID NO: 699871 - DNA, 25 bp, Mus musculus
gtgagggctgcttcaaagtctttac

SEQ ID NO: 699872 - DNA, 25 bp, Mus musculus
gtgagggctgggaatttctccccac

SEQ ID NO: 699873 - DNA, 25 bp, Mus musculus
gtgagggctgggtatttctccccac

SEQ ID NO: 699874 - DNA, 25 bp, Mus musculus
gtgagggtagcacctttcaggatct

SEQ ID NO: 699875 - DNA, 25 bp, Mus musculus
gtgagggtagcagctttcaggatct

SEQ ID NO: 699876 - DNA, 25 bp, Mus musculus
gtgagggtcataaagactccagttt

SEQ ID NO: 699877 - DNA, 25 bp, Mus musculus
gtgagggtcatatagactccagttt

SEQ ID NO: 699878 - DNA, 25 bp, Mus musculus
gtgagggtccagatctaaaccagca

SEQ ID NO: 699879 - DNA, 25 bp, Mus musculus
gtgagggtccagttctaaaccagca

SEQ ID NO: 699880 - DNA, 25 bp, Mus musculus
gtgagggtccccagtaatagaaatc

SEQ ID NO: 699881 - DNA, 25 bp, Mus musculus
gtgagggtcccctgtaatagaaatc

SEQ ID NO: 699882 - DNA, 25 bp, Mus musculus
gtgagggtctcacgacaggtttcca

SEQ ID NO: 699883 - DNA, 25 bp, Mus musculus
gtgagggtctcaggacaggtttcca

SEQ ID NO: 699884 - DNA, 25 bp, Mus musculus
gtgagggtgtgactgaaggtttccc

SEQ ID NO: 699885 - DNA, 25 bp, Mus musculus
gtgagggtgtgagtgaaggtttccc

SEQ ID NO: 699886 - DNA, 25 bp, Mus musculus
gtgagggttactcctatttagttca

SEQ ID NO: 699887 - DNA, 25 bp, Mus musculus
gtgagggttactgctatttagttca

SEQ ID NO: 699888 - DNA, 25 bp, Mus musculus
gtgagggttatcagttttctcccct

SEQ ID NO: 699889 - DNA, 25 bp, Mus musculus
gtgagggttatctgttttctcccct

SEQ ID NO: 699890 - DNA, 25 bp, Mus musculus
gtgagggttattaccacaacctagt

SEQ ID NO: 699891 - DNA, 25 bp, Mus musculus
gtgagggttatttccacaacctagt

SEQ ID NO: 699892 - DNA, 25 bp, Mus musculus
gtgagggttgaactcaagcccaatt

SEQ ID NO: 699893 - DNA, 25 bp, Mus musculus
gtgagggttgaagtcaagcccaatt

SEQ ID NO: 699894 - DNA, 25 bp, Mus musculus
gtgaggtaacaccatgcctagatgt

SEQ ID NO: 699895 - DNA, 25 bp, Mus musculus
gtgaggtaacacgatgcctagatgt

SEQ ID NO: 699896 - DNA, 25 bp, Mus musculus
gtgaggtaacccaatgtgtgggttt

SEQ ID NO: 699897 - DNA, 25 bp, Mus musculus
gtgaggtaacccaggatcttatccc

SEQ ID NO: 699898 - DNA, 25 bp, Mus musculus
gtgaggtaaccctatgtgtgggttt

SEQ ID NO: 699899 - DNA, 25 bp, Mus musculus
gtgaggtaaccctggatcttatccc

SEQ ID NO: 699900 - DNA, 25 bp, Mus musculus
gtgaggtacgccaccagtttagtga

SEQ ID NO: 699901 - DNA, 25 bp, Mus musculus
gtgaggtacgcctccagtttagtga

SEQ ID NO: 699902 - DNA, 25 bp, Mus musculus
gtgaggtatccaatctctgtttggt

SEQ ID NO: 699903 - DNA, 25 bp, Mus musculus
gtgaggtatccattctctgtttggt

SEQ ID NO: 699904 - DNA, 25 bp, Mus musculus
gtgaggtcaccaacctgggagacaa

SEQ ID NO: 699905 - DNA, 25 bp, Mus musculus
gtgaggtcaccatcctgggagacaa

SEQ ID NO: 699906 - DNA, 25 bp, Mus musculus
gtgaggtcacctcatgacacattcc

SEQ ID NO: 699907 - DNA, 25 bp, Mus musculus
gtgaggtcacctgatgacacattcc

SEQ ID NO: 699908 - DNA, 25 bp, Mus musculus
gtgaggtcaggaagctgccaccagc

SEQ ID NO: 699909 - DNA, 25 bp, Mus musculus
gtgaggtcaggatgctgccaccagc

SEQ ID NO: 699910 - DNA, 25 bp, Mus musculus
gtgaggtcatcgatgctgttagtgc

SEQ ID NO: 699911 - DNA, 25 bp, Mus musculus
gtgaggtcatcgttgctgttagtgc

SEQ ID NO: 699912 - DNA, 25 bp, Mus musculus
gtgaggtcatgaactgagctacagc

SEQ ID NO: 699913 - DNA, 25 bp, Mus musculus
gtgaggtcatgatctgagctacagc

SEQ ID NO: 699914 - DNA, 25 bp, Mus musculus
gtgaggtcatttacccagctgaact

SEQ ID NO: 699915 - DNA, 25 bp, Mus musculus
gtgaggtcattttcccagctgaact

SEQ ID NO: 699916 - DNA, 25 bp, Mus musculus
gtgaggtcccaaactcagggtcaac

SEQ ID NO: 699917 - DNA, 25 bp, Mus musculus
gtgaggtcccaatctcagggtcaac

SEQ ID NO: 699918 - DNA, 25 bp, Mus musculus
gtgaggtccgtgctcagctatgctt

SEQ ID NO: 699919 - DNA, 25 bp, Mus musculus
gtgaggtccgtggtcagctatgctt

SEQ ID NO: 699920 - DNA, 25 bp, Mus musculus
gtgaggtcctgcatagtgggacaca

SEQ ID NO: 699921 - DNA, 25 bp, Mus musculus
gtgaggtcctgcttagtgggacaca

SEQ ID NO: 699922 - DNA, 25 bp, Mus musculus
gtgaggtcctttagtcttcagttca

SEQ ID NO: 699923 - DNA, 25 bp, Mus musculus
gtgaggtccttttgtcttcagttca

SEQ ID NO: 699924 - DNA, 25 bp, Mus musculus
gtgaggtctaaccttccctatgaag

SEQ ID NO: 699925 - DNA, 25 bp, Mus musculus
gtgaggtctaacgttccctatgaag

SEQ ID NO: 699926 - DNA, 25 bp, Mus musculus
gtgaggtgaaatctgctcttgcaaa

SEQ ID NO: 699927 - DNA, 25 bp, Mus musculus
gtgaggtgaaatgtgctcttgcaaa

SEQ ID NO: 699928 - DNA, 25 bp, Mus musculus
gtgaggtgaccaatgacttcatcat

SEQ ID NO: 699929 - DNA, 25 bp, Mus musculus
gtgaggtgaccattgacttcatcat

SEQ ID NO: 699930 - DNA, 25 bp, Mus musculus
gtgaggtgacctctccttcccctaa

SEQ ID NO: 699931 - DNA, 25 bp, Mus musculus
gtgaggtgacctgtccttcccctaa

SEQ ID NO: 699932 - DNA, 25 bp, Mus musculus
gtgaggtgcgtgctctggaagagag

SEQ ID NO: 699933 - DNA, 25 bp, Mus musculus
gtgaggtgcgtggtctggaagagag

SEQ ID NO: 699934 - DNA, 25 bp, Mus musculus
gtgaggtgctttaacatggagaagc

SEQ ID NO: 699935 - DNA, 25 bp, Mus musculus
gtgaggtgcttttacatggagaagc

SEQ ID NO: 699936 - DNA, 25 bp, Mus musculus
gtgaggtggcaccacaccgaatgaa

SEQ ID NO: 699937 - DNA, 25 bp, Mus musculus
gtgaggtggcacgacaccgaatgaa

SEQ ID NO: 699938 - DNA, 25 bp, Mus musculus
gtgaggtggctcctgccttaaatcc

SEQ ID NO: 699939 - DNA, 25 bp, Mus musculus
gtgaggtggctcgtgccttaaatcc

SEQ ID NO: 699940 - DNA, 25 bp, Mus musculus
gtgaggtggtttccttcacaggatc

SEQ ID NO: 699941 - DNA, 25 bp, Mus musculus
gtgaggtggtttgcttcacaggatc

SEQ ID NO: 699942 - DNA, 25 bp, Mus musculus
gtgaggtgttctactcccttccatc

SEQ ID NO: 699943 - DNA, 25 bp, Mus musculus
gtgaggtgttcttctcccttccatc

SEQ ID NO: 699944 - DNA, 25 bp, Mus musculus
gtgaggtgttgacctaacccttccc

SEQ ID NO: 699945 - DNA, 25 bp, Mus musculus
gtgaggtgttgagctaacccttccc

SEQ ID NO: 699946 - DNA, 25 bp, Mus musculus
gtgaggttaactctggaatcatcca

SEQ ID NO: 699947 - DNA, 25 bp, Mus musculus
gtgaggttaactgtggaatcatcca

SEQ ID NO: 699948 - DNA, 25 bp, Mus musculus
gtgaggttactcaggcctacatact

SEQ ID NO: 699949 - DNA, 25 bp, Mus musculus
gtgaggttactctggcctacatact

SEQ ID NO: 699950 - DNA, 25 bp, Mus musculus
gtgaggttcatgatcccaaagcagg

SEQ ID NO: 699951 - DNA, 25 bp, Mus musculus
gtgaggttcatgttcccaaagcagg

SEQ ID NO: 699952 - DNA, 25 bp, Mus musculus
gtgaggttcccgaaaaattctgtct

SEQ ID NO: 699953 - DNA, 25 bp, Mus musculus
gtgaggttcccgtaaaattctgtct

SEQ ID NO: 699954 - DNA, 25 bp, Mus musculus
gtgaggttcctccattgttgaaatt

SEQ ID NO: 699955 - DNA, 25 bp, Mus musculus
gtgaggttcctcgattgttgaaatt

SEQ ID NO: 699956 - DNA, 25 bp, Mus musculus
gtgaggttctagaatgccccgtgat

SEQ ID NO: 699957 - DNA, 25 bp, Mus musculus
gtgaggttctagtatgccccgtgat

SEQ ID NO: 699958 - DNA, 25 bp, Mus musculus
gtgaggttgacacactttttctaaa

SEQ ID NO: 699959 - DNA, 25 bp, Mus musculus
gtgaggttgacagactttttctaaa

SEQ ID NO: 699960 - DNA, 25 bp, Mus musculus
gtgaggttgggtccctccactctga

SEQ ID NO: 699961 - DNA, 25 bp, Mus musculus
gtgaggttgggtgcctccactctga

SEQ ID NO: 699962 - DNA, 25 bp, Mus musculus
gtgaggtttaccagtgtgactccac

SEQ ID NO: 699963 - DNA, 25 bp, Mus musculus
gtgaggtttaccatggaagttcttt

SEQ ID NO: 699964 - DNA, 25 bp, Mus musculus
gtgaggtttacctgtgtgactccac

SEQ ID NO: 699965 - DNA, 25 bp, Mus musculus
gtgaggtttaccttggaagttcttt

SEQ ID NO: 699966 - DNA, 25 bp, Mus musculus
gtgaggtttcccacagggattccat

SEQ ID NO: 699967 - DNA, 25 bp, Mus musculus
gtgaggtttccctcagggattccat

SEQ ID NO: 699968 - DNA, 25 bp, Mus musculus
gtgaggttttaccaaagcctccctg

SEQ ID NO: 699969 - DNA, 25 bp, Mus musculus
gtgaggttttacgaaagcctccctg

SEQ ID NO: 699970 - DNA, 25 bp, Mus musculus
gtgaggttttatcctaatgacagtt

SEQ ID NO: 699971 - DNA, 25 bp, Mus musculus
gtgaggttttatgctaatgacagtt

SEQ ID NO: 699972 - DNA, 25 bp, Mus musculus
gtgagtaaatctaccaaagaaatct

SEQ ID NO: 699973 - DNA, 25 bp, Mus musculus
gtgagtaaatcttccaaagaaatct

SEQ ID NO: 699974 - DNA, 25 bp, Mus musculus
gtgagtaaatggctcaacaaaccat

SEQ ID NO: 699975 - DNA, 25 bp, Mus musculus
gtgagtaaatgggtcaacaaaccat

SEQ ID NO: 699976 - DNA, 25 bp, Mus musculus
gtgagtaaccctaggacattttatg

SEQ ID NO: 699977 - DNA, 25 bp, Mus musculus
gtgagtaacccttggacattttatg

SEQ ID NO: 699978 - DNA, 25 bp, Mus musculus
gtgagtaactaacacactgacaaag

SEQ ID NO: 699979 - DNA, 25 bp, Mus musculus
gtgagtaactaagacactgacaaag

SEQ ID NO: 699980 - DNA, 25 bp, Mus musculus
gtgagtaagaagatctctccctcct

SEQ ID NO: 699981 - DNA, 25 bp, Mus musculus
gtgagtaagaagttctctccctcct

SEQ ID NO: 699982 - DNA, 25 bp, Mus musculus
gtgagtaaggatcgctttcctcaaa

SEQ ID NO: 699983 - DNA, 25 bp, Mus musculus
gtgagtaaggatggctttcctcaaa

SEQ ID NO: 699984 - DNA, 25 bp, Mus musculus
gtgagtaatcgcaaccactgagcaa

SEQ ID NO: 699985 - DNA, 25 bp, Mus musculus
gtgagtaatcgctaccactgagcaa

SEQ ID NO: 699986 - DNA, 25 bp, Mus musculus
gtgagtaattaacagccagcgtatc

SEQ ID NO: 699987 - DNA, 25 bp, Mus musculus
gtgagtaattaagagccagcgtatc

SEQ ID NO: 699988 - DNA, 25 bp, Mus musculus
gtgagtaattctcctctttaagtta

SEQ ID NO: 699989 - DNA, 25 bp, Mus musculus
gtgagtaattctgctctttaagtta

SEQ ID NO: 699990 - DNA, 25 bp, Mus musculus
gtgagtacagctctttggcatttac

SEQ ID NO: 699991 - DNA, 25 bp, Mus musculus
gtgagtacagctgtttggcatttac

SEQ ID NO: 699992 - DNA, 25 bp, Mus musculus
gtgagtaccaagaattaaaactgtc

SEQ ID NO: 699993 - DNA, 25 bp, Mus musculus
gtgagtaccaagtattaaaactgtc

SEQ ID NO: 699994 - DNA, 25 bp, Mus musculus
gtgagtaccactcctctgggaccag

SEQ ID NO: 699995 - DNA, 25 bp, Mus musculus
gtgagtaccactgctctgggaccag

SEQ ID NO: 699996 - DNA, 25 bp, Mus musculus
gtgagtaccagtaggttttgaactc

SEQ ID NO: 699997 - DNA, 25 bp, Mus musculus
gtgagtaccagttggttttgaactc

SEQ ID NO: 699998 - DNA, 25 bp, Mus musculus
gtgagtacctcaagccaaaagagtg

SEQ ID NO: 699999 - DNA, 25 bp, Mus musculus
gtgagtacctcatgccaaaagagtg

SEQ ID NO: 700000 - DNA, 25 bp, Mus musculus
gtgagtacctgtctcgtttacgaga

SEQ ID NO: 700001 - DNA, 25 bp, Mus musculus
gtgagtacctgtgtcgtttacgaga

SEQ ID NO: 700002 - DNA, 25 bp, Mus musculus
gtgagtactatgagctactatttgt

SEQ ID NO: 700003 - DNA, 25 bp, Mus musculus
gtgagtactatgtgctactatttgt

SEQ ID NO: 700004 - DNA, 25 bp, Mus musculus
gtgagtactggcacaggctgccatt

SEQ ID NO: 700005 - DNA, 25 bp, Mus musculus
gtgagtactggctcaggctgccatt

SEQ ID NO: 700006 - DNA, 25 bp, Mus musculus
gtgagtagcaacaaggaggtccctg

SEQ ID NO: 700007 - DNA, 25 bp, Mus musculus
gtgagtagcaactaggaggtccctg

SEQ ID NO: 700008 - DNA, 25 bp, Mus musculus
gtgagtagccccacataggtgctaa

SEQ ID NO: 700009 - DNA, 25 bp, Mus musculus
gtgagtagcccctcataggtgctaa

SEQ ID NO: 700010 - DNA, 25 bp, Mus musculus
gtgagtagcttccagtacgcatctg

SEQ ID NO: 700011 - DNA, 25 bp, Mus musculus
gtgagtagcttcgagtacgcatctg

SEQ ID NO: 700012 - DNA, 25 bp, Mus musculus
gtgagtaggcctagttgaacttcaa

SEQ ID NO: 700013 - DNA, 25 bp, Mus musculus
gtgagtaggccttgttgaacttcaa

SEQ ID NO: 700014 - DNA, 25 bp, Mus musculus
gtgagtaggttgcacccaccaggat

SEQ ID NO: 700015 - DNA, 25 bp, Mus musculus
gtgagtaggttggacccaccaggat

SEQ ID NO: 700016 - DNA, 25 bp, Mus musculus
gtgagtagtgtactgcttccctcag

SEQ ID NO: 700017 - DNA, 25 bp, Mus musculus
gtgagtagtgtagtgcttccctcag

SEQ ID NO: 700018 - DNA, 25 bp, Mus musculus
gtgagtagttcacatctttacaaaa

SEQ ID NO: 700019 - DNA, 25 bp, Mus musculus
gtgagtagttcagatctttacaaaa

SEQ ID NO: 700020 - DNA, 25 bp, Mus musculus
gtgagtataataagcgtgtaaccat

SEQ ID NO: 700021 - DNA, 25 bp, Mus musculus
gtgagtataatatgcgtgtaaccat

SEQ ID NO: 700022 - DNA, 25 bp, Mus musculus
gtgagtatagaaattctcccatacc

SEQ ID NO: 700023 - DNA, 25 bp, Mus musculus
gtgagtatagaatttctcccatacc

SEQ ID NO: 700024 - DNA, 25 bp, Mus musculus
gtgagtatcagacctttggcttcag

SEQ ID NO: 700025 - DNA, 25 bp, Mus musculus
gtgagtatcagagctttggcttcag

SEQ ID NO: 700026 - DNA, 25 bp, Mus musculus
gtgagtatctgaaacccagtctcat

SEQ ID NO: 700027 - DNA, 25 bp, Mus musculus
gtgagtatctgatacccagtctcat

SEQ ID NO: 700028 - DNA, 25 bp, Mus musculus
gtgagtatgctgatctccgattttc

SEQ ID NO: 700029 - DNA, 25 bp, Mus musculus
gtgagtatgctgttctccgattttc

SEQ ID NO: 700030 - DNA, 25 bp, Mus musculus
gtgagtatgtatcccatggatgtat

SEQ ID NO: 700031 - DNA, 25 bp, Mus musculus
gtgagtatgtatgccatggatgtat

SEQ ID NO: 700032 - DNA, 25 bp, Mus musculus
gtgagtattcagatacaccgggctg

SEQ ID NO: 700033 - DNA, 25 bp, Mus musculus
gtgagtattcagttacaccgggctg

SEQ ID NO: 700034 - DNA, 25 bp, Mus musculus
gtgagtcaaaacacttagtttttct

SEQ ID NO: 700035 - DNA, 25 bp, Mus musculus
gtgagtcaaaactcttagtttttct

SEQ ID NO: 700036 - DNA, 25 bp, Mus musculus
gtgagtcaagacaacttttccctgt

SEQ ID NO: 700037 - DNA, 25 bp, Mus musculus
gtgagtcaagactacttttccctgt

SEQ ID NO: 700038 - DNA, 25 bp, Mus musculus
gtgagtcaagcccatgagacgcccc

SEQ ID NO: 700039 - DNA, 25 bp, Mus musculus
gtgagtcaagccgatgagacgcccc

SEQ ID NO: 700040 - DNA, 25 bp, Mus musculus
gtgagtcaatatatagcatggtttc

SEQ ID NO: 700041 - DNA, 25 bp, Mus musculus
gtgagtcaatatttagcatggtttc

SEQ ID NO: 700042 - DNA, 25 bp, Mus musculus
gtgagtcacaagatggatgcctgga

SEQ ID NO: 700043 - DNA, 25 bp, Mus musculus
gtgagtcacaagttggatgcctgga

SEQ ID NO: 700044 - DNA, 25 bp, Mus musculus
gtgagtcacaccacagagcaagggt

SEQ ID NO: 700045 - DNA, 25 bp, Mus musculus
gtgagtcacacctcagagcaagggt

SEQ ID NO: 700046 - DNA, 25 bp, Mus musculus
gtgagtcaccaccagtcggaagcct

SEQ ID NO: 700047 - DNA, 25 bp, Mus musculus
gtgagtcaccacgagtcggaagcct

SEQ ID NO: 700048 - DNA, 25 bp, Mus musculus
gtgagtcaccagcataaactgagct

SEQ ID NO: 700049 - DNA, 25 bp, Mus musculus
gtgagtcaccaggataaactgagct

SEQ ID NO: 700050 - DNA, 25 bp, Mus musculus
gtgagtcaccatcacatgctatttt

SEQ ID NO: 700051 - DNA, 25 bp, Mus musculus
gtgagtcaccatgacatgctatttt

SEQ ID NO: 700052 - DNA, 25 bp, Mus musculus
gtgagtcacctcagtataaaaacca

SEQ ID NO: 700053 - DNA, 25 bp, Mus musculus
gtgagtcacctcatcaacaaacaag

SEQ ID NO: 700054 - DNA, 25 bp, Mus musculus
gtgagtcacctctgtataaaaacca

SEQ ID NO: 700055 - DNA, 25 bp, Mus musculus
gtgagtcacctcttcaacaaacaag

SEQ ID NO: 700056 - DNA, 25 bp, Mus musculus
gtgagtcacggtcgtcataacccct

SEQ ID NO: 700057 - DNA, 25 bp, Mus musculus
gtgagtcacggtggtcataacccct

SEQ ID NO: 700058 - DNA, 25 bp, Mus musculus
gtgagtcacgtaacatcccgttgta

SEQ ID NO: 700059 - DNA, 25 bp, Mus musculus
gtgagtcacgtatcatcccgttgta

SEQ ID NO: 700060 - DNA, 25 bp, Mus musculus
gtgagtcactaaacaccagtctttt

SEQ ID NO: 700061 - DNA, 25 bp, Mus musculus
gtgagtcactaacccaagggtagtc

SEQ ID NO: 700062 - DNA, 25 bp, Mus musculus
gtgagtcactaagccaagggtagtc

SEQ ID NO: 700063 - DNA, 25 bp, Mus musculus
gtgagtcactaatcaccagtctttt

SEQ ID NO: 700064 - DNA, 25 bp, Mus musculus
gtgagtcactatcaggtccaacctg

SEQ ID NO: 700065 - DNA, 25 bp, Mus musculus
gtgagtcactatgaggtccaacctg

SEQ ID NO: 700066 - DNA, 25 bp, Mus musculus
gtgagtcactccattgtataatgca

SEQ ID NO: 700067 - DNA, 25 bp, Mus musculus
gtgagtcactcctttgtataatgca

SEQ ID NO: 700068 - DNA, 25 bp, Mus musculus
gtgagtcagaccatccttggtgttt

SEQ ID NO: 700069 - DNA, 25 bp, Mus musculus
gtgagtcagaccttccttggtgttt

SEQ ID NO: 700070 - DNA, 25 bp, Mus musculus
gtgagtcagagaatcttttgctagt

SEQ ID NO: 700071 - DNA, 25 bp, Mus musculus
gtgagtcagagattcttttgctagt

SEQ ID NO: 700072 - DNA, 25 bp, Mus musculus
gtgagtcagagcatgctcagacatc

SEQ ID NO: 700073 - DNA, 25 bp, Mus musculus
gtgagtcagagcttgctcagacatc

SEQ ID NO: 700074 - DNA, 25 bp, Mus musculus
gtgagtcagcatacctttccaaaag

SEQ ID NO: 700075 - DNA, 25 bp, Mus musculus
gtgagtcagcattcctttccaaaag

SEQ ID NO: 700076 - DNA, 25 bp, Mus musculus
gtgagtcagtagaacccttccaaaa

SEQ ID NO: 700077 - DNA, 25 bp, Mus musculus
gtgagtcagtagtacccttccaaaa

SEQ ID NO: 700078 - DNA, 25 bp, Mus musculus
gtgagtcagtcaaccaccagacacg

SEQ ID NO: 700079 - DNA, 25 bp, Mus musculus
gtgagtcagtcatccaccagacacg

SEQ ID NO: 700080 - DNA, 25 bp, Mus musculus
gtgagtcattgccacattgtatcag

SEQ ID NO: 700081 - DNA, 25 bp, Mus musculus
gtgagtcattgcgacattgtatcag

SEQ ID NO: 700082 - DNA, 25 bp, Mus musculus
gtgagtccaagaaccctcctccatt

SEQ ID NO: 700083 - DNA, 25 bp, Mus musculus
gtgagtccaagatccctcctccatt

SEQ ID NO: 700084 - DNA, 25 bp, Mus musculus
gtgagtccaagcatcgacttcagaa

SEQ ID NO: 700085 - DNA, 25 bp, Mus musculus
gtgagtccaagcttcgacttcagaa

SEQ ID NO: 700086 - DNA, 25 bp, Mus musculus
gtgagtccacgaagggcacattcta

SEQ ID NO: 700087 - DNA, 25 bp, Mus musculus
gtgagtccacgatgggcacattcta

SEQ ID NO: 700088 - DNA, 25 bp, Mus musculus
gtgagtccagggagctctgcaaaaa

SEQ ID NO: 700089 - DNA, 25 bp, Mus musculus
gtgagtccagggtgctctgcaaaaa

SEQ ID NO: 700090 - DNA, 25 bp, Mus musculus
gtgagtccataaacagacgcttgat

SEQ ID NO: 700091 - DNA, 25 bp, Mus musculus
gtgagtccataatcagacgcttgat

SEQ ID NO: 700092 - DNA, 25 bp, Mus musculus
gtgagtccatacctcctggatcaag

SEQ ID NO: 700093 - DNA, 25 bp, Mus musculus
gtgagtccatacgtcctggatcaag

SEQ ID NO: 700094 - DNA, 25 bp, Mus musculus
gtgagtccatccatgaagtcaaaat

SEQ ID NO: 700095 - DNA, 25 bp, Mus musculus
gtgagtccatccttgaagtcaaaat

SEQ ID NO: 700096 - DNA, 25 bp, Mus musculus
gtgagtccccttcgtgatttatttt

SEQ ID NO: 700097 - DNA, 25 bp, Mus musculus
gtgagtccccttggtgatttatttt

SEQ ID NO: 700098 - DNA, 25 bp, Mus musculus
gtgagtccctagctgctaacagctg

SEQ ID NO: 700099 - DNA, 25 bp, Mus musculus
gtgagtccctaggtgctaacagctg

SEQ ID NO: 700100 - DNA, 25 bp, Mus musculus
gtgagtccctcaccagttattagga

SEQ ID NO: 700101 - DNA, 25 bp, Mus musculus
gtgagtccctcagcagttattagga

SEQ ID NO: 700102 - DNA, 25 bp, Mus musculus
gtgagtcccttgactagacacttaa

SEQ ID NO: 700103 - DNA, 25 bp, Mus musculus
gtgagtcccttgtctagacacttaa

SEQ ID NO: 700104 - DNA, 25 bp, Mus musculus
gtgagtccggtgaagattcctttta

SEQ ID NO: 700105 - DNA, 25 bp, Mus musculus
gtgagtccggtgtagattcctttta

SEQ ID NO: 700106 - DNA, 25 bp, Mus musculus
gtgagtccgttcaccgagctgaaga

SEQ ID NO: 700107 - DNA, 25 bp, Mus musculus
gtgagtccgttctccgagctgaaga

SEQ ID NO: 700108 - DNA, 25 bp, Mus musculus
gtgagtcctacaaatggcattccaa

SEQ ID NO: 700109 - DNA, 25 bp, Mus musculus
gtgagtcctacactgagcacaggca

SEQ ID NO: 700110 - DNA, 25 bp, Mus musculus
gtgagtcctacagtgagcacaggca

SEQ ID NO: 700111 - DNA, 25 bp, Mus musculus
gtgagtcctacatatggcattccaa

SEQ ID NO: 700112 - DNA, 25 bp, Mus musculus
gtgagtcctatgacccagcaaaaga

SEQ ID NO: 700113 - DNA, 25 bp, Mus musculus
gtgagtcctatgtcccagcaaaaga

SEQ ID NO: 700114 - DNA, 25 bp, Mus musculus
gtgagtcctcaaaacacttagttct

SEQ ID NO: 700115 - DNA, 25 bp, Mus musculus
gtgagtcctcaatacacttagttct

SEQ ID NO: 700116 - DNA, 25 bp, Mus musculus
gtgagtcctgtgattctagcatttg

SEQ ID NO: 700117 - DNA, 25 bp, Mus musculus
gtgagtcctgtgtttctagcatttg

SEQ ID NO: 700118 - DNA, 25 bp, Mus musculus
gtgagtcctgttacacagtggtaac

SEQ ID NO: 700119 - DNA, 25 bp, Mus musculus
gtgagtcctgtttcacagtggtaac

SEQ ID NO: 700120 - DNA, 25 bp, Mus musculus
gtgagtctaaagctatccgttgcct

SEQ ID NO: 700121 - DNA, 25 bp, Mus musculus
gtgagtctaaaggtatccgttgcct

SEQ ID NO: 700122 - DNA, 25 bp, Mus musculus
gtgagtctaatccccgttggtctgt

SEQ ID NO: 700123 - DNA, 25 bp, Mus musculus
gtgagtctaatcgccgttggtctgt

SEQ ID NO: 700124 - DNA, 25 bp, Mus musculus
gtgagtctacctaaagctgtgctaa

SEQ ID NO: 700125 - DNA, 25 bp, Mus musculus
gtgagtctaccttaagctgtgctaa

SEQ ID NO: 700126 - DNA, 25 bp, Mus musculus
gtgagtctagatctctggattcaga

SEQ ID NO: 700127 - DNA, 25 bp, Mus musculus
gtgagtctagatgtctggattcaga

SEQ ID NO: 700128 - DNA, 25 bp, Mus musculus
gtgagtctatgtattcagagtttca

SEQ ID NO: 700129 - DNA, 25 bp, Mus musculus
gtgagtctatgttttcagagtttca

SEQ ID NO: 700130 - DNA, 25 bp, Mus musculus
gtgagtctcaagacacccttagaat

SEQ ID NO: 700131 - DNA, 25 bp, Mus musculus
gtgagtctcaagtcacccttagaat

SEQ ID NO: 700132 - DNA, 25 bp, Mus musculus
gtgagtctcagtaatcctgcaccaa

SEQ ID NO: 700133 - DNA, 25 bp, Mus musculus
gtgagtctcagttatcctgcaccaa

SEQ ID NO: 700134 - DNA, 25 bp, Mus musculus
gtgagtctccttacagaaaacccgg

SEQ ID NO: 700135 - DNA, 25 bp, Mus musculus
gtgagtctccttcggtacacaaacc

SEQ ID NO: 700136 - DNA, 25 bp, Mus musculus
gtgagtctccttgggtacacaaacc

SEQ ID NO: 700137 - DNA, 25 bp, Mus musculus
gtgagtctcctttcagaaaacccgg

SEQ ID NO: 700138 - DNA, 25 bp, Mus musculus
gtgagtctcttaaatggtgctgttt

SEQ ID NO: 700139 - DNA, 25 bp, Mus musculus
gtgagtctcttatatggtgctgttt

SEQ ID NO: 700140 - DNA, 25 bp, Mus musculus
gtgagtctgacaaattccactgtga

SEQ ID NO: 700141 - DNA, 25 bp, Mus musculus
gtgagtctgacatattccactgtga

SEQ ID NO: 700142 - DNA, 25 bp, Mus musculus
gtgagtctgaccagtaaatccgcca

SEQ ID NO: 700143 - DNA, 25 bp, Mus musculus
gtgagtctgacctgtaaatccgcca

SEQ ID NO: 700144 - DNA, 25 bp, Mus musculus
gtgagtctgagaatcatctctatct

SEQ ID NO: 700145 - DNA, 25 bp, Mus musculus
gtgagtctgagattcatctctatct

SEQ ID NO: 700146 - DNA, 25 bp, Mus musculus
gtgagtctgctaccacggaatggaa

SEQ ID NO: 700147 - DNA, 25 bp, Mus musculus
gtgagtctgctagcacggaatggaa

SEQ ID NO: 700148 - DNA, 25 bp, Mus musculus
gtgagtctggacaccccagggaaag

SEQ ID NO: 700149 - DNA, 25 bp, Mus musculus
gtgagtctggactccccagggaaag

SEQ ID NO: 700150 - DNA, 25 bp, Mus musculus
gtgagtctggctcaagaccgacatt

SEQ ID NO: 700151 - DNA, 25 bp, Mus musculus
gtgagtctggctgaagaccgacatt

SEQ ID NO: 700152 - DNA, 25 bp, Mus musculus
gtgagtctgggcagagtccccatct

SEQ ID NO: 700153 - DNA, 25 bp, Mus musculus
gtgagtctgggctgagtccccatct

SEQ ID NO: 700154 - DNA, 25 bp, Mus musculus
gtgagtctgtgtccgtcctgcgtca

SEQ ID NO: 700155 - DNA, 25 bp, Mus musculus
gtgagtctgtgtgcgtcctgcgtca

SEQ ID NO: 700156 - DNA, 25 bp, Mus musculus
gtgagtgaaatacagcagcttgcta

SEQ ID NO: 700157 - DNA, 25 bp, Mus musculus
gtgagtgaaatagagcagcttgcta

SEQ ID NO: 700158 - DNA, 25 bp, Mus musculus
gtgagtgaacagactggtgacagac

SEQ ID NO: 700159 - DNA, 25 bp, Mus musculus
gtgagtgaacagtctggtgacagac

SEQ ID NO: 700160 - DNA, 25 bp, Mus musculus
gtgagtgaacttctcttactttcca

SEQ ID NO: 700161 - DNA, 25 bp, Mus musculus
gtgagtgaacttgtcttactttcca

SEQ ID NO: 700162 - DNA, 25 bp, Mus musculus
gtgagtgacagcatgcattttacat

SEQ ID NO: 700163 - DNA, 25 bp, Mus musculus
gtgagtgacagcttgcattttacat

SEQ ID NO: 700164 - DNA, 25 bp, Mus musculus
gtgagtgacaggatttgccgtgcac

SEQ ID NO: 700165 - DNA, 25 bp, Mus musculus
gtgagtgacaggttttgccgtgcac

SEQ ID NO: 700166 - DNA, 25 bp, Mus musculus
gtgagtgaccagcactccactgata

SEQ ID NO: 700167 - DNA, 25 bp, Mus musculus
gtgagtgaccaggactccactgata

SEQ ID NO: 700168 - DNA, 25 bp, Mus musculus
gtgagtgactaaagccagagagaat

SEQ ID NO: 700169 - DNA, 25 bp, Mus musculus
gtgagtgactaatgccagagagaat

SEQ ID NO: 700170 - DNA, 25 bp, Mus musculus
gtgagtgactggaatgaacaacatc

SEQ ID NO: 700171 - DNA, 25 bp, Mus musculus
gtgagtgactggtatgaacaacatc

SEQ ID NO: 700172 - DNA, 25 bp, Mus musculus
gtgagtgactgtaacacgtgagaag

SEQ ID NO: 700173 - DNA, 25 bp, Mus musculus
gtgagtgactgttacacgtgagaag

SEQ ID NO: 700174 - DNA, 25 bp, Mus musculus
gtgagtgagcctctcaagcagcctg

SEQ ID NO: 700175 - DNA, 25 bp, Mus musculus
gtgagtgagcctgtcaagcagcctg

SEQ ID NO: 700176 - DNA, 25 bp, Mus musculus
gtgagtgaggtactagactgctcaa

SEQ ID NO: 700177 - DNA, 25 bp, Mus musculus
gtgagtgaggtagtagactgctcaa

SEQ ID NO: 700178 - DNA, 25 bp, Mus musculus
gtgagtgaggtgaagcccacctacc

SEQ ID NO: 700179 - DNA, 25 bp, Mus musculus
gtgagtgaggtgtagcccacctacc

SEQ ID NO: 700180 - DNA, 25 bp, Mus musculus
gtgagtgatagaagcacacctgtaa

SEQ ID NO: 700181 - DNA, 25 bp, Mus musculus
gtgagtgatagatgcacacctgtaa

SEQ ID NO: 700182 - DNA, 25 bp, Mus musculus
gtgagtgatggcaaggctattgaac

SEQ ID NO: 700183 - DNA, 25 bp, Mus musculus
gtgagtgatggctaggctattgaac

SEQ ID NO: 700184 - DNA, 25 bp, Mus musculus
gtgagtgcaatcacccctttaaaga

SEQ ID NO: 700185 - DNA, 25 bp, Mus musculus
gtgagtgcaatctcccctttaaaga

SEQ ID NO: 700186 - DNA, 25 bp, Mus musculus
gtgagtgcagaacgcccacgaagaa

SEQ ID NO: 700187 - DNA, 25 bp, Mus musculus
gtgagtgcagaaggcccacgaagaa

SEQ ID NO: 700188 - DNA, 25 bp, Mus musculus
gtgagtgcatttaattggtgttaca

SEQ ID NO: 700189 - DNA, 25 bp, Mus musculus
gtgagtgcattttattggtgttaca

SEQ ID NO: 700190 - DNA, 25 bp, Mus musculus
gtgagtgccagtaaaaacctttgaa

SEQ ID NO: 700191 - DNA, 25 bp, Mus musculus
gtgagtgccagttaaaacctttgaa

SEQ ID NO: 700192 - DNA, 25 bp, Mus musculus
gtgagtgcccgaaatcctgacataa

SEQ ID NO: 700193 - DNA, 25 bp, Mus musculus
gtgagtgcccgatatcctgacataa

SEQ ID NO: 700194 - DNA, 25 bp, Mus musculus
gtgagtgcccgcaatggacattggc

SEQ ID NO: 700195 - DNA, 25 bp, Mus musculus
gtgagtgcccgctatggacattggc

SEQ ID NO: 700196 - DNA, 25 bp, Mus musculus
gtgagtgccgggactcgcgctgtca

SEQ ID NO: 700197 - DNA, 25 bp, Mus musculus
gtgagtgccgggtctcgcgctgtca

SEQ ID NO: 700198 - DNA, 25 bp, Mus musculus
gtgagtgcctggctttcttataccc

SEQ ID NO: 700199 - DNA, 25 bp, Mus musculus
gtgagtgcctgggtttcttataccc

SEQ ID NO: 700200 - DNA, 25 bp, Mus musculus
gtgagtgcgaccacggcttcacgca

SEQ ID NO: 700201 - DNA, 25 bp, Mus musculus
gtgagtgcgacctcggcttcacgca

SEQ ID NO: 700202 - DNA, 25 bp, Mus musculus
gtgagtgcgcagagccttcgctgcc

SEQ ID NO: 700203 - DNA, 25 bp, Mus musculus
gtgagtgcgcagtgccttcgctgcc

SEQ ID NO: 700204 - DNA, 25 bp, Mus musculus
gtgagtgctcgccacacaagtgtgc

SEQ ID NO: 700205 - DNA, 25 bp, Mus musculus
gtgagtgctcgcgacacaagtgtgc

SEQ ID NO: 700206 - DNA, 25 bp, Mus musculus
gtgagtgctcttaacttactatagg

SEQ ID NO: 700207 - DNA, 25 bp, Mus musculus
gtgagtgctctttacttactatagg

SEQ ID NO: 700208 - DNA, 25 bp, Mus musculus
gtgagtgctgtaagcgctatggtta

SEQ ID NO: 700209 - DNA, 25 bp, Mus musculus
gtgagtgctgtatgcgctatggtta

SEQ ID NO: 700210 - DNA, 25 bp, Mus musculus
gtgagtgcttggagtgttcttccta

SEQ ID NO: 700211 - DNA, 25 bp, Mus musculus
gtgagtgcttggtgtgttcttccta

SEQ ID NO: 700212 - DNA, 25 bp, Mus musculus
gtgagtggaggcctacagtacctac

SEQ ID NO: 700213 - DNA, 25 bp, Mus musculus
gtgagtggaggcgtacagtacctac

SEQ ID NO: 700214 - DNA, 25 bp, Mus musculus
gtgagtggatcaccatctcgcaacc

SEQ ID NO: 700215 - DNA, 25 bp, Mus musculus
gtgagtggatcagcatctcgcaacc

SEQ ID NO: 700216 - DNA, 25 bp, Mus musculus
gtgagtggattgaactgctactgct

SEQ ID NO: 700217 - DNA, 25 bp, Mus musculus
gtgagtggattgtactgctactgct

SEQ ID NO: 700218 - DNA, 25 bp, Mus musculus
gtgagtggcagtatacacactttaa

SEQ ID NO: 700219 - DNA, 25 bp, Mus musculus
gtgagtggcagtttacacactttaa

SEQ ID NO: 700220 - DNA, 25 bp, Mus musculus
gtgagtggcctcaagggcttgaaaa

SEQ ID NO: 700221 - DNA, 25 bp, Mus musculus
gtgagtggcctctagggcttgaaaa

SEQ ID NO: 700222 - DNA, 25 bp, Mus musculus
gtgagtggcgtcagctaatgctgct

SEQ ID NO: 700223 - DNA, 25 bp, Mus musculus
gtgagtggcgtctgctaatgctgct

SEQ ID NO: 700224 - DNA, 25 bp, Mus musculus
gtgagtggctcaccaacaaaatcca

SEQ ID NO: 700225 - DNA, 25 bp, Mus musculus
gtgagtggctcagcaacaaaatcca

SEQ ID NO: 700226 - DNA, 25 bp, Mus musculus
gtgagtggctgaccacccatgctaa

SEQ ID NO: 700227 - DNA, 25 bp, Mus musculus
gtgagtggctgagcacccatgctaa

SEQ ID NO: 700228 - DNA, 25 bp, Mus musculus
gtgagtggctttaaggctacacagc

SEQ ID NO: 700229 - DNA, 25 bp, Mus musculus
gtgagtggcttttaggctacacagc

SEQ ID NO: 700230 - DNA, 25 bp, Mus musculus
gtgagtggtactccattgaataagt

SEQ ID NO: 700231 - DNA, 25 bp, Mus musculus
gtgagtggtactgcattgaataagt

SEQ ID NO: 700232 - DNA, 25 bp, Mus musculus
gtgagtggtgccagctactaaagaa

SEQ ID NO: 700233 - DNA, 25 bp, Mus musculus
gtgagtggtgcctgctactaaagaa

SEQ ID NO: 700234 - DNA, 25 bp, Mus musculus
gtgagtgtaattatccctgcctttt

SEQ ID NO: 700235 - DNA, 25 bp, Mus musculus
gtgagtgtaattttccctgcctttt

SEQ ID NO: 700236 - DNA, 25 bp, Mus musculus
gtgagtgtagttcacaggccgcaca

SEQ ID NO: 700237 - DNA, 25 bp, Mus musculus
gtgagtgtagttgacaggccgcaca

SEQ ID NO: 700238 - DNA, 25 bp, Mus musculus
gtgagtgtattaatgggtagcacaa

SEQ ID NO: 700239 - DNA, 25 bp, Mus musculus
gtgagtgtattattgggtagcacaa

SEQ ID NO: 700240 - DNA, 25 bp, Mus musculus
gtgagtgtcacacaggccctagaag

SEQ ID NO: 700241 - DNA, 25 bp, Mus musculus
gtgagtgtcacagaggccctagaag

SEQ ID NO: 700242 - DNA, 25 bp, Mus musculus
gtgagtgtcatcactatccgtagtg

SEQ ID NO: 700243 - DNA, 25 bp, Mus musculus
gtgagtgtcatctctatccgtagtg

SEQ ID NO: 700244 - DNA, 25 bp, Mus musculus
gtgagtgtccctcgatcacagcatc

SEQ ID NO: 700245 - DNA, 25 bp, Mus musculus
gtgagtgtccctggatcacagcatc

SEQ ID NO: 700246 - DNA, 25 bp, Mus musculus
gtgagtgtcctgagtaacctttata

SEQ ID NO: 700247 - DNA, 25 bp, Mus musculus
gtgagtgtcctgtgtaacctttata

SEQ ID NO: 700248 - DNA, 25 bp, Mus musculus
gtgagtgtctgcatgtgtcagcttt

SEQ ID NO: 700249 - DNA, 25 bp, Mus musculus
gtgagtgtctgcttgtgtcagcttt

SEQ ID NO: 700250 - DNA, 25 bp, Mus musculus
gtgagtgtcttactttcacaggcct

SEQ ID NO: 700251 - DNA, 25 bp, Mus musculus
gtgagtgtcttagtttcacaggcct

SEQ ID NO: 700252 - DNA, 25 bp, Mus musculus
gtgagtgtgctaaaaggaagtttgc

SEQ ID NO: 700253 - DNA, 25 bp, Mus musculus
gtgagtgtgctataaggaagtttgc

SEQ ID NO: 700254 - DNA, 25 bp, Mus musculus
gtgagtgtgcttagaaatatacttc

SEQ ID NO: 700255 - DNA, 25 bp, Mus musculus
gtgagtgtgctttgaaatatacttc

SEQ ID NO: 700256 - DNA, 25 bp, Mus musculus
gtgagtgttgagctgtccctatctt

SEQ ID NO: 700257 - DNA, 25 bp, Mus musculus
gtgagtgttgaggtgtccctatctt

SEQ ID NO: 700258 - DNA, 25 bp, Mus musculus
gtgagtgtttatccactcacaccct

SEQ ID NO: 700259 - DNA, 25 bp, Mus musculus
gtgagtgtttatgcactcacaccct

SEQ ID NO: 700260 - DNA, 25 bp, Mus musculus
gtgagtgttttaatgagacttccta

SEQ ID NO: 700261 - DNA, 25 bp, Mus musculus
gtgagtgttttaattccatgaatct

SEQ ID NO: 700262 - DNA, 25 bp, Mus musculus
gtgagtgttttattgagacttccta

SEQ ID NO: 700263 - DNA, 25 bp, Mus musculus
gtgagtgttttatttccatgaatct

SEQ ID NO: 700264 - DNA, 25 bp, Mus musculus
gtgagttacagcacccaagtttggc

SEQ ID NO: 700265 - DNA, 25 bp, Mus musculus
gtgagttacagctcccaagtttggc

SEQ ID NO: 700266 - DNA, 25 bp, Mus musculus
gtgagttacatgatttgctttattt

SEQ ID NO: 700267 - DNA, 25 bp, Mus musculus
gtgagttacatgttttgctttattt

SEQ ID NO: 700268 - DNA, 25 bp, Mus musculus
gtgagttaccatcttggtgtaggta

SEQ ID NO: 700269 - DNA, 25 bp, Mus musculus
gtgagttaccatgttggtgtaggta

SEQ ID NO: 700270 - DNA, 25 bp, Mus musculus
gtgagttactgcattcataaaccaa

SEQ ID NO: 700271 - DNA, 25 bp, Mus musculus
gtgagttactgctttcataaaccaa

SEQ ID NO: 700272 - DNA, 25 bp, Mus musculus
gtgagttacttcatagtgttctaaa

SEQ ID NO: 700273 - DNA, 25 bp, Mus musculus
gtgagttacttcttagtgttctaaa

SEQ ID NO: 700274 - DNA, 25 bp, Mus musculus
gtgagttagggcagcacattgcttg

SEQ ID NO: 700275 - DNA, 25 bp, Mus musculus
gtgagttagggctgcacattgcttg

SEQ ID NO: 700276 - DNA, 25 bp, Mus musculus
gtgagttagttgctttcagtccatt

SEQ ID NO: 700277 - DNA, 25 bp, Mus musculus
gtgagttagttggtttcagtccatt

SEQ ID NO: 700278 - DNA, 25 bp, Mus musculus
gtgagttagtttcctatgatccagt

SEQ ID NO: 700279 - DNA, 25 bp, Mus musculus
gtgagttagtttgctatgatccagt

SEQ ID NO: 700280 - DNA, 25 bp, Mus musculus
gtgagttattttaacacatctgtat

SEQ ID NO: 700281 - DNA, 25 bp, Mus musculus
gtgagttatttttacacatctgtat

SEQ ID NO: 700282 - DNA, 25 bp, Mus musculus
gtgagttcacctattagtggtcatt

SEQ ID NO: 700283 - DNA, 25 bp, Mus musculus
gtgagttcacctcatcttggaagct

SEQ ID NO: 700284 - DNA, 25 bp, Mus musculus
gtgagttcacctgatcttggaagct

SEQ ID NO: 700285 - DNA, 25 bp, Mus musculus
gtgagttcaccttttagtggtcatt

SEQ ID NO: 700286 - DNA, 25 bp, Mus musculus
gtgagttcactgcatattgtcctaa

SEQ ID NO: 700287 - DNA, 25 bp, Mus musculus
gtgagttcactggatattgtcctaa

SEQ ID NO: 700288 - DNA, 25 bp, Mus musculus
gtgagttcacttatgacgctgttgc

SEQ ID NO: 700289 - DNA, 25 bp, Mus musculus
gtgagttcacttctattacagggtt

SEQ ID NO: 700290 - DNA, 25 bp, Mus musculus
gtgagttcacttgtattacagggtt

SEQ ID NO: 700291 - DNA, 25 bp, Mus musculus
gtgagttcacttttgacgctgttgc

SEQ ID NO: 700292 - DNA, 25 bp, Mus musculus
gtgagttcagcaaagagatcccgga

SEQ ID NO: 700293 - DNA, 25 bp, Mus musculus
gtgagttcagcatagagatcccgga

SEQ ID NO: 700294 - DNA, 25 bp, Mus musculus
gtgagttcaggccagacaacactac

SEQ ID NO: 700295 - DNA, 25 bp, Mus musculus
gtgagttcaggcgagacaacactac

SEQ ID NO: 700296 - DNA, 25 bp, Mus musculus
gtgagttcattcagcagttcagtaa

SEQ ID NO: 700297 - DNA, 25 bp, Mus musculus
gtgagttcattctgcagttcagtaa

SEQ ID NO: 700298 - DNA, 25 bp, Mus musculus
gtgagttcatttaatggtgcccagt

SEQ ID NO: 700299 - DNA, 25 bp, Mus musculus
gtgagttcattttatggtgcccagt

SEQ ID NO: 700300 - DNA, 25 bp, Mus musculus
gtgagttccattaataaacatcgat

SEQ ID NO: 700301 - DNA, 25 bp, Mus musculus
gtgagttccatttataaacatcgat

SEQ ID NO: 700302 - DNA, 25 bp, Mus musculus
gtgagttccgcaatcaaaggttctt

SEQ ID NO: 700303 - DNA, 25 bp, Mus musculus
gtgagttccgcattcaaaggttctt

SEQ ID NO: 700304 - DNA, 25 bp, Mus musculus
gtgagttccggaagtagccaccttc

SEQ ID NO: 700305 - DNA, 25 bp, Mus musculus
gtgagttccggatgtagccaccttc

SEQ ID NO: 700306 - DNA, 25 bp, Mus musculus
gtgagttccgttatcttaagcgatt

SEQ ID NO: 700307 - DNA, 25 bp, Mus musculus
gtgagttccgttttcttaagcgatt

SEQ ID NO: 700308 - DNA, 25 bp, Mus musculus
gtgagttctaaaacatctgtgttct

SEQ ID NO: 700309 - DNA, 25 bp, Mus musculus
gtgagttctaaatcatctgtgttct

SEQ ID NO: 700310 - DNA, 25 bp, Mus musculus
gtgagttctacactttaaatggttt

SEQ ID NO: 700311 - DNA, 25 bp, Mus musculus
gtgagttctacagtttaaatggttt

SEQ ID NO: 700312 - DNA, 25 bp, Mus musculus
gtgagttctagaattcacagagaaa

SEQ ID NO: 700313 - DNA, 25 bp, Mus musculus
gtgagttctagatttcacagagaaa

SEQ ID NO: 700314 - DNA, 25 bp, Mus musculus
gtgagttctagtcactccatagcct

SEQ ID NO: 700315 - DNA, 25 bp, Mus musculus
gtgagttctagtgactccatagcct

SEQ ID NO: 700316 - DNA, 25 bp, Mus musculus
gtgagttctcagatccacgtacaca

SEQ ID NO: 700317 - DNA, 25 bp, Mus musculus
gtgagttctcagttccacgtacaca

SEQ ID NO: 700318 - DNA, 25 bp, Mus musculus
gtgagttctctcctggacagtaaag

SEQ ID NO: 700319 - DNA, 25 bp, Mus musculus
gtgagttctctcgtggacagtaaag

SEQ ID NO: 700320 - DNA, 25 bp, Mus musculus
gtgagttctgagacctcatgtcaac

SEQ ID NO: 700321 - DNA, 25 bp, Mus musculus
gtgagttctgagtcctcatgtcaac

SEQ ID NO: 700322 - DNA, 25 bp, Mus musculus
gtgagttctgatatgtgttcgtttc

SEQ ID NO: 700323 - DNA, 25 bp, Mus musculus
gtgagttctgatttgtgttcgtttc

SEQ ID NO: 700324 - DNA, 25 bp, Mus musculus
gtgagttctgcacagtcggacattt

SEQ ID NO: 700325 - DNA, 25 bp, Mus musculus
gtgagttctgcagagtcggacattt

SEQ ID NO: 700326 - DNA, 25 bp, Mus musculus
gtgagttcttcgacgccttcttcaa

SEQ ID NO: 700327 - DNA, 25 bp, Mus musculus
gtgagttcttcgtcgccttcttcaa

SEQ ID NO: 700328 - DNA, 25 bp, Mus musculus
gtgagttgaactatctttttagaga

SEQ ID NO: 700329 - DNA, 25 bp, Mus musculus
gtgagttgaactttctttttagaga

SEQ ID NO: 700330 - DNA, 25 bp, Mus musculus
gtgagttgatgactgcagtccccac

SEQ ID NO: 700331 - DNA, 25 bp, Mus musculus
gtgagttgatgagtgcagtccccac

SEQ ID NO: 700332 - DNA, 25 bp, Mus musculus
gtgagttgcttcagggcagactgca

SEQ ID NO: 700333 - DNA, 25 bp, Mus musculus
gtgagttgcttctgggcagactgca

SEQ ID NO: 700334 - DNA, 25 bp, Mus musculus
gtgagttggattaagtgtctaggaa

SEQ ID NO: 700335 - DNA, 25 bp, Mus musculus
gtgagttggatttagtgtctaggaa

SEQ ID NO: 700336 - DNA, 25 bp, Mus musculus
gtgagtttaatcaacacattttctg

SEQ ID NO: 700337 - DNA, 25 bp, Mus musculus
gtgagtttaatctacacattttctg

SEQ ID NO: 700338 - DNA, 25 bp, Mus musculus
gtgagtttacctccttattattaag

SEQ ID NO: 700339 - DNA, 25 bp, Mus musculus
gtgagtttacctgcttattattaag

SEQ ID NO: 700340 - DNA, 25 bp, Mus musculus
gtgagtttacttattaattacagag

SEQ ID NO: 700341 - DNA, 25 bp, Mus musculus
gtgagtttactttttaattacagag

SEQ ID NO: 700342 - DNA, 25 bp, Mus musculus
gtgagtttatcaccattttagtttt

SEQ ID NO: 700343 - DNA, 25 bp, Mus musculus
gtgagtttatcagcattttagtttt

SEQ ID NO: 700344 - DNA, 25 bp, Mus musculus
gtgagtttatggacaaggtcatcaa

SEQ ID NO: 700345 - DNA, 25 bp, Mus musculus
gtgagtttatggctacacagtaaaa

SEQ ID NO: 700346 - DNA, 25 bp, Mus musculus
gtgagtttatgggtacacagtaaaa

SEQ ID NO: 700347 - DNA, 25 bp, Mus musculus
gtgagtttatggtcaaggtcatcaa

SEQ ID NO: 700348 - DNA, 25 bp, Mus musculus
gtgagtttcagaatagcctggtata

SEQ ID NO: 700349 - DNA, 25 bp, Mus musculus
gtgagtttcagattagcctggtata

SEQ ID NO: 700350 - DNA, 25 bp, Mus musculus
gtgagtttccaaagagcacttgaga

SEQ ID NO: 700351 - DNA, 25 bp, Mus musculus
gtgagtttccaatgagcacttgaga

SEQ ID NO: 700352 - DNA, 25 bp, Mus musculus
gtgagtttcccactaaatgtggctt

SEQ ID NO: 700353 - DNA, 25 bp, Mus musculus
gtgagtttcccagtaaatgtggctt

SEQ ID NO: 700354 - DNA, 25 bp, Mus musculus
gtgagtttcctaaagtgtgttcata

SEQ ID NO: 700355 - DNA, 25 bp, Mus musculus
gtgagtttcctatagtgtgttcata

SEQ ID NO: 700356 - DNA, 25 bp, Mus musculus
gtgagtttccttctttcttgttatc

SEQ ID NO: 700357 - DNA, 25 bp, Mus musculus
gtgagtttccttgtttcttgttatc

SEQ ID NO: 700358 - DNA, 25 bp, Mus musculus
gtgagtttctctagttccactttga

SEQ ID NO: 700359 - DNA, 25 bp, Mus musculus
gtgagtttctcttgttccactttga

SEQ ID NO: 700360 - DNA, 25 bp, Mus musculus
gtgagtttctgtcaacttactgatg

SEQ ID NO: 700361 - DNA, 25 bp, Mus musculus
gtgagtttctgtgaacttactgatg

SEQ ID NO: 700362 - DNA, 25 bp, Mus musculus
gtgagtttgtgtacaataaccccaa

SEQ ID NO: 700363 - DNA, 25 bp, Mus musculus
gtgagtttgtgttcaataaccccaa

SEQ ID NO: 700364 - DNA, 25 bp, Mus musculus
gtgagtttgttgaggtcaaagagca

SEQ ID NO: 700365 - DNA, 25 bp, Mus musculus
gtgagtttgttgtggtcaaagagca

SEQ ID NO: 700366 - DNA, 25 bp, Mus musculus
gtgagttttaaaatctactgcttgg

SEQ ID NO: 700367 - DNA, 25 bp, Mus musculus
gtgagttttaaattctactgcttgg

SEQ ID NO: 700368 - DNA, 25 bp, Mus musculus
gtgagttttgagacagccacagcaa

SEQ ID NO: 700369 - DNA, 25 bp, Mus musculus
gtgagttttgagtcagccacagcaa

SEQ ID NO: 700370 - DNA, 25 bp, Mus musculus
gtgagttttgttacatgagtagaca

SEQ ID NO: 700371 - DNA, 25 bp, Mus musculus
gtgagttttgtttcatgagtagaca

SEQ ID NO: 700372 - DNA, 25 bp, Mus musculus
gtgagtttttccctatgtgactgaa

SEQ ID NO: 700373 - DNA, 25 bp, Mus musculus
gtgagtttttccgtatgtgactgaa

SEQ ID NO: 700374 - DNA, 25 bp, Mus musculus
gtgataaaatggactaagggctctt

SEQ ID NO: 700375 - DNA, 25 bp, Mus musculus
gtgataaaatggtctaagggctctt

SEQ ID NO: 700376 - DNA, 25 bp, Mus musculus
gtgataaaccatctgatctctcagc

SEQ ID NO: 700377 - DNA, 25 bp, Mus musculus
gtgataaaccatgtgatctctcagc

SEQ ID NO: 700378 - DNA, 25 bp, Mus musculus
gtgataaactgtcctttaccgctcc

SEQ ID NO: 700379 - DNA, 25 bp, Mus musculus
gtgataaactgtgctttaccgctcc

SEQ ID NO: 700380 - DNA, 25 bp, Mus musculus
gtgataaatctcaacgtgccctttg

SEQ ID NO: 700381 - DNA, 25 bp, Mus musculus
gtgataaatctctacgtgccctttg

SEQ ID NO: 700382 - DNA, 25 bp, Mus musculus
gtgataaatttcattagtcccaata

SEQ ID NO: 700383 - DNA, 25 bp, Mus musculus
gtgataaatttctttagtcccaata

SEQ ID NO: 700384 - DNA, 25 bp, Mus musculus
gtgataaattttcattcaggcttat

SEQ ID NO: 700385 - DNA, 25 bp, Mus musculus
gtgataaattttgattcaggcttat

SEQ ID NO: 700386 - DNA, 25 bp, Mus musculus
gtgataacattgacacccggactgt

SEQ ID NO: 700387 - DNA, 25 bp, Mus musculus
gtgataacattgtcacccggactgt

SEQ ID NO: 700388 - DNA, 25 bp, Mus musculus
gtgataaccaatatcctcataggtg

SEQ ID NO: 700389 - DNA, 25 bp, Mus musculus
gtgataaccaatttcctcataggtg

SEQ ID NO: 700390 - DNA, 25 bp, Mus musculus
gtgataacccagataacccactttg

SEQ ID NO: 700391 - DNA, 25 bp, Mus musculus
gtgataacccagttaacccactttg

SEQ ID NO: 700392 - DNA, 25 bp, Mus musculus
gtgataacccctcgatgttgctttc

SEQ ID NO: 700393 - DNA, 25 bp, Mus musculus
gtgataacccctggatgttgctttc

SEQ ID NO: 700394 - DNA, 25 bp, Mus musculus
gtgataacctgtcttgactctttat

SEQ ID NO: 700395 - DNA, 25 bp, Mus musculus
gtgataacctgtgttgactctttat

SEQ ID NO: 700396 - DNA, 25 bp, Mus musculus
gtgataactcaaaagcccaagggat

SEQ ID NO: 700397 - DNA, 25 bp, Mus musculus
gtgataactcaatagcccaagggat

SEQ ID NO: 700398 - DNA, 25 bp, Mus musculus
gtgataactcttattaaattcttat

SEQ ID NO: 700399 - DNA, 25 bp, Mus musculus
gtgataactctttttaaattcttat

SEQ ID NO: 700400 - DNA, 25 bp, Mus musculus
gtgataagaaatatgtagggagtgt

SEQ ID NO: 700401 - DNA, 25 bp, Mus musculus
gtgataagaaatttgtagggagtgt

SEQ ID NO: 700402 - DNA, 25 bp, Mus musculus
gtgataagaaccaaacacgggtcct

SEQ ID NO: 700403 - DNA, 25 bp, Mus musculus
gtgataagaacctaacacgggtcct

SEQ ID NO: 700404 - DNA, 25 bp, Mus musculus
gtgataagaagacggaaaccccacg

SEQ ID NO: 700405 - DNA, 25 bp, Mus musculus
gtgataagaagagggaaaccccacg

SEQ ID NO: 700406 - DNA, 25 bp, Mus musculus
gtgataagactgctcatttttaatg

SEQ ID NO: 700407 - DNA, 25 bp, Mus musculus
gtgataagactggtcatttttaatg

SEQ ID NO: 700408 - DNA, 25 bp, Mus musculus
gtgataagatccacctactttttca

SEQ ID NO: 700409 - DNA, 25 bp, Mus musculus
gtgataagatcctcctactttttca

SEQ ID NO: 700410 - DNA, 25 bp, Mus musculus
gtgataagcattaaaagcacaaaca

SEQ ID NO: 700411 - DNA, 25 bp, Mus musculus
gtgataagcatttaaagcacaaaca

SEQ ID NO: 700412 - DNA, 25 bp, Mus musculus
gtgataagccctcgctacatccata

SEQ ID NO: 700413 - DNA, 25 bp, Mus musculus
gtgataagccctggctacatccata

SEQ ID NO: 700414 - DNA, 25 bp, Mus musculus
gtgataagccgtacattgcaccttc

SEQ ID NO: 700415 - DNA, 25 bp, Mus musculus
gtgataagccgttcattgcaccttc

SEQ ID NO: 700416 - DNA, 25 bp, Mus musculus
gtgataaggtgtactggacctgccg

SEQ ID NO: 700417 - DNA, 25 bp, Mus musculus
gtgataaggtgttctggacctgccg

SEQ ID NO: 700418 - DNA, 25 bp, Mus musculus
gtgataataccgaaggatcccaaaa

SEQ ID NO: 700419 - DNA, 25 bp, Mus musculus
gtgataataccgtaggatcccaaaa

SEQ ID NO: 700420 - DNA, 25 bp, Mus musculus
gtgataatcataccttccaccaaag

SEQ ID NO: 700421 - DNA, 25 bp, Mus musculus
gtgataatcatagcttccaccaaag

SEQ ID NO: 700422 - DNA, 25 bp, Mus musculus
gtgataatccagcagacactccacc

SEQ ID NO: 700423 - DNA, 25 bp, Mus musculus
gtgataatccaggagacactccacc

SEQ ID NO: 700424 - DNA, 25 bp, Mus musculus
gtgataatcctaaacacgggaccat

SEQ ID NO: 700425 - DNA, 25 bp, Mus musculus
gtgataatcctatacacgggaccat

SEQ ID NO: 700426 - DNA, 25 bp, Mus musculus
gtgataatctgacactcctgctaac

SEQ ID NO: 700427 - DNA, 25 bp, Mus musculus
gtgataatctgagactcctgctaac

SEQ ID NO: 700428 - DNA, 25 bp, Mus musculus
gtgataatggcactcctgcccagac

SEQ ID NO: 700429 - DNA, 25 bp, Mus musculus
gtgataatggcagtcctgcccagac

SEQ ID NO: 700430 - DNA, 25 bp, Mus musculus
gtgataatgtaacacctctggctgt

SEQ ID NO: 700431 - DNA, 25 bp, Mus musculus
gtgataatgtaagacctctggctgt

SEQ ID NO: 700432 - DNA, 25 bp, Mus musculus
gtgataatgtagaccctccaaaatt

SEQ ID NO: 700433 - DNA, 25 bp, Mus musculus
gtgataatgtagtccctccaaaatt

SEQ ID NO: 700434 - DNA, 25 bp, Mus musculus
gtgatacaaacaagccgaattacct

SEQ ID NO: 700435 - DNA, 25 bp, Mus musculus
gtgatacaaacatgccgaattacct

SEQ ID NO: 700436 - DNA, 25 bp, Mus musculus
gtgatacaaaccaataacccaaagt

SEQ ID NO: 700437 - DNA, 25 bp, Mus musculus
gtgatacaaaccactaataacccca

SEQ ID NO: 700438 - DNA, 25 bp, Mus musculus
gtgatacaaacctataacccaaagt

SEQ ID NO: 700439 - DNA, 25 bp, Mus musculus
gtgatacaaacctctaataacccca

SEQ ID NO: 700440 - DNA, 25 bp, Mus musculus
gtgatacaacagcatccagttcttc

SEQ ID NO: 700441 - DNA, 25 bp, Mus musculus
gtgatacaacaggatccagttcttc

SEQ ID NO: 700442 - DNA, 25 bp, Mus musculus
gtgatacacatcattaatcatctca

SEQ ID NO: 700443 - DNA, 25 bp, Mus musculus
gtgatacacatctttaatcatctca

SEQ ID NO: 700444 - DNA, 25 bp, Mus musculus
gtgatacaccccacagagatctatg

SEQ ID NO: 700445 - DNA, 25 bp, Mus musculus
gtgatacacccctcagagatctatg

SEQ ID NO: 700446 - DNA, 25 bp, Mus musculus
gtgatacactggcagatacacagat

SEQ ID NO: 700447 - DNA, 25 bp, Mus musculus
gtgatacactgggagatacacagat

SEQ ID NO: 700448 - DNA, 25 bp, Mus musculus
gtgatacactgtaatctgccttctg

SEQ ID NO: 700449 - DNA, 25 bp, Mus musculus
gtgatacactgttatctgccttctg

SEQ ID NO: 700450 - DNA, 25 bp, Mus musculus
gtgatacagaggaagcccacgtccc

SEQ ID NO: 700451 - DNA, 25 bp, Mus musculus
gtgatacagaggtagcccacgtccc

SEQ ID NO: 700452 - DNA, 25 bp, Mus musculus
gtgatacagcaaagcgcacgcagct

SEQ ID NO: 700453 - DNA, 25 bp, Mus musculus
gtgatacagcaatgcgcacgcagct

SEQ ID NO: 700454 - DNA, 25 bp, Mus musculus
gtgatacatgaaccatagggctaaa

SEQ ID NO: 700455 - DNA, 25 bp, Mus musculus
gtgatacatgaagcatagggctaaa

SEQ ID NO: 700456 - DNA, 25 bp, Mus musculus
gtgatacatgcaagacatgccctaa

SEQ ID NO: 700457 - DNA, 25 bp, Mus musculus
gtgatacatgcatgacatgccctaa

SEQ ID NO: 700458 - DNA, 25 bp, Mus musculus
gtgataccaaaccatgcaagtctga

SEQ ID NO: 700459 - DNA, 25 bp, Mus musculus
gtgataccaaacgatgcaagtctga

SEQ ID NO: 700460 - DNA, 25 bp, Mus musculus
gtgataccaacaagggcatcccggg

SEQ ID NO: 700461 - DNA, 25 bp, Mus musculus
gtgataccaacatgggcatcccggg

SEQ ID NO: 700462 - DNA, 25 bp, Mus musculus
gtgataccaccacatcagagtgaca

SEQ ID NO: 700463 - DNA, 25 bp, Mus musculus
gtgataccaccagatcagagtgaca

SEQ ID NO: 700464 - DNA, 25 bp, Mus musculus
gtgataccacgtctttttcaaacca

SEQ ID NO: 700465 - DNA, 25 bp, Mus musculus
gtgataccacgtgtttttcaaacca

SEQ ID NO: 700466 - DNA, 25 bp, Mus musculus
gtgataccatctacctagccaacta

SEQ ID NO: 700467 - DNA, 25 bp, Mus musculus
gtgataccatcttcctagccaacta

SEQ ID NO: 700468 - DNA, 25 bp, Mus musculus
gtgataccattcagctgattctcca

SEQ ID NO: 700469 - DNA, 25 bp, Mus musculus
gtgataccattctgctgattctcca

SEQ ID NO: 700470 - DNA, 25 bp, Mus musculus
gtgatacccaccactcttaagagga

SEQ ID NO: 700471 - DNA, 25 bp, Mus musculus
gtgatacccacctctcttaagagga

SEQ ID NO: 700472 - DNA, 25 bp, Mus musculus
gtgatacccttgaataacagctagg

SEQ ID NO: 700473 - DNA, 25 bp, Mus musculus
gtgatacccttgtataacagctagg

SEQ ID NO: 700474 - DNA, 25 bp, Mus musculus
gtgatacctacaaagatggccgcgt

SEQ ID NO: 700475 - DNA, 25 bp, Mus musculus
gtgatacctacatagatggccgcgt

SEQ ID NO: 700476 - DNA, 25 bp, Mus musculus
gtgatacctccaactctgggatttt

SEQ ID NO: 700477 - DNA, 25 bp, Mus musculus
gtgatacctccatctctgggatttt

SEQ ID NO: 700478 - DNA, 25 bp, Mus musculus
gtgatacctgaaatctgcttcccag

SEQ ID NO: 700479 - DNA, 25 bp, Mus musculus
gtgatacctgaattctgcttcccag

SEQ ID NO: 700480 - DNA, 25 bp, Mus musculus
gtgatacctggacaagtggtcagtt

SEQ ID NO: 700481 - DNA, 25 bp, Mus musculus
gtgatacctggagaagtggtcagtt

SEQ ID NO: 700482 - DNA, 25 bp, Mus musculus
gtgataccttaacccatatgctttg

SEQ ID NO: 700483 - DNA, 25 bp, Mus musculus
gtgataccttaagccatatgctttg

SEQ ID NO: 700484 - DNA, 25 bp, Mus musculus
gtgataccttgacttttccactcga

SEQ ID NO: 700485 - DNA, 25 bp, Mus musculus
gtgataccttgagttttccactcga

SEQ ID NO: 700486 - DNA, 25 bp, Mus musculus
gtgataccttgtaatgcttctgaaa

SEQ ID NO: 700487 - DNA, 25 bp, Mus musculus
gtgataccttgttatgcttctgaaa

SEQ ID NO: 700488 - DNA, 25 bp, Mus musculus
gtgatacggtcaccactgcagtcct

SEQ ID NO: 700489 - DNA, 25 bp, Mus musculus
gtgatacggtcagcactgcagtcct

SEQ ID NO: 700490 - DNA, 25 bp, Mus musculus
gtgatacgtctcaatcacactctgt

SEQ ID NO: 700491 - DNA, 25 bp, Mus musculus
gtgatacgtctctatcacactctgt

SEQ ID NO: 700492 - DNA, 25 bp, Mus musculus
gtgatactaattacctcttgttctg

SEQ ID NO: 700493 - DNA, 25 bp, Mus musculus
gtgatactaatttcctcttgttctg

SEQ ID NO: 700494 - DNA, 25 bp, Mus musculus
gtgatactcatactatagtcttctg

SEQ ID NO: 700495 - DNA, 25 bp, Mus musculus
gtgatactcatagtatagtcttctg

SEQ ID NO: 700496 - DNA, 25 bp, Mus musculus
gtgatactcctacttgataatgtga

SEQ ID NO: 700497 - DNA, 25 bp, Mus musculus
gtgatactcctagttgataatgtga

SEQ ID NO: 700498 - DNA, 25 bp, Mus musculus
gtgatactgttgaaccttagctagg

SEQ ID NO: 700499 - DNA, 25 bp, Mus musculus
gtgatactgttgtaccttagctagg

SEQ ID NO: 700500 - DNA, 25 bp, Mus musculus
gtgatacttatcaggcgcattttta

SEQ ID NO: 700501 - DNA, 25 bp, Mus musculus
gtgatacttatctggcgcattttta

SEQ ID NO: 700502 - DNA, 25 bp, Mus musculus
gtgatacttcatatcatccatttac

SEQ ID NO: 700503 - DNA, 25 bp, Mus musculus
gtgatacttcatttcatccatttac

SEQ ID NO: 700504 - DNA, 25 bp, Mus musculus
gtgatactttctaaccttgggacct

SEQ ID NO: 700505 - DNA, 25 bp, Mus musculus
gtgatactttcttaccttgggacct

SEQ ID NO: 700506 - DNA, 25 bp, Mus musculus
gtgatactttgaatacttctttcca

SEQ ID NO: 700507 - DNA, 25 bp, Mus musculus
gtgatactttgattacttctttcca

SEQ ID NO: 700508 - DNA, 25 bp, Mus musculus
gtgatagaacacatgcctcgcatgt

SEQ ID NO: 700509 - DNA, 25 bp, Mus musculus
gtgatagaacacttgcctcgcatgt

SEQ ID NO: 700510 - DNA, 25 bp, Mus musculus
gtgatagaagatcctgttgccctcc

SEQ ID NO: 700511 - DNA, 25 bp, Mus musculus
gtgatagaagatgctgttgccctcc

SEQ ID NO: 700512 - DNA, 25 bp, Mus musculus
gtgatagaatctaccaagccagaga

SEQ ID NO: 700513 - DNA, 25 bp, Mus musculus
gtgatagaatcttccaagccagaga

SEQ ID NO: 700514 - DNA, 25 bp, Mus musculus
gtgatagatctgcaccctgtggagc

SEQ ID NO: 700515 - DNA, 25 bp, Mus musculus
gtgatagatctggaccctgtggagc

SEQ ID NO: 700516 - DNA, 25 bp, Mus musculus
gtgatagcaaacaactactgttatt

SEQ ID NO: 700517 - DNA, 25 bp, Mus musculus
gtgatagcaaactactactgttatt

SEQ ID NO: 700518 - DNA, 25 bp, Mus musculus
gtgatagcaatcagctggcctggtt

SEQ ID NO: 700519 - DNA, 25 bp, Mus musculus
gtgatagcaatctgctggcctggtt

SEQ ID NO: 700520 - DNA, 25 bp, Mus musculus
gtgatagcacaaaccgaggcatgtt

SEQ ID NO: 700521 - DNA, 25 bp, Mus musculus
gtgatagcacaatccgaggcatgtt

SEQ ID NO: 700522 - DNA, 25 bp, Mus musculus
gtgatagcacacctagctttcagaa

SEQ ID NO: 700523 - DNA, 25 bp, Mus musculus
gtgatagcacacgtagctttcagaa

SEQ ID NO: 700524 - DNA, 25 bp, Mus musculus
gtgatagcaggtcagcccctggaat

SEQ ID NO: 700525 - DNA, 25 bp, Mus musculus
gtgatagcaggtgagcccctggaat

SEQ ID NO: 700526 - DNA, 25 bp, Mus musculus
gtgatagcatacactcatgaactac

SEQ ID NO: 700527 - DNA, 25 bp, Mus musculus
gtgatagcatactctcatgaactac

SEQ ID NO: 700528 - DNA, 25 bp, Mus musculus
gtgatagcatatctacttccataaa

SEQ ID NO: 700529 - DNA, 25 bp, Mus musculus
gtgatagcatatgtacttccataaa

SEQ ID NO: 700530 - DNA, 25 bp, Mus musculus
gtgatagccctgattatctctccaa

SEQ ID NO: 700531 - DNA, 25 bp, Mus musculus
gtgatagccctgtttatctctccaa

SEQ ID NO: 700532 - DNA, 25 bp, Mus musculus
gtgataggaacacacccagggtccc

SEQ ID NO: 700533 - DNA, 25 bp, Mus musculus
gtgataggaacagacccagggtccc

SEQ ID NO: 700534 - DNA, 25 bp, Mus musculus
gtgataggactactggctgctgccc

SEQ ID NO: 700535 - DNA, 25 bp, Mus musculus
gtgataggactagtggctgctgccc

SEQ ID NO: 700536 - DNA, 25 bp, Mus musculus
gtgataggcatacagttacttgata

SEQ ID NO: 700537 - DNA, 25 bp, Mus musculus
gtgataggcatagagttacttgata

SEQ ID NO: 700538 - DNA, 25 bp, Mus musculus
gtgataggcatccttgttaccgtcc

SEQ ID NO: 700539 - DNA, 25 bp, Mus musculus
gtgataggcatcgttgttaccgtcc

SEQ ID NO: 700540 - DNA, 25 bp, Mus musculus
gtgataggtagactcttagtgttaa

SEQ ID NO: 700541 - DNA, 25 bp, Mus musculus
gtgataggtagagtcttagtgttaa

SEQ ID NO: 700542 - DNA, 25 bp, Mus musculus
gtgataggtataagtccacaacctt

SEQ ID NO: 700543 - DNA, 25 bp, Mus musculus
gtgataggtatatgtccacaacctt

SEQ ID NO: 700544 - DNA, 25 bp, Mus musculus
gtgatagtacacacttgtcattgaa

SEQ ID NO: 700545 - DNA, 25 bp, Mus musculus
gtgatagtacactcttgtcattgaa

SEQ ID NO: 700546 - DNA, 25 bp, Mus musculus
gtgatagtatggatgctggcgtctt

SEQ ID NO: 700547 - DNA, 25 bp, Mus musculus
gtgatagtatggttgctggcgtctt

SEQ ID NO: 700548 - DNA, 25 bp, Mus musculus
gtgatagtccataactgcctagggt

SEQ ID NO: 700549 - DNA, 25 bp, Mus musculus
gtgatagtccattactgcctagggt

SEQ ID NO: 700550 - DNA, 25 bp, Mus musculus
gtgatagtcgaactgctggagccct

SEQ ID NO: 700551 - DNA, 25 bp, Mus musculus
gtgatagtcgaagtgctggagccct

SEQ ID NO: 700552 - DNA, 25 bp, Mus musculus
gtgatagtctcacatcttccaaaaa

SEQ ID NO: 700553 - DNA, 25 bp, Mus musculus
gtgatagtctcagatcttccaaaaa

SEQ ID NO: 700554 - DNA, 25 bp, Mus musculus
gtgatagtgctgaggccaagcccca

SEQ ID NO: 700555 - DNA, 25 bp, Mus musculus
gtgatagtgctgtggccaagcccca

SEQ ID NO: 700556 - DNA, 25 bp, Mus musculus
gtgatagtgcttatcccagtggaga

SEQ ID NO: 700557 - DNA, 25 bp, Mus musculus
gtgatagtgcttttcccagtggaga

SEQ ID NO: 700558 - DNA, 25 bp, Mus musculus
gtgatagtttgcatcatgctaagat

SEQ ID NO: 700559 - DNA, 25 bp, Mus musculus
gtgatagtttgcttcatgctaagat

SEQ ID NO: 700560 - DNA, 25 bp, Mus musculus
gtgatatacaaaagactaaccaaat

SEQ ID NO: 700561 - DNA, 25 bp, Mus musculus
gtgatatacaaatgactaaccaaat

SEQ ID NO: 700562 - DNA, 25 bp, Mus musculus
gtgatatactgacttcttcccagaa

SEQ ID NO: 700563 - DNA, 25 bp, Mus musculus
gtgatatactgagttcttcccagaa

SEQ ID NO: 700564 - DNA, 25 bp, Mus musculus
gtgatatatactatgctccagttaa

SEQ ID NO: 700565 - DNA, 25 bp, Mus musculus
gtgatatatactttgctccagttaa

SEQ ID NO: 700566 - DNA, 25 bp, Mus musculus
gtgatatattacaccagagagatac

SEQ ID NO: 700567 - DNA, 25 bp, Mus musculus
gtgatatattactccagagagatac

SEQ ID NO: 700568 - DNA, 25 bp, Mus musculus
gtgatatatttgattctgtagcaaa

SEQ ID NO: 700569 - DNA, 25 bp, Mus musculus
gtgatatatttgtttctgtagcaaa

SEQ ID NO: 700570 - DNA, 25 bp, Mus musculus
gtgatatcacacctggctgaacctt

SEQ ID NO: 700571 - DNA, 25 bp, Mus musculus
gtgatatcacacgtggctgaacctt

SEQ ID NO: 700572 - DNA, 25 bp, Mus musculus
gtgatatcacctataaaccgttcca

SEQ ID NO: 700573 - DNA, 25 bp, Mus musculus
gtgatatcacctttaaaccgttcca

SEQ ID NO: 700574 - DNA, 25 bp, Mus musculus
gtgatatcacttcatacctgtcaag

SEQ ID NO: 700575 - DNA, 25 bp, Mus musculus
gtgatatcacttgatacctgtcaag

SEQ ID NO: 700576 - DNA, 25 bp, Mus musculus
gtgatatcatctatgctggcgagaa

SEQ ID NO: 700577 - DNA, 25 bp, Mus musculus
gtgatatcatctttgctggcgagaa

SEQ ID NO: 700578 - DNA, 25 bp, Mus musculus
gtgatatcatttacttcttacctgt

SEQ ID NO: 700579 - DNA, 25 bp, Mus musculus
gtgatatcattttcttcttacctgt

SEQ ID NO: 700580 - DNA, 25 bp, Mus musculus
gtgatatcctttacctctcattgat

SEQ ID NO: 700581 - DNA, 25 bp, Mus musculus
gtgatatccttttcctctcattgat

SEQ ID NO: 700582 - DNA, 25 bp, Mus musculus
gtgatatcgtatctgtttgtcccgg

SEQ ID NO: 700583 - DNA, 25 bp, Mus musculus
gtgatatcgtatgtgtttgtcccgg

SEQ ID NO: 700584 - DNA, 25 bp, Mus musculus
gtgatatctcgtccaaaatctgaca

SEQ ID NO: 700585 - DNA, 25 bp, Mus musculus
gtgatatctcgtgcaaaatctgaca

SEQ ID NO: 700586 - DNA, 25 bp, Mus musculus
gtgatatctgtcaccctgatgaaaa

SEQ ID NO: 700587 - DNA, 25 bp, Mus musculus
gtgatatctgtctccctgatgaaaa

SEQ ID NO: 700588 - DNA, 25 bp, Mus musculus
gtgatatgatggctggccacgccat

SEQ ID NO: 700589 - DNA, 25 bp, Mus musculus
gtgatatgatgggtggccacgccat

SEQ ID NO: 700590 - DNA, 25 bp, Mus musculus
gtgatatgcatgattcaagtggtat

SEQ ID NO: 700591 - DNA, 25 bp, Mus musculus
gtgatatgcatgtttcaagtggtat

SEQ ID NO: 700592 - DNA, 25 bp, Mus musculus
gtgatatgtaaaacccacgagtacc

SEQ ID NO: 700593 - DNA, 25 bp, Mus musculus
gtgatatgtaaatcccacgagtacc

SEQ ID NO: 700594 - DNA, 25 bp, Mus musculus
gtgatatgtaccagatcccaagtta

SEQ ID NO: 700595 - DNA, 25 bp, Mus musculus
gtgatatgtacctgatcccaagtta

SEQ ID NO: 700596 - DNA, 25 bp, Mus musculus
gtgatatgtatgaagcccctgtctc

SEQ ID NO: 700597 - DNA, 25 bp, Mus musculus
gtgatatgtatgctatagggcctaa

SEQ ID NO: 700598 - DNA, 25 bp, Mus musculus
gtgatatgtatggtatagggcctaa

SEQ ID NO: 700599 - DNA, 25 bp, Mus musculus
gtgatatgtatgtagcccctgtctc

SEQ ID NO: 700600 - DNA, 25 bp, Mus musculus
gtgatatgtcacatccacaaatggc

SEQ ID NO: 700601 - DNA, 25 bp, Mus musculus
gtgatatgtcacttccacaaatggc

SEQ ID NO: 700602 - DNA, 25 bp, Mus musculus
gtgatatgtccactgggctgagatt

SEQ ID NO: 700603 - DNA, 25 bp, Mus musculus
gtgatatgtccagtgggctgagatt

SEQ ID NO: 700604 - DNA, 25 bp, Mus musculus
gtgatatgtcccagtaaccttagca

SEQ ID NO: 700605 - DNA, 25 bp, Mus musculus
gtgatatgtccctgtaaccttagca

SEQ ID NO: 700606 - DNA, 25 bp, Mus musculus
gtgatattaagcaatggcgtgccat

SEQ ID NO: 700607 - DNA, 25 bp, Mus musculus
gtgatattaagctatggcgtgccat

SEQ ID NO: 700608 - DNA, 25 bp, Mus musculus
gtgatattagtgctagtgcctccga

SEQ ID NO: 700609 - DNA, 25 bp, Mus musculus
gtgatattagtggtagtgcctccga

SEQ ID NO: 700610 - DNA, 25 bp, Mus musculus
gtgatattcaaacacctggttccta

SEQ ID NO: 700611 - DNA, 25 bp, Mus musculus
gtgatattcaaagacctggttccta

SEQ ID NO: 700612 - DNA, 25 bp, Mus musculus
gtgatattcccaatgagttcccagg

SEQ ID NO: 700613 - DNA, 25 bp, Mus musculus
gtgatattcccattgagttcccagg

SEQ ID NO: 700614 - DNA, 25 bp, Mus musculus
gtgatattccccacaggcacgttaa

SEQ ID NO: 700615 - DNA, 25 bp, Mus musculus
gtgatattcccctcaggcacgttaa

SEQ ID NO: 700616 - DNA, 25 bp, Mus musculus
gtgatattcctgcagtttttatcta

SEQ ID NO: 700617 - DNA, 25 bp, Mus musculus
gtgatattcctggagtttttatcta

SEQ ID NO: 700618 - DNA, 25 bp, Mus musculus
gtgatattgcctaggtacaaccaac

SEQ ID NO: 700619 - DNA, 25 bp, Mus musculus
gtgatattgccttggtacaaccaac

SEQ ID NO: 700620 - DNA, 25 bp, Mus musculus
gtgatattgttacatgtctctctct

SEQ ID NO: 700621 - DNA, 25 bp, Mus musculus
gtgatattgttagatgtctctctct

SEQ ID NO: 700622 - DNA, 25 bp, Mus musculus
gtgatatttaggaaccctgcgtttt

SEQ ID NO: 700623 - DNA, 25 bp, Mus musculus
gtgatatttaggtaccctgcgtttt

SEQ ID NO: 700624 - DNA, 25 bp, Mus musculus
gtgatatttcacatttaaatctttt

SEQ ID NO: 700625 - DNA, 25 bp, Mus musculus
gtgatatttcacttttaaatctttt

SEQ ID NO: 700626 - DNA, 25 bp, Mus musculus
gtgatatttcttcctagcctataga

SEQ ID NO: 700627 - DNA, 25 bp, Mus musculus
gtgatatttcttgctagcctataga

SEQ ID NO: 700628 - DNA, 25 bp, Mus musculus
gtgatcaaagctctgtactcaggct

SEQ ID NO: 700629 - DNA, 25 bp, Mus musculus
gtgatcaaagctgtgtactcaggct

SEQ ID NO: 700630 - DNA, 25 bp, Mus musculus
gtgatcaacatccaagacctgacag

SEQ ID NO: 700631 - DNA, 25 bp, Mus musculus
gtgatcaacatcgaagacctgacag

SEQ ID NO: 700632 - DNA, 25 bp, Mus musculus
gtgatcaaccctcttttaaaaacat

SEQ ID NO: 700633 - DNA, 25 bp, Mus musculus
gtgatcaaccctgttttaaaaacat

SEQ ID NO: 700634 - DNA, 25 bp, Mus musculus
gtgatcaagagtatattgcattatt

SEQ ID NO: 700635 - DNA, 25 bp, Mus musculus
gtgatcaagagtttattgcattatt

SEQ ID NO: 700636 - DNA, 25 bp, Mus musculus
gtgatcaagatacggaagctgacct

SEQ ID NO: 700637 - DNA, 25 bp, Mus musculus
gtgatcaagatagggaagctgacct

SEQ ID NO: 700638 - DNA, 25 bp, Mus musculus
gtgatcaagatcaatggcagcgcag

SEQ ID NO: 700639 - DNA, 25 bp, Mus musculus
gtgatcaagatctatggcagcgcag

SEQ ID NO: 700640 - DNA, 25 bp, Mus musculus
gtgatcaagtcgagtcttcctatcc

SEQ ID NO: 700641 - DNA, 25 bp, Mus musculus
gtgatcaagtcgtgtcttcctatcc

SEQ ID NO: 700642 - DNA, 25 bp, Mus musculus
gtgatcaagtctagtcagtttgtgc

SEQ ID NO: 700643 - DNA, 25 bp, Mus musculus
gtgatcaagtcttgtcagtttgtgc

SEQ ID NO: 700644 - DNA, 25 bp, Mus musculus
gtgatcaataaaaacgtccctccta

SEQ ID NO: 700645 - DNA, 25 bp, Mus musculus
gtgatcaataaatacgtccctccta

SEQ ID NO: 700646 - DNA, 25 bp, Mus musculus
gtgatcaatcaaccaatggcagagc

SEQ ID NO: 700647 - DNA, 25 bp, Mus musculus
gtgatcaatcaagcaatggcagagc

SEQ ID NO: 700648 - DNA, 25 bp, Mus musculus
gtgatcacacaacacacctttagtt

SEQ ID NO: 700649 - DNA, 25 bp, Mus musculus
gtgatcacacaagacacctttagtt

SEQ ID NO: 700650 - DNA, 25 bp, Mus musculus
gtgatcacagcaaagctaacactgg

SEQ ID NO: 700651 - DNA, 25 bp, Mus musculus
gtgatcacagcatagctaacactgg

SEQ ID NO: 700652 - DNA, 25 bp, Mus musculus
gtgatcacagtgcatcatgtccaaa

SEQ ID NO: 700653 - DNA, 25 bp, Mus musculus
gtgatcacagtggatcatgtccaaa

SEQ ID NO: 700654 - DNA, 25 bp, Mus musculus
gtgatcaccaggacttgacttcagc

SEQ ID NO: 700655 - DNA, 25 bp, Mus musculus
gtgatcaccaggtcttgacttcagc

SEQ ID NO: 700656 - DNA, 25 bp, Mus musculus
gtgatcaccattctgttcaacccac

SEQ ID NO: 700657 - DNA, 25 bp, Mus musculus
gtgatcaccattgtgttcaacccac

SEQ ID NO: 700658 - DNA, 25 bp, Mus musculus
gtgatcacccaaattaatcttttgt

SEQ ID NO: 700659 - DNA, 25 bp, Mus musculus
gtgatcacccaatttaatcttttgt

SEQ ID NO: 700660 - DNA, 25 bp, Mus musculus
gtgatcactactcgcactttttaag

SEQ ID NO: 700661 - DNA, 25 bp, Mus musculus
gtgatcactactggcactttttaag

SEQ ID NO: 700662 - DNA, 25 bp, Mus musculus
gtgatcactcagatgtcagcccttc

SEQ ID NO: 700663 - DNA, 25 bp, Mus musculus
gtgatcactcagttgtcagcccttc

SEQ ID NO: 700664 - DNA, 25 bp, Mus musculus
gtgatcactgacacaaggctctggc

SEQ ID NO: 700665 - DNA, 25 bp, Mus musculus
gtgatcactgactcaaggctctggc

SEQ ID NO: 700666 - DNA, 25 bp, Mus musculus
gtgatcactgtcatctgtggtctga

SEQ ID NO: 700667 - DNA, 25 bp, Mus musculus
gtgatcactgtcttctgtggtctga

SEQ ID NO: 700668 - DNA, 25 bp, Mus musculus
gtgatcactgtgaagtttcctcgta

SEQ ID NO: 700669 - DNA, 25 bp, Mus musculus
gtgatcactgtgtagtttcctcgta

SEQ ID NO: 700670 - DNA, 25 bp, Mus musculus
gtgatcactgttacctcatttctga

SEQ ID NO: 700671 - DNA, 25 bp, Mus musculus
gtgatcactgtttcctcatttctga

SEQ ID NO: 700672 - DNA, 25 bp, Mus musculus
gtgatcactttcattagtcacaata

SEQ ID NO: 700673 - DNA, 25 bp, Mus musculus
gtgatcactttctttagtcacaata

SEQ ID NO: 700674 - DNA, 25 bp, Mus musculus
gtgatcagacccaacacatttcttg

SEQ ID NO: 700675 - DNA, 25 bp, Mus musculus
gtgatcagaccctacacatttcttg

SEQ ID NO: 700676 - DNA, 25 bp, Mus musculus
gtgatcagaggcattaacgtttccc

SEQ ID NO: 700677 - DNA, 25 bp, Mus musculus
gtgatcagaggccttgactccttaa

SEQ ID NO: 700678 - DNA, 25 bp, Mus musculus
gtgatcagaggcgttgactccttaa

SEQ ID NO: 700679 - DNA, 25 bp, Mus musculus
gtgatcagaggctttaacgtttccc

SEQ ID NO: 700680 - DNA, 25 bp, Mus musculus
gtgatcagattgactctgttctcac

SEQ ID NO: 700681 - DNA, 25 bp, Mus musculus
gtgatcagattgattccctctagtc

SEQ ID NO: 700682 - DNA, 25 bp, Mus musculus
gtgatcagattgtctctgttctcac

SEQ ID NO: 700683 - DNA, 25 bp, Mus musculus
gtgatcagattgtttccctctagtc

SEQ ID NO: 700684 - DNA, 25 bp, Mus musculus
gtgatcagcaagacattaccaatgg

SEQ ID NO: 700685 - DNA, 25 bp, Mus musculus
gtgatcagcaagtcattaccaatgg

SEQ ID NO: 700686 - DNA, 25 bp, Mus musculus
gtgatcagcagtcttcaatggtatt

SEQ ID NO: 700687 - DNA, 25 bp, Mus musculus
gtgatcagcagtgttcaatggtatt

SEQ ID NO: 700688 - DNA, 25 bp, Mus musculus
gtgatcagcatcagtgagtcactct

SEQ ID NO: 700689 - DNA, 25 bp, Mus musculus
gtgatcagcatctgtgagtcactct

SEQ ID NO: 700690 - DNA, 25 bp, Mus musculus
gtgatcagctcacgacagaggacca

SEQ ID NO: 700691 - DNA, 25 bp, Mus musculus
gtgatcagctcaggacagaggacca

SEQ ID NO: 700692 - DNA, 25 bp, Mus musculus
gtgatcagctggcttgcggacattt

SEQ ID NO: 700693 - DNA, 25 bp, Mus musculus
gtgatcagctgggttgcggacattt

SEQ ID NO: 700694 - DNA, 25 bp, Mus musculus
gtgatcaggaacatagccacctctg

SEQ ID NO: 700695 - DNA, 25 bp, Mus musculus
gtgatcaggaacttagccacctctg

SEQ ID NO: 700696 - DNA, 25 bp, Mus musculus
gtgatcagtaagactcctgctcctg

SEQ ID NO: 700697 - DNA, 25 bp, Mus musculus
gtgatcagtaagtctcctgctcctg

SEQ ID NO: 700698 - DNA, 25 bp, Mus musculus
gtgatcagtataatccaaccttcta

SEQ ID NO: 700699 - DNA, 25 bp, Mus musculus
gtgatcagtatattccaaccttcta

SEQ ID NO: 700700 - DNA, 25 bp, Mus musculus
gtgatcagtcctacttatagcttta

SEQ ID NO: 700701 - DNA, 25 bp, Mus musculus
gtgatcagtccttcttatagcttta

SEQ ID NO: 700702 - DNA, 25 bp, Mus musculus
gtgatcagtgcccacatcaccggac

SEQ ID NO: 700703 - DNA, 25 bp, Mus musculus
gtgatcagtgccgacatcaccggac

SEQ ID NO: 700704 - DNA, 25 bp, Mus musculus
gtgatcagtttaaactccccttaag

SEQ ID NO: 700705 - DNA, 25 bp, Mus musculus
gtgatcagtttatactccccttaag

SEQ ID NO: 700706 - DNA, 25 bp, Mus musculus
gtgatcataactctttgttgaacta

SEQ ID NO: 700707 - DNA, 25 bp, Mus musculus
gtgatcataactgtttgttgaacta

SEQ ID NO: 700708 - DNA, 25 bp, Mus musculus
gtgatcataagcacctgtgggctgt

SEQ ID NO: 700709 - DNA, 25 bp, Mus musculus
gtgatcataagctcctgtgggctgt

SEQ ID NO: 700710 - DNA, 25 bp, Mus musculus
gtgatcatacccagtgttgcctggc

SEQ ID NO: 700711 - DNA, 25 bp, Mus musculus
gtgatcataccctgtgttgcctggc

SEQ ID NO: 700712 - DNA, 25 bp, Mus musculus
gtgatcatcatgcttgtgggtaaca

SEQ ID NO: 700713 - DNA, 25 bp, Mus musculus
gtgatcatcatggttgtgggtaaca

SEQ ID NO: 700714 - DNA, 25 bp, Mus musculus
gtgatcatcctgctcatactctgga

SEQ ID NO: 700715 - DNA, 25 bp, Mus musculus
gtgatcatcctggtcatactctgga

SEQ ID NO: 700716 - DNA, 25 bp, Mus musculus
gtgatcatctcaagtgcagccaatc

SEQ ID NO: 700717 - DNA, 25 bp, Mus musculus
gtgatcatctcatgtgcagccaatc

SEQ ID NO: 700718 - DNA, 25 bp, Mus musculus
gtgatcatgacacgaatgaacccaa

SEQ ID NO: 700719 - DNA, 25 bp, Mus musculus
gtgatcatgacaggaatgaacccaa

SEQ ID NO: 700720 - DNA, 25 bp, Mus musculus
gtgatcatgctgacacgttagcgac

SEQ ID NO: 700721 - DNA, 25 bp, Mus musculus
gtgatcatgctgtcacgttagcgac

SEQ ID NO: 700722 - DNA, 25 bp, Mus musculus
gtgatcatgcttacttctctataaa

SEQ ID NO: 700723 - DNA, 25 bp, Mus musculus
gtgatcatgctttcttctctataaa

SEQ ID NO: 700724 - DNA, 25 bp, Mus musculus
gtgatcatggatatcaccaaatgat

SEQ ID NO: 700725 - DNA, 25 bp, Mus musculus
gtgatcatggatttcaccaaatgat

SEQ ID NO: 700726 - DNA, 25 bp, Mus musculus
gtgatcatggctcatgaaatcttct

SEQ ID NO: 700727 - DNA, 25 bp, Mus musculus
gtgatcatggctgatgaaatcttct

SEQ ID NO: 700728 - DNA, 25 bp, Mus musculus
gtgatcatgtctactccatgttgta

SEQ ID NO: 700729 - DNA, 25 bp, Mus musculus
gtgatcatgtcttctccatgttgta

SEQ ID NO: 700730 - DNA, 25 bp, Mus musculus
gtgatcattgagaacccgactttgc

SEQ ID NO: 700731 - DNA, 25 bp, Mus musculus
gtgatcattgagtacccgactttgc

SEQ ID NO: 700732 - DNA, 25 bp, Mus musculus
gtgatcattgccagactggtaattc

SEQ ID NO: 700733 - DNA, 25 bp, Mus musculus
gtgatcattgcctgactggtaattc

SEQ ID NO: 700734 - DNA, 25 bp, Mus musculus
gtgatcatttctcccctggagacaa

SEQ ID NO: 700735 - DNA, 25 bp, Mus musculus
gtgatcatttctctataggatgcaa

SEQ ID NO: 700736 - DNA, 25 bp, Mus musculus
gtgatcatttctgccctggagacaa

SEQ ID NO: 700737 - DNA, 25 bp, Mus musculus
gtgatcatttctgtataggatgcaa

SEQ ID NO: 700738 - DNA, 25 bp, Mus musculus
gtgatcattttacttccatctggaa

SEQ ID NO: 700739 - DNA, 25 bp, Mus musculus
gtgatcattttagttccatctggaa

SEQ ID NO: 700740 - DNA, 25 bp, Mus musculus
gtgatccaaagacacccggaggctc

SEQ ID NO: 700741 - DNA, 25 bp, Mus musculus
gtgatccaaagagacccggaggctc

SEQ ID NO: 700742 - DNA, 25 bp, Mus musculus
gtgatccacagacttggcttctcat

SEQ ID NO: 700743 - DNA, 25 bp, Mus musculus
gtgatccacagagttggcttctcat

SEQ ID NO: 700744 - DNA, 25 bp, Mus musculus
gtgatccacagcagaagttgtttct

SEQ ID NO: 700745 - DNA, 25 bp, Mus musculus
gtgatccacagctgaagttgtttct

SEQ ID NO: 700746 - DNA, 25 bp, Mus musculus
gtgatccacatgatacaggccttct

SEQ ID NO: 700747 - DNA, 25 bp, Mus musculus
gtgatccacatgttacaggccttct

SEQ ID NO: 700748 - DNA, 25 bp, Mus musculus
gtgatccactgtaatagtcctgtct

SEQ ID NO: 700749 - DNA, 25 bp, Mus musculus
gtgatccactgttatagtcctgtct

SEQ ID NO: 700750 - DNA, 25 bp, Mus musculus
gtgatccagaaacgctcactctaga

SEQ ID NO: 700751 - DNA, 25 bp, Mus musculus
gtgatccagaaaggctcactctaga

SEQ ID NO: 700752 - DNA, 25 bp, Mus musculus
gtgatccagatcaagctcagtgaac

SEQ ID NO: 700753 - DNA, 25 bp, Mus musculus
gtgatccagatctagctcagtgaac

SEQ ID NO: 700754 - DNA, 25 bp, Mus musculus
gtgatccagggtcagttcttaagct

SEQ ID NO: 700755 - DNA, 25 bp, Mus musculus
gtgatccagggtgagttcttaagct

SEQ ID NO: 700756 - DNA, 25 bp, Mus musculus
gtgatccagttcaaaaacttgtgtt

SEQ ID NO: 700757 - DNA, 25 bp, Mus musculus
gtgatccagttctaaaacttgtgtt

SEQ ID NO: 700758 - DNA, 25 bp, Mus musculus
gtgatccagttgatttccatccttt

SEQ ID NO: 700759 - DNA, 25 bp, Mus musculus
gtgatccagttgttttccatccttt

SEQ ID NO: 700760 - DNA, 25 bp, Mus musculus
gtgatccatgaaacctccgaaagta

SEQ ID NO: 700761 - DNA, 25 bp, Mus musculus
gtgatccatgaatcctccgaaagta

SEQ ID NO: 700762 - DNA, 25 bp, Mus musculus
gtgatcccacatccacataagactt

SEQ ID NO: 700763 - DNA, 25 bp, Mus musculus
gtgatcccacatgcacataagactt

SEQ ID NO: 700764 - DNA, 25 bp, Mus musculus
gtgatcccagcaacggcaagcgagg

SEQ ID NO: 700765 - DNA, 25 bp, Mus musculus
gtgatcccagcatcggcaagcgagg

SEQ ID NO: 700766 - DNA, 25 bp, Mus musculus
gtgatcccagcgactgatatgtcca

SEQ ID NO: 700767 - DNA, 25 bp, Mus musculus
gtgatcccagcgtctgatatgtcca

SEQ ID NO: 700768 - DNA, 25 bp, Mus musculus
gtgatcccatccagtgtttaaagtc

SEQ ID NO: 700769 - DNA, 25 bp, Mus musculus
gtgatcccatccctcatttgatttc

SEQ ID NO: 700770 - DNA, 25 bp, Mus musculus
gtgatcccatccgtcatttgatttc

SEQ ID NO: 700771 - DNA, 25 bp, Mus musculus
gtgatcccatcctgtgtttaaagtc

SEQ ID NO: 700772 - DNA, 25 bp, Mus musculus
gtgatccccatgacagatctcatgt

SEQ ID NO: 700773 - DNA, 25 bp, Mus musculus
gtgatccccatgtcagatctcatgt

SEQ ID NO: 700774 - DNA, 25 bp, Mus musculus
gtgatcccgaagactgtgacgccat

SEQ ID NO: 700775 - DNA, 25 bp, Mus musculus
gtgatcccgaagtctgtgacgccat

SEQ ID NO: 700776 - DNA, 25 bp, Mus musculus
gtgatcccgcagattcagaaagtgt

SEQ ID NO: 700777 - DNA, 25 bp, Mus musculus
gtgatcccgcagtttcagaaagtgt

SEQ ID NO: 700778 - DNA, 25 bp, Mus musculus
gtgatcccggagatggtcggccaca

SEQ ID NO: 700779 - DNA, 25 bp, Mus musculus
gtgatcccggagttggtcggccaca

SEQ ID NO: 700780 - DNA, 25 bp, Mus musculus
gtgatccctaaacgtattttcacct

SEQ ID NO: 700781 - DNA, 25 bp, Mus musculus
gtgatccctaaaggtattttcacct

SEQ ID NO: 700782 - DNA, 25 bp, Mus musculus
gtgatccctgggataaaacttgcta

SEQ ID NO: 700783 - DNA, 25 bp, Mus musculus
gtgatccctgggttaaaacttgcta

SEQ ID NO: 700784 - DNA, 25 bp, Mus musculus
gtgatccctggtccttaggtggcac

SEQ ID NO: 700785 - DNA, 25 bp, Mus musculus
gtgatccctggtgcttaggtggcac

SEQ ID NO: 700786 - DNA, 25 bp, Mus musculus
gtgatcccttcacatatggtttttt

SEQ ID NO: 700787 - DNA, 25 bp, Mus musculus
gtgatcccttcagatatggtttttt

SEQ ID NO: 700788 - DNA, 25 bp, Mus musculus
gtgatccctttcatgtgggaggcag

SEQ ID NO: 700789 - DNA, 25 bp, Mus musculus
gtgatccctttcttgtgggaggcag

SEQ ID NO: 700790 - DNA, 25 bp, Mus musculus
gtgatccgggaaccaacttttctaa

SEQ ID NO: 700791 - DNA, 25 bp, Mus musculus
gtgatccgggaagcaacttttctaa

SEQ ID NO: 700792 - DNA, 25 bp, Mus musculus
gtgatccgtatcaactccagactgg

SEQ ID NO: 700793 - DNA, 25 bp, Mus musculus
gtgatccgtatctactccagactgg

SEQ ID NO: 700794 - DNA, 25 bp, Mus musculus
gtgatcctaactaactccattttaa

SEQ ID NO: 700795 - DNA, 25 bp, Mus musculus
gtgatcctaacttactccattttaa

SEQ ID NO: 700796 - DNA, 25 bp, Mus musculus
gtgatcctagacactccttgttttc

SEQ ID NO: 700797 - DNA, 25 bp, Mus musculus
gtgatcctagactctccttgttttc

SEQ ID NO: 700798 - DNA, 25 bp, Mus musculus
gtgatcctagcaccggagagtctga

SEQ ID NO: 700799 - DNA, 25 bp, Mus musculus
gtgatcctagcagcggagagtctga

SEQ ID NO: 700800 - DNA, 25 bp, Mus musculus
gtgatcctaggcagtgttaaccaaa

SEQ ID NO: 700801 - DNA, 25 bp, Mus musculus
gtgatcctaggctgtgttaaccaaa

SEQ ID NO: 700802 - DNA, 25 bp, Mus musculus
gtgatcctgagaaaactggccttaa

SEQ ID NO: 700803 - DNA, 25 bp, Mus musculus
gtgatcctgagataactggccttaa

SEQ ID NO: 700804 - DNA, 25 bp, Mus musculus
gtgatcctgatactgagtctgccct

SEQ ID NO: 700805 - DNA, 25 bp, Mus musculus
gtgatcctgatagtgagtctgccct

SEQ ID NO: 700806 - DNA, 25 bp, Mus musculus
gtgatcctgctaatgtgtgcatgtc

SEQ ID NO: 700807 - DNA, 25 bp, Mus musculus
gtgatcctgctattgtgtgcatgtc

SEQ ID NO: 700808 - DNA, 25 bp, Mus musculus
gtgatcctggaccatgtggacagca

SEQ ID NO: 700809 - DNA, 25 bp, Mus musculus
gtgatcctggacgatgtggacagca

SEQ ID NO: 700810 - DNA, 25 bp, Mus musculus
gtgatcctgtgtctagctgtcagaa

SEQ ID NO: 700811 - DNA, 25 bp, Mus musculus
gtgatcctgtgtgtagctgtcagaa

SEQ ID NO: 700812 - DNA, 25 bp, Mus musculus
gtgatccttactccgcctgggatgg

SEQ ID NO: 700813 - DNA, 25 bp, Mus musculus
gtgatccttactgcgcctgggatgg

SEQ ID NO: 700814 - DNA, 25 bp, Mus musculus
gtgatccttttgagtgtttgaccag

SEQ ID NO: 700815 - DNA, 25 bp, Mus musculus
gtgatccttttgtgtgtttgaccag

SEQ ID NO: 700816 - DNA, 25 bp, Mus musculus
gtgatcgagcgcctaaaggcttttg

SEQ ID NO: 700817 - DNA, 25 bp, Mus musculus
gtgatcgagcgcgtaaaggcttttg

SEQ ID NO: 700818 - DNA, 25 bp, Mus musculus
gtgatcgatttccttgagcctcaga

SEQ ID NO: 700819 - DNA, 25 bp, Mus musculus
gtgatcgatttcgttgagcctcaga

SEQ ID NO: 700820 - DNA, 25 bp, Mus musculus
gtgatcgcccacctttggttttaag

SEQ ID NO: 700821 - DNA, 25 bp, Mus musculus
gtgatcgcccacgtttggttttaag

SEQ ID NO: 700822 - DNA, 25 bp, Mus musculus
gtgatcgccctaataatgaccacaa

SEQ ID NO: 700823 - DNA, 25 bp, Mus musculus
gtgatcgccctattaatgaccacaa

SEQ ID NO: 700824 - DNA, 25 bp, Mus musculus
gtgatcggacttacacatagtggta

SEQ ID NO: 700825 - DNA, 25 bp, Mus musculus
gtgatcggactttcacatagtggta

SEQ ID NO: 700826 - DNA, 25 bp, Mus musculus
gtgatcggcctgcatgaggatgacg

SEQ ID NO: 700827 - DNA, 25 bp, Mus musculus
gtgatcggcctggatgaggatgacg

SEQ ID NO: 700828 - DNA, 25 bp, Mus musculus
gtgatcggctttccacaaatgctaa

SEQ ID NO: 700829 - DNA, 25 bp, Mus musculus
gtgatcggctttgcacaaatgctaa

SEQ ID NO: 700830 - DNA, 25 bp, Mus musculus
gtgatcgggagcagactgacctcgt

SEQ ID NO: 700831 - DNA, 25 bp, Mus musculus
gtgatcgggagctgactgacctcgt

SEQ ID NO: 700832 - DNA, 25 bp, Mus musculus
gtgatcgggatcagtcagcttgtga

SEQ ID NO: 700833 - DNA, 25 bp, Mus musculus
gtgatcgggatctgtcagcttgtga

SEQ ID NO: 700834 - DNA, 25 bp, Mus musculus
gtgatcgggctcaccacgagacttc

SEQ ID NO: 700835 - DNA, 25 bp, Mus musculus
gtgatcgggctctccacgagacttc

SEQ ID NO: 700836 - DNA, 25 bp, Mus musculus
gtgatcggtctcaccaagtccgtgg

SEQ ID NO: 700837 - DNA, 25 bp, Mus musculus
gtgatcggtctctccaagtccgtgg

SEQ ID NO: 700838 - DNA, 25 bp, Mus musculus
gtgatcgtagccaaggcggcacgct

SEQ ID NO: 700839 - DNA, 25 bp, Mus musculus
gtgatcgtagcctaggcggcacgct

SEQ ID NO: 700840 - DNA, 25 bp, Mus musculus
gtgatcgtgaatcatactgtcctta

SEQ ID NO: 700841 - DNA, 25 bp, Mus musculus
gtgatcgtgaatgatactgtcctta

SEQ ID NO: 700842 - DNA, 25 bp, Mus musculus
gtgatcgttgctcttctgggtgtcc

SEQ ID NO: 700843 - DNA, 25 bp, Mus musculus
gtgatcgttgctgttctgggtgtcc

SEQ ID NO: 700844 - DNA, 25 bp, Mus musculus
gtgatcgtttcaatatttgcttaca

SEQ ID NO: 700845 - DNA, 25 bp, Mus musculus
gtgatcgtttcattatttgcttaca

SEQ ID NO: 700846 - DNA, 25 bp, Mus musculus
gtgatctaaaatagctcctttgagc

SEQ ID NO: 700847 - DNA, 25 bp, Mus musculus
gtgatctaaaattgctcctttgagc

SEQ ID NO: 700848 - DNA, 25 bp, Mus musculus
gtgatctaaaccattcttcatgaag

SEQ ID NO: 700849 - DNA, 25 bp, Mus musculus
gtgatctaaacctttcttcatgaag

SEQ ID NO: 700850 - DNA, 25 bp, Mus musculus
gtgatctaaggcctgcgtgacctct

SEQ ID NO: 700851 - DNA, 25 bp, Mus musculus
gtgatctaaggcgtgcgtgacctct

SEQ ID NO: 700852 - DNA, 25 bp, Mus musculus
gtgatctaagtgctcagactccttt

SEQ ID NO: 700853 - DNA, 25 bp, Mus musculus
gtgatctaagtggtcagactccttt

SEQ ID NO: 700854 - DNA, 25 bp, Mus musculus
gtgatctaatccagagcaaccgcag

SEQ ID NO: 700855 - DNA, 25 bp, Mus musculus
gtgatctaatcctgagcaaccgcag

SEQ ID NO: 700856 - DNA, 25 bp, Mus musculus
gtgatctaccacaatgatgtgagga

SEQ ID NO: 700857 - DNA, 25 bp, Mus musculus
gtgatctaccactatgatgtgagga

SEQ ID NO: 700858 - DNA, 25 bp, Mus musculus
gtgatctagactccctcttccaggg

SEQ ID NO: 700859 - DNA, 25 bp, Mus musculus
gtgatctagactgcctcttccaggg

SEQ ID NO: 700860 - DNA, 25 bp, Mus musculus
gtgatctatagtctttgcatgccaa

SEQ ID NO: 700861 - DNA, 25 bp, Mus musculus
gtgatctatagtgtttgcatgccaa

SEQ ID NO: 700862 - DNA, 25 bp, Mus musculus
gtgatctatatgaatgtgctaccag

SEQ ID NO: 700863 - DNA, 25 bp, Mus musculus
gtgatctatatgtatgtgctaccag

SEQ ID NO: 700864 - DNA, 25 bp, Mus musculus
gtgatctcaataagccatgtcaatt

SEQ ID NO: 700865 - DNA, 25 bp, Mus musculus
gtgatctcaatatgccatgtcaatt

SEQ ID NO: 700866 - DNA, 25 bp, Mus musculus
gtgatctcagtgatgtatttacctt

SEQ ID NO: 700867 - DNA, 25 bp, Mus musculus
gtgatctcagtgttgtatttacctt

SEQ ID NO: 700868 - DNA, 25 bp, Mus musculus
gtgatctcatccaaaagtcagctga

SEQ ID NO: 700869 - DNA, 25 bp, Mus musculus
gtgatctcatcctaaagtcagctga

SEQ ID NO: 700870 - DNA, 25 bp, Mus musculus
gtgatctcatgcctagctttttgta

SEQ ID NO: 700871 - DNA, 25 bp, Mus musculus
gtgatctcatgcgtagctttttgta

SEQ ID NO: 700872 - DNA, 25 bp, Mus musculus
gtgatctcattcattcatggatgcc

SEQ ID NO: 700873 - DNA, 25 bp, Mus musculus
gtgatctcattctttcatggatgcc

SEQ ID NO: 700874 - DNA, 25 bp, Mus musculus
gtgatctccaagactgtgtgtgtgc

SEQ ID NO: 700875 - DNA, 25 bp, Mus musculus
gtgatctccaagtctgtgtgtgtgc

SEQ ID NO: 700876 - DNA, 25 bp, Mus musculus
gtgatctccatcactcttataacaa

SEQ ID NO: 700877 - DNA, 25 bp, Mus musculus
gtgatctccatctctcttataacaa

SEQ ID NO: 700878 - DNA, 25 bp, Mus musculus
gtgatctcccctctgggtaatagga

SEQ ID NO: 700879 - DNA, 25 bp, Mus musculus
gtgatctcccctgtgggtaatagga

SEQ ID NO: 700880 - DNA, 25 bp, Mus musculus
gtgatctccctgactaagcgctgaa

SEQ ID NO: 700881 - DNA, 25 bp, Mus musculus
gtgatctccctgtctaagcgctgaa

SEQ ID NO: 700882 - DNA, 25 bp, Mus musculus
gtgatctcgagtcaaggctgtttta

SEQ ID NO: 700883 - DNA, 25 bp, Mus musculus
gtgatctcgagtgaaggctgtttta

SEQ ID NO: 700884 - DNA, 25 bp, Mus musculus
gtgatctcgggaatggctctcctcc

SEQ ID NO: 700885 - DNA, 25 bp, Mus musculus
gtgatctcgggattggctctcctcc

SEQ ID NO: 700886 - DNA, 25 bp, Mus musculus
gtgatctctaacacttcactcttaa

SEQ ID NO: 700887 - DNA, 25 bp, Mus musculus
gtgatctctaactcttcactcttaa

SEQ ID NO: 700888 - DNA, 25 bp, Mus musculus
gtgatctctcccctgtttctggaat

SEQ ID NO: 700889 - DNA, 25 bp, Mus musculus
gtgatctctcccgtgtttctggaat

SEQ ID NO: 700890 - DNA, 25 bp, Mus musculus
gtgatctctggaactactcaagtgc

SEQ ID NO: 700891 - DNA, 25 bp, Mus musculus
gtgatctctggatctactcaagtgc

SEQ ID NO: 700892 - DNA, 25 bp, Mus musculus
gtgatctgaactataatgtacagtt

SEQ ID NO: 700893 - DNA, 25 bp, Mus musculus
gtgatctgaactttaatgtacagtt

SEQ ID NO: 700894 - DNA, 25 bp, Mus musculus
gtgatctgacctcggaattctgtcc

SEQ ID NO: 700895 - DNA, 25 bp, Mus musculus
gtgatctgacctgggaattctgtcc

SEQ ID NO: 700896 - DNA, 25 bp, Mus musculus
gtgatctgatccattgagcggtttc

SEQ ID NO: 700897 - DNA, 25 bp, Mus musculus
gtgatctgatcctttgagcggtttc

SEQ ID NO: 700898 - DNA, 25 bp, Mus musculus
gtgatctgattacaggtatcctaca

SEQ ID NO: 700899 - DNA, 25 bp, Mus musculus
gtgatctgattagaggtatcctaca

SEQ ID NO: 700900 - DNA, 25 bp, Mus musculus
gtgatctgcactatttggacaaggc

SEQ ID NO: 700901 - DNA, 25 bp, Mus musculus
gtgatctgcactttttggacaaggc

SEQ ID NO: 700902 - DNA, 25 bp, Mus musculus
gtgatctgcatgagattctggtaga

SEQ ID NO: 700903 - DNA, 25 bp, Mus musculus
gtgatctgcatgcattacccttact

SEQ ID NO: 700904 - DNA, 25 bp, Mus musculus
gtgatctgcatggattacccttact

SEQ ID NO: 700905 - DNA, 25 bp, Mus musculus
gtgatctgcatgtgattctggtaga

SEQ ID NO: 700906 - DNA, 25 bp, Mus musculus
gtgatctgcgacacaagcccaatga

SEQ ID NO: 700907 - DNA, 25 bp, Mus musculus
gtgatctgcgactcaagcccaatga

SEQ ID NO: 700908 - DNA, 25 bp, Mus musculus
gtgatctgggtaaagtcatgaccat

SEQ ID NO: 700909 - DNA, 25 bp, Mus musculus
gtgatctgggtatagtcatgaccat

SEQ ID NO: 700910 - DNA, 25 bp, Mus musculus
gtgatctggtcaaccactcctttcc

SEQ ID NO: 700911 - DNA, 25 bp, Mus musculus
gtgatctggtcatccactcctttcc

SEQ ID NO: 700912 - DNA, 25 bp, Mus musculus
gtgatctggttaccttggaaatgca

SEQ ID NO: 700913 - DNA, 25 bp, Mus musculus
gtgatctggttagcttggaaatgca

SEQ ID NO: 700914 - DNA, 25 bp, Mus musculus
gtgatctgtaatccctatgagtata

SEQ ID NO: 700915 - DNA, 25 bp, Mus musculus
gtgatctgtaatgcctatgagtata

SEQ ID NO: 700916 - DNA, 25 bp, Mus musculus
gtgatctgtactccagcagaggcaa

SEQ ID NO: 700917 - DNA, 25 bp, Mus musculus
gtgatctgtactgcagcagaggcaa

SEQ ID NO: 700918 - DNA, 25 bp, Mus musculus
gtgatctgtagtctctgcagcacat

SEQ ID NO: 700919 - DNA, 25 bp, Mus musculus
gtgatctgtagtgtctgcagcacat

SEQ ID NO: 700920 - DNA, 25 bp, Mus musculus
gtgatctgtcagatgatgtctctgg

SEQ ID NO: 700921 - DNA, 25 bp, Mus musculus
gtgatctgtcagttgatgtctctgg

SEQ ID NO: 700922 - DNA, 25 bp, Mus musculus
gtgatctgtctacacttgactgtct

SEQ ID NO: 700923 - DNA, 25 bp, Mus musculus
gtgatctgtctagacttgactgtct

SEQ ID NO: 700924 - DNA, 25 bp, Mus musculus
gtgatctgtgaactctaccttttaa

SEQ ID NO: 700925 - DNA, 25 bp, Mus musculus
gtgatctgtgaagtctaccttttaa

SEQ ID NO: 700926 - DNA, 25 bp, Mus musculus
gtgatctgtgggaattctgccattt

SEQ ID NO: 700927 - DNA, 25 bp, Mus musculus
gtgatctgtgggtattctgccattt

SEQ ID NO: 700928 - DNA, 25 bp, Mus musculus
gtgatctgtggtcatggcccagact

SEQ ID NO: 700929 - DNA, 25 bp, Mus musculus
gtgatctgtggtgatggcccagact

SEQ ID NO: 700930 - DNA, 25 bp, Mus musculus
gtgatcttaaaaacacccacctgca

SEQ ID NO: 700931 - DNA, 25 bp, Mus musculus
gtgatcttaaaatcacccacctgca

SEQ ID NO: 700932 - DNA, 25 bp, Mus musculus
gtgatcttaaatcctgacccatccc

SEQ ID NO: 700933 - DNA, 25 bp, Mus musculus
gtgatcttaaatgctgacccatccc

SEQ ID NO: 700934 - DNA, 25 bp, Mus musculus
gtgatcttaagcaagctgcacctcc

SEQ ID NO: 700935 - DNA, 25 bp, Mus musculus
gtgatcttaagctagctgcacctcc

SEQ ID NO: 700936 - DNA, 25 bp, Mus musculus
gtgatcttaccacttcaaatggatg

SEQ ID NO: 700937 - DNA, 25 bp, Mus musculus
gtgatcttaccagttcaaatggatg

SEQ ID NO: 700938 - DNA, 25 bp, Mus musculus
gtgatcttactgcttacacagccaa

SEQ ID NO: 700939 - DNA, 25 bp, Mus musculus
gtgatcttactggttacacagccaa

SEQ ID NO: 700940 - DNA, 25 bp, Mus musculus
gtgatcttcaagaacgacaatgcat

SEQ ID NO: 700941 - DNA, 25 bp, Mus musculus
gtgatcttcaagtacgacaatgcat

SEQ ID NO: 700942 - DNA, 25 bp, Mus musculus
gtgatcttcaccatctaattgattc

SEQ ID NO: 700943 - DNA, 25 bp, Mus musculus
gtgatcttcacccagaacactgtat

SEQ ID NO: 700944 - DNA, 25 bp, Mus musculus
gtgatcttcaccgagaacactgtat

SEQ ID NO: 700945 - DNA, 25 bp, Mus musculus
gtgatcttcaccttctaattgattc

SEQ ID NO: 700946 - DNA, 25 bp, Mus musculus
gtgatcttctaccagtgtctttatg

SEQ ID NO: 700947 - DNA, 25 bp, Mus musculus
gtgatcttctacgagtgtctttatg

SEQ ID NO: 700948 - DNA, 25 bp, Mus musculus
gtgatcttggccattctatatccga

SEQ ID NO: 700949 - DNA, 25 bp, Mus musculus
gtgatcttggcctttctatatccga

SEQ ID NO: 700950 - DNA, 25 bp, Mus musculus
gtgatcttgtgtattggttttttta

SEQ ID NO: 700951 - DNA, 25 bp, Mus musculus
gtgatcttgtgttttggttttttta

SEQ ID NO: 700952 - DNA, 25 bp, Mus musculus
gtgatcttgttaaagcaaccctgag

SEQ ID NO: 700953 - DNA, 25 bp, Mus musculus
gtgatcttgttatagcaaccctgag

SEQ ID NO: 700954 - DNA, 25 bp, Mus musculus
gtgatctttaagaatacctcttccc

SEQ ID NO: 700955 - DNA, 25 bp, Mus musculus
gtgatctttaagtatacctcttccc

SEQ ID NO: 700956 - DNA, 25 bp, Mus musculus
gtgatctttactactcttgcataag

SEQ ID NO: 700957 - DNA, 25 bp, Mus musculus
gtgatctttacttctcttgcataag

SEQ ID NO: 700958 - DNA, 25 bp, Mus musculus
gtgatctttctgatttacacaacat

SEQ ID NO: 700959 - DNA, 25 bp, Mus musculus
gtgatctttctgttttacacaacat

SEQ ID NO: 700960 - DNA, 25 bp, Mus musculus
gtgatctttggtacttacagttatg

SEQ ID NO: 700961 - DNA, 25 bp, Mus musculus
gtgatctttggttcttacagttatg

SEQ ID NO: 700962 - DNA, 25 bp, Mus musculus
gtgatctttgtcctcatgaactttc

SEQ ID NO: 700963 - DNA, 25 bp, Mus musculus
gtgatctttgtcgtcatgaactttc

SEQ ID NO: 700964 - DNA, 25 bp, Mus musculus
gtgatctttgtgatgttacttgtac

SEQ ID NO: 700965 - DNA, 25 bp, Mus musculus
gtgatctttgtgttgttacttgtac

SEQ ID NO: 700966 - DNA, 25 bp, Mus musculus
gtgatgaaacatcgactgcccctta

SEQ ID NO: 700967 - DNA, 25 bp, Mus musculus
gtgatgaaacatggactgcccctta

SEQ ID NO: 700968 - DNA, 25 bp, Mus musculus
gtgatgaaacccattaatcctgcat

SEQ ID NO: 700969 - DNA, 25 bp, Mus musculus
gtgatgaaaccctttaatcctgcat

SEQ ID NO: 700970 - DNA, 25 bp, Mus musculus
gtgatgaaatgaacagctactacga

SEQ ID NO: 700971 - DNA, 25 bp, Mus musculus
gtgatgaaatgatcagctactacga

SEQ ID NO: 700972 - DNA, 25 bp, Mus musculus
gtgatgaaatttctggcacttctca

SEQ ID NO: 700973 - DNA, 25 bp, Mus musculus
gtgatgaaatttgtggcacttctca

SEQ ID NO: 700974 - DNA, 25 bp, Mus musculus
gtgatgaaccacatgcaccatgaag

SEQ ID NO: 700975 - DNA, 25 bp, Mus musculus
gtgatgaaccacttgcaccatgaag

SEQ ID NO: 700976 - DNA, 25 bp, Mus musculus
gtgatgaacgtactgcaggtgccat

SEQ ID NO: 700977 - DNA, 25 bp, Mus musculus
gtgatgaacgtagtgcaggtgccat

SEQ ID NO: 700978 - DNA, 25 bp, Mus musculus
gtgatgaactggctttggcattaca

SEQ ID NO: 700979 - DNA, 25 bp, Mus musculus
gtgatgaactgggtttggcattaca

SEQ ID NO: 700980 - DNA, 25 bp, Mus musculus
gtgatgaactttctcgcctggagtt

SEQ ID NO: 700981 - DNA, 25 bp, Mus musculus
gtgatgaactttgtcgcctggagtt

SEQ ID NO: 700982 - DNA, 25 bp, Mus musculus
gtgatgaatcaaccataattttagt

SEQ ID NO: 700983 - DNA, 25 bp, Mus musculus
gtgatgaatcaagcataattttagt

SEQ ID NO: 700984 - DNA, 25 bp, Mus musculus
gtgatgacaaaccttggcgagaagt

SEQ ID NO: 700985 - DNA, 25 bp, Mus musculus
gtgatgacaaacgttggcgagaagt

SEQ ID NO: 700986 - DNA, 25 bp, Mus musculus
gtgatgacaaatagtccctcctcct

SEQ ID NO: 700987 - DNA, 25 bp, Mus musculus
gtgatgacaaattgtccctcctcct

SEQ ID NO: 700988 - DNA, 25 bp, Mus musculus
gtgatgacacttagaaacgccgtat

SEQ ID NO: 700989 - DNA, 25 bp, Mus musculus
gtgatgacactttgaaacgccgtat

SEQ ID NO: 700990 - DNA, 25 bp, Mus musculus
gtgatgacatcgctggagtttacat

SEQ ID NO: 700991 - DNA, 25 bp, Mus musculus
gtgatgacatcggtggagtttacat

SEQ ID NO: 700992 - DNA, 25 bp, Mus musculus
gtgatgacatgcagacgtgttacat

SEQ ID NO: 700993 - DNA, 25 bp, Mus musculus
gtgatgacatgctgacgtgttacat

SEQ ID NO: 700994 - DNA, 25 bp, Mus musculus
gtgatgaccagtcccttcactgagt

SEQ ID NO: 700995 - DNA, 25 bp, Mus musculus
gtgatgaccagtgccttcactgagt

SEQ ID NO: 700996 - DNA, 25 bp, Mus musculus
gtgatgaccattatcgtggccttca

SEQ ID NO: 700997 - DNA, 25 bp, Mus musculus
gtgatgaccattttcgtggccttca

SEQ ID NO: 700998 - DNA, 25 bp, Mus musculus
gtgatgacctaaagtgtttaagctt

SEQ ID NO: 700999 - DNA, 25 bp, Mus musculus
gtgatgacctaatgtgtttaagctt

SEQ ID NO: 701000 - DNA, 25 bp, Mus musculus
gtgatgacgagtcgcttcctgtcgc

SEQ ID NO: 701001 - DNA, 25 bp, Mus musculus
gtgatgacgagtggcttcctgtcgc

SEQ ID NO: 701002 - DNA, 25 bp, Mus musculus
gtgatgacgcatatacaccagctca

SEQ ID NO: 701003 - DNA, 25 bp, Mus musculus
gtgatgacgcatttacaccagctca

SEQ ID NO: 701004 - DNA, 25 bp, Mus musculus
gtgatgactgtaagtgttctgcctt

SEQ ID NO: 701005 - DNA, 25 bp, Mus musculus
gtgatgactgtatgtgttctgcctt

SEQ ID NO: 701006 - DNA, 25 bp, Mus musculus
gtgatgactgtgatgacttcaattt

SEQ ID NO: 701007 - DNA, 25 bp, Mus musculus
gtgatgactgtgttgacttcaattt

SEQ ID NO: 701008 - DNA, 25 bp, Mus musculus
gtgatgacttaactgctttggctca

SEQ ID NO: 701009 - DNA, 25 bp, Mus musculus
gtgatgacttaagtgctttggctca

SEQ ID NO: 701010 - DNA, 25 bp, Mus musculus
gtgatgacttatagccagtctctgg

SEQ ID NO: 701011 - DNA, 25 bp, Mus musculus
gtgatgacttattgccagtctctgg

SEQ ID NO: 701012 - DNA, 25 bp, Mus musculus
gtgatgagacttcaacctaggacct

SEQ ID NO: 701013 - DNA, 25 bp, Mus musculus
gtgatgagacttgaacctaggacct

SEQ ID NO: 701014 - DNA, 25 bp, Mus musculus
gtgatgagaggcctttcactctgca

SEQ ID NO: 701015 - DNA, 25 bp, Mus musculus
gtgatgagaggcgtttcactctgca

SEQ ID NO: 701016 - DNA, 25 bp, Mus musculus
gtgatgagatcactgagctcaaaga

SEQ ID NO: 701017 - DNA, 25 bp, Mus musculus
gtgatgagatcagtgagctcaaaga

SEQ ID NO: 701018 - DNA, 25 bp, Mus musculus
gtgatgagatccatgaccgggtaaa

SEQ ID NO: 701019 - DNA, 25 bp, Mus musculus
gtgatgagatccttgaccgggtaaa

SEQ ID NO: 701020 - DNA, 25 bp, Mus musculus
gtgatgagcaacatggacagcaaca

SEQ ID NO: 701021 - DNA, 25 bp, Mus musculus
gtgatgagcaacttggacagcaaca

SEQ ID NO: 701022 - DNA, 25 bp, Mus musculus
gtgatgagctatatctaggccatga

SEQ ID NO: 701023 - DNA, 25 bp, Mus musculus
gtgatgagctatttctaggccatga

SEQ ID NO: 701024 - DNA, 25 bp, Mus musculus
gtgatgagctctaatttaccttccc

SEQ ID NO: 701025 - DNA, 25 bp, Mus musculus
gtgatgagctcttatttaccttccc

SEQ ID NO: 701026 - DNA, 25 bp, Mus musculus
gtgatgagctgaacaagaagtagtc

SEQ ID NO: 701027 - DNA, 25 bp, Mus musculus
gtgatgagctgatcaagaagtagtc

SEQ ID NO: 701028 - DNA, 25 bp, Mus musculus
gtgatgaggaggcactgctaacaca

SEQ ID NO: 701029 - DNA, 25 bp, Mus musculus
gtgatgaggagggactgctaacaca

SEQ ID NO: 701030 - DNA, 25 bp, Mus musculus
gtgatgaggcagatttatgaactat

SEQ ID NO: 701031 - DNA, 25 bp, Mus musculus
gtgatgaggcagttttatgaactat

SEQ ID NO: 701032 - DNA, 25 bp, Mus musculus
gtgatgaggcctacagactgagcag

SEQ ID NO: 701033 - DNA, 25 bp, Mus musculus
gtgatgaggccttcagactgagcag

SEQ ID NO: 701034 - DNA, 25 bp, Mus musculus
gtgatgagtcatatccagcactggg

SEQ ID NO: 701035 - DNA, 25 bp, Mus musculus
gtgatgagtcatttccagcactggg

SEQ ID NO: 701036 - DNA, 25 bp, Mus musculus
gtgatgataagtagtccctccttct

SEQ ID NO: 701037 - DNA, 25 bp, Mus musculus
gtgatgataagttgtccctccttct

SEQ ID NO: 701038 - DNA, 25 bp, Mus musculus
gtgatgatcgagagacccatcctct

SEQ ID NO: 701039 - DNA, 25 bp, Mus musculus
gtgatgatcgagtgacccatcctct

SEQ ID NO: 701040 - DNA, 25 bp, Mus musculus
gtgatgatctacagatgctcttgga

SEQ ID NO: 701041 - DNA, 25 bp, Mus musculus
gtgatgatctactgatgctcttgga

SEQ ID NO: 701042 - DNA, 25 bp, Mus musculus
gtgatgatgaccatgcctggaacat

SEQ ID NO: 701043 - DNA, 25 bp, Mus musculus
gtgatgatgaccttgcctggaacat

SEQ ID NO: 701044 - DNA, 25 bp, Mus musculus
gtgatgatgcccagaaagaccaaca

SEQ ID NO: 701045 - DNA, 25 bp, Mus musculus
gtgatgatgccctgaaagaccaaca

SEQ ID NO: 701046 - DNA, 25 bp, Mus musculus
gtgatgatggatagggcgcttccca

SEQ ID NO: 701047 - DNA, 25 bp, Mus musculus
gtgatgatggattgggcgcttccca

SEQ ID NO: 701048 - DNA, 25 bp, Mus musculus
gtgatgatggctaccatccctgata

SEQ ID NO: 701049 - DNA, 25 bp, Mus musculus
gtgatgatggcttccatccctgata

SEQ ID NO: 701050 - DNA, 25 bp, Mus musculus
gtgatgatggtccattctcaccagc

SEQ ID NO: 701051 - DNA, 25 bp, Mus musculus
gtgatgatggtcgattctcaccagc

SEQ ID NO: 701052 - DNA, 25 bp, Mus musculus
gtgatgatgtttctccctgttcaac

SEQ ID NO: 701053 - DNA, 25 bp, Mus musculus
gtgatgatgtttgtccctgttcaac

SEQ ID NO: 701054 - DNA, 25 bp, Mus musculus
gtgatgatttccaatgccatcccat

SEQ ID NO: 701055 - DNA, 25 bp, Mus musculus
gtgatgatttcctatgccatcccat

SEQ ID NO: 701056 - DNA, 25 bp, Mus musculus
gtgatgatttctcaggtactttcaa

SEQ ID NO: 701057 - DNA, 25 bp, Mus musculus
gtgatgatttctgaggtactttcaa

SEQ ID NO: 701058 - DNA, 25 bp, Mus musculus
gtgatgcaaggcaaggcctcctgca

SEQ ID NO: 701059 - DNA, 25 bp, Mus musculus
gtgatgcaaggctaggcctcctgca

SEQ ID NO: 701060 - DNA, 25 bp, Mus musculus
gtgatgcacataccaacaggaggta

SEQ ID NO: 701061 - DNA, 25 bp, Mus musculus
gtgatgcacatagcaacaggaggta

SEQ ID NO: 701062 - DNA, 25 bp, Mus musculus
gtgatgcagcagctaactcagaact

SEQ ID NO: 701063 - DNA, 25 bp, Mus musculus
gtgatgcagcaggtaactcagaact

SEQ ID NO: 701064 - DNA, 25 bp, Mus musculus
gtgatgcaggcacgctatgttagca

SEQ ID NO: 701065 - DNA, 25 bp, Mus musculus
gtgatgcaggcaggctatgttagca

SEQ ID NO: 701066 - DNA, 25 bp, Mus musculus
gtgatgcagggccttacagagcccc

SEQ ID NO: 701067 - DNA, 25 bp, Mus musculus
gtgatgcagggcgttacagagcccc

SEQ ID NO: 701068 - DNA, 25 bp, Mus musculus
gtgatgcataatcctgtacaccatg

SEQ ID NO: 701069 - DNA, 25 bp, Mus musculus
gtgatgcataatgctgtacaccatg

SEQ ID NO: 701070 - DNA, 25 bp, Mus musculus
gtgatgcatccgaacaacacataaa

SEQ ID NO: 701071 - DNA, 25 bp, Mus musculus
gtgatgcatccgtacaacacataaa

SEQ ID NO: 701072 - DNA, 25 bp, Mus musculus
gtgatgcatctgagtggctggtcca

SEQ ID NO: 701073 - DNA, 25 bp, Mus musculus
gtgatgcatctgtgtggctggtcca

SEQ ID NO: 701074 - DNA, 25 bp, Mus musculus
gtgatgcattcactcccacagatca

SEQ ID NO: 701075 - DNA, 25 bp, Mus musculus
gtgatgcattcagtcccacagatca

SEQ ID NO: 701076 - DNA, 25 bp, Mus musculus
gtgatgccagccagcggtgcagtgt

SEQ ID NO: 701077 - DNA, 25 bp, Mus musculus
gtgatgccagcctgcggtgcagtgt

SEQ ID NO: 701078 - DNA, 25 bp, Mus musculus
gtgatgccagggaaaactgctcctc

SEQ ID NO: 701079 - DNA, 25 bp, Mus musculus
gtgatgccagggtaaactgctcctc

SEQ ID NO: 701080 - DNA, 25 bp, Mus musculus
gtgatgcccacacacagcgattgtc

SEQ ID NO: 701081 - DNA, 25 bp, Mus musculus
gtgatgcccacagacagcgattgtc

SEQ ID NO: 701082 - DNA, 25 bp, Mus musculus
gtgatgcccaggacacacatttaaa

SEQ ID NO: 701083 - DNA, 25 bp, Mus musculus
gtgatgcccaggtcacacatttaaa

SEQ ID NO: 701084 - DNA, 25 bp, Mus musculus
gtgatgccctcaccgagaagcaatg

SEQ ID NO: 701085 - DNA, 25 bp, Mus musculus
gtgatgccctcagcgagaagcaatg

SEQ ID NO: 701086 - DNA, 25 bp, Mus musculus
gtgatgcccttaactacagcctgga

SEQ ID NO: 701087 - DNA, 25 bp, Mus musculus
gtgatgcccttacatgtccggggct

SEQ ID NO: 701088 - DNA, 25 bp, Mus musculus
gtgatgcccttagatgtccggggct

SEQ ID NO: 701089 - DNA, 25 bp, Mus musculus
gtgatgcccttatctacagcctgga

SEQ ID NO: 701090 - DNA, 25 bp, Mus musculus
gtgatgcctatgaaacagaaacaga

SEQ ID NO: 701091 - DNA, 25 bp, Mus musculus
gtgatgcctatgtaacagaaacaga

SEQ ID NO: 701092 - DNA, 25 bp, Mus musculus
gtgatgcctgccatggcacctatag

SEQ ID NO: 701093 - DNA, 25 bp, Mus musculus
gtgatgcctgccttggcacctatag

SEQ ID NO: 701094 - DNA, 25 bp, Mus musculus
gtgatgcctggaaatgtcattccaa

SEQ ID NO: 701095 - DNA, 25 bp, Mus musculus
gtgatgcctggatatgtcattccaa

SEQ ID NO: 701096 - DNA, 25 bp, Mus musculus
gtgatgcctgggattacaagagatt

SEQ ID NO: 701097 - DNA, 25 bp, Mus musculus
gtgatgcctgggtttacaagagatt

SEQ ID NO: 701098 - DNA, 25 bp, Mus musculus
gtgatgcctgttcagtcagatgctt

SEQ ID NO: 701099 - DNA, 25 bp, Mus musculus
gtgatgcctgttgagtcagatgctt

SEQ ID NO: 701100 - DNA, 25 bp, Mus musculus
gtgatgccttatctggattgttttg

SEQ ID NO: 701101 - DNA, 25 bp, Mus musculus
gtgatgccttatgtggattgttttg

SEQ ID NO: 701102 - DNA, 25 bp, Mus musculus
gtgatgccttcaaaaatacccttgt

SEQ ID NO: 701103 - DNA, 25 bp, Mus musculus
gtgatgccttcataaatacccttgt

SEQ ID NO: 701104 - DNA, 25 bp, Mus musculus
gtgatgccttggatcagctgattga

SEQ ID NO: 701105 - DNA, 25 bp, Mus musculus
gtgatgccttggttcagctgattga

SEQ ID NO: 701106 - DNA, 25 bp, Mus musculus
gtgatgcgcaggactcattggttcg

SEQ ID NO: 701107 - DNA, 25 bp, Mus musculus
gtgatgcgcaggtctcattggttcg

SEQ ID NO: 701108 - DNA, 25 bp, Mus musculus
gtgatgcgcattacgattttgcttt

SEQ ID NO: 701109 - DNA, 25 bp, Mus musculus
gtgatgcgcatttcgattttgcttt

SEQ ID NO: 701110 - DNA, 25 bp, Mus musculus
gtgatgctaacacgctggacaggtt

SEQ ID NO: 701111 - DNA, 25 bp, Mus musculus
gtgatgctaacaggctggacaggtt

SEQ ID NO: 701112 - DNA, 25 bp, Mus musculus
gtgatgctacaaacacacttagtgt

SEQ ID NO: 701113 - DNA, 25 bp, Mus musculus
gtgatgctacaatcacacttagtgt

SEQ ID NO: 701114 - DNA, 25 bp, Mus musculus
gtgatgctacacaccatttggagat

SEQ ID NO: 701115 - DNA, 25 bp, Mus musculus
gtgatgctacactccatttggagat

SEQ ID NO: 701116 - DNA, 25 bp, Mus musculus
gtgatgctactcaggaaggacctca

SEQ ID NO: 701117 - DNA, 25 bp, Mus musculus
gtgatgctactctggaaggacctca

SEQ ID NO: 701118 - DNA, 25 bp, Mus musculus
gtgatgctatccaaggctgtttcct

SEQ ID NO: 701119 - DNA, 25 bp, Mus musculus
gtgatgctatcctaggctgtttcct

SEQ ID NO: 701120 - DNA, 25 bp, Mus musculus
gtgatgctatggaatccccactgat

SEQ ID NO: 701121 - DNA, 25 bp, Mus musculus
gtgatgctatggtatccccactgat

SEQ ID NO: 701122 - DNA, 25 bp, Mus musculus
gtgatgctcacaataggttagtctg

SEQ ID NO: 701123 - DNA, 25 bp, Mus musculus
gtgatgctcacattaggttagtctg

SEQ ID NO: 701124 - DNA, 25 bp, Mus musculus
gtgatgctcagcacgttttttataa

SEQ ID NO: 701125 - DNA, 25 bp, Mus musculus
gtgatgctcagctcgttttttataa

SEQ ID NO: 701126 - DNA, 25 bp, Mus musculus
gtgatgctcattatccacaaacata

SEQ ID NO: 701127 - DNA, 25 bp, Mus musculus
gtgatgctcattttccacaaacata

SEQ ID NO: 701128 - DNA, 25 bp, Mus musculus
gtgatgctgcccatagatgtccctg

SEQ ID NO: 701129 - DNA, 25 bp, Mus musculus
gtgatgctgcccttagatgtccctg

SEQ ID NO: 701130 - DNA, 25 bp, Mus musculus
gtgatgctgctaaacatttgtgcct

SEQ ID NO: 701131 - DNA, 25 bp, Mus musculus
gtgatgctgctaatgatctgccatg

SEQ ID NO: 701132 - DNA, 25 bp, Mus musculus
gtgatgctgctatacatttgtgcct

SEQ ID NO: 701133 - DNA, 25 bp, Mus musculus
gtgatgctgctattgatctgccatg

SEQ ID NO: 701134 - DNA, 25 bp, Mus musculus
gtgatgctggacactactgctccct

SEQ ID NO: 701135 - DNA, 25 bp, Mus musculus
gtgatgctggactctactgctccct

SEQ ID NO: 701136 - DNA, 25 bp, Mus musculus
gtgatgctggagaacgttacccaag

SEQ ID NO: 701137 - DNA, 25 bp, Mus musculus
gtgatgctggagtacgttacccaag

SEQ ID NO: 701138 - DNA, 25 bp, Mus musculus
gtgatgctggatcttactaaacgca

SEQ ID NO: 701139 - DNA, 25 bp, Mus musculus
gtgatgctggatgttactaaacgca

SEQ ID NO: 701140 - DNA, 25 bp, Mus musculus
gtgatgctgtagaagctcagcactt

SEQ ID NO: 701141 - DNA, 25 bp, Mus musculus
gtgatgctgtagtagctcagcactt

SEQ ID NO: 701142 - DNA, 25 bp, Mus musculus
gtgatgctgtttcgaacttcttaac

SEQ ID NO: 701143 - DNA, 25 bp, Mus musculus
gtgatgctgtttggaacttcttaac

SEQ ID NO: 701144 - DNA, 25 bp, Mus musculus
gtgatgcttgagagtgcagtcccat

SEQ ID NO: 701145 - DNA, 25 bp, Mus musculus
gtgatgcttgagtgtgcagtcccat

SEQ ID NO: 701146 - DNA, 25 bp, Mus musculus
gtgatgcttttcaacaaggcccact

SEQ ID NO: 701147 - DNA, 25 bp, Mus musculus
gtgatgcttttctacaaggcccact

SEQ ID NO: 701148 - DNA, 25 bp, Mus musculus
gtgatggaacctatgaaccttcttg

SEQ ID NO: 701149 - DNA, 25 bp, Mus musculus
gtgatggaacctttgaaccttcttg

SEQ ID NO: 701150 - DNA, 25 bp, Mus musculus
gtgatggaactgacacctgagcagg

SEQ ID NO: 701151 - DNA, 25 bp, Mus musculus
gtgatggaactgtcacctgagcagg

SEQ ID NO: 701152 - DNA, 25 bp, Mus musculus
gtgatggacatcattgcccttgcag

SEQ ID NO: 701153 - DNA, 25 bp, Mus musculus
gtgatggacatctttgcccttgcag

SEQ ID NO: 701154 - DNA, 25 bp, Mus musculus
gtgatggactttactgtatctgccc

SEQ ID NO: 701155 - DNA, 25 bp, Mus musculus
gtgatggactttcactatgttacag

SEQ ID NO: 701156 - DNA, 25 bp, Mus musculus
gtgatggactttgactatgttacag

SEQ ID NO: 701157 - DNA, 25 bp, Mus musculus
gtgatggacttttctgtatctgccc

SEQ ID NO: 701158 - DNA, 25 bp, Mus musculus
gtgatggagaccagccagatgtcca

SEQ ID NO: 701159 - DNA, 25 bp, Mus musculus
gtgatggagacctgccagatgtcca

SEQ ID NO: 701160 - DNA, 25 bp, Mus musculus
gtgatggagactatgcaggagccta

SEQ ID NO: 701161 - DNA, 25 bp, Mus musculus
gtgatggagactttgcaggagccta

SEQ ID NO: 701162 - DNA, 25 bp, Mus musculus
gtgatggagctcagatcctcagtct

SEQ ID NO: 701163 - DNA, 25 bp, Mus musculus
gtgatggagctctgatcctcagtct

SEQ ID NO: 701164 - DNA, 25 bp, Mus musculus
gtgatggaggacatctgtgtgtcac

SEQ ID NO: 701165 - DNA, 25 bp, Mus musculus
gtgatggaggacttctgtgtgtcac

SEQ ID NO: 701166 - DNA, 25 bp, Mus musculus
gtgatggaggctccagccccagcca

SEQ ID NO: 701167 - DNA, 25 bp, Mus musculus
gtgatggaggctgcagccccagcca

SEQ ID NO: 701168 - DNA, 25 bp, Mus musculus
gtgatggagtaaacattccgctggg

SEQ ID NO: 701169 - DNA, 25 bp, Mus musculus
gtgatggagtaatcattccgctggg

SEQ ID NO: 701170 - DNA, 25 bp, Mus musculus
gtgatggagtctacggccctttaaa

SEQ ID NO: 701171 - DNA, 25 bp, Mus musculus
gtgatggagtcttcggccctttaaa

SEQ ID NO: 701172 - DNA, 25 bp, Mus musculus
gtgatggagttaaactttcctgtat

SEQ ID NO: 701173 - DNA, 25 bp, Mus musculus
gtgatggagttatactttcctgtat

SEQ ID NO: 701174 - DNA, 25 bp, Mus musculus
gtgatggataatcttctggaagccc

SEQ ID NO: 701175 - DNA, 25 bp, Mus musculus
gtgatggataatgttctggaagccc

SEQ ID NO: 701176 - DNA, 25 bp, Mus musculus
gtgatggatcagcaagacctctgcc

SEQ ID NO: 701177 - DNA, 25 bp, Mus musculus
gtgatggatcaggaagacctctgcc

SEQ ID NO: 701178 - DNA, 25 bp, Mus musculus
gtgatggatcatcgtctgtctgttc

SEQ ID NO: 701179 - DNA, 25 bp, Mus musculus
gtgatggatcatggtctgtctgttc

SEQ ID NO: 701180 - DNA, 25 bp, Mus musculus
gtgatggatgcgctcccagcacgaa

SEQ ID NO: 701181 - DNA, 25 bp, Mus musculus
gtgatggatgcggtcccagcacgaa

SEQ ID NO: 701182 - DNA, 25 bp, Mus musculus
gtgatggcaaacaatcccagatcca

SEQ ID NO: 701183 - DNA, 25 bp, Mus musculus
gtgatggcaaactatcccagatcca

SEQ ID NO: 701184 - DNA, 25 bp, Mus musculus
gtgatggcaccaacgatttccgaga

SEQ ID NO: 701185 - DNA, 25 bp, Mus musculus
gtgatggcaccatcgatttccgaga

SEQ ID NO: 701186 - DNA, 25 bp, Mus musculus
gtgatggcacctcagtttttaagta

SEQ ID NO: 701187 - DNA, 25 bp, Mus musculus
gtgatggcacctgagtttttaagta

SEQ ID NO: 701188 - DNA, 25 bp, Mus musculus
gtgatggcagtgattcaggacaagc

SEQ ID NO: 701189 - DNA, 25 bp, Mus musculus
gtgatggcagtgtttcaggacaagc

SEQ ID NO: 701190 - DNA, 25 bp, Mus musculus
gtgatggcagttcaccacctctggg

SEQ ID NO: 701191 - DNA, 25 bp, Mus musculus
gtgatggcagttgaccacctctggg

SEQ ID NO: 701192 - DNA, 25 bp, Mus musculus
gtgatggcatccaagctgagctgga

SEQ ID NO: 701193 - DNA, 25 bp, Mus musculus
gtgatggcatcctagctgagctgga

SEQ ID NO: 701194 - DNA, 25 bp, Mus musculus
gtgatggcatgaaatgtggtcctga

SEQ ID NO: 701195 - DNA, 25 bp, Mus musculus
gtgatggcatgatatgtggtcctga

SEQ ID NO: 701196 - DNA, 25 bp, Mus musculus
gtgatggcattgcaagttggctact

SEQ ID NO: 701197 - DNA, 25 bp, Mus musculus
gtgatggcattggaagttggctact

SEQ ID NO: 701198 - DNA, 25 bp, Mus musculus
gtgatggccaccatttgtacactgc

SEQ ID NO: 701199 - DNA, 25 bp, Mus musculus
gtgatggccaccttttgtacactgc

SEQ ID NO: 701200 - DNA, 25 bp, Mus musculus
gtgatggccgacataatggttttgt

SEQ ID NO: 701201 - DNA, 25 bp, Mus musculus
gtgatggccgacttaatggttttgt

SEQ ID NO: 701202 - DNA, 25 bp, Mus musculus
gtgatggcctaaaacctatcctggt

SEQ ID NO: 701203 - DNA, 25 bp, Mus musculus
gtgatggcctaatacctatcctggt

SEQ ID NO: 701204 - DNA, 25 bp, Mus musculus
gtgatggcctccaattacttcctgg

SEQ ID NO: 701205 - DNA, 25 bp, Mus musculus
gtgatggcctcctattacttcctgg

SEQ ID NO: 701206 - DNA, 25 bp, Mus musculus
gtgatggcgcttagggtcaagtaca

SEQ ID NO: 701207 - DNA, 25 bp, Mus musculus
gtgatggcgctttgggtcaagtaca

SEQ ID NO: 701208 - DNA, 25 bp, Mus musculus
gtgatggcggccaagactccagaat

SEQ ID NO: 701209 - DNA, 25 bp, Mus musculus
gtgatggcggcctagactccagaat

SEQ ID NO: 701210 - DNA, 25 bp, Mus musculus
gtgatggcgtttaccagatcggaga

SEQ ID NO: 701211 - DNA, 25 bp, Mus musculus
gtgatggcgttttccagatcggaga

SEQ ID NO: 701212 - DNA, 25 bp, Mus musculus
gtgatggctaaccttgatacctttc

SEQ ID NO: 701213 - DNA, 25 bp, Mus musculus
gtgatggctaacgttgatacctttc

SEQ ID NO: 701214 - DNA, 25 bp, Mus musculus
gtgatggctgaaccctccctgaaca

SEQ ID NO: 701215 - DNA, 25 bp, Mus musculus
gtgatggctgaagcctccctgaaca

SEQ ID NO: 701216 - DNA, 25 bp, Mus musculus
gtgatggctgacactctggaggccc

SEQ ID NO: 701217 - DNA, 25 bp, Mus musculus
gtgatggctgactctctggaggccc

SEQ ID NO: 701218 - DNA, 25 bp, Mus musculus
gtgatggcttttcttcgaatatgtg

SEQ ID NO: 701219 - DNA, 25 bp, Mus musculus
gtgatggcttttgttcgaatatgtg

SEQ ID NO: 701220 - DNA, 25 bp, Mus musculus
gtgatgggaaccattacaccagcat

SEQ ID NO: 701221 - DNA, 25 bp, Mus musculus
gtgatgggaacctttacaccagcat

SEQ ID NO: 701222 - DNA, 25 bp, Mus musculus
gtgatgggaccaccgagatctcacc

SEQ ID NO: 701223 - DNA, 25 bp, Mus musculus
gtgatgggaccagcgagatctcacc

SEQ ID NO: 701224 - DNA, 25 bp, Mus musculus
gtgatgggacctatagtccatgcaa

SEQ ID NO: 701225 - DNA, 25 bp, Mus musculus
gtgatgggacctttagtccatgcaa

SEQ ID NO: 701226 - DNA, 25 bp, Mus musculus
gtgatgggatcccatgccagtgaat

SEQ ID NO: 701227 - DNA, 25 bp, Mus musculus
gtgatgggatccgatgccagtgaat

SEQ ID NO: 701228 - DNA, 25 bp, Mus musculus
gtgatgggattacaccccggtcttc

SEQ ID NO: 701229 - DNA, 25 bp, Mus musculus
gtgatgggattagaccccggtcttc

SEQ ID NO: 701230 - DNA, 25 bp, Mus musculus
gtgatgggcaagaagaaatattatt

SEQ ID NO: 701231 - DNA, 25 bp, Mus musculus
gtgatgggcaagtagaaatattatt

SEQ ID NO: 701232 - DNA, 25 bp, Mus musculus
gtgatgggccctatatggttaacat

SEQ ID NO: 701233 - DNA, 25 bp, Mus musculus
gtgatgggccctttatggttaacat

SEQ ID NO: 701234 - DNA, 25 bp, Mus musculus
gtgatgggctatacgagcaggcctt

SEQ ID NO: 701235 - DNA, 25 bp, Mus musculus
gtgatgggctattcgagcaggcctt

SEQ ID NO: 701236 - DNA, 25 bp, Mus musculus
gtgatggtaaaacctcagctgatga

SEQ ID NO: 701237 - DNA, 25 bp, Mus musculus
gtgatggtaaaagctcagctgatga

SEQ ID NO: 701238 - DNA, 25 bp, Mus musculus
gtgatggtaacaataagctattcaa

SEQ ID NO: 701239 - DNA, 25 bp, Mus musculus
gtgatggtaacattaagctattcaa

SEQ ID NO: 701240 - DNA, 25 bp, Mus musculus
gtgatggtcaagcttgttcctacat

SEQ ID NO: 701241 - DNA, 25 bp, Mus musculus
gtgatggtcaaggttgttcctacat

SEQ ID NO: 701242 - DNA, 25 bp, Mus musculus
gtgatggtcgagacatgtacatgga

SEQ ID NO: 701243 - DNA, 25 bp, Mus musculus
gtgatggtcgagtcatgtacatgga

SEQ ID NO: 701244 - DNA, 25 bp, Mus musculus
gtgatggtcgccaaaaaggatgtcc

SEQ ID NO: 701245 - DNA, 25 bp, Mus musculus
gtgatggtcgcctaaaaggatgtcc

SEQ ID NO: 701246 - DNA, 25 bp, Mus musculus
gtgatggtgacaacgcaagagcaga

SEQ ID NO: 701247 - DNA, 25 bp, Mus musculus
gtgatggtgacatcgcaagagcaga

SEQ ID NO: 701248 - DNA, 25 bp, Mus musculus
gtgatggtgcaaaacgcctttaatc

SEQ ID NO: 701249 - DNA, 25 bp, Mus musculus
gtgatggtgcaatacgcctttaatc

SEQ ID NO: 701250 - DNA, 25 bp, Mus musculus
gtgatggtgcagatttgtaatccca

SEQ ID NO: 701251 - DNA, 25 bp, Mus musculus
gtgatggtgcagttttgtaatccca

SEQ ID NO: 701252 - DNA, 25 bp, Mus musculus
gtgatggttcccctgactgtcagga

SEQ ID NO: 701253 - DNA, 25 bp, Mus musculus
gtgatggttcccgtgactgtcagga

SEQ ID NO: 701254 - DNA, 25 bp, Mus musculus
gtgatggttcgtcttctctgataca

SEQ ID NO: 701255 - DNA, 25 bp, Mus musculus
gtgatggttcgtgttctctgataca

SEQ ID NO: 701256 - DNA, 25 bp, Mus musculus
gtgatgtaagatatatctcccagaa

SEQ ID NO: 701257 - DNA, 25 bp, Mus musculus
gtgatgtaagatttatctcccagaa

SEQ ID NO: 701258 - DNA, 25 bp, Mus musculus
gtgatgtaaggccttccgcaatgag

SEQ ID NO: 701259 - DNA, 25 bp, Mus musculus
gtgatgtaaggcgttccgcaatgag

SEQ ID NO: 701260 - DNA, 25 bp, Mus musculus
gtgatgtaccctacctatcaaagag

SEQ ID NO: 701261 - DNA, 25 bp, Mus musculus
gtgatgtacccttcctatcaaagag

SEQ ID NO: 701262 - DNA, 25 bp, Mus musculus
gtgatgtacgtgcaacagcactgtt

SEQ ID NO: 701263 - DNA, 25 bp, Mus musculus
gtgatgtacgtggaacagcactgtt

SEQ ID NO: 701264 - DNA, 25 bp, Mus musculus
gtgatgtacgttcccaaggcagcat

SEQ ID NO: 701265 - DNA, 25 bp, Mus musculus
gtgatgtacgttgccaaggcagcat

SEQ ID NO: 701266 - DNA, 25 bp, Mus musculus
gtgatgtactgtatttgattggcca

SEQ ID NO: 701267 - DNA, 25 bp, Mus musculus
gtgatgtactgtttttgattggcca

SEQ ID NO: 701268 - DNA, 25 bp, Mus musculus
gtgatgtagttaacgtttacctggt

SEQ ID NO: 701269 - DNA, 25 bp, Mus musculus
gtgatgtagttatcgtttacctggt

SEQ ID NO: 701270 - DNA, 25 bp, Mus musculus
gtgatgtcaacactcttactcagct

SEQ ID NO: 701271 - DNA, 25 bp, Mus musculus
gtgatgtcaacagtcttactcagct

SEQ ID NO: 701272 - DNA, 25 bp, Mus musculus
gtgatgtcacataaggcagcgcagc

SEQ ID NO: 701273 - DNA, 25 bp, Mus musculus
gtgatgtcacattaggcagcgcagc

SEQ ID NO: 701274 - DNA, 25 bp, Mus musculus
gtgatgtcagagcaacccttgagca

SEQ ID NO: 701275 - DNA, 25 bp, Mus musculus
gtgatgtcagaggaacccttgagca

SEQ ID NO: 701276 - DNA, 25 bp, Mus musculus
gtgatgtcagctactgttagcagcc

SEQ ID NO: 701277 - DNA, 25 bp, Mus musculus
gtgatgtcagcttctgttagcagcc

SEQ ID NO: 701278 - DNA, 25 bp, Mus musculus
gtgatgtcatataacttgctgcttg

SEQ ID NO: 701279 - DNA, 25 bp, Mus musculus
gtgatgtcatattacttgctgcttg

SEQ ID NO: 701280 - DNA, 25 bp, Mus musculus
gtgatgtccatcatcatgaggatgt

SEQ ID NO: 701281 - DNA, 25 bp, Mus musculus
gtgatgtccatcttcatgaggatgt

SEQ ID NO: 701282 - DNA, 25 bp, Mus musculus
gtgatgtccgccagaggctcatgaa

SEQ ID NO: 701283 - DNA, 25 bp, Mus musculus
gtgatgtccgcctgaggctcatgaa

SEQ ID NO: 701284 - DNA, 25 bp, Mus musculus
gtgatgtcctgtaactctttactta

SEQ ID NO: 701285 - DNA, 25 bp, Mus musculus
gtgatgtcctgttactctttactta

SEQ ID NO: 701286 - DNA, 25 bp, Mus musculus
gtgatgtctaaaaaccctttattgt

SEQ ID NO: 701287 - DNA, 25 bp, Mus musculus
gtgatgtctaaataccctttattgt

SEQ ID NO: 701288 - DNA, 25 bp, Mus musculus
gtgatgtctaagctgttactgtata

SEQ ID NO: 701289 - DNA, 25 bp, Mus musculus
gtgatgtctaaggtgttactgtata

SEQ ID NO: 701290 - DNA, 25 bp, Mus musculus
gtgatgtctgtgaacctgttcatga

SEQ ID NO: 701291 - DNA, 25 bp, Mus musculus
gtgatgtctgtgtacctgttcatga

SEQ ID NO: 701292 - DNA, 25 bp, Mus musculus
gtgatgtcttccacacgactgtcaa

SEQ ID NO: 701293 - DNA, 25 bp, Mus musculus
gtgatgtcttcctcacgactgtcaa

SEQ ID NO: 701294 - DNA, 25 bp, Mus musculus
gtgatgtcttttatccaacaggatt

SEQ ID NO: 701295 - DNA, 25 bp, Mus musculus
gtgatgtcttttttccaacaggatt

SEQ ID NO: 701296 - DNA, 25 bp, Mus musculus
gtgatgtgaactcctcctgttgcca

SEQ ID NO: 701297 - DNA, 25 bp, Mus musculus
gtgatgtgaactgctcctgttgcca

SEQ ID NO: 701298 - DNA, 25 bp, Mus musculus
gtgatgtgacctatgacaactggta

SEQ ID NO: 701299 - DNA, 25 bp, Mus musculus
gtgatgtgacctttgacaactggta

SEQ ID NO: 701300 - DNA, 25 bp, Mus musculus
gtgatgtgagacaccctttgcccaa

SEQ ID NO: 701301 - DNA, 25 bp, Mus musculus
gtgatgtgagactccctttgcccaa

SEQ ID NO: 701302 - DNA, 25 bp, Mus musculus
gtgatgtgatgaatctgccaaatga

SEQ ID NO: 701303 - DNA, 25 bp, Mus musculus
gtgatgtgatgattctgccaaatga

SEQ ID NO: 701304 - DNA, 25 bp, Mus musculus
gtgatgtgatttccttcacaccagc

SEQ ID NO: 701305 - DNA, 25 bp, Mus musculus
gtgatgtgatttgcttcacaccagc

SEQ ID NO: 701306 - DNA, 25 bp, Mus musculus
gtgatgtgcctgcaattgtcaaaat

SEQ ID NO: 701307 - DNA, 25 bp, Mus musculus
gtgatgtgcctggaattgtcaaaat

SEQ ID NO: 701308 - DNA, 25 bp, Mus musculus
gtgatgtgctagatccctttaacta

SEQ ID NO: 701309 - DNA, 25 bp, Mus musculus
gtgatgtgctagttccctttaacta

SEQ ID NO: 701310 - DNA, 25 bp, Mus musculus
gtgatgtgctttaccagtatcttca

SEQ ID NO: 701311 - DNA, 25 bp, Mus musculus
gtgatgtgcttttccagtatcttca

SEQ ID NO: 701312 - DNA, 25 bp, Mus musculus
gtgatgtggacacttgcgtggccga

SEQ ID NO: 701313 - DNA, 25 bp, Mus musculus
gtgatgtggacagttgcgtggccga

SEQ ID NO: 701314 - DNA, 25 bp, Mus musculus
gtgatgtggctgaacactgtcttaa

SEQ ID NO: 701315 - DNA, 25 bp, Mus musculus
gtgatgtggctgtacactgtcttaa

SEQ ID NO: 701316 - DNA, 25 bp, Mus musculus
gtgatgtggtttaccttcaactgca

SEQ ID NO: 701317 - DNA, 25 bp, Mus musculus
gtgatgtggttttccttcaactgca

SEQ ID NO: 701318 - DNA, 25 bp, Mus musculus
gtgatgtgtggaacctcaagcccca

SEQ ID NO: 701319 - DNA, 25 bp, Mus musculus
gtgatgtgtggatcctcaagcccca

SEQ ID NO: 701320 - DNA, 25 bp, Mus musculus
gtgatgtgtggtcacttccctctgc

SEQ ID NO: 701321 - DNA, 25 bp, Mus musculus
gtgatgtgtggtgacttccctctgc

SEQ ID NO: 701322 - DNA, 25 bp, Mus musculus
gtgatgtgtgtaacttgtccccagc

SEQ ID NO: 701323 - DNA, 25 bp, Mus musculus
gtgatgtgtgtatcttgtccccagc

SEQ ID NO: 701324 - DNA, 25 bp, Mus musculus
gtgatgtgttcacaccagaggtaaa

SEQ ID NO: 701325 - DNA, 25 bp, Mus musculus
gtgatgtgttcagaccagaggtaaa

SEQ ID NO: 701326 - DNA, 25 bp, Mus musculus
gtgatgtgttccatttccttgctct

SEQ ID NO: 701327 - DNA, 25 bp, Mus musculus
gtgatgtgttccttttccttgctct

SEQ ID NO: 701328 - DNA, 25 bp, Mus musculus
gtgatgtgttggagactgcacccca

SEQ ID NO: 701329 - DNA, 25 bp, Mus musculus
gtgatgtgttggtgactgcacccca

SEQ ID NO: 701330 - DNA, 25 bp, Mus musculus
gtgatgttaaggactctgtggcaaa

SEQ ID NO: 701331 - DNA, 25 bp, Mus musculus
gtgatgttaaggtctctgtggcaaa

SEQ ID NO: 701332 - DNA, 25 bp, Mus musculus
gtgatgttcactaccatattttgca

SEQ ID NO: 701333 - DNA, 25 bp, Mus musculus
gtgatgttcactccctgtggtagca

SEQ ID NO: 701334 - DNA, 25 bp, Mus musculus
gtgatgttcactgcctgtggtagca

SEQ ID NO: 701335 - DNA, 25 bp, Mus musculus
gtgatgttcacttccatattttgca

SEQ ID NO: 701336 - DNA, 25 bp, Mus musculus
gtgatgttgatactgcagcttagca

SEQ ID NO: 701337 - DNA, 25 bp, Mus musculus
gtgatgttgatagtgcagcttagca

SEQ ID NO: 701338 - DNA, 25 bp, Mus musculus
gtgatgttgcaaagaaactaggaga

SEQ ID NO: 701339 - DNA, 25 bp, Mus musculus
gtgatgttgcaatgaaactaggaga

SEQ ID NO: 701340 - DNA, 25 bp, Mus musculus
gtgatgttgcacacaggaagactgt

SEQ ID NO: 701341 - DNA, 25 bp, Mus musculus
gtgatgttgcactcaggaagactgt

SEQ ID NO: 701342 - DNA, 25 bp, Mus musculus
gtgatgtttactctgttctctagca

SEQ ID NO: 701343 - DNA, 25 bp, Mus musculus
gtgatgtttactgtgttctctagca

SEQ ID NO: 701344 - DNA, 25 bp, Mus musculus
gtgatgtttataatctgaccaaagt

SEQ ID NO: 701345 - DNA, 25 bp, Mus musculus
gtgatgtttatattctgaccaaagt

SEQ ID NO: 701346 - DNA, 25 bp, Mus musculus
gtgatgtttcaaatgctgtttgtaa

SEQ ID NO: 701347 - DNA, 25 bp, Mus musculus
gtgatgtttcaattgctgtttgtaa

SEQ ID NO: 701348 - DNA, 25 bp, Mus musculus
gtgatgtttcatagctgctaaaaat

SEQ ID NO: 701349 - DNA, 25 bp, Mus musculus
gtgatgtttcattgctgctaaaaat

SEQ ID NO: 701350 - DNA, 25 bp, Mus musculus
gtgatgtttcctacttatttctgaa

SEQ ID NO: 701351 - DNA, 25 bp, Mus musculus
gtgatgtttccttcttatttctgaa

SEQ ID NO: 701352 - DNA, 25 bp, Mus musculus
gtgatgtttcttccattcatgtaaa

SEQ ID NO: 701353 - DNA, 25 bp, Mus musculus
gtgatgtttcttgcattcatgtaaa

SEQ ID NO: 701354 - DNA, 25 bp, Mus musculus
gtgatgtttggaccactttcagaac

SEQ ID NO: 701355 - DNA, 25 bp, Mus musculus
gtgatgtttggagcactttcagaac

SEQ ID NO: 701356 - DNA, 25 bp, Mus musculus
gtgatgtttgtcactagtgttctaa

SEQ ID NO: 701357 - DNA, 25 bp, Mus musculus
gtgatgtttgtctctagtgttctaa

SEQ ID NO: 701358 - DNA, 25 bp, Mus musculus
gtgatgttttatagactatagtata

SEQ ID NO: 701359 - DNA, 25 bp, Mus musculus
gtgatgttttatctcttttagtctg

SEQ ID NO: 701360 - DNA, 25 bp, Mus musculus
gtgatgttttatgtcttttagtctg

SEQ ID NO: 701361 - DNA, 25 bp, Mus musculus
gtgatgttttattgactatagtata

SEQ ID NO: 701362 - DNA, 25 bp, Mus musculus
gtgattaaaagaccatcaaactcag

SEQ ID NO: 701363 - DNA, 25 bp, Mus musculus
gtgattaaaagagcatcaaactcag

SEQ ID NO: 701364 - DNA, 25 bp, Mus musculus
gtgattaaaggcaggcaccacccac

SEQ ID NO: 701365 - DNA, 25 bp, Mus musculus
gtgattaaaggctggcaccacccac

SEQ ID NO: 701366 - DNA, 25 bp, Mus musculus
gtgattaaagtgaccccagcgctta

SEQ ID NO: 701367 - DNA, 25 bp, Mus musculus
gtgattaaagtgtccccagcgctta

SEQ ID NO: 701368 - DNA, 25 bp, Mus musculus
gtgattaaatataagcatgtttctc

SEQ ID NO: 701369 - DNA, 25 bp, Mus musculus
gtgattaaatattagcatgtttctc

SEQ ID NO: 701370 - DNA, 25 bp, Mus musculus
gtgattaaggctccccttctatata

SEQ ID NO: 701371 - DNA, 25 bp, Mus musculus
gtgattaaggctgcccttctatata

SEQ ID NO: 701372 - DNA, 25 bp, Mus musculus
gtgattaagtcaccactggcggctg

SEQ ID NO: 701373 - DNA, 25 bp, Mus musculus
gtgattaagtcagcactggcggctg

SEQ ID NO: 701374 - DNA, 25 bp, Mus musculus
gtgattacagcaacgccatggacaa

SEQ ID NO: 701375 - DNA, 25 bp, Mus musculus
gtgattacagcaataaactctactt

SEQ ID NO: 701376 - DNA, 25 bp, Mus musculus
gtgattacagcatcgccatggacaa

SEQ ID NO: 701377 - DNA, 25 bp, Mus musculus
gtgattacagcattaaactctactt

SEQ ID NO: 701378 - DNA, 25 bp, Mus musculus
gtgattacaggaacagcatttccca

SEQ ID NO: 701379 - DNA, 25 bp, Mus musculus
gtgattacaggatcagcatttccca

SEQ ID NO: 701380 - DNA, 25 bp, Mus musculus
gtgattacatcacagttgccacaat

SEQ ID NO: 701381 - DNA, 25 bp, Mus musculus
gtgattacatcagagttgccacaat

SEQ ID NO: 701382 - DNA, 25 bp, Mus musculus
gtgattacattacgccttcactcac

SEQ ID NO: 701383 - DNA, 25 bp, Mus musculus
gtgattacattaggccttcactcac

SEQ ID NO: 701384 - DNA, 25 bp, Mus musculus
gtgattaccaaaattggcatattta

SEQ ID NO: 701385 - DNA, 25 bp, Mus musculus
gtgattaccaaatttggcatattta

SEQ ID NO: 701386 - DNA, 25 bp, Mus musculus
gtgattaccacactttaaagaccca

SEQ ID NO: 701387 - DNA, 25 bp, Mus musculus
gtgattaccacagtttaaagaccca

SEQ ID NO: 701388 - DNA, 25 bp, Mus musculus
gtgattacctcacacccttaagcat

SEQ ID NO: 701389 - DNA, 25 bp, Mus musculus
gtgattacctcaccttcaactgggc

SEQ ID NO: 701390 - DNA, 25 bp, Mus musculus
gtgattacctcagacccttaagcat

SEQ ID NO: 701391 - DNA, 25 bp, Mus musculus
gtgattacctcagcttcaactgggc

SEQ ID NO: 701392 - DNA, 25 bp, Mus musculus
gtgattacgagcagcacgtgataat

SEQ ID NO: 701393 - DNA, 25 bp, Mus musculus
gtgattacgagctgcacgtgataat

SEQ ID NO: 701394 - DNA, 25 bp, Mus musculus
gtgattacggatacgggcgccaagc

SEQ ID NO: 701395 - DNA, 25 bp, Mus musculus
gtgattacggattcgggcgccaagc

SEQ ID NO: 701396 - DNA, 25 bp, Mus musculus
gtgattacgtctaaggacctccaga

SEQ ID NO: 701397 - DNA, 25 bp, Mus musculus
gtgattacgtcttaggacctccaga

SEQ ID NO: 701398 - DNA, 25 bp, Mus musculus
gtgattactatcatgagaggtgccc

SEQ ID NO: 701399 - DNA, 25 bp, Mus musculus
gtgattactatcttgagaggtgccc

SEQ ID NO: 701400 - DNA, 25 bp, Mus musculus
gtgattactgaacatactcagcccc

SEQ ID NO: 701401 - DNA, 25 bp, Mus musculus
gtgattactgaagatactcagcccc

SEQ ID NO: 701402 - DNA, 25 bp, Mus musculus
gtgattactgtgcaagtcctccttc

SEQ ID NO: 701403 - DNA, 25 bp, Mus musculus
gtgattactgtggaagtcctccttc

SEQ ID NO: 701404 - DNA, 25 bp, Mus musculus
gtgattacttatatctttccttact

SEQ ID NO: 701405 - DNA, 25 bp, Mus musculus
gtgattacttatttctttccttact

SEQ ID NO: 701406 - DNA, 25 bp, Mus musculus
gtgattagacccctctgggactgga

SEQ ID NO: 701407 - DNA, 25 bp, Mus musculus
gtgattagacccgtctgggactgga

SEQ ID NO: 701408 - DNA, 25 bp, Mus musculus
gtgattagcaaaaacttcctcttag

SEQ ID NO: 701409 - DNA, 25 bp, Mus musculus
gtgattagcaaatacttcctcttag

SEQ ID NO: 701410 - DNA, 25 bp, Mus musculus
gtgattagccacctttgatttttgt

SEQ ID NO: 701411 - DNA, 25 bp, Mus musculus
gtgattagccacgtttgatttttgt

SEQ ID NO: 701412 - DNA, 25 bp, Mus musculus
gtgattaggagcacgtgtgcaccct

SEQ ID NO: 701413 - DNA, 25 bp, Mus musculus
gtgattaggagctcgtgtgcaccct

SEQ ID NO: 701414 - DNA, 25 bp, Mus musculus
gtgattaggccaaaccaatcccatg

SEQ ID NO: 701415 - DNA, 25 bp, Mus musculus
gtgattaggccataccaatcccatg

SEQ ID NO: 701416 - DNA, 25 bp, Mus musculus
gtgattagtcagataaaaccccaag

SEQ ID NO: 701417 - DNA, 25 bp, Mus musculus
gtgattagtcagttaaaaccccaag

SEQ ID NO: 701418 - DNA, 25 bp, Mus musculus
gtgattagttttatccaacctgcag

SEQ ID NO: 701419 - DNA, 25 bp, Mus musculus
gtgattagttttttccaacctgcag

SEQ ID NO: 701420 - DNA, 25 bp, Mus musculus
gtgattatcaataccttgttcacat

SEQ ID NO: 701421 - DNA, 25 bp, Mus musculus
gtgattatcaattccttgttcacat

SEQ ID NO: 701422 - DNA, 25 bp, Mus musculus
gtgattatcacactctcatacctac

SEQ ID NO: 701423 - DNA, 25 bp, Mus musculus
gtgattatcacagtctcatacctac

SEQ ID NO: 701424 - DNA, 25 bp, Mus musculus
gtgattatcatgaaagtcagtcctt

SEQ ID NO: 701425 - DNA, 25 bp, Mus musculus
gtgattatcatgtaagtcagtcctt

SEQ ID NO: 701426 - DNA, 25 bp, Mus musculus
gtgattatccagctcaatggctccg

SEQ ID NO: 701427 - DNA, 25 bp, Mus musculus
gtgattatccaggtcaatggctccg

SEQ ID NO: 701428 - DNA, 25 bp, Mus musculus
gtgattatcgagacaatccctccag

SEQ ID NO: 701429 - DNA, 25 bp, Mus musculus
gtgattatcgagtcaatccctccag

SEQ ID NO: 701430 - DNA, 25 bp, Mus musculus
gtgattatctgacgtcagtgacgtt

SEQ ID NO: 701431 - DNA, 25 bp, Mus musculus
gtgattatctgactggtcgcctgct

SEQ ID NO: 701432 - DNA, 25 bp, Mus musculus
gtgattatctgaggtcagtgacgtt

SEQ ID NO: 701433 - DNA, 25 bp, Mus musculus
gtgattatctgagtggtcgcctgct

SEQ ID NO: 701434 - DNA, 25 bp, Mus musculus
gtgattatctggaccttagcacgtg

SEQ ID NO: 701435 - DNA, 25 bp, Mus musculus
gtgattatctggtccttagcacgtg

SEQ ID NO: 701436 - DNA, 25 bp, Mus musculus
gtgattatcttcaatgcagccagta

SEQ ID NO: 701437 - DNA, 25 bp, Mus musculus
gtgattatcttctatgcagccagta

SEQ ID NO: 701438 - DNA, 25 bp, Mus musculus
gtgattattaaccaccaacttctgt

SEQ ID NO: 701439 - DNA, 25 bp, Mus musculus
gtgattattaacgaccaacttctgt

SEQ ID NO: 701440 - DNA, 25 bp, Mus musculus
gtgattattgacctctgttgcattt

SEQ ID NO: 701441 - DNA, 25 bp, Mus musculus
gtgattattgacgtctgttgcattt

SEQ ID NO: 701442 - DNA, 25 bp, Mus musculus
gtgattattgatactgtacatacca

SEQ ID NO: 701443 - DNA, 25 bp, Mus musculus
gtgattattgattctgtacatacca

SEQ ID NO: 701444 - DNA, 25 bp, Mus musculus
gtgattattgtaaccaaagactcgg

SEQ ID NO: 701445 - DNA, 25 bp, Mus musculus
gtgattattgtatccaaagactcgg

SEQ ID NO: 701446 - DNA, 25 bp, Mus musculus
gtgattatttcacgagtttgggata

SEQ ID NO: 701447 - DNA, 25 bp, Mus musculus
gtgattatttcaggagtttgggata

SEQ ID NO: 701448 - DNA, 25 bp, Mus musculus
gtgattattttcatgacccgatctt

SEQ ID NO: 701449 - DNA, 25 bp, Mus musculus
gtgattattttcttgacccgatctt

SEQ ID NO: 701450 - DNA, 25 bp, Mus musculus
gtgattatttttaagtacagctgaa

SEQ ID NO: 701451 - DNA, 25 bp, Mus musculus
gtgattattttttagtacagctgaa

SEQ ID NO: 701452 - DNA, 25 bp, Mus musculus
gtgattcaaaccagcaactggagta

SEQ ID NO: 701453 - DNA, 25 bp, Mus musculus
gtgattcaaacctgcaactggagta

SEQ ID NO: 701454 - DNA, 25 bp, Mus musculus
gtgattcaagttactgactgtcatt

SEQ ID NO: 701455 - DNA, 25 bp, Mus musculus
gtgattcaagtttctgactgtcatt

SEQ ID NO: 701456 - DNA, 25 bp, Mus musculus
gtgattcacatcaagacctctacgg

SEQ ID NO: 701457 - DNA, 25 bp, Mus musculus
gtgattcacatctagacctctacgg

SEQ ID NO: 701458 - DNA, 25 bp, Mus musculus
gtgattcaccccagaatgctggagt

SEQ ID NO: 701459 - DNA, 25 bp, Mus musculus
gtgattcacccctgaatgctggagt

SEQ ID NO: 701460 - DNA, 25 bp, Mus musculus
gtgattcaggccaagtgcttaccaa

SEQ ID NO: 701461 - DNA, 25 bp, Mus musculus
gtgattcaggcctagtgcttaccaa

SEQ ID NO: 701462 - DNA, 25 bp, Mus musculus
gtgattcatcagaactttgcgctgc

SEQ ID NO: 701463 - DNA, 25 bp, Mus musculus
gtgattcatcagtactttgcgctgc

SEQ ID NO: 701464 - DNA, 25 bp, Mus musculus
gtgattcatcggaaaagccttgatt

SEQ ID NO: 701465 - DNA, 25 bp, Mus musculus
gtgattcatcggtaaagccttgatt

SEQ ID NO: 701466 - DNA, 25 bp, Mus musculus
gtgattcatttcatgtacctatttt

SEQ ID NO: 701467 - DNA, 25 bp, Mus musculus
gtgattcatttcttgtacctatttt

SEQ ID NO: 701468 - DNA, 25 bp, Mus musculus
gtgattccaaaaatatcttctaggt

SEQ ID NO: 701469 - DNA, 25 bp, Mus musculus
gtgattccaaaattatcttctaggt

SEQ ID NO: 701470 - DNA, 25 bp, Mus musculus
gtgattccaacacacatagcaagct

SEQ ID NO: 701471 - DNA, 25 bp, Mus musculus
gtgattccaacagacatagcaagct

SEQ ID NO: 701472 - DNA, 25 bp, Mus musculus
gtgattccaagcaccggcagatctg

SEQ ID NO: 701473 - DNA, 25 bp, Mus musculus
gtgattccaagctccggcagatctg

SEQ ID NO: 701474 - DNA, 25 bp, Mus musculus
gtgattccaatcagaatggtcttct

SEQ ID NO: 701475 - DNA, 25 bp, Mus musculus
gtgattccaatctgaatggtcttct

SEQ ID NO: 701476 - DNA, 25 bp, Mus musculus
gtgattccacttcttctggacctat

SEQ ID NO: 701477 - DNA, 25 bp, Mus musculus
gtgattccacttgttctggacctat

SEQ ID NO: 701478 - DNA, 25 bp, Mus musculus
gtgattccagataagcctttcctac

SEQ ID NO: 701479 - DNA, 25 bp, Mus musculus
gtgattccagattagcctttcctac

SEQ ID NO: 701480 - DNA, 25 bp, Mus musculus
gtgattcccacaataatgtcagtag

SEQ ID NO: 701481 - DNA, 25 bp, Mus musculus
gtgattcccacattaatgtcagtag

SEQ ID NO: 701482 - DNA, 25 bp, Mus musculus
gtgattcccagaccctaatagtagt

SEQ ID NO: 701483 - DNA, 25 bp, Mus musculus
gtgattcccagagcctaatagtagt

SEQ ID NO: 701484 - DNA, 25 bp, Mus musculus
gtgattcccagcacattcagaggga

SEQ ID NO: 701485 - DNA, 25 bp, Mus musculus
gtgattcccagctcattcagaggga

SEQ ID NO: 701486 - DNA, 25 bp, Mus musculus
gtgattccggatactctgttaaaac

SEQ ID NO: 701487 - DNA, 25 bp, Mus musculus
gtgattccggattctctgttaaaac

SEQ ID NO: 701488 - DNA, 25 bp, Mus musculus
gtgattcctaatacactggcagtga

SEQ ID NO: 701489 - DNA, 25 bp, Mus musculus
gtgattcctaattcactggcagtga

SEQ ID NO: 701490 - DNA, 25 bp, Mus musculus
gtgattcctcacattatggctgtca

SEQ ID NO: 701491 - DNA, 25 bp, Mus musculus
gtgattcctcactttatggctgtca

SEQ ID NO: 701492 - DNA, 25 bp, Mus musculus
gtgattcctgacacagttctttggc

SEQ ID NO: 701493 - DNA, 25 bp, Mus musculus
gtgattcctgactcagttctttggc

SEQ ID NO: 701494 - DNA, 25 bp, Mus musculus
gtgattccttagagactacctcatg

SEQ ID NO: 701495 - DNA, 25 bp, Mus musculus
gtgattccttagtgactacctcatg

SEQ ID NO: 701496 - DNA, 25 bp, Mus musculus
gtgattcctttccattactctgaca

SEQ ID NO: 701497 - DNA, 25 bp, Mus musculus
gtgattcctttcgattactctgaca

SEQ ID NO: 701498 - DNA, 25 bp, Mus musculus
gtgattcgcttcagttggtgagaga

SEQ ID NO: 701499 - DNA, 25 bp, Mus musculus
gtgattcgcttctgttggtgagaga

SEQ ID NO: 701500 - DNA, 25 bp, Mus musculus
gtgattcggagacaccagttataat

SEQ ID NO: 701501 - DNA, 25 bp, Mus musculus
gtgattcggagagaccagttataat

SEQ ID NO: 701502 - DNA, 25 bp, Mus musculus
gtgattcgtgatatcaacaccaaca

SEQ ID NO: 701503 - DNA, 25 bp, Mus musculus
gtgattcgtgatttcaacaccaaca

SEQ ID NO: 701504 - DNA, 25 bp, Mus musculus
gtgattctaagtcttttattgaaca

SEQ ID NO: 701505 - DNA, 25 bp, Mus musculus
gtgattctaagtgttttattgaaca

SEQ ID NO: 701506 - DNA, 25 bp, Mus musculus
gtgattctactgaggctgacttaaa

SEQ ID NO: 701507 - DNA, 25 bp, Mus musculus
gtgattctactgtggctgacttaaa

SEQ ID NO: 701508 - DNA, 25 bp, Mus musculus
gtgattctagacacacaggctcaga

SEQ ID NO: 701509 - DNA, 25 bp, Mus musculus
gtgattctagactcacaggctcaga

SEQ ID NO: 701510 - DNA, 25 bp, Mus musculus
gtgattctcaaactgcgttgtattt

SEQ ID NO: 701511 - DNA, 25 bp, Mus musculus
gtgattctcaaagtgcgttgtattt

SEQ ID NO: 701512 - DNA, 25 bp, Mus musculus
gtgattctcactactgttttttggt

SEQ ID NO: 701513 - DNA, 25 bp, Mus musculus
gtgattctcactataaaatcccagt

SEQ ID NO: 701514 - DNA, 25 bp, Mus musculus
gtgattctcacttctgttttttggt

SEQ ID NO: 701515 - DNA, 25 bp, Mus musculus
gtgattctcactttaaaatcccagt

SEQ ID NO: 701516 - DNA, 25 bp, Mus musculus
gtgattctccagcaacttatataga

SEQ ID NO: 701517 - DNA, 25 bp, Mus musculus
gtgattctccaggaacttatataga

SEQ ID NO: 701518 - DNA, 25 bp, Mus musculus
gtgattctcgtaactcttttcttga

SEQ ID NO: 701519 - DNA, 25 bp, Mus musculus
gtgattctcgtatctcttttcttga

SEQ ID NO: 701520 - DNA, 25 bp, Mus musculus
gtgattctcttgactaaaacagttt

SEQ ID NO: 701521 - DNA, 25 bp, Mus musculus
gtgattctcttgtctaaaacagttt

SEQ ID NO: 701522 - DNA, 25 bp, Mus musculus
gtgattctgaacagtagtaccctag

SEQ ID NO: 701523 - DNA, 25 bp, Mus musculus
gtgattctgaactgtagtaccctag

SEQ ID NO: 701524 - DNA, 25 bp, Mus musculus
gtgattctgaagactctgacagaaa

SEQ ID NO: 701525 - DNA, 25 bp, Mus musculus
gtgattctgaagaggccctgcacgc

SEQ ID NO: 701526 - DNA, 25 bp, Mus musculus
gtgattctgaagtctctgacagaaa

SEQ ID NO: 701527 - DNA, 25 bp, Mus musculus
gtgattctgaagtggccctgcacgc

SEQ ID NO: 701528 - DNA, 25 bp, Mus musculus
gtgattctgctcagtgcaagtttag

SEQ ID NO: 701529 - DNA, 25 bp, Mus musculus
gtgattctgctctgtgcaagtttag

SEQ ID NO: 701530 - DNA, 25 bp, Mus musculus
gtgattctggcaaagagagttggat

SEQ ID NO: 701531 - DNA, 25 bp, Mus musculus
gtgattctggcatagagagttggat

SEQ ID NO: 701532 - DNA, 25 bp, Mus musculus
gtgattctgtgaaagtcccggctgc

SEQ ID NO: 701533 - DNA, 25 bp, Mus musculus
gtgattctgtgaaccatttccagca

SEQ ID NO: 701534 - DNA, 25 bp, Mus musculus
gtgattctgtgatagtcccggctgc

SEQ ID NO: 701535 - DNA, 25 bp, Mus musculus
gtgattctgtgatccatttccagca

SEQ ID NO: 701536 - DNA, 25 bp, Mus musculus
gtgattctgtgtagacctctttcca

SEQ ID NO: 701537 - DNA, 25 bp, Mus musculus
gtgattctgtgttgacctctttcca

SEQ ID NO: 701538 - DNA, 25 bp, Mus musculus
gtgattcttaggaagggcagcttta

SEQ ID NO: 701539 - DNA, 25 bp, Mus musculus
gtgattcttaggtagggcagcttta

SEQ ID NO: 701540 - DNA, 25 bp, Mus musculus
gtgattcttcataaaccattgtctt

SEQ ID NO: 701541 - DNA, 25 bp, Mus musculus
gtgattcttcattaaccattgtctt

SEQ ID NO: 701542 - DNA, 25 bp, Mus musculus
gtgattcttggactgttgtaataac

SEQ ID NO: 701543 - DNA, 25 bp, Mus musculus
gtgattcttggagtgttgtaataac

SEQ ID NO: 701544 - DNA, 25 bp, Mus musculus
gtgattctttatcctggtgagtcaa

SEQ ID NO: 701545 - DNA, 25 bp, Mus musculus
gtgattctttatgctggtgagtcaa

SEQ ID NO: 701546 - DNA, 25 bp, Mus musculus
gtgattctttccatccattctatta

SEQ ID NO: 701547 - DNA, 25 bp, Mus musculus
gtgattctttccttccattctatta

SEQ ID NO: 701548 - DNA, 25 bp, Mus musculus
gtgattgaaagtcgtccttgtgtgt

SEQ ID NO: 701549 - DNA, 25 bp, Mus musculus
gtgattgaaagtggtccttgtgtgt

SEQ ID NO: 701550 - DNA, 25 bp, Mus musculus
gtgattgaatgtcaccttctggtgt

SEQ ID NO: 701551 - DNA, 25 bp, Mus musculus
gtgattgaatgtgaccttctggtgt

SEQ ID NO: 701552 - DNA, 25 bp, Mus musculus
gtgattgacaacaccaacccagatg

SEQ ID NO: 701553 - DNA, 25 bp, Mus musculus
gtgattgacaactccaacccagatg

SEQ ID NO: 701554 - DNA, 25 bp, Mus musculus
gtgattgacaccatactgccaacta

SEQ ID NO: 701555 - DNA, 25 bp, Mus musculus
gtgattgacaccatctttgcctaaa

SEQ ID NO: 701556 - DNA, 25 bp, Mus musculus
gtgattgacaccttactgccaacta

SEQ ID NO: 701557 - DNA, 25 bp, Mus musculus
gtgattgacaccttctttgcctaaa

SEQ ID NO: 701558 - DNA, 25 bp, Mus musculus
gtgattgacagcctggtaagccagt

SEQ ID NO: 701559 - DNA, 25 bp, Mus musculus
gtgattgacagcgtggtaagccagt

SEQ ID NO: 701560 - DNA, 25 bp, Mus musculus
gtgattgactttactgaaactctag

SEQ ID NO: 701561 - DNA, 25 bp, Mus musculus
gtgattgacttttctgaaactctag

SEQ ID NO: 701562 - DNA, 25 bp, Mus musculus
gtgattgaggctcgtacctgatacc

SEQ ID NO: 701563 - DNA, 25 bp, Mus musculus
gtgattgaggctggtacctgatacc

SEQ ID NO: 701564 - DNA, 25 bp, Mus musculus
gtgattgagggaagctttgtctaca

SEQ ID NO: 701565 - DNA, 25 bp, Mus musculus
gtgattgagggatgctttgtctaca

SEQ ID NO: 701566 - DNA, 25 bp, Mus musculus
gtgattgattcaagatttcccctta

SEQ ID NO: 701567 - DNA, 25 bp, Mus musculus
gtgattgattcatgatttcccctta

SEQ ID NO: 701568 - DNA, 25 bp, Mus musculus
gtgattgcaattaggttaacattac

SEQ ID NO: 701569 - DNA, 25 bp, Mus musculus
gtgattgcaatttggttaacattac

SEQ ID NO: 701570 - DNA, 25 bp, Mus musculus
gtgattgcagctctgccaaagccag

SEQ ID NO: 701571 - DNA, 25 bp, Mus musculus
gtgattgcagctgtgccaaagccag

SEQ ID NO: 701572 - DNA, 25 bp, Mus musculus
gtgattgcatatctgcccaggcacc

SEQ ID NO: 701573 - DNA, 25 bp, Mus musculus
gtgattgcatatgtgcccaggcacc

SEQ ID NO: 701574 - DNA, 25 bp, Mus musculus
gtgattgccataagcagggatccat

SEQ ID NO: 701575 - DNA, 25 bp, Mus musculus
gtgattgccatatgcagggatccat

SEQ ID NO: 701576 - DNA, 25 bp, Mus musculus
gtgattgcccaacagctggtcgtga

SEQ ID NO: 701577 - DNA, 25 bp, Mus musculus
gtgattgcccaagagctggtcgtga

SEQ ID NO: 701578 - DNA, 25 bp, Mus musculus
gtgattgcccatcacgtagacccca

SEQ ID NO: 701579 - DNA, 25 bp, Mus musculus
gtgattgcccatgacgtagacccca

SEQ ID NO: 701580 - DNA, 25 bp, Mus musculus
gtgattgctactacctgttattttt

SEQ ID NO: 701581 - DNA, 25 bp, Mus musculus
gtgattgctactcaaatataaccat

SEQ ID NO: 701582 - DNA, 25 bp, Mus musculus
gtgattgctactgaaatataaccat

SEQ ID NO: 701583 - DNA, 25 bp, Mus musculus
gtgattgctacttcctgttattttt

SEQ ID NO: 701584 - DNA, 25 bp, Mus musculus
gtgattgctcttacttttacttagt

SEQ ID NO: 701585 - DNA, 25 bp, Mus musculus
gtgattgctctttcttttacttagt

SEQ ID NO: 701586 - DNA, 25 bp, Mus musculus
gtgattgcttgacttgaggcttgat

SEQ ID NO: 701587 - DNA, 25 bp, Mus musculus
gtgattgcttgagttgaggcttgat

SEQ ID NO: 701588 - DNA, 25 bp, Mus musculus
gtgattgctttgacacactacttaa

SEQ ID NO: 701589 - DNA, 25 bp, Mus musculus
gtgattgctttgtcacactacttaa

SEQ ID NO: 701590 - DNA, 25 bp, Mus musculus
gtgattgcttttctatggtgctttt

SEQ ID NO: 701591 - DNA, 25 bp, Mus musculus
gtgattgcttttgtatggtgctttt

SEQ ID NO: 701592 - DNA, 25 bp, Mus musculus
gtgattggaactatgagtagtattt

SEQ ID NO: 701593 - DNA, 25 bp, Mus musculus
gtgattggaactttgagtagtattt

SEQ ID NO: 701594 - DNA, 25 bp, Mus musculus
gtgattggcacaccaggagctctgc

SEQ ID NO: 701595 - DNA, 25 bp, Mus musculus
gtgattggcacagcaggagctctgc

SEQ ID NO: 701596 - DNA, 25 bp, Mus musculus
gtgattggcccgaagctatatagct

SEQ ID NO: 701597 - DNA, 25 bp, Mus musculus
gtgattggcccgtagctatatagct

SEQ ID NO: 701598 - DNA, 25 bp, Mus musculus
gtgattggctgacttcagtcatgat

SEQ ID NO: 701599 - DNA, 25 bp, Mus musculus
gtgattggctgagttcagtcatgat

SEQ ID NO: 701600 - DNA, 25 bp, Mus musculus
gtgattgggattccgcagtaaacat

SEQ ID NO: 701601 - DNA, 25 bp, Mus musculus
gtgattgggattgcgcagtaaacat

SEQ ID NO: 701602 - DNA, 25 bp, Mus musculus
gtgattggtaatatgcttgtttctc

SEQ ID NO: 701603 - DNA, 25 bp, Mus musculus
gtgattggtaatttgcttgtttctc

SEQ ID NO: 701604 - DNA, 25 bp, Mus musculus
gtgattggtccacatgctaatttgc

SEQ ID NO: 701605 - DNA, 25 bp, Mus musculus
gtgattggtccagatgctaatttgc

SEQ ID NO: 701606 - DNA, 25 bp, Mus musculus
gtgattggttcactcatggacacaa

SEQ ID NO: 701607 - DNA, 25 bp, Mus musculus
gtgattggttcagtcatggacacaa

SEQ ID NO: 701608 - DNA, 25 bp, Mus musculus
gtgattggttggcttccttacccca

SEQ ID NO: 701609 - DNA, 25 bp, Mus musculus
gtgattggttgggttccttacccca

SEQ ID NO: 701610 - DNA, 25 bp, Mus musculus
gtgattgtacagcagccagcggcaa

SEQ ID NO: 701611 - DNA, 25 bp, Mus musculus
gtgattgtacaggagccagcggcaa

SEQ ID NO: 701612 - DNA, 25 bp, Mus musculus
gtgattgtacatacctctctttgct

SEQ ID NO: 701613 - DNA, 25 bp, Mus musculus
gtgattgtacattcctctctttgct

SEQ ID NO: 701614 - DNA, 25 bp, Mus musculus
gtgattgtacgtacgatgaaaacca

SEQ ID NO: 701615 - DNA, 25 bp, Mus musculus
gtgattgtacgttcgatgaaaacca

SEQ ID NO: 701616 - DNA, 25 bp, Mus musculus
gtgattgtagtgatttcttatttct

SEQ ID NO: 701617 - DNA, 25 bp, Mus musculus
gtgattgtagtgttttcttatttct

SEQ ID NO: 701618 - DNA, 25 bp, Mus musculus
gtgattgtatatccactaacacaca

SEQ ID NO: 701619 - DNA, 25 bp, Mus musculus
gtgattgtatatgcactaacacaca

SEQ ID NO: 701620 - DNA, 25 bp, Mus musculus
gtgattgtatttactgcaaatgtct

SEQ ID NO: 701621 - DNA, 25 bp, Mus musculus
gtgattgtattttctgcaaatgtct

SEQ ID NO: 701622 - DNA, 25 bp, Mus musculus
gtgattgtctgtactgtgggtctta

SEQ ID NO: 701623 - DNA, 25 bp, Mus musculus
gtgattgtctgttctgtgggtctta

SEQ ID NO: 701624 - DNA, 25 bp, Mus musculus
gtgattgtcttcatgtagtgcagag

SEQ ID NO: 701625 - DNA, 25 bp, Mus musculus
gtgattgtcttcttgtagtgcagag

SEQ ID NO: 701626 - DNA, 25 bp, Mus musculus
gtgattgtgaacaactttcaagcca

SEQ ID NO: 701627 - DNA, 25 bp, Mus musculus
gtgattgtgaactactttcaagcca

SEQ ID NO: 701628 - DNA, 25 bp, Mus musculus
gtgattgtgaccactgtcagtccca

SEQ ID NO: 701629 - DNA, 25 bp, Mus musculus
gtgattgtgacctctgtcagtccca

SEQ ID NO: 701630 - DNA, 25 bp, Mus musculus
gtgattgtgtcgacaaccgaattca

SEQ ID NO: 701631 - DNA, 25 bp, Mus musculus
gtgattgtgtcgtcaaccgaattca

SEQ ID NO: 701632 - DNA, 25 bp, Mus musculus
gtgattgttgctatggtaccctctg

SEQ ID NO: 701633 - DNA, 25 bp, Mus musculus
gtgattgttgctttggtaccctctg

SEQ ID NO: 701634 - DNA, 25 bp, Mus musculus
gtgattgttggtatccgagaagctg

SEQ ID NO: 701635 - DNA, 25 bp, Mus musculus
gtgattgttggtttccgagaagctg

SEQ ID NO: 701636 - DNA, 25 bp, Mus musculus
gtgattgtttcaaaagcctattctt

SEQ ID NO: 701637 - DNA, 25 bp, Mus musculus
gtgattgtttcataagcctattctt

SEQ ID NO: 701638 - DNA, 25 bp, Mus musculus
gtgatttaaatcctaactttcccag

SEQ ID NO: 701639 - DNA, 25 bp, Mus musculus
gtgatttaaatcgtaactttcccag

SEQ ID NO: 701640 - DNA, 25 bp, Mus musculus
gtgatttacaacctcatgtctcaga

SEQ ID NO: 701641 - DNA, 25 bp, Mus musculus
gtgatttacaacgtcatgtctcaga

SEQ ID NO: 701642 - DNA, 25 bp, Mus musculus
gtgatttaccctctaagccttctac

SEQ ID NO: 701643 - DNA, 25 bp, Mus musculus
gtgatttaccctgtaagccttctac

SEQ ID NO: 701644 - DNA, 25 bp, Mus musculus
gtgatttacctgcgatttacaaggg

SEQ ID NO: 701645 - DNA, 25 bp, Mus musculus
gtgatttacctgggatttacaaggg

SEQ ID NO: 701646 - DNA, 25 bp, Mus musculus
gtgatttactgaaactgttttggta

SEQ ID NO: 701647 - DNA, 25 bp, Mus musculus
gtgatttactgatactgttttggta

SEQ ID NO: 701648 - DNA, 25 bp, Mus musculus
gtgatttactgtaagattgccaata

SEQ ID NO: 701649 - DNA, 25 bp, Mus musculus
gtgatttactgtatcttgtgacata

SEQ ID NO: 701650 - DNA, 25 bp, Mus musculus
gtgatttactgttagattgccaata

SEQ ID NO: 701651 - DNA, 25 bp, Mus musculus
gtgatttactgtttcttgtgacata

SEQ ID NO: 701652 - DNA, 25 bp, Mus musculus
gtgatttagctcactagccattaaa

SEQ ID NO: 701653 - DNA, 25 bp, Mus musculus
gtgatttagctctctagccattaaa

SEQ ID NO: 701654 - DNA, 25 bp, Mus musculus
gtgatttataccaatccatcctcaa

SEQ ID NO: 701655 - DNA, 25 bp, Mus musculus
gtgatttatacctatccatcctcaa

SEQ ID NO: 701656 - DNA, 25 bp, Mus musculus
gtgatttatcatccctctcagagat

SEQ ID NO: 701657 - DNA, 25 bp, Mus musculus
gtgatttatcatgcctctcagagat

SEQ ID NO: 701658 - DNA, 25 bp, Mus musculus
gtgatttattttcctccttagaaaa

SEQ ID NO: 701659 - DNA, 25 bp, Mus musculus
gtgatttattttgctccttagaaaa

SEQ ID NO: 701660 - DNA, 25 bp, Mus musculus
gtgatttcaactcttgtcggtctaa

SEQ ID NO: 701661 - DNA, 25 bp, Mus musculus
gtgatttcaactgttgtcggtctaa

SEQ ID NO: 701662 - DNA, 25 bp, Mus musculus
gtgatttcacaaccttctgagatct

SEQ ID NO: 701663 - DNA, 25 bp, Mus musculus
gtgatttcacaagcttctgagatct

SEQ ID NO: 701664 - DNA, 25 bp, Mus musculus
gtgatttcacctcagtaaagttagt

SEQ ID NO: 701665 - DNA, 25 bp, Mus musculus
gtgatttcacctgagtaaagttagt

SEQ ID NO: 701666 - DNA, 25 bp, Mus musculus
gtgatttcactactctgaacccata

SEQ ID NO: 701667 - DNA, 25 bp, Mus musculus
gtgatttcactagtctgaacccata

SEQ ID NO: 701668 - DNA, 25 bp, Mus musculus
gtgatttcagatatgaccctgatag

SEQ ID NO: 701669 - DNA, 25 bp, Mus musculus
gtgatttcagatttgaccctgatag

SEQ ID NO: 701670 - DNA, 25 bp, Mus musculus
gtgatttcagccaacgttgaggcct

SEQ ID NO: 701671 - DNA, 25 bp, Mus musculus
gtgatttcagcctacgttgaggcct

SEQ ID NO: 701672 - DNA, 25 bp, Mus musculus
gtgatttcagtgacggccgggaacc

SEQ ID NO: 701673 - DNA, 25 bp, Mus musculus
gtgatttcagtgtcggccgggaacc

SEQ ID NO: 701674 - DNA, 25 bp, Mus musculus
gtgatttcatccataactcggtagt

SEQ ID NO: 701675 - DNA, 25 bp, Mus musculus
gtgatttcatccttaactcggtagt

SEQ ID NO: 701676 - DNA, 25 bp, Mus musculus
gtgatttccagtcagtaccttacaa

SEQ ID NO: 701677 - DNA, 25 bp, Mus musculus
gtgatttccagtgagtaccttacaa

SEQ ID NO: 701678 - DNA, 25 bp, Mus musculus
gtgatttccatactggacccctgga

SEQ ID NO: 701679 - DNA, 25 bp, Mus musculus
gtgatttccatagtggacccctgga

SEQ ID NO: 701680 - DNA, 25 bp, Mus musculus
gtgatttccatcacactgcaggcat

SEQ ID NO: 701681 - DNA, 25 bp, Mus musculus
gtgatttccatctcactgcaggcat

SEQ ID NO: 701682 - DNA, 25 bp, Mus musculus
gtgatttcctatattcattgagtca

SEQ ID NO: 701683 - DNA, 25 bp, Mus musculus
gtgatttcctattttcattgagtca

SEQ ID NO: 701684 - DNA, 25 bp, Mus musculus
gtgatttcctgaagccaatgtgtca

SEQ ID NO: 701685 - DNA, 25 bp, Mus musculus
gtgatttcctgatgccaatgtgtca

SEQ ID NO: 701686 - DNA, 25 bp, Mus musculus
gtgatttctaccagtgaccatggta

SEQ ID NO: 701687 - DNA, 25 bp, Mus musculus
gtgatttctacctgtgaccatggta

SEQ ID NO: 701688 - DNA, 25 bp, Mus musculus
gtgatttctatcagagcagtagcta

SEQ ID NO: 701689 - DNA, 25 bp, Mus musculus
gtgatttctatcatactcctcagca

SEQ ID NO: 701690 - DNA, 25 bp, Mus musculus
gtgatttctatctgagcagtagcta

SEQ ID NO: 701691 - DNA, 25 bp, Mus musculus
gtgatttctatcttactcctcagca

SEQ ID NO: 701692 - DNA, 25 bp, Mus musculus
gtgatttctcagactgcagcgggac

SEQ ID NO: 701693 - DNA, 25 bp, Mus musculus
gtgatttctcagtctgcagcgggac

SEQ ID NO: 701694 - DNA, 25 bp, Mus musculus
gtgatttctcatagcagcactggaa

SEQ ID NO: 701695 - DNA, 25 bp, Mus musculus
gtgatttctcattgcagcactggaa

SEQ ID NO: 701696 - DNA, 25 bp, Mus musculus
gtgatttctgaaagtcgccatgttc

SEQ ID NO: 701697 - DNA, 25 bp, Mus musculus
gtgatttctgaatgtcgccatgttc

SEQ ID NO: 701698 - DNA, 25 bp, Mus musculus
gtgatttctgacagataaaaccaaa

SEQ ID NO: 701699 - DNA, 25 bp, Mus musculus
gtgatttctgactgataaaaccaaa

SEQ ID NO: 701700 - DNA, 25 bp, Mus musculus
gtgatttctggaccactgacagccc

SEQ ID NO: 701701 - DNA, 25 bp, Mus musculus
gtgatttctggagcactgacagccc

SEQ ID NO: 701702 - DNA, 25 bp, Mus musculus
gtgatttctgtaagtttgagcccta

SEQ ID NO: 701703 - DNA, 25 bp, Mus musculus
gtgatttctgtatgtttgagcccta

SEQ ID NO: 701704 - DNA, 25 bp, Mus musculus
gtgatttgacaacgtccccattgca

SEQ ID NO: 701705 - DNA, 25 bp, Mus musculus
gtgatttgacaaggtccccattgca

SEQ ID NO: 701706 - DNA, 25 bp, Mus musculus
gtgatttgatatcccgcccagagtg

SEQ ID NO: 701707 - DNA, 25 bp, Mus musculus
gtgatttgatatgccgcccagagtg

SEQ ID NO: 701708 - DNA, 25 bp, Mus musculus
gtgatttgcaaaagcaagcccagga

SEQ ID NO: 701709 - DNA, 25 bp, Mus musculus
gtgatttgcaaatgcaagcccagga

SEQ ID NO: 701710 - DNA, 25 bp, Mus musculus
gtgatttgcataatgtatgccccag

SEQ ID NO: 701711 - DNA, 25 bp, Mus musculus
gtgatttgcatattgtatgccccag

SEQ ID NO: 701712 - DNA, 25 bp, Mus musculus
gtgatttgcccacctcactaataaa

SEQ ID NO: 701713 - DNA, 25 bp, Mus musculus
gtgatttgcccagctcactaataaa

SEQ ID NO: 701714 - DNA, 25 bp, Mus musculus
gtgatttgctctacatttgacagta

SEQ ID NO: 701715 - DNA, 25 bp, Mus musculus
gtgatttgctcttcatttgacagta

SEQ ID NO: 701716 - DNA, 25 bp, Mus musculus
gtgatttgcttaaatgcctgagaat

SEQ ID NO: 701717 - DNA, 25 bp, Mus musculus
gtgatttgcttatatgcctgagaat

SEQ ID NO: 701718 - DNA, 25 bp, Mus musculus
gtgatttgtaccaagtagtttccta

SEQ ID NO: 701719 - DNA, 25 bp, Mus musculus
gtgatttgtacctagtagtttccta

SEQ ID NO: 701720 - DNA, 25 bp, Mus musculus
gtgatttgtagactcatgctaactt

SEQ ID NO: 701721 - DNA, 25 bp, Mus musculus
gtgatttgtagagtcatgctaactt

SEQ ID NO: 701722 - DNA, 25 bp, Mus musculus
gtgatttgtgaaccttggcttctct

SEQ ID NO: 701723 - DNA, 25 bp, Mus musculus
gtgatttgtgaagcttggcttctct

SEQ ID NO: 701724 - DNA, 25 bp, Mus musculus
gtgatttgttaaccactcgtgaaca

SEQ ID NO: 701725 - DNA, 25 bp, Mus musculus
gtgatttgttaagcactcgtgaaca

SEQ ID NO: 701726 - DNA, 25 bp, Mus musculus
gtgattttaaaccacaattcagtga

SEQ ID NO: 701727 - DNA, 25 bp, Mus musculus
gtgattttaaacgacaattcagtga

SEQ ID NO: 701728 - DNA, 25 bp, Mus musculus
gtgattttaatcctctatttctccc

SEQ ID NO: 701729 - DNA, 25 bp, Mus musculus
gtgattttaatcgtctatttctccc

SEQ ID NO: 701730 - DNA, 25 bp, Mus musculus
gtgattttagccaactatcagaagt

SEQ ID NO: 701731 - DNA, 25 bp, Mus musculus
gtgattttagcctactatcagaagt

SEQ ID NO: 701732 - DNA, 25 bp, Mus musculus
gtgattttaggcattatgtctgaat

SEQ ID NO: 701733 - DNA, 25 bp, Mus musculus
gtgattttaggctttatgtctgaat

SEQ ID NO: 701734 - DNA, 25 bp, Mus musculus
gtgattttatacagcgagcactggt

SEQ ID NO: 701735 - DNA, 25 bp, Mus musculus
gtgattttatactgcgagcactggt

SEQ ID NO: 701736 - DNA, 25 bp, Mus musculus
gtgattttatcacaagaacaagact

SEQ ID NO: 701737 - DNA, 25 bp, Mus musculus
gtgattttatcagaagaacaagact

SEQ ID NO: 701738 - DNA, 25 bp, Mus musculus
gtgattttcaagacctgtaccgtaa

SEQ ID NO: 701739 - DNA, 25 bp, Mus musculus
gtgattttcaagtcctgtaccgtaa

SEQ ID NO: 701740 - DNA, 25 bp, Mus musculus
gtgattttcagtcaccctgagccag

SEQ ID NO: 701741 - DNA, 25 bp, Mus musculus
gtgattttcagtgaccctgagccag

SEQ ID NO: 701742 - DNA, 25 bp, Mus musculus
gtgattttcctgctcgttgtaccca

SEQ ID NO: 701743 - DNA, 25 bp, Mus musculus
gtgattttcctggtcgttgtaccca

SEQ ID NO: 701744 - DNA, 25 bp, Mus musculus
gtgattttcgaaatccaggctttgt

SEQ ID NO: 701745 - DNA, 25 bp, Mus musculus
gtgattttcgaattccaggctttgt

SEQ ID NO: 701746 - DNA, 25 bp, Mus musculus
gtgattttctaccacagtgactgga

SEQ ID NO: 701747 - DNA, 25 bp, Mus musculus
gtgattttctacgacagtgactgga

SEQ ID NO: 701748 - DNA, 25 bp, Mus musculus
gtgattttcttcaatgagctctgcc

SEQ ID NO: 701749 - DNA, 25 bp, Mus musculus
gtgattttcttctatgagctctgcc

SEQ ID NO: 701750 - DNA, 25 bp, Mus musculus
gtgattttctttcctgactttgaca

SEQ ID NO: 701751 - DNA, 25 bp, Mus musculus
gtgattttctttgctgactttgaca

SEQ ID NO: 701752 - DNA, 25 bp, Mus musculus
gtgattttgacaagcaccgaaagat

SEQ ID NO: 701753 - DNA, 25 bp, Mus musculus
gtgattttgacatgcaccgaaagat

SEQ ID NO: 701754 - DNA, 25 bp, Mus musculus
gtgattttgatgataacttctctct

SEQ ID NO: 701755 - DNA, 25 bp, Mus musculus
gtgattttgatgttaacttctctct

SEQ ID NO: 701756 - DNA, 25 bp, Mus musculus
gtgattttgcacatgcactctcgtg

SEQ ID NO: 701757 - DNA, 25 bp, Mus musculus
gtgattttgcacttgcactctcgtg

SEQ ID NO: 701758 - DNA, 25 bp, Mus musculus
gtgattttgccaatctacggcagag

SEQ ID NO: 701759 - DNA, 25 bp, Mus musculus
gtgattttgccattctacggcagag

SEQ ID NO: 701760 - DNA, 25 bp, Mus musculus
gtgattttggtcatggaggcccata

SEQ ID NO: 701761 - DNA, 25 bp, Mus musculus
gtgattttggtcttggaggcccata

SEQ ID NO: 701762 - DNA, 25 bp, Mus musculus
gtgattttgtgaaccacgggaccat

SEQ ID NO: 701763 - DNA, 25 bp, Mus musculus
gtgattttgtgatccacgggaccat

SEQ ID NO: 701764 - DNA, 25 bp, Mus musculus
gtgattttgtttcacaggctgcctc

SEQ ID NO: 701765 - DNA, 25 bp, Mus musculus
gtgattttgtttgacaggctgcctc

SEQ ID NO: 701766 - DNA, 25 bp, Mus musculus
gtgatttttagcacagcagccctta

SEQ ID NO: 701767 - DNA, 25 bp, Mus musculus
gtgatttttagctcagcagccctta

SEQ ID NO: 701768 - DNA, 25 bp, Mus musculus
gtgatttttcacctctggatatgag

SEQ ID NO: 701769 - DNA, 25 bp, Mus musculus
gtgatttttcacgtctggatatgag

SEQ ID NO: 701770 - DNA, 25 bp, Mus musculus
gtgatttttctaagaggactgtaac

SEQ ID NO: 701771 - DNA, 25 bp, Mus musculus
gtgatttttctatgaggactgtaac

SEQ ID NO: 701772 - DNA, 25 bp, Mus musculus
gtgatttttgaactcgagtatatcc

SEQ ID NO: 701773 - DNA, 25 bp, Mus musculus
gtgatttttgaagtcgagtatatcc

SEQ ID NO: 701774 - DNA, 25 bp, Mus musculus
gtgatttttgagcttccaggtttgg

SEQ ID NO: 701775 - DNA, 25 bp, Mus musculus
gtgatttttgaggttccaggtttgg

SEQ ID NO: 701776 - DNA, 25 bp, Mus musculus
gtgatttttggcacagtacccactt

SEQ ID NO: 701777 - DNA, 25 bp, Mus musculus
gtgatttttggctcagtacccactt

SEQ ID NO: 701778 - DNA, 25 bp, Mus musculus
gtgcaaaacagcctgctagccttag

SEQ ID NO: 701779 - DNA, 25 bp, Mus musculus
gtgcaaaacagcgtgctagccttag

SEQ ID NO: 701780 - DNA, 25 bp, Mus musculus
gtgcaaaacccactcattatctcaa

SEQ ID NO: 701781 - DNA, 25 bp, Mus musculus
gtgcaaaacccagtcattatctcaa

SEQ ID NO: 701782 - DNA, 25 bp, Mus musculus
gtgcaaaacttgagccagtggcaaa

SEQ ID NO: 701783 - DNA, 25 bp, Mus musculus
gtgcaaaacttgtgccagtggcaaa

SEQ ID NO: 701784 - DNA, 25 bp, Mus musculus
gtgcaaaagcatatacacgttcttc

SEQ ID NO: 701785 - DNA, 25 bp, Mus musculus
gtgcaaaagcatttacacgttcttc

SEQ ID NO: 701786 - DNA, 25 bp, Mus musculus
gtgcaaaagcccctcacgggtatgc

SEQ ID NO: 701787 - DNA, 25 bp, Mus musculus
gtgcaaaagcccgtcacgggtatgc

SEQ ID NO: 701788 - DNA, 25 bp, Mus musculus
gtgcaaaagctacaagagcgcctgg

SEQ ID NO: 701789 - DNA, 25 bp, Mus musculus
gtgcaaaagctagaagagcgcctgg

SEQ ID NO: 701790 - DNA, 25 bp, Mus musculus
gtgcaaacaagaagcctttctgtgg

SEQ ID NO: 701791 - DNA, 25 bp, Mus musculus
gtgcaaacaagatgcctttctgtgg

SEQ ID NO: 701792 - DNA, 25 bp, Mus musculus
gtgcaaacacagctcgcccaatggg

SEQ ID NO: 701793 - DNA, 25 bp, Mus musculus
gtgcaaacacaggtcgcccaatggg

SEQ ID NO: 701794 - DNA, 25 bp, Mus musculus
gtgcaaacagctcagactgcccaga

SEQ ID NO: 701795 - DNA, 25 bp, Mus musculus
gtgcaaacagctgagactgcccaga

SEQ ID NO: 701796 - DNA, 25 bp, Mus musculus
gtgcaaacccagaattaatcagctc

SEQ ID NO: 701797 - DNA, 25 bp, Mus musculus
gtgcaaacccagtattaatcagctc

SEQ ID NO: 701798 - DNA, 25 bp, Mus musculus
gtgcaaacccttcaaagattactgg

SEQ ID NO: 701799 - DNA, 25 bp, Mus musculus
gtgcaaacccttgaaagattactgg

SEQ ID NO: 701800 - DNA, 25 bp, Mus musculus
gtgcaaaccttgagtcttagaccca

SEQ ID NO: 701801 - DNA, 25 bp, Mus musculus
gtgcaaaccttgtgtcttagaccca

SEQ ID NO: 701802 - DNA, 25 bp, Mus musculus
gtgcaaacggccaaagtaatggatt

SEQ ID NO: 701803 - DNA, 25 bp, Mus musculus
gtgcaaacggcctaagtaatggatt

SEQ ID NO: 701804 - DNA, 25 bp, Mus musculus
gtgcaaacgtgcacaggatctcagt

SEQ ID NO: 701805 - DNA, 25 bp, Mus musculus
gtgcaaacgtgctcaggatctcagt

SEQ ID NO: 701806 - DNA, 25 bp, Mus musculus
gtgcaaactgaccactatggctgcc

SEQ ID NO: 701807 - DNA, 25 bp, Mus musculus
gtgcaaactgacgactatggctgcc

SEQ ID NO: 701808 - DNA, 25 bp, Mus musculus
gtgcaaactgatctgtgagcggcta

SEQ ID NO: 701809 - DNA, 25 bp, Mus musculus
gtgcaaactgatgtgtgagcggcta

SEQ ID NO: 701810 - DNA, 25 bp, Mus musculus
gtgcaaactgggacttactacctca

SEQ ID NO: 701811 - DNA, 25 bp, Mus musculus
gtgcaaactgggtcttactacctca

SEQ ID NO: 701812 - DNA, 25 bp, Mus musculus
gtgcaaacttgtacttccatgatgt

SEQ ID NO: 701813 - DNA, 25 bp, Mus musculus
gtgcaaacttgttcttccatgatgt

SEQ ID NO: 701814 - DNA, 25 bp, Mus musculus
gtgcaaagacagatgctgccactga

SEQ ID NO: 701815 - DNA, 25 bp, Mus musculus
gtgcaaagacagttgctgccactga

SEQ ID NO: 701816 - DNA, 25 bp, Mus musculus
gtgcaaagacgccattcattccaat

SEQ ID NO: 701817 - DNA, 25 bp, Mus musculus
gtgcaaagacgcgattcattccaat

SEQ ID NO: 701818 - DNA, 25 bp, Mus musculus
gtgcaaagcactactagaggacctg

SEQ ID NO: 701819 - DNA, 25 bp, Mus musculus
gtgcaaagcacttctagaggacctg

SEQ ID NO: 701820 - DNA, 25 bp, Mus musculus
gtgcaaagcataaaacctcctgtgt

SEQ ID NO: 701821 - DNA, 25 bp, Mus musculus
gtgcaaagcatataacctcctgtgt

SEQ ID NO: 701822 - DNA, 25 bp, Mus musculus
gtgcaaagctgcaacactacagaca

SEQ ID NO: 701823 - DNA, 25 bp, Mus musculus
gtgcaaagctgctacactacagaca

SEQ ID NO: 701824 - DNA, 25 bp, Mus musculus
gtgcaaagtcctagatctccagaac

SEQ ID NO: 701825 - DNA, 25 bp, Mus musculus
gtgcaaagtccttgatctccagaac

SEQ ID NO: 701826 - DNA, 25 bp, Mus musculus
gtgcaaagtgcaactgtcttcttac

SEQ ID NO: 701827 - DNA, 25 bp, Mus musculus
gtgcaaagtgcatctgtcttcttac

SEQ ID NO: 701828 - DNA, 25 bp, Mus musculus
gtgcaaataggcacactttatgtgt

SEQ ID NO: 701829 - DNA, 25 bp, Mus musculus
gtgcaaataggctcactttatgtgt

SEQ ID NO: 701830 - DNA, 25 bp, Mus musculus
gtgcaaatagtcaacaagccggtgg

SEQ ID NO: 701831 - DNA, 25 bp, Mus musculus
gtgcaaatagtctacaagccggtgg

SEQ ID NO: 701832 - DNA, 25 bp, Mus musculus
gtgcaaatatcaagtgcccgggttt

SEQ ID NO: 701833 - DNA, 25 bp, Mus musculus
gtgcaaatatcatgtgcccgggttt

SEQ ID NO: 701834 - DNA, 25 bp, Mus musculus
gtgcaaatccatcaaccctggtgaa

SEQ ID NO: 701835 - DNA, 25 bp, Mus musculus
gtgcaaatccatgaaccctggtgaa

SEQ ID NO: 701836 - DNA, 25 bp, Mus musculus
gtgcaaatccgaccgtggaacctaa

SEQ ID NO: 701837 - DNA, 25 bp, Mus musculus
gtgcaaatccgagcgtggaacctaa

SEQ ID NO: 701838 - DNA, 25 bp, Mus musculus
gtgcaaatgactattgccccatggg

SEQ ID NO: 701839 - DNA, 25 bp, Mus musculus
gtgcaaatgacttttgccccatggg

SEQ ID NO: 701840 - DNA, 25 bp, Mus musculus
gtgcaaatgatcatctgcaaaggta

SEQ ID NO: 701841 - DNA, 25 bp, Mus musculus
gtgcaaatgatcttctgcaaaggta

SEQ ID NO: 701842 - DNA, 25 bp, Mus musculus
gtgcaaattattacaccagggttaa

SEQ ID NO: 701843 - DNA, 25 bp, Mus musculus
gtgcaaattatttcaccagggttaa

SEQ ID NO: 701844 - DNA, 25 bp, Mus musculus
gtgcaaattcctccatacaggtggg

SEQ ID NO: 701845 - DNA, 25 bp, Mus musculus
gtgcaaattcctgcatacaggtggg

SEQ ID NO: 701846 - DNA, 25 bp, Mus musculus
gtgcaaattggtcctcacagtcctc

SEQ ID NO: 701847 - DNA, 25 bp, Mus musculus
gtgcaaattggtgctcacagtcctc

SEQ ID NO: 701848 - DNA, 25 bp, Mus musculus
gtgcaaatttggagagccttcctct

SEQ ID NO: 701849 - DNA, 25 bp, Mus musculus
gtgcaaatttggtgagccttcctct

SEQ ID NO: 701850 - DNA, 25 bp, Mus musculus
gtgcaacaagcaacaaagacaccca

SEQ ID NO: 701851 - DNA, 25 bp, Mus musculus
gtgcaacaagcatcaaagacaccca

SEQ ID NO: 701852 - DNA, 25 bp, Mus musculus
gtgcaacaagtgagccactcgagtc

SEQ ID NO: 701853 - DNA, 25 bp, Mus musculus
gtgcaacaagtgtgccactcgagtc

SEQ ID NO: 701854 - DNA, 25 bp, Mus musculus
gtgcaacacaccaagtatttttacc

SEQ ID NO: 701855 - DNA, 25 bp, Mus musculus
gtgcaacacacctagtatttttacc

SEQ ID NO: 701856 - DNA, 25 bp, Mus musculus
gtgcaacaccgacaccaggcttgag

SEQ ID NO: 701857 - DNA, 25 bp, Mus musculus
gtgcaacaccgagaccaggcttgag

SEQ ID NO: 701858 - DNA, 25 bp, Mus musculus
gtgcaacaggttacttttgctggct

SEQ ID NO: 701859 - DNA, 25 bp, Mus musculus
gtgcaacaggtttcttttgctggct

SEQ ID NO: 701860 - DNA, 25 bp, Mus musculus
gtgcaacagtggatctgtgtgccca

SEQ ID NO: 701861 - DNA, 25 bp, Mus musculus
gtgcaacagtggttctgtgtgccca

SEQ ID NO: 701862 - DNA, 25 bp, Mus musculus
gtgcaacatgaccttggtgcctcag

SEQ ID NO: 701863 - DNA, 25 bp, Mus musculus
gtgcaacatgacgttggtgcctcag

SEQ ID NO: 701864 - DNA, 25 bp, Mus musculus
gtgcaacatggaacaacctgactgt

SEQ ID NO: 701865 - DNA, 25 bp, Mus musculus
gtgcaacatggatcaacctgactgt

SEQ ID NO: 701866 - DNA, 25 bp, Mus musculus
gtgcaacatttacctccaacaagaa

SEQ ID NO: 701867 - DNA, 25 bp, Mus musculus
gtgcaacatttagctccaacaagaa

SEQ ID NO: 701868 - DNA, 25 bp, Mus musculus
gtgcaaccaaacctttcaacatcaa

SEQ ID NO: 701869 - DNA, 25 bp, Mus musculus
gtgcaaccaaacgtttcaacatcaa

SEQ ID NO: 701870 - DNA, 25 bp, Mus musculus
gtgcaaccaacactctgctttttaa

SEQ ID NO: 701871 - DNA, 25 bp, Mus musculus
gtgcaaccaacagtctgctttttaa

SEQ ID NO: 701872 - DNA, 25 bp, Mus musculus
gtgcaaccaccactactacaattgg

SEQ ID NO: 701873 - DNA, 25 bp, Mus musculus
gtgcaaccaccagtactacaattgg

SEQ ID NO: 701874 - DNA, 25 bp, Mus musculus
gtgcaaccactacaggcttattccc

SEQ ID NO: 701875 - DNA, 25 bp, Mus musculus
gtgcaaccactagaggcttattccc

SEQ ID NO: 701876 - DNA, 25 bp, Mus musculus
gtgcaaccagctactatcaacgtga

SEQ ID NO: 701877 - DNA, 25 bp, Mus musculus
gtgcaaccagcttctatcaacgtga

SEQ ID NO: 701878 - DNA, 25 bp, Mus musculus
gtgcaaccagtaagtgaaaacaccc

SEQ ID NO: 701879 - DNA, 25 bp, Mus musculus
gtgcaaccagtatgtgaaaacaccc

SEQ ID NO: 701880 - DNA, 25 bp, Mus musculus
gtgcaaccagtgctctcagctgtaa

SEQ ID NO: 701881 - DNA, 25 bp, Mus musculus
gtgcaaccagtggtctcagctgtaa

SEQ ID NO: 701882 - DNA, 25 bp, Mus musculus
gtgcaaccctcgcaattacagcgac

SEQ ID NO: 701883 - DNA, 25 bp, Mus musculus
gtgcaaccctcggaattacagcgac

SEQ ID NO: 701884 - DNA, 25 bp, Mus musculus
gtgcaaccctgcattgaaccaaaag

SEQ ID NO: 701885 - DNA, 25 bp, Mus musculus
gtgcaaccctgctttgaaccaaaag

SEQ ID NO: 701886 - DNA, 25 bp, Mus musculus
gtgcaacctgcaacagttcatccag

SEQ ID NO: 701887 - DNA, 25 bp, Mus musculus
gtgcaacctgcatcagttcatccag

SEQ ID NO: 701888 - DNA, 25 bp, Mus musculus
gtgcaacctgctctacaacaaagat

SEQ ID NO: 701889 - DNA, 25 bp, Mus musculus
gtgcaacctgctgtacaacaaagat

SEQ ID NO: 701890 - DNA, 25 bp, Mus musculus
gtgcaacgaaaaccaatccgctgtc

SEQ ID NO: 701891 - DNA, 25 bp, Mus musculus
gtgcaacgaaaagcaatccgctgtc

SEQ ID NO: 701892 - DNA, 25 bp, Mus musculus
gtgcaacgacagcagtgtctactat

SEQ ID NO: 701893 - DNA, 25 bp, Mus musculus
gtgcaacgacaggagtgtctactat

SEQ ID NO: 701894 - DNA, 25 bp, Mus musculus
gtgcaacgatgcactgaagcctagt

SEQ ID NO: 701895 - DNA, 25 bp, Mus musculus
gtgcaacgatgctctgaagcctagt

SEQ ID NO: 701896 - DNA, 25 bp, Mus musculus
gtgcaacgtagcaacggatcgctgc

SEQ ID NO: 701897 - DNA, 25 bp, Mus musculus
gtgcaacgtagctacggatcgctgc

SEQ ID NO: 701898 - DNA, 25 bp, Mus musculus
gtgcaacgttgtaacgtcgttcaaa

SEQ ID NO: 701899 - DNA, 25 bp, Mus musculus
gtgcaacgttgttacgtcgttcaaa

SEQ ID NO: 701900 - DNA, 25 bp, Mus musculus
gtgcaactacttaggattgtcatag

SEQ ID NO: 701901 - DNA, 25 bp, Mus musculus
gtgcaactactttggattgtcatag

SEQ ID NO: 701902 - DNA, 25 bp, Mus musculus
gtgcaactattcaagtgtacagtgt

SEQ ID NO: 701903 - DNA, 25 bp, Mus musculus
gtgcaactattctagtgtacagtgt

SEQ ID NO: 701904 - DNA, 25 bp, Mus musculus
gtgcaactccctatatgccttttta

SEQ ID NO: 701905 - DNA, 25 bp, Mus musculus
gtgcaactccctttatgccttttta

SEQ ID NO: 701906 - DNA, 25 bp, Mus musculus
gtgcaactgaatcccttccagactg

SEQ ID NO: 701907 - DNA, 25 bp, Mus musculus
gtgcaactgaatgccttccagactg

SEQ ID NO: 701908 - DNA, 25 bp, Mus musculus
gtgcaactgagtcgcagtccccagc

SEQ ID NO: 701909 - DNA, 25 bp, Mus musculus
gtgcaactgagtggcagtccccagc

SEQ ID NO: 701910 - DNA, 25 bp, Mus musculus
gtgcaactgccaaaggagctggagt

SEQ ID NO: 701911 - DNA, 25 bp, Mus musculus
gtgcaactgccataggagctggagt

SEQ ID NO: 701912 - DNA, 25 bp, Mus musculus
gtgcaactgcgaccaatgtcttaag

SEQ ID NO: 701913 - DNA, 25 bp, Mus musculus
gtgcaactgcgagcaatgtcttaag

SEQ ID NO: 701914 - DNA, 25 bp, Mus musculus
gtgcaactgtaaatatcctttcatg

SEQ ID NO: 701915 - DNA, 25 bp, Mus musculus
gtgcaactgtaattatcctttcatg

SEQ ID NO: 701916 - DNA, 25 bp, Mus musculus
gtgcaacttctcagctttaactcta

SEQ ID NO: 701917 - DNA, 25 bp, Mus musculus
gtgcaacttctctgctttaactcta

SEQ ID NO: 701918 - DNA, 25 bp, Mus musculus
gtgcaacttctgaaggtctctgatc

SEQ ID NO: 701919 - DNA, 25 bp, Mus musculus
gtgcaacttctgtaggtctctgatc

SEQ ID NO: 701920 - DNA, 25 bp, Mus musculus
gtgcaagaaacactacatggttggg

SEQ ID NO: 701921 - DNA, 25 bp, Mus musculus
gtgcaagaaacagtacatggttggg

SEQ ID NO: 701922 - DNA, 25 bp, Mus musculus
gtgcaagaagttcagagcggcctct

SEQ ID NO: 701923 - DNA, 25 bp, Mus musculus
gtgcaagaagttgagagcggcctct

SEQ ID NO: 701924 - DNA, 25 bp, Mus musculus
gtgcaagaattaaggtactcggatt

SEQ ID NO: 701925 - DNA, 25 bp, Mus musculus
gtgcaagaattatggtactcggatt

SEQ ID NO: 701926 - DNA, 25 bp, Mus musculus
gtgcaagacactactggtccaagat

SEQ ID NO: 701927 - DNA, 25 bp, Mus musculus
gtgcaagacacttctggtccaagat

SEQ ID NO: 701928 - DNA, 25 bp, Mus musculus
gtgcaagacaggcaacgcatacctc

SEQ ID NO: 701929 - DNA, 25 bp, Mus musculus
gtgcaagacagggaacgcatacctc

SEQ ID NO: 701930 - DNA, 25 bp, Mus musculus
gtgcaagacagtcctgctgagacca

SEQ ID NO: 701931 - DNA, 25 bp, Mus musculus
gtgcaagacagtgctgctgagacca

SEQ ID NO: 701932 - DNA, 25 bp, Mus musculus
gtgcaagaccatcgtgtccaagtac

SEQ ID NO: 701933 - DNA, 25 bp, Mus musculus
gtgcaagaccatggtgtccaagtac

SEQ ID NO: 701934 - DNA, 25 bp, Mus musculus
gtgcaagaccccagtgaggactgtg

SEQ ID NO: 701935 - DNA, 25 bp, Mus musculus
gtgcaagacccctgtgaggactgtg

SEQ ID NO: 701936 - DNA, 25 bp, Mus musculus
gtgcaagagaacaccttacccacaa

SEQ ID NO: 701937 - DNA, 25 bp, Mus musculus
gtgcaagagaactccttacccacaa

SEQ ID NO: 701938 - DNA, 25 bp, Mus musculus
gtgcaagagcacacttgtcacctgg

SEQ ID NO: 701939 - DNA, 25 bp, Mus musculus
gtgcaagagcactcttgtcacctgg

SEQ ID NO: 701940 - DNA, 25 bp, Mus musculus
gtgcaagagcttcggtcacctcaag

SEQ ID NO: 701941 - DNA, 25 bp, Mus musculus
gtgcaagagcttgggtcacctcaag

SEQ ID NO: 701942 - DNA, 25 bp, Mus musculus
gtgcaagagtcccaatgccatcaaa

SEQ ID NO: 701943 - DNA, 25 bp, Mus musculus
gtgcaagagtccgaatgccatcaaa

SEQ ID NO: 701944 - DNA, 25 bp, Mus musculus
gtgcaagatagacttcgatgacttc

SEQ ID NO: 701945 - DNA, 25 bp, Mus musculus
gtgcaagatagagttcgatgacttc

SEQ ID NO: 701946 - DNA, 25 bp, Mus musculus
gtgcaagcaagcatgcttatggaaa

SEQ ID NO: 701947 - DNA, 25 bp, Mus musculus
gtgcaagcaagcttgcttatggaaa

SEQ ID NO: 701948 - DNA, 25 bp, Mus musculus
gtgcaagcacacactttcattgtta

SEQ ID NO: 701949 - DNA, 25 bp, Mus musculus
gtgcaagcacactctttcattgtta

SEQ ID NO: 701950 - DNA, 25 bp, Mus musculus
gtgcaagcagatctcagttgtcact

SEQ ID NO: 701951 - DNA, 25 bp, Mus musculus
gtgcaagcagatgtcagttgtcact

SEQ ID NO: 701952 - DNA, 25 bp, Mus musculus
gtgcaagcaggcctttaacttgtat

SEQ ID NO: 701953 - DNA, 25 bp, Mus musculus
gtgcaagcaggcgtttaacttgtat

SEQ ID NO: 701954 - DNA, 25 bp, Mus musculus
gtgcaagcatacattcaggccagaa

SEQ ID NO: 701955 - DNA, 25 bp, Mus musculus
gtgcaagcatactttcaggccagaa

SEQ ID NO: 701956 - DNA, 25 bp, Mus musculus
gtgcaagcccgtctcatgtagtaga

SEQ ID NO: 701957 - DNA, 25 bp, Mus musculus
gtgcaagcccgtgtcatgtagtaga

SEQ ID NO: 701958 - DNA, 25 bp, Mus musculus
gtgcaagcgagtcgcattaagtctt

SEQ ID NO: 701959 - DNA, 25 bp, Mus musculus
gtgcaagcgagtggcattaagtctt

SEQ ID NO: 701960 - DNA, 25 bp, Mus musculus
gtgcaagcggtaccaggtctccagc

SEQ ID NO: 701961 - DNA, 25 bp, Mus musculus
gtgcaagcggtagcaggtctccagc

SEQ ID NO: 701962 - DNA, 25 bp, Mus musculus
gtgcaagcggtcagagttgcgtcat

SEQ ID NO: 701963 - DNA, 25 bp, Mus musculus
gtgcaagcggtctgagttgcgtcat

SEQ ID NO: 701964 - DNA, 25 bp, Mus musculus
gtgcaagcgtcgaggaggcctatcc

SEQ ID NO: 701965 - DNA, 25 bp, Mus musculus
gtgcaagcgtcgtggaggcctatcc

SEQ ID NO: 701966 - DNA, 25 bp, Mus musculus
gtgcaagcgtgcatgtgtgactctt

SEQ ID NO: 701967 - DNA, 25 bp, Mus musculus
gtgcaagcgtgcttgtgtgactctt

SEQ ID NO: 701968 - DNA, 25 bp, Mus musculus
gtgcaaggagccaccgtgagaccaa

SEQ ID NO: 701969 - DNA, 25 bp, Mus musculus
gtgcaaggagcctccgtgagaccaa

SEQ ID NO: 701970 - DNA, 25 bp, Mus musculus
gtgcaaggagtactacctgggcttt

SEQ ID NO: 701971 - DNA, 25 bp, Mus musculus
gtgcaaggagtagtacctgggcttt

SEQ ID NO: 701972 - DNA, 25 bp, Mus musculus
gtgcaaggccttcggagagatttct

SEQ ID NO: 701973 - DNA, 25 bp, Mus musculus
gtgcaaggccttgggagagatttct

SEQ ID NO: 701974 - DNA, 25 bp, Mus musculus
gtgcaaggctcaacactgtgtttgt

SEQ ID NO: 701975 - DNA, 25 bp, Mus musculus
gtgcaaggctcatcactgtgtttgt

SEQ ID NO: 701976 - DNA, 25 bp, Mus musculus
gtgcaaggctctaccttaacctata

SEQ ID NO: 701977 - DNA, 25 bp, Mus musculus
gtgcaaggctcttccttaacctata

SEQ ID NO: 701978 - DNA, 25 bp, Mus musculus
gtgcaagggcaacattcttcagaat

SEQ ID NO: 701979 - DNA, 25 bp, Mus musculus
gtgcaagggcaagattcttcagaat

SEQ ID NO: 701980 - DNA, 25 bp, Mus musculus
gtgcaagtaaatacgcagcccttgg

SEQ ID NO: 701981 - DNA, 25 bp, Mus musculus
gtgcaagtaaattcgcagcccttgg

SEQ ID NO: 701982 - DNA, 25 bp, Mus musculus
gtgcaagtaagcacgcgaacaagca

SEQ ID NO: 701983 - DNA, 25 bp, Mus musculus
gtgcaagtaagctcgcgaacaagca

SEQ ID NO: 701984 - DNA, 25 bp, Mus musculus
gtgcaagtatccatcatgagtccca

SEQ ID NO: 701985 - DNA, 25 bp, Mus musculus
gtgcaagtatccttcatgagtccca

SEQ ID NO: 701986 - DNA, 25 bp, Mus musculus
gtgcaagtcttcaggatttcataat

SEQ ID NO: 701987 - DNA, 25 bp, Mus musculus
gtgcaagtcttctggatttcataat

SEQ ID NO: 701988 - DNA, 25 bp, Mus musculus
gtgcaagtgaacagtgaggtgacaa

SEQ ID NO: 701989 - DNA, 25 bp, Mus musculus
gtgcaagtgaactgtgaggtgacaa

SEQ ID NO: 701990 - DNA, 25 bp, Mus musculus
gtgcaagtgcctcaagagtccagaa

SEQ ID NO: 701991 - DNA, 25 bp, Mus musculus
gtgcaagtgcctgaagagtccagaa

SEQ ID NO: 701992 - DNA, 25 bp, Mus musculus
gtgcaagtgtgcactcacctgaata

SEQ ID NO: 701993 - DNA, 25 bp, Mus musculus
gtgcaagtgtgcagtcccttagttc

SEQ ID NO: 701994 - DNA, 25 bp, Mus musculus
gtgcaagtgtgctctcacctgaata

SEQ ID NO: 701995 - DNA, 25 bp, Mus musculus
gtgcaagtgtgctgtcccttagttc

SEQ ID NO: 701996 - DNA, 25 bp, Mus musculus
gtgcaagtgttgcttctacagagca

SEQ ID NO: 701997 - DNA, 25 bp, Mus musculus
gtgcaagtgttggttctacagagca

SEQ ID NO: 701998 - DNA, 25 bp, Mus musculus
gtgcaagttaacatataatacgaaa

SEQ ID NO: 701999 - DNA, 25 bp, Mus musculus
gtgcaagttaacttataatacgaaa

SEQ ID NO: 702000 - DNA, 25 bp, Mus musculus
gtgcaagttccaccagataaagcgt

SEQ ID NO: 702001 - DNA, 25 bp, Mus musculus
gtgcaagttccagcagataaagcgt

SEQ ID NO: 702002 - DNA, 25 bp, Mus musculus
gtgcaagttgatactgtacctggta

SEQ ID NO: 702003 - DNA, 25 bp, Mus musculus
gtgcaagttgattctgtacctggta

SEQ ID NO: 702004 - DNA, 25 bp, Mus musculus
gtgcaagttgcaagggcccttattg

SEQ ID NO: 702005 - DNA, 25 bp, Mus musculus
gtgcaagttgcatgggcccttattg

SEQ ID NO: 702006 - DNA, 25 bp, Mus musculus
gtgcaagtttgtatatggccactct

SEQ ID NO: 702007 - DNA, 25 bp, Mus musculus
gtgcaagtttgtttatggccactct

SEQ ID NO: 702008 - DNA, 25 bp, Mus musculus
gtgcaagttttacagggttatcctg

SEQ ID NO: 702009 - DNA, 25 bp, Mus musculus
gtgcaagttttagagggttatcctg

SEQ ID NO: 702010 - DNA, 25 bp, Mus musculus
gtgcaataaacaaactactacagat

SEQ ID NO: 702011 - DNA, 25 bp, Mus musculus
gtgcaataaacatactactacagat

SEQ ID NO: 702012 - DNA, 25 bp, Mus musculus
gtgcaataacagagacttcctcagt

SEQ ID NO: 702013 - DNA, 25 bp, Mus musculus
gtgcaataacagtgacttcctcagt

SEQ ID NO: 702014 - DNA, 25 bp, Mus musculus
gtgcaataccagattctccttaaga

SEQ ID NO: 702015 - DNA, 25 bp, Mus musculus
gtgcaataccagtttctccttaaga

SEQ ID NO: 702016 - DNA, 25 bp, Mus musculus
gtgcaatactgtatgtactgtttgt

SEQ ID NO: 702017 - DNA, 25 bp, Mus musculus
gtgcaatactgtttgtactgtttgt

SEQ ID NO: 702018 - DNA, 25 bp, Mus musculus
gtgcaatacttaactcacactttgg

SEQ ID NO: 702019 - DNA, 25 bp, Mus musculus
gtgcaatacttatctcacactttgg

SEQ ID NO: 702020 - DNA, 25 bp, Mus musculus
gtgcaatatattaatttctgccaga

SEQ ID NO: 702021 - DNA, 25 bp, Mus musculus
gtgcaatatatttatttctgccaga

SEQ ID NO: 702022 - DNA, 25 bp, Mus musculus
gtgcaatatctcaacgaagccccta

SEQ ID NO: 702023 - DNA, 25 bp, Mus musculus
gtgcaatatctctacgaagccccta

SEQ ID NO: 702024 - DNA, 25 bp, Mus musculus
gtgcaatatggacatgtatacagtc

SEQ ID NO: 702025 - DNA, 25 bp, Mus musculus
gtgcaatatggagatgtatacagtc

SEQ ID NO: 702026 - DNA, 25 bp, Mus musculus
gtgcaatcaattcccctttgaggca

SEQ ID NO: 702027 - DNA, 25 bp, Mus musculus
gtgcaatcaattgccctttgaggca

SEQ ID NO: 702028 - DNA, 25 bp, Mus musculus
gtgcaatcacaactccttctggagt

SEQ ID NO: 702029 - DNA, 25 bp, Mus musculus
gtgcaatcacaagtccttctggagt

SEQ ID NO: 702030 - DNA, 25 bp, Mus musculus
gtgcaatcacggaacctgtgcccaa

SEQ ID NO: 702031 - DNA, 25 bp, Mus musculus
gtgcaatcacggtacctgtgcccaa

SEQ ID NO: 702032 - DNA, 25 bp, Mus musculus
gtgcaatcagacacattgccttcga

SEQ ID NO: 702033 - DNA, 25 bp, Mus musculus
gtgcaatcagactcattgccttcga

SEQ ID NO: 702034 - DNA, 25 bp, Mus musculus
gtgcaatcagatctttcctaccagg

SEQ ID NO: 702035 - DNA, 25 bp, Mus musculus
gtgcaatcagatgtttcctaccagg

SEQ ID NO: 702036 - DNA, 25 bp, Mus musculus
gtgcaatcatgaacttttgaccaat

SEQ ID NO: 702037 - DNA, 25 bp, Mus musculus
gtgcaatcatgatcttttgaccaat

SEQ ID NO: 702038 - DNA, 25 bp, Mus musculus
gtgcaatccctacggtggcatctga

SEQ ID NO: 702039 - DNA, 25 bp, Mus musculus
gtgcaatccctagggtggcatctga

SEQ ID NO: 702040 - DNA, 25 bp, Mus musculus
gtgcaatccctgagttcggaggaga

SEQ ID NO: 702041 - DNA, 25 bp, Mus musculus
gtgcaatccctgtgttcggaggaga

SEQ ID NO: 702042 - DNA, 25 bp, Mus musculus
gtgcaatctattaaaggactccctc

SEQ ID NO: 702043 - DNA, 25 bp, Mus musculus
gtgcaatctatttaaggactccctc

SEQ ID NO: 702044 - DNA, 25 bp, Mus musculus
gtgcaatctgaaatgacctggacaa

SEQ ID NO: 702045 - DNA, 25 bp, Mus musculus
gtgcaatctgaattgacctggacaa

SEQ ID NO: 702046 - DNA, 25 bp, Mus musculus
gtgcaatctgtgattctgagtgttc

SEQ ID NO: 702047 - DNA, 25 bp, Mus musculus
gtgcaatctgtgtttctgagtgttc

SEQ ID NO: 702048 - DNA, 25 bp, Mus musculus
gtgcaatctgttaccttactctgaa

SEQ ID NO: 702049 - DNA, 25 bp, Mus musculus
gtgcaatctgtttccttactctgaa

SEQ ID NO: 702050 - DNA, 25 bp, Mus musculus
gtgcaatgccttctttcttcatgac

SEQ ID NO: 702051 - DNA, 25 bp, Mus musculus
gtgcaatgccttgtttcttcatgac

SEQ ID NO: 702052 - DNA, 25 bp, Mus musculus
gtgcaatgctggactgtgtcacaca

SEQ ID NO: 702053 - DNA, 25 bp, Mus musculus
gtgcaatgctggcaagttcttgtat

SEQ ID NO: 702054 - DNA, 25 bp, Mus musculus
gtgcaatgctgggaagttcttgtat

SEQ ID NO: 702055 - DNA, 25 bp, Mus musculus
gtgcaatgctggtctgtgtcacaca

SEQ ID NO: 702056 - DNA, 25 bp, Mus musculus
gtgcaatgcttgatgtccagccaaa

SEQ ID NO: 702057 - DNA, 25 bp, Mus musculus
gtgcaatgcttgttgtccagccaaa

SEQ ID NO: 702058 - DNA, 25 bp, Mus musculus
gtgcaatgtaacattaccaccgcca

SEQ ID NO: 702059 - DNA, 25 bp, Mus musculus
gtgcaatgtaactttaccaccgcca

SEQ ID NO: 702060 - DNA, 25 bp, Mus musculus
gtgcaatgtagaattcttccttata

SEQ ID NO: 702061 - DNA, 25 bp, Mus musculus
gtgcaatgtagatttcttccttata

SEQ ID NO: 702062 - DNA, 25 bp, Mus musculus
gtgcaatgtagtcgaagtattttta

SEQ ID NO: 702063 - DNA, 25 bp, Mus musculus
gtgcaatgtagtggaagtattttta

SEQ ID NO: 702064 - DNA, 25 bp, Mus musculus
gtgcaatgtcacagcccgcgtggtc

SEQ ID NO: 702065 - DNA, 25 bp, Mus musculus
gtgcaatgtcactgcccgcgtggtc

SEQ ID NO: 702066 - DNA, 25 bp, Mus musculus
gtgcaatgtgcaaccctgggatgtg

SEQ ID NO: 702067 - DNA, 25 bp, Mus musculus
gtgcaatgtgcatccctgggatgtg

SEQ ID NO: 702068 - DNA, 25 bp, Mus musculus
gtgcaatgtttaaacctcatacaaa

SEQ ID NO: 702069 - DNA, 25 bp, Mus musculus
gtgcaatgtttatacctcatacaaa

SEQ ID NO: 702070 - DNA, 25 bp, Mus musculus
gtgcaatgtttcaataggattccga

SEQ ID NO: 702071 - DNA, 25 bp, Mus musculus
gtgcaatgtttctataggattccga

SEQ ID NO: 702072 - DNA, 25 bp, Mus musculus
gtgcaatgtttgcaggcgacacact

SEQ ID NO: 702073 - DNA, 25 bp, Mus musculus
gtgcaatgtttggaggcgacacact

SEQ ID NO: 702074 - DNA, 25 bp, Mus musculus
gtgcaattagtgctacatcaagtaa

SEQ ID NO: 702075 - DNA, 25 bp, Mus musculus
gtgcaattagtggtacatcaagtaa

SEQ ID NO: 702076 - DNA, 25 bp, Mus musculus
gtgcaattctgtcactgctttttgt

SEQ ID NO: 702077 - DNA, 25 bp, Mus musculus
gtgcaattctgtgactgctttttgt

SEQ ID NO: 702078 - DNA, 25 bp, Mus musculus
gtgcaattgtgaaaactacgctaga

SEQ ID NO: 702079 - DNA, 25 bp, Mus musculus
gtgcaattgtgataactacgctaga

SEQ ID NO: 702080 - DNA, 25 bp, Mus musculus
gtgcaattgtgtaccctttaccttt

SEQ ID NO: 702081 - DNA, 25 bp, Mus musculus
gtgcaattgtgttccctttaccttt

SEQ ID NO: 702082 - DNA, 25 bp, Mus musculus
gtgcaattgtttctacaactagggt

SEQ ID NO: 702083 - DNA, 25 bp, Mus musculus
gtgcaattgtttgtacaactagggt

SEQ ID NO: 702084 - DNA, 25 bp, Mus musculus
gtgcaatttcatcttctggtgaagc

SEQ ID NO: 702085 - DNA, 25 bp, Mus musculus
gtgcaatttcatgttctggtgaagc

SEQ ID NO: 702086 - DNA, 25 bp, Mus musculus
gtgcaatttggaagaactggttaaa

SEQ ID NO: 702087 - DNA, 25 bp, Mus musculus
gtgcaatttggatgaactggttaaa

SEQ ID NO: 702088 - DNA, 25 bp, Mus musculus
gtgcacaaacacagtctatggtaga

SEQ ID NO: 702089 - DNA, 25 bp, Mus musculus
gtgcacaaacactgtctatggtaga

SEQ ID NO: 702090 - DNA, 25 bp, Mus musculus
gtgcacaaagtgaaggagtaacccc

SEQ ID NO: 702091 - DNA, 25 bp, Mus musculus
gtgcacaaagtgtaggagtaacccc

SEQ ID NO: 702092 - DNA, 25 bp, Mus musculus
gtgcacaacagcatatccgctttat

SEQ ID NO: 702093 - DNA, 25 bp, Mus musculus
gtgcacaacagcttatccgctttat

SEQ ID NO: 702094 - DNA, 25 bp, Mus musculus
gtgcacaaccaactcacttacagaa

SEQ ID NO: 702095 - DNA, 25 bp, Mus musculus
gtgcacaaccaagtcacttacagaa

SEQ ID NO: 702096 - DNA, 25 bp, Mus musculus
gtgcacaagacaaaacgctgcccct

SEQ ID NO: 702097 - DNA, 25 bp, Mus musculus
gtgcacaagacataacgctgcccct

SEQ ID NO: 702098 - DNA, 25 bp, Mus musculus
gtgcacaagagtccaggtgtccatg

SEQ ID NO: 702099 - DNA, 25 bp, Mus musculus
gtgcacaagagtgcaggtgtccatg

SEQ ID NO: 702100 - DNA, 25 bp, Mus musculus
gtgcacaagcacatggttccaataa

SEQ ID NO: 702101 - DNA, 25 bp, Mus musculus
gtgcacaagcacttggttccaataa

SEQ ID NO: 702102 - DNA, 25 bp, Mus musculus
gtgcacaagccacagttagtaactg

SEQ ID NO: 702103 - DNA, 25 bp, Mus musculus
gtgcacaagccagagttagtaactg

SEQ ID NO: 702104 - DNA, 25 bp, Mus musculus
gtgcacaagtggacggcgttgctaa

SEQ ID NO: 702105 - DNA, 25 bp, Mus musculus
gtgcacaagtggtcggcgttgctaa

SEQ ID NO: 702106 - DNA, 25 bp, Mus musculus
gtgcacaatgagaggtgaccagacc

SEQ ID NO: 702107 - DNA, 25 bp, Mus musculus
gtgcacaatgagtggtgaccagacc

SEQ ID NO: 702108 - DNA, 25 bp, Mus musculus
gtgcacacaaccatttattgaggat

SEQ ID NO: 702109 - DNA, 25 bp, Mus musculus
gtgcacacaaccttttattgaggat

SEQ ID NO: 702110 - DNA, 25 bp, Mus musculus
gtgcacacacagaaagttcttatag

SEQ ID NO: 702111 - DNA, 25 bp, Mus musculus
gtgcacacacagctttagcaaccaa

SEQ ID NO: 702112 - DNA, 25 bp, Mus musculus
gtgcacacacaggtttagcaaccaa

SEQ ID NO: 702113 - DNA, 25 bp, Mus musculus
gtgcacacacagtaagttcttatag

SEQ ID NO: 702114 - DNA, 25 bp, Mus musculus
gtgcacacacccatgtatatatatt

SEQ ID NO: 702115 - DNA, 25 bp, Mus musculus
gtgcacacacccttgtatatatatt

SEQ ID NO: 702116 - DNA, 25 bp, Mus musculus
gtgcacacaccgagatggcagccat

SEQ ID NO: 702117 - DNA, 25 bp, Mus musculus
gtgcacacaccgtgatggcagccat

SEQ ID NO: 702118 - DNA, 25 bp, Mus musculus
gtgcacacacctcggttttattgcg

SEQ ID NO: 702119 - DNA, 25 bp, Mus musculus
gtgcacacacctgggttttattgcg

SEQ ID NO: 702120 - DNA, 25 bp, Mus musculus
gtgcacacacttccgcatttgtagg

SEQ ID NO: 702121 - DNA, 25 bp, Mus musculus
gtgcacacacttgcgcatttgtagg

SEQ ID NO: 702122 - DNA, 25 bp, Mus musculus
gtgcacacatgtataacctcaatta

SEQ ID NO: 702123 - DNA, 25 bp, Mus musculus
gtgcacacatgtccccttgttcatg

SEQ ID NO: 702124 - DNA, 25 bp, Mus musculus
gtgcacacatgtgcccttgttcatg

SEQ ID NO: 702125 - DNA, 25 bp, Mus musculus
gtgcacacatgtttaacctcaatta

SEQ ID NO: 702126 - DNA, 25 bp, Mus musculus
gtgcacacattccttctcaagaaag

SEQ ID NO: 702127 - DNA, 25 bp, Mus musculus
gtgcacacattcgttctcaagaaag

SEQ ID NO: 702128 - DNA, 25 bp, Mus musculus
gtgcacaccaaaatttaccacattt

SEQ ID NO: 702129 - DNA, 25 bp, Mus musculus
gtgcacaccaaattttaccacattt

SEQ ID NO: 702130 - DNA, 25 bp, Mus musculus
gtgcacaccattacttgcaagagtc

SEQ ID NO: 702131 - DNA, 25 bp, Mus musculus
gtgcacaccatttcttgcaagagtc

SEQ ID NO: 702132 - DNA, 25 bp, Mus musculus
gtgcacacccagctcttttaagttt

SEQ ID NO: 702133 - DNA, 25 bp, Mus musculus
gtgcacacccaggtcttttaagttt

SEQ ID NO: 702134 - DNA, 25 bp, Mus musculus
gtgcacacctatacatgtacctatc

SEQ ID NO: 702135 - DNA, 25 bp, Mus musculus
gtgcacacctatcttggaggcctgc

SEQ ID NO: 702136 - DNA, 25 bp, Mus musculus
gtgcacacctatgttggaggcctgc

SEQ ID NO: 702137 - DNA, 25 bp, Mus musculus
gtgcacacctattcatgtacctatc

SEQ ID NO: 702138 - DNA, 25 bp, Mus musculus
gtgcacaccttcacaccaaggacaa

SEQ ID NO: 702139 - DNA, 25 bp, Mus musculus
gtgcacaccttctcaccaaggacaa

SEQ ID NO: 702140 - DNA, 25 bp, Mus musculus
gtgcacacctttcataccattactt

SEQ ID NO: 702141 - DNA, 25 bp, Mus musculus
gtgcacacctttgataccattactt

SEQ ID NO: 702142 - DNA, 25 bp, Mus musculus
gtgcacacggaaacaaagccagcat

SEQ ID NO: 702143 - DNA, 25 bp, Mus musculus
gtgcacacggaatcaaagccagcat

SEQ ID NO: 702144 - DNA, 25 bp, Mus musculus
gtgcacactcagctgggactgaaca

SEQ ID NO: 702145 - DNA, 25 bp, Mus musculus
gtgcacactcaggtgggactgaaca

SEQ ID NO: 702146 - DNA, 25 bp, Mus musculus
gtgcacactgaaaccttacttgaac

SEQ ID NO: 702147 - DNA, 25 bp, Mus musculus
gtgcacactgaatccttacttgaac

SEQ ID NO: 702148 - DNA, 25 bp, Mus musculus
gtgcacactgtcagccaaaaccaga

SEQ ID NO: 702149 - DNA, 25 bp, Mus musculus
gtgcacactgtctgccaaaaccaga

SEQ ID NO: 702150 - DNA, 25 bp, Mus musculus
gtgcacagaatcaccagagcaggct

SEQ ID NO: 702151 - DNA, 25 bp, Mus musculus
gtgcacagaatctccagagcaggct

SEQ ID NO: 702152 - DNA, 25 bp, Mus musculus
gtgcacagagctacattagactccc

SEQ ID NO: 702153 - DNA, 25 bp, Mus musculus
gtgcacagagctcggtatccgcaca

SEQ ID NO: 702154 - DNA, 25 bp, Mus musculus
gtgcacagagctgggtatccgcaca

SEQ ID NO: 702155 - DNA, 25 bp, Mus musculus
gtgcacagagcttcattagactccc

SEQ ID NO: 702156 - DNA, 25 bp, Mus musculus
gtgcacagattcagttttcaaggga

SEQ ID NO: 702157 - DNA, 25 bp, Mus musculus
gtgcacagattctgttttcaaggga

SEQ ID NO: 702158 - DNA, 25 bp, Mus musculus
gtgcacagcaacaggttctcagttc

SEQ ID NO: 702159 - DNA, 25 bp, Mus musculus
gtgcacagcaactggttctcagttc

SEQ ID NO: 702160 - DNA, 25 bp, Mus musculus
gtgcacagcacgagtcaagcttgta

SEQ ID NO: 702161 - DNA, 25 bp, Mus musculus
gtgcacagcacgtgtcaagcttgta

SEQ ID NO: 702162 - DNA, 25 bp, Mus musculus
gtgcacagccacagttagccagaga

SEQ ID NO: 702163 - DNA, 25 bp, Mus musculus
gtgcacagccactgttagccagaga

SEQ ID NO: 702164 - DNA, 25 bp, Mus musculus
gtgcacagccttctttacagggaat

SEQ ID NO: 702165 - DNA, 25 bp, Mus musculus
gtgcacagccttgtttacagggaat

SEQ ID NO: 702166 - DNA, 25 bp, Mus musculus
gtgcacagctaaccaaatgcctctt

SEQ ID NO: 702167 - DNA, 25 bp, Mus musculus
gtgcacagctaagcaaatgcctctt

SEQ ID NO: 702168 - DNA, 25 bp, Mus musculus
gtgcacagctacagagatgggaagc

SEQ ID NO: 702169 - DNA, 25 bp, Mus musculus
gtgcacagctactgagatgggaagc

SEQ ID NO: 702170 - DNA, 25 bp, Mus musculus
gtgcacagctttattgggagcctac

SEQ ID NO: 702171 - DNA, 25 bp, Mus musculus
gtgcacagcttttttgggagcctac

SEQ ID NO: 702172 - DNA, 25 bp, Mus musculus
gtgcacaggaacctcaggattttct

SEQ ID NO: 702173 - DNA, 25 bp, Mus musculus
gtgcacaggaacgtcaggattttct

SEQ ID NO: 702174 - DNA, 25 bp, Mus musculus
gtgcacaggatgagacagctcccca

SEQ ID NO: 702175 - DNA, 25 bp, Mus musculus
gtgcacaggatgtgacagctcccca

SEQ ID NO: 702176 - DNA, 25 bp, Mus musculus
gtgcacaggcatagctgcatgtatt

SEQ ID NO: 702177 - DNA, 25 bp, Mus musculus
gtgcacaggcattgctgcatgtatt

SEQ ID NO: 702178 - DNA, 25 bp, Mus musculus
gtgcacaggcctagtagggaactct

SEQ ID NO: 702179 - DNA, 25 bp, Mus musculus
gtgcacaggccttgtagggaactct

SEQ ID NO: 702180 - DNA, 25 bp, Mus musculus
gtgcacaggcgactgccacccttta

SEQ ID NO: 702181 - DNA, 25 bp, Mus musculus
gtgcacaggcgagtgccacccttta

SEQ ID NO: 702182 - DNA, 25 bp, Mus musculus
gtgcacagggacacaggctgactgt

SEQ ID NO: 702183 - DNA, 25 bp, Mus musculus
gtgcacagggactcaggctgactgt

SEQ ID NO: 702184 - DNA, 25 bp, Mus musculus
gtgcacagtaagcaaccttcacagt

SEQ ID NO: 702185 - DNA, 25 bp, Mus musculus
gtgcacagtaaggaaccttcacagt

SEQ ID NO: 702186 - DNA, 25 bp, Mus musculus
gtgcacagtccactactaactgaac

SEQ ID NO: 702187 - DNA, 25 bp, Mus musculus
gtgcacagtccagtactaactgaac

SEQ ID NO: 702188 - DNA, 25 bp, Mus musculus
gtgcacagtcccatggatggctggg

SEQ ID NO: 702189 - DNA, 25 bp, Mus musculus
gtgcacagtcccttggatggctggg

SEQ ID NO: 702190 - DNA, 25 bp, Mus musculus
gtgcacagtcgcacggaatggagaa

SEQ ID NO: 702191 - DNA, 25 bp, Mus musculus
gtgcacagtcgctcggaatggagaa

SEQ ID NO: 702192 - DNA, 25 bp, Mus musculus
gtgcacagtgcaacagtaccacaca

SEQ ID NO: 702193 - DNA, 25 bp, Mus musculus
gtgcacagtgcatcagtaccacaca

SEQ ID NO: 702194 - DNA, 25 bp, Mus musculus
gtgcacagttgtattttccatgaag

SEQ ID NO: 702195 - DNA, 25 bp, Mus musculus
gtgcacagttgttttttccatgaag

SEQ ID NO: 702196 - DNA, 25 bp, Mus musculus
gtgcacagtttacatttcctggaca

SEQ ID NO: 702197 - DNA, 25 bp, Mus musculus
gtgcacagtttagatttcctggaca

SEQ ID NO: 702198 - DNA, 25 bp, Mus musculus
gtgcacagtttgatttggtttacct

SEQ ID NO: 702199 - DNA, 25 bp, Mus musculus
gtgcacagtttgctgtatgaagtaa

SEQ ID NO: 702200 - DNA, 25 bp, Mus musculus
gtgcacagtttggtgtatgaagtaa

SEQ ID NO: 702201 - DNA, 25 bp, Mus musculus
gtgcacagtttgttttggtttacct

SEQ ID NO: 702202 - DNA, 25 bp, Mus musculus
gtgcacatactgactatagttaaac

SEQ ID NO: 702203 - DNA, 25 bp, Mus musculus
gtgcacatactgtctatagttaaac

SEQ ID NO: 702204 - DNA, 25 bp, Mus musculus
gtgcacatagtccttattacaagtt

SEQ ID NO: 702205 - DNA, 25 bp, Mus musculus
gtgcacatagtcgttattacaagtt

SEQ ID NO: 702206 - DNA, 25 bp, Mus musculus
gtgcacatatataactgacctggag

SEQ ID NO: 702207 - DNA, 25 bp, Mus musculus
gtgcacatatattactgacctggag

SEQ ID NO: 702208 - DNA, 25 bp, Mus musculus
gtgcacatatccactcattcacata

SEQ ID NO: 702209 - DNA, 25 bp, Mus musculus
gtgcacatatcctctcattcacata

SEQ ID NO: 702210 - DNA, 25 bp, Mus musculus
gtgcacatatgcatcttcttgtata

SEQ ID NO: 702211 - DNA, 25 bp, Mus musculus
gtgcacatatgcttcttcttgtata

SEQ ID NO: 702212 - DNA, 25 bp, Mus musculus
gtgcacatatggagacatacaccca

SEQ ID NO: 702213 - DNA, 25 bp, Mus musculus
gtgcacatatggtgacatacaccca

SEQ ID NO: 702214 - DNA, 25 bp, Mus musculus
gtgcacatatgtagatgttcagatc

SEQ ID NO: 702215 - DNA, 25 bp, Mus musculus
gtgcacatatgttgatgttcagatc

SEQ ID NO: 702216 - DNA, 25 bp, Mus musculus
gtgcacatcacactgaccaacagca

SEQ ID NO: 702217 - DNA, 25 bp, Mus musculus
gtgcacatcacagtgaccaacagca

SEQ ID NO: 702218 - DNA, 25 bp, Mus musculus
gtgcacatccgcattcagaactctt

SEQ ID NO: 702219 - DNA, 25 bp, Mus musculus
gtgcacatccgctttcagaactctt

SEQ ID NO: 702220 - DNA, 25 bp, Mus musculus
gtgcacatctaaatatctgtcttca

SEQ ID NO: 702221 - DNA, 25 bp, Mus musculus
gtgcacatctaacaatcttcaggag

SEQ ID NO: 702222 - DNA, 25 bp, Mus musculus
gtgcacatctaagaatcttcaggag

SEQ ID NO: 702223 - DNA, 25 bp, Mus musculus
gtgcacatctaattatctgtcttca

SEQ ID NO: 702224 - DNA, 25 bp, Mus musculus
gtgcacatgaggacaactacctggg

SEQ ID NO: 702225 - DNA, 25 bp, Mus musculus
gtgcacatgaggtcaactacctggg

SEQ ID NO: 702226 - DNA, 25 bp, Mus musculus
gtgcacatgagtccaatgcctgcat

SEQ ID NO: 702227 - DNA, 25 bp, Mus musculus
gtgcacatgagtgcaatgcctgcat

SEQ ID NO: 702228 - DNA, 25 bp, Mus musculus
gtgcacatgcaaattccacgtggtg

SEQ ID NO: 702229 - DNA, 25 bp, Mus musculus
gtgcacatgcaatttccacgtggtg

SEQ ID NO: 702230 - DNA, 25 bp, Mus musculus
gtgcacatgcaccagtaaacagtaa

SEQ ID NO: 702231 - DNA, 25 bp, Mus musculus
gtgcacatgcacgagtaaacagtaa

SEQ ID NO: 702232 - DNA, 25 bp, Mus musculus
gtgcacatgcatatttatcacaaat

SEQ ID NO: 702233 - DNA, 25 bp, Mus musculus
gtgcacatgcatctacaggtacact

SEQ ID NO: 702234 - DNA, 25 bp, Mus musculus
gtgcacatgcatgtacaggtacact

SEQ ID NO: 702235 - DNA, 25 bp, Mus musculus
gtgcacatgcatttttatcacaaat

SEQ ID NO: 702236 - DNA, 25 bp, Mus musculus
gtgcacatgcgtcgttttcacagat

SEQ ID NO: 702237 - DNA, 25 bp, Mus musculus
gtgcacatgcgtggttttcacagat

SEQ ID NO: 702238 - DNA, 25 bp, Mus musculus
gtgcacatggacatgaatctgatat

SEQ ID NO: 702239 - DNA, 25 bp, Mus musculus
gtgcacatggacttgaatctgatat

SEQ ID NO: 702240 - DNA, 25 bp, Mus musculus
gtgcacatggtcagagcgccacgtt

SEQ ID NO: 702241 - DNA, 25 bp, Mus musculus
gtgcacatggtctgagcgccacgtt

SEQ ID NO: 702242 - DNA, 25 bp, Mus musculus
gtgcacatgttcactgaaggccttc

SEQ ID NO: 702243 - DNA, 25 bp, Mus musculus
gtgcacatgttctctgaaggccttc

SEQ ID NO: 702244 - DNA, 25 bp, Mus musculus
gtgcacattaatctgaactgctgta

SEQ ID NO: 702245 - DNA, 25 bp, Mus musculus
gtgcacattaatgtgaactgctgta

SEQ ID NO: 702246 - DNA, 25 bp, Mus musculus
gtgcacattatcctgagctggatga

SEQ ID NO: 702247 - DNA, 25 bp, Mus musculus
gtgcacattatcgtgagctggatga

SEQ ID NO: 702248 - DNA, 25 bp, Mus musculus
gtgcacattgatcaactcacccatt

SEQ ID NO: 702249 - DNA, 25 bp, Mus musculus
gtgcacattgatgaactcacccatt

SEQ ID NO: 702250 - DNA, 25 bp, Mus musculus
gtgcacatttcaccaggcgaggtca

SEQ ID NO: 702251 - DNA, 25 bp, Mus musculus
gtgcacatttcagcaggcgaggtca

SEQ ID NO: 702252 - DNA, 25 bp, Mus musculus
gtgcacattttcataactacattcg

SEQ ID NO: 702253 - DNA, 25 bp, Mus musculus
gtgcacattttcttaactacattcg

SEQ ID NO: 702254 - DNA, 25 bp, Mus musculus
gtgcaccaaaacagaggctaacttc

SEQ ID NO: 702255 - DNA, 25 bp, Mus musculus
gtgcaccaaaactgaggctaacttc

SEQ ID NO: 702256 - DNA, 25 bp, Mus musculus
gtgcaccaaactagagacgagggat

SEQ ID NO: 702257 - DNA, 25 bp, Mus musculus
gtgcaccaaacttgagacgagggat

SEQ ID NO: 702258 - DNA, 25 bp, Mus musculus
gtgcaccaggaaaccagctctgaat

SEQ ID NO: 702259 - DNA, 25 bp, Mus musculus
gtgcaccaggaatccagctctgaat

SEQ ID NO: 702260 - DNA, 25 bp, Mus musculus
gtgcaccaggtcacagaatcggttt

SEQ ID NO: 702261 - DNA, 25 bp, Mus musculus
gtgcaccaggtctcagaatcggttt

SEQ ID NO: 702262 - DNA, 25 bp, Mus musculus
gtgcaccatcatatgcaatttttgt

SEQ ID NO: 702263 - DNA, 25 bp, Mus musculus
gtgcaccatcatttgcaatttttgt

SEQ ID NO: 702264 - DNA, 25 bp, Mus musculus
gtgcaccatcgtatccagtattttt

SEQ ID NO: 702265 - DNA, 25 bp, Mus musculus
gtgcaccatcgtttccagtattttt

SEQ ID NO: 702266 - DNA, 25 bp, Mus musculus
gtgcaccatggaaacattaactgac

SEQ ID NO: 702267 - DNA, 25 bp, Mus musculus
gtgcaccatggacccgaagcccaga

SEQ ID NO: 702268 - DNA, 25 bp, Mus musculus
gtgcaccatggagccgaagcccaga

SEQ ID NO: 702269 - DNA, 25 bp, Mus musculus
gtgcaccatggatacattaactgac

SEQ ID NO: 702270 - DNA, 25 bp, Mus musculus
gtgcaccatggcacacacgtaaata

SEQ ID NO: 702271 - DNA, 25 bp, Mus musculus
gtgcaccatggctcacacgtaaata

SEQ ID NO: 702272 - DNA, 25 bp, Mus musculus
gtgcaccatgttctggttaactcct

SEQ ID NO: 702273 - DNA, 25 bp, Mus musculus
gtgcaccatgttgtggttaactcct

SEQ ID NO: 702274 - DNA, 25 bp, Mus musculus
gtgcacccaagcaggaagggcagat

SEQ ID NO: 702275 - DNA, 25 bp, Mus musculus
gtgcacccaagctggaagggcagat

SEQ ID NO: 702276 - DNA, 25 bp, Mus musculus
gtgcacccacctcctcattggatgg

SEQ ID NO: 702277 - DNA, 25 bp, Mus musculus
gtgcacccacctgctcattggatgg

SEQ ID NO: 702278 - DNA, 25 bp, Mus musculus
gtgcaccccagacatggctgttgag

SEQ ID NO: 702279 - DNA, 25 bp, Mus musculus
gtgcaccccagagatggctgttgag

SEQ ID NO: 702280 - DNA, 25 bp, Mus musculus
gtgcaccccatacacgtcaaagaag

SEQ ID NO: 702281 - DNA, 25 bp, Mus musculus
gtgcaccccatagacgtcaaagaag

SEQ ID NO: 702282 - DNA, 25 bp, Mus musculus
gtgcacccctatacctggaaacata

SEQ ID NO: 702283 - DNA, 25 bp, Mus musculus
gtgcacccctattcctggaaacata

SEQ ID NO: 702284 - DNA, 25 bp, Mus musculus
gtgcacccctctaggtttatccgaa

SEQ ID NO: 702285 - DNA, 25 bp, Mus musculus
gtgcacccctcttggtttatccgaa

SEQ ID NO: 702286 - DNA, 25 bp, Mus musculus
gtgcaccctcagctgtagcatggta

SEQ ID NO: 702287 - DNA, 25 bp, Mus musculus
gtgcaccctcaggtgtagcatggta

SEQ ID NO: 702288 - DNA, 25 bp, Mus musculus
gtgcacccttttcagctggatgaga

SEQ ID NO: 702289 - DNA, 25 bp, Mus musculus
gtgcacccttttgagctggatgaga

SEQ ID NO: 702290 - DNA, 25 bp, Mus musculus
gtgcaccgaatcatggtactcatat

SEQ ID NO: 702291 - DNA, 25 bp, Mus musculus
gtgcaccgaatcttggtactcatat

SEQ ID NO: 702292 - DNA, 25 bp, Mus musculus
gtgcaccgactcaacatgtcaggac

SEQ ID NO: 702293 - DNA, 25 bp, Mus musculus
gtgcaccgactctacatgtcaggac

SEQ ID NO: 702294 - DNA, 25 bp, Mus musculus
gtgcaccggcagaccagagacctag

SEQ ID NO: 702295 - DNA, 25 bp, Mus musculus
gtgcaccggcagtccagagacctag

SEQ ID NO: 702296 - DNA, 25 bp, Mus musculus
gtgcaccgggcgacgatcatgagct

SEQ ID NO: 702297 - DNA, 25 bp, Mus musculus
gtgcaccgggcgtcgatcatgagct

SEQ ID NO: 702298 - DNA, 25 bp, Mus musculus
gtgcaccgtcacacataagttctgt

SEQ ID NO: 702299 - DNA, 25 bp, Mus musculus
gtgcaccgtcactcataagttctgt

SEQ ID NO: 702300 - DNA, 25 bp, Mus musculus
gtgcaccgtggtaatatttttgagt

SEQ ID NO: 702301 - DNA, 25 bp, Mus musculus
gtgcaccgtggttatatttttgagt

SEQ ID NO: 702302 - DNA, 25 bp, Mus musculus
gtgcacctacacatattcaaatata

SEQ ID NO: 702303 - DNA, 25 bp, Mus musculus
gtgcacctacacttattcaaatata

SEQ ID NO: 702304 - DNA, 25 bp, Mus musculus
gtgcacctagagctttttataacag

SEQ ID NO: 702305 - DNA, 25 bp, Mus musculus
gtgcacctagaggtttttataacag

SEQ ID NO: 702306 - DNA, 25 bp, Mus musculus
gtgcacctaggacagatggccttga

SEQ ID NO: 702307 - DNA, 25 bp, Mus musculus
gtgcacctaggagagatggccttga

SEQ ID NO: 702308 - DNA, 25 bp, Mus musculus
gtgcacctatgaaatgctctttgga

SEQ ID NO: 702309 - DNA, 25 bp, Mus musculus
gtgcacctatgatatgctctttgga

SEQ ID NO: 702310 - DNA, 25 bp, Mus musculus
gtgcacctcaatatgtggagctact

SEQ ID NO: 702311 - DNA, 25 bp, Mus musculus
gtgcacctcaatttgtggagctact

SEQ ID NO: 702312 - DNA, 25 bp, Mus musculus
gtgcacctccacaatgagcagaagt

SEQ ID NO: 702313 - DNA, 25 bp, Mus musculus
gtgcacctccactatgagcagaagt

SEQ ID NO: 702314 - DNA, 25 bp, Mus musculus
gtgcacctctggaggttatctgcca

SEQ ID NO: 702315 - DNA, 25 bp, Mus musculus
gtgcacctctggtggttatctgcca

SEQ ID NO: 702316 - DNA, 25 bp, Mus musculus
gtgcacctctttcgactggtatcta

SEQ ID NO: 702317 - DNA, 25 bp, Mus musculus
gtgcacctctttggactggtatcta

SEQ ID NO: 702318 - DNA, 25 bp, Mus musculus
gtgcacctgattattgctctaaaag

SEQ ID NO: 702319 - DNA, 25 bp, Mus musculus
gtgcacctgatttttgctctaaaag

SEQ ID NO: 702320 - DNA, 25 bp, Mus musculus
gtgcacctgcacattgcaaaggttt

SEQ ID NO: 702321 - DNA, 25 bp, Mus musculus
gtgcacctgcactttgcaaaggttt

SEQ ID NO: 702322 - DNA, 25 bp, Mus musculus
gtgcacctgtgtctgatacctcaca

SEQ ID NO: 702323 - DNA, 25 bp, Mus musculus
gtgcacctgtgtgtgatacctcaca

SEQ ID NO: 702324 - DNA, 25 bp, Mus musculus
gtgcacctgttgagtgtggtcccgt

SEQ ID NO: 702325 - DNA, 25 bp, Mus musculus
gtgcacctgttgtgtgtggtcccgt

SEQ ID NO: 702326 - DNA, 25 bp, Mus musculus
gtgcaccttcaaacattgacacact

SEQ ID NO: 702327 - DNA, 25 bp, Mus musculus
gtgcaccttcaatcattgacacact

SEQ ID NO: 702328 - DNA, 25 bp, Mus musculus
gtgcaccttggtacagtcgtctaag

SEQ ID NO: 702329 - DNA, 25 bp, Mus musculus
gtgcaccttggttcagtcgtctaag

SEQ ID NO: 702330 - DNA, 25 bp, Mus musculus
gtgcacgaaagccttctaaccattc

SEQ ID NO: 702331 - DNA, 25 bp, Mus musculus
gtgcacgaaagcgttctaaccattc

SEQ ID NO: 702332 - DNA, 25 bp, Mus musculus
gtgcacgacgttacaccgcgactta

SEQ ID NO: 702333 - DNA, 25 bp, Mus musculus
gtgcacgacgtttcaccgcgactta

SEQ ID NO: 702334 - DNA, 25 bp, Mus musculus
gtgcacgactgcatctggacacatg

SEQ ID NO: 702335 - DNA, 25 bp, Mus musculus
gtgcacgactgcttctggacacatg

SEQ ID NO: 702336 - DNA, 25 bp, Mus musculus
gtgcacgactgtacctgcaattgat

SEQ ID NO: 702337 - DNA, 25 bp, Mus musculus
gtgcacgactgttcctgcaattgat

SEQ ID NO: 702338 - DNA, 25 bp, Mus musculus
gtgcacgaggccatcggtctataat

SEQ ID NO: 702339 - DNA, 25 bp, Mus musculus
gtgcacgaggccttcggtctataat

SEQ ID NO: 702340 - DNA, 25 bp, Mus musculus
gtgcacgatgatagagcccttctta

SEQ ID NO: 702341 - DNA, 25 bp, Mus musculus
gtgcacgatgattgagcccttctta

SEQ ID NO: 702342 - DNA, 25 bp, Mus musculus
gtgcacgcaggtctcctttgttgtt

SEQ ID NO: 702343 - DNA, 25 bp, Mus musculus
gtgcacgcaggtgtcctttgttgtt

SEQ ID NO: 702344 - DNA, 25 bp, Mus musculus
gtgcacgcatataacaacgtccaat

SEQ ID NO: 702345 - DNA, 25 bp, Mus musculus
gtgcacgcatattacaacgtccaat

SEQ ID NO: 702346 - DNA, 25 bp, Mus musculus
gtgcacgcatgcattcttgtgggta

SEQ ID NO: 702347 - DNA, 25 bp, Mus musculus
gtgcacgcatgctttcttgtgggta

SEQ ID NO: 702348 - DNA, 25 bp, Mus musculus
gtgcacgcatggcagctgacaacct

SEQ ID NO: 702349 - DNA, 25 bp, Mus musculus
gtgcacgcatgggagctgacaacct

SEQ ID NO: 702350 - DNA, 25 bp, Mus musculus
gtgcacgcattaccgatgccatgat

SEQ ID NO: 702351 - DNA, 25 bp, Mus musculus
gtgcacgcattagcgatgccatgat

SEQ ID NO: 702352 - DNA, 25 bp, Mus musculus
gtgcacgcccagatgccgagaaaaa

SEQ ID NO: 702353 - DNA, 25 bp, Mus musculus
gtgcacgcccagttgccgagaaaaa

SEQ ID NO: 702354 - DNA, 25 bp, Mus musculus
gtgcacgcctcacggcggtatttga

SEQ ID NO: 702355 - DNA, 25 bp, Mus musculus
gtgcacgcctcagggcggtatttga

SEQ ID NO: 702356 - DNA, 25 bp, Mus musculus
gtgcacgggcagctacatttatcta

SEQ ID NO: 702357 - DNA, 25 bp, Mus musculus
gtgcacgggcaggtacatttatcta

SEQ ID NO: 702358 - DNA, 25 bp, Mus musculus
gtgcacgtacatacatacttgcagg

SEQ ID NO: 702359 - DNA, 25 bp, Mus musculus
gtgcacgtacattcatacttgcagg

SEQ ID NO: 702360 - DNA, 25 bp, Mus musculus
gtgcacgtgcaccaggcgctcagta

SEQ ID NO: 702361 - DNA, 25 bp, Mus musculus
gtgcacgtgcacgaggcgctcagta

SEQ ID NO: 702362 - DNA, 25 bp, Mus musculus
gtgcacgtgcatacacatgttatgt

SEQ ID NO: 702363 - DNA, 25 bp, Mus musculus
gtgcacgtgcattcacatgttatgt

SEQ ID NO: 702364 - DNA, 25 bp, Mus musculus
gtgcacgttcccaagatgcaaactg

SEQ ID NO: 702365 - DNA, 25 bp, Mus musculus
gtgcacgttccctagatgcaaactg

SEQ ID NO: 702366 - DNA, 25 bp, Mus musculus
gtgcactaaacaacttcaatttcct

SEQ ID NO: 702367 - DNA, 25 bp, Mus musculus
gtgcactaaacatcttcaatttcct

SEQ ID NO: 702368 - DNA, 25 bp, Mus musculus
gtgcactaacttatatgagactcag

SEQ ID NO: 702369 - DNA, 25 bp, Mus musculus
gtgcactaacttttatgagactcag

SEQ ID NO: 702370 - DNA, 25 bp, Mus musculus
gtgcactacagcacaccgtaataaa

SEQ ID NO: 702371 - DNA, 25 bp, Mus musculus
gtgcactacagctcaccgtaataaa

SEQ ID NO: 702372 - DNA, 25 bp, Mus musculus
gtgcactactgtatgaatcatctga

SEQ ID NO: 702373 - DNA, 25 bp, Mus musculus
gtgcactactgtttgaatcatctga

SEQ ID NO: 702374 - DNA, 25 bp, Mus musculus
gtgcactataaactacctcaccagc

SEQ ID NO: 702375 - DNA, 25 bp, Mus musculus
gtgcactataaagtacctcaccagc

SEQ ID NO: 702376 - DNA, 25 bp, Mus musculus
gtgcactataccatctgtcttagaa

SEQ ID NO: 702377 - DNA, 25 bp, Mus musculus
gtgcactataccttctgtcttagaa

SEQ ID NO: 702378 - DNA, 25 bp, Mus musculus
gtgcactatactctgaaggcccaag

SEQ ID NO: 702379 - DNA, 25 bp, Mus musculus
gtgcactatactgtgaaggcccaag

SEQ ID NO: 702380 - DNA, 25 bp, Mus musculus
gtgcactatcttaatgttgctgcga

SEQ ID NO: 702381 - DNA, 25 bp, Mus musculus
gtgcactatctttatgttgctgcga

SEQ ID NO: 702382 - DNA, 25 bp, Mus musculus
gtgcactcaattagcatgcttccta

SEQ ID NO: 702383 - DNA, 25 bp, Mus musculus
gtgcactcaatttgcatgcttccta

SEQ ID NO: 702384 - DNA, 25 bp, Mus musculus
gtgcactcacatacactttttgttt

SEQ ID NO: 702385 - DNA, 25 bp, Mus musculus
gtgcactcacattcactttttgttt

SEQ ID NO: 702386 - DNA, 25 bp, Mus musculus
gtgcactcactgcttacatttggat

SEQ ID NO: 702387 - DNA, 25 bp, Mus musculus
gtgcactcactggttacatttggat

SEQ ID NO: 702388 - DNA, 25 bp, Mus musculus
gtgcactcagctaggaaactcgtct

SEQ ID NO: 702389 - DNA, 25 bp, Mus musculus
gtgcactcagcttggaaactcgtct

SEQ ID NO: 702390 - DNA, 25 bp, Mus musculus
gtgcactcaggaacctactttagtt

SEQ ID NO: 702391 - DNA, 25 bp, Mus musculus
gtgcactcaggatcctactttagtt

SEQ ID NO: 702392 - DNA, 25 bp, Mus musculus
gtgcactcagtcactagcagcgcga

SEQ ID NO: 702393 - DNA, 25 bp, Mus musculus
gtgcactcagtctctagcagcgcga

SEQ ID NO: 702394 - DNA, 25 bp, Mus musculus
gtgcactcagttccgtaggattcca

SEQ ID NO: 702395 - DNA, 25 bp, Mus musculus
gtgcactcagttgcgtaggattcca

SEQ ID NO: 702396 - DNA, 25 bp, Mus musculus
gtgcactcattcagtggaatatagt

SEQ ID NO: 702397 - DNA, 25 bp, Mus musculus
gtgcactcattctgtggaatatagt

SEQ ID NO: 702398 - DNA, 25 bp, Mus musculus
gtgcactccaaacatttgatttctg

SEQ ID NO: 702399 - DNA, 25 bp, Mus musculus
gtgcactccaaagatttgatttctg

SEQ ID NO: 702400 - DNA, 25 bp, Mus musculus
gtgcactccagaataactccaatgt

SEQ ID NO: 702401 - DNA, 25 bp, Mus musculus
gtgcactccagattaactccaatgt

SEQ ID NO: 702402 - DNA, 25 bp, Mus musculus
gtgcactcgcttctgtttattttgt

SEQ ID NO: 702403 - DNA, 25 bp, Mus musculus
gtgcactcgcttgtgtttattttgt

SEQ ID NO: 702404 - DNA, 25 bp, Mus musculus
gtgcactcggagcaggtctttgcat

SEQ ID NO: 702405 - DNA, 25 bp, Mus musculus
gtgcactcggaggaggtctttgcat

SEQ ID NO: 702406 - DNA, 25 bp, Mus musculus
gtgcactctaccagctgagatacat

SEQ ID NO: 702407 - DNA, 25 bp, Mus musculus
gtgcactctacctgctgagatacat

SEQ ID NO: 702408 - DNA, 25 bp, Mus musculus
gtgcactctctgaagagggctgcgt

SEQ ID NO: 702409 - DNA, 25 bp, Mus musculus
gtgcactctctgtagagggctgcgt

SEQ ID NO: 702410 - DNA, 25 bp, Mus musculus
gtgcactctgctagaacagtacatt

SEQ ID NO: 702411 - DNA, 25 bp, Mus musculus
gtgcactctgcttgaacagtacatt

SEQ ID NO: 702412 - DNA, 25 bp, Mus musculus
gtgcactcttccaggatgtgcagaa

SEQ ID NO: 702413 - DNA, 25 bp, Mus musculus
gtgcactcttcctggatgtgcagaa

SEQ ID NO: 702414 - DNA, 25 bp, Mus musculus
gtgcactcttttaattcctgctctt

SEQ ID NO: 702415 - DNA, 25 bp, Mus musculus
gtgcactctttttattcctgctctt

SEQ ID NO: 702416 - DNA, 25 bp, Mus musculus
gtgcactgaatcaaacctttaaggt

SEQ ID NO: 702417 - DNA, 25 bp, Mus musculus
gtgcactgaatctaacctttaaggt

SEQ ID NO: 702418 - DNA, 25 bp, Mus musculus
gtgcactgaattaagatggtccatc

SEQ ID NO: 702419 - DNA, 25 bp, Mus musculus
gtgcactgaatttagatggtccatc

SEQ ID NO: 702420 - DNA, 25 bp, Mus musculus
gtgcactgagtgaagaagcctttat

SEQ ID NO: 702421 - DNA, 25 bp, Mus musculus
gtgcactgagtgtagaagcctttat

SEQ ID NO: 702422 - DNA, 25 bp, Mus musculus
gtgcactgatcaatttagtacgttt

SEQ ID NO: 702423 - DNA, 25 bp, Mus musculus
gtgcactgatcattttagtacgttt

SEQ ID NO: 702424 - DNA, 25 bp, Mus musculus
gtgcactgcaagatacaggacctat

SEQ ID NO: 702425 - DNA, 25 bp, Mus musculus
gtgcactgcaagttacaggacctat

SEQ ID NO: 702426 - DNA, 25 bp, Mus musculus
gtgcactgcatgcacagtccttggt

SEQ ID NO: 702427 - DNA, 25 bp, Mus musculus
gtgcactgcatggacagtccttggt

SEQ ID NO: 702428 - DNA, 25 bp, Mus musculus
gtgcactgcgccatgtggagaagca

SEQ ID NO: 702429 - DNA, 25 bp, Mus musculus
gtgcactgcgccttgtggagaagca

SEQ ID NO: 702430 - DNA, 25 bp, Mus musculus
gtgcactgctaaagtactcggtata

SEQ ID NO: 702431 - DNA, 25 bp, Mus musculus
gtgcactgctaatgtactcggtata

SEQ ID NO: 702432 - DNA, 25 bp, Mus musculus
gtgcactggcccagtattcagaaag

SEQ ID NO: 702433 - DNA, 25 bp, Mus musculus
gtgcactggccctgtattcagaaag

SEQ ID NO: 702434 - DNA, 25 bp, Mus musculus
gtgcactgggaaaacttttttgcct

SEQ ID NO: 702435 - DNA, 25 bp, Mus musculus
gtgcactgggaatacttttttgcct

SEQ ID NO: 702436 - DNA, 25 bp, Mus musculus
gtgcactgtattctagagccttgcc

SEQ ID NO: 702437 - DNA, 25 bp, Mus musculus
gtgcactgtattgtagagccttgcc

SEQ ID NO: 702438 - DNA, 25 bp, Mus musculus
gtgcactgtgggaaacattgtccga

SEQ ID NO: 702439 - DNA, 25 bp, Mus musculus
gtgcactgtgggtaacattgtccga

SEQ ID NO: 702440 - DNA, 25 bp, Mus musculus
gtgcactgtgtaatcagggaactca

SEQ ID NO: 702441 - DNA, 25 bp, Mus musculus
gtgcactgtgtattcagggaactca

SEQ ID NO: 702442 - DNA, 25 bp, Mus musculus
gtgcactgtgttattactactattt

SEQ ID NO: 702443 - DNA, 25 bp, Mus musculus
gtgcactgtgtttttactactattt

SEQ ID NO: 702444 - DNA, 25 bp, Mus musculus
gtgcactgttaacggactgccattc

SEQ ID NO: 702445 - DNA, 25 bp, Mus musculus
gtgcactgttaagggactgccattc

SEQ ID NO: 702446 - DNA, 25 bp, Mus musculus
gtgcactgtttcatacacatcggtc

SEQ ID NO: 702447 - DNA, 25 bp, Mus musculus
gtgcactgtttcttacacatcggtc

SEQ ID NO: 702448 - DNA, 25 bp, Mus musculus
gtgcacttacagcttgacttatcaa

SEQ ID NO: 702449 - DNA, 25 bp, Mus musculus
gtgcacttacaggttgacttatcaa

SEQ ID NO: 702450 - DNA, 25 bp, Mus musculus
gtgcacttcaatactcgggagacaa

SEQ ID NO: 702451 - DNA, 25 bp, Mus musculus
gtgcacttcaattctcgggagacaa

SEQ ID NO: 702452 - DNA, 25 bp, Mus musculus
gtgcacttcccgacagttgttttat

SEQ ID NO: 702453 - DNA, 25 bp, Mus musculus
gtgcacttcccgtcagttgttttat

SEQ ID NO: 702454 - DNA, 25 bp, Mus musculus
gtgcacttcctaaagtctggagttt

SEQ ID NO: 702455 - DNA, 25 bp, Mus musculus
gtgcacttcctatagtctggagttt

SEQ ID NO: 702456 - DNA, 25 bp, Mus musculus
gtgcacttctaacaatttggccggg

SEQ ID NO: 702457 - DNA, 25 bp, Mus musculus
gtgcacttctaagaatttggccggg

SEQ ID NO: 702458 - DNA, 25 bp, Mus musculus
gtgcacttctgcctttaatgatttg

SEQ ID NO: 702459 - DNA, 25 bp, Mus musculus
gtgcacttctgcgtttaatgatttg

SEQ ID NO: 702460 - DNA, 25 bp, Mus musculus
gtgcacttcttacgaatgccggttc

SEQ ID NO: 702461 - DNA, 25 bp, Mus musculus
gtgcacttcttaggaatgccggttc

SEQ ID NO: 702462 - DNA, 25 bp, Mus musculus
gtgcacttgagccaggaacctagtc

SEQ ID NO: 702463 - DNA, 25 bp, Mus musculus
gtgcacttgagcgaggaacctagtc

SEQ ID NO: 702464 - DNA, 25 bp, Mus musculus
gtgcacttgcctatttacagatgac

SEQ ID NO: 702465 - DNA, 25 bp, Mus musculus
gtgcacttgcctttttacagatgac

SEQ ID NO: 702466 - DNA, 25 bp, Mus musculus
gtgcacttgggtccatatgttcaaa

SEQ ID NO: 702467 - DNA, 25 bp, Mus musculus
gtgcacttgggtgcatatgttcaaa

SEQ ID NO: 702468 - DNA, 25 bp, Mus musculus
gtgcacttggtcacatgtactttta

SEQ ID NO: 702469 - DNA, 25 bp, Mus musculus
gtgcacttggtctcatgtactttta

SEQ ID NO: 702470 - DNA, 25 bp, Mus musculus
gtgcacttgtcacacgtgtaggttg

SEQ ID NO: 702471 - DNA, 25 bp, Mus musculus
gtgcacttgtcagacgtgtaggttg

SEQ ID NO: 702472 - DNA, 25 bp, Mus musculus
gtgcacttgttacacctggaaagca

SEQ ID NO: 702473 - DNA, 25 bp, Mus musculus
gtgcacttgttagacctggaaagca

SEQ ID NO: 702474 - DNA, 25 bp, Mus musculus
gtgcactttacaagtcatcatgcca

SEQ ID NO: 702475 - DNA, 25 bp, Mus musculus
gtgcactttacatgtcatcatgcca

SEQ ID NO: 702476 - DNA, 25 bp, Mus musculus
gtgcactttatcaacatttggcaaa

SEQ ID NO: 702477 - DNA, 25 bp, Mus musculus
gtgcactttatctacatttggcaaa

SEQ ID NO: 702478 - DNA, 25 bp, Mus musculus
gtgcactttcatatgtttctctgtc

SEQ ID NO: 702479 - DNA, 25 bp, Mus musculus
gtgcactttcatttgtttctctgtc

SEQ ID NO: 702480 - DNA, 25 bp, Mus musculus
gtgcactttctgaatacctgatgaa

SEQ ID NO: 702481 - DNA, 25 bp, Mus musculus
gtgcactttctgtatacctgatgaa

SEQ ID NO: 702482 - DNA, 25 bp, Mus musculus
gtgcactttcttcgagaaccccatt

SEQ ID NO: 702483 - DNA, 25 bp, Mus musculus
gtgcactttcttggagaaccccatt

SEQ ID NO: 702484 - DNA, 25 bp, Mus musculus
gtgcactttgtaatctagtgaggga

SEQ ID NO: 702485 - DNA, 25 bp, Mus musculus
gtgcactttgtattctagtgaggga

SEQ ID NO: 702486 - DNA, 25 bp, Mus musculus
gtgcactttgtgactacagtacctg

SEQ ID NO: 702487 - DNA, 25 bp, Mus musculus
gtgcactttgtgtctacagtacctg

SEQ ID NO: 702488 - DNA, 25 bp, Mus musculus
gtgcactttttacataactccaaca

SEQ ID NO: 702489 - DNA, 25 bp, Mus musculus
gtgcactttttagataactccaaca

SEQ ID NO: 702490 - DNA, 25 bp, Mus musculus
gtgcagaaactgcatgtaattctga

SEQ ID NO: 702491 - DNA, 25 bp, Mus musculus
gtgcagaaactggatgtaattctga

SEQ ID NO: 702492 - DNA, 25 bp, Mus musculus
gtgcagaaatgtagctaggtcccgc

SEQ ID NO: 702493 - DNA, 25 bp, Mus musculus
gtgcagaaatgttgctaggtcccgc

SEQ ID NO: 702494 - DNA, 25 bp, Mus musculus
gtgcagaacaatcctgctctccttg

SEQ ID NO: 702495 - DNA, 25 bp, Mus musculus
gtgcagaacaatgctgctctccttg

SEQ ID NO: 702496 - DNA, 25 bp, Mus musculus
gtgcagaaccacattggtcctaacc

SEQ ID NO: 702497 - DNA, 25 bp, Mus musculus
gtgcagaaccactttggtcctaacc

SEQ ID NO: 702498 - DNA, 25 bp, Mus musculus
gtgcagaaccttagggcaacggaca

SEQ ID NO: 702499 - DNA, 25 bp, Mus musculus
gtgcagaacctttgggcaacggaca

SEQ ID NO: 702500 - DNA, 25 bp, Mus musculus
gtgcagaactggctggtttcatttc

SEQ ID NO: 702501 - DNA, 25 bp, Mus musculus
gtgcagaactgggtggtttcatttc

SEQ ID NO: 702502 - DNA, 25 bp, Mus musculus
gtgcagaagacgctcggactatctc

SEQ ID NO: 702503 - DNA, 25 bp, Mus musculus
gtgcagaagacggtcggactatctc

SEQ ID NO: 702504 - DNA, 25 bp, Mus musculus
gtgcagaagatgacgcttgctccac

SEQ ID NO: 702505 - DNA, 25 bp, Mus musculus
gtgcagaagatgtcgcttgctccac

SEQ ID NO: 702506 - DNA, 25 bp, Mus musculus
gtgcagaataaacgctcactccatt

SEQ ID NO: 702507 - DNA, 25 bp, Mus musculus
gtgcagaataaaggctcactccatt

SEQ ID NO: 702508 - DNA, 25 bp, Mus musculus
gtgcagaatcgaaccccacacgggt

SEQ ID NO: 702509 - DNA, 25 bp, Mus musculus
gtgcagaatcgatccccacacgggt

SEQ ID NO: 702510 - DNA, 25 bp, Mus musculus
gtgcagaatgcacactggtttcgat

SEQ ID NO: 702511 - DNA, 25 bp, Mus musculus
gtgcagaatgcagactggtttcgat

SEQ ID NO: 702512 - DNA, 25 bp, Mus musculus
gtgcagaatgccacaattttatgtt

SEQ ID NO: 702513 - DNA, 25 bp, Mus musculus
gtgcagaatgcctcaattttatgtt

SEQ ID NO: 702514 - DNA, 25 bp, Mus musculus
gtgcagacaagaagtccaaccccgt

SEQ ID NO: 702515 - DNA, 25 bp, Mus musculus
gtgcagacaagatgtccaaccccgt

SEQ ID NO: 702516 - DNA, 25 bp, Mus musculus
gtgcagacacaactacgaggagact

SEQ ID NO: 702517 - DNA, 25 bp, Mus musculus
gtgcagacacaagtacgaggagact

SEQ ID NO: 702518 - DNA, 25 bp, Mus musculus
gtgcagacactcctgtaagcagttt

SEQ ID NO: 702519 - DNA, 25 bp, Mus musculus
gtgcagacactcgtgtaagcagttt

SEQ ID NO: 702520 - DNA, 25 bp, Mus musculus
gtgcagacactgcaaacactcctaa

SEQ ID NO: 702521 - DNA, 25 bp, Mus musculus
gtgcagacactggaaacactcctaa

SEQ ID NO: 702522 - DNA, 25 bp, Mus musculus
gtgcagacagacagtctctcagctc

SEQ ID NO: 702523 - DNA, 25 bp, Mus musculus
gtgcagacagactgtctctcagctc

SEQ ID NO: 702524 - DNA, 25 bp, Mus musculus
gtgcagacagcaactcttattgggt

SEQ ID NO: 702525 - DNA, 25 bp, Mus musculus
gtgcagacagcatctcttattgggt

SEQ ID NO: 702526 - DNA, 25 bp, Mus musculus
gtgcagacagccagactagtttaag

SEQ ID NO: 702527 - DNA, 25 bp, Mus musculus
gtgcagacagcctgactagtttaag

SEQ ID NO: 702528 - DNA, 25 bp, Mus musculus
gtgcagacaggactcttccgggatt

SEQ ID NO: 702529 - DNA, 25 bp, Mus musculus
gtgcagacaggagtcttccgggatt

SEQ ID NO: 702530 - DNA, 25 bp, Mus musculus
gtgcagacatcacttgaccattttt

SEQ ID NO: 702531 - DNA, 25 bp, Mus musculus
gtgcagacatcagttgaccattttt

SEQ ID NO: 702532 - DNA, 25 bp, Mus musculus
gtgcagaccaatctcaaagactcat

SEQ ID NO: 702533 - DNA, 25 bp, Mus musculus
gtgcagaccaatgtcaaagactcat

SEQ ID NO: 702534 - DNA, 25 bp, Mus musculus
gtgcagaccacgagacagttgagat

SEQ ID NO: 702535 - DNA, 25 bp, Mus musculus
gtgcagaccacgtgacagttgagat

SEQ ID NO: 702536 - DNA, 25 bp, Mus musculus
gtgcagaccgtaaaatatgtcacat

SEQ ID NO: 702537 - DNA, 25 bp, Mus musculus
gtgcagaccgtataatatgtcacat

SEQ ID NO: 702538 - DNA, 25 bp, Mus musculus
gtgcagacctagatagatttacctt

SEQ ID NO: 702539 - DNA, 25 bp, Mus musculus
gtgcagacctagttagatttacctt

SEQ ID NO: 702540 - DNA, 25 bp, Mus musculus
gtgcagacctgaactggacgtgaat

SEQ ID NO: 702541 - DNA, 25 bp, Mus musculus
gtgcagacctgatctggacgtgaat

SEQ ID NO: 702542 - DNA, 25 bp, Mus musculus
gtgcagacttgtcgcccagaattgc

SEQ ID NO: 702543 - DNA, 25 bp, Mus musculus
gtgcagacttgtggcccagaattgc

SEQ ID NO: 702544 - DNA, 25 bp, Mus musculus
gtgcagagaattcttgtaatcaaaa

SEQ ID NO: 702545 - DNA, 25 bp, Mus musculus
gtgcagagaattgttgtaatcaaaa

SEQ ID NO: 702546 - DNA, 25 bp, Mus musculus
gtgcagagagacaaaggcgtcccta

SEQ ID NO: 702547 - DNA, 25 bp, Mus musculus
gtgcagagagactaaggcgtcccta

SEQ ID NO: 702548 - DNA, 25 bp, Mus musculus
gtgcagaggaatctggctccattct

SEQ ID NO: 702549 - DNA, 25 bp, Mus musculus
gtgcagaggaatgtggctccattct

SEQ ID NO: 702550 - DNA, 25 bp, Mus musculus
gtgcagaggccaagtgccaggatct

SEQ ID NO: 702551 - DNA, 25 bp, Mus musculus
gtgcagaggccatgtgccaggatct

SEQ ID NO: 702552 - DNA, 25 bp, Mus musculus
gtgcagaggctgaaactttatccgg

SEQ ID NO: 702553 - DNA, 25 bp, Mus musculus
gtgcagaggctgtaactttatccgg

SEQ ID NO: 702554 - DNA, 25 bp, Mus musculus
gtgcagagtatgagccttccagtct

SEQ ID NO: 702555 - DNA, 25 bp, Mus musculus
gtgcagagtatgtgccttccagtct

SEQ ID NO: 702556 - DNA, 25 bp, Mus musculus
gtgcagagtcacatccttcatttgg

SEQ ID NO: 702557 - DNA, 25 bp, Mus musculus
gtgcagagtcacttccttcatttgg

SEQ ID NO: 702558 - DNA, 25 bp, Mus musculus
gtgcagagtcgcatcacaaaatcta

SEQ ID NO: 702559 - DNA, 25 bp, Mus musculus
gtgcagagtcgcttcacaaaatcta

SEQ ID NO: 702560 - DNA, 25 bp, Mus musculus
gtgcagagtcttctccttggagcag

SEQ ID NO: 702561 - DNA, 25 bp, Mus musculus
gtgcagagtcttgtccttggagcag

SEQ ID NO: 702562 - DNA, 25 bp, Mus musculus
gtgcagagtttaaatttagctagac

SEQ ID NO: 702563 - DNA, 25 bp, Mus musculus
gtgcagagtttatatttagctagac

SEQ ID NO: 702564 - DNA, 25 bp, Mus musculus
gtgcagataaccatcgagttcgttt

SEQ ID NO: 702565 - DNA, 25 bp, Mus musculus
gtgcagataaccttcgagttcgttt

SEQ ID NO: 702566 - DNA, 25 bp, Mus musculus
gtgcagataataatctttcattagc

SEQ ID NO: 702567 - DNA, 25 bp, Mus musculus
gtgcagataatattctttcattagc

SEQ ID NO: 702568 - DNA, 25 bp, Mus musculus
gtgcagatacctacactagaacttg

SEQ ID NO: 702569 - DNA, 25 bp, Mus musculus
gtgcagataccttcactagaacttg

SEQ ID NO: 702570 - DNA, 25 bp, Mus musculus
gtgcagatccatccaaactgccgta

SEQ ID NO: 702571 - DNA, 25 bp, Mus musculus
gtgcagatccatgcaaactgccgta

SEQ ID NO: 702572 - DNA, 25 bp, Mus musculus
gtgcagatcccgagttgcgtgtaat

SEQ ID NO: 702573 - DNA, 25 bp, Mus musculus
gtgcagatcccgtgttgcgtgtaat

SEQ ID NO: 702574 - DNA, 25 bp, Mus musculus
gtgcagatcctgaggtcatgctcat

SEQ ID NO: 702575 - DNA, 25 bp, Mus musculus
gtgcagatcctgtggtcatgctcat

SEQ ID NO: 702576 - DNA, 25 bp, Mus musculus
gtgcagatcgcactcggccaactaa

SEQ ID NO: 702577 - DNA, 25 bp, Mus musculus
gtgcagatcgcagtcggccaactaa

SEQ ID NO: 702578 - DNA, 25 bp, Mus musculus
gtgcagatctcacgactggacccaa

SEQ ID NO: 702579 - DNA, 25 bp, Mus musculus
gtgcagatctcaggactggacccaa

SEQ ID NO: 702580 - DNA, 25 bp, Mus musculus
gtgcagatctgcagtattcccaggc

SEQ ID NO: 702581 - DNA, 25 bp, Mus musculus
gtgcagatctgctgtattcccaggc

SEQ ID NO: 702582 - DNA, 25 bp, Mus musculus
gtgcagatcttgcaactgcttgatt

SEQ ID NO: 702583 - DNA, 25 bp, Mus musculus
gtgcagatcttgcacagagctttga

SEQ ID NO: 702584 - DNA, 25 bp, Mus musculus
gtgcagatcttggaactgcttgatt

SEQ ID NO: 702585 - DNA, 25 bp, Mus musculus
gtgcagatcttggacagagctttga

SEQ ID NO: 702586 - DNA, 25 bp, Mus musculus
gtgcagatgactaaaccggttgaca

SEQ ID NO: 702587 - DNA, 25 bp, Mus musculus
gtgcagatgacttaaccggttgaca

SEQ ID NO: 702588 - DNA, 25 bp, Mus musculus
gtgcagatgagtaccctaacagtga

SEQ ID NO: 702589 - DNA, 25 bp, Mus musculus
gtgcagatgagttccctaacagtga

SEQ ID NO: 702590 - DNA, 25 bp, Mus musculus
gtgcagatgcacagtactccagaca

SEQ ID NO: 702591 - DNA, 25 bp, Mus musculus
gtgcagatgcactgtactccagaca

SEQ ID NO: 702592 - DNA, 25 bp, Mus musculus
gtgcagatgcgcatgattcagccca

SEQ ID NO: 702593 - DNA, 25 bp, Mus musculus
gtgcagatgcgcttgattcagccca

SEQ ID NO: 702594 - DNA, 25 bp, Mus musculus
gtgcagatgcttaactttgtgtgta

SEQ ID NO: 702595 - DNA, 25 bp, Mus musculus
gtgcagatgctttactttgtgtgta

SEQ ID NO: 702596 - DNA, 25 bp, Mus musculus
gtgcagatggcacactcttcaaagt

SEQ ID NO: 702597 - DNA, 25 bp, Mus musculus
gtgcagatggcacctacacacatag

SEQ ID NO: 702598 - DNA, 25 bp, Mus musculus
gtgcagatggcactttaaacagtag

SEQ ID NO: 702599 - DNA, 25 bp, Mus musculus
gtgcagatggcagactcttcaaagt

SEQ ID NO: 702600 - DNA, 25 bp, Mus musculus
gtgcagatggcagctacacacatag

SEQ ID NO: 702601 - DNA, 25 bp, Mus musculus
gtgcagatggcagtttaaacagtag

SEQ ID NO: 702602 - DNA, 25 bp, Mus musculus
gtgcagatgttacagctgtgtctac

SEQ ID NO: 702603 - DNA, 25 bp, Mus musculus
gtgcagatgttagagctgtgtctac

SEQ ID NO: 702604 - DNA, 25 bp, Mus musculus
gtgcagatgttcaattaggctccaa

SEQ ID NO: 702605 - DNA, 25 bp, Mus musculus
gtgcagatgttctattaggctccaa

SEQ ID NO: 702606 - DNA, 25 bp, Mus musculus
gtgcagattggcagatccacccaag

SEQ ID NO: 702607 - DNA, 25 bp, Mus musculus
gtgcagattggctgatccacccaag

SEQ ID NO: 702608 - DNA, 25 bp, Mus musculus
gtgcagattttcaagctccctgaaa

SEQ ID NO: 702609 - DNA, 25 bp, Mus musculus
gtgcagattttctagctccctgaaa

SEQ ID NO: 702610 - DNA, 25 bp, Mus musculus
gtgcagattttgctgtgacaggtcc

SEQ ID NO: 702611 - DNA, 25 bp, Mus musculus
gtgcagattttggtgtgacaggtcc

SEQ ID NO: 702612 - DNA, 25 bp, Mus musculus
gtgcagcaaaatcttgcatggagta

SEQ ID NO: 702613 - DNA, 25 bp, Mus musculus
gtgcagcaaaatgttgcatggagta

SEQ ID NO: 702614 - DNA, 25 bp, Mus musculus
gtgcagcaaagacagaaccccgatg

SEQ ID NO: 702615 - DNA, 25 bp, Mus musculus
gtgcagcaaagagagaaccccgatg

SEQ ID NO: 702616 - DNA, 25 bp, Mus musculus
gtgcagcaaatgctctacacactaa

SEQ ID NO: 702617 - DNA, 25 bp, Mus musculus
gtgcagcaaatggtctacacactaa

SEQ ID NO: 702618 - DNA, 25 bp, Mus musculus
gtgcagcaacacattagcgtggatg

SEQ ID NO: 702619 - DNA, 25 bp, Mus musculus
gtgcagcaacactttagcgtggatg

SEQ ID NO: 702620 - DNA, 25 bp, Mus musculus
gtgcagcaagcactgggttcagtca

SEQ ID NO: 702621 - DNA, 25 bp, Mus musculus
gtgcagcaagcagtgggttcagtca

SEQ ID NO: 702622 - DNA, 25 bp, Mus musculus
gtgcagcaattcacacagttgtatt

SEQ ID NO: 702623 - DNA, 25 bp, Mus musculus
gtgcagcaattctcacagttgtatt

SEQ ID NO: 702624 - DNA, 25 bp, Mus musculus
gtgcagcaattgactctactctttt

SEQ ID NO: 702625 - DNA, 25 bp, Mus musculus
gtgcagcaattgtctctactctttt

SEQ ID NO: 702626 - DNA, 25 bp, Mus musculus
gtgcagcacacgcagcacgtgtaca

SEQ ID NO: 702627 - DNA, 25 bp, Mus musculus
gtgcagcacacggagcacgtgtaca

SEQ ID NO: 702628 - DNA, 25 bp, Mus musculus
gtgcagcaccatcagaacggtttga

SEQ ID NO: 702629 - DNA, 25 bp, Mus musculus
gtgcagcaccatgagaacggtttga

SEQ ID NO: 702630 - DNA, 25 bp, Mus musculus
gtgcagcaccgcacggcagatgtag

SEQ ID NO: 702631 - DNA, 25 bp, Mus musculus
gtgcagcaccgctcggcagatgtag

SEQ ID NO: 702632 - DNA, 25 bp, Mus musculus
gtgcagcaccttcaacatgtgactt

SEQ ID NO: 702633 - DNA, 25 bp, Mus musculus
gtgcagcaccttgaacatgtgactt

SEQ ID NO: 702634 - DNA, 25 bp, Mus musculus
gtgcagcacgagattgacttgcctc

SEQ ID NO: 702635 - DNA, 25 bp, Mus musculus
gtgcagcacgagtttgacttgcctc

SEQ ID NO: 702636 - DNA, 25 bp, Mus musculus
gtgcagcactacatacatgaacttg

SEQ ID NO: 702637 - DNA, 25 bp, Mus musculus
gtgcagcactacttacatgaacttg

SEQ ID NO: 702638 - DNA, 25 bp, Mus musculus
gtgcagcactcacagaacctgttct

SEQ ID NO: 702639 - DNA, 25 bp, Mus musculus
gtgcagcactcagagaacctgttct

SEQ ID NO: 702640 - DNA, 25 bp, Mus musculus
gtgcagcagaaaacgcttcacattt

SEQ ID NO: 702641 - DNA, 25 bp, Mus musculus
gtgcagcagaaatcgcttcacattt

SEQ ID NO: 702642 - DNA, 25 bp, Mus musculus
gtgcagcagcagcatctacagccaa

SEQ ID NO: 702643 - DNA, 25 bp, Mus musculus
gtgcagcagcaggatctacagccaa

SEQ ID NO: 702644 - DNA, 25 bp, Mus musculus
gtgcagcatgggagccactcaggaa

SEQ ID NO: 702645 - DNA, 25 bp, Mus musculus
gtgcagcatgggtgccactcaggaa

SEQ ID NO: 702646 - DNA, 25 bp, Mus musculus
gtgcagcattcaaaatcacccctag

SEQ ID NO: 702647 - DNA, 25 bp, Mus musculus
gtgcagcattcataatcacccctag

SEQ ID NO: 702648 - DNA, 25 bp, Mus musculus
gtgcagcattgacgtctgacatgtt

SEQ ID NO: 702649 - DNA, 25 bp, Mus musculus
gtgcagcattgaggtctgacatgtt

SEQ ID NO: 702650 - DNA, 25 bp, Mus musculus
gtgcagccagtgatcgggatcagtc

SEQ ID NO: 702651 - DNA, 25 bp, Mus musculus
gtgcagccagtgttcgggatcagtc

SEQ ID NO: 702652 - DNA, 25 bp, Mus musculus
gtgcagccatacaaccaactaagta

SEQ ID NO: 702653 - DNA, 25 bp, Mus musculus
gtgcagccatactaccaactaagta

SEQ ID NO: 702654 - DNA, 25 bp, Mus musculus
gtgcagccatccaaagtcttacaga

SEQ ID NO: 702655 - DNA, 25 bp, Mus musculus
gtgcagccatcctaagtcttacaga

SEQ ID NO: 702656 - DNA, 25 bp, Mus musculus
gtgcagccccatcaaaacatataga

SEQ ID NO: 702657 - DNA, 25 bp, Mus musculus
gtgcagccccatgaaaacatataga

SEQ ID NO: 702658 - DNA, 25 bp, Mus musculus
gtgcagccctggagcatccacagaa

SEQ ID NO: 702659 - DNA, 25 bp, Mus musculus
gtgcagccctggagtcgaaaacttt

SEQ ID NO: 702660 - DNA, 25 bp, Mus musculus
gtgcagccctggtgcatccacagaa

SEQ ID NO: 702661 - DNA, 25 bp, Mus musculus
gtgcagccctggtgtcgaaaacttt

SEQ ID NO: 702662 - DNA, 25 bp, Mus musculus
gtgcagcctcagcttcggccagaga

SEQ ID NO: 702663 - DNA, 25 bp, Mus musculus
gtgcagcctcaggttcggccagaga

SEQ ID NO: 702664 - DNA, 25 bp, Mus musculus
gtgcagcctccacttgtcgaagaat

SEQ ID NO: 702665 - DNA, 25 bp, Mus musculus
gtgcagcctccagttgtcgaagaat

SEQ ID NO: 702666 - DNA, 25 bp, Mus musculus
gtgcagcctctgatagaaatggttt

SEQ ID NO: 702667 - DNA, 25 bp, Mus musculus
gtgcagcctctgttagaaatggttt

SEQ ID NO: 702668 - DNA, 25 bp, Mus musculus
gtgcagcctgaactgacgtccacag

SEQ ID NO: 702669 - DNA, 25 bp, Mus musculus
gtgcagcctgaagtgacgtccacag

SEQ ID NO: 702670 - DNA, 25 bp, Mus musculus
gtgcagcctggtcagaatttccaca

SEQ ID NO: 702671 - DNA, 25 bp, Mus musculus
gtgcagcctggtgagaatttccaca

SEQ ID NO: 702672 - DNA, 25 bp, Mus musculus
gtgcagcctgtgagtcgagtgctta

SEQ ID NO: 702673 - DNA, 25 bp, Mus musculus
gtgcagcctgtgtgtcgagtgctta

SEQ ID NO: 702674 - DNA, 25 bp, Mus musculus
gtgcagcgaacactttacctgttgg

SEQ ID NO: 702675 - DNA, 25 bp, Mus musculus
gtgcagcgaacagtttacctgttgg

SEQ ID NO: 702676 - DNA, 25 bp, Mus musculus
gtgcagcgatggcacttcgtttgct

SEQ ID NO: 702677 - DNA, 25 bp, Mus musculus
gtgcagcgatgggacttcgtttgct

SEQ ID NO: 702678 - DNA, 25 bp, Mus musculus
gtgcagcgctacaagatgctcatcc

SEQ ID NO: 702679 - DNA, 25 bp, Mus musculus
gtgcagcgctactagatgctcatcc

SEQ ID NO: 702680 - DNA, 25 bp, Mus musculus
gtgcagcgctggcaacattttattt

SEQ ID NO: 702681 - DNA, 25 bp, Mus musculus
gtgcagcgctgggaacattttattt

SEQ ID NO: 702682 - DNA, 25 bp, Mus musculus
gtgcagcggacaatcagggtgcctc

SEQ ID NO: 702683 - DNA, 25 bp, Mus musculus
gtgcagcggacattcagggtgcctc

SEQ ID NO: 702684 - DNA, 25 bp, Mus musculus
gtgcagcggctcattattttatgct

SEQ ID NO: 702685 - DNA, 25 bp, Mus musculus
gtgcagcggctctttattttatgct

SEQ ID NO: 702686 - DNA, 25 bp, Mus musculus
gtgcagctaagccagtatttttact

SEQ ID NO: 702687 - DNA, 25 bp, Mus musculus
gtgcagctaagcgagtatttttact

SEQ ID NO: 702688 - DNA, 25 bp, Mus musculus
gtgcagctagccactagatttagag

SEQ ID NO: 702689 - DNA, 25 bp, Mus musculus
gtgcagctagcctctagatttagag

SEQ ID NO: 702690 - DNA, 25 bp, Mus musculus
gtgcagctcgagacccagaacaaaa

SEQ ID NO: 702691 - DNA, 25 bp, Mus musculus
gtgcagctcgagtcccagaacaaaa

SEQ ID NO: 702692 - DNA, 25 bp, Mus musculus
gtgcagctcgctagccaatcagagt

SEQ ID NO: 702693 - DNA, 25 bp, Mus musculus
gtgcagctcgcttgccaatcagagt

SEQ ID NO: 702694 - DNA, 25 bp, Mus musculus
gtgcagctgacaattccatagggaa

SEQ ID NO: 702695 - DNA, 25 bp, Mus musculus
gtgcagctgacatttccatagggaa

SEQ ID NO: 702696 - DNA, 25 bp, Mus musculus
gtgcagctgagcatgaccttgacct

SEQ ID NO: 702697 - DNA, 25 bp, Mus musculus
gtgcagctgagcttgaccttgacct

SEQ ID NO: 702698 - DNA, 25 bp, Mus musculus
gtgcagctgataaagactggagaca

SEQ ID NO: 702699 - DNA, 25 bp, Mus musculus
gtgcagctgatatagactggagaca

SEQ ID NO: 702700 - DNA, 25 bp, Mus musculus
gtgcagctgattagtgacgcgttta

SEQ ID NO: 702701 - DNA, 25 bp, Mus musculus
gtgcagctgatttgtgacgcgttta

SEQ ID NO: 702702 - DNA, 25 bp, Mus musculus
gtgcagctggaaaggagagccccaa

SEQ ID NO: 702703 - DNA, 25 bp, Mus musculus
gtgcagctggaaagtcttttcagac

SEQ ID NO: 702704 - DNA, 25 bp, Mus musculus
gtgcagctggaatggagagccccaa

SEQ ID NO: 702705 - DNA, 25 bp, Mus musculus
gtgcagctggaatgtcttttcagac

SEQ ID NO: 702706 - DNA, 25 bp, Mus musculus
gtgcagctgtgcactgaattccgtt

SEQ ID NO: 702707 - DNA, 25 bp, Mus musculus
gtgcagctgtgctctgaattccgtt

SEQ ID NO: 702708 - DNA, 25 bp, Mus musculus
gtgcagctgtggctagaacaacttt

SEQ ID NO: 702709 - DNA, 25 bp, Mus musculus
gtgcagctgtgggtagaacaacttt

SEQ ID NO: 702710 - DNA, 25 bp, Mus musculus
gtgcagctgttactcactatgaact

SEQ ID NO: 702711 - DNA, 25 bp, Mus musculus
gtgcagctgttagtcactatgaact

SEQ ID NO: 702712 - DNA, 25 bp, Mus musculus
gtgcagcttaataacaacccagata

SEQ ID NO: 702713 - DNA, 25 bp, Mus musculus
gtgcagcttaattacaacccagata

SEQ ID NO: 702714 - DNA, 25 bp, Mus musculus
gtgcagcttactacgcgtacctgct

SEQ ID NO: 702715 - DNA, 25 bp, Mus musculus
gtgcagcttacttcgcgtacctgct

SEQ ID NO: 702716 - DNA, 25 bp, Mus musculus
gtgcagcttccaaaagattcccgtc

SEQ ID NO: 702717 - DNA, 25 bp, Mus musculus
gtgcagcttccataagattcccgtc

SEQ ID NO: 702718 - DNA, 25 bp, Mus musculus
gtgcagcttcccacttttgatcaag

SEQ ID NO: 702719 - DNA, 25 bp, Mus musculus
gtgcagcttccctcttttgatcaag

SEQ ID NO: 702720 - DNA, 25 bp, Mus musculus
gtgcagcttctgaacctgtttgtca

SEQ ID NO: 702721 - DNA, 25 bp, Mus musculus
gtgcagcttctgtacctgtttgtca

SEQ ID NO: 702722 - DNA, 25 bp, Mus musculus
gtgcagcttcttcgtaggcgtgatc

SEQ ID NO: 702723 - DNA, 25 bp, Mus musculus
gtgcagcttcttggtaggcgtgatc

SEQ ID NO: 702724 - DNA, 25 bp, Mus musculus
gtgcagcttgctaggtagccagcag

SEQ ID NO: 702725 - DNA, 25 bp, Mus musculus
gtgcagcttgcttggtagccagcag

SEQ ID NO: 702726 - DNA, 25 bp, Mus musculus
gtgcagctttgcatctttgcctctc

SEQ ID NO: 702727 - DNA, 25 bp, Mus musculus
gtgcagctttgcttctttgcctctc

SEQ ID NO: 702728 - DNA, 25 bp, Mus musculus
gtgcagctttggatgacctgtcagc

SEQ ID NO: 702729 - DNA, 25 bp, Mus musculus
gtgcagctttggttgacctgtcagc

SEQ ID NO: 702730 - DNA, 25 bp, Mus musculus
gtgcaggaaactacatgtgccattg

SEQ ID NO: 702731 - DNA, 25 bp, Mus musculus
gtgcaggaaacttcatgtgccattg

SEQ ID NO: 702732 - DNA, 25 bp, Mus musculus
gtgcaggaactacccagggctatca

SEQ ID NO: 702733 - DNA, 25 bp, Mus musculus
gtgcaggaactagccagggctatca

SEQ ID NO: 702734 - DNA, 25 bp, Mus musculus
gtgcaggaacttaccctgacccaag

SEQ ID NO: 702735 - DNA, 25 bp, Mus musculus
gtgcaggaactttccctgacccaag

SEQ ID NO: 702736 - DNA, 25 bp, Mus musculus
gtgcaggaattaagacgtcgatgct

SEQ ID NO: 702737 - DNA, 25 bp, Mus musculus
gtgcaggaattatgacgtcgatgct

SEQ ID NO: 702738 - DNA, 25 bp, Mus musculus
gtgcaggacacgattgttgttatgt

SEQ ID NO: 702739 - DNA, 25 bp, Mus musculus
gtgcaggacacgtttgttgttatgt

SEQ ID NO: 702740 - DNA, 25 bp, Mus musculus
gtgcaggaccagacactatggtcag

SEQ ID NO: 702741 - DNA, 25 bp, Mus musculus
gtgcaggaccagtcactatggtcag

SEQ ID NO: 702742 - DNA, 25 bp, Mus musculus
gtgcaggaccccaaacagcagagct

SEQ ID NO: 702743 - DNA, 25 bp, Mus musculus
gtgcaggacccctaacagcagagct

SEQ ID NO: 702744 - DNA, 25 bp, Mus musculus
gtgcaggacgagaacttccgtcatt

SEQ ID NO: 702745 - DNA, 25 bp, Mus musculus
gtgcaggacgagtacttccgtcatt

SEQ ID NO: 702746 - DNA, 25 bp, Mus musculus
gtgcaggagaaaacagtttccattt

SEQ ID NO: 702747 - DNA, 25 bp, Mus musculus
gtgcaggagaaatcagtttccattt

SEQ ID NO: 702748 - DNA, 25 bp, Mus musculus
gtgcaggatgtcaatcaatctgggt

SEQ ID NO: 702749 - DNA, 25 bp, Mus musculus
gtgcaggatgtctatcaatctgggt

SEQ ID NO: 702750 - DNA, 25 bp, Mus musculus
gtgcaggcaaaccacatctacaaag

SEQ ID NO: 702751 - DNA, 25 bp, Mus musculus
gtgcaggcaaacgacatctacaaag

SEQ ID NO: 702752 - DNA, 25 bp, Mus musculus
gtgcaggcaagactgaatctccaga

SEQ ID NO: 702753 - DNA, 25 bp, Mus musculus
gtgcaggcaagagtgaatctccaga

SEQ ID NO: 702754 - DNA, 25 bp, Mus musculus
gtgcaggcacatagccctgtacagc

SEQ ID NO: 702755 - DNA, 25 bp, Mus musculus
gtgcaggcacattgccctgtacagc

SEQ ID NO: 702756 - DNA, 25 bp, Mus musculus
gtgcaggcaccaagtttgttccctt

SEQ ID NO: 702757 - DNA, 25 bp, Mus musculus
gtgcaggcaccatgtttgttccctt

SEQ ID NO: 702758 - DNA, 25 bp, Mus musculus
gtgcaggcacggcaagccactagta

SEQ ID NO: 702759 - DNA, 25 bp, Mus musculus
gtgcaggcacgggaagccactagta

SEQ ID NO: 702760 - DNA, 25 bp, Mus musculus
gtgcaggcactgagcagggtctcaa

SEQ ID NO: 702761 - DNA, 25 bp, Mus musculus
gtgcaggcactgtgcagggtctcaa

SEQ ID NO: 702762 - DNA, 25 bp, Mus musculus
gtgcaggcatcgattctaacactgt

SEQ ID NO: 702763 - DNA, 25 bp, Mus musculus
gtgcaggcatcgtttctaacactgt

SEQ ID NO: 702764 - DNA, 25 bp, Mus musculus
gtgcaggccagtcgcacacttgtaa

SEQ ID NO: 702765 - DNA, 25 bp, Mus musculus
gtgcaggccagtggcacacttgtaa

SEQ ID NO: 702766 - DNA, 25 bp, Mus musculus
gtgcaggccgatcgagttcaacgat

SEQ ID NO: 702767 - DNA, 25 bp, Mus musculus
gtgcaggccgatggagttcaacgat

SEQ ID NO: 702768 - DNA, 25 bp, Mus musculus
gtgcaggcctgtattgtgtagatct

SEQ ID NO: 702769 - DNA, 25 bp, Mus musculus
gtgcaggcctgttttgtgtagatct

SEQ ID NO: 702770 - DNA, 25 bp, Mus musculus
gtgcaggcgagtactgctcaactgg

SEQ ID NO: 702771 - DNA, 25 bp, Mus musculus
gtgcaggcgagttctgctcaactgg

SEQ ID NO: 702772 - DNA, 25 bp, Mus musculus
gtgcaggctcagaggaaggaacatc

SEQ ID NO: 702773 - DNA, 25 bp, Mus musculus
gtgcaggctcagtggaaggaacatc

SEQ ID NO: 702774 - DNA, 25 bp, Mus musculus
gtgcaggctccaaaaggtctactca

SEQ ID NO: 702775 - DNA, 25 bp, Mus musculus
gtgcaggctccacagtctataacgc

SEQ ID NO: 702776 - DNA, 25 bp, Mus musculus
gtgcaggctccagagtctataacgc

SEQ ID NO: 702777 - DNA, 25 bp, Mus musculus
gtgcaggctccataaggtctactca

SEQ ID NO: 702778 - DNA, 25 bp, Mus musculus
gtgcaggcttgacaagaatctgggt

SEQ ID NO: 702779 - DNA, 25 bp, Mus musculus
gtgcaggcttgagaagaatctgggt

SEQ ID NO: 702780 - DNA, 25 bp, Mus musculus
gtgcaggcttggataactaacattc

SEQ ID NO: 702781 - DNA, 25 bp, Mus musculus
gtgcaggcttggttaactaacattc

SEQ ID NO: 702782 - DNA, 25 bp, Mus musculus
gtgcagggagacatacttcccacct

SEQ ID NO: 702783 - DNA, 25 bp, Mus musculus
gtgcagggagacttacttcccacct

SEQ ID NO: 702784 - DNA, 25 bp, Mus musculus
gtgcagggcacaaaatctccaggat

SEQ ID NO: 702785 - DNA, 25 bp, Mus musculus
gtgcagggcacataatctccaggat

SEQ ID NO: 702786 - DNA, 25 bp, Mus musculus
gtgcagggcattaacacaccatctt

SEQ ID NO: 702787 - DNA, 25 bp, Mus musculus
gtgcagggcatttacacaccatctt

SEQ ID NO: 702788 - DNA, 25 bp, Mus musculus
gtgcagggctcaccattcaacgtga

SEQ ID NO: 702789 - DNA, 25 bp, Mus musculus
gtgcagggctcagcattcaacgtga

SEQ ID NO: 702790 - DNA, 25 bp, Mus musculus
gtgcagggtctgatgatctttcttg

SEQ ID NO: 702791 - DNA, 25 bp, Mus musculus
gtgcagggtctgttgatctttcttg

SEQ ID NO: 702792 - DNA, 25 bp, Mus musculus
gtgcaggtagctattatcaacaaca

SEQ ID NO: 702793 - DNA, 25 bp, Mus musculus
gtgcaggtagcttttatcaacaaca

SEQ ID NO: 702794 - DNA, 25 bp, Mus musculus
gtgcaggtcaccacgggattagaca

SEQ ID NO: 702795 - DNA, 25 bp, Mus musculus
gtgcaggtcacctcgggattagaca

SEQ ID NO: 702796 - DNA, 25 bp, Mus musculus
gtgcaggtctacatgtctgtgtcga

SEQ ID NO: 702797 - DNA, 25 bp, Mus musculus
gtgcaggtctacttgtctgtgtcga

SEQ ID NO: 702798 - DNA, 25 bp, Mus musculus
gtgcaggtctagaactttaagccat

SEQ ID NO: 702799 - DNA, 25 bp, Mus musculus
gtgcaggtctagtactttaagccat

SEQ ID NO: 702800 - DNA, 25 bp, Mus musculus
gtgcaggtgcccctgaagttcagaa

SEQ ID NO: 702801 - DNA, 25 bp, Mus musculus
gtgcaggtgcccgtgaagttcagaa

SEQ ID NO: 702802 - DNA, 25 bp, Mus musculus
gtgcaggtgtgacggccccaaaaat

SEQ ID NO: 702803 - DNA, 25 bp, Mus musculus
gtgcaggtgtgagggccccaaaaat

SEQ ID NO: 702804 - DNA, 25 bp, Mus musculus
gtgcaggttatcaaggcgttcatct

SEQ ID NO: 702805 - DNA, 25 bp, Mus musculus
gtgcaggttatctaggcgttcatct

SEQ ID NO: 702806 - DNA, 25 bp, Mus musculus
gtgcaggtttccatacagcttctga

SEQ ID NO: 702807 - DNA, 25 bp, Mus musculus
gtgcaggtttccttacagcttctga

SEQ ID NO: 702808 - DNA, 25 bp, Mus musculus
gtgcagtaacaacttcctcaaaaat

SEQ ID NO: 702809 - DNA, 25 bp, Mus musculus
gtgcagtaacaagttcctcaaaaat

SEQ ID NO: 702810 - DNA, 25 bp, Mus musculus
gtgcagtaactgcagacccaagatt

SEQ ID NO: 702811 - DNA, 25 bp, Mus musculus
gtgcagtaactggagacccaagatt

SEQ ID NO: 702812 - DNA, 25 bp, Mus musculus
gtgcagtaatggctagtccttttta

SEQ ID NO: 702813 - DNA, 25 bp, Mus musculus
gtgcagtaatgggtagtccttttta

SEQ ID NO: 702814 - DNA, 25 bp, Mus musculus
gtgcagtaatttctagccttttgag

SEQ ID NO: 702815 - DNA, 25 bp, Mus musculus
gtgcagtaatttgtagccttttgag

SEQ ID NO: 702816 - DNA, 25 bp, Mus musculus
gtgcagtacctaactcagccacagc

SEQ ID NO: 702817 - DNA, 25 bp, Mus musculus
gtgcagtacctatctcagccacagc

SEQ ID NO: 702818 - DNA, 25 bp, Mus musculus
gtgcagtagagtattcttttagcct

SEQ ID NO: 702819 - DNA, 25 bp, Mus musculus
gtgcagtagagttttcttttagcct

SEQ ID NO: 702820 - DNA, 25 bp, Mus musculus
gtgcagtagatccttttctaggata

SEQ ID NO: 702821 - DNA, 25 bp, Mus musculus
gtgcagtagatcgttttctaggata

SEQ ID NO: 702822 - DNA, 25 bp, Mus musculus
gtgcagtaggtgctatagatcattc

SEQ ID NO: 702823 - DNA, 25 bp, Mus musculus
gtgcagtaggtggtatagatcattc

SEQ ID NO: 702824 - DNA, 25 bp, Mus musculus
gtgcagtaggttaagtacgttttct

SEQ ID NO: 702825 - DNA, 25 bp, Mus musculus
gtgcagtaggtttagtacgttttct

SEQ ID NO: 702826 - DNA, 25 bp, Mus musculus
gtgcagtagtgccaaaaggcccctt

SEQ ID NO: 702827 - DNA, 25 bp, Mus musculus
gtgcagtagtgcgaaaaggcccctt

SEQ ID NO: 702828 - DNA, 25 bp, Mus musculus
gtgcagtagttcatgtactgtcata

SEQ ID NO: 702829 - DNA, 25 bp, Mus musculus
gtgcagtagttcttgtactgtcata

SEQ ID NO: 702830 - DNA, 25 bp, Mus musculus
gtgcagtatctcacctaagctgact

SEQ ID NO: 702831 - DNA, 25 bp, Mus musculus
gtgcagtatctctcctaagctgact

SEQ ID NO: 702832 - DNA, 25 bp, Mus musculus
gtgcagtatggcacgggcataccca

SEQ ID NO: 702833 - DNA, 25 bp, Mus musculus
gtgcagtatggctcgggcataccca

SEQ ID NO: 702834 - DNA, 25 bp, Mus musculus
gtgcagtattacattttccccacag

SEQ ID NO: 702835 - DNA, 25 bp, Mus musculus
gtgcagtattactttttccccacag

SEQ ID NO: 702836 - DNA, 25 bp, Mus musculus
gtgcagtcaaataccaacgagccat

SEQ ID NO: 702837 - DNA, 25 bp, Mus musculus
gtgcagtcaaattccaacgagccat

SEQ ID NO: 702838 - DNA, 25 bp, Mus musculus
gtgcagtcaacaatcctgctgataa

SEQ ID NO: 702839 - DNA, 25 bp, Mus musculus
gtgcagtcaacattcctgctgataa

SEQ ID NO: 702840 - DNA, 25 bp, Mus musculus
gtgcagtcaaccatgttttaagatt

SEQ ID NO: 702841 - DNA, 25 bp, Mus musculus
gtgcagtcaaccttgttttaagatt

SEQ ID NO: 702842 - DNA, 25 bp, Mus musculus
gtgcagtcacacagtgctaccgaga

SEQ ID NO: 702843 - DNA, 25 bp, Mus musculus
gtgcagtcacactgtgctaccgaga

SEQ ID NO: 702844 - DNA, 25 bp, Mus musculus
gtgcagtcacgaacagaccttctga

SEQ ID NO: 702845 - DNA, 25 bp, Mus musculus
gtgcagtcacgatcagaccttctga

SEQ ID NO: 702846 - DNA, 25 bp, Mus musculus
gtgcagtcactcacctgtgaagtgg

SEQ ID NO: 702847 - DNA, 25 bp, Mus musculus
gtgcagtcactctcctgtgaagtgg

SEQ ID NO: 702848 - DNA, 25 bp, Mus musculus
gtgcagtccagacacacatagcttt

SEQ ID NO: 702849 - DNA, 25 bp, Mus musculus
gtgcagtccagagacacatagcttt

SEQ ID NO: 702850 - DNA, 25 bp, Mus musculus
gtgcagtcctgtactcgaagcctgg

SEQ ID NO: 702851 - DNA, 25 bp, Mus musculus
gtgcagtcctgttctcgaagcctgg

SEQ ID NO: 702852 - DNA, 25 bp, Mus musculus
gtgcagtcgctgacattcatgtgga

SEQ ID NO: 702853 - DNA, 25 bp, Mus musculus
gtgcagtcgctgtcattcatgtgga

SEQ ID NO: 702854 - DNA, 25 bp, Mus musculus
gtgcagtcgttcagtcagtcgcgct

SEQ ID NO: 702855 - DNA, 25 bp, Mus musculus
gtgcagtcgttctgtcagtcgcgct

SEQ ID NO: 702856 - DNA, 25 bp, Mus musculus
gtgcagtctgacaaaggccccaaaa

SEQ ID NO: 702857 - DNA, 25 bp, Mus musculus
gtgcagtctgactaaggccccaaaa

SEQ ID NO: 702858 - DNA, 25 bp, Mus musculus
gtgcagtctggacgttcaaagatct

SEQ ID NO: 702859 - DNA, 25 bp, Mus musculus
gtgcagtctggaggttcaaagatct

SEQ ID NO: 702860 - DNA, 25 bp, Mus musculus
gtgcagtgaattaaacccagggttt

SEQ ID NO: 702861 - DNA, 25 bp, Mus musculus
gtgcagtgaatttaacccagggttt

SEQ ID NO: 702862 - DNA, 25 bp, Mus musculus
gtgcagtgacaaaataagtagaaac

SEQ ID NO: 702863 - DNA, 25 bp, Mus musculus
gtgcagtgacaatataagtagaaac

SEQ ID NO: 702864 - DNA, 25 bp, Mus musculus
gtgcagtgacctagtgaatacccta

SEQ ID NO: 702865 - DNA, 25 bp, Mus musculus
gtgcagtgaccttgtgaatacccta

SEQ ID NO: 702866 - DNA, 25 bp, Mus musculus
gtgcagtgactgacatggcgtccca

SEQ ID NO: 702867 - DNA, 25 bp, Mus musculus
gtgcagtgactgtcatggcgtccca

SEQ ID NO: 702868 - DNA, 25 bp, Mus musculus
gtgcagtgatccagctcacgcgccg

SEQ ID NO: 702869 - DNA, 25 bp, Mus musculus
gtgcagtgatcctgctcacgcgccg

SEQ ID NO: 702870 - DNA, 25 bp, Mus musculus
gtgcagtgcctgaaatgtctggcga

SEQ ID NO: 702871 - DNA, 25 bp, Mus musculus
gtgcagtgcctgtaatgtctggcga

SEQ ID NO: 702872 - DNA, 25 bp, Mus musculus
gtgcagtgccttcagtacacgtttg

SEQ ID NO: 702873 - DNA, 25 bp, Mus musculus
gtgcagtgccttgagtacacgtttg

SEQ ID NO: 702874 - DNA, 25 bp, Mus musculus
gtgcagtgcggcacttccacaatac

SEQ ID NO: 702875 - DNA, 25 bp, Mus musculus
gtgcagtgcggctcttccacaatac

SEQ ID NO: 702876 - DNA, 25 bp, Mus musculus
gtgcagtgctaacgctatcctatca

SEQ ID NO: 702877 - DNA, 25 bp, Mus musculus
gtgcagtgctaaggctatcctatca

SEQ ID NO: 702878 - DNA, 25 bp, Mus musculus
gtgcagtgctagaagggagccctct

SEQ ID NO: 702879 - DNA, 25 bp, Mus musculus
gtgcagtgctagtagggagccctct

SEQ ID NO: 702880 - DNA, 25 bp, Mus musculus
gtgcagtgctggcatattcagtatg

SEQ ID NO: 702881 - DNA, 25 bp, Mus musculus
gtgcagtgctgggatattcagtatg

SEQ ID NO: 702882 - DNA, 25 bp, Mus musculus
gtgcagtgcttgaggcaagctcttc

SEQ ID NO: 702883 - DNA, 25 bp, Mus musculus
gtgcagtgcttgtggcaagctcttc

SEQ ID NO: 702884 - DNA, 25 bp, Mus musculus
gtgcagtggcagaatcatagcccgt

SEQ ID NO: 702885 - DNA, 25 bp, Mus musculus
gtgcagtggcagtatcatagcccgt

SEQ ID NO: 702886 - DNA, 25 bp, Mus musculus
gtgcagtggttcataggcttgagcc

SEQ ID NO: 702887 - DNA, 25 bp, Mus musculus
gtgcagtggttcttaggcttgagcc

SEQ ID NO: 702888 - DNA, 25 bp, Mus musculus
gtgcagtgtaaaaactatccctgag

SEQ ID NO: 702889 - DNA, 25 bp, Mus musculus
gtgcagtgtaaatactatccctgag

SEQ ID NO: 702890 - DNA, 25 bp, Mus musculus
gtgcagtgtaatacccaaggctaat

SEQ ID NO: 702891 - DNA, 25 bp, Mus musculus
gtgcagtgtaattcccaaggctaat

SEQ ID NO: 702892 - DNA, 25 bp, Mus musculus
gtgcagtgtgtgcagacattttgct

SEQ ID NO: 702893 - DNA, 25 bp, Mus musculus
gtgcagtgtgtggagacattttgct

SEQ ID NO: 702894 - DNA, 25 bp, Mus musculus
gtgcagtgttatctacttgctgtaa

SEQ ID NO: 702895 - DNA, 25 bp, Mus musculus
gtgcagtgttatgtacttgctgtaa

SEQ ID NO: 702896 - DNA, 25 bp, Mus musculus
gtgcagttcccaactttctgcagaa

SEQ ID NO: 702897 - DNA, 25 bp, Mus musculus
gtgcagttcccatctttctgcagaa

SEQ ID NO: 702898 - DNA, 25 bp, Mus musculus
gtgcagttcctcagcaggattttca

SEQ ID NO: 702899 - DNA, 25 bp, Mus musculus
gtgcagttcctctgcaggattttca

SEQ ID NO: 702900 - DNA, 25 bp, Mus musculus
gtgcagttctgaaatcctactattt

SEQ ID NO: 702901 - DNA, 25 bp, Mus musculus
gtgcagttctgatatcctactattt

SEQ ID NO: 702902 - DNA, 25 bp, Mus musculus
gtgcagttctgcatagttccattca

SEQ ID NO: 702903 - DNA, 25 bp, Mus musculus
gtgcagttctgcttagttccattca

SEQ ID NO: 702904 - DNA, 25 bp, Mus musculus
gtgcagttgacaaggcatgctccgt

SEQ ID NO: 702905 - DNA, 25 bp, Mus musculus
gtgcagttgacatggcatgctccgt

SEQ ID NO: 702906 - DNA, 25 bp, Mus musculus
gtgcagttgactcccacacaaaaac

SEQ ID NO: 702907 - DNA, 25 bp, Mus musculus
gtgcagttgactgccacacaaaaac

SEQ ID NO: 702908 - DNA, 25 bp, Mus musculus
gtgcagttggctagccaagcaggct

SEQ ID NO: 702909 - DNA, 25 bp, Mus musculus
gtgcagttggcttgccaagcaggct

SEQ ID NO: 702910 - DNA, 25 bp, Mus musculus
gtgcagttggtaacctgcctagtat

SEQ ID NO: 702911 - DNA, 25 bp, Mus musculus
gtgcagttggtatcctgcctagtat

SEQ ID NO: 702912 - DNA, 25 bp, Mus musculus
gtgcagtttcttagacattatagga

SEQ ID NO: 702913 - DNA, 25 bp, Mus musculus
gtgcagtttctttgacattatagga

SEQ ID NO: 702914 - DNA, 25 bp, Mus musculus
gtgcagttttatacctatgtccact

SEQ ID NO: 702915 - DNA, 25 bp, Mus musculus
gtgcagttttattcctatgtccact

SEQ ID NO: 702916 - DNA, 25 bp, Mus musculus
gtgcataaaataaagcatggcgtac

SEQ ID NO: 702917 - DNA, 25 bp, Mus musculus
gtgcataaaatatagcatggcgtac

SEQ ID NO: 702918 - DNA, 25 bp, Mus musculus
gtgcataaactgacctaactcgagg

SEQ ID NO: 702919 - DNA, 25 bp, Mus musculus
gtgcataaactgtcctaactcgagg

SEQ ID NO: 702920 - DNA, 25 bp, Mus musculus
gtgcataaagggaatccatcctctt

SEQ ID NO: 702921 - DNA, 25 bp, Mus musculus
gtgcataaagggtatccatcctctt

SEQ ID NO: 702922 - DNA, 25 bp, Mus musculus
gtgcataaggccattgtggaggtta

SEQ ID NO: 702923 - DNA, 25 bp, Mus musculus
gtgcataaggcctttgtggaggtta

SEQ ID NO: 702924 - DNA, 25 bp, Mus musculus
gtgcatacaaacacaacaaccctca

SEQ ID NO: 702925 - DNA, 25 bp, Mus musculus
gtgcatacaaactcaacaaccctca

SEQ ID NO: 702926 - DNA, 25 bp, Mus musculus
gtgcatacacacattctgggtaacc

SEQ ID NO: 702927 - DNA, 25 bp, Mus musculus
gtgcatacacactttctgggtaacc

SEQ ID NO: 702928 - DNA, 25 bp, Mus musculus
gtgcatacacagcaacctgagcagt

SEQ ID NO: 702929 - DNA, 25 bp, Mus musculus
gtgcatacacaggaacctgagcagt

SEQ ID NO: 702930 - DNA, 25 bp, Mus musculus
gtgcatacagctctttacatcccat

SEQ ID NO: 702931 - DNA, 25 bp, Mus musculus
gtgcatacagctgtttacatcccat

SEQ ID NO: 702932 - DNA, 25 bp, Mus musculus
gtgcatacataccacagcacatatg

SEQ ID NO: 702933 - DNA, 25 bp, Mus musculus
gtgcatacatacgacagcacatatg

SEQ ID NO: 702934 - DNA, 25 bp, Mus musculus
gtgcatacatatacactctccacaa

SEQ ID NO: 702935 - DNA, 25 bp, Mus musculus
gtgcatacatattcactctccacaa

SEQ ID NO: 702936 - DNA, 25 bp, Mus musculus
gtgcatacatgtccaaatccagatt

SEQ ID NO: 702937 - DNA, 25 bp, Mus musculus
gtgcatacatgtgcaaatccagatt

SEQ ID NO: 702938 - DNA, 25 bp, Mus musculus
gtgcatacccacatatatgcattta

SEQ ID NO: 702939 - DNA, 25 bp, Mus musculus
gtgcatacccacttatatgcattta

SEQ ID NO: 702940 - DNA, 25 bp, Mus musculus
gtgcataccgatacacatacaaaaa

SEQ ID NO: 702941 - DNA, 25 bp, Mus musculus
gtgcataccgattcacatacaaaaa

SEQ ID NO: 702942 - DNA, 25 bp, Mus musculus
gtgcatacctatcatcaaattctgg

SEQ ID NO: 702943 - DNA, 25 bp, Mus musculus
gtgcatacctatgatcaaattctgg

SEQ ID NO: 702944 - DNA, 25 bp, Mus musculus
gtgcatacctgtcattctagtactt

SEQ ID NO: 702945 - DNA, 25 bp, Mus musculus
gtgcatacctgtgattctagtactt

SEQ ID NO: 702946 - DNA, 25 bp, Mus musculus
gtgcataccttcaacctgtaagttg

SEQ ID NO: 702947 - DNA, 25 bp, Mus musculus
gtgcataccttctacctgtaagttg

SEQ ID NO: 702948 - DNA, 25 bp, Mus musculus
gtgcataccttgcagactacggtct

SEQ ID NO: 702949 - DNA, 25 bp, Mus musculus
gtgcataccttggagactacggtct

SEQ ID NO: 702950 - DNA, 25 bp, Mus musculus
gtgcatacgaggaacctatgtgatt

SEQ ID NO: 702951 - DNA, 25 bp, Mus musculus
gtgcatacgaggtacctatgtgatt

SEQ ID NO: 702952 - DNA, 25 bp, Mus musculus
gtgcatacgcatacccataagctct

SEQ ID NO: 702953 - DNA, 25 bp, Mus musculus
gtgcatacgcattcccataagctct

SEQ ID NO: 702954 - DNA, 25 bp, Mus musculus
gtgcatacttgtcaccatacaaatg

SEQ ID NO: 702955 - DNA, 25 bp, Mus musculus
gtgcatacttgtgaccatacaaatg

SEQ ID NO: 702956 - DNA, 25 bp, Mus musculus
gtgcatagaatgatattccgccaac

SEQ ID NO: 702957 - DNA, 25 bp, Mus musculus
gtgcatagaatgttattccgccaac

SEQ ID NO: 702958 - DNA, 25 bp, Mus musculus
gtgcatagatagaacctctttccag

SEQ ID NO: 702959 - DNA, 25 bp, Mus musculus
gtgcatagatagtacctctttccag

SEQ ID NO: 702960 - DNA, 25 bp, Mus musculus
gtgcatagatcaaaaagctttccct

SEQ ID NO: 702961 - DNA, 25 bp, Mus musculus
gtgcatagatcataaagctttccct

SEQ ID NO: 702962 - DNA, 25 bp, Mus musculus
gtgcatagccagagacacaagacgt

SEQ ID NO: 702963 - DNA, 25 bp, Mus musculus
gtgcatagccagtgacacaagacgt

SEQ ID NO: 702964 - DNA, 25 bp, Mus musculus
gtgcatagcctaagaccacagtcct

SEQ ID NO: 702965 - DNA, 25 bp, Mus musculus
gtgcatagcctatgaccacagtcct

SEQ ID NO: 702966 - DNA, 25 bp, Mus musculus
gtgcatagcgtccttcacacggtga

SEQ ID NO: 702967 - DNA, 25 bp, Mus musculus
gtgcatagcgtcgttcacacggtga

SEQ ID NO: 702968 - DNA, 25 bp, Mus musculus
gtgcataggaagcaggtttcaacag

SEQ ID NO: 702969 - DNA, 25 bp, Mus musculus
gtgcataggaaggaggtttcaacag

SEQ ID NO: 702970 - DNA, 25 bp, Mus musculus
gtgcataggtgtactccaatccagc

SEQ ID NO: 702971 - DNA, 25 bp, Mus musculus
gtgcataggtgtatgcctgcatata

SEQ ID NO: 702972 - DNA, 25 bp, Mus musculus
gtgcataggtgttctccaatccagc

SEQ ID NO: 702973 - DNA, 25 bp, Mus musculus
gtgcataggtgtttgcctgcatata

SEQ ID NO: 702974 - DNA, 25 bp, Mus musculus
gtgcatagtcaaagaagtgctgcta

SEQ ID NO: 702975 - DNA, 25 bp, Mus musculus
gtgcatagtcaatgaagtgctgcta

SEQ ID NO: 702976 - DNA, 25 bp, Mus musculus
gtgcatataaacctacagttaacac

SEQ ID NO: 702977 - DNA, 25 bp, Mus musculus
gtgcatataaacgtacagttaacac

SEQ ID NO: 702978 - DNA, 25 bp, Mus musculus
gtgcatatatttataccctatgggt

SEQ ID NO: 702979 - DNA, 25 bp, Mus musculus
gtgcatatatttttaccctatgggt

SEQ ID NO: 702980 - DNA, 25 bp, Mus musculus
gtgcatatctgaagcttttccccag

SEQ ID NO: 702981 - DNA, 25 bp, Mus musculus
gtgcatatctgatgcttttccccag

SEQ ID NO: 702982 - DNA, 25 bp, Mus musculus
gtgcatatctgtatgggtgtgtaca

SEQ ID NO: 702983 - DNA, 25 bp, Mus musculus
gtgcatatctgtttgggtgtgtaca

SEQ ID NO: 702984 - DNA, 25 bp, Mus musculus
gtgcatatcttacctccagatcaat

SEQ ID NO: 702985 - DNA, 25 bp, Mus musculus
gtgcatatcttagctccagatcaat

SEQ ID NO: 702986 - DNA, 25 bp, Mus musculus
gtgcatatgctcatgtatttgttat

SEQ ID NO: 702987 - DNA, 25 bp, Mus musculus
gtgcatatgctccacagctttgaga

SEQ ID NO: 702988 - DNA, 25 bp, Mus musculus
gtgcatatgctcgacagctttgaga

SEQ ID NO: 702989 - DNA, 25 bp, Mus musculus
gtgcatatgctcttgtatttgttat

SEQ ID NO: 702990 - DNA, 25 bp, Mus musculus
gtgcatatggatcacactgtctggg

SEQ ID NO: 702991 - DNA, 25 bp, Mus musculus
gtgcatatggatgacactgtctggg

SEQ ID NO: 702992 - DNA, 25 bp, Mus musculus
gtgcatatggccagtgtacacgtgt

SEQ ID NO: 702993 - DNA, 25 bp, Mus musculus
gtgcatatggcctgtgtacacgtgt

SEQ ID NO: 702994 - DNA, 25 bp, Mus musculus
gtgcatattctgatctattactttt

SEQ ID NO: 702995 - DNA, 25 bp, Mus musculus
gtgcatattctgatggcatagtgct

SEQ ID NO: 702996 - DNA, 25 bp, Mus musculus
gtgcatattctgttctattactttt

SEQ ID NO: 702997 - DNA, 25 bp, Mus musculus
gtgcatattctgttggcatagtgct

SEQ ID NO: 702998 - DNA, 25 bp, Mus musculus
gtgcatattgcacttagatcataga

SEQ ID NO: 702999 - DNA, 25 bp, Mus musculus
gtgcatattgcagttagatcataga

SEQ ID NO: 703000 - DNA, 25 bp, Mus musculus
gtgcatattgtacttaggagtgtgt

SEQ ID NO: 703001 - DNA, 25 bp, Mus musculus
gtgcatattgtagttaggagtgtgt

SEQ ID NO: 703002 - DNA, 25 bp, Mus musculus
gtgcatatttgtctgttttctgtta

SEQ ID NO: 703003 - DNA, 25 bp, Mus musculus
gtgcatatttgtgtgttttctgtta

SEQ ID NO: 703004 - DNA, 25 bp, Mus musculus
gtgcatcaaacactacgtctgccct

SEQ ID NO: 703005 - DNA, 25 bp, Mus musculus
gtgcatcaaacagtacgtctgccct

SEQ ID NO: 703006 - DNA, 25 bp, Mus musculus
gtgcatcaacctagtcatttgggag

SEQ ID NO: 703007 - DNA, 25 bp, Mus musculus
gtgcatcaaccttgtcatttgggag

SEQ ID NO: 703008 - DNA, 25 bp, Mus musculus
gtgcatcaagcccagtggtattcca

SEQ ID NO: 703009 - DNA, 25 bp, Mus musculus
gtgcatcaagccgagtggtattcca

SEQ ID NO: 703010 - DNA, 25 bp, Mus musculus
gtgcatcaagtcagttattagtgtt

SEQ ID NO: 703011 - DNA, 25 bp, Mus musculus
gtgcatcaagtctgttattagtgtt

SEQ ID NO: 703012 - DNA, 25 bp, Mus musculus
gtgcatcaatctataggccctagga

SEQ ID NO: 703013 - DNA, 25 bp, Mus musculus
gtgcatcaatctttaggccctagga

SEQ ID NO: 703014 - DNA, 25 bp, Mus musculus
gtgcatcaatttaaatgttacaacc

SEQ ID NO: 703015 - DNA, 25 bp, Mus musculus
gtgcatcaattttaatgttacaacc

SEQ ID NO: 703016 - DNA, 25 bp, Mus musculus
gtgcatcacaagaccacaagccaat

SEQ ID NO: 703017 - DNA, 25 bp, Mus musculus
gtgcatcacaagtccacaagccaat

SEQ ID NO: 703018 - DNA, 25 bp, Mus musculus
gtgcatcacacaccacataatcgga

SEQ ID NO: 703019 - DNA, 25 bp, Mus musculus
gtgcatcacacagcacataatcgga

SEQ ID NO: 703020 - DNA, 25 bp, Mus musculus
gtgcatcacctaactttggtttgtg

SEQ ID NO: 703021 - DNA, 25 bp, Mus musculus
gtgcatcacctatctttggtttgtg

SEQ ID NO: 703022 - DNA, 25 bp, Mus musculus
gtgcatcacgtgcacctctgaaaaa

SEQ ID NO: 703023 - DNA, 25 bp, Mus musculus
gtgcatcacgtggacctctgaaaaa

SEQ ID NO: 703024 - DNA, 25 bp, Mus musculus
gtgcatcacttcaaggaggttggct

SEQ ID NO: 703025 - DNA, 25 bp, Mus musculus
gtgcatcacttctaggaggttggct

SEQ ID NO: 703026 - DNA, 25 bp, Mus musculus
gtgcatcagcttcatcacatgttta

SEQ ID NO: 703027 - DNA, 25 bp, Mus musculus
gtgcatcagcttgatcacatgttta

SEQ ID NO: 703028 - DNA, 25 bp, Mus musculus
gtgcatcagtgcatcgcagttgcat

SEQ ID NO: 703029 - DNA, 25 bp, Mus musculus
gtgcatcagtgcttcgcagttgcat

SEQ ID NO: 703030 - DNA, 25 bp, Mus musculus
gtgcatcagttcattacagacatgg

SEQ ID NO: 703031 - DNA, 25 bp, Mus musculus
gtgcatcagttctttacagacatgg

SEQ ID NO: 703032 - DNA, 25 bp, Mus musculus
gtgcatcatacaacaaacccttatt

SEQ ID NO: 703033 - DNA, 25 bp, Mus musculus
gtgcatcatacatcaaacccttatt

SEQ ID NO: 703034 - DNA, 25 bp, Mus musculus
gtgcatcatagactgttcctccata

SEQ ID NO: 703035 - DNA, 25 bp, Mus musculus
gtgcatcatagagtgttcctccata

SEQ ID NO: 703036 - DNA, 25 bp, Mus musculus
gtgcatcatcatatgcttcaagccc

SEQ ID NO: 703037 - DNA, 25 bp, Mus musculus
gtgcatcatcatttgcttcaagccc

SEQ ID NO: 703038 - DNA, 25 bp, Mus musculus
gtgcatcatgtgaagttggttattt

SEQ ID NO: 703039 - DNA, 25 bp, Mus musculus
gtgcatcatgtgcatcatcccgaaa

SEQ ID NO: 703040 - DNA, 25 bp, Mus musculus
gtgcatcatgtggatcatcccgaaa

SEQ ID NO: 703041 - DNA, 25 bp, Mus musculus
gtgcatcatgtgtagttggttattt

SEQ ID NO: 703042 - DNA, 25 bp, Mus musculus
gtgcatccaaccatatatgtgctat

SEQ ID NO: 703043 - DNA, 25 bp, Mus musculus
gtgcatccaaccttatatgtgctat

SEQ ID NO: 703044 - DNA, 25 bp, Mus musculus
gtgcatccaagtactatctgggcaa

SEQ ID NO: 703045 - DNA, 25 bp, Mus musculus
gtgcatccaagttctatctgggcaa

SEQ ID NO: 703046 - DNA, 25 bp, Mus musculus
gtgcatccaattaacagcagctccc

SEQ ID NO: 703047 - DNA, 25 bp, Mus musculus
gtgcatccaatttacagcagctccc

SEQ ID NO: 703048 - DNA, 25 bp, Mus musculus
gtgcatccacacaagcaagcaaatg

SEQ ID NO: 703049 - DNA, 25 bp, Mus musculus
gtgcatccacactagcaagcaaatg

SEQ ID NO: 703050 - DNA, 25 bp, Mus musculus
gtgcatccatgcagcacagcctaat

SEQ ID NO: 703051 - DNA, 25 bp, Mus musculus
gtgcatccatgctgcacagcctaat

SEQ ID NO: 703052 - DNA, 25 bp, Mus musculus
gtgcatccccttctaactaaaattt

SEQ ID NO: 703053 - DNA, 25 bp, Mus musculus
gtgcatccccttgtaactaaaattt

SEQ ID NO: 703054 - DNA, 25 bp, Mus musculus
gtgcatcccgggatgaccagactcc

SEQ ID NO: 703055 - DNA, 25 bp, Mus musculus
gtgcatcccgggttgaccagactcc

SEQ ID NO: 703056 - DNA, 25 bp, Mus musculus
gtgcatcctgaccacactggaagag

SEQ ID NO: 703057 - DNA, 25 bp, Mus musculus
gtgcatcctgacgacactggaagag

SEQ ID NO: 703058 - DNA, 25 bp, Mus musculus
gtgcatcctgatctgaacttcattc

SEQ ID NO: 703059 - DNA, 25 bp, Mus musculus
gtgcatcctgatgtgaacttcattc

SEQ ID NO: 703060 - DNA, 25 bp, Mus musculus
gtgcatcctggacgtaattgaccat

SEQ ID NO: 703061 - DNA, 25 bp, Mus musculus
gtgcatcctggaggtaattgaccat

SEQ ID NO: 703062 - DNA, 25 bp, Mus musculus
gtgcatcctgtgaatctcatgacaa

SEQ ID NO: 703063 - DNA, 25 bp, Mus musculus
gtgcatcctgtgtatctcatgacaa

SEQ ID NO: 703064 - DNA, 25 bp, Mus musculus
gtgcatccttgcagtacctgacgaa

SEQ ID NO: 703065 - DNA, 25 bp, Mus musculus
gtgcatccttgctgtacctgacgaa

SEQ ID NO: 703066 - DNA, 25 bp, Mus musculus
gtgcatccttttagagctgttgtgg

SEQ ID NO: 703067 - DNA, 25 bp, Mus musculus
gtgcatcctttttgagctgttgtgg

SEQ ID NO: 703068 - DNA, 25 bp, Mus musculus
gtgcatcgcagtcctgttgtaccgg

SEQ ID NO: 703069 - DNA, 25 bp, Mus musculus
gtgcatcgcagtgctgttgtaccgg

SEQ ID NO: 703070 - DNA, 25 bp, Mus musculus
gtgcatcgcattcgccgtacaggtc

SEQ ID NO: 703071 - DNA, 25 bp, Mus musculus
gtgcatcgcattggccgtacaggtc

SEQ ID NO: 703072 - DNA, 25 bp, Mus musculus
gtgcatcggctgaattgaccttaat

SEQ ID NO: 703073 - DNA, 25 bp, Mus musculus
gtgcatcggctgtattgaccttaat

SEQ ID NO: 703074 - DNA, 25 bp, Mus musculus
gtgcatcgggagcaatcatgactgt

SEQ ID NO: 703075 - DNA, 25 bp, Mus musculus
gtgcatcgggaggaatcatgactgt

SEQ ID NO: 703076 - DNA, 25 bp, Mus musculus
gtgcatcggtacatgagcaacgctt

SEQ ID NO: 703077 - DNA, 25 bp, Mus musculus
gtgcatcggtacttgagcaacgctt

SEQ ID NO: 703078 - DNA, 25 bp, Mus musculus
gtgcatcggtgtatgacacagccag

SEQ ID NO: 703079 - DNA, 25 bp, Mus musculus
gtgcatcggtgtttgacacagccag

SEQ ID NO: 703080 - DNA, 25 bp, Mus musculus
gtgcatcggttacaggcggttcatc

SEQ ID NO: 703081 - DNA, 25 bp, Mus musculus
gtgcatcggttagaggcggttcatc

SEQ ID NO: 703082 - DNA, 25 bp, Mus musculus
gtgcatcgtgatcctactagtgaca

SEQ ID NO: 703083 - DNA, 25 bp, Mus musculus
gtgcatcgtgatgctactagtgaca

SEQ ID NO: 703084 - DNA, 25 bp, Mus musculus
gtgcatctaaaccttcttgtctaca

SEQ ID NO: 703085 - DNA, 25 bp, Mus musculus
gtgcatctaaacgttcttgtctaca

SEQ ID NO: 703086 - DNA, 25 bp, Mus musculus
gtgcatctaccaattaaactctcaa

SEQ ID NO: 703087 - DNA, 25 bp, Mus musculus
gtgcatctaccatttaaactctcaa

SEQ ID NO: 703088 - DNA, 25 bp, Mus musculus
gtgcatctagtgcttacctaaaatt

SEQ ID NO: 703089 - DNA, 25 bp, Mus musculus
gtgcatctagtggttacctaaaatt

SEQ ID NO: 703090 - DNA, 25 bp, Mus musculus
gtgcatctatatagagccaccaccc

SEQ ID NO: 703091 - DNA, 25 bp, Mus musculus
gtgcatctatattgagccaccaccc

SEQ ID NO: 703092 - DNA, 25 bp, Mus musculus
gtgcatctcactaaagtgttgtcaa

SEQ ID NO: 703093 - DNA, 25 bp, Mus musculus
gtgcatctcacttaagtgttgtcaa

SEQ ID NO: 703094 - DNA, 25 bp, Mus musculus
gtgcatctcatgaacaataaccaga

SEQ ID NO: 703095 - DNA, 25 bp, Mus musculus
gtgcatctcatgtacaataaccaga

SEQ ID NO: 703096 - DNA, 25 bp, Mus musculus
gtgcatctccacaggcgtgtttggc

SEQ ID NO: 703097 - DNA, 25 bp, Mus musculus
gtgcatctccactggcgtgtttggc

SEQ ID NO: 703098 - DNA, 25 bp, Mus musculus
gtgcatctcctcatgagctaggcaa

SEQ ID NO: 703099 - DNA, 25 bp, Mus musculus
gtgcatctcctcttgagctaggcaa

SEQ ID NO: 703100 - DNA, 25 bp, Mus musculus
gtgcatctcgcaaccacgtggatta

SEQ ID NO: 703101 - DNA, 25 bp, Mus musculus
gtgcatctcgcatccacgtggatta

SEQ ID NO: 703102 - DNA, 25 bp, Mus musculus
gtgcatctctgaactgtatgtgttt

SEQ ID NO: 703103 - DNA, 25 bp, Mus musculus
gtgcatctctgaccacagatctcac

SEQ ID NO: 703104 - DNA, 25 bp, Mus musculus
gtgcatctctgagcacagatctcac

SEQ ID NO: 703105 - DNA, 25 bp, Mus musculus
gtgcatctctgatctgtatgtgttt

SEQ ID NO: 703106 - DNA, 25 bp, Mus musculus
gtgcatctgctaaaagcaaaaaccc

SEQ ID NO: 703107 - DNA, 25 bp, Mus musculus
gtgcatctgctataagcaaaaaccc

SEQ ID NO: 703108 - DNA, 25 bp, Mus musculus
gtgcatctggaaaagactggacaca

SEQ ID NO: 703109 - DNA, 25 bp, Mus musculus
gtgcatctggaatagactggacaca

SEQ ID NO: 703110 - DNA, 25 bp, Mus musculus
gtgcatctggctctccatattgagt

SEQ ID NO: 703111 - DNA, 25 bp, Mus musculus
gtgcatctggctgtccatattgagt

SEQ ID NO: 703112 - DNA, 25 bp, Mus musculus
gtgcatctgtaaaggcaaaccagag

SEQ ID NO: 703113 - DNA, 25 bp, Mus musculus
gtgcatctgtaatggcaaaccagag

SEQ ID NO: 703114 - DNA, 25 bp, Mus musculus
gtgcatctgtatccagcgataggcg

SEQ ID NO: 703115 - DNA, 25 bp, Mus musculus
gtgcatctgtatgcagcgataggcg

SEQ ID NO: 703116 - DNA, 25 bp, Mus musculus
gtgcatctgtgtatgtgatacagca

SEQ ID NO: 703117 - DNA, 25 bp, Mus musculus
gtgcatctgtgtttgtgatacagca

SEQ ID NO: 703118 - DNA, 25 bp, Mus musculus
gtgcatctgttactttttcaagctg

SEQ ID NO: 703119 - DNA, 25 bp, Mus musculus
gtgcatctgttagtttttcaagctg

SEQ ID NO: 703120 - DNA, 25 bp, Mus musculus
gtgcatcttacaatatatcagttac

SEQ ID NO: 703121 - DNA, 25 bp, Mus musculus
gtgcatcttacattatatcagttac

SEQ ID NO: 703122 - DNA, 25 bp, Mus musculus
gtgcatcttcggactgagcaggagt

SEQ ID NO: 703123 - DNA, 25 bp, Mus musculus
gtgcatcttcggtctgagcaggagt

SEQ ID NO: 703124 - DNA, 25 bp, Mus musculus
gtgcatcttgaaagcggccttagct

SEQ ID NO: 703125 - DNA, 25 bp, Mus musculus
gtgcatcttgaatgcggccttagct

SEQ ID NO: 703126 - DNA, 25 bp, Mus musculus
gtgcatcttgtgcaacaaggccttt

SEQ ID NO: 703127 - DNA, 25 bp, Mus musculus
gtgcatcttgtggaacaaggccttt

SEQ ID NO: 703128 - DNA, 25 bp, Mus musculus
gtgcatcttttcacatatcactgat

SEQ ID NO: 703129 - DNA, 25 bp, Mus musculus
gtgcatcttttctcatatcactgat

SEQ ID NO: 703130 - DNA, 25 bp, Mus musculus
gtgcatgaaacacggcttggtttga

SEQ ID NO: 703131 - DNA, 25 bp, Mus musculus
gtgcatgaaacagggcttggtttga

SEQ ID NO: 703132 - DNA, 25 bp, Mus musculus
gtgcatgaacctagtattgcctggt

SEQ ID NO: 703133 - DNA, 25 bp, Mus musculus
gtgcatgaaccttgtattgcctggt

SEQ ID NO: 703134 - DNA, 25 bp, Mus musculus
gtgcatgaagaaaccaacgaccttg

SEQ ID NO: 703135 - DNA, 25 bp, Mus musculus
gtgcatgaagaatccaacgaccttg

SEQ ID NO: 703136 - DNA, 25 bp, Mus musculus
gtgcatgaatagattctctcctaat

SEQ ID NO: 703137 - DNA, 25 bp, Mus musculus
gtgcatgaatagtttctctcctaat

SEQ ID NO: 703138 - DNA, 25 bp, Mus musculus
gtgcatgacaaaactcatcctgaat

SEQ ID NO: 703139 - DNA, 25 bp, Mus musculus
gtgcatgacaaatctcatcctgaat

SEQ ID NO: 703140 - DNA, 25 bp, Mus musculus
gtgcatgacaatacgtgatactctc

SEQ ID NO: 703141 - DNA, 25 bp, Mus musculus
gtgcatgacaattcgtgatactctc

SEQ ID NO: 703142 - DNA, 25 bp, Mus musculus
gtgcatgacaccagctcaaaatact

SEQ ID NO: 703143 - DNA, 25 bp, Mus musculus
gtgcatgacacctgctcaaaatact

SEQ ID NO: 703144 - DNA, 25 bp, Mus musculus
gtgcatgaccaaagggttcgtacgt

SEQ ID NO: 703145 - DNA, 25 bp, Mus musculus
gtgcatgaccaatgggttcgtacgt

SEQ ID NO: 703146 - DNA, 25 bp, Mus musculus
gtgcatgacctgctttcatctgtaa

SEQ ID NO: 703147 - DNA, 25 bp, Mus musculus
gtgcatgacctggtttcatctgtaa

SEQ ID NO: 703148 - DNA, 25 bp, Mus musculus
gtgcatgagaatacacccttcgtgg

SEQ ID NO: 703149 - DNA, 25 bp, Mus musculus
gtgcatgagaattcacccttcgtgg

SEQ ID NO: 703150 - DNA, 25 bp, Mus musculus
gtgcatgaggctacatcattcctta

SEQ ID NO: 703151 - DNA, 25 bp, Mus musculus
gtgcatgaggcttcatcattcctta

SEQ ID NO: 703152 - DNA, 25 bp, Mus musculus
gtgcatgataagacctaagaactga

SEQ ID NO: 703153 - DNA, 25 bp, Mus musculus
gtgcatgataagtcctaagaactga

SEQ ID NO: 703154 - DNA, 25 bp, Mus musculus
gtgcatgatagcagtgtggctcccc

SEQ ID NO: 703155 - DNA, 25 bp, Mus musculus
gtgcatgatagctgtgtggctcccc

SEQ ID NO: 703156 - DNA, 25 bp, Mus musculus
gtgcatgatgcactagtttatgtca

SEQ ID NO: 703157 - DNA, 25 bp, Mus musculus
gtgcatgatgcagtagtttatgtca

SEQ ID NO: 703158 - DNA, 25 bp, Mus musculus
gtgcatgcacacatgtatgtacaca

SEQ ID NO: 703159 - DNA, 25 bp, Mus musculus
gtgcatgcacacttgtatgtacaca

SEQ ID NO: 703160 - DNA, 25 bp, Mus musculus
gtgcatgcagatatgaacccctgtg

SEQ ID NO: 703161 - DNA, 25 bp, Mus musculus
gtgcatgcagatttgaacccctgtg

SEQ ID NO: 703162 - DNA, 25 bp, Mus musculus
gtgcatgcagtcacatttgctatga

SEQ ID NO: 703163 - DNA, 25 bp, Mus musculus
gtgcatgcagtctcatttgctatga

SEQ ID NO: 703164 - DNA, 25 bp, Mus musculus
gtgcatgcatgtctttctaatcact

SEQ ID NO: 703165 - DNA, 25 bp, Mus musculus
gtgcatgcatgtgtttctaatcact

SEQ ID NO: 703166 - DNA, 25 bp, Mus musculus
gtgcatgccagaccttcctagcaga

SEQ ID NO: 703167 - DNA, 25 bp, Mus musculus
gtgcatgccagagcttcctagcaga

SEQ ID NO: 703168 - DNA, 25 bp, Mus musculus
gtgcatgccatgattacagaaacta

SEQ ID NO: 703169 - DNA, 25 bp, Mus musculus
gtgcatgccatgtttacagaaacta

SEQ ID NO: 703170 - DNA, 25 bp, Mus musculus
gtgcatgccattattgacacgcagg

SEQ ID NO: 703171 - DNA, 25 bp, Mus musculus
gtgcatgccatttttgacacgcagg

SEQ ID NO: 703172 - DNA, 25 bp, Mus musculus
gtgcatgcccacacacagaaaagga

SEQ ID NO: 703173 - DNA, 25 bp, Mus musculus
gtgcatgcccactcacagaaaagga

SEQ ID NO: 703174 - DNA, 25 bp, Mus musculus
gtgcatgcccagattattaccacta

SEQ ID NO: 703175 - DNA, 25 bp, Mus musculus
gtgcatgcccagtttattaccacta

SEQ ID NO: 703176 - DNA, 25 bp, Mus musculus
gtgcatgcctgtagccttagtactg

SEQ ID NO: 703177 - DNA, 25 bp, Mus musculus
gtgcatgcctgttgccttagtactg

SEQ ID NO: 703178 - DNA, 25 bp, Mus musculus
gtgcatgcgcaacagggccccgatt

SEQ ID NO: 703179 - DNA, 25 bp, Mus musculus
gtgcatgcgcaagagggccccgatt

SEQ ID NO: 703180 - DNA, 25 bp, Mus musculus
gtgcatgctaatcaggagacgacag

SEQ ID NO: 703181 - DNA, 25 bp, Mus musculus
gtgcatgctaatgaggagacgacag

SEQ ID NO: 703182 - DNA, 25 bp, Mus musculus
gtgcatgctactcggaacaaggttt

SEQ ID NO: 703183 - DNA, 25 bp, Mus musculus
gtgcatgctactgggaacaaggttt

SEQ ID NO: 703184 - DNA, 25 bp, Mus musculus
gtgcatgctatcacagttttgcttg

SEQ ID NO: 703185 - DNA, 25 bp, Mus musculus
gtgcatgctatctcagttttgcttg

SEQ ID NO: 703186 - DNA, 25 bp, Mus musculus
gtgcatgctcagaactttccattta

SEQ ID NO: 703187 - DNA, 25 bp, Mus musculus
gtgcatgctcagtactttccattta

SEQ ID NO: 703188 - DNA, 25 bp, Mus musculus
gtgcatgctgctctaagaccttaca

SEQ ID NO: 703189 - DNA, 25 bp, Mus musculus
gtgcatgctgctgtaagaccttaca

SEQ ID NO: 703190 - DNA, 25 bp, Mus musculus
gtgcatgctggtcttgtatttctat

SEQ ID NO: 703191 - DNA, 25 bp, Mus musculus
gtgcatgctggtgttgtatttctat

SEQ ID NO: 703192 - DNA, 25 bp, Mus musculus
gtgcatgctgtgactgaattcctga

SEQ ID NO: 703193 - DNA, 25 bp, Mus musculus
gtgcatgctgtgtctgaattcctga

SEQ ID NO: 703194 - DNA, 25 bp, Mus musculus
gtgcatgcttcaaaacctaccaggt

SEQ ID NO: 703195 - DNA, 25 bp, Mus musculus
gtgcatgcttcataacctaccaggt

SEQ ID NO: 703196 - DNA, 25 bp, Mus musculus
gtgcatgctttgctgccacagagaa

SEQ ID NO: 703197 - DNA, 25 bp, Mus musculus
gtgcatgctttggtgccacagagaa

SEQ ID NO: 703198 - DNA, 25 bp, Mus musculus
gtgcatggacagaataaagggataa

SEQ ID NO: 703199 - DNA, 25 bp, Mus musculus
gtgcatggacagtataaagggataa

SEQ ID NO: 703200 - DNA, 25 bp, Mus musculus
gtgcatggactaagactgcttctgt

SEQ ID NO: 703201 - DNA, 25 bp, Mus musculus
gtgcatggactatgactgcttctgt

SEQ ID NO: 703202 - DNA, 25 bp, Mus musculus
gtgcatggactcattgataatgttt

SEQ ID NO: 703203 - DNA, 25 bp, Mus musculus
gtgcatggactctttgataatgttt

SEQ ID NO: 703204 - DNA, 25 bp, Mus musculus
gtgcatggactgataggccagttca

SEQ ID NO: 703205 - DNA, 25 bp, Mus musculus
gtgcatggactgttaggccagttca

SEQ ID NO: 703206 - DNA, 25 bp, Mus musculus
gtgcatggagtcacaagcagacaca

SEQ ID NO: 703207 - DNA, 25 bp, Mus musculus
gtgcatggagtctcaagcagacaca

SEQ ID NO: 703208 - DNA, 25 bp, Mus musculus
gtgcatggccagagacacaagaact

SEQ ID NO: 703209 - DNA, 25 bp, Mus musculus
gtgcatggccagtgacacaagaact

SEQ ID NO: 703210 - DNA, 25 bp, Mus musculus
gtgcatggcctacaatgacttcttc

SEQ ID NO: 703211 - DNA, 25 bp, Mus musculus
gtgcatggcctagaatgacttcttc

SEQ ID NO: 703212 - DNA, 25 bp, Mus musculus
gtgcatggctcaaactgtagtgtct

SEQ ID NO: 703213 - DNA, 25 bp, Mus musculus
gtgcatggctcatactgtagtgtct

SEQ ID NO: 703214 - DNA, 25 bp, Mus musculus
gtgcatgggagtccctgcccgtaat

SEQ ID NO: 703215 - DNA, 25 bp, Mus musculus
gtgcatgggagtgcctgcccgtaat

SEQ ID NO: 703216 - DNA, 25 bp, Mus musculus
gtgcatgggcaccagcgatgaccac

SEQ ID NO: 703217 - DNA, 25 bp, Mus musculus
gtgcatgggcacgagcgatgaccac

SEQ ID NO: 703218 - DNA, 25 bp, Mus musculus
gtgcatgggcttatctctgattaac

SEQ ID NO: 703219 - DNA, 25 bp, Mus musculus
gtgcatgggcttcgtttatacgaat

SEQ ID NO: 703220 - DNA, 25 bp, Mus musculus
gtgcatgggcttggtttatacgaat

SEQ ID NO: 703221 - DNA, 25 bp, Mus musculus
gtgcatgggcttttctctgattaac

SEQ ID NO: 703222 - DNA, 25 bp, Mus musculus
gtgcatgggttactgctaactcttt

SEQ ID NO: 703223 - DNA, 25 bp, Mus musculus
gtgcatgggttagtgctaactcttt

SEQ ID NO: 703224 - DNA, 25 bp, Mus musculus
gtgcatggtactaacctggtcccca

SEQ ID NO: 703225 - DNA, 25 bp, Mus musculus
gtgcatggtactagtttttcaataa

SEQ ID NO: 703226 - DNA, 25 bp, Mus musculus
gtgcatggtacttacctggtcccca

SEQ ID NO: 703227 - DNA, 25 bp, Mus musculus
gtgcatggtacttgtttttcaataa

SEQ ID NO: 703228 - DNA, 25 bp, Mus musculus
gtgcatggtctcaatgctgtcttta

SEQ ID NO: 703229 - DNA, 25 bp, Mus musculus
gtgcatggtctctatgctgtcttta

SEQ ID NO: 703230 - DNA, 25 bp, Mus musculus
gtgcatggtgtcataggcctttaat

SEQ ID NO: 703231 - DNA, 25 bp, Mus musculus
gtgcatggtgtcttaggcctttaat

SEQ ID NO: 703232 - DNA, 25 bp, Mus musculus
gtgcatggtgttacaggctggctgt

SEQ ID NO: 703233 - DNA, 25 bp, Mus musculus
gtgcatggtgtttcaggctggctgt

SEQ ID NO: 703234 - DNA, 25 bp, Mus musculus
gtgcatgtagttcagaccaccgtct

SEQ ID NO: 703235 - DNA, 25 bp, Mus musculus
gtgcatgtagttgagaccaccgtct

SEQ ID NO: 703236 - DNA, 25 bp, Mus musculus
gtgcatgtatctctatattccacat

SEQ ID NO: 703237 - DNA, 25 bp, Mus musculus
gtgcatgtatctgtatattccacat

SEQ ID NO: 703238 - DNA, 25 bp, Mus musculus
gtgcatgtatgcactatgtaaatat

SEQ ID NO: 703239 - DNA, 25 bp, Mus musculus
gtgcatgtatgctctatgtaaatat

SEQ ID NO: 703240 - DNA, 25 bp, Mus musculus
gtgcatgtcaggcacacactcccaa

SEQ ID NO: 703241 - DNA, 25 bp, Mus musculus
gtgcatgtcagggacacactcccaa

SEQ ID NO: 703242 - DNA, 25 bp, Mus musculus
gtgcatgtcattactagttctttct

SEQ ID NO: 703243 - DNA, 25 bp, Mus musculus
gtgcatgtcatttctagttctttct

SEQ ID NO: 703244 - DNA, 25 bp, Mus musculus
gtgcatgtctaaactgttcccatta

SEQ ID NO: 703245 - DNA, 25 bp, Mus musculus
gtgcatgtctaatctgttcccatta

SEQ ID NO: 703246 - DNA, 25 bp, Mus musculus
gtgcatgtgaatccctactgtaatt

SEQ ID NO: 703247 - DNA, 25 bp, Mus musculus
gtgcatgtgaatcgcctagagaacc

SEQ ID NO: 703248 - DNA, 25 bp, Mus musculus
gtgcatgtgaatgcctactgtaatt

SEQ ID NO: 703249 - DNA, 25 bp, Mus musculus
gtgcatgtgaatggcctagagaacc

SEQ ID NO: 703250 - DNA, 25 bp, Mus musculus
gtgcatgtgagccattatcttgtct

SEQ ID NO: 703251 - DNA, 25 bp, Mus musculus
gtgcatgtgagcgattatcttgtct

SEQ ID NO: 703252 - DNA, 25 bp, Mus musculus
gtgcatgtgcgaaaatgattacctt

SEQ ID NO: 703253 - DNA, 25 bp, Mus musculus
gtgcatgtgcgataatgattacctt

SEQ ID NO: 703254 - DNA, 25 bp, Mus musculus
gtgcatgtggtaccaaaactcctca

SEQ ID NO: 703255 - DNA, 25 bp, Mus musculus
gtgcatgtggtagcaaaactcctca

SEQ ID NO: 703256 - DNA, 25 bp, Mus musculus
gtgcatgtgttcagtgttacagaat

SEQ ID NO: 703257 - DNA, 25 bp, Mus musculus
gtgcatgtgttccaccagtgttgga

SEQ ID NO: 703258 - DNA, 25 bp, Mus musculus
gtgcatgtgttcgaccagtgttgga

SEQ ID NO: 703259 - DNA, 25 bp, Mus musculus
gtgcatgtgttctgtgttacagaat

SEQ ID NO: 703260 - DNA, 25 bp, Mus musculus
gtgcatgttaaacaggtgctctgcc

SEQ ID NO: 703261 - DNA, 25 bp, Mus musculus
gtgcatgttaaagaggtgctctgcc

SEQ ID NO: 703262 - DNA, 25 bp, Mus musculus
gtgcatgttaccaatttttccttat

SEQ ID NO: 703263 - DNA, 25 bp, Mus musculus
gtgcatgttacctatttttccttat

SEQ ID NO: 703264 - DNA, 25 bp, Mus musculus
gtgcatgttactcaggacttcgcca

SEQ ID NO: 703265 - DNA, 25 bp, Mus musculus
gtgcatgttactgaggacttcgcca

SEQ ID NO: 703266 - DNA, 25 bp, Mus musculus
gtgcatgttatcatctgattccagt

SEQ ID NO: 703267 - DNA, 25 bp, Mus musculus
gtgcatgttatcttctgattccagt

SEQ ID NO: 703268 - DNA, 25 bp, Mus musculus
gtgcatgttcatagagcccgtgagt

SEQ ID NO: 703269 - DNA, 25 bp, Mus musculus
gtgcatgttcatatcgactcacaac

SEQ ID NO: 703270 - DNA, 25 bp, Mus musculus
gtgcatgttcattgagcccgtgagt

SEQ ID NO: 703271 - DNA, 25 bp, Mus musculus
gtgcatgttcatttcgactcacaac

SEQ ID NO: 703272 - DNA, 25 bp, Mus musculus
gtgcattaaaatctgcttgccatta

SEQ ID NO: 703273 - DNA, 25 bp, Mus musculus
gtgcattaaaatgtgcttgccatta

SEQ ID NO: 703274 - DNA, 25 bp, Mus musculus
gtgcattaactcatgtggctattct

SEQ ID NO: 703275 - DNA, 25 bp, Mus musculus
gtgcattaactcttgtggctattct

SEQ ID NO: 703276 - DNA, 25 bp, Mus musculus
gtgcattaagtacccagttgctgaa

SEQ ID NO: 703277 - DNA, 25 bp, Mus musculus
gtgcattaagtagccagttgctgaa

SEQ ID NO: 703278 - DNA, 25 bp, Mus musculus
gtgcattaccacaagctttctgttt

SEQ ID NO: 703279 - DNA, 25 bp, Mus musculus
gtgcattaccactagctttctgttt

SEQ ID NO: 703280 - DNA, 25 bp, Mus musculus
gtgcattactcacggctttcattct

SEQ ID NO: 703281 - DNA, 25 bp, Mus musculus
gtgcattactcagggctttcattct

SEQ ID NO: 703282 - DNA, 25 bp, Mus musculus
gtgcattactgacgtctctcattac

SEQ ID NO: 703283 - DNA, 25 bp, Mus musculus
gtgcattactgaggtctctcattac

SEQ ID NO: 703284 - DNA, 25 bp, Mus musculus
gtgcattagcacatctgctgggtga

SEQ ID NO: 703285 - DNA, 25 bp, Mus musculus
gtgcattagcacttctgctgggtga

SEQ ID NO: 703286 - DNA, 25 bp, Mus musculus
gtgcattatcacaagcagcggcggc

SEQ ID NO: 703287 - DNA, 25 bp, Mus musculus
gtgcattatcactagcagcggcggc

SEQ ID NO: 703288 - DNA, 25 bp, Mus musculus
gtgcattatgcaaaccatgtaggtt

SEQ ID NO: 703289 - DNA, 25 bp, Mus musculus
gtgcattatgcataccatgtaggtt

SEQ ID NO: 703290 - DNA, 25 bp, Mus musculus
gtgcattatgccatttaccttaaat

SEQ ID NO: 703291 - DNA, 25 bp, Mus musculus
gtgcattatgccttttaccttaaat

SEQ ID NO: 703292 - DNA, 25 bp, Mus musculus
gtgcattattttacatatgctctat

SEQ ID NO: 703293 - DNA, 25 bp, Mus musculus
gtgcattatttttcatatgctctat

SEQ ID NO: 703294 - DNA, 25 bp, Mus musculus
gtgcattcaactatgatgctcagtt

SEQ ID NO: 703295 - DNA, 25 bp, Mus musculus
gtgcattcaactcaggaggcctgta

SEQ ID NO: 703296 - DNA, 25 bp, Mus musculus
gtgcattcaactgaggaggcctgta

SEQ ID NO: 703297 - DNA, 25 bp, Mus musculus
gtgcattcaactttgatgctcagtt

SEQ ID NO: 703298 - DNA, 25 bp, Mus musculus
gtgcattcagtgaccctttgacaaa

SEQ ID NO: 703299 - DNA, 25 bp, Mus musculus
gtgcattcagtgtccctttgacaaa

SEQ ID NO: 703300 - DNA, 25 bp, Mus musculus
gtgcattcattgatcctttaggctt

SEQ ID NO: 703301 - DNA, 25 bp, Mus musculus
gtgcattcattgttcctttaggctt

SEQ ID NO: 703302 - DNA, 25 bp, Mus musculus
gtgcattccaagctgtttcagggct

SEQ ID NO: 703303 - DNA, 25 bp, Mus musculus
gtgcattccaaggtgtttcagggct

SEQ ID NO: 703304 - DNA, 25 bp, Mus musculus
gtgcattccataactcgctgtttgt

SEQ ID NO: 703305 - DNA, 25 bp, Mus musculus
gtgcattccatatctcgctgtttgt

SEQ ID NO: 703306 - DNA, 25 bp, Mus musculus
gtgcattcccaaaacaactaccaaa

SEQ ID NO: 703307 - DNA, 25 bp, Mus musculus
gtgcattcccaatacaactaccaaa

SEQ ID NO: 703308 - DNA, 25 bp, Mus musculus
gtgcattcctgactttaactgtttg

SEQ ID NO: 703309 - DNA, 25 bp, Mus musculus
gtgcattcctgagtttaactgtttg

SEQ ID NO: 703310 - DNA, 25 bp, Mus musculus
gtgcattcctgtaagcccagtagtt

SEQ ID NO: 703311 - DNA, 25 bp, Mus musculus
gtgcattcctgtctgagtttctgtg

SEQ ID NO: 703312 - DNA, 25 bp, Mus musculus
gtgcattcctgtgtgagtttctgtg

SEQ ID NO: 703313 - DNA, 25 bp, Mus musculus
gtgcattcctgttagcccagtagtt

SEQ ID NO: 703314 - DNA, 25 bp, Mus musculus
gtgcattctagcatcagcagactga

SEQ ID NO: 703315 - DNA, 25 bp, Mus musculus
gtgcattctagcttcagcagactga

SEQ ID NO: 703316 - DNA, 25 bp, Mus musculus
gtgcattctccaatttataccttta

SEQ ID NO: 703317 - DNA, 25 bp, Mus musculus
gtgcattctccattttataccttta

SEQ ID NO: 703318 - DNA, 25 bp, Mus musculus
gtgcattctctcaaggcccaggtca

SEQ ID NO: 703319 - DNA, 25 bp, Mus musculus
gtgcattctctctaggcccaggtca

SEQ ID NO: 703320 - DNA, 25 bp, Mus musculus
gtgcattctggccaacttgatatac

SEQ ID NO: 703321 - DNA, 25 bp, Mus musculus
gtgcattctggcgaacttgatatac

SEQ ID NO: 703322 - DNA, 25 bp, Mus musculus
gtgcattctggtaatcacatggatc

SEQ ID NO: 703323 - DNA, 25 bp, Mus musculus
gtgcattctggttatcacatggatc

SEQ ID NO: 703324 - DNA, 25 bp, Mus musculus
gtgcattgaaatcgtctcactggcc

SEQ ID NO: 703325 - DNA, 25 bp, Mus musculus
gtgcattgaaatggtctcactggcc

SEQ ID NO: 703326 - DNA, 25 bp, Mus musculus
gtgcattgaactcgagcagcagttt

SEQ ID NO: 703327 - DNA, 25 bp, Mus musculus
gtgcattgaactggagcagcagttt

SEQ ID NO: 703328 - DNA, 25 bp, Mus musculus
gtgcattgacgacgccacagcaagt

SEQ ID NO: 703329 - DNA, 25 bp, Mus musculus
gtgcattgacgaggccacagcaagt

SEQ ID NO: 703330 - DNA, 25 bp, Mus musculus
gtgcattgagaacacaccaagtttc

SEQ ID NO: 703331 - DNA, 25 bp, Mus musculus
gtgcattgagaagacaccaagtttc

SEQ ID NO: 703332 - DNA, 25 bp, Mus musculus
gtgcattgagccacgtgaaccgctg

SEQ ID NO: 703333 - DNA, 25 bp, Mus musculus
gtgcattgagcctcgtgaaccgctg

SEQ ID NO: 703334 - DNA, 25 bp, Mus musculus
gtgcattgattacccaggacccacc

SEQ ID NO: 703335 - DNA, 25 bp, Mus musculus
gtgcattgattagccaggacccacc

SEQ ID NO: 703336 - DNA, 25 bp, Mus musculus
gtgcattgcacgatggataagccag

SEQ ID NO: 703337 - DNA, 25 bp, Mus musculus
gtgcattgcacgttggataagccag

SEQ ID NO: 703338 - DNA, 25 bp, Mus musculus
gtgcattgcagaccaaaccctgagt

SEQ ID NO: 703339 - DNA, 25 bp, Mus musculus
gtgcattgcagagcaaaccctgagt

SEQ ID NO: 703340 - DNA, 25 bp, Mus musculus
gtgcattgccaacgttttacttata

SEQ ID NO: 703341 - DNA, 25 bp, Mus musculus
gtgcattgccaaggttttacttata

SEQ ID NO: 703342 - DNA, 25 bp, Mus musculus
gtgcattgccatatctttcactttc

SEQ ID NO: 703343 - DNA, 25 bp, Mus musculus
gtgcattgccatttctttcactttc

SEQ ID NO: 703344 - DNA, 25 bp, Mus musculus
gtgcattgggttaggttgtacagta

SEQ ID NO: 703345 - DNA, 25 bp, Mus musculus
gtgcattgggtttggttgtacagta

SEQ ID NO: 703346 - DNA, 25 bp, Mus musculus
gtgcattgttttaatgtcctccatc

SEQ ID NO: 703347 - DNA, 25 bp, Mus musculus
gtgcattgtttttatgtcctccatc

SEQ ID NO: 703348 - DNA, 25 bp, Mus musculus
gtgcatttaactcacgaaccatctc

SEQ ID NO: 703349 - DNA, 25 bp, Mus musculus
gtgcatttaactgacgaaccatctc

SEQ ID NO: 703350 - DNA, 25 bp, Mus musculus
gtgcatttaatgactcttctgtctg

SEQ ID NO: 703351 - DNA, 25 bp, Mus musculus
gtgcatttaatgtctcttctgtctg

SEQ ID NO: 703352 - DNA, 25 bp, Mus musculus
gtgcatttaattaatctctccctgt

SEQ ID NO: 703353 - DNA, 25 bp, Mus musculus
gtgcatttaatttatctctccctgt

SEQ ID NO: 703354 - DNA, 25 bp, Mus musculus
gtgcatttacacctgaagccctgtc

SEQ ID NO: 703355 - DNA, 25 bp, Mus musculus
gtgcatttacacgtgaagccctgtc

SEQ ID NO: 703356 - DNA, 25 bp, Mus musculus
gtgcatttacagagaaatttcagca

SEQ ID NO: 703357 - DNA, 25 bp, Mus musculus
gtgcatttacagtgaaatttcagca

SEQ ID NO: 703358 - DNA, 25 bp, Mus musculus
gtgcatttaccaagctagatccatt

SEQ ID NO: 703359 - DNA, 25 bp, Mus musculus
gtgcatttaccatgctagatccatt

SEQ ID NO: 703360 - DNA, 25 bp, Mus musculus
gtgcatttactcacagtcaggaagc

SEQ ID NO: 703361 - DNA, 25 bp, Mus musculus
gtgcatttactctcagtcaggaagc

SEQ ID NO: 703362 - DNA, 25 bp, Mus musculus
gtgcatttactgacaccttaagttt

SEQ ID NO: 703363 - DNA, 25 bp, Mus musculus
gtgcatttactgtcaccttaagttt

SEQ ID NO: 703364 - DNA, 25 bp, Mus musculus
gtgcatttaggcaagctctaccatt

SEQ ID NO: 703365 - DNA, 25 bp, Mus musculus
gtgcatttaggctagctctaccatt

SEQ ID NO: 703366 - DNA, 25 bp, Mus musculus
gtgcatttagggaagtttgtctcaa

SEQ ID NO: 703367 - DNA, 25 bp, Mus musculus
gtgcatttagggtagtttgtctcaa

SEQ ID NO: 703368 - DNA, 25 bp, Mus musculus
gtgcatttcaaaccaggactttccc

SEQ ID NO: 703369 - DNA, 25 bp, Mus musculus
gtgcatttcaaagcaggactttccc

SEQ ID NO: 703370 - DNA, 25 bp, Mus musculus
gtgcatttcaagcaacagccctcaa

SEQ ID NO: 703371 - DNA, 25 bp, Mus musculus
gtgcatttcaaggaacagccctcaa

SEQ ID NO: 703372 - DNA, 25 bp, Mus musculus
gtgcatttcagtcacgccattgact

SEQ ID NO: 703373 - DNA, 25 bp, Mus musculus
gtgcatttcagtgacgccattgact

SEQ ID NO: 703374 - DNA, 25 bp, Mus musculus
gtgcatttcatgatcagttattgtc

SEQ ID NO: 703375 - DNA, 25 bp, Mus musculus
gtgcatttcatgttcagttattgtc

SEQ ID NO: 703376 - DNA, 25 bp, Mus musculus
gtgcatttcgtaccattgaacctga

SEQ ID NO: 703377 - DNA, 25 bp, Mus musculus
gtgcatttcgtagcattgaacctga

SEQ ID NO: 703378 - DNA, 25 bp, Mus musculus
gtgcatttctcaatcagtagtcatc

SEQ ID NO: 703379 - DNA, 25 bp, Mus musculus
gtgcatttctcattcagtagtcatc

SEQ ID NO: 703380 - DNA, 25 bp, Mus musculus
gtgcatttcttcaaccataaacttt

SEQ ID NO: 703381 - DNA, 25 bp, Mus musculus
gtgcatttcttctaccataaacttt

SEQ ID NO: 703382 - DNA, 25 bp, Mus musculus
gtgcatttgcaacatttgttttaag

SEQ ID NO: 703383 - DNA, 25 bp, Mus musculus
gtgcatttgcaagatttgttttaag

SEQ ID NO: 703384 - DNA, 25 bp, Mus musculus
gtgcatttgttaatgctgatcacta

SEQ ID NO: 703385 - DNA, 25 bp, Mus musculus
gtgcatttgttattgctgatcacta

SEQ ID NO: 703386 - DNA, 25 bp, Mus musculus
gtgcatttgtttcagggagtgttcc

SEQ ID NO: 703387 - DNA, 25 bp, Mus musculus
gtgcatttgtttctggccaaggcct

SEQ ID NO: 703388 - DNA, 25 bp, Mus musculus
gtgcatttgtttgagggagtgttcc

SEQ ID NO: 703389 - DNA, 25 bp, Mus musculus
gtgcatttgtttgtggccaaggcct

SEQ ID NO: 703390 - DNA, 25 bp, Mus musculus
gtgcattttacacttgctactgcag

SEQ ID NO: 703391 - DNA, 25 bp, Mus musculus
gtgcattttacagttgctactgcag

SEQ ID NO: 703392 - DNA, 25 bp, Mus musculus
gtgcattttcaactgggtagacact

SEQ ID NO: 703393 - DNA, 25 bp, Mus musculus
gtgcattttcaagtgggtagacact

SEQ ID NO: 703394 - DNA, 25 bp, Mus musculus
gtgcattttcagatgttggtgaact

SEQ ID NO: 703395 - DNA, 25 bp, Mus musculus
gtgcattttcagttgttggtgaact

SEQ ID NO: 703396 - DNA, 25 bp, Mus musculus
gtgcattttctgacatggcatggag

SEQ ID NO: 703397 - DNA, 25 bp, Mus musculus
gtgcattttctgtcatggcatggag

SEQ ID NO: 703398 - DNA, 25 bp, Mus musculus
gtgcattttgcaattgctcatatca

SEQ ID NO: 703399 - DNA, 25 bp, Mus musculus
gtgcattttgcatttgctcatatca

SEQ ID NO: 703400 - DNA, 25 bp, Mus musculus
gtgcattttgctaactcacagggca

SEQ ID NO: 703401 - DNA, 25 bp, Mus musculus
gtgcattttgcttactcacagggca

SEQ ID NO: 703402 - DNA, 25 bp, Mus musculus
gtgcatttttataggtatactatga

SEQ ID NO: 703403 - DNA, 25 bp, Mus musculus
gtgcatttttattggtatactatga

SEQ ID NO: 703404 - DNA, 25 bp, Mus musculus
gtgcattttttcacactattttaag

SEQ ID NO: 703405 - DNA, 25 bp, Mus musculus
gtgcattttttcacctacttaattt

SEQ ID NO: 703406 - DNA, 25 bp, Mus musculus
gtgcattttttctcactattttaag

SEQ ID NO: 703407 - DNA, 25 bp, Mus musculus
gtgcattttttctcctacttaattt

SEQ ID NO: 703408 - DNA, 25 bp, Mus musculus
gtgccaaaaccaacaattagataga

SEQ ID NO: 703409 - DNA, 25 bp, Mus musculus
gtgccaaaaccatcaattagataga

SEQ ID NO: 703410 - DNA, 25 bp, Mus musculus
gtgccaaaagcaatagtgtcagata

SEQ ID NO: 703411 - DNA, 25 bp, Mus musculus
gtgccaaaagcattagtgtcagata

SEQ ID NO: 703412 - DNA, 25 bp, Mus musculus
gtgccaaaatatatccccagtaaat

SEQ ID NO: 703413 - DNA, 25 bp, Mus musculus
gtgccaaaatatttccccagtaaat

SEQ ID NO: 703414 - DNA, 25 bp, Mus musculus
gtgccaaaccctcgatgttctatgt

SEQ ID NO: 703415 - DNA, 25 bp, Mus musculus
gtgccaaaccctggatgttctatgt

SEQ ID NO: 703416 - DNA, 25 bp, Mus musculus
gtgccaaacttgcaaccttgtgcag

SEQ ID NO: 703417 - DNA, 25 bp, Mus musculus
gtgccaaacttggaaccttgtgcag

SEQ ID NO: 703418 - DNA, 25 bp, Mus musculus
gtgccaaagagaatttttccctgga

SEQ ID NO: 703419 - DNA, 25 bp, Mus musculus
gtgccaaagagattttttccctgga

SEQ ID NO: 703420 - DNA, 25 bp, Mus musculus
gtgccaaagcccctgtattgtgttt

SEQ ID NO: 703421 - DNA, 25 bp, Mus musculus
gtgccaaagcccgtgtattgtgttt

SEQ ID NO: 703422 - DNA, 25 bp, Mus musculus
gtgccaaagcctacgtacataaagt

SEQ ID NO: 703423 - DNA, 25 bp, Mus musculus
gtgccaaagccttcgtacataaagt

SEQ ID NO: 703424 - DNA, 25 bp, Mus musculus
gtgccaaagtgtaaaagctagctct

SEQ ID NO: 703425 - DNA, 25 bp, Mus musculus
gtgccaaagtgttaaagctagctct

SEQ ID NO: 703426 - DNA, 25 bp, Mus musculus
gtgccaaagttcattaaaatgcata

SEQ ID NO: 703427 - DNA, 25 bp, Mus musculus
gtgccaaagttctttaaaatgcata

SEQ ID NO: 703428 - DNA, 25 bp, Mus musculus
gtgccaaagttgagacaatcctgtc

SEQ ID NO: 703429 - DNA, 25 bp, Mus musculus
gtgccaaagttgtgacaatcctgtc

SEQ ID NO: 703430 - DNA, 25 bp, Mus musculus
gtgccaaatactccaacttcaaatg

SEQ ID NO: 703431 - DNA, 25 bp, Mus musculus
gtgccaaatactgcaacttcaaatg

SEQ ID NO: 703432 - DNA, 25 bp, Mus musculus
gtgccaaatggcctcagtccatgtg

SEQ ID NO: 703433 - DNA, 25 bp, Mus musculus
gtgccaaatggcgtcagtccatgtg

SEQ ID NO: 703434 - DNA, 25 bp, Mus musculus
gtgccaacaatgatgaaggtaaagg

SEQ ID NO: 703435 - DNA, 25 bp, Mus musculus
gtgccaacaatgttgaaggtaaagg

SEQ ID NO: 703436 - DNA, 25 bp, Mus musculus
gtgccaacagccaatgaagagacag

SEQ ID NO: 703437 - DNA, 25 bp, Mus musculus
gtgccaacagccacactttgtaatt

SEQ ID NO: 703438 - DNA, 25 bp, Mus musculus
gtgccaacagcccagaattgtcact

SEQ ID NO: 703439 - DNA, 25 bp, Mus musculus
gtgccaacagccgagaattgtcact

SEQ ID NO: 703440 - DNA, 25 bp, Mus musculus
gtgccaacagcctatgaagagacag

SEQ ID NO: 703441 - DNA, 25 bp, Mus musculus
gtgccaacagcctcactttgtaatt

SEQ ID NO: 703442 - DNA, 25 bp, Mus musculus
gtgccaacccagctgtatgactaag

SEQ ID NO: 703443 - DNA, 25 bp, Mus musculus
gtgccaacccaggtgtatgactaag

SEQ ID NO: 703444 - DNA, 25 bp, Mus musculus
gtgccaaccctacgtaattggtcct

SEQ ID NO: 703445 - DNA, 25 bp, Mus musculus
gtgccaaccctaggtaattggtcct

SEQ ID NO: 703446 - DNA, 25 bp, Mus musculus
gtgccaaccggcaaattcatcaaac

SEQ ID NO: 703447 - DNA, 25 bp, Mus musculus
gtgccaaccggctaattcatcaaac

SEQ ID NO: 703448 - DNA, 25 bp, Mus musculus
gtgccaacctatcacaagattgcag

SEQ ID NO: 703449 - DNA, 25 bp, Mus musculus
gtgccaacctatgacaagattgcag

SEQ ID NO: 703450 - DNA, 25 bp, Mus musculus
gtgccaacctggaacaagactgatt

SEQ ID NO: 703451 - DNA, 25 bp, Mus musculus
gtgccaacctggagtgatggtcttc

SEQ ID NO: 703452 - DNA, 25 bp, Mus musculus
gtgccaacctggtacaagactgatt

SEQ ID NO: 703453 - DNA, 25 bp, Mus musculus
gtgccaacctggtgtgatggtcttc

SEQ ID NO: 703454 - DNA, 25 bp, Mus musculus
gtgccaacgcatatcgtgtctgaga

SEQ ID NO: 703455 - DNA, 25 bp, Mus musculus
gtgccaacgcatttcgtgtctgaga

SEQ ID NO: 703456 - DNA, 25 bp, Mus musculus
gtgccaacgctaataaatctctctt

SEQ ID NO: 703457 - DNA, 25 bp, Mus musculus
gtgccaacgctattaaatctctctt

SEQ ID NO: 703458 - DNA, 25 bp, Mus musculus
gtgccaacgtctactacgctatgag

SEQ ID NO: 703459 - DNA, 25 bp, Mus musculus
gtgccaacgtcttctacgctatgag

SEQ ID NO: 703460 - DNA, 25 bp, Mus musculus
gtgccaactcagcatagatcctgtc

SEQ ID NO: 703461 - DNA, 25 bp, Mus musculus
gtgccaactcaggatagatcctgtc

SEQ ID NO: 703462 - DNA, 25 bp, Mus musculus
gtgccaactcttctgaaaccaacct

SEQ ID NO: 703463 - DNA, 25 bp, Mus musculus
gtgccaactcttgtgaaaccaacct

SEQ ID NO: 703464 - DNA, 25 bp, Mus musculus
gtgccaagactaatcctgtacagaa

SEQ ID NO: 703465 - DNA, 25 bp, Mus musculus
gtgccaagactattcctgtacagaa

SEQ ID NO: 703466 - DNA, 25 bp, Mus musculus
gtgccaagagctcgcctcgattcaa

SEQ ID NO: 703467 - DNA, 25 bp, Mus musculus
gtgccaagagctggcctcgattcaa

SEQ ID NO: 703468 - DNA, 25 bp, Mus musculus
gtgccaagaggcaagttctgaccca

SEQ ID NO: 703469 - DNA, 25 bp, Mus musculus
gtgccaagaggctagttctgaccca

SEQ ID NO: 703470 - DNA, 25 bp, Mus musculus
gtgccaagagtaattttccactaca

SEQ ID NO: 703471 - DNA, 25 bp, Mus musculus
gtgccaagagtatttttccactaca

SEQ ID NO: 703472 - DNA, 25 bp, Mus musculus
gtgccaagcaaaacatcaccgcagt

SEQ ID NO: 703473 - DNA, 25 bp, Mus musculus
gtgccaagcaaatcatcaccgcagt

SEQ ID NO: 703474 - DNA, 25 bp, Mus musculus
gtgccaagcaagaacaattcgtgca

SEQ ID NO: 703475 - DNA, 25 bp, Mus musculus
gtgccaagcaagtacaattcgtgca

SEQ ID NO: 703476 - DNA, 25 bp, Mus musculus
gtgccaagcatccaggaccagtcca

SEQ ID NO: 703477 - DNA, 25 bp, Mus musculus
gtgccaagcatcgaggaccagtcca

SEQ ID NO: 703478 - DNA, 25 bp, Mus musculus
gtgccaagccagctcctcaaatgaa

SEQ ID NO: 703479 - DNA, 25 bp, Mus musculus
gtgccaagccaggtcctcaaatgaa

SEQ ID NO: 703480 - DNA, 25 bp, Mus musculus
gtgccaagccatacattccaagtta

SEQ ID NO: 703481 - DNA, 25 bp, Mus musculus
gtgccaagccattcattccaagtta

SEQ ID NO: 703482 - DNA, 25 bp, Mus musculus
gtgccaagcctcattgcatactgaa

SEQ ID NO: 703483 - DNA, 25 bp, Mus musculus
gtgccaagcctctttgcatactgaa

SEQ ID NO: 703484 - DNA, 25 bp, Mus musculus
gtgccaagccttataaatgctccca

SEQ ID NO: 703485 - DNA, 25 bp, Mus musculus
gtgccaagccttttaaatgctccca

SEQ ID NO: 703486 - DNA, 25 bp, Mus musculus
gtgccaagctcacgcctcagaaggt

SEQ ID NO: 703487 - DNA, 25 bp, Mus musculus
gtgccaagctcaggcctcagaaggt

SEQ ID NO: 703488 - DNA, 25 bp, Mus musculus
gtgccaagctctatacctactgaga

SEQ ID NO: 703489 - DNA, 25 bp, Mus musculus
gtgccaagctctttacctactgaga

SEQ ID NO: 703490 - DNA, 25 bp, Mus musculus
gtgccaaggacacatcagcctgaga

SEQ ID NO: 703491 - DNA, 25 bp, Mus musculus
gtgccaaggacagatcagcctgaga

SEQ ID NO: 703492 - DNA, 25 bp, Mus musculus
gtgccaaggatacctaaggtttttt

SEQ ID NO: 703493 - DNA, 25 bp, Mus musculus
gtgccaaggatagctaaggtttttt

SEQ ID NO: 703494 - DNA, 25 bp, Mus musculus
gtgccaaggatcatgctgcagacag

SEQ ID NO: 703495 - DNA, 25 bp, Mus musculus
gtgccaaggatcttgctgcagacag

SEQ ID NO: 703496 - DNA, 25 bp, Mus musculus
gtgccaaggattctgctgaaggtca

SEQ ID NO: 703497 - DNA, 25 bp, Mus musculus
gtgccaaggattgtgctgaaggtca

SEQ ID NO: 703498 - DNA, 25 bp, Mus musculus
gtgccaaggcttacctgtttatcaa

SEQ ID NO: 703499 - DNA, 25 bp, Mus musculus
gtgccaaggctttcctgtttatcaa

SEQ ID NO: 703500 - DNA, 25 bp, Mus musculus
gtgccaagggtaatttaccactact

SEQ ID NO: 703501 - DNA, 25 bp, Mus musculus
gtgccaagggtattttaccactact

SEQ ID NO: 703502 - DNA, 25 bp, Mus musculus
gtgccaagggttattgtctctgttc

SEQ ID NO: 703503 - DNA, 25 bp, Mus musculus
gtgccaagggtttttgtctctgttc

SEQ ID NO: 703504 - DNA, 25 bp, Mus musculus
gtgccaaggtccctgggaaccgcaa

SEQ ID NO: 703505 - DNA, 25 bp, Mus musculus
gtgccaaggtccgtgggaaccgcaa

SEQ ID NO: 703506 - DNA, 25 bp, Mus musculus
gtgccaaggttacatgataaggtcc

SEQ ID NO: 703507 - DNA, 25 bp, Mus musculus
gtgccaaggttagatgataaggtcc

SEQ ID NO: 703508 - DNA, 25 bp, Mus musculus
gtgccaagtagcctgcctccggatt

SEQ ID NO: 703509 - DNA, 25 bp, Mus musculus
gtgccaagtagcgtgcctccggatt

SEQ ID NO: 703510 - DNA, 25 bp, Mus musculus
gtgccaagtggcatcggcagcgtcc

SEQ ID NO: 703511 - DNA, 25 bp, Mus musculus
gtgccaagtggcttcggcagcgtcc

SEQ ID NO: 703512 - DNA, 25 bp, Mus musculus
gtgccaagttggcttcctttaactg

SEQ ID NO: 703513 - DNA, 25 bp, Mus musculus
gtgccaagttgggttcctttaactg

SEQ ID NO: 703514 - DNA, 25 bp, Mus musculus
gtgccaataactacgcaatgaaagg

SEQ ID NO: 703515 - DNA, 25 bp, Mus musculus
gtgccaataacttcgcaatgaaagg

SEQ ID NO: 703516 - DNA, 25 bp, Mus musculus
gtgccaataatcaatgtccctgcct

SEQ ID NO: 703517 - DNA, 25 bp, Mus musculus
gtgccaataatctatgtccctgcct

SEQ ID NO: 703518 - DNA, 25 bp, Mus musculus
gtgccaataatgaccctggagtcaa

SEQ ID NO: 703519 - DNA, 25 bp, Mus musculus
gtgccaataatgtccctggagtcaa

SEQ ID NO: 703520 - DNA, 25 bp, Mus musculus
gtgccaatgccccactctttggcat

SEQ ID NO: 703521 - DNA, 25 bp, Mus musculus
gtgccaatgcccgactctttggcat

SEQ ID NO: 703522 - DNA, 25 bp, Mus musculus
gtgccaatggcacaactcagtgcta

SEQ ID NO: 703523 - DNA, 25 bp, Mus musculus
gtgccaatggcagaactcagtgcta

SEQ ID NO: 703524 - DNA, 25 bp, Mus musculus
gtgccaatggccatctcatttacaa

SEQ ID NO: 703525 - DNA, 25 bp, Mus musculus
gtgccaatggccttctcatttacaa

SEQ ID NO: 703526 - DNA, 25 bp, Mus musculus
gtgccaatggttacccaatcacata

SEQ ID NO: 703527 - DNA, 25 bp, Mus musculus
gtgccaatggtttcccaatcacata

SEQ ID NO: 703528 - DNA, 25 bp, Mus musculus
gtgccaatgtatacaaccaaccgtc

SEQ ID NO: 703529 - DNA, 25 bp, Mus musculus
gtgccaatgtattcaaccaaccgtc

SEQ ID NO: 703530 - DNA, 25 bp, Mus musculus
gtgccaatgtctaatctctctggaa

SEQ ID NO: 703531 - DNA, 25 bp, Mus musculus
gtgccaatgtctctgggccaagcat

SEQ ID NO: 703532 - DNA, 25 bp, Mus musculus
gtgccaatgtctgtgggccaagcat

SEQ ID NO: 703533 - DNA, 25 bp, Mus musculus
gtgccaatgtcttatctctctggaa

SEQ ID NO: 703534 - DNA, 25 bp, Mus musculus
gtgccaatgtggcaaataaagaact

SEQ ID NO: 703535 - DNA, 25 bp, Mus musculus
gtgccaatgtgggaaataaagaact

SEQ ID NO: 703536 - DNA, 25 bp, Mus musculus
gtgccaattacgagacccatctgag

SEQ ID NO: 703537 - DNA, 25 bp, Mus musculus
gtgccaattacgtgacccatctgag

SEQ ID NO: 703538 - DNA, 25 bp, Mus musculus
gtgccaattgcaaccgacctttggt

SEQ ID NO: 703539 - DNA, 25 bp, Mus musculus
gtgccaattgcatccgacctttggt

SEQ ID NO: 703540 - DNA, 25 bp, Mus musculus
gtgccaatttatatatagtcaagtg

SEQ ID NO: 703541 - DNA, 25 bp, Mus musculus
gtgccaatttatttatagtcaagtg

SEQ ID NO: 703542 - DNA, 25 bp, Mus musculus
gtgccacaagcaactcatctcaaac

SEQ ID NO: 703543 - DNA, 25 bp, Mus musculus
gtgccacaagcacccaagtgcggta

SEQ ID NO: 703544 - DNA, 25 bp, Mus musculus
gtgccacaagcagccaagtgcggta

SEQ ID NO: 703545 - DNA, 25 bp, Mus musculus
gtgccacaagcatctcatctcaaac

SEQ ID NO: 703546 - DNA, 25 bp, Mus musculus
gtgccacacagaacagccaagctgg

SEQ ID NO: 703547 - DNA, 25 bp, Mus musculus
gtgccacacagatcagccaagctgg

SEQ ID NO: 703548 - DNA, 25 bp, Mus musculus
gtgccacaccacatcatgtattttt

SEQ ID NO: 703549 - DNA, 25 bp, Mus musculus
gtgccacaccacttcatgtattttt

SEQ ID NO: 703550 - DNA, 25 bp, Mus musculus
gtgccacaccccaatactaattatg

SEQ ID NO: 703551 - DNA, 25 bp, Mus musculus
gtgccacacccctatactaattatg

SEQ ID NO: 703552 - DNA, 25 bp, Mus musculus
gtgccacacgtgataggcgtctatc

SEQ ID NO: 703553 - DNA, 25 bp, Mus musculus
gtgccacacgtgttaggcgtctatc

SEQ ID NO: 703554 - DNA, 25 bp, Mus musculus
gtgccacactcaagtacacttatgt

SEQ ID NO: 703555 - DNA, 25 bp, Mus musculus
gtgccacactcatgtacacttatgt

SEQ ID NO: 703556 - DNA, 25 bp, Mus musculus
gtgccacactggatacgaatctccg

SEQ ID NO: 703557 - DNA, 25 bp, Mus musculus
gtgccacactggttacgaatctccg

SEQ ID NO: 703558 - DNA, 25 bp, Mus musculus
gtgccacagagtagctcctcacaaa

SEQ ID NO: 703559 - DNA, 25 bp, Mus musculus
gtgccacagagttgctcctcacaaa

SEQ ID NO: 703560 - DNA, 25 bp, Mus musculus
gtgccacagcagcttgcgccagaga

SEQ ID NO: 703561 - DNA, 25 bp, Mus musculus
gtgccacagcaggttgcgccagaga

SEQ ID NO: 703562 - DNA, 25 bp, Mus musculus
gtgccacagcccaggtggcctgcaa

SEQ ID NO: 703563 - DNA, 25 bp, Mus musculus
gtgccacagccctggtggcctgcaa

SEQ ID NO: 703564 - DNA, 25 bp, Mus musculus
gtgccacagtgtacattggttcagt

SEQ ID NO: 703565 - DNA, 25 bp, Mus musculus
gtgccacagtgttcattggttcagt

SEQ ID NO: 703566 - DNA, 25 bp, Mus musculus
gtgccacagttcaggctcgtgaatg

SEQ ID NO: 703567 - DNA, 25 bp, Mus musculus
gtgccacagttctggctcgtgaatg

SEQ ID NO: 703568 - DNA, 25 bp, Mus musculus
gtgccacagtttctagtttctcaat

SEQ ID NO: 703569 - DNA, 25 bp, Mus musculus
gtgccacagtttgtagtttctcaat

SEQ ID NO: 703570 - DNA, 25 bp, Mus musculus
gtgccacataagaccagggtgctga

SEQ ID NO: 703571 - DNA, 25 bp, Mus musculus
gtgccacataagtccagggtgctga

SEQ ID NO: 703572 - DNA, 25 bp, Mus musculus
gtgccacatcgaaccatggccaaat

SEQ ID NO: 703573 - DNA, 25 bp, Mus musculus
gtgccacatcgatccatggccaaat

SEQ ID NO: 703574 - DNA, 25 bp, Mus musculus
gtgccacatctgctgagctctgtaa

SEQ ID NO: 703575 - DNA, 25 bp, Mus musculus
gtgccacatctggtgagctctgtaa

SEQ ID NO: 703576 - DNA, 25 bp, Mus musculus
gtgccacatgcaagatttacccttt

SEQ ID NO: 703577 - DNA, 25 bp, Mus musculus
gtgccacatgcatgatttacccttt

SEQ ID NO: 703578 - DNA, 25 bp, Mus musculus
gtgccacatgccctttgaagatctt

SEQ ID NO: 703579 - DNA, 25 bp, Mus musculus
gtgccacatgccgtttgaagatctt

SEQ ID NO: 703580 - DNA, 25 bp, Mus musculus
gtgccacattccacacagcaggtgt

SEQ ID NO: 703581 - DNA, 25 bp, Mus musculus
gtgccacattcctcacagcaggtgt

SEQ ID NO: 703582 - DNA, 25 bp, Mus musculus
gtgccacattgcatgggtcttgata

SEQ ID NO: 703583 - DNA, 25 bp, Mus musculus
gtgccacattgcttgggtcttgata

SEQ ID NO: 703584 - DNA, 25 bp, Mus musculus
gtgccaccaactataactgactatc

SEQ ID NO: 703585 - DNA, 25 bp, Mus musculus
gtgccaccaactttaactgactatc

SEQ ID NO: 703586 - DNA, 25 bp, Mus musculus
gtgccaccaccaatcagatctaaaa

SEQ ID NO: 703587 - DNA, 25 bp, Mus musculus
gtgccaccaccattcagatctaaaa

SEQ ID NO: 703588 - DNA, 25 bp, Mus musculus
gtgccaccacccaagctgtgaagaa

SEQ ID NO: 703589 - DNA, 25 bp, Mus musculus
gtgccaccacccatacgatatggac

SEQ ID NO: 703590 - DNA, 25 bp, Mus musculus
gtgccaccaccctagctgtgaagaa

SEQ ID NO: 703591 - DNA, 25 bp, Mus musculus
gtgccaccacccttacgatatggac

SEQ ID NO: 703592 - DNA, 25 bp, Mus musculus
gtgccaccacgcctagctaaaggat

SEQ ID NO: 703593 - DNA, 25 bp, Mus musculus
gtgccaccacgcgtagctaaaggat

SEQ ID NO: 703594 - DNA, 25 bp, Mus musculus
gtgccaccagcaagagagtgaggct

SEQ ID NO: 703595 - DNA, 25 bp, Mus musculus
gtgccaccagcatgagagtgaggct

SEQ ID NO: 703596 - DNA, 25 bp, Mus musculus
gtgccaccatatctcaatcatctga

SEQ ID NO: 703597 - DNA, 25 bp, Mus musculus
gtgccaccatatgtcaatcatctga

SEQ ID NO: 703598 - DNA, 25 bp, Mus musculus
gtgccaccatggatctggattgtga

SEQ ID NO: 703599 - DNA, 25 bp, Mus musculus
gtgccaccatggttctggattgtga

SEQ ID NO: 703600 - DNA, 25 bp, Mus musculus
gtgccaccccaccagatgtgatgag

SEQ ID NO: 703601 - DNA, 25 bp, Mus musculus
gtgccaccccacgagatgtgatgag

SEQ ID NO: 703602 - DNA, 25 bp, Mus musculus
gtgccaccgaagagccctttaaata

SEQ ID NO: 703603 - DNA, 25 bp, Mus musculus
gtgccaccgaagtgccctttaaata

SEQ ID NO: 703604 - DNA, 25 bp, Mus musculus
gtgccaccgaatatccaaagtgtac

SEQ ID NO: 703605 - DNA, 25 bp, Mus musculus
gtgccaccgaatttccaaagtgtac

SEQ ID NO: 703606 - DNA, 25 bp, Mus musculus
gtgccaccgtcaactggattcagaa

SEQ ID NO: 703607 - DNA, 25 bp, Mus musculus
gtgccaccgtcatctggattcagaa

SEQ ID NO: 703608 - DNA, 25 bp, Mus musculus
gtgccaccgtgcagctttgtcgtta

SEQ ID NO: 703609 - DNA, 25 bp, Mus musculus
gtgccaccgtgcatcatgacatgat

SEQ ID NO: 703610 - DNA, 25 bp, Mus musculus
gtgccaccgtgctgctttgtcgtta

SEQ ID NO: 703611 - DNA, 25 bp, Mus musculus
gtgccaccgtgcttcatgacatgat

SEQ ID NO: 703612 - DNA, 25 bp, Mus musculus
gtgccacctcctaagagccaattaa

SEQ ID NO: 703613 - DNA, 25 bp, Mus musculus
gtgccacctccttagagccaattaa

SEQ ID NO: 703614 - DNA, 25 bp, Mus musculus
gtgccacctgctcagagaactttat

SEQ ID NO: 703615 - DNA, 25 bp, Mus musculus
gtgccacctgctcgtaagacgcaga

SEQ ID NO: 703616 - DNA, 25 bp, Mus musculus
gtgccacctgctgagagaactttat

SEQ ID NO: 703617 - DNA, 25 bp, Mus musculus
gtgccacctgctggtaagacgcaga

SEQ ID NO: 703618 - DNA, 25 bp, Mus musculus
gtgccacctgtgaagcaagtttttt

SEQ ID NO: 703619 - DNA, 25 bp, Mus musculus
gtgccacctgtgtagcaagtttttt

SEQ ID NO: 703620 - DNA, 25 bp, Mus musculus
gtgccacggaaactcaggccagaca

SEQ ID NO: 703621 - DNA, 25 bp, Mus musculus
gtgccacggaaagtcaggccagaca

SEQ ID NO: 703622 - DNA, 25 bp, Mus musculus
gtgccacggctgcaaaatgagctgt

SEQ ID NO: 703623 - DNA, 25 bp, Mus musculus
gtgccacggctggaaaatgagctgt

SEQ ID NO: 703624 - DNA, 25 bp, Mus musculus
gtgccacgtgaacctgacattaaga

SEQ ID NO: 703625 - DNA, 25 bp, Mus musculus
gtgccacgtgaagctgacattaaga

SEQ ID NO: 703626 - DNA, 25 bp, Mus musculus
gtgccactaacacttaaatgtgagt

SEQ ID NO: 703627 - DNA, 25 bp, Mus musculus
gtgccactaacagttaaatgtgagt

SEQ ID NO: 703628 - DNA, 25 bp, Mus musculus
gtgccactacctcgctttaaagact

SEQ ID NO: 703629 - DNA, 25 bp, Mus musculus
gtgccactacctggctttaaagact

SEQ ID NO: 703630 - DNA, 25 bp, Mus musculus
gtgccactacgcactgtttataaaa

SEQ ID NO: 703631 - DNA, 25 bp, Mus musculus
gtgccactacgctctgtttataaaa

SEQ ID NO: 703632 - DNA, 25 bp, Mus musculus
gtgccactacggaatctttaggctt

SEQ ID NO: 703633 - DNA, 25 bp, Mus musculus
gtgccactacggtatctttaggctt

SEQ ID NO: 703634 - DNA, 25 bp, Mus musculus
gtgccactagaaagtttgctagata

SEQ ID NO: 703635 - DNA, 25 bp, Mus musculus
gtgccactagaatgtttgctagata

SEQ ID NO: 703636 - DNA, 25 bp, Mus musculus
gtgccactagagaacatctgaaggg

SEQ ID NO: 703637 - DNA, 25 bp, Mus musculus
gtgccactagagtacatctgaaggg

SEQ ID NO: 703638 - DNA, 25 bp, Mus musculus
gtgccactcactcctaagacgaata

SEQ ID NO: 703639 - DNA, 25 bp, Mus musculus
gtgccactcactgctaagacgaata

SEQ ID NO: 703640 - DNA, 25 bp, Mus musculus
gtgccactcagcaacgaagctgaca

SEQ ID NO: 703641 - DNA, 25 bp, Mus musculus
gtgccactcagctacgaagctgaca

SEQ ID NO: 703642 - DNA, 25 bp, Mus musculus
gtgccactcatgaaccgggtatttt

SEQ ID NO: 703643 - DNA, 25 bp, Mus musculus
gtgccactcatgtaccgggtatttt

SEQ ID NO: 703644 - DNA, 25 bp, Mus musculus
gtgccactcggcaaaccagagcctg

SEQ ID NO: 703645 - DNA, 25 bp, Mus musculus
gtgccactcggctaaccagagcctg

SEQ ID NO: 703646 - DNA, 25 bp, Mus musculus
gtgccactgattaagccacatgaac

SEQ ID NO: 703647 - DNA, 25 bp, Mus musculus
gtgccactgatttagccacatgaac

SEQ ID NO: 703648 - DNA, 25 bp, Mus musculus
gtgccactgcatcatagtatgctcg

SEQ ID NO: 703649 - DNA, 25 bp, Mus musculus
gtgccactgcatgatagtatgctcg

SEQ ID NO: 703650 - DNA, 25 bp, Mus musculus
gtgccactgctgaacctgatgtatc

SEQ ID NO: 703651 - DNA, 25 bp, Mus musculus
gtgccactgctgtacctgatgtatc

SEQ ID NO: 703652 - DNA, 25 bp, Mus musculus
gtgccactgcttatgtatagagatc

SEQ ID NO: 703653 - DNA, 25 bp, Mus musculus
gtgccactgcttttgtatagagatc

SEQ ID NO: 703654 - DNA, 25 bp, Mus musculus
gtgccacttagtagagagctttttt

SEQ ID NO: 703655 - DNA, 25 bp, Mus musculus
gtgccacttagtctatgtcaccaga

SEQ ID NO: 703656 - DNA, 25 bp, Mus musculus
gtgccacttagtgtatgtcaccaga

SEQ ID NO: 703657 - DNA, 25 bp, Mus musculus
gtgccacttagttgagagctttttt

SEQ ID NO: 703658 - DNA, 25 bp, Mus musculus
gtgccacttgcaaaagacagagtca

SEQ ID NO: 703659 - DNA, 25 bp, Mus musculus
gtgccacttgcataagacagagtca

SEQ ID NO: 703660 - DNA, 25 bp, Mus musculus
gtgccacttggacaccgtatttaca

SEQ ID NO: 703661 - DNA, 25 bp, Mus musculus
gtgccacttggagaccgtatttaca

SEQ ID NO: 703662 - DNA, 25 bp, Mus musculus
gtgccacttggcaatggtgctgcaa

SEQ ID NO: 703663 - DNA, 25 bp, Mus musculus
gtgccacttggctatggtgctgcaa

SEQ ID NO: 703664 - DNA, 25 bp, Mus musculus
gtgccagaaactacggtttcgtcca

SEQ ID NO: 703665 - DNA, 25 bp, Mus musculus
gtgccagaaacttcggtttcgtcca

SEQ ID NO: 703666 - DNA, 25 bp, Mus musculus
gtgccagaagtgaccccaaatcaga

SEQ ID NO: 703667 - DNA, 25 bp, Mus musculus
gtgccagaagtgtccccaaatcaga

SEQ ID NO: 703668 - DNA, 25 bp, Mus musculus
gtgccagaagttatatgtccctacc

SEQ ID NO: 703669 - DNA, 25 bp, Mus musculus
gtgccagaagttttatgtccctacc

SEQ ID NO: 703670 - DNA, 25 bp, Mus musculus
gtgccagaatttccttcttcgtgaa

SEQ ID NO: 703671 - DNA, 25 bp, Mus musculus
gtgccagaatttgcttcttcgtgaa

SEQ ID NO: 703672 - DNA, 25 bp, Mus musculus
gtgccagaccagagcctctcaaaga

SEQ ID NO: 703673 - DNA, 25 bp, Mus musculus
gtgccagaccagtgcctctcaaaga

SEQ ID NO: 703674 - DNA, 25 bp, Mus musculus
gtgccagaccgcagagacagtgctg

SEQ ID NO: 703675 - DNA, 25 bp, Mus musculus
gtgccagaccgctgagacagtgctg

SEQ ID NO: 703676 - DNA, 25 bp, Mus musculus
gtgccagagaacaccacataccttg

SEQ ID NO: 703677 - DNA, 25 bp, Mus musculus
gtgccagagaactccacataccttg

SEQ ID NO: 703678 - DNA, 25 bp, Mus musculus
gtgccagaggaaattgcccagtaat

SEQ ID NO: 703679 - DNA, 25 bp, Mus musculus
gtgccagaggaatttgcccagtaat

SEQ ID NO: 703680 - DNA, 25 bp, Mus musculus
gtgccagaggcgcagttcttaagct

SEQ ID NO: 703681 - DNA, 25 bp, Mus musculus
gtgccagaggcggagttcttaagct

SEQ ID NO: 703682 - DNA, 25 bp, Mus musculus
gtgccagagggaaatcctgctccag

SEQ ID NO: 703683 - DNA, 25 bp, Mus musculus
gtgccagagggacccatattgccaa

SEQ ID NO: 703684 - DNA, 25 bp, Mus musculus
gtgccagagggagccatattgccaa

SEQ ID NO: 703685 - DNA, 25 bp, Mus musculus
gtgccagagggatatcctgctccag

SEQ ID NO: 703686 - DNA, 25 bp, Mus musculus
gtgccagagtaaattccattccttt

SEQ ID NO: 703687 - DNA, 25 bp, Mus musculus
gtgccagagtaatttccattccttt

SEQ ID NO: 703688 - DNA, 25 bp, Mus musculus
gtgccagagtctctgacccagcaga

SEQ ID NO: 703689 - DNA, 25 bp, Mus musculus
gtgccagagtctgtgacccagcaga

SEQ ID NO: 703690 - DNA, 25 bp, Mus musculus
gtgccagagtttacagtttagccag

SEQ ID NO: 703691 - DNA, 25 bp, Mus musculus
gtgccagagttttcagtttagccag

SEQ ID NO: 703692 - DNA, 25 bp, Mus musculus
gtgccagatcggcttggaatcctca

SEQ ID NO: 703693 - DNA, 25 bp, Mus musculus
gtgccagatcgggttggaatcctca

SEQ ID NO: 703694 - DNA, 25 bp, Mus musculus
gtgccagatgctctttgttgctatc

SEQ ID NO: 703695 - DNA, 25 bp, Mus musculus
gtgccagatgctgtttgttgctatc

SEQ ID NO: 703696 - DNA, 25 bp, Mus musculus
gtgccagattcgaaagctattgcta

SEQ ID NO: 703697 - DNA, 25 bp, Mus musculus
gtgccagattcgtaagctattgcta

SEQ ID NO: 703698 - DNA, 25 bp, Mus musculus
gtgccagcaccaaatagcatgttta

SEQ ID NO: 703699 - DNA, 25 bp, Mus musculus
gtgccagcaccatatagcatgttta

SEQ ID NO: 703700 - DNA, 25 bp, Mus musculus
gtgccagcacttcgctcataaagtt

SEQ ID NO: 703701 - DNA, 25 bp, Mus musculus
gtgccagcacttggctcataaagtt

SEQ ID NO: 703702 - DNA, 25 bp, Mus musculus
gtgccagcagggatattgtgattac

SEQ ID NO: 703703 - DNA, 25 bp, Mus musculus
gtgccagcagggttattgtgattac

SEQ ID NO: 703704 - DNA, 25 bp, Mus musculus
gtgccagcatctacttgggaggagt

SEQ ID NO: 703705 - DNA, 25 bp, Mus musculus
gtgccagcatcttcttgggaggagt

SEQ ID NO: 703706 - DNA, 25 bp, Mus musculus
gtgccagcattcaccgtgtgcatat

SEQ ID NO: 703707 - DNA, 25 bp, Mus musculus
gtgccagcattctccgtgtgcatat

SEQ ID NO: 703708 - DNA, 25 bp, Mus musculus
gtgccagcatttaaagctccttaag

SEQ ID NO: 703709 - DNA, 25 bp, Mus musculus
gtgccagcattttaagctccttaag

SEQ ID NO: 703710 - DNA, 25 bp, Mus musculus
gtgccagccaaaatacctgaaattg

SEQ ID NO: 703711 - DNA, 25 bp, Mus musculus
gtgccagccaaattacctgaaattg

SEQ ID NO: 703712 - DNA, 25 bp, Mus musculus
gtgccagccaagcataccatcatgg

SEQ ID NO: 703713 - DNA, 25 bp, Mus musculus
gtgccagccaaggataccatcatgg

SEQ ID NO: 703714 - DNA, 25 bp, Mus musculus
gtgccagcccacatggtcaaagata

SEQ ID NO: 703715 - DNA, 25 bp, Mus musculus
gtgccagcccacttggtcaaagata

SEQ ID NO: 703716 - DNA, 25 bp, Mus musculus
gtgccagcctggaatctcaatgtca

SEQ ID NO: 703717 - DNA, 25 bp, Mus musculus
gtgccagcctggtatctcaatgtca

SEQ ID NO: 703718 - DNA, 25 bp, Mus musculus
gtgccagcgactacctgaagatcaa

SEQ ID NO: 703719 - DNA, 25 bp, Mus musculus
gtgccagcgacttcctgaagatcaa

SEQ ID NO: 703720 - DNA, 25 bp, Mus musculus
gtgccagcgcacagagatgattaag

SEQ ID NO: 703721 - DNA, 25 bp, Mus musculus
gtgccagcgcactgagatgattaag

SEQ ID NO: 703722 - DNA, 25 bp, Mus musculus
gtgccagctcgaaggcgattcaaac

SEQ ID NO: 703723 - DNA, 25 bp, Mus musculus
gtgccagctcgatggcgattcaaac

SEQ ID NO: 703724 - DNA, 25 bp, Mus musculus
gtgccagctgctaacgagattttca

SEQ ID NO: 703725 - DNA, 25 bp, Mus musculus
gtgccagctgcttacgagattttca

SEQ ID NO: 703726 - DNA, 25 bp, Mus musculus
gtgccagctgtaagcccagaaaggt

SEQ ID NO: 703727 - DNA, 25 bp, Mus musculus
gtgccagctgtatgcccagaaaggt

SEQ ID NO: 703728 - DNA, 25 bp, Mus musculus
gtgccagctgtcactcatataggac

SEQ ID NO: 703729 - DNA, 25 bp, Mus musculus
gtgccagctgtctctcatataggac

SEQ ID NO: 703730 - DNA, 25 bp, Mus musculus
gtgccagctgttaggcttcagtgga

SEQ ID NO: 703731 - DNA, 25 bp, Mus musculus
gtgccagctgtttggcttcagtgga

SEQ ID NO: 703732 - DNA, 25 bp, Mus musculus
gtgccagcttccatgagggagactc

SEQ ID NO: 703733 - DNA, 25 bp, Mus musculus
gtgccagcttccttgagggagactc

SEQ ID NO: 703734 - DNA, 25 bp, Mus musculus
gtgccaggaacaccatgccagcagc

SEQ ID NO: 703735 - DNA, 25 bp, Mus musculus
gtgccaggaacagcatgccagcagc

SEQ ID NO: 703736 - DNA, 25 bp, Mus musculus
gtgccaggaactattaccattctgt

SEQ ID NO: 703737 - DNA, 25 bp, Mus musculus
gtgccaggaacttttaccattctgt

SEQ ID NO: 703738 - DNA, 25 bp, Mus musculus
gtgccaggacatataaccccgggat

SEQ ID NO: 703739 - DNA, 25 bp, Mus musculus
gtgccaggacatttaaccccgggat

SEQ ID NO: 703740 - DNA, 25 bp, Mus musculus
gtgccaggatgcagtccatgttcag

SEQ ID NO: 703741 - DNA, 25 bp, Mus musculus
gtgccaggatgctgtccatgttcag

SEQ ID NO: 703742 - DNA, 25 bp, Mus musculus
gtgccaggcacaatctggcccctgg

SEQ ID NO: 703743 - DNA, 25 bp, Mus musculus
gtgccaggcacattctggcccctgg

SEQ ID NO: 703744 - DNA, 25 bp, Mus musculus
gtgccaggcactccaggaacggtaa

SEQ ID NO: 703745 - DNA, 25 bp, Mus musculus
gtgccaggcactgcaggaacggtaa

SEQ ID NO: 703746 - DNA, 25 bp, Mus musculus
gtgccaggcagacctagtctacaga

SEQ ID NO: 703747 - DNA, 25 bp, Mus musculus
gtgccaggcagagctagtctacaga

SEQ ID NO: 703748 - DNA, 25 bp, Mus musculus
gtgccaggcagtagaccgtctttgt

SEQ ID NO: 703749 - DNA, 25 bp, Mus musculus
gtgccaggcagtatttgtgttcgat

SEQ ID NO: 703750 - DNA, 25 bp, Mus musculus
gtgccaggcagttgaccgtctttgt

SEQ ID NO: 703751 - DNA, 25 bp, Mus musculus
gtgccaggcagtttttgtgttcgat

SEQ ID NO: 703752 - DNA, 25 bp, Mus musculus
gtgccaggcatacagttggtgtcta

SEQ ID NO: 703753 - DNA, 25 bp, Mus musculus
gtgccaggcatactggttcctgcca

SEQ ID NO: 703754 - DNA, 25 bp, Mus musculus
gtgccaggcatagagttggtgtcta

SEQ ID NO: 703755 - DNA, 25 bp, Mus musculus
gtgccaggcatagtggttcctgcca

SEQ ID NO: 703756 - DNA, 25 bp, Mus musculus
gtgccaggcattaggcttcagagct

SEQ ID NO: 703757 - DNA, 25 bp, Mus musculus
gtgccaggcatttggcttcagagct

SEQ ID NO: 703758 - DNA, 25 bp, Mus musculus
gtgccaggccaaaatcgaggactta

SEQ ID NO: 703759 - DNA, 25 bp, Mus musculus
gtgccaggccaatatcgaggactta

SEQ ID NO: 703760 - DNA, 25 bp, Mus musculus
gtgccaggctacatgtttgtgtgaa

SEQ ID NO: 703761 - DNA, 25 bp, Mus musculus
gtgccaggctacttgtttgtgtgaa

SEQ ID NO: 703762 - DNA, 25 bp, Mus musculus
gtgccagggacaatagggaattgct

SEQ ID NO: 703763 - DNA, 25 bp, Mus musculus
gtgccagggacattagggaattgct

SEQ ID NO: 703764 - DNA, 25 bp, Mus musculus
gtgccagggagaacagaggactatt

SEQ ID NO: 703765 - DNA, 25 bp, Mus musculus
gtgccagggagactttcctctgctg

SEQ ID NO: 703766 - DNA, 25 bp, Mus musculus
gtgccagggagagtttcctctgctg

SEQ ID NO: 703767 - DNA, 25 bp, Mus musculus
gtgccagggagatcagaggactatt

SEQ ID NO: 703768 - DNA, 25 bp, Mus musculus
gtgccagggctcaagggcgacatcc

SEQ ID NO: 703769 - DNA, 25 bp, Mus musculus
gtgccagggctctagggcgacatcc

SEQ ID NO: 703770 - DNA, 25 bp, Mus musculus
gtgccagggctgagcatactccaga

SEQ ID NO: 703771 - DNA, 25 bp, Mus musculus
gtgccagggctgtgcatactccaga

SEQ ID NO: 703772 - DNA, 25 bp, Mus musculus
gtgccaggggatcaagcctgaataa

SEQ ID NO: 703773 - DNA, 25 bp, Mus musculus
gtgccaggggatgaagcctgaataa

SEQ ID NO: 703774 - DNA, 25 bp, Mus musculus
gtgccagggtcgcatcgggtgactc

SEQ ID NO: 703775 - DNA, 25 bp, Mus musculus
gtgccagggtcggatcgggtgactc

SEQ ID NO: 703776 - DNA, 25 bp, Mus musculus
gtgccagggtgtagagcccgtttct

SEQ ID NO: 703777 - DNA, 25 bp, Mus musculus
gtgccagggtgttgagcccgtttct

SEQ ID NO: 703778 - DNA, 25 bp, Mus musculus
gtgccaggtaggagcgatgcccaat

SEQ ID NO: 703779 - DNA, 25 bp, Mus musculus
gtgccaggtaggtgcgatgcccaat

SEQ ID NO: 703780 - DNA, 25 bp, Mus musculus
gtgccaggtccgcatccgctacatg

SEQ ID NO: 703781 - DNA, 25 bp, Mus musculus
gtgccaggtccggatccgctacatg

SEQ ID NO: 703782 - DNA, 25 bp, Mus musculus
gtgccaggtgtcactcttagaagca

SEQ ID NO: 703783 - DNA, 25 bp, Mus musculus
gtgccaggtgtctctcttagaagca

SEQ ID NO: 703784 - DNA, 25 bp, Mus musculus
gtgccaggtttacagcagtagtcct

SEQ ID NO: 703785 - DNA, 25 bp, Mus musculus
gtgccaggtttagagcagtagtcct

SEQ ID NO: 703786 - DNA, 25 bp, Mus musculus
gtgccagtacttagatcccaaactt

SEQ ID NO: 703787 - DNA, 25 bp, Mus musculus
gtgccagtacttctgtgacacctga

SEQ ID NO: 703788 - DNA, 25 bp, Mus musculus
gtgccagtacttgtgtgacacctga

SEQ ID NO: 703789 - DNA, 25 bp, Mus musculus
gtgccagtactttgatcccaaactt

SEQ ID NO: 703790 - DNA, 25 bp, Mus musculus
gtgccagtccaaatacaacttgtag

SEQ ID NO: 703791 - DNA, 25 bp, Mus musculus
gtgccagtccaattacaacttgtag

SEQ ID NO: 703792 - DNA, 25 bp, Mus musculus
gtgccagtccctcacatatcatgaa

SEQ ID NO: 703793 - DNA, 25 bp, Mus musculus
gtgccagtccctgacatatcatgaa

SEQ ID NO: 703794 - DNA, 25 bp, Mus musculus
gtgccagtccgtagatgaccagcaa

SEQ ID NO: 703795 - DNA, 25 bp, Mus musculus
gtgccagtccgtctgatctttatgt

SEQ ID NO: 703796 - DNA, 25 bp, Mus musculus
gtgccagtccgtgtgatctttatgt

SEQ ID NO: 703797 - DNA, 25 bp, Mus musculus
gtgccagtccgttgatgaccagcaa

SEQ ID NO: 703798 - DNA, 25 bp, Mus musculus
gtgccagtgaccagcgcaagcatga

SEQ ID NO: 703799 - DNA, 25 bp, Mus musculus
gtgccagtgacctgcgcaagcatga

SEQ ID NO: 703800 - DNA, 25 bp, Mus musculus
gtgccagtgcttaggattgttgtct

SEQ ID NO: 703801 - DNA, 25 bp, Mus musculus
gtgccagtgctttggattgttgtct

SEQ ID NO: 703802 - DNA, 25 bp, Mus musculus
gtgccagtggaaacaagagggcatt

SEQ ID NO: 703803 - DNA, 25 bp, Mus musculus
gtgccagtggaatcaagagggcatt

SEQ ID NO: 703804 - DNA, 25 bp, Mus musculus
gtgccagtgtatcaggaattctctt

SEQ ID NO: 703805 - DNA, 25 bp, Mus musculus
gtgccagtgtatctaataaccctct

SEQ ID NO: 703806 - DNA, 25 bp, Mus musculus
gtgccagtgtatgaggaattctctt

SEQ ID NO: 703807 - DNA, 25 bp, Mus musculus
gtgccagtgtatgtaataaccctct

SEQ ID NO: 703808 - DNA, 25 bp, Mus musculus
gtgccagtgtggaaattgcctcccg

SEQ ID NO: 703809 - DNA, 25 bp, Mus musculus
gtgccagtgtggtaattgcctcccg

SEQ ID NO: 703810 - DNA, 25 bp, Mus musculus
gtgccagtgtttaaaatagcgttct

SEQ ID NO: 703811 - DNA, 25 bp, Mus musculus
gtgccagtgttttaaatagcgttct

SEQ ID NO: 703812 - DNA, 25 bp, Mus musculus
gtgccagtttgaacagtacccttat

SEQ ID NO: 703813 - DNA, 25 bp, Mus musculus
gtgccagtttgatcagtacccttat

SEQ ID NO: 703814 - DNA, 25 bp, Mus musculus
gtgccataactcactgcaagcgggc

SEQ ID NO: 703815 - DNA, 25 bp, Mus musculus
gtgccataactctctgcaagcgggc

SEQ ID NO: 703816 - DNA, 25 bp, Mus musculus
gtgccataagccaaggtggacctca

SEQ ID NO: 703817 - DNA, 25 bp, Mus musculus
gtgccataagcctaggtggacctca

SEQ ID NO: 703818 - DNA, 25 bp, Mus musculus
gtgccatacctgagggaacatcgtc

SEQ ID NO: 703819 - DNA, 25 bp, Mus musculus
gtgccatacctgtgggaacatcgtc

SEQ ID NO: 703820 - DNA, 25 bp, Mus musculus
gtgccatacttgagggtttacagag

SEQ ID NO: 703821 - DNA, 25 bp, Mus musculus
gtgccatacttgtgggtttacagag

SEQ ID NO: 703822 - DNA, 25 bp, Mus musculus
gtgccatagattactgtgtgaacca

SEQ ID NO: 703823 - DNA, 25 bp, Mus musculus
gtgccatagatttctgtgtgaacca

SEQ ID NO: 703824 - DNA, 25 bp, Mus musculus
gtgccatagtagatgtacatgcttt

SEQ ID NO: 703825 - DNA, 25 bp, Mus musculus
gtgccatagtagttgtacatgcttt

SEQ ID NO: 703826 - DNA, 25 bp, Mus musculus
gtgccatatactccagagactgtgg

SEQ ID NO: 703827 - DNA, 25 bp, Mus musculus
gtgccatatactgcagagactgtgg

SEQ ID NO: 703828 - DNA, 25 bp, Mus musculus
gtgccatatatgctaaatgatagtt

SEQ ID NO: 703829 - DNA, 25 bp, Mus musculus
gtgccatatatggtaaatgatagtt

SEQ ID NO: 703830 - DNA, 25 bp, Mus musculus
gtgccatatcaacatgtacatgcat

SEQ ID NO: 703831 - DNA, 25 bp, Mus musculus
gtgccatatcaacgtcaaagctagg

SEQ ID NO: 703832 - DNA, 25 bp, Mus musculus
gtgccatatcaagatgtacatgcat

SEQ ID NO: 703833 - DNA, 25 bp, Mus musculus
gtgccatatcaaggtcaaagctagg

SEQ ID NO: 703834 - DNA, 25 bp, Mus musculus
gtgccatatgatctggtaccccgtg

SEQ ID NO: 703835 - DNA, 25 bp, Mus musculus
gtgccatatgatgtggtaccccgtg

SEQ ID NO: 703836 - DNA, 25 bp, Mus musculus
gtgccatattacagttaagcgtcat

SEQ ID NO: 703837 - DNA, 25 bp, Mus musculus
gtgccatattactgttaagcgtcat

SEQ ID NO: 703838 - DNA, 25 bp, Mus musculus
gtgccatatttgctcagtagacaaa

SEQ ID NO: 703839 - DNA, 25 bp, Mus musculus
gtgccatatttggtcagtagacaaa

SEQ ID NO: 703840 - DNA, 25 bp, Mus musculus
gtgccatcaaaccatgtcgcctgag

SEQ ID NO: 703841 - DNA, 25 bp, Mus musculus
gtgccatcaaacgatgtcgcctgag

SEQ ID NO: 703842 - DNA, 25 bp, Mus musculus
gtgccatcacgcatttaagacagga

SEQ ID NO: 703843 - DNA, 25 bp, Mus musculus
gtgccatcacgcttttaagacagga

SEQ ID NO: 703844 - DNA, 25 bp, Mus musculus
gtgccatcagaaagtgtacatcgaa

SEQ ID NO: 703845 - DNA, 25 bp, Mus musculus
gtgccatcagaatgtgtacatcgaa

SEQ ID NO: 703846 - DNA, 25 bp, Mus musculus
gtgccatcataaacagggtgccatt

SEQ ID NO: 703847 - DNA, 25 bp, Mus musculus
gtgccatcataatcagggtgccatt

SEQ ID NO: 703848 - DNA, 25 bp, Mus musculus
gtgccatccaccaggctaaggtgaa

SEQ ID NO: 703849 - DNA, 25 bp, Mus musculus
gtgccatccacctggctaaggtgaa

SEQ ID NO: 703850 - DNA, 25 bp, Mus musculus
gtgccatccacgagcatgagttcgg

SEQ ID NO: 703851 - DNA, 25 bp, Mus musculus
gtgccatccacgtgcatgagttcgg

SEQ ID NO: 703852 - DNA, 25 bp, Mus musculus
gtgccatccattcactcctatagga

SEQ ID NO: 703853 - DNA, 25 bp, Mus musculus
gtgccatccattcttctgaacaaat

SEQ ID NO: 703854 - DNA, 25 bp, Mus musculus
gtgccatccattgactcctatagga

SEQ ID NO: 703855 - DNA, 25 bp, Mus musculus
gtgccatccattgttctgaacaaat

SEQ ID NO: 703856 - DNA, 25 bp, Mus musculus
gtgccatcctaaacttgactgagtg

SEQ ID NO: 703857 - DNA, 25 bp, Mus musculus
gtgccatcctaatcttgactgagtg

SEQ ID NO: 703858 - DNA, 25 bp, Mus musculus
gtgccatctactctcatcgtgggct

SEQ ID NO: 703859 - DNA, 25 bp, Mus musculus
gtgccatctactgtcatcgtgggct

SEQ ID NO: 703860 - DNA, 25 bp, Mus musculus
gtgccatctagcctgtggtgttaat

SEQ ID NO: 703861 - DNA, 25 bp, Mus musculus
gtgccatctagcgtgtggtgttaat

SEQ ID NO: 703862 - DNA, 25 bp, Mus musculus
gtgccatctcagacatgaccaatca

SEQ ID NO: 703863 - DNA, 25 bp, Mus musculus
gtgccatctcagtcatgaccaatca

SEQ ID NO: 703864 - DNA, 25 bp, Mus musculus
gtgccatctcgacccagatatctgt

SEQ ID NO: 703865 - DNA, 25 bp, Mus musculus
gtgccatctcgagccagatatctgt

SEQ ID NO: 703866 - DNA, 25 bp, Mus musculus
gtgccatctctcaagaatcctggaa

SEQ ID NO: 703867 - DNA, 25 bp, Mus musculus
gtgccatctctctagaatcctggaa

SEQ ID NO: 703868 - DNA, 25 bp, Mus musculus
gtgccatctggtactctgggtcaaa

SEQ ID NO: 703869 - DNA, 25 bp, Mus musculus
gtgccatctggttctctgggtcaaa

SEQ ID NO: 703870 - DNA, 25 bp, Mus musculus
gtgccatcttatagatgaacagcat

SEQ ID NO: 703871 - DNA, 25 bp, Mus musculus
gtgccatcttattgatgaacagcat

SEQ ID NO: 703872 - DNA, 25 bp, Mus musculus
gtgccatgaaggaagctgcctgctc

SEQ ID NO: 703873 - DNA, 25 bp, Mus musculus
gtgccatgaaggtagctgcctgctc

SEQ ID NO: 703874 - DNA, 25 bp, Mus musculus
gtgccatgacccatatgcaaaggga

SEQ ID NO: 703875 - DNA, 25 bp, Mus musculus
gtgccatgacccttatgcaaaggga

SEQ ID NO: 703876 - DNA, 25 bp, Mus musculus
gtgccatgactactaactgtggatg

SEQ ID NO: 703877 - DNA, 25 bp, Mus musculus
gtgccatgactagtaactgtggatg

SEQ ID NO: 703878 - DNA, 25 bp, Mus musculus
gtgccatgatctctttctcagcatg

SEQ ID NO: 703879 - DNA, 25 bp, Mus musculus
gtgccatgatctgtttctcagcatg

SEQ ID NO: 703880 - DNA, 25 bp, Mus musculus
gtgccatgcaaaatacctctaggat

SEQ ID NO: 703881 - DNA, 25 bp, Mus musculus
gtgccatgcaaattacctctaggat

SEQ ID NO: 703882 - DNA, 25 bp, Mus musculus
gtgccatgccagcatctcaaggtca

SEQ ID NO: 703883 - DNA, 25 bp, Mus musculus
gtgccatgccaggatctcaaggtca

SEQ ID NO: 703884 - DNA, 25 bp, Mus musculus
gtgccatgcccacgctacagggata

SEQ ID NO: 703885 - DNA, 25 bp, Mus musculus
gtgccatgcccaggctacagggata

SEQ ID NO: 703886 - DNA, 25 bp, Mus musculus
gtgccatgctctctaccatggtggt

SEQ ID NO: 703887 - DNA, 25 bp, Mus musculus
gtgccatgctctgtaccatggtggt

SEQ ID NO: 703888 - DNA, 25 bp, Mus musculus
gtgccatgctggaattgggatccta

SEQ ID NO: 703889 - DNA, 25 bp, Mus musculus
gtgccatgctggtattgggatccta

SEQ ID NO: 703890 - DNA, 25 bp, Mus musculus
gtgccatgctttatgttaactgcat

SEQ ID NO: 703891 - DNA, 25 bp, Mus musculus
gtgccatgctttttgttaactgcat

SEQ ID NO: 703892 - DNA, 25 bp, Mus musculus
gtgccatggatcaacaggacctact

SEQ ID NO: 703893 - DNA, 25 bp, Mus musculus
gtgccatggatctacaggacctact

SEQ ID NO: 703894 - DNA, 25 bp, Mus musculus
gtgccatggatgaccccgttaagaa

SEQ ID NO: 703895 - DNA, 25 bp, Mus musculus
gtgccatggatgtccccgttaagaa

SEQ ID NO: 703896 - DNA, 25 bp, Mus musculus
gtgccatggcacatgatctagaatt

SEQ ID NO: 703897 - DNA, 25 bp, Mus musculus
gtgccatggcacttgatctagaatt

SEQ ID NO: 703898 - DNA, 25 bp, Mus musculus
gtgccatggccaagtttggttacat

SEQ ID NO: 703899 - DNA, 25 bp, Mus musculus
gtgccatggccatgtttggttacat

SEQ ID NO: 703900 - DNA, 25 bp, Mus musculus
gtgccatggcttatgttaccatttc

SEQ ID NO: 703901 - DNA, 25 bp, Mus musculus
gtgccatggcttttgttaccatttc

SEQ ID NO: 703902 - DNA, 25 bp, Mus musculus
gtgccatggtcactgattcacaatg

SEQ ID NO: 703903 - DNA, 25 bp, Mus musculus
gtgccatggtcagtgattcacaatg

SEQ ID NO: 703904 - DNA, 25 bp, Mus musculus
gtgccatggtgtcttatcacacata

SEQ ID NO: 703905 - DNA, 25 bp, Mus musculus
gtgccatggtgtgttatcacacata

SEQ ID NO: 703906 - DNA, 25 bp, Mus musculus
gtgccatgtgcaagatgctgatgcc

SEQ ID NO: 703907 - DNA, 25 bp, Mus musculus
gtgccatgtgcatgatgctgatgcc

SEQ ID NO: 703908 - DNA, 25 bp, Mus musculus
gtgccatgtgccactataatgagaa

SEQ ID NO: 703909 - DNA, 25 bp, Mus musculus
gtgccatgtgcctctataatgagaa

SEQ ID NO: 703910 - DNA, 25 bp, Mus musculus
gtgccatgtggaccagacaagctgc

SEQ ID NO: 703911 - DNA, 25 bp, Mus musculus
gtgccatgtggagcagacaagctgc

SEQ ID NO: 703912 - DNA, 25 bp, Mus musculus
gtgccatgtgtgcacagctaaggaa

SEQ ID NO: 703913 - DNA, 25 bp, Mus musculus
gtgccatgtgtggacagctaaggaa

SEQ ID NO: 703914 - DNA, 25 bp, Mus musculus
gtgccatgttctaagtgtccaagtg

SEQ ID NO: 703915 - DNA, 25 bp, Mus musculus
gtgccatgttcttagtgtccaagtg

SEQ ID NO: 703916 - DNA, 25 bp, Mus musculus
gtgccattaaccatgtagtctgtac

SEQ ID NO: 703917 - DNA, 25 bp, Mus musculus
gtgccattaaccttgtagtctgtac

SEQ ID NO: 703918 - DNA, 25 bp, Mus musculus
gtgccattaagacccactgtagata

SEQ ID NO: 703919 - DNA, 25 bp, Mus musculus
gtgccattaagagccactgtagata

SEQ ID NO: 703920 - DNA, 25 bp, Mus musculus
gtgccattacatcatggtggctatt

SEQ ID NO: 703921 - DNA, 25 bp, Mus musculus
gtgccattacatgatggtggctatt

SEQ ID NO: 703922 - DNA, 25 bp, Mus musculus
gtgccattagttagtgccaaccaca

SEQ ID NO: 703923 - DNA, 25 bp, Mus musculus
gtgccattagtttgtgccaaccaca

SEQ ID NO: 703924 - DNA, 25 bp, Mus musculus
gtgccattatagctggagtgccctt

SEQ ID NO: 703925 - DNA, 25 bp, Mus musculus
gtgccattataggtggagtgccctt

SEQ ID NO: 703926 - DNA, 25 bp, Mus musculus
gtgccattattccaaactgctgtct

SEQ ID NO: 703927 - DNA, 25 bp, Mus musculus
gtgccattattcgaaactgctgtct

SEQ ID NO: 703928 - DNA, 25 bp, Mus musculus
gtgccattccagagatatgatcata

SEQ ID NO: 703929 - DNA, 25 bp, Mus musculus
gtgccattccagtgatatgatcata

SEQ ID NO: 703930 - DNA, 25 bp, Mus musculus
gtgccattcctaaagggctgaagta

SEQ ID NO: 703931 - DNA, 25 bp, Mus musculus
gtgccattcctatagggctgaagta

SEQ ID NO: 703932 - DNA, 25 bp, Mus musculus
gtgccattctgaagctccaagtatt

SEQ ID NO: 703933 - DNA, 25 bp, Mus musculus
gtgccattctgatgctccaagtatt

SEQ ID NO: 703934 - DNA, 25 bp, Mus musculus
gtgccattgaaacaaagcctactaa

SEQ ID NO: 703935 - DNA, 25 bp, Mus musculus
gtgccattgaaagaaagcctactaa

SEQ ID NO: 703936 - DNA, 25 bp, Mus musculus
gtgccattgaagcagatatgaagat

SEQ ID NO: 703937 - DNA, 25 bp, Mus musculus
gtgccattgaagcattacctcatga

SEQ ID NO: 703938 - DNA, 25 bp, Mus musculus
gtgccattgaaggagatatgaagat

SEQ ID NO: 703939 - DNA, 25 bp, Mus musculus
gtgccattgaaggattacctcatga

SEQ ID NO: 703940 - DNA, 25 bp, Mus musculus
gtgccattgacactgcccaagaatg

SEQ ID NO: 703941 - DNA, 25 bp, Mus musculus
gtgccattgacagtgcccaagaatg

SEQ ID NO: 703942 - DNA, 25 bp, Mus musculus
gtgccattgcacatcgccagagagg

SEQ ID NO: 703943 - DNA, 25 bp, Mus musculus
gtgccattgcacttcgccagagagg

SEQ ID NO: 703944 - DNA, 25 bp, Mus musculus
gtgccattgctgctaattcatgttt

SEQ ID NO: 703945 - DNA, 25 bp, Mus musculus
gtgccattgctggtaattcatgttt

SEQ ID NO: 703946 - DNA, 25 bp, Mus musculus
gtgccattgtggcttttgacccatg

SEQ ID NO: 703947 - DNA, 25 bp, Mus musculus
gtgccattgtgggttttgacccatg

SEQ ID NO: 703948 - DNA, 25 bp, Mus musculus
gtgccattgtttcatgatcctgagt

SEQ ID NO: 703949 - DNA, 25 bp, Mus musculus
gtgccattgtttgatgatcctgagt

SEQ ID NO: 703950 - DNA, 25 bp, Mus musculus
gtgccatttagcaaactgtctttag

SEQ ID NO: 703951 - DNA, 25 bp, Mus musculus
gtgccatttagctaactgtctttag

SEQ ID NO: 703952 - DNA, 25 bp, Mus musculus
gtgccatttcagaacatttgtacaa

SEQ ID NO: 703953 - DNA, 25 bp, Mus musculus
gtgccatttcagtacatttgtacaa

SEQ ID NO: 703954 - DNA, 25 bp, Mus musculus
gtgccatttcctatacctgggaact

SEQ ID NO: 703955 - DNA, 25 bp, Mus musculus
gtgccatttcctttacctgggaact

SEQ ID NO: 703956 - DNA, 25 bp, Mus musculus
gtgccatttctgaaccaaaagctgg

SEQ ID NO: 703957 - DNA, 25 bp, Mus musculus
gtgccatttctgtaccaaaagctgg

SEQ ID NO: 703958 - DNA, 25 bp, Mus musculus
gtgccatttggacgaccccacgtga

SEQ ID NO: 703959 - DNA, 25 bp, Mus musculus
gtgccatttggaggaccccacgtga

SEQ ID NO: 703960 - DNA, 25 bp, Mus musculus
gtgccatttggcaaataatgttttc

SEQ ID NO: 703961 - DNA, 25 bp, Mus musculus
gtgccatttggctaataatgttttc

SEQ ID NO: 703962 - DNA, 25 bp, Mus musculus
gtgccattttaactgatacgcttgc

SEQ ID NO: 703963 - DNA, 25 bp, Mus musculus
gtgccattttaagtgatacgcttgc

SEQ ID NO: 703964 - DNA, 25 bp, Mus musculus
gtgccattttcaaccaggctctggg

SEQ ID NO: 703965 - DNA, 25 bp, Mus musculus
gtgccattttcatccaggctctggg

SEQ ID NO: 703966 - DNA, 25 bp, Mus musculus
gtgccattttgtaactcctactgtt

SEQ ID NO: 703967 - DNA, 25 bp, Mus musculus
gtgccattttgttactcctactgtt

SEQ ID NO: 703968 - DNA, 25 bp, Mus musculus
gtgcccaaactgaactttgctgatg

SEQ ID NO: 703969 - DNA, 25 bp, Mus musculus
gtgcccaaactgtactttgctgatg

SEQ ID NO: 703970 - DNA, 25 bp, Mus musculus
gtgcccaagaacaccgtgaatcaaa

SEQ ID NO: 703971 - DNA, 25 bp, Mus musculus
gtgcccaagaactccgtgaatcaaa

SEQ ID NO: 703972 - DNA, 25 bp, Mus musculus
gtgcccaagccacttgcttaggagg

SEQ ID NO: 703973 - DNA, 25 bp, Mus musculus
gtgcccaagccagttgcttaggagg

SEQ ID NO: 703974 - DNA, 25 bp, Mus musculus
gtgcccaaggtcaaacctacagttt

SEQ ID NO: 703975 - DNA, 25 bp, Mus musculus
gtgcccaaggtctaacctacagttt

SEQ ID NO: 703976 - DNA, 25 bp, Mus musculus
gtgcccaagtttagtggtgactatt

SEQ ID NO: 703977 - DNA, 25 bp, Mus musculus
gtgcccaagttttgtggtgactatt

SEQ ID NO: 703978 - DNA, 25 bp, Mus musculus
gtgcccaatcacattctgctttaaa

SEQ ID NO: 703979 - DNA, 25 bp, Mus musculus
gtgcccaatcactttctgctttaaa

SEQ ID NO: 703980 - DNA, 25 bp, Mus musculus
gtgcccacaaagctcttctgtaaat

SEQ ID NO: 703981 - DNA, 25 bp, Mus musculus
gtgcccacaaaggtcttctgtaaat

SEQ ID NO: 703982 - DNA, 25 bp, Mus musculus
gtgcccacacagaggttggtgcttc

SEQ ID NO: 703983 - DNA, 25 bp, Mus musculus
gtgcccacacagtggttggtgcttc

SEQ ID NO: 703984 - DNA, 25 bp, Mus musculus
gtgcccacagaacgcaacggttgct

SEQ ID NO: 703985 - DNA, 25 bp, Mus musculus
gtgcccacagaaggcaacggttgct

SEQ ID NO: 703986 - DNA, 25 bp, Mus musculus
gtgcccacagacaaggaagcccgat

SEQ ID NO: 703987 - DNA, 25 bp, Mus musculus
gtgcccacagactaggaagcccgat

SEQ ID NO: 703988 - DNA, 25 bp, Mus musculus
gtgcccacagatacaccaggttttg

SEQ ID NO: 703989 - DNA, 25 bp, Mus musculus
gtgcccacagattcaccaggttttg

SEQ ID NO: 703990 - DNA, 25 bp, Mus musculus
gtgcccacagcaaccagacaaaatt

SEQ ID NO: 703991 - DNA, 25 bp, Mus musculus
gtgcccacagcatccagacaaaatt

SEQ ID NO: 703992 - DNA, 25 bp, Mus musculus
gtgcccacaggtaccagtaaacctt

SEQ ID NO: 703993 - DNA, 25 bp, Mus musculus
gtgcccacaggttccagtaaacctt

SEQ ID NO: 703994 - DNA, 25 bp, Mus musculus
gtgcccacagtgcatctggcgtcac

SEQ ID NO: 703995 - DNA, 25 bp, Mus musculus
gtgcccacagtggatctggcgtcac

SEQ ID NO: 703996 - DNA, 25 bp, Mus musculus
gtgcccacatgcaacatttcttgta

SEQ ID NO: 703997 - DNA, 25 bp, Mus musculus
gtgcccacatgctacatttcttgta

SEQ ID NO: 703998 - DNA, 25 bp, Mus musculus
gtgcccacatgtacaaatgccttca

SEQ ID NO: 703999 - DNA, 25 bp, Mus musculus
gtgcccacatgttcaaatgccttca

SEQ ID NO: 704000 - DNA, 25 bp, Mus musculus
gtgcccacattgattggatgcctgc

SEQ ID NO: 704001 - DNA, 25 bp, Mus musculus
gtgcccacattgtttggatgcctgc

SEQ ID NO: 704002 - DNA, 25 bp, Mus musculus
gtgcccaccagcagagtgtgcagcg

SEQ ID NO: 704003 - DNA, 25 bp, Mus musculus
gtgcccaccagcatcaacaaaggga

SEQ ID NO: 704004 - DNA, 25 bp, Mus musculus
gtgcccaccagctgagtgtgcagcg

SEQ ID NO: 704005 - DNA, 25 bp, Mus musculus
gtgcccaccagcttcaacaaaggga

SEQ ID NO: 704006 - DNA, 25 bp, Mus musculus
gtgcccacccgtcggtgtgaagtac

SEQ ID NO: 704007 - DNA, 25 bp, Mus musculus
gtgcccacccgtgggtgtgaagtac

SEQ ID NO: 704008 - DNA, 25 bp, Mus musculus
gtgcccaccgggagtccaggactgt

SEQ ID NO: 704009 - DNA, 25 bp, Mus musculus
gtgcccaccgggtgtccaggactgt

SEQ ID NO: 704010 - DNA, 25 bp, Mus musculus
gtgcccaccgtaagtgatctccaaa

SEQ ID NO: 704011 - DNA, 25 bp, Mus musculus
gtgcccaccgtatgtgatctccaaa

SEQ ID NO: 704012 - DNA, 25 bp, Mus musculus
gtgcccacctgaataacctctgaag

SEQ ID NO: 704013 - DNA, 25 bp, Mus musculus
gtgcccacctgattaacctctgaag

SEQ ID NO: 704014 - DNA, 25 bp, Mus musculus
gtgcccacgggcattgtgagaatag

SEQ ID NO: 704015 - DNA, 25 bp, Mus musculus
gtgcccacgggctttgtgagaatag

SEQ ID NO: 704016 - DNA, 25 bp, Mus musculus
gtgcccacggtgctcataagtcagg

SEQ ID NO: 704017 - DNA, 25 bp, Mus musculus
gtgcccacggtggtcataagtcagg

SEQ ID NO: 704018 - DNA, 25 bp, Mus musculus
gtgcccacgtcaaggagtatttcta

SEQ ID NO: 704019 - DNA, 25 bp, Mus musculus
gtgcccacgtcatggagtatttcta

SEQ ID NO: 704020 - DNA, 25 bp, Mus musculus
gtgcccactactccttttgtaactg

SEQ ID NO: 704021 - DNA, 25 bp, Mus musculus
gtgcccactactgcttttgtaactg

SEQ ID NO: 704022 - DNA, 25 bp, Mus musculus
gtgcccactcagagaactaagtctg

SEQ ID NO: 704023 - DNA, 25 bp, Mus musculus
gtgcccactcagtgaactaagtctg

SEQ ID NO: 704024 - DNA, 25 bp, Mus musculus
gtgcccactccacaatcaacaaggg

SEQ ID NO: 704025 - DNA, 25 bp, Mus musculus
gtgcccactccagaatcaacaaggg

SEQ ID NO: 704026 - DNA, 25 bp, Mus musculus
gtgcccactctgaaggcttgacagg

SEQ ID NO: 704027 - DNA, 25 bp, Mus musculus
gtgcccactctgtaggcttgacagg

SEQ ID NO: 704028 - DNA, 25 bp, Mus musculus
gtgcccactcttagcatctgctttt

SEQ ID NO: 704029 - DNA, 25 bp, Mus musculus
gtgcccactctttgcatctgctttt

SEQ ID NO: 704030 - DNA, 25 bp, Mus musculus
gtgcccactggtaactggctacaac

SEQ ID NO: 704031 - DNA, 25 bp, Mus musculus
gtgcccactggtagataaggcccca

SEQ ID NO: 704032 - DNA, 25 bp, Mus musculus
gtgcccactggttactggctacaac

SEQ ID NO: 704033 - DNA, 25 bp, Mus musculus
gtgcccactggttgataaggcccca

SEQ ID NO: 704034 - DNA, 25 bp, Mus musculus
gtgcccagagcaaattatcataacc

SEQ ID NO: 704035 - DNA, 25 bp, Mus musculus
gtgcccagagcatattatcataacc

SEQ ID NO: 704036 - DNA, 25 bp, Mus musculus
gtgcccagcaggacaagcagtggtt

SEQ ID NO: 704037 - DNA, 25 bp, Mus musculus
gtgcccagcaggtcaagcagtggtt

SEQ ID NO: 704038 - DNA, 25 bp, Mus musculus
gtgcccagcagtatacctgtcaatg

SEQ ID NO: 704039 - DNA, 25 bp, Mus musculus
gtgcccagcagtccattacagtgga

SEQ ID NO: 704040 - DNA, 25 bp, Mus musculus
gtgcccagcagtgcattacagtgga

SEQ ID NO: 704041 - DNA, 25 bp, Mus musculus
gtgcccagcagtttacctgtcaatg

SEQ ID NO: 704042 - DNA, 25 bp, Mus musculus
gtgcccagccagcacattctgaaga

SEQ ID NO: 704043 - DNA, 25 bp, Mus musculus
gtgcccagccaggacattctgaaga

SEQ ID NO: 704044 - DNA, 25 bp, Mus musculus
gtgcccagccctccatggaaataaa

SEQ ID NO: 704045 - DNA, 25 bp, Mus musculus
gtgcccagccctgcatggaaataaa

SEQ ID NO: 704046 - DNA, 25 bp, Mus musculus
gtgcccagcgcacgagtgacagtat

SEQ ID NO: 704047 - DNA, 25 bp, Mus musculus
gtgcccagcgcaggagtgacagtat

SEQ ID NO: 704048 - DNA, 25 bp, Mus musculus
gtgcccagctaacctctggagttgt

SEQ ID NO: 704049 - DNA, 25 bp, Mus musculus
gtgcccagctaagctctggagttgt

SEQ ID NO: 704050 - DNA, 25 bp, Mus musculus
gtgcccagctagataagaagcaaca

SEQ ID NO: 704051 - DNA, 25 bp, Mus musculus
gtgcccagctagttaagaagcaaca

SEQ ID NO: 704052 - DNA, 25 bp, Mus musculus
gtgcccaggaagctgatgttccttc

SEQ ID NO: 704053 - DNA, 25 bp, Mus musculus
gtgcccaggaaggtgatgttccttc

SEQ ID NO: 704054 - DNA, 25 bp, Mus musculus
gtgcccaggacaaacaaatcttcat

SEQ ID NO: 704055 - DNA, 25 bp, Mus musculus
gtgcccaggacatacaaatcttcat

SEQ ID NO: 704056 - DNA, 25 bp, Mus musculus
gtgcccaggtcaccagcaacagtgg

SEQ ID NO: 704057 - DNA, 25 bp, Mus musculus
gtgcccaggtcagcagcaacagtgg

SEQ ID NO: 704058 - DNA, 25 bp, Mus musculus
gtgcccagtatgaaggatgccatgt

SEQ ID NO: 704059 - DNA, 25 bp, Mus musculus
gtgcccagtatgtaggatgccatgt

SEQ ID NO: 704060 - DNA, 25 bp, Mus musculus
gtgcccagtcagaagaggatttgtc

SEQ ID NO: 704061 - DNA, 25 bp, Mus musculus
gtgcccagtcagtagaggatttgtc

SEQ ID NO: 704062 - DNA, 25 bp, Mus musculus
gtgcccagtgtgagccaaaggcttt

SEQ ID NO: 704063 - DNA, 25 bp, Mus musculus
gtgcccagtgtgtgccaaaggcttt

SEQ ID NO: 704064 - DNA, 25 bp, Mus musculus
gtgcccataaaacttctactaccgc

SEQ ID NO: 704065 - DNA, 25 bp, Mus musculus
gtgcccataaaagttctactaccgc

SEQ ID NO: 704066 - DNA, 25 bp, Mus musculus
gtgcccataccacacagagacatat

SEQ ID NO: 704067 - DNA, 25 bp, Mus musculus
gtgcccataccagacagagacatat

SEQ ID NO: 704068 - DNA, 25 bp, Mus musculus
gtgcccatagatctgtctaatgata

SEQ ID NO: 704069 - DNA, 25 bp, Mus musculus
gtgcccatagatgtgtctaatgata

SEQ ID NO: 704070 - DNA, 25 bp, Mus musculus
gtgcccataggccaatgtgatccag

SEQ ID NO: 704071 - DNA, 25 bp, Mus musculus
gtgcccataggcgaatgtgatccag

SEQ ID NO: 704072 - DNA, 25 bp, Mus musculus
gtgcccatcaccatggtgtgtacgg

SEQ ID NO: 704073 - DNA, 25 bp, Mus musculus
gtgcccatcaccttggtgtgtacgg

SEQ ID NO: 704074 - DNA, 25 bp, Mus musculus
gtgcccatcacgcacgtgacggaga

SEQ ID NO: 704075 - DNA, 25 bp, Mus musculus
gtgcccatcacggacgtgacggaga

SEQ ID NO: 704076 - DNA, 25 bp, Mus musculus
gtgcccatcagtcgctgtagacaag

SEQ ID NO: 704077 - DNA, 25 bp, Mus musculus
gtgcccatcagtggctgtagacaag

SEQ ID NO: 704078 - DNA, 25 bp, Mus musculus
gtgcccatcatgagatcgctgtctg

SEQ ID NO: 704079 - DNA, 25 bp, Mus musculus
gtgcccatcatgtgatcgctgtctg

SEQ ID NO: 704080 - DNA, 25 bp, Mus musculus
gtgcccatcgttcctgtggaatgaa

SEQ ID NO: 704081 - DNA, 25 bp, Mus musculus
gtgcccatcgttgctgtggaatgaa

SEQ ID NO: 704082 - DNA, 25 bp, Mus musculus
gtgcccatctatcagcctcttgaaa

SEQ ID NO: 704083 - DNA, 25 bp, Mus musculus
gtgcccatctatgagcctcttgaaa

SEQ ID NO: 704084 - DNA, 25 bp, Mus musculus
gtgcccatgaccagcatatgatgct

SEQ ID NO: 704085 - DNA, 25 bp, Mus musculus
gtgcccatgacctgcatatgatgct

SEQ ID NO: 704086 - DNA, 25 bp, Mus musculus
gtgcccatggacagacaaagttgta

SEQ ID NO: 704087 - DNA, 25 bp, Mus musculus
gtgcccatggactgacaaagttgta

SEQ ID NO: 704088 - DNA, 25 bp, Mus musculus
gtgcccatgggtctaacattgctcc

SEQ ID NO: 704089 - DNA, 25 bp, Mus musculus
gtgcccatgggtgtaacattgctcc

SEQ ID NO: 704090 - DNA, 25 bp, Mus musculus
gtgcccatgtcacccttggaagtca

SEQ ID NO: 704091 - DNA, 25 bp, Mus musculus
gtgcccatgtcagccttggaagtca

SEQ ID NO: 704092 - DNA, 25 bp, Mus musculus
gtgcccatgtccagcagaattctga

SEQ ID NO: 704093 - DNA, 25 bp, Mus musculus
gtgcccatgtcctgcagaattctga

SEQ ID NO: 704094 - DNA, 25 bp, Mus musculus
gtgcccatgtggaactgtgtgtgta

SEQ ID NO: 704095 - DNA, 25 bp, Mus musculus
gtgcccatgtggtactgtgtgtgta

SEQ ID NO: 704096 - DNA, 25 bp, Mus musculus
gtgcccattgcacttgtattgactc

SEQ ID NO: 704097 - DNA, 25 bp, Mus musculus
gtgcccattgcagttgtattgactc

SEQ ID NO: 704098 - DNA, 25 bp, Mus musculus
gtgcccattgctagccattaggtat

SEQ ID NO: 704099 - DNA, 25 bp, Mus musculus
gtgcccattgcttgccattaggtat

SEQ ID NO: 704100 - DNA, 25 bp, Mus musculus
gtgcccatttgtcatattttaagtc

SEQ ID NO: 704101 - DNA, 25 bp, Mus musculus
gtgcccatttgtgatattttaagtc

SEQ ID NO: 704102 - DNA, 25 bp, Mus musculus
gtgccccaaatactgactgagctac

SEQ ID NO: 704103 - DNA, 25 bp, Mus musculus
gtgccccaaatagtgactgagctac

SEQ ID NO: 704104 - DNA, 25 bp, Mus musculus
gtgccccaacctcgcgttctagaga

SEQ ID NO: 704105 - DNA, 25 bp, Mus musculus
gtgccccaacctggcgttctagaga

SEQ ID NO: 704106 - DNA, 25 bp, Mus musculus
gtgccccaagaactttctgagggat

SEQ ID NO: 704107 - DNA, 25 bp, Mus musculus
gtgccccaagaagtttctgagggat

SEQ ID NO: 704108 - DNA, 25 bp, Mus musculus
gtgccccaagcactttgtcagtagg

SEQ ID NO: 704109 - DNA, 25 bp, Mus musculus
gtgccccaagcagtttgtcagtagg

SEQ ID NO: 704110 - DNA, 25 bp, Mus musculus
gtgccccaagtaacatgtggtcctg

SEQ ID NO: 704111 - DNA, 25 bp, Mus musculus
gtgccccaagtatcatgtggtcctg

SEQ ID NO: 704112 - DNA, 25 bp, Mus musculus
gtgccccaagttcactgacgatgaa

SEQ ID NO: 704113 - DNA, 25 bp, Mus musculus
gtgccccaagttgactgacgatgaa

SEQ ID NO: 704114 - DNA, 25 bp, Mus musculus
gtgccccaccaaatggcccactgag

SEQ ID NO: 704115 - DNA, 25 bp, Mus musculus
gtgccccaccaattggcccactgag

SEQ ID NO: 704116 - DNA, 25 bp, Mus musculus
gtgccccacctcagtgagcgaaggt

SEQ ID NO: 704117 - DNA, 25 bp, Mus musculus
gtgccccacctctgtgagcgaaggt

SEQ ID NO: 704118 - DNA, 25 bp, Mus musculus
gtgccccactagaaagttctgtctg

SEQ ID NO: 704119 - DNA, 25 bp, Mus musculus
gtgccccactagtaagttctgtctg

SEQ ID NO: 704120 - DNA, 25 bp, Mus musculus
gtgccccactgtaatttattgctgg

SEQ ID NO: 704121 - DNA, 25 bp, Mus musculus
gtgccccactgttatttattgctgg

SEQ ID NO: 704122 - DNA, 25 bp, Mus musculus
gtgccccagaagatcacctgttaaa

SEQ ID NO: 704123 - DNA, 25 bp, Mus musculus
gtgccccagaagttcacctgttaaa

SEQ ID NO: 704124 - DNA, 25 bp, Mus musculus
gtgccccagaataccatggtgacct

SEQ ID NO: 704125 - DNA, 25 bp, Mus musculus
gtgccccagaattccatggtgacct

SEQ ID NO: 704126 - DNA, 25 bp, Mus musculus
gtgccccagaccaggaattcggact

SEQ ID NO: 704127 - DNA, 25 bp, Mus musculus
gtgccccagacctggaattcggact

SEQ ID NO: 704128 - DNA, 25 bp, Mus musculus
gtgccccagagtaaagtgtttccat

SEQ ID NO: 704129 - DNA, 25 bp, Mus musculus
gtgccccagagttaagtgtttccat

SEQ ID NO: 704130 - DNA, 25 bp, Mus musculus
gtgccccagggcactgatcatggta

SEQ ID NO: 704131 - DNA, 25 bp, Mus musculus
gtgccccagggctctgatcatggta

SEQ ID NO: 704132 - DNA, 25 bp, Mus musculus
gtgccccagggtcaaatacttcttt

SEQ ID NO: 704133 - DNA, 25 bp, Mus musculus
gtgccccagggtgaaatacttcttt

SEQ ID NO: 704134 - DNA, 25 bp, Mus musculus
gtgccccagtgaatacttgtaaagt

SEQ ID NO: 704135 - DNA, 25 bp, Mus musculus
gtgccccagtgattacttgtaaagt

SEQ ID NO: 704136 - DNA, 25 bp, Mus musculus
gtgccccagtgcaggtgatcagaga

SEQ ID NO: 704137 - DNA, 25 bp, Mus musculus
gtgccccagtgctggtgatcagaga

SEQ ID NO: 704138 - DNA, 25 bp, Mus musculus
gtgccccatggaagctgtggttttc

SEQ ID NO: 704139 - DNA, 25 bp, Mus musculus
gtgccccatggatgctgtggttttc

SEQ ID NO: 704140 - DNA, 25 bp, Mus musculus
gtgccccattacatgttggaacgca

SEQ ID NO: 704141 - DNA, 25 bp, Mus musculus
gtgccccattacttgttggaacgca

SEQ ID NO: 704142 - DNA, 25 bp, Mus musculus
gtgccccattttatagaaccagctt

SEQ ID NO: 704143 - DNA, 25 bp, Mus musculus
gtgccccattttttagaaccagctt

SEQ ID NO: 704144 - DNA, 25 bp, Mus musculus
gtgccccgatgactgctgggtaaac

SEQ ID NO: 704145 - DNA, 25 bp, Mus musculus
gtgccccgatgagtgctgggtaaac

SEQ ID NO: 704146 - DNA, 25 bp, Mus musculus
gtgccccggcatcatttaaaaattg

SEQ ID NO: 704147 - DNA, 25 bp, Mus musculus
gtgccccggcatgatttaaaaattg

SEQ ID NO: 704148 - DNA, 25 bp, Mus musculus
gtgccccgggctagccagttaccac

SEQ ID NO: 704149 - DNA, 25 bp, Mus musculus
gtgccccgggcttgccagttaccac

SEQ ID NO: 704150 - DNA, 25 bp, Mus musculus
gtgccccgtgctcgtgatgatcagt

SEQ ID NO: 704151 - DNA, 25 bp, Mus musculus
gtgccccgtgctggtgatgatcagt

SEQ ID NO: 704152 - DNA, 25 bp, Mus musculus
gtgccccgttccaggcgcacgaggt

SEQ ID NO: 704153 - DNA, 25 bp, Mus musculus
gtgccccgttcctggcgcacgaggt

SEQ ID NO: 704154 - DNA, 25 bp, Mus musculus
gtgcccctaaagcaggtacagatag

SEQ ID NO: 704155 - DNA, 25 bp, Mus musculus
gtgcccctaaaggaggtacagatag

SEQ ID NO: 704156 - DNA, 25 bp, Mus musculus
gtgcccctaagacgtagtcatagtt

SEQ ID NO: 704157 - DNA, 25 bp, Mus musculus
gtgcccctaagaggtagtcatagtt

SEQ ID NO: 704158 - DNA, 25 bp, Mus musculus
gtgcccctaggaagaacctcagtgt

SEQ ID NO: 704159 - DNA, 25 bp, Mus musculus
gtgcccctaggatgaacctcagtgt

SEQ ID NO: 704160 - DNA, 25 bp, Mus musculus
gtgcccctcacacatttattaacca

SEQ ID NO: 704161 - DNA, 25 bp, Mus musculus
gtgcccctcacagatttattaacca

SEQ ID NO: 704162 - DNA, 25 bp, Mus musculus
gtgcccctcagacgtgtagttctga

SEQ ID NO: 704163 - DNA, 25 bp, Mus musculus
gtgcccctcagaggtgtagttctga

SEQ ID NO: 704164 - DNA, 25 bp, Mus musculus
gtgcccctcattatactatttggtg

SEQ ID NO: 704165 - DNA, 25 bp, Mus musculus
gtgcccctcattttactatttggtg

SEQ ID NO: 704166 - DNA, 25 bp, Mus musculus
gtgcccctgggactattgtatttgt

SEQ ID NO: 704167 - DNA, 25 bp, Mus musculus
gtgcccctgggagtattgtatttgt

SEQ ID NO: 704168 - DNA, 25 bp, Mus musculus
gtgcccctggtgactatttcaagag

SEQ ID NO: 704169 - DNA, 25 bp, Mus musculus
gtgcccctggtgtctatttcaagag

SEQ ID NO: 704170 - DNA, 25 bp, Mus musculus
gtgcccctgtgactacagagaagga

SEQ ID NO: 704171 - DNA, 25 bp, Mus musculus
gtgcccctgtgagtacagagaagga

SEQ ID NO: 704172 - DNA, 25 bp, Mus musculus
gtgccccttcaaacttcttcaaaga

SEQ ID NO: 704173 - DNA, 25 bp, Mus musculus
gtgccccttcaatcttcttcaaaga

SEQ ID NO: 704174 - DNA, 25 bp, Mus musculus
gtgccccttctgagaatctgtttgc

SEQ ID NO: 704175 - DNA, 25 bp, Mus musculus
gtgccccttctgtgaatctgtttgc

SEQ ID NO: 704176 - DNA, 25 bp, Mus musculus
gtgccccttgagaccacagcaaaga

SEQ ID NO: 704177 - DNA, 25 bp, Mus musculus
gtgccccttgagtccacagcaaaga

SEQ ID NO: 704178 - DNA, 25 bp, Mus musculus
gtgccccttgggacatttgaaagtt

SEQ ID NO: 704179 - DNA, 25 bp, Mus musculus
gtgccccttgggtcatttgaaagtt

SEQ ID NO: 704180 - DNA, 25 bp, Mus musculus
gtgcccctttctcatcttaagaggt

SEQ ID NO: 704181 - DNA, 25 bp, Mus musculus
gtgcccctttctgatcttaagaggt

SEQ ID NO: 704182 - DNA, 25 bp, Mus musculus
gtgcccgaagaacgtcatgatgcag

SEQ ID NO: 704183 - DNA, 25 bp, Mus musculus
gtgcccgaagaaggtcatgatgcag

SEQ ID NO: 704184 - DNA, 25 bp, Mus musculus
gtgcccgaagctcccattgtgcaaa

SEQ ID NO: 704185 - DNA, 25 bp, Mus musculus
gtgcccgaagctgccattgtgcaaa

SEQ ID NO: 704186 - DNA, 25 bp, Mus musculus
gtgcccgagaatcttgtcaagtgct

SEQ ID NO: 704187 - DNA, 25 bp, Mus musculus
gtgcccgagaatgttgtcaagtgct

SEQ ID NO: 704188 - DNA, 25 bp, Mus musculus
gtgcccgagggaaacagtgtgctgg

SEQ ID NO: 704189 - DNA, 25 bp, Mus musculus
gtgcccgagggatacagtgtgctgg

SEQ ID NO: 704190 - DNA, 25 bp, Mus musculus
gtgcccgataccagaaatcctaccg

SEQ ID NO: 704191 - DNA, 25 bp, Mus musculus
gtgcccgatacctgaaatcctaccg

SEQ ID NO: 704192 - DNA, 25 bp, Mus musculus
gtgcccgatgagattgagatttctt

SEQ ID NO: 704193 - DNA, 25 bp, Mus musculus
gtgcccgatgagtttgagatttctt

SEQ ID NO: 704194 - DNA, 25 bp, Mus musculus
gtgcccgcacgtactttagtgagtt

SEQ ID NO: 704195 - DNA, 25 bp, Mus musculus
gtgcccgcacgttctttagtgagtt

SEQ ID NO: 704196 - DNA, 25 bp, Mus musculus
gtgcccgctccaataagcatgaggt

SEQ ID NO: 704197 - DNA, 25 bp, Mus musculus
gtgcccgctccattaagcatgaggt

SEQ ID NO: 704198 - DNA, 25 bp, Mus musculus
gtgcccgctctcaaattagcatgat

SEQ ID NO: 704199 - DNA, 25 bp, Mus musculus
gtgcccgctctctaattagcatgat

SEQ ID NO: 704200 - DNA, 25 bp, Mus musculus
gtgcccgctgggacaaactgtgcaa

SEQ ID NO: 704201 - DNA, 25 bp, Mus musculus
gtgcccgctgggtcaaactgtgcaa

SEQ ID NO: 704202 - DNA, 25 bp, Mus musculus
gtgcccggagccagcagacagtaag

SEQ ID NO: 704203 - DNA, 25 bp, Mus musculus
gtgcccggagcctgcagacagtaag

SEQ ID NO: 704204 - DNA, 25 bp, Mus musculus
gtgcccggagctctaaacatgtatg

SEQ ID NO: 704205 - DNA, 25 bp, Mus musculus
gtgcccggagctgtaaacatgtatg

SEQ ID NO: 704206 - DNA, 25 bp, Mus musculus
gtgcccggatagagcttcatgagac

SEQ ID NO: 704207 - DNA, 25 bp, Mus musculus
gtgcccggatagtgcttcatgagac

SEQ ID NO: 704208 - DNA, 25 bp, Mus musculus
gtgcccgggactccccatacgtttg

SEQ ID NO: 704209 - DNA, 25 bp, Mus musculus
gtgcccgggactgcccatacgtttg

SEQ ID NO: 704210 - DNA, 25 bp, Mus musculus
gtgcccgggtacacactgtagaaga

SEQ ID NO: 704211 - DNA, 25 bp, Mus musculus
gtgcccgggtactcactgtagaaga

SEQ ID NO: 704212 - DNA, 25 bp, Mus musculus
gtgcccggtgctatagactacatgt

SEQ ID NO: 704213 - DNA, 25 bp, Mus musculus
gtgcccggtgctttagactacatgt

SEQ ID NO: 704214 - DNA, 25 bp, Mus musculus
gtgcccgtcatacattggtttttag

SEQ ID NO: 704215 - DNA, 25 bp, Mus musculus
gtgcccgtcatagattggtttttag

SEQ ID NO: 704216 - DNA, 25 bp, Mus musculus
gtgcccgtcattcagctattaaaga

SEQ ID NO: 704217 - DNA, 25 bp, Mus musculus
gtgcccgtcattgagctattaaaga

SEQ ID NO: 704218 - DNA, 25 bp, Mus musculus
gtgcccgtgatcattgttctgtatc

SEQ ID NO: 704219 - DNA, 25 bp, Mus musculus
gtgcccgtgatctttgttctgtatc

SEQ ID NO: 704220 - DNA, 25 bp, Mus musculus
gtgcccgtggtaacgatgttgaaca

SEQ ID NO: 704221 - DNA, 25 bp, Mus musculus
gtgcccgtggtatcgatgttgaaca

SEQ ID NO: 704222 - DNA, 25 bp, Mus musculus
gtgcccgtgtcgcagccgcgcgaga

SEQ ID NO: 704223 - DNA, 25 bp, Mus musculus
gtgcccgtgtcggagccgcgcgaga

SEQ ID NO: 704224 - DNA, 25 bp, Mus musculus
gtgcccgttctaaaccaggatctga

SEQ ID NO: 704225 - DNA, 25 bp, Mus musculus
gtgcccgttctataccaggatctga

SEQ ID NO: 704226 - DNA, 25 bp, Mus musculus
gtgcccgtttttagacatctgtgtc

SEQ ID NO: 704227 - DNA, 25 bp, Mus musculus
gtgcccgttttttgacatctgtgtc

SEQ ID NO: 704228 - DNA, 25 bp, Mus musculus
gtgccctaatgtcactggacagaga

SEQ ID NO: 704229 - DNA, 25 bp, Mus musculus
gtgccctaatgtgactggacagaga

SEQ ID NO: 704230 - DNA, 25 bp, Mus musculus
gtgccctacaagctgatcatgaagc

SEQ ID NO: 704231 - DNA, 25 bp, Mus musculus
gtgccctacaaggtgatcatgaagc

SEQ ID NO: 704232 - DNA, 25 bp, Mus musculus
gtgccctacataatgaagtccctca

SEQ ID NO: 704233 - DNA, 25 bp, Mus musculus
gtgccctacatattgaagtccctca

SEQ ID NO: 704234 - DNA, 25 bp, Mus musculus
gtgccctactggatgtgttgactga

SEQ ID NO: 704235 - DNA, 25 bp, Mus musculus
gtgccctactggttgtgttgactga

SEQ ID NO: 704236 - DNA, 25 bp, Mus musculus
gtgccctagcagagtatgaaacctt

SEQ ID NO: 704237 - DNA, 25 bp, Mus musculus
gtgccctagcagtgtatgaaacctt

SEQ ID NO: 704238 - DNA, 25 bp, Mus musculus
gtgccctagtctattaaatggcctc

SEQ ID NO: 704239 - DNA, 25 bp, Mus musculus
gtgccctagtcttttaaatggcctc

SEQ ID NO: 704240 - DNA, 25 bp, Mus musculus
gtgccctatattaagttggtttgta

SEQ ID NO: 704241 - DNA, 25 bp, Mus musculus
gtgccctatatttagttggtttgta

SEQ ID NO: 704242 - DNA, 25 bp, Mus musculus
gtgccctatcaaatacaatgtccat

SEQ ID NO: 704243 - DNA, 25 bp, Mus musculus
gtgccctatcaattacaatgtccat

SEQ ID NO: 704244 - DNA, 25 bp, Mus musculus
gtgccctatcatatctggctattta

SEQ ID NO: 704245 - DNA, 25 bp, Mus musculus
gtgccctatcatttctggctattta

SEQ ID NO: 704246 - DNA, 25 bp, Mus musculus
gtgccctatggcactagtggcctgt

SEQ ID NO: 704247 - DNA, 25 bp, Mus musculus
gtgccctatggctctagtggcctgt

SEQ ID NO: 704248 - DNA, 25 bp, Mus musculus
gtgccctattacaccgatgcaaaaa

SEQ ID NO: 704249 - DNA, 25 bp, Mus musculus
gtgccctattactccgatgcaaaaa

SEQ ID NO: 704250 - DNA, 25 bp, Mus musculus
gtgccctcacctaaagcagtgcatt

SEQ ID NO: 704251 - DNA, 25 bp, Mus musculus
gtgccctcaccttaagcagtgcatt

SEQ ID NO: 704252 - DNA, 25 bp, Mus musculus
gtgccctcagagctttctagagcag

SEQ ID NO: 704253 - DNA, 25 bp, Mus musculus
gtgccctcagaggtttctagagcag

SEQ ID NO: 704254 - DNA, 25 bp, Mus musculus
gtgccctcatgtctagaaggctcaa

SEQ ID NO: 704255 - DNA, 25 bp, Mus musculus
gtgccctcatgtctgttatcattca

SEQ ID NO: 704256 - DNA, 25 bp, Mus musculus
gtgccctcatgtgtagaaggctcaa

SEQ ID NO: 704257 - DNA, 25 bp, Mus musculus
gtgccctcatgtgtgttatcattca

SEQ ID NO: 704258 - DNA, 25 bp, Mus musculus
gtgccctccaggaactaccttaatg

SEQ ID NO: 704259 - DNA, 25 bp, Mus musculus
gtgccctccaggtactaccttaatg

SEQ ID NO: 704260 - DNA, 25 bp, Mus musculus
gtgccctcctccaggtgagaacgag

SEQ ID NO: 704261 - DNA, 25 bp, Mus musculus
gtgccctcctcctggtgagaacgag

SEQ ID NO: 704262 - DNA, 25 bp, Mus musculus
gtgccctcctctcacttagtggaaa

SEQ ID NO: 704263 - DNA, 25 bp, Mus musculus
gtgccctcctctgacttagtggaaa

SEQ ID NO: 704264 - DNA, 25 bp, Mus musculus
gtgccctcctgaccttattagaagg

SEQ ID NO: 704265 - DNA, 25 bp, Mus musculus
gtgccctcctgagcttattagaagg

SEQ ID NO: 704266 - DNA, 25 bp, Mus musculus
gtgccctctacacttgagctatttt

SEQ ID NO: 704267 - DNA, 25 bp, Mus musculus
gtgccctctacagttgagctatttt

SEQ ID NO: 704268 - DNA, 25 bp, Mus musculus
gtgccctctgcacagttatgtctaa

SEQ ID NO: 704269 - DNA, 25 bp, Mus musculus
gtgccctctgcagagttatgtctaa

SEQ ID NO: 704270 - DNA, 25 bp, Mus musculus
gtgccctctggaaagactgttgtga

SEQ ID NO: 704271 - DNA, 25 bp, Mus musculus
gtgccctctggatagactgttgtga

SEQ ID NO: 704272 - DNA, 25 bp, Mus musculus
gtgccctcttagacttctaagctag

SEQ ID NO: 704273 - DNA, 25 bp, Mus musculus
gtgccctcttagtcttctaagctag

SEQ ID NO: 704274 - DNA, 25 bp, Mus musculus
gtgccctgaaaaagtgctcacactc

SEQ ID NO: 704275 - DNA, 25 bp, Mus musculus
gtgccctgaaaatgtgctcacactc

SEQ ID NO: 704276 - DNA, 25 bp, Mus musculus
gtgccctgacaaagctggtgctgtg

SEQ ID NO: 704277 - DNA, 25 bp, Mus musculus
gtgccctgacaatgctggtgctgtg

SEQ ID NO: 704278 - DNA, 25 bp, Mus musculus
gtgccctgacagcactaccaggcgt

SEQ ID NO: 704279 - DNA, 25 bp, Mus musculus
gtgccctgacaggactaccaggcgt

SEQ ID NO: 704280 - DNA, 25 bp, Mus musculus
gtgccctgagagactcttgacatgg

SEQ ID NO: 704281 - DNA, 25 bp, Mus musculus
gtgccctgagagtctcttgacatgg

SEQ ID NO: 704282 - DNA, 25 bp, Mus musculus
gtgccctgagctcggtgtccgacca

SEQ ID NO: 704283 - DNA, 25 bp, Mus musculus
gtgccctgagctgggtgtccgacca

SEQ ID NO: 704284 - DNA, 25 bp, Mus musculus
gtgccctgcagaactctgaacttgt

SEQ ID NO: 704285 - DNA, 25 bp, Mus musculus
gtgccctgcagatctctgaacttgt

SEQ ID NO: 704286 - DNA, 25 bp, Mus musculus
gtgccctgcccaagtctgggctgca

SEQ ID NO: 704287 - DNA, 25 bp, Mus musculus
gtgccctgcccatgtctgggctgca

SEQ ID NO: 704288 - DNA, 25 bp, Mus musculus
gtgccctggaggatcttggaagact

SEQ ID NO: 704289 - DNA, 25 bp, Mus musculus
gtgccctggaggttcttggaagact

SEQ ID NO: 704290 - DNA, 25 bp, Mus musculus
gtgccctggatgcatttttctaaca

SEQ ID NO: 704291 - DNA, 25 bp, Mus musculus
gtgccctggatggatttttctaaca

SEQ ID NO: 704292 - DNA, 25 bp, Mus musculus
gtgccctgggcaatatagtccttat

SEQ ID NO: 704293 - DNA, 25 bp, Mus musculus
gtgccctgggcattatagtccttat

SEQ ID NO: 704294 - DNA, 25 bp, Mus musculus
gtgccctggtacaccttggaaaact

SEQ ID NO: 704295 - DNA, 25 bp, Mus musculus
gtgccctggtactccttggaaaact

SEQ ID NO: 704296 - DNA, 25 bp, Mus musculus
gtgccctggtgtacctatggaagtc

SEQ ID NO: 704297 - DNA, 25 bp, Mus musculus
gtgccctggtgttcctatggaagtc

SEQ ID NO: 704298 - DNA, 25 bp, Mus musculus
gtgccctgtacgcttttccagagga

SEQ ID NO: 704299 - DNA, 25 bp, Mus musculus
gtgccctgtacggttttccagagga

SEQ ID NO: 704300 - DNA, 25 bp, Mus musculus
gtgccctgtactccggtcaactgtt

SEQ ID NO: 704301 - DNA, 25 bp, Mus musculus
gtgccctgtactgcggtcaactgtt

SEQ ID NO: 704302 - DNA, 25 bp, Mus musculus
gtgccctgtcacactagactggaag

SEQ ID NO: 704303 - DNA, 25 bp, Mus musculus
gtgccctgtcactctagactggaag

SEQ ID NO: 704304 - DNA, 25 bp, Mus musculus
gtgccctgtgacctcatgaagtgtg

SEQ ID NO: 704305 - DNA, 25 bp, Mus musculus
gtgccctgtgacgtcatgaagtgtg

SEQ ID NO: 704306 - DNA, 25 bp, Mus musculus
gtgccctgtggtatatcatggagag

SEQ ID NO: 704307 - DNA, 25 bp, Mus musculus
gtgccctgtggtttatcatggagag

SEQ ID NO: 704308 - DNA, 25 bp, Mus musculus
gtgccctgtgtgaagtgagctagag

SEQ ID NO: 704309 - DNA, 25 bp, Mus musculus
gtgccctgtgtgtagtgagctagag

SEQ ID NO: 704310 - DNA, 25 bp, Mus musculus
gtgccctgttatcgctgcatgctga

SEQ ID NO: 704311 - DNA, 25 bp, Mus musculus
gtgccctgttatggctgcatgctga

SEQ ID NO: 704312 - DNA, 25 bp, Mus musculus
gtgccctgttctcactttagcaaag

SEQ ID NO: 704313 - DNA, 25 bp, Mus musculus
gtgccctgttctgactttagcaaag

SEQ ID NO: 704314 - DNA, 25 bp, Mus musculus
gtgccctgttgcagtgatgcttgcg

SEQ ID NO: 704315 - DNA, 25 bp, Mus musculus
gtgccctgttgctgtgatgcttgcg

SEQ ID NO: 704316 - DNA, 25 bp, Mus musculus
gtgcccttaattcatccacttaatt

SEQ ID NO: 704317 - DNA, 25 bp, Mus musculus
gtgcccttaattgatccacttaatt

SEQ ID NO: 704318 - DNA, 25 bp, Mus musculus
gtgcccttaccaagctccggaagga

SEQ ID NO: 704319 - DNA, 25 bp, Mus musculus
gtgcccttaccatgctccggaagga

SEQ ID NO: 704320 - DNA, 25 bp, Mus musculus
gtgcccttagagcaaaactacctga

SEQ ID NO: 704321 - DNA, 25 bp, Mus musculus
gtgcccttagaggaaaactacctga

SEQ ID NO: 704322 - DNA, 25 bp, Mus musculus
gtgcccttatgtcccagaaacttcg

SEQ ID NO: 704323 - DNA, 25 bp, Mus musculus
gtgcccttatgtgccagaaacttcg

SEQ ID NO: 704324 - DNA, 25 bp, Mus musculus
gtgcccttatttactttcggactag

SEQ ID NO: 704325 - DNA, 25 bp, Mus musculus
gtgcccttattttctttcggactag

SEQ ID NO: 704326 - DNA, 25 bp, Mus musculus
gtgcccttcatcaggttggaaacta

SEQ ID NO: 704327 - DNA, 25 bp, Mus musculus
gtgcccttcatctggttggaaacta

SEQ ID NO: 704328 - DNA, 25 bp, Mus musculus
gtgcccttctctcgccaaaagtaga

SEQ ID NO: 704329 - DNA, 25 bp, Mus musculus
gtgcccttctctggccaaaagtaga

SEQ ID NO: 704330 - DNA, 25 bp, Mus musculus
gtgcccttctgtcgagaactctgtt

SEQ ID NO: 704331 - DNA, 25 bp, Mus musculus
gtgcccttctgtggagaactctgtt

SEQ ID NO: 704332 - DNA, 25 bp, Mus musculus
gtgcccttgacaacctagataactg

SEQ ID NO: 704333 - DNA, 25 bp, Mus musculus
gtgcccttgacatcctagataactg

SEQ ID NO: 704334 - DNA, 25 bp, Mus musculus
gtgcccttgcctcaccgaaataagt

SEQ ID NO: 704335 - DNA, 25 bp, Mus musculus
gtgcccttgcctgaccgaaataagt

SEQ ID NO: 704336 - DNA, 25 bp, Mus musculus
gtgcccttggctctatagctgtcta

SEQ ID NO: 704337 - DNA, 25 bp, Mus musculus
gtgcccttggctgtatagctgtcta

SEQ ID NO: 704338 - DNA, 25 bp, Mus musculus
gtgcccttgtccaacgctatgggaa

SEQ ID NO: 704339 - DNA, 25 bp, Mus musculus
gtgcccttgtcctacgctatgggaa

SEQ ID NO: 704340 - DNA, 25 bp, Mus musculus
gtgcccttgtggcaaaactcgaaag

SEQ ID NO: 704341 - DNA, 25 bp, Mus musculus
gtgcccttgtgggaaaactcgaaag

SEQ ID NO: 704342 - DNA, 25 bp, Mus musculus
gtgccctttaaaattcttgccaaca

SEQ ID NO: 704343 - DNA, 25 bp, Mus musculus
gtgccctttaaatttcttgccaaca

SEQ ID NO: 704344 - DNA, 25 bp, Mus musculus
gtgccctttaacagagacagatttt

SEQ ID NO: 704345 - DNA, 25 bp, Mus musculus
gtgccctttaactgagacagatttt

SEQ ID NO: 704346 - DNA, 25 bp, Mus musculus
gtgccctttactattcctctggaag

SEQ ID NO: 704347 - DNA, 25 bp, Mus musculus
gtgccctttacttttcctctggaag

SEQ ID NO: 704348 - DNA, 25 bp, Mus musculus
gtgccctttagaacttgacctggaa

SEQ ID NO: 704349 - DNA, 25 bp, Mus musculus
gtgccctttagatcttgacctggaa

SEQ ID NO: 704350 - DNA, 25 bp, Mus musculus
gtgccctttattagtactgtcctgt

SEQ ID NO: 704351 - DNA, 25 bp, Mus musculus
gtgccctttatttgtactgtcctgt

SEQ ID NO: 704352 - DNA, 25 bp, Mus musculus
gtgccctttctaagaagagctgtga

SEQ ID NO: 704353 - DNA, 25 bp, Mus musculus
gtgccctttctatgaagagctgtga

SEQ ID NO: 704354 - DNA, 25 bp, Mus musculus
gtgccctttgtacccaatgaaacga

SEQ ID NO: 704355 - DNA, 25 bp, Mus musculus
gtgccctttgtagccaatgaaacga

SEQ ID NO: 704356 - DNA, 25 bp, Mus musculus
gtgcccttttatatccatatctacg

SEQ ID NO: 704357 - DNA, 25 bp, Mus musculus
gtgcccttttatttccatatctacg

SEQ ID NO: 704358 - DNA, 25 bp, Mus musculus
gtgcccttttcccaggaagagctgg

SEQ ID NO: 704359 - DNA, 25 bp, Mus musculus
gtgcccttttccgaggaagagctgg

SEQ ID NO: 704360 - DNA, 25 bp, Mus musculus
gtgccctttttcaacacactagtat

SEQ ID NO: 704361 - DNA, 25 bp, Mus musculus
gtgccctttttctacacactagtat

SEQ ID NO: 704362 - DNA, 25 bp, Mus musculus
gtgccgaaactacctgcacatggta

SEQ ID NO: 704363 - DNA, 25 bp, Mus musculus
gtgccgaaactagctgcacatggta

SEQ ID NO: 704364 - DNA, 25 bp, Mus musculus
gtgccgacaatcacgtggccatcaa

SEQ ID NO: 704365 - DNA, 25 bp, Mus musculus
gtgccgacaatctcgtggccatcaa

SEQ ID NO: 704366 - DNA, 25 bp, Mus musculus
gtgccgacagccagtagtgaccaga

SEQ ID NO: 704367 - DNA, 25 bp, Mus musculus
gtgccgacagcctgtagtgaccaga

SEQ ID NO: 704368 - DNA, 25 bp, Mus musculus
gtgccgacatcaatgtgatcaaata

SEQ ID NO: 704369 - DNA, 25 bp, Mus musculus
gtgccgacatcattgtgatcaaata

SEQ ID NO: 704370 - DNA, 25 bp, Mus musculus
gtgccgacatggagactttgctttg

SEQ ID NO: 704371 - DNA, 25 bp, Mus musculus
gtgccgacatggtgactttgctttg

SEQ ID NO: 704372 - DNA, 25 bp, Mus musculus
gtgccgacattacaggatttttcta

SEQ ID NO: 704373 - DNA, 25 bp, Mus musculus
gtgccgacattagaggatttttcta

SEQ ID NO: 704374 - DNA, 25 bp, Mus musculus
gtgccgaccagtactcttaagtatt

SEQ ID NO: 704375 - DNA, 25 bp, Mus musculus
gtgccgaccagttctcttaagtatt

SEQ ID NO: 704376 - DNA, 25 bp, Mus musculus
gtgccgatcatgattttgtagttca

SEQ ID NO: 704377 - DNA, 25 bp, Mus musculus
gtgccgatcatgtttttgtagttca

SEQ ID NO: 704378 - DNA, 25 bp, Mus musculus
gtgccgatggctaggctgaagattt

SEQ ID NO: 704379 - DNA, 25 bp, Mus musculus
gtgccgatggcttggctgaagattt

SEQ ID NO: 704380 - DNA, 25 bp, Mus musculus
gtgccgattattaccggttcttact

SEQ ID NO: 704381 - DNA, 25 bp, Mus musculus
gtgccgattatttccggttcttact

SEQ ID NO: 704382 - DNA, 25 bp, Mus musculus
gtgccgcaagccataggtttaacat

SEQ ID NO: 704383 - DNA, 25 bp, Mus musculus
gtgccgcaagccttaggtttaacat

SEQ ID NO: 704384 - DNA, 25 bp, Mus musculus
gtgccgcacacaaacaatgcaatgg

SEQ ID NO: 704385 - DNA, 25 bp, Mus musculus
gtgccgcacacatacaatgcaatgg

SEQ ID NO: 704386 - DNA, 25 bp, Mus musculus
gtgccgcactggacacagctgacga

SEQ ID NO: 704387 - DNA, 25 bp, Mus musculus
gtgccgcactggtcacagctgacga

SEQ ID NO: 704388 - DNA, 25 bp, Mus musculus
gtgccgccagagaatagcaggcaat

SEQ ID NO: 704389 - DNA, 25 bp, Mus musculus
gtgccgccagagtatagcaggcaat

SEQ ID NO: 704390 - DNA, 25 bp, Mus musculus
gtgccgccccaaagaaagctccaag

SEQ ID NO: 704391 - DNA, 25 bp, Mus musculus
gtgccgccccaatgaaagctccaag

SEQ ID NO: 704392 - DNA, 25 bp, Mus musculus
gtgccgcctgcacaatgaggtgaat

SEQ ID NO: 704393 - DNA, 25 bp, Mus musculus
gtgccgcctgcagaatgaggtgaat

SEQ ID NO: 704394 - DNA, 25 bp, Mus musculus
gtgccgcggcgacacagcaatagaa

SEQ ID NO: 704395 - DNA, 25 bp, Mus musculus
gtgccgcggcgagacagcaatagaa

SEQ ID NO: 704396 - DNA, 25 bp, Mus musculus
gtgccgcgtcagacatgccgaagca

SEQ ID NO: 704397 - DNA, 25 bp, Mus musculus
gtgccgcgtcagtcatgccgaagca

SEQ ID NO: 704398 - DNA, 25 bp, Mus musculus
gtgccgctaaacaatgagggtctgt

SEQ ID NO: 704399 - DNA, 25 bp, Mus musculus
gtgccgctaaactatgagggtctgt

SEQ ID NO: 704400 - DNA, 25 bp, Mus musculus
gtgccgctctgtaatactgtgtgga

SEQ ID NO: 704401 - DNA, 25 bp, Mus musculus
gtgccgctctgttatactgtgtgga

SEQ ID NO: 704402 - DNA, 25 bp, Mus musculus
gtgccgctgaaacgaatcgtgaact

SEQ ID NO: 704403 - DNA, 25 bp, Mus musculus
gtgccgctgaaaggaatcgtgaact

SEQ ID NO: 704404 - DNA, 25 bp, Mus musculus
gtgccgctttctacaggagcaggga

SEQ ID NO: 704405 - DNA, 25 bp, Mus musculus
gtgccgctttcttcaggagcaggga

SEQ ID NO: 704406 - DNA, 25 bp, Mus musculus
gtgccggaaggaaaacagccaccta

SEQ ID NO: 704407 - DNA, 25 bp, Mus musculus
gtgccggaaggataacagccaccta

SEQ ID NO: 704408 - DNA, 25 bp, Mus musculus
gtgccggagatcacaccaatcagaa

SEQ ID NO: 704409 - DNA, 25 bp, Mus musculus
gtgccggagatctcaccaatcagaa

SEQ ID NO: 704410 - DNA, 25 bp, Mus musculus
gtgccggcaaccaaagcaggtccta

SEQ ID NO: 704411 - DNA, 25 bp, Mus musculus
gtgccggcaacctaagcaggtccta

SEQ ID NO: 704412 - DNA, 25 bp, Mus musculus
gtgccggcacccaaactgaggtgtt

SEQ ID NO: 704413 - DNA, 25 bp, Mus musculus
gtgccggcaccctaactgaggtgtt

SEQ ID NO: 704414 - DNA, 25 bp, Mus musculus
gtgccggcagtcaacagcatggctt

SEQ ID NO: 704415 - DNA, 25 bp, Mus musculus
gtgccggcagtctacagcatggctt

SEQ ID NO: 704416 - DNA, 25 bp, Mus musculus
gtgccgggactgattgttctcaaga

SEQ ID NO: 704417 - DNA, 25 bp, Mus musculus
gtgccgggactgtttgttctcaaga

SEQ ID NO: 704418 - DNA, 25 bp, Mus musculus
gtgccgggagctactcagggaaaca

SEQ ID NO: 704419 - DNA, 25 bp, Mus musculus
gtgccgggagcttctcagggaaaca

SEQ ID NO: 704420 - DNA, 25 bp, Mus musculus
gtgccgggcctcattgacagttgga

SEQ ID NO: 704421 - DNA, 25 bp, Mus musculus
gtgccgggcctctttgacagttgga

SEQ ID NO: 704422 - DNA, 25 bp, Mus musculus
gtgccggtatttcaagtgaagttta

SEQ ID NO: 704423 - DNA, 25 bp, Mus musculus
gtgccggtatttgaagtgaagttta

SEQ ID NO: 704424 - DNA, 25 bp, Mus musculus
gtgccggtcttcacagatgtttcca

SEQ ID NO: 704425 - DNA, 25 bp, Mus musculus
gtgccggtcttctcagatgtttcca

SEQ ID NO: 704426 - DNA, 25 bp, Mus musculus
gtgccggtgccaactcagcaggaga

SEQ ID NO: 704427 - DNA, 25 bp, Mus musculus
gtgccggtgccatctcagcaggaga

SEQ ID NO: 704428 - DNA, 25 bp, Mus musculus
gtgccggttatcatcagacgtctca

SEQ ID NO: 704429 - DNA, 25 bp, Mus musculus
gtgccggttatcttcagacgtctca

SEQ ID NO: 704430 - DNA, 25 bp, Mus musculus
gtgccggttgctatggtaagcactt

SEQ ID NO: 704431 - DNA, 25 bp, Mus musculus
gtgccggttgctttggtaagcactt

SEQ ID NO: 704432 - DNA, 25 bp, Mus musculus
gtgccgtaatagaatattgcccgta

SEQ ID NO: 704433 - DNA, 25 bp, Mus musculus
gtgccgtaatagtatattgcccgta

SEQ ID NO: 704434 - DNA, 25 bp, Mus musculus
gtgccgtaggaactgccatgtttct

SEQ ID NO: 704435 - DNA, 25 bp, Mus musculus
gtgccgtaggaagtgccatgtttct

SEQ ID NO: 704436 - DNA, 25 bp, Mus musculus
gtgccgtatcggaactccaaactga

SEQ ID NO: 704437 - DNA, 25 bp, Mus musculus
gtgccgtatcggtactccaaactga

SEQ ID NO: 704438 - DNA, 25 bp, Mus musculus
gtgccgtccagccatcgttggaaaa

SEQ ID NO: 704439 - DNA, 25 bp, Mus musculus
gtgccgtccagcgatcgttggaaaa

SEQ ID NO: 704440 - DNA, 25 bp, Mus musculus
gtgccgtctaatcacagaaggaaca

SEQ ID NO: 704441 - DNA, 25 bp, Mus musculus
gtgccgtctaatgacagaaggaaca

SEQ ID NO: 704442 - DNA, 25 bp, Mus musculus
gtgccgtctttcatcctagaatgct

SEQ ID NO: 704443 - DNA, 25 bp, Mus musculus
gtgccgtctttcttcctagaatgct

SEQ ID NO: 704444 - DNA, 25 bp, Mus musculus
gtgccgtgaactacaagtgtctgca

SEQ ID NO: 704445 - DNA, 25 bp, Mus musculus
gtgccgtgaacttcaagtgtctgca

SEQ ID NO: 704446 - DNA, 25 bp, Mus musculus
gtgccgtgcagacttttctatattg

SEQ ID NO: 704447 - DNA, 25 bp, Mus musculus
gtgccgtgcagagttttctatattg

SEQ ID NO: 704448 - DNA, 25 bp, Mus musculus
gtgccgtggtcaaagcagactctga

SEQ ID NO: 704449 - DNA, 25 bp, Mus musculus
gtgccgtggtcatagcagactctga

SEQ ID NO: 704450 - DNA, 25 bp, Mus musculus
gtgccgtgtacgagtttggtcaaac

SEQ ID NO: 704451 - DNA, 25 bp, Mus musculus
gtgccgtgtacgtgtttggtcaaac

SEQ ID NO: 704452 - DNA, 25 bp, Mus musculus
gtgccgtgtgtaaaagcgaagtcat

SEQ ID NO: 704453 - DNA, 25 bp, Mus musculus
gtgccgtgtgtataagcgaagtcat

SEQ ID NO: 704454 - DNA, 25 bp, Mus musculus
gtgccgtgtgtgagaaatgcccatg

SEQ ID NO: 704455 - DNA, 25 bp, Mus musculus
gtgccgtgtgtgtgaaatgcccatg

SEQ ID NO: 704456 - DNA, 25 bp, Mus musculus
gtgccgtttgagcagtactcgccag

SEQ ID NO: 704457 - DNA, 25 bp, Mus musculus
gtgccgtttgaggagtactcgccag

SEQ ID NO: 704458 - DNA, 25 bp, Mus musculus
gtgcctaaaaatcatgtgaaccgtt

SEQ ID NO: 704459 - DNA, 25 bp, Mus musculus
gtgcctaaaaatgatgtgaaccgtt

SEQ ID NO: 704460 - DNA, 25 bp, Mus musculus
gtgcctaaaatgagcttctgaacta

SEQ ID NO: 704461 - DNA, 25 bp, Mus musculus
gtgcctaaaatgtgcttctgaacta

SEQ ID NO: 704462 - DNA, 25 bp, Mus musculus
gtgcctaaacttctgcttttgtatg

SEQ ID NO: 704463 - DNA, 25 bp, Mus musculus
gtgcctaaacttgtgcttttgtatg

SEQ ID NO: 704464 - DNA, 25 bp, Mus musculus
gtgcctaaagccaacctaatggaga

SEQ ID NO: 704465 - DNA, 25 bp, Mus musculus
gtgcctaaagcctacctaatggaga

SEQ ID NO: 704466 - DNA, 25 bp, Mus musculus
gtgcctaaagttcgtgatccactag

SEQ ID NO: 704467 - DNA, 25 bp, Mus musculus
gtgcctaaagttggtgatccactag

SEQ ID NO: 704468 - DNA, 25 bp, Mus musculus
gtgcctaaatgtcttaatgctctct

SEQ ID NO: 704469 - DNA, 25 bp, Mus musculus
gtgcctaaatgtgttaatgctctct

SEQ ID NO: 704470 - DNA, 25 bp, Mus musculus
gtgcctaacggaagggctgttgact

SEQ ID NO: 704471 - DNA, 25 bp, Mus musculus
gtgcctaacggatgggctgttgact

SEQ ID NO: 704472 - DNA, 25 bp, Mus musculus
gtgcctaagctaagtgggtcctgac

SEQ ID NO: 704473 - DNA, 25 bp, Mus musculus
gtgcctaagctatgtgggtcctgac

SEQ ID NO: 704474 - DNA, 25 bp, Mus musculus
gtgcctaaggtgcaagaggccctaa

SEQ ID NO: 704475 - DNA, 25 bp, Mus musculus
gtgcctaaggtggaagaggccctaa

SEQ ID NO: 704476 - DNA, 25 bp, Mus musculus
gtgcctaagttaacttactatagaa

SEQ ID NO: 704477 - DNA, 25 bp, Mus musculus
gtgcctaagttatcttactatagaa

SEQ ID NO: 704478 - DNA, 25 bp, Mus musculus
gtgcctaatcacatatccccattga

SEQ ID NO: 704479 - DNA, 25 bp, Mus musculus
gtgcctaatcacttatccccattga

SEQ ID NO: 704480 - DNA, 25 bp, Mus musculus
gtgcctacaaacctgaagagatgct

SEQ ID NO: 704481 - DNA, 25 bp, Mus musculus
gtgcctacaaacgtgaagagatgct

SEQ ID NO: 704482 - DNA, 25 bp, Mus musculus
gtgcctacacctctcagcgcaggaa

SEQ ID NO: 704483 - DNA, 25 bp, Mus musculus
gtgcctacacctgtcagcgcaggaa

SEQ ID NO: 704484 - DNA, 25 bp, Mus musculus
gtgcctacactcatatgccatggta

SEQ ID NO: 704485 - DNA, 25 bp, Mus musculus
gtgcctacactcttatgccatggta

SEQ ID NO: 704486 - DNA, 25 bp, Mus musculus
gtgcctacataacagttcacaacca

SEQ ID NO: 704487 - DNA, 25 bp, Mus musculus
gtgcctacataagagttcacaacca

SEQ ID NO: 704488 - DNA, 25 bp, Mus musculus
gtgcctacatcccaacgtttgtaag

SEQ ID NO: 704489 - DNA, 25 bp, Mus musculus
gtgcctacatccgaacgtttgtaag

SEQ ID NO: 704490 - DNA, 25 bp, Mus musculus
gtgcctacatgaagctcagaactaa

SEQ ID NO: 704491 - DNA, 25 bp, Mus musculus
gtgcctacatgatgctcagaactaa

SEQ ID NO: 704492 - DNA, 25 bp, Mus musculus
gtgcctacatggagattacgttctt

SEQ ID NO: 704493 - DNA, 25 bp, Mus musculus
gtgcctacatggtgattacgttctt

SEQ ID NO: 704494 - DNA, 25 bp, Mus musculus
gtgcctacatttagtagtggaaata

SEQ ID NO: 704495 - DNA, 25 bp, Mus musculus
gtgcctacattttgtagtggaaata

SEQ ID NO: 704496 - DNA, 25 bp, Mus musculus
gtgcctaccacacaggaaaccttga

SEQ ID NO: 704497 - DNA, 25 bp, Mus musculus
gtgcctaccacagaggaaaccttga

SEQ ID NO: 704498 - DNA, 25 bp, Mus musculus
gtgcctaccactcccttcaagaagt

SEQ ID NO: 704499 - DNA, 25 bp, Mus musculus
gtgcctaccactgccttcaagaagt

SEQ ID NO: 704500 - DNA, 25 bp, Mus musculus
gtgcctacccctagctgtattgtca

SEQ ID NO: 704501 - DNA, 25 bp, Mus musculus
gtgcctaccccttgctgtattgtca

SEQ ID NO: 704502 - DNA, 25 bp, Mus musculus
gtgcctaccggaccctgaacagaat

SEQ ID NO: 704503 - DNA, 25 bp, Mus musculus
gtgcctaccggaccctgtgaaaaat

SEQ ID NO: 704504 - DNA, 25 bp, Mus musculus
gtgcctaccggagcctgaacagaat

SEQ ID NO: 704505 - DNA, 25 bp, Mus musculus
gtgcctaccggagcctgtgaaaaat

SEQ ID NO: 704506 - DNA, 25 bp, Mus musculus
gtgcctacctaaccaggaggattca

SEQ ID NO: 704507 - DNA, 25 bp, Mus musculus
gtgcctacctaagcaggaggattca

SEQ ID NO: 704508 - DNA, 25 bp, Mus musculus
gtgcctacctgtacacggtatgaaa

SEQ ID NO: 704509 - DNA, 25 bp, Mus musculus
gtgcctacctgttcacggtatgaaa

SEQ ID NO: 704510 - DNA, 25 bp, Mus musculus
gtgcctacggagatcttatccataa

SEQ ID NO: 704511 - DNA, 25 bp, Mus musculus
gtgcctacggagttcttatccataa

SEQ ID NO: 704512 - DNA, 25 bp, Mus musculus
gtgcctactggaattactttgtcaa

SEQ ID NO: 704513 - DNA, 25 bp, Mus musculus
gtgcctactggatttactttgtcaa

SEQ ID NO: 704514 - DNA, 25 bp, Mus musculus
gtgcctagaaagacggacctgttcc

SEQ ID NO: 704515 - DNA, 25 bp, Mus musculus
gtgcctagaaagtcggacctgttcc

SEQ ID NO: 704516 - DNA, 25 bp, Mus musculus
gtgcctagaaatatgtcccagtgtg

SEQ ID NO: 704517 - DNA, 25 bp, Mus musculus
gtgcctagaaatttgtcccagtgtg

SEQ ID NO: 704518 - DNA, 25 bp, Mus musculus
gtgcctagacttccagtggcattgg

SEQ ID NO: 704519 - DNA, 25 bp, Mus musculus
gtgcctagacttgcagtggcattgg

SEQ ID NO: 704520 - DNA, 25 bp, Mus musculus
gtgcctagattgatttccatgacat

SEQ ID NO: 704521 - DNA, 25 bp, Mus musculus
gtgcctagattgttttccatgacat

SEQ ID NO: 704522 - DNA, 25 bp, Mus musculus
gtgcctagcacaagtttttacccaa

SEQ ID NO: 704523 - DNA, 25 bp, Mus musculus
gtgcctagcacatgtttttacccaa

SEQ ID NO: 704524 - DNA, 25 bp, Mus musculus
gtgcctagcatgcaaaagggcccta

SEQ ID NO: 704525 - DNA, 25 bp, Mus musculus
gtgcctagcatggaaaagggcccta

SEQ ID NO: 704526 - DNA, 25 bp, Mus musculus
gtgcctagccccaaattgaactttg

SEQ ID NO: 704527 - DNA, 25 bp, Mus musculus
gtgcctagcccctaattgaactttg

SEQ ID NO: 704528 - DNA, 25 bp, Mus musculus
gtgcctagcctgcaggacatcagct

SEQ ID NO: 704529 - DNA, 25 bp, Mus musculus
gtgcctagcctggaggacatcagct

SEQ ID NO: 704530 - DNA, 25 bp, Mus musculus
gtgcctagctagcaagttctaaaat

SEQ ID NO: 704531 - DNA, 25 bp, Mus musculus
gtgcctagctaggaagttctaaaat

SEQ ID NO: 704532 - DNA, 25 bp, Mus musculus
gtgcctagtacactgtaaatgctca

SEQ ID NO: 704533 - DNA, 25 bp, Mus musculus
gtgcctagtacagtgtaaatgctca

SEQ ID NO: 704534 - DNA, 25 bp, Mus musculus
gtgcctagtcctccatactcttttc

SEQ ID NO: 704535 - DNA, 25 bp, Mus musculus
gtgcctagtcctcctgggaattgat

SEQ ID NO: 704536 - DNA, 25 bp, Mus musculus
gtgcctagtcctgcatactcttttc

SEQ ID NO: 704537 - DNA, 25 bp, Mus musculus
gtgcctagtcctgctgggaattgat

SEQ ID NO: 704538 - DNA, 25 bp, Mus musculus
gtgcctagtctgagcctagcaaata

SEQ ID NO: 704539 - DNA, 25 bp, Mus musculus
gtgcctagtctgtgcctagcaaata

SEQ ID NO: 704540 - DNA, 25 bp, Mus musculus
gtgcctagtgacaacagtggctgtt

SEQ ID NO: 704541 - DNA, 25 bp, Mus musculus
gtgcctagtgactacagtggctgtt

SEQ ID NO: 704542 - DNA, 25 bp, Mus musculus
gtgcctagttctaaggacttctgaa

SEQ ID NO: 704543 - DNA, 25 bp, Mus musculus
gtgcctagttcttaggacttctgaa

SEQ ID NO: 704544 - DNA, 25 bp, Mus musculus
gtgcctagtttgctgtggcttccgc

SEQ ID NO: 704545 - DNA, 25 bp, Mus musculus
gtgcctagtttggtgtggcttccgc

SEQ ID NO: 704546 - DNA, 25 bp, Mus musculus
gtgcctatatctcagagacctctgt

SEQ ID NO: 704547 - DNA, 25 bp, Mus musculus
gtgcctatatctcgcccttacaaag

SEQ ID NO: 704548 - DNA, 25 bp, Mus musculus
gtgcctatatctgagagacctctgt

SEQ ID NO: 704549 - DNA, 25 bp, Mus musculus
gtgcctatatctggcccttacaaag

SEQ ID NO: 704550 - DNA, 25 bp, Mus musculus
gtgcctatcagcaggattgtgtgtc

SEQ ID NO: 704551 - DNA, 25 bp, Mus musculus
gtgcctatcagctggattgtgtgtc

SEQ ID NO: 704552 - DNA, 25 bp, Mus musculus
gtgcctatctaaaatactctctgag

SEQ ID NO: 704553 - DNA, 25 bp, Mus musculus
gtgcctatctaatatactctctgag

SEQ ID NO: 704554 - DNA, 25 bp, Mus musculus
gtgcctatctgaacctggatggact

SEQ ID NO: 704555 - DNA, 25 bp, Mus musculus
gtgcctatctgatcctggatggact

SEQ ID NO: 704556 - DNA, 25 bp, Mus musculus
gtgcctatctgtaggctgacacaaa

SEQ ID NO: 704557 - DNA, 25 bp, Mus musculus
gtgcctatctgttggctgacacaaa

SEQ ID NO: 704558 - DNA, 25 bp, Mus musculus
gtgcctatcttgaatgatagcgtca

SEQ ID NO: 704559 - DNA, 25 bp, Mus musculus
gtgcctatcttgtatgatagcgtca

SEQ ID NO: 704560 - DNA, 25 bp, Mus musculus
gtgcctatctttagtcccaggctca

SEQ ID NO: 704561 - DNA, 25 bp, Mus musculus
gtgcctatcttttgtcccaggctca

SEQ ID NO: 704562 - DNA, 25 bp, Mus musculus
gtgcctatgattataacttatgttt

SEQ ID NO: 704563 - DNA, 25 bp, Mus musculus
gtgcctatgattttaacttatgttt

SEQ ID NO: 704564 - DNA, 25 bp, Mus musculus
gtgcctatgtgcagtaatactggga

SEQ ID NO: 704565 - DNA, 25 bp, Mus musculus
gtgcctatgtgctgtaatactggga

SEQ ID NO: 704566 - DNA, 25 bp, Mus musculus
gtgcctatgtgtatggtaacaacaa

SEQ ID NO: 704567 - DNA, 25 bp, Mus musculus
gtgcctatgtgtttggtaacaacaa

SEQ ID NO: 704568 - DNA, 25 bp, Mus musculus
gtgcctattcctatgagatttacag

SEQ ID NO: 704569 - DNA, 25 bp, Mus musculus
gtgcctattcctttgagatttacag

SEQ ID NO: 704570 - DNA, 25 bp, Mus musculus
gtgcctcaaacacgaaattctgcat

SEQ ID NO: 704571 - DNA, 25 bp, Mus musculus
gtgcctcaaacaggaaattctgcat

SEQ ID NO: 704572 - DNA, 25 bp, Mus musculus
gtgcctcaacatactgttgatgtct

SEQ ID NO: 704573 - DNA, 25 bp, Mus musculus
gtgcctcaacattctgttgatgtct

SEQ ID NO: 704574 - DNA, 25 bp, Mus musculus
gtgcctcaagcactaagcatccagg

SEQ ID NO: 704575 - DNA, 25 bp, Mus musculus
gtgcctcaagcagtaagcatccagg

SEQ ID NO: 704576 - DNA, 25 bp, Mus musculus
gtgcctcaattcctccatttgtgaa

SEQ ID NO: 704577 - DNA, 25 bp, Mus musculus
gtgcctcaattcgtccatttgtgaa

SEQ ID NO: 704578 - DNA, 25 bp, Mus musculus
gtgcctcacagacagcgacaggaat

SEQ ID NO: 704579 - DNA, 25 bp, Mus musculus
gtgcctcacagagagcgacaggaat

SEQ ID NO: 704580 - DNA, 25 bp, Mus musculus
gtgcctcacgcacagcagttactga

SEQ ID NO: 704581 - DNA, 25 bp, Mus musculus
gtgcctcacgcagagcagttactga

SEQ ID NO: 704582 - DNA, 25 bp, Mus musculus
gtgcctcacgctctaaagccatgaa

SEQ ID NO: 704583 - DNA, 25 bp, Mus musculus
gtgcctcacgctgtaaagccatgaa

SEQ ID NO: 704584 - DNA, 25 bp, Mus musculus
gtgcctcacttcagactgcttagag

SEQ ID NO: 704585 - DNA, 25 bp, Mus musculus
gtgcctcacttctgactgcttagag

SEQ ID NO: 704586 - DNA, 25 bp, Mus musculus
gtgcctcagatcatatttgtaaatt

SEQ ID NO: 704587 - DNA, 25 bp, Mus musculus
gtgcctcagatcatgaatgaccaca

SEQ ID NO: 704588 - DNA, 25 bp, Mus musculus
gtgcctcagatcttatttgtaaatt

SEQ ID NO: 704589 - DNA, 25 bp, Mus musculus
gtgcctcagatcttgaatgaccaca

SEQ ID NO: 704590 - DNA, 25 bp, Mus musculus
gtgcctcagattatttcctgcatga

SEQ ID NO: 704591 - DNA, 25 bp, Mus musculus
gtgcctcagattttttcctgcatga

SEQ ID NO: 704592 - DNA, 25 bp, Mus musculus
gtgcctcagccaatcctggaaaaga

SEQ ID NO: 704593 - DNA, 25 bp, Mus musculus
gtgcctcagccattcctggaaaaga

SEQ ID NO: 704594 - DNA, 25 bp, Mus musculus
gtgcctcagcgtcttgtaggatgac

SEQ ID NO: 704595 - DNA, 25 bp, Mus musculus
gtgcctcagcgtgttgtaggatgac

SEQ ID NO: 704596 - DNA, 25 bp, Mus musculus
gtgcctcaggaacagaaccaccaga

SEQ ID NO: 704597 - DNA, 25 bp, Mus musculus
gtgcctcaggaagagaaccaccaga

SEQ ID NO: 704598 - DNA, 25 bp, Mus musculus
gtgcctcaggctacaggaatgacgt

SEQ ID NO: 704599 - DNA, 25 bp, Mus musculus
gtgcctcaggcttcaggaatgacgt

SEQ ID NO: 704600 - DNA, 25 bp, Mus musculus
gtgcctcagtcacagcctggaatca

SEQ ID NO: 704601 - DNA, 25 bp, Mus musculus
gtgcctcagtcagagcctggaatca

SEQ ID NO: 704602 - DNA, 25 bp, Mus musculus
gtgcctcatcgtcgaagtatacact

SEQ ID NO: 704603 - DNA, 25 bp, Mus musculus
gtgcctcatcgtggaagtatacact

SEQ ID NO: 704604 - DNA, 25 bp, Mus musculus
gtgcctcatgttacagagccctaag

SEQ ID NO: 704605 - DNA, 25 bp, Mus musculus
gtgcctcatgttcatgcactcagaa

SEQ ID NO: 704606 - DNA, 25 bp, Mus musculus
gtgcctcatgttgatgcactcagaa

SEQ ID NO: 704607 - DNA, 25 bp, Mus musculus
gtgcctcatgtttcagagccctaag

SEQ ID NO: 704608 - DNA, 25 bp, Mus musculus
gtgcctcattacctgctgaaactat

SEQ ID NO: 704609 - DNA, 25 bp, Mus musculus
gtgcctcattacgtgctgaaactat

SEQ ID NO: 704610 - DNA, 25 bp, Mus musculus
gtgcctcattatcttgcagctgtaa

SEQ ID NO: 704611 - DNA, 25 bp, Mus musculus
gtgcctcattatgttgcagctgtaa

SEQ ID NO: 704612 - DNA, 25 bp, Mus musculus
gtgcctccaacccatggtttgtgtg

SEQ ID NO: 704613 - DNA, 25 bp, Mus musculus
gtgcctccaaccgatggtttgtgtg

SEQ ID NO: 704614 - DNA, 25 bp, Mus musculus
gtgcctccacaacccagtagaattg

SEQ ID NO: 704615 - DNA, 25 bp, Mus musculus
gtgcctccacaagccagtagaattg

SEQ ID NO: 704616 - DNA, 25 bp, Mus musculus
gtgcctccactcagacagcaaatgg

SEQ ID NO: 704617 - DNA, 25 bp, Mus musculus
gtgcctccactctgacagcaaatgg

SEQ ID NO: 704618 - DNA, 25 bp, Mus musculus
gtgcctccagagatagtccacccta

SEQ ID NO: 704619 - DNA, 25 bp, Mus musculus
gtgcctccagagttagtccacccta

SEQ ID NO: 704620 - DNA, 25 bp, Mus musculus
gtgcctccatacattggtcgtctgg

SEQ ID NO: 704621 - DNA, 25 bp, Mus musculus
gtgcctccatactttggtcgtctgg

SEQ ID NO: 704622 - DNA, 25 bp, Mus musculus
gtgcctccatctcattctgacaaaa

SEQ ID NO: 704623 - DNA, 25 bp, Mus musculus
gtgcctccatctgattctgacaaaa

SEQ ID NO: 704624 - DNA, 25 bp, Mus musculus
gtgcctcccaagctgaaatgcttga

SEQ ID NO: 704625 - DNA, 25 bp, Mus musculus
gtgcctcccaaggtgaaatgcttga

SEQ ID NO: 704626 - DNA, 25 bp, Mus musculus
gtgcctcccagaaactggttcttcc

SEQ ID NO: 704627 - DNA, 25 bp, Mus musculus
gtgcctcccagaagcagaaggttat

SEQ ID NO: 704628 - DNA, 25 bp, Mus musculus
gtgcctcccagatactggttcttcc

SEQ ID NO: 704629 - DNA, 25 bp, Mus musculus
gtgcctcccagatgcagaaggttat

SEQ ID NO: 704630 - DNA, 25 bp, Mus musculus
gtgcctcccattcgaagagacccag

SEQ ID NO: 704631 - DNA, 25 bp, Mus musculus
gtgcctcccattggaagagacccag

SEQ ID NO: 704632 - DNA, 25 bp, Mus musculus
gtgcctccctggactcattggagaa

SEQ ID NO: 704633 - DNA, 25 bp, Mus musculus
gtgcctccctggtctcattggagaa

SEQ ID NO: 704634 - DNA, 25 bp, Mus musculus
gtgcctccgatactcttagtatctg

SEQ ID NO: 704635 - DNA, 25 bp, Mus musculus
gtgcctccgatagtcttagtatctg

SEQ ID NO: 704636 - DNA, 25 bp, Mus musculus
gtgcctcctaccaggtcatattaaa

SEQ ID NO: 704637 - DNA, 25 bp, Mus musculus
gtgcctcctacctggtcatattaaa

SEQ ID NO: 704638 - DNA, 25 bp, Mus musculus
gtgcctcctgcaatgaagaattcga

SEQ ID NO: 704639 - DNA, 25 bp, Mus musculus
gtgcctcctgcattgaagaattcga

SEQ ID NO: 704640 - DNA, 25 bp, Mus musculus
gtgcctcctggccatagacgaagaa

SEQ ID NO: 704641 - DNA, 25 bp, Mus musculus
gtgcctcctggcgatagacgaagaa

SEQ ID NO: 704642 - DNA, 25 bp, Mus musculus
gtgcctcgggacaccgtgcttatgg

SEQ ID NO: 704643 - DNA, 25 bp, Mus musculus
gtgcctcgggacagaggcacaccca

SEQ ID NO: 704644 - DNA, 25 bp, Mus musculus
gtgcctcgggacatacccagaaatg

SEQ ID NO: 704645 - DNA, 25 bp, Mus musculus
gtgcctcgggactccgtgcttatgg

SEQ ID NO: 704646 - DNA, 25 bp, Mus musculus
gtgcctcgggactgaggcacaccca

SEQ ID NO: 704647 - DNA, 25 bp, Mus musculus
gtgcctcgggacttacccagaaatg

SEQ ID NO: 704648 - DNA, 25 bp, Mus musculus
gtgcctcggtgtaccacatcaagta

SEQ ID NO: 704649 - DNA, 25 bp, Mus musculus
gtgcctcggtgttccacatcaagta

SEQ ID NO: 704650 - DNA, 25 bp, Mus musculus
gtgcctcgtcagctctgcctataat

SEQ ID NO: 704651 - DNA, 25 bp, Mus musculus
gtgcctcgtcaggtctgcctataat

SEQ ID NO: 704652 - DNA, 25 bp, Mus musculus
gtgcctcgtgctcaagacaatccaa

SEQ ID NO: 704653 - DNA, 25 bp, Mus musculus
gtgcctcgtgctgaagacaatccaa

SEQ ID NO: 704654 - DNA, 25 bp, Mus musculus
gtgcctcgttctccagtgagagaat

SEQ ID NO: 704655 - DNA, 25 bp, Mus musculus
gtgcctcgttctgcagtgagagaat

SEQ ID NO: 704656 - DNA, 25 bp, Mus musculus
gtgcctctaaaaacttggctcccta

SEQ ID NO: 704657 - DNA, 25 bp, Mus musculus
gtgcctctaaaatcttggctcccta

SEQ ID NO: 704658 - DNA, 25 bp, Mus musculus
gtgcctctaagcactgtccctggaa

SEQ ID NO: 704659 - DNA, 25 bp, Mus musculus
gtgcctctaagctctgtccctggaa

SEQ ID NO: 704660 - DNA, 25 bp, Mus musculus
gtgcctctaatcaggttgctcacag

SEQ ID NO: 704661 - DNA, 25 bp, Mus musculus
gtgcctctaatctggttgctcacag

SEQ ID NO: 704662 - DNA, 25 bp, Mus musculus
gtgcctctactcacttggaggagaa

SEQ ID NO: 704663 - DNA, 25 bp, Mus musculus
gtgcctctactctcttggaggagaa

SEQ ID NO: 704664 - DNA, 25 bp, Mus musculus
gtgcctctagagctgctagttcagt

SEQ ID NO: 704665 - DNA, 25 bp, Mus musculus
gtgcctctagaggtgctagttcagt

SEQ ID NO: 704666 - DNA, 25 bp, Mus musculus
gtgcctctaggccaattttattcat

SEQ ID NO: 704667 - DNA, 25 bp, Mus musculus
gtgcctctaggcgaattttattcat

SEQ ID NO: 704668 - DNA, 25 bp, Mus musculus
gtgcctctagtgagatctgcctaaa

SEQ ID NO: 704669 - DNA, 25 bp, Mus musculus
gtgcctctagtgtgatctgcctaaa

SEQ ID NO: 704670 - DNA, 25 bp, Mus musculus
gtgcctctatgcctagccagagtga

SEQ ID NO: 704671 - DNA, 25 bp, Mus musculus
gtgcctctatgcgtagccagagtga

SEQ ID NO: 704672 - DNA, 25 bp, Mus musculus
gtgcctctatttattatctgaactg

SEQ ID NO: 704673 - DNA, 25 bp, Mus musculus
gtgcctctattttttatctgaactg

SEQ ID NO: 704674 - DNA, 25 bp, Mus musculus
gtgcctctcaaaacgtcctgatagt

SEQ ID NO: 704675 - DNA, 25 bp, Mus musculus
gtgcctctcaaatcgtcctgatagt

SEQ ID NO: 704676 - DNA, 25 bp, Mus musculus
gtgcctctcaacacttgcaattttt

SEQ ID NO: 704677 - DNA, 25 bp, Mus musculus
gtgcctctcaactcttgcaattttt

SEQ ID NO: 704678 - DNA, 25 bp, Mus musculus
gtgcctctcaccactggttaaaatt

SEQ ID NO: 704679 - DNA, 25 bp, Mus musculus
gtgcctctcacctctggttaaaatt

SEQ ID NO: 704680 - DNA, 25 bp, Mus musculus
gtgcctctccaaaatccagaaatta

SEQ ID NO: 704681 - DNA, 25 bp, Mus musculus
gtgcctctccaatatccagaaatta

SEQ ID NO: 704682 - DNA, 25 bp, Mus musculus
gtgcctctcggaaactttacttaga

SEQ ID NO: 704683 - DNA, 25 bp, Mus musculus
gtgcctctcggatactttacttaga

SEQ ID NO: 704684 - DNA, 25 bp, Mus musculus
gtgcctctgacgaaaatcaggcgtg

SEQ ID NO: 704685 - DNA, 25 bp, Mus musculus
gtgcctctgacgtaaatcaggcgtg

SEQ ID NO: 704686 - DNA, 25 bp, Mus musculus
gtgcctctgagaacccgtttcatgc

SEQ ID NO: 704687 - DNA, 25 bp, Mus musculus
gtgcctctgagatcccgtttcatgc

SEQ ID NO: 704688 - DNA, 25 bp, Mus musculus
gtgcctctgatcaagcactgccaag

SEQ ID NO: 704689 - DNA, 25 bp, Mus musculus
gtgcctctgatctagcactgccaag

SEQ ID NO: 704690 - DNA, 25 bp, Mus musculus
gtgcctctgattcacagaatgtcta

SEQ ID NO: 704691 - DNA, 25 bp, Mus musculus
gtgcctctgattgacagaatgtcta

SEQ ID NO: 704692 - DNA, 25 bp, Mus musculus
gtgcctctgcaccagacaccacaaa

SEQ ID NO: 704693 - DNA, 25 bp, Mus musculus
gtgcctctgcacgagacaccacaaa

SEQ ID NO: 704694 - DNA, 25 bp, Mus musculus
gtgcctctgcatctgtatgcttcat

SEQ ID NO: 704695 - DNA, 25 bp, Mus musculus
gtgcctctgcatgtgtatgcttcat

SEQ ID NO: 704696 - DNA, 25 bp, Mus musculus
gtgcctctgccaagctgacttatgg

SEQ ID NO: 704697 - DNA, 25 bp, Mus musculus
gtgcctctgccacggaagccgagaa

SEQ ID NO: 704698 - DNA, 25 bp, Mus musculus
gtgcctctgccactgtaatccagaa

SEQ ID NO: 704699 - DNA, 25 bp, Mus musculus
gtgcctctgccagggaagccgagaa

SEQ ID NO: 704700 - DNA, 25 bp, Mus musculus
gtgcctctgccagtgtaatccagaa

SEQ ID NO: 704701 - DNA, 25 bp, Mus musculus
gtgcctctgccatgctgacttatgg

SEQ ID NO: 704702 - DNA, 25 bp, Mus musculus
gtgcctctgggcacatgtgaacaga

SEQ ID NO: 704703 - DNA, 25 bp, Mus musculus
gtgcctctgggctcatgtgaacaga

SEQ ID NO: 704704 - DNA, 25 bp, Mus musculus
gtgcctctggtgaattatccatcct

SEQ ID NO: 704705 - DNA, 25 bp, Mus musculus
gtgcctctggtgtattatccatcct

SEQ ID NO: 704706 - DNA, 25 bp, Mus musculus
gtgcctctgtaacttatatcttcaa

SEQ ID NO: 704707 - DNA, 25 bp, Mus musculus
gtgcctctgtaagttatatcttcaa

SEQ ID NO: 704708 - DNA, 25 bp, Mus musculus
gtgcctctgtgtctacacttgtgca

SEQ ID NO: 704709 - DNA, 25 bp, Mus musculus
gtgcctctgtgtgtacacttgtgca

SEQ ID NO: 704710 - DNA, 25 bp, Mus musculus
gtgcctctgttcattggtctgcaga

SEQ ID NO: 704711 - DNA, 25 bp, Mus musculus
gtgcctctgttcctccttacagata

SEQ ID NO: 704712 - DNA, 25 bp, Mus musculus
gtgcctctgttcgtccttacagata

SEQ ID NO: 704713 - DNA, 25 bp, Mus musculus
gtgcctctgttctttggtctgcaga

SEQ ID NO: 704714 - DNA, 25 bp, Mus musculus
gtgcctctgttgagaagaccccgtg

SEQ ID NO: 704715 - DNA, 25 bp, Mus musculus
gtgcctctgttgtgaagaccccgtg

SEQ ID NO: 704716 - DNA, 25 bp, Mus musculus
gtgcctcttgtaagcaaggactact

SEQ ID NO: 704717 - DNA, 25 bp, Mus musculus
gtgcctcttgtatgcaaggactact

SEQ ID NO: 704718 - DNA, 25 bp, Mus musculus
gtgcctcttgtcatgcctgcattgg

SEQ ID NO: 704719 - DNA, 25 bp, Mus musculus
gtgcctcttgtcttgcctgcattgg

SEQ ID NO: 704720 - DNA, 25 bp, Mus musculus
gtgcctctttggatgggagccctat

SEQ ID NO: 704721 - DNA, 25 bp, Mus musculus
gtgcctctttggttgggagccctat

SEQ ID NO: 704722 - DNA, 25 bp, Mus musculus
gtgcctgaaaaaagccctgaccaca

SEQ ID NO: 704723 - DNA, 25 bp, Mus musculus
gtgcctgaaaaatgccctgaccaca

SEQ ID NO: 704724 - DNA, 25 bp, Mus musculus
gtgcctgaaaacacttaacactgat

SEQ ID NO: 704725 - DNA, 25 bp, Mus musculus
gtgcctgaaaactcttaacactgat

SEQ ID NO: 704726 - DNA, 25 bp, Mus musculus
gtgcctgaagacctttaaagctcac

SEQ ID NO: 704727 - DNA, 25 bp, Mus musculus
gtgcctgaagacgtttaaagctcac

SEQ ID NO: 704728 - DNA, 25 bp, Mus musculus
gtgcctgaaggcaatccaatacatt

SEQ ID NO: 704729 - DNA, 25 bp, Mus musculus
gtgcctgaaggctatccaatacatt

SEQ ID NO: 704730 - DNA, 25 bp, Mus musculus
gtgcctgaaggtagtggatttgatt

SEQ ID NO: 704731 - DNA, 25 bp, Mus musculus
gtgcctgaaggttgtggatttgatt

SEQ ID NO: 704732 - DNA, 25 bp, Mus musculus
gtgcctgacaacacgatatgatggt

SEQ ID NO: 704733 - DNA, 25 bp, Mus musculus
gtgcctgacaactcgatatgatggt

SEQ ID NO: 704734 - DNA, 25 bp, Mus musculus
gtgcctgacactctaaacactcaaa

SEQ ID NO: 704735 - DNA, 25 bp, Mus musculus
gtgcctgacactgtaaacactcaaa

SEQ ID NO: 704736 - DNA, 25 bp, Mus musculus
gtgcctgacatcctgcagtaactta

SEQ ID NO: 704737 - DNA, 25 bp, Mus musculus
gtgcctgacatcgtgcagtaactta

SEQ ID NO: 704738 - DNA, 25 bp, Mus musculus
gtgcctgacctgatatcctgaggaa

SEQ ID NO: 704739 - DNA, 25 bp, Mus musculus
gtgcctgacctgttatcctgaggaa

SEQ ID NO: 704740 - DNA, 25 bp, Mus musculus
gtgcctgaccttaaatctaactacc

SEQ ID NO: 704741 - DNA, 25 bp, Mus musculus
gtgcctgacctttaatctaactacc

SEQ ID NO: 704742 - DNA, 25 bp, Mus musculus
gtgcctgacttactgagagaccctc

SEQ ID NO: 704743 - DNA, 25 bp, Mus musculus
gtgcctgacttagtgagagaccctc

SEQ ID NO: 704744 - DNA, 25 bp, Mus musculus
gtgcctgacttcagcctcctaggca

SEQ ID NO: 704745 - DNA, 25 bp, Mus musculus
gtgcctgacttctgcctcctaggca

SEQ ID NO: 704746 - DNA, 25 bp, Mus musculus
gtgcctgagaccagctcagagccat

SEQ ID NO: 704747 - DNA, 25 bp, Mus musculus
gtgcctgagacctgctcagagccat

SEQ ID NO: 704748 - DNA, 25 bp, Mus musculus
gtgcctgagcagatgtctctcggtg

SEQ ID NO: 704749 - DNA, 25 bp, Mus musculus
gtgcctgagcagttgtctctcggtg

SEQ ID NO: 704750 - DNA, 25 bp, Mus musculus
gtgcctgagcgaccggagttgacca

SEQ ID NO: 704751 - DNA, 25 bp, Mus musculus
gtgcctgagcgagcggagttgacca

SEQ ID NO: 704752 - DNA, 25 bp, Mus musculus
gtgcctgagctaatcagattctcaa

SEQ ID NO: 704753 - DNA, 25 bp, Mus musculus
gtgcctgagctattcagattctcaa

SEQ ID NO: 704754 - DNA, 25 bp, Mus musculus
gtgcctgagcttattaaagttgttc

SEQ ID NO: 704755 - DNA, 25 bp, Mus musculus
gtgcctgagctttttaaagttgttc

SEQ ID NO: 704756 - DNA, 25 bp, Mus musculus
gtgcctgaggatcttttcccgacaa

SEQ ID NO: 704757 - DNA, 25 bp, Mus musculus
gtgcctgaggatgttttcccgacaa

SEQ ID NO: 704758 - DNA, 25 bp, Mus musculus
gtgcctgaggtaccagtctgctttg

SEQ ID NO: 704759 - DNA, 25 bp, Mus musculus
gtgcctgaggtagcagtctgctttg

SEQ ID NO: 704760 - DNA, 25 bp, Mus musculus
gtgcctgaggttctttttacacctg

SEQ ID NO: 704761 - DNA, 25 bp, Mus musculus
gtgcctgaggttgtttttacacctg

SEQ ID NO: 704762 - DNA, 25 bp, Mus musculus
gtgcctgagtaaagacctggtagct

SEQ ID NO: 704763 - DNA, 25 bp, Mus musculus
gtgcctgagtaacggtctcacttcg

SEQ ID NO: 704764 - DNA, 25 bp, Mus musculus
gtgcctgagtaagggtctcacttcg

SEQ ID NO: 704765 - DNA, 25 bp, Mus musculus
gtgcctgagtaatgacctggtagct

SEQ ID NO: 704766 - DNA, 25 bp, Mus musculus
gtgcctgagtctcctaaccgaagaa

SEQ ID NO: 704767 - DNA, 25 bp, Mus musculus
gtgcctgagtctgctaaccgaagaa

SEQ ID NO: 704768 - DNA, 25 bp, Mus musculus
gtgcctgagtggatttaaccccaag

SEQ ID NO: 704769 - DNA, 25 bp, Mus musculus
gtgcctgagtggttttaaccccaag

SEQ ID NO: 704770 - DNA, 25 bp, Mus musculus
gtgcctgataagactgggtgtgtaa

SEQ ID NO: 704771 - DNA, 25 bp, Mus musculus
gtgcctgataagtctgggtgtgtaa

SEQ ID NO: 704772 - DNA, 25 bp, Mus musculus
gtgcctgatacccaaaaccaagtgt

SEQ ID NO: 704773 - DNA, 25 bp, Mus musculus
gtgcctgataccgaaaaccaagtgt

SEQ ID NO: 704774 - DNA, 25 bp, Mus musculus
gtgcctgatgatcgagctctctgcc

SEQ ID NO: 704775 - DNA, 25 bp, Mus musculus
gtgcctgatgatggagctctctgcc

SEQ ID NO: 704776 - DNA, 25 bp, Mus musculus
gtgcctgatgtcaatttcagctcag

SEQ ID NO: 704777 - DNA, 25 bp, Mus musculus
gtgcctgatgtctatttcagctcag

SEQ ID NO: 704778 - DNA, 25 bp, Mus musculus
gtgcctgattcccaactgataagat

SEQ ID NO: 704779 - DNA, 25 bp, Mus musculus
gtgcctgattccgaactgataagat

SEQ ID NO: 704780 - DNA, 25 bp, Mus musculus
gtgcctgcaagccatctgtaagcca

SEQ ID NO: 704781 - DNA, 25 bp, Mus musculus
gtgcctgcaagcgatctgtaagcca

SEQ ID NO: 704782 - DNA, 25 bp, Mus musculus
gtgcctgcaaggaccaatcggtaca

SEQ ID NO: 704783 - DNA, 25 bp, Mus musculus
gtgcctgcaaggtccaatcggtaca

SEQ ID NO: 704784 - DNA, 25 bp, Mus musculus
gtgcctgcacaaatctaccaacaag

SEQ ID NO: 704785 - DNA, 25 bp, Mus musculus
gtgcctgcacaattctaccaacaag

SEQ ID NO: 704786 - DNA, 25 bp, Mus musculus
gtgcctgcacctcctgcatgtcaga

SEQ ID NO: 704787 - DNA, 25 bp, Mus musculus
gtgcctgcacctgctgcatgtcaga

SEQ ID NO: 704788 - DNA, 25 bp, Mus musculus
gtgcctgcatgacactggtggaaat

SEQ ID NO: 704789 - DNA, 25 bp, Mus musculus
gtgcctgcatgagactggtggaaat

SEQ ID NO: 704790 - DNA, 25 bp, Mus musculus
gtgcctgccaatcgtatatcttctt

SEQ ID NO: 704791 - DNA, 25 bp, Mus musculus
gtgcctgccaatggtatatcttctt

SEQ ID NO: 704792 - DNA, 25 bp, Mus musculus
gtgcctgccagtcattgatgccaaa

SEQ ID NO: 704793 - DNA, 25 bp, Mus musculus
gtgcctgccagtgattgatgccaaa

SEQ ID NO: 704794 - DNA, 25 bp, Mus musculus
gtgcctgcccagagcctgtggaagc

SEQ ID NO: 704795 - DNA, 25 bp, Mus musculus
gtgcctgcccagtgcctgtggaagc

SEQ ID NO: 704796 - DNA, 25 bp, Mus musculus
gtgcctgcctacaccaatgaggaga

SEQ ID NO: 704797 - DNA, 25 bp, Mus musculus
gtgcctgcctactccaatgaggaga

SEQ ID NO: 704798 - DNA, 25 bp, Mus musculus
gtgcctgccttactgactctggttt

SEQ ID NO: 704799 - DNA, 25 bp, Mus musculus
gtgcctgccttagtgactctggttt

SEQ ID NO: 704800 - DNA, 25 bp, Mus musculus
gtgcctgctcctcacatttcaataa

SEQ ID NO: 704801 - DNA, 25 bp, Mus musculus
gtgcctgctcctgacatttcaataa

SEQ ID NO: 704802 - DNA, 25 bp, Mus musculus
gtgcctgctggaacctcgtatgtgt

SEQ ID NO: 704803 - DNA, 25 bp, Mus musculus
gtgcctgctggatcctcgtatgtgt

SEQ ID NO: 704804 - DNA, 25 bp, Mus musculus
gtgcctgctgttaataatgttgaat

SEQ ID NO: 704805 - DNA, 25 bp, Mus musculus
gtgcctgctgttcagaacatgaagc

SEQ ID NO: 704806 - DNA, 25 bp, Mus musculus
gtgcctgctgttgagaacatgaagc

SEQ ID NO: 704807 - DNA, 25 bp, Mus musculus
gtgcctgctgtttataatgttgaat

SEQ ID NO: 704808 - DNA, 25 bp, Mus musculus
gtgcctgcttaaaattcataacgaa

SEQ ID NO: 704809 - DNA, 25 bp, Mus musculus
gtgcctgcttaatattcataacgaa

SEQ ID NO: 704810 - DNA, 25 bp, Mus musculus
gtgcctgcttccacttgctataggt

SEQ ID NO: 704811 - DNA, 25 bp, Mus musculus
gtgcctgcttcctcttgctataggt

SEQ ID NO: 704812 - DNA, 25 bp, Mus musculus
gtgcctgcttctaatagttactcct

SEQ ID NO: 704813 - DNA, 25 bp, Mus musculus
gtgcctgcttcttatagttactcct

SEQ ID NO: 704814 - DNA, 25 bp, Mus musculus
gtgcctgctttgagttgtaggctct

SEQ ID NO: 704815 - DNA, 25 bp, Mus musculus
gtgcctgctttgtgttgtaggctct

SEQ ID NO: 704816 - DNA, 25 bp, Mus musculus
gtgcctggaacaaccctaatatgcg

SEQ ID NO: 704817 - DNA, 25 bp, Mus musculus
gtgcctggaacaatctaggtgctcc

SEQ ID NO: 704818 - DNA, 25 bp, Mus musculus
gtgcctggaacatccctaatatgcg

SEQ ID NO: 704819 - DNA, 25 bp, Mus musculus
gtgcctggaacattctaggtgctcc

SEQ ID NO: 704820 - DNA, 25 bp, Mus musculus
gtgcctggaagacgtctttgccatc

SEQ ID NO: 704821 - DNA, 25 bp, Mus musculus
gtgcctggaagaggtctttgccatc

SEQ ID NO: 704822 - DNA, 25 bp, Mus musculus
gtgcctggaatcagctgctgacaaa

SEQ ID NO: 704823 - DNA, 25 bp, Mus musculus
gtgcctggaatctgctgctgacaaa

SEQ ID NO: 704824 - DNA, 25 bp, Mus musculus
gtgcctggacataaaaattgcttag

SEQ ID NO: 704825 - DNA, 25 bp, Mus musculus
gtgcctggacattaaaattgcttag

SEQ ID NO: 704826 - DNA, 25 bp, Mus musculus
gtgcctggagcccatcagtagaagt

SEQ ID NO: 704827 - DNA, 25 bp, Mus musculus
gtgcctggagccgatcagtagaagt

SEQ ID NO: 704828 - DNA, 25 bp, Mus musculus
gtgcctggaggaagatccctcgact

SEQ ID NO: 704829 - DNA, 25 bp, Mus musculus
gtgcctggaggatgatccctcgact

SEQ ID NO: 704830 - DNA, 25 bp, Mus musculus
gtgcctggaggcactttgtgctgtt

SEQ ID NO: 704831 - DNA, 25 bp, Mus musculus
gtgcctggaggctctttgtgctgtt

SEQ ID NO: 704832 - DNA, 25 bp, Mus musculus
gtgcctggatctatgtctgtacaac

SEQ ID NO: 704833 - DNA, 25 bp, Mus musculus
gtgcctggatctttgtctgtacaac

SEQ ID NO: 704834 - DNA, 25 bp, Mus musculus
gtgcctggatggctaccgagcttaa

SEQ ID NO: 704835 - DNA, 25 bp, Mus musculus
gtgcctggatgggtaccgagcttaa

SEQ ID NO: 704836 - DNA, 25 bp, Mus musculus
gtgcctggcaaacactctaagcatc

SEQ ID NO: 704837 - DNA, 25 bp, Mus musculus
gtgcctggcaaagactctaagcatc

SEQ ID NO: 704838 - DNA, 25 bp, Mus musculus
gtgcctggcacaccttaggaagttt

SEQ ID NO: 704839 - DNA, 25 bp, Mus musculus
gtgcctggcacagcttaggaagttt

SEQ ID NO: 704840 - DNA, 25 bp, Mus musculus
gtgcctggcaggaatctttactaaa

SEQ ID NO: 704841 - DNA, 25 bp, Mus musculus
gtgcctggcaggtatctttactaaa

SEQ ID NO: 704842 - DNA, 25 bp, Mus musculus
gtgcctggcagtccagacatcacag

SEQ ID NO: 704843 - DNA, 25 bp, Mus musculus
gtgcctggcagtgcagacatcacag

SEQ ID NO: 704844 - DNA, 25 bp, Mus musculus
gtgcctggcataatgtaggtgctta

SEQ ID NO: 704845 - DNA, 25 bp, Mus musculus
gtgcctggcatattgtaggtgctta

SEQ ID NO: 704846 - DNA, 25 bp, Mus musculus
gtgcctggctacatcgacatggtgt

SEQ ID NO: 704847 - DNA, 25 bp, Mus musculus
gtgcctggctacttcgacatggtgt

SEQ ID NO: 704848 - DNA, 25 bp, Mus musculus
gtgcctggcttgcaactacgtggat

SEQ ID NO: 704849 - DNA, 25 bp, Mus musculus
gtgcctggcttggaactacgtggat

SEQ ID NO: 704850 - DNA, 25 bp, Mus musculus
gtgcctggctttaagtccacttaat

SEQ ID NO: 704851 - DNA, 25 bp, Mus musculus
gtgcctggcttttagtccacttaat

SEQ ID NO: 704852 - DNA, 25 bp, Mus musculus
gtgcctgggcctcagactgctccta

SEQ ID NO: 704853 - DNA, 25 bp, Mus musculus
gtgcctgggcctcagtaagacttct

SEQ ID NO: 704854 - DNA, 25 bp, Mus musculus
gtgcctgggcctgagactgctccta

SEQ ID NO: 704855 - DNA, 25 bp, Mus musculus
gtgcctgggcctgagtaagacttct

SEQ ID NO: 704856 - DNA, 25 bp, Mus musculus
gtgcctgggtagaattacacgataa

SEQ ID NO: 704857 - DNA, 25 bp, Mus musculus
gtgcctgggtagactcagctgtagc

SEQ ID NO: 704858 - DNA, 25 bp, Mus musculus
gtgcctgggtagtattacacgataa

SEQ ID NO: 704859 - DNA, 25 bp, Mus musculus
gtgcctgggtagtctcagctgtagc

SEQ ID NO: 704860 - DNA, 25 bp, Mus musculus
gtgcctgggtctacatacatgggtg

SEQ ID NO: 704861 - DNA, 25 bp, Mus musculus
gtgcctgggtcttcatacatgggtg

SEQ ID NO: 704862 - DNA, 25 bp, Mus musculus
gtgcctgggttgatgatacctcaca

SEQ ID NO: 704863 - DNA, 25 bp, Mus musculus
gtgcctgggttgttgatacctcaca

SEQ ID NO: 704864 - DNA, 25 bp, Mus musculus
gtgcctggtctcaatgcctagaaat

SEQ ID NO: 704865 - DNA, 25 bp, Mus musculus
gtgcctggtctctatgcctagaaat

SEQ ID NO: 704866 - DNA, 25 bp, Mus musculus
gtgcctggtcttacagtctgtgttc

SEQ ID NO: 704867 - DNA, 25 bp, Mus musculus
gtgcctggtctttcagtctgtgttc

SEQ ID NO: 704868 - DNA, 25 bp, Mus musculus
gtgcctggtgtaagtaactccctat

SEQ ID NO: 704869 - DNA, 25 bp, Mus musculus
gtgcctggtgtatgtaactccctat

SEQ ID NO: 704870 - DNA, 25 bp, Mus musculus
gtgcctgtaactatagaatgcccat

SEQ ID NO: 704871 - DNA, 25 bp, Mus musculus
gtgcctgtaactcatttgtccatat

SEQ ID NO: 704872 - DNA, 25 bp, Mus musculus
gtgcctgtaactgatttgtccatat

SEQ ID NO: 704873 - DNA, 25 bp, Mus musculus
gtgcctgtaactttagaatgcccat

SEQ ID NO: 704874 - DNA, 25 bp, Mus musculus
gtgcctgtacatagacatggccacc

SEQ ID NO: 704875 - DNA, 25 bp, Mus musculus
gtgcctgtacattgacatggccacc

SEQ ID NO: 704876 - DNA, 25 bp, Mus musculus
gtgcctgtataaacgtggctgtaca

SEQ ID NO: 704877 - DNA, 25 bp, Mus musculus
gtgcctgtataatcgtggctgtaca

SEQ ID NO: 704878 - DNA, 25 bp, Mus musculus
gtgcctgtatggacttgtatgtaat

SEQ ID NO: 704879 - DNA, 25 bp, Mus musculus
gtgcctgtatggtcttgtatgtaat

SEQ ID NO: 704880 - DNA, 25 bp, Mus musculus
gtgcctgtattcacttcttggacat

SEQ ID NO: 704881 - DNA, 25 bp, Mus musculus
gtgcctgtattccacaccagagaga

SEQ ID NO: 704882 - DNA, 25 bp, Mus musculus
gtgcctgtattcgacaccagagaga

SEQ ID NO: 704883 - DNA, 25 bp, Mus musculus
gtgcctgtattctcttcttggacat

SEQ ID NO: 704884 - DNA, 25 bp, Mus musculus
gtgcctgtcaacactggtgtcaaac

SEQ ID NO: 704885 - DNA, 25 bp, Mus musculus
gtgcctgtcaactctggtgtcaaac

SEQ ID NO: 704886 - DNA, 25 bp, Mus musculus
gtgcctgtcagaaacagtgggattt

SEQ ID NO: 704887 - DNA, 25 bp, Mus musculus
gtgcctgtcagatacagtgggattt

SEQ ID NO: 704888 - DNA, 25 bp, Mus musculus
gtgcctgtcatgaaatctcatctcg

SEQ ID NO: 704889 - DNA, 25 bp, Mus musculus
gtgcctgtcatgagtgggtcctaag

SEQ ID NO: 704890 - DNA, 25 bp, Mus musculus
gtgcctgtcatgtaatctcatctcg

SEQ ID NO: 704891 - DNA, 25 bp, Mus musculus
gtgcctgtcatgtgtgggtcctaag

SEQ ID NO: 704892 - DNA, 25 bp, Mus musculus
gtgcctgtcctacaaatgaacattg

SEQ ID NO: 704893 - DNA, 25 bp, Mus musculus
gtgcctgtcctagaaatgaacattg

SEQ ID NO: 704894 - DNA, 25 bp, Mus musculus
gtgcctgtctgaagtgtttagcttc

SEQ ID NO: 704895 - DNA, 25 bp, Mus musculus
gtgcctgtctgatgtgtttagcttc

SEQ ID NO: 704896 - DNA, 25 bp, Mus musculus
gtgcctgtgattagtagtttgtcta

SEQ ID NO: 704897 - DNA, 25 bp, Mus musculus
gtgcctgtgatttgtagtttgtcta

SEQ ID NO: 704898 - DNA, 25 bp, Mus musculus
gtgcctgtgcagaaggtcaccgaca

SEQ ID NO: 704899 - DNA, 25 bp, Mus musculus
gtgcctgtgcagtaggtcaccgaca

SEQ ID NO: 704900 - DNA, 25 bp, Mus musculus
gtgcctgtgcatctcatttaagaac

SEQ ID NO: 704901 - DNA, 25 bp, Mus musculus
gtgcctgtgcatgtcatttaagaac

SEQ ID NO: 704902 - DNA, 25 bp, Mus musculus
gtgcctgtgctgcacagcgcttcta

SEQ ID NO: 704903 - DNA, 25 bp, Mus musculus
gtgcctgtgctggacagcgcttcta

SEQ ID NO: 704904 - DNA, 25 bp, Mus musculus
gtgcctgtggccaaaaattcccaga

SEQ ID NO: 704905 - DNA, 25 bp, Mus musculus
gtgcctgtggcctaaaattcccaga

SEQ ID NO: 704906 - DNA, 25 bp, Mus musculus
gtgcctgtggtaatgccaatcctca

SEQ ID NO: 704907 - DNA, 25 bp, Mus musculus
gtgcctgtggtattgccaatcctca

SEQ ID NO: 704908 - DNA, 25 bp, Mus musculus
gtgcctgtggtcagtattgctgcat

SEQ ID NO: 704909 - DNA, 25 bp, Mus musculus
gtgcctgtggtctgtattgctgcat

SEQ ID NO: 704910 - DNA, 25 bp, Mus musculus
gtgcctgtggttatgagatctaata

SEQ ID NO: 704911 - DNA, 25 bp, Mus musculus
gtgcctgtggttttgagatctaata

SEQ ID NO: 704912 - DNA, 25 bp, Mus musculus
gtgcctgtgtacagtcctctgactg

SEQ ID NO: 704913 - DNA, 25 bp, Mus musculus
gtgcctgtgtactgtcctctgactg

SEQ ID NO: 704914 - DNA, 25 bp, Mus musculus
gtgcctgtgtgtcactttagccagt

SEQ ID NO: 704915 - DNA, 25 bp, Mus musculus
gtgcctgtgtgtgactttagccagt

SEQ ID NO: 704916 - DNA, 25 bp, Mus musculus
gtgcctgtgtttaggtctattacaa

SEQ ID NO: 704917 - DNA, 25 bp, Mus musculus
gtgcctgtgtttctgcacaagccac

SEQ ID NO: 704918 - DNA, 25 bp, Mus musculus
gtgcctgtgtttgtgcacaagccac

SEQ ID NO: 704919 - DNA, 25 bp, Mus musculus
gtgcctgtgttttggtctattacaa

SEQ ID NO: 704920 - DNA, 25 bp, Mus musculus
gtgcctgttaaccagagagccacct

SEQ ID NO: 704921 - DNA, 25 bp, Mus musculus
gtgcctgttaacgagagagccacct

SEQ ID NO: 704922 - DNA, 25 bp, Mus musculus
gtgcctgttctcatacagtgagctt

SEQ ID NO: 704923 - DNA, 25 bp, Mus musculus
gtgcctgttctcttacagtgagctt

SEQ ID NO: 704924 - DNA, 25 bp, Mus musculus
gtgcctgttctgaggagaaacttct

SEQ ID NO: 704925 - DNA, 25 bp, Mus musculus
gtgcctgttctgtggagaaacttct

SEQ ID NO: 704926 - DNA, 25 bp, Mus musculus
gtgcctgttggaccattagttcttt

SEQ ID NO: 704927 - DNA, 25 bp, Mus musculus
gtgcctgttggagcattagttcttt

SEQ ID NO: 704928 - DNA, 25 bp, Mus musculus
gtgcctgttttcaaaccttgttgat

SEQ ID NO: 704929 - DNA, 25 bp, Mus musculus
gtgcctgttttctaaccttgttgat

SEQ ID NO: 704930 - DNA, 25 bp, Mus musculus
gtgccttaaaccatcatggcgtcta

SEQ ID NO: 704931 - DNA, 25 bp, Mus musculus
gtgccttaaaccttcatggcgtcta

SEQ ID NO: 704932 - DNA, 25 bp, Mus musculus
gtgccttaacacaaggtgaccagac

SEQ ID NO: 704933 - DNA, 25 bp, Mus musculus
gtgccttaacactaggtgaccagac

SEQ ID NO: 704934 - DNA, 25 bp, Mus musculus
gtgccttaatcaagtcaccaaagcc

SEQ ID NO: 704935 - DNA, 25 bp, Mus musculus
gtgccttaatcatgtcaccaaagcc

SEQ ID NO: 704936 - DNA, 25 bp, Mus musculus
gtgccttaatggacactggtggaac

SEQ ID NO: 704937 - DNA, 25 bp, Mus musculus
gtgccttaatggtcactggtggaac

SEQ ID NO: 704938 - DNA, 25 bp, Mus musculus
gtgccttacatgagggtcacggact

SEQ ID NO: 704939 - DNA, 25 bp, Mus musculus
gtgccttacatgtgggtcacggact

SEQ ID NO: 704940 - DNA, 25 bp, Mus musculus
gtgccttaccacagtagatataacc

SEQ ID NO: 704941 - DNA, 25 bp, Mus musculus
gtgccttaccactgtagatataacc

SEQ ID NO: 704942 - DNA, 25 bp, Mus musculus
gtgccttacttaatccattgtcttc

SEQ ID NO: 704943 - DNA, 25 bp, Mus musculus
gtgccttacttattccattgtcttc

SEQ ID NO: 704944 - DNA, 25 bp, Mus musculus
gtgccttagcaactgaaaacatcta

SEQ ID NO: 704945 - DNA, 25 bp, Mus musculus
gtgccttagcaagtgaaaacatcta

SEQ ID NO: 704946 - DNA, 25 bp, Mus musculus
gtgccttagccaacctaaatacatc

SEQ ID NO: 704947 - DNA, 25 bp, Mus musculus
gtgccttagccatcctaaatacatc

SEQ ID NO: 704948 - DNA, 25 bp, Mus musculus
gtgccttaggacactataactccag

SEQ ID NO: 704949 - DNA, 25 bp, Mus musculus
gtgccttaggactctataactccag

SEQ ID NO: 704950 - DNA, 25 bp, Mus musculus
gtgccttaggctcagtaatatgtcc

SEQ ID NO: 704951 - DNA, 25 bp, Mus musculus
gtgccttaggctgagtaatatgtcc

SEQ ID NO: 704952 - DNA, 25 bp, Mus musculus
gtgccttaggttatgaacgatcttt

SEQ ID NO: 704953 - DNA, 25 bp, Mus musculus
gtgccttaggttcactccggatgag

SEQ ID NO: 704954 - DNA, 25 bp, Mus musculus
gtgccttaggttgactccggatgag

SEQ ID NO: 704955 - DNA, 25 bp, Mus musculus
gtgccttaggttttgaacgatcttt

SEQ ID NO: 704956 - DNA, 25 bp, Mus musculus
gtgccttagtacagtatttatgcct

SEQ ID NO: 704957 - DNA, 25 bp, Mus musculus
gtgccttagtactgtatttatgcct

SEQ ID NO: 704958 - DNA, 25 bp, Mus musculus
gtgccttagttgagggtccctttct

SEQ ID NO: 704959 - DNA, 25 bp, Mus musculus
gtgccttagttgtgggtccctttct

SEQ ID NO: 704960 - DNA, 25 bp, Mus musculus
gtgccttatactctgttctgaaagg

SEQ ID NO: 704961 - DNA, 25 bp, Mus musculus
gtgccttatactgtgttctgaaagg

SEQ ID NO: 704962 - DNA, 25 bp, Mus musculus
gtgccttataggcattcgcgtaact

SEQ ID NO: 704963 - DNA, 25 bp, Mus musculus
gtgccttatagggattcgcgtaact

SEQ ID NO: 704964 - DNA, 25 bp, Mus musculus
gtgccttatcaactggagagcctgg

SEQ ID NO: 704965 - DNA, 25 bp, Mus musculus
gtgccttatcaagtggagagcctgg

SEQ ID NO: 704966 - DNA, 25 bp, Mus musculus
gtgccttatccaccagaacttactg

SEQ ID NO: 704967 - DNA, 25 bp, Mus musculus
gtgccttatccagcagaacttactg

SEQ ID NO: 704968 - DNA, 25 bp, Mus musculus
gtgccttatgaaatatcccgagtct

SEQ ID NO: 704969 - DNA, 25 bp, Mus musculus
gtgccttatgaattatcccgagtct

SEQ ID NO: 704970 - DNA, 25 bp, Mus musculus
gtgccttatgacagggaactggaat

SEQ ID NO: 704971 - DNA, 25 bp, Mus musculus
gtgccttatgactgggaactggaat

SEQ ID NO: 704972 - DNA, 25 bp, Mus musculus
gtgccttattcaagtacttggtaaa

SEQ ID NO: 704973 - DNA, 25 bp, Mus musculus
gtgccttattcatgtacttggtaaa

SEQ ID NO: 704974 - DNA, 25 bp, Mus musculus
gtgccttattctatggcgaacccaa

SEQ ID NO: 704975 - DNA, 25 bp, Mus musculus
gtgccttattctttggcgaacccaa

SEQ ID NO: 704976 - DNA, 25 bp, Mus musculus
gtgccttattgtctattgctgtgat

SEQ ID NO: 704977 - DNA, 25 bp, Mus musculus
gtgccttattgtgtattgctgtgat

SEQ ID NO: 704978 - DNA, 25 bp, Mus musculus
gtgccttcaaacacagctgttccag

SEQ ID NO: 704979 - DNA, 25 bp, Mus musculus
gtgccttcaaactcagctgttccag

SEQ ID NO: 704980 - DNA, 25 bp, Mus musculus
gtgccttcagggactgacatgtcat

SEQ ID NO: 704981 - DNA, 25 bp, Mus musculus
gtgccttcagggtctgacatgtcat

SEQ ID NO: 704982 - DNA, 25 bp, Mus musculus
gtgccttcagtacacgtttggactc

SEQ ID NO: 704983 - DNA, 25 bp, Mus musculus
gtgccttcagtagacgtttggactc

SEQ ID NO: 704984 - DNA, 25 bp, Mus musculus
gtgccttcataccatgtggcttaat

SEQ ID NO: 704985 - DNA, 25 bp, Mus musculus
gtgccttcatacgatgtggcttaat

SEQ ID NO: 704986 - DNA, 25 bp, Mus musculus
gtgccttcatgtattcttcgatgag

SEQ ID NO: 704987 - DNA, 25 bp, Mus musculus
gtgccttcatgttttcttcgatgag

SEQ ID NO: 704988 - DNA, 25 bp, Mus musculus
gtgccttccaagaggtttggacctc

SEQ ID NO: 704989 - DNA, 25 bp, Mus musculus
gtgccttccaagtggtttggacctc

SEQ ID NO: 704990 - DNA, 25 bp, Mus musculus
gtgccttccaccaagagatgactgt

SEQ ID NO: 704991 - DNA, 25 bp, Mus musculus
gtgccttccacctagagatgactgt

SEQ ID NO: 704992 - DNA, 25 bp, Mus musculus
gtgccttccactagataaatattta

SEQ ID NO: 704993 - DNA, 25 bp, Mus musculus
gtgccttccacttgataaatattta

SEQ ID NO: 704994 - DNA, 25 bp, Mus musculus
gtgccttcccacctggttttagtag

SEQ ID NO: 704995 - DNA, 25 bp, Mus musculus
gtgccttcccacgtggttttagtag

SEQ ID NO: 704996 - DNA, 25 bp, Mus musculus
gtgccttcctggaatgcgagtaatc

SEQ ID NO: 704997 - DNA, 25 bp, Mus musculus
gtgccttcctggtatgcgagtaatc

SEQ ID NO: 704998 - DNA, 25 bp, Mus musculus
gtgccttcggccaaagtggcaagtt

SEQ ID NO: 704999 - DNA, 25 bp, Mus musculus
gtgccttcggcctaagtggcaagtt

SEQ ID NO: 705000 - DNA, 25 bp, Mus musculus
gtgccttcgtcacctacgagaagat

SEQ ID NO: 705001 - DNA, 25 bp, Mus musculus
gtgccttcgtcagctacgagaagat

SEQ ID NO: 705002 - DNA, 25 bp, Mus musculus
gtgccttctactcgcctctgcaggt

SEQ ID NO: 705003 - DNA, 25 bp, Mus musculus
gtgccttctactggcctctgcaggt

SEQ ID NO: 705004 - DNA, 25 bp, Mus musculus
gtgccttctataccaaagagaatat

SEQ ID NO: 705005 - DNA, 25 bp, Mus musculus
gtgccttctatagcaaagagaatat

SEQ ID NO: 705006 - DNA, 25 bp, Mus musculus
gtgccttctattacatcattccagt

SEQ ID NO: 705007 - DNA, 25 bp, Mus musculus
gtgccttctattaggtgacaccagc

SEQ ID NO: 705008 - DNA, 25 bp, Mus musculus
gtgccttctatttcatcattccagt

SEQ ID NO: 705009 - DNA, 25 bp, Mus musculus
gtgccttctatttggtgacaccagc

SEQ ID NO: 705010 - DNA, 25 bp, Mus musculus
gtgccttctcagcaagttctgatcc

SEQ ID NO: 705011 - DNA, 25 bp, Mus musculus
gtgccttctcaggaagttctgatcc

SEQ ID NO: 705012 - DNA, 25 bp, Mus musculus
gtgccttctctgaaacttatgatcc

SEQ ID NO: 705013 - DNA, 25 bp, Mus musculus
gtgccttctctgtaacttatgatcc

SEQ ID NO: 705014 - DNA, 25 bp, Mus musculus
gtgccttctgagagtaatgcagcaa

SEQ ID NO: 705015 - DNA, 25 bp, Mus musculus
gtgccttctgagtgtaatgcagcaa

SEQ ID NO: 705016 - DNA, 25 bp, Mus musculus
gtgccttctggcattctaagcatag

SEQ ID NO: 705017 - DNA, 25 bp, Mus musculus
gtgccttctggctttctaagcatag

SEQ ID NO: 705018 - DNA, 25 bp, Mus musculus
gtgccttcttagactttaggaatag

SEQ ID NO: 705019 - DNA, 25 bp, Mus musculus
gtgccttcttagtctttaggaatag

SEQ ID NO: 705020 - DNA, 25 bp, Mus musculus
gtgccttcttatatcctcagtgaac

SEQ ID NO: 705021 - DNA, 25 bp, Mus musculus
gtgccttcttatttcctcagtgaac

SEQ ID NO: 705022 - DNA, 25 bp, Mus musculus
gtgccttctttcaggcatacatctc

SEQ ID NO: 705023 - DNA, 25 bp, Mus musculus
gtgccttctttctggcatacatctc

SEQ ID NO: 705024 - DNA, 25 bp, Mus musculus
gtgccttgaataactatgtgtccta

SEQ ID NO: 705025 - DNA, 25 bp, Mus musculus
gtgccttgaatatctatgtgtccta

SEQ ID NO: 705026 - DNA, 25 bp, Mus musculus
gtgccttgacacagagaccatttat

SEQ ID NO: 705027 - DNA, 25 bp, Mus musculus
gtgccttgacactgagaccatttat

SEQ ID NO: 705028 - DNA, 25 bp, Mus musculus
gtgccttgactcctagtgccctgga

SEQ ID NO: 705029 - DNA, 25 bp, Mus musculus
gtgccttgactcgtagtgccctgga

SEQ ID NO: 705030 - DNA, 25 bp, Mus musculus
gtgccttgcagaaacagacagtcag

SEQ ID NO: 705031 - DNA, 25 bp, Mus musculus
gtgccttgcagaaaggtgagctttc

SEQ ID NO: 705032 - DNA, 25 bp, Mus musculus
gtgccttgcagatacagacagtcag

SEQ ID NO: 705033 - DNA, 25 bp, Mus musculus
gtgccttgcagataggtgagctttc

SEQ ID NO: 705034 - DNA, 25 bp, Mus musculus
gtgccttgccatctggctgagaaga

SEQ ID NO: 705035 - DNA, 25 bp, Mus musculus
gtgccttgccatgtggctgagaaga

SEQ ID NO: 705036 - DNA, 25 bp, Mus musculus
gtgccttgcccaaaataggtactca

SEQ ID NO: 705037 - DNA, 25 bp, Mus musculus
gtgccttgcccaaattgtggccgga

SEQ ID NO: 705038 - DNA, 25 bp, Mus musculus
gtgccttgcccataataggtactca

SEQ ID NO: 705039 - DNA, 25 bp, Mus musculus
gtgccttgcccatattgtggccgga

SEQ ID NO: 705040 - DNA, 25 bp, Mus musculus
gtgccttgcccgaaataggatccat

SEQ ID NO: 705041 - DNA, 25 bp, Mus musculus
gtgccttgcccgtaataggatccat

SEQ ID NO: 705042 - DNA, 25 bp, Mus musculus
gtgccttgcggaactgttttctgtt

SEQ ID NO: 705043 - DNA, 25 bp, Mus musculus
gtgccttgcggatctgttttctgtt

SEQ ID NO: 705044 - DNA, 25 bp, Mus musculus
gtgccttgctatacttctctaaaga

SEQ ID NO: 705045 - DNA, 25 bp, Mus musculus
gtgccttgctattcttctctaaaga

SEQ ID NO: 705046 - DNA, 25 bp, Mus musculus
gtgccttgctcaatcttgagtagca

SEQ ID NO: 705047 - DNA, 25 bp, Mus musculus
gtgccttgctcattcttgagtagca

SEQ ID NO: 705048 - DNA, 25 bp, Mus musculus
gtgccttgctggagcgttaaccact

SEQ ID NO: 705049 - DNA, 25 bp, Mus musculus
gtgccttgctggtgcgttaaccact

SEQ ID NO: 705050 - DNA, 25 bp, Mus musculus
gtgccttgctttacacttgtgttgg

SEQ ID NO: 705051 - DNA, 25 bp, Mus musculus
gtgccttgcttttcacttgtgttgg

SEQ ID NO: 705052 - DNA, 25 bp, Mus musculus
gtgccttggaaaactcagtggtctc

SEQ ID NO: 705053 - DNA, 25 bp, Mus musculus
gtgccttggaaatctcagtggtctc

SEQ ID NO: 705054 - DNA, 25 bp, Mus musculus
gtgccttggacgagtacacctccga

SEQ ID NO: 705055 - DNA, 25 bp, Mus musculus
gtgccttggacgcttgctctctcag

SEQ ID NO: 705056 - DNA, 25 bp, Mus musculus
gtgccttggacggttgctctctcag

SEQ ID NO: 705057 - DNA, 25 bp, Mus musculus
gtgccttggacgtgtacacctccga

SEQ ID NO: 705058 - DNA, 25 bp, Mus musculus
gtgccttggcaaaaggactgggatt

SEQ ID NO: 705059 - DNA, 25 bp, Mus musculus
gtgccttggcaataggactgggatt

SEQ ID NO: 705060 - DNA, 25 bp, Mus musculus
gtgccttggtacaaacagacccaca

SEQ ID NO: 705061 - DNA, 25 bp, Mus musculus
gtgccttggtactaacagacccaca

SEQ ID NO: 705062 - DNA, 25 bp, Mus musculus
gtgccttggttccagtcaagttgtg

SEQ ID NO: 705063 - DNA, 25 bp, Mus musculus
gtgccttggttcgagtcaagttgtg

SEQ ID NO: 705064 - DNA, 25 bp, Mus musculus
gtgccttggtttcggtttattatca

SEQ ID NO: 705065 - DNA, 25 bp, Mus musculus
gtgccttggtttgggtttattatca

SEQ ID NO: 705066 - DNA, 25 bp, Mus musculus
gtgccttgtagtagtatccacaggt

SEQ ID NO: 705067 - DNA, 25 bp, Mus musculus
gtgccttgtagttgtatccacaggt

SEQ ID NO: 705068 - DNA, 25 bp, Mus musculus
gtgccttgtcacatgtttcagaatt

SEQ ID NO: 705069 - DNA, 25 bp, Mus musculus
gtgccttgtcacttgtttcagaatt

SEQ ID NO: 705070 - DNA, 25 bp, Mus musculus
gtgccttgtcagcttcagtttccta

SEQ ID NO: 705071 - DNA, 25 bp, Mus musculus
gtgccttgtcaggttcagtttccta

SEQ ID NO: 705072 - DNA, 25 bp, Mus musculus
gtgccttgtcgaaaaccacactcgg

SEQ ID NO: 705073 - DNA, 25 bp, Mus musculus
gtgccttgtcgataaccacactcgg

SEQ ID NO: 705074 - DNA, 25 bp, Mus musculus
gtgccttgtctacgagcactagcat

SEQ ID NO: 705075 - DNA, 25 bp, Mus musculus
gtgccttgtctaggagcactagcat

SEQ ID NO: 705076 - DNA, 25 bp, Mus musculus
gtgccttgtctgagtgccagtgaga

SEQ ID NO: 705077 - DNA, 25 bp, Mus musculus
gtgccttgtctgtgtgccagtgaga

SEQ ID NO: 705078 - DNA, 25 bp, Mus musculus
gtgccttgtgaacaagagttttcct

SEQ ID NO: 705079 - DNA, 25 bp, Mus musculus
gtgccttgtgaagaagagttttcct

SEQ ID NO: 705080 - DNA, 25 bp, Mus musculus
gtgccttgtggcaccaagtatggca

SEQ ID NO: 705081 - DNA, 25 bp, Mus musculus
gtgccttgtggctccaagtatggca

SEQ ID NO: 705082 - DNA, 25 bp, Mus musculus
gtgccttgtgtgactgactgctgcg

SEQ ID NO: 705083 - DNA, 25 bp, Mus musculus
gtgccttgtgtgtctgactgctgcg

SEQ ID NO: 705084 - DNA, 25 bp, Mus musculus
gtgccttgtttcaacattagcaact

SEQ ID NO: 705085 - DNA, 25 bp, Mus musculus
gtgccttgtttcagcagagcttaca

SEQ ID NO: 705086 - DNA, 25 bp, Mus musculus
gtgccttgtttctacattagcaact

SEQ ID NO: 705087 - DNA, 25 bp, Mus musculus
gtgccttgtttctgcagagcttaca

SEQ ID NO: 705088 - DNA, 25 bp, Mus musculus
gtgcctttacatacataatcccgac

SEQ ID NO: 705089 - DNA, 25 bp, Mus musculus
gtgcctttacattcataatcccgac

SEQ ID NO: 705090 - DNA, 25 bp, Mus musculus
gtgcctttactgattgtacatatta

SEQ ID NO: 705091 - DNA, 25 bp, Mus musculus
gtgcctttactgtttgtacatatta

SEQ ID NO: 705092 - DNA, 25 bp, Mus musculus
gtgcctttacttactgacctggatg

SEQ ID NO: 705093 - DNA, 25 bp, Mus musculus
gtgcctttactttctgacctggatg

SEQ ID NO: 705094 - DNA, 25 bp, Mus musculus
gtgcctttagacagccaatgtttgg

SEQ ID NO: 705095 - DNA, 25 bp, Mus musculus
gtgcctttagactgccaatgtttgg

SEQ ID NO: 705096 - DNA, 25 bp, Mus musculus
gtgcctttatatcacatacatgaca

SEQ ID NO: 705097 - DNA, 25 bp, Mus musculus
gtgcctttatatgacatacatgaca

SEQ ID NO: 705098 - DNA, 25 bp, Mus musculus
gtgcctttatcaatgggacggccac

SEQ ID NO: 705099 - DNA, 25 bp, Mus musculus
gtgcctttatcattgggacggccac

SEQ ID NO: 705100 - DNA, 25 bp, Mus musculus
gtgcctttatctaggctaatttagc

SEQ ID NO: 705101 - DNA, 25 bp, Mus musculus
gtgcctttatctccttccaattgga

SEQ ID NO: 705102 - DNA, 25 bp, Mus musculus
gtgcctttatctgcttccaattgga

SEQ ID NO: 705103 - DNA, 25 bp, Mus musculus
gtgcctttatcttggctaatttagc

SEQ ID NO: 705104 - DNA, 25 bp, Mus musculus
gtgcctttcaacaacttctttcata

SEQ ID NO: 705105 - DNA, 25 bp, Mus musculus
gtgcctttcaactacttctttcata

SEQ ID NO: 705106 - DNA, 25 bp, Mus musculus
gtgcctttccccatcgacatcaaga

SEQ ID NO: 705107 - DNA, 25 bp, Mus musculus
gtgcctttccccttcgacatcaaga

SEQ ID NO: 705108 - DNA, 25 bp, Mus musculus
gtgcctttctctatctctatttttg

SEQ ID NO: 705109 - DNA, 25 bp, Mus musculus
gtgcctttctctttctctatttttg

SEQ ID NO: 705110 - DNA, 25 bp, Mus musculus
gtgcctttcttcagcagtagagcgc

SEQ ID NO: 705111 - DNA, 25 bp, Mus musculus
gtgcctttcttctgcagtagagcgc

SEQ ID NO: 705112 - DNA, 25 bp, Mus musculus
gtgcctttctttaccgacgagtgta

SEQ ID NO: 705113 - DNA, 25 bp, Mus musculus
gtgcctttcttttccgacgagtgta

SEQ ID NO: 705114 - DNA, 25 bp, Mus musculus
gtgcctttgaggcctttgataccag

SEQ ID NO: 705115 - DNA, 25 bp, Mus musculus
gtgcctttgagggctttgataccag

SEQ ID NO: 705116 - DNA, 25 bp, Mus musculus
gtgcctttgataacagctgaccata

SEQ ID NO: 705117 - DNA, 25 bp, Mus musculus
gtgcctttgatatcagctgaccata

SEQ ID NO: 705118 - DNA, 25 bp, Mus musculus
gtgcctttgcatcagggaagcccag

SEQ ID NO: 705119 - DNA, 25 bp, Mus musculus
gtgcctttgcatccatttggtagcc

SEQ ID NO: 705120 - DNA, 25 bp, Mus musculus
gtgcctttgcatgagggaagcccag

SEQ ID NO: 705121 - DNA, 25 bp, Mus musculus
gtgcctttgcatgcatttggtagcc

SEQ ID NO: 705122 - DNA, 25 bp, Mus musculus
gtgcctttgctgctatggatcaaaa

SEQ ID NO: 705123 - DNA, 25 bp, Mus musculus
gtgcctttgctggtatggatcaaaa

SEQ ID NO: 705124 - DNA, 25 bp, Mus musculus
gtgcctttggccaagttactttgct

SEQ ID NO: 705125 - DNA, 25 bp, Mus musculus
gtgcctttggcctagttactttgct

SEQ ID NO: 705126 - DNA, 25 bp, Mus musculus
gtgcctttgggaagccccagggcac

SEQ ID NO: 705127 - DNA, 25 bp, Mus musculus
gtgcctttgggatgccccagggcac

SEQ ID NO: 705128 - DNA, 25 bp, Mus musculus
gtgcctttgtaaaacagtcttcccc

SEQ ID NO: 705129 - DNA, 25 bp, Mus musculus
gtgcctttgtaaagccatcagctgt

SEQ ID NO: 705130 - DNA, 25 bp, Mus musculus
gtgcctttgtaatacagtcttcccc

SEQ ID NO: 705131 - DNA, 25 bp, Mus musculus
gtgcctttgtaatgccatcagctgt

SEQ ID NO: 705132 - DNA, 25 bp, Mus musculus
gtgcctttgtctcgcgatgatgaaa

SEQ ID NO: 705133 - DNA, 25 bp, Mus musculus
gtgcctttgtctggcgatgatgaaa

SEQ ID NO: 705134 - DNA, 25 bp, Mus musculus
gtgcctttgtggcaccttggtgcca

SEQ ID NO: 705135 - DNA, 25 bp, Mus musculus
gtgcctttgtgggaccttggtgcca

SEQ ID NO: 705136 - DNA, 25 bp, Mus musculus
gtgcctttgtgtcataaatgggttc

SEQ ID NO: 705137 - DNA, 25 bp, Mus musculus
gtgcctttgtgtgataaatgggttc

SEQ ID NO: 705138 - DNA, 25 bp, Mus musculus
gtgcctttgttgagttgcaatgctg

SEQ ID NO: 705139 - DNA, 25 bp, Mus musculus
gtgcctttgttgtgttgcaatgctg

SEQ ID NO: 705140 - DNA, 25 bp, Mus musculus
gtgccttttaataagtttgtctcaa

SEQ ID NO: 705141 - DNA, 25 bp, Mus musculus
gtgccttttaattagtttgtctcaa

SEQ ID NO: 705142 - DNA, 25 bp, Mus musculus
gtgccttttcaaagacaacgacgac

SEQ ID NO: 705143 - DNA, 25 bp, Mus musculus
gtgccttttcaatgacaacgacgac

SEQ ID NO: 705144 - DNA, 25 bp, Mus musculus
gtgccttttcttaactttgcttata

SEQ ID NO: 705145 - DNA, 25 bp, Mus musculus
gtgccttttctttactttgcttata

SEQ ID NO: 705146 - DNA, 25 bp, Mus musculus
gtgccttttggtacgagcttagaat

SEQ ID NO: 705147 - DNA, 25 bp, Mus musculus
gtgccttttggtagatacttgtgtg

SEQ ID NO: 705148 - DNA, 25 bp, Mus musculus
gtgccttttggttcgagcttagaat

SEQ ID NO: 705149 - DNA, 25 bp, Mus musculus
gtgccttttggttgatacttgtgtg

SEQ ID NO: 705150 - DNA, 25 bp, Mus musculus
gtgcctttttacacaacttcatggt

SEQ ID NO: 705151 - DNA, 25 bp, Mus musculus
gtgcctttttactcaacttcatggt

SEQ ID NO: 705152 - DNA, 25 bp, Mus musculus
gtgcctttttcacaaaagtcagctg

SEQ ID NO: 705153 - DNA, 25 bp, Mus musculus
gtgcctttttcagaaaagtcagctg

SEQ ID NO: 705154 - DNA, 25 bp, Mus musculus
gtgcgaacacatagacaggtccagc

SEQ ID NO: 705155 - DNA, 25 bp, Mus musculus
gtgcgaacacattgacaggtccagc

SEQ ID NO: 705156 - DNA, 25 bp, Mus musculus
gtgcgaacagtcatggcctcctgac

SEQ ID NO: 705157 - DNA, 25 bp, Mus musculus
gtgcgaacagtcttggcctcctgac

SEQ ID NO: 705158 - DNA, 25 bp, Mus musculus
gtgcgaactgcccacatacagttaa

SEQ ID NO: 705159 - DNA, 25 bp, Mus musculus
gtgcgaactgccgacatacagttaa

SEQ ID NO: 705160 - DNA, 25 bp, Mus musculus
gtgcgaagtagccagcttctcaacg

SEQ ID NO: 705161 - DNA, 25 bp, Mus musculus
gtgcgaagtagcgagcttctcaacg

SEQ ID NO: 705162 - DNA, 25 bp, Mus musculus
gtgcgaatacacaccagtcttccat

SEQ ID NO: 705163 - DNA, 25 bp, Mus musculus
gtgcgaatacactccagtcttccat

SEQ ID NO: 705164 - DNA, 25 bp, Mus musculus
gtgcgaatcgacagaagcattgtga

SEQ ID NO: 705165 - DNA, 25 bp, Mus musculus
gtgcgaatcgactgaagcattgtga

SEQ ID NO: 705166 - DNA, 25 bp, Mus musculus
gtgcgaatggccagttgacaaagtt

SEQ ID NO: 705167 - DNA, 25 bp, Mus musculus
gtgcgaatggcctgttgacaaagtt

SEQ ID NO: 705168 - DNA, 25 bp, Mus musculus
gtgcgaattgagctgagcccacaat

SEQ ID NO: 705169 - DNA, 25 bp, Mus musculus
gtgcgaattgaggtgagcccacaat

SEQ ID NO: 705170 - DNA, 25 bp, Mus musculus
gtgcgacacatacatgtctgtgcta

SEQ ID NO: 705171 - DNA, 25 bp, Mus musculus
gtgcgacacatagatgtctgtgcta

SEQ ID NO: 705172 - DNA, 25 bp, Mus musculus
gtgcgacacatgatctatgacctta

SEQ ID NO: 705173 - DNA, 25 bp, Mus musculus
gtgcgacacatgttctatgacctta

SEQ ID NO: 705174 - DNA, 25 bp, Mus musculus
gtgcgaccacagagccagggagtat

SEQ ID NO: 705175 - DNA, 25 bp, Mus musculus
gtgcgaccacagtgccagggagtat

SEQ ID NO: 705176 - DNA, 25 bp, Mus musculus
gtgcgaccatcacctgggctgcagt

SEQ ID NO: 705177 - DNA, 25 bp, Mus musculus
gtgcgaccatcagctgggctgcagt

SEQ ID NO: 705178 - DNA, 25 bp, Mus musculus
gtgcgaccccaaagcaagctgctgt

SEQ ID NO: 705179 - DNA, 25 bp, Mus musculus
gtgcgaccccaatgcaagctgctgt

SEQ ID NO: 705180 - DNA, 25 bp, Mus musculus
gtgcgaccttcaatagtggagctga

SEQ ID NO: 705181 - DNA, 25 bp, Mus musculus
gtgcgaccttcattagtggagctga

SEQ ID NO: 705182 - DNA, 25 bp, Mus musculus
gtgcgactaaggaggtctctgtcct

SEQ ID NO: 705183 - DNA, 25 bp, Mus musculus
gtgcgactaaggtggtctctgtcct

SEQ ID NO: 705184 - DNA, 25 bp, Mus musculus
gtgcgacttgccacagtgaatttcc

SEQ ID NO: 705185 - DNA, 25 bp, Mus musculus
gtgcgacttgcctcagtgaatttcc

SEQ ID NO: 705186 - DNA, 25 bp, Mus musculus
gtgcgagaaattcctcaggacttca

SEQ ID NO: 705187 - DNA, 25 bp, Mus musculus
gtgcgagaaattgctcaggacttca

SEQ ID NO: 705188 - DNA, 25 bp, Mus musculus
gtgcgagaagatcattaacatcgtg

SEQ ID NO: 705189 - DNA, 25 bp, Mus musculus
gtgcgagaagatgattaacatcgtg

SEQ ID NO: 705190 - DNA, 25 bp, Mus musculus
gtgcgagactgtcatgccgaactgt

SEQ ID NO: 705191 - DNA, 25 bp, Mus musculus
gtgcgagactgtgatgccgaactgt

SEQ ID NO: 705192 - DNA, 25 bp, Mus musculus
gtgcgagagactacatgcgggtttt

SEQ ID NO: 705193 - DNA, 25 bp, Mus musculus
gtgcgagagacttcatgcgggtttt

SEQ ID NO: 705194 - DNA, 25 bp, Mus musculus
gtgcgagagccgatagctgtcagaa

SEQ ID NO: 705195 - DNA, 25 bp, Mus musculus
gtgcgagagccgttagctgtcagaa

SEQ ID NO: 705196 - DNA, 25 bp, Mus musculus
gtgcgagagtgtattcatgccaagt

SEQ ID NO: 705197 - DNA, 25 bp, Mus musculus
gtgcgagagtgttttcatgccaagt

SEQ ID NO: 705198 - DNA, 25 bp, Mus musculus
gtgcgagagttccaaagagccactc

SEQ ID NO: 705199 - DNA, 25 bp, Mus musculus
gtgcgagagttcgaaagagccactc

SEQ ID NO: 705200 - DNA, 25 bp, Mus musculus
gtgcgagcctatcaacattcttctt

SEQ ID NO: 705201 - DNA, 25 bp, Mus musculus
gtgcgagcctatgaacattcttctt

SEQ ID NO: 705202 - DNA, 25 bp, Mus musculus
gtgcgagcgaaaacacagcctttct

SEQ ID NO: 705203 - DNA, 25 bp, Mus musculus
gtgcgagcgaaatcacagcctttct

SEQ ID NO: 705204 - DNA, 25 bp, Mus musculus
gtgcgagcgacacacacacttgggc

SEQ ID NO: 705205 - DNA, 25 bp, Mus musculus
gtgcgagcgacagacacacttgggc

SEQ ID NO: 705206 - DNA, 25 bp, Mus musculus
gtgcgagcgcttacacagcgcggac

SEQ ID NO: 705207 - DNA, 25 bp, Mus musculus
gtgcgagcgctttcacagcgcggac

SEQ ID NO: 705208 - DNA, 25 bp, Mus musculus
gtgcgaggaatgagtaagaccgtct

SEQ ID NO: 705209 - DNA, 25 bp, Mus musculus
gtgcgaggaatgtgtaagaccgtct

SEQ ID NO: 705210 - DNA, 25 bp, Mus musculus
gtgcgaggcggccatccgcatctac

SEQ ID NO: 705211 - DNA, 25 bp, Mus musculus
gtgcgaggcggcgatccgcatctac

SEQ ID NO: 705212 - DNA, 25 bp, Mus musculus
gtgcgagtaatccttaaattggaat

SEQ ID NO: 705213 - DNA, 25 bp, Mus musculus
gtgcgagtaatcgttaaattggaat

SEQ ID NO: 705214 - DNA, 25 bp, Mus musculus
gtgcgagtacaacggcagactctca

SEQ ID NO: 705215 - DNA, 25 bp, Mus musculus
gtgcgagtacaagggcagactctca

SEQ ID NO: 705216 - DNA, 25 bp, Mus musculus
gtgcgagtagttaaatagcctttga

SEQ ID NO: 705217 - DNA, 25 bp, Mus musculus
gtgcgagtagtttaatagcctttga

SEQ ID NO: 705218 - DNA, 25 bp, Mus musculus
gtgcgagttcacagtttaatctctt

SEQ ID NO: 705219 - DNA, 25 bp, Mus musculus
gtgcgagttcactgtttaatctctt

SEQ ID NO: 705220 - DNA, 25 bp, Mus musculus
gtgcgatatctacagtaccctttta

SEQ ID NO: 705221 - DNA, 25 bp, Mus musculus
gtgcgatatctagagtaccctttta

SEQ ID NO: 705222 - DNA, 25 bp, Mus musculus
gtgcgatcagtaaggattcctgtaa

SEQ ID NO: 705223 - DNA, 25 bp, Mus musculus
gtgcgatcagtatggattcctgtaa

SEQ ID NO: 705224 - DNA, 25 bp, Mus musculus
gtgcgatcgtcacaatttgtccctc

SEQ ID NO: 705225 - DNA, 25 bp, Mus musculus
gtgcgatcgtcagaatttgtccctc

SEQ ID NO: 705226 - DNA, 25 bp, Mus musculus
gtgcgatgagcacgttcaactattc

SEQ ID NO: 705227 - DNA, 25 bp, Mus musculus
gtgcgatgagcaggttcaactattc

SEQ ID NO: 705228 - DNA, 25 bp, Mus musculus
gtgcgatggagtcgatcatgattaa

SEQ ID NO: 705229 - DNA, 25 bp, Mus musculus
gtgcgatggagtggatcatgattaa

SEQ ID NO: 705230 - DNA, 25 bp, Mus musculus
gtgcgatggattaaatatcctcctg

SEQ ID NO: 705231 - DNA, 25 bp, Mus musculus
gtgcgatggatttaatatcctcctg

SEQ ID NO: 705232 - DNA, 25 bp, Mus musculus
gtgcgatggcatcgttgagccctcc

SEQ ID NO: 705233 - DNA, 25 bp, Mus musculus
gtgcgatggcatggttgagccctcc

SEQ ID NO: 705234 - DNA, 25 bp, Mus musculus
gtgcgatggtaacagtccaaccgta

SEQ ID NO: 705235 - DNA, 25 bp, Mus musculus
gtgcgatggtaagagtccaaccgta

SEQ ID NO: 705236 - DNA, 25 bp, Mus musculus
gtgcgatgtgtcatgagctaataaa

SEQ ID NO: 705237 - DNA, 25 bp, Mus musculus
gtgcgatgtgtcttgagctaataaa

SEQ ID NO: 705238 - DNA, 25 bp, Mus musculus
gtgcgcaacactacatcttcatgtg

SEQ ID NO: 705239 - DNA, 25 bp, Mus musculus
gtgcgcaacacttcatcttcatgtg

SEQ ID NO: 705240 - DNA, 25 bp, Mus musculus
gtgcgcaactggacaagtccccagg

SEQ ID NO: 705241 - DNA, 25 bp, Mus musculus
gtgcgcaactggtcaagtccccagg

SEQ ID NO: 705242 - DNA, 25 bp, Mus musculus
gtgcgcaaggagcacttggaacccc

SEQ ID NO: 705243 - DNA, 25 bp, Mus musculus
gtgcgcaaggaggacttggaacccc

SEQ ID NO: 705244 - DNA, 25 bp, Mus musculus
gtgcgcacacatatgtgtacctgtt

SEQ ID NO: 705245 - DNA, 25 bp, Mus musculus
gtgcgcacacatttgtgtacctgtt

SEQ ID NO: 705246 - DNA, 25 bp, Mus musculus
gtgcgcacagacagcactggctctg

SEQ ID NO: 705247 - DNA, 25 bp, Mus musculus
gtgcgcacagactgcactggctctg

SEQ ID NO: 705248 - DNA, 25 bp, Mus musculus
gtgcgcaccctgaggttcagctgtg

SEQ ID NO: 705249 - DNA, 25 bp, Mus musculus
gtgcgcaccctgtggttcagctgtg

SEQ ID NO: 705250 - DNA, 25 bp, Mus musculus
gtgcgcaccgggactctagccagaa

SEQ ID NO: 705251 - DNA, 25 bp, Mus musculus
gtgcgcaccgggtctctagccagaa

SEQ ID NO: 705252 - DNA, 25 bp, Mus musculus
gtgcgcaccgtcaagttcatgttta

SEQ ID NO: 705253 - DNA, 25 bp, Mus musculus
gtgcgcaccgtctagttcatgttta

SEQ ID NO: 705254 - DNA, 25 bp, Mus musculus
gtgcgcacctctactgacataagat

SEQ ID NO: 705255 - DNA, 25 bp, Mus musculus
gtgcgcacctcttctgacataagat

SEQ ID NO: 705256 - DNA, 25 bp, Mus musculus
gtgcgcacgtggaaaaggtgaccta

SEQ ID NO: 705257 - DNA, 25 bp, Mus musculus
gtgcgcacgtggtaaaggtgaccta

SEQ ID NO: 705258 - DNA, 25 bp, Mus musculus
gtgcgcactaatcctatcctttaag

SEQ ID NO: 705259 - DNA, 25 bp, Mus musculus
gtgcgcactaatgctatcctttaag

SEQ ID NO: 705260 - DNA, 25 bp, Mus musculus
gtgcgcactcacaggatcttgctat

SEQ ID NO: 705261 - DNA, 25 bp, Mus musculus
gtgcgcactcactggatcttgctat

SEQ ID NO: 705262 - DNA, 25 bp, Mus musculus
gtgcgcactgcacaccatatatggt

SEQ ID NO: 705263 - DNA, 25 bp, Mus musculus
gtgcgcactgcagaccatatatggt

SEQ ID NO: 705264 - DNA, 25 bp, Mus musculus
gtgcgcactggaaatctctaggctg

SEQ ID NO: 705265 - DNA, 25 bp, Mus musculus
gtgcgcactggatatctctaggctg

SEQ ID NO: 705266 - DNA, 25 bp, Mus musculus
gtgcgcacttctctggacctggagc

SEQ ID NO: 705267 - DNA, 25 bp, Mus musculus
gtgcgcacttctgtggacctggagc

SEQ ID NO: 705268 - DNA, 25 bp, Mus musculus
gtgcgcagacagaccgtgtctctat

SEQ ID NO: 705269 - DNA, 25 bp, Mus musculus
gtgcgcagacagtccgtgtctctat

SEQ ID NO: 705270 - DNA, 25 bp, Mus musculus
gtgcgcagggctcaatgcaacctct

SEQ ID NO: 705271 - DNA, 25 bp, Mus musculus
gtgcgcagggctgaatgcaacctct

SEQ ID NO: 705272 - DNA, 25 bp, Mus musculus
gtgcgcataagcaatcaccatcttc

SEQ ID NO: 705273 - DNA, 25 bp, Mus musculus
gtgcgcataagcacatgcaggcatg

SEQ ID NO: 705274 - DNA, 25 bp, Mus musculus
gtgcgcataagctatcaccatcttc

SEQ ID NO: 705275 - DNA, 25 bp, Mus musculus
gtgcgcataagctcatgcaggcatg

SEQ ID NO: 705276 - DNA, 25 bp, Mus musculus
gtgcgcatcaagaagggcagccatc

SEQ ID NO: 705277 - DNA, 25 bp, Mus musculus
gtgcgcatcaagtagggcagccatc

SEQ ID NO: 705278 - DNA, 25 bp, Mus musculus
gtgcgcatgatgcagctcattcagg

SEQ ID NO: 705279 - DNA, 25 bp, Mus musculus
gtgcgcatgatggagctcattcagg

SEQ ID NO: 705280 - DNA, 25 bp, Mus musculus
gtgcgcattggcctcttctcggtgc

SEQ ID NO: 705281 - DNA, 25 bp, Mus musculus
gtgcgcattggcgtcttctcggtgc

SEQ ID NO: 705282 - DNA, 25 bp, Mus musculus
gtgcgcattgtgagtaccctagaga

SEQ ID NO: 705283 - DNA, 25 bp, Mus musculus
gtgcgcattgtgtgtaccctagaga

SEQ ID NO: 705284 - DNA, 25 bp, Mus musculus
gtgcgccacatgagattttgaaata

SEQ ID NO: 705285 - DNA, 25 bp, Mus musculus
gtgcgccacatgtgattttgaaata

SEQ ID NO: 705286 - DNA, 25 bp, Mus musculus
gtgcgccaccagcaccggctaagaa

SEQ ID NO: 705287 - DNA, 25 bp, Mus musculus
gtgcgccaccaggaccggctaagaa

SEQ ID NO: 705288 - DNA, 25 bp, Mus musculus
gtgcgccagagaagtcacagttcaa

SEQ ID NO: 705289 - DNA, 25 bp, Mus musculus
gtgcgccagagatgtcacagttcaa

SEQ ID NO: 705290 - DNA, 25 bp, Mus musculus
gtgcgccagctcatgttatacttaa

SEQ ID NO: 705291 - DNA, 25 bp, Mus musculus
gtgcgccagctcttgttatacttaa

SEQ ID NO: 705292 - DNA, 25 bp, Mus musculus
gtgcgccatgagattattgaaaaaa

SEQ ID NO: 705293 - DNA, 25 bp, Mus musculus
gtgcgccatgagtttattgaaaaaa

SEQ ID NO: 705294 - DNA, 25 bp, Mus musculus
gtgcgcccaccgatgtgccgggaga

SEQ ID NO: 705295 - DNA, 25 bp, Mus musculus
gtgcgcccaccgttgtgccgggaga

SEQ ID NO: 705296 - DNA, 25 bp, Mus musculus
gtgcgcccatcgagctaaggagtaa

SEQ ID NO: 705297 - DNA, 25 bp, Mus musculus
gtgcgcccatcgtgctaaggagtaa

SEQ ID NO: 705298 - DNA, 25 bp, Mus musculus
gtgcgccctgccactagagaagtgg

SEQ ID NO: 705299 - DNA, 25 bp, Mus musculus
gtgcgccctgcctctagagaagtgg

SEQ ID NO: 705300 - DNA, 25 bp, Mus musculus
gtgcgccctgttaatgatggatact

SEQ ID NO: 705301 - DNA, 25 bp, Mus musculus
gtgcgccctgtttatgatggatact

SEQ ID NO: 705302 - DNA, 25 bp, Mus musculus
gtgcgccgcattctacaccgctgtg

SEQ ID NO: 705303 - DNA, 25 bp, Mus musculus
gtgcgccgcattgtacaccgctgtg

SEQ ID NO: 705304 - DNA, 25 bp, Mus musculus
gtgcgcctaggacatatggcatgca

SEQ ID NO: 705305 - DNA, 25 bp, Mus musculus
gtgcgcctaggagatatggcatgca

SEQ ID NO: 705306 - DNA, 25 bp, Mus musculus
gtgcgcctatcaagtggacttctga

SEQ ID NO: 705307 - DNA, 25 bp, Mus musculus
gtgcgcctatcatgtggacttctga

SEQ ID NO: 705308 - DNA, 25 bp, Mus musculus
gtgcgcctggtaccaaatacggcga

SEQ ID NO: 705309 - DNA, 25 bp, Mus musculus
gtgcgcctggtagcaaatacggcga

SEQ ID NO: 705310 - DNA, 25 bp, Mus musculus
gtgcgccttcggcacactgcatgtg

SEQ ID NO: 705311 - DNA, 25 bp, Mus musculus
gtgcgccttcgggacactgcatgtg

SEQ ID NO: 705312 - DNA, 25 bp, Mus musculus
gtgcgcgcatatactcacacatatg

SEQ ID NO: 705313 - DNA, 25 bp, Mus musculus
gtgcgcgcatattctcacacatatg

SEQ ID NO: 705314 - DNA, 25 bp, Mus musculus
gtgcgcgccgctagtaatgcccgga

SEQ ID NO: 705315 - DNA, 25 bp, Mus musculus
gtgcgcgccgcttgtaatgcccgga

SEQ ID NO: 705316 - DNA, 25 bp, Mus musculus
gtgcgcgcgagaccaatgatttttt

SEQ ID NO: 705317 - DNA, 25 bp, Mus musculus
gtgcgcgcgagagcaatgatttttt

SEQ ID NO: 705318 - DNA, 25 bp, Mus musculus
gtgcgcgtcatcattgttcttgtta

SEQ ID NO: 705319 - DNA, 25 bp, Mus musculus
gtgcgcgtcatctttgttcttgtta

SEQ ID NO: 705320 - DNA, 25 bp, Mus musculus
gtgcgctaagtaaaagttccatgat

SEQ ID NO: 705321 - DNA, 25 bp, Mus musculus
gtgcgctaagtataagttccatgat

SEQ ID NO: 705322 - DNA, 25 bp, Mus musculus
gtgcgctattctacatttggatcag

SEQ ID NO: 705323 - DNA, 25 bp, Mus musculus
gtgcgctattcttcatttggatcag

SEQ ID NO: 705324 - DNA, 25 bp, Mus musculus
gtgcgctcagtcaaggtggaaaacg

SEQ ID NO: 705325 - DNA, 25 bp, Mus musculus
gtgcgctcagtctaggtggaaaacg

SEQ ID NO: 705326 - DNA, 25 bp, Mus musculus
gtgcgctcctcacaattggatttgc

SEQ ID NO: 705327 - DNA, 25 bp, Mus musculus
gtgcgctcctcagaattggatttgc

SEQ ID NO: 705328 - DNA, 25 bp, Mus musculus
gtgcgctcctctacaagaagcataa

SEQ ID NO: 705329 - DNA, 25 bp, Mus musculus
gtgcgctcctcttcaagaagcataa

SEQ ID NO: 705330 - DNA, 25 bp, Mus musculus
gtgcgctcctgtcttgtgcaaggaa

SEQ ID NO: 705331 - DNA, 25 bp, Mus musculus
gtgcgctcctgtgttgtgcaaggaa

SEQ ID NO: 705332 - DNA, 25 bp, Mus musculus
gtgcgctcgcacagtggagtctgcc

SEQ ID NO: 705333 - DNA, 25 bp, Mus musculus
gtgcgctcgcactgtggagtctgcc

SEQ ID NO: 705334 - DNA, 25 bp, Mus musculus
gtgcgctcttgtcaagccatttatg

SEQ ID NO: 705335 - DNA, 25 bp, Mus musculus
gtgcgctcttgtgaagccatttatg

SEQ ID NO: 705336 - DNA, 25 bp, Mus musculus
gtgcgctgcgctacctacaggaggc

SEQ ID NO: 705337 - DNA, 25 bp, Mus musculus
gtgcgctgcgcttcctacaggaggc

SEQ ID NO: 705338 - DNA, 25 bp, Mus musculus
gtgcgctgctaccagaatctcaagg

SEQ ID NO: 705339 - DNA, 25 bp, Mus musculus
gtgcgctgctacgagaatctcaagg

SEQ ID NO: 705340 - DNA, 25 bp, Mus musculus
gtgcgctggactactcagtagcaaa

SEQ ID NO: 705341 - DNA, 25 bp, Mus musculus
gtgcgctggacttctcagtagcaaa

SEQ ID NO: 705342 - DNA, 25 bp, Mus musculus
gtgcgctggcaccaacaaacgtgac

SEQ ID NO: 705343 - DNA, 25 bp, Mus musculus
gtgcgctggcacgaacaaacgtgac

SEQ ID NO: 705344 - DNA, 25 bp, Mus musculus
gtgcgctgtgcaatctatagtcaat

SEQ ID NO: 705345 - DNA, 25 bp, Mus musculus
gtgcgctgtgcattctatagtcaat

SEQ ID NO: 705346 - DNA, 25 bp, Mus musculus
gtgcgcttacacagagaggcctgga

SEQ ID NO: 705347 - DNA, 25 bp, Mus musculus
gtgcgcttacactgagaggcctgga

SEQ ID NO: 705348 - DNA, 25 bp, Mus musculus
gtgcgcttgtgaagttcctgtttac

SEQ ID NO: 705349 - DNA, 25 bp, Mus musculus
gtgcgcttgtgatgttcctgtttac

SEQ ID NO: 705350 - DNA, 25 bp, Mus musculus
gtgcgctttgcaacgttgttcaacg

SEQ ID NO: 705351 - DNA, 25 bp, Mus musculus
gtgcgctttgcatcgttgttcaacg

SEQ ID NO: 705352 - DNA, 25 bp, Mus musculus
gtgcgctttgtgacgcagacggccc

SEQ ID NO: 705353 - DNA, 25 bp, Mus musculus
gtgcgctttgtgtcgcagacggccc

SEQ ID NO: 705354 - DNA, 25 bp, Mus musculus
gtgcggaacaatagacctcttcttt

SEQ ID NO: 705355 - DNA, 25 bp, Mus musculus
gtgcggaacaattgacctcttcttt

SEQ ID NO: 705356 - DNA, 25 bp, Mus musculus
gtgcggaaggacacagactccatca

SEQ ID NO: 705357 - DNA, 25 bp, Mus musculus
gtgcggaaggactcagactccatca

SEQ ID NO: 705358 - DNA, 25 bp, Mus musculus
gtgcggacatcaacacggtcaacgt

SEQ ID NO: 705359 - DNA, 25 bp, Mus musculus
gtgcggacatcatcacggtcaacgt

SEQ ID NO: 705360 - DNA, 25 bp, Mus musculus
gtgcggacccaaaactgaaacgtca

SEQ ID NO: 705361 - DNA, 25 bp, Mus musculus
gtgcggacccaatactgaaacgtca

SEQ ID NO: 705362 - DNA, 25 bp, Mus musculus
gtgcggacccgcaggcctagcataa

SEQ ID NO: 705363 - DNA, 25 bp, Mus musculus
gtgcggacccgctggcctagcataa

SEQ ID NO: 705364 - DNA, 25 bp, Mus musculus
gtgcggacctaaataacgagcctta

SEQ ID NO: 705365 - DNA, 25 bp, Mus musculus
gtgcggacctaattaacgagcctta

SEQ ID NO: 705366 - DNA, 25 bp, Mus musculus
gtgcggactatgacatcctcgtgag

SEQ ID NO: 705367 - DNA, 25 bp, Mus musculus
gtgcggactatgtcatcctcgtgag

SEQ ID NO: 705368 - DNA, 25 bp, Mus musculus
gtgcggactccaccccaacaaaaag

SEQ ID NO: 705369 - DNA, 25 bp, Mus musculus
gtgcggactccagcccaacaaaaag

SEQ ID NO: 705370 - DNA, 25 bp, Mus musculus
gtgcggagaatcactctcacggatt

SEQ ID NO: 705371 - DNA, 25 bp, Mus musculus
gtgcggagaatctctctcacggatt

SEQ ID NO: 705372 - DNA, 25 bp, Mus musculus
gtgcggagacacaagttctggagta

SEQ ID NO: 705373 - DNA, 25 bp, Mus musculus
gtgcggagacacatgatttacttgg

SEQ ID NO: 705374 - DNA, 25 bp, Mus musculus
gtgcggagacactagttctggagta

SEQ ID NO: 705375 - DNA, 25 bp, Mus musculus
gtgcggagacacttgatttacttgg

SEQ ID NO: 705376 - DNA, 25 bp, Mus musculus
gtgcggagtcgacaaccttgacctg

SEQ ID NO: 705377 - DNA, 25 bp, Mus musculus
gtgcggagtcgagaaccttgacctg

SEQ ID NO: 705378 - DNA, 25 bp, Mus musculus
gtgcggatcaaaaccttctctgagg

SEQ ID NO: 705379 - DNA, 25 bp, Mus musculus
gtgcggatcaaatccttctctgagg

SEQ ID NO: 705380 - DNA, 25 bp, Mus musculus
gtgcggatgatgcttctcctggtaa

SEQ ID NO: 705381 - DNA, 25 bp, Mus musculus
gtgcggatgatggttctcctggtaa

SEQ ID NO: 705382 - DNA, 25 bp, Mus musculus
gtgcggatgtctagcaaccattgtt

SEQ ID NO: 705383 - DNA, 25 bp, Mus musculus
gtgcggatgtcttgcaaccattgtt

SEQ ID NO: 705384 - DNA, 25 bp, Mus musculus
gtgcggattctcacatctctagagg

SEQ ID NO: 705385 - DNA, 25 bp, Mus musculus
gtgcggattctctcatctctagagg

SEQ ID NO: 705386 - DNA, 25 bp, Mus musculus
gtgcggattctgcaagttcccaagc

SEQ ID NO: 705387 - DNA, 25 bp, Mus musculus
gtgcggattctggaagttcccaagc

SEQ ID NO: 705388 - DNA, 25 bp, Mus musculus
gtgcggatttgtaaccaggctattt

SEQ ID NO: 705389 - DNA, 25 bp, Mus musculus
gtgcggatttgttaccaggctattt

SEQ ID NO: 705390 - DNA, 25 bp, Mus musculus
gtgcggcacgagaaattggctccat

SEQ ID NO: 705391 - DNA, 25 bp, Mus musculus
gtgcggcacgagtaattggctccat

SEQ ID NO: 705392 - DNA, 25 bp, Mus musculus
gtgcggcagctgaacattgacttta

SEQ ID NO: 705393 - DNA, 25 bp, Mus musculus
gtgcggcagctgtacattgacttta

SEQ ID NO: 705394 - DNA, 25 bp, Mus musculus
gtgcggccatggagatccgagctca

SEQ ID NO: 705395 - DNA, 25 bp, Mus musculus
gtgcggccatggtgatccgagctca

SEQ ID NO: 705396 - DNA, 25 bp, Mus musculus
gtgcggccatgtacctcgggtatga

SEQ ID NO: 705397 - DNA, 25 bp, Mus musculus
gtgcggccatgttcctcgggtatga

SEQ ID NO: 705398 - DNA, 25 bp, Mus musculus
gtgcggccccgtatttatggaatgg

SEQ ID NO: 705399 - DNA, 25 bp, Mus musculus
gtgcggccccgtttttatggaatgg

SEQ ID NO: 705400 - DNA, 25 bp, Mus musculus
gtgcggcctcataactagcaagtat

SEQ ID NO: 705401 - DNA, 25 bp, Mus musculus
gtgcggcctcattactagcaagtat

SEQ ID NO: 705402 - DNA, 25 bp, Mus musculus
gtgcggcgattcattagttcctgtt

SEQ ID NO: 705403 - DNA, 25 bp, Mus musculus
gtgcggcgattctttagttcctgtt

SEQ ID NO: 705404 - DNA, 25 bp, Mus musculus
gtgcggctcagacagacagctccat

SEQ ID NO: 705405 - DNA, 25 bp, Mus musculus
gtgcggctcagagagacagctccat

SEQ ID NO: 705406 - DNA, 25 bp, Mus musculus
gtgcggctgtccaaaaccctgatta

SEQ ID NO: 705407 - DNA, 25 bp, Mus musculus
gtgcggctgtcctaaaccctgatta

SEQ ID NO: 705408 - DNA, 25 bp, Mus musculus
gtgcggctgtgaattccatgagcag

SEQ ID NO: 705409 - DNA, 25 bp, Mus musculus
gtgcggctgtgatttccatgagcag

SEQ ID NO: 705410 - DNA, 25 bp, Mus musculus
gtgcggctgtgtattcattgttgaa

SEQ ID NO: 705411 - DNA, 25 bp, Mus musculus
gtgcggctgtgttttcattgttgaa

SEQ ID NO: 705412 - DNA, 25 bp, Mus musculus
gtgcggcttaggctttatttctgtt

SEQ ID NO: 705413 - DNA, 25 bp, Mus musculus
gtgcggcttagggtttatttctgtt

SEQ ID NO: 705414 - DNA, 25 bp, Mus musculus
gtgcgggagtacaagcaggctcatc

SEQ ID NO: 705415 - DNA, 25 bp, Mus musculus
gtgcgggagtactagcaggctcatc

SEQ ID NO: 705416 - DNA, 25 bp, Mus musculus
gtgcgggcactaaaggatccaaatg

SEQ ID NO: 705417 - DNA, 25 bp, Mus musculus
gtgcgggcactataggatccaaatg

SEQ ID NO: 705418 - DNA, 25 bp, Mus musculus
gtgcgggcagacaccaacctaggca

SEQ ID NO: 705419 - DNA, 25 bp, Mus musculus
gtgcgggcagactccaacctaggca

SEQ ID NO: 705420 - DNA, 25 bp, Mus musculus
gtgcgggcatggcttaaaagaaccc

SEQ ID NO: 705421 - DNA, 25 bp, Mus musculus
gtgcgggcatgggttaaaagaaccc

SEQ ID NO: 705422 - DNA, 25 bp, Mus musculus
gtgcgggcgcacagcaaatgataaa

SEQ ID NO: 705423 - DNA, 25 bp, Mus musculus
gtgcgggcgcactgcaaatgataaa

SEQ ID NO: 705424 - DNA, 25 bp, Mus musculus
gtgcgggtcaccaattcgtgttaag

SEQ ID NO: 705425 - DNA, 25 bp, Mus musculus
gtgcgggtcacctattcgtgttaag

SEQ ID NO: 705426 - DNA, 25 bp, Mus musculus
gtgcgggtctcaactttccccaggg

SEQ ID NO: 705427 - DNA, 25 bp, Mus musculus
gtgcgggtctcatctttccccaggg

SEQ ID NO: 705428 - DNA, 25 bp, Mus musculus
gtgcgggtgcgcaaacttattggac

SEQ ID NO: 705429 - DNA, 25 bp, Mus musculus
gtgcgggtgcgctaacttattggac

SEQ ID NO: 705430 - DNA, 25 bp, Mus musculus
gtgcgggtggagacagacttctttc

SEQ ID NO: 705431 - DNA, 25 bp, Mus musculus
gtgcgggtggagtcagacttctttc

SEQ ID NO: 705432 - DNA, 25 bp, Mus musculus
gtgcgggttagaattttgacaagtt

SEQ ID NO: 705433 - DNA, 25 bp, Mus musculus
gtgcgggttagatttttgacaagtt

SEQ ID NO: 705434 - DNA, 25 bp, Mus musculus
gtgcggtacagacaagagtcctttc

SEQ ID NO: 705435 - DNA, 25 bp, Mus musculus
gtgcggtacagagaagagtcctttc

SEQ ID NO: 705436 - DNA, 25 bp, Mus musculus
gtgcggtaggtcaggttgtccacct

SEQ ID NO: 705437 - DNA, 25 bp, Mus musculus
gtgcggtaggtctggttgtccacct

SEQ ID NO: 705438 - DNA, 25 bp, Mus musculus
gtgcggtcactacaatgggcccaga

SEQ ID NO: 705439 - DNA, 25 bp, Mus musculus
gtgcggtcactagaatgggcccaga

SEQ ID NO: 705440 - DNA, 25 bp, Mus musculus
gtgcggtccctacattgtgatgctg

SEQ ID NO: 705441 - DNA, 25 bp, Mus musculus
gtgcggtccctagattgtgatgctg

SEQ ID NO: 705442 - DNA, 25 bp, Mus musculus
gtgcggtctcgaatcgctgaattgc

SEQ ID NO: 705443 - DNA, 25 bp, Mus musculus
gtgcggtctcgattcgctgaattgc

SEQ ID NO: 705444 - DNA, 25 bp, Mus musculus
gtgcggtgacatctctttaaccatt

SEQ ID NO: 705445 - DNA, 25 bp, Mus musculus
gtgcggtgacatgtctttaaccatt

SEQ ID NO: 705446 - DNA, 25 bp, Mus musculus
gtgcggtgatcacggctgctcttaa

SEQ ID NO: 705447 - DNA, 25 bp, Mus musculus
gtgcggtgatcagggctgctcttaa

SEQ ID NO: 705448 - DNA, 25 bp, Mus musculus
gtgcggtgattaaactgacttctag

SEQ ID NO: 705449 - DNA, 25 bp, Mus musculus
gtgcggtgattatactgacttctag

SEQ ID NO: 705450 - DNA, 25 bp, Mus musculus
gtgcggtgcgttaatgttggacata

SEQ ID NO: 705451 - DNA, 25 bp, Mus musculus
gtgcggtgcgtttatgttggacata

SEQ ID NO: 705452 - DNA, 25 bp, Mus musculus
gtgcggtgtgtcaccactgaataat

SEQ ID NO: 705453 - DNA, 25 bp, Mus musculus
gtgcggtgtgtctccactgaataat

SEQ ID NO: 705454 - DNA, 25 bp, Mus musculus
gtgcggtgttagctttgtgcttttt

SEQ ID NO: 705455 - DNA, 25 bp, Mus musculus
gtgcggtgttaggtttgtgcttttt

SEQ ID NO: 705456 - DNA, 25 bp, Mus musculus
gtgcggttcaacctgatggagaaaa

SEQ ID NO: 705457 - DNA, 25 bp, Mus musculus
gtgcggttcaacgtgatggagaaaa

SEQ ID NO: 705458 - DNA, 25 bp, Mus musculus
gtgcggttggaaacagcgactctgc

SEQ ID NO: 705459 - DNA, 25 bp, Mus musculus
gtgcggttggaatcagcgactctgc

SEQ ID NO: 705460 - DNA, 25 bp, Mus musculus
gtgcggtttgctcatctttaatttt

SEQ ID NO: 705461 - DNA, 25 bp, Mus musculus
gtgcggtttgctgatctttaatttt

SEQ ID NO: 705462 - DNA, 25 bp, Mus musculus
gtgcgtaacaacattgaaagcatta

SEQ ID NO: 705463 - DNA, 25 bp, Mus musculus
gtgcgtaacaactttgaaagcatta

SEQ ID NO: 705464 - DNA, 25 bp, Mus musculus
gtgcgtacaagcaaagggctcccca

SEQ ID NO: 705465 - DNA, 25 bp, Mus musculus
gtgcgtacaagctaagggctcccca

SEQ ID NO: 705466 - DNA, 25 bp, Mus musculus
gtgcgtacatcgacaccaagggtca

SEQ ID NO: 705467 - DNA, 25 bp, Mus musculus
gtgcgtacatcgtcaccaagggtca

SEQ ID NO: 705468 - DNA, 25 bp, Mus musculus
gtgcgtacatggaggttgtgcattc

SEQ ID NO: 705469 - DNA, 25 bp, Mus musculus
gtgcgtacatggtggttgtgcattc

SEQ ID NO: 705470 - DNA, 25 bp, Mus musculus
gtgcgtagtgccaatgaaagtcaga

SEQ ID NO: 705471 - DNA, 25 bp, Mus musculus
gtgcgtagtgcctatgaaagtcaga

SEQ ID NO: 705472 - DNA, 25 bp, Mus musculus
gtgcgtatacgtctgtgtttctttc

SEQ ID NO: 705473 - DNA, 25 bp, Mus musculus
gtgcgtatacgtgtgtgtttctttc

SEQ ID NO: 705474 - DNA, 25 bp, Mus musculus
gtgcgtatagacactgtcatctgta

SEQ ID NO: 705475 - DNA, 25 bp, Mus musculus
gtgcgtatagactctgtcatctgta

SEQ ID NO: 705476 - DNA, 25 bp, Mus musculus
gtgcgtcacttcatcgagtcataac

SEQ ID NO: 705477 - DNA, 25 bp, Mus musculus
gtgcgtcacttcttcgagtcataac

SEQ ID NO: 705478 - DNA, 25 bp, Mus musculus
gtgcgtcagctcagttcaattgttt

SEQ ID NO: 705479 - DNA, 25 bp, Mus musculus
gtgcgtcagctctgttcaattgttt

SEQ ID NO: 705480 - DNA, 25 bp, Mus musculus
gtgcgtcagttaattgtactacttg

SEQ ID NO: 705481 - DNA, 25 bp, Mus musculus
gtgcgtcagttatttgtactacttg

SEQ ID NO: 705482 - DNA, 25 bp, Mus musculus
gtgcgtcatatccagaatcactctg

SEQ ID NO: 705483 - DNA, 25 bp, Mus musculus
gtgcgtcatatcgagaatcactctg

SEQ ID NO: 705484 - DNA, 25 bp, Mus musculus
gtgcgtcattctcgttattattatt

SEQ ID NO: 705485 - DNA, 25 bp, Mus musculus
gtgcgtcattctggttattattatt

SEQ ID NO: 705486 - DNA, 25 bp, Mus musculus
gtgcgtcctcagacatcgataatgt

SEQ ID NO: 705487 - DNA, 25 bp, Mus musculus
gtgcgtcctcagtcatcgataatgt

SEQ ID NO: 705488 - DNA, 25 bp, Mus musculus
gtgcgtcctcgccgtgagcaagtta

SEQ ID NO: 705489 - DNA, 25 bp, Mus musculus
gtgcgtcctcgcggtgagcaagtta

SEQ ID NO: 705490 - DNA, 25 bp, Mus musculus
gtgcgtctccctagacagacatggg

SEQ ID NO: 705491 - DNA, 25 bp, Mus musculus
gtgcgtctcccttgacagacatggg

SEQ ID NO: 705492 - DNA, 25 bp, Mus musculus
gtgcgtctctaaatcctgtcaagcc

SEQ ID NO: 705493 - DNA, 25 bp, Mus musculus
gtgcgtctctaattcctgtcaagcc

SEQ ID NO: 705494 - DNA, 25 bp, Mus musculus
gtgcgtctgacccagttgctaaagc

SEQ ID NO: 705495 - DNA, 25 bp, Mus musculus
gtgcgtctgaccgagttgctaaagc

SEQ ID NO: 705496 - DNA, 25 bp, Mus musculus
gtgcgtctggcacttctgagtgtta

SEQ ID NO: 705497 - DNA, 25 bp, Mus musculus
gtgcgtctggcagttctgagtgtta

SEQ ID NO: 705498 - DNA, 25 bp, Mus musculus
gtgcgtctgggtcatcatagcctcc

SEQ ID NO: 705499 - DNA, 25 bp, Mus musculus
gtgcgtctgggtgatcatagcctcc

SEQ ID NO: 705500 - DNA, 25 bp, Mus musculus
gtgcgtctgtcgaaagctgaagtgc

SEQ ID NO: 705501 - DNA, 25 bp, Mus musculus
gtgcgtctgtcgtaagctgaagtgc

SEQ ID NO: 705502 - DNA, 25 bp, Mus musculus
gtgcgtgaacaccagtggatccttc

SEQ ID NO: 705503 - DNA, 25 bp, Mus musculus
gtgcgtgaacacgagtggatccttc

SEQ ID NO: 705504 - DNA, 25 bp, Mus musculus
gtgcgtgaagttaccacttccattg

SEQ ID NO: 705505 - DNA, 25 bp, Mus musculus
gtgcgtgaagttacccacaggccgc

SEQ ID NO: 705506 - DNA, 25 bp, Mus musculus
gtgcgtgaagtttccacttccattg

SEQ ID NO: 705507 - DNA, 25 bp, Mus musculus
gtgcgtgaagtttcccacaggccgc

SEQ ID NO: 705508 - DNA, 25 bp, Mus musculus
gtgcgtgagcatctgcagaaccact

SEQ ID NO: 705509 - DNA, 25 bp, Mus musculus
gtgcgtgagcatgtgcagaaccact

SEQ ID NO: 705510 - DNA, 25 bp, Mus musculus
gtgcgtgcaaagaccttaccaaaga

SEQ ID NO: 705511 - DNA, 25 bp, Mus musculus
gtgcgtgcaaagtccttaccaaaga

SEQ ID NO: 705512 - DNA, 25 bp, Mus musculus
gtgcgtgcacacattcatgctacag

SEQ ID NO: 705513 - DNA, 25 bp, Mus musculus
gtgcgtgcacactttcatgctacag

SEQ ID NO: 705514 - DNA, 25 bp, Mus musculus
gtgcgtgcacctcttgattgcatca

SEQ ID NO: 705515 - DNA, 25 bp, Mus musculus
gtgcgtgcacctgttgattgcatca

SEQ ID NO: 705516 - DNA, 25 bp, Mus musculus
gtgcgtgcacgtacagcaacttgga

SEQ ID NO: 705517 - DNA, 25 bp, Mus musculus
gtgcgtgcacgttcagcaacttgga

SEQ ID NO: 705518 - DNA, 25 bp, Mus musculus
gtgcgtgcataaaaacttgctctgc

SEQ ID NO: 705519 - DNA, 25 bp, Mus musculus
gtgcgtgcataataacttgctctgc

SEQ ID NO: 705520 - DNA, 25 bp, Mus musculus
gtgcgtgcattaattctttgctgta

SEQ ID NO: 705521 - DNA, 25 bp, Mus musculus
gtgcgtgcattatttctttgctgta

SEQ ID NO: 705522 - DNA, 25 bp, Mus musculus
gtgcgtggagaaatgcaacatcctg

SEQ ID NO: 705523 - DNA, 25 bp, Mus musculus
gtgcgtggagaattgcaacatcctg

SEQ ID NO: 705524 - DNA, 25 bp, Mus musculus
gtgcgtggcaaaccaccactgtgaa

SEQ ID NO: 705525 - DNA, 25 bp, Mus musculus
gtgcgtggcaaagcaccactgtgaa

SEQ ID NO: 705526 - DNA, 25 bp, Mus musculus
gtgcgtggcaccaacgagtgcgaca

SEQ ID NO: 705527 - DNA, 25 bp, Mus musculus
gtgcgtggcacctacgagtgcgaca

SEQ ID NO: 705528 - DNA, 25 bp, Mus musculus
gtgcgtggccacactgttataattt

SEQ ID NO: 705529 - DNA, 25 bp, Mus musculus
gtgcgtggccactctgttataattt

SEQ ID NO: 705530 - DNA, 25 bp, Mus musculus
gtgcgtggtgccaaccagtggatca

SEQ ID NO: 705531 - DNA, 25 bp, Mus musculus
gtgcgtggtgcctaccagtggatca

SEQ ID NO: 705532 - DNA, 25 bp, Mus musculus
gtgcgtgtataaagctcatttgcgg

SEQ ID NO: 705533 - DNA, 25 bp, Mus musculus
gtgcgtgtataatgctcatttgcgg

SEQ ID NO: 705534 - DNA, 25 bp, Mus musculus
gtgcgtgtctggatgccacagcctt

SEQ ID NO: 705535 - DNA, 25 bp, Mus musculus
gtgcgtgtctggttgccacagcctt

SEQ ID NO: 705536 - DNA, 25 bp, Mus musculus
gtgcgtgtctgtccctactgctttc

SEQ ID NO: 705537 - DNA, 25 bp, Mus musculus
gtgcgtgtctgtgcctactgctttc

SEQ ID NO: 705538 - DNA, 25 bp, Mus musculus
gtgcgtgtggtgagctcgtggtgaa

SEQ ID NO: 705539 - DNA, 25 bp, Mus musculus
gtgcgtgtggtgtgctcgtggtgaa

SEQ ID NO: 705540 - DNA, 25 bp, Mus musculus
gtgcgtgtgttgcagaatcacccac

SEQ ID NO: 705541 - DNA, 25 bp, Mus musculus
gtgcgtgtgttgctccaataaagtt

SEQ ID NO: 705542 - DNA, 25 bp, Mus musculus
gtgcgtgtgttggagaatcacccac

SEQ ID NO: 705543 - DNA, 25 bp, Mus musculus
gtgcgtgtgttggtccaataaagtt

SEQ ID NO: 705544 - DNA, 25 bp, Mus musculus
gtgcgtgttcatacacccacggtga

SEQ ID NO: 705545 - DNA, 25 bp, Mus musculus
gtgcgtgttcattcacccacggtga

SEQ ID NO: 705546 - DNA, 25 bp, Mus musculus
gtgcgtgtttaacttctcggaattt

SEQ ID NO: 705547 - DNA, 25 bp, Mus musculus
gtgcgtgtttaagttctcggaattt

SEQ ID NO: 705548 - DNA, 25 bp, Mus musculus
gtgcgtgtttgaccactggcagatc

SEQ ID NO: 705549 - DNA, 25 bp, Mus musculus
gtgcgtgtttgagcactggcagatc

SEQ ID NO: 705550 - DNA, 25 bp, Mus musculus
gtgcgttagagacgccattgccaga

SEQ ID NO: 705551 - DNA, 25 bp, Mus musculus
gtgcgttagagaggccattgccaga

SEQ ID NO: 705552 - DNA, 25 bp, Mus musculus
gtgcgttcagaaccaggacaccaac

SEQ ID NO: 705553 - DNA, 25 bp, Mus musculus
gtgcgttcagaagcaggacaccaac

SEQ ID NO: 705554 - DNA, 25 bp, Mus musculus
gtgcgttcattcagcaaagccaaca

SEQ ID NO: 705555 - DNA, 25 bp, Mus musculus
gtgcgttcattctgcaaagccaaca

SEQ ID NO: 705556 - DNA, 25 bp, Mus musculus
gtgcgttcctataatcatactgcgt

SEQ ID NO: 705557 - DNA, 25 bp, Mus musculus
gtgcgttcctattatcatactgcgt

SEQ ID NO: 705558 - DNA, 25 bp, Mus musculus
gtgcgttcttccaaccggacaaggt

SEQ ID NO: 705559 - DNA, 25 bp, Mus musculus
gtgcgttcttcctaccggacaaggt

SEQ ID NO: 705560 - DNA, 25 bp, Mus musculus
gtgcgttgagctattgtttcacttt

SEQ ID NO: 705561 - DNA, 25 bp, Mus musculus
gtgcgttgagcttttgtttcacttt

SEQ ID NO: 705562 - DNA, 25 bp, Mus musculus
gtgcgttgcttactaaatattctcg

SEQ ID NO: 705563 - DNA, 25 bp, Mus musculus
gtgcgttgcttagtaaatattctcg

SEQ ID NO: 705564 - DNA, 25 bp, Mus musculus
gtgcgttgtattaatgctggcctta

SEQ ID NO: 705565 - DNA, 25 bp, Mus musculus
gtgcgttgtatttatgctggcctta

SEQ ID NO: 705566 - DNA, 25 bp, Mus musculus
gtgcgtttactaagcttcttgatgt

SEQ ID NO: 705567 - DNA, 25 bp, Mus musculus
gtgcgtttactatgcttcttgatgt

SEQ ID NO: 705568 - DNA, 25 bp, Mus musculus
gtgcgtttccctcagcaggtgctgt

SEQ ID NO: 705569 - DNA, 25 bp, Mus musculus
gtgcgtttccctgagcaggtgctgt

SEQ ID NO: 705570 - DNA, 25 bp, Mus musculus
gtgcgtttcttaattaatccctctc

SEQ ID NO: 705571 - DNA, 25 bp, Mus musculus
gtgcgtttcttatttaatccctctc

SEQ ID NO: 705572 - DNA, 25 bp, Mus musculus
gtgcgtttctttcgcgttgacagta

SEQ ID NO: 705573 - DNA, 25 bp, Mus musculus
gtgcgtttctttggcgttgacagta

SEQ ID NO: 705574 - DNA, 25 bp, Mus musculus
gtgcgtttggcactgagacttaaat

SEQ ID NO: 705575 - DNA, 25 bp, Mus musculus
gtgcgtttggcagtgagacttaaat

SEQ ID NO: 705576 - DNA, 25 bp, Mus musculus
gtgctaaaagcacacaatttcaaga

SEQ ID NO: 705577 - DNA, 25 bp, Mus musculus
gtgctaaaagcagacaatttcaaga

SEQ ID NO: 705578 - DNA, 25 bp, Mus musculus
gtgctaaacaacatctgtgtgtgtt

SEQ ID NO: 705579 - DNA, 25 bp, Mus musculus
gtgctaaacaacttctgtgtgtgtt

SEQ ID NO: 705580 - DNA, 25 bp, Mus musculus
gtgctaaacagcatattacctctgt

SEQ ID NO: 705581 - DNA, 25 bp, Mus musculus
gtgctaaacagcttattacctctgt

SEQ ID NO: 705582 - DNA, 25 bp, Mus musculus
gtgctaaaccctatttatcccaagc

SEQ ID NO: 705583 - DNA, 25 bp, Mus musculus
gtgctaaaccctttttatcccaagc

SEQ ID NO: 705584 - DNA, 25 bp, Mus musculus
gtgctaaaccgaaagagctctcatt

SEQ ID NO: 705585 - DNA, 25 bp, Mus musculus
gtgctaaaccgatagagctctcatt

SEQ ID NO: 705586 - DNA, 25 bp, Mus musculus
gtgctaaacctaactcctgggagca

SEQ ID NO: 705587 - DNA, 25 bp, Mus musculus
gtgctaaacctatctcctgggagca

SEQ ID NO: 705588 - DNA, 25 bp, Mus musculus
gtgctaaagcagaccgtgccaggtt

SEQ ID NO: 705589 - DNA, 25 bp, Mus musculus
gtgctaaagcagtccgtgccaggtt

SEQ ID NO: 705590 - DNA, 25 bp, Mus musculus
gtgctaaagccacctgcgtttgctt

SEQ ID NO: 705591 - DNA, 25 bp, Mus musculus
gtgctaaagccagctgcgtttgctt

SEQ ID NO: 705592 - DNA, 25 bp, Mus musculus
gtgctaaagctccaaggccaagcct

SEQ ID NO: 705593 - DNA, 25 bp, Mus musculus
gtgctaaagctcgaaggccaagcct

SEQ ID NO: 705594 - DNA, 25 bp, Mus musculus
gtgctaaagctgcaattgtctgtta

SEQ ID NO: 705595 - DNA, 25 bp, Mus musculus
gtgctaaagctggaattgtctgtta

SEQ ID NO: 705596 - DNA, 25 bp, Mus musculus
gtgctaaatgcacagtcgatccgtg

SEQ ID NO: 705597 - DNA, 25 bp, Mus musculus
gtgctaaatgcagagtcgatccgtg

SEQ ID NO: 705598 - DNA, 25 bp, Mus musculus
gtgctaaatgtacctaccgctgtta

SEQ ID NO: 705599 - DNA, 25 bp, Mus musculus
gtgctaaatgtagctaccgctgtta

SEQ ID NO: 705600 - DNA, 25 bp, Mus musculus
gtgctaacagtgagcgctcgagtca

SEQ ID NO: 705601 - DNA, 25 bp, Mus musculus
gtgctaacagtgtgcgctcgagtca

SEQ ID NO: 705602 - DNA, 25 bp, Mus musculus
gtgctaacatatctccaggatcctc

SEQ ID NO: 705603 - DNA, 25 bp, Mus musculus
gtgctaacatatgtccaggatcctc

SEQ ID NO: 705604 - DNA, 25 bp, Mus musculus
gtgctaacatccatgtatgtcatat

SEQ ID NO: 705605 - DNA, 25 bp, Mus musculus
gtgctaacatccttgtatgtcatat

SEQ ID NO: 705606 - DNA, 25 bp, Mus musculus
gtgctaacattgctggcctggatct

SEQ ID NO: 705607 - DNA, 25 bp, Mus musculus
gtgctaacattggtggcctggatct

SEQ ID NO: 705608 - DNA, 25 bp, Mus musculus
gtgctaactagcattatagaagagt

SEQ ID NO: 705609 - DNA, 25 bp, Mus musculus
gtgctaactagctttatagaagagt

SEQ ID NO: 705610 - DNA, 25 bp, Mus musculus
gtgctaactgttcagtttgcagtga

SEQ ID NO: 705611 - DNA, 25 bp, Mus musculus
gtgctaactgttgagtttgcagtga

SEQ ID NO: 705612 - DNA, 25 bp, Mus musculus
gtgctaagaaccatacccaaggctt

SEQ ID NO: 705613 - DNA, 25 bp, Mus musculus
gtgctaagaaccttacccaaggctt

SEQ ID NO: 705614 - DNA, 25 bp, Mus musculus
gtgctaagatacagcaagccctatt

SEQ ID NO: 705615 - DNA, 25 bp, Mus musculus
gtgctaagatactgcaagccctatt

SEQ ID NO: 705616 - DNA, 25 bp, Mus musculus
gtgctaagcacaatattttgagaaa

SEQ ID NO: 705617 - DNA, 25 bp, Mus musculus
gtgctaagcacattattttgagaaa

SEQ ID NO: 705618 - DNA, 25 bp, Mus musculus
gtgctaagctggatccgtgtccttt

SEQ ID NO: 705619 - DNA, 25 bp, Mus musculus
gtgctaagctggttccgtgtccttt

SEQ ID NO: 705620 - DNA, 25 bp, Mus musculus
gtgctaagctgtcacttgcgaagat

SEQ ID NO: 705621 - DNA, 25 bp, Mus musculus
gtgctaagctgtctgcacctctgct

SEQ ID NO: 705622 - DNA, 25 bp, Mus musculus
gtgctaagctgtgacttgcgaagat

SEQ ID NO: 705623 - DNA, 25 bp, Mus musculus
gtgctaagctgtgtgcacctctgct

SEQ ID NO: 705624 - DNA, 25 bp, Mus musculus
gtgctaaggatcagcctcagtcttc

SEQ ID NO: 705625 - DNA, 25 bp, Mus musculus
gtgctaaggatctgcctcagtcttc

SEQ ID NO: 705626 - DNA, 25 bp, Mus musculus
gtgctaagtcagctgtggatccaca

SEQ ID NO: 705627 - DNA, 25 bp, Mus musculus
gtgctaagtcaggtgtggatccaca

SEQ ID NO: 705628 - DNA, 25 bp, Mus musculus
gtgctaagtgccagtagctcactgc

SEQ ID NO: 705629 - DNA, 25 bp, Mus musculus
gtgctaagtgcctgtagctcactgc

SEQ ID NO: 705630 - DNA, 25 bp, Mus musculus
gtgctaatcgagatatttccgttct

SEQ ID NO: 705631 - DNA, 25 bp, Mus musculus
gtgctaatcgagttatttccgttct

SEQ ID NO: 705632 - DNA, 25 bp, Mus musculus
gtgctaatctcacagggaccaccct

SEQ ID NO: 705633 - DNA, 25 bp, Mus musculus
gtgctaatctcagagggaccaccct

SEQ ID NO: 705634 - DNA, 25 bp, Mus musculus
gtgctaatgaacagagccagacact

SEQ ID NO: 705635 - DNA, 25 bp, Mus musculus
gtgctaatgaactgagccagacact

SEQ ID NO: 705636 - DNA, 25 bp, Mus musculus
gtgctaatgaagacaccggacattt

SEQ ID NO: 705637 - DNA, 25 bp, Mus musculus
gtgctaatgaagtcaccggacattt

SEQ ID NO: 705638 - DNA, 25 bp, Mus musculus
gtgctaatgaccattgaacctgatc

SEQ ID NO: 705639 - DNA, 25 bp, Mus musculus
gtgctaatgacctttgaacctgatc

SEQ ID NO: 705640 - DNA, 25 bp, Mus musculus
gtgctaatgatcaaagcgctgcagg

SEQ ID NO: 705641 - DNA, 25 bp, Mus musculus
gtgctaatgatctaagcgctgcagg

SEQ ID NO: 705642 - DNA, 25 bp, Mus musculus
gtgctaatggcgaacagtgtctgat

SEQ ID NO: 705643 - DNA, 25 bp, Mus musculus
gtgctaatggcgtacagtgtctgat

SEQ ID NO: 705644 - DNA, 25 bp, Mus musculus
gtgctaatggttctgatgcagcttt

SEQ ID NO: 705645 - DNA, 25 bp, Mus musculus
gtgctaatggttgtgatgcagcttt

SEQ ID NO: 705646 - DNA, 25 bp, Mus musculus
gtgctaattacactttctcctcctt

SEQ ID NO: 705647 - DNA, 25 bp, Mus musculus
gtgctaattacagtttctcctcctt

SEQ ID NO: 705648 - DNA, 25 bp, Mus musculus
gtgctaattacgacctgcagctaat

SEQ ID NO: 705649 - DNA, 25 bp, Mus musculus
gtgctaattacgtcctgcagctaat

SEQ ID NO: 705650 - DNA, 25 bp, Mus musculus
gtgctaattcctccataatccaatg

SEQ ID NO: 705651 - DNA, 25 bp, Mus musculus
gtgctaattcctgcataatccaatg

SEQ ID NO: 705652 - DNA, 25 bp, Mus musculus
gtgctaatttaaacacccggtgaat

SEQ ID NO: 705653 - DNA, 25 bp, Mus musculus
gtgctaatttaatcacccggtgaat

SEQ ID NO: 705654 - DNA, 25 bp, Mus musculus
gtgctacaaaacagtgaccactgtg

SEQ ID NO: 705655 - DNA, 25 bp, Mus musculus
gtgctacaaaactgtgaccactgtg

SEQ ID NO: 705656 - DNA, 25 bp, Mus musculus
gtgctacaaagccatgtcctcagag

SEQ ID NO: 705657 - DNA, 25 bp, Mus musculus
gtgctacaaagcgatgtcctcagag

SEQ ID NO: 705658 - DNA, 25 bp, Mus musculus
gtgctacaaatgatttgcctacaga

SEQ ID NO: 705659 - DNA, 25 bp, Mus musculus
gtgctacaaatgttttgcctacaga

SEQ ID NO: 705660 - DNA, 25 bp, Mus musculus
gtgctacaaggtaccagaatggtgc

SEQ ID NO: 705661 - DNA, 25 bp, Mus musculus
gtgctacaaggttccagaatggtgc

SEQ ID NO: 705662 - DNA, 25 bp, Mus musculus
gtgctacaatcaaacgcccaacaag

SEQ ID NO: 705663 - DNA, 25 bp, Mus musculus
gtgctacaatcatacgcccaacaag

SEQ ID NO: 705664 - DNA, 25 bp, Mus musculus
gtgctacactatagagaaactctgt

SEQ ID NO: 705665 - DNA, 25 bp, Mus musculus
gtgctacactattgagaaactctgt

SEQ ID NO: 705666 - DNA, 25 bp, Mus musculus
gtgctacactgtccactgttatata

SEQ ID NO: 705667 - DNA, 25 bp, Mus musculus
gtgctacactgtgcactgttatata

SEQ ID NO: 705668 - DNA, 25 bp, Mus musculus
gtgctacagtctcaggctctggaaa

SEQ ID NO: 705669 - DNA, 25 bp, Mus musculus
gtgctacagtctgaggctctggaaa

SEQ ID NO: 705670 - DNA, 25 bp, Mus musculus
gtgctacataatcccatgtatcatg

SEQ ID NO: 705671 - DNA, 25 bp, Mus musculus
gtgctacataatgccatgtatcatg

SEQ ID NO: 705672 - DNA, 25 bp, Mus musculus
gtgctacatacacccttatacatgc

SEQ ID NO: 705673 - DNA, 25 bp, Mus musculus
gtgctacatacagccttatacatgc

SEQ ID NO: 705674 - DNA, 25 bp, Mus musculus
gtgctacatctaacacaacggcaag

SEQ ID NO: 705675 - DNA, 25 bp, Mus musculus
gtgctacatctatcacaacggcaag

SEQ ID NO: 705676 - DNA, 25 bp, Mus musculus
gtgctacatttaagaccaggagacc

SEQ ID NO: 705677 - DNA, 25 bp, Mus musculus
gtgctacatttaagatcggcatacc

SEQ ID NO: 705678 - DNA, 25 bp, Mus musculus
gtgctacatttatgaccaggagacc

SEQ ID NO: 705679 - DNA, 25 bp, Mus musculus
gtgctacatttatgatcggcatacc

SEQ ID NO: 705680 - DNA, 25 bp, Mus musculus
gtgctaccaagtccctatgaattga

SEQ ID NO: 705681 - DNA, 25 bp, Mus musculus
gtgctaccaagtgcctatgaattga

SEQ ID NO: 705682 - DNA, 25 bp, Mus musculus
gtgctaccacatatctgtgtgtgaa

SEQ ID NO: 705683 - DNA, 25 bp, Mus musculus
gtgctaccacatttctgtgtgtgaa

SEQ ID NO: 705684 - DNA, 25 bp, Mus musculus
gtgctaccacggcaaaaccggaaga

SEQ ID NO: 705685 - DNA, 25 bp, Mus musculus
gtgctaccacgggaaaaccggaaga

SEQ ID NO: 705686 - DNA, 25 bp, Mus musculus
gtgctaccactgactgtcatctttt

SEQ ID NO: 705687 - DNA, 25 bp, Mus musculus
gtgctaccactgtctgtcatctttt

SEQ ID NO: 705688 - DNA, 25 bp, Mus musculus
gtgctaccagtgaataactcttatt

SEQ ID NO: 705689 - DNA, 25 bp, Mus musculus
gtgctaccagtgtataactcttatt

SEQ ID NO: 705690 - DNA, 25 bp, Mus musculus
gtgctaccagttaatgatagctctg

SEQ ID NO: 705691 - DNA, 25 bp, Mus musculus
gtgctaccagtttatgatagctctg

SEQ ID NO: 705692 - DNA, 25 bp, Mus musculus
gtgctaccatccaggagaatgttga

SEQ ID NO: 705693 - DNA, 25 bp, Mus musculus
gtgctaccatcctggagaatgttga

SEQ ID NO: 705694 - DNA, 25 bp, Mus musculus
gtgctaccatctaagatttcctctg

SEQ ID NO: 705695 - DNA, 25 bp, Mus musculus
gtgctaccatcttagatttcctctg

SEQ ID NO: 705696 - DNA, 25 bp, Mus musculus
gtgctaccattcagactcaatcttg

SEQ ID NO: 705697 - DNA, 25 bp, Mus musculus
gtgctaccattctgactcaatcttg

SEQ ID NO: 705698 - DNA, 25 bp, Mus musculus
gtgctacccttacgtcctgaatacc

SEQ ID NO: 705699 - DNA, 25 bp, Mus musculus
gtgctacccttaggtcctgaatacc

SEQ ID NO: 705700 - DNA, 25 bp, Mus musculus
gtgctacctttcaagtttgtgggtt

SEQ ID NO: 705701 - DNA, 25 bp, Mus musculus
gtgctacctttctagtttgtgggtt

SEQ ID NO: 705702 - DNA, 25 bp, Mus musculus
gtgctacctttgatgttcgctttct

SEQ ID NO: 705703 - DNA, 25 bp, Mus musculus
gtgctacctttgttgttcgctttct

SEQ ID NO: 705704 - DNA, 25 bp, Mus musculus
gtgctacgagttatagaaccctttg

SEQ ID NO: 705705 - DNA, 25 bp, Mus musculus
gtgctacgagttttagaaccctttg

SEQ ID NO: 705706 - DNA, 25 bp, Mus musculus
gtgctacgcatcatcatggtgtttt

SEQ ID NO: 705707 - DNA, 25 bp, Mus musculus
gtgctacgcatcttcatggtgtttt

SEQ ID NO: 705708 - DNA, 25 bp, Mus musculus
gtgctacgtgacatgtgtatagtat

SEQ ID NO: 705709 - DNA, 25 bp, Mus musculus
gtgctacgtgacttgtgtatagtat

SEQ ID NO: 705710 - DNA, 25 bp, Mus musculus
gtgctactaaatcacggatcccgct

SEQ ID NO: 705711 - DNA, 25 bp, Mus musculus
gtgctactaaatgacggatcccgct

SEQ ID NO: 705712 - DNA, 25 bp, Mus musculus
gtgctactaatacatcccaataaat

SEQ ID NO: 705713 - DNA, 25 bp, Mus musculus
gtgctactaatagatcccaataaat

SEQ ID NO: 705714 - DNA, 25 bp, Mus musculus
gtgctactacttacccagatgtgta

SEQ ID NO: 705715 - DNA, 25 bp, Mus musculus
gtgctactactttcccagatgtgta

SEQ ID NO: 705716 - DNA, 25 bp, Mus musculus
gtgctactatttaggcaagggctcc

SEQ ID NO: 705717 - DNA, 25 bp, Mus musculus
gtgctactattttggcaagggctcc

SEQ ID NO: 705718 - DNA, 25 bp, Mus musculus
gtgctactcatgctcaccgagagaa

SEQ ID NO: 705719 - DNA, 25 bp, Mus musculus
gtgctactcatggtcaccgagagaa

SEQ ID NO: 705720 - DNA, 25 bp, Mus musculus
gtgctactccacagcaggcaggata

SEQ ID NO: 705721 - DNA, 25 bp, Mus musculus
gtgctactccactgcaggcaggata

SEQ ID NO: 705722 - DNA, 25 bp, Mus musculus
gtgctactgcgaagccggaaggatt

SEQ ID NO: 705723 - DNA, 25 bp, Mus musculus
gtgctactgcgatgccggaaggatt

SEQ ID NO: 705724 - DNA, 25 bp, Mus musculus
gtgctactgtagcaaaccacagcat

SEQ ID NO: 705725 - DNA, 25 bp, Mus musculus
gtgctactgtaggaaaccacagcat

SEQ ID NO: 705726 - DNA, 25 bp, Mus musculus
gtgctactgtatataacgtgtgcta

SEQ ID NO: 705727 - DNA, 25 bp, Mus musculus
gtgctactgtatttaacgtgtgcta

SEQ ID NO: 705728 - DNA, 25 bp, Mus musculus
gtgctacttacaattgtaaccctgg

SEQ ID NO: 705729 - DNA, 25 bp, Mus musculus
gtgctacttacatttgtaaccctgg

SEQ ID NO: 705730 - DNA, 25 bp, Mus musculus
gtgctacttaccacacaaagcccag

SEQ ID NO: 705731 - DNA, 25 bp, Mus musculus
gtgctacttacctcacaaagcccag

SEQ ID NO: 705732 - DNA, 25 bp, Mus musculus
gtgctacttagtatctaggcttcta

SEQ ID NO: 705733 - DNA, 25 bp, Mus musculus
gtgctacttagtttctaggcttcta

SEQ ID NO: 705734 - DNA, 25 bp, Mus musculus
gtgctacttcatccttaaagagtct

SEQ ID NO: 705735 - DNA, 25 bp, Mus musculus
gtgctacttcatgcttaaagagtct

SEQ ID NO: 705736 - DNA, 25 bp, Mus musculus
gtgctacttctacactaacaactga

SEQ ID NO: 705737 - DNA, 25 bp, Mus musculus
gtgctacttctagactaacaactga

SEQ ID NO: 705738 - DNA, 25 bp, Mus musculus
gtgctacttgatctgttttggtttg

SEQ ID NO: 705739 - DNA, 25 bp, Mus musculus
gtgctacttgatgtgttttggtttg

SEQ ID NO: 705740 - DNA, 25 bp, Mus musculus
gtgctacttgcgaatctctgagaat

SEQ ID NO: 705741 - DNA, 25 bp, Mus musculus
gtgctacttgcgtatctctgagaat

SEQ ID NO: 705742 - DNA, 25 bp, Mus musculus
gtgctactttctatgggaattaatt

SEQ ID NO: 705743 - DNA, 25 bp, Mus musculus
gtgctactttctttgggaattaatt

SEQ ID NO: 705744 - DNA, 25 bp, Mus musculus
gtgctagacctcagtataaaaccga

SEQ ID NO: 705745 - DNA, 25 bp, Mus musculus
gtgctagacctctgtataaaaccga

SEQ ID NO: 705746 - DNA, 25 bp, Mus musculus
gtgctagactggatctgccgaagat

SEQ ID NO: 705747 - DNA, 25 bp, Mus musculus
gtgctagactggttctgccgaagat

SEQ ID NO: 705748 - DNA, 25 bp, Mus musculus
gtgctagatcaaaggcatccatttt

SEQ ID NO: 705749 - DNA, 25 bp, Mus musculus
gtgctagatcaatggcatccatttt

SEQ ID NO: 705750 - DNA, 25 bp, Mus musculus
gtgctagatccacagaaccgcgagt

SEQ ID NO: 705751 - DNA, 25 bp, Mus musculus
gtgctagatccagagaaccgcgagt

SEQ ID NO: 705752 - DNA, 25 bp, Mus musculus
gtgctagatgccatttttcaatctg

SEQ ID NO: 705753 - DNA, 25 bp, Mus musculus
gtgctagatgccttttttcaatctg

SEQ ID NO: 705754 - DNA, 25 bp, Mus musculus
gtgctagattgtcttctactattag

SEQ ID NO: 705755 - DNA, 25 bp, Mus musculus
gtgctagattgtgttctactattag

SEQ ID NO: 705756 - DNA, 25 bp, Mus musculus
gtgctagcaatcatgcttttgctta

SEQ ID NO: 705757 - DNA, 25 bp, Mus musculus
gtgctagcaatcttgcttttgctta

SEQ ID NO: 705758 - DNA, 25 bp, Mus musculus
gtgctagcacccatgattttggaat

SEQ ID NO: 705759 - DNA, 25 bp, Mus musculus
gtgctagcacccttgattttggaat

SEQ ID NO: 705760 - DNA, 25 bp, Mus musculus
gtgctagcagataatccacactggt

SEQ ID NO: 705761 - DNA, 25 bp, Mus musculus
gtgctagcagattatccacactggt

SEQ ID NO: 705762 - DNA, 25 bp, Mus musculus
gtgctagcaggactacccaggcgct

SEQ ID NO: 705763 - DNA, 25 bp, Mus musculus
gtgctagcaggagtacccaggcgct

SEQ ID NO: 705764 - DNA, 25 bp, Mus musculus
gtgctagcatgcaagccagggtcat

SEQ ID NO: 705765 - DNA, 25 bp, Mus musculus
gtgctagcatgctagccagggtcat

SEQ ID NO: 705766 - DNA, 25 bp, Mus musculus
gtgctagcatggaactttggtcttc

SEQ ID NO: 705767 - DNA, 25 bp, Mus musculus
gtgctagcatggtactttggtcttc

SEQ ID NO: 705768 - DNA, 25 bp, Mus musculus
gtgctagcatgtccttgtagtccca

SEQ ID NO: 705769 - DNA, 25 bp, Mus musculus
gtgctagcatgtgcttgtagtccca

SEQ ID NO: 705770 - DNA, 25 bp, Mus musculus
gtgctagccaccattttgactacta

SEQ ID NO: 705771 - DNA, 25 bp, Mus musculus
gtgctagccacctttttgactacta

SEQ ID NO: 705772 - DNA, 25 bp, Mus musculus
gtgctagccattcagcttctcgcgg

SEQ ID NO: 705773 - DNA, 25 bp, Mus musculus
gtgctagccattgagcttctcgcgg

SEQ ID NO: 705774 - DNA, 25 bp, Mus musculus
gtgctagcccctcttagagatacaa

SEQ ID NO: 705775 - DNA, 25 bp, Mus musculus
gtgctagcccctgttagagatacaa

SEQ ID NO: 705776 - DNA, 25 bp, Mus musculus
gtgctagcccgaatctggcgccaag

SEQ ID NO: 705777 - DNA, 25 bp, Mus musculus
gtgctagcccgattctggcgccaag

SEQ ID NO: 705778 - DNA, 25 bp, Mus musculus
gtgctagccctcagaaatttcacct

SEQ ID NO: 705779 - DNA, 25 bp, Mus musculus
gtgctagccctctgaaatttcacct

SEQ ID NO: 705780 - DNA, 25 bp, Mus musculus
gtgctagcctacacacactaaaaag

SEQ ID NO: 705781 - DNA, 25 bp, Mus musculus
gtgctagcctactcacactaaaaag

SEQ ID NO: 705782 - DNA, 25 bp, Mus musculus
gtgctagcctagcatctgcctcgta

SEQ ID NO: 705783 - DNA, 25 bp, Mus musculus
gtgctagcctaggatctgcctcgta

SEQ ID NO: 705784 - DNA, 25 bp, Mus musculus
gtgctagctcccaagtcatttaaag

SEQ ID NO: 705785 - DNA, 25 bp, Mus musculus
gtgctagctccctagtcatttaaag

SEQ ID NO: 705786 - DNA, 25 bp, Mus musculus
gtgctagctgatcggcagatcattt

SEQ ID NO: 705787 - DNA, 25 bp, Mus musculus
gtgctagctgatctttcggacaact

SEQ ID NO: 705788 - DNA, 25 bp, Mus musculus
gtgctagctgatgggcagatcattt

SEQ ID NO: 705789 - DNA, 25 bp, Mus musculus
gtgctagctgatgtttcggacaact

SEQ ID NO: 705790 - DNA, 25 bp, Mus musculus
gtgctagctggaatgggctctccac

SEQ ID NO: 705791 - DNA, 25 bp, Mus musculus
gtgctagctggattgggctctccac

SEQ ID NO: 705792 - DNA, 25 bp, Mus musculus
gtgctaggaatcaactccatggctt

SEQ ID NO: 705793 - DNA, 25 bp, Mus musculus
gtgctaggaatctactccatggctt

SEQ ID NO: 705794 - DNA, 25 bp, Mus musculus
gtgctaggatctcaggcatgagcta

SEQ ID NO: 705795 - DNA, 25 bp, Mus musculus
gtgctaggatctgaggcatgagcta

SEQ ID NO: 705796 - DNA, 25 bp, Mus musculus
gtgctaggcaaacctttagattcaa

SEQ ID NO: 705797 - DNA, 25 bp, Mus musculus
gtgctaggcaaagctttagattcaa

SEQ ID NO: 705798 - DNA, 25 bp, Mus musculus
gtgctaggcaggagtgcatcacttt

SEQ ID NO: 705799 - DNA, 25 bp, Mus musculus
gtgctaggcaggtgtgcatcacttt

SEQ ID NO: 705800 - DNA, 25 bp, Mus musculus
gtgctaggcctgagtgcttgtctgt

SEQ ID NO: 705801 - DNA, 25 bp, Mus musculus
gtgctaggcctgtgtgcttgtctgt

SEQ ID NO: 705802 - DNA, 25 bp, Mus musculus
gtgctaggcgctacctccaagggaa

SEQ ID NO: 705803 - DNA, 25 bp, Mus musculus
gtgctaggcgcttcctccaagggaa

SEQ ID NO: 705804 - DNA, 25 bp, Mus musculus
gtgctaggctccaggtagaccctga

SEQ ID NO: 705805 - DNA, 25 bp, Mus musculus
gtgctaggctcctggtagaccctga

SEQ ID NO: 705806 - DNA, 25 bp, Mus musculus
gtgctaggcttaaacacatggtcta

SEQ ID NO: 705807 - DNA, 25 bp, Mus musculus
gtgctaggcttatacacatggtcta

SEQ ID NO: 705808 - DNA, 25 bp, Mus musculus
gtgctaggtcctctagtcttcgtgc

SEQ ID NO: 705809 - DNA, 25 bp, Mus musculus
gtgctaggtcctgtagtcttcgtgc

SEQ ID NO: 705810 - DNA, 25 bp, Mus musculus
gtgctagtacccagcctgaggagat

SEQ ID NO: 705811 - DNA, 25 bp, Mus musculus
gtgctagtaccctgcctgaggagat

SEQ ID NO: 705812 - DNA, 25 bp, Mus musculus
gtgctagtcagcagtgcgaacatgc

SEQ ID NO: 705813 - DNA, 25 bp, Mus musculus
gtgctagtcagctgtgcgaacatgc

SEQ ID NO: 705814 - DNA, 25 bp, Mus musculus
gtgctagtcatgagcttcaattctg

SEQ ID NO: 705815 - DNA, 25 bp, Mus musculus
gtgctagtcatgtgcttcaattctg

SEQ ID NO: 705816 - DNA, 25 bp, Mus musculus
gtgctagtctccacgttagctattt

SEQ ID NO: 705817 - DNA, 25 bp, Mus musculus
gtgctagtctcctcgttagctattt

SEQ ID NO: 705818 - DNA, 25 bp, Mus musculus
gtgctagtctggaaagcatccttcc

SEQ ID NO: 705819 - DNA, 25 bp, Mus musculus
gtgctagtctggtaagcatccttcc

SEQ ID NO: 705820 - DNA, 25 bp, Mus musculus
gtgctagtgctgactgcgcttgccg

SEQ ID NO: 705821 - DNA, 25 bp, Mus musculus
gtgctagtgctgtctgcgcttgccg

SEQ ID NO: 705822 - DNA, 25 bp, Mus musculus
gtgctagtgcttccttctaaacagg

SEQ ID NO: 705823 - DNA, 25 bp, Mus musculus
gtgctagtgcttgcttctaaacagg

SEQ ID NO: 705824 - DNA, 25 bp, Mus musculus
gtgctagtggagatactacccctca

SEQ ID NO: 705825 - DNA, 25 bp, Mus musculus
gtgctagtggagttactacccctca

SEQ ID NO: 705826 - DNA, 25 bp, Mus musculus
gtgctagttcacattggttgctata

SEQ ID NO: 705827 - DNA, 25 bp, Mus musculus
gtgctagttcactttggttgctata

SEQ ID NO: 705828 - DNA, 25 bp, Mus musculus
gtgctagttgctctcacagaaggcc

SEQ ID NO: 705829 - DNA, 25 bp, Mus musculus
gtgctagttgctgtcacagaaggcc

SEQ ID NO: 705830 - DNA, 25 bp, Mus musculus
gtgctagtttgaatgggcccactca

SEQ ID NO: 705831 - DNA, 25 bp, Mus musculus
gtgctagtttgattgggcccactca

SEQ ID NO: 705832 - DNA, 25 bp, Mus musculus
gtgctagtttgtccctgaagtctgt

SEQ ID NO: 705833 - DNA, 25 bp, Mus musculus
gtgctagtttgtgcctgaagtctgt

SEQ ID NO: 705834 - DNA, 25 bp, Mus musculus
gtgctataaaagatccaaggaccag

SEQ ID NO: 705835 - DNA, 25 bp, Mus musculus
gtgctataaaagttccaaggaccag

SEQ ID NO: 705836 - DNA, 25 bp, Mus musculus
gtgctataaactctgggaattccat

SEQ ID NO: 705837 - DNA, 25 bp, Mus musculus
gtgctataaactgtgggaattccat

SEQ ID NO: 705838 - DNA, 25 bp, Mus musculus
gtgctataacatcgtacaaggaata

SEQ ID NO: 705839 - DNA, 25 bp, Mus musculus
gtgctataacatggtacaaggaata

SEQ ID NO: 705840 - DNA, 25 bp, Mus musculus
gtgctataccagagaatgctccttc

SEQ ID NO: 705841 - DNA, 25 bp, Mus musculus
gtgctataccagtgaatgctccttc

SEQ ID NO: 705842 - DNA, 25 bp, Mus musculus
gtgctataccttacataggtcttat

SEQ ID NO: 705843 - DNA, 25 bp, Mus musculus
gtgctatacctttcataggtcttat

SEQ ID NO: 705844 - DNA, 25 bp, Mus musculus
gtgctatacgggaggtgctctcaag

SEQ ID NO: 705845 - DNA, 25 bp, Mus musculus
gtgctatacgggtggtgctctcaag

SEQ ID NO: 705846 - DNA, 25 bp, Mus musculus
gtgctatagattaaccattccttgt

SEQ ID NO: 705847 - DNA, 25 bp, Mus musculus
gtgctatagatttaccattccttgt

SEQ ID NO: 705848 - DNA, 25 bp, Mus musculus
gtgctatagctacaagcatgtccca

SEQ ID NO: 705849 - DNA, 25 bp, Mus musculus
gtgctatagctagaagcatgtccca

SEQ ID NO: 705850 - DNA, 25 bp, Mus musculus
gtgctatagcttatccaggactttg

SEQ ID NO: 705851 - DNA, 25 bp, Mus musculus
gtgctatagcttttccaggactttg

SEQ ID NO: 705852 - DNA, 25 bp, Mus musculus
gtgctatatagcactttggctcgtg

SEQ ID NO: 705853 - DNA, 25 bp, Mus musculus
gtgctatatagctctttggctcgtg

SEQ ID NO: 705854 - DNA, 25 bp, Mus musculus
gtgctatatctgcttgggcccatga

SEQ ID NO: 705855 - DNA, 25 bp, Mus musculus
gtgctatatctggttgggcccatga

SEQ ID NO: 705856 - DNA, 25 bp, Mus musculus
gtgctatcaatgcttccagtaccac

SEQ ID NO: 705857 - DNA, 25 bp, Mus musculus
gtgctatcaatggttccagtaccac

SEQ ID NO: 705858 - DNA, 25 bp, Mus musculus
gtgctatcagacagcaggcctgcca

SEQ ID NO: 705859 - DNA, 25 bp, Mus musculus
gtgctatcagactgcaggcctgcca

SEQ ID NO: 705860 - DNA, 25 bp, Mus musculus
gtgctatcccacagaactttaagag

SEQ ID NO: 705861 - DNA, 25 bp, Mus musculus
gtgctatcccactgaactttaagag

SEQ ID NO: 705862 - DNA, 25 bp, Mus musculus
gtgctatccctacagtgtgatatca

SEQ ID NO: 705863 - DNA, 25 bp, Mus musculus
gtgctatccctagagtgtgatatca

SEQ ID NO: 705864 - DNA, 25 bp, Mus musculus
gtgctatccctgacactgaggatca

SEQ ID NO: 705865 - DNA, 25 bp, Mus musculus
gtgctatccctgtcactgaggatca

SEQ ID NO: 705866 - DNA, 25 bp, Mus musculus
gtgctatctactctgagcccctttc

SEQ ID NO: 705867 - DNA, 25 bp, Mus musculus
gtgctatctactgtgagcccctttc

SEQ ID NO: 705868 - DNA, 25 bp, Mus musculus
gtgctatctatgatgtgtctcacat

SEQ ID NO: 705869 - DNA, 25 bp, Mus musculus
gtgctatctatgttgtgtctcacat

SEQ ID NO: 705870 - DNA, 25 bp, Mus musculus
gtgctatctctacctagccctacaa

SEQ ID NO: 705871 - DNA, 25 bp, Mus musculus
gtgctatctctagctagccctacaa

SEQ ID NO: 705872 - DNA, 25 bp, Mus musculus
gtgctatctgtaactctaattccag

SEQ ID NO: 705873 - DNA, 25 bp, Mus musculus
gtgctatctgtacacctggaggtgt

SEQ ID NO: 705874 - DNA, 25 bp, Mus musculus
gtgctatctgtagacctggaggtgt

SEQ ID NO: 705875 - DNA, 25 bp, Mus musculus
gtgctatctgtatctctaattccag

SEQ ID NO: 705876 - DNA, 25 bp, Mus musculus
gtgctatgagcaatgcccacctcag

SEQ ID NO: 705877 - DNA, 25 bp, Mus musculus
gtgctatgagcattgcccacctcag

SEQ ID NO: 705878 - DNA, 25 bp, Mus musculus
gtgctatgatgaatgaccttgtaaa

SEQ ID NO: 705879 - DNA, 25 bp, Mus musculus
gtgctatgatgattgaccttgtaaa

SEQ ID NO: 705880 - DNA, 25 bp, Mus musculus
gtgctatggcacaggttcagtttca

SEQ ID NO: 705881 - DNA, 25 bp, Mus musculus
gtgctatggcactggttcagtttca

SEQ ID NO: 705882 - DNA, 25 bp, Mus musculus
gtgctatggcggcatggtcatctca

SEQ ID NO: 705883 - DNA, 25 bp, Mus musculus
gtgctatggcgggatggtcatctca

SEQ ID NO: 705884 - DNA, 25 bp, Mus musculus
gtgctatggttgaacattgtgctta

SEQ ID NO: 705885 - DNA, 25 bp, Mus musculus
gtgctatggttgtacattgtgctta

SEQ ID NO: 705886 - DNA, 25 bp, Mus musculus
gtgctatgtgacaacgttcaggtgt

SEQ ID NO: 705887 - DNA, 25 bp, Mus musculus
gtgctatgtgactacgttcaggtgt

SEQ ID NO: 705888 - DNA, 25 bp, Mus musculus
gtgctattcactcggtttacttgtt

SEQ ID NO: 705889 - DNA, 25 bp, Mus musculus
gtgctattcactgggtttacttgtt

SEQ ID NO: 705890 - DNA, 25 bp, Mus musculus
gtgctattccaccactagttcagct

SEQ ID NO: 705891 - DNA, 25 bp, Mus musculus
gtgctattccacgactagttcagct

SEQ ID NO: 705892 - DNA, 25 bp, Mus musculus
gtgctattcgttcttgattttcaaa

SEQ ID NO: 705893 - DNA, 25 bp, Mus musculus
gtgctattcgttgttgattttcaaa

SEQ ID NO: 705894 - DNA, 25 bp, Mus musculus
gtgctattctgcatctatcggttaa

SEQ ID NO: 705895 - DNA, 25 bp, Mus musculus
gtgctattctgcttctatcggttaa

SEQ ID NO: 705896 - DNA, 25 bp, Mus musculus
gtgctattgaacatctaccagtgtc

SEQ ID NO: 705897 - DNA, 25 bp, Mus musculus
gtgctattgaacttctaccagtgtc

SEQ ID NO: 705898 - DNA, 25 bp, Mus musculus
gtgctattgacaagctgtctcttca

SEQ ID NO: 705899 - DNA, 25 bp, Mus musculus
gtgctattgacatgctgtctcttca

SEQ ID NO: 705900 - DNA, 25 bp, Mus musculus
gtgctattgagcaggttcgcttccg

SEQ ID NO: 705901 - DNA, 25 bp, Mus musculus
gtgctattgagctggttcgcttccg

SEQ ID NO: 705902 - DNA, 25 bp, Mus musculus
gtgctattgcaactccaaaaatttc

SEQ ID NO: 705903 - DNA, 25 bp, Mus musculus
gtgctattgcaagtccaaaaatttc

SEQ ID NO: 705904 - DNA, 25 bp, Mus musculus
gtgctattggtgatcggcattgcca

SEQ ID NO: 705905 - DNA, 25 bp, Mus musculus
gtgctattggtgttcggcattgcca

SEQ ID NO: 705906 - DNA, 25 bp, Mus musculus
gtgctatttaatattcacctgtggg

SEQ ID NO: 705907 - DNA, 25 bp, Mus musculus
gtgctatttaattttcacctgtggg

SEQ ID NO: 705908 - DNA, 25 bp, Mus musculus
gtgctatttcaaatatagaagttta

SEQ ID NO: 705909 - DNA, 25 bp, Mus musculus
gtgctatttcaattatagaagttta

SEQ ID NO: 705910 - DNA, 25 bp, Mus musculus
gtgctatttgccaagcgtgttgata

SEQ ID NO: 705911 - DNA, 25 bp, Mus musculus
gtgctatttgcctagcgtgttgata

SEQ ID NO: 705912 - DNA, 25 bp, Mus musculus
gtgctattttggcatctgaggtcaa

SEQ ID NO: 705913 - DNA, 25 bp, Mus musculus
gtgctattttgggatctgaggtcaa

SEQ ID NO: 705914 - DNA, 25 bp, Mus musculus
gtgctattttgtaatatgattgcca

SEQ ID NO: 705915 - DNA, 25 bp, Mus musculus
gtgctattttgttatatgattgcca

SEQ ID NO: 705916 - DNA, 25 bp, Mus musculus
gtgctcaaattcaatccattaagat

SEQ ID NO: 705917 - DNA, 25 bp, Mus musculus
gtgctcaaattctatccattaagat

SEQ ID NO: 705918 - DNA, 25 bp, Mus musculus
gtgctcaacaaaactatgcttactg

SEQ ID NO: 705919 - DNA, 25 bp, Mus musculus
gtgctcaacaaatctatgcttactg

SEQ ID NO: 705920 - DNA, 25 bp, Mus musculus
gtgctcaacaagatccggatctacc

SEQ ID NO: 705921 - DNA, 25 bp, Mus musculus
gtgctcaacaagttccggatctacc

SEQ ID NO: 705922 - DNA, 25 bp, Mus musculus
gtgctcaacactaatcagctcagag

SEQ ID NO: 705923 - DNA, 25 bp, Mus musculus
gtgctcaacacttatcagctcagag

SEQ ID NO: 705924 - DNA, 25 bp, Mus musculus
gtgctcaacgtgcagtcatagcctg

SEQ ID NO: 705925 - DNA, 25 bp, Mus musculus
gtgctcaacgtggagtcatagcctg

SEQ ID NO: 705926 - DNA, 25 bp, Mus musculus
gtgctcaactgaccctgagggcgaa

SEQ ID NO: 705927 - DNA, 25 bp, Mus musculus
gtgctcaactgagcctgagggcgaa

SEQ ID NO: 705928 - DNA, 25 bp, Mus musculus
gtgctcaagacaaccacgtggctta

SEQ ID NO: 705929 - DNA, 25 bp, Mus musculus
gtgctcaagacatccacgtggctta

SEQ ID NO: 705930 - DNA, 25 bp, Mus musculus
gtgctcaagctccatccagaatgtt

SEQ ID NO: 705931 - DNA, 25 bp, Mus musculus
gtgctcaagctcgatccagaatgtt

SEQ ID NO: 705932 - DNA, 25 bp, Mus musculus
gtgctcaaggcaactggaaccagaa

SEQ ID NO: 705933 - DNA, 25 bp, Mus musculus
gtgctcaaggcatctggaaccagaa

SEQ ID NO: 705934 - DNA, 25 bp, Mus musculus
gtgctcaagttgcaagaacatgggc

SEQ ID NO: 705935 - DNA, 25 bp, Mus musculus
gtgctcaagttggaagaacatgggc

SEQ ID NO: 705936 - DNA, 25 bp, Mus musculus
gtgctcaatcgaaggctggttctgc

SEQ ID NO: 705937 - DNA, 25 bp, Mus musculus
gtgctcaatcgatggctggttctgc

SEQ ID NO: 705938 - DNA, 25 bp, Mus musculus
gtgctcaattccatcttctataggg

SEQ ID NO: 705939 - DNA, 25 bp, Mus musculus
gtgctcaattccttcttctataggg

SEQ ID NO: 705940 - DNA, 25 bp, Mus musculus
gtgctcacacagctaagaaggatga

SEQ ID NO: 705941 - DNA, 25 bp, Mus musculus
gtgctcacacaggtaagaaggatga

SEQ ID NO: 705942 - DNA, 25 bp, Mus musculus
gtgctcacactgctgatgacttcaa

SEQ ID NO: 705943 - DNA, 25 bp, Mus musculus
gtgctcacactggtgatgacttcaa

SEQ ID NO: 705944 - DNA, 25 bp, Mus musculus
gtgctcacagacacatatcagctgg

SEQ ID NO: 705945 - DNA, 25 bp, Mus musculus
gtgctcacagactcatatcagctgg

SEQ ID NO: 705946 - DNA, 25 bp, Mus musculus
gtgctcacaggaaactttgaccaag

SEQ ID NO: 705947 - DNA, 25 bp, Mus musculus
gtgctcacaggatactttgaccaag

SEQ ID NO: 705948 - DNA, 25 bp, Mus musculus
gtgctcacagtcacgatggaccaga

SEQ ID NO: 705949 - DNA, 25 bp, Mus musculus
gtgctcacagtcatcgtggttgttg

SEQ ID NO: 705950 - DNA, 25 bp, Mus musculus
gtgctcacagtctcgatggaccaga

SEQ ID NO: 705951 - DNA, 25 bp, Mus musculus
gtgctcacagtcttcgtggttgttg

SEQ ID NO: 705952 - DNA, 25 bp, Mus musculus
gtgctcacataccatctgtttttcc

SEQ ID NO: 705953 - DNA, 25 bp, Mus musculus
gtgctcacatacgatctgtttttcc

SEQ ID NO: 705954 - DNA, 25 bp, Mus musculus
gtgctcacatggagttctgttttgt

SEQ ID NO: 705955 - DNA, 25 bp, Mus musculus
gtgctcacatggtgttctgttttgt

SEQ ID NO: 705956 - DNA, 25 bp, Mus musculus
gtgctcacattaacctacacttgac

SEQ ID NO: 705957 - DNA, 25 bp, Mus musculus
gtgctcacattatcctacacttgac

SEQ ID NO: 705958 - DNA, 25 bp, Mus musculus
gtgctcaccacaaagctgagaagag

SEQ ID NO: 705959 - DNA, 25 bp, Mus musculus
gtgctcaccacatagctgagaagag

SEQ ID NO: 705960 - DNA, 25 bp, Mus musculus
gtgctcacccagagcttcgtgactc

SEQ ID NO: 705961 - DNA, 25 bp, Mus musculus
gtgctcacccagtgcttcgtgactc

SEQ ID NO: 705962 - DNA, 25 bp, Mus musculus
gtgctcaccctaatggagtcagaaa

SEQ ID NO: 705963 - DNA, 25 bp, Mus musculus
gtgctcaccctattggagtcagaaa

SEQ ID NO: 705964 - DNA, 25 bp, Mus musculus
gtgctcacctacagatgttctattt

SEQ ID NO: 705965 - DNA, 25 bp, Mus musculus
gtgctcacctactgatgttctattt

SEQ ID NO: 705966 - DNA, 25 bp, Mus musculus
gtgctcacctagaatacgctggtct

SEQ ID NO: 705967 - DNA, 25 bp, Mus musculus
gtgctcacctagtatacgctggtct

SEQ ID NO: 705968 - DNA, 25 bp, Mus musculus
gtgctcacctttcccttagagatgg

SEQ ID NO: 705969 - DNA, 25 bp, Mus musculus
gtgctcacctttgccttagagatgg

SEQ ID NO: 705970 - DNA, 25 bp, Mus musculus
gtgctcacgctcaaccttgtcattg

SEQ ID NO: 705971 - DNA, 25 bp, Mus musculus
gtgctcacgctctaccttgtcattg

SEQ ID NO: 705972 - DNA, 25 bp, Mus musculus
gtgctcacgggtacatgtgcttaca

SEQ ID NO: 705973 - DNA, 25 bp, Mus musculus
gtgctcacgggttcatgtgcttaca

SEQ ID NO: 705974 - DNA, 25 bp, Mus musculus
gtgctcactcagaaacagcaggttg

SEQ ID NO: 705975 - DNA, 25 bp, Mus musculus
gtgctcactcagtaacagcaggttg

SEQ ID NO: 705976 - DNA, 25 bp, Mus musculus
gtgctcactccacatgatggtctaa

SEQ ID NO: 705977 - DNA, 25 bp, Mus musculus
gtgctcactccagatgatggtctaa

SEQ ID NO: 705978 - DNA, 25 bp, Mus musculus
gtgctcactgctatgaaatacctta

SEQ ID NO: 705979 - DNA, 25 bp, Mus musculus
gtgctcactgctttgaaatacctta

SEQ ID NO: 705980 - DNA, 25 bp, Mus musculus
gtgctcactgggaaagcagtcccca

SEQ ID NO: 705981 - DNA, 25 bp, Mus musculus
gtgctcactgggtaagcagtcccca

SEQ ID NO: 705982 - DNA, 25 bp, Mus musculus
gtgctcactgtgaataggaatctgt

SEQ ID NO: 705983 - DNA, 25 bp, Mus musculus
gtgctcactgtgtataggaatctgt

SEQ ID NO: 705984 - DNA, 25 bp, Mus musculus
gtgctcactttcatgttcctggagc

SEQ ID NO: 705985 - DNA, 25 bp, Mus musculus
gtgctcactttcttgttcctggagc

SEQ ID NO: 705986 - DNA, 25 bp, Mus musculus
gtgctcagaacactcctcgaggaaa

SEQ ID NO: 705987 - DNA, 25 bp, Mus musculus
gtgctcagaacagtcctcgaggaaa

SEQ ID NO: 705988 - DNA, 25 bp, Mus musculus
gtgctcagaagcacactctcgagtg

SEQ ID NO: 705989 - DNA, 25 bp, Mus musculus
gtgctcagaagctcactctcgagtg

SEQ ID NO: 705990 - DNA, 25 bp, Mus musculus
gtgctcagaatccaaccagccttga

SEQ ID NO: 705991 - DNA, 25 bp, Mus musculus
gtgctcagaatcgaaccagccttga

SEQ ID NO: 705992 - DNA, 25 bp, Mus musculus
gtgctcagactgattgatgctaagt

SEQ ID NO: 705993 - DNA, 25 bp, Mus musculus
gtgctcagactgtttgatgctaagt

SEQ ID NO: 705994 - DNA, 25 bp, Mus musculus
gtgctcagagagatctggctcctga

SEQ ID NO: 705995 - DNA, 25 bp, Mus musculus
gtgctcagagagttctggctcctga

SEQ ID NO: 705996 - DNA, 25 bp, Mus musculus
gtgctcagagccctagtattgacta

SEQ ID NO: 705997 - DNA, 25 bp, Mus musculus
gtgctcagagccgtagtattgacta

SEQ ID NO: 705998 - DNA, 25 bp, Mus musculus
gtgctcagagtcaacattccagatt

SEQ ID NO: 705999 - DNA, 25 bp, Mus musculus
gtgctcagagtcaaccttggtgctt

SEQ ID NO: 706000 - DNA, 25 bp, Mus musculus
gtgctcagagtctacattccagatt

SEQ ID NO: 706001 - DNA, 25 bp, Mus musculus
gtgctcagagtctaccttggtgctt

SEQ ID NO: 706002 - DNA, 25 bp, Mus musculus
gtgctcagatcaccagatggccaga

SEQ ID NO: 706003 - DNA, 25 bp, Mus musculus
gtgctcagatcagcagatggccaga

SEQ ID NO: 706004 - DNA, 25 bp, Mus musculus
gtgctcagcactaaacttacataat

SEQ ID NO: 706005 - DNA, 25 bp, Mus musculus
gtgctcagcactactgaggtctgga

SEQ ID NO: 706006 - DNA, 25 bp, Mus musculus
gtgctcagcacttaacttacataat

SEQ ID NO: 706007 - DNA, 25 bp, Mus musculus
gtgctcagcacttctgaggtctgga

SEQ ID NO: 706008 - DNA, 25 bp, Mus musculus
gtgctcagccacaaagcaatggttt

SEQ ID NO: 706009 - DNA, 25 bp, Mus musculus
gtgctcagccactaagcaatggttt

SEQ ID NO: 706010 - DNA, 25 bp, Mus musculus
gtgctcagcgccatgaagatggaga

SEQ ID NO: 706011 - DNA, 25 bp, Mus musculus
gtgctcagcgccttgaagatggaga

SEQ ID NO: 706012 - DNA, 25 bp, Mus musculus
gtgctcagcggaacagaccaggtgt

SEQ ID NO: 706013 - DNA, 25 bp, Mus musculus
gtgctcagcggatcagaccaggtgt

SEQ ID NO: 706014 - DNA, 25 bp, Mus musculus
gtgctcagcgtaatgtaagtgctct

SEQ ID NO: 706015 - DNA, 25 bp, Mus musculus
gtgctcagcgtattgtaagtgctct

SEQ ID NO: 706016 - DNA, 25 bp, Mus musculus
gtgctcagctatccttgcaggcctg

SEQ ID NO: 706017 - DNA, 25 bp, Mus musculus
gtgctcagctatgcttgcaggcctg

SEQ ID NO: 706018 - DNA, 25 bp, Mus musculus
gtgctcagctcacgaggacgttcat

SEQ ID NO: 706019 - DNA, 25 bp, Mus musculus
gtgctcagctcaggaggacgttcat

SEQ ID NO: 706020 - DNA, 25 bp, Mus musculus
gtgctcagctgacgctaggattact

SEQ ID NO: 706021 - DNA, 25 bp, Mus musculus
gtgctcagctgaggctaggattact

SEQ ID NO: 706022 - DNA, 25 bp, Mus musculus
gtgctcagcttcacgtagacagtga

SEQ ID NO: 706023 - DNA, 25 bp, Mus musculus
gtgctcagcttctcgtagacagtga

SEQ ID NO: 706024 - DNA, 25 bp, Mus musculus
gtgctcaggaaactgtcaccacagt

SEQ ID NO: 706025 - DNA, 25 bp, Mus musculus
gtgctcaggaaagtgtcaccacagt

SEQ ID NO: 706026 - DNA, 25 bp, Mus musculus
gtgctcaggagaatatgccttccct

SEQ ID NO: 706027 - DNA, 25 bp, Mus musculus
gtgctcaggagattatgccttccct

SEQ ID NO: 706028 - DNA, 25 bp, Mus musculus
gtgctcagtagacagaggcccacta

SEQ ID NO: 706029 - DNA, 25 bp, Mus musculus
gtgctcagtagagagaggcccacta

SEQ ID NO: 706030 - DNA, 25 bp, Mus musculus
gtgctcagtgtacgtcttgtcacag

SEQ ID NO: 706031 - DNA, 25 bp, Mus musculus
gtgctcagtgtaggtcttgtcacag

SEQ ID NO: 706032 - DNA, 25 bp, Mus musculus
gtgctcagttaacagaaaccccaat

SEQ ID NO: 706033 - DNA, 25 bp, Mus musculus
gtgctcagttaagagaaaccccaat

SEQ ID NO: 706034 - DNA, 25 bp, Mus musculus
gtgctcagttctcaatatacagatg

SEQ ID NO: 706035 - DNA, 25 bp, Mus musculus
gtgctcagttctgaatatacagatg

SEQ ID NO: 706036 - DNA, 25 bp, Mus musculus
gtgctcatcaaaaactcagaaattg

SEQ ID NO: 706037 - DNA, 25 bp, Mus musculus
gtgctcatcaaatactcagaaattg

SEQ ID NO: 706038 - DNA, 25 bp, Mus musculus
gtgctcatcccgatcaaagacatgg

SEQ ID NO: 706039 - DNA, 25 bp, Mus musculus
gtgctcatcccgttcaaagacatgg

SEQ ID NO: 706040 - DNA, 25 bp, Mus musculus
gtgctcatccctctttgtggaaaca

SEQ ID NO: 706041 - DNA, 25 bp, Mus musculus
gtgctcatccctgtttgtggaaaca

SEQ ID NO: 706042 - DNA, 25 bp, Mus musculus
gtgctcatcgaacaattggttcaga

SEQ ID NO: 706043 - DNA, 25 bp, Mus musculus
gtgctcatcgaagaattggttcaga

SEQ ID NO: 706044 - DNA, 25 bp, Mus musculus
gtgctcatctaaaaccattatattg

SEQ ID NO: 706045 - DNA, 25 bp, Mus musculus
gtgctcatctaataccattatattg

SEQ ID NO: 706046 - DNA, 25 bp, Mus musculus
gtgctcatctccacagacgtctggg

SEQ ID NO: 706047 - DNA, 25 bp, Mus musculus
gtgctcatctcctcagacgtctggg

SEQ ID NO: 706048 - DNA, 25 bp, Mus musculus
gtgctcatctcgcagaaagtcgagg

SEQ ID NO: 706049 - DNA, 25 bp, Mus musculus
gtgctcatctcggagaaagtcgagg

SEQ ID NO: 706050 - DNA, 25 bp, Mus musculus
gtgctcatctgactataggccatgc

SEQ ID NO: 706051 - DNA, 25 bp, Mus musculus
gtgctcatctgagtataggccatgc

SEQ ID NO: 706052 - DNA, 25 bp, Mus musculus
gtgctcatcttgcttttgtacttgc

SEQ ID NO: 706053 - DNA, 25 bp, Mus musculus
gtgctcatcttggttttgtacttgc

SEQ ID NO: 706054 - DNA, 25 bp, Mus musculus
gtgctcatggcgattcagggtacga

SEQ ID NO: 706055 - DNA, 25 bp, Mus musculus
gtgctcatggcgtttcagggtacga

SEQ ID NO: 706056 - DNA, 25 bp, Mus musculus
gtgctcatgtttacctctggcgaat

SEQ ID NO: 706057 - DNA, 25 bp, Mus musculus
gtgctcatgttttcctctggcgaat

SEQ ID NO: 706058 - DNA, 25 bp, Mus musculus
gtgctcattacccactgaggaaacc

SEQ ID NO: 706059 - DNA, 25 bp, Mus musculus
gtgctcattaccgactgaggaaacc

SEQ ID NO: 706060 - DNA, 25 bp, Mus musculus
gtgctcattctccataaatctgatg

SEQ ID NO: 706061 - DNA, 25 bp, Mus musculus
gtgctcattctcgataaatctgatg

SEQ ID NO: 706062 - DNA, 25 bp, Mus musculus
gtgctcattgccctcaagactgctt

SEQ ID NO: 706063 - DNA, 25 bp, Mus musculus
gtgctcattgccgtcaagactgctt

SEQ ID NO: 706064 - DNA, 25 bp, Mus musculus
gtgctcatttgcctggttttaggaa

SEQ ID NO: 706065 - DNA, 25 bp, Mus musculus
gtgctcatttgcgtggttttaggaa

SEQ ID NO: 706066 - DNA, 25 bp, Mus musculus
gtgctcattttcagtcctttgaggg

SEQ ID NO: 706067 - DNA, 25 bp, Mus musculus
gtgctcattttctgtcctttgaggg

SEQ ID NO: 706068 - DNA, 25 bp, Mus musculus
gtgctccaaaacctcctcccaccgt

SEQ ID NO: 706069 - DNA, 25 bp, Mus musculus
gtgctccaaaacgtcctcccaccgt

SEQ ID NO: 706070 - DNA, 25 bp, Mus musculus
gtgctccaaaatacgcagtgctttt

SEQ ID NO: 706071 - DNA, 25 bp, Mus musculus
gtgctccaaaattcgcagtgctttt

SEQ ID NO: 706072 - DNA, 25 bp, Mus musculus
gtgctccaaccccatttagtgtgtt

SEQ ID NO: 706073 - DNA, 25 bp, Mus musculus
gtgctccaacccgatttagtgtgtt

SEQ ID NO: 706074 - DNA, 25 bp, Mus musculus
gtgctccaagggagaacaatagcta

SEQ ID NO: 706075 - DNA, 25 bp, Mus musculus
gtgctccaagggtgaacaatagcta

SEQ ID NO: 706076 - DNA, 25 bp, Mus musculus
gtgctccaatctctcagaagttcta

SEQ ID NO: 706077 - DNA, 25 bp, Mus musculus
gtgctccaatctgtcagaagttcta

SEQ ID NO: 706078 - DNA, 25 bp, Mus musculus
gtgctccaatttctaccacagatgt

SEQ ID NO: 706079 - DNA, 25 bp, Mus musculus
gtgctccaatttgtaccacagatgt

SEQ ID NO: 706080 - DNA, 25 bp, Mus musculus
gtgctccacggacacggcaagagta

SEQ ID NO: 706081 - DNA, 25 bp, Mus musculus
gtgctccacggagacggcaagagta

SEQ ID NO: 706082 - DNA, 25 bp, Mus musculus
gtgctccagaagatgacagacctca

SEQ ID NO: 706083 - DNA, 25 bp, Mus musculus
gtgctccagaagttgacagacctca

SEQ ID NO: 706084 - DNA, 25 bp, Mus musculus
gtgctccagacgagagactcacctg

SEQ ID NO: 706085 - DNA, 25 bp, Mus musculus
gtgctccagacgtgagactcacctg

SEQ ID NO: 706086 - DNA, 25 bp, Mus musculus
gtgctccagagcatgcagcttgcgt

SEQ ID NO: 706087 - DNA, 25 bp, Mus musculus
gtgctccagagcttgcagcttgcgt

SEQ ID NO: 706088 - DNA, 25 bp, Mus musculus
gtgctccagccaaatattttcttag

SEQ ID NO: 706089 - DNA, 25 bp, Mus musculus
gtgctccagccatatattttcttag

SEQ ID NO: 706090 - DNA, 25 bp, Mus musculus
gtgctccagtgactagtatttcagc

SEQ ID NO: 706091 - DNA, 25 bp, Mus musculus
gtgctccagtgagtagtatttcagc

SEQ ID NO: 706092 - DNA, 25 bp, Mus musculus
gtgctccatcagaggtcctcatttg

SEQ ID NO: 706093 - DNA, 25 bp, Mus musculus
gtgctccatcagtggtcctcatttg

SEQ ID NO: 706094 - DNA, 25 bp, Mus musculus
gtgctccatgagaaacaggtttatc

SEQ ID NO: 706095 - DNA, 25 bp, Mus musculus
gtgctccatgagtaacaggtttatc

SEQ ID NO: 706096 - DNA, 25 bp, Mus musculus
gtgctccattggccgccaagcgtcg

SEQ ID NO: 706097 - DNA, 25 bp, Mus musculus
gtgctccattgggcgccaagcgtcg

SEQ ID NO: 706098 - DNA, 25 bp, Mus musculus
gtgctcccaaaacttggtgttcatg

SEQ ID NO: 706099 - DNA, 25 bp, Mus musculus
gtgctcccaaaagttggtgttcatg

SEQ ID NO: 706100 - DNA, 25 bp, Mus musculus
gtgctcccagagaatgaatttcctg

SEQ ID NO: 706101 - DNA, 25 bp, Mus musculus
gtgctcccagagtatgaatttcctg

SEQ ID NO: 706102 - DNA, 25 bp, Mus musculus
gtgctccccacgaggatagattaga

SEQ ID NO: 706103 - DNA, 25 bp, Mus musculus
gtgctccccacgtggatagattaga

SEQ ID NO: 706104 - DNA, 25 bp, Mus musculus
gtgctccccactatgtatgatgcaa

SEQ ID NO: 706105 - DNA, 25 bp, Mus musculus
gtgctccccactttgtatgatgcaa

SEQ ID NO: 706106 - DNA, 25 bp, Mus musculus
gtgctccccatgaacgaaggcagga

SEQ ID NO: 706107 - DNA, 25 bp, Mus musculus
gtgctccccatgtacgaaggcagga

SEQ ID NO: 706108 - DNA, 25 bp, Mus musculus
gtgctcccgccgacaagtgtaggca

SEQ ID NO: 706109 - DNA, 25 bp, Mus musculus
gtgctcccgccgtcaagtgtaggca

SEQ ID NO: 706110 - DNA, 25 bp, Mus musculus
gtgctccctacaaacactgtgtcct

SEQ ID NO: 706111 - DNA, 25 bp, Mus musculus
gtgctccctacatacactgtgtcct

SEQ ID NO: 706112 - DNA, 25 bp, Mus musculus
gtgctccctatgctaagcagcaagg

SEQ ID NO: 706113 - DNA, 25 bp, Mus musculus
gtgctccctatggtaagcagcaagg

SEQ ID NO: 706114 - DNA, 25 bp, Mus musculus
gtgctccctcccatacataaaggta

SEQ ID NO: 706115 - DNA, 25 bp, Mus musculus
gtgctccctcccttacataaaggta

SEQ ID NO: 706116 - DNA, 25 bp, Mus musculus
gtgctccgacacagtctctgaagag

SEQ ID NO: 706117 - DNA, 25 bp, Mus musculus
gtgctccgacactgtctctgaagag

SEQ ID NO: 706118 - DNA, 25 bp, Mus musculus
gtgctccgagcactgtttacaacta

SEQ ID NO: 706119 - DNA, 25 bp, Mus musculus
gtgctccgagcagtgtttacaacta

SEQ ID NO: 706120 - DNA, 25 bp, Mus musculus
gtgctccgagctctggatgacttca

SEQ ID NO: 706121 - DNA, 25 bp, Mus musculus
gtgctccgagctgtggatgacttca

SEQ ID NO: 706122 - DNA, 25 bp, Mus musculus
gtgctccgcattacagagtggcaga

SEQ ID NO: 706123 - DNA, 25 bp, Mus musculus
gtgctccgcatttcagagtggcaga

SEQ ID NO: 706124 - DNA, 25 bp, Mus musculus
gtgctccgcctacaagctatcatga

SEQ ID NO: 706125 - DNA, 25 bp, Mus musculus
gtgctccgcctagaagctatcatga

SEQ ID NO: 706126 - DNA, 25 bp, Mus musculus
gtgctccggaggaaaaccttgctaa

SEQ ID NO: 706127 - DNA, 25 bp, Mus musculus
gtgctccggaggtaaaccttgctaa

SEQ ID NO: 706128 - DNA, 25 bp, Mus musculus
gtgctcctacccacagatggcatat

SEQ ID NO: 706129 - DNA, 25 bp, Mus musculus
gtgctcctaccctcagatggcatat

SEQ ID NO: 706130 - DNA, 25 bp, Mus musculus
gtgctcctacctaccgaagtggtga

SEQ ID NO: 706131 - DNA, 25 bp, Mus musculus
gtgctcctaccttccgaagtggtga

SEQ ID NO: 706132 - DNA, 25 bp, Mus musculus
gtgctcctactgagacgtgcgcttt

SEQ ID NO: 706133 - DNA, 25 bp, Mus musculus
gtgctcctactgtgacgtgcgcttt

SEQ ID NO: 706134 - DNA, 25 bp, Mus musculus
gtgctcctatgtatgtattgaacta

SEQ ID NO: 706135 - DNA, 25 bp, Mus musculus
gtgctcctatgtttgtattgaacta

SEQ ID NO: 706136 - DNA, 25 bp, Mus musculus
gtgctcctcggtcgtggttcaaaca

SEQ ID NO: 706137 - DNA, 25 bp, Mus musculus
gtgctcctcggtggtggttcaaaca

SEQ ID NO: 706138 - DNA, 25 bp, Mus musculus
gtgctcctcttaaacccaaactcaa

SEQ ID NO: 706139 - DNA, 25 bp, Mus musculus
gtgctcctcttaatttttgtgtcag

SEQ ID NO: 706140 - DNA, 25 bp, Mus musculus
gtgctcctcttatacccaaactcaa

SEQ ID NO: 706141 - DNA, 25 bp, Mus musculus
gtgctcctcttattttttgtgtcag

SEQ ID NO: 706142 - DNA, 25 bp, Mus musculus
gtgctcctgaaaagagtccaatcca

SEQ ID NO: 706143 - DNA, 25 bp, Mus musculus
gtgctcctgaaatgagtccaatcca

SEQ ID NO: 706144 - DNA, 25 bp, Mus musculus
gtgctcctgaaccttcgtcaagtga

SEQ ID NO: 706145 - DNA, 25 bp, Mus musculus
gtgctcctgaacgttcgtcaagtga

SEQ ID NO: 706146 - DNA, 25 bp, Mus musculus
gtgctcctgcccaacttggagtagt

SEQ ID NO: 706147 - DNA, 25 bp, Mus musculus
gtgctcctgccctacttggagtagt

SEQ ID NO: 706148 - DNA, 25 bp, Mus musculus
gtgctcctgcttatataccaaatgc

SEQ ID NO: 706149 - DNA, 25 bp, Mus musculus
gtgctcctgcttttataccaaatgc

SEQ ID NO: 706150 - DNA, 25 bp, Mus musculus
gtgctcctggcgagcctgagcttgc

SEQ ID NO: 706151 - DNA, 25 bp, Mus musculus
gtgctcctggcgtgcctgagcttgc

SEQ ID NO: 706152 - DNA, 25 bp, Mus musculus
gtgctcctgggtcaaccatgactta

SEQ ID NO: 706153 - DNA, 25 bp, Mus musculus
gtgctcctgggtgaaccatgactta

SEQ ID NO: 706154 - DNA, 25 bp, Mus musculus
gtgctcctgtatattctgttgatct

SEQ ID NO: 706155 - DNA, 25 bp, Mus musculus
gtgctcctgtattttctgttgatct

SEQ ID NO: 706156 - DNA, 25 bp, Mus musculus
gtgctcctgtctccagagtgctgtc

SEQ ID NO: 706157 - DNA, 25 bp, Mus musculus
gtgctcctgtctgcagagtgctgtc

SEQ ID NO: 706158 - DNA, 25 bp, Mus musculus
gtgctcctgtggaagatgggcttct

SEQ ID NO: 706159 - DNA, 25 bp, Mus musculus
gtgctcctgtggtagatgggcttct

SEQ ID NO: 706160 - DNA, 25 bp, Mus musculus
gtgctcctgttcctcaccaaaatga

SEQ ID NO: 706161 - DNA, 25 bp, Mus musculus
gtgctcctgttcgtcaccaaaatga

SEQ ID NO: 706162 - DNA, 25 bp, Mus musculus
gtgctccttaaaaaattgttgtgtg

SEQ ID NO: 706163 - DNA, 25 bp, Mus musculus
gtgctccttaaataattgttgtgtg

SEQ ID NO: 706164 - DNA, 25 bp, Mus musculus
gtgctccttagtctcacagttcctt

SEQ ID NO: 706165 - DNA, 25 bp, Mus musculus
gtgctccttagtgtcacagttcctt

SEQ ID NO: 706166 - DNA, 25 bp, Mus musculus
gtgctccttatgctctgagtacata

SEQ ID NO: 706167 - DNA, 25 bp, Mus musculus
gtgctccttatggtctgagtacata

SEQ ID NO: 706168 - DNA, 25 bp, Mus musculus
gtgctccttcgaacggacagcaggg

SEQ ID NO: 706169 - DNA, 25 bp, Mus musculus
gtgctccttcgatcggacagcaggg

SEQ ID NO: 706170 - DNA, 25 bp, Mus musculus
gtgctccttgaccttcttttggagg

SEQ ID NO: 706171 - DNA, 25 bp, Mus musculus
gtgctccttgacgttcttttggagg

SEQ ID NO: 706172 - DNA, 25 bp, Mus musculus
gtgctccttggcacttgcatactca

SEQ ID NO: 706173 - DNA, 25 bp, Mus musculus
gtgctccttggctcttgcatactca

SEQ ID NO: 706174 - DNA, 25 bp, Mus musculus
gtgctcctttccctagtccaggaag

SEQ ID NO: 706175 - DNA, 25 bp, Mus musculus
gtgctcctttccgtagtccaggaag

SEQ ID NO: 706176 - DNA, 25 bp, Mus musculus
gtgctccttttaaacttgccatgga

SEQ ID NO: 706177 - DNA, 25 bp, Mus musculus
gtgctccttttatacttgccatgga

SEQ ID NO: 706178 - DNA, 25 bp, Mus musculus
gtgctcgaagaaagttcacctggaa

SEQ ID NO: 706179 - DNA, 25 bp, Mus musculus
gtgctcgaagaatgttcacctggaa

SEQ ID NO: 706180 - DNA, 25 bp, Mus musculus
gtgctcgagagtatcatgcttccaa

SEQ ID NO: 706181 - DNA, 25 bp, Mus musculus
gtgctcgagagtttcatgcttccaa

SEQ ID NO: 706182 - DNA, 25 bp, Mus musculus
gtgctcgagtctatgactatgacct

SEQ ID NO: 706183 - DNA, 25 bp, Mus musculus
gtgctcgagtctttgactatgacct

SEQ ID NO: 706184 - DNA, 25 bp, Mus musculus
gtgctcgattctatgcgatgcgcaa

SEQ ID NO: 706185 - DNA, 25 bp, Mus musculus
gtgctcgattctttgcgatgcgcaa

SEQ ID NO: 706186 - DNA, 25 bp, Mus musculus
gtgctcgccacaaggtcatgcaaaa

SEQ ID NO: 706187 - DNA, 25 bp, Mus musculus
gtgctcgccacatggtcatgcaaaa

SEQ ID NO: 706188 - DNA, 25 bp, Mus musculus
gtgctcgctgcaaagatccgtctgg

SEQ ID NO: 706189 - DNA, 25 bp, Mus musculus
gtgctcgctgcatagatccgtctgg

SEQ ID NO: 706190 - DNA, 25 bp, Mus musculus
gtgctcgctgggaacgctccaaaaa

SEQ ID NO: 706191 - DNA, 25 bp, Mus musculus
gtgctcgctgggtacgctccaaaaa

SEQ ID NO: 706192 - DNA, 25 bp, Mus musculus
gtgctcgctttactgaacgatgaat

SEQ ID NO: 706193 - DNA, 25 bp, Mus musculus
gtgctcgctttagtgaacgatgaat

SEQ ID NO: 706194 - DNA, 25 bp, Mus musculus
gtgctcggagcaaggagctcagccc

SEQ ID NO: 706195 - DNA, 25 bp, Mus musculus
gtgctcggagcatggagctcagccc

SEQ ID NO: 706196 - DNA, 25 bp, Mus musculus
gtgctcggccaacactaaggaaggg

SEQ ID NO: 706197 - DNA, 25 bp, Mus musculus
gtgctcggccaagactaaggaaggg

SEQ ID NO: 706198 - DNA, 25 bp, Mus musculus
gtgctcgggaagagttctttattca

SEQ ID NO: 706199 - DNA, 25 bp, Mus musculus
gtgctcgggaagtgttctttattca

SEQ ID NO: 706200 - DNA, 25 bp, Mus musculus
gtgctcgggctaatgacaggtctca

SEQ ID NO: 706201 - DNA, 25 bp, Mus musculus
gtgctcgggctattgacaggtctca

SEQ ID NO: 706202 - DNA, 25 bp, Mus musculus
gtgctcggtggtagccaagagtacc

SEQ ID NO: 706203 - DNA, 25 bp, Mus musculus
gtgctcggtggttgccaagagtacc

SEQ ID NO: 706204 - DNA, 25 bp, Mus musculus
gtgctcggtgtaacacaagcgttaa

SEQ ID NO: 706205 - DNA, 25 bp, Mus musculus
gtgctcggtgtatcacaagcgttaa

SEQ ID NO: 706206 - DNA, 25 bp, Mus musculus
gtgctcggtttcagtattcaactct

SEQ ID NO: 706207 - DNA, 25 bp, Mus musculus
gtgctcggtttctgtattcaactct

SEQ ID NO: 706208 - DNA, 25 bp, Mus musculus
gtgctcgtgcggcacggcaagccgt

SEQ ID NO: 706209 - DNA, 25 bp, Mus musculus
gtgctcgtgcgggacggcaagccgt

SEQ ID NO: 706210 - DNA, 25 bp, Mus musculus
gtgctcgtgggaaacttcttagtcg

SEQ ID NO: 706211 - DNA, 25 bp, Mus musculus
gtgctcgtgggactggtctgtgcct

SEQ ID NO: 706212 - DNA, 25 bp, Mus musculus
gtgctcgtgggagtggtctgtgcct

SEQ ID NO: 706213 - DNA, 25 bp, Mus musculus
gtgctcgtgggatacttcttagtcg

SEQ ID NO: 706214 - DNA, 25 bp, Mus musculus
gtgctcgtggtcactaattgtataa

SEQ ID NO: 706215 - DNA, 25 bp, Mus musculus
gtgctcgtggtctctaattgtataa

SEQ ID NO: 706216 - DNA, 25 bp, Mus musculus
gtgctctaaactctaatccatcttc

SEQ ID NO: 706217 - DNA, 25 bp, Mus musculus
gtgctctaaactgtaatccatcttc

SEQ ID NO: 706218 - DNA, 25 bp, Mus musculus
gtgctctaactgacctaaactgtca

SEQ ID NO: 706219 - DNA, 25 bp, Mus musculus
gtgctctaactgtcctaaactgtca

SEQ ID NO: 706220 - DNA, 25 bp, Mus musculus
gtgctctaaggcctatattcataca

SEQ ID NO: 706221 - DNA, 25 bp, Mus musculus
gtgctctaaggcgtatattcataca

SEQ ID NO: 706222 - DNA, 25 bp, Mus musculus
gtgctctacaaactattccagactg

SEQ ID NO: 706223 - DNA, 25 bp, Mus musculus
gtgctctacaaagtattccagactg

SEQ ID NO: 706224 - DNA, 25 bp, Mus musculus
gtgctctacagtctttgcttactct

SEQ ID NO: 706225 - DNA, 25 bp, Mus musculus
gtgctctacagtgtttgcttactct

SEQ ID NO: 706226 - DNA, 25 bp, Mus musculus
gtgctctacatccagaccaaggaag

SEQ ID NO: 706227 - DNA, 25 bp, Mus musculus
gtgctctacatcgagaccaaggaag

SEQ ID NO: 706228 - DNA, 25 bp, Mus musculus
gtgctctaccatagatcaacatcac

SEQ ID NO: 706229 - DNA, 25 bp, Mus musculus
gtgctctaccattgatcaacatcac

SEQ ID NO: 706230 - DNA, 25 bp, Mus musculus
gtgctctagagccagggttgtcaac

SEQ ID NO: 706231 - DNA, 25 bp, Mus musculus
gtgctctagagcgagggttgtcaac

SEQ ID NO: 706232 - DNA, 25 bp, Mus musculus
gtgctctagcacagaactatttcct

SEQ ID NO: 706233 - DNA, 25 bp, Mus musculus
gtgctctagcactgaactatttcct

SEQ ID NO: 706234 - DNA, 25 bp, Mus musculus
gtgctctagcagctcatagctcaga

SEQ ID NO: 706235 - DNA, 25 bp, Mus musculus
gtgctctagcaggtcatagctcaga

SEQ ID NO: 706236 - DNA, 25 bp, Mus musculus
gtgctctagggtacctcaggtgcag

SEQ ID NO: 706237 - DNA, 25 bp, Mus musculus
gtgctctagggttcctcaggtgcag

SEQ ID NO: 706238 - DNA, 25 bp, Mus musculus
gtgctctagtgccactttcaagtag

SEQ ID NO: 706239 - DNA, 25 bp, Mus musculus
gtgctctagtgcgactttcaagtag

SEQ ID NO: 706240 - DNA, 25 bp, Mus musculus
gtgctctataataatgtgcttgtac

SEQ ID NO: 706241 - DNA, 25 bp, Mus musculus
gtgctctataattatgtgcttgtac

SEQ ID NO: 706242 - DNA, 25 bp, Mus musculus
gtgctctatctgctgccttatatga

SEQ ID NO: 706243 - DNA, 25 bp, Mus musculus
gtgctctatctggtgccttatatga

SEQ ID NO: 706244 - DNA, 25 bp, Mus musculus
gtgctctatgacatgatctgctcaa

SEQ ID NO: 706245 - DNA, 25 bp, Mus musculus
gtgctctatgacttgatctgctcaa

SEQ ID NO: 706246 - DNA, 25 bp, Mus musculus
gtgctctatgtgagagaagaataaa

SEQ ID NO: 706247 - DNA, 25 bp, Mus musculus
gtgctctatgtgtgagaagaataaa

SEQ ID NO: 706248 - DNA, 25 bp, Mus musculus
gtgctctatttcctgtcccggagaa

SEQ ID NO: 706249 - DNA, 25 bp, Mus musculus
gtgctctatttcgtgtcccggagaa

SEQ ID NO: 706250 - DNA, 25 bp, Mus musculus
gtgctctattttcatgtatactgca

SEQ ID NO: 706251 - DNA, 25 bp, Mus musculus
gtgctctattttgatgtatactgca

SEQ ID NO: 706252 - DNA, 25 bp, Mus musculus
gtgctctcaagaatttcgtgtgaca

SEQ ID NO: 706253 - DNA, 25 bp, Mus musculus
gtgctctcaagattttcgtgtgaca

SEQ ID NO: 706254 - DNA, 25 bp, Mus musculus
gtgctctcagagagcagctgacgta

SEQ ID NO: 706255 - DNA, 25 bp, Mus musculus
gtgctctcagagtgcagctgacgta

SEQ ID NO: 706256 - DNA, 25 bp, Mus musculus
gtgctctcatctataggttctatga

SEQ ID NO: 706257 - DNA, 25 bp, Mus musculus
gtgctctcatctttaggttctatga

SEQ ID NO: 706258 - DNA, 25 bp, Mus musculus
gtgctctcattaactgccagcagct

SEQ ID NO: 706259 - DNA, 25 bp, Mus musculus
gtgctctcattatctgccagcagct

SEQ ID NO: 706260 - DNA, 25 bp, Mus musculus
gtgctctcccttctatttactttaa

SEQ ID NO: 706261 - DNA, 25 bp, Mus musculus
gtgctctcccttgtatttactttaa

SEQ ID NO: 706262 - DNA, 25 bp, Mus musculus
gtgctctcctgcaggtgacatgatg

SEQ ID NO: 706263 - DNA, 25 bp, Mus musculus
gtgctctcctgctggtgacatgatg

SEQ ID NO: 706264 - DNA, 25 bp, Mus musculus
gtgctctcctggaggatgtaaccgc

SEQ ID NO: 706265 - DNA, 25 bp, Mus musculus
gtgctctcctggtggatgtaaccgc

SEQ ID NO: 706266 - DNA, 25 bp, Mus musculus
gtgctctcctgtcacaaatgctgca

SEQ ID NO: 706267 - DNA, 25 bp, Mus musculus
gtgctctcctgtcagattatctgag

SEQ ID NO: 706268 - DNA, 25 bp, Mus musculus
gtgctctcctgtgacaaatgctgca

SEQ ID NO: 706269 - DNA, 25 bp, Mus musculus
gtgctctcctgtgagattatctgag

SEQ ID NO: 706270 - DNA, 25 bp, Mus musculus
gtgctctctaaacgtttggtgggaa

SEQ ID NO: 706271 - DNA, 25 bp, Mus musculus
gtgctctctaaaggtttggtgggaa

SEQ ID NO: 706272 - DNA, 25 bp, Mus musculus
gtgctctctaagctcatgcttcagg

SEQ ID NO: 706273 - DNA, 25 bp, Mus musculus
gtgctctctaaggtcatgcttcagg

SEQ ID NO: 706274 - DNA, 25 bp, Mus musculus
gtgctctctctaaagacttgcatcc

SEQ ID NO: 706275 - DNA, 25 bp, Mus musculus
gtgctctctctatagacttgcatcc

SEQ ID NO: 706276 - DNA, 25 bp, Mus musculus
gtgctctctgaacttaggtgatgaa

SEQ ID NO: 706277 - DNA, 25 bp, Mus musculus
gtgctctctgaagttaggtgatgaa

SEQ ID NO: 706278 - DNA, 25 bp, Mus musculus
gtgctctctggaacactgaagctat

SEQ ID NO: 706279 - DNA, 25 bp, Mus musculus
gtgctctctggatcactgaagctat

SEQ ID NO: 706280 - DNA, 25 bp, Mus musculus
gtgctctctgtccttttgtttttaa

SEQ ID NO: 706281 - DNA, 25 bp, Mus musculus
gtgctctctgtcgttttgtttttaa

SEQ ID NO: 706282 - DNA, 25 bp, Mus musculus
gtgctctcttcaatggctgttgaca

SEQ ID NO: 706283 - DNA, 25 bp, Mus musculus
gtgctctcttcattggctgttgaca

SEQ ID NO: 706284 - DNA, 25 bp, Mus musculus
gtgctctgaaatacttctatgcctt

SEQ ID NO: 706285 - DNA, 25 bp, Mus musculus
gtgctctgaaattcttctatgcctt

SEQ ID NO: 706286 - DNA, 25 bp, Mus musculus
gtgctctgaaggagagtccaagatc

SEQ ID NO: 706287 - DNA, 25 bp, Mus musculus
gtgctctgaaggtgagtccaagatc

SEQ ID NO: 706288 - DNA, 25 bp, Mus musculus
gtgctctgaatactgcttctggtat

SEQ ID NO: 706289 - DNA, 25 bp, Mus musculus
gtgctctgaatagtgcttctggtat

SEQ ID NO: 706290 - DNA, 25 bp, Mus musculus
gtgctctgacttcaagtgcgtgatt

SEQ ID NO: 706291 - DNA, 25 bp, Mus musculus
gtgctctgacttgaagtgcgtgatt

SEQ ID NO: 706292 - DNA, 25 bp, Mus musculus
gtgctctgagacaacagggtaacag

SEQ ID NO: 706293 - DNA, 25 bp, Mus musculus
gtgctctgagacagtcacctggatc

SEQ ID NO: 706294 - DNA, 25 bp, Mus musculus
gtgctctgagactacagggtaacag

SEQ ID NO: 706295 - DNA, 25 bp, Mus musculus
gtgctctgagactgtcacctggatc

SEQ ID NO: 706296 - DNA, 25 bp, Mus musculus
gtgctctgagcaatgtgtgtaagtt

SEQ ID NO: 706297 - DNA, 25 bp, Mus musculus
gtgctctgagcacagtctgggctta

SEQ ID NO: 706298 - DNA, 25 bp, Mus musculus
gtgctctgagcagagtctgggctta

SEQ ID NO: 706299 - DNA, 25 bp, Mus musculus
gtgctctgagcattgtgtgtaagtt

SEQ ID NO: 706300 - DNA, 25 bp, Mus musculus
gtgctctgaggcaccgaggctcctt

SEQ ID NO: 706301 - DNA, 25 bp, Mus musculus
gtgctctgaggctccgaggctcctt

SEQ ID NO: 706302 - DNA, 25 bp, Mus musculus
gtgctctgataaactctcggacctt

SEQ ID NO: 706303 - DNA, 25 bp, Mus musculus
gtgctctgataatctctcggacctt

SEQ ID NO: 706304 - DNA, 25 bp, Mus musculus
gtgctctgcaagaatccttgggttt

SEQ ID NO: 706305 - DNA, 25 bp, Mus musculus
gtgctctgcaagtatccttgggttt

SEQ ID NO: 706306 - DNA, 25 bp, Mus musculus
gtgctctgcaccagagggcaaaaga

SEQ ID NO: 706307 - DNA, 25 bp, Mus musculus
gtgctctgcacctgagggcaaaaga

SEQ ID NO: 706308 - DNA, 25 bp, Mus musculus
gtgctctgcaggaatgtttgctgaa

SEQ ID NO: 706309 - DNA, 25 bp, Mus musculus
gtgctctgcaggtatgtttgctgaa

SEQ ID NO: 706310 - DNA, 25 bp, Mus musculus
gtgctctgcagtctgttttccttct

SEQ ID NO: 706311 - DNA, 25 bp, Mus musculus
gtgctctgcagtgtgttttccttct

SEQ ID NO: 706312 - DNA, 25 bp, Mus musculus
gtgctctgccacagggggcctcatc

SEQ ID NO: 706313 - DNA, 25 bp, Mus musculus
gtgctctgccactgggggcctcatc

SEQ ID NO: 706314 - DNA, 25 bp, Mus musculus
gtgctctgcctaaggttgtcaaaaa

SEQ ID NO: 706315 - DNA, 25 bp, Mus musculus
gtgctctgcctatggttgtcaaaaa

SEQ ID NO: 706316 - DNA, 25 bp, Mus musculus
gtgctctgcctcaggagcgagaata

SEQ ID NO: 706317 - DNA, 25 bp, Mus musculus
gtgctctgcctcatcaagtcagtgg

SEQ ID NO: 706318 - DNA, 25 bp, Mus musculus
gtgctctgcctctggagcgagaata

SEQ ID NO: 706319 - DNA, 25 bp, Mus musculus
gtgctctgcctcttcaagtcagtgg

SEQ ID NO: 706320 - DNA, 25 bp, Mus musculus
gtgctctgctacctccaagtgtggc

SEQ ID NO: 706321 - DNA, 25 bp, Mus musculus
gtgctctgctacgtccaagtgtggc

SEQ ID NO: 706322 - DNA, 25 bp, Mus musculus
gtgctctggaaacgagttccatcct

SEQ ID NO: 706323 - DNA, 25 bp, Mus musculus
gtgctctggaaaggagttccatcct

SEQ ID NO: 706324 - DNA, 25 bp, Mus musculus
gtgctctggaagagaggcggagctt

SEQ ID NO: 706325 - DNA, 25 bp, Mus musculus
gtgctctggaagtgaggcggagctt

SEQ ID NO: 706326 - DNA, 25 bp, Mus musculus
gtgctctggacactgtacatttgta

SEQ ID NO: 706327 - DNA, 25 bp, Mus musculus
gtgctctggacagtgtacatttgta

SEQ ID NO: 706328 - DNA, 25 bp, Mus musculus
gtgctctgtaacagctgccgggtgc

SEQ ID NO: 706329 - DNA, 25 bp, Mus musculus
gtgctctgtaactgctgccgggtgc

SEQ ID NO: 706330 - DNA, 25 bp, Mus musculus
gtgctctgtacacctgtctttgttt

SEQ ID NO: 706331 - DNA, 25 bp, Mus musculus
gtgctctgtacagctgtctttgttt

SEQ ID NO: 706332 - DNA, 25 bp, Mus musculus
gtgctctgtctgaaacactccaaga

SEQ ID NO: 706333 - DNA, 25 bp, Mus musculus
gtgctctgtctgtaacactccaaga

SEQ ID NO: 706334 - DNA, 25 bp, Mus musculus
gtgctctgtgcacggatgctgtata

SEQ ID NO: 706335 - DNA, 25 bp, Mus musculus
gtgctctgtgcagggatgctgtata

SEQ ID NO: 706336 - DNA, 25 bp, Mus musculus
gtgctctgtggactgatgctaacaa

SEQ ID NO: 706337 - DNA, 25 bp, Mus musculus
gtgctctgtggagtgatgctaacaa

SEQ ID NO: 706338 - DNA, 25 bp, Mus musculus
gtgctctgttcaagccataaaggca

SEQ ID NO: 706339 - DNA, 25 bp, Mus musculus
gtgctctgttcatgccataaaggca

SEQ ID NO: 706340 - DNA, 25 bp, Mus musculus
gtgctctgttctcttgaagggacca

SEQ ID NO: 706341 - DNA, 25 bp, Mus musculus
gtgctctgttctgttgaagggacca

SEQ ID NO: 706342 - DNA, 25 bp, Mus musculus
gtgctcttaaccatagagcctctag

SEQ ID NO: 706343 - DNA, 25 bp, Mus musculus
gtgctcttaaccttagagcctctag

SEQ ID NO: 706344 - DNA, 25 bp, Mus musculus
gtgctcttaaggagggatgtgttca

SEQ ID NO: 706345 - DNA, 25 bp, Mus musculus
gtgctcttaaggtgggatgtgttca

SEQ ID NO: 706346 - DNA, 25 bp, Mus musculus
gtgctcttagtgactcttcttctcc

SEQ ID NO: 706347 - DNA, 25 bp, Mus musculus
gtgctcttagtgtctcttcttctcc

SEQ ID NO: 706348 - DNA, 25 bp, Mus musculus
gtgctcttagttaggacatcagttg

SEQ ID NO: 706349 - DNA, 25 bp, Mus musculus
gtgctcttagtttggacatcagttg

SEQ ID NO: 706350 - DNA, 25 bp, Mus musculus
gtgctcttatataaacaattcatct

SEQ ID NO: 706351 - DNA, 25 bp, Mus musculus
gtgctcttatattaacaattcatct

SEQ ID NO: 706352 - DNA, 25 bp, Mus musculus
gtgctcttcacactcgggttacagg

SEQ ID NO: 706353 - DNA, 25 bp, Mus musculus
gtgctcttcacagtcgggttacagg

SEQ ID NO: 706354 - DNA, 25 bp, Mus musculus
gtgctcttcagcatgatgatttcat

SEQ ID NO: 706355 - DNA, 25 bp, Mus musculus
gtgctcttcagcttgatgatttcat

SEQ ID NO: 706356 - DNA, 25 bp, Mus musculus
gtgctcttcagtagtcgagttggct

SEQ ID NO: 706357 - DNA, 25 bp, Mus musculus
gtgctcttcagttgtcgagttggct

SEQ ID NO: 706358 - DNA, 25 bp, Mus musculus
gtgctcttcctaagactagaactgg

SEQ ID NO: 706359 - DNA, 25 bp, Mus musculus
gtgctcttcctatgactagaactgg

SEQ ID NO: 706360 - DNA, 25 bp, Mus musculus
gtgctcttccttcctaagggtgtac

SEQ ID NO: 706361 - DNA, 25 bp, Mus musculus
gtgctcttccttgctaagggtgtac

SEQ ID NO: 706362 - DNA, 25 bp, Mus musculus
gtgctcttcttaatggatcaccaaa

SEQ ID NO: 706363 - DNA, 25 bp, Mus musculus
gtgctcttcttattggatcaccaaa

SEQ ID NO: 706364 - DNA, 25 bp, Mus musculus
gtgctcttgaatactagtgatctta

SEQ ID NO: 706365 - DNA, 25 bp, Mus musculus
gtgctcttgaattctagtgatctta

SEQ ID NO: 706366 - DNA, 25 bp, Mus musculus
gtgctcttgcaaaactattcagaac

SEQ ID NO: 706367 - DNA, 25 bp, Mus musculus
gtgctcttgcaatactattcagaac

SEQ ID NO: 706368 - DNA, 25 bp, Mus musculus
gtgctcttgcagatggtgctggata

SEQ ID NO: 706369 - DNA, 25 bp, Mus musculus
gtgctcttgcagttggtgctggata

SEQ ID NO: 706370 - DNA, 25 bp, Mus musculus
gtgctcttggcacggtttaaacctc

SEQ ID NO: 706371 - DNA, 25 bp, Mus musculus
gtgctcttggcagggtttaaacctc

SEQ ID NO: 706372 - DNA, 25 bp, Mus musculus
gtgctcttgggcatgctgaaactaa

SEQ ID NO: 706373 - DNA, 25 bp, Mus musculus
gtgctcttgggcttgctgaaactaa

SEQ ID NO: 706374 - DNA, 25 bp, Mus musculus
gtgctcttgtcaagatcttctttgt

SEQ ID NO: 706375 - DNA, 25 bp, Mus musculus
gtgctcttgtcatgatcttctttgt

SEQ ID NO: 706376 - DNA, 25 bp, Mus musculus
gtgctctttaatagcaaatgccact

SEQ ID NO: 706377 - DNA, 25 bp, Mus musculus
gtgctctttaattgcaaatgccact

SEQ ID NO: 706378 - DNA, 25 bp, Mus musculus
gtgctctttagccagtatctgtaaa

SEQ ID NO: 706379 - DNA, 25 bp, Mus musculus
gtgctctttagcgagtatctgtaaa

SEQ ID NO: 706380 - DNA, 25 bp, Mus musculus
gtgctctttagtcttatgctgcgga

SEQ ID NO: 706381 - DNA, 25 bp, Mus musculus
gtgctctttagtgttatgctgcgga

SEQ ID NO: 706382 - DNA, 25 bp, Mus musculus
gtgctctttataaaaccctggtgtc

SEQ ID NO: 706383 - DNA, 25 bp, Mus musculus
gtgctctttatacctcagtttcaat

SEQ ID NO: 706384 - DNA, 25 bp, Mus musculus
gtgctctttatagctcagtttcaat

SEQ ID NO: 706385 - DNA, 25 bp, Mus musculus
gtgctctttatataaccctggtgtc

SEQ ID NO: 706386 - DNA, 25 bp, Mus musculus
gtgctctttcttcgcctctgcttgc

SEQ ID NO: 706387 - DNA, 25 bp, Mus musculus
gtgctctttcttggcctctgcttgc

SEQ ID NO: 706388 - DNA, 25 bp, Mus musculus
gtgctctttgccatattcaatcttg

SEQ ID NO: 706389 - DNA, 25 bp, Mus musculus
gtgctctttgccttattcaatcttg

SEQ ID NO: 706390 - DNA, 25 bp, Mus musculus
gtgctctttgtgaagtgatactttc

SEQ ID NO: 706391 - DNA, 25 bp, Mus musculus
gtgctctttgtgattgggtggataa

SEQ ID NO: 706392 - DNA, 25 bp, Mus musculus
gtgctctttgtgtagtgatactttc

SEQ ID NO: 706393 - DNA, 25 bp, Mus musculus
gtgctctttgtgtttgggtggataa

SEQ ID NO: 706394 - DNA, 25 bp, Mus musculus
gtgctctttgttaattctgtggtaa

SEQ ID NO: 706395 - DNA, 25 bp, Mus musculus
gtgctctttgtttattctgtggtaa

SEQ ID NO: 706396 - DNA, 25 bp, Mus musculus
gtgctcttttcacccactgggagga

SEQ ID NO: 706397 - DNA, 25 bp, Mus musculus
gtgctcttttcagccactgggagga

SEQ ID NO: 706398 - DNA, 25 bp, Mus musculus
gtgctgaacaagctcctggttagtt

SEQ ID NO: 706399 - DNA, 25 bp, Mus musculus
gtgctgaacaaggtcctggttagtt

SEQ ID NO: 706400 - DNA, 25 bp, Mus musculus
gtgctgaacatgatgcagtcttcga

SEQ ID NO: 706401 - DNA, 25 bp, Mus musculus
gtgctgaacatgttgcagtcttcga

SEQ ID NO: 706402 - DNA, 25 bp, Mus musculus
gtgctgaacggacatgccgtcctgt

SEQ ID NO: 706403 - DNA, 25 bp, Mus musculus
gtgctgaacggagatgccgtcctgt

SEQ ID NO: 706404 - DNA, 25 bp, Mus musculus
gtgctgaactgacatgaacaaccga

SEQ ID NO: 706405 - DNA, 25 bp, Mus musculus
gtgctgaactgagatgaacaaccga

SEQ ID NO: 706406 - DNA, 25 bp, Mus musculus
gtgctgaagatccagagccttttcg

SEQ ID NO: 706407 - DNA, 25 bp, Mus musculus
gtgctgaagatcgagagccttttcg

SEQ ID NO: 706408 - DNA, 25 bp, Mus musculus
gtgctgaagcaacctgtaacacagt

SEQ ID NO: 706409 - DNA, 25 bp, Mus musculus
gtgctgaagcaagctgtaacacagt

SEQ ID NO: 706410 - DNA, 25 bp, Mus musculus
gtgctgaagccgctctatctctaca

SEQ ID NO: 706411 - DNA, 25 bp, Mus musculus
gtgctgaagccggtctatctctaca

SEQ ID NO: 706412 - DNA, 25 bp, Mus musculus
gtgctgaaggataactcggacatta

SEQ ID NO: 706413 - DNA, 25 bp, Mus musculus
gtgctgaaggattactcggacatta

SEQ ID NO: 706414 - DNA, 25 bp, Mus musculus
gtgctgaagtaaagtcctcactggt

SEQ ID NO: 706415 - DNA, 25 bp, Mus musculus
gtgctgaagtaatgtcctcactggt

SEQ ID NO: 706416 - DNA, 25 bp, Mus musculus
gtgctgaataggattcttctcagtt

SEQ ID NO: 706417 - DNA, 25 bp, Mus musculus
gtgctgaataggtttcttctcagtt

SEQ ID NO: 706418 - DNA, 25 bp, Mus musculus
gtgctgaatcctacccagggtaaag

SEQ ID NO: 706419 - DNA, 25 bp, Mus musculus
gtgctgaatccttcccagggtaaag

SEQ ID NO: 706420 - DNA, 25 bp, Mus musculus
gtgctgaatctgctgtggtctctac

SEQ ID NO: 706421 - DNA, 25 bp, Mus musculus
gtgctgaatctggtgtggtctctac

SEQ ID NO: 706422 - DNA, 25 bp, Mus musculus
gtgctgaatcttcgaggaggtttcg

SEQ ID NO: 706423 - DNA, 25 bp, Mus musculus
gtgctgaatcttggaggaggtttcg

SEQ ID NO: 706424 - DNA, 25 bp, Mus musculus
gtgctgaattacacgaccattccgg

SEQ ID NO: 706425 - DNA, 25 bp, Mus musculus
gtgctgaattactcgaccattccgg

SEQ ID NO: 706426 - DNA, 25 bp, Mus musculus
gtgctgaattttagctgcacatgct

SEQ ID NO: 706427 - DNA, 25 bp, Mus musculus
gtgctgaatttttgctgcacatgct

SEQ ID NO: 706428 - DNA, 25 bp, Mus musculus
gtgctgacacagagtaagatttcaa

SEQ ID NO: 706429 - DNA, 25 bp, Mus musculus
gtgctgacacagatccactaaagga

SEQ ID NO: 706430 - DNA, 25 bp, Mus musculus
gtgctgacacagtgtaagatttcaa

SEQ ID NO: 706431 - DNA, 25 bp, Mus musculus
gtgctgacacagttccactaaagga

SEQ ID NO: 706432 - DNA, 25 bp, Mus musculus
gtgctgacactgacattttacttgg

SEQ ID NO: 706433 - DNA, 25 bp, Mus musculus
gtgctgacactgtcattttacttgg

SEQ ID NO: 706434 - DNA, 25 bp, Mus musculus
gtgctgacagcgcacgccgaggcca

SEQ ID NO: 706435 - DNA, 25 bp, Mus musculus
gtgctgacagcggacgccgaggcca

SEQ ID NO: 706436 - DNA, 25 bp, Mus musculus
gtgctgacaggtcagggccactact

SEQ ID NO: 706437 - DNA, 25 bp, Mus musculus
gtgctgacaggtgagggccactact

SEQ ID NO: 706438 - DNA, 25 bp, Mus musculus
gtgctgacatcactggcttgtgctg

SEQ ID NO: 706439 - DNA, 25 bp, Mus musculus
gtgctgacatcagtggcttgtgctg

SEQ ID NO: 706440 - DNA, 25 bp, Mus musculus
gtgctgacatctcaggatctctgtt

SEQ ID NO: 706441 - DNA, 25 bp, Mus musculus
gtgctgacatctgaggatctctgtt

SEQ ID NO: 706442 - DNA, 25 bp, Mus musculus
gtgctgacatggctgctgagaacta

SEQ ID NO: 706443 - DNA, 25 bp, Mus musculus
gtgctgacatgggtgctgagaacta

SEQ ID NO: 706444 - DNA, 25 bp, Mus musculus
gtgctgaccactactgtactggagg

SEQ ID NO: 706445 - DNA, 25 bp, Mus musculus
gtgctgaccacttctgtactggagg

SEQ ID NO: 706446 - DNA, 25 bp, Mus musculus
gtgctgacccctaattctatttcaa

SEQ ID NO: 706447 - DNA, 25 bp, Mus musculus
gtgctgaccccttattctatttcaa

SEQ ID NO: 706448 - DNA, 25 bp, Mus musculus
gtgctgacccgcattgggctcgaga

SEQ ID NO: 706449 - DNA, 25 bp, Mus musculus
gtgctgacccgctttgggctcgaga

SEQ ID NO: 706450 - DNA, 25 bp, Mus musculus
gtgctgacccttaacatactttgct

SEQ ID NO: 706451 - DNA, 25 bp, Mus musculus
gtgctgaccctttacatactttgct

SEQ ID NO: 706452 - DNA, 25 bp, Mus musculus
gtgctgacctccagactggtttata

SEQ ID NO: 706453 - DNA, 25 bp, Mus musculus
gtgctgacctcctgactggtttata

SEQ ID NO: 706454 - DNA, 25 bp, Mus musculus
gtgctgacctgacggctgttctaca

SEQ ID NO: 706455 - DNA, 25 bp, Mus musculus
gtgctgacctgagggctgttctaca

SEQ ID NO: 706456 - DNA, 25 bp, Mus musculus
gtgctgacctgtagtatatacacaa

SEQ ID NO: 706457 - DNA, 25 bp, Mus musculus
gtgctgacctgttgtatatacacaa

SEQ ID NO: 706458 - DNA, 25 bp, Mus musculus
gtgctgactaacctctcattgcagt

SEQ ID NO: 706459 - DNA, 25 bp, Mus musculus
gtgctgactaacgtctcattgcagt

SEQ ID NO: 706460 - DNA, 25 bp, Mus musculus
gtgctgactataccgggaccaccat

SEQ ID NO: 706461 - DNA, 25 bp, Mus musculus
gtgctgactatagcgggaccaccat

SEQ ID NO: 706462 - DNA, 25 bp, Mus musculus
gtgctgactcacaagccaaggtctc

SEQ ID NO: 706463 - DNA, 25 bp, Mus musculus
gtgctgactcacacaaacagcccaa

SEQ ID NO: 706464 - DNA, 25 bp, Mus musculus
gtgctgactcactagccaaggtctc

SEQ ID NO: 706465 - DNA, 25 bp, Mus musculus
gtgctgactcactcaaacagcccaa

SEQ ID NO: 706466 - DNA, 25 bp, Mus musculus
gtgctgactccaaaggctaaagcag

SEQ ID NO: 706467 - DNA, 25 bp, Mus musculus
gtgctgactccataggctaaagcag

SEQ ID NO: 706468 - DNA, 25 bp, Mus musculus
gtgctgactcctagcttgtttgaaa

SEQ ID NO: 706469 - DNA, 25 bp, Mus musculus
gtgctgactccttgcttgtttgaaa

SEQ ID NO: 706470 - DNA, 25 bp, Mus musculus
gtgctgactcgaaatgctattttgt

SEQ ID NO: 706471 - DNA, 25 bp, Mus musculus
gtgctgactcgatatgctattttgt

SEQ ID NO: 706472 - DNA, 25 bp, Mus musculus
gtgctgactctgcactactgatgga

SEQ ID NO: 706473 - DNA, 25 bp, Mus musculus
gtgctgactctggactactgatgga

SEQ ID NO: 706474 - DNA, 25 bp, Mus musculus
gtgctgactgctctacttccggaac

SEQ ID NO: 706475 - DNA, 25 bp, Mus musculus
gtgctgactgctgtacttccggaac

SEQ ID NO: 706476 - DNA, 25 bp, Mus musculus
gtgctgacttataacagatgcctga

SEQ ID NO: 706477 - DNA, 25 bp, Mus musculus
gtgctgacttattacagatgcctga

SEQ ID NO: 706478 - DNA, 25 bp, Mus musculus
gtgctgactttccagagtgttaccc

SEQ ID NO: 706479 - DNA, 25 bp, Mus musculus
gtgctgactttccattggagacttg

SEQ ID NO: 706480 - DNA, 25 bp, Mus musculus
gtgctgactttcgagagtgttaccc

SEQ ID NO: 706481 - DNA, 25 bp, Mus musculus
gtgctgactttcgattggagacttg

SEQ ID NO: 706482 - DNA, 25 bp, Mus musculus
gtgctgagaaccagtccgtgggctc

SEQ ID NO: 706483 - DNA, 25 bp, Mus musculus
gtgctgagaacctgtccgtgggctc

SEQ ID NO: 706484 - DNA, 25 bp, Mus musculus
gtgctgagaatcaaatcccagtcct

SEQ ID NO: 706485 - DNA, 25 bp, Mus musculus
gtgctgagaatctaatcccagtcct

SEQ ID NO: 706486 - DNA, 25 bp, Mus musculus
gtgctgagacctcttaactcttcaa

SEQ ID NO: 706487 - DNA, 25 bp, Mus musculus
gtgctgagacctgttaactcttcaa

SEQ ID NO: 706488 - DNA, 25 bp, Mus musculus
gtgctgagagccagacagtggatct

SEQ ID NO: 706489 - DNA, 25 bp, Mus musculus
gtgctgagagcctgacagtggatct

SEQ ID NO: 706490 - DNA, 25 bp, Mus musculus
gtgctgagagctcttaccttgccca

SEQ ID NO: 706491 - DNA, 25 bp, Mus musculus
gtgctgagagctgttaccttgccca

SEQ ID NO: 706492 - DNA, 25 bp, Mus musculus
gtgctgagcatccagacatggcaga

SEQ ID NO: 706493 - DNA, 25 bp, Mus musculus
gtgctgagcatcgagacatggcaga

SEQ ID NO: 706494 - DNA, 25 bp, Mus musculus
gtgctgagcatgaaaagtggtacta

SEQ ID NO: 706495 - DNA, 25 bp, Mus musculus
gtgctgagcatgtaaagtggtacta

SEQ ID NO: 706496 - DNA, 25 bp, Mus musculus
gtgctgagccagatcctctcaggtg

SEQ ID NO: 706497 - DNA, 25 bp, Mus musculus
gtgctgagccagttcctctcaggtg

SEQ ID NO: 706498 - DNA, 25 bp, Mus musculus
gtgctgagcccgagtgtttactaga

SEQ ID NO: 706499 - DNA, 25 bp, Mus musculus
gtgctgagcccgcaaagcccgacat

SEQ ID NO: 706500 - DNA, 25 bp, Mus musculus
gtgctgagcccggaaagcccgacat

SEQ ID NO: 706501 - DNA, 25 bp, Mus musculus
gtgctgagcccgtgtgtttactaga

SEQ ID NO: 706502 - DNA, 25 bp, Mus musculus
gtgctgagcgatagcgttacggtct

SEQ ID NO: 706503 - DNA, 25 bp, Mus musculus
gtgctgagcgattgcgttacggtct

SEQ ID NO: 706504 - DNA, 25 bp, Mus musculus
gtgctgaggatgcagctcctctcag

SEQ ID NO: 706505 - DNA, 25 bp, Mus musculus
gtgctgaggatggagctcctctcag

SEQ ID NO: 706506 - DNA, 25 bp, Mus musculus
gtgctgagggaaatctgctgccttc

SEQ ID NO: 706507 - DNA, 25 bp, Mus musculus
gtgctgagggaattctgctgccttc

SEQ ID NO: 706508 - DNA, 25 bp, Mus musculus
gtgctgagtacgaatgcctgctgaa

SEQ ID NO: 706509 - DNA, 25 bp, Mus musculus
gtgctgagtacgtatgcctgctgaa

SEQ ID NO: 706510 - DNA, 25 bp, Mus musculus
gtgctgagtcacagagtcaccatgg

SEQ ID NO: 706511 - DNA, 25 bp, Mus musculus
gtgctgagtcactgagtcaccatgg

SEQ ID NO: 706512 - DNA, 25 bp, Mus musculus
gtgctgagtcatctaaggcctaatt

SEQ ID NO: 706513 - DNA, 25 bp, Mus musculus
gtgctgagtcatgtaaggcctaatt

SEQ ID NO: 706514 - DNA, 25 bp, Mus musculus
gtgctgagtctgagattgcaactta

SEQ ID NO: 706515 - DNA, 25 bp, Mus musculus
gtgctgagtctgatagctgctttaa

SEQ ID NO: 706516 - DNA, 25 bp, Mus musculus
gtgctgagtctgtgattgcaactta

SEQ ID NO: 706517 - DNA, 25 bp, Mus musculus
gtgctgagtctgttagctgctttaa

SEQ ID NO: 706518 - DNA, 25 bp, Mus musculus
gtgctgagtggtcttattctctact

SEQ ID NO: 706519 - DNA, 25 bp, Mus musculus
gtgctgagtggtgttattctctact

SEQ ID NO: 706520 - DNA, 25 bp, Mus musculus
gtgctgagtttacagtaccctcact

SEQ ID NO: 706521 - DNA, 25 bp, Mus musculus
gtgctgagtttagagtaccctcact

SEQ ID NO: 706522 - DNA, 25 bp, Mus musculus
gtgctgataagaagtctgccaccaa

SEQ ID NO: 706523 - DNA, 25 bp, Mus musculus
gtgctgataagatgtctgccaccaa

SEQ ID NO: 706524 - DNA, 25 bp, Mus musculus
gtgctgatacatccctatttgaact

SEQ ID NO: 706525 - DNA, 25 bp, Mus musculus
gtgctgatacatgcctatttgaact

SEQ ID NO: 706526 - DNA, 25 bp, Mus musculus
gtgctgatagctcacgatgtgccat

SEQ ID NO: 706527 - DNA, 25 bp, Mus musculus
gtgctgatagctgacgatgtgccat

SEQ ID NO: 706528 - DNA, 25 bp, Mus musculus
gtgctgatagttctggattgtttcc

SEQ ID NO: 706529 - DNA, 25 bp, Mus musculus
gtgctgatagttgtggattgtttcc

SEQ ID NO: 706530 - DNA, 25 bp, Mus musculus
gtgctgatcattccacatctgcttg

SEQ ID NO: 706531 - DNA, 25 bp, Mus musculus
gtgctgatcattgcacatctgcttg

SEQ ID NO: 706532 - DNA, 25 bp, Mus musculus
gtgctgatgcagcttctctggagtt

SEQ ID NO: 706533 - DNA, 25 bp, Mus musculus
gtgctgatgcaggttctctggagtt

SEQ ID NO: 706534 - DNA, 25 bp, Mus musculus
gtgctgatggccctttccacatacc

SEQ ID NO: 706535 - DNA, 25 bp, Mus musculus
gtgctgatggccgtttccacatacc

SEQ ID NO: 706536 - DNA, 25 bp, Mus musculus
gtgctgatgtcaaaccagtcttcga

SEQ ID NO: 706537 - DNA, 25 bp, Mus musculus
gtgctgatgtcataccagtcttcga

SEQ ID NO: 706538 - DNA, 25 bp, Mus musculus
gtgctgatgtccatgcgctttgatg

SEQ ID NO: 706539 - DNA, 25 bp, Mus musculus
gtgctgatgtccttgcgctttgatg

SEQ ID NO: 706540 - DNA, 25 bp, Mus musculus
gtgctgatgttcaatcattttctgt

SEQ ID NO: 706541 - DNA, 25 bp, Mus musculus
gtgctgatgttctatcattttctgt

SEQ ID NO: 706542 - DNA, 25 bp, Mus musculus
gtgctgatgtttcagacgcctgtga

SEQ ID NO: 706543 - DNA, 25 bp, Mus musculus
gtgctgatgtttgagacgcctgtga

SEQ ID NO: 706544 - DNA, 25 bp, Mus musculus
gtgctgattaatatagcctccctct

SEQ ID NO: 706545 - DNA, 25 bp, Mus musculus
gtgctgattaatttagcctccctct

SEQ ID NO: 706546 - DNA, 25 bp, Mus musculus
gtgctgattagacaggtccccagag

SEQ ID NO: 706547 - DNA, 25 bp, Mus musculus
gtgctgattagagaggtccccagag

SEQ ID NO: 706548 - DNA, 25 bp, Mus musculus
gtgctgattgaaatttacgcccctt

SEQ ID NO: 706549 - DNA, 25 bp, Mus musculus
gtgctgattgaattttacgcccctt

SEQ ID NO: 706550 - DNA, 25 bp, Mus musculus
gtgctgattgagaactttccattct

SEQ ID NO: 706551 - DNA, 25 bp, Mus musculus
gtgctgattgagtactttccattct

SEQ ID NO: 706552 - DNA, 25 bp, Mus musculus
gtgctgattggaagcagtcctttct

SEQ ID NO: 706553 - DNA, 25 bp, Mus musculus
gtgctgattggatgcagtcctttct

SEQ ID NO: 706554 - DNA, 25 bp, Mus musculus
gtgctgatttagctcatctcacttt

SEQ ID NO: 706555 - DNA, 25 bp, Mus musculus
gtgctgatttaggtcatctcacttt

SEQ ID NO: 706556 - DNA, 25 bp, Mus musculus
gtgctgatttcaccgccatcatgca

SEQ ID NO: 706557 - DNA, 25 bp, Mus musculus
gtgctgatttcagcgccatcatgca

SEQ ID NO: 706558 - DNA, 25 bp, Mus musculus
gtgctgcaaagcaactgcccattgg

SEQ ID NO: 706559 - DNA, 25 bp, Mus musculus
gtgctgcaaagctactgcccattgg

SEQ ID NO: 706560 - DNA, 25 bp, Mus musculus
gtgctgcaaattacaccaatgggag

SEQ ID NO: 706561 - DNA, 25 bp, Mus musculus
gtgctgcaaatttcaccaatgggag

SEQ ID NO: 706562 - DNA, 25 bp, Mus musculus
gtgctgcacaaacaagacgagaacc

SEQ ID NO: 706563 - DNA, 25 bp, Mus musculus
gtgctgcacaaagaagacgagaacc

SEQ ID NO: 706564 - DNA, 25 bp, Mus musculus
gtgctgcacattctgtggcttacat

SEQ ID NO: 706565 - DNA, 25 bp, Mus musculus
gtgctgcacattgtgtggcttacat

SEQ ID NO: 706566 - DNA, 25 bp, Mus musculus
gtgctgcaccagagtgttgagcttt

SEQ ID NO: 706567 - DNA, 25 bp, Mus musculus
gtgctgcaccagtgtgttgagcttt

SEQ ID NO: 706568 - DNA, 25 bp, Mus musculus
gtgctgcaccgtcgctaccccgagt

SEQ ID NO: 706569 - DNA, 25 bp, Mus musculus
gtgctgcaccgtggctaccccgagt

SEQ ID NO: 706570 - DNA, 25 bp, Mus musculus
gtgctgcacgagcagcgcttcctca

SEQ ID NO: 706571 - DNA, 25 bp, Mus musculus
gtgctgcacgaggagcgcttcctca

SEQ ID NO: 706572 - DNA, 25 bp, Mus musculus
gtgctgcactgcaaggtcgcaaggt

SEQ ID NO: 706573 - DNA, 25 bp, Mus musculus
gtgctgcactgctaggtcgcaaggt

SEQ ID NO: 706574 - DNA, 25 bp, Mus musculus
gtgctgcagcacaggaagcccacgc

SEQ ID NO: 706575 - DNA, 25 bp, Mus musculus
gtgctgcagcactggaagcccacgc

SEQ ID NO: 706576 - DNA, 25 bp, Mus musculus
gtgctgcagccaacagagtgggtct

SEQ ID NO: 706577 - DNA, 25 bp, Mus musculus
gtgctgcagccaattactacagttc

SEQ ID NO: 706578 - DNA, 25 bp, Mus musculus
gtgctgcagccatcagagtgggtct

SEQ ID NO: 706579 - DNA, 25 bp, Mus musculus
gtgctgcagccatttactacagttc

SEQ ID NO: 706580 - DNA, 25 bp, Mus musculus
gtgctgcagctcacgccagaggtgc

SEQ ID NO: 706581 - DNA, 25 bp, Mus musculus
gtgctgcagctcatgctacgcaggg

SEQ ID NO: 706582 - DNA, 25 bp, Mus musculus
gtgctgcagctccagttcacgatca

SEQ ID NO: 706583 - DNA, 25 bp, Mus musculus
gtgctgcagctcgagttcacgatca

SEQ ID NO: 706584 - DNA, 25 bp, Mus musculus
gtgctgcagctctcgccagaggtgc

SEQ ID NO: 706585 - DNA, 25 bp, Mus musculus
gtgctgcagctcttgctacgcaggg

SEQ ID NO: 706586 - DNA, 25 bp, Mus musculus
gtgctgcaggcactactccagttac

SEQ ID NO: 706587 - DNA, 25 bp, Mus musculus
gtgctgcaggcagtactccagttac

SEQ ID NO: 706588 - DNA, 25 bp, Mus musculus
gtgctgcaggctatgtaaccactgg

SEQ ID NO: 706589 - DNA, 25 bp, Mus musculus
gtgctgcaggctttgtaaccactgg

SEQ ID NO: 706590 - DNA, 25 bp, Mus musculus
gtgctgcagggcatcttgtggatat

SEQ ID NO: 706591 - DNA, 25 bp, Mus musculus
gtgctgcagggcttcttgtggatat

SEQ ID NO: 706592 - DNA, 25 bp, Mus musculus
gtgctgcataataaaaatacctgtt

SEQ ID NO: 706593 - DNA, 25 bp, Mus musculus
gtgctgcataattaaaatacctgtt

SEQ ID NO: 706594 - DNA, 25 bp, Mus musculus
gtgctgcatacgcttattgacatcc

SEQ ID NO: 706595 - DNA, 25 bp, Mus musculus
gtgctgcatacggttattgacatcc

SEQ ID NO: 706596 - DNA, 25 bp, Mus musculus
gtgctgcatatcagggatcccaaat

SEQ ID NO: 706597 - DNA, 25 bp, Mus musculus
gtgctgcatatctgggatcccaaat

SEQ ID NO: 706598 - DNA, 25 bp, Mus musculus
gtgctgcatgctacttgtgttaatg

SEQ ID NO: 706599 - DNA, 25 bp, Mus musculus
gtgctgcatgcttcttgtgttaatg

SEQ ID NO: 706600 - DNA, 25 bp, Mus musculus
gtgctgcatgggaatatccattatt

SEQ ID NO: 706601 - DNA, 25 bp, Mus musculus
gtgctgcatgggtatatccattatt

SEQ ID NO: 706602 - DNA, 25 bp, Mus musculus
gtgctgcattataattccaccagtg

SEQ ID NO: 706603 - DNA, 25 bp, Mus musculus
gtgctgcattattattccaccagtg

SEQ ID NO: 706604 - DNA, 25 bp, Mus musculus
gtgctgcattcgctagggagctttc

SEQ ID NO: 706605 - DNA, 25 bp, Mus musculus
gtgctgcattcggtagggagctttc

SEQ ID NO: 706606 - DNA, 25 bp, Mus musculus
gtgctgccaaagaccttctgggtca

SEQ ID NO: 706607 - DNA, 25 bp, Mus musculus
gtgctgccaaagtccttctgggtca

SEQ ID NO: 706608 - DNA, 25 bp, Mus musculus
gtgctgccacagcactacaacataa

SEQ ID NO: 706609 - DNA, 25 bp, Mus musculus
gtgctgccacaggactacaacataa

SEQ ID NO: 706610 - DNA, 25 bp, Mus musculus
gtgctgccacttctagttcaacaag

SEQ ID NO: 706611 - DNA, 25 bp, Mus musculus
gtgctgccacttgtagttcaacaag

SEQ ID NO: 706612 - DNA, 25 bp, Mus musculus
gtgctgccagccagcctgctctgga

SEQ ID NO: 706613 - DNA, 25 bp, Mus musculus
gtgctgccagcccattcgaagcaag

SEQ ID NO: 706614 - DNA, 25 bp, Mus musculus
gtgctgccagccgattcgaagcaag

SEQ ID NO: 706615 - DNA, 25 bp, Mus musculus
gtgctgccagcctgcctgctctgga

SEQ ID NO: 706616 - DNA, 25 bp, Mus musculus
gtgctgccagctattagtaagatgt

SEQ ID NO: 706617 - DNA, 25 bp, Mus musculus
gtgctgccagcttttagtaagatgt

SEQ ID NO: 706618 - DNA, 25 bp, Mus musculus
gtgctgccagtgataagttctagac

SEQ ID NO: 706619 - DNA, 25 bp, Mus musculus
gtgctgccagtgttaagttctagac

SEQ ID NO: 706620 - DNA, 25 bp, Mus musculus
gtgctgccattgataaaatgccaat

SEQ ID NO: 706621 - DNA, 25 bp, Mus musculus
gtgctgccattgttaaaatgccaat

SEQ ID NO: 706622 - DNA, 25 bp, Mus musculus
gtgctgcccaaactgtgatgtctgt

SEQ ID NO: 706623 - DNA, 25 bp, Mus musculus
gtgctgcccaaagtgtgatgtctgt

SEQ ID NO: 706624 - DNA, 25 bp, Mus musculus
gtgctgcccactacatgaacattga

SEQ ID NO: 706625 - DNA, 25 bp, Mus musculus
gtgctgcccacttcatgaacattga

SEQ ID NO: 706626 - DNA, 25 bp, Mus musculus
gtgctgcccataaaaaagcctgtct

SEQ ID NO: 706627 - DNA, 25 bp, Mus musculus
gtgctgcccatataaaagcctgtct

SEQ ID NO: 706628 - DNA, 25 bp, Mus musculus
gtgctgcccattatggagacacgca

SEQ ID NO: 706629 - DNA, 25 bp, Mus musculus
gtgctgcccattttggagacacgca

SEQ ID NO: 706630 - DNA, 25 bp, Mus musculus
gtgctgcccgagcttcaaggagtaa

SEQ ID NO: 706631 - DNA, 25 bp, Mus musculus
gtgctgcccgaggttcaaggagtaa

SEQ ID NO: 706632 - DNA, 25 bp, Mus musculus
gtgctgccgctaacagggatcgttt

SEQ ID NO: 706633 - DNA, 25 bp, Mus musculus
gtgctgccgctatcagggatcgttt

SEQ ID NO: 706634 - DNA, 25 bp, Mus musculus
gtgctgccgtccctgctcaacaagt

SEQ ID NO: 706635 - DNA, 25 bp, Mus musculus
gtgctgccgtccgtgctcaacaagt

SEQ ID NO: 706636 - DNA, 25 bp, Mus musculus
gtgctgcctgacagtagtcctgctg

SEQ ID NO: 706637 - DNA, 25 bp, Mus musculus
gtgctgcctgactgtagtcctgctg

SEQ ID NO: 706638 - DNA, 25 bp, Mus musculus
gtgctgcctggcacagaattaacca

SEQ ID NO: 706639 - DNA, 25 bp, Mus musculus
gtgctgcctggctcagaattaacca

SEQ ID NO: 706640 - DNA, 25 bp, Mus musculus
gtgctgcctgggacagcctacagaa

SEQ ID NO: 706641 - DNA, 25 bp, Mus musculus
gtgctgcctgggtcagcctacagaa

SEQ ID NO: 706642 - DNA, 25 bp, Mus musculus
gtgctgcctttgaagctgttgttgt

SEQ ID NO: 706643 - DNA, 25 bp, Mus musculus
gtgctgcctttgtagctgttgttgt

SEQ ID NO: 706644 - DNA, 25 bp, Mus musculus
gtgctgcgagtcactaagaacctta

SEQ ID NO: 706645 - DNA, 25 bp, Mus musculus
gtgctgcgagtctctaagaacctta

SEQ ID NO: 706646 - DNA, 25 bp, Mus musculus
gtgctgcgcaagctttctgacatga

SEQ ID NO: 706647 - DNA, 25 bp, Mus musculus
gtgctgcgcaaggtttctgacatga

SEQ ID NO: 706648 - DNA, 25 bp, Mus musculus
gtgctgcggatcattatagccttta

SEQ ID NO: 706649 - DNA, 25 bp, Mus musculus
gtgctgcggatctttatagccttta

SEQ ID NO: 706650 - DNA, 25 bp, Mus musculus
gtgctgcggctgagtcaatgttgaa

SEQ ID NO: 706651 - DNA, 25 bp, Mus musculus
gtgctgcggctgtgtcaatgttgaa

SEQ ID NO: 706652 - DNA, 25 bp, Mus musculus
gtgctgcgtattcgccttgtgcttc

SEQ ID NO: 706653 - DNA, 25 bp, Mus musculus
gtgctgcgtattggccttgtgcttc

SEQ ID NO: 706654 - DNA, 25 bp, Mus musculus
gtgctgcgtcctaatgaatgttttg

SEQ ID NO: 706655 - DNA, 25 bp, Mus musculus
gtgctgcgtccttatgaatgttttg

SEQ ID NO: 706656 - DNA, 25 bp, Mus musculus
gtgctgcgtctcaaaactcatctta

SEQ ID NO: 706657 - DNA, 25 bp, Mus musculus
gtgctgcgtctctaaactcatctta

SEQ ID NO: 706658 - DNA, 25 bp, Mus musculus
gtgctgcgtttaaacttccgaggct

SEQ ID NO: 706659 - DNA, 25 bp, Mus musculus
gtgctgcgtttatacttccgaggct

SEQ ID NO: 706660 - DNA, 25 bp, Mus musculus
gtgctgctagagaagctaagatttt

SEQ ID NO: 706661 - DNA, 25 bp, Mus musculus
gtgctgctagagtagctaagatttt

SEQ ID NO: 706662 - DNA, 25 bp, Mus musculus
gtgctgctccagaactatggcatga

SEQ ID NO: 706663 - DNA, 25 bp, Mus musculus
gtgctgctccagactgaaatcctga

SEQ ID NO: 706664 - DNA, 25 bp, Mus musculus
gtgctgctccagtactatggcatga

SEQ ID NO: 706665 - DNA, 25 bp, Mus musculus
gtgctgctccagtctgaaatcctga

SEQ ID NO: 706666 - DNA, 25 bp, Mus musculus
gtgctgctctgaattcctaaagaat

SEQ ID NO: 706667 - DNA, 25 bp, Mus musculus
gtgctgctctgatttcctaaagaat

SEQ ID NO: 706668 - DNA, 25 bp, Mus musculus
gtgctgctctggaaaagactctaat

SEQ ID NO: 706669 - DNA, 25 bp, Mus musculus
gtgctgctctggtaaagactctaat

SEQ ID NO: 706670 - DNA, 25 bp, Mus musculus
gtgctgctcttgcagaccgactaca

SEQ ID NO: 706671 - DNA, 25 bp, Mus musculus
gtgctgctcttggagaccgactaca

SEQ ID NO: 706672 - DNA, 25 bp, Mus musculus
gtgctgctctttagtaacagtccaa

SEQ ID NO: 706673 - DNA, 25 bp, Mus musculus
gtgctgctcttttgtaacagtccaa

SEQ ID NO: 706674 - DNA, 25 bp, Mus musculus
gtgctgctgcaaaatcctcagagaa

SEQ ID NO: 706675 - DNA, 25 bp, Mus musculus
gtgctgctgcaatatcctcagagaa

SEQ ID NO: 706676 - DNA, 25 bp, Mus musculus
gtgctgctgcctacttttgacacag

SEQ ID NO: 706677 - DNA, 25 bp, Mus musculus
gtgctgctgccttcttttgacacag

SEQ ID NO: 706678 - DNA, 25 bp, Mus musculus
gtgctgctgcgtagagctctctcct

SEQ ID NO: 706679 - DNA, 25 bp, Mus musculus
gtgctgctgcgttgagctctctcct

SEQ ID NO: 706680 - DNA, 25 bp, Mus musculus
gtgctgctggacctctacctggaga

SEQ ID NO: 706681 - DNA, 25 bp, Mus musculus
gtgctgctggacgtctacctggaga

SEQ ID NO: 706682 - DNA, 25 bp, Mus musculus
gtgctgctggccaaaccgagggatt

SEQ ID NO: 706683 - DNA, 25 bp, Mus musculus
gtgctgctggcctaaccgagggatt

SEQ ID NO: 706684 - DNA, 25 bp, Mus musculus
gtgctgctggctctgtaacattctg

SEQ ID NO: 706685 - DNA, 25 bp, Mus musculus
gtgctgctggctgtgtaacattctg

SEQ ID NO: 706686 - DNA, 25 bp, Mus musculus
gtgctgctggtcatgacagtacact

SEQ ID NO: 706687 - DNA, 25 bp, Mus musculus
gtgctgctggtcttgacagtacact

SEQ ID NO: 706688 - DNA, 25 bp, Mus musculus
gtgctgctgtaccatagtgtagact

SEQ ID NO: 706689 - DNA, 25 bp, Mus musculus
gtgctgctgtacgatagtgtagact

SEQ ID NO: 706690 - DNA, 25 bp, Mus musculus
gtgctgctgtcaacaaggctcggaa

SEQ ID NO: 706691 - DNA, 25 bp, Mus musculus
gtgctgctgtcatcaaggctcggaa

SEQ ID NO: 706692 - DNA, 25 bp, Mus musculus
gtgctgctgttactgcaactgctgt

SEQ ID NO: 706693 - DNA, 25 bp, Mus musculus
gtgctgctgttagtgcaactgctgt

SEQ ID NO: 706694 - DNA, 25 bp, Mus musculus
gtgctgcttacaagattaggctttg

SEQ ID NO: 706695 - DNA, 25 bp, Mus musculus
gtgctgcttacatgattaggctttg

SEQ ID NO: 706696 - DNA, 25 bp, Mus musculus
gtgctgcttcagctgtaacgaatga

SEQ ID NO: 706697 - DNA, 25 bp, Mus musculus
gtgctgcttcaggtgtaacgaatga

SEQ ID NO: 706698 - DNA, 25 bp, Mus musculus
gtgctgcttccacagggatgtttat

SEQ ID NO: 706699 - DNA, 25 bp, Mus musculus
gtgctgcttccagagggatgtttat

SEQ ID NO: 706700 - DNA, 25 bp, Mus musculus
gtgctgcttctccttaggttgtaga

SEQ ID NO: 706701 - DNA, 25 bp, Mus musculus
gtgctgcttctcgttaggttgtaga

SEQ ID NO: 706702 - DNA, 25 bp, Mus musculus
gtgctgctttccacctgactaagga

SEQ ID NO: 706703 - DNA, 25 bp, Mus musculus
gtgctgctttcctcctgactaagga

SEQ ID NO: 706704 - DNA, 25 bp, Mus musculus
gtgctgctttctcgagcataaatta

SEQ ID NO: 706705 - DNA, 25 bp, Mus musculus
gtgctgctttctggagcataaatta

SEQ ID NO: 706706 - DNA, 25 bp, Mus musculus
gtgctgcttttactgatctcatcca

SEQ ID NO: 706707 - DNA, 25 bp, Mus musculus
gtgctgcttttagtgatctcatcca

SEQ ID NO: 706708 - DNA, 25 bp, Mus musculus
gtgctggaaaacacggaccttttgg

SEQ ID NO: 706709 - DNA, 25 bp, Mus musculus
gtgctggaaaactcggaccttttgg

SEQ ID NO: 706710 - DNA, 25 bp, Mus musculus
gtgctggaaataaagtattagctgg

SEQ ID NO: 706711 - DNA, 25 bp, Mus musculus
gtgctggaaatatagtattagctgg

SEQ ID NO: 706712 - DNA, 25 bp, Mus musculus
gtgctggaacacacatgatgctgtg

SEQ ID NO: 706713 - DNA, 25 bp, Mus musculus
gtgctggaacactcatgatgctgtg

SEQ ID NO: 706714 - DNA, 25 bp, Mus musculus
gtgctggaacctctgatgagtctcg

SEQ ID NO: 706715 - DNA, 25 bp, Mus musculus
gtgctggaacctgtgatgagtctcg

SEQ ID NO: 706716 - DNA, 25 bp, Mus musculus
gtgctggaagaacaaacaactacta

SEQ ID NO: 706717 - DNA, 25 bp, Mus musculus
gtgctggaagaagaaacaactacta

SEQ ID NO: 706718 - DNA, 25 bp, Mus musculus
gtgctggaagtgatccctaccaaca

SEQ ID NO: 706719 - DNA, 25 bp, Mus musculus
gtgctggaagtgttccctaccaaca

SEQ ID NO: 706720 - DNA, 25 bp, Mus musculus
gtgctggaattgcagatgcgtacca

SEQ ID NO: 706721 - DNA, 25 bp, Mus musculus
gtgctggaattggagatgcgtacca

SEQ ID NO: 706722 - DNA, 25 bp, Mus musculus
gtgctggaccaaaagttactgagtt

SEQ ID NO: 706723 - DNA, 25 bp, Mus musculus
gtgctggaccaacactaggtttttc

SEQ ID NO: 706724 - DNA, 25 bp, Mus musculus
gtgctggaccaagactaggtttttc

SEQ ID NO: 706725 - DNA, 25 bp, Mus musculus
gtgctggaccaatagttactgagtt

SEQ ID NO: 706726 - DNA, 25 bp, Mus musculus
gtgctggaccagaagtgcttgctgc

SEQ ID NO: 706727 - DNA, 25 bp, Mus musculus
gtgctggaccagtagtgcttgctgc

SEQ ID NO: 706728 - DNA, 25 bp, Mus musculus
gtgctggacgccaataactgcgact

SEQ ID NO: 706729 - DNA, 25 bp, Mus musculus
gtgctggacgcctataactgcgact

SEQ ID NO: 706730 - DNA, 25 bp, Mus musculus
gtgctggacttcaggatgtaccaat

SEQ ID NO: 706731 - DNA, 25 bp, Mus musculus
gtgctggacttctggatgtaccaat

SEQ ID NO: 706732 - DNA, 25 bp, Mus musculus
gtgctggagaaaacatgtatagaac

SEQ ID NO: 706733 - DNA, 25 bp, Mus musculus
gtgctggagaaaacttgaatagctt

SEQ ID NO: 706734 - DNA, 25 bp, Mus musculus
gtgctggagaaatcatgtatagaac

SEQ ID NO: 706735 - DNA, 25 bp, Mus musculus
gtgctggagaaatcttgaatagctt

SEQ ID NO: 706736 - DNA, 25 bp, Mus musculus
gtgctggagaatcagctctggcctc

SEQ ID NO: 706737 - DNA, 25 bp, Mus musculus
gtgctggagaatgagctctggcctc

SEQ ID NO: 706738 - DNA, 25 bp, Mus musculus
gtgctggagccgagaaaagccacta

SEQ ID NO: 706739 - DNA, 25 bp, Mus musculus
gtgctggagccgtgaaaagccacta

SEQ ID NO: 706740 - DNA, 25 bp, Mus musculus
gtgctggagcctcaagttcgatgct

SEQ ID NO: 706741 - DNA, 25 bp, Mus musculus
gtgctggagcctgaagttcgatgct

SEQ ID NO: 706742 - DNA, 25 bp, Mus musculus
gtgctggagctcaacatctaacatt

SEQ ID NO: 706743 - DNA, 25 bp, Mus musculus
gtgctggagctctacatctaacatt

SEQ ID NO: 706744 - DNA, 25 bp, Mus musculus
gtgctggagggcaggactctcctca

SEQ ID NO: 706745 - DNA, 25 bp, Mus musculus
gtgctggagggctggactctcctca

SEQ ID NO: 706746 - DNA, 25 bp, Mus musculus
gtgctggataatacttttgtctttc

SEQ ID NO: 706747 - DNA, 25 bp, Mus musculus
gtgctggataattcttttgtctttc

SEQ ID NO: 706748 - DNA, 25 bp, Mus musculus
gtgctggatagccatggtagccttt

SEQ ID NO: 706749 - DNA, 25 bp, Mus musculus
gtgctggatagcgatggtagccttt

SEQ ID NO: 706750 - DNA, 25 bp, Mus musculus
gtgctggatatcacagatcgcctct

SEQ ID NO: 706751 - DNA, 25 bp, Mus musculus
gtgctggatatctcagatcgcctct

SEQ ID NO: 706752 - DNA, 25 bp, Mus musculus
gtgctggatgctaccgagagacctt

SEQ ID NO: 706753 - DNA, 25 bp, Mus musculus
gtgctggatgctatttgtttgccaa

SEQ ID NO: 706754 - DNA, 25 bp, Mus musculus
gtgctggatgcttccgagagacctt

SEQ ID NO: 706755 - DNA, 25 bp, Mus musculus
gtgctggatgctttttgtttgccaa

SEQ ID NO: 706756 - DNA, 25 bp, Mus musculus
gtgctggattgaatcttgggaccaa

SEQ ID NO: 706757 - DNA, 25 bp, Mus musculus
gtgctggattgattcttgggaccaa

SEQ ID NO: 706758 - DNA, 25 bp, Mus musculus
gtgctggcaaagacatggagtgact

SEQ ID NO: 706759 - DNA, 25 bp, Mus musculus
gtgctggcaaagtcatggagtgact

SEQ ID NO: 706760 - DNA, 25 bp, Mus musculus
gtgctggcaataaactctgaacatt

SEQ ID NO: 706761 - DNA, 25 bp, Mus musculus
gtgctggcaatatactctgaacatt

SEQ ID NO: 706762 - DNA, 25 bp, Mus musculus
gtgctggcaatcaactagttttgaa

SEQ ID NO: 706763 - DNA, 25 bp, Mus musculus
gtgctggcaatctactagttttgaa

SEQ ID NO: 706764 - DNA, 25 bp, Mus musculus
gtgctggcaccacagatttcactgt

SEQ ID NO: 706765 - DNA, 25 bp, Mus musculus
gtgctggcaccagagatttcactgt

SEQ ID NO: 706766 - DNA, 25 bp, Mus musculus
gtgctggcacttaccatgggtgtgt

SEQ ID NO: 706767 - DNA, 25 bp, Mus musculus
gtgctggcactttccatgggtgtgt

SEQ ID NO: 706768 - DNA, 25 bp, Mus musculus
gtgctggccataacacctggagtaa

SEQ ID NO: 706769 - DNA, 25 bp, Mus musculus
gtgctggccatatcacctggagtaa

SEQ ID NO: 706770 - DNA, 25 bp, Mus musculus
gtgctggccatgaagcccagatctt

SEQ ID NO: 706771 - DNA, 25 bp, Mus musculus
gtgctggccatgtagcccagatctt

SEQ ID NO: 706772 - DNA, 25 bp, Mus musculus
gtgctggccctcatcttaggaataa

SEQ ID NO: 706773 - DNA, 25 bp, Mus musculus
gtgctggccctcttcttaggaataa

SEQ ID NO: 706774 - DNA, 25 bp, Mus musculus
gtgctggcctacattgcttgctggg

SEQ ID NO: 706775 - DNA, 25 bp, Mus musculus
gtgctggcctactttgcttgctggg

SEQ ID NO: 706776 - DNA, 25 bp, Mus musculus
gtgctggcctgaaggtaatgttcgt

SEQ ID NO: 706777 - DNA, 25 bp, Mus musculus
gtgctggcctgatggtaatgttcgt

SEQ ID NO: 706778 - DNA, 25 bp, Mus musculus
gtgctggccttaaggtctccaactt

SEQ ID NO: 706779 - DNA, 25 bp, Mus musculus
gtgctggccttatggtctccaactt

SEQ ID NO: 706780 - DNA, 25 bp, Mus musculus
gtgctggcgctaactgtgcctgtgt

SEQ ID NO: 706781 - DNA, 25 bp, Mus musculus
gtgctggcgctatctgtgcctgtgt

SEQ ID NO: 706782 - DNA, 25 bp, Mus musculus
gtgctggcggcaagtgattgaatat

SEQ ID NO: 706783 - DNA, 25 bp, Mus musculus
gtgctggcggcatgtgattgaatat

SEQ ID NO: 706784 - DNA, 25 bp, Mus musculus
gtgctggctatacagacctgatgac

SEQ ID NO: 706785 - DNA, 25 bp, Mus musculus
gtgctggctatagagacctgatgac

SEQ ID NO: 706786 - DNA, 25 bp, Mus musculus
gtgctggctcaaacctagtaccatg

SEQ ID NO: 706787 - DNA, 25 bp, Mus musculus
gtgctggctcaatcctagtaccatg

SEQ ID NO: 706788 - DNA, 25 bp, Mus musculus
gtgctggctcccatctataacagaa

SEQ ID NO: 706789 - DNA, 25 bp, Mus musculus
gtgctggctcccttctataacagaa

SEQ ID NO: 706790 - DNA, 25 bp, Mus musculus
gtgctggctggtattataatctgct

SEQ ID NO: 706791 - DNA, 25 bp, Mus musculus
gtgctggctggttttataatctgct

SEQ ID NO: 706792 - DNA, 25 bp, Mus musculus
gtgctggctgtacagtgactcacgc

SEQ ID NO: 706793 - DNA, 25 bp, Mus musculus
gtgctggctgtagagtgactcacgc

SEQ ID NO: 706794 - DNA, 25 bp, Mus musculus
gtgctgggaaacacatccattctaa

SEQ ID NO: 706795 - DNA, 25 bp, Mus musculus
gtgctgggaaactcatccattctaa

SEQ ID NO: 706796 - DNA, 25 bp, Mus musculus
gtgctgggaagaaatgccccaccta

SEQ ID NO: 706797 - DNA, 25 bp, Mus musculus
gtgctgggaagatatgccccaccta

SEQ ID NO: 706798 - DNA, 25 bp, Mus musculus
gtgctgggaattcaatcctagccct

SEQ ID NO: 706799 - DNA, 25 bp, Mus musculus
gtgctgggaattgaatcctagccct

SEQ ID NO: 706800 - DNA, 25 bp, Mus musculus
gtgctgggacaaatttcttttttct

SEQ ID NO: 706801 - DNA, 25 bp, Mus musculus
gtgctgggacaacgtatccctgcag

SEQ ID NO: 706802 - DNA, 25 bp, Mus musculus
gtgctgggacaaggtatccctgcag

SEQ ID NO: 706803 - DNA, 25 bp, Mus musculus
gtgctgggacaattttcttttttct

SEQ ID NO: 706804 - DNA, 25 bp, Mus musculus
gtgctgggactgcatcagttcttct

SEQ ID NO: 706805 - DNA, 25 bp, Mus musculus
gtgctgggactggatcagttcttct

SEQ ID NO: 706806 - DNA, 25 bp, Mus musculus
gtgctgggatatccctggatgtctt

SEQ ID NO: 706807 - DNA, 25 bp, Mus musculus
gtgctgggatatgcctggatgtctt

SEQ ID NO: 706808 - DNA, 25 bp, Mus musculus
gtgctgggattgattttagggcttt

SEQ ID NO: 706809 - DNA, 25 bp, Mus musculus
gtgctgggattgcataccgcccact

SEQ ID NO: 706810 - DNA, 25 bp, Mus musculus
gtgctgggattggataccgcccact

SEQ ID NO: 706811 - DNA, 25 bp, Mus musculus
gtgctgggattgtttttagggcttt

SEQ ID NO: 706812 - DNA, 25 bp, Mus musculus
gtgctgggcacgaacaactttgggt

SEQ ID NO: 706813 - DNA, 25 bp, Mus musculus
gtgctgggcacgtacaactttgggt

SEQ ID NO: 706814 - DNA, 25 bp, Mus musculus
gtgctgggcataaggactggttcaa

SEQ ID NO: 706815 - DNA, 25 bp, Mus musculus
gtgctgggcatatggactggttcaa

SEQ ID NO: 706816 - DNA, 25 bp, Mus musculus
gtgctgggccagatgagcaatttca

SEQ ID NO: 706817 - DNA, 25 bp, Mus musculus
gtgctgggccagttgagcaatttca

SEQ ID NO: 706818 - DNA, 25 bp, Mus musculus
gtgctgggcctacctacagggcatc

SEQ ID NO: 706819 - DNA, 25 bp, Mus musculus
gtgctgggcctagctacagggcatc

SEQ ID NO: 706820 - DNA, 25 bp, Mus musculus
gtgctgggctcgagttattttcctt

SEQ ID NO: 706821 - DNA, 25 bp, Mus musculus
gtgctgggctcgtgttattttcctt

SEQ ID NO: 706822 - DNA, 25 bp, Mus musculus
gtgctgggctgcatggtttttgccc

SEQ ID NO: 706823 - DNA, 25 bp, Mus musculus
gtgctgggctgcttggtttttgccc

SEQ ID NO: 706824 - DNA, 25 bp, Mus musculus
gtgctgggcttaccactgtgcacct

SEQ ID NO: 706825 - DNA, 25 bp, Mus musculus
gtgctgggcttagcactgtgcacct

SEQ ID NO: 706826 - DNA, 25 bp, Mus musculus
gtgctggggctaaataccatcattt

SEQ ID NO: 706827 - DNA, 25 bp, Mus musculus
gtgctggggctatataccatcattt

SEQ ID NO: 706828 - DNA, 25 bp, Mus musculus
gtgctgggtgacactaagtctccac

SEQ ID NO: 706829 - DNA, 25 bp, Mus musculus
gtgctgggtgactctaagtctccac

SEQ ID NO: 706830 - DNA, 25 bp, Mus musculus
gtgctggtaatgctctgttctcaaa

SEQ ID NO: 706831 - DNA, 25 bp, Mus musculus
gtgctggtaatggtctgttctcaaa

SEQ ID NO: 706832 - DNA, 25 bp, Mus musculus
gtgctggtacagctcattatcagaa

SEQ ID NO: 706833 - DNA, 25 bp, Mus musculus
gtgctggtacaggtcattatcagaa

SEQ ID NO: 706834 - DNA, 25 bp, Mus musculus
gtgctggtaccaatggcaagacccc

SEQ ID NO: 706835 - DNA, 25 bp, Mus musculus
gtgctggtaccattggcaagacccc

SEQ ID NO: 706836 - DNA, 25 bp, Mus musculus
gtgctggtagacacagaaccaccca

SEQ ID NO: 706837 - DNA, 25 bp, Mus musculus
gtgctggtagactcagaaccaccca

SEQ ID NO: 706838 - DNA, 25 bp, Mus musculus
gtgctggtagctaagttccgtggta

SEQ ID NO: 706839 - DNA, 25 bp, Mus musculus
gtgctggtagctccttgtgtctgca

SEQ ID NO: 706840 - DNA, 25 bp, Mus musculus
gtgctggtagctgcttgtgtctgca

SEQ ID NO: 706841 - DNA, 25 bp, Mus musculus
gtgctggtagcttagttccgtggta

SEQ ID NO: 706842 - DNA, 25 bp, Mus musculus
gtgctggtatctcaagctctcttaa

SEQ ID NO: 706843 - DNA, 25 bp, Mus musculus
gtgctggtatctgaagctctcttaa

SEQ ID NO: 706844 - DNA, 25 bp, Mus musculus
gtgctggtcacgaatggttgttgct

SEQ ID NO: 706845 - DNA, 25 bp, Mus musculus
gtgctggtcacgtatggttgttgct

SEQ ID NO: 706846 - DNA, 25 bp, Mus musculus
gtgctggtcagtaactactaggccc

SEQ ID NO: 706847 - DNA, 25 bp, Mus musculus
gtgctggtcagttactactaggccc

SEQ ID NO: 706848 - DNA, 25 bp, Mus musculus
gtgctggtctaactagaatctccct

SEQ ID NO: 706849 - DNA, 25 bp, Mus musculus
gtgctggtctaagtagaatctccct

SEQ ID NO: 706850 - DNA, 25 bp, Mus musculus
gtgctggtctatcactattgggcat

SEQ ID NO: 706851 - DNA, 25 bp, Mus musculus
gtgctggtctatgactattgggcat

SEQ ID NO: 706852 - DNA, 25 bp, Mus musculus
gtgctggtctctcagcagctcactc

SEQ ID NO: 706853 - DNA, 25 bp, Mus musculus
gtgctggtctctgagcagctcactc

SEQ ID NO: 706854 - DNA, 25 bp, Mus musculus
gtgctggtctgaaagcttaccaact

SEQ ID NO: 706855 - DNA, 25 bp, Mus musculus
gtgctggtctgatagcttaccaact

SEQ ID NO: 706856 - DNA, 25 bp, Mus musculus
gtgctggtctttcacagcttgtcta

SEQ ID NO: 706857 - DNA, 25 bp, Mus musculus
gtgctggtctttgacagcttgtcta

SEQ ID NO: 706858 - DNA, 25 bp, Mus musculus
gtgctggtgaccagccatctgtgac

SEQ ID NO: 706859 - DNA, 25 bp, Mus musculus
gtgctggtgacctgccatctgtgac

SEQ ID NO: 706860 - DNA, 25 bp, Mus musculus
gtgctggtgctgagaccgtcaaatt

SEQ ID NO: 706861 - DNA, 25 bp, Mus musculus
gtgctggtgctgtgaccgtcaaatt

SEQ ID NO: 706862 - DNA, 25 bp, Mus musculus
gtgctggtggaaatgctgtttctcc

SEQ ID NO: 706863 - DNA, 25 bp, Mus musculus
gtgctggtggaattgctgtttctcc

SEQ ID NO: 706864 - DNA, 25 bp, Mus musculus
gtgctggtgggcatcttcaccaagc

SEQ ID NO: 706865 - DNA, 25 bp, Mus musculus
gtgctggtgggcttcttcaccaagc

SEQ ID NO: 706866 - DNA, 25 bp, Mus musculus
gtgctggtgggtccgcgccatcagg

SEQ ID NO: 706867 - DNA, 25 bp, Mus musculus
gtgctggtgggtgcgcgccatcagg

SEQ ID NO: 706868 - DNA, 25 bp, Mus musculus
gtgctggtggtcatgctagcttcaa

SEQ ID NO: 706869 - DNA, 25 bp, Mus musculus
gtgctggtggtcttgctagcttcaa

SEQ ID NO: 706870 - DNA, 25 bp, Mus musculus
gtgctggtgtaactagccacttttc

SEQ ID NO: 706871 - DNA, 25 bp, Mus musculus
gtgctggtgtaagtagccacttttc

SEQ ID NO: 706872 - DNA, 25 bp, Mus musculus
gtgctggtgtgacagatgccacaca

SEQ ID NO: 706873 - DNA, 25 bp, Mus musculus
gtgctggtgtgagagatgccacaca

SEQ ID NO: 706874 - DNA, 25 bp, Mus musculus
gtgctggttaacaaatcctctacat

SEQ ID NO: 706875 - DNA, 25 bp, Mus musculus
gtgctggttaactaatcctctacat

SEQ ID NO: 706876 - DNA, 25 bp, Mus musculus
gtgctggttaatctatttgcctgat

SEQ ID NO: 706877 - DNA, 25 bp, Mus musculus
gtgctggttaatgtatttgcctgat

SEQ ID NO: 706878 - DNA, 25 bp, Mus musculus
gtgctggttactcaagatgcgctta

SEQ ID NO: 706879 - DNA, 25 bp, Mus musculus
gtgctggttactgaagatgcgctta

SEQ ID NO: 706880 - DNA, 25 bp, Mus musculus
gtgctggttcatcggacagtccctt

SEQ ID NO: 706881 - DNA, 25 bp, Mus musculus
gtgctggttcatgggacagtccctt

SEQ ID NO: 706882 - DNA, 25 bp, Mus musculus
gtgctggttgcaaagagttcatatt

SEQ ID NO: 706883 - DNA, 25 bp, Mus musculus
gtgctggttgcatagagttcatatt

SEQ ID NO: 706884 - DNA, 25 bp, Mus musculus
gtgctggttggaaacagagcctaca

SEQ ID NO: 706885 - DNA, 25 bp, Mus musculus
gtgctggttggatacagagcctaca

SEQ ID NO: 706886 - DNA, 25 bp, Mus musculus
gtgctggttgtaattattgtccgtc

SEQ ID NO: 706887 - DNA, 25 bp, Mus musculus
gtgctggttgtatttattgtccgtc

SEQ ID NO: 706888 - DNA, 25 bp, Mus musculus
gtgctggtttggacgagaatgactt

SEQ ID NO: 706889 - DNA, 25 bp, Mus musculus
gtgctggtttggtcgagaatgactt

SEQ ID NO: 706890 - DNA, 25 bp, Mus musculus
gtgctgtaaacaaaaccaagaacca

SEQ ID NO: 706891 - DNA, 25 bp, Mus musculus
gtgctgtaaacataaccaagaacca

SEQ ID NO: 706892 - DNA, 25 bp, Mus musculus
gtgctgtaaagaaggtcattgggcc

SEQ ID NO: 706893 - DNA, 25 bp, Mus musculus
gtgctgtaaagatggtcattgggcc

SEQ ID NO: 706894 - DNA, 25 bp, Mus musculus
gtgctgtaacatcagttcttatctg

SEQ ID NO: 706895 - DNA, 25 bp, Mus musculus
gtgctgtaacatgagttcttatctg

SEQ ID NO: 706896 - DNA, 25 bp, Mus musculus
gtgctgtaccagcatttgatttcta

SEQ ID NO: 706897 - DNA, 25 bp, Mus musculus
gtgctgtaccaggatttgatttcta

SEQ ID NO: 706898 - DNA, 25 bp, Mus musculus
gtgctgtaccgtcatgctaattgtt

SEQ ID NO: 706899 - DNA, 25 bp, Mus musculus
gtgctgtaccgtgatgctaattgtt

SEQ ID NO: 706900 - DNA, 25 bp, Mus musculus
gtgctgtacctaaaagtgctttcct

SEQ ID NO: 706901 - DNA, 25 bp, Mus musculus
gtgctgtacctataagtgctttcct

SEQ ID NO: 706902 - DNA, 25 bp, Mus musculus
gtgctgtacgcgaggaatgacctag

SEQ ID NO: 706903 - DNA, 25 bp, Mus musculus
gtgctgtacgcgtggaatgacctag

SEQ ID NO: 706904 - DNA, 25 bp, Mus musculus
gtgctgtacgtgaaaatgtctttat

SEQ ID NO: 706905 - DNA, 25 bp, Mus musculus
gtgctgtacgtgtaaatgtctttat

SEQ ID NO: 706906 - DNA, 25 bp, Mus musculus
gtgctgtactatccagttcctgtaa

SEQ ID NO: 706907 - DNA, 25 bp, Mus musculus
gtgctgtactatgcagttcctgtaa

SEQ ID NO: 706908 - DNA, 25 bp, Mus musculus
gtgctgtactctaagtgttatttat

SEQ ID NO: 706909 - DNA, 25 bp, Mus musculus
gtgctgtactcttagtgttatttat

SEQ ID NO: 706910 - DNA, 25 bp, Mus musculus
gtgctgtagagtacactgttgtaca

SEQ ID NO: 706911 - DNA, 25 bp, Mus musculus
gtgctgtagagttcactgttgtaca

SEQ ID NO: 706912 - DNA, 25 bp, Mus musculus
gtgctgtagatgaaagccctatcct

SEQ ID NO: 706913 - DNA, 25 bp, Mus musculus
gtgctgtagatgtaagccctatcct

SEQ ID NO: 706914 - DNA, 25 bp, Mus musculus
gtgctgtagcaactatcggacccat

SEQ ID NO: 706915 - DNA, 25 bp, Mus musculus
gtgctgtagcaagtatcggacccat

SEQ ID NO: 706916 - DNA, 25 bp, Mus musculus
gtgctgtagcacacactaggctcag

SEQ ID NO: 706917 - DNA, 25 bp, Mus musculus
gtgctgtagcactcactaggctcag

SEQ ID NO: 706918 - DNA, 25 bp, Mus musculus
gtgctgtagcatcaacacacccaca

SEQ ID NO: 706919 - DNA, 25 bp, Mus musculus
gtgctgtagcatgaacacacccaca

SEQ ID NO: 706920 - DNA, 25 bp, Mus musculus
gtgctgtagtttagtctcaccctat

SEQ ID NO: 706921 - DNA, 25 bp, Mus musculus
gtgctgtagttttgtctcaccctat

SEQ ID NO: 706922 - DNA, 25 bp, Mus musculus
gtgctgtataagactgcctcagaat

SEQ ID NO: 706923 - DNA, 25 bp, Mus musculus
gtgctgtataagtctgcctcagaat

SEQ ID NO: 706924 - DNA, 25 bp, Mus musculus
gtgctgtatattccttgatcttcct

SEQ ID NO: 706925 - DNA, 25 bp, Mus musculus
gtgctgtatattgcttgatcttcct

SEQ ID NO: 706926 - DNA, 25 bp, Mus musculus
gtgctgtatctgatggattcttttg

SEQ ID NO: 706927 - DNA, 25 bp, Mus musculus
gtgctgtatctgttggattcttttg

SEQ ID NO: 706928 - DNA, 25 bp, Mus musculus
gtgctgtatgtaccaggtctggcca

SEQ ID NO: 706929 - DNA, 25 bp, Mus musculus
gtgctgtatgtagcaggtctggcca

SEQ ID NO: 706930 - DNA, 25 bp, Mus musculus
gtgctgtattgtccttttagcctgt

SEQ ID NO: 706931 - DNA, 25 bp, Mus musculus
gtgctgtattgtgcttttagcctgt

SEQ ID NO: 706932 - DNA, 25 bp, Mus musculus
gtgctgtattttagtgtcacatctc

SEQ ID NO: 706933 - DNA, 25 bp, Mus musculus
gtgctgtatttttgtgtcacatctc

SEQ ID NO: 706934 - DNA, 25 bp, Mus musculus
gtgctgtcaaatacctggagtgctc

SEQ ID NO: 706935 - DNA, 25 bp, Mus musculus
gtgctgtcaaattcctggagtgctc

SEQ ID NO: 706936 - DNA, 25 bp, Mus musculus
gtgctgtcaagcaggctaacactgc

SEQ ID NO: 706937 - DNA, 25 bp, Mus musculus
gtgctgtcaagctggctaacactgc

SEQ ID NO: 706938 - DNA, 25 bp, Mus musculus
gtgctgtcacctcactacatatatg

SEQ ID NO: 706939 - DNA, 25 bp, Mus musculus
gtgctgtcacctgactacatatatg

SEQ ID NO: 706940 - DNA, 25 bp, Mus musculus
gtgctgtcactgatgcgaggccgcc

SEQ ID NO: 706941 - DNA, 25 bp, Mus musculus
gtgctgtcactgttgcgaggccgcc

SEQ ID NO: 706942 - DNA, 25 bp, Mus musculus
gtgctgtcagaaatggtcaaccctg

SEQ ID NO: 706943 - DNA, 25 bp, Mus musculus
gtgctgtcagaattggtcaaccctg

SEQ ID NO: 706944 - DNA, 25 bp, Mus musculus
gtgctgtcagccaaattgcttacag

SEQ ID NO: 706945 - DNA, 25 bp, Mus musculus
gtgctgtcagcctaattgcttacag

SEQ ID NO: 706946 - DNA, 25 bp, Mus musculus
gtgctgtcagtaagctgtgcccaga

SEQ ID NO: 706947 - DNA, 25 bp, Mus musculus
gtgctgtcagtatgctgtgcccaga

SEQ ID NO: 706948 - DNA, 25 bp, Mus musculus
gtgctgtcatttcacctcggaataa

SEQ ID NO: 706949 - DNA, 25 bp, Mus musculus
gtgctgtcatttgacctcggaataa

SEQ ID NO: 706950 - DNA, 25 bp, Mus musculus
gtgctgtccacacagaagatccttc

SEQ ID NO: 706951 - DNA, 25 bp, Mus musculus
gtgctgtccacagagaagatccttc

SEQ ID NO: 706952 - DNA, 25 bp, Mus musculus
gtgctgtccacgagtcatatgatgt

SEQ ID NO: 706953 - DNA, 25 bp, Mus musculus
gtgctgtccacgtgtcatatgatgt

SEQ ID NO: 706954 - DNA, 25 bp, Mus musculus
gtgctgtccagcaactagtatatgt

SEQ ID NO: 706955 - DNA, 25 bp, Mus musculus
gtgctgtccagctactagtatatgt

SEQ ID NO: 706956 - DNA, 25 bp, Mus musculus
gtgctgtcccacatgctaggagatg

SEQ ID NO: 706957 - DNA, 25 bp, Mus musculus
gtgctgtcccacttgctaggagatg

SEQ ID NO: 706958 - DNA, 25 bp, Mus musculus
gtgctgtcctggcaagccacttaac

SEQ ID NO: 706959 - DNA, 25 bp, Mus musculus
gtgctgtcctgggaagccacttaac

SEQ ID NO: 706960 - DNA, 25 bp, Mus musculus
gtgctgtctagaatggctgaaataa

SEQ ID NO: 706961 - DNA, 25 bp, Mus musculus
gtgctgtctagattggctgaaataa

SEQ ID NO: 706962 - DNA, 25 bp, Mus musculus
gtgctgtctctaaactagtgagatt

SEQ ID NO: 706963 - DNA, 25 bp, Mus musculus
gtgctgtctctatactagtgagatt

SEQ ID NO: 706964 - DNA, 25 bp, Mus musculus
gtgctgtctgcaatttcttggagaa

SEQ ID NO: 706965 - DNA, 25 bp, Mus musculus
gtgctgtctgcattttcttggagaa

SEQ ID NO: 706966 - DNA, 25 bp, Mus musculus
gtgctgtctgccaaggaatccttca

SEQ ID NO: 706967 - DNA, 25 bp, Mus musculus
gtgctgtctgccatcatgtggttaa

SEQ ID NO: 706968 - DNA, 25 bp, Mus musculus
gtgctgtctgcctaggaatccttca

SEQ ID NO: 706969 - DNA, 25 bp, Mus musculus
gtgctgtctgccttcatgtggttaa

SEQ ID NO: 706970 - DNA, 25 bp, Mus musculus
gtgctgtctgctcaaacaacactct

SEQ ID NO: 706971 - DNA, 25 bp, Mus musculus
gtgctgtctgctgaaacaacactct

SEQ ID NO: 706972 - DNA, 25 bp, Mus musculus
gtgctgtctggtcaagatgtttcta

SEQ ID NO: 706973 - DNA, 25 bp, Mus musculus
gtgctgtctggtgaagatgtttcta

SEQ ID NO: 706974 - DNA, 25 bp, Mus musculus
gtgctgtctgtcacaaccttataat

SEQ ID NO: 706975 - DNA, 25 bp, Mus musculus
gtgctgtctgtctcaaccttataat

SEQ ID NO: 706976 - DNA, 25 bp, Mus musculus
gtgctgtcttcacaggatactgcaa

SEQ ID NO: 706977 - DNA, 25 bp, Mus musculus
gtgctgtcttcagaggatactgcaa

SEQ ID NO: 706978 - DNA, 25 bp, Mus musculus
gtgctgtgaactagaaccgtgggta

SEQ ID NO: 706979 - DNA, 25 bp, Mus musculus
gtgctgtgaacttgaaccgtgggta

SEQ ID NO: 706980 - DNA, 25 bp, Mus musculus
gtgctgtgacacacaggattctgtt

SEQ ID NO: 706981 - DNA, 25 bp, Mus musculus
gtgctgtgacactcaggattctgtt

SEQ ID NO: 706982 - DNA, 25 bp, Mus musculus
gtgctgtgacagacaatggtcttct

SEQ ID NO: 706983 - DNA, 25 bp, Mus musculus
gtgctgtgacagcaagagccagaca

SEQ ID NO: 706984 - DNA, 25 bp, Mus musculus
gtgctgtgacaggaagagccagaca

SEQ ID NO: 706985 - DNA, 25 bp, Mus musculus
gtgctgtgacagtcaatggtcttct

SEQ ID NO: 706986 - DNA, 25 bp, Mus musculus
gtgctgtgagtaaaagtgtgtgcct

SEQ ID NO: 706987 - DNA, 25 bp, Mus musculus
gtgctgtgagtataagtgtgtgcct

SEQ ID NO: 706988 - DNA, 25 bp, Mus musculus
gtgctgtgatgtatatgcttattca

SEQ ID NO: 706989 - DNA, 25 bp, Mus musculus
gtgctgtgatgtttatgcttattca

SEQ ID NO: 706990 - DNA, 25 bp, Mus musculus
gtgctgtgcaggcaatccgatgtcc

SEQ ID NO: 706991 - DNA, 25 bp, Mus musculus
gtgctgtgcagggaatccgatgtcc

SEQ ID NO: 706992 - DNA, 25 bp, Mus musculus
gtgctgtgcctaaagttggtgatcc

SEQ ID NO: 706993 - DNA, 25 bp, Mus musculus
gtgctgtgcctacccagtagctgga

SEQ ID NO: 706994 - DNA, 25 bp, Mus musculus
gtgctgtgcctagccagtagctgga

SEQ ID NO: 706995 - DNA, 25 bp, Mus musculus
gtgctgtgcctatagttggtgatcc

SEQ ID NO: 706996 - DNA, 25 bp, Mus musculus
gtgctgtgcgaactaaactacctca

SEQ ID NO: 706997 - DNA, 25 bp, Mus musculus
gtgctgtgcgaagtaaactacctca

SEQ ID NO: 706998 - DNA, 25 bp, Mus musculus
gtgctgtgctccagactgcagagga

SEQ ID NO: 706999 - DNA, 25 bp, Mus musculus
gtgctgtgctcctgactgcagagga

SEQ ID NO: 707000 - DNA, 25 bp, Mus musculus
gtgctgtgctggaattcactatgaa

SEQ ID NO: 707001 - DNA, 25 bp, Mus musculus
gtgctgtgctggtattcactatgaa

SEQ ID NO: 707002 - DNA, 25 bp, Mus musculus
gtgctgtggagcctatactaacaac

SEQ ID NO: 707003 - DNA, 25 bp, Mus musculus
gtgctgtggagcgtatactaacaac

SEQ ID NO: 707004 - DNA, 25 bp, Mus musculus
gtgctgtggccaaacgcattggata

SEQ ID NO: 707005 - DNA, 25 bp, Mus musculus
gtgctgtggccatacgcattggata

SEQ ID NO: 707006 - DNA, 25 bp, Mus musculus
gtgctgtggctactacagtgtgtat

SEQ ID NO: 707007 - DNA, 25 bp, Mus musculus
gtgctgtggctagtacagtgtgtat

SEQ ID NO: 707008 - DNA, 25 bp, Mus musculus
gtgctgtgggatagtctatagccaa

SEQ ID NO: 707009 - DNA, 25 bp, Mus musculus
gtgctgtgggattgtctatagccaa

SEQ ID NO: 707010 - DNA, 25 bp, Mus musculus
gtgctgtgggtgacaagcgctattt

SEQ ID NO: 707011 - DNA, 25 bp, Mus musculus
gtgctgtgggtgtcaagcgctattt

SEQ ID NO: 707012 - DNA, 25 bp, Mus musculus
gtgctgtggtagatctagctctatc

SEQ ID NO: 707013 - DNA, 25 bp, Mus musculus
gtgctgtggtagttctagctctatc

SEQ ID NO: 707014 - DNA, 25 bp, Mus musculus
gtgctgtgtaccattaatactagta

SEQ ID NO: 707015 - DNA, 25 bp, Mus musculus
gtgctgtgtacctttaatactagta

SEQ ID NO: 707016 - DNA, 25 bp, Mus musculus
gtgctgtgtgcccaaaactcttaag

SEQ ID NO: 707017 - DNA, 25 bp, Mus musculus
gtgctgtgtgccgaaaactcttaag

SEQ ID NO: 707018 - DNA, 25 bp, Mus musculus
gtgctgtgtgctatatatctgatgg

SEQ ID NO: 707019 - DNA, 25 bp, Mus musculus
gtgctgtgtgctttatatctgatgg

SEQ ID NO: 707020 - DNA, 25 bp, Mus musculus
gtgctgtgttccaagcaatctgcat

SEQ ID NO: 707021 - DNA, 25 bp, Mus musculus
gtgctgtgttcctagcaatctgcat

SEQ ID NO: 707022 - DNA, 25 bp, Mus musculus
gtgctgtgttgtacactatctatag

SEQ ID NO: 707023 - DNA, 25 bp, Mus musculus
gtgctgtgttgttcactatctatag

SEQ ID NO: 707024 - DNA, 25 bp, Mus musculus
gtgctgttagcaatctcgataaatc

SEQ ID NO: 707025 - DNA, 25 bp, Mus musculus
gtgctgttagcattctcgataaatc

SEQ ID NO: 707026 - DNA, 25 bp, Mus musculus
gtgctgttagtgaccagaggctcct

SEQ ID NO: 707027 - DNA, 25 bp, Mus musculus
gtgctgttagtgtccagaggctcct

SEQ ID NO: 707028 - DNA, 25 bp, Mus musculus
gtgctgttatagataggagtcctct

SEQ ID NO: 707029 - DNA, 25 bp, Mus musculus
gtgctgttatagttaggagtcctct

SEQ ID NO: 707030 - DNA, 25 bp, Mus musculus
gtgctgttatcaaggtgactcgtcc

SEQ ID NO: 707031 - DNA, 25 bp, Mus musculus
gtgctgttatcatggtgactcgtcc

SEQ ID NO: 707032 - DNA, 25 bp, Mus musculus
gtgctgttattcacacagtcctgca

SEQ ID NO: 707033 - DNA, 25 bp, Mus musculus
gtgctgttattctcacagtcctgca

SEQ ID NO: 707034 - DNA, 25 bp, Mus musculus
gtgctgttcaatcaccaacaggaga

SEQ ID NO: 707035 - DNA, 25 bp, Mus musculus
gtgctgttcaatgaccaacaggaga

SEQ ID NO: 707036 - DNA, 25 bp, Mus musculus
gtgctgttcacacttattttcattg

SEQ ID NO: 707037 - DNA, 25 bp, Mus musculus
gtgctgttcacagttattttcattg

SEQ ID NO: 707038 - DNA, 25 bp, Mus musculus
gtgctgttcagaaatttaccttttt

SEQ ID NO: 707039 - DNA, 25 bp, Mus musculus
gtgctgttcagatatttaccttttt

SEQ ID NO: 707040 - DNA, 25 bp, Mus musculus
gtgctgttcatccacgaggtccaca

SEQ ID NO: 707041 - DNA, 25 bp, Mus musculus
gtgctgttcatcgacgaggtccaca

SEQ ID NO: 707042 - DNA, 25 bp, Mus musculus
gtgctgttcctaaccataaacctga

SEQ ID NO: 707043 - DNA, 25 bp, Mus musculus
gtgctgttcctatccataaacctga

SEQ ID NO: 707044 - DNA, 25 bp, Mus musculus
gtgctgttcctgaaagtttgctatt

SEQ ID NO: 707045 - DNA, 25 bp, Mus musculus
gtgctgttcctgtaagtttgctatt

SEQ ID NO: 707046 - DNA, 25 bp, Mus musculus
gtgctgttctccaaaagggctaaac

SEQ ID NO: 707047 - DNA, 25 bp, Mus musculus
gtgctgttctcctaaagggctaaac

SEQ ID NO: 707048 - DNA, 25 bp, Mus musculus
gtgctgttctgtcagcagacaccag

SEQ ID NO: 707049 - DNA, 25 bp, Mus musculus
gtgctgttctgtgagcagacaccag

SEQ ID NO: 707050 - DNA, 25 bp, Mus musculus
gtgctgttcttgagacagatgtgta

SEQ ID NO: 707051 - DNA, 25 bp, Mus musculus
gtgctgttcttgtgacagatgtgta

SEQ ID NO: 707052 - DNA, 25 bp, Mus musculus
gtgctgttgacacgacatctctctc

SEQ ID NO: 707053 - DNA, 25 bp, Mus musculus
gtgctgttgacaggacatctctctc

SEQ ID NO: 707054 - DNA, 25 bp, Mus musculus
gtgctgttgactctgattgcctgac

SEQ ID NO: 707055 - DNA, 25 bp, Mus musculus
gtgctgttgactgtgattgcctgac

SEQ ID NO: 707056 - DNA, 25 bp, Mus musculus
gtgctgttgatacctcatgcagtat

SEQ ID NO: 707057 - DNA, 25 bp, Mus musculus
gtgctgttgatagctcatgcagtat

SEQ ID NO: 707058 - DNA, 25 bp, Mus musculus
gtgctgttggctacttagatgctac

SEQ ID NO: 707059 - DNA, 25 bp, Mus musculus
gtgctgttggcttcttagatgctac

SEQ ID NO: 707060 - DNA, 25 bp, Mus musculus
gtgctgttgggcctcacagctcaga

SEQ ID NO: 707061 - DNA, 25 bp, Mus musculus
gtgctgttgggcgtcacagctcaga

SEQ ID NO: 707062 - DNA, 25 bp, Mus musculus
gtgctgttgtggcaagtcttctctt

SEQ ID NO: 707063 - DNA, 25 bp, Mus musculus
gtgctgttgtgggaagtcttctctt

SEQ ID NO: 707064 - DNA, 25 bp, Mus musculus
gtgctgtttactaacatggaggcat

SEQ ID NO: 707065 - DNA, 25 bp, Mus musculus
gtgctgtttacttacatggaggcat

SEQ ID NO: 707066 - DNA, 25 bp, Mus musculus
gtgctgtttattccccttctgacct

SEQ ID NO: 707067 - DNA, 25 bp, Mus musculus
gtgctgtttattgcccttctgacct

SEQ ID NO: 707068 - DNA, 25 bp, Mus musculus
gtgctgtttgctatgataatcgtta

SEQ ID NO: 707069 - DNA, 25 bp, Mus musculus
gtgctgtttgctttgataatcgtta

SEQ ID NO: 707070 - DNA, 25 bp, Mus musculus
gtgctgtttgtacgcaaccttgcca

SEQ ID NO: 707071 - DNA, 25 bp, Mus musculus
gtgctgtttgtaggcaaccttgcca

SEQ ID NO: 707072 - DNA, 25 bp, Mus musculus
gtgctgtttgtgagctatagtaact

SEQ ID NO: 707073 - DNA, 25 bp, Mus musculus
gtgctgtttgtgtgctatagtaact

SEQ ID NO: 707074 - DNA, 25 bp, Mus musculus
gtgctgtttgttattcttaacttct

SEQ ID NO: 707075 - DNA, 25 bp, Mus musculus
gtgctgtttgtttttcttaacttct

SEQ ID NO: 707076 - DNA, 25 bp, Mus musculus
gtgctgttttctaagctgaatgatg

SEQ ID NO: 707077 - DNA, 25 bp, Mus musculus
gtgctgttttcttagctgaatgatg

SEQ ID NO: 707078 - DNA, 25 bp, Mus musculus
gtgcttaaacttcacccttgtttag

SEQ ID NO: 707079 - DNA, 25 bp, Mus musculus
gtgcttaaacttgacccttgtttag

SEQ ID NO: 707080 - DNA, 25 bp, Mus musculus
gtgcttaaatccacagatcttacaa

SEQ ID NO: 707081 - DNA, 25 bp, Mus musculus
gtgcttaaatcctcagatcttacaa

SEQ ID NO: 707082 - DNA, 25 bp, Mus musculus
gtgcttaactgtacgtttccggaat

SEQ ID NO: 707083 - DNA, 25 bp, Mus musculus
gtgcttaactgttcgtttccggaat

SEQ ID NO: 707084 - DNA, 25 bp, Mus musculus
gtgcttaagagtcaggaggatccca

SEQ ID NO: 707085 - DNA, 25 bp, Mus musculus
gtgcttaagagtgaggaggatccca

SEQ ID NO: 707086 - DNA, 25 bp, Mus musculus
gtgcttaagccaacagcatgtcctg

SEQ ID NO: 707087 - DNA, 25 bp, Mus musculus
gtgcttaagccatcagcatgtcctg

SEQ ID NO: 707088 - DNA, 25 bp, Mus musculus
gtgcttaatctcacaaattactcat

SEQ ID NO: 707089 - DNA, 25 bp, Mus musculus
gtgcttaatctctcaaattactcat

SEQ ID NO: 707090 - DNA, 25 bp, Mus musculus
gtgcttaattgaaactttcatggta

SEQ ID NO: 707091 - DNA, 25 bp, Mus musculus
gtgcttaattgatactttcatggta

SEQ ID NO: 707092 - DNA, 25 bp, Mus musculus
gtgcttacaaggactggtcctggct

SEQ ID NO: 707093 - DNA, 25 bp, Mus musculus
gtgcttacaaggtctggtcctggct

SEQ ID NO: 707094 - DNA, 25 bp, Mus musculus
gtgcttacagctccctacatatagt

SEQ ID NO: 707095 - DNA, 25 bp, Mus musculus
gtgcttacagctgcctacatatagt

SEQ ID NO: 707096 - DNA, 25 bp, Mus musculus
gtgcttacccgtagagtggtttttg

SEQ ID NO: 707097 - DNA, 25 bp, Mus musculus
gtgcttacccgttgagtggtttttg

SEQ ID NO: 707098 - DNA, 25 bp, Mus musculus
gtgcttacgaagagacccaggccaa

SEQ ID NO: 707099 - DNA, 25 bp, Mus musculus
gtgcttacgaagtgacccaggccaa

SEQ ID NO: 707100 - DNA, 25 bp, Mus musculus
gtgcttactcggataatttgtcaat

SEQ ID NO: 707101 - DNA, 25 bp, Mus musculus
gtgcttactcggttaatttgtcaat

SEQ ID NO: 707102 - DNA, 25 bp, Mus musculus
gtgcttacttcacaggtacttctaa

SEQ ID NO: 707103 - DNA, 25 bp, Mus musculus
gtgcttacttcagaggtacttctaa

SEQ ID NO: 707104 - DNA, 25 bp, Mus musculus
gtgcttacttccagggtgcttgcca

SEQ ID NO: 707105 - DNA, 25 bp, Mus musculus
gtgcttacttcctgggtgcttgcca

SEQ ID NO: 707106 - DNA, 25 bp, Mus musculus
gtgcttagcgcccacatggtgactc

SEQ ID NO: 707107 - DNA, 25 bp, Mus musculus
gtgcttagcgccgacatggtgactc

SEQ ID NO: 707108 - DNA, 25 bp, Mus musculus
gtgcttagctcgatagactctgaat

SEQ ID NO: 707109 - DNA, 25 bp, Mus musculus
gtgcttagctcgttagactctgaat

SEQ ID NO: 707110 - DNA, 25 bp, Mus musculus
gtgcttagtagtcagccaccccagt

SEQ ID NO: 707111 - DNA, 25 bp, Mus musculus
gtgcttagtagtgagccaccccagt

SEQ ID NO: 707112 - DNA, 25 bp, Mus musculus
gtgcttagtatccagaagttaccct

SEQ ID NO: 707113 - DNA, 25 bp, Mus musculus
gtgcttagtatcgagaagttaccct

SEQ ID NO: 707114 - DNA, 25 bp, Mus musculus
gtgcttagtcagacggattaccata

SEQ ID NO: 707115 - DNA, 25 bp, Mus musculus
gtgcttagtcagtcggattaccata

SEQ ID NO: 707116 - DNA, 25 bp, Mus musculus
gtgcttagtctcagatattgaacaa

SEQ ID NO: 707117 - DNA, 25 bp, Mus musculus
gtgcttagtctctgatattgaacaa

SEQ ID NO: 707118 - DNA, 25 bp, Mus musculus
gtgcttagtcttagtgtaatgtcct

SEQ ID NO: 707119 - DNA, 25 bp, Mus musculus
gtgcttagtctttgtgtaatgtcct

SEQ ID NO: 707120 - DNA, 25 bp, Mus musculus
gtgcttagtgctaacacatgtgtgg

SEQ ID NO: 707121 - DNA, 25 bp, Mus musculus
gtgcttagtgcttacacatgtgtgg

SEQ ID NO: 707122 - DNA, 25 bp, Mus musculus
gtgcttagtggactgaagccatata

SEQ ID NO: 707123 - DNA, 25 bp, Mus musculus
gtgcttagtggagtgaagccatata

SEQ ID NO: 707124 - DNA, 25 bp, Mus musculus
gtgcttataaggataggtactctaa

SEQ ID NO: 707125 - DNA, 25 bp, Mus musculus
gtgcttataaggttaggtactctaa

SEQ ID NO: 707126 - DNA, 25 bp, Mus musculus
gtgcttatacacactatactggagg

SEQ ID NO: 707127 - DNA, 25 bp, Mus musculus
gtgcttatacactctatactggagg

SEQ ID NO: 707128 - DNA, 25 bp, Mus musculus
gtgcttatacctatgtggtttgttc

SEQ ID NO: 707129 - DNA, 25 bp, Mus musculus
gtgcttatacctttgtggtttgttc

SEQ ID NO: 707130 - DNA, 25 bp, Mus musculus
gtgcttatagaaagtgaccctgcca

SEQ ID NO: 707131 - DNA, 25 bp, Mus musculus
gtgcttatagaatgtgaccctgcca

SEQ ID NO: 707132 - DNA, 25 bp, Mus musculus
gtgcttatccagcttatcttctctg

SEQ ID NO: 707133 - DNA, 25 bp, Mus musculus
gtgcttatccaggttatcttctctg

SEQ ID NO: 707134 - DNA, 25 bp, Mus musculus
gtgcttatccatccatgctgacaag

SEQ ID NO: 707135 - DNA, 25 bp, Mus musculus
gtgcttatccatgcatgctgacaag

SEQ ID NO: 707136 - DNA, 25 bp, Mus musculus
gtgcttatctaacaaaccatgtgta

SEQ ID NO: 707137 - DNA, 25 bp, Mus musculus
gtgcttatctaagaaaccatgtgta

SEQ ID NO: 707138 - DNA, 25 bp, Mus musculus
gtgcttatgaggaatcaatcgctat

SEQ ID NO: 707139 - DNA, 25 bp, Mus musculus
gtgcttatgaggtatcaatcgctat

SEQ ID NO: 707140 - DNA, 25 bp, Mus musculus
gtgcttatgcaaccgtcatggagtt

SEQ ID NO: 707141 - DNA, 25 bp, Mus musculus
gtgcttatgcaagcgtcatggagtt

SEQ ID NO: 707142 - DNA, 25 bp, Mus musculus
gtgcttatgtaaatgcattccggcc

SEQ ID NO: 707143 - DNA, 25 bp, Mus musculus
gtgcttatgtaattgcattccggcc

SEQ ID NO: 707144 - DNA, 25 bp, Mus musculus
gtgcttatgtataccagacttgcct

SEQ ID NO: 707145 - DNA, 25 bp, Mus musculus
gtgcttatgtattccagacttgcct

SEQ ID NO: 707146 - DNA, 25 bp, Mus musculus
gtgcttattcatatgtgttacgctg

SEQ ID NO: 707147 - DNA, 25 bp, Mus musculus
gtgcttattcatttgtgttacgctg

SEQ ID NO: 707148 - DNA, 25 bp, Mus musculus
gtgcttattgatctgggaaccggct

SEQ ID NO: 707149 - DNA, 25 bp, Mus musculus
gtgcttattgatgtgggaaccggct

SEQ ID NO: 707150 - DNA, 25 bp, Mus musculus
gtgcttattgcaccccatgggaaca

SEQ ID NO: 707151 - DNA, 25 bp, Mus musculus
gtgcttattgcagcccatgggaaca

SEQ ID NO: 707152 - DNA, 25 bp, Mus musculus
gtgcttattgggattgtctcctggg

SEQ ID NO: 707153 - DNA, 25 bp, Mus musculus
gtgcttattgggtttgtctcctggg

SEQ ID NO: 707154 - DNA, 25 bp, Mus musculus
gtgcttcaagccctgaacctttgca

SEQ ID NO: 707155 - DNA, 25 bp, Mus musculus
gtgcttcaagccgtgaacctttgca

SEQ ID NO: 707156 - DNA, 25 bp, Mus musculus
gtgcttcaattcagccatcttttga

SEQ ID NO: 707157 - DNA, 25 bp, Mus musculus
gtgcttcaattctgccatcttttga

SEQ ID NO: 707158 - DNA, 25 bp, Mus musculus
gtgcttcacaacagttcccagaatc

SEQ ID NO: 707159 - DNA, 25 bp, Mus musculus
gtgcttcacaactgttcccagaatc

SEQ ID NO: 707160 - DNA, 25 bp, Mus musculus
gtgcttcacacaagaaaaactcaaa

SEQ ID NO: 707161 - DNA, 25 bp, Mus musculus
gtgcttcacacatgaaaaactcaaa

SEQ ID NO: 707162 - DNA, 25 bp, Mus musculus
gtgcttcacatgctgagtagccatt

SEQ ID NO: 707163 - DNA, 25 bp, Mus musculus
gtgcttcacatggtgagtagccatt

SEQ ID NO: 707164 - DNA, 25 bp, Mus musculus
gtgcttcaccggcagagagctaaag

SEQ ID NO: 707165 - DNA, 25 bp, Mus musculus
gtgcttcaccgggagagagctaaag

SEQ ID NO: 707166 - DNA, 25 bp, Mus musculus
gtgcttcaccttaggatccttggaa

SEQ ID NO: 707167 - DNA, 25 bp, Mus musculus
gtgcttcacctttggatccttggaa

SEQ ID NO: 707168 - DNA, 25 bp, Mus musculus
gtgcttcacgatctccaacaacaag

SEQ ID NO: 707169 - DNA, 25 bp, Mus musculus
gtgcttcacgatgtccaacaacaag

SEQ ID NO: 707170 - DNA, 25 bp, Mus musculus
gtgcttcacggactgcagagcagca

SEQ ID NO: 707171 - DNA, 25 bp, Mus musculus
gtgcttcacggagtgcagagcagca

SEQ ID NO: 707172 - DNA, 25 bp, Mus musculus
gtgcttcagaccagtcttagagctg

SEQ ID NO: 707173 - DNA, 25 bp, Mus musculus
gtgcttcagacctgtcttagagctg

SEQ ID NO: 707174 - DNA, 25 bp, Mus musculus
gtgcttcaggatatatgcttgccgc

SEQ ID NO: 707175 - DNA, 25 bp, Mus musculus
gtgcttcaggatttatgcttgccgc

SEQ ID NO: 707176 - DNA, 25 bp, Mus musculus
gtgcttcaggccatgaaatcgtttt

SEQ ID NO: 707177 - DNA, 25 bp, Mus musculus
gtgcttcaggccttgaaatcgtttt

SEQ ID NO: 707178 - DNA, 25 bp, Mus musculus
gtgcttcagtctcccaggaaactgg

SEQ ID NO: 707179 - DNA, 25 bp, Mus musculus
gtgcttcagtctgccaggaaactgg

SEQ ID NO: 707180 - DNA, 25 bp, Mus musculus
gtgcttcagtgtctttgcaatcagc

SEQ ID NO: 707181 - DNA, 25 bp, Mus musculus
gtgcttcagtgtgtttgcaatcagc

SEQ ID NO: 707182 - DNA, 25 bp, Mus musculus
gtgcttcagtttcttacctttgtag

SEQ ID NO: 707183 - DNA, 25 bp, Mus musculus
gtgcttcagtttctttagcagaacc

SEQ ID NO: 707184 - DNA, 25 bp, Mus musculus
gtgcttcagtttgttacctttgtag

SEQ ID NO: 707185 - DNA, 25 bp, Mus musculus
gtgcttcagtttgtttagcagaacc

SEQ ID NO: 707186 - DNA, 25 bp, Mus musculus
gtgcttcatatcatgtacctctcta

SEQ ID NO: 707187 - DNA, 25 bp, Mus musculus
gtgcttcatatcttgtacctctcta

SEQ ID NO: 707188 - DNA, 25 bp, Mus musculus
gtgcttcatcatcggactggcaagt

SEQ ID NO: 707189 - DNA, 25 bp, Mus musculus
gtgcttcatcatgggactggcaagt

SEQ ID NO: 707190 - DNA, 25 bp, Mus musculus
gtgcttcatctactagtcacagtaa

SEQ ID NO: 707191 - DNA, 25 bp, Mus musculus
gtgcttcatctagtagtcacagtaa

SEQ ID NO: 707192 - DNA, 25 bp, Mus musculus
gtgcttcatgacaaagactctgaga

SEQ ID NO: 707193 - DNA, 25 bp, Mus musculus
gtgcttcatgactaagactctgaga

SEQ ID NO: 707194 - DNA, 25 bp, Mus musculus
gtgcttcatgcaataggcttttcta

SEQ ID NO: 707195 - DNA, 25 bp, Mus musculus
gtgcttcatgcattaggcttttcta

SEQ ID NO: 707196 - DNA, 25 bp, Mus musculus
gtgcttcattatcttgctgaggcca

SEQ ID NO: 707197 - DNA, 25 bp, Mus musculus
gtgcttcattatgttgctgaggcca

SEQ ID NO: 707198 - DNA, 25 bp, Mus musculus
gtgcttcattgtagtttcttgatta

SEQ ID NO: 707199 - DNA, 25 bp, Mus musculus
gtgcttcattgttgtttcttgatta

SEQ ID NO: 707200 - DNA, 25 bp, Mus musculus
gtgcttccaaagaatcagacactgt

SEQ ID NO: 707201 - DNA, 25 bp, Mus musculus
gtgcttccaaagtatcagacactgt

SEQ ID NO: 707202 - DNA, 25 bp, Mus musculus
gtgcttccaagaccgcagtaaagtg

SEQ ID NO: 707203 - DNA, 25 bp, Mus musculus
gtgcttccaagagcgcagtaaagtg

SEQ ID NO: 707204 - DNA, 25 bp, Mus musculus
gtgcttccaatgagtccaaggaatt

SEQ ID NO: 707205 - DNA, 25 bp, Mus musculus
gtgcttccaatgtgtccaaggaatt

SEQ ID NO: 707206 - DNA, 25 bp, Mus musculus
gtgcttccacccagaggtcacatgg

SEQ ID NO: 707207 - DNA, 25 bp, Mus musculus
gtgcttccaccctgaggtcacatgg

SEQ ID NO: 707208 - DNA, 25 bp, Mus musculus
gtgcttccagtcattagttggtcct

SEQ ID NO: 707209 - DNA, 25 bp, Mus musculus
gtgcttccagtctttagttggtcct

SEQ ID NO: 707210 - DNA, 25 bp, Mus musculus
gtgcttcccaacactgactgttcag

SEQ ID NO: 707211 - DNA, 25 bp, Mus musculus
gtgcttcccaacaggatcggaggag

SEQ ID NO: 707212 - DNA, 25 bp, Mus musculus
gtgcttcccaactctgactgttcag

SEQ ID NO: 707213 - DNA, 25 bp, Mus musculus
gtgcttcccaactggatcggaggag

SEQ ID NO: 707214 - DNA, 25 bp, Mus musculus
gtgcttcccgaactaatagaactct

SEQ ID NO: 707215 - DNA, 25 bp, Mus musculus
gtgcttcccgaagtaatagaactct

SEQ ID NO: 707216 - DNA, 25 bp, Mus musculus
gtgcttcccgcgcagtgtaagactc

SEQ ID NO: 707217 - DNA, 25 bp, Mus musculus
gtgcttcccgcggagtgtaagactc

SEQ ID NO: 707218 - DNA, 25 bp, Mus musculus
gtgcttccctccctcgtgggaaata

SEQ ID NO: 707219 - DNA, 25 bp, Mus musculus
gtgcttccctccgtcgtgggaaata

SEQ ID NO: 707220 - DNA, 25 bp, Mus musculus
gtgcttccctctagtggtacaagaa

SEQ ID NO: 707221 - DNA, 25 bp, Mus musculus
gtgcttccctcttgtggtacaagaa

SEQ ID NO: 707222 - DNA, 25 bp, Mus musculus
gtgcttccggcactacgcgaaggac

SEQ ID NO: 707223 - DNA, 25 bp, Mus musculus
gtgcttccggcagtacgcgaaggac

SEQ ID NO: 707224 - DNA, 25 bp, Mus musculus
gtgcttccgggacggccatgataac

SEQ ID NO: 707225 - DNA, 25 bp, Mus musculus
gtgcttccgggagggccatgataac

SEQ ID NO: 707226 - DNA, 25 bp, Mus musculus
gtgcttcctagcaatgttctgaaca

SEQ ID NO: 707227 - DNA, 25 bp, Mus musculus
gtgcttcctagctatgttctgaaca

SEQ ID NO: 707228 - DNA, 25 bp, Mus musculus
gtgcttcctgtcactagaatgtttt

SEQ ID NO: 707229 - DNA, 25 bp, Mus musculus
gtgcttcctgtctctagaatgtttt

SEQ ID NO: 707230 - DNA, 25 bp, Mus musculus
gtgcttcctgtgaagtcaccaaggt

SEQ ID NO: 707231 - DNA, 25 bp, Mus musculus
gtgcttcctgtgtagtcaccaaggt

SEQ ID NO: 707232 - DNA, 25 bp, Mus musculus
gtgcttccttcacattgtacatgct

SEQ ID NO: 707233 - DNA, 25 bp, Mus musculus
gtgcttccttcacgtttactttaag

SEQ ID NO: 707234 - DNA, 25 bp, Mus musculus
gtgcttccttcagattgtacatgct

SEQ ID NO: 707235 - DNA, 25 bp, Mus musculus
gtgcttccttcaggtttactttaag

SEQ ID NO: 707236 - DNA, 25 bp, Mus musculus
gtgcttccttctcatgtcatgatgc

SEQ ID NO: 707237 - DNA, 25 bp, Mus musculus
gtgcttccttctgatgtcatgatgc

SEQ ID NO: 707238 - DNA, 25 bp, Mus musculus
gtgcttcgaaggatgagacttcttc

SEQ ID NO: 707239 - DNA, 25 bp, Mus musculus
gtgcttcgaaggttgagacttcttc

SEQ ID NO: 707240 - DNA, 25 bp, Mus musculus
gtgcttcggctgatcccatattgga

SEQ ID NO: 707241 - DNA, 25 bp, Mus musculus
gtgcttcggctgttcccatattgga

SEQ ID NO: 707242 - DNA, 25 bp, Mus musculus
gtgcttctaaacaggattcatttca

SEQ ID NO: 707243 - DNA, 25 bp, Mus musculus
gtgcttctaaactggattcatttca

SEQ ID NO: 707244 - DNA, 25 bp, Mus musculus
gtgcttctagtcattttggcaacta

SEQ ID NO: 707245 - DNA, 25 bp, Mus musculus
gtgcttctagtctttttggcaacta

SEQ ID NO: 707246 - DNA, 25 bp, Mus musculus
gtgcttctattgacactgcaattgt

SEQ ID NO: 707247 - DNA, 25 bp, Mus musculus
gtgcttctattgtcactgcaattgt

SEQ ID NO: 707248 - DNA, 25 bp, Mus musculus
gtgcttctcaggcaacatcatcagc

SEQ ID NO: 707249 - DNA, 25 bp, Mus musculus
gtgcttctcagggaacatcatcagc

SEQ ID NO: 707250 - DNA, 25 bp, Mus musculus
gtgcttctctaaagggacttaccca

SEQ ID NO: 707251 - DNA, 25 bp, Mus musculus
gtgcttctctaatgggacttaccca

SEQ ID NO: 707252 - DNA, 25 bp, Mus musculus
gtgcttctctccatggtgctagggc

SEQ ID NO: 707253 - DNA, 25 bp, Mus musculus
gtgcttctctccttggtgctagggc

SEQ ID NO: 707254 - DNA, 25 bp, Mus musculus
gtgcttctcttcactactagcagag

SEQ ID NO: 707255 - DNA, 25 bp, Mus musculus
gtgcttctcttctctactagcagag

SEQ ID NO: 707256 - DNA, 25 bp, Mus musculus
gtgcttctgaacctgtacaacacta

SEQ ID NO: 707257 - DNA, 25 bp, Mus musculus
gtgcttctgaacgtgtacaacacta

SEQ ID NO: 707258 - DNA, 25 bp, Mus musculus
gtgcttctgctacgatcaatgtgta

SEQ ID NO: 707259 - DNA, 25 bp, Mus musculus
gtgcttctgctaggatcaatgtgta

SEQ ID NO: 707260 - DNA, 25 bp, Mus musculus
gtgcttctggaaatcacactgaatg

SEQ ID NO: 707261 - DNA, 25 bp, Mus musculus
gtgcttctggaattcacactgaatg

SEQ ID NO: 707262 - DNA, 25 bp, Mus musculus
gtgcttctgggcacagtcaacactc

SEQ ID NO: 707263 - DNA, 25 bp, Mus musculus
gtgcttctgggctcagtcaacactc

SEQ ID NO: 707264 - DNA, 25 bp, Mus musculus
gtgcttctgtacctttaagtcctgg

SEQ ID NO: 707265 - DNA, 25 bp, Mus musculus
gtgcttctgtacgtttaagtcctgg

SEQ ID NO: 707266 - DNA, 25 bp, Mus musculus
gtgcttctgtagataatgtctgtgg

SEQ ID NO: 707267 - DNA, 25 bp, Mus musculus
gtgcttctgtagttaatgtctgtgg

SEQ ID NO: 707268 - DNA, 25 bp, Mus musculus
gtgcttcttactaactgatatccag

SEQ ID NO: 707269 - DNA, 25 bp, Mus musculus
gtgcttcttactaagcgtcatgaat

SEQ ID NO: 707270 - DNA, 25 bp, Mus musculus
gtgcttcttacttactgatatccag

SEQ ID NO: 707271 - DNA, 25 bp, Mus musculus
gtgcttcttacttagcgtcatgaat

SEQ ID NO: 707272 - DNA, 25 bp, Mus musculus
gtgcttcttcaactacagtgaccta

SEQ ID NO: 707273 - DNA, 25 bp, Mus musculus
gtgcttcttcaagtacagtgaccta

SEQ ID NO: 707274 - DNA, 25 bp, Mus musculus
gtgcttcttcttattgtctgccatt

SEQ ID NO: 707275 - DNA, 25 bp, Mus musculus
gtgcttcttctttttgtctgccatt

SEQ ID NO: 707276 - DNA, 25 bp, Mus musculus
gtgcttcttttgaccagacaatacg

SEQ ID NO: 707277 - DNA, 25 bp, Mus musculus
gtgcttcttttgacttgataacggt

SEQ ID NO: 707278 - DNA, 25 bp, Mus musculus
gtgcttcttttgtccagacaatacg

SEQ ID NO: 707279 - DNA, 25 bp, Mus musculus
gtgcttcttttgtcttgataacggt

SEQ ID NO: 707280 - DNA, 25 bp, Mus musculus
gtgcttgaagatcgtctttggcctt

SEQ ID NO: 707281 - DNA, 25 bp, Mus musculus
gtgcttgaagatggtctttggcctt

SEQ ID NO: 707282 - DNA, 25 bp, Mus musculus
gtgcttgaagtcctacagaaacatt

SEQ ID NO: 707283 - DNA, 25 bp, Mus musculus
gtgcttgaagtcgtacagaaacatt

SEQ ID NO: 707284 - DNA, 25 bp, Mus musculus
gtgcttgaagtgcataaggacctga

SEQ ID NO: 707285 - DNA, 25 bp, Mus musculus
gtgcttgaagtggataaggacctga

SEQ ID NO: 707286 - DNA, 25 bp, Mus musculus
gtgcttgaatttagccaggctcctc

SEQ ID NO: 707287 - DNA, 25 bp, Mus musculus
gtgcttgaattttgccaggctcctc

SEQ ID NO: 707288 - DNA, 25 bp, Mus musculus
gtgcttgaccgtcctggaaacccat

SEQ ID NO: 707289 - DNA, 25 bp, Mus musculus
gtgcttgaccgtccttgaccatgat

SEQ ID NO: 707290 - DNA, 25 bp, Mus musculus
gtgcttgaccgtgctggaaacccat

SEQ ID NO: 707291 - DNA, 25 bp, Mus musculus
gtgcttgaccgtgcttgaccatgat

SEQ ID NO: 707292 - DNA, 25 bp, Mus musculus
gtgcttgactatattgttcgtaact

SEQ ID NO: 707293 - DNA, 25 bp, Mus musculus
gtgcttgactattttgttcgtaact

SEQ ID NO: 707294 - DNA, 25 bp, Mus musculus
gtgcttgagcaaacacaaccttgtc

SEQ ID NO: 707295 - DNA, 25 bp, Mus musculus
gtgcttgagcaatcacaaccttgtc

SEQ ID NO: 707296 - DNA, 25 bp, Mus musculus
gtgcttgatcatcctgtgcctgtgg

SEQ ID NO: 707297 - DNA, 25 bp, Mus musculus
gtgcttgatcatgctgtgcctgtgg

SEQ ID NO: 707298 - DNA, 25 bp, Mus musculus
gtgcttgatcctcagggtttcacaa

SEQ ID NO: 707299 - DNA, 25 bp, Mus musculus
gtgcttgatcctgagggtttcacaa

SEQ ID NO: 707300 - DNA, 25 bp, Mus musculus
gtgcttgcaagtccatcggcagaca

SEQ ID NO: 707301 - DNA, 25 bp, Mus musculus
gtgcttgcaagtgcatcggcagaca

SEQ ID NO: 707302 - DNA, 25 bp, Mus musculus
gtgcttgcacacagtagtgaccaca

SEQ ID NO: 707303 - DNA, 25 bp, Mus musculus
gtgcttgcacactgtagtgaccaca

SEQ ID NO: 707304 - DNA, 25 bp, Mus musculus
gtgcttgcagcaagacctaaattca

SEQ ID NO: 707305 - DNA, 25 bp, Mus musculus
gtgcttgcagcacgaaattactcct

SEQ ID NO: 707306 - DNA, 25 bp, Mus musculus
gtgcttgcagcaggaaattactcct

SEQ ID NO: 707307 - DNA, 25 bp, Mus musculus
gtgcttgcagcatgacctaaattca

SEQ ID NO: 707308 - DNA, 25 bp, Mus musculus
gtgcttgcagtaacatctcagcagt

SEQ ID NO: 707309 - DNA, 25 bp, Mus musculus
gtgcttgcagtatcatctcagcagt

SEQ ID NO: 707310 - DNA, 25 bp, Mus musculus
gtgcttgcatctcaggctagacact

SEQ ID NO: 707311 - DNA, 25 bp, Mus musculus
gtgcttgcatctgaggctagacact

SEQ ID NO: 707312 - DNA, 25 bp, Mus musculus
gtgcttgccaacatgtagaacacag

SEQ ID NO: 707313 - DNA, 25 bp, Mus musculus
gtgcttgccaacttgtagaacacag

SEQ ID NO: 707314 - DNA, 25 bp, Mus musculus
gtgcttgccaagcaaagaccaccaa

SEQ ID NO: 707315 - DNA, 25 bp, Mus musculus
gtgcttgccaaggaaagaccaccaa

SEQ ID NO: 707316 - DNA, 25 bp, Mus musculus
gtgcttgccagacagaatacccaga

SEQ ID NO: 707317 - DNA, 25 bp, Mus musculus
gtgcttgccagagagaatacccaga

SEQ ID NO: 707318 - DNA, 25 bp, Mus musculus
gtgcttgcctcacatcagctgatag

SEQ ID NO: 707319 - DNA, 25 bp, Mus musculus
gtgcttgcctcagatcagctgatag

SEQ ID NO: 707320 - DNA, 25 bp, Mus musculus
gtgcttgcggtgctgttacccctca

SEQ ID NO: 707321 - DNA, 25 bp, Mus musculus
gtgcttgcggtggtgttacccctca

SEQ ID NO: 707322 - DNA, 25 bp, Mus musculus
gtgcttgctcaacttcccaaatatg

SEQ ID NO: 707323 - DNA, 25 bp, Mus musculus
gtgcttgctcaagttcccaaatatg

SEQ ID NO: 707324 - DNA, 25 bp, Mus musculus
gtgcttgctgggaagacttttcatc

SEQ ID NO: 707325 - DNA, 25 bp, Mus musculus
gtgcttgctgggtagacttttcatc

SEQ ID NO: 707326 - DNA, 25 bp, Mus musculus
gtgcttgctgtacaactctgacaac

SEQ ID NO: 707327 - DNA, 25 bp, Mus musculus
gtgcttgctgtagaactctgacaac

SEQ ID NO: 707328 - DNA, 25 bp, Mus musculus
gtgcttgcttctctccagcaataaa

SEQ ID NO: 707329 - DNA, 25 bp, Mus musculus
gtgcttgcttctgtccagcaataaa

SEQ ID NO: 707330 - DNA, 25 bp, Mus musculus
gtgcttgcttgacggctcaccttct

SEQ ID NO: 707331 - DNA, 25 bp, Mus musculus
gtgcttgcttgagggctcaccttct

SEQ ID NO: 707332 - DNA, 25 bp, Mus musculus
gtgcttggaagaacaggtcatgctc

SEQ ID NO: 707333 - DNA, 25 bp, Mus musculus
gtgcttggaagatcaggtcatgctc

SEQ ID NO: 707334 - DNA, 25 bp, Mus musculus
gtgcttggagtgatcttcctaataa

SEQ ID NO: 707335 - DNA, 25 bp, Mus musculus
gtgcttggagtgttcttcctaataa

SEQ ID NO: 707336 - DNA, 25 bp, Mus musculus
gtgcttggatataattgagcaacca

SEQ ID NO: 707337 - DNA, 25 bp, Mus musculus
gtgcttggatattattgagcaacca

SEQ ID NO: 707338 - DNA, 25 bp, Mus musculus
gtgcttggatcaccccactgtacca

SEQ ID NO: 707339 - DNA, 25 bp, Mus musculus
gtgcttggatcagcccactgtacca

SEQ ID NO: 707340 - DNA, 25 bp, Mus musculus
gtgcttggcaagcactggatttagt

SEQ ID NO: 707341 - DNA, 25 bp, Mus musculus
gtgcttggcaaggactggatttagt

SEQ ID NO: 707342 - DNA, 25 bp, Mus musculus
gtgcttggcagacacagaacgcaat

SEQ ID NO: 707343 - DNA, 25 bp, Mus musculus
gtgcttggcagagacagaacgcaat

SEQ ID NO: 707344 - DNA, 25 bp, Mus musculus
gtgcttggcatgacgttattttcca

SEQ ID NO: 707345 - DNA, 25 bp, Mus musculus
gtgcttggcatgtcgttattttcca

SEQ ID NO: 707346 - DNA, 25 bp, Mus musculus
gtgcttggccctccgtgagaaagca

SEQ ID NO: 707347 - DNA, 25 bp, Mus musculus
gtgcttggccctgcgtgagaaagca

SEQ ID NO: 707348 - DNA, 25 bp, Mus musculus
gtgcttggctgccattgtgaacctc

SEQ ID NO: 707349 - DNA, 25 bp, Mus musculus
gtgcttggctgcgattgtgaacctc

SEQ ID NO: 707350 - DNA, 25 bp, Mus musculus
gtgcttgggaataggttttgccaat

SEQ ID NO: 707351 - DNA, 25 bp, Mus musculus
gtgcttgggaattggttttgccaat

SEQ ID NO: 707352 - DNA, 25 bp, Mus musculus
gtgcttgggagaacagaccatgtgc

SEQ ID NO: 707353 - DNA, 25 bp, Mus musculus
gtgcttgggagatcagaccatgtgc

SEQ ID NO: 707354 - DNA, 25 bp, Mus musculus
gtgcttgggcatcaggttagtttta

SEQ ID NO: 707355 - DNA, 25 bp, Mus musculus
gtgcttgggcatgaggttagtttta

SEQ ID NO: 707356 - DNA, 25 bp, Mus musculus
gtgcttgggctcacaactctcatgg

SEQ ID NO: 707357 - DNA, 25 bp, Mus musculus
gtgcttgggctctcaactctcatgg

SEQ ID NO: 707358 - DNA, 25 bp, Mus musculus
gtgcttgggtcactttcagatcttc

SEQ ID NO: 707359 - DNA, 25 bp, Mus musculus
gtgcttgggtcagtttcagatcttc

SEQ ID NO: 707360 - DNA, 25 bp, Mus musculus
gtgcttggtatgaaacattcaggtt

SEQ ID NO: 707361 - DNA, 25 bp, Mus musculus
gtgcttggtatgtaacattcaggtt

SEQ ID NO: 707362 - DNA, 25 bp, Mus musculus
gtgcttggtgtgaacccctgaagac

SEQ ID NO: 707363 - DNA, 25 bp, Mus musculus
gtgcttggtgtgtacccctgaagac

SEQ ID NO: 707364 - DNA, 25 bp, Mus musculus
gtgcttggttttagatttgtgggtt

SEQ ID NO: 707365 - DNA, 25 bp, Mus musculus
gtgcttggtttttgatttgtgggtt

SEQ ID NO: 707366 - DNA, 25 bp, Mus musculus
gtgcttgtaagcagacctgtaggtg

SEQ ID NO: 707367 - DNA, 25 bp, Mus musculus
gtgcttgtaagctgacctgtaggtg

SEQ ID NO: 707368 - DNA, 25 bp, Mus musculus
gtgcttgtaatgcaggtctcatctc

SEQ ID NO: 707369 - DNA, 25 bp, Mus musculus
gtgcttgtaatggaggtctcatctc

SEQ ID NO: 707370 - DNA, 25 bp, Mus musculus
gtgcttgtatgtaagtgcagaccta

SEQ ID NO: 707371 - DNA, 25 bp, Mus musculus
gtgcttgtatgttagtgcagaccta

SEQ ID NO: 707372 - DNA, 25 bp, Mus musculus
gtgcttgtcaacaggagactttttc

SEQ ID NO: 707373 - DNA, 25 bp, Mus musculus
gtgcttgtcaactggagactttttc

SEQ ID NO: 707374 - DNA, 25 bp, Mus musculus
gtgcttgtcactcccaaatggccca

SEQ ID NO: 707375 - DNA, 25 bp, Mus musculus
gtgcttgtcactgccaaatggccca

SEQ ID NO: 707376 - DNA, 25 bp, Mus musculus
gtgcttgtcataatctgggaattac

SEQ ID NO: 707377 - DNA, 25 bp, Mus musculus
gtgcttgtcatattctgggaattac

SEQ ID NO: 707378 - DNA, 25 bp, Mus musculus
gtgcttgtcatcatcagtttcttag

SEQ ID NO: 707379 - DNA, 25 bp, Mus musculus
gtgcttgtcatcttcagtttcttag

SEQ ID NO: 707380 - DNA, 25 bp, Mus musculus
gtgcttgtccatccatcacagattt

SEQ ID NO: 707381 - DNA, 25 bp, Mus musculus
gtgcttgtccatgcatcacagattt

SEQ ID NO: 707382 - DNA, 25 bp, Mus musculus
gtgcttgtcgtcaatttattaggta

SEQ ID NO: 707383 - DNA, 25 bp, Mus musculus
gtgcttgtcgtctatttattaggta

SEQ ID NO: 707384 - DNA, 25 bp, Mus musculus
gtgcttgtctaaagtctgctctgaa

SEQ ID NO: 707385 - DNA, 25 bp, Mus musculus
gtgcttgtctaatgtctgctctgaa

SEQ ID NO: 707386 - DNA, 25 bp, Mus musculus
gtgcttgtgagcaatcttaattcta

SEQ ID NO: 707387 - DNA, 25 bp, Mus musculus
gtgcttgtgagctatcttaattcta

SEQ ID NO: 707388 - DNA, 25 bp, Mus musculus
gtgcttgtgcttcatgactgtgtgt

SEQ ID NO: 707389 - DNA, 25 bp, Mus musculus
gtgcttgtgcttgatgactgtgtgt

SEQ ID NO: 707390 - DNA, 25 bp, Mus musculus
gtgcttgtggcaatccctccatcat

SEQ ID NO: 707391 - DNA, 25 bp, Mus musculus
gtgcttgtggcattccctccatcat

SEQ ID NO: 707392 - DNA, 25 bp, Mus musculus
gtgcttgtggctcaccttagcctca

SEQ ID NO: 707393 - DNA, 25 bp, Mus musculus
gtgcttgtggctgaccttagcctca

SEQ ID NO: 707394 - DNA, 25 bp, Mus musculus
gtgcttgtggtaactggactctctg

SEQ ID NO: 707395 - DNA, 25 bp, Mus musculus
gtgcttgtggtatctggactctctg

SEQ ID NO: 707396 - DNA, 25 bp, Mus musculus
gtgcttgtgtctatctttcccggga

SEQ ID NO: 707397 - DNA, 25 bp, Mus musculus
gtgcttgtgtctttctttcccggga

SEQ ID NO: 707398 - DNA, 25 bp, Mus musculus
gtgcttgttaataaattgccatcat

SEQ ID NO: 707399 - DNA, 25 bp, Mus musculus
gtgcttgttaattaattgccatcat

SEQ ID NO: 707400 - DNA, 25 bp, Mus musculus
gtgcttgttggaacttagttgtttc

SEQ ID NO: 707401 - DNA, 25 bp, Mus musculus
gtgcttgttggatcttagttgtttc

SEQ ID NO: 707402 - DNA, 25 bp, Mus musculus
gtgcttgttggcacctgagacctgg

SEQ ID NO: 707403 - DNA, 25 bp, Mus musculus
gtgcttgttggctcctgagacctgg

SEQ ID NO: 707404 - DNA, 25 bp, Mus musculus
gtgcttgtttagctctgaatcggga

SEQ ID NO: 707405 - DNA, 25 bp, Mus musculus
gtgcttgtttaggtctgaatcggga

SEQ ID NO: 707406 - DNA, 25 bp, Mus musculus
gtgctttaaaacaactcataattct

SEQ ID NO: 707407 - DNA, 25 bp, Mus musculus
gtgctttaaaactactcataattct

SEQ ID NO: 707408 - DNA, 25 bp, Mus musculus
gtgctttaagacctggaactttctc

SEQ ID NO: 707409 - DNA, 25 bp, Mus musculus
gtgctttaagacgtggaactttctc

SEQ ID NO: 707410 - DNA, 25 bp, Mus musculus
gtgctttaccgtagtgacttctcaa

SEQ ID NO: 707411 - DNA, 25 bp, Mus musculus
gtgctttaccgttgtgacttctcaa

SEQ ID NO: 707412 - DNA, 25 bp, Mus musculus
gtgctttaccttcaaaagcagtctt

SEQ ID NO: 707413 - DNA, 25 bp, Mus musculus
gtgctttaccttgaaaagcagtctt

SEQ ID NO: 707414 - DNA, 25 bp, Mus musculus
gtgctttactccaggagaacatcat

SEQ ID NO: 707415 - DNA, 25 bp, Mus musculus
gtgctttactcctggagaacatcat

SEQ ID NO: 707416 - DNA, 25 bp, Mus musculus
gtgctttactctagtgctctaagga

SEQ ID NO: 707417 - DNA, 25 bp, Mus musculus
gtgctttactcttgtgctctaagga

SEQ ID NO: 707418 - DNA, 25 bp, Mus musculus
gtgctttagcaacttgagccacctc

SEQ ID NO: 707419 - DNA, 25 bp, Mus musculus
gtgctttagcaagttgagccacctc

SEQ ID NO: 707420 - DNA, 25 bp, Mus musculus
gtgctttagggcatgctgtgtcctt

SEQ ID NO: 707421 - DNA, 25 bp, Mus musculus
gtgctttagggcttgctgtgtcctt

SEQ ID NO: 707422 - DNA, 25 bp, Mus musculus
gtgctttatccaaagctttcacaag

SEQ ID NO: 707423 - DNA, 25 bp, Mus musculus
gtgctttatccatagctttcacaag

SEQ ID NO: 707424 - DNA, 25 bp, Mus musculus
gtgctttatgcaaaccaaacagcct

SEQ ID NO: 707425 - DNA, 25 bp, Mus musculus
gtgctttatgcacatgtacggtttc

SEQ ID NO: 707426 - DNA, 25 bp, Mus musculus
gtgctttatgcagatgtacggtttc

SEQ ID NO: 707427 - DNA, 25 bp, Mus musculus
gtgctttatgcataccaaacagcct

SEQ ID NO: 707428 - DNA, 25 bp, Mus musculus
gtgctttatggcaggcgcaaactcg

SEQ ID NO: 707429 - DNA, 25 bp, Mus musculus
gtgctttatggctggcgcaaactcg

SEQ ID NO: 707430 - DNA, 25 bp, Mus musculus
gtgctttatggtaaatcctacagtc

SEQ ID NO: 707431 - DNA, 25 bp, Mus musculus
gtgctttatggttaatcctacagtc

SEQ ID NO: 707432 - DNA, 25 bp, Mus musculus
gtgctttatgtgaatccattcttga

SEQ ID NO: 707433 - DNA, 25 bp, Mus musculus
gtgctttatgtgtatccattcttga

SEQ ID NO: 707434 - DNA, 25 bp, Mus musculus
gtgctttattcgattattatgcttt

SEQ ID NO: 707435 - DNA, 25 bp, Mus musculus
gtgctttattcgtttattatgcttt

SEQ ID NO: 707436 - DNA, 25 bp, Mus musculus
gtgctttatttaaaggctcccgact

SEQ ID NO: 707437 - DNA, 25 bp, Mus musculus
gtgctttatttataggctcccgact

SEQ ID NO: 707438 - DNA, 25 bp, Mus musculus
gtgctttcaaagctgccccgttgaa

SEQ ID NO: 707439 - DNA, 25 bp, Mus musculus
gtgctttcaaaggtgccccgttgaa

SEQ ID NO: 707440 - DNA, 25 bp, Mus musculus
gtgctttcaagcatcctggatacca

SEQ ID NO: 707441 - DNA, 25 bp, Mus musculus
gtgctttcaagcttcctggatacca

SEQ ID NO: 707442 - DNA, 25 bp, Mus musculus
gtgctttcaatgcagcctgcgagct

SEQ ID NO: 707443 - DNA, 25 bp, Mus musculus
gtgctttcaatggagcctgcgagct

SEQ ID NO: 707444 - DNA, 25 bp, Mus musculus
gtgctttcagttacagtagtatttc

SEQ ID NO: 707445 - DNA, 25 bp, Mus musculus
gtgctttcagttctgcacttaccaa

SEQ ID NO: 707446 - DNA, 25 bp, Mus musculus
gtgctttcagttgtgcacttaccaa

SEQ ID NO: 707447 - DNA, 25 bp, Mus musculus
gtgctttcagtttcagtagtatttc

SEQ ID NO: 707448 - DNA, 25 bp, Mus musculus
gtgctttcatggcataggcctgacg

SEQ ID NO: 707449 - DNA, 25 bp, Mus musculus
gtgctttcatgggataggcctgacg

SEQ ID NO: 707450 - DNA, 25 bp, Mus musculus
gtgctttccagcagtgtttgtgtca

SEQ ID NO: 707451 - DNA, 25 bp, Mus musculus
gtgctttccagctgtgtttgtgtca

SEQ ID NO: 707452 - DNA, 25 bp, Mus musculus
gtgctttccataaggaccatgttaa

SEQ ID NO: 707453 - DNA, 25 bp, Mus musculus
gtgctttccatatggaccatgttaa

SEQ ID NO: 707454 - DNA, 25 bp, Mus musculus
gtgctttccatgactgtaatatata

SEQ ID NO: 707455 - DNA, 25 bp, Mus musculus
gtgctttccatgtctgtaatatata

SEQ ID NO: 707456 - DNA, 25 bp, Mus musculus
gtgctttcccagacataatctatag

SEQ ID NO: 707457 - DNA, 25 bp, Mus musculus
gtgctttcccagtcataatctatag

SEQ ID NO: 707458 - DNA, 25 bp, Mus musculus
gtgctttcctggcattcgtgaggcc

SEQ ID NO: 707459 - DNA, 25 bp, Mus musculus
gtgctttcctgggattcgtgaggcc

SEQ ID NO: 707460 - DNA, 25 bp, Mus musculus
gtgctttccttaaaaacatgctgat

SEQ ID NO: 707461 - DNA, 25 bp, Mus musculus
gtgctttccttataaacatgctgat

SEQ ID NO: 707462 - DNA, 25 bp, Mus musculus
gtgctttccttcatagttgagacca

SEQ ID NO: 707463 - DNA, 25 bp, Mus musculus
gtgctttccttcttagttgagacca

SEQ ID NO: 707464 - DNA, 25 bp, Mus musculus
gtgctttcgcaaagcatggtatcca

SEQ ID NO: 707465 - DNA, 25 bp, Mus musculus
gtgctttcgcaatgcatggtatcca

SEQ ID NO: 707466 - DNA, 25 bp, Mus musculus
gtgctttctaatagccattgccttc

SEQ ID NO: 707467 - DNA, 25 bp, Mus musculus
gtgctttctaattgccattgccttc

SEQ ID NO: 707468 - DNA, 25 bp, Mus musculus
gtgctttctaggcatgagcagtgca

SEQ ID NO: 707469 - DNA, 25 bp, Mus musculus
gtgctttctagggatgagcagtgca

SEQ ID NO: 707470 - DNA, 25 bp, Mus musculus
gtgctttctagtcttctgtttccaa

SEQ ID NO: 707471 - DNA, 25 bp, Mus musculus
gtgctttctagtgttctgtttccaa

SEQ ID NO: 707472 - DNA, 25 bp, Mus musculus
gtgctttctattatcgggaagagtt

SEQ ID NO: 707473 - DNA, 25 bp, Mus musculus
gtgctttctattttcgggaagagtt

SEQ ID NO: 707474 - DNA, 25 bp, Mus musculus
gtgctttctcagctcaaattggagt

SEQ ID NO: 707475 - DNA, 25 bp, Mus musculus
gtgctttctcaggtcaaattggagt

SEQ ID NO: 707476 - DNA, 25 bp, Mus musculus
gtgctttctcctcttctttaattat

SEQ ID NO: 707477 - DNA, 25 bp, Mus musculus
gtgctttctcctgttctttaattat

SEQ ID NO: 707478 - DNA, 25 bp, Mus musculus
gtgctttctgagaacttcgtacgga

SEQ ID NO: 707479 - DNA, 25 bp, Mus musculus
gtgctttctgagtacttcgtacgga

SEQ ID NO: 707480 - DNA, 25 bp, Mus musculus
gtgctttctggacccacatatacta

SEQ ID NO: 707481 - DNA, 25 bp, Mus musculus
gtgctttctggagccacatatacta

SEQ ID NO: 707482 - DNA, 25 bp, Mus musculus
gtgctttcttgcacgtatcttttaa

SEQ ID NO: 707483 - DNA, 25 bp, Mus musculus
gtgctttcttgctcgtatcttttaa

SEQ ID NO: 707484 - DNA, 25 bp, Mus musculus
gtgctttcttgtaatcatgggccat

SEQ ID NO: 707485 - DNA, 25 bp, Mus musculus
gtgctttcttgttatcatgggccat

SEQ ID NO: 707486 - DNA, 25 bp, Mus musculus
gtgctttgaacaccttcccttgcct

SEQ ID NO: 707487 - DNA, 25 bp, Mus musculus
gtgctttgaacagcttcccttgcct

SEQ ID NO: 707488 - DNA, 25 bp, Mus musculus
gtgctttgaactagatgctcactca

SEQ ID NO: 707489 - DNA, 25 bp, Mus musculus
gtgctttgaacttgatgctcactca

SEQ ID NO: 707490 - DNA, 25 bp, Mus musculus
gtgctttgacaactaaagggtttgt

SEQ ID NO: 707491 - DNA, 25 bp, Mus musculus
gtgctttgacaagtaaagggtttgt

SEQ ID NO: 707492 - DNA, 25 bp, Mus musculus
gtgctttgactaagctgagcgagct

SEQ ID NO: 707493 - DNA, 25 bp, Mus musculus
gtgctttgactatgctgagcgagct

SEQ ID NO: 707494 - DNA, 25 bp, Mus musculus
gtgctttgagccatgtcttccttca

SEQ ID NO: 707495 - DNA, 25 bp, Mus musculus
gtgctttgagccttgtcttccttca

SEQ ID NO: 707496 - DNA, 25 bp, Mus musculus
gtgctttgataaatcttggttcccc

SEQ ID NO: 707497 - DNA, 25 bp, Mus musculus
gtgctttgataattcttggttcccc

SEQ ID NO: 707498 - DNA, 25 bp, Mus musculus
gtgctttgatgaagtaatacctaat

SEQ ID NO: 707499 - DNA, 25 bp, Mus musculus
gtgctttgatgatgtaatacctaat

SEQ ID NO: 707500 - DNA, 25 bp, Mus musculus
gtgctttgcaagacagatcttccct

SEQ ID NO: 707501 - DNA, 25 bp, Mus musculus
gtgctttgcaagtcagatcttccct

SEQ ID NO: 707502 - DNA, 25 bp, Mus musculus
gtgctttgcacacagccagagacct

SEQ ID NO: 707503 - DNA, 25 bp, Mus musculus
gtgctttgcacagagccagagacct

SEQ ID NO: 707504 - DNA, 25 bp, Mus musculus
gtgctttgcattaccaggaggtttc

SEQ ID NO: 707505 - DNA, 25 bp, Mus musculus
gtgctttgcattctcaagctgtcaa

SEQ ID NO: 707506 - DNA, 25 bp, Mus musculus
gtgctttgcattgtcaagctgtcaa

SEQ ID NO: 707507 - DNA, 25 bp, Mus musculus
gtgctttgcatttccaggaggtttc

SEQ ID NO: 707508 - DNA, 25 bp, Mus musculus
gtgctttgccataattaactatcag

SEQ ID NO: 707509 - DNA, 25 bp, Mus musculus
gtgctttgccattattaactatcag

SEQ ID NO: 707510 - DNA, 25 bp, Mus musculus
gtgctttgccctctgtgtatatctg

SEQ ID NO: 707511 - DNA, 25 bp, Mus musculus
gtgctttgccctgtgtgtatatctg

SEQ ID NO: 707512 - DNA, 25 bp, Mus musculus
gtgctttgcggcacttgcggtacta

SEQ ID NO: 707513 - DNA, 25 bp, Mus musculus
gtgctttgcggctcttgcggtacta

SEQ ID NO: 707514 - DNA, 25 bp, Mus musculus
gtgctttgctaaaccatgtactagt

SEQ ID NO: 707515 - DNA, 25 bp, Mus musculus
gtgctttgctaatccatgtactagt

SEQ ID NO: 707516 - DNA, 25 bp, Mus musculus
gtgctttgctctcgtgcccgggact

SEQ ID NO: 707517 - DNA, 25 bp, Mus musculus
gtgctttgctctggtgcccgggact

SEQ ID NO: 707518 - DNA, 25 bp, Mus musculus
gtgctttgctgacagtcactcctac

SEQ ID NO: 707519 - DNA, 25 bp, Mus musculus
gtgctttgctgagagtcactcctac

SEQ ID NO: 707520 - DNA, 25 bp, Mus musculus
gtgctttggagtaagtttaccctct

SEQ ID NO: 707521 - DNA, 25 bp, Mus musculus
gtgctttggagtacttgttgcgctt

SEQ ID NO: 707522 - DNA, 25 bp, Mus musculus
gtgctttggagttagtttaccctct

SEQ ID NO: 707523 - DNA, 25 bp, Mus musculus
gtgctttggagttcttgttgcgctt

SEQ ID NO: 707524 - DNA, 25 bp, Mus musculus
gtgctttggcataccttactggaat

SEQ ID NO: 707525 - DNA, 25 bp, Mus musculus
gtgctttggcattccttactggaat

SEQ ID NO: 707526 - DNA, 25 bp, Mus musculus
gtgctttgggtaagatatacaccat

SEQ ID NO: 707527 - DNA, 25 bp, Mus musculus
gtgctttgggtatgatatacaccat

SEQ ID NO: 707528 - DNA, 25 bp, Mus musculus
gtgctttgtaaaagcctttttcctt

SEQ ID NO: 707529 - DNA, 25 bp, Mus musculus
gtgctttgtaaatgcctttttcctt

SEQ ID NO: 707530 - DNA, 25 bp, Mus musculus
gtgctttgtagaaatgtctctgtca

SEQ ID NO: 707531 - DNA, 25 bp, Mus musculus
gtgctttgtagatatgtctctgtca

SEQ ID NO: 707532 - DNA, 25 bp, Mus musculus
gtgctttgtagcctgttatacggaa

SEQ ID NO: 707533 - DNA, 25 bp, Mus musculus
gtgctttgtagcgtgttatacggaa

SEQ ID NO: 707534 - DNA, 25 bp, Mus musculus
gtgctttgtatactgacacttccat

SEQ ID NO: 707535 - DNA, 25 bp, Mus musculus
gtgctttgtatagtgacacttccat

SEQ ID NO: 707536 - DNA, 25 bp, Mus musculus
gtgctttgtattctggactcttggt

SEQ ID NO: 707537 - DNA, 25 bp, Mus musculus
gtgctttgtattgtggactcttggt

SEQ ID NO: 707538 - DNA, 25 bp, Mus musculus
gtgctttgtgaaactgtacgccctt

SEQ ID NO: 707539 - DNA, 25 bp, Mus musculus
gtgctttgtgaatctgtacgccctt

SEQ ID NO: 707540 - DNA, 25 bp, Mus musculus
gtgctttgttcaaggtttccactaa

SEQ ID NO: 707541 - DNA, 25 bp, Mus musculus
gtgctttgttcacaggacaccatag

SEQ ID NO: 707542 - DNA, 25 bp, Mus musculus
gtgctttgttcagaggacaccatag

SEQ ID NO: 707543 - DNA, 25 bp, Mus musculus
gtgctttgttcatggtttccactaa

SEQ ID NO: 707544 - DNA, 25 bp, Mus musculus
gtgctttgttgtcggctgtgtaaaa

SEQ ID NO: 707545 - DNA, 25 bp, Mus musculus
gtgctttgttgtgggctgtgtaaaa

SEQ ID NO: 707546 - DNA, 25 bp, Mus musculus
gtgcttttaaatcgtgctcagtagg

SEQ ID NO: 707547 - DNA, 25 bp, Mus musculus
gtgcttttaaatggtgctcagtagg

SEQ ID NO: 707548 - DNA, 25 bp, Mus musculus
gtgcttttaagacctatgagcctgt

SEQ ID NO: 707549 - DNA, 25 bp, Mus musculus
gtgcttttaagagctatgagcctgt

SEQ ID NO: 707550 - DNA, 25 bp, Mus musculus
gtgcttttaagcagactgtagaaca

SEQ ID NO: 707551 - DNA, 25 bp, Mus musculus
gtgcttttaagctgactgtagaaca

SEQ ID NO: 707552 - DNA, 25 bp, Mus musculus
gtgcttttaaggcattaggttaaca

SEQ ID NO: 707553 - DNA, 25 bp, Mus musculus
gtgcttttaagggattaggttaaca

SEQ ID NO: 707554 - DNA, 25 bp, Mus musculus
gtgcttttaattacacttcagtgag

SEQ ID NO: 707555 - DNA, 25 bp, Mus musculus
gtgcttttaatttcacttcagtgag

SEQ ID NO: 707556 - DNA, 25 bp, Mus musculus
gtgcttttagaccacttcagggaat

SEQ ID NO: 707557 - DNA, 25 bp, Mus musculus
gtgcttttagacgacttcagggaat

SEQ ID NO: 707558 - DNA, 25 bp, Mus musculus
gtgcttttagatatggcttcttctt

SEQ ID NO: 707559 - DNA, 25 bp, Mus musculus
gtgcttttagatttggcttcttctt

SEQ ID NO: 707560 - DNA, 25 bp, Mus musculus
gtgcttttagctatgattaacactg

SEQ ID NO: 707561 - DNA, 25 bp, Mus musculus
gtgcttttagctttgattaacactg

SEQ ID NO: 707562 - DNA, 25 bp, Mus musculus
gtgcttttcaaaattctaactgctg

SEQ ID NO: 707563 - DNA, 25 bp, Mus musculus
gtgcttttcaaatttctaactgctg

SEQ ID NO: 707564 - DNA, 25 bp, Mus musculus
gtgcttttcaacactctcgaattat

SEQ ID NO: 707565 - DNA, 25 bp, Mus musculus
gtgcttttcaactctctcgaattat

SEQ ID NO: 707566 - DNA, 25 bp, Mus musculus
gtgcttttcattatcctgtactctg

SEQ ID NO: 707567 - DNA, 25 bp, Mus musculus
gtgcttttcattttcctgtactctg

SEQ ID NO: 707568 - DNA, 25 bp, Mus musculus
gtgcttttccagaatcttcagtcta

SEQ ID NO: 707569 - DNA, 25 bp, Mus musculus
gtgcttttccagtatcttcagtcta

SEQ ID NO: 707570 - DNA, 25 bp, Mus musculus
gtgcttttccttaacatggtgggtg

SEQ ID NO: 707571 - DNA, 25 bp, Mus musculus
gtgcttttcctttacatggtgggtg

SEQ ID NO: 707572 - DNA, 25 bp, Mus musculus
gtgcttttcgtgagggagctcctac

SEQ ID NO: 707573 - DNA, 25 bp, Mus musculus
gtgcttttcgtgtgggagctcctac

SEQ ID NO: 707574 - DNA, 25 bp, Mus musculus
gtgcttttctacattttcatatggg

SEQ ID NO: 707575 - DNA, 25 bp, Mus musculus
gtgcttttctactttttcatatggg

SEQ ID NO: 707576 - DNA, 25 bp, Mus musculus
gtgcttttctcgagtcctgtagatg

SEQ ID NO: 707577 - DNA, 25 bp, Mus musculus
gtgcttttctcgtgtcctgtagatg

SEQ ID NO: 707578 - DNA, 25 bp, Mus musculus
gtgcttttctgtactgctaggtaac

SEQ ID NO: 707579 - DNA, 25 bp, Mus musculus
gtgcttttctgttctgctaggtaac

SEQ ID NO: 707580 - DNA, 25 bp, Mus musculus
gtgcttttgaatccctttactgact

SEQ ID NO: 707581 - DNA, 25 bp, Mus musculus
gtgcttttgaatgcctttactgact

SEQ ID NO: 707582 - DNA, 25 bp, Mus musculus
gtgcttttgtacattgggtccctgg

SEQ ID NO: 707583 - DNA, 25 bp, Mus musculus
gtgcttttgtactttgggtccctgg

SEQ ID NO: 707584 - DNA, 25 bp, Mus musculus
gtgcttttgtgaacaactggtttgt

SEQ ID NO: 707585 - DNA, 25 bp, Mus musculus
gtgcttttgtgatcaactggtttgt

SEQ ID NO: 707586 - DNA, 25 bp, Mus musculus
gtgctttttaaaacagtacttccgg

SEQ ID NO: 707587 - DNA, 25 bp, Mus musculus
gtgctttttaaatcagtacttccgg

SEQ ID NO: 707588 - DNA, 25 bp, Mus musculus
gtgctttttctcacaatagaaaggt

SEQ ID NO: 707589 - DNA, 25 bp, Mus musculus
gtgctttttctcagtagtattttga

SEQ ID NO: 707590 - DNA, 25 bp, Mus musculus
gtgctttttctctcaatagaaaggt

SEQ ID NO: 707591 - DNA, 25 bp, Mus musculus
gtgctttttctctgtagtattttga

SEQ ID NO: 707592 - DNA, 25 bp, Mus musculus
gtggaaaaaagcacaaccccgactg

SEQ ID NO: 707593 - DNA, 25 bp, Mus musculus
gtggaaaaaagctcaaccccgactg

SEQ ID NO: 707594 - DNA, 25 bp, Mus musculus
gtggaaaaatcaaagccccagcaaa

SEQ ID NO: 707595 - DNA, 25 bp, Mus musculus
gtggaaaaatcatagccccagcaaa

SEQ ID NO: 707596 - DNA, 25 bp, Mus musculus
gtggaaaaatctatgctgggcagtt

SEQ ID NO: 707597 - DNA, 25 bp, Mus musculus
gtggaaaaatctttgctgggcagtt

SEQ ID NO: 707598 - DNA, 25 bp, Mus musculus
gtggaaaacagtccttttaccatga

SEQ ID NO: 707599 - DNA, 25 bp, Mus musculus
gtggaaaacagtgcttttaccatga

SEQ ID NO: 707600 - DNA, 25 bp, Mus musculus
gtggaaaactctatcctctgatcct

SEQ ID NO: 707601 - DNA, 25 bp, Mus musculus
gtggaaaactctttcctctgatcct

SEQ ID NO: 707602 - DNA, 25 bp, Mus musculus
gtggaaaactttcgtggttcttcat

SEQ ID NO: 707603 - DNA, 25 bp, Mus musculus
gtggaaaactttggtggttcttcat

SEQ ID NO: 707604 - DNA, 25 bp, Mus musculus
gtggaaaagaccaggtttgaacgag

SEQ ID NO: 707605 - DNA, 25 bp, Mus musculus
gtggaaaagacctggtttgaacgag

SEQ ID NO: 707606 - DNA, 25 bp, Mus musculus
gtggaaaagagaacagatacctgca

SEQ ID NO: 707607 - DNA, 25 bp, Mus musculus
gtggaaaagagatcagatacctgca

SEQ ID NO: 707608 - DNA, 25 bp, Mus musculus
gtggaaaagccactccttttttgag

SEQ ID NO: 707609 - DNA, 25 bp, Mus musculus
gtggaaaagccagtccttttttgag

SEQ ID NO: 707610 - DNA, 25 bp, Mus musculus
gtggaaaagctgcatagcacttaaa

SEQ ID NO: 707611 - DNA, 25 bp, Mus musculus
gtggaaaagctggatagcacttaaa

SEQ ID NO: 707612 - DNA, 25 bp, Mus musculus
gtggaaaaggacaatatactgtcta

SEQ ID NO: 707613 - DNA, 25 bp, Mus musculus
gtggaaaaggactatatactgtcta

SEQ ID NO: 707614 - DNA, 25 bp, Mus musculus
gtggaaaaggtacacgagctaaaga

SEQ ID NO: 707615 - DNA, 25 bp, Mus musculus
gtggaaaaggtagacgagctaaaga

SEQ ID NO: 707616 - DNA, 25 bp, Mus musculus
gtggaaaatgctctgattacactca

SEQ ID NO: 707617 - DNA, 25 bp, Mus musculus
gtggaaaatgctgtgattacactca

SEQ ID NO: 707618 - DNA, 25 bp, Mus musculus
gtggaaaattctactcctgacttta

SEQ ID NO: 707619 - DNA, 25 bp, Mus musculus
gtggaaaattcttctcctgacttta

SEQ ID NO: 707620 - DNA, 25 bp, Mus musculus
gtggaaacacacctgataactaatg

SEQ ID NO: 707621 - DNA, 25 bp, Mus musculus
gtggaaacacacgtgataactaatg

SEQ ID NO: 707622 - DNA, 25 bp, Mus musculus
gtggaaacaccactagacggctgac

SEQ ID NO: 707623 - DNA, 25 bp, Mus musculus
gtggaaacaccagtagacggctgac

SEQ ID NO: 707624 - DNA, 25 bp, Mus musculus
gtggaaacagcacgcctttcagctc

SEQ ID NO: 707625 - DNA, 25 bp, Mus musculus
gtggaaacagcaggcctttcagctc

SEQ ID NO: 707626 - DNA, 25 bp, Mus musculus
gtggaaacatcccttgctgacagaa

SEQ ID NO: 707627 - DNA, 25 bp, Mus musculus
gtggaaacatccgttgctgacagaa

SEQ ID NO: 707628 - DNA, 25 bp, Mus musculus
gtggaaacatcgcacttccctttgc

SEQ ID NO: 707629 - DNA, 25 bp, Mus musculus
gtggaaacatcggacttccctttgc

SEQ ID NO: 707630 - DNA, 25 bp, Mus musculus
gtggaaacatttcctgcctgtgggc

SEQ ID NO: 707631 - DNA, 25 bp, Mus musculus
gtggaaacatttgctgcctgtgggc

SEQ ID NO: 707632 - DNA, 25 bp, Mus musculus
gtggaaaccaccaccgtatacaccg

SEQ ID NO: 707633 - DNA, 25 bp, Mus musculus
gtggaaaccacctccgtatacaccg

SEQ ID NO: 707634 - DNA, 25 bp, Mus musculus
gtggaaaccactagcaaatgccatg

SEQ ID NO: 707635 - DNA, 25 bp, Mus musculus
gtggaaaccacttgcaaatgccatg

SEQ ID NO: 707636 - DNA, 25 bp, Mus musculus
gtggaaaccagtaggtcccaggcaa

SEQ ID NO: 707637 - DNA, 25 bp, Mus musculus
gtggaaaccagttggtcccaggcaa

SEQ ID NO: 707638 - DNA, 25 bp, Mus musculus
gtggaaaccatcaatgctgacagtc

SEQ ID NO: 707639 - DNA, 25 bp, Mus musculus
gtggaaaccatctatgctgacagtc

SEQ ID NO: 707640 - DNA, 25 bp, Mus musculus
gtggaaacctctacacgggctgttt

SEQ ID NO: 707641 - DNA, 25 bp, Mus musculus
gtggaaacctctatgaacaccattt

SEQ ID NO: 707642 - DNA, 25 bp, Mus musculus
gtggaaacctcttcacgggctgttt

SEQ ID NO: 707643 - DNA, 25 bp, Mus musculus
gtggaaacctctttgaacaccattt

SEQ ID NO: 707644 - DNA, 25 bp, Mus musculus
gtggaaactgctctccgatccgcta

SEQ ID NO: 707645 - DNA, 25 bp, Mus musculus
gtggaaactgctgtccgatccgcta

SEQ ID NO: 707646 - DNA, 25 bp, Mus musculus
gtggaaacttggcacatacgccttt

SEQ ID NO: 707647 - DNA, 25 bp, Mus musculus
gtggaaacttgggacatacgccttt

SEQ ID NO: 707648 - DNA, 25 bp, Mus musculus
gtggaaagacagcaccaaccgcgca

SEQ ID NO: 707649 - DNA, 25 bp, Mus musculus
gtggaaagacaggaccaaccgcgca

SEQ ID NO: 707650 - DNA, 25 bp, Mus musculus
gtggaaagcagtcattgctctcaat

SEQ ID NO: 707651 - DNA, 25 bp, Mus musculus
gtggaaagcagtgattgctctcaat

SEQ ID NO: 707652 - DNA, 25 bp, Mus musculus
gtggaaagcccgactgattcatttt

SEQ ID NO: 707653 - DNA, 25 bp, Mus musculus
gtggaaagcccgtctgattcatttt

SEQ ID NO: 707654 - DNA, 25 bp, Mus musculus
gtggaaagcctaatttactgaacgt

SEQ ID NO: 707655 - DNA, 25 bp, Mus musculus
gtggaaagcctattttactgaacgt

SEQ ID NO: 707656 - DNA, 25 bp, Mus musculus
gtggaaagcctgattttgactgtca

SEQ ID NO: 707657 - DNA, 25 bp, Mus musculus
gtggaaagcctgtttttgactgtca

SEQ ID NO: 707658 - DNA, 25 bp, Mus musculus
gtggaaagctctccagggagcctaa

SEQ ID NO: 707659 - DNA, 25 bp, Mus musculus
gtggaaagctctcgaaagccctaaa

SEQ ID NO: 707660 - DNA, 25 bp, Mus musculus
gtggaaagctctgcagggagcctaa

SEQ ID NO: 707661 - DNA, 25 bp, Mus musculus
gtggaaagctctggaaagccctaaa

SEQ ID NO: 707662 - DNA, 25 bp, Mus musculus
gtggaaagcttacgtattggaacaa

SEQ ID NO: 707663 - DNA, 25 bp, Mus musculus
gtggaaagcttaggtattggaacaa

SEQ ID NO: 707664 - DNA, 25 bp, Mus musculus
gtggaaaggacaatgttcatggaac

SEQ ID NO: 707665 - DNA, 25 bp, Mus musculus
gtggaaaggacattgttcatggaac

SEQ ID NO: 707666 - DNA, 25 bp, Mus musculus
gtggaaagtacaactttatacaata

SEQ ID NO: 707667 - DNA, 25 bp, Mus musculus
gtggaaagtacatctttatacaata

SEQ ID NO: 707668 - DNA, 25 bp, Mus musculus
gtggaaagtcagctcagcatcccat

SEQ ID NO: 707669 - DNA, 25 bp, Mus musculus
gtggaaagtcaggtcagcatcccat

SEQ ID NO: 707670 - DNA, 25 bp, Mus musculus
gtggaaagtcggaatacgctgctga

SEQ ID NO: 707671 - DNA, 25 bp, Mus musculus
gtggaaagtcggtatacgctgctga

SEQ ID NO: 707672 - DNA, 25 bp, Mus musculus
gtggaaagtctaacccacttcacaa

SEQ ID NO: 707673 - DNA, 25 bp, Mus musculus
gtggaaagtctatcccacttcacaa

SEQ ID NO: 707674 - DNA, 25 bp, Mus musculus
gtggaaagttctcacggctctaggg

SEQ ID NO: 707675 - DNA, 25 bp, Mus musculus
gtggaaagttctgacggctctaggg

SEQ ID NO: 707676 - DNA, 25 bp, Mus musculus
gtggaaataccacactcatctatta

SEQ ID NO: 707677 - DNA, 25 bp, Mus musculus
gtggaaataccactccccggacctg

SEQ ID NO: 707678 - DNA, 25 bp, Mus musculus
gtggaaataccagactcatctatta

SEQ ID NO: 707679 - DNA, 25 bp, Mus musculus
gtggaaataccagtccccggacctg

SEQ ID NO: 707680 - DNA, 25 bp, Mus musculus
gtggaaatcaccagctaagaagcta

SEQ ID NO: 707681 - DNA, 25 bp, Mus musculus
gtggaaatcacctgctaagaagcta

SEQ ID NO: 707682 - DNA, 25 bp, Mus musculus
gtggaaatcagaccatagacttggg

SEQ ID NO: 707683 - DNA, 25 bp, Mus musculus
gtggaaatcagagcatagacttggg

SEQ ID NO: 707684 - DNA, 25 bp, Mus musculus
gtggaaatccatattgcccttttaa

SEQ ID NO: 707685 - DNA, 25 bp, Mus musculus
gtggaaatccattttgcccttttaa

SEQ ID NO: 707686 - DNA, 25 bp, Mus musculus
gtggaaatcccaatccatttatgca

SEQ ID NO: 707687 - DNA, 25 bp, Mus musculus
gtggaaatcccaccagagcaaagac

SEQ ID NO: 707688 - DNA, 25 bp, Mus musculus
gtggaaatcccagcagagcaaagac

SEQ ID NO: 707689 - DNA, 25 bp, Mus musculus
gtggaaatcccattccatttatgca

SEQ ID NO: 707690 - DNA, 25 bp, Mus musculus
gtggaaatcctaatttcctcgttca

SEQ ID NO: 707691 - DNA, 25 bp, Mus musculus
gtggaaatcctattttcctcgttca

SEQ ID NO: 707692 - DNA, 25 bp, Mus musculus
gtggaaatcctgcaaggctgcactc

SEQ ID NO: 707693 - DNA, 25 bp, Mus musculus
gtggaaatcctggaaggctgcactc

SEQ ID NO: 707694 - DNA, 25 bp, Mus musculus
gtggaaatcttgatcatacccgaag

SEQ ID NO: 707695 - DNA, 25 bp, Mus musculus
gtggaaatcttgttcatacccgaag

SEQ ID NO: 707696 - DNA, 25 bp, Mus musculus
gtggaaatgaccacggtcctctcag

SEQ ID NO: 707697 - DNA, 25 bp, Mus musculus
gtggaaatgacctcggtcctctcag

SEQ ID NO: 707698 - DNA, 25 bp, Mus musculus
gtggaaatgagcatgacccctgacc

SEQ ID NO: 707699 - DNA, 25 bp, Mus musculus
gtggaaatgagcttgacccctgacc

SEQ ID NO: 707700 - DNA, 25 bp, Mus musculus
gtggaaatgaggcttatcccctgct

SEQ ID NO: 707701 - DNA, 25 bp, Mus musculus
gtggaaatgagggttatcccctgct

SEQ ID NO: 707702 - DNA, 25 bp, Mus musculus
gtggaaatgcacctaacagttgatc

SEQ ID NO: 707703 - DNA, 25 bp, Mus musculus
gtggaaatgcacgtaacagttgatc

SEQ ID NO: 707704 - DNA, 25 bp, Mus musculus
gtggaaatgcatcgcctcatcaggg

SEQ ID NO: 707705 - DNA, 25 bp, Mus musculus
gtggaaatgcatggcctcatcaggg

SEQ ID NO: 707706 - DNA, 25 bp, Mus musculus
gtggaaatgctaccggccaggtcct

SEQ ID NO: 707707 - DNA, 25 bp, Mus musculus
gtggaaatgctagcggccaggtcct

SEQ ID NO: 707708 - DNA, 25 bp, Mus musculus
gtggaaatgctgagctctcccataa

SEQ ID NO: 707709 - DNA, 25 bp, Mus musculus
gtggaaatgctgtgctctcccataa

SEQ ID NO: 707710 - DNA, 25 bp, Mus musculus
gtggaaatgtaaagctctctgtaac

SEQ ID NO: 707711 - DNA, 25 bp, Mus musculus
gtggaaatgtaatgctctctgtaac

SEQ ID NO: 707712 - DNA, 25 bp, Mus musculus
gtggaaattctgatgagtcccctgc

SEQ ID NO: 707713 - DNA, 25 bp, Mus musculus
gtggaaattctgttgagtcccctgc

SEQ ID NO: 707714 - DNA, 25 bp, Mus musculus
gtggaacaagacaaagcagaagcaa

SEQ ID NO: 707715 - DNA, 25 bp, Mus musculus
gtggaacaagactaagcagaagcaa

SEQ ID NO: 707716 - DNA, 25 bp, Mus musculus
gtggaacacaccctacattgagaat

SEQ ID NO: 707717 - DNA, 25 bp, Mus musculus
gtggaacacaccgtacattgagaat

SEQ ID NO: 707718 - DNA, 25 bp, Mus musculus
gtggaacaccaaacaggaaagtact

SEQ ID NO: 707719 - DNA, 25 bp, Mus musculus
gtggaacaccaatcaggaaagtact

SEQ ID NO: 707720 - DNA, 25 bp, Mus musculus
gtggaacagaacatcccagccattg

SEQ ID NO: 707721 - DNA, 25 bp, Mus musculus
gtggaacagaacttcccagccattg

SEQ ID NO: 707722 - DNA, 25 bp, Mus musculus
gtggaacagcgaacagagcacccct

SEQ ID NO: 707723 - DNA, 25 bp, Mus musculus
gtggaacagcgatcagagcacccct

SEQ ID NO: 707724 - DNA, 25 bp, Mus musculus
gtggaacagtaaatctgcctcggcc

SEQ ID NO: 707725 - DNA, 25 bp, Mus musculus
gtggaacagtaattctgcctcggcc

SEQ ID NO: 707726 - DNA, 25 bp, Mus musculus
gtggaacagtctccttatcttctaa

SEQ ID NO: 707727 - DNA, 25 bp, Mus musculus
gtggaacagtctgcttatcttctaa

SEQ ID NO: 707728 - DNA, 25 bp, Mus musculus
gtggaacagtgcctccaatttaaaa

SEQ ID NO: 707729 - DNA, 25 bp, Mus musculus
gtggaacagtgcgtccaatttaaaa

SEQ ID NO: 707730 - DNA, 25 bp, Mus musculus
gtggaacataccctagctgagcctt

SEQ ID NO: 707731 - DNA, 25 bp, Mus musculus
gtggaacataccgtagctgagcctt

SEQ ID NO: 707732 - DNA, 25 bp, Mus musculus
gtggaacatctacgcagttcaactg

SEQ ID NO: 707733 - DNA, 25 bp, Mus musculus
gtggaacatctaggcagttcaactg

SEQ ID NO: 707734 - DNA, 25 bp, Mus musculus
gtggaacattacactctttgtataa

SEQ ID NO: 707735 - DNA, 25 bp, Mus musculus
gtggaacattacatagccttaacta

SEQ ID NO: 707736 - DNA, 25 bp, Mus musculus
gtggaacattactctctttgtataa

SEQ ID NO: 707737 - DNA, 25 bp, Mus musculus
gtggaacattacttagccttaacta

SEQ ID NO: 707738 - DNA, 25 bp, Mus musculus
gtggaacattgtcccacacactgca

SEQ ID NO: 707739 - DNA, 25 bp, Mus musculus
gtggaacattgtgccacacactgca

SEQ ID NO: 707740 - DNA, 25 bp, Mus musculus
gtggaacatttcatgaattctaacc

SEQ ID NO: 707741 - DNA, 25 bp, Mus musculus
gtggaacatttcttgaattctaacc

SEQ ID NO: 707742 - DNA, 25 bp, Mus musculus
gtggaaccaaacctccctagagagt

SEQ ID NO: 707743 - DNA, 25 bp, Mus musculus
gtggaaccaaacctctagaactttg

SEQ ID NO: 707744 - DNA, 25 bp, Mus musculus
gtggaaccaaacgtccctagagagt

SEQ ID NO: 707745 - DNA, 25 bp, Mus musculus
gtggaaccaaacgtctagaactttg

SEQ ID NO: 707746 - DNA, 25 bp, Mus musculus
gtggaaccaactaagtgcccagcat

SEQ ID NO: 707747 - DNA, 25 bp, Mus musculus
gtggaaccaacttagtgcccagcat

SEQ ID NO: 707748 - DNA, 25 bp, Mus musculus
gtggaaccaaggcacgagtatgaac

SEQ ID NO: 707749 - DNA, 25 bp, Mus musculus
gtggaaccaagggacgagtatgaac

SEQ ID NO: 707750 - DNA, 25 bp, Mus musculus
gtggaaccacgtatctaagttgctc

SEQ ID NO: 707751 - DNA, 25 bp, Mus musculus
gtggaaccacgtttctaagttgctc

SEQ ID NO: 707752 - DNA, 25 bp, Mus musculus
gtggaaccaggtctctaagcaactg

SEQ ID NO: 707753 - DNA, 25 bp, Mus musculus
gtggaaccaggtgtctaagcaactg

SEQ ID NO: 707754 - DNA, 25 bp, Mus musculus
gtggaaccagtgattgcatcttgcc

SEQ ID NO: 707755 - DNA, 25 bp, Mus musculus
gtggaaccagtgtttgcatcttgcc

SEQ ID NO: 707756 - DNA, 25 bp, Mus musculus
gtggaaccatctataattcagagaa

SEQ ID NO: 707757 - DNA, 25 bp, Mus musculus
gtggaaccatctttaattcagagaa

SEQ ID NO: 707758 - DNA, 25 bp, Mus musculus
gtggaacccagactgtcacgcttga

SEQ ID NO: 707759 - DNA, 25 bp, Mus musculus
gtggaacccagagtgtcacgcttga

SEQ ID NO: 707760 - DNA, 25 bp, Mus musculus
gtggaaccccttcacacaattttca

SEQ ID NO: 707761 - DNA, 25 bp, Mus musculus
gtggaaccccttgacacaattttca

SEQ ID NO: 707762 - DNA, 25 bp, Mus musculus
gtggaaccctgacgcctgccggtca

SEQ ID NO: 707763 - DNA, 25 bp, Mus musculus
gtggaaccctgaggcctgccggtca

SEQ ID NO: 707764 - DNA, 25 bp, Mus musculus
gtggaaccctgcacatttcggaatg

SEQ ID NO: 707765 - DNA, 25 bp, Mus musculus
gtggaaccctgctcatttcggaatg

SEQ ID NO: 707766 - DNA, 25 bp, Mus musculus
gtggaaccctttaggaatcatgatt

SEQ ID NO: 707767 - DNA, 25 bp, Mus musculus
gtggaacccttttggaatcatgatt

SEQ ID NO: 707768 - DNA, 25 bp, Mus musculus
gtggaaccgcttcgttaccagtgac

SEQ ID NO: 707769 - DNA, 25 bp, Mus musculus
gtggaaccgcttggttaccagtgac

SEQ ID NO: 707770 - DNA, 25 bp, Mus musculus
gtggaacctacgacctgattgacat

SEQ ID NO: 707771 - DNA, 25 bp, Mus musculus
gtggaacctacgtcctgattgacat

SEQ ID NO: 707772 - DNA, 25 bp, Mus musculus
gtggaacctcttaccgctttcaata

SEQ ID NO: 707773 - DNA, 25 bp, Mus musculus
gtggaacctctttccgctttcaata

SEQ ID NO: 707774 - DNA, 25 bp, Mus musculus
gtggaacctgtgaaccacggcccct

SEQ ID NO: 707775 - DNA, 25 bp, Mus musculus
gtggaacctgtgtaccacggcccct

SEQ ID NO: 707776 - DNA, 25 bp, Mus musculus
gtggaaccttaaagagcacacctac

SEQ ID NO: 707777 - DNA, 25 bp, Mus musculus
gtggaaccttaatgagcacacctac

SEQ ID NO: 707778 - DNA, 25 bp, Mus musculus
gtggaaccttcactctgagactggg

SEQ ID NO: 707779 - DNA, 25 bp, Mus musculus
gtggaaccttcagtctgagactggg

SEQ ID NO: 707780 - DNA, 25 bp, Mus musculus
gtggaacggtaccaccctcgaagca

SEQ ID NO: 707781 - DNA, 25 bp, Mus musculus
gtggaacggtacgaccctcgaagca

SEQ ID NO: 707782 - DNA, 25 bp, Mus musculus
gtggaacgtgttaccaattcattaa

SEQ ID NO: 707783 - DNA, 25 bp, Mus musculus
gtggaacgtgtttccaattcattaa

SEQ ID NO: 707784 - DNA, 25 bp, Mus musculus
gtggaactactaatagcttgattgc

SEQ ID NO: 707785 - DNA, 25 bp, Mus musculus
gtggaactactattagcttgattgc

SEQ ID NO: 707786 - DNA, 25 bp, Mus musculus
gtggaactagttacccagctgcaga

SEQ ID NO: 707787 - DNA, 25 bp, Mus musculus
gtggaactagtttcccagctgcaga

SEQ ID NO: 707788 - DNA, 25 bp, Mus musculus
gtggaactatgactatgctcctcct

SEQ ID NO: 707789 - DNA, 25 bp, Mus musculus
gtggaactatgagtatgctcctcct

SEQ ID NO: 707790 - DNA, 25 bp, Mus musculus
gtggaactattaacctctacctgga

SEQ ID NO: 707791 - DNA, 25 bp, Mus musculus
gtggaactattatcctctacctgga

SEQ ID NO: 707792 - DNA, 25 bp, Mus musculus
gtggaactcacaatactcatgcaag

SEQ ID NO: 707793 - DNA, 25 bp, Mus musculus
gtggaactcacattactcatgcaag

SEQ ID NO: 707794 - DNA, 25 bp, Mus musculus
gtggaactcccaaaacgtcggcaat

SEQ ID NO: 707795 - DNA, 25 bp, Mus musculus
gtggaactcccataacgtcggcaat

SEQ ID NO: 707796 - DNA, 25 bp, Mus musculus
gtggaactctagagccaagggatct

SEQ ID NO: 707797 - DNA, 25 bp, Mus musculus
gtggaactctagtgccaagggatct

SEQ ID NO: 707798 - DNA, 25 bp, Mus musculus
gtggaactctctcttgcaatcctaa

SEQ ID NO: 707799 - DNA, 25 bp, Mus musculus
gtggaactctctgttgcaatcctaa

SEQ ID NO: 707800 - DNA, 25 bp, Mus musculus
gtggaactgacgcatcctgtgtccc

SEQ ID NO: 707801 - DNA, 25 bp, Mus musculus
gtggaactgacggatcctgtgtccc

SEQ ID NO: 707802 - DNA, 25 bp, Mus musculus
gtggaactgcgcctgtgcaacaagc

SEQ ID NO: 707803 - DNA, 25 bp, Mus musculus
gtggaactgcgcgtgtgcaacaagc

SEQ ID NO: 707804 - DNA, 25 bp, Mus musculus
gtggaactggttctgcggactctca

SEQ ID NO: 707805 - DNA, 25 bp, Mus musculus
gtggaactggttgtgcggactctca

SEQ ID NO: 707806 - DNA, 25 bp, Mus musculus
gtggaactgtagacatgctgatagc

SEQ ID NO: 707807 - DNA, 25 bp, Mus musculus
gtggaactgtagtcatgctgatagc

SEQ ID NO: 707808 - DNA, 25 bp, Mus musculus
gtggaactgtcaagtcagagctcag

SEQ ID NO: 707809 - DNA, 25 bp, Mus musculus
gtggaactgtcatgtcagagctcag

SEQ ID NO: 707810 - DNA, 25 bp, Mus musculus
gtggaactgtgccggtcccagcacc

SEQ ID NO: 707811 - DNA, 25 bp, Mus musculus
gtggaactgtgcgggtcccagcacc

SEQ ID NO: 707812 - DNA, 25 bp, Mus musculus
gtggaactgtttcgctttcctgctg

SEQ ID NO: 707813 - DNA, 25 bp, Mus musculus
gtggaactgtttggctttcctgctg

SEQ ID NO: 707814 - DNA, 25 bp, Mus musculus
gtggaacttcctcagattcctctaa

SEQ ID NO: 707815 - DNA, 25 bp, Mus musculus
gtggaacttcctctggcagctgcca

SEQ ID NO: 707816 - DNA, 25 bp, Mus musculus
gtggaacttcctgagattcctctaa

SEQ ID NO: 707817 - DNA, 25 bp, Mus musculus
gtggaacttcctgtggcagctgcca

SEQ ID NO: 707818 - DNA, 25 bp, Mus musculus
gtggaacttcttcatggcaacctgt

SEQ ID NO: 707819 - DNA, 25 bp, Mus musculus
gtggaacttcttgatggcaacctgt

SEQ ID NO: 707820 - DNA, 25 bp, Mus musculus
gtggaacttggcattgacctactgg

SEQ ID NO: 707821 - DNA, 25 bp, Mus musculus
gtggaacttggctttgacctactgg

SEQ ID NO: 707822 - DNA, 25 bp, Mus musculus
gtggaacttttgatggaccttacag

SEQ ID NO: 707823 - DNA, 25 bp, Mus musculus
gtggaacttttgttggaccttacag

SEQ ID NO: 707824 - DNA, 25 bp, Mus musculus
gtggaagacacccatacctgtatat

SEQ ID NO: 707825 - DNA, 25 bp, Mus musculus
gtggaagacaccctccctattatac

SEQ ID NO: 707826 - DNA, 25 bp, Mus musculus
gtggaagacaccgatacctgtatat

SEQ ID NO: 707827 - DNA, 25 bp, Mus musculus
gtggaagacaccgtccctattatac

SEQ ID NO: 707828 - DNA, 25 bp, Mus musculus
gtggaagacagtcggctccatgcct

SEQ ID NO: 707829 - DNA, 25 bp, Mus musculus
gtggaagacagtgggctccatgcct

SEQ ID NO: 707830 - DNA, 25 bp, Mus musculus
gtggaagacataacctcgagcttag

SEQ ID NO: 707831 - DNA, 25 bp, Mus musculus
gtggaagacatatcctcgagcttag

SEQ ID NO: 707832 - DNA, 25 bp, Mus musculus
gtggaagacatgagccgtgtataat

SEQ ID NO: 707833 - DNA, 25 bp, Mus musculus
gtggaagacatgtgccgtgtataat

SEQ ID NO: 707834 - DNA, 25 bp, Mus musculus
gtggaagacctaaaagctgagatcg

SEQ ID NO: 707835 - DNA, 25 bp, Mus musculus
gtggaagacctataagctgagatcg

SEQ ID NO: 707836 - DNA, 25 bp, Mus musculus
gtggaagacggcaggcagttcccct

SEQ ID NO: 707837 - DNA, 25 bp, Mus musculus
gtggaagacggctggcagttcccct

SEQ ID NO: 707838 - DNA, 25 bp, Mus musculus
gtggaagactacctacattagctat

SEQ ID NO: 707839 - DNA, 25 bp, Mus musculus
gtggaagactacgtacattagctat

SEQ ID NO: 707840 - DNA, 25 bp, Mus musculus
gtggaagactcgctcccaaaggctc

SEQ ID NO: 707841 - DNA, 25 bp, Mus musculus
gtggaagactcggtcccaaaggctc

SEQ ID NO: 707842 - DNA, 25 bp, Mus musculus
gtggaagacttaacactgtgctaag

SEQ ID NO: 707843 - DNA, 25 bp, Mus musculus
gtggaagacttatcactgtgctaag

SEQ ID NO: 707844 - DNA, 25 bp, Mus musculus
gtggaagacttgaattggcgctcag

SEQ ID NO: 707845 - DNA, 25 bp, Mus musculus
gtggaagacttgtattggcgctcag

SEQ ID NO: 707846 - DNA, 25 bp, Mus musculus
gtggaagactttcacccatcaatgt

SEQ ID NO: 707847 - DNA, 25 bp, Mus musculus
gtggaagactttgacccatcaatgt

SEQ ID NO: 707848 - DNA, 25 bp, Mus musculus
gtggaagagcctcacctatgatgaa

SEQ ID NO: 707849 - DNA, 25 bp, Mus musculus
gtggaagagcctgacctatgatgaa

SEQ ID NO: 707850 - DNA, 25 bp, Mus musculus
gtggaagagcgtaccaaacctcctg

SEQ ID NO: 707851 - DNA, 25 bp, Mus musculus
gtggaagagcgttccaaacctcctg

SEQ ID NO: 707852 - DNA, 25 bp, Mus musculus
gtggaagagcttcatagagtttatt

SEQ ID NO: 707853 - DNA, 25 bp, Mus musculus
gtggaagagcttgatagagtttatt

SEQ ID NO: 707854 - DNA, 25 bp, Mus musculus
gtggaagatcttctaacctcataat

SEQ ID NO: 707855 - DNA, 25 bp, Mus musculus
gtggaagatcttgtaacctcataat

SEQ ID NO: 707856 - DNA, 25 bp, Mus musculus
gtggaagatgtgaccctaggacaaa

SEQ ID NO: 707857 - DNA, 25 bp, Mus musculus
gtggaagatgtgtccctaggacaaa

SEQ ID NO: 707858 - DNA, 25 bp, Mus musculus
gtggaagattaccactcgaggcccc

SEQ ID NO: 707859 - DNA, 25 bp, Mus musculus
gtggaagattacgactcgaggcccc

SEQ ID NO: 707860 - DNA, 25 bp, Mus musculus
gtggaagattccaataagttgctct

SEQ ID NO: 707861 - DNA, 25 bp, Mus musculus
gtggaagattcctataagttgctct

SEQ ID NO: 707862 - DNA, 25 bp, Mus musculus
gtggaagcagccagtgattctctgg

SEQ ID NO: 707863 - DNA, 25 bp, Mus musculus
gtggaagcagcctgtgattctctgg

SEQ ID NO: 707864 - DNA, 25 bp, Mus musculus
gtggaagccagaagcactgggacaa

SEQ ID NO: 707865 - DNA, 25 bp, Mus musculus
gtggaagccagatgcactgggacaa

SEQ ID NO: 707866 - DNA, 25 bp, Mus musculus
gtggaagcccctccaggaggttcta

SEQ ID NO: 707867 - DNA, 25 bp, Mus musculus
gtggaagcccctgcaggaggttcta

SEQ ID NO: 707868 - DNA, 25 bp, Mus musculus
gtggaagctaccattcttggagaaa

SEQ ID NO: 707869 - DNA, 25 bp, Mus musculus
gtggaagctacctttcttggagaaa

SEQ ID NO: 707870 - DNA, 25 bp, Mus musculus
gtggaagctcttaatttttaagact

SEQ ID NO: 707871 - DNA, 25 bp, Mus musculus
gtggaagctctttatttttaagact

SEQ ID NO: 707872 - DNA, 25 bp, Mus musculus
gtggaagctgctcgtttctgtatgc

SEQ ID NO: 707873 - DNA, 25 bp, Mus musculus
gtggaagctgctggtttctgtatgc

SEQ ID NO: 707874 - DNA, 25 bp, Mus musculus
gtggaagctgggacggctcaatcac

SEQ ID NO: 707875 - DNA, 25 bp, Mus musculus
gtggaagctgggtcggctcaatcac

SEQ ID NO: 707876 - DNA, 25 bp, Mus musculus
gtggaagcttccaaagtggctcaga

SEQ ID NO: 707877 - DNA, 25 bp, Mus musculus
gtggaagcttcctaagtggctcaga

SEQ ID NO: 707878 - DNA, 25 bp, Mus musculus
gtggaaggatagaaccaagtcctga

SEQ ID NO: 707879 - DNA, 25 bp, Mus musculus
gtggaaggatagtaccaagtcctga

SEQ ID NO: 707880 - DNA, 25 bp, Mus musculus
gtggaaggatcaagttgccccggac

SEQ ID NO: 707881 - DNA, 25 bp, Mus musculus
gtggaaggatcatgttgccccggac

SEQ ID NO: 707882 - DNA, 25 bp, Mus musculus
gtggaaggcaacagtgcccttgcat

SEQ ID NO: 707883 - DNA, 25 bp, Mus musculus
gtggaaggcaactgtgcccttgcat

SEQ ID NO: 707884 - DNA, 25 bp, Mus musculus
gtggaaggcagcactattcctgtcc

SEQ ID NO: 707885 - DNA, 25 bp, Mus musculus
gtggaaggcagctctattcctgtcc

SEQ ID NO: 707886 - DNA, 25 bp, Mus musculus
gtggaaggccatccatagcaaaact

SEQ ID NO: 707887 - DNA, 25 bp, Mus musculus
gtggaaggccatgcatagcaaaact

SEQ ID NO: 707888 - DNA, 25 bp, Mus musculus
gtggaagggtttctcactctgtctt

SEQ ID NO: 707889 - DNA, 25 bp, Mus musculus
gtggaagggtttgtcactctgtctt

SEQ ID NO: 707890 - DNA, 25 bp, Mus musculus
gtggaaggtgccaaccggaccctga

SEQ ID NO: 707891 - DNA, 25 bp, Mus musculus
gtggaaggtgcctaccggaccctga

SEQ ID NO: 707892 - DNA, 25 bp, Mus musculus
gtggaagtaccacgcagtgacagcc

SEQ ID NO: 707893 - DNA, 25 bp, Mus musculus
gtggaagtaccaggcagtgacagcc

SEQ ID NO: 707894 - DNA, 25 bp, Mus musculus
gtggaagtattgcatgtcaccaaac

SEQ ID NO: 707895 - DNA, 25 bp, Mus musculus
gtggaagtattggatgtcaccaaac

SEQ ID NO: 707896 - DNA, 25 bp, Mus musculus
gtggaagtcaaactacagctctgtg

SEQ ID NO: 707897 - DNA, 25 bp, Mus musculus
gtggaagtcaaagtacagctctgtg

SEQ ID NO: 707898 - DNA, 25 bp, Mus musculus
gtggaagtcatcatttctgctttaa

SEQ ID NO: 707899 - DNA, 25 bp, Mus musculus
gtggaagtcatcttttctgctttaa

SEQ ID NO: 707900 - DNA, 25 bp, Mus musculus
gtggaagtcattctgcctttacctc

SEQ ID NO: 707901 - DNA, 25 bp, Mus musculus
gtggaagtcattgtgcctttacctc

SEQ ID NO: 707902 - DNA, 25 bp, Mus musculus
gtggaagtcccaatagccagagctc

SEQ ID NO: 707903 - DNA, 25 bp, Mus musculus
gtggaagtcccattagccagagctc

SEQ ID NO: 707904 - DNA, 25 bp, Mus musculus
gtggaagtctctattctgtcagttt

SEQ ID NO: 707905 - DNA, 25 bp, Mus musculus
gtggaagtctcttttctgtcagttt

SEQ ID NO: 707906 - DNA, 25 bp, Mus musculus
gtggaagtcttcactaagcctgaat

SEQ ID NO: 707907 - DNA, 25 bp, Mus musculus
gtggaagtcttctctaagcctgaat

SEQ ID NO: 707908 - DNA, 25 bp, Mus musculus
gtggaagtgaacacctgcagtcata

SEQ ID NO: 707909 - DNA, 25 bp, Mus musculus
gtggaagtgaactcctgcagtcata

SEQ ID NO: 707910 - DNA, 25 bp, Mus musculus
gtggaagtgagaacaactccctcta

SEQ ID NO: 707911 - DNA, 25 bp, Mus musculus
gtggaagtgagatcaactccctcta

SEQ ID NO: 707912 - DNA, 25 bp, Mus musculus
gtggaagtggatcaactcaaggaaa

SEQ ID NO: 707913 - DNA, 25 bp, Mus musculus
gtggaagtggatgaactcaaggaaa

SEQ ID NO: 707914 - DNA, 25 bp, Mus musculus
gtggaagtgttcagtcctctggacc

SEQ ID NO: 707915 - DNA, 25 bp, Mus musculus
gtggaagtgttctgtcctctggacc

SEQ ID NO: 707916 - DNA, 25 bp, Mus musculus
gtggaagttagtcttctgtttatac

SEQ ID NO: 707917 - DNA, 25 bp, Mus musculus
gtggaagttagtgttctgtttatac

SEQ ID NO: 707918 - DNA, 25 bp, Mus musculus
gtggaagtttctattccctatctct

SEQ ID NO: 707919 - DNA, 25 bp, Mus musculus
gtggaagtttcttttccctatctct

SEQ ID NO: 707920 - DNA, 25 bp, Mus musculus
gtggaatacaaaacatcacctttat

SEQ ID NO: 707921 - DNA, 25 bp, Mus musculus
gtggaatacaaatcatcacctttat

SEQ ID NO: 707922 - DNA, 25 bp, Mus musculus
gtggaataccagacttggagcagtt

SEQ ID NO: 707923 - DNA, 25 bp, Mus musculus
gtggaataccagcatctatgtgcat

SEQ ID NO: 707924 - DNA, 25 bp, Mus musculus
gtggaataccaggatctatgtgcat

SEQ ID NO: 707925 - DNA, 25 bp, Mus musculus
gtggaataccagtcttggagcagtt

SEQ ID NO: 707926 - DNA, 25 bp, Mus musculus
gtggaataccttactggaacttgtc

SEQ ID NO: 707927 - DNA, 25 bp, Mus musculus
gtggaatacctttctggaacttgtc

SEQ ID NO: 707928 - DNA, 25 bp, Mus musculus
gtggaatacgagactgcctcggttc

SEQ ID NO: 707929 - DNA, 25 bp, Mus musculus
gtggaatacgagtctgcctcggttc

SEQ ID NO: 707930 - DNA, 25 bp, Mus musculus
gtggaatactgtaccatatgctcct

SEQ ID NO: 707931 - DNA, 25 bp, Mus musculus
gtggaatactgttccatatgctcct

SEQ ID NO: 707932 - DNA, 25 bp, Mus musculus
gtggaatagcagaacttatgtagaa

SEQ ID NO: 707933 - DNA, 25 bp, Mus musculus
gtggaatagcagtacttatgtagaa

SEQ ID NO: 707934 - DNA, 25 bp, Mus musculus
gtggaatagccacctcttgaccagt

SEQ ID NO: 707935 - DNA, 25 bp, Mus musculus
gtggaatagccagctcttgaccagt

SEQ ID NO: 707936 - DNA, 25 bp, Mus musculus
gtggaatatcacatagccttggtta

SEQ ID NO: 707937 - DNA, 25 bp, Mus musculus
gtggaatatcacttagccttggtta

SEQ ID NO: 707938 - DNA, 25 bp, Mus musculus
gtggaatcaaagcaccttttgcttt

SEQ ID NO: 707939 - DNA, 25 bp, Mus musculus
gtggaatcaaaggaccttttgcttt

SEQ ID NO: 707940 - DNA, 25 bp, Mus musculus
gtggaatcaagcaaattaccctgag

SEQ ID NO: 707941 - DNA, 25 bp, Mus musculus
gtggaatcaagctaattaccctgag

SEQ ID NO: 707942 - DNA, 25 bp, Mus musculus
gtggaatcacctacagatccttcaa

SEQ ID NO: 707943 - DNA, 25 bp, Mus musculus
gtggaatcaccttcagatccttcaa

SEQ ID NO: 707944 - DNA, 25 bp, Mus musculus
gtggaatcacttatctatttgttca

SEQ ID NO: 707945 - DNA, 25 bp, Mus musculus
gtggaatcacttttctatttgttca

SEQ ID NO: 707946 - DNA, 25 bp, Mus musculus
gtggaatcaggcactgtcagcttcc

SEQ ID NO: 707947 - DNA, 25 bp, Mus musculus
gtggaatcaggctctgtcagcttcc

SEQ ID NO: 707948 - DNA, 25 bp, Mus musculus
gtggaatcagtcatgcacaggctgc

SEQ ID NO: 707949 - DNA, 25 bp, Mus musculus
gtggaatcagtcttgcacaggctgc

SEQ ID NO: 707950 - DNA, 25 bp, Mus musculus
gtggaatccatacataccgccagaa

SEQ ID NO: 707951 - DNA, 25 bp, Mus musculus
gtggaatccatagataccgccagaa

SEQ ID NO: 707952 - DNA, 25 bp, Mus musculus
gtggaatcctacattctgtatagct

SEQ ID NO: 707953 - DNA, 25 bp, Mus musculus
gtggaatcctactttctgtatagct

SEQ ID NO: 707954 - DNA, 25 bp, Mus musculus
gtggaatcctcactgtttaatccca

SEQ ID NO: 707955 - DNA, 25 bp, Mus musculus
gtggaatcctcagtgtttaatccca

SEQ ID NO: 707956 - DNA, 25 bp, Mus musculus
gtggaatcctggattaaacattctt

SEQ ID NO: 707957 - DNA, 25 bp, Mus musculus
gtggaatcctggtttaaacattctt

SEQ ID NO: 707958 - DNA, 25 bp, Mus musculus
gtggaatccttcaaagttagccttg

SEQ ID NO: 707959 - DNA, 25 bp, Mus musculus
gtggaatccttctaagttagccttg

SEQ ID NO: 707960 - DNA, 25 bp, Mus musculus
gtggaatcgccacaaactaacattg

SEQ ID NO: 707961 - DNA, 25 bp, Mus musculus
gtggaatcgccagaaactaacattg

SEQ ID NO: 707962 - DNA, 25 bp, Mus musculus
gtggaatctccaaatactgtctggc

SEQ ID NO: 707963 - DNA, 25 bp, Mus musculus
gtggaatctccatatactgtctggc

SEQ ID NO: 707964 - DNA, 25 bp, Mus musculus
gtggaatctgatcgactaaggacaa

SEQ ID NO: 707965 - DNA, 25 bp, Mus musculus
gtggaatctgatggactaaggacaa

SEQ ID NO: 707966 - DNA, 25 bp, Mus musculus
gtggaatctgtgatcaccagctttg

SEQ ID NO: 707967 - DNA, 25 bp, Mus musculus
gtggaatctgtgttcaccagctttg

SEQ ID NO: 707968 - DNA, 25 bp, Mus musculus
gtggaatcttttagcataatgtacc

SEQ ID NO: 707969 - DNA, 25 bp, Mus musculus
gtggaatctttttgcataatgtacc

SEQ ID NO: 707970 - DNA, 25 bp, Mus musculus
gtggaatgaagtcacccggagaata

SEQ ID NO: 707971 - DNA, 25 bp, Mus musculus
gtggaatgaagtgacccggagaata

SEQ ID NO: 707972 - DNA, 25 bp, Mus musculus
gtggaatgaatgcttctgtgctcag

SEQ ID NO: 707973 - DNA, 25 bp, Mus musculus
gtggaatgaatggttctgtgctcag

SEQ ID NO: 707974 - DNA, 25 bp, Mus musculus
gtggaatgaccacaagacttttaat

SEQ ID NO: 707975 - DNA, 25 bp, Mus musculus
gtggaatgaccagaagacttttaat

SEQ ID NO: 707976 - DNA, 25 bp, Mus musculus
gtggaatgcagccacattgtgtcat

SEQ ID NO: 707977 - DNA, 25 bp, Mus musculus
gtggaatgcagcgacattgtgtcat

SEQ ID NO: 707978 - DNA, 25 bp, Mus musculus
gtggaatgctatatctcagggagaa

SEQ ID NO: 707979 - DNA, 25 bp, Mus musculus
gtggaatgctatttctcagggagaa

SEQ ID NO: 707980 - DNA, 25 bp, Mus musculus
gtggaatgctcaccagcgcgtgaaa

SEQ ID NO: 707981 - DNA, 25 bp, Mus musculus
gtggaatgctcagcagcgcgtgaaa

SEQ ID NO: 707982 - DNA, 25 bp, Mus musculus
gtggaatggacacctatagacagta

SEQ ID NO: 707983 - DNA, 25 bp, Mus musculus
gtggaatggacagctatagacagta

SEQ ID NO: 707984 - DNA, 25 bp, Mus musculus
gtggaatggactatctgtctcacag

SEQ ID NO: 707985 - DNA, 25 bp, Mus musculus
gtggaatggactttctgtctcacag

SEQ ID NO: 707986 - DNA, 25 bp, Mus musculus
gtggaatgtcacacgagacccaggc

SEQ ID NO: 707987 - DNA, 25 bp, Mus musculus
gtggaatgtcactcgagacccaggc

SEQ ID NO: 707988 - DNA, 25 bp, Mus musculus
gtggaatgtttcactgtagcccttc

SEQ ID NO: 707989 - DNA, 25 bp, Mus musculus
gtggaatgtttctctgtagcccttc

SEQ ID NO: 707990 - DNA, 25 bp, Mus musculus
gtggaattacctctgtctaaccatg

SEQ ID NO: 707991 - DNA, 25 bp, Mus musculus
gtggaattacctgtgtctaaccatg

SEQ ID NO: 707992 - DNA, 25 bp, Mus musculus
gtggaattcgatattatgcagactg

SEQ ID NO: 707993 - DNA, 25 bp, Mus musculus
gtggaattcgattttatgcagactg

SEQ ID NO: 707994 - DNA, 25 bp, Mus musculus
gtggaattctccatggcctcagaga

SEQ ID NO: 707995 - DNA, 25 bp, Mus musculus
gtggaattctccttggcctcagaga

SEQ ID NO: 707996 - DNA, 25 bp, Mus musculus
gtggaattctctacaactgtggtgg

SEQ ID NO: 707997 - DNA, 25 bp, Mus musculus
gtggaattctcttcaactgtggtgg

SEQ ID NO: 707998 - DNA, 25 bp, Mus musculus
gtggaattctgactaaagcatggga

SEQ ID NO: 707999 - DNA, 25 bp, Mus musculus
gtggaattctgagtaaagcatggga

SEQ ID NO: 708000 - DNA, 25 bp, Mus musculus
gtggaattgcatctgctggcttctc

SEQ ID NO: 708001 - DNA, 25 bp, Mus musculus
gtggaattgcatgtgctggcttctc

SEQ ID NO: 708002 - DNA, 25 bp, Mus musculus
gtggaatttacaaaacaggaggaac

SEQ ID NO: 708003 - DNA, 25 bp, Mus musculus
gtggaatttacataacaggaggaac

SEQ ID NO: 708004 - DNA, 25 bp, Mus musculus
gtggaatttactcctctggacttgc

SEQ ID NO: 708005 - DNA, 25 bp, Mus musculus
gtggaatttactgctctggacttgc

SEQ ID NO: 708006 - DNA, 25 bp, Mus musculus
gtggaatttcttaggccaagacagt

SEQ ID NO: 708007 - DNA, 25 bp, Mus musculus
gtggaatttctttggccaagacagt

SEQ ID NO: 708008 - DNA, 25 bp, Mus musculus
gtggaatttgttaccagatatcagt

SEQ ID NO: 708009 - DNA, 25 bp, Mus musculus
gtggaatttgtttccagatatcagt

SEQ ID NO: 708010 - DNA, 25 bp, Mus musculus
gtggacaaacctcgcagttgagctt

SEQ ID NO: 708011 - DNA, 25 bp, Mus musculus
gtggacaaacctggcagttgagctt

SEQ ID NO: 708012 - DNA, 25 bp, Mus musculus
gtggacaaatggacaggcttagcat

SEQ ID NO: 708013 - DNA, 25 bp, Mus musculus
gtggacaaatggtcaggcttagcat

SEQ ID NO: 708014 - DNA, 25 bp, Mus musculus
gtggacaaattaccccagctataag

SEQ ID NO: 708015 - DNA, 25 bp, Mus musculus
gtggacaaattagcccagctataag

SEQ ID NO: 708016 - DNA, 25 bp, Mus musculus
gtggacaacaaaagggtctgctggt

SEQ ID NO: 708017 - DNA, 25 bp, Mus musculus
gtggacaacaaatgggtctgctggt

SEQ ID NO: 708018 - DNA, 25 bp, Mus musculus
gtggacaacccacaacgagtctttg

SEQ ID NO: 708019 - DNA, 25 bp, Mus musculus
gtggacaacccagaacgagtctttg

SEQ ID NO: 708020 - DNA, 25 bp, Mus musculus
gtggacaacgctcccaggtttggct

SEQ ID NO: 708021 - DNA, 25 bp, Mus musculus
gtggacaacgctgccaggtttggct

SEQ ID NO: 708022 - DNA, 25 bp, Mus musculus
gtggacaacttcacacccattggtg

SEQ ID NO: 708023 - DNA, 25 bp, Mus musculus
gtggacaacttctcacccattggtg

SEQ ID NO: 708024 - DNA, 25 bp, Mus musculus
gtggacaactttatgacctcctaaa

SEQ ID NO: 708025 - DNA, 25 bp, Mus musculus
gtggacaactttttgacctcctaaa

SEQ ID NO: 708026 - DNA, 25 bp, Mus musculus
gtggacaagagtacatttgttcctg

SEQ ID NO: 708027 - DNA, 25 bp, Mus musculus
gtggacaagagttcatttgttcctg

SEQ ID NO: 708028 - DNA, 25 bp, Mus musculus
gtggacaagatcatgcagcgcacaa

SEQ ID NO: 708029 - DNA, 25 bp, Mus musculus
gtggacaagatcttgcagcgcacaa

SEQ ID NO: 708030 - DNA, 25 bp, Mus musculus
gtggacaaggtcatcaacctcagta

SEQ ID NO: 708031 - DNA, 25 bp, Mus musculus
gtggacaaggtcctggcctgcacct

SEQ ID NO: 708032 - DNA, 25 bp, Mus musculus
gtggacaaggtcgtggcctgcacct

SEQ ID NO: 708033 - DNA, 25 bp, Mus musculus
gtggacaaggtcttcaacctcagta

SEQ ID NO: 708034 - DNA, 25 bp, Mus musculus
gtggacaatatcagggttctgtaaa

SEQ ID NO: 708035 - DNA, 25 bp, Mus musculus
gtggacaatatctgggttctgtaaa

SEQ ID NO: 708036 - DNA, 25 bp, Mus musculus
gtggacaatcccaacggagatatca

SEQ ID NO: 708037 - DNA, 25 bp, Mus musculus
gtggacaatccctacggagatatca

SEQ ID NO: 708038 - DNA, 25 bp, Mus musculus
gtggacacaactcggtttccattaa

SEQ ID NO: 708039 - DNA, 25 bp, Mus musculus
gtggacacaactgggtttccattaa

SEQ ID NO: 708040 - DNA, 25 bp, Mus musculus
gtggacacacctacatcagaagcat

SEQ ID NO: 708041 - DNA, 25 bp, Mus musculus
gtggacacaccttcatcagaagcat

SEQ ID NO: 708042 - DNA, 25 bp, Mus musculus
gtggacacacggctttcccaggttc

SEQ ID NO: 708043 - DNA, 25 bp, Mus musculus
gtggacacacgggtttcccaggttc

SEQ ID NO: 708044 - DNA, 25 bp, Mus musculus
gtggacacactgatctcacagacta

SEQ ID NO: 708045 - DNA, 25 bp, Mus musculus
gtggacacactgttctcacagacta

SEQ ID NO: 708046 - DNA, 25 bp, Mus musculus
gtggacacagcaatcgggtgacctc

SEQ ID NO: 708047 - DNA, 25 bp, Mus musculus
gtggacacagcattcgggtgacctc

SEQ ID NO: 708048 - DNA, 25 bp, Mus musculus
gtggacacagtgaggaacccattgt

SEQ ID NO: 708049 - DNA, 25 bp, Mus musculus
gtggacacagtgtggaacccattgt

SEQ ID NO: 708050 - DNA, 25 bp, Mus musculus
gtggacacagttatggctagaggta

SEQ ID NO: 708051 - DNA, 25 bp, Mus musculus
gtggacacagttcaggaacctccca

SEQ ID NO: 708052 - DNA, 25 bp, Mus musculus
gtggacacagttgaggaacctccca

SEQ ID NO: 708053 - DNA, 25 bp, Mus musculus
gtggacacagttttggctagaggta

SEQ ID NO: 708054 - DNA, 25 bp, Mus musculus
gtggacacatgaaggcccacgtctt

SEQ ID NO: 708055 - DNA, 25 bp, Mus musculus
gtggacacatgatggcccacgtctt

SEQ ID NO: 708056 - DNA, 25 bp, Mus musculus
gtggacacatggcaaatagacctca

SEQ ID NO: 708057 - DNA, 25 bp, Mus musculus
gtggacacatgggaaatagacctca

SEQ ID NO: 708058 - DNA, 25 bp, Mus musculus
gtggacacatgtacctgacactcaa

SEQ ID NO: 708059 - DNA, 25 bp, Mus musculus
gtggacacatgttcctgacactcaa

SEQ ID NO: 708060 - DNA, 25 bp, Mus musculus
gtggacacattgaggtcctgtgcct

SEQ ID NO: 708061 - DNA, 25 bp, Mus musculus
gtggacacattgtggtcctgtgcct

SEQ ID NO: 708062 - DNA, 25 bp, Mus musculus
gtggacaccaacaaacctgcagaca

SEQ ID NO: 708063 - DNA, 25 bp, Mus musculus
gtggacaccaactaacctgcagaca

SEQ ID NO: 708064 - DNA, 25 bp, Mus musculus
gtggacaccaccatgccatcgtgta

SEQ ID NO: 708065 - DNA, 25 bp, Mus musculus
gtggacaccaccttgccatcgtgta

SEQ ID NO: 708066 - DNA, 25 bp, Mus musculus
gtggacaccagccaggaagctcacc

SEQ ID NO: 708067 - DNA, 25 bp, Mus musculus
gtggacaccagcgaggaagctcacc

SEQ ID NO: 708068 - DNA, 25 bp, Mus musculus
gtggacaccaggcacctgtgtagaa

SEQ ID NO: 708069 - DNA, 25 bp, Mus musculus
gtggacaccagggacctgtgtagaa

SEQ ID NO: 708070 - DNA, 25 bp, Mus musculus
gtggacaccagtatccttttttcat

SEQ ID NO: 708071 - DNA, 25 bp, Mus musculus
gtggacaccagtttccttttttcat

SEQ ID NO: 708072 - DNA, 25 bp, Mus musculus
gtggacaccatccttaccatgaaga

SEQ ID NO: 708073 - DNA, 25 bp, Mus musculus
gtggacaccatcgttaccatgaaga

SEQ ID NO: 708074 - DNA, 25 bp, Mus musculus
gtggacacccagatcatcgatgaga

SEQ ID NO: 708075 - DNA, 25 bp, Mus musculus
gtggacacccagttcatcgatgaga

SEQ ID NO: 708076 - DNA, 25 bp, Mus musculus
gtggacacgcccacagcacggagcc

SEQ ID NO: 708077 - DNA, 25 bp, Mus musculus
gtggacacgccctcagcacggagcc

SEQ ID NO: 708078 - DNA, 25 bp, Mus musculus
gtggacacggagctcctggaacaat

SEQ ID NO: 708079 - DNA, 25 bp, Mus musculus
gtggacacggaggtcctggaacaat

SEQ ID NO: 708080 - DNA, 25 bp, Mus musculus
gtggacacgtcaactttttgagtta

SEQ ID NO: 708081 - DNA, 25 bp, Mus musculus
gtggacacgtcatctttttgagtta

SEQ ID NO: 708082 - DNA, 25 bp, Mus musculus
gtggacacgtccaacaaaacattga

SEQ ID NO: 708083 - DNA, 25 bp, Mus musculus
gtggacacgtcctacaaaacattga

SEQ ID NO: 708084 - DNA, 25 bp, Mus musculus
gtggacacgtctactgcaagtgatt

SEQ ID NO: 708085 - DNA, 25 bp, Mus musculus
gtggacacgtcttctgcaagtgatt

SEQ ID NO: 708086 - DNA, 25 bp, Mus musculus
gtggacactcgcacttggccaggta

SEQ ID NO: 708087 - DNA, 25 bp, Mus musculus
gtggacactcgctcttggccaggta

SEQ ID NO: 708088 - DNA, 25 bp, Mus musculus
gtggacactgaaatccgcgtcgagt

SEQ ID NO: 708089 - DNA, 25 bp, Mus musculus
gtggacactgaattccgcgtcgagt

SEQ ID NO: 708090 - DNA, 25 bp, Mus musculus
gtggacacttcacagtcagacccat

SEQ ID NO: 708091 - DNA, 25 bp, Mus musculus
gtggacacttcagagtcagacccat

SEQ ID NO: 708092 - DNA, 25 bp, Mus musculus
gtggacacttgaaaacccctaactg

SEQ ID NO: 708093 - DNA, 25 bp, Mus musculus
gtggacacttgaatattatagcctg

SEQ ID NO: 708094 - DNA, 25 bp, Mus musculus
gtggacacttgataacccctaactg

SEQ ID NO: 708095 - DNA, 25 bp, Mus musculus
gtggacacttgattattatagcctg

SEQ ID NO: 708096 - DNA, 25 bp, Mus musculus
gtggacagaaacattggaacctagt

SEQ ID NO: 708097 - DNA, 25 bp, Mus musculus
gtggacagaaactttggaacctagt

SEQ ID NO: 708098 - DNA, 25 bp, Mus musculus
gtggacagaagaacctacacaagaa

SEQ ID NO: 708099 - DNA, 25 bp, Mus musculus
gtggacagaagatcctacacaagaa

SEQ ID NO: 708100 - DNA, 25 bp, Mus musculus
gtggacagacatcgatccagctgcc

SEQ ID NO: 708101 - DNA, 25 bp, Mus musculus
gtggacagacatggatccagctgcc

SEQ ID NO: 708102 - DNA, 25 bp, Mus musculus
gtggacagagcaagcacactcccat

SEQ ID NO: 708103 - DNA, 25 bp, Mus musculus
gtggacagagcatgcacactcccat

SEQ ID NO: 708104 - DNA, 25 bp, Mus musculus
gtggacagatgaagaactgggaatc

SEQ ID NO: 708105 - DNA, 25 bp, Mus musculus
gtggacagatgatgaactgggaatc

SEQ ID NO: 708106 - DNA, 25 bp, Mus musculus
gtggacagcacaataggctttcttc

SEQ ID NO: 708107 - DNA, 25 bp, Mus musculus
gtggacagcacattaggctttcttc

SEQ ID NO: 708108 - DNA, 25 bp, Mus musculus
gtggacagcaggcaccatacactcc

SEQ ID NO: 708109 - DNA, 25 bp, Mus musculus
gtggacagcagggaccatacactcc

SEQ ID NO: 708110 - DNA, 25 bp, Mus musculus
gtggacagcattcatcttggcagcc

SEQ ID NO: 708111 - DNA, 25 bp, Mus musculus
gtggacagcattgatcttggcagcc

SEQ ID NO: 708112 - DNA, 25 bp, Mus musculus
gtggacagcctgatacctcaaaaca

SEQ ID NO: 708113 - DNA, 25 bp, Mus musculus
gtggacagcctgttacctcaaaaca

SEQ ID NO: 708114 - DNA, 25 bp, Mus musculus
gtggacagcgccacatagaagggat

SEQ ID NO: 708115 - DNA, 25 bp, Mus musculus
gtggacagcgcctcatagaagggat

SEQ ID NO: 708116 - DNA, 25 bp, Mus musculus
gtggacagctccctgttgagagttt

SEQ ID NO: 708117 - DNA, 25 bp, Mus musculus
gtggacagctccgtgttgagagttt

SEQ ID NO: 708118 - DNA, 25 bp, Mus musculus
gtggacaggagcaccgcacagcagt

SEQ ID NO: 708119 - DNA, 25 bp, Mus musculus
gtggacaggagctccgcacagcagt

SEQ ID NO: 708120 - DNA, 25 bp, Mus musculus
gtggacagggctacaaaatggcatt

SEQ ID NO: 708121 - DNA, 25 bp, Mus musculus
gtggacagggcttcaaaatggcatt

SEQ ID NO: 708122 - DNA, 25 bp, Mus musculus
gtggacagtagacactatgctagct

SEQ ID NO: 708123 - DNA, 25 bp, Mus musculus
gtggacagtagagactatgctagct

SEQ ID NO: 708124 - DNA, 25 bp, Mus musculus
gtggacagtgaacctccatgtctcc

SEQ ID NO: 708125 - DNA, 25 bp, Mus musculus
gtggacagtgaagctccatgtctcc

SEQ ID NO: 708126 - DNA, 25 bp, Mus musculus
gtggacagtgcccatgtttctgaga

SEQ ID NO: 708127 - DNA, 25 bp, Mus musculus
gtggacagtgccgatgtttctgaga

SEQ ID NO: 708128 - DNA, 25 bp, Mus musculus
gtggacagtgcgatattcattacag

SEQ ID NO: 708129 - DNA, 25 bp, Mus musculus
gtggacagtgcgttattcattacag

SEQ ID NO: 708130 - DNA, 25 bp, Mus musculus
gtggacagtggcactctttcagaag

SEQ ID NO: 708131 - DNA, 25 bp, Mus musculus
gtggacagtggctctctttcagaag

SEQ ID NO: 708132 - DNA, 25 bp, Mus musculus
gtggacagttagacctttccacttt

SEQ ID NO: 708133 - DNA, 25 bp, Mus musculus
gtggacagttagtcctttccacttt

SEQ ID NO: 708134 - DNA, 25 bp, Mus musculus
gtggacagttgaatataccctcgaa

SEQ ID NO: 708135 - DNA, 25 bp, Mus musculus
gtggacagttgattataccctcgaa

SEQ ID NO: 708136 - DNA, 25 bp, Mus musculus
gtggacagttggatggctttgtttc

SEQ ID NO: 708137 - DNA, 25 bp, Mus musculus
gtggacagttggttggctttgtttc

SEQ ID NO: 708138 - DNA, 25 bp, Mus musculus
gtggacagtttacacacttaacaca

SEQ ID NO: 708139 - DNA, 25 bp, Mus musculus
gtggacagtttagacacttaacaca

SEQ ID NO: 708140 - DNA, 25 bp, Mus musculus
gtggacagttttcaccttttattag

SEQ ID NO: 708141 - DNA, 25 bp, Mus musculus
gtggacagttttcagcaagttgcaa

SEQ ID NO: 708142 - DNA, 25 bp, Mus musculus
gtggacagttttgaccttttattag

SEQ ID NO: 708143 - DNA, 25 bp, Mus musculus
gtggacagttttgagcaagttgcaa

SEQ ID NO: 708144 - DNA, 25 bp, Mus musculus
gtggacatacaacatgagcatggct

SEQ ID NO: 708145 - DNA, 25 bp, Mus musculus
gtggacatacaagatgagcatggct

SEQ ID NO: 708146 - DNA, 25 bp, Mus musculus
gtggacatacagagaaggtttattt

SEQ ID NO: 708147 - DNA, 25 bp, Mus musculus
gtggacatacagtgaaggtttattt

SEQ ID NO: 708148 - DNA, 25 bp, Mus musculus
gtggacatactcacacttattgtgt

SEQ ID NO: 708149 - DNA, 25 bp, Mus musculus
gtggacatactctcacttattgtgt

SEQ ID NO: 708150 - DNA, 25 bp, Mus musculus
gtggacatagaacaccagacacatg

SEQ ID NO: 708151 - DNA, 25 bp, Mus musculus
gtggacatagaagaccagacacatg

SEQ ID NO: 708152 - DNA, 25 bp, Mus musculus
gtggacatagagatgccggagcccc

SEQ ID NO: 708153 - DNA, 25 bp, Mus musculus
gtggacatagagttgccggagcccc

SEQ ID NO: 708154 - DNA, 25 bp, Mus musculus
gtggacatagccacaactccagtta

SEQ ID NO: 708155 - DNA, 25 bp, Mus musculus
gtggacatagcctcaactccagtta

SEQ ID NO: 708156 - DNA, 25 bp, Mus musculus
gtggacatattccataccctggtgt

SEQ ID NO: 708157 - DNA, 25 bp, Mus musculus
gtggacatattcgataccctggtgt

SEQ ID NO: 708158 - DNA, 25 bp, Mus musculus
gtggacatcatcagccttttcattt

SEQ ID NO: 708159 - DNA, 25 bp, Mus musculus
gtggacatcatctgccttttcattt

SEQ ID NO: 708160 - DNA, 25 bp, Mus musculus
gtggacatcattccctgtgttcatt

SEQ ID NO: 708161 - DNA, 25 bp, Mus musculus
gtggacatcattgcctgtgttcatt

SEQ ID NO: 708162 - DNA, 25 bp, Mus musculus
gtggacatccaaccaaattgagagt

SEQ ID NO: 708163 - DNA, 25 bp, Mus musculus
gtggacatccaagcaaattgagagt

SEQ ID NO: 708164 - DNA, 25 bp, Mus musculus
gtggacatccagctctgccagtgta

SEQ ID NO: 708165 - DNA, 25 bp, Mus musculus
gtggacatccaggtctgccagtgta

SEQ ID NO: 708166 - DNA, 25 bp, Mus musculus
gtggacatcctaactctaagcgaga

SEQ ID NO: 708167 - DNA, 25 bp, Mus musculus
gtggacatcctatctctaagcgaga

SEQ ID NO: 708168 - DNA, 25 bp, Mus musculus
gtggacatcctcatcatggatgacg

SEQ ID NO: 708169 - DNA, 25 bp, Mus musculus
gtggacatcctcttcatggatgacg

SEQ ID NO: 708170 - DNA, 25 bp, Mus musculus
gtggacatcgacatggatggatcct

SEQ ID NO: 708171 - DNA, 25 bp, Mus musculus
gtggacatcgacttggatggatcct

SEQ ID NO: 708172 - DNA, 25 bp, Mus musculus
gtggacatcttaattcacttttggg

SEQ ID NO: 708173 - DNA, 25 bp, Mus musculus
gtggacatcttacggctggtatcag

SEQ ID NO: 708174 - DNA, 25 bp, Mus musculus
gtggacatcttagggctggtatcag

SEQ ID NO: 708175 - DNA, 25 bp, Mus musculus
gtggacatcttatttcacttttggg

SEQ ID NO: 708176 - DNA, 25 bp, Mus musculus
gtggacatgaaacagctgggtattt

SEQ ID NO: 708177 - DNA, 25 bp, Mus musculus
gtggacatgaaagagctgggtattt

SEQ ID NO: 708178 - DNA, 25 bp, Mus musculus
gtggacatgaagaccgcaactgaca

SEQ ID NO: 708179 - DNA, 25 bp, Mus musculus
gtggacatgaagtccgcaactgaca

SEQ ID NO: 708180 - DNA, 25 bp, Mus musculus
gtggacatgactaagaaactgctct

SEQ ID NO: 708181 - DNA, 25 bp, Mus musculus
gtggacatgacttagaaactgctct

SEQ ID NO: 708182 - DNA, 25 bp, Mus musculus
gtggacatgcaaaatctctgcgcct

SEQ ID NO: 708183 - DNA, 25 bp, Mus musculus
gtggacatgcaatatctctgcgcct

SEQ ID NO: 708184 - DNA, 25 bp, Mus musculus
gtggacatgctaactttcaatgaag

SEQ ID NO: 708185 - DNA, 25 bp, Mus musculus
gtggacatgctatctttcaatgaag

SEQ ID NO: 708186 - DNA, 25 bp, Mus musculus
gtggacatggagactcttatcagat

SEQ ID NO: 708187 - DNA, 25 bp, Mus musculus
gtggacatggagtctcttatcagat

SEQ ID NO: 708188 - DNA, 25 bp, Mus musculus
gtggacatggctatttaccaaggaa

SEQ ID NO: 708189 - DNA, 25 bp, Mus musculus
gtggacatggctttttaccaaggaa

SEQ ID NO: 708190 - DNA, 25 bp, Mus musculus
gtggacattaatcccttgactggaa

SEQ ID NO: 708191 - DNA, 25 bp, Mus musculus
gtggacattaatgccttgactggaa

SEQ ID NO: 708192 - DNA, 25 bp, Mus musculus
gtggacattatcagaggctttctta

SEQ ID NO: 708193 - DNA, 25 bp, Mus musculus
gtggacattatctgaggctttctta

SEQ ID NO: 708194 - DNA, 25 bp, Mus musculus
gtggacattcaaccagatgcactga

SEQ ID NO: 708195 - DNA, 25 bp, Mus musculus
gtggacattcaagcagatgcactga

SEQ ID NO: 708196 - DNA, 25 bp, Mus musculus
gtggacattcatctattgttcaagc

SEQ ID NO: 708197 - DNA, 25 bp, Mus musculus
gtggacattcatgtattgttcaagc

SEQ ID NO: 708198 - DNA, 20 bp, Mus musculus
gtggacattccacactgtgg

SEQ ID NO: 708199 - DNA, 20 bp, Mus musculus
gtggacattccccactgtgg

SEQ ID NO: 708200 - DNA, 20 bp, Mus musculus
gtggacattccgcactgtgg

SEQ ID NO: 708201 - DNA, 20 bp, Mus musculus
gtggacattcctcactgtgg

SEQ ID NO: 708202 - DNA, 25 bp, Mus musculus
gtggaccaaatcctgtcccagacag

SEQ ID NO: 708203 - DNA, 25 bp, Mus musculus
gtggaccaaatcgtgtcccagacag

SEQ ID NO: 708204 - DNA, 25 bp, Mus musculus
gtggaccaaccacttttatacaagt

SEQ ID NO: 708205 - DNA, 25 bp, Mus musculus
gtggaccaaccagttttatacaagt

SEQ ID NO: 708206 - DNA, 25 bp, Mus musculus
gtggaccaagcacttgactctgttc

SEQ ID NO: 708207 - DNA, 25 bp, Mus musculus
gtggaccaagcagttgactctgttc

SEQ ID NO: 708208 - DNA, 25 bp, Mus musculus
gtggaccacacaaagccatcctgtc

SEQ ID NO: 708209 - DNA, 25 bp, Mus musculus
gtggaccacacatagccatcctgtc

SEQ ID NO: 708210 - DNA, 25 bp, Mus musculus
gtggaccaccccagatacattcaat

SEQ ID NO: 708211 - DNA, 25 bp, Mus musculus
gtggaccacccctgatacattcaat

SEQ ID NO: 708212 - DNA, 25 bp, Mus musculus
gtggaccaccctatgtaggcagagg

SEQ ID NO: 708213 - DNA, 25 bp, Mus musculus
gtggaccaccctttgtaggcagagg

SEQ ID NO: 708214 - DNA, 25 bp, Mus musculus
gtggaccaccgtcagttctaggaca

SEQ ID NO: 708215 - DNA, 25 bp, Mus musculus
gtggaccaccgtgagttctaggaca

SEQ ID NO: 708216 - DNA, 25 bp, Mus musculus
gtggaccagaaaccaattcatattg

SEQ ID NO: 708217 - DNA, 25 bp, Mus musculus
gtggaccagaaagcaattcatattg

SEQ ID NO: 708218 - DNA, 25 bp, Mus musculus
gtggaccagattcggctttgtgcct

SEQ ID NO: 708219 - DNA, 25 bp, Mus musculus
gtggaccagattgggctttgtgcct

SEQ ID NO: 708220 - DNA, 25 bp, Mus musculus
gtggaccagcaacgtttctcgcgac

SEQ ID NO: 708221 - DNA, 25 bp, Mus musculus
gtggaccagcaaggtttctcgcgac

SEQ ID NO: 708222 - DNA, 25 bp, Mus musculus
gtggaccagcatcttactctgaatg

SEQ ID NO: 708223 - DNA, 25 bp, Mus musculus
gtggaccagcatgttactctgaatg

SEQ ID NO: 708224 - DNA, 25 bp, Mus musculus
gtggaccagtcaaggatgcaagcaa

SEQ ID NO: 708225 - DNA, 25 bp, Mus musculus
gtggaccagtcatggatgcaagcaa

SEQ ID NO: 708226 - DNA, 25 bp, Mus musculus
gtggaccagtcgatttttcttgaga

SEQ ID NO: 708227 - DNA, 25 bp, Mus musculus
gtggaccagtcgttttttcttgaga

SEQ ID NO: 708228 - DNA, 25 bp, Mus musculus
gtggaccatcaaaccaatgtgggta

SEQ ID NO: 708229 - DNA, 25 bp, Mus musculus
gtggaccatcaatccaatgtgggta

SEQ ID NO: 708230 - DNA, 25 bp, Mus musculus
gtggaccatgttcctggcatatatg

SEQ ID NO: 708231 - DNA, 25 bp, Mus musculus
gtggaccatgttgctggcatatatg

SEQ ID NO: 708232 - DNA, 25 bp, Mus musculus
gtggacccaattcctggacacagta

SEQ ID NO: 708233 - DNA, 25 bp, Mus musculus
gtggacccaattgctggacacagta

SEQ ID NO: 708234 - DNA, 25 bp, Mus musculus
gtggacccagtcaaggcaccccagt

SEQ ID NO: 708235 - DNA, 25 bp, Mus musculus
gtggacccagtctaggcaccccagt

SEQ ID NO: 708236 - DNA, 25 bp, Mus musculus
gtggaccccataaataccaacgtaa

SEQ ID NO: 708237 - DNA, 25 bp, Mus musculus
gtggaccccataacaaacagcctat

SEQ ID NO: 708238 - DNA, 25 bp, Mus musculus
gtggaccccatatataccaacgtaa

SEQ ID NO: 708239 - DNA, 25 bp, Mus musculus
gtggaccccatatcaaacagcctat

SEQ ID NO: 708240 - DNA, 25 bp, Mus musculus
gtggaccccctaacaacagtgagag

SEQ ID NO: 708241 - DNA, 25 bp, Mus musculus
gtggaccccctatcaacagtgagag

SEQ ID NO: 708242 - DNA, 25 bp, Mus musculus
gtggaccccgagagaagacagcctg

SEQ ID NO: 708243 - DNA, 25 bp, Mus musculus
gtggaccccgagtgaagacagcctg

SEQ ID NO: 708244 - DNA, 25 bp, Mus musculus
gtggacccctgaatgggacattata

SEQ ID NO: 708245 - DNA, 25 bp, Mus musculus
gtggacccctgattgggacattata

SEQ ID NO: 708246 - DNA, 25 bp, Mus musculus
gtggacccgacaccggcgtgaatga

SEQ ID NO: 708247 - DNA, 25 bp, Mus musculus
gtggacccgacagcggcgtgaatga

SEQ ID NO: 708248 - DNA, 25 bp, Mus musculus
gtggacccggagctaaaggaaacat

SEQ ID NO: 708249 - DNA, 25 bp, Mus musculus
gtggacccggaggtaaaggaaacat

SEQ ID NO: 708250 - DNA, 25 bp, Mus musculus
gtggaccctacaccactgaaacgaa

SEQ ID NO: 708251 - DNA, 25 bp, Mus musculus
gtggaccctacagcactgaaacgaa

SEQ ID NO: 708252 - DNA, 25 bp, Mus musculus
gtggaccctcagatgcagcatttca

SEQ ID NO: 708253 - DNA, 25 bp, Mus musculus
gtggaccctcagttgcagcatttca

SEQ ID NO: 708254 - DNA, 25 bp, Mus musculus
gtggaccctgctcaacggaaagacg

SEQ ID NO: 708255 - DNA, 25 bp, Mus musculus
gtggaccctgctgaacggaaagacg

SEQ ID NO: 708256 - DNA, 25 bp, Mus musculus
gtggaccctggcacagtcatgagag

SEQ ID NO: 708257 - DNA, 25 bp, Mus musculus
gtggaccctggctcagtcatgagag

SEQ ID NO: 708258 - DNA, 25 bp, Mus musculus
gtggacccttacaagaaagaatcac

SEQ ID NO: 708259 - DNA, 25 bp, Mus musculus
gtggacccttactagaaagaatcac

SEQ ID NO: 708260 - DNA, 25 bp, Mus musculus
gtggacccttatatttctaacagtt

SEQ ID NO: 708261 - DNA, 25 bp, Mus musculus
gtggacccttatttttctaacagtt

SEQ ID NO: 708262 - DNA, 25 bp, Mus musculus
gtggaccggaatccctttgaggaca

SEQ ID NO: 708263 - DNA, 25 bp, Mus musculus
gtggaccggaatgcctttgaggaca

SEQ ID NO: 708264 - DNA, 25 bp, Mus musculus
gtggaccgtgtaaacctggcatcag

SEQ ID NO: 708265 - DNA, 25 bp, Mus musculus
gtggaccgtgtatacctggcatcag

SEQ ID NO: 708266 - DNA, 25 bp, Mus musculus
gtggacctagaaacgtctctctttc

SEQ ID NO: 708267 - DNA, 25 bp, Mus musculus
gtggacctagaatcgtctctctttc

SEQ ID NO: 708268 - DNA, 25 bp, Mus musculus
gtggacctagatacatcagccagat

SEQ ID NO: 708269 - DNA, 25 bp, Mus musculus
gtggacctagatatgaatccccagg

SEQ ID NO: 708270 - DNA, 25 bp, Mus musculus
gtggacctagattcatcagccagat

SEQ ID NO: 708271 - DNA, 25 bp, Mus musculus
gtggacctagatttgaatccccagg

SEQ ID NO: 708272 - DNA, 25 bp, Mus musculus
gtggacctagccagcttgagggtat

SEQ ID NO: 708273 - DNA, 25 bp, Mus musculus
gtggacctagcctgcttgagggtat

SEQ ID NO: 708274 - DNA, 25 bp, Mus musculus
gtggacctcaatcagctcagaagta

SEQ ID NO: 708275 - DNA, 25 bp, Mus musculus
gtggacctcaatgagctcagaagta

SEQ ID NO: 708276 - DNA, 25 bp, Mus musculus
gtggacctctagaaacatgctgcct

SEQ ID NO: 708277 - DNA, 25 bp, Mus musculus
gtggacctctagtaacatgctgcct

SEQ ID NO: 708278 - DNA, 25 bp, Mus musculus
gtggacctctgacttggagaccacc

SEQ ID NO: 708279 - DNA, 25 bp, Mus musculus
gtggacctctgagttggagaccacc

SEQ ID NO: 708280 - DNA, 25 bp, Mus musculus
gtggacctctgtcatgggacatctt

SEQ ID NO: 708281 - DNA, 25 bp, Mus musculus
gtggacctctgtgatgggacatctt

SEQ ID NO: 708282 - DNA, 25 bp, Mus musculus
gtggacctcttgagggcagttccca

SEQ ID NO: 708283 - DNA, 25 bp, Mus musculus
gtggacctcttgcccaaaatggcct

SEQ ID NO: 708284 - DNA, 25 bp, Mus musculus
gtggacctcttggccaaaatggcct

SEQ ID NO: 708285 - DNA, 25 bp, Mus musculus
gtggacctcttgtgggcagttccca

SEQ ID NO: 708286 - DNA, 25 bp, Mus musculus
gtggacctgcaccatttgtttgagg

SEQ ID NO: 708287 - DNA, 25 bp, Mus musculus
gtggacctgcacgatttgtttgagg

SEQ ID NO: 708288 - DNA, 25 bp, Mus musculus
gtggacctggaaccctactggaccc

SEQ ID NO: 708289 - DNA, 25 bp, Mus musculus
gtggacctggaagcctactggaccc

SEQ ID NO: 708290 - DNA, 25 bp, Mus musculus
gtggacctggccatctatgaaccaa

SEQ ID NO: 708291 - DNA, 25 bp, Mus musculus
gtggacctggccttctatgaaccaa

SEQ ID NO: 708292 - DNA, 25 bp, Mus musculus
gtggacctgggaagcttctacttgc

SEQ ID NO: 708293 - DNA, 25 bp, Mus musculus
gtggacctgggatgcttctacttgc

SEQ ID NO: 708294 - DNA, 25 bp, Mus musculus
gtggacctggtccacctcatgaaaa

SEQ ID NO: 708295 - DNA, 25 bp, Mus musculus
gtggacctggtcgacctcatgaaaa

SEQ ID NO: 708296 - DNA, 25 bp, Mus musculus
gtggacctggtgaatgcaaaaagct

SEQ ID NO: 708297 - DNA, 25 bp, Mus musculus
gtggacctggtgtatgcaaaaagct

SEQ ID NO: 708298 - DNA, 25 bp, Mus musculus
gtggacctgtagagtggcctcaaag

SEQ ID NO: 708299 - DNA, 25 bp, Mus musculus
gtggacctgtagtgtggcctcaaag

SEQ ID NO: 708300 - DNA, 25 bp, Mus musculus
gtggacctgtgcaatcttcctagaa

SEQ ID NO: 708301 - DNA, 25 bp, Mus musculus
gtggacctgtgctatcttcctagaa

SEQ ID NO: 708302 - DNA, 25 bp, Mus musculus
gtggaccttaccctgttatacaaga

SEQ ID NO: 708303 - DNA, 25 bp, Mus musculus
gtggaccttaccgtgttatacaaga

SEQ ID NO: 708304 - DNA, 25 bp, Mus musculus
gtggaccttggaaactgagagttgc

SEQ ID NO: 708305 - DNA, 25 bp, Mus musculus
gtggaccttggatactgagagttgc

SEQ ID NO: 708306 - DNA, 25 bp, Mus musculus
gtggacgacaagcacctgctgaaga

SEQ ID NO: 708307 - DNA, 25 bp, Mus musculus
gtggacgacaaggacctgctgaaga

SEQ ID NO: 708308 - DNA, 25 bp, Mus musculus
gtggacgacacacctgactgccatg

SEQ ID NO: 708309 - DNA, 25 bp, Mus musculus
gtggacgacacagctgactgccatg

SEQ ID NO: 708310 - DNA, 25 bp, Mus musculus
gtggacgacagcaacctggtgtatc

SEQ ID NO: 708311 - DNA, 25 bp, Mus musculus
gtggacgacagctacctggtgtatc

SEQ ID NO: 708312 - DNA, 25 bp, Mus musculus
gtggacgacttacacaggtgctgcc

SEQ ID NO: 708313 - DNA, 25 bp, Mus musculus
gtggacgacttagacaggtgctgcc

SEQ ID NO: 708314 - DNA, 25 bp, Mus musculus
gtggacgagacgaggaactacatca

SEQ ID NO: 708315 - DNA, 25 bp, Mus musculus
gtggacgagacgtggaactacatca

SEQ ID NO: 708316 - DNA, 25 bp, Mus musculus
gtggacgagcgtccgcatgctaatc

SEQ ID NO: 708317 - DNA, 25 bp, Mus musculus
gtggacgagcgtgcgcatgctaatc

SEQ ID NO: 708318 - DNA, 25 bp, Mus musculus
gtggacgagtctctagcctagttgc

SEQ ID NO: 708319 - DNA, 25 bp, Mus musculus
gtggacgagtctgtagcctagttgc

SEQ ID NO: 708320 - DNA, 25 bp, Mus musculus
gtggacgccatgaggatgtctttaa

SEQ ID NO: 708321 - DNA, 25 bp, Mus musculus
gtggacgccatgtggatgtctttaa

SEQ ID NO: 708322 - DNA, 25 bp, Mus musculus
gtggacgcgctgaaatttcaacttg

SEQ ID NO: 708323 - DNA, 25 bp, Mus musculus
gtggacgcgctgtaatttcaacttg

SEQ ID NO: 708324 - DNA, 25 bp, Mus musculus
gtggacgctgaacgcaactttgatc

SEQ ID NO: 708325 - DNA, 25 bp, Mus musculus
gtggacgctgaaggcaactttgatc

SEQ ID NO: 708326 - DNA, 25 bp, Mus musculus
gtggacggagacaatcaactgcata

SEQ ID NO: 708327 - DNA, 25 bp, Mus musculus
gtggacggagactatcaactgcata

SEQ ID NO: 708328 - DNA, 25 bp, Mus musculus
gtggacgggagtcacctaaatttca

SEQ ID NO: 708329 - DNA, 25 bp, Mus musculus
gtggacgggagtgacctaaatttca

SEQ ID NO: 708330 - DNA, 25 bp, Mus musculus
gtggacgggccaatccgaataacca

SEQ ID NO: 708331 - DNA, 25 bp, Mus musculus
gtggacgggccattccgaataacca

SEQ ID NO: 708332 - DNA, 25 bp, Mus musculus
gtggacgtaatacctcttctgtttg

SEQ ID NO: 708333 - DNA, 25 bp, Mus musculus
gtggacgtaatagctcttctgtttg

SEQ ID NO: 708334 - DNA, 25 bp, Mus musculus
gtggacgtagttacgtctctcccaa

SEQ ID NO: 708335 - DNA, 25 bp, Mus musculus
gtggacgtagtttcgtctctcccaa

SEQ ID NO: 708336 - DNA, 25 bp, Mus musculus
gtggacgtgtttactcaattcattt

SEQ ID NO: 708337 - DNA, 25 bp, Mus musculus
gtggacgtgttttctcaattcattt

SEQ ID NO: 708338 - DNA, 25 bp, Mus musculus
gtggacgttcatcagggatcctctc

SEQ ID NO: 708339 - DNA, 25 bp, Mus musculus
gtggacgttcatgagggatcctctc

SEQ ID NO: 708340 - DNA, 25 bp, Mus musculus
gtggacgttcccacagtggtcttta

SEQ ID NO: 708341 - DNA, 25 bp, Mus musculus
gtggacgttccctcagtggtcttta

SEQ ID NO: 708342 - DNA, 25 bp, Mus musculus
gtggacgttcttaaggtgtttagag

SEQ ID NO: 708343 - DNA, 25 bp, Mus musculus
gtggacgttctttaggtgtttagag

SEQ ID NO: 708344 - DNA, 25 bp, Mus musculus
gtggacgttggtattttagctggaa

SEQ ID NO: 708345 - DNA, 25 bp, Mus musculus
gtggacgttggttttttagctggaa

SEQ ID NO: 708346 - DNA, 25 bp, Mus musculus
gtggactacttgaggataacccaac

SEQ ID NO: 708347 - DNA, 25 bp, Mus musculus
gtggactacttgtggataacccaac

SEQ ID NO: 708348 - DNA, 25 bp, Mus musculus
gtggactagagcattgccctaatca

SEQ ID NO: 708349 - DNA, 25 bp, Mus musculus
gtggactagagctttgccctaatca

SEQ ID NO: 708350 - DNA, 25 bp, Mus musculus
gtggactagcacaagcagctgctct

SEQ ID NO: 708351 - DNA, 25 bp, Mus musculus
gtggactagcactagcagctgctct

SEQ ID NO: 708352 - DNA, 25 bp, Mus musculus
gtggactagcatcatgttataggca

SEQ ID NO: 708353 - DNA, 25 bp, Mus musculus
gtggactagcatgatgttataggca

SEQ ID NO: 708354 - DNA, 25 bp, Mus musculus
gtggactaggtcaatctacaacctt

SEQ ID NO: 708355 - DNA, 25 bp, Mus musculus
gtggactaggtctatctacaacctt

SEQ ID NO: 708356 - DNA, 25 bp, Mus musculus
gtggactagttacatcatttctgcc

SEQ ID NO: 708357 - DNA, 25 bp, Mus musculus
gtggactagttagatcatttctgcc

SEQ ID NO: 708358 - DNA, 25 bp, Mus musculus
gtggactataaaccaacctgtcatt

SEQ ID NO: 708359 - DNA, 25 bp, Mus musculus
gtggactataaagcaacctgtcatt

SEQ ID NO: 708360 - DNA, 25 bp, Mus musculus
gtggactattccaatagactgttgg

SEQ ID NO: 708361 - DNA, 25 bp, Mus musculus
gtggactattcctatagactgttgg

SEQ ID NO: 708362 - DNA, 25 bp, Mus musculus
gtggactcacagacacagccaggca

SEQ ID NO: 708363 - DNA, 25 bp, Mus musculus
gtggactcacagtcacagccaggca

SEQ ID NO: 708364 - DNA, 25 bp, Mus musculus
gtggactcagcaacctgtgttcaga

SEQ ID NO: 708365 - DNA, 25 bp, Mus musculus
gtggactcagcatcctgtgttcaga

SEQ ID NO: 708366 - DNA, 25 bp, Mus musculus
gtggactcatacaatggtctgtaca

SEQ ID NO: 708367 - DNA, 25 bp, Mus musculus
gtggactcatactatggtctgtaca

SEQ ID NO: 708368 - DNA, 25 bp, Mus musculus
gtggactccctaatacagatatgtg

SEQ ID NO: 708369 - DNA, 25 bp, Mus musculus
gtggactccctattacagatatgtg

SEQ ID NO: 708370 - DNA, 25 bp, Mus musculus
gtggactcccttatttatatgacag

SEQ ID NO: 708371 - DNA, 25 bp, Mus musculus
gtggactcccttttttatatgacag

SEQ ID NO: 708372 - DNA, 25 bp, Mus musculus
gtggactctaaactgtacttttctt

SEQ ID NO: 708373 - DNA, 25 bp, Mus musculus
gtggactctaaagtgtacttttctt

SEQ ID NO: 708374 - DNA, 25 bp, Mus musculus
gtggactctaagcttgtcgccaagt

SEQ ID NO: 708375 - DNA, 25 bp, Mus musculus
gtggactctaaggttgtcgccaagt

SEQ ID NO: 708376 - DNA, 25 bp, Mus musculus
gtggactctctacaaccagtcttca

SEQ ID NO: 708377 - DNA, 25 bp, Mus musculus
gtggactctctagaaccagtcttca

SEQ ID NO: 708378 - DNA, 25 bp, Mus musculus
gtggactctgggaaaacacctgcag

SEQ ID NO: 708379 - DNA, 25 bp, Mus musculus
gtggactctgggtaaacacctgcag

SEQ ID NO: 708380 - DNA, 25 bp, Mus musculus
gtggactctgtcagcatgaatttca

SEQ ID NO: 708381 - DNA, 25 bp, Mus musculus
gtggactctgtctgcatgaatttca

SEQ ID NO: 708382 - DNA, 25 bp, Mus musculus
gtggactcttaaaaggctggagcca

SEQ ID NO: 708383 - DNA, 25 bp, Mus musculus
gtggactcttaataggctggagcca

SEQ ID NO: 708384 - DNA, 25 bp, Mus musculus
gtggactctttgatacttcaagccc

SEQ ID NO: 708385 - DNA, 25 bp, Mus musculus
gtggactctttgttacttcaagccc

SEQ ID NO: 708386 - DNA, 25 bp, Mus musculus
gtggactgaaaaattctacccggat

SEQ ID NO: 708387 - DNA, 25 bp, Mus musculus
gtggactgaaaatttctacccggat

SEQ ID NO: 708388 - DNA, 25 bp, Mus musculus
gtggactgaactatttccccaaact

SEQ ID NO: 708389 - DNA, 25 bp, Mus musculus
gtggactgaactttttccccaaact

SEQ ID NO: 708390 - DNA, 25 bp, Mus musculus
gtggactgaatcaaccctttacaag

SEQ ID NO: 708391 - DNA, 25 bp, Mus musculus
gtggactgaatctaccctttacaag

SEQ ID NO: 708392 - DNA, 25 bp, Mus musculus
gtggactgacaaacacccatcatgc

SEQ ID NO: 708393 - DNA, 25 bp, Mus musculus
gtggactgacaaacttgggatcttt

SEQ ID NO: 708394 - DNA, 25 bp, Mus musculus
gtggactgacaatcacccatcatgc

SEQ ID NO: 708395 - DNA, 25 bp, Mus musculus
gtggactgacaatcttgggatcttt

SEQ ID NO: 708396 - DNA, 25 bp, Mus musculus
gtggactgacttcagcagcttatta

SEQ ID NO: 708397 - DNA, 25 bp, Mus musculus
gtggactgacttgagcagcttatta

SEQ ID NO: 708398 - DNA, 25 bp, Mus musculus
gtggactgagacatgctaccggagc

SEQ ID NO: 708399 - DNA, 25 bp, Mus musculus
gtggactgagacttgctaccggagc

SEQ ID NO: 708400 - DNA, 25 bp, Mus musculus
gtggactgaggcacctggatggctg

SEQ ID NO: 708401 - DNA, 25 bp, Mus musculus
gtggactgaggctcctggatggctg

SEQ ID NO: 708402 - DNA, 25 bp, Mus musculus
gtggactgcttgaataaccttactc

SEQ ID NO: 708403 - DNA, 25 bp, Mus musculus
gtggactgcttgtataaccttactc

SEQ ID NO: 708404 - DNA, 25 bp, Mus musculus
gtggactgtcccaggatggcacagc

SEQ ID NO: 708405 - DNA, 25 bp, Mus musculus
gtggactgtccctggatggcacagc

SEQ ID NO: 708406 - DNA, 25 bp, Mus musculus
gtggactgtcctcattctggatcaa

SEQ ID NO: 708407 - DNA, 25 bp, Mus musculus
gtggactgtcctgattctggatcaa

SEQ ID NO: 708408 - DNA, 25 bp, Mus musculus
gtggactgtgagctctatccatgac

SEQ ID NO: 708409 - DNA, 25 bp, Mus musculus
gtggactgtgaggtctatccatgac

SEQ ID NO: 708410 - DNA, 25 bp, Mus musculus
gtggactgtgataaatcttccagac

SEQ ID NO: 708411 - DNA, 25 bp, Mus musculus
gtggactgtgattaatcttccagac

SEQ ID NO: 708412 - DNA, 25 bp, Mus musculus
gtggactgtggaccacattatctat

SEQ ID NO: 708413 - DNA, 25 bp, Mus musculus
gtggactgtggagcacattatctat

SEQ ID NO: 708414 - DNA, 25 bp, Mus musculus
gtggactgttagcacttttctacat

SEQ ID NO: 708415 - DNA, 25 bp, Mus musculus
gtggactgttaggacttttctacat

SEQ ID NO: 708416 - DNA, 25 bp, Mus musculus
gtggacttacgtccaatttgttcaa

SEQ ID NO: 708417 - DNA, 25 bp, Mus musculus
gtggacttacgtgcaatttgttcaa

SEQ ID NO: 708418 - DNA, 25 bp, Mus musculus
gtggacttaggcacgagacaccttt

SEQ ID NO: 708419 - DNA, 25 bp, Mus musculus
gtggacttaggctcgagacaccttt

SEQ ID NO: 708420 - DNA, 25 bp, Mus musculus
gtggacttcacacgacatacttaga

SEQ ID NO: 708421 - DNA, 25 bp, Mus musculus
gtggacttcacaggacatacttaga

SEQ ID NO: 708422 - DNA, 25 bp, Mus musculus
gtggacttcatgacttgtccttgct

SEQ ID NO: 708423 - DNA, 25 bp, Mus musculus
gtggacttcatgtcttgtccttgct

SEQ ID NO: 708424 - DNA, 25 bp, Mus musculus
gtggacttcattcagttgatctttt

SEQ ID NO: 708425 - DNA, 25 bp, Mus musculus
gtggacttcattgagttgatctttt

SEQ ID NO: 708426 - DNA, 25 bp, Mus musculus
gtggacttccagcatcggctggact

SEQ ID NO: 708427 - DNA, 25 bp, Mus musculus
gtggacttccaggatcggctggact

SEQ ID NO: 708428 - DNA, 25 bp, Mus musculus
gtggacttcctactgcagagtacat

SEQ ID NO: 708429 - DNA, 25 bp, Mus musculus
gtggacttcctagtgcagagtacat

SEQ ID NO: 708430 - DNA, 25 bp, Mus musculus
gtggacttctaaagtcttcctcata

SEQ ID NO: 708431 - DNA, 25 bp, Mus musculus
gtggacttctaatgtcttcctcata

SEQ ID NO: 708432 - DNA, 25 bp, Mus musculus
gtggacttctagattggcggaacca

SEQ ID NO: 708433 - DNA, 25 bp, Mus musculus
gtggacttctagtttggcggaacca

SEQ ID NO: 708434 - DNA, 25 bp, Mus musculus
gtggacttctcactttagttataaa

SEQ ID NO: 708435 - DNA, 25 bp, Mus musculus
gtggacttctcagtttagttataaa

SEQ ID NO: 708436 - DNA, 25 bp, Mus musculus
gtggacttctgcaaagacccggatg

SEQ ID NO: 708437 - DNA, 25 bp, Mus musculus
gtggacttctgctaagacccggatg

SEQ ID NO: 708438 - DNA, 25 bp, Mus musculus
gtggacttgactctctcactttcct

SEQ ID NO: 708439 - DNA, 25 bp, Mus musculus
gtggacttgactgtctcactttcct

SEQ ID NO: 708440 - DNA, 25 bp, Mus musculus
gtggacttgattatattcctggaaa

SEQ ID NO: 708441 - DNA, 25 bp, Mus musculus
gtggacttgattatgaccgacttca

SEQ ID NO: 708442 - DNA, 25 bp, Mus musculus
gtggacttgattcccaaatacatcg

SEQ ID NO: 708443 - DNA, 25 bp, Mus musculus
gtggacttgattgccaaatacatcg

SEQ ID NO: 708444 - DNA, 25 bp, Mus musculus
gtggacttgattttattcctggaaa

SEQ ID NO: 708445 - DNA, 25 bp, Mus musculus
gtggacttgattttgaccgacttca

SEQ ID NO: 708446 - DNA, 25 bp, Mus musculus
gtggacttgccacatgtgtcacctt

SEQ ID NO: 708447 - DNA, 25 bp, Mus musculus
gtggacttgccagatgtgtcacctt

SEQ ID NO: 708448 - DNA, 25 bp, Mus musculus
gtggacttggtgagcatcaacctgc

SEQ ID NO: 708449 - DNA, 25 bp, Mus musculus
gtggacttggtgtgcatcaacctgc

SEQ ID NO: 708450 - DNA, 25 bp, Mus musculus
gtggacttgtccattgagcatgaaa

SEQ ID NO: 708451 - DNA, 25 bp, Mus musculus
gtggacttgtcctttgagcatgaaa

SEQ ID NO: 708452 - DNA, 25 bp, Mus musculus
gtggactttcttctcctatcaaaag

SEQ ID NO: 708453 - DNA, 25 bp, Mus musculus
gtggactttcttgtcctatcaaaag

SEQ ID NO: 708454 - DNA, 25 bp, Mus musculus
gtggactttgacattccttcaagtt

SEQ ID NO: 708455 - DNA, 25 bp, Mus musculus
gtggactttgactttccttcaagtt

SEQ ID NO: 708456 - DNA, 25 bp, Mus musculus
gtggacttttctcaggacgttatct

SEQ ID NO: 708457 - DNA, 25 bp, Mus musculus
gtggacttttctgaggacgttatct

SEQ ID NO: 708458 - DNA, 25 bp, Mus musculus
gtggagaaacacaacttgcatgtaa

SEQ ID NO: 708459 - DNA, 25 bp, Mus musculus
gtggagaaacactacttgcatgtaa

SEQ ID NO: 708460 - DNA, 25 bp, Mus musculus
gtggagaaaggtccctcatttccct

SEQ ID NO: 708461 - DNA, 25 bp, Mus musculus
gtggagaaaggtgcctcatttccct

SEQ ID NO: 708462 - DNA, 25 bp, Mus musculus
gtggagaaagtccatcctgacttgt

SEQ ID NO: 708463 - DNA, 25 bp, Mus musculus
gtggagaaagtcgatcctgacttgt

SEQ ID NO: 708464 - DNA, 25 bp, Mus musculus
gtggagaacaaaatttccatggtca

SEQ ID NO: 708465 - DNA, 25 bp, Mus musculus
gtggagaacaaattttccatggtca

SEQ ID NO: 708466 - DNA, 25 bp, Mus musculus
gtggagaacaagatcctcctgccca

SEQ ID NO: 708467 - DNA, 25 bp, Mus musculus
gtggagaacaagttcctcctgccca

SEQ ID NO: 708468 - DNA, 25 bp, Mus musculus
gtggagaaccagaggcctgccgtca

SEQ ID NO: 708469 - DNA, 25 bp, Mus musculus
gtggagaaccagtggcctgccgtca

SEQ ID NO: 708470 - DNA, 25 bp, Mus musculus
gtggagaacccacctttgatatgat

SEQ ID NO: 708471 - DNA, 25 bp, Mus musculus
gtggagaacccagctttgatatgat

SEQ ID NO: 708472 - DNA, 25 bp, Mus musculus
gtggagaactacaacctcactgcct

SEQ ID NO: 708473 - DNA, 25 bp, Mus musculus
gtggagaactacaatccccggcagc

SEQ ID NO: 708474 - DNA, 25 bp, Mus musculus
gtggagaactactacctcactgcct

SEQ ID NO: 708475 - DNA, 25 bp, Mus musculus
gtggagaactactatccccggcagc

SEQ ID NO: 708476 - DNA, 25 bp, Mus musculus
gtggagaactgtctgtgtaccctga

SEQ ID NO: 708477 - DNA, 25 bp, Mus musculus
gtggagaactgtgtgtgtaccctga

SEQ ID NO: 708478 - DNA, 25 bp, Mus musculus
gtggagaactttccttccaacttct

SEQ ID NO: 708479 - DNA, 25 bp, Mus musculus
gtggagaactttgcttccaacttct

SEQ ID NO: 708480 - DNA, 25 bp, Mus musculus
gtggagaagcccaacttgcgaagag

SEQ ID NO: 708481 - DNA, 25 bp, Mus musculus
gtggagaagccctacttgcgaagag

SEQ ID NO: 708482 - DNA, 25 bp, Mus musculus
gtggagaaggccccccggatttatg

SEQ ID NO: 708483 - DNA, 25 bp, Mus musculus
gtggagaaggccgcccggatttatg

SEQ ID NO: 708484 - DNA, 25 bp, Mus musculus
gtggagaagtccaactcactggctt

SEQ ID NO: 708485 - DNA, 25 bp, Mus musculus
gtggagaagtcctactcactggctt

SEQ ID NO: 708486 - DNA, 25 bp, Mus musculus
gtggagaagtgcaactgcctgccat

SEQ ID NO: 708487 - DNA, 25 bp, Mus musculus
gtggagaagtgctactgcctgccat

SEQ ID NO: 708488 - DNA, 25 bp, Mus musculus
gtggagaatcacagcccatatataa

SEQ ID NO: 708489 - DNA, 25 bp, Mus musculus
gtggagaatcactgcccatatataa

SEQ ID NO: 708490 - DNA, 25 bp, Mus musculus
gtggagaatcctaacggcagaggca

SEQ ID NO: 708491 - DNA, 25 bp, Mus musculus
gtggagaatccttacggcagaggca

SEQ ID NO: 708492 - DNA, 25 bp, Mus musculus
gtggagacaagtatccctcaaatag

SEQ ID NO: 708493 - DNA, 25 bp, Mus musculus
gtggagacaagtttccctcaaatag

SEQ ID NO: 708494 - DNA, 25 bp, Mus musculus
gtggagacaatgatctggagtcaat

SEQ ID NO: 708495 - DNA, 25 bp, Mus musculus
gtggagacaatgttctggagtcaat

SEQ ID NO: 708496 - DNA, 25 bp, Mus musculus
gtggagacacggactaccttgcaaa

SEQ ID NO: 708497 - DNA, 25 bp, Mus musculus
gtggagacacggtctaccttgcaaa

SEQ ID NO: 708498 - DNA, 25 bp, Mus musculus
gtggagacagtactgaccaagcctt

SEQ ID NO: 708499 - DNA, 25 bp, Mus musculus
gtggagacagtagtgaccaagcctt

SEQ ID NO: 708500 - DNA, 25 bp, Mus musculus
gtggagaccgatacttttggaagca

SEQ ID NO: 708501 - DNA, 25 bp, Mus musculus
gtggagaccgattcttttggaagca

SEQ ID NO: 708502 - DNA, 25 bp, Mus musculus
gtggagacctacacagtgaactttg

SEQ ID NO: 708503 - DNA, 25 bp, Mus musculus
gtggagacctactcagtgaactttg

SEQ ID NO: 708504 - DNA, 25 bp, Mus musculus
gtggagacgccaatgacaaacctat

SEQ ID NO: 708505 - DNA, 25 bp, Mus musculus
gtggagacgccattgacaaacctat

SEQ ID NO: 708506 - DNA, 25 bp, Mus musculus
gtggagacgctgaggaccgcccctt

SEQ ID NO: 708507 - DNA, 25 bp, Mus musculus
gtggagacgctgtggaccgcccctt

SEQ ID NO: 708508 - DNA, 25 bp, Mus musculus
gtggagagaactataaactgctgta

SEQ ID NO: 708509 - DNA, 25 bp, Mus musculus
gtggagagaactttaaactgctgta

SEQ ID NO: 708510 - DNA, 25 bp, Mus musculus
gtggagagacaacacatggacagct

SEQ ID NO: 708511 - DNA, 25 bp, Mus musculus
gtggagagacaagacatggacagct

SEQ ID NO: 708512 - DNA, 25 bp, Mus musculus
gtggagagattgctttattttctga

SEQ ID NO: 708513 - DNA, 25 bp, Mus musculus
gtggagagattggtttattttctga

SEQ ID NO: 708514 - DNA, 25 bp, Mus musculus
gtggagagatttctgctcaacctct

SEQ ID NO: 708515 - DNA, 25 bp, Mus musculus
gtggagagatttgtgctcaacctct

SEQ ID NO: 708516 - DNA, 25 bp, Mus musculus
gtggagagccaaagcctcagagttc

SEQ ID NO: 708517 - DNA, 25 bp, Mus musculus
gtggagagccaatgcctcagagttc

SEQ ID NO: 708518 - DNA, 25 bp, Mus musculus
gtggagagccggaaccttacagaaa

SEQ ID NO: 708519 - DNA, 25 bp, Mus musculus
gtggagagccggtaccttacagaaa

SEQ ID NO: 708520 - DNA, 25 bp, Mus musculus
gtggagagcctgagaccttcttgcc

SEQ ID NO: 708521 - DNA, 25 bp, Mus musculus
gtggagagcctgtgaccttcttgcc

SEQ ID NO: 708522 - DNA, 25 bp, Mus musculus
gtggagagcgccagattttcgcctg

SEQ ID NO: 708523 - DNA, 25 bp, Mus musculus
gtggagagcgcctgattttcgcctg

SEQ ID NO: 708524 - DNA, 25 bp, Mus musculus
gtggagaggtttacacctgccaggt

SEQ ID NO: 708525 - DNA, 25 bp, Mus musculus
gtggagaggttttcacctgccaggt

SEQ ID NO: 708526 - DNA, 25 bp, Mus musculus
gtggagagtccactttgaaatactt

SEQ ID NO: 708527 - DNA, 25 bp, Mus musculus
gtggagagtccagtttgaaatactt

SEQ ID NO: 708528 - DNA, 25 bp, Mus musculus
gtggagagtgaacaccaagcacaac

SEQ ID NO: 708529 - DNA, 25 bp, Mus musculus
gtggagagtgaaccccgcatcttac

SEQ ID NO: 708530 - DNA, 25 bp, Mus musculus
gtggagagtgaagaccaagcacaac

SEQ ID NO: 708531 - DNA, 25 bp, Mus musculus
gtggagagtgaagcccgcatcttac

SEQ ID NO: 708532 - DNA, 25 bp, Mus musculus
gtggagagttcaattaagtggtgtt

SEQ ID NO: 708533 - DNA, 25 bp, Mus musculus
gtggagagttcatttaagtggtgtt

SEQ ID NO: 708534 - DNA, 25 bp, Mus musculus
gtggagataaatacaccatcgaaat

SEQ ID NO: 708535 - DNA, 25 bp, Mus musculus
gtggagataaattcaccatcgaaat

SEQ ID NO: 708536 - DNA, 25 bp, Mus musculus
gtggagatccagacaggcgctcagt

SEQ ID NO: 708537 - DNA, 25 bp, Mus musculus
gtggagatccagtcaggcgctcagt

SEQ ID NO: 708538 - DNA, 25 bp, Mus musculus
gtggagatcctacgacttcactgga

SEQ ID NO: 708539 - DNA, 25 bp, Mus musculus
gtggagatcctaggacttcactgga

SEQ ID NO: 708540 - DNA, 25 bp, Mus musculus
gtggagatctcccttatgtgtgtaa

SEQ ID NO: 708541 - DNA, 25 bp, Mus musculus
gtggagatctccgttatgtgtgtaa

SEQ ID NO: 708542 - DNA, 25 bp, Mus musculus
gtggagatgaatactgccgccgtta

SEQ ID NO: 708543 - DNA, 25 bp, Mus musculus
gtggagatgaattctgccgccgtta

SEQ ID NO: 708544 - DNA, 25 bp, Mus musculus
gtggagatgcgtacctcccaaccag

SEQ ID NO: 708545 - DNA, 25 bp, Mus musculus
gtggagatgcgttcctcccaaccag

SEQ ID NO: 708546 - DNA, 25 bp, Mus musculus
gtggagattaagcacgtgaagctgc

SEQ ID NO: 708547 - DNA, 25 bp, Mus musculus
gtggagattaaggacgtgaagctgc

SEQ ID NO: 708548 - DNA, 25 bp, Mus musculus
gtggagattaggagcaacactgcac

SEQ ID NO: 708549 - DNA, 25 bp, Mus musculus
gtggagattaggtgcaacactgcac

SEQ ID NO: 708550 - DNA, 25 bp, Mus musculus
gtggagattgcacaccgctccaggt

SEQ ID NO: 708551 - DNA, 25 bp, Mus musculus
gtggagattgcagaccgctccaggt

SEQ ID NO: 708552 - DNA, 25 bp, Mus musculus
gtggagatttcaaagctgtcatagt

SEQ ID NO: 708553 - DNA, 25 bp, Mus musculus
gtggagatttcatagctgtcatagt

SEQ ID NO: 708554 - DNA, 25 bp, Mus musculus
gtggagatttgcattgaactgtata

SEQ ID NO: 708555 - DNA, 25 bp, Mus musculus
gtggagatttgctttgaactgtata

SEQ ID NO: 708556 - DNA, 25 bp, Mus musculus
gtggagcaacaacaggtggcctctc

SEQ ID NO: 708557 - DNA, 25 bp, Mus musculus
gtggagcaacaagaggtggcctctc

SEQ ID NO: 708558 - DNA, 25 bp, Mus musculus
gtggagcaacttcgaatcccagaac

SEQ ID NO: 708559 - DNA, 25 bp, Mus musculus
gtggagcaacttggaatcccagaac

SEQ ID NO: 708560 - DNA, 25 bp, Mus musculus
gtggagcacaacatgggagcctcgt

SEQ ID NO: 708561 - DNA, 25 bp, Mus musculus
gtggagcacaacttgggagcctcgt

SEQ ID NO: 708562 - DNA, 25 bp, Mus musculus
gtggagcacagaccaagagcccgat

SEQ ID NO: 708563 - DNA, 25 bp, Mus musculus
gtggagcacagagcaagagcccgat

SEQ ID NO: 708564 - DNA, 25 bp, Mus musculus
gtggagcaccacctcatattgaagg

SEQ ID NO: 708565 - DNA, 25 bp, Mus musculus
gtggagcaccacgtcatattgaagg

SEQ ID NO: 708566 - DNA, 25 bp, Mus musculus
gtggagcaccctccggtcactggaa

SEQ ID NO: 708567 - DNA, 25 bp, Mus musculus
gtggagcaccctgcggtcactggaa

SEQ ID NO: 708568 - DNA, 25 bp, Mus musculus
gtggagcactgcaaactcactcaca

SEQ ID NO: 708569 - DNA, 25 bp, Mus musculus
gtggagcactgctaactcactcaca

SEQ ID NO: 708570 - DNA, 25 bp, Mus musculus
gtggagcagccaactttcaaacaga

SEQ ID NO: 708571 - DNA, 25 bp, Mus musculus
gtggagcagccatctttcaaacaga

SEQ ID NO: 708572 - DNA, 25 bp, Mus musculus
gtggagcagctcacaaatcaaatat

SEQ ID NO: 708573 - DNA, 25 bp, Mus musculus
gtggagcagctctcaaatcaaatat

SEQ ID NO: 708574 - DNA, 25 bp, Mus musculus
gtggagcagctgacgcgagagctca

SEQ ID NO: 708575 - DNA, 25 bp, Mus musculus
gtggagcagctgtcgcgagagctca

SEQ ID NO: 708576 - DNA, 25 bp, Mus musculus
gtggagcaggacaccttctacactg

SEQ ID NO: 708577 - DNA, 25 bp, Mus musculus
gtggagcaggactccttctacactg

SEQ ID NO: 708578 - DNA, 25 bp, Mus musculus
gtggagcagtaactcacagccagtt

SEQ ID NO: 708579 - DNA, 25 bp, Mus musculus
gtggagcagtaagtcacagccagtt

SEQ ID NO: 708580 - DNA, 25 bp, Mus musculus
gtggagcagtatctgttggccatca

SEQ ID NO: 708581 - DNA, 25 bp, Mus musculus
gtggagcagtatgtgttggccatca

SEQ ID NO: 708582 - DNA, 25 bp, Mus musculus
gtggagcatctccttgattactgat

SEQ ID NO: 708583 - DNA, 25 bp, Mus musculus
gtggagcatctcgttgattactgat

SEQ ID NO: 708584 - DNA, 25 bp, Mus musculus
gtggagcatctgacaaataggtttt

SEQ ID NO: 708585 - DNA, 25 bp, Mus musculus
gtggagcatctgtcaaataggtttt

SEQ ID NO: 708586 - DNA, 25 bp, Mus musculus
gtggagcatgccagtaaagagcatt

SEQ ID NO: 708587 - DNA, 25 bp, Mus musculus
gtggagcatgcctgtaaagagcatt

SEQ ID NO: 708588 - DNA, 25 bp, Mus musculus
gtggagcatgctcaaaagtatttag

SEQ ID NO: 708589 - DNA, 25 bp, Mus musculus
gtggagcatgctgaaaagtatttag

SEQ ID NO: 708590 - DNA, 25 bp, Mus musculus
gtggagccacccctggatgacctgt

SEQ ID NO: 708591 - DNA, 25 bp, Mus musculus
gtggagccacccgtggatgacctgt

SEQ ID NO: 708592 - DNA, 25 bp, Mus musculus
gtggagccagctcaccctaaggata

SEQ ID NO: 708593 - DNA, 25 bp, Mus musculus
gtggagccagctgaccctaaggata

SEQ ID NO: 708594 - DNA, 25 bp, Mus musculus
gtggagccagtgcaagtcagggtga

SEQ ID NO: 708595 - DNA, 25 bp, Mus musculus
gtggagccagtggaagtcagggtga

SEQ ID NO: 708596 - DNA, 25 bp, Mus musculus
gtggagcccaggactttctctaagg

SEQ ID NO: 708597 - DNA, 25 bp, Mus musculus
gtggagcccaggtctttctctaagg

SEQ ID NO: 708598 - DNA, 25 bp, Mus musculus
gtggagcccatacatttcatctgga

SEQ ID NO: 708599 - DNA, 25 bp, Mus musculus
gtggagcccatagatttcatctgga

SEQ ID NO: 708600 - DNA, 25 bp, Mus musculus
gtggagcccatgctgaactgcagca

SEQ ID NO: 708601 - DNA, 25 bp, Mus musculus
gtggagcccatggtgaactgcagca

SEQ ID NO: 708602 - DNA, 25 bp, Mus musculus
gtggagccgtataaactgcattgtt

SEQ ID NO: 708603 - DNA, 25 bp, Mus musculus
gtggagccgtattaactgcattgtt

SEQ ID NO: 708604 - DNA, 25 bp, Mus musculus
gtggagcctcagatacgtacagcct

SEQ ID NO: 708605 - DNA, 25 bp, Mus musculus
gtggagcctcagttacgtacagcct

SEQ ID NO: 708606 - DNA, 25 bp, Mus musculus
gtggagcctcctaagcggcgcgatc

SEQ ID NO: 708607 - DNA, 25 bp, Mus musculus
gtggagcctccttagcggcgcgatc

SEQ ID NO: 708608 - DNA, 25 bp, Mus musculus
gtggagcctctgagacaagtccaaa

SEQ ID NO: 708609 - DNA, 25 bp, Mus musculus
gtggagcctctgtgacaagtccaaa

SEQ ID NO: 708610 - DNA, 25 bp, Mus musculus
gtggagcgagtgatcaccatcatgc

SEQ ID NO: 708611 - DNA, 25 bp, Mus musculus
gtggagcgagtgttcaccatcatgc

SEQ ID NO: 708612 - DNA, 25 bp, Mus musculus
gtggagcgatgtctttacttgatga

SEQ ID NO: 708613 - DNA, 25 bp, Mus musculus
gtggagcgatgtgtttacttgatga

SEQ ID NO: 708614 - DNA, 25 bp, Mus musculus
gtggagctacacaaggtgaccttat

SEQ ID NO: 708615 - DNA, 25 bp, Mus musculus
gtggagctacactaggtgaccttat

SEQ ID NO: 708616 - DNA, 25 bp, Mus musculus
gtggagctactcattcatcagaaag

SEQ ID NO: 708617 - DNA, 25 bp, Mus musculus
gtggagctactctttcatcagaaag

SEQ ID NO: 708618 - DNA, 25 bp, Mus musculus
gtggagctatctaagtcctctgacc

SEQ ID NO: 708619 - DNA, 25 bp, Mus musculus
gtggagctatcttagtcctctgacc

SEQ ID NO: 708620 - DNA, 25 bp, Mus musculus
gtggagctcagaagtggacaagtat

SEQ ID NO: 708621 - DNA, 25 bp, Mus musculus
gtggagctcagatgtggacaagtat

SEQ ID NO: 708622 - DNA, 25 bp, Mus musculus
gtggagctcatgaggaccaacccca

SEQ ID NO: 708623 - DNA, 25 bp, Mus musculus
gtggagctcatgtggaccaacccca

SEQ ID NO: 708624 - DNA, 25 bp, Mus musculus
gtggagctccacattgaagaattga

SEQ ID NO: 708625 - DNA, 25 bp, Mus musculus
gtggagctccactttgaagaattga

SEQ ID NO: 708626 - DNA, 25 bp, Mus musculus
gtggagctccttagtgcccagacca

SEQ ID NO: 708627 - DNA, 25 bp, Mus musculus
gtggagctcctttgtgcccagacca

SEQ ID NO: 708628 - DNA, 25 bp, Mus musculus
gtggagctctgcagtatggacatag

SEQ ID NO: 708629 - DNA, 25 bp, Mus musculus
gtggagctctgctgtatggacatag

SEQ ID NO: 708630 - DNA, 25 bp, Mus musculus
gtggagctgactccttgccactcaa

SEQ ID NO: 708631 - DNA, 25 bp, Mus musculus
gtggagctgactgcttgccactcaa

SEQ ID NO: 708632 - DNA, 25 bp, Mus musculus
gtggagctggctatgttttaatatg

SEQ ID NO: 708633 - DNA, 25 bp, Mus musculus
gtggagctggctttgttttaatatg

SEQ ID NO: 708634 - DNA, 25 bp, Mus musculus
gtggagctgttactctgatagtcaa

SEQ ID NO: 708635 - DNA, 25 bp, Mus musculus
gtggagctgttagtctgatagtcaa

SEQ ID NO: 708636 - DNA, 25 bp, Mus musculus
gtggagcttccactctatgacatca

SEQ ID NO: 708637 - DNA, 25 bp, Mus musculus
gtggagcttccagtctatgacatca

SEQ ID NO: 708638 - DNA, 25 bp, Mus musculus
gtggagcttcgtaaggccccaggct

SEQ ID NO: 708639 - DNA, 25 bp, Mus musculus
gtggagcttcgttaggccccaggct

SEQ ID NO: 708640 - DNA, 25 bp, Mus musculus
gtggaggaaaaccagctctctcacc

SEQ ID NO: 708641 - DNA, 25 bp, Mus musculus
gtggaggaaaacgagctctctcacc

SEQ ID NO: 708642 - DNA, 25 bp, Mus musculus
gtggaggaaacacaaagtctccaga

SEQ ID NO: 708643 - DNA, 25 bp, Mus musculus
gtggaggaaacagaaagtctccaga

SEQ ID NO: 708644 - DNA, 25 bp, Mus musculus
gtggaggaagacaattccgaatatt

SEQ ID NO: 708645 - DNA, 25 bp, Mus musculus
gtggaggaagactattccgaatatt

SEQ ID NO: 708646 - DNA, 25 bp, Mus musculus
gtggaggaagcaaagcccgagctga

SEQ ID NO: 708647 - DNA, 25 bp, Mus musculus
gtggaggaagcatagcccgagctga

SEQ ID NO: 708648 - DNA, 25 bp, Mus musculus
gtggaggaatgcaaccgctacttta

SEQ ID NO: 708649 - DNA, 25 bp, Mus musculus
gtggaggaatgctaccgctacttta

SEQ ID NO: 708650 - DNA, 25 bp, Mus musculus
gtggaggacaccagtctgcggaata

SEQ ID NO: 708651 - DNA, 25 bp, Mus musculus
gtggaggacacctgtctgcggaata

SEQ ID NO: 708652 - DNA, 25 bp, Mus musculus
gtggaggacacgaaacaccggccca

SEQ ID NO: 708653 - DNA, 25 bp, Mus musculus
gtggaggacacgattgagctgctca

SEQ ID NO: 708654 - DNA, 25 bp, Mus musculus
gtggaggacacgtaacaccggccca

SEQ ID NO: 708655 - DNA, 25 bp, Mus musculus
gtggaggacacgtttgagctgctca

SEQ ID NO: 708656 - DNA, 25 bp, Mus musculus
gtggaggacatcacctgtcaaagtt

SEQ ID NO: 708657 - DNA, 25 bp, Mus musculus
gtggaggacatctcctgtcaaagtt

SEQ ID NO: 708658 - DNA, 25 bp, Mus musculus
gtggaggacattactgcttgaggat

SEQ ID NO: 708659 - DNA, 25 bp, Mus musculus
gtggaggacatttctgcttgaggat

SEQ ID NO: 708660 - DNA, 25 bp, Mus musculus
gtggaggaccacaactacgaaggtg

SEQ ID NO: 708661 - DNA, 25 bp, Mus musculus
gtggaggaccacatgtacatcgcta

SEQ ID NO: 708662 - DNA, 25 bp, Mus musculus
gtggaggaccactactacgaaggtg

SEQ ID NO: 708663 - DNA, 25 bp, Mus musculus
gtggaggaccacttgtacatcgcta

SEQ ID NO: 708664 - DNA, 25 bp, Mus musculus
gtggaggaccttcagttacactctg

SEQ ID NO: 708665 - DNA, 25 bp, Mus musculus
gtggaggaccttgagttacactctg

SEQ ID NO: 708666 - DNA, 25 bp, Mus musculus
gtggaggacgatctctacatagatt

SEQ ID NO: 708667 - DNA, 25 bp, Mus musculus
gtggaggacgatgtctacatagatt

SEQ ID NO: 708668 - DNA, 25 bp, Mus musculus
gtggaggacgcccaggcattgccgg

SEQ ID NO: 708669 - DNA, 25 bp, Mus musculus
gtggaggacgccgaggcattgccgg

SEQ ID NO: 708670 - DNA, 25 bp, Mus musculus
gtggaggacgtgcagactctcatca

SEQ ID NO: 708671 - DNA, 25 bp, Mus musculus
gtggaggacgtggagactctcatca

SEQ ID NO: 708672 - DNA, 25 bp, Mus musculus
gtggaggactctaaattaggtgcat

SEQ ID NO: 708673 - DNA, 25 bp, Mus musculus
gtggaggactcttaattaggtgcat

SEQ ID NO: 708674 - DNA, 25 bp, Mus musculus
gtggaggacttcactgtgagccaga

SEQ ID NO: 708675 - DNA, 25 bp, Mus musculus
gtggaggacttctctgtgagccaga

SEQ ID NO: 708676 - DNA, 25 bp, Mus musculus
gtggaggagcctatactgatttatg

SEQ ID NO: 708677 - DNA, 25 bp, Mus musculus
gtggaggagcctttactgatttatg

SEQ ID NO: 708678 - DNA, 25 bp, Mus musculus
gtggaggaggttctgaggtccagct

SEQ ID NO: 708679 - DNA, 25 bp, Mus musculus
gtggaggaggttgtgaggtccagct

SEQ ID NO: 708680 - DNA, 25 bp, Mus musculus
gtggaggcaagcagaccagaccttc

SEQ ID NO: 708681 - DNA, 25 bp, Mus musculus
gtggaggcaagctgaccagaccttc

SEQ ID NO: 708682 - DNA, 25 bp, Mus musculus
gtggaggcaaggagcccatgcttat

SEQ ID NO: 708683 - DNA, 25 bp, Mus musculus
gtggaggcaaggtgcccatgcttat

SEQ ID NO: 708684 - DNA, 25 bp, Mus musculus
gtggaggcagcgacaccaaaaagcg

SEQ ID NO: 708685 - DNA, 25 bp, Mus musculus
gtggaggcagcgtcaccaaaaagcg

SEQ ID NO: 708686 - DNA, 25 bp, Mus musculus
gtggaggcagctcagtcccataaaa

SEQ ID NO: 708687 - DNA, 25 bp, Mus musculus
gtggaggcagctgagtcccataaaa

SEQ ID NO: 708688 - DNA, 25 bp, Mus musculus
gtggaggcagttaccaggcagtaat

SEQ ID NO: 708689 - DNA, 25 bp, Mus musculus
gtggaggcagtttccaggcagtaat

SEQ ID NO: 708690 - DNA, 25 bp, Mus musculus
gtggaggccatcacacacagaaact

SEQ ID NO: 708691 - DNA, 25 bp, Mus musculus
gtggaggccatctcacacagaaact

SEQ ID NO: 708692 - DNA, 25 bp, Mus musculus
gtggaggcccacagacaaatttctc

SEQ ID NO: 708693 - DNA, 25 bp, Mus musculus
gtggaggcccactgacaaatttctc

SEQ ID NO: 708694 - DNA, 25 bp, Mus musculus
gtggaggccctgcacgcctacgtct

SEQ ID NO: 708695 - DNA, 25 bp, Mus musculus
gtggaggccctggacgcctacgtct

SEQ ID NO: 708696 - DNA, 25 bp, Mus musculus
gtggaggccggcatttgccctttta

SEQ ID NO: 708697 - DNA, 25 bp, Mus musculus
gtggaggccggcttttgccctttta

SEQ ID NO: 708698 - DNA, 25 bp, Mus musculus
gtggaggcgtcacctccaagctgct

SEQ ID NO: 708699 - DNA, 25 bp, Mus musculus
gtggaggcgtcagctccaagctgct

SEQ ID NO: 708700 - DNA, 25 bp, Mus musculus
gtggaggctacaaggatccctgatt

SEQ ID NO: 708701 - DNA, 25 bp, Mus musculus
gtggaggctacacctgctcaggcca

SEQ ID NO: 708702 - DNA, 25 bp, Mus musculus
gtggaggctacagctgctcaggcca

SEQ ID NO: 708703 - DNA, 25 bp, Mus musculus
gtggaggctacatggatccctgatt

SEQ ID NO: 708704 - DNA, 25 bp, Mus musculus
gtggaggctccaaatacttgtattg

SEQ ID NO: 708705 - DNA, 25 bp, Mus musculus
gtggaggctccatatacttgtattg

SEQ ID NO: 708706 - DNA, 25 bp, Mus musculus
gtggaggctgttcatatcgcagcaa

SEQ ID NO: 708707 - DNA, 25 bp, Mus musculus
gtggaggctgttgatatcgcagcaa

SEQ ID NO: 708708 - DNA, 25 bp, Mus musculus
gtggaggcttaccaaaggttgcaat

SEQ ID NO: 708709 - DNA, 25 bp, Mus musculus
gtggaggcttacgaaaggttgcaat

SEQ ID NO: 708710 - DNA, 25 bp, Mus musculus
gtggaggcttagctatccctacagt

SEQ ID NO: 708711 - DNA, 25 bp, Mus musculus
gtggaggcttaggtatccctacagt

SEQ ID NO: 708712 - DNA, 25 bp, Mus musculus
gtggaggcttcgattctgggatccc

SEQ ID NO: 708713 - DNA, 25 bp, Mus musculus
gtggaggcttcgtttctgggatccc

SEQ ID NO: 708714 - DNA, 25 bp, Mus musculus
gtggagggaatacccccagatcagc

SEQ ID NO: 708715 - DNA, 25 bp, Mus musculus
gtggagggaatagccccagatcagc

SEQ ID NO: 708716 - DNA, 25 bp, Mus musculus
gtggagggattcattctctcccaac

SEQ ID NO: 708717 - DNA, 25 bp, Mus musculus
gtggagggattctttctctcccaac

SEQ ID NO: 708718 - DNA, 25 bp, Mus musculus
gtggagggccatctgtccctgactt

SEQ ID NO: 708719 - DNA, 25 bp, Mus musculus
gtggagggccatgtgtccctgactt

SEQ ID NO: 708720 - DNA, 25 bp, Mus musculus
gtggagggcctcaactaacgttgtc

SEQ ID NO: 708721 - DNA, 25 bp, Mus musculus
gtggagggcctctactaacgttgtc

SEQ ID NO: 708722 - DNA, 25 bp, Mus musculus
gtggagggcggcacttaacaacaaa

SEQ ID NO: 708723 - DNA, 25 bp, Mus musculus
gtggagggcggctcttaacaacaaa

SEQ ID NO: 708724 - DNA, 25 bp, Mus musculus
gtggagggctccagaggacacccaa

SEQ ID NO: 708725 - DNA, 25 bp, Mus musculus
gtggagggctcctgaggacacccaa

SEQ ID NO: 708726 - DNA, 25 bp, Mus musculus
gtggagggtttgactacagtcagtg

SEQ ID NO: 708727 - DNA, 25 bp, Mus musculus
gtggagggtttgtctacagtcagtg

SEQ ID NO: 708728 - DNA, 25 bp, Mus musculus
gtggaggtcaaccagttacttataa

SEQ ID NO: 708729 - DNA, 25 bp, Mus musculus
gtggaggtcaacgagttacttataa

SEQ ID NO: 708730 - DNA, 25 bp, Mus musculus
gtggaggtccccaactatctgactt

SEQ ID NO: 708731 - DNA, 25 bp, Mus musculus
gtggaggtcccctactatctgactt

SEQ ID NO: 708732 - DNA, 25 bp, Mus musculus
gtggaggtctctagtccccgtagta

SEQ ID NO: 708733 - DNA, 25 bp, Mus musculus
gtggaggtctcttgtccccgtagta

SEQ ID NO: 708734 - DNA, 25 bp, Mus musculus
gtggaggtctgtccccgtaatccca

SEQ ID NO: 708735 - DNA, 25 bp, Mus musculus
gtggaggtctgtgcccgtaatccca

SEQ ID NO: 708736 - DNA, 25 bp, Mus musculus
gtggaggtctttccaacttatcctt

SEQ ID NO: 708737 - DNA, 25 bp, Mus musculus
gtggaggtctttgcaacttatcctt

SEQ ID NO: 708738 - DNA, 25 bp, Mus musculus
gtggaggtgcagcacacttccagct

SEQ ID NO: 708739 - DNA, 25 bp, Mus musculus
gtggaggtgcaggacacttccagct

SEQ ID NO: 708740 - DNA, 25 bp, Mus musculus
gtggaggtgtgtcccacaacgcctc

SEQ ID NO: 708741 - DNA, 25 bp, Mus musculus
gtggaggtgtgtgccacaacgcctc

SEQ ID NO: 708742 - DNA, 25 bp, Mus musculus
gtggagtaactgagcccgtaacttc

SEQ ID NO: 708743 - DNA, 25 bp, Mus musculus
gtggagtaactgtgcccgtaacttc

SEQ ID NO: 708744 - DNA, 25 bp, Mus musculus
gtggagtaagttcctagcatcacgt

SEQ ID NO: 708745 - DNA, 25 bp, Mus musculus
gtggagtaagttgctagcatcacgt

SEQ ID NO: 708746 - DNA, 25 bp, Mus musculus
gtggagtacacaacatcacttctgt

SEQ ID NO: 708747 - DNA, 25 bp, Mus musculus
gtggagtacacatcatcacttctgt

SEQ ID NO: 708748 - DNA, 25 bp, Mus musculus
gtggagtacacccttcggaagcgac

SEQ ID NO: 708749 - DNA, 25 bp, Mus musculus
gtggagtacaccgttcggaagcgac

SEQ ID NO: 708750 - DNA, 25 bp, Mus musculus
gtggagtacagcagcatgggcttta

SEQ ID NO: 708751 - DNA, 25 bp, Mus musculus
gtggagtacagctgcatgggcttta

SEQ ID NO: 708752 - DNA, 25 bp, Mus musculus
gtggagtaccacatatgccaggagt

SEQ ID NO: 708753 - DNA, 25 bp, Mus musculus
gtggagtaccacttatgccaggagt

SEQ ID NO: 708754 - DNA, 25 bp, Mus musculus
gtggagtactgcctagcagacctcg

SEQ ID NO: 708755 - DNA, 25 bp, Mus musculus
gtggagtactgcgtagcagacctcg

SEQ ID NO: 708756 - DNA, 25 bp, Mus musculus
gtggagtactttattcctgttgtgt

SEQ ID NO: 708757 - DNA, 25 bp, Mus musculus
gtggagtacttttttcctgttgtgt

SEQ ID NO: 708758 - DNA, 25 bp, Mus musculus
gtggagtagattaccatgacccagc

SEQ ID NO: 708759 - DNA, 25 bp, Mus musculus
gtggagtagatttccatgacccagc

SEQ ID NO: 708760 - DNA, 25 bp, Mus musculus
gtggagtatgtaccgcatctcacac

SEQ ID NO: 708761 - DNA, 25 bp, Mus musculus
gtggagtatgtagcgcatctcacac

SEQ ID NO: 708762 - DNA, 25 bp, Mus musculus
gtggagtattatcaaagcaactacg

SEQ ID NO: 708763 - DNA, 25 bp, Mus musculus
gtggagtattatgaaagcaactacg

SEQ ID NO: 708764 - DNA, 25 bp, Mus musculus
gtggagtattttctcccagtaccaa

SEQ ID NO: 708765 - DNA, 25 bp, Mus musculus
gtggagtattttgtcccagtaccaa

SEQ ID NO: 708766 - DNA, 25 bp, Mus musculus
gtggagtcaagcacagagccagctc

SEQ ID NO: 708767 - DNA, 25 bp, Mus musculus
gtggagtcaagctcagagccagctc

SEQ ID NO: 708768 - DNA, 25 bp, Mus musculus
gtggagtcactcagatggcatagca

SEQ ID NO: 708769 - DNA, 25 bp, Mus musculus
gtggagtcactctgatggcatagca

SEQ ID NO: 708770 - DNA, 25 bp, Mus musculus
gtggagtcagccaattcctttttat

SEQ ID NO: 708771 - DNA, 25 bp, Mus musculus
gtggagtcagcctattcctttttat

SEQ ID NO: 708772 - DNA, 25 bp, Mus musculus
gtggagtcattcacttactgccata

SEQ ID NO: 708773 - DNA, 25 bp, Mus musculus
gtggagtcattctcttactgccata

SEQ ID NO: 708774 - DNA, 25 bp, Mus musculus
gtggagtccgcgatggacaccgcat

SEQ ID NO: 708775 - DNA, 25 bp, Mus musculus
gtggagtccgcgttggacaccgcat

SEQ ID NO: 708776 - DNA, 25 bp, Mus musculus
gtggagtcgtctcagaaggcctaca

SEQ ID NO: 708777 - DNA, 25 bp, Mus musculus
gtggagtcgtctgagaaggcctaca

SEQ ID NO: 708778 - DNA, 25 bp, Mus musculus
gtggagtctacaccataggctgtga

SEQ ID NO: 708779 - DNA, 25 bp, Mus musculus
gtggagtctacagcataggctgtga

SEQ ID NO: 708780 - DNA, 25 bp, Mus musculus
gtggagtctatgcactcagggtaca

SEQ ID NO: 708781 - DNA, 25 bp, Mus musculus
gtggagtctatggactcagggtaca

SEQ ID NO: 708782 - DNA, 25 bp, Mus musculus
gtggagtctccaagctgagagcacc

SEQ ID NO: 708783 - DNA, 25 bp, Mus musculus
gtggagtctccatgctgagagcacc

SEQ ID NO: 708784 - DNA, 25 bp, Mus musculus
gtggagtctgacaggcccttatacc

SEQ ID NO: 708785 - DNA, 25 bp, Mus musculus
gtggagtctgactggcccttatacc

SEQ ID NO: 708786 - DNA, 25 bp, Mus musculus
gtggagtctggcaataaaacctcaa

SEQ ID NO: 708787 - DNA, 25 bp, Mus musculus
gtggagtctggctataaaacctcaa

SEQ ID NO: 708788 - DNA, 25 bp, Mus musculus
gtggagtcttcacggcgctcacatg

SEQ ID NO: 708789 - DNA, 25 bp, Mus musculus
gtggagtcttcacttgtggctttga

SEQ ID NO: 708790 - DNA, 25 bp, Mus musculus
gtggagtcttcagggcgctcacatg

SEQ ID NO: 708791 - DNA, 25 bp, Mus musculus
gtggagtcttcagttgtggctttga

SEQ ID NO: 708792 - DNA, 25 bp, Mus musculus
gtggagtcttctcatgtatttttaa

SEQ ID NO: 708793 - DNA, 25 bp, Mus musculus
gtggagtcttctgatgtatttttaa

SEQ ID NO: 708794 - DNA, 25 bp, Mus musculus
gtggagtctttactctctagcttta

SEQ ID NO: 708795 - DNA, 25 bp, Mus musculus
gtggagtctttagtctctagcttta

SEQ ID NO: 708796 - DNA, 25 bp, Mus musculus
gtggagtgaaagagctcagccattt

SEQ ID NO: 708797 - DNA, 25 bp, Mus musculus
gtggagtgaaagtgctcagccattt

SEQ ID NO: 708798 - DNA, 25 bp, Mus musculus
gtggagtgaagccaccactcttaca

SEQ ID NO: 708799 - DNA, 25 bp, Mus musculus
gtggagtgaagcgaccactcttaca

SEQ ID NO: 708800 - DNA, 25 bp, Mus musculus
gtggagtgaataagtctccttttca

SEQ ID NO: 708801 - DNA, 25 bp, Mus musculus
gtggagtgaatatgtctccttttca

SEQ ID NO: 708802 - DNA, 25 bp, Mus musculus
gtggagtgacaccatcttccaagaa

SEQ ID NO: 708803 - DNA, 25 bp, Mus musculus
gtggagtgacacgatcttccaagaa

SEQ ID NO: 708804 - DNA, 25 bp, Mus musculus
gtggagtgactcacccatttactga

SEQ ID NO: 708805 - DNA, 25 bp, Mus musculus
gtggagtgactctcccatttactga

SEQ ID NO: 708806 - DNA, 25 bp, Mus musculus
gtggagtgactgagaaccgtctatg

SEQ ID NO: 708807 - DNA, 25 bp, Mus musculus
gtggagtgactgtgaaccgtctatg

SEQ ID NO: 708808 - DNA, 25 bp, Mus musculus
gtggagtgatcaaacagctgtacct

SEQ ID NO: 708809 - DNA, 25 bp, Mus musculus
gtggagtgatcatacagctgtacct

SEQ ID NO: 708810 - DNA, 25 bp, Mus musculus
gtggagtgcagtacatgcctgagta

SEQ ID NO: 708811 - DNA, 25 bp, Mus musculus
gtggagtgcagttcatgcctgagta

SEQ ID NO: 708812 - DNA, 25 bp, Mus musculus
gtggagtgcggcagagacctctcca

SEQ ID NO: 708813 - DNA, 25 bp, Mus musculus
gtggagtgcggctgagacctctcca

SEQ ID NO: 708814 - DNA, 25 bp, Mus musculus
gtggagtggctccaccctagtgaca

SEQ ID NO: 708815 - DNA, 25 bp, Mus musculus
gtggagtggctcgaccctagtgaca

SEQ ID NO: 708816 - DNA, 25 bp, Mus musculus
gtggagtgtgttcttttcacagtaa

SEQ ID NO: 708817 - DNA, 25 bp, Mus musculus
gtggagtgtgttgttttcacagtaa

SEQ ID NO: 708818 - DNA, 25 bp, Mus musculus
gtggagttaactcatgattaaatcg

SEQ ID NO: 708819 - DNA, 25 bp, Mus musculus
gtggagttaactgatgattaaatcg

SEQ ID NO: 708820 - DNA, 25 bp, Mus musculus
gtggagttacaactgggactccctg

SEQ ID NO: 708821 - DNA, 25 bp, Mus musculus
gtggagttacaagtgggactccctg

SEQ ID NO: 708822 - DNA, 25 bp, Mus musculus
gtggagttacggattcatgtgagcc

SEQ ID NO: 708823 - DNA, 25 bp, Mus musculus
gtggagttacggtttcatgtgagcc

SEQ ID NO: 708824 - DNA, 25 bp, Mus musculus
gtggagttactgaaccgctgaggca

SEQ ID NO: 708825 - DNA, 25 bp, Mus musculus
gtggagttactgtaccgctgaggca

SEQ ID NO: 708826 - DNA, 25 bp, Mus musculus
gtggagttcaacattgacctgccca

SEQ ID NO: 708827 - DNA, 25 bp, Mus musculus
gtggagttcaactttgacctgccca

SEQ ID NO: 708828 - DNA, 25 bp, Mus musculus
gtggagttcaatcccagagggccta

SEQ ID NO: 708829 - DNA, 25 bp, Mus musculus
gtggagttcaatgccagagggccta

SEQ ID NO: 708830 - DNA, 25 bp, Mus musculus
gtggagttcactcgcatcctcaaac

SEQ ID NO: 708831 - DNA, 25 bp, Mus musculus
gtggagttcactggcatcctcaaac

SEQ ID NO: 708832 - DNA, 25 bp, Mus musculus
gtggagttcatcagggccgctttcc

SEQ ID NO: 708833 - DNA, 25 bp, Mus musculus
gtggagttcatctgggccgctttcc

SEQ ID NO: 708834 - DNA, 25 bp, Mus musculus
gtggagttcatgagcaggtttgatt

SEQ ID NO: 708835 - DNA, 25 bp, Mus musculus
gtggagttcatgtgcaggtttgatt

SEQ ID NO: 708836 - DNA, 25 bp, Mus musculus
gtggagttctatatctgtttggtta

SEQ ID NO: 708837 - DNA, 25 bp, Mus musculus
gtggagttctatttctgtttggtta

SEQ ID NO: 708838 - DNA, 25 bp, Mus musculus
gtggagttcttcaggagtttgaatc

SEQ ID NO: 708839 - DNA, 25 bp, Mus musculus
gtggagttcttctggagtttgaatc

SEQ ID NO: 708840 - DNA, 25 bp, Mus musculus
gtggagttgctcattagctaccagc

SEQ ID NO: 708841 - DNA, 25 bp, Mus musculus
gtggagttgctctttagctaccagc

SEQ ID NO: 708842 - DNA, 25 bp, Mus musculus
gtggagttggtacgtgcgcccaggc

SEQ ID NO: 708843 - DNA, 25 bp, Mus musculus
gtggagttggtaggtgcgcccaggc

SEQ ID NO: 708844 - DNA, 25 bp, Mus musculus
gtggagttgttcatatcaccttgct

SEQ ID NO: 708845 - DNA, 25 bp, Mus musculus
gtggagttgttcttatcaccttgct

SEQ ID NO: 708846 - DNA, 25 bp, Mus musculus
gtggagttgtttcctcctctctgca

SEQ ID NO: 708847 - DNA, 25 bp, Mus musculus
gtggagttgtttgctcctctctgca

SEQ ID NO: 708848 - DNA, 25 bp, Mus musculus
gtggagtttgatatgttcgtttgtt

SEQ ID NO: 708849 - DNA, 25 bp, Mus musculus
gtggagtttgatttgttcgtttgtt

SEQ ID NO: 708850 - DNA, 25 bp, Mus musculus
gtggagttttcccagcctgccttag

SEQ ID NO: 708851 - DNA, 25 bp, Mus musculus
gtggagttttccgagcctgccttag

SEQ ID NO: 708852 - DNA, 25 bp, Mus musculus
gtggagttttgtacggctgttaaag

SEQ ID NO: 708853 - DNA, 25 bp, Mus musculus
gtggagttttgttcggctgttaaag

SEQ ID NO: 708854 - DNA, 25 bp, Mus musculus
gtggagtttttaccaaatagatcat

SEQ ID NO: 708855 - DNA, 25 bp, Mus musculus
gtggagtttttagcaaatagatcat

SEQ ID NO: 708856 - DNA, 25 bp, Mus musculus
gtggataaactgactttgccgcaag

SEQ ID NO: 708857 - DNA, 25 bp, Mus musculus
gtggataaactgtctttgccgcaag

SEQ ID NO: 708858 - DNA, 25 bp, Mus musculus
gtggataaagcactccaggctctgc

SEQ ID NO: 708859 - DNA, 25 bp, Mus musculus
gtggataaagcagtccaggctctgc

SEQ ID NO: 708860 - DNA, 25 bp, Mus musculus
gtggataacaataccctgggcctaa

SEQ ID NO: 708861 - DNA, 25 bp, Mus musculus
gtggataacaattccctgggcctaa

SEQ ID NO: 708862 - DNA, 25 bp, Mus musculus
gtggataaccaacccagagtcaatc

SEQ ID NO: 708863 - DNA, 25 bp, Mus musculus
gtggataaccaagccagagtcaatc

SEQ ID NO: 708864 - DNA, 25 bp, Mus musculus
gtggataacccaacccatatgacta

SEQ ID NO: 708865 - DNA, 25 bp, Mus musculus
gtggataacccatcccatatgacta

SEQ ID NO: 708866 - DNA, 25 bp, Mus musculus
gtggataacctaagctcagacgtga

SEQ ID NO: 708867 - DNA, 25 bp, Mus musculus
gtggataacctatgctcagacgtga

SEQ ID NO: 708868 - DNA, 25 bp, Mus musculus
gtggataaggttcctgccactgatc

SEQ ID NO: 708869 - DNA, 25 bp, Mus musculus
gtggataaggttgctgccactgatc

SEQ ID NO: 708870 - DNA, 25 bp, Mus musculus
gtggataagttccttgtcagatata

SEQ ID NO: 708871 - DNA, 25 bp, Mus musculus
gtggataagttcgttgtcagatata

SEQ ID NO: 708872 - DNA, 25 bp, Mus musculus
gtggataatttaacactattctggg

SEQ ID NO: 708873 - DNA, 25 bp, Mus musculus
gtggataatttatcactattctggg

SEQ ID NO: 708874 - DNA, 25 bp, Mus musculus
gtggatacaactattaactaacagt

SEQ ID NO: 708875 - DNA, 25 bp, Mus musculus
gtggatacaacttttaactaacagt

SEQ ID NO: 708876 - DNA, 25 bp, Mus musculus
gtggatacaatgcattctctgaatt

SEQ ID NO: 708877 - DNA, 25 bp, Mus musculus
gtggatacaatggattctctgaatt

SEQ ID NO: 708878 - DNA, 25 bp, Mus musculus
gtggatacacgtagaattctgtttt

SEQ ID NO: 708879 - DNA, 25 bp, Mus musculus
gtggatacacgttgaattctgtttt

SEQ ID NO: 708880 - DNA, 25 bp, Mus musculus
gtggatacagacaaacctgggcaaa

SEQ ID NO: 708881 - DNA, 25 bp, Mus musculus
gtggatacagacagttggttgcaag

SEQ ID NO: 708882 - DNA, 25 bp, Mus musculus
gtggatacagactaacctgggcaaa

SEQ ID NO: 708883 - DNA, 25 bp, Mus musculus
gtggatacagactgttggttgcaag

SEQ ID NO: 708884 - DNA, 25 bp, Mus musculus
gtggatacagcccaggcaccagatt

SEQ ID NO: 708885 - DNA, 25 bp, Mus musculus
gtggatacagccgaggcaccagatt

SEQ ID NO: 708886 - DNA, 25 bp, Mus musculus
gtggatacagcgaaaccaggcacct

SEQ ID NO: 708887 - DNA, 25 bp, Mus musculus
gtggatacagcgtaaccaggcacct

SEQ ID NO: 708888 - DNA, 25 bp, Mus musculus
gtggatacagtcagtactgcgccct

SEQ ID NO: 708889 - DNA, 25 bp, Mus musculus
gtggatacagtctgtactgcgccct

SEQ ID NO: 708890 - DNA, 25 bp, Mus musculus
gtggatacatggacccaggctgctt

SEQ ID NO: 708891 - DNA, 25 bp, Mus musculus
gtggatacatggtcccaggctgctt

SEQ ID NO: 708892 - DNA, 25 bp, Mus musculus
gtggatacattgctctaactaaatt

SEQ ID NO: 708893 - DNA, 25 bp, Mus musculus
gtggatacattggtctaactaaatt

SEQ ID NO: 708894 - DNA, 25 bp, Mus musculus
gtggataccatcagtttctccttaa

SEQ ID NO: 708895 - DNA, 25 bp, Mus musculus
gtggataccatctgtttctccttaa

SEQ ID NO: 708896 - DNA, 25 bp, Mus musculus
gtggatacggctcaagatatggcta

SEQ ID NO: 708897 - DNA, 25 bp, Mus musculus
gtggatacggctgaagatatggcta

SEQ ID NO: 708898 - DNA, 25 bp, Mus musculus
gtggatacggtcagcagctggactc

SEQ ID NO: 708899 - DNA, 25 bp, Mus musculus
gtggatacggtctgcagctggactc

SEQ ID NO: 708900 - DNA, 25 bp, Mus musculus
gtggatactaacctaccaatctgaa

SEQ ID NO: 708901 - DNA, 25 bp, Mus musculus
gtggatactaacgtaccaatctgaa

SEQ ID NO: 708902 - DNA, 25 bp, Mus musculus
gtggatacttttaaagtctgcggaa

SEQ ID NO: 708903 - DNA, 25 bp, Mus musculus
gtggatactttttaagtctgcggaa

SEQ ID NO: 708904 - DNA, 25 bp, Mus musculus
gtggatagagggaactgtcttcagt

SEQ ID NO: 708905 - DNA, 25 bp, Mus musculus
gtggatagagggtactgtcttcagt

SEQ ID NO: 708906 - DNA, 25 bp, Mus musculus
gtggatagctttcactgtctactta

SEQ ID NO: 708907 - DNA, 25 bp, Mus musculus
gtggatagctttgactgtctactta

SEQ ID NO: 708908 - DNA, 25 bp, Mus musculus
gtggataggaaaaacctgtatgcat

SEQ ID NO: 708909 - DNA, 25 bp, Mus musculus
gtggataggaaatacctgtatgcat

SEQ ID NO: 708910 - DNA, 25 bp, Mus musculus
gtggatagggtgatcccatagcatt

SEQ ID NO: 708911 - DNA, 25 bp, Mus musculus
gtggatagggtgttcccatagcatt

SEQ ID NO: 708912 - DNA, 25 bp, Mus musculus
gtggatatacgcattggctggtctc

SEQ ID NO: 708913 - DNA, 25 bp, Mus musculus
gtggatatacgctttggctggtctc

SEQ ID NO: 708914 - DNA, 25 bp, Mus musculus
gtggatatacttcccttctgaatga

SEQ ID NO: 708915 - DNA, 25 bp, Mus musculus
gtggatatacttgccttctgaatga

SEQ ID NO: 708916 - DNA, 25 bp, Mus musculus
gtggatatcactattcccagtattt

SEQ ID NO: 708917 - DNA, 25 bp, Mus musculus
gtggatatcacttttcccagtattt

SEQ ID NO: 708918 - DNA, 25 bp, Mus musculus
gtggatatcagacggtaacttacat

SEQ ID NO: 708919 - DNA, 25 bp, Mus musculus
gtggatatcagagggtaacttacat

SEQ ID NO: 708920 - DNA, 25 bp, Mus musculus
gtggatatccaacaccctagagaat

SEQ ID NO: 708921 - DNA, 25 bp, Mus musculus
gtggatatccaagaccctagagaat

SEQ ID NO: 708922 - DNA, 25 bp, Mus musculus
gtggatatgatcaagtatgcaagca

SEQ ID NO: 708923 - DNA, 25 bp, Mus musculus
gtggatatgatctagtatgcaagca

SEQ ID NO: 708924 - DNA, 25 bp, Mus musculus
gtggatatggctcttactacagatc

SEQ ID NO: 708925 - DNA, 25 bp, Mus musculus
gtggatatggctgttactacagatc

SEQ ID NO: 708926 - DNA, 25 bp, Mus musculus
gtggatatggtcatccgtaacccat

SEQ ID NO: 708927 - DNA, 25 bp, Mus musculus
gtggatatggtcttccgtaacccat

SEQ ID NO: 708928 - DNA, 25 bp, Mus musculus
gtggatattgttccttgagcctcct

SEQ ID NO: 708929 - DNA, 25 bp, Mus musculus
gtggatattgttctggcttcacact

SEQ ID NO: 708930 - DNA, 25 bp, Mus musculus
gtggatattgttgcttgagcctcct

SEQ ID NO: 708931 - DNA, 25 bp, Mus musculus
gtggatattgttgtggcttcacact

SEQ ID NO: 708932 - DNA, 25 bp, Mus musculus
gtggatatttagatgtccccgagtc

SEQ ID NO: 708933 - DNA, 25 bp, Mus musculus
gtggatatttagttgtccccgagtc

SEQ ID NO: 708934 - DNA, 25 bp, Mus musculus
gtggatatttatctgtgtaccctgc

SEQ ID NO: 708935 - DNA, 25 bp, Mus musculus
gtggatatttatgtgtgtaccctgc

SEQ ID NO: 708936 - DNA, 25 bp, Mus musculus
gtggatcaagaaatgcccatataca

SEQ ID NO: 708937 - DNA, 25 bp, Mus musculus
gtggatcaagaattgcccatataca

SEQ ID NO: 708938 - DNA, 25 bp, Mus musculus
gtggatcaagcactcagaaatacct

SEQ ID NO: 708939 - DNA, 25 bp, Mus musculus
gtggatcaagcagtcagaaatacct

SEQ ID NO: 708940 - DNA, 25 bp, Mus musculus
gtggatcaagttattagcgctcgga

SEQ ID NO: 708941 - DNA, 25 bp, Mus musculus
gtggatcaagtttttagcgctcgga

SEQ ID NO: 708942 - DNA, 25 bp, Mus musculus
gtggatcaatgtcatgccatttttt

SEQ ID NO: 708943 - DNA, 25 bp, Mus musculus
gtggatcaatgtgatgccatttttt

SEQ ID NO: 708944 - DNA, 25 bp, Mus musculus
gtggatcaatttacaaagactagtc

SEQ ID NO: 708945 - DNA, 25 bp, Mus musculus
gtggatcaattttcaaagactagtc

SEQ ID NO: 708946 - DNA, 25 bp, Mus musculus
gtggatcacaggctcggccagatca

SEQ ID NO: 708947 - DNA, 25 bp, Mus musculus
gtggatcacagggtcggccagatca

SEQ ID NO: 708948 - DNA, 25 bp, Mus musculus
gtggatcacatgatttaagccgggt

SEQ ID NO: 708949 - DNA, 25 bp, Mus musculus
gtggatcacatgttttaagccgggt

SEQ ID NO: 708950 - DNA, 25 bp, Mus musculus
gtggatcactgacctggctaaaagt

SEQ ID NO: 708951 - DNA, 25 bp, Mus musculus
gtggatcactgagctggctaaaagt

SEQ ID NO: 708952 - DNA, 25 bp, Mus musculus
gtggatcagaagatggttctttctt

SEQ ID NO: 708953 - DNA, 25 bp, Mus musculus
gtggatcagaagttggttctttctt

SEQ ID NO: 708954 - DNA, 25 bp, Mus musculus
gtggatcagagcaccagacttctgg

SEQ ID NO: 708955 - DNA, 25 bp, Mus musculus
gtggatcagagctccagacttctgg

SEQ ID NO: 708956 - DNA, 25 bp, Mus musculus
gtggatcagcaaacaggaatacgac

SEQ ID NO: 708957 - DNA, 25 bp, Mus musculus
gtggatcagcaatcaggaatacgac

SEQ ID NO: 708958 - DNA, 25 bp, Mus musculus
gtggatcagctgaagctctcaatgt

SEQ ID NO: 708959 - DNA, 25 bp, Mus musculus
gtggatcagctgtagctctcaatgt

SEQ ID NO: 708960 - DNA, 25 bp, Mus musculus
gtggatcaggtaagcccatcacatg

SEQ ID NO: 708961 - DNA, 25 bp, Mus musculus
gtggatcaggtatgcccatcacatg

SEQ ID NO: 708962 - DNA, 25 bp, Mus musculus
gtggatcatcatcattgaatgaacc

SEQ ID NO: 708963 - DNA, 25 bp, Mus musculus
gtggatcatcatgattgaatgaacc

SEQ ID NO: 708964 - DNA, 25 bp, Mus musculus
gtggatcatgataaaagtgcgcgtg

SEQ ID NO: 708965 - DNA, 25 bp, Mus musculus
gtggatcatgattaaagtgcgcgtg

SEQ ID NO: 708966 - DNA, 25 bp, Mus musculus
gtggatcatgccagtggagctgcaa

SEQ ID NO: 708967 - DNA, 25 bp, Mus musculus
gtggatcatgcctgtggagctgcaa

SEQ ID NO: 708968 - DNA, 25 bp, Mus musculus
gtggatcattagacccaccagggca

SEQ ID NO: 708969 - DNA, 25 bp, Mus musculus
gtggatcattagtcccaccagggca

SEQ ID NO: 708970 - DNA, 25 bp, Mus musculus
gtggatcattgcactgaaaaccgac

SEQ ID NO: 708971 - DNA, 25 bp, Mus musculus
gtggatcattgctctgaaaaccgac

SEQ ID NO: 708972 - DNA, 25 bp, Mus musculus
gtggatccaaaacagagttccaaac

SEQ ID NO: 708973 - DNA, 25 bp, Mus musculus
gtggatccaaaagagagttccaaac

SEQ ID NO: 708974 - DNA, 25 bp, Mus musculus
gtggatccaaggaccgtatcccaaa

SEQ ID NO: 708975 - DNA, 25 bp, Mus musculus
gtggatccaaggtccgtatcccaaa

SEQ ID NO: 708976 - DNA, 25 bp, Mus musculus
gtggatccagaaagcatctactcag

SEQ ID NO: 708977 - DNA, 25 bp, Mus musculus
gtggatccagaacgaattgccccaa

SEQ ID NO: 708978 - DNA, 25 bp, Mus musculus
gtggatccagaaggaattgccccaa

SEQ ID NO: 708979 - DNA, 25 bp, Mus musculus
gtggatccagaatgcatctactcag

SEQ ID NO: 708980 - DNA, 25 bp, Mus musculus
gtggatccagatcttcttgctcctt

SEQ ID NO: 708981 - DNA, 25 bp, Mus musculus
gtggatccagatgttcttgctcctt

SEQ ID NO: 708982 - DNA, 25 bp, Mus musculus
gtggatccatgcactgatgctgtga

SEQ ID NO: 708983 - DNA, 25 bp, Mus musculus
gtggatccatgctctgatgctgtga

SEQ ID NO: 708984 - DNA, 25 bp, Mus musculus
gtggatccatttatagacgctgccc

SEQ ID NO: 708985 - DNA, 25 bp, Mus musculus
gtggatccatttttagacgctgccc

SEQ ID NO: 708986 - DNA, 25 bp, Mus musculus
gtggatcccagaagatttcaggtac

SEQ ID NO: 708987 - DNA, 25 bp, Mus musculus
gtggatcccagatgatttcaggtac

SEQ ID NO: 708988 - DNA, 25 bp, Mus musculus
gtggatcccatgagtctgcagtaga

SEQ ID NO: 708989 - DNA, 25 bp, Mus musculus
gtggatcccatgtgtctgcagtaga

SEQ ID NO: 708990 - DNA, 25 bp, Mus musculus
gtggatcctctaagacactcatcac

SEQ ID NO: 708991 - DNA, 25 bp, Mus musculus
gtggatcctctatgacactcatcac

SEQ ID NO: 708992 - DNA, 25 bp, Mus musculus
gtggatcctcttaataccacagcat

SEQ ID NO: 708993 - DNA, 25 bp, Mus musculus
gtggatcctctttataccacagcat

SEQ ID NO: 708994 - DNA, 25 bp, Mus musculus
gtggatcctggaccctacagaaaac

SEQ ID NO: 708995 - DNA, 25 bp, Mus musculus
gtggatcctggagcctacagaaaac

SEQ ID NO: 708996 - DNA, 25 bp, Mus musculus
gtggatcctggcatataatgtgtaa

SEQ ID NO: 708997 - DNA, 25 bp, Mus musculus
gtggatcctggcttataatgtgtaa

SEQ ID NO: 708998 - DNA, 25 bp, Mus musculus
gtggatcgagatactgctgctgatt

SEQ ID NO: 708999 - DNA, 25 bp, Mus musculus
gtggatcgagattctgctgctgatt

SEQ ID NO: 709000 - DNA, 25 bp, Mus musculus
gtggatcgcccaagccaatttagaa

SEQ ID NO: 709001 - DNA, 25 bp, Mus musculus
gtggatcgcccatgccaatttagaa

SEQ ID NO: 709002 - DNA, 25 bp, Mus musculus
gtggatcggtagaaggcacctgttt

SEQ ID NO: 709003 - DNA, 25 bp, Mus musculus
gtggatcggtagtaggcacctgttt

SEQ ID NO: 709004 - DNA, 25 bp, Mus musculus
gtggatcggtggctccatcttggcc

SEQ ID NO: 709005 - DNA, 25 bp, Mus musculus
gtggatcggtgggtccatcttggcc

SEQ ID NO: 709006 - DNA, 25 bp, Mus musculus
gtggatctacaaatcctcccatgag

SEQ ID NO: 709007 - DNA, 25 bp, Mus musculus
gtggatctacaattcctcccatgag

SEQ ID NO: 709008 - DNA, 25 bp, Mus musculus
gtggatctcaccacaaagcccaaag

SEQ ID NO: 709009 - DNA, 25 bp, Mus musculus
gtggatctcacctcaaagcccaaag

SEQ ID NO: 709010 - DNA, 25 bp, Mus musculus
gtggatctcagacagctctgtgtgt

SEQ ID NO: 709011 - DNA, 25 bp, Mus musculus
gtggatctcagagagctctgtgtgt

SEQ ID NO: 709012 - DNA, 25 bp, Mus musculus
gtggatctccaaagtcagcatcatg

SEQ ID NO: 709013 - DNA, 25 bp, Mus musculus
gtggatctccaatgtcagcatcatg

SEQ ID NO: 709014 - DNA, 25 bp, Mus musculus
gtggatctccatactggagctgaat

SEQ ID NO: 709015 - DNA, 25 bp, Mus musculus
gtggatctccatatccttggaacag

SEQ ID NO: 709016 - DNA, 25 bp, Mus musculus
gtggatctccattctggagctgaat

SEQ ID NO: 709017 - DNA, 25 bp, Mus musculus
gtggatctccatttccttggaacag

SEQ ID NO: 709018 - DNA, 25 bp, Mus musculus
gtggatctctgccaatgttcttaga

SEQ ID NO: 709019 - DNA, 25 bp, Mus musculus
gtggatctctgcgaatgttcttaga

SEQ ID NO: 709020 - DNA, 25 bp, Mus musculus
gtggatctcttcaaaagcttgcaaa

SEQ ID NO: 709021 - DNA, 25 bp, Mus musculus
gtggatctcttctaaagcttgcaaa

SEQ ID NO: 709022 - DNA, 25 bp, Mus musculus
gtggatctgaaaaactaccgaccga

SEQ ID NO: 709023 - DNA, 25 bp, Mus musculus
gtggatctgaaatactaccgaccga

SEQ ID NO: 709024 - DNA, 25 bp, Mus musculus
gtggatctgagcagctatgtgccct

SEQ ID NO: 709025 - DNA, 25 bp, Mus musculus
gtggatctgagctgctatgtgccct

SEQ ID NO: 709026 - DNA, 25 bp, Mus musculus
gtggatctgcctatctggaagttac

SEQ ID NO: 709027 - DNA, 25 bp, Mus musculus
gtggatctgcctttctggaagttac

SEQ ID NO: 709028 - DNA, 25 bp, Mus musculus
gtggatctgcgcctgactccaattc

SEQ ID NO: 709029 - DNA, 25 bp, Mus musculus
gtggatctgcgcgtgactccaattc

SEQ ID NO: 709030 - DNA, 25 bp, Mus musculus
gtggatctggaacaggtttcacatt

SEQ ID NO: 709031 - DNA, 25 bp, Mus musculus
gtggatctggaagaggtttcacatt

SEQ ID NO: 709032 - DNA, 25 bp, Mus musculus
gtggatctgtaaagcccgtggtcgt

SEQ ID NO: 709033 - DNA, 25 bp, Mus musculus
gtggatctgtaatgcccgtggtcgt

SEQ ID NO: 709034 - DNA, 25 bp, Mus musculus
gtggatctgtctcgatccccttaca

SEQ ID NO: 709035 - DNA, 25 bp, Mus musculus
gtggatctgtctggatccccttaca

SEQ ID NO: 709036 - DNA, 25 bp, Mus musculus
gtggatctgtgcaatctgacactgt

SEQ ID NO: 709037 - DNA, 25 bp, Mus musculus
gtggatctgtgctatctgacactgt

SEQ ID NO: 709038 - DNA, 25 bp, Mus musculus
gtggatcttcctcatatagcaagtg

SEQ ID NO: 709039 - DNA, 25 bp, Mus musculus
gtggatcttcctgatatagcaagtg

SEQ ID NO: 709040 - DNA, 25 bp, Mus musculus
gtggatcttgcaattctctaagctg

SEQ ID NO: 709041 - DNA, 25 bp, Mus musculus
gtggatcttgcatttctctaagctg

SEQ ID NO: 709042 - DNA, 25 bp, Mus musculus
gtggatcttgtaccatcttcatgtg

SEQ ID NO: 709043 - DNA, 25 bp, Mus musculus
gtggatcttgtagcatcttcatgtg

SEQ ID NO: 709044 - DNA, 25 bp, Mus musculus
gtggatctttccagaaggtcttccc

SEQ ID NO: 709045 - DNA, 25 bp, Mus musculus
gtggatctttcctgaaggtcttccc

SEQ ID NO: 709046 - DNA, 25 bp, Mus musculus
gtggatgaaatacggctcctggcct

SEQ ID NO: 709047 - DNA, 25 bp, Mus musculus
gtggatgaaatagggctcctggcct

SEQ ID NO: 709048 - DNA, 25 bp, Mus musculus
gtggatgaagcacagctccaacaac

SEQ ID NO: 709049 - DNA, 25 bp, Mus musculus
gtggatgaagcagagctccaacaac

SEQ ID NO: 709050 - DNA, 25 bp, Mus musculus
gtggatgacaatcgagcagcagaaa

SEQ ID NO: 709051 - DNA, 25 bp, Mus musculus
gtggatgacaatggagcagcagaaa

SEQ ID NO: 709052 - DNA, 25 bp, Mus musculus
gtggatgacatacagagccatgcac

SEQ ID NO: 709053 - DNA, 25 bp, Mus musculus
gtggatgacatagagagccatgcac

SEQ ID NO: 709054 - DNA, 25 bp, Mus musculus
gtggatgaccacattgccaaagcac

SEQ ID NO: 709055 - DNA, 25 bp, Mus musculus
gtggatgaccactttgccaaagcac

SEQ ID NO: 709056 - DNA, 25 bp, Mus musculus
gtggatgagcctacatatacactgg

SEQ ID NO: 709057 - DNA, 25 bp, Mus musculus
gtggatgagccttcatatacactgg

SEQ ID NO: 709058 - DNA, 25 bp, Mus musculus
gtggatgaggaaccgctcacactct

SEQ ID NO: 709059 - DNA, 25 bp, Mus musculus
gtggatgaggaagcgctcacactct

SEQ ID NO: 709060 - DNA, 25 bp, Mus musculus
gtggatgatcccattcagcggaagt

SEQ ID NO: 709061 - DNA, 25 bp, Mus musculus
gtggatgatccctttcagcggaagt

SEQ ID NO: 709062 - DNA, 25 bp, Mus musculus
gtggatgcagcgagcagcgccctct

SEQ ID NO: 709063 - DNA, 25 bp, Mus musculus
gtggatgcagcgtgcagcgccctct

SEQ ID NO: 709064 - DNA, 25 bp, Mus musculus
gtggatgcatttattgtctgtttac

SEQ ID NO: 709065 - DNA, 25 bp, Mus musculus
gtggatgcattttttgtctgtttac

SEQ ID NO: 709066 - DNA, 25 bp, Mus musculus
gtggatgccaaaacttgtttgtttg

SEQ ID NO: 709067 - DNA, 25 bp, Mus musculus
gtggatgccaaatcttgtttgtttg

SEQ ID NO: 709068 - DNA, 25 bp, Mus musculus
gtggatgccagcaagactgtgtgaa

SEQ ID NO: 709069 - DNA, 25 bp, Mus musculus
gtggatgccagctagactgtgtgaa

SEQ ID NO: 709070 - DNA, 25 bp, Mus musculus
gtggatgccctaacttagatggttt

SEQ ID NO: 709071 - DNA, 25 bp, Mus musculus
gtggatgccctatcttagatggttt

SEQ ID NO: 709072 - DNA, 25 bp, Mus musculus
gtggatgcccttcctctgtctctgc

SEQ ID NO: 709073 - DNA, 25 bp, Mus musculus
gtggatgcccttgctctgtctctgc

SEQ ID NO: 709074 - DNA, 25 bp, Mus musculus
gtggatgccgcacaaaacaactcag

SEQ ID NO: 709075 - DNA, 25 bp, Mus musculus
gtggatgccgcagaaaacaactcag

SEQ ID NO: 709076 - DNA, 25 bp, Mus musculus
gtggatgccggaagcctccttgcca

SEQ ID NO: 709077 - DNA, 25 bp, Mus musculus
gtggatgccggatgcctccttgcca

SEQ ID NO: 709078 - DNA, 25 bp, Mus musculus
gtggatgcctgtctgatcactgcag

SEQ ID NO: 709079 - DNA, 25 bp, Mus musculus
gtggatgcctgtgtgatcactgcag

SEQ ID NO: 709080 - DNA, 25 bp, Mus musculus
gtggatgcgcctaaggaactctgct

SEQ ID NO: 709081 - DNA, 25 bp, Mus musculus
gtggatgcgccttaggaactctgct

SEQ ID NO: 709082 - DNA, 25 bp, Mus musculus
gtggatgcgtgtccaaatgcactga

SEQ ID NO: 709083 - DNA, 25 bp, Mus musculus
gtggatgcgtgtgcaaatgcactga

SEQ ID NO: 709084 - DNA, 25 bp, Mus musculus
gtggatgctcagatatttgtgggat

SEQ ID NO: 709085 - DNA, 25 bp, Mus musculus
gtggatgctcagttatttgtgggat

SEQ ID NO: 709086 - DNA, 25 bp, Mus musculus
gtggatgctccaacaggctgagcag

SEQ ID NO: 709087 - DNA, 25 bp, Mus musculus
gtggatgctccatcaggctgagcag

SEQ ID NO: 709088 - DNA, 25 bp, Mus musculus
gtggatgctcttcctatggataaca

SEQ ID NO: 709089 - DNA, 25 bp, Mus musculus
gtggatgctcttgctatggataaca

SEQ ID NO: 709090 - DNA, 25 bp, Mus musculus
gtggatgctgagagctaacaaccct

SEQ ID NO: 709091 - DNA, 25 bp, Mus musculus
gtggatgctgagtgctaacaaccct

SEQ ID NO: 709092 - DNA, 25 bp, Mus musculus
gtggatgctggtcacactgactgat

SEQ ID NO: 709093 - DNA, 25 bp, Mus musculus
gtggatgctggtgacactgactgat

SEQ ID NO: 709094 - DNA, 25 bp, Mus musculus
gtggatgctgtcattgaagcatttg

SEQ ID NO: 709095 - DNA, 25 bp, Mus musculus
gtggatgctgtctttgaagcatttg

SEQ ID NO: 709096 - DNA, 25 bp, Mus musculus
gtggatgcttcacatctttttggaa

SEQ ID NO: 709097 - DNA, 25 bp, Mus musculus
gtggatgcttcagatctttttggaa

SEQ ID NO: 709098 - DNA, 25 bp, Mus musculus
gtggatgcttccattaatcctctgt

SEQ ID NO: 709099 - DNA, 25 bp, Mus musculus
gtggatgcttcctttaatcctctgt

SEQ ID NO: 709100 - DNA, 25 bp, Mus musculus
gtggatgcttctaagtccgtacgta

SEQ ID NO: 709101 - DNA, 25 bp, Mus musculus
gtggatgcttcttagtccgtacgta

SEQ ID NO: 709102 - DNA, 25 bp, Mus musculus
gtggatggaaagatccttcccttcg

SEQ ID NO: 709103 - DNA, 25 bp, Mus musculus
gtggatggaaagttccttcccttcg

SEQ ID NO: 709104 - DNA, 25 bp, Mus musculus
gtggatggaattcgttgtcccctcc

SEQ ID NO: 709105 - DNA, 25 bp, Mus musculus
gtggatggaattggttgtcccctcc

SEQ ID NO: 709106 - DNA, 25 bp, Mus musculus
gtggatggagcaccctttctgatga

SEQ ID NO: 709107 - DNA, 25 bp, Mus musculus
gtggatggagcagcctttctgatga

SEQ ID NO: 709108 - DNA, 25 bp, Mus musculus
gtggatggccgaatgtgctcagtcc

SEQ ID NO: 709109 - DNA, 25 bp, Mus musculus
gtggatggccgattgtgctcagtcc

SEQ ID NO: 709110 - DNA, 25 bp, Mus musculus
gtggatggctctaattgccttgtct

SEQ ID NO: 709111 - DNA, 25 bp, Mus musculus
gtggatggctcttattgccttgtct

SEQ ID NO: 709112 - DNA, 25 bp, Mus musculus
gtggatggctgcaccaccaaatcat

SEQ ID NO: 709113 - DNA, 25 bp, Mus musculus
gtggatggctgctccaccaaatcat

SEQ ID NO: 709114 - DNA, 25 bp, Mus musculus
gtggatgggacaccttctgagacca

SEQ ID NO: 709115 - DNA, 25 bp, Mus musculus
gtggatgggacagcttctgagacca

SEQ ID NO: 709116 - DNA, 25 bp, Mus musculus
gtggatgggtccatgtccccagcaa

SEQ ID NO: 709117 - DNA, 25 bp, Mus musculus
gtggatgggtccttgtccccagcaa

SEQ ID NO: 709118 - DNA, 25 bp, Mus musculus
gtggatggtaccagcagacttccaa

SEQ ID NO: 709119 - DNA, 25 bp, Mus musculus
gtggatggtacctgcagacttccaa

SEQ ID NO: 709120 - DNA, 25 bp, Mus musculus
gtggatggtctcatttctgaaaaag

SEQ ID NO: 709121 - DNA, 25 bp, Mus musculus
gtggatggtctcttttctgaaaaag

SEQ ID NO: 709122 - DNA, 25 bp, Mus musculus
gtggatgtaacgagctcgggacaat

SEQ ID NO: 709123 - DNA, 25 bp, Mus musculus
gtggatgtaacgtgctcgggacaat

SEQ ID NO: 709124 - DNA, 25 bp, Mus musculus
gtggatgtagacctgaacctgattt

SEQ ID NO: 709125 - DNA, 25 bp, Mus musculus
gtggatgtagacgtgaacctgattt

SEQ ID NO: 709126 - DNA, 25 bp, Mus musculus
gtggatgtcattccatttggagtat

SEQ ID NO: 709127 - DNA, 25 bp, Mus musculus
gtggatgtcattgcatttggagtat

SEQ ID NO: 709128 - DNA, 25 bp, Mus musculus
gtggatgtccttatttgcatgtaat

SEQ ID NO: 709129 - DNA, 25 bp, Mus musculus
gtggatgtccttttttgcatgtaat

SEQ ID NO: 709130 - DNA, 25 bp, Mus musculus
gtggatgtctacattgacaatgttg

SEQ ID NO: 709131 - DNA, 25 bp, Mus musculus
gtggatgtctactttgacaatgttg

SEQ ID NO: 709132 - DNA, 25 bp, Mus musculus
gtggatgtctggagacagcttctca

SEQ ID NO: 709133 - DNA, 25 bp, Mus musculus
gtggatgtctggtgacagcttctca

SEQ ID NO: 709134 - DNA, 25 bp, Mus musculus
gtggatgtgattcccaagcgcttgc

SEQ ID NO: 709135 - DNA, 25 bp, Mus musculus
gtggatgtgattgccaagcgcttgc

SEQ ID NO: 709136 - DNA, 25 bp, Mus musculus
gtggatgtgcacatttgtaaatgtt

SEQ ID NO: 709137 - DNA, 25 bp, Mus musculus
gtggatgtgcacttttgtaaatgtt

SEQ ID NO: 709138 - DNA, 25 bp, Mus musculus
gtggatgtgcttatgacttcaaata

SEQ ID NO: 709139 - DNA, 25 bp, Mus musculus
gtggatgtgcttttgacttcaaata

SEQ ID NO: 709140 - DNA, 25 bp, Mus musculus
gtggatgtggctacagaactcctgc

SEQ ID NO: 709141 - DNA, 25 bp, Mus musculus
gtggatgtggcttcagaactcctgc

SEQ ID NO: 709142 - DNA, 25 bp, Mus musculus
gtggatgtgtctctcaaattctcaa

SEQ ID NO: 709143 - DNA, 25 bp, Mus musculus
gtggatgtgtctgtcaaattctcaa

SEQ ID NO: 709144 - DNA, 25 bp, Mus musculus
gtggatgtgtgtagcagcacccttt

SEQ ID NO: 709145 - DNA, 25 bp, Mus musculus
gtggatgtgtgttgcagcacccttt

SEQ ID NO: 709146 - DNA, 25 bp, Mus musculus
gtggatgttcttcggagtctcccca

SEQ ID NO: 709147 - DNA, 25 bp, Mus musculus
gtggatgttcttgggagtctcccca

SEQ ID NO: 709148 - DNA, 25 bp, Mus musculus
gtggatgttgcaaaccaaagtctgt

SEQ ID NO: 709149 - DNA, 25 bp, Mus musculus
gtggatgttgcataccaaagtctgt

SEQ ID NO: 709150 - DNA, 25 bp, Mus musculus
gtggatgtttacctcgaacgctcct

SEQ ID NO: 709151 - DNA, 25 bp, Mus musculus
gtggatgtttacgtcgaacgctcct

SEQ ID NO: 709152 - DNA, 25 bp, Mus musculus
gtggattaaactcctcccagaagag

SEQ ID NO: 709153 - DNA, 25 bp, Mus musculus
gtggattaaactgctcccagaagag

SEQ ID NO: 709154 - DNA, 25 bp, Mus musculus
gtggattaaagtaccgagattgctg

SEQ ID NO: 709155 - DNA, 25 bp, Mus musculus
gtggattaaagttccgagattgctg

SEQ ID NO: 709156 - DNA, 25 bp, Mus musculus
gtggattaagttctgctctcatcac

SEQ ID NO: 709157 - DNA, 25 bp, Mus musculus
gtggattaagttgtgctctcatcac

SEQ ID NO: 709158 - DNA, 25 bp, Mus musculus
gtggattaccgcactgtcttgttgc

SEQ ID NO: 709159 - DNA, 25 bp, Mus musculus
gtggattaccgctctgtcttgttgc

SEQ ID NO: 709160 - DNA, 25 bp, Mus musculus
gtggattatcacagcatttgtctct

SEQ ID NO: 709161 - DNA, 25 bp, Mus musculus
gtggattatcactgcatttgtctct

SEQ ID NO: 709162 - DNA, 25 bp, Mus musculus
gtggattatcccaattgctatttta

SEQ ID NO: 709163 - DNA, 25 bp, Mus musculus
gtggattatccctattgctatttta

SEQ ID NO: 709164 - DNA, 25 bp, Mus musculus
gtggattatctgatggccatacttt

SEQ ID NO: 709165 - DNA, 25 bp, Mus musculus
gtggattatctgttggccatacttt

SEQ ID NO: 709166 - DNA, 25 bp, Mus musculus
gtggattatgttcctgatcatttgc

SEQ ID NO: 709167 - DNA, 25 bp, Mus musculus
gtggattatgttgctgatcatttgc

SEQ ID NO: 709168 - DNA, 25 bp, Mus musculus
gtggattcacccaccagatgaagac

SEQ ID NO: 709169 - DNA, 25 bp, Mus musculus
gtggattcacccacgtgaagagtga

SEQ ID NO: 709170 - DNA, 25 bp, Mus musculus
gtggattcacccatctagcgggagg

SEQ ID NO: 709171 - DNA, 25 bp, Mus musculus
gtggattcaccctccagatgaagac

SEQ ID NO: 709172 - DNA, 25 bp, Mus musculus
gtggattcaccctcgtgaagagtga

SEQ ID NO: 709173 - DNA, 25 bp, Mus musculus
gtggattcacccttctagcgggagg

SEQ ID NO: 709174 - DNA, 25 bp, Mus musculus
gtggattcacggctcagcttgtaaa

SEQ ID NO: 709175 - DNA, 25 bp, Mus musculus
gtggattcacgggtcagcttgtaaa

SEQ ID NO: 709176 - DNA, 25 bp, Mus musculus
gtggattcaggtatattctgtcctt

SEQ ID NO: 709177 - DNA, 25 bp, Mus musculus
gtggattcaggtttattctgtcctt

SEQ ID NO: 709178 - DNA, 25 bp, Mus musculus
gtggattcagttctattgacttatg

SEQ ID NO: 709179 - DNA, 25 bp, Mus musculus
gtggattcagttgtattgacttatg

SEQ ID NO: 709180 - DNA, 25 bp, Mus musculus
gtggattcatcaactcacaagaact

SEQ ID NO: 709181 - DNA, 25 bp, Mus musculus
gtggattcatcatctcacaagaact

SEQ ID NO: 709182 - DNA, 25 bp, Mus musculus
gtggattcatctactttaaaccaag

SEQ ID NO: 709183 - DNA, 25 bp, Mus musculus
gtggattcatcttctttaaaccaag

SEQ ID NO: 709184 - DNA, 25 bp, Mus musculus
gtggattcatgcaacttttctttta

SEQ ID NO: 709185 - DNA, 25 bp, Mus musculus
gtggattcatgctacttttctttta

SEQ ID NO: 709186 - DNA, 25 bp, Mus musculus
gtggattccattctaaaaggctttg

SEQ ID NO: 709187 - DNA, 25 bp, Mus musculus
gtggattccattgtaaaaggctttg

SEQ ID NO: 709188 - DNA, 25 bp, Mus musculus
gtggattcccgcagactcggacaaa

SEQ ID NO: 709189 - DNA, 25 bp, Mus musculus
gtggattcccgctgactcggacaaa

SEQ ID NO: 709190 - DNA, 25 bp, Mus musculus
gtggattcctatactcatttagtaa

SEQ ID NO: 709191 - DNA, 25 bp, Mus musculus
gtggattcctattctcatttagtaa

SEQ ID NO: 709192 - DNA, 25 bp, Mus musculus
gtggattctagccttatgttgggtt

SEQ ID NO: 709193 - DNA, 25 bp, Mus musculus
gtggattctagcgttatgttgggtt

SEQ ID NO: 709194 - DNA, 25 bp, Mus musculus
gtggattctataaatctctctgtaa

SEQ ID NO: 709195 - DNA, 25 bp, Mus musculus
gtggattctatactagctgttagct

SEQ ID NO: 709196 - DNA, 25 bp, Mus musculus
gtggattctatagtagctgttagct

SEQ ID NO: 709197 - DNA, 25 bp, Mus musculus
gtggattctatatatctctctgtaa

SEQ ID NO: 709198 - DNA, 25 bp, Mus musculus
gtggattctcctctaatctcaatat

SEQ ID NO: 709199 - DNA, 25 bp, Mus musculus
gtggattctcctgtaatctcaatat

SEQ ID NO: 709200 - DNA, 25 bp, Mus musculus
gtggattctctacaatctatcccgg

SEQ ID NO: 709201 - DNA, 25 bp, Mus musculus
gtggattctctagaatctatcccgg

SEQ ID NO: 709202 - DNA, 25 bp, Mus musculus
gtggattctctgattccagacaact

SEQ ID NO: 709203 - DNA, 25 bp, Mus musculus
gtggattctctgtttccagacaact

SEQ ID NO: 709204 - DNA, 25 bp, Mus musculus
gtggattctgcgaggtactacttca

SEQ ID NO: 709205 - DNA, 25 bp, Mus musculus
gtggattctgcgtggtactacttca

SEQ ID NO: 709206 - DNA, 25 bp, Mus musculus
gtggattctggaaacctttgctgaa

SEQ ID NO: 709207 - DNA, 25 bp, Mus musculus
gtggattctggatacctttgctgaa

SEQ ID NO: 709208 - DNA, 25 bp, Mus musculus
gtggattctgttcctagcactacac

SEQ ID NO: 709209 - DNA, 25 bp, Mus musculus
gtggattctgttgctagcactacac

SEQ ID NO: 709210 - DNA, 25 bp, Mus musculus
gtggattcttcgcaagctgctttca

SEQ ID NO: 709211 - DNA, 25 bp, Mus musculus
gtggattcttcggaagctgctttca

SEQ ID NO: 709212 - DNA, 25 bp, Mus musculus
gtggattgaggaaccaacaccttgc

SEQ ID NO: 709213 - DNA, 25 bp, Mus musculus
gtggattgaggatccaacaccttgc

SEQ ID NO: 709214 - DNA, 25 bp, Mus musculus
gtggattgaggtagccctcagagca

SEQ ID NO: 709215 - DNA, 25 bp, Mus musculus
gtggattgaggttgccctcagagca

SEQ ID NO: 709216 - DNA, 25 bp, Mus musculus
gtggattgagttagctctcacctga

SEQ ID NO: 709217 - DNA, 25 bp, Mus musculus
gtggattgagtttgctctcacctga

SEQ ID NO: 709218 - DNA, 25 bp, Mus musculus
gtggattgtcacatttcctttcaaa

SEQ ID NO: 709219 - DNA, 25 bp, Mus musculus
gtggattgtcacttttcctttcaaa

SEQ ID NO: 709220 - DNA, 25 bp, Mus musculus
gtggattgtccacagcatactataa

SEQ ID NO: 709221 - DNA, 25 bp, Mus musculus
gtggattgtccagagcatactataa

SEQ ID NO: 709222 - DNA, 25 bp, Mus musculus
gtggatttaatcctcacaggttttg

SEQ ID NO: 709223 - DNA, 25 bp, Mus musculus
gtggatttaatcgtcacaggttttg

SEQ ID NO: 709224 - DNA, 25 bp, Mus musculus
gtggatttagctagcgtgagccaac

SEQ ID NO: 709225 - DNA, 25 bp, Mus musculus
gtggatttagcttgcgtgagccaac

SEQ ID NO: 709226 - DNA, 25 bp, Mus musculus
gtggatttatctaaattcccttcag

SEQ ID NO: 709227 - DNA, 25 bp, Mus musculus
gtggatttatcttaattcccttcag

SEQ ID NO: 709228 - DNA, 25 bp, Mus musculus
gtggatttcaagatcgtcaggtgta

SEQ ID NO: 709229 - DNA, 25 bp, Mus musculus
gtggatttcaagatgtctcctggct

SEQ ID NO: 709230 - DNA, 25 bp, Mus musculus
gtggatttcaagttcgtcaggtgta

SEQ ID NO: 709231 - DNA, 25 bp, Mus musculus
gtggatttcaagttgtctcctggct

SEQ ID NO: 709232 - DNA, 25 bp, Mus musculus
gtggatttcacacttcaggctggcc

SEQ ID NO: 709233 - DNA, 25 bp, Mus musculus
gtggatttcacagttcaggctggcc

SEQ ID NO: 709234 - DNA, 25 bp, Mus musculus
gtggatttcacccagataaaaccag

SEQ ID NO: 709235 - DNA, 25 bp, Mus musculus
gtggatttcaccgagataaaaccag

SEQ ID NO: 709236 - DNA, 25 bp, Mus musculus
gtggatttcgaacactctctggacc

SEQ ID NO: 709237 - DNA, 25 bp, Mus musculus
gtggatttcgaagactctctggacc

SEQ ID NO: 709238 - DNA, 25 bp, Mus musculus
gtggatttctcaccaaacaacttag

SEQ ID NO: 709239 - DNA, 25 bp, Mus musculus
gtggatttctcagcaaacaacttag

SEQ ID NO: 709240 - DNA, 25 bp, Mus musculus
gtggatttctctctttgccttaaac

SEQ ID NO: 709241 - DNA, 25 bp, Mus musculus
gtggatttctctgtttgccttaaac

SEQ ID NO: 709242 - DNA, 25 bp, Mus musculus
gtggatttctgactgtgactgaaat

SEQ ID NO: 709243 - DNA, 25 bp, Mus musculus
gtggatttctgagtgtgactgaaat

SEQ ID NO: 709244 - DNA, 25 bp, Mus musculus
gtggatttctggactgctgcgtgac

SEQ ID NO: 709245 - DNA, 25 bp, Mus musculus
gtggatttctggtctgctgcgtgac

SEQ ID NO: 709246 - DNA, 25 bp, Mus musculus
gtggatttgccacgatcaaggacct

SEQ ID NO: 709247 - DNA, 25 bp, Mus musculus
gtggatttgccaggatcaaggacct

SEQ ID NO: 709248 - DNA, 25 bp, Mus musculus
gtggatttgccgcaggacgcacctc

SEQ ID NO: 709249 - DNA, 25 bp, Mus musculus
gtggatttgccggaggacgcacctc

SEQ ID NO: 709250 - DNA, 25 bp, Mus musculus
gtggatttgcctcatgtgagacaaa

SEQ ID NO: 709251 - DNA, 25 bp, Mus musculus
gtggatttgcctgatgtgagacaaa

SEQ ID NO: 709252 - DNA, 25 bp, Mus musculus
gtggatttggcaatgactgcgccat

SEQ ID NO: 709253 - DNA, 25 bp, Mus musculus
gtggatttggcattgactgcgccat

SEQ ID NO: 709254 - DNA, 25 bp, Mus musculus
gtggatttgggcatttctttaagta

SEQ ID NO: 709255 - DNA, 25 bp, Mus musculus
gtggatttgggcttttctttaagta

SEQ ID NO: 709256 - DNA, 25 bp, Mus musculus
gtggatttgttgatacctgctgaag

SEQ ID NO: 709257 - DNA, 25 bp, Mus musculus
gtggatttgttgttacctgctgaag

SEQ ID NO: 709258 - DNA, 25 bp, Mus musculus
gtggattttataccccaaattcact

SEQ ID NO: 709259 - DNA, 25 bp, Mus musculus
gtggattttatagcccaaattcact

SEQ ID NO: 709260 - DNA, 25 bp, Mus musculus
gtggattttgtgcaacactgcagtt

SEQ ID NO: 709261 - DNA, 25 bp, Mus musculus
gtggattttgtggaacactgcagtt

SEQ ID NO: 709262 - DNA, 25 bp, Mus musculus
gtggatttttctatagggacatgac

SEQ ID NO: 709263 - DNA, 25 bp, Mus musculus
gtggatttttctttagggacatgac

SEQ ID NO: 709264 - DNA, 25 bp, Mus musculus
gtggatttttgaacctatgtaagaa

SEQ ID NO: 709265 - DNA, 25 bp, Mus musculus
gtggatttttgatcctatgtaagaa

SEQ ID NO: 709266 - DNA, 25 bp, Mus musculus
gtggcaaaaatcacattcttctcgt

SEQ ID NO: 709267 - DNA, 25 bp, Mus musculus
gtggcaaaaatctcattcttctcgt

SEQ ID NO: 709268 - DNA, 25 bp, Mus musculus
gtggcaaaatctacatctggaaggg

SEQ ID NO: 709269 - DNA, 25 bp, Mus musculus
gtggcaaaatcttcatctggaaggg

SEQ ID NO: 709270 - DNA, 25 bp, Mus musculus
gtggcaaaatgaagacacctgttct

SEQ ID NO: 709271 - DNA, 25 bp, Mus musculus
gtggcaaaatgatgacacctgttct

SEQ ID NO: 709272 - DNA, 25 bp, Mus musculus
gtggcaaaccacaggagtccaaatc

SEQ ID NO: 709273 - DNA, 25 bp, Mus musculus
gtggcaaaccactggagtccaaatc

SEQ ID NO: 709274 - DNA, 25 bp, Mus musculus
gtggcaaacgatccaaagcccacct

SEQ ID NO: 709275 - DNA, 25 bp, Mus musculus
gtggcaaacgatgcaaagcccacct

SEQ ID NO: 709276 - DNA, 25 bp, Mus musculus
gtggcaaagacgcagagcccttgta

SEQ ID NO: 709277 - DNA, 25 bp, Mus musculus
gtggcaaagacggagagcccttgta

SEQ ID NO: 709278 - DNA, 25 bp, Mus musculus
gtggcaaagcccagaatgaacgcaa

SEQ ID NO: 709279 - DNA, 25 bp, Mus musculus
gtggcaaagcccaggcacaggtata

SEQ ID NO: 709280 - DNA, 25 bp, Mus musculus
gtggcaaagccctgaatgaacgcaa

SEQ ID NO: 709281 - DNA, 25 bp, Mus musculus
gtggcaaagccctggcacaggtata

SEQ ID NO: 709282 - DNA, 25 bp, Mus musculus
gtggcaaagcgacaataccctaagt

SEQ ID NO: 709283 - DNA, 25 bp, Mus musculus
gtggcaaagcgagaataccctaagt

SEQ ID NO: 709284 - DNA, 25 bp, Mus musculus
gtggcaaagctccagtgccctttca

SEQ ID NO: 709285 - DNA, 25 bp, Mus musculus
gtggcaaagctcgagtgccctttca

SEQ ID NO: 709286 - DNA, 25 bp, Mus musculus
gtggcaaatcaaactcctacagctg

SEQ ID NO: 709287 - DNA, 25 bp, Mus musculus
gtggcaaatcaatctcctacagctg

SEQ ID NO: 709288 - DNA, 25 bp, Mus musculus
gtggcaaatcccacaggagtttgtc

SEQ ID NO: 709289 - DNA, 25 bp, Mus musculus
gtggcaaatccctcaggagtttgtc

SEQ ID NO: 709290 - DNA, 25 bp, Mus musculus
gtggcaaatgagctatcctcttagt

SEQ ID NO: 709291 - DNA, 25 bp, Mus musculus
gtggcaaatgaggtatcctcttagt

SEQ ID NO: 709292 - DNA, 25 bp, Mus musculus
gtggcaacaaataggcctgatgtgt

SEQ ID NO: 709293 - DNA, 25 bp, Mus musculus
gtggcaacaaattggcctgatgtgt

SEQ ID NO: 709294 - DNA, 25 bp, Mus musculus
gtggcaacaatcagcatcctctttc

SEQ ID NO: 709295 - DNA, 25 bp, Mus musculus
gtggcaacaatctgcatcctctttc

SEQ ID NO: 709296 - DNA, 25 bp, Mus musculus
gtggcaacacctatgcttcagtttt

SEQ ID NO: 709297 - DNA, 25 bp, Mus musculus
gtggcaacacctttgcttcagtttt

SEQ ID NO: 709298 - DNA, 25 bp, Mus musculus
gtggcaacagccctctctgtggtct

SEQ ID NO: 709299 - DNA, 25 bp, Mus musculus
gtggcaacagccgtctctgtggtct

SEQ ID NO: 709300 - DNA, 25 bp, Mus musculus
gtggcaacaggcagtttaggatttt

SEQ ID NO: 709301 - DNA, 25 bp, Mus musculus
gtggcaacaggctgtttaggatttt

SEQ ID NO: 709302 - DNA, 25 bp, Mus musculus
gtggcaacagtcacgtgtgtggaaa

SEQ ID NO: 709303 - DNA, 25 bp, Mus musculus
gtggcaacagtctcgtgtgtggaaa

SEQ ID NO: 709304 - DNA, 25 bp, Mus musculus
gtggcaacatgtcgtctcctgatat

SEQ ID NO: 709305 - DNA, 25 bp, Mus musculus
gtggcaacatgtggtctcctgatat

SEQ ID NO: 709306 - DNA, 25 bp, Mus musculus
gtggcaacattacctgccttcctca

SEQ ID NO: 709307 - DNA, 25 bp, Mus musculus
gtggcaacattagctgccttcctca

SEQ ID NO: 709308 - DNA, 25 bp, Mus musculus
gtggcaaccaagaattttgatcatt

SEQ ID NO: 709309 - DNA, 25 bp, Mus musculus
gtggcaaccaagtattttgatcatt

SEQ ID NO: 709310 - DNA, 25 bp, Mus musculus
gtggcaaccactatagtccttagtg

SEQ ID NO: 709311 - DNA, 25 bp, Mus musculus
gtggcaaccactccacgtagcaagt

SEQ ID NO: 709312 - DNA, 25 bp, Mus musculus
gtggcaaccactgcacgtagcaagt

SEQ ID NO: 709313 - DNA, 25 bp, Mus musculus
gtggcaaccactttagtccttagtg

SEQ ID NO: 709314 - DNA, 25 bp, Mus musculus
gtggcaaccattacacattgtcttt

SEQ ID NO: 709315 - DNA, 25 bp, Mus musculus
gtggcaaccatttcacattgtcttt

SEQ ID NO: 709316 - DNA, 25 bp, Mus musculus
gtggcaaccctaaagtgattggctg

SEQ ID NO: 709317 - DNA, 25 bp, Mus musculus
gtggcaaccctatagtgattggctg

SEQ ID NO: 709318 - DNA, 25 bp, Mus musculus
gtggcaaccgaaagtccttgagacg

SEQ ID NO: 709319 - DNA, 25 bp, Mus musculus
gtggcaaccgaatgtccttgagacg

SEQ ID NO: 709320 - DNA, 25 bp, Mus musculus
gtggcaaccgggaaggatctattta

SEQ ID NO: 709321 - DNA, 25 bp, Mus musculus
gtggcaaccgggtaggatctattta

SEQ ID NO: 709322 - DNA, 25 bp, Mus musculus
gtggcaacggaaatcgagtccttct

SEQ ID NO: 709323 - DNA, 25 bp, Mus musculus
gtggcaacggaattcgagtccttct

SEQ ID NO: 709324 - DNA, 25 bp, Mus musculus
gtggcaactatcatcactgtacatt

SEQ ID NO: 709325 - DNA, 25 bp, Mus musculus
gtggcaactatcttcactgtacatt

SEQ ID NO: 709326 - DNA, 25 bp, Mus musculus
gtggcaactggcaggctctgaagct

SEQ ID NO: 709327 - DNA, 25 bp, Mus musculus
gtggcaactggctggctctgaagct

SEQ ID NO: 709328 - DNA, 25 bp, Mus musculus
gtggcaacttaaaggttcttcactt

SEQ ID NO: 709329 - DNA, 25 bp, Mus musculus
gtggcaacttaatggttcttcactt

SEQ ID NO: 709330 - DNA, 25 bp, Mus musculus
gtggcaacttctatgatttactagt

SEQ ID NO: 709331 - DNA, 25 bp, Mus musculus
gtggcaacttctttgatttactagt

SEQ ID NO: 709332 - DNA, 25 bp, Mus musculus
gtggcaagaacacgccctttggcaa

SEQ ID NO: 709333 - DNA, 25 bp, Mus musculus
gtggcaagaacaggccctttggcaa

SEQ ID NO: 709334 - DNA, 25 bp, Mus musculus
gtggcaagacttctgattggcatgt

SEQ ID NO: 709335 - DNA, 25 bp, Mus musculus
gtggcaagacttgtgattggcatgt

SEQ ID NO: 709336 - DNA, 25 bp, Mus musculus
gtggcaagagtcagtacagatatat

SEQ ID NO: 709337 - DNA, 25 bp, Mus musculus
gtggcaagagtctgtacagatatat

SEQ ID NO: 709338 - DNA, 25 bp, Mus musculus
gtggcaagcaaaacattagagtggt

SEQ ID NO: 709339 - DNA, 25 bp, Mus musculus
gtggcaagcaaatcattagagtggt

SEQ ID NO: 709340 - DNA, 25 bp, Mus musculus
gtggcaagcactctactctttgacc

SEQ ID NO: 709341 - DNA, 25 bp, Mus musculus
gtggcaagcactcttgcttaagcct

SEQ ID NO: 709342 - DNA, 25 bp, Mus musculus
gtggcaagcactgtactctttgacc

SEQ ID NO: 709343 - DNA, 25 bp, Mus musculus
gtggcaagcactgttgcttaagcct

SEQ ID NO: 709344 - DNA, 25 bp, Mus musculus
gtggcaagcagaccatcatcagact

SEQ ID NO: 709345 - DNA, 25 bp, Mus musculus
gtggcaagcagagcatcatcagact

SEQ ID NO: 709346 - DNA, 25 bp, Mus musculus
gtggcaagccacatatcctggatca

SEQ ID NO: 709347 - DNA, 25 bp, Mus musculus
gtggcaagccacttatcctggatca

SEQ ID NO: 709348 - DNA, 25 bp, Mus musculus
gtggcaagccctcgcacaagacctg

SEQ ID NO: 709349 - DNA, 25 bp, Mus musculus
gtggcaagccctggcacaagacctg

SEQ ID NO: 709350 - DNA, 25 bp, Mus musculus
gtggcaagcctgagaagaacctaat

SEQ ID NO: 709351 - DNA, 25 bp, Mus musculus
gtggcaagcctgtgaagaacctaat

SEQ ID NO: 709352 - DNA, 25 bp, Mus musculus
gtggcaagccttcagttcaagccca

SEQ ID NO: 709353 - DNA, 25 bp, Mus musculus
gtggcaagccttcattacacacaca

SEQ ID NO: 709354 - DNA, 25 bp, Mus musculus
gtggcaagccttgagttcaagccca

SEQ ID NO: 709355 - DNA, 25 bp, Mus musculus
gtggcaagccttgattacacacaca

SEQ ID NO: 709356 - DNA, 25 bp, Mus musculus
gtggcaagctacatcaagctcctgt

SEQ ID NO: 709357 - DNA, 25 bp, Mus musculus
gtggcaagctacttcaagctcctgt

SEQ ID NO: 709358 - DNA, 25 bp, Mus musculus
gtggcaagcttgagataccagtgct

SEQ ID NO: 709359 - DNA, 25 bp, Mus musculus
gtggcaagcttgtgataccagtgct

SEQ ID NO: 709360 - DNA, 25 bp, Mus musculus
gtggcaaggattactctgcttcccg

SEQ ID NO: 709361 - DNA, 25 bp, Mus musculus
gtggcaaggatttctctgcttcccg

SEQ ID NO: 709362 - DNA, 25 bp, Mus musculus
gtggcaaggcatacaagacacgctt

SEQ ID NO: 709363 - DNA, 25 bp, Mus musculus
gtggcaaggcattcaagacacgctt

SEQ ID NO: 709364 - DNA, 25 bp, Mus musculus
gtggcaaggccaatcaccttaggac

SEQ ID NO: 709365 - DNA, 25 bp, Mus musculus
gtggcaaggccattcaccttaggac

SEQ ID NO: 709366 - DNA, 25 bp, Mus musculus
gtggcaagtatcatagcaggattac

SEQ ID NO: 709367 - DNA, 25 bp, Mus musculus
gtggcaagtatcttagcaggattac

SEQ ID NO: 709368 - DNA, 25 bp, Mus musculus
gtggcaagtctgagtgtctgcactc

SEQ ID NO: 709369 - DNA, 25 bp, Mus musculus
gtggcaagtctgtgtgtctgcactc

SEQ ID NO: 709370 - DNA, 25 bp, Mus musculus
gtggcaagttcactagactttttta

SEQ ID NO: 709371 - DNA, 25 bp, Mus musculus
gtggcaagttcagtagactttttta

SEQ ID NO: 709372 - DNA, 25 bp, Mus musculus
gtggcaatccttaaagactccctat

SEQ ID NO: 709373 - DNA, 25 bp, Mus musculus
gtggcaatcctttaagactccctat

SEQ ID NO: 709374 - DNA, 25 bp, Mus musculus
gtggcaatcgtgatgtctcagtgac

SEQ ID NO: 709375 - DNA, 25 bp, Mus musculus
gtggcaatcgtgttgtctcagtgac

SEQ ID NO: 709376 - DNA, 25 bp, Mus musculus
gtggcaatgcagaaaaggtcagaca

SEQ ID NO: 709377 - DNA, 25 bp, Mus musculus
gtggcaatgcagtaaaggtcagaca

SEQ ID NO: 709378 - DNA, 25 bp, Mus musculus
gtggcaatgccacctttactgtgtg

SEQ ID NO: 709379 - DNA, 25 bp, Mus musculus
gtggcaatgccagctttactgtgtg

SEQ ID NO: 709380 - DNA, 25 bp, Mus musculus
gtggcaatgcccatgtttgtgataa

SEQ ID NO: 709381 - DNA, 25 bp, Mus musculus
gtggcaatgcccttgtttgtgataa

SEQ ID NO: 709382 - DNA, 25 bp, Mus musculus
gtggcaatgctgagttggctgtctt

SEQ ID NO: 709383 - DNA, 25 bp, Mus musculus
gtggcaatgctgtgttggctgtctt

SEQ ID NO: 709384 - DNA, 25 bp, Mus musculus
gtggcaattcatcaacgggaaacat

SEQ ID NO: 709385 - DNA, 25 bp, Mus musculus
gtggcaattcatgaacgggaaacat

SEQ ID NO: 709386 - DNA, 25 bp, Mus musculus
gtggcaattcgaacatgaaattcaa

SEQ ID NO: 709387 - DNA, 25 bp, Mus musculus
gtggcaattcgatcatgaaattcaa

SEQ ID NO: 709388 - DNA, 25 bp, Mus musculus
gtggcaattggcattttcagacttt

SEQ ID NO: 709389 - DNA, 25 bp, Mus musculus
gtggcaattggctttttcagacttt

SEQ ID NO: 709390 - DNA, 25 bp, Mus musculus
gtggcaattggtcttcctttttaca

SEQ ID NO: 709391 - DNA, 25 bp, Mus musculus
gtggcaattggtgttcctttttaca

SEQ ID NO: 709392 - DNA, 25 bp, Mus musculus
gtggcaatttccagcgcactacagg

SEQ ID NO: 709393 - DNA, 25 bp, Mus musculus
gtggcaatttcctgcgcactacagg

SEQ ID NO: 709394 - DNA, 25 bp, Mus musculus
gtggcacaaactagtcacacacaac

SEQ ID NO: 709395 - DNA, 25 bp, Mus musculus
gtggcacaaacttgtcacacacaac

SEQ ID NO: 709396 - DNA, 25 bp, Mus musculus
gtggcacaactaatgtgacaccgtg

SEQ ID NO: 709397 - DNA, 25 bp, Mus musculus
gtggcacaactattgtgacaccgtg

SEQ ID NO: 709398 - DNA, 25 bp, Mus musculus
gtggcacaagtgcatattatgatgt

SEQ ID NO: 709399 - DNA, 25 bp, Mus musculus
gtggcacaagtggatattatgatgt

SEQ ID NO: 709400 - DNA, 25 bp, Mus musculus
gtggcacaatcaaacttcacttgag

SEQ ID NO: 709401 - DNA, 25 bp, Mus musculus
gtggcacaatcatacttcacttgag

SEQ ID NO: 709402 - DNA, 25 bp, Mus musculus
gtggcacacacaacatgtatcggga

SEQ ID NO: 709403 - DNA, 25 bp, Mus musculus
gtggcacacacatcatgtatcggga

SEQ ID NO: 709404 - DNA, 25 bp, Mus musculus
gtggcacacccaaacagaaattaga

SEQ ID NO: 709405 - DNA, 25 bp, Mus musculus
gtggcacacccatacagaaattaga

SEQ ID NO: 709406 - DNA, 25 bp, Mus musculus
gtggcacacctcaaatgcaacctag

SEQ ID NO: 709407 - DNA, 25 bp, Mus musculus
gtggcacacctctaatgcaacctag

SEQ ID NO: 709408 - DNA, 25 bp, Mus musculus
gtggcacaccttattcatgatttgt

SEQ ID NO: 709409 - DNA, 25 bp, Mus musculus
gtggcacacctttttcatgatttgt

SEQ ID NO: 709410 - DNA, 25 bp, Mus musculus
gtggcacacggtcggaatgttttcc

SEQ ID NO: 709411 - DNA, 25 bp, Mus musculus
gtggcacacggtgggaatgttttcc

SEQ ID NO: 709412 - DNA, 25 bp, Mus musculus
gtggcacactacaacgacgcacgtt

SEQ ID NO: 709413 - DNA, 25 bp, Mus musculus
gtggcacactactacgacgcacgtt

SEQ ID NO: 709414 - DNA, 25 bp, Mus musculus
gtggcacacttcatggagaactgga

SEQ ID NO: 709415 - DNA, 25 bp, Mus musculus
gtggcacacttcattaactatgtca

SEQ ID NO: 709416 - DNA, 25 bp, Mus musculus
gtggcacacttcttggagaactgga

SEQ ID NO: 709417 - DNA, 25 bp, Mus musculus
gtggcacacttctttaactatgtca

SEQ ID NO: 709418 - DNA, 25 bp, Mus musculus
gtggcacagagacttctttagtcat

SEQ ID NO: 709419 - DNA, 25 bp, Mus musculus
gtggcacagagagttctttagtcat

SEQ ID NO: 709420 - DNA, 25 bp, Mus musculus
gtggcacagtgcaccttggtatcgg

SEQ ID NO: 709421 - DNA, 25 bp, Mus musculus
gtggcacagtgctccttggtatcgg

SEQ ID NO: 709422 - DNA, 25 bp, Mus musculus
gtggcacagtggaccggatttcttc

SEQ ID NO: 709423 - DNA, 25 bp, Mus musculus
gtggcacagtggtccggatttcttc

SEQ ID NO: 709424 - DNA, 25 bp, Mus musculus
gtggcacatatgctggagtctatat

SEQ ID NO: 709425 - DNA, 25 bp, Mus musculus
gtggcacatatggtggagtctatat

SEQ ID NO: 709426 - DNA, 25 bp, Mus musculus
gtggcacatgggacggctaccagta

SEQ ID NO: 709427 - DNA, 25 bp, Mus musculus
gtggcacatgggtcggctaccagta

SEQ ID NO: 709428 - DNA, 25 bp, Mus musculus
gtggcacattccagaagatgatcta

SEQ ID NO: 709429 - DNA, 25 bp, Mus musculus
gtggcacattcctgaagatgatcta

SEQ ID NO: 709430 - DNA, 25 bp, Mus musculus
gtggcacatttgctaagatgcttaa

SEQ ID NO: 709431 - DNA, 25 bp, Mus musculus
gtggcacatttggtaagatgcttaa

SEQ ID NO: 709432 - DNA, 25 bp, Mus musculus
gtggcaccaaagaagccccgaggta

SEQ ID NO: 709433 - DNA, 25 bp, Mus musculus
gtggcaccaaagtagccccgaggta

SEQ ID NO: 709434 - DNA, 25 bp, Mus musculus
gtggcaccaaatcacttgcatgttt

SEQ ID NO: 709435 - DNA, 25 bp, Mus musculus
gtggcaccaaatgacttgcatgttt

SEQ ID NO: 709436 - DNA, 25 bp, Mus musculus
gtggcaccaacacaggccgagctga

SEQ ID NO: 709437 - DNA, 25 bp, Mus musculus
gtggcaccaacagaggccgagctga

SEQ ID NO: 709438 - DNA, 25 bp, Mus musculus
gtggcaccaatacctctgacatgaa

SEQ ID NO: 709439 - DNA, 25 bp, Mus musculus
gtggcaccaatagctctgacatgaa

SEQ ID NO: 709440 - DNA, 25 bp, Mus musculus
gtggcaccactgctaaatgcttatg

SEQ ID NO: 709441 - DNA, 25 bp, Mus musculus
gtggcaccactggtaaatgcttatg

SEQ ID NO: 709442 - DNA, 25 bp, Mus musculus
gtggcaccagaacggcttttacata

SEQ ID NO: 709443 - DNA, 25 bp, Mus musculus
gtggcaccagaagggcttttacata

SEQ ID NO: 709444 - DNA, 25 bp, Mus musculus
gtggcaccatgaattcctggaagca

SEQ ID NO: 709445 - DNA, 25 bp, Mus musculus
gtggcaccatgatttcctggaagca

SEQ ID NO: 709446 - DNA, 25 bp, Mus musculus
gtggcacccacaaactttcaaacaa

SEQ ID NO: 709447 - DNA, 25 bp, Mus musculus
gtggcacccacatactttcaaacaa

SEQ ID NO: 709448 - DNA, 25 bp, Mus musculus
gtggcacccattaacactgtgtgtt

SEQ ID NO: 709449 - DNA, 25 bp, Mus musculus
gtggcacccatttacactgtgtgtt

SEQ ID NO: 709450 - DNA, 25 bp, Mus musculus
gtggcaccctcaactggagatgatt

SEQ ID NO: 709451 - DNA, 25 bp, Mus musculus
gtggcaccctcatctggagatgatt

SEQ ID NO: 709452 - DNA, 25 bp, Mus musculus
gtggcaccctgaagaatgtttaaag

SEQ ID NO: 709453 - DNA, 25 bp, Mus musculus
gtggcaccctgatgaatgtttaaag

SEQ ID NO: 709454 - DNA, 25 bp, Mus musculus
gtggcaccctttaggtttagagatt

SEQ ID NO: 709455 - DNA, 25 bp, Mus musculus
gtggcacccttttggtttagagatt

SEQ ID NO: 709456 - DNA, 25 bp, Mus musculus
gtggcaccgaggatggcatcagacc

SEQ ID NO: 709457 - DNA, 25 bp, Mus musculus
gtggcaccgaggttggcatcagacc

SEQ ID NO: 709458 - DNA, 25 bp, Mus musculus
gtggcacctcatattgatgattcca

SEQ ID NO: 709459 - DNA, 25 bp, Mus musculus
gtggcacctcattttgatgattcca

SEQ ID NO: 709460 - DNA, 25 bp, Mus musculus
gtggcacctccaattggcatatttt

SEQ ID NO: 709461 - DNA, 25 bp, Mus musculus
gtggcacctccatttggcatatttt

SEQ ID NO: 709462 - DNA, 25 bp, Mus musculus
gtggcacctcggaggtgctcatctg

SEQ ID NO: 709463 - DNA, 25 bp, Mus musculus
gtggcacctcggtggtgctcatctg

SEQ ID NO: 709464 - DNA, 25 bp, Mus musculus
gtggcacctgccacacaaggagagc

SEQ ID NO: 709465 - DNA, 25 bp, Mus musculus
gtggcacctgcctcacaaggagagc

SEQ ID NO: 709466 - DNA, 25 bp, Mus musculus
gtggcacctggcctgtgatgctaca

SEQ ID NO: 709467 - DNA, 25 bp, Mus musculus
gtggcacctggcgtgtgatgctaca

SEQ ID NO: 709468 - DNA, 25 bp, Mus musculus
gtggcaccttgtcacaatgtacaga

SEQ ID NO: 709469 - DNA, 25 bp, Mus musculus
gtggcaccttgtgacaatgtacaga

SEQ ID NO: 709470 - DNA, 25 bp, Mus musculus
gtggcaccttttagtcttgagttcc

SEQ ID NO: 709471 - DNA, 25 bp, Mus musculus
gtggcacctttttgtcttgagttcc

SEQ ID NO: 709472 - DNA, 25 bp, Mus musculus
gtggcacgcagactataactgactt

SEQ ID NO: 709473 - DNA, 25 bp, Mus musculus
gtggcacgcagagtataactgactt

SEQ ID NO: 709474 - DNA, 25 bp, Mus musculus
gtggcacggtacattgggatcaagc

SEQ ID NO: 709475 - DNA, 25 bp, Mus musculus
gtggcacggtactttgggatcaagc

SEQ ID NO: 709476 - DNA, 25 bp, Mus musculus
gtggcacggtcacacatgcttgtga

SEQ ID NO: 709477 - DNA, 25 bp, Mus musculus
gtggcacggtcagacatgcttgtga

SEQ ID NO: 709478 - DNA, 25 bp, Mus musculus
gtggcacggtgaacacttgctgact

SEQ ID NO: 709479 - DNA, 25 bp, Mus musculus
gtggcacggtgatcacttgctgact

SEQ ID NO: 709480 - DNA, 25 bp, Mus musculus
gtggcacgtgtcattgactccagca

SEQ ID NO: 709481 - DNA, 25 bp, Mus musculus
gtggcacgtgtctttgactccagca

SEQ ID NO: 709482 - DNA, 25 bp, Mus musculus
gtggcacgtgtgcactcatgttcac

SEQ ID NO: 709483 - DNA, 25 bp, Mus musculus
gtggcacgtgtggactcatgttcac

SEQ ID NO: 709484 - DNA, 25 bp, Mus musculus
gtggcactaagcatacagatgaaga

SEQ ID NO: 709485 - DNA, 25 bp, Mus musculus
gtggcactaagcttacagatgaaga

SEQ ID NO: 709486 - DNA, 25 bp, Mus musculus
gtggcactaatacataccctttaac

SEQ ID NO: 709487 - DNA, 25 bp, Mus musculus
gtggcactaatagataccctttaac

SEQ ID NO: 709488 - DNA, 25 bp, Mus musculus
gtggcactacttcaaagggcccagt

SEQ ID NO: 709489 - DNA, 25 bp, Mus musculus
gtggcactacttgaaagggcccagt

SEQ ID NO: 709490 - DNA, 25 bp, Mus musculus
gtggcactagttcttcatgtttctt

SEQ ID NO: 709491 - DNA, 25 bp, Mus musculus
gtggcactagttgttcatgtttctt

SEQ ID NO: 709492 - DNA, 25 bp, Mus musculus
gtggcactcagtccggtaggccttt

SEQ ID NO: 709493 - DNA, 25 bp, Mus musculus
gtggcactcagtgcggtaggccttt

SEQ ID NO: 709494 - DNA, 25 bp, Mus musculus
gtggcactccagacttcagaaagct

SEQ ID NO: 709495 - DNA, 25 bp, Mus musculus
gtggcactccagtcttcagaaagct

SEQ ID NO: 709496 - DNA, 25 bp, Mus musculus
gtggcactctggagaccaggtcact

SEQ ID NO: 709497 - DNA, 25 bp, Mus musculus
gtggcactctggagagtcaccttca

SEQ ID NO: 709498 - DNA, 25 bp, Mus musculus
gtggcactctggtgaccaggtcact

SEQ ID NO: 709499 - DNA, 25 bp, Mus musculus
gtggcactctggtgagtcaccttca

SEQ ID NO: 709500 - DNA, 25 bp, Mus musculus
gtggcactcttgaagactgctcata

SEQ ID NO: 709501 - DNA, 25 bp, Mus musculus
gtggcactcttgtagactgctcata

SEQ ID NO: 709502 - DNA, 25 bp, Mus musculus
gtggcactgaccagcgttgtaggaa

SEQ ID NO: 709503 - DNA, 25 bp, Mus musculus
gtggcactgacctgcgttgtaggaa

SEQ ID NO: 709504 - DNA, 25 bp, Mus musculus
gtggcactgaggaaactaaggtata

SEQ ID NO: 709505 - DNA, 25 bp, Mus musculus
gtggcactgaggtaactaaggtata

SEQ ID NO: 709506 - DNA, 25 bp, Mus musculus
gtggcactgcctcaaagaagaagct

SEQ ID NO: 709507 - DNA, 25 bp, Mus musculus
gtggcactgcctgaaagaagaagct

SEQ ID NO: 709508 - DNA, 25 bp, Mus musculus
gtggcactgcttcttctatagaata

SEQ ID NO: 709509 - DNA, 25 bp, Mus musculus
gtggcactgcttgttctatagaata

SEQ ID NO: 709510 - DNA, 25 bp, Mus musculus
gtggcactggctaaatgctgttaat

SEQ ID NO: 709511 - DNA, 25 bp, Mus musculus
gtggcactggctacgattcacaggt

SEQ ID NO: 709512 - DNA, 25 bp, Mus musculus
gtggcactggcttaatgctgttaat

SEQ ID NO: 709513 - DNA, 25 bp, Mus musculus
gtggcactggcttcgattcacaggt

SEQ ID NO: 709514 - DNA, 25 bp, Mus musculus
gtggcactgtgccagattcagtctt

SEQ ID NO: 709515 - DNA, 25 bp, Mus musculus
gtggcactgtgcgagattcagtctt

SEQ ID NO: 709516 - DNA, 25 bp, Mus musculus
gtggcacttagactactgcctggta

SEQ ID NO: 709517 - DNA, 25 bp, Mus musculus
gtggcacttagagtactgcctggta

SEQ ID NO: 709518 - DNA, 25 bp, Mus musculus
gtggcacttccgcaaatcccagagg

SEQ ID NO: 709519 - DNA, 25 bp, Mus musculus
gtggcacttccggaaatcccagagg

SEQ ID NO: 709520 - DNA, 25 bp, Mus musculus
gtggcacttgacaatgtgtagcctt

SEQ ID NO: 709521 - DNA, 25 bp, Mus musculus
gtggcacttgactatgtgtagcctt

SEQ ID NO: 709522 - DNA, 25 bp, Mus musculus
gtggcacttgtaatgtgctgtactt

SEQ ID NO: 709523 - DNA, 25 bp, Mus musculus
gtggcacttgtattgtgctgtactt

SEQ ID NO: 709524 - DNA, 25 bp, Mus musculus
gtggcactttaaagggcctgatcca

SEQ ID NO: 709525 - DNA, 25 bp, Mus musculus
gtggcactttaatgggcctgatcca

SEQ ID NO: 709526 - DNA, 25 bp, Mus musculus
gtggcactttgacagtaaccgtctt

SEQ ID NO: 709527 - DNA, 25 bp, Mus musculus
gtggcactttgagagtaaccgtctt

SEQ ID NO: 709528 - DNA, 25 bp, Mus musculus
gtggcactttggcagagcagatctt

SEQ ID NO: 709529 - DNA, 25 bp, Mus musculus
gtggcactttgggagagcagatctt

SEQ ID NO: 709530 - DNA, 25 bp, Mus musculus
gtggcagaaaccctagtgttctcca

SEQ ID NO: 709531 - DNA, 25 bp, Mus musculus
gtggcagaaaccgtagtgttctcca

SEQ ID NO: 709532 - DNA, 25 bp, Mus musculus
gtggcagaacacaaatacagcatct

SEQ ID NO: 709533 - DNA, 25 bp, Mus musculus
gtggcagaacactaatacagcatct

SEQ ID NO: 709534 - DNA, 25 bp, Mus musculus
gtggcagaagcaaaccgttctctgg

SEQ ID NO: 709535 - DNA, 25 bp, Mus musculus
gtggcagaagcataccgttctctgg

SEQ ID NO: 709536 - DNA, 25 bp, Mus musculus
gtggcagaatcaccaaccctggact

SEQ ID NO: 709537 - DNA, 25 bp, Mus musculus
gtggcagaatcagcaaccctggact

SEQ ID NO: 709538 - DNA, 25 bp, Mus musculus
gtggcagaatctcaacgacgctcag

SEQ ID NO: 709539 - DNA, 25 bp, Mus musculus
gtggcagaatctgaacgacgctcag

SEQ ID NO: 709540 - DNA, 25 bp, Mus musculus
gtggcagaatgaaggtttttcccaa

SEQ ID NO: 709541 - DNA, 25 bp, Mus musculus
gtggcagaatgatggtttttcccaa

SEQ ID NO: 709542 - DNA, 25 bp, Mus musculus
gtggcagaatgtacactttcaccgt

SEQ ID NO: 709543 - DNA, 25 bp, Mus musculus
gtggcagaatgttcactttcaccgt

SEQ ID NO: 709544 - DNA, 25 bp, Mus musculus
gtggcagacaacattggaccaacgg

SEQ ID NO: 709545 - DNA, 25 bp, Mus musculus
gtggcagacaactttggaccaacgg

SEQ ID NO: 709546 - DNA, 25 bp, Mus musculus
gtggcagacctgagtgcgattccag

SEQ ID NO: 709547 - DNA, 25 bp, Mus musculus
gtggcagacctgtgtgcgattccag

SEQ ID NO: 709548 - DNA, 25 bp, Mus musculus
gtggcagactacatgcgctacctaa

SEQ ID NO: 709549 - DNA, 25 bp, Mus musculus
gtggcagactacttgcgctacctaa

SEQ ID NO: 709550 - DNA, 25 bp, Mus musculus
gtggcagactataggttgctgacaa

SEQ ID NO: 709551 - DNA, 25 bp, Mus musculus
gtggcagactattggttgctgacaa

SEQ ID NO: 709552 - DNA, 25 bp, Mus musculus
gtggcagactggctgatgctcccct

SEQ ID NO: 709553 - DNA, 25 bp, Mus musculus
gtggcagactgggtgatgctcccct

SEQ ID NO: 709554 - DNA, 25 bp, Mus musculus
gtggcagagacaccagaacacctgt

SEQ ID NO: 709555 - DNA, 25 bp, Mus musculus
gtggcagagacagcagaacacctgt

SEQ ID NO: 709556 - DNA, 25 bp, Mus musculus
gtggcagagcacctatatagcatac

SEQ ID NO: 709557 - DNA, 25 bp, Mus musculus
gtggcagagcacgtatatagcatac

SEQ ID NO: 709558 - DNA, 25 bp, Mus musculus
gtggcagagcatctaatggcttctt

SEQ ID NO: 709559 - DNA, 25 bp, Mus musculus
gtggcagagcatgtaatggcttctt

SEQ ID NO: 709560 - DNA, 25 bp, Mus musculus
gtggcagagcctcaatcccagctct

SEQ ID NO: 709561 - DNA, 25 bp, Mus musculus
gtggcagagcctgaatcccagctct

SEQ ID NO: 709562 - DNA, 25 bp, Mus musculus
gtggcagagcgtaatgatcacgata

SEQ ID NO: 709563 - DNA, 25 bp, Mus musculus
gtggcagagcgttatgatcacgata

SEQ ID NO: 709564 - DNA, 25 bp, Mus musculus
gtggcagaggtgaactttgacgtct

SEQ ID NO: 709565 - DNA, 25 bp, Mus musculus
gtggcagaggtgtactttgacgtct

SEQ ID NO: 709566 - DNA, 25 bp, Mus musculus
gtggcagatacaacagcctatggga

SEQ ID NO: 709567 - DNA, 25 bp, Mus musculus
gtggcagatacatcagcctatggga

SEQ ID NO: 709568 - DNA, 25 bp, Mus musculus
gtggcagatcaccactacattggat

SEQ ID NO: 709569 - DNA, 25 bp, Mus musculus
gtggcagatcacgactacattggat

SEQ ID NO: 709570 - DNA, 25 bp, Mus musculus
gtggcagatcgaacgtgagcttgat

SEQ ID NO: 709571 - DNA, 25 bp, Mus musculus
gtggcagatcgatcgtgagcttgat

SEQ ID NO: 709572 - DNA, 25 bp, Mus musculus
gtggcagatgccacttatcacagca

SEQ ID NO: 709573 - DNA, 25 bp, Mus musculus
gtggcagatgcctcttatcacagca

SEQ ID NO: 709574 - DNA, 25 bp, Mus musculus
gtggcagattctcgaacatttgttt

SEQ ID NO: 709575 - DNA, 25 bp, Mus musculus
gtggcagattctggaacatttgttt

SEQ ID NO: 709576 - DNA, 25 bp, Mus musculus
gtggcagcaacacccatcagcagtc

SEQ ID NO: 709577 - DNA, 25 bp, Mus musculus
gtggcagcaacagccatcagcagtc

SEQ ID NO: 709578 - DNA, 25 bp, Mus musculus
gtggcagcaataaacccaactggaa

SEQ ID NO: 709579 - DNA, 25 bp, Mus musculus
gtggcagcaatatacccaactggaa

SEQ ID NO: 709580 - DNA, 25 bp, Mus musculus
gtggcagcaccaacaagtacctgcg

SEQ ID NO: 709581 - DNA, 25 bp, Mus musculus
gtggcagcaccatcaagtacctgcg

SEQ ID NO: 709582 - DNA, 25 bp, Mus musculus
gtggcagcagccaaccaagagctgt

SEQ ID NO: 709583 - DNA, 25 bp, Mus musculus
gtggcagcagcctaccaagagctgt

SEQ ID NO: 709584 - DNA, 25 bp, Mus musculus
gtggcagcatgacaccataggtcat

SEQ ID NO: 709585 - DNA, 25 bp, Mus musculus
gtggcagcatgagaccataggtcat

SEQ ID NO: 709586 - DNA, 25 bp, Mus musculus
gtggcagcatttcgaaagaacctaa

SEQ ID NO: 709587 - DNA, 25 bp, Mus musculus
gtggcagcatttggaaagaacctaa

SEQ ID NO: 709588 - DNA, 25 bp, Mus musculus
gtggcagccactctagttcttactg

SEQ ID NO: 709589 - DNA, 25 bp, Mus musculus
gtggcagccactgtagttcttactg

SEQ ID NO: 709590 - DNA, 25 bp, Mus musculus
gtggcagcccaaaactgtcgcaaga

SEQ ID NO: 709591 - DNA, 25 bp, Mus musculus
gtggcagcccaatactgtcgcaaga

SEQ ID NO: 709592 - DNA, 25 bp, Mus musculus
gtggcagcccgtaagactccgagga

SEQ ID NO: 709593 - DNA, 25 bp, Mus musculus
gtggcagcccgttagactccgagga

SEQ ID NO: 709594 - DNA, 25 bp, Mus musculus
gtggcagcccttcaggtgatgtcac

SEQ ID NO: 709595 - DNA, 25 bp, Mus musculus
gtggcagcccttgaggtgatgtcac

SEQ ID NO: 709596 - DNA, 25 bp, Mus musculus
gtggcagccgtgattattgcgcaac

SEQ ID NO: 709597 - DNA, 25 bp, Mus musculus
gtggcagccgtgtttattgcgcaac

SEQ ID NO: 709598 - DNA, 25 bp, Mus musculus
gtggcagccttcaatgcccaggaca

SEQ ID NO: 709599 - DNA, 25 bp, Mus musculus
gtggcagccttctatgcccaggaca

SEQ ID NO: 709600 - DNA, 25 bp, Mus musculus
gtggcagcgcgtccctgtagctcca

SEQ ID NO: 709601 - DNA, 25 bp, Mus musculus
gtggcagcgcgtgcctgtagctcca

SEQ ID NO: 709602 - DNA, 25 bp, Mus musculus
gtggcagctacaactatcaataact

SEQ ID NO: 709603 - DNA, 25 bp, Mus musculus
gtggcagctacatctatcaataact

SEQ ID NO: 709604 - DNA, 25 bp, Mus musculus
gtggcagctagtaagcactttcagc

SEQ ID NO: 709605 - DNA, 25 bp, Mus musculus
gtggcagctagttagcactttcagc

SEQ ID NO: 709606 - DNA, 25 bp, Mus musculus
gtggcagctcagcaatgccttacct

SEQ ID NO: 709607 - DNA, 25 bp, Mus musculus
gtggcagctcaggaatgccttacct

SEQ ID NO: 709608 - DNA, 25 bp, Mus musculus
gtggcagctcccactgagaaaacca

SEQ ID NO: 709609 - DNA, 25 bp, Mus musculus
gtggcagctccctctgagaaaacca

SEQ ID NO: 709610 - DNA, 25 bp, Mus musculus
gtggcagctctcacgagagccaaga

SEQ ID NO: 709611 - DNA, 25 bp, Mus musculus
gtggcagctctcaggactaggacta

SEQ ID NO: 709612 - DNA, 25 bp, Mus musculus
gtggcagctctctcgagagccaaga

SEQ ID NO: 709613 - DNA, 25 bp, Mus musculus
gtggcagctctctggactaggacta

SEQ ID NO: 709614 - DNA, 25 bp, Mus musculus
gtggcagctctgacaacctgttgca

SEQ ID NO: 709615 - DNA, 25 bp, Mus musculus
gtggcagctctgtcaacctgttgca

SEQ ID NO: 709616 - DNA, 25 bp, Mus musculus
gtggcagctgccatcacaaaaaata

SEQ ID NO: 709617 - DNA, 25 bp, Mus musculus
gtggcagctgccttcacaaaaaata

SEQ ID NO: 709618 - DNA, 25 bp, Mus musculus
gtggcagctgtaatctaaatgcttt

SEQ ID NO: 709619 - DNA, 25 bp, Mus musculus
gtggcagctgtattctaaatgcttt

SEQ ID NO: 709620 - DNA, 25 bp, Mus musculus
gtggcagcttacagtattctttgtt

SEQ ID NO: 709621 - DNA, 25 bp, Mus musculus
gtggcagcttactgtattctttgtt

SEQ ID NO: 709622 - DNA, 25 bp, Mus musculus
gtggcagcttcaagtttcccaagct

SEQ ID NO: 709623 - DNA, 25 bp, Mus musculus
gtggcagcttcatgtttcccaagct

SEQ ID NO: 709624 - DNA, 25 bp, Mus musculus
gtggcagcttctatctaattctacc

SEQ ID NO: 709625 - DNA, 25 bp, Mus musculus
gtggcagcttctttctaattctacc

SEQ ID NO: 709626 - DNA, 25 bp, Mus musculus
gtggcaggaattcctctcctaagtt

SEQ ID NO: 709627 - DNA, 25 bp, Mus musculus
gtggcaggaattgctctcctaagtt

SEQ ID NO: 709628 - DNA, 25 bp, Mus musculus
gtggcaggactcagtgcttcgtgca

SEQ ID NO: 709629 - DNA, 25 bp, Mus musculus
gtggcaggactcatcaccgtggtga

SEQ ID NO: 709630 - DNA, 25 bp, Mus musculus
gtggcaggactctgtgcttcgtgca

SEQ ID NO: 709631 - DNA, 25 bp, Mus musculus
gtggcaggactcttcaccgtggtga

SEQ ID NO: 709632 - DNA, 25 bp, Mus musculus
gtggcaggagacagttttttccttt

SEQ ID NO: 709633 - DNA, 25 bp, Mus musculus
gtggcaggagactgttttttccttt

SEQ ID NO: 709634 - DNA, 25 bp, Mus musculus
gtggcaggagcgcacacccatcatc

SEQ ID NO: 709635 - DNA, 25 bp, Mus musculus
gtggcaggagcggacacccatcatc

SEQ ID NO: 709636 - DNA, 25 bp, Mus musculus
gtggcaggcattcgtcaatggccca

SEQ ID NO: 709637 - DNA, 25 bp, Mus musculus
gtggcaggcattggtcaatggccca

SEQ ID NO: 709638 - DNA, 25 bp, Mus musculus
gtggcaggcccaatttgtcttgttc

SEQ ID NO: 709639 - DNA, 25 bp, Mus musculus
gtggcaggcccattttgtcttgttc

SEQ ID NO: 709640 - DNA, 25 bp, Mus musculus
gtggcaggcctcactgtaactgtta

SEQ ID NO: 709641 - DNA, 25 bp, Mus musculus
gtggcaggcctctctgtaactgtta

SEQ ID NO: 709642 - DNA, 25 bp, Mus musculus
gtggcaggccttccacacacagtaa

SEQ ID NO: 709643 - DNA, 25 bp, Mus musculus
gtggcaggccttgcacacacagtaa

SEQ ID NO: 709644 - DNA, 25 bp, Mus musculus
gtggcaggctacaaagtcaaccttc

SEQ ID NO: 709645 - DNA, 25 bp, Mus musculus
gtggcaggctactaagtcaaccttc

SEQ ID NO: 709646 - DNA, 25 bp, Mus musculus
gtggcaggtcacaatgggccattgt

SEQ ID NO: 709647 - DNA, 25 bp, Mus musculus
gtggcaggtcactatgggccattgt

SEQ ID NO: 709648 - DNA, 25 bp, Mus musculus
gtggcaggtggcagtgccttccatc

SEQ ID NO: 709649 - DNA, 25 bp, Mus musculus
gtggcaggtggctgtgccttccatc

SEQ ID NO: 709650 - DNA, 25 bp, Mus musculus
gtggcaggtgtgactgcagctctcc

SEQ ID NO: 709651 - DNA, 25 bp, Mus musculus
gtggcaggtgtgtctgcagctctcc

SEQ ID NO: 709652 - DNA, 25 bp, Mus musculus
gtggcaggttgccttcctggtccca

SEQ ID NO: 709653 - DNA, 25 bp, Mus musculus
gtggcaggttgcgttcctggtccca

SEQ ID NO: 709654 - DNA, 25 bp, Mus musculus
gtggcagtaaaaacctcccaagcaa

SEQ ID NO: 709655 - DNA, 25 bp, Mus musculus
gtggcagtaaaatcctcccaagcaa

SEQ ID NO: 709656 - DNA, 25 bp, Mus musculus
gtggcagtactcactgctgcatgca

SEQ ID NO: 709657 - DNA, 25 bp, Mus musculus
gtggcagtactcagagtcgattata

SEQ ID NO: 709658 - DNA, 25 bp, Mus musculus
gtggcagtactctctgctgcatgca

SEQ ID NO: 709659 - DNA, 25 bp, Mus musculus
gtggcagtactctgagtcgattata

SEQ ID NO: 709660 - DNA, 25 bp, Mus musculus
gtggcagtacttcttaggaacctag

SEQ ID NO: 709661 - DNA, 25 bp, Mus musculus
gtggcagtacttgttaggaacctag

SEQ ID NO: 709662 - DNA, 25 bp, Mus musculus
gtggcagtcccacaaacggaattca

SEQ ID NO: 709663 - DNA, 25 bp, Mus musculus
gtggcagtcccagaaacggaattca

SEQ ID NO: 709664 - DNA, 25 bp, Mus musculus
gtggcagtccccagccactttaggg

SEQ ID NO: 709665 - DNA, 25 bp, Mus musculus
gtggcagtcccctgccactttaggg

SEQ ID NO: 709666 - DNA, 25 bp, Mus musculus
gtggcagtcctcagtaaccatcaga

SEQ ID NO: 709667 - DNA, 25 bp, Mus musculus
gtggcagtcctctgtaaccatcaga

SEQ ID NO: 709668 - DNA, 25 bp, Mus musculus
gtggcagtcctgcaggctcaccatg

SEQ ID NO: 709669 - DNA, 25 bp, Mus musculus
gtggcagtcctggaggctcaccatg

SEQ ID NO: 709670 - DNA, 25 bp, Mus musculus
gtggcagtctatctcttacagtagc

SEQ ID NO: 709671 - DNA, 25 bp, Mus musculus
gtggcagtctatgtcttacagtagc

SEQ ID NO: 709672 - DNA, 25 bp, Mus musculus
gtggcagtctttcagccaactctga

SEQ ID NO: 709673 - DNA, 25 bp, Mus musculus
gtggcagtctttgagccaactctga

SEQ ID NO: 709674 - DNA, 25 bp, Mus musculus
gtggcagtgataaagatgtcctttt

SEQ ID NO: 709675 - DNA, 25 bp, Mus musculus
gtggcagtgatatagatgtcctttt

SEQ ID NO: 709676 - DNA, 25 bp, Mus musculus
gtggcagtgcaaaacccaggttcat

SEQ ID NO: 709677 - DNA, 25 bp, Mus musculus
gtggcagtgcaatacccaggttcat

SEQ ID NO: 709678 - DNA, 25 bp, Mus musculus
gtggcagtgccaagatgcttatgtt

SEQ ID NO: 709679 - DNA, 25 bp, Mus musculus
gtggcagtgccactacttttcaaga

SEQ ID NO: 709680 - DNA, 25 bp, Mus musculus
gtggcagtgccagtacttttcaaga

SEQ ID NO: 709681 - DNA, 25 bp, Mus musculus
gtggcagtgccatgatgcttatgtt

SEQ ID NO: 709682 - DNA, 25 bp, Mus musculus
gtggcagtggacctgttcccacaga

SEQ ID NO: 709683 - DNA, 25 bp, Mus musculus
gtggcagtggacgtgttcccacaga

SEQ ID NO: 709684 - DNA, 25 bp, Mus musculus
gtggcagtggagcagaaaaatcttc

SEQ ID NO: 709685 - DNA, 25 bp, Mus musculus
gtggcagtggaggagaaaaatcttc

SEQ ID NO: 709686 - DNA, 25 bp, Mus musculus
gtggcagtgggccagttcatataca

SEQ ID NO: 709687 - DNA, 25 bp, Mus musculus
gtggcagtgggcgagttcatataca

SEQ ID NO: 709688 - DNA, 25 bp, Mus musculus
gtggcagtgtccatgagatctgtca

SEQ ID NO: 709689 - DNA, 25 bp, Mus musculus
gtggcagtgtccttgagatctgtca

SEQ ID NO: 709690 - DNA, 25 bp, Mus musculus
gtggcagtgtttaccctaatattct

SEQ ID NO: 709691 - DNA, 25 bp, Mus musculus
gtggcagtgtttcggtcccgacacc

SEQ ID NO: 709692 - DNA, 25 bp, Mus musculus
gtggcagtgtttgggtcccgacacc

SEQ ID NO: 709693 - DNA, 25 bp, Mus musculus
gtggcagtgttttccctaatattct

SEQ ID NO: 709694 - DNA, 25 bp, Mus musculus
gtggcagttacaaacacaccttcca

SEQ ID NO: 709695 - DNA, 25 bp, Mus musculus
gtggcagttacatacacaccttcca

SEQ ID NO: 709696 - DNA, 25 bp, Mus musculus
gtggcagttaccagcacaaacgcag

SEQ ID NO: 709697 - DNA, 25 bp, Mus musculus
gtggcagttacctgcacaaacgcag

SEQ ID NO: 709698 - DNA, 25 bp, Mus musculus
gtggcagttcagaactctttgtcat

SEQ ID NO: 709699 - DNA, 25 bp, Mus musculus
gtggcagttcagtactctttgtcat

SEQ ID NO: 709700 - DNA, 25 bp, Mus musculus
gtggcagttcttaaccatattagtt

SEQ ID NO: 709701 - DNA, 25 bp, Mus musculus
gtggcagttctttaccatattagtt

SEQ ID NO: 709702 - DNA, 25 bp, Mus musculus
gtggcagttgccaagctctcggaga

SEQ ID NO: 709703 - DNA, 25 bp, Mus musculus
gtggcagttgcctagctctcggaga

SEQ ID NO: 709704 - DNA, 25 bp, Mus musculus
gtggcagttgggacatttttaggta

SEQ ID NO: 709705 - DNA, 25 bp, Mus musculus
gtggcagttgggtcatttttaggta

SEQ ID NO: 709706 - DNA, 25 bp, Mus musculus
gtggcagttttcagtccataacttt

SEQ ID NO: 709707 - DNA, 25 bp, Mus musculus
gtggcagttttctgtccataacttt

SEQ ID NO: 709708 - DNA, 25 bp, Mus musculus
gtggcagttttgctcatagagctct

SEQ ID NO: 709709 - DNA, 25 bp, Mus musculus
gtggcagttttggtcatagagctct

SEQ ID NO: 709710 - DNA, 25 bp, Mus musculus
gtggcataaatgctgttgtgtgcac

SEQ ID NO: 709711 - DNA, 25 bp, Mus musculus
gtggcataaatggtgttgtgtgcac

SEQ ID NO: 709712 - DNA, 25 bp, Mus musculus
gtggcataacccatgtttcattatt

SEQ ID NO: 709713 - DNA, 25 bp, Mus musculus
gtggcataacccttgtttcattatt

SEQ ID NO: 709714 - DNA, 25 bp, Mus musculus
gtggcataccgcagtaatctcagca

SEQ ID NO: 709715 - DNA, 25 bp, Mus musculus
gtggcataccgctgtaatctcagca

SEQ ID NO: 709716 - DNA, 25 bp, Mus musculus
gtggcatagcctacatagacctaca

SEQ ID NO: 709717 - DNA, 25 bp, Mus musculus
gtggcatagccttcatagacctaca

SEQ ID NO: 709718 - DNA, 25 bp, Mus musculus
gtggcataggccataaaagtaatta

SEQ ID NO: 709719 - DNA, 25 bp, Mus musculus
gtggcataggccttaaaagtaatta

SEQ ID NO: 709720 - DNA, 25 bp, Mus musculus
gtggcatatgctacactaatatagt

SEQ ID NO: 709721 - DNA, 25 bp, Mus musculus
gtggcatatgctatagacaagctct

SEQ ID NO: 709722 - DNA, 25 bp, Mus musculus
gtggcatatgcttcactaatatagt

SEQ ID NO: 709723 - DNA, 25 bp, Mus musculus
gtggcatatgctttagacaagctct

SEQ ID NO: 709724 - DNA, 25 bp, Mus musculus
gtggcatattcaagttatacagtaa

SEQ ID NO: 709725 - DNA, 25 bp, Mus musculus
gtggcatattcatgttatacagtaa

SEQ ID NO: 709726 - DNA, 25 bp, Mus musculus
gtggcatcaactacacggtggcgtt

SEQ ID NO: 709727 - DNA, 25 bp, Mus musculus
gtggcatcaacttcacggtggcgtt

SEQ ID NO: 709728 - DNA, 25 bp, Mus musculus
gtggcatcaccaccagctgatgaga

SEQ ID NO: 709729 - DNA, 25 bp, Mus musculus
gtggcatcaccagcagctgatgaga

SEQ ID NO: 709730 - DNA, 25 bp, Mus musculus
gtggcatcacccacgcagagccggg

SEQ ID NO: 709731 - DNA, 25 bp, Mus musculus
gtggcatcaccctcgcagagccggg

SEQ ID NO: 709732 - DNA, 25 bp, Mus musculus
gtggcatcatgtagtcacatcatat

SEQ ID NO: 709733 - DNA, 25 bp, Mus musculus
gtggcatcatgttgtcacatcatat

SEQ ID NO: 709734 - DNA, 25 bp, Mus musculus
gtggcatcattgctgtaagtgtgtc

SEQ ID NO: 709735 - DNA, 25 bp, Mus musculus
gtggcatcattggtgtaagtgtgtc

SEQ ID NO: 709736 - DNA, 25 bp, Mus musculus
gtggcatccacgcttaaacaggtga

SEQ ID NO: 709737 - DNA, 25 bp, Mus musculus
gtggcatccacggttaaacaggtga

SEQ ID NO: 709738 - DNA, 25 bp, Mus musculus
gtggcatccaggaaccagttgctat

SEQ ID NO: 709739 - DNA, 25 bp, Mus musculus
gtggcatccaggtaccagttgctat

SEQ ID NO: 709740 - DNA, 25 bp, Mus musculus
gtggcatccagtaggttctttctag

SEQ ID NO: 709741 - DNA, 25 bp, Mus musculus
gtggcatccagtccggcgaaactaa

SEQ ID NO: 709742 - DNA, 25 bp, Mus musculus
gtggcatccagtgcggcgaaactaa

SEQ ID NO: 709743 - DNA, 25 bp, Mus musculus
gtggcatccagttggttctttctag

SEQ ID NO: 709744 - DNA, 25 bp, Mus musculus
gtggcatcccaacattgtgcatatg

SEQ ID NO: 709745 - DNA, 25 bp, Mus musculus
gtggcatcccaagattgtgcatatg

SEQ ID NO: 709746 - DNA, 25 bp, Mus musculus
gtggcatccgttaactttgcttttc

SEQ ID NO: 709747 - DNA, 25 bp, Mus musculus
gtggcatccgtttactttgcttttc

SEQ ID NO: 709748 - DNA, 25 bp, Mus musculus
gtggcatcctaaccagcgacttcat

SEQ ID NO: 709749 - DNA, 25 bp, Mus musculus
gtggcatcctaagcagcgacttcat

SEQ ID NO: 709750 - DNA, 25 bp, Mus musculus
gtggcatcctatagttttacattgt

SEQ ID NO: 709751 - DNA, 25 bp, Mus musculus
gtggcatcctattgttttacattgt

SEQ ID NO: 709752 - DNA, 25 bp, Mus musculus
gtggcatcctggagcaccctgatgg

SEQ ID NO: 709753 - DNA, 25 bp, Mus musculus
gtggcatcctggtgcaccctgatgg

SEQ ID NO: 709754 - DNA, 25 bp, Mus musculus
gtggcatctacgacagccgtatcaa

SEQ ID NO: 709755 - DNA, 25 bp, Mus musculus
gtggcatctacgtcagccgtatcaa

SEQ ID NO: 709756 - DNA, 25 bp, Mus musculus
gtggcatctatgaactgggatccta

SEQ ID NO: 709757 - DNA, 25 bp, Mus musculus
gtggcatctatgtactgggatccta

SEQ ID NO: 709758 - DNA, 25 bp, Mus musculus
gtggcatctcacataaacttctcaa

SEQ ID NO: 709759 - DNA, 25 bp, Mus musculus
gtggcatctcacttaaacttctcaa

SEQ ID NO: 709760 - DNA, 25 bp, Mus musculus
gtggcatctcccagaaaatatctct

SEQ ID NO: 709761 - DNA, 25 bp, Mus musculus
gtggcatctccctgaaaatatctct

SEQ ID NO: 709762 - DNA, 25 bp, Mus musculus
gtggcatcttatctttctgtttaac

SEQ ID NO: 709763 - DNA, 25 bp, Mus musculus
gtggcatcttatgtttctgtttaac

SEQ ID NO: 709764 - DNA, 25 bp, Mus musculus
gtggcatctttaactacaacatcat

SEQ ID NO: 709765 - DNA, 25 bp, Mus musculus
gtggcatctttatctacaacatcat

SEQ ID NO: 709766 - DNA, 25 bp, Mus musculus
gtggcatgaaatacaggctgagttt

SEQ ID NO: 709767 - DNA, 25 bp, Mus musculus
gtggcatgaaattcaggctgagttt

SEQ ID NO: 709768 - DNA, 25 bp, Mus musculus
gtggcatgacttcggctataaaact

SEQ ID NO: 709769 - DNA, 25 bp, Mus musculus
gtggcatgacttgggctataaaact

SEQ ID NO: 709770 - DNA, 25 bp, Mus musculus
gtggcatgagataagattcacgtgt

SEQ ID NO: 709771 - DNA, 25 bp, Mus musculus
gtggcatgagattagattcacgtgt

SEQ ID NO: 709772 - DNA, 25 bp, Mus musculus
gtggcatgcagtatcttgtcatcat

SEQ ID NO: 709773 - DNA, 25 bp, Mus musculus
gtggcatgcagtttcttgtcatcat

SEQ ID NO: 709774 - DNA, 25 bp, Mus musculus
gtggcatgccatcaagttaactcaa

SEQ ID NO: 709775 - DNA, 25 bp, Mus musculus
gtggcatgccatgaagttaactcaa

SEQ ID NO: 709776 - DNA, 25 bp, Mus musculus
gtggcatgctatatagtacttactt

SEQ ID NO: 709777 - DNA, 25 bp, Mus musculus
gtggcatgctatttagtacttactt

SEQ ID NO: 709778 - DNA, 25 bp, Mus musculus
gtggcatggctcaatctatattctc

SEQ ID NO: 709779 - DNA, 25 bp, Mus musculus
gtggcatggctctatctatattctc

SEQ ID NO: 709780 - DNA, 25 bp, Mus musculus
gtggcatgggcgaagacatctcgct

SEQ ID NO: 709781 - DNA, 25 bp, Mus musculus
gtggcatgggcgtagacatctcgct

SEQ ID NO: 709782 - DNA, 25 bp, Mus musculus
gtggcatgtcccaatgagctggtca

SEQ ID NO: 709783 - DNA, 25 bp, Mus musculus
gtggcatgtccctatgagctggtca

SEQ ID NO: 709784 - DNA, 25 bp, Mus musculus
gtggcatgttctctgccataggcat

SEQ ID NO: 709785 - DNA, 25 bp, Mus musculus
gtggcatgttctgtgccataggcat

SEQ ID NO: 709786 - DNA, 25 bp, Mus musculus
gtggcattaatgatgctttgtcaat

SEQ ID NO: 709787 - DNA, 25 bp, Mus musculus
gtggcattaatgttgctttgtcaat

SEQ ID NO: 709788 - DNA, 25 bp, Mus musculus
gtggcattacatcttatcaaccctg

SEQ ID NO: 709789 - DNA, 25 bp, Mus musculus
gtggcattacatgttatcaaccctg

SEQ ID NO: 709790 - DNA, 25 bp, Mus musculus
gtggcattagaccttgtttcttttc

SEQ ID NO: 709791 - DNA, 25 bp, Mus musculus
gtggcattagacgttgtttcttttc

SEQ ID NO: 709792 - DNA, 25 bp, Mus musculus
gtggcattatcaactgtgctgggaa

SEQ ID NO: 709793 - DNA, 25 bp, Mus musculus
gtggcattatcatctgtgctgggaa

SEQ ID NO: 709794 - DNA, 25 bp, Mus musculus
gtggcattatctatgacaacacaga

SEQ ID NO: 709795 - DNA, 25 bp, Mus musculus
gtggcattatctttgacaacacaga

SEQ ID NO: 709796 - DNA, 25 bp, Mus musculus
gtggcattcaccaatagttccagca

SEQ ID NO: 709797 - DNA, 25 bp, Mus musculus
gtggcattcacccataattctagca

SEQ ID NO: 709798 - DNA, 25 bp, Mus musculus
gtggcattcaccgataattctagca

SEQ ID NO: 709799 - DNA, 25 bp, Mus musculus
gtggcattcacctatagttccagca

SEQ ID NO: 709800 - DNA, 25 bp, Mus musculus
gtggcattcagcatccgtgtttaat

SEQ ID NO: 709801 - DNA, 25 bp, Mus musculus
gtggcattcagcttccgtgtttaat

SEQ ID NO: 709802 - DNA, 25 bp, Mus musculus
gtggcattcagtattctttactgat

SEQ ID NO: 709803 - DNA, 25 bp, Mus musculus
gtggcattcagttttctttactgat

SEQ ID NO: 709804 - DNA, 25 bp, Mus musculus
gtggcattcatgagctattttttac

SEQ ID NO: 709805 - DNA, 25 bp, Mus musculus
gtggcattcatgtgctattttttac

SEQ ID NO: 709806 - DNA, 25 bp, Mus musculus
gtggcattcattcccctttgagcca

SEQ ID NO: 709807 - DNA, 25 bp, Mus musculus
gtggcattcattgccctttgagcca

SEQ ID NO: 709808 - DNA, 25 bp, Mus musculus
gtggcattccgacgtctctgagcct

SEQ ID NO: 709809 - DNA, 25 bp, Mus musculus
gtggcattccgaggtctctgagcct

SEQ ID NO: 709810 - DNA, 25 bp, Mus musculus
gtggcattccttcccataagctggg

SEQ ID NO: 709811 - DNA, 25 bp, Mus musculus
gtggcattccttgccataagctggg

SEQ ID NO: 709812 - DNA, 25 bp, Mus musculus
gtggcattctaacttgtacctctga

SEQ ID NO: 709813 - DNA, 25 bp, Mus musculus
gtggcattctaagttgtacctctga

SEQ ID NO: 709814 - DNA, 25 bp, Mus musculus
gtggcattctgcaaactttatagat

SEQ ID NO: 709815 - DNA, 25 bp, Mus musculus
gtggcattctgctaactttatagat

SEQ ID NO: 709816 - DNA, 25 bp, Mus musculus
gtggcattgaagaggatacccaacc

SEQ ID NO: 709817 - DNA, 25 bp, Mus musculus
gtggcattgaagtggatacccaacc

SEQ ID NO: 709818 - DNA, 25 bp, Mus musculus
gtggcattgaccagttgatgaaaga

SEQ ID NO: 709819 - DNA, 25 bp, Mus musculus
gtggcattgacctgttgatgaaaga

SEQ ID NO: 709820 - DNA, 25 bp, Mus musculus
gtggcattgagcagcacttacactg

SEQ ID NO: 709821 - DNA, 25 bp, Mus musculus
gtggcattgagctgcacttacactg

SEQ ID NO: 709822 - DNA, 25 bp, Mus musculus
gtggcattgcacatctaatttgttg

SEQ ID NO: 709823 - DNA, 25 bp, Mus musculus
gtggcattgcacttctaatttgttg

SEQ ID NO: 709824 - DNA, 25 bp, Mus musculus
gtggcattgccaatcagctcttgca

SEQ ID NO: 709825 - DNA, 25 bp, Mus musculus
gtggcattgccattcagctcttgca

SEQ ID NO: 709826 - DNA, 25 bp, Mus musculus
gtggcattgccgcacagacaaggaa

SEQ ID NO: 709827 - DNA, 25 bp, Mus musculus
gtggcattgccggacagacaaggaa

SEQ ID NO: 709828 - DNA, 25 bp, Mus musculus
gtggcattggtgatggcggccttcg

SEQ ID NO: 709829 - DNA, 25 bp, Mus musculus
gtggcattggtgttggcggccttcg

SEQ ID NO: 709830 - DNA, 25 bp, Mus musculus
gtggcattgtaacaactctgtgtaa

SEQ ID NO: 709831 - DNA, 25 bp, Mus musculus
gtggcattgtaagaactctgtgtaa

SEQ ID NO: 709832 - DNA, 25 bp, Mus musculus
gtggcatttaaaacagtaaagttgt

SEQ ID NO: 709833 - DNA, 25 bp, Mus musculus
gtggcatttaaatcagtaaagttgt

SEQ ID NO: 709834 - DNA, 25 bp, Mus musculus
gtggcatttagaactgagctggcat

SEQ ID NO: 709835 - DNA, 25 bp, Mus musculus
gtggcatttagatctgagctggcat

SEQ ID NO: 709836 - DNA, 25 bp, Mus musculus
gtggcatttatgaaacccgctgcta

SEQ ID NO: 709837 - DNA, 25 bp, Mus musculus
gtggcatttatgtaacccgctgcta

SEQ ID NO: 709838 - DNA, 25 bp, Mus musculus
gtggcatttattcagtgtattgcac

SEQ ID NO: 709839 - DNA, 25 bp, Mus musculus
gtggcatttattgagtgtattgcac

SEQ ID NO: 709840 - DNA, 25 bp, Mus musculus
gtggcatttccaagtcttactggca

SEQ ID NO: 709841 - DNA, 25 bp, Mus musculus
gtggcatttccatgtcttactggca

SEQ ID NO: 709842 - DNA, 25 bp, Mus musculus
gtggcatttcccaactttatggaca

SEQ ID NO: 709843 - DNA, 25 bp, Mus musculus
gtggcatttcccaggtgacaggaca

SEQ ID NO: 709844 - DNA, 25 bp, Mus musculus
gtggcatttcccatgtggtggcctc

SEQ ID NO: 709845 - DNA, 25 bp, Mus musculus
gtggcatttccccaaacttattgtg

SEQ ID NO: 709846 - DNA, 25 bp, Mus musculus
gtggcatttcccgaaacttattgtg

SEQ ID NO: 709847 - DNA, 25 bp, Mus musculus
gtggcatttccctactttatggaca

SEQ ID NO: 709848 - DNA, 25 bp, Mus musculus
gtggcatttccctggtgacaggaca

SEQ ID NO: 709849 - DNA, 25 bp, Mus musculus
gtggcatttcccttgtggtggcctc

SEQ ID NO: 709850 - DNA, 25 bp, Mus musculus
gtggcatttggaagtgtgttaatgt

SEQ ID NO: 709851 - DNA, 25 bp, Mus musculus
gtggcatttggatgtgtgttaatgt

SEQ ID NO: 709852 - DNA, 25 bp, Mus musculus
gtggcattttagagagtaacactca

SEQ ID NO: 709853 - DNA, 25 bp, Mus musculus
gtggcattttagtgagtaacactca

SEQ ID NO: 709854 - DNA, 25 bp, Mus musculus
gtggcatttttcagaaactatcctg

SEQ ID NO: 709855 - DNA, 25 bp, Mus musculus
gtggcatttttctgaaactatcctg

SEQ ID NO: 709856 - DNA, 25 bp, Mus musculus
gtggccaaaaatctttgtctcttgt

SEQ ID NO: 709857 - DNA, 25 bp, Mus musculus
gtggccaaaaatgtttgtctcttgt

SEQ ID NO: 709858 - DNA, 25 bp, Mus musculus
gtggccaaacagatctcagatgcgc

SEQ ID NO: 709859 - DNA, 25 bp, Mus musculus
gtggccaaacagttctcagatgcgc

SEQ ID NO: 709860 - DNA, 25 bp, Mus musculus
gtggccaaacctcagaagcaaagtc

SEQ ID NO: 709861 - DNA, 25 bp, Mus musculus
gtggccaaacctgagaagcaaagtc

SEQ ID NO: 709862 - DNA, 25 bp, Mus musculus
gtggccaaagaacatcacccatggg

SEQ ID NO: 709863 - DNA, 25 bp, Mus musculus
gtggccaaagaagatcacccatggg

SEQ ID NO: 709864 - DNA, 25 bp, Mus musculus
gtggccaaagccctcaggagtattt

SEQ ID NO: 709865 - DNA, 25 bp, Mus musculus
gtggccaaagccgtcaggagtattt

SEQ ID NO: 709866 - DNA, 25 bp, Mus musculus
gtggccaaaggcagatccaagctaa

SEQ ID NO: 709867 - DNA, 25 bp, Mus musculus
gtggccaaaggctgatccaagctaa

SEQ ID NO: 709868 - DNA, 25 bp, Mus musculus
gtggccaaagtaaataactcagaca

SEQ ID NO: 709869 - DNA, 25 bp, Mus musculus
gtggccaaagtatataactcagaca

SEQ ID NO: 709870 - DNA, 25 bp, Mus musculus
gtggccaaagtgagctaggagttta

SEQ ID NO: 709871 - DNA, 25 bp, Mus musculus
gtggccaaagtgtgctaggagttta

SEQ ID NO: 709872 - DNA, 25 bp, Mus musculus
gtggccaaagttatacacaattgaa

SEQ ID NO: 709873 - DNA, 25 bp, Mus musculus
gtggccaaagttttacacaattgaa

SEQ ID NO: 709874 - DNA, 25 bp, Mus musculus
gtggccaacagtatccagtgcaaca

SEQ ID NO: 709875 - DNA, 25 bp, Mus musculus
gtggccaacagtttccagtgcaaca

SEQ ID NO: 709876 - DNA, 25 bp, Mus musculus
gtggccaacctccaagtactaagtt

SEQ ID NO: 709877 - DNA, 25 bp, Mus musculus
gtggccaacctcgaagtactaagtt

SEQ ID NO: 709878 - DNA, 25 bp, Mus musculus
gtggccaacgatagggatattttca

SEQ ID NO: 709879 - DNA, 25 bp, Mus musculus
gtggccaacgattgggatattttca

SEQ ID NO: 709880 - DNA, 25 bp, Mus musculus
gtggccaacgccactgggaggaaat

SEQ ID NO: 709881 - DNA, 25 bp, Mus musculus
gtggccaacgcctctgggaggaaat

SEQ ID NO: 709882 - DNA, 25 bp, Mus musculus
gtggccaacgctattcagcaggaag

SEQ ID NO: 709883 - DNA, 25 bp, Mus musculus
gtggccaacgcttttcagcaggaag

SEQ ID NO: 709884 - DNA, 25 bp, Mus musculus
gtggccaagaccctgctgtaacaca

SEQ ID NO: 709885 - DNA, 25 bp, Mus musculus
gtggccaagaccgtgctgtaacaca

SEQ ID NO: 709886 - DNA, 25 bp, Mus musculus
gtggccaagcgcatccctggcaagc

SEQ ID NO: 709887 - DNA, 25 bp, Mus musculus
gtggccaagcgcttccctggcaagc

SEQ ID NO: 709888 - DNA, 25 bp, Mus musculus
gtggccaaggaaaacacccatccat

SEQ ID NO: 709889 - DNA, 25 bp, Mus musculus
gtggccaaggaatacacccatccat

SEQ ID NO: 709890 - DNA, 25 bp, Mus musculus
gtggccaaggccaaaattgacaaac

SEQ ID NO: 709891 - DNA, 25 bp, Mus musculus
gtggccaaggcctaaattgacaaac

SEQ ID NO: 709892 - DNA, 25 bp, Mus musculus
gtggccaagtcactccagaagatag

SEQ ID NO: 709893 - DNA, 25 bp, Mus musculus
gtggccaagtcagtccagaagatag

SEQ ID NO: 709894 - DNA, 25 bp, Mus musculus
gtggccaagtggctgggagcgggag

SEQ ID NO: 709895 - DNA, 25 bp, Mus musculus
gtggccaagtgggtgggagcgggag

SEQ ID NO: 709896 - DNA, 25 bp, Mus musculus
gtggccaatcataaatgctctttca

SEQ ID NO: 709897 - DNA, 25 bp, Mus musculus
gtggccaatcattaatgctctttca

SEQ ID NO: 709898 - DNA, 25 bp, Mus musculus
gtggccaattggctattttcttcgt

SEQ ID NO: 709899 - DNA, 25 bp, Mus musculus
gtggccaattgggtattttcttcgt

SEQ ID NO: 709900 - DNA, 25 bp, Mus musculus
gtggccacaaacatcagtatcgacc

SEQ ID NO: 709901 - DNA, 25 bp, Mus musculus
gtggccacaaacttcagtatcgacc

SEQ ID NO: 709902 - DNA, 25 bp, Mus musculus
gtggccacaagaccaactcactgat

SEQ ID NO: 709903 - DNA, 25 bp, Mus musculus
gtggccacaagagcaactcactgat

SEQ ID NO: 709904 - DNA, 25 bp, Mus musculus
gtggccacacaaatacaagatgctt

SEQ ID NO: 709905 - DNA, 25 bp, Mus musculus
gtggccacacaattacaagatgctt

SEQ ID NO: 709906 - DNA, 25 bp, Mus musculus
gtggccacacagaagactgacacag

SEQ ID NO: 709907 - DNA, 25 bp, Mus musculus
gtggccacacagtagactgacacag

SEQ ID NO: 709908 - DNA, 25 bp, Mus musculus
gtggccacacgcaaagattataaaa

SEQ ID NO: 709909 - DNA, 25 bp, Mus musculus
gtggccacacgctaagattataaaa

SEQ ID NO: 709910 - DNA, 25 bp, Mus musculus
gtggccacagaaacctctttaattt

SEQ ID NO: 709911 - DNA, 25 bp, Mus musculus
gtggccacagaatcctctttaattt

SEQ ID NO: 709912 - DNA, 25 bp, Mus musculus
gtggccacaggacgaaaacaaagac

SEQ ID NO: 709913 - DNA, 25 bp, Mus musculus
gtggccacaggaggaaaacaaagac

SEQ ID NO: 709914 - DNA, 25 bp, Mus musculus
gtggccacagttctctgtgatctct

SEQ ID NO: 709915 - DNA, 25 bp, Mus musculus
gtggccacagttgtctgtgatctct

SEQ ID NO: 709916 - DNA, 25 bp, Mus musculus
gtggccacatccagaaacattgttc

SEQ ID NO: 709917 - DNA, 25 bp, Mus musculus
gtggccacatcctgaaacattgttc

SEQ ID NO: 709918 - DNA, 25 bp, Mus musculus
gtggccaccaagatcaactcgagcg

SEQ ID NO: 709919 - DNA, 25 bp, Mus musculus
gtggccaccaagttcaactcgagcg

SEQ ID NO: 709920 - DNA, 25 bp, Mus musculus
gtggccaccatgattacaaacatct

SEQ ID NO: 709921 - DNA, 25 bp, Mus musculus
gtggccaccatgtttacaaacatct

SEQ ID NO: 709922 - DNA, 25 bp, Mus musculus
gtggccacccttaatttgtgcagta

SEQ ID NO: 709923 - DNA, 25 bp, Mus musculus
gtggccaccctttatttgtgcagta

SEQ ID NO: 709924 - DNA, 25 bp, Mus musculus
gtggccaccgcccagggtaacttcg

SEQ ID NO: 709925 - DNA, 25 bp, Mus musculus
gtggccaccgccgagggtaacttcg

SEQ ID NO: 709926 - DNA, 25 bp, Mus musculus
gtggccacctctagacagttgttct

SEQ ID NO: 709927 - DNA, 25 bp, Mus musculus
gtggccacctcttgacagttgttct

SEQ ID NO: 709928 - DNA, 25 bp, Mus musculus
gtggccacctgcagactatttgtgg

SEQ ID NO: 709929 - DNA, 25 bp, Mus musculus
gtggccacctgctgactatttgtgg

SEQ ID NO: 709930 - DNA, 25 bp, Mus musculus
gtggccacgagtcctccatgaagaa

SEQ ID NO: 709931 - DNA, 25 bp, Mus musculus
gtggccacgagtgctccatgaagaa

SEQ ID NO: 709932 - DNA, 25 bp, Mus musculus
gtggccacgcatcattgcaatcaag

SEQ ID NO: 709933 - DNA, 25 bp, Mus musculus
gtggccacgcatgattgcaatcaag

SEQ ID NO: 709934 - DNA, 25 bp, Mus musculus
gtggccacgctgctgcatcaggaat

SEQ ID NO: 709935 - DNA, 25 bp, Mus musculus
gtggccacgctggtgcatcaggaat

SEQ ID NO: 709936 - DNA, 25 bp, Mus musculus
gtggccacggccagtgtcactaagc

SEQ ID NO: 709937 - DNA, 25 bp, Mus musculus
gtggccacggcctgtgtcactaagc

SEQ ID NO: 709938 - DNA, 25 bp, Mus musculus
gtggccacgtggattttgatgactt

SEQ ID NO: 709939 - DNA, 25 bp, Mus musculus
gtggccacgtggtttttgatgactt

SEQ ID NO: 709940 - DNA, 25 bp, Mus musculus
gtggccactcagcaaaaacttactc

SEQ ID NO: 709941 - DNA, 25 bp, Mus musculus
gtggccactcaggaaaaacttactc

SEQ ID NO: 709942 - DNA, 25 bp, Mus musculus
gtggccactcccatgacggaaggag

SEQ ID NO: 709943 - DNA, 25 bp, Mus musculus
gtggccactcccttgacggaaggag

SEQ ID NO: 709944 - DNA, 25 bp, Mus musculus
gtggccactcttagaattttctctt

SEQ ID NO: 709945 - DNA, 25 bp, Mus musculus
gtggccactcttccaaaagagccat

SEQ ID NO: 709946 - DNA, 25 bp, Mus musculus
gtggccactcttgcaaaagagccat

SEQ ID NO: 709947 - DNA, 25 bp, Mus musculus
gtggccactctttgaattttctctt

SEQ ID NO: 709948 - DNA, 25 bp, Mus musculus
gtggccactgaaccccagtgataga

SEQ ID NO: 709949 - DNA, 25 bp, Mus musculus
gtggccactgaagcccagtgataga

SEQ ID NO: 709950 - DNA, 25 bp, Mus musculus
gtggccactgccatgattatgaaaa

SEQ ID NO: 709951 - DNA, 25 bp, Mus musculus
gtggccactgccttgattatgaaaa

SEQ ID NO: 709952 - DNA, 25 bp, Mus musculus
gtggccactgtcacaattcagactg

SEQ ID NO: 709953 - DNA, 25 bp, Mus musculus
gtggccactgtctcaattcagactg

SEQ ID NO: 709954 - DNA, 25 bp, Mus musculus
gtggccacttgacatgttgtaggtc

SEQ ID NO: 709955 - DNA, 25 bp, Mus musculus
gtggccacttgagatgttgtaggtc

SEQ ID NO: 709956 - DNA, 25 bp, Mus musculus
gtggccacttgtcctcagtgaagga

SEQ ID NO: 709957 - DNA, 25 bp, Mus musculus
gtggccacttgtgctcagtgaagga

SEQ ID NO: 709958 - DNA, 25 bp, Mus musculus
gtggccagattgctctacagtgaca

SEQ ID NO: 709959 - DNA, 25 bp, Mus musculus
gtggccagattggtctacagtgaca

SEQ ID NO: 709960 - DNA, 25 bp, Mus musculus
gtggccagcactccatccaaaggaa

SEQ ID NO: 709961 - DNA, 25 bp, Mus musculus
gtggccagcactgcatccaaaggaa

SEQ ID NO: 709962 - DNA, 25 bp, Mus musculus
gtggccagccagatactgctagatt

SEQ ID NO: 709963 - DNA, 25 bp, Mus musculus
gtggccagccagttactgctagatt

SEQ ID NO: 709964 - DNA, 25 bp, Mus musculus
gtggccagccgtcagacagcagtta

SEQ ID NO: 709965 - DNA, 25 bp, Mus musculus
gtggccagccgtgagacagcagtta

SEQ ID NO: 709966 - DNA, 25 bp, Mus musculus
gtggccagcgctatttgttgctgcg

SEQ ID NO: 709967 - DNA, 25 bp, Mus musculus
gtggccagcgctttttgttgctgcg

SEQ ID NO: 709968 - DNA, 25 bp, Mus musculus
gtggccagctccagtctacaaagga

SEQ ID NO: 709969 - DNA, 25 bp, Mus musculus
gtggccagctcctgtctacaaagga

SEQ ID NO: 709970 - DNA, 25 bp, Mus musculus
gtggccagctctaagcgcgacactt

SEQ ID NO: 709971 - DNA, 25 bp, Mus musculus
gtggccagctctataaacaggtcag

SEQ ID NO: 709972 - DNA, 25 bp, Mus musculus
gtggccagctcttagcgcgacactt

SEQ ID NO: 709973 - DNA, 25 bp, Mus musculus
gtggccagctctttaaacaggtcag

SEQ ID NO: 709974 - DNA, 25 bp, Mus musculus
gtggccagctgtacacacaactgtt

SEQ ID NO: 709975 - DNA, 25 bp, Mus musculus
gtggccagctgttcacacaactgtt

SEQ ID NO: 709976 - DNA, 25 bp, Mus musculus
gtggccaggacaagctgccttgcag

SEQ ID NO: 709977 - DNA, 25 bp, Mus musculus
gtggccaggacatgctgccttgcag

SEQ ID NO: 709978 - DNA, 25 bp, Mus musculus
gtggccaggatcacttgaagttgtt

SEQ ID NO: 709979 - DNA, 25 bp, Mus musculus
gtggccaggatcataggcagctcat

SEQ ID NO: 709980 - DNA, 25 bp, Mus musculus
gtggccaggatctcttgaagttgtt

SEQ ID NO: 709981 - DNA, 25 bp, Mus musculus
gtggccaggatcttaggcagctcat

SEQ ID NO: 709982 - DNA, 25 bp, Mus musculus
gtggccaggattcaagagctccagt

SEQ ID NO: 709983 - DNA, 25 bp, Mus musculus
gtggccaggattgaagagctccagt

SEQ ID NO: 709984 - DNA, 25 bp, Mus musculus
gtggccaggcagcaacttggtttat

SEQ ID NO: 709985 - DNA, 25 bp, Mus musculus
gtggccaggcaggaacttggtttat

SEQ ID NO: 709986 - DNA, 25 bp, Mus musculus
gtggccagggacaatcggcaactga

SEQ ID NO: 709987 - DNA, 25 bp, Mus musculus
gtggccagggactatcggcaactga

SEQ ID NO: 709988 - DNA, 25 bp, Mus musculus
gtggccagggcaactgttgcatgct

SEQ ID NO: 709989 - DNA, 25 bp, Mus musculus
gtggccagggcacggacaattccaa

SEQ ID NO: 709990 - DNA, 25 bp, Mus musculus
gtggccagggcagggacaattccaa

SEQ ID NO: 709991 - DNA, 25 bp, Mus musculus
gtggccagggcatctgttgcatgct

SEQ ID NO: 709992 - DNA, 25 bp, Mus musculus
gtggccaggtctactgactcaaagt

SEQ ID NO: 709993 - DNA, 25 bp, Mus musculus
gtggccaggtcttctgactcaaagt

SEQ ID NO: 709994 - DNA, 25 bp, Mus musculus
gtggccaggttaaccctatgacata

SEQ ID NO: 709995 - DNA, 25 bp, Mus musculus
gtggccaggttatccctatgacata

SEQ ID NO: 709996 - DNA, 25 bp, Mus musculus
gtggccataaccataaagtcagtat

SEQ ID NO: 709997 - DNA, 25 bp, Mus musculus
gtggccataaccttaaagtcagtat

SEQ ID NO: 709998 - DNA, 25 bp, Mus musculus
gtggccatagttacaccccaaacag

SEQ ID NO: 709999 - DNA, 25 bp, Mus musculus
gtggccatagtttcaccccaaacag

SEQ ID NO: 710000 - DNA, 25 bp, Mus musculus
gtggccatatatcctaccaatgaat

SEQ ID NO: 710001 - DNA, 25 bp, Mus musculus
gtggccatatatgctaccaatgaat

SEQ ID NO: 710002 - DNA, 25 bp, Mus musculus
gtggccatcactatgcacaggaagc

SEQ ID NO: 710003 - DNA, 25 bp, Mus musculus
gtggccatcactttgcacaggaagc

SEQ ID NO: 710004 - DNA, 25 bp, Mus musculus
gtggccatcaggaacctttcagaaa

SEQ ID NO: 710005 - DNA, 25 bp, Mus musculus
gtggccatcaggattctgcaatttc

SEQ ID NO: 710006 - DNA, 25 bp, Mus musculus
gtggccatcaggtacctttcagaaa

SEQ ID NO: 710007 - DNA, 25 bp, Mus musculus
gtggccatcaggtttctgcaatttc

SEQ ID NO: 710008 - DNA, 25 bp, Mus musculus
gtggccatcattctgctttgtgaag

SEQ ID NO: 710009 - DNA, 25 bp, Mus musculus
gtggccatcattgtgctttgtgaag

SEQ ID NO: 710010 - DNA, 25 bp, Mus musculus
gtggccatccaaatatcacctgcaa

SEQ ID NO: 710011 - DNA, 25 bp, Mus musculus
gtggccatccaattatcacctgcaa

SEQ ID NO: 710012 - DNA, 25 bp, Mus musculus
gtggccatcccacaaactgaggcct

SEQ ID NO: 710013 - DNA, 25 bp, Mus musculus
gtggccatcccagaaactgaggcct

SEQ ID NO: 710014 - DNA, 25 bp, Mus musculus
gtggccatcctgagcatagacatac

SEQ ID NO: 710015 - DNA, 25 bp, Mus musculus
gtggccatcctgtgcatagacatac

SEQ ID NO: 710016 - DNA, 25 bp, Mus musculus
gtggccatccttctgtgcatcgtga

SEQ ID NO: 710017 - DNA, 25 bp, Mus musculus
gtggccatccttgtgtgcatcgtga

SEQ ID NO: 710018 - DNA, 25 bp, Mus musculus
gtggccatcgtcattctcaacaagt

SEQ ID NO: 710019 - DNA, 25 bp, Mus musculus
gtggccatcgtctttctcaacaagt

SEQ ID NO: 710020 - DNA, 25 bp, Mus musculus
gtggccatctgcaaagggttcctga

SEQ ID NO: 710021 - DNA, 25 bp, Mus musculus
gtggccatctgctaagggttcctga

SEQ ID NO: 710022 - DNA, 25 bp, Mus musculus
gtggccatcttcagcacatcatgaa

SEQ ID NO: 710023 - DNA, 25 bp, Mus musculus
gtggccatcttctgcacatcatgaa

SEQ ID NO: 710024 - DNA, 25 bp, Mus musculus
gtggccatgaagactccaggcattc

SEQ ID NO: 710025 - DNA, 25 bp, Mus musculus
gtggccatgaagtctccaggcattc

SEQ ID NO: 710026 - DNA, 25 bp, Mus musculus
gtggccatgactatgaggaacttta

SEQ ID NO: 710027 - DNA, 25 bp, Mus musculus
gtggccatgactttgaggaacttta

SEQ ID NO: 710028 - DNA, 25 bp, Mus musculus
gtggccatgagcattagtcacacag

SEQ ID NO: 710029 - DNA, 25 bp, Mus musculus
gtggccatgagctttagtcacacag

SEQ ID NO: 710030 - DNA, 25 bp, Mus musculus
gtggccatggagcagaggtgctgca

SEQ ID NO: 710031 - DNA, 25 bp, Mus musculus
gtggccatggaggagaggtgctgca

SEQ ID NO: 710032 - DNA, 25 bp, Mus musculus
gtggccatggcactcgtgacctgaa

SEQ ID NO: 710033 - DNA, 25 bp, Mus musculus
gtggccatggcagtcgtgacctgaa

SEQ ID NO: 710034 - DNA, 25 bp, Mus musculus
gtggccatggccattcataaggcag

SEQ ID NO: 710035 - DNA, 25 bp, Mus musculus
gtggccatggcctttcataaggcag

SEQ ID NO: 710036 - DNA, 25 bp, Mus musculus
gtggccatgtaccaaaccagctgta

SEQ ID NO: 710037 - DNA, 25 bp, Mus musculus
gtggccatgtacgaaaccagctgta

SEQ ID NO: 710038 - DNA, 25 bp, Mus musculus
gtggccatgtagcagctggactcaa

SEQ ID NO: 710039 - DNA, 25 bp, Mus musculus
gtggccatgtaggagctggactcaa

SEQ ID NO: 710040 - DNA, 25 bp, Mus musculus
gtggccatgtggatacagtaggtct

SEQ ID NO: 710041 - DNA, 25 bp, Mus musculus
gtggccatgtggttacagtaggtct

SEQ ID NO: 710042 - DNA, 25 bp, Mus musculus
gtggccattactcaacattgtatgt

SEQ ID NO: 710043 - DNA, 25 bp, Mus musculus
gtggccattactgaacattgtatgt

SEQ ID NO: 710044 - DNA, 25 bp, Mus musculus
gtggccattcaacaaaccctgctag

SEQ ID NO: 710045 - DNA, 25 bp, Mus musculus
gtggccattcaagaaaccctgctag

SEQ ID NO: 710046 - DNA, 25 bp, Mus musculus
gtggccattcatcattttcaggtaa

SEQ ID NO: 710047 - DNA, 25 bp, Mus musculus
gtggccattcatgattttcaggtaa

SEQ ID NO: 710048 - DNA, 25 bp, Mus musculus
gtggccattgcaatcactaatcagg

SEQ ID NO: 710049 - DNA, 25 bp, Mus musculus
gtggccattgcattcactaatcagg

SEQ ID NO: 710050 - DNA, 25 bp, Mus musculus
gtggccatttaaactgaagtcctat

SEQ ID NO: 710051 - DNA, 25 bp, Mus musculus
gtggccatttaatctgaagtcctat

SEQ ID NO: 710052 - DNA, 25 bp, Mus musculus
gtggccatttatatgagtttgctca

SEQ ID NO: 710053 - DNA, 25 bp, Mus musculus
gtggccatttatttgagtttgctca

SEQ ID NO: 710054 - DNA, 25 bp, Mus musculus
gtggccatttgtaaacctttgaggt

SEQ ID NO: 710055 - DNA, 25 bp, Mus musculus
gtggccatttgttaacctttgaggt

SEQ ID NO: 710056 - DNA, 25 bp, Mus musculus
gtggccattttcaaggaaccctgga

SEQ ID NO: 710057 - DNA, 25 bp, Mus musculus
gtggccattttctaggaaccctgga

SEQ ID NO: 710058 - DNA, 25 bp, Mus musculus
gtggcccaaaccagattcgggctga

SEQ ID NO: 710059 - DNA, 25 bp, Mus musculus
gtggcccaaacctgattcgggctga

SEQ ID NO: 710060 - DNA, 25 bp, Mus musculus
gtggcccaacaaacccaaagcagaa

SEQ ID NO: 710061 - DNA, 25 bp, Mus musculus
gtggcccaacaatcccaaagcagaa

SEQ ID NO: 710062 - DNA, 25 bp, Mus musculus
gtggcccaacagactttatcgcaac

SEQ ID NO: 710063 - DNA, 25 bp, Mus musculus
gtggcccaacagtctttatcgcaac

SEQ ID NO: 710064 - DNA, 25 bp, Mus musculus
gtggcccaagatacggaactgtgat

SEQ ID NO: 710065 - DNA, 25 bp, Mus musculus
gtggcccaagattcggaactgtgat

SEQ ID NO: 710066 - DNA, 25 bp, Mus musculus
gtggcccacacacgtagttctaatg

SEQ ID NO: 710067 - DNA, 25 bp, Mus musculus
gtggcccacacaggtagttctaatg

SEQ ID NO: 710068 - DNA, 25 bp, Mus musculus
gtggcccacagtcagtcaggtgttc

SEQ ID NO: 710069 - DNA, 25 bp, Mus musculus
gtggcccacagtgagtcaggtgttc

SEQ ID NO: 710070 - DNA, 25 bp, Mus musculus
gtggcccacggcaacggagagaact

SEQ ID NO: 710071 - DNA, 25 bp, Mus musculus
gtggcccacggctacggagagaact

SEQ ID NO: 710072 - DNA, 25 bp, Mus musculus
gtggcccagaaactagagactacag

SEQ ID NO: 710073 - DNA, 25 bp, Mus musculus
gtggcccagaaagtagagactacag

SEQ ID NO: 710074 - DNA, 25 bp, Mus musculus
gtggcccagacaaaccatcatgtgt

SEQ ID NO: 710075 - DNA, 25 bp, Mus musculus
gtggcccagacataccatcatgtgt

SEQ ID NO: 710076 - DNA, 25 bp, Mus musculus
gtggcccagagacttttcagtatgg

SEQ ID NO: 710077 - DNA, 25 bp, Mus musculus
gtggcccagagagttttcagtatgg

SEQ ID NO: 710078 - DNA, 25 bp, Mus musculus
gtggcccagccacataaacattttt

SEQ ID NO: 710079 - DNA, 25 bp, Mus musculus
gtggcccagccagataaacattttt

SEQ ID NO: 710080 - DNA, 25 bp, Mus musculus
gtggcccagctgatcaactgtatgg

SEQ ID NO: 710081 - DNA, 25 bp, Mus musculus
gtggcccagctgttcaactgtatgg

SEQ ID NO: 710082 - DNA, 25 bp, Mus musculus
gtggcccaggagaacttcaagcgtt

SEQ ID NO: 710083 - DNA, 25 bp, Mus musculus
gtggcccaggagtacttcaagcgtt

SEQ ID NO: 710084 - DNA, 25 bp, Mus musculus
gtggcccagtatacagacttgtcta

SEQ ID NO: 710085 - DNA, 25 bp, Mus musculus
gtggcccagtattcagacttgtcta

SEQ ID NO: 710086 - DNA, 25 bp, Mus musculus
gtggcccataacatgtatttgctgc

SEQ ID NO: 710087 - DNA, 25 bp, Mus musculus
gtggcccataacttgtatttgctgc

SEQ ID NO: 710088 - DNA, 25 bp, Mus musculus
gtggcccatcatcgctcgagaggaa

SEQ ID NO: 710089 - DNA, 25 bp, Mus musculus
gtggcccatcatggctcgagaggaa

SEQ ID NO: 710090 - DNA, 25 bp, Mus musculus
gtggcccatccaacatcaattttaa

SEQ ID NO: 710091 - DNA, 25 bp, Mus musculus
gtggcccatccatcatcaattttaa

SEQ ID NO: 710092 - DNA, 25 bp, Mus musculus
gtggcccatgtaatctcaggatgaa

SEQ ID NO: 710093 - DNA, 25 bp, Mus musculus
gtggcccatgtattctcaggatgaa

SEQ ID NO: 710094 - DNA, 25 bp, Mus musculus
gtggcccatgttaatttcctagttt

SEQ ID NO: 710095 - DNA, 25 bp, Mus musculus
gtggcccatgtttatttcctagttt

SEQ ID NO: 710096 - DNA, 25 bp, Mus musculus
gtggcccattcactgctctttgaat

SEQ ID NO: 710097 - DNA, 25 bp, Mus musculus
gtggcccattcagtgctctttgaat

SEQ ID NO: 710098 - DNA, 25 bp, Mus musculus
gtggcccattctaaattgctgctaa

SEQ ID NO: 710099 - DNA, 25 bp, Mus musculus
gtggcccattcttaattgctgctaa

SEQ ID NO: 710100 - DNA, 25 bp, Mus musculus
gtggcccattggacacaaagttttt

SEQ ID NO: 710101 - DNA, 25 bp, Mus musculus
gtggcccattggtcacaaagttttt

SEQ ID NO: 710102 - DNA, 25 bp, Mus musculus
gtggccccaagactagtcctaggaa

SEQ ID NO: 710103 - DNA, 25 bp, Mus musculus
gtggccccaagagtagtcctaggaa

SEQ ID NO: 710104 - DNA, 25 bp, Mus musculus
gtggccccaccaagtatgtagagta

SEQ ID NO: 710105 - DNA, 25 bp, Mus musculus
gtggccccaccatgtatgtagagta

SEQ ID NO: 710106 - DNA, 25 bp, Mus musculus
gtggccccagacaagggatttcctt

SEQ ID NO: 710107 - DNA, 25 bp, Mus musculus
gtggccccagactagggatttcctt

SEQ ID NO: 710108 - DNA, 25 bp, Mus musculus
gtggccccagggagtcacaaaataa

SEQ ID NO: 710109 - DNA, 25 bp, Mus musculus
gtggccccagggtgtcacaaaataa

SEQ ID NO: 710110 - DNA, 25 bp, Mus musculus
gtggccccagtactgttgagaatga

SEQ ID NO: 710111 - DNA, 25 bp, Mus musculus
gtggccccagtagtgttgagaatga

SEQ ID NO: 710112 - DNA, 25 bp, Mus musculus
gtggccccagttaccaaggcaagag

SEQ ID NO: 710113 - DNA, 25 bp, Mus musculus
gtggccccagtttccaaggcaagag

SEQ ID NO: 710114 - DNA, 25 bp, Mus musculus
gtggccccatggcaatttggtgtct

SEQ ID NO: 710115 - DNA, 25 bp, Mus musculus
gtggccccatgggaatttggtgtct

SEQ ID NO: 710116 - DNA, 25 bp, Mus musculus
gtggccccattcatggaccgagaca

SEQ ID NO: 710117 - DNA, 25 bp, Mus musculus
gtggccccattcttggaccgagaca

SEQ ID NO: 710118 - DNA, 25 bp, Mus musculus
gtggccccgaatagtgctgtcggaa

SEQ ID NO: 710119 - DNA, 25 bp, Mus musculus
gtggccccgaattgtgctgtcggaa

SEQ ID NO: 710120 - DNA, 25 bp, Mus musculus
gtggcccctaagcacacacttgaaa

SEQ ID NO: 710121 - DNA, 25 bp, Mus musculus
gtggcccctaaggacacacttgaaa

SEQ ID NO: 710122 - DNA, 25 bp, Mus musculus
gtggcccctatactaatccttggag

SEQ ID NO: 710123 - DNA, 25 bp, Mus musculus
gtggcccctatagtaatccttggag

SEQ ID NO: 710124 - DNA, 25 bp, Mus musculus
gtggcccctgataggttgaatcctg

SEQ ID NO: 710125 - DNA, 25 bp, Mus musculus
gtggcccctgattggttgaatcctg

SEQ ID NO: 710126 - DNA, 25 bp, Mus musculus
gtggcccctgttactagattgtgga

SEQ ID NO: 710127 - DNA, 25 bp, Mus musculus
gtggcccctgtttctagattgtgga

SEQ ID NO: 710128 - DNA, 25 bp, Mus musculus
gtggccccttatctaaagacccttg

SEQ ID NO: 710129 - DNA, 25 bp, Mus musculus
gtggccccttatgtaaagacccttg

SEQ ID NO: 710130 - DNA, 25 bp, Mus musculus
gtggcccgaactcctctggacatgg

SEQ ID NO: 710131 - DNA, 25 bp, Mus musculus
gtggcccgaactgctctggacatgg

SEQ ID NO: 710132 - DNA, 25 bp, Mus musculus
gtggcccgacggcaattccagacca

SEQ ID NO: 710133 - DNA, 25 bp, Mus musculus
gtggcccgacgggaattccagacca

SEQ ID NO: 710134 - DNA, 25 bp, Mus musculus
gtggcccgaggaagatctgaagtca

SEQ ID NO: 710135 - DNA, 25 bp, Mus musculus
gtggcccgaggatgatctgaagtca

SEQ ID NO: 710136 - DNA, 25 bp, Mus musculus
gtggcccgcagcacagagaaatgta

SEQ ID NO: 710137 - DNA, 25 bp, Mus musculus
gtggcccgcagctcagagaaatgta

SEQ ID NO: 710138 - DNA, 25 bp, Mus musculus
gtggcccgctacaagttttatctag

SEQ ID NO: 710139 - DNA, 25 bp, Mus musculus
gtggcccgctactagttttatctag

SEQ ID NO: 710140 - DNA, 25 bp, Mus musculus
gtggcccggtttccaagtgcagaat

SEQ ID NO: 710141 - DNA, 25 bp, Mus musculus
gtggcccggtttgcaagtgcagaat

SEQ ID NO: 710142 - DNA, 25 bp, Mus musculus
gtggcccgtccacataagatttcag

SEQ ID NO: 710143 - DNA, 25 bp, Mus musculus
gtggcccgtccagataagatttcag

SEQ ID NO: 710144 - DNA, 25 bp, Mus musculus
gtggccctaaataacagtgtcatca

SEQ ID NO: 710145 - DNA, 25 bp, Mus musculus
gtggccctaaattacagtgtcatca

SEQ ID NO: 710146 - DNA, 25 bp, Mus musculus
gtggccctacatactgtgctataat

SEQ ID NO: 710147 - DNA, 25 bp, Mus musculus
gtggccctacattctgtgctataat

SEQ ID NO: 710148 - DNA, 25 bp, Mus musculus
gtggccctactactacagtttttgt

SEQ ID NO: 710149 - DNA, 25 bp, Mus musculus
gtggccctactagtacagtttttgt

SEQ ID NO: 710150 - DNA, 25 bp, Mus musculus
gtggccctcacacaattaagctgga

SEQ ID NO: 710151 - DNA, 25 bp, Mus musculus
gtggccctcacagaattaagctgga

SEQ ID NO: 710152 - DNA, 25 bp, Mus musculus
gtggccctcaccatgtggagtagga

SEQ ID NO: 710153 - DNA, 25 bp, Mus musculus
gtggccctcaccttgtggagtagga

SEQ ID NO: 710154 - DNA, 25 bp, Mus musculus
gtggccctcactcccaaggtgcaga

SEQ ID NO: 710155 - DNA, 25 bp, Mus musculus
gtggccctcactgccaaggtgcaga

SEQ ID NO: 710156 - DNA, 25 bp, Mus musculus
gtggccctcaggcttgtgtcccaag

SEQ ID NO: 710157 - DNA, 25 bp, Mus musculus
gtggccctcagggttgtgtcccaag

SEQ ID NO: 710158 - DNA, 25 bp, Mus musculus
gtggccctcctcaatgtgaaaagaa

SEQ ID NO: 710159 - DNA, 25 bp, Mus musculus
gtggccctcctctatgtgaaaagaa

SEQ ID NO: 710160 - DNA, 25 bp, Mus musculus
gtggccctcctgacttgtcagagaa

SEQ ID NO: 710161 - DNA, 25 bp, Mus musculus
gtggccctcctgtcttgtcagagaa

SEQ ID NO: 710162 - DNA, 25 bp, Mus musculus
gtggccctcgaacttagagctatcc

SEQ ID NO: 710163 - DNA, 25 bp, Mus musculus
gtggccctcgaagttagagctatcc

SEQ ID NO: 710164 - DNA, 25 bp, Mus musculus
gtggccctctcacagcagccttggg

SEQ ID NO: 710165 - DNA, 25 bp, Mus musculus
gtggccctctcagagcagccttggg

SEQ ID NO: 710166 - DNA, 25 bp, Mus musculus
gtggccctctgaaatatactggatg

SEQ ID NO: 710167 - DNA, 25 bp, Mus musculus
gtggccctctgaccattatggttaa

SEQ ID NO: 710168 - DNA, 25 bp, Mus musculus
gtggccctctgagcattatggttaa

SEQ ID NO: 710169 - DNA, 25 bp, Mus musculus
gtggccctctgatatatactggatg

SEQ ID NO: 710170 - DNA, 25 bp, Mus musculus
gtggccctcttcacatgatttggaa

SEQ ID NO: 710171 - DNA, 25 bp, Mus musculus
gtggccctcttctcatgatttggaa

SEQ ID NO: 710172 - DNA, 25 bp, Mus musculus
gtggccctgaacagtgtctgctgtg

SEQ ID NO: 710173 - DNA, 25 bp, Mus musculus
gtggccctgaactgtgtctgctgtg

SEQ ID NO: 710174 - DNA, 25 bp, Mus musculus
gtggccctgaggacttccaatgctg

SEQ ID NO: 710175 - DNA, 25 bp, Mus musculus
gtggccctgaggataatctgctgtc

SEQ ID NO: 710176 - DNA, 25 bp, Mus musculus
gtggccctgaggtcttccaatgctg

SEQ ID NO: 710177 - DNA, 25 bp, Mus musculus
gtggccctgaggttaatctgctgtc

SEQ ID NO: 710178 - DNA, 25 bp, Mus musculus
gtggccctgatacatctttttgtta

SEQ ID NO: 710179 - DNA, 25 bp, Mus musculus
gtggccctgatagatctttttgtta

SEQ ID NO: 710180 - DNA, 25 bp, Mus musculus
gtggccctgatgcagtctgattttg

SEQ ID NO: 710181 - DNA, 25 bp, Mus musculus
gtggccctgatggagtctgattttg

SEQ ID NO: 710182 - DNA, 25 bp, Mus musculus
gtggccctgattcgcaattagccta

SEQ ID NO: 710183 - DNA, 25 bp, Mus musculus
gtggccctgattggcaattagccta

SEQ ID NO: 710184 - DNA, 25 bp, Mus musculus
gtggccctggatcctatgagtaagc

SEQ ID NO: 710185 - DNA, 25 bp, Mus musculus
gtggccctggatgctatgagtaagc

SEQ ID NO: 710186 - DNA, 25 bp, Mus musculus
gtggccctgtttcagagactgagca

SEQ ID NO: 710187 - DNA, 25 bp, Mus musculus
gtggccctgtttgagagactgagca

SEQ ID NO: 710188 - DNA, 25 bp, Mus musculus
gtggcccttataatatgctctcttg

SEQ ID NO: 710189 - DNA, 25 bp, Mus musculus
gtggcccttatattatgctctcttg

SEQ ID NO: 710190 - DNA, 25 bp, Mus musculus
gtggcccttggcagatgatgaaacc

SEQ ID NO: 710191 - DNA, 25 bp, Mus musculus
gtggcccttggctgatgatgaaacc

SEQ ID NO: 710192 - DNA, 25 bp, Mus musculus
gtggcccttgtgcacagagcatatt

SEQ ID NO: 710193 - DNA, 25 bp, Mus musculus
gtggcccttgtggacagagcatatt

SEQ ID NO: 710194 - DNA, 25 bp, Mus musculus
gtggccgaatttctgtaccaggtcc

SEQ ID NO: 710195 - DNA, 25 bp, Mus musculus
gtggccgaatttgtgtaccaggtcc

SEQ ID NO: 710196 - DNA, 25 bp, Mus musculus
gtggccgacattagaagtacttacc

SEQ ID NO: 710197 - DNA, 25 bp, Mus musculus
gtggccgacatttgaagtacttacc

SEQ ID NO: 710198 - DNA, 25 bp, Mus musculus
gtggccgactcacaaaggcgatgtt

SEQ ID NO: 710199 - DNA, 25 bp, Mus musculus
gtggccgactcagaaaggcgatgtt

SEQ ID NO: 710200 - DNA, 25 bp, Mus musculus
gtggccgagcacatgtctaatatgt

SEQ ID NO: 710201 - DNA, 25 bp, Mus musculus
gtggccgagcacttgtctaatatgt

SEQ ID NO: 710202 - DNA, 25 bp, Mus musculus
gtggccgagcgcatcctgatggcta

SEQ ID NO: 710203 - DNA, 25 bp, Mus musculus
gtggccgagcgcttcctgatggcta

SEQ ID NO: 710204 - DNA, 25 bp, Mus musculus
gtggccgaggagattccaggaccaa

SEQ ID NO: 710205 - DNA, 25 bp, Mus musculus
gtggccgaggagtttccaggaccaa

SEQ ID NO: 710206 - DNA, 25 bp, Mus musculus
gtggccgagggcagcaggtaactgg

SEQ ID NO: 710207 - DNA, 25 bp, Mus musculus
gtggccgagggctgcaggtaactgg

SEQ ID NO: 710208 - DNA, 25 bp, Mus musculus
gtggccgcagtccaagaggcttaca

SEQ ID NO: 710209 - DNA, 25 bp, Mus musculus
gtggccgcagtcgaagaggcttaca

SEQ ID NO: 710210 - DNA, 25 bp, Mus musculus
gtggccgccatgcttcagcattaca

SEQ ID NO: 710211 - DNA, 25 bp, Mus musculus
gtggccgccatggttcagcattaca

SEQ ID NO: 710212 - DNA, 25 bp, Mus musculus
gtggccgctaaaccctcatgtgagg

SEQ ID NO: 710213 - DNA, 25 bp, Mus musculus
gtggccgctaaagcctcatgtgagg

SEQ ID NO: 710214 - DNA, 25 bp, Mus musculus
gtggccgctaagcaaaaactgctgt

SEQ ID NO: 710215 - DNA, 25 bp, Mus musculus
gtggccgctaaggaaaaactgctgt

SEQ ID NO: 710216 - DNA, 25 bp, Mus musculus
gtggccggaaataagactgcagctt

SEQ ID NO: 710217 - DNA, 25 bp, Mus musculus
gtggccggaaattagactgcagctt

SEQ ID NO: 710218 - DNA, 25 bp, Mus musculus
gtggccggaatgatgcaaaccttaa

SEQ ID NO: 710219 - DNA, 25 bp, Mus musculus
gtggccggaatgttgcaaaccttaa

SEQ ID NO: 710220 - DNA, 25 bp, Mus musculus
gtggccggacaaccaacagcttgga

SEQ ID NO: 710221 - DNA, 25 bp, Mus musculus
gtggccggacaagcaacagcttgga

SEQ ID NO: 710222 - DNA, 25 bp, Mus musculus
gtggccggcgagaaaacgaactcct

SEQ ID NO: 710223 - DNA, 25 bp, Mus musculus
gtggccggcgagtaaacgaactcct

SEQ ID NO: 710224 - DNA, 25 bp, Mus musculus
gtggccggctacagcagcaatggca

SEQ ID NO: 710225 - DNA, 25 bp, Mus musculus
gtggccggctactgcagcaatggca

SEQ ID NO: 710226 - DNA, 25 bp, Mus musculus
gtggccggctggatgtacccaagca

SEQ ID NO: 710227 - DNA, 25 bp, Mus musculus
gtggccggctggttgtacccaagca

SEQ ID NO: 710228 - DNA, 25 bp, Mus musculus
gtggccgtacatacaagtctacact

SEQ ID NO: 710229 - DNA, 25 bp, Mus musculus
gtggccgtacattcaagtctacact

SEQ ID NO: 710230 - DNA, 25 bp, Mus musculus
gtggccgtaggcagtgagtcacaca

SEQ ID NO: 710231 - DNA, 25 bp, Mus musculus
gtggccgtaggctgtgagtcacaca

SEQ ID NO: 710232 - DNA, 25 bp, Mus musculus
gtggccgtcacgcacacagctgatc

SEQ ID NO: 710233 - DNA, 25 bp, Mus musculus
gtggccgtcacggacacagctgatc

SEQ ID NO: 710234 - DNA, 25 bp, Mus musculus
gtggccgtgactcctttgaggtaaa

SEQ ID NO: 710235 - DNA, 25 bp, Mus musculus
gtggccgtgactgctttgaggtaaa

SEQ ID NO: 710236 - DNA, 25 bp, Mus musculus
gtggccgtgtagactttgaagactt

SEQ ID NO: 710237 - DNA, 25 bp, Mus musculus
gtggccgtgtagtctttgaagactt

SEQ ID NO: 710238 - DNA, 25 bp, Mus musculus
gtggccgtgtgtcactgtttaacta

SEQ ID NO: 710239 - DNA, 25 bp, Mus musculus
gtggccgtgtgtgactgtttaacta

SEQ ID NO: 710240 - DNA, 25 bp, Mus musculus
gtggccgttcagatcagtttcatgt

SEQ ID NO: 710241 - DNA, 25 bp, Mus musculus
gtggccgttcagttcagtttcatgt

SEQ ID NO: 710242 - DNA, 25 bp, Mus musculus
gtggccgttgctaggtagagcatat

SEQ ID NO: 710243 - DNA, 25 bp, Mus musculus
gtggccgttgcttggtagagcatat

SEQ ID NO: 710244 - DNA, 25 bp, Mus musculus
gtggccgtttctatggcaacactaa

SEQ ID NO: 710245 - DNA, 25 bp, Mus musculus
gtggccgtttctttggcaacactaa

SEQ ID NO: 710246 - DNA, 25 bp, Mus musculus
gtggcctaagaaccactcagggtct

SEQ ID NO: 710247 - DNA, 25 bp, Mus musculus
gtggcctaagaagcactcagggtct

SEQ ID NO: 710248 - DNA, 25 bp, Mus musculus
gtggcctacatgagtcttcatcctt

SEQ ID NO: 710249 - DNA, 25 bp, Mus musculus
gtggcctacatgtgtcttcatcctt

SEQ ID NO: 710250 - DNA, 25 bp, Mus musculus
gtggcctacccaaagttgcagatgc

SEQ ID NO: 710251 - DNA, 25 bp, Mus musculus
gtggcctacccatagttgcagatgc

SEQ ID NO: 710252 - DNA, 25 bp, Mus musculus
gtggcctacctgataaagcagctaa

SEQ ID NO: 710253 - DNA, 25 bp, Mus musculus
gtggcctacctgttaaagcagctaa

SEQ ID NO: 710254 - DNA, 25 bp, Mus musculus
gtggcctactaactctgcctgtaaa

SEQ ID NO: 710255 - DNA, 25 bp, Mus musculus
gtggcctactaagtctgcctgtaaa

SEQ ID NO: 710256 - DNA, 25 bp, Mus musculus
gtggcctactatatcatcttgcttt

SEQ ID NO: 710257 - DNA, 25 bp, Mus musculus
gtggcctactatttcatcttgcttt

SEQ ID NO: 710258 - DNA, 25 bp, Mus musculus
gtggcctagagacggctcccaaatt

SEQ ID NO: 710259 - DNA, 25 bp, Mus musculus
gtggcctagagactcatatctgaca

SEQ ID NO: 710260 - DNA, 25 bp, Mus musculus
gtggcctagagagggctcccaaatt

SEQ ID NO: 710261 - DNA, 25 bp, Mus musculus
gtggcctagagagtcatatctgaca

SEQ ID NO: 710262 - DNA, 25 bp, Mus musculus
gtggcctaggctcgctttaaaccca

SEQ ID NO: 710263 - DNA, 25 bp, Mus musculus
gtggcctaggctggctttaaaccca

SEQ ID NO: 710264 - DNA, 25 bp, Mus musculus
gtggcctagtttcagtgagagacct

SEQ ID NO: 710265 - DNA, 25 bp, Mus musculus
gtggcctagtttgagtgagagacct

SEQ ID NO: 710266 - DNA, 25 bp, Mus musculus
gtggcctattagatgtcatctctgt

SEQ ID NO: 710267 - DNA, 25 bp, Mus musculus
gtggcctattagttgtcatctctgt

SEQ ID NO: 710268 - DNA, 25 bp, Mus musculus
gtggcctcacaaagcacatgactgt

SEQ ID NO: 710269 - DNA, 25 bp, Mus musculus
gtggcctcacaatgcacatgactgt

SEQ ID NO: 710270 - DNA, 25 bp, Mus musculus
gtggcctcacctactattgttatat

SEQ ID NO: 710271 - DNA, 25 bp, Mus musculus
gtggcctcaccttctattgttatat

SEQ ID NO: 710272 - DNA, 25 bp, Mus musculus
gtggcctcagagcttcctgcaagga

SEQ ID NO: 710273 - DNA, 25 bp, Mus musculus
gtggcctcagaggttcctgcaagga

SEQ ID NO: 710274 - DNA, 25 bp, Mus musculus
gtggcctcagatctcttttatctct

SEQ ID NO: 710275 - DNA, 25 bp, Mus musculus
gtggcctcagatgtcttttatctct

SEQ ID NO: 710276 - DNA, 25 bp, Mus musculus
gtggcctcagctcaatgaccatggg

SEQ ID NO: 710277 - DNA, 25 bp, Mus musculus
gtggcctcagctgaatgaccatggg

SEQ ID NO: 710278 - DNA, 25 bp, Mus musculus
gtggcctcatacagcaaccaatatg

SEQ ID NO: 710279 - DNA, 25 bp, Mus musculus
gtggcctcatactgcaaccaatatg

SEQ ID NO: 710280 - DNA, 25 bp, Mus musculus
gtggcctcatcactctgccagggag

SEQ ID NO: 710281 - DNA, 25 bp, Mus musculus
gtggcctcatcagtctgccagggag

SEQ ID NO: 710282 - DNA, 25 bp, Mus musculus
gtggcctcatggcatggttctcata

SEQ ID NO: 710283 - DNA, 25 bp, Mus musculus
gtggcctcatgggatggttctcata

SEQ ID NO: 710284 - DNA, 25 bp, Mus musculus
gtggcctcatttagtggcaccggat

SEQ ID NO: 710285 - DNA, 25 bp, Mus musculus
gtggcctcattttgtggcaccggat

SEQ ID NO: 710286 - DNA, 25 bp, Mus musculus
gtggcctccacaaaagagctgacat

SEQ ID NO: 710287 - DNA, 25 bp, Mus musculus
gtggcctccacataagagctgacat

SEQ ID NO: 710288 - DNA, 25 bp, Mus musculus
gtggcctccagcctttgctcagtgt

SEQ ID NO: 710289 - DNA, 25 bp, Mus musculus
gtggcctccagcgtttgctcagtgt

SEQ ID NO: 710290 - DNA, 25 bp, Mus musculus
gtggcctccagtacttaggaccgaa

SEQ ID NO: 710291 - DNA, 25 bp, Mus musculus
gtggcctccagttcttaggaccgaa

SEQ ID NO: 710292 - DNA, 25 bp, Mus musculus
gtggcctcccagagctctggaccaa

SEQ ID NO: 710293 - DNA, 25 bp, Mus musculus
gtggcctcccagtgctctggaccaa

SEQ ID NO: 710294 - DNA, 25 bp, Mus musculus
gtggcctcccttaatacgtggaatt

SEQ ID NO: 710295 - DNA, 25 bp, Mus musculus
gtggcctccctttatacgtggaatt

SEQ ID NO: 710296 - DNA, 25 bp, Mus musculus
gtggcctccgagcaagaatatggat

SEQ ID NO: 710297 - DNA, 25 bp, Mus musculus
gtggcctccgaggaagaatatggat

SEQ ID NO: 710298 - DNA, 25 bp, Mus musculus
gtggcctccggaatgataaggctat

SEQ ID NO: 710299 - DNA, 25 bp, Mus musculus
gtggcctccggattgataaggctat

SEQ ID NO: 710300 - DNA, 25 bp, Mus musculus
gtggcctcctgacgaattcctggtc

SEQ ID NO: 710301 - DNA, 25 bp, Mus musculus
gtggcctcctgaggaattcctggtc

SEQ ID NO: 710302 - DNA, 25 bp, Mus musculus
gtggcctccttaaggcttctcagat

SEQ ID NO: 710303 - DNA, 25 bp, Mus musculus
gtggcctccttatggcttctcagat

SEQ ID NO: 710304 - DNA, 25 bp, Mus musculus
gtggcctcgaatacacctaccgctg

SEQ ID NO: 710305 - DNA, 25 bp, Mus musculus
gtggcctcgaattcacctaccgctg

SEQ ID NO: 710306 - DNA, 25 bp, Mus musculus
gtggcctcgtgaattgggaccagca

SEQ ID NO: 710307 - DNA, 25 bp, Mus musculus
gtggcctcgtgatttgggaccagca

SEQ ID NO: 710308 - DNA, 25 bp, Mus musculus
gtggcctctaacatgggacctaaat

SEQ ID NO: 710309 - DNA, 25 bp, Mus musculus
gtggcctctaacttgggacctaaat

SEQ ID NO: 710310 - DNA, 25 bp, Mus musculus
gtggcctctcatcgcacagtttgca

SEQ ID NO: 710311 - DNA, 25 bp, Mus musculus
gtggcctctcatggcacagtttgca

SEQ ID NO: 710312 - DNA, 25 bp, Mus musculus
gtggcctctgacctgcagttgtaaa

SEQ ID NO: 710313 - DNA, 25 bp, Mus musculus
gtggcctctgacgtgcagttgtaaa

SEQ ID NO: 710314 - DNA, 25 bp, Mus musculus
gtggcctctgccctgtgaagtgtct

SEQ ID NO: 710315 - DNA, 25 bp, Mus musculus
gtggcctctgccgtgtgaagtgtct

SEQ ID NO: 710316 - DNA, 25 bp, Mus musculus
gtggcctctgctcgcacgtttctga

SEQ ID NO: 710317 - DNA, 25 bp, Mus musculus
gtggcctctgctggcacgtttctga

SEQ ID NO: 710318 - DNA, 25 bp, Mus musculus
gtggcctcttgtctcaagacctttg

SEQ ID NO: 710319 - DNA, 25 bp, Mus musculus
gtggcctcttgtgtcaagacctttg

SEQ ID NO: 710320 - DNA, 25 bp, Mus musculus
gtggcctgaataacactcctcaatg

SEQ ID NO: 710321 - DNA, 25 bp, Mus musculus
gtggcctgaatatcactcctcaatg

SEQ ID NO: 710322 - DNA, 25 bp, Mus musculus
gtggcctgaggcatgaattgttcac

SEQ ID NO: 710323 - DNA, 25 bp, Mus musculus
gtggcctgaggcttgaattgttcac

SEQ ID NO: 710324 - DNA, 25 bp, Mus musculus
gtggcctgagtcatgtgcccttgga

SEQ ID NO: 710325 - DNA, 25 bp, Mus musculus
gtggcctgagtcttgtgcccttgga

SEQ ID NO: 710326 - DNA, 25 bp, Mus musculus
gtggcctgagttatgccgccaagca

SEQ ID NO: 710327 - DNA, 25 bp, Mus musculus
gtggcctgagttttgccgccaagca

SEQ ID NO: 710328 - DNA, 25 bp, Mus musculus
gtggcctgatccacggtttctccat

SEQ ID NO: 710329 - DNA, 25 bp, Mus musculus
gtggcctgatccatcctatgcagaa

SEQ ID NO: 710330 - DNA, 25 bp, Mus musculus
gtggcctgatcctcggtttctccat

SEQ ID NO: 710331 - DNA, 25 bp, Mus musculus
gtggcctgatccttcctatgcagaa

SEQ ID NO: 710332 - DNA, 25 bp, Mus musculus
gtggcctgcataatatcacctaggg

SEQ ID NO: 710333 - DNA, 25 bp, Mus musculus
gtggcctgcatattatcacctaggg

SEQ ID NO: 710334 - DNA, 25 bp, Mus musculus
gtggcctgctagacttaaactttct

SEQ ID NO: 710335 - DNA, 25 bp, Mus musculus
gtggcctgctagtcttaaactttct

SEQ ID NO: 710336 - DNA, 25 bp, Mus musculus
gtggcctgctctacaagtgttaaaa

SEQ ID NO: 710337 - DNA, 25 bp, Mus musculus
gtggcctgctcttcaagtgttaaaa

SEQ ID NO: 710338 - DNA, 25 bp, Mus musculus
gtggcctgctggactgctggaacca

SEQ ID NO: 710339 - DNA, 25 bp, Mus musculus
gtggcctgctggtctgctggaacca

SEQ ID NO: 710340 - DNA, 25 bp, Mus musculus
gtggcctgcttcagctatggttgac

SEQ ID NO: 710341 - DNA, 25 bp, Mus musculus
gtggcctgcttctgctatggttgac

SEQ ID NO: 710342 - DNA, 25 bp, Mus musculus
gtggcctggatcagggacatctcta

SEQ ID NO: 710343 - DNA, 25 bp, Mus musculus
gtggcctggatctgggacatctcta

SEQ ID NO: 710344 - DNA, 25 bp, Mus musculus
gtggcctggctaatcggaaactgtc

SEQ ID NO: 710345 - DNA, 25 bp, Mus musculus
gtggcctggctattcggaaactgtc

SEQ ID NO: 710346 - DNA, 25 bp, Mus musculus
gtggcctggctgaatggtttacatg

SEQ ID NO: 710347 - DNA, 25 bp, Mus musculus
gtggcctggctgtatggtttacatg

SEQ ID NO: 710348 - DNA, 25 bp, Mus musculus
gtggcctgggaacttatgatcctcc

SEQ ID NO: 710349 - DNA, 25 bp, Mus musculus
gtggcctgggaagttatgatcctcc

SEQ ID NO: 710350 - DNA, 25 bp, Mus musculus
gtggcctggtccattgctgccatct

SEQ ID NO: 710351 - DNA, 25 bp, Mus musculus
gtggcctggtcctttgctgccatct

SEQ ID NO: 710352 - DNA, 25 bp, Mus musculus
gtggcctgtaccaaagggactcctt

SEQ ID NO: 710353 - DNA, 25 bp, Mus musculus
gtggcctgtaccacagtgacactga

SEQ ID NO: 710354 - DNA, 25 bp, Mus musculus
gtggcctgtacctaagggactcctt

SEQ ID NO: 710355 - DNA, 25 bp, Mus musculus
gtggcctgtacctcagtgacactga

SEQ ID NO: 710356 - DNA, 25 bp, Mus musculus
gtggcctgtattattggtacttagt

SEQ ID NO: 710357 - DNA, 25 bp, Mus musculus
gtggcctgtatttttggtacttagt

SEQ ID NO: 710358 - DNA, 25 bp, Mus musculus
gtggcctgtcacaatcagtgtttca

SEQ ID NO: 710359 - DNA, 25 bp, Mus musculus
gtggcctgtcactatcagtgtttca

SEQ ID NO: 710360 - DNA, 25 bp, Mus musculus
gtggcctgtcttcacaagtactgaa

SEQ ID NO: 710361 - DNA, 25 bp, Mus musculus
gtggcctgtcttgacaagtactgaa

SEQ ID NO: 710362 - DNA, 25 bp, Mus musculus
gtggcctgtgaacaacatttaatgg

SEQ ID NO: 710363 - DNA, 25 bp, Mus musculus
gtggcctgtgaagaacatttaatgg

SEQ ID NO: 710364 - DNA, 25 bp, Mus musculus
gtggcctgtgccaatctgtggctgc

SEQ ID NO: 710365 - DNA, 25 bp, Mus musculus
gtggcctgtgcctatctgtggctgc

SEQ ID NO: 710366 - DNA, 25 bp, Mus musculus
gtggcctgtggtagaagacaatcct

SEQ ID NO: 710367 - DNA, 25 bp, Mus musculus
gtggcctgtggttgaagacaatcct

SEQ ID NO: 710368 - DNA, 25 bp, Mus musculus
gtggcctgtgtgagtcaagacaact

SEQ ID NO: 710369 - DNA, 25 bp, Mus musculus
gtggcctgtgtgtgtcaagacaact

SEQ ID NO: 710370 - DNA, 25 bp, Mus musculus
gtggcctgtgttatattcacgttct

SEQ ID NO: 710371 - DNA, 25 bp, Mus musculus
gtggcctgtgttttattcacgttct

SEQ ID NO: 710372 - DNA, 25 bp, Mus musculus
gtggccttaaacaacacctgtgctg

SEQ ID NO: 710373 - DNA, 25 bp, Mus musculus
gtggccttaaactacacctgtgctg

SEQ ID NO: 710374 - DNA, 25 bp, Mus musculus
gtggccttaactactagactggttg

SEQ ID NO: 710375 - DNA, 25 bp, Mus musculus
gtggccttaacttctagactggttg

SEQ ID NO: 710376 - DNA, 25 bp, Mus musculus
gtggccttacttaagcttcattttc

SEQ ID NO: 710377 - DNA, 25 bp, Mus musculus
gtggccttactttagcttcattttc

SEQ ID NO: 710378 - DNA, 25 bp, Mus musculus
gtggccttagcgctgtgtatctaaa

SEQ ID NO: 710379 - DNA, 25 bp, Mus musculus
gtggccttagcggtgtgtatctaaa

SEQ ID NO: 710380 - DNA, 25 bp, Mus musculus
gtggccttatgtagaacacgctaac

SEQ ID NO: 710381 - DNA, 25 bp, Mus musculus
gtggccttatgttgaacacgctaac

SEQ ID NO: 710382 - DNA, 25 bp, Mus musculus
gtggccttccaaaggatgctggcga

SEQ ID NO: 710383 - DNA, 25 bp, Mus musculus
gtggccttccaatggatgctggcga

SEQ ID NO: 710384 - DNA, 25 bp, Mus musculus
gtggccttcgataccgatatggctc

SEQ ID NO: 710385 - DNA, 25 bp, Mus musculus
gtggccttcgattccgatatggctc

SEQ ID NO: 710386 - DNA, 25 bp, Mus musculus
gtggccttcgtgatttctgtatgtg

SEQ ID NO: 710387 - DNA, 25 bp, Mus musculus
gtggccttcgtgttttctgtatgtg

SEQ ID NO: 710388 - DNA, 25 bp, Mus musculus
gtggccttctagaaagagtcattta

SEQ ID NO: 710389 - DNA, 25 bp, Mus musculus
gtggccttctagtaagagtcattta

SEQ ID NO: 710390 - DNA, 25 bp, Mus musculus
gtggccttctatatacccggagaga

SEQ ID NO: 710391 - DNA, 25 bp, Mus musculus
gtggccttctatttacccggagaga

SEQ ID NO: 710392 - DNA, 25 bp, Mus musculus
gtggccttctgaaagaggtcagtgc

SEQ ID NO: 710393 - DNA, 25 bp, Mus musculus
gtggccttctgactgccatggcctg

SEQ ID NO: 710394 - DNA, 25 bp, Mus musculus
gtggccttctgagtgccatggcctg

SEQ ID NO: 710395 - DNA, 25 bp, Mus musculus
gtggccttctgatagaggtcagtgc

SEQ ID NO: 710396 - DNA, 25 bp, Mus musculus
gtggccttctgtctctacttagaaa

SEQ ID NO: 710397 - DNA, 25 bp, Mus musculus
gtggccttctgtgtctacttagaaa

SEQ ID NO: 710398 - DNA, 25 bp, Mus musculus
gtggccttcttgagctgacattggc

SEQ ID NO: 710399 - DNA, 25 bp, Mus musculus
gtggccttcttgtgctgacattggc

SEQ ID NO: 710400 - DNA, 25 bp, Mus musculus
gtggccttgctgactcagagccaag

SEQ ID NO: 710401 - DNA, 25 bp, Mus musculus
gtggccttgctgtctcagagccaag

SEQ ID NO: 710402 - DNA, 25 bp, Mus musculus
gtggccttggccacaagcaatgtca

SEQ ID NO: 710403 - DNA, 25 bp, Mus musculus
gtggccttggcctcaagcaatgtca

SEQ ID NO: 710404 - DNA, 25 bp, Mus musculus
gtggccttgtctagaggtcctggaa

SEQ ID NO: 710405 - DNA, 25 bp, Mus musculus
gtggccttgtcttgaggtcctggaa

SEQ ID NO: 710406 - DNA, 25 bp, Mus musculus
gtggcctttaaacagcaactgcagc

SEQ ID NO: 710407 - DNA, 25 bp, Mus musculus
gtggcctttaaagagcaactgcagc

SEQ ID NO: 710408 - DNA, 25 bp, Mus musculus
gtggcctttacacctgggacatgtc

SEQ ID NO: 710409 - DNA, 25 bp, Mus musculus
gtggcctttacagctgggacatgtc

SEQ ID NO: 710410 - DNA, 25 bp, Mus musculus
gtggcctttgaaactcgggatgaag

SEQ ID NO: 710411 - DNA, 25 bp, Mus musculus
gtggcctttgaatctcgggatgaag

SEQ ID NO: 710412 - DNA, 25 bp, Mus musculus
gtggccttttccaataccctggagg

SEQ ID NO: 710413 - DNA, 25 bp, Mus musculus
gtggccttttcctataccctggagg

SEQ ID NO: 710414 - DNA, 25 bp, Mus musculus
gtggccttttgtctagactctatga

SEQ ID NO: 710415 - DNA, 25 bp, Mus musculus
gtggccttttgtctcgaatcacatc

SEQ ID NO: 710416 - DNA, 25 bp, Mus musculus
gtggccttttgtgtagactctatga

SEQ ID NO: 710417 - DNA, 25 bp, Mus musculus
gtggccttttgtgtcgaatcacatc

SEQ ID NO: 710418 - DNA, 25 bp, Mus musculus
gtggcgacctcaaatattgctcaat

SEQ ID NO: 710419 - DNA, 25 bp, Mus musculus
gtggcgacctcatatattgctcaat

SEQ ID NO: 710420 - DNA, 25 bp, Mus musculus
gtggcgacctgtctaccattggtgc

SEQ ID NO: 710421 - DNA, 25 bp, Mus musculus
gtggcgacctgtgtaccattggtgc

SEQ ID NO: 710422 - DNA, 25 bp, Mus musculus
gtggcgactattctgaccctgaaag

SEQ ID NO: 710423 - DNA, 25 bp, Mus musculus
gtggcgactattgtgaccctgaaag

SEQ ID NO: 710424 - DNA, 25 bp, Mus musculus
gtggcgactgccctggaacagatct

SEQ ID NO: 710425 - DNA, 25 bp, Mus musculus
gtggcgactgccgtggaacagatct

SEQ ID NO: 710426 - DNA, 25 bp, Mus musculus
gtggcgaggaaacttcttgcccaaa

SEQ ID NO: 710427 - DNA, 25 bp, Mus musculus
gtggcgaggaaagttcttgcccaaa

SEQ ID NO: 710428 - DNA, 25 bp, Mus musculus
gtggcgaggccaaacctggtaatgt

SEQ ID NO: 710429 - DNA, 25 bp, Mus musculus
gtggcgaggccatacctggtaatgt

SEQ ID NO: 710430 - DNA, 25 bp, Mus musculus
gtggcgatcaagaactactgttggc

SEQ ID NO: 710431 - DNA, 25 bp, Mus musculus
gtggcgatcaagtactactgttggc

SEQ ID NO: 710432 - DNA, 25 bp, Mus musculus
gtggcgatccaactatacaacgtct

SEQ ID NO: 710433 - DNA, 25 bp, Mus musculus
gtggcgatccaagtatacaacgtct

SEQ ID NO: 710434 - DNA, 25 bp, Mus musculus
gtggcgattaggactgccagtgtca

SEQ ID NO: 710435 - DNA, 25 bp, Mus musculus
gtggcgattaggtctgccagtgtca

SEQ ID NO: 710436 - DNA, 25 bp, Mus musculus
gtggcgcagtgtaaatatgccaggt

SEQ ID NO: 710437 - DNA, 25 bp, Mus musculus
gtggcgcagtgttaatatgccaggt

SEQ ID NO: 710438 - DNA, 25 bp, Mus musculus
gtggcgcataaaagcctgctggctc

SEQ ID NO: 710439 - DNA, 25 bp, Mus musculus
gtggcgcataaatgcctgctggctc

SEQ ID NO: 710440 - DNA, 25 bp, Mus musculus
gtggcgccaacacattccaggcata

SEQ ID NO: 710441 - DNA, 25 bp, Mus musculus
gtggcgccaacagattccaggcata

SEQ ID NO: 710442 - DNA, 25 bp, Mus musculus
gtggcgccagtgatgaacaacgaca

SEQ ID NO: 710443 - DNA, 25 bp, Mus musculus
gtggcgccagtgttgaacaacgaca

SEQ ID NO: 710444 - DNA, 25 bp, Mus musculus
gtggcgctcaaacagtttcgttctg

SEQ ID NO: 710445 - DNA, 25 bp, Mus musculus
gtggcgctcaaagagtttcgttctg

SEQ ID NO: 710446 - DNA, 25 bp, Mus musculus
gtggcgctctgacgcaaaaagttgt

SEQ ID NO: 710447 - DNA, 25 bp, Mus musculus
gtggcgctctgaggcaaaaagttgt

SEQ ID NO: 710448 - DNA, 25 bp, Mus musculus
gtggcgctgcccaaagacagactaa

SEQ ID NO: 710449 - DNA, 25 bp, Mus musculus
gtggcgctgccctaagacagactaa

SEQ ID NO: 710450 - DNA, 25 bp, Mus musculus
gtggcgctggccaatgaaatgctgt

SEQ ID NO: 710451 - DNA, 25 bp, Mus musculus
gtggcgctggcctatgaaatgctgt

SEQ ID NO: 710452 - DNA, 25 bp, Mus musculus
gtggcgctggtcactccagtaaatc

SEQ ID NO: 710453 - DNA, 25 bp, Mus musculus
gtggcgctggtctctccagtaaatc

SEQ ID NO: 710454 - DNA, 25 bp, Mus musculus
gtggcgctgtgcagtatgagcatta

SEQ ID NO: 710455 - DNA, 25 bp, Mus musculus
gtggcgctgtgctgtatgagcatta

SEQ ID NO: 710456 - DNA, 25 bp, Mus musculus
gtggcgctgtttatggaaccttcgg

SEQ ID NO: 710457 - DNA, 25 bp, Mus musculus
gtggcgctgtttttggaaccttcgg

SEQ ID NO: 710458 - DNA, 25 bp, Mus musculus
gtggcgcttaggctaactgcagctt

SEQ ID NO: 710459 - DNA, 25 bp, Mus musculus
gtggcgcttagggtaactgcagctt

SEQ ID NO: 710460 - DNA, 25 bp, Mus musculus
gtggcgctttcacaacccaaagatt

SEQ ID NO: 710461 - DNA, 25 bp, Mus musculus
gtggcgctttcagaacccaaagatt

SEQ ID NO: 710462 - DNA, 25 bp, Mus musculus
gtggcggaagaacctcacgctacga

SEQ ID NO: 710463 - DNA, 25 bp, Mus musculus
gtggcggaagaagctcacgctacga

SEQ ID NO: 710464 - DNA, 25 bp, Mus musculus
gtggcggcagaaactcagcccaatt

SEQ ID NO: 710465 - DNA, 25 bp, Mus musculus
gtggcggcagaatctcagcccaatt

SEQ ID NO: 710466 - DNA, 25 bp, Mus musculus
gtggcggcagcgacacccatagatt

SEQ ID NO: 710467 - DNA, 25 bp, Mus musculus
gtggcggcagcgtcacccatagatt

SEQ ID NO: 710468 - DNA, 25 bp, Mus musculus
gtggcggccgtgaaccagattgcct

SEQ ID NO: 710469 - DNA, 25 bp, Mus musculus
gtggcggccgtgtaccagattgcct

SEQ ID NO: 710470 - DNA, 25 bp, Mus musculus
gtggcggctcttcccttaggtctta

SEQ ID NO: 710471 - DNA, 25 bp, Mus musculus
gtggcggctcttgccttaggtctta

SEQ ID NO: 710472 - DNA, 25 bp, Mus musculus
gtggcggctttcattttgtctgtta

SEQ ID NO: 710473 - DNA, 25 bp, Mus musculus
gtggcggctttctttttgtctgtta

SEQ ID NO: 710474 - DNA, 25 bp, Mus musculus
gtggcgggctttaacgtagctcgaa

SEQ ID NO: 710475 - DNA, 25 bp, Mus musculus
gtggcgggcttttacgtagctcgaa

SEQ ID NO: 710476 - DNA, 25 bp, Mus musculus
gtggcgggtgaacctgcctgacctc

SEQ ID NO: 710477 - DNA, 25 bp, Mus musculus
gtggcgggtgaagctgcctgacctc

SEQ ID NO: 710478 - DNA, 25 bp, Mus musculus
gtggcggtattaagttgctttttca

SEQ ID NO: 710479 - DNA, 25 bp, Mus musculus
gtggcggtattatgttgctttttca

SEQ ID NO: 710480 - DNA, 25 bp, Mus musculus
gtggcggtgttacctggcttaccca

SEQ ID NO: 710481 - DNA, 25 bp, Mus musculus
gtggcggtgttagctggcttaccca

SEQ ID NO: 710482 - DNA, 25 bp, Mus musculus
gtggcgtaaacactacactcactga

SEQ ID NO: 710483 - DNA, 25 bp, Mus musculus
gtggcgtaaacagtacactcactga

SEQ ID NO: 710484 - DNA, 25 bp, Mus musculus
gtggcgtactaactaggtcaacctg

SEQ ID NO: 710485 - DNA, 25 bp, Mus musculus
gtggcgtactaagtaggtcaacctg

SEQ ID NO: 710486 - DNA, 25 bp, Mus musculus
gtggcgtagaccacgaccaactgct

SEQ ID NO: 710487 - DNA, 25 bp, Mus musculus
gtggcgtagacctcgaccaactgct

SEQ ID NO: 710488 - DNA, 25 bp, Mus musculus
gtggcgtcacttacgagctctttaa

SEQ ID NO: 710489 - DNA, 25 bp, Mus musculus
gtggcgtcactttcgagctctttaa

SEQ ID NO: 710490 - DNA, 25 bp, Mus musculus
gtggcgtcagacagtcatctactaa

SEQ ID NO: 710491 - DNA, 25 bp, Mus musculus
gtggcgtcagactgtcatctactaa

SEQ ID NO: 710492 - DNA, 25 bp, Mus musculus
gtggcgtccgtacctctgcaagaag

SEQ ID NO: 710493 - DNA, 25 bp, Mus musculus
gtggcgtccgtagctctgcaagaag

SEQ ID NO: 710494 - DNA, 25 bp, Mus musculus
gtggcgtctcagattatattctcag

SEQ ID NO: 710495 - DNA, 25 bp, Mus musculus
gtggcgtctcagtttatattctcag

SEQ ID NO: 710496 - DNA, 25 bp, Mus musculus
gtggcgtctgtacagtttctttctc

SEQ ID NO: 710497 - DNA, 25 bp, Mus musculus
gtggcgtctgtagagtttctttctc

SEQ ID NO: 710498 - DNA, 25 bp, Mus musculus
gtggcgtctgtgaccaccagtgctt

SEQ ID NO: 710499 - DNA, 25 bp, Mus musculus
gtggcgtctgtgtccaccagtgctt

SEQ ID NO: 710500 - DNA, 25 bp, Mus musculus
gtggcgtcttaacactactggtaga

SEQ ID NO: 710501 - DNA, 25 bp, Mus musculus
gtggcgtcttaagactactggtaga

SEQ ID NO: 710502 - DNA, 25 bp, Mus musculus
gtggcgtgctaacctagtatgtgag

SEQ ID NO: 710503 - DNA, 25 bp, Mus musculus
gtggcgtgctaagctagtatgtgag

SEQ ID NO: 710504 - DNA, 25 bp, Mus musculus
gtggcgtggctcctggtccaaacct

SEQ ID NO: 710505 - DNA, 25 bp, Mus musculus
gtggcgtggctcgtggtccaaacct

SEQ ID NO: 710506 - DNA, 25 bp, Mus musculus
gtggcgtggcttaatttgcttaaat

SEQ ID NO: 710507 - DNA, 25 bp, Mus musculus
gtggcgtggctttatttgcttaaat

SEQ ID NO: 710508 - DNA, 25 bp, Mus musculus
gtggcgtgtggactgtcatctcttc

SEQ ID NO: 710509 - DNA, 25 bp, Mus musculus
gtggcgtgtggagtgtcatctcttc

SEQ ID NO: 710510 - DNA, 25 bp, Mus musculus
gtggcgttcaatatcttccgaaaat

SEQ ID NO: 710511 - DNA, 25 bp, Mus musculus
gtggcgttcaatttcttccgaaaat

SEQ ID NO: 710512 - DNA, 25 bp, Mus musculus
gtggcgttctaaccttaccgtgaaa

SEQ ID NO: 710513 - DNA, 25 bp, Mus musculus
gtggcgttctaagcttaccgtgaaa

SEQ ID NO: 710514 - DNA, 25 bp, Mus musculus
gtggcgttgacaacactgaaacgga

SEQ ID NO: 710515 - DNA, 25 bp, Mus musculus
gtggcgttgacatcactgaaacgga

SEQ ID NO: 710516 - DNA, 25 bp, Mus musculus
gtggctaaaagtatgcaggcagatc

SEQ ID NO: 710517 - DNA, 25 bp, Mus musculus
gtggctaaaagtttgcaggcagatc

SEQ ID NO: 710518 - DNA, 25 bp, Mus musculus
gtggctaaaattcctgcaggccctt

SEQ ID NO: 710519 - DNA, 25 bp, Mus musculus
gtggctaaaattgctgcaggccctt

SEQ ID NO: 710520 - DNA, 25 bp, Mus musculus
gtggctaaacagatcatcacatgaa

SEQ ID NO: 710521 - DNA, 25 bp, Mus musculus
gtggctaaacagttcatcacatgaa

SEQ ID NO: 710522 - DNA, 25 bp, Mus musculus
gtggctaaacggcacatttcaaaca

SEQ ID NO: 710523 - DNA, 25 bp, Mus musculus
gtggctaaacgggacatttcaaaca

SEQ ID NO: 710524 - DNA, 25 bp, Mus musculus
gtggctaaagctaagtctattttga

SEQ ID NO: 710525 - DNA, 25 bp, Mus musculus
gtggctaaagcttagtctattttga

SEQ ID NO: 710526 - DNA, 25 bp, Mus musculus
gtggctaaatgacactgggaccatt

SEQ ID NO: 710527 - DNA, 25 bp, Mus musculus
gtggctaaatgagactgggaccatt

SEQ ID NO: 710528 - DNA, 25 bp, Mus musculus
gtggctaaattcaacacaaattgtt

SEQ ID NO: 710529 - DNA, 25 bp, Mus musculus
gtggctaaattctacacaaattgtt

SEQ ID NO: 710530 - DNA, 25 bp, Mus musculus
gtggctaacactacatggaccctgg

SEQ ID NO: 710531 - DNA, 25 bp, Mus musculus
gtggctaacacttcatggaccctgg

SEQ ID NO: 710532 - DNA, 25 bp, Mus musculus
gtggctaacatccaaacaattgttt

SEQ ID NO: 710533 - DNA, 25 bp, Mus musculus
gtggctaacatcgaaacaattgttt

SEQ ID NO: 710534 - DNA, 25 bp, Mus musculus
gtggctaacccaagccagttcaaaa

SEQ ID NO: 710535 - DNA, 25 bp, Mus musculus
gtggctaacccacaagacatcatct

SEQ ID NO: 710536 - DNA, 25 bp, Mus musculus
gtggctaacccagaagacatcatct

SEQ ID NO: 710537 - DNA, 25 bp, Mus musculus
gtggctaacccatgccagttcaaaa

SEQ ID NO: 710538 - DNA, 25 bp, Mus musculus
gtggctaagaaaacttctgggcctg

SEQ ID NO: 710539 - DNA, 25 bp, Mus musculus
gtggctaagaaatcttctgggcctg

SEQ ID NO: 710540 - DNA, 25 bp, Mus musculus
gtggctaagagcatgaaccattctt

SEQ ID NO: 710541 - DNA, 25 bp, Mus musculus
gtggctaagagcttgaaccattctt

SEQ ID NO: 710542 - DNA, 25 bp, Mus musculus
gtggctaagcatacttagactaact

SEQ ID NO: 710543 - DNA, 25 bp, Mus musculus
gtggctaagcattcttagactaact

SEQ ID NO: 710544 - DNA, 25 bp, Mus musculus
gtggctaataatcttggaaatatct

SEQ ID NO: 710545 - DNA, 25 bp, Mus musculus
gtggctaataatgttggaaatatct

SEQ ID NO: 710546 - DNA, 25 bp, Mus musculus
gtggctaatactacattccttttgt

SEQ ID NO: 710547 - DNA, 25 bp, Mus musculus
gtggctaatactaggcgcacgatcc

SEQ ID NO: 710548 - DNA, 25 bp, Mus musculus
gtggctaatactatttctgaggcta

SEQ ID NO: 710549 - DNA, 25 bp, Mus musculus
gtggctaatacttcattccttttgt

SEQ ID NO: 710550 - DNA, 25 bp, Mus musculus
gtggctaatacttggcgcacgatcc

SEQ ID NO: 710551 - DNA, 25 bp, Mus musculus
gtggctaatactttttctgaggcta

SEQ ID NO: 710552 - DNA, 25 bp, Mus musculus
gtggctaataggactcactgagtgt

SEQ ID NO: 710553 - DNA, 25 bp, Mus musculus
gtggctaataggtctcactgagtgt

SEQ ID NO: 710554 - DNA, 25 bp, Mus musculus
gtggctaatctccttaaatctgcat

SEQ ID NO: 710555 - DNA, 25 bp, Mus musculus
gtggctaatctcgttaaatctgcat

SEQ ID NO: 710556 - DNA, 25 bp, Mus musculus
gtggctacaacactgcccagttatg

SEQ ID NO: 710557 - DNA, 25 bp, Mus musculus
gtggctacaacagtgcccagttatg

SEQ ID NO: 710558 - DNA, 25 bp, Mus musculus
gtggctacaagacgcctgtgcaata

SEQ ID NO: 710559 - DNA, 25 bp, Mus musculus
gtggctacaagaggcctgtgcaata

SEQ ID NO: 710560 - DNA, 25 bp, Mus musculus
gtggctacacatctacttgatggac

SEQ ID NO: 710561 - DNA, 25 bp, Mus musculus
gtggctacacatgtacttgatggac

SEQ ID NO: 710562 - DNA, 25 bp, Mus musculus
gtggctacactgcagtctagacact

SEQ ID NO: 710563 - DNA, 25 bp, Mus musculus
gtggctacactggagtctagacact

SEQ ID NO: 710564 - DNA, 25 bp, Mus musculus
gtggctacagacactgctctgtaca

SEQ ID NO: 710565 - DNA, 25 bp, Mus musculus
gtggctacagactctgctctgtaca

SEQ ID NO: 710566 - DNA, 25 bp, Mus musculus
gtggctacagttcctagcttgctaa

SEQ ID NO: 710567 - DNA, 25 bp, Mus musculus
gtggctacagttcgaaccaggagtt

SEQ ID NO: 710568 - DNA, 25 bp, Mus musculus
gtggctacagttgctagcttgctaa

SEQ ID NO: 710569 - DNA, 25 bp, Mus musculus
gtggctacagttggaaccaggagtt

SEQ ID NO: 710570 - DNA, 25 bp, Mus musculus
gtggctaccggcatcatcttcaagt

SEQ ID NO: 710571 - DNA, 25 bp, Mus musculus
gtggctaccggcttcatcttcaagt

SEQ ID NO: 710572 - DNA, 25 bp, Mus musculus
gtggctacgtttaaggctgtggaac

SEQ ID NO: 710573 - DNA, 25 bp, Mus musculus
gtggctacgtttacttggtgcagtt

SEQ ID NO: 710574 - DNA, 25 bp, Mus musculus
gtggctacgttttaggctgtggaac

SEQ ID NO: 710575 - DNA, 25 bp, Mus musculus
gtggctacgttttcttggtgcagtt

SEQ ID NO: 710576 - DNA, 25 bp, Mus musculus
gtggctactaccactgcaaggtcag

SEQ ID NO: 710577 - DNA, 25 bp, Mus musculus
gtggctactacctctgcaaggtcag

SEQ ID NO: 710578 - DNA, 25 bp, Mus musculus
gtggctactattctcccttataaat

SEQ ID NO: 710579 - DNA, 25 bp, Mus musculus
gtggctactattgtcccttataaat

SEQ ID NO: 710580 - DNA, 25 bp, Mus musculus
gtggctactgtgacttatgatctgc

SEQ ID NO: 710581 - DNA, 25 bp, Mus musculus
gtggctactgtgtcttatgatctgc

SEQ ID NO: 710582 - DNA, 25 bp, Mus musculus
gtggctacttcacggactcgtgcaa

SEQ ID NO: 710583 - DNA, 25 bp, Mus musculus
gtggctacttcagggactcgtgcaa

SEQ ID NO: 710584 - DNA, 25 bp, Mus musculus
gtggctagaattctccagataggtt

SEQ ID NO: 710585 - DNA, 25 bp, Mus musculus
gtggctagaattgtccagataggtt

SEQ ID NO: 710586 - DNA, 25 bp, Mus musculus
gtggctagacaaatagaacacattt

SEQ ID NO: 710587 - DNA, 25 bp, Mus musculus
gtggctagacaattagaacacattt

SEQ ID NO: 710588 - DNA, 25 bp, Mus musculus
gtggctagactgagacagacccatt

SEQ ID NO: 710589 - DNA, 25 bp, Mus musculus
gtggctagactgtgacagacccatt

SEQ ID NO: 710590 - DNA, 25 bp, Mus musculus
gtggctagcagaaaccatcacactt

SEQ ID NO: 710591 - DNA, 25 bp, Mus musculus
gtggctagcagataccatcacactt

SEQ ID NO: 710592 - DNA, 25 bp, Mus musculus
gtggctagccctaaacggagatcca

SEQ ID NO: 710593 - DNA, 25 bp, Mus musculus
gtggctagccctactggaagctaag

SEQ ID NO: 710594 - DNA, 25 bp, Mus musculus
gtggctagcccttaacggagatcca

SEQ ID NO: 710595 - DNA, 25 bp, Mus musculus
gtggctagcccttctggaagctaag

SEQ ID NO: 710596 - DNA, 25 bp, Mus musculus
gtggctagtctaatctgatatgtgc

SEQ ID NO: 710597 - DNA, 25 bp, Mus musculus
gtggctagtctattctgatatgtgc

SEQ ID NO: 710598 - DNA, 25 bp, Mus musculus
gtggctagtctgagacgtccgtggt

SEQ ID NO: 710599 - DNA, 25 bp, Mus musculus
gtggctagtctgtgacgtccgtggt

SEQ ID NO: 710600 - DNA, 25 bp, Mus musculus
gtggctataactcgatccatccagt

SEQ ID NO: 710601 - DNA, 25 bp, Mus musculus
gtggctataactggatccatccagt

SEQ ID NO: 710602 - DNA, 25 bp, Mus musculus
gtggctataaggattccgaagctga

SEQ ID NO: 710603 - DNA, 25 bp, Mus musculus
gtggctataaggtttccgaagctga

SEQ ID NO: 710604 - DNA, 25 bp, Mus musculus
gtggctatagagaccttgaccataa

SEQ ID NO: 710605 - DNA, 25 bp, Mus musculus
gtggctatagagtccttgaccataa

SEQ ID NO: 710606 - DNA, 25 bp, Mus musculus
gtggctatatccagccttatttaga

SEQ ID NO: 710607 - DNA, 25 bp, Mus musculus
gtggctatatcctgccttatttaga

SEQ ID NO: 710608 - DNA, 25 bp, Mus musculus
gtggctatcagcatgtctatcatct

SEQ ID NO: 710609 - DNA, 25 bp, Mus musculus
gtggctatcagcttgtctatcatct

SEQ ID NO: 710610 - DNA, 25 bp, Mus musculus
gtggctatcatcactggtggacaag

SEQ ID NO: 710611 - DNA, 25 bp, Mus musculus
gtggctatcatctctggtggacaag

SEQ ID NO: 710612 - DNA, 25 bp, Mus musculus
gtggctatccttatgttaagtgcag

SEQ ID NO: 710613 - DNA, 25 bp, Mus musculus
gtggctatccttttgttaagtgcag

SEQ ID NO: 710614 - DNA, 25 bp, Mus musculus
gtggctatctaccattttgaaggat

SEQ ID NO: 710615 - DNA, 25 bp, Mus musculus
gtggctatctacgattttgaaggat

SEQ ID NO: 710616 - DNA, 25 bp, Mus musculus
gtggctatgacacttccatttctaa

SEQ ID NO: 710617 - DNA, 25 bp, Mus musculus
gtggctatgacagttccatttctaa

SEQ ID NO: 710618 - DNA, 25 bp, Mus musculus
gtggctatgcttataatttcagctc

SEQ ID NO: 710619 - DNA, 25 bp, Mus musculus
gtggctatgcttttaatttcagctc

SEQ ID NO: 710620 - DNA, 25 bp, Mus musculus
gtggctatggccaccaacctaggtg

SEQ ID NO: 710621 - DNA, 25 bp, Mus musculus
gtggctatggcctccaacctaggtg

SEQ ID NO: 710622 - DNA, 25 bp, Mus musculus
gtggctatggttcaagatcgactcg

SEQ ID NO: 710623 - DNA, 25 bp, Mus musculus
gtggctatggttgaagatcgactcg

SEQ ID NO: 710624 - DNA, 25 bp, Mus musculus
gtggctatgtcaaagtatggctcct

SEQ ID NO: 710625 - DNA, 25 bp, Mus musculus
gtggctatgtcatagtatggctcct

SEQ ID NO: 710626 - DNA, 25 bp, Mus musculus
gtggctatgtgtccacttacagtaa

SEQ ID NO: 710627 - DNA, 25 bp, Mus musculus
gtggctatgtgtgcacttacagtaa

SEQ ID NO: 710628 - DNA, 25 bp, Mus musculus
gtggctattaacatggtgaccgaag

SEQ ID NO: 710629 - DNA, 25 bp, Mus musculus
gtggctattaacttggtgaccgaag

SEQ ID NO: 710630 - DNA, 25 bp, Mus musculus
gtggctattccacatctattacagt

SEQ ID NO: 710631 - DNA, 25 bp, Mus musculus
gtggctattccagatctattacagt

SEQ ID NO: 710632 - DNA, 25 bp, Mus musculus
gtggctattctacaccttggttgat

SEQ ID NO: 710633 - DNA, 25 bp, Mus musculus
gtggctattctagaccttggttgat

SEQ ID NO: 710634 - DNA, 25 bp, Mus musculus
gtggctattctgaattgaaccattc

SEQ ID NO: 710635 - DNA, 25 bp, Mus musculus
gtggctattctgtattgaaccattc

SEQ ID NO: 710636 - DNA, 25 bp, Mus musculus
gtggctattgagcaccggaatgaaa

SEQ ID NO: 710637 - DNA, 25 bp, Mus musculus
gtggctattgaggaccggaatgaaa

SEQ ID NO: 710638 - DNA, 25 bp, Mus musculus
gtggctatttgcagtctagggctgc

SEQ ID NO: 710639 - DNA, 25 bp, Mus musculus
gtggctatttgctgtctagggctgc

SEQ ID NO: 710640 - DNA, 25 bp, Mus musculus
gtggctatttgtaaacctttgcagt

SEQ ID NO: 710641 - DNA, 25 bp, Mus musculus
gtggctatttgtattagaggcaagt

SEQ ID NO: 710642 - DNA, 25 bp, Mus musculus
gtggctatttgttaacctttgcagt

SEQ ID NO: 710643 - DNA, 25 bp, Mus musculus
gtggctatttgttttagaggcaagt

SEQ ID NO: 710644 - DNA, 25 bp, Mus musculus
gtggctcaaagcagggatctgtaca

SEQ ID NO: 710645 - DNA, 25 bp, Mus musculus
gtggctcaaagctgggatctgtaca

SEQ ID NO: 710646 - DNA, 25 bp, Mus musculus
gtggctcaacaacaatgtcctcaat

SEQ ID NO: 710647 - DNA, 25 bp, Mus musculus
gtggctcaacaagaatgtcctcaat

SEQ ID NO: 710648 - DNA, 25 bp, Mus musculus
gtggctcaagccaagcagtggcacc

SEQ ID NO: 710649 - DNA, 25 bp, Mus musculus
gtggctcaagcctagcagtggcacc

SEQ ID NO: 710650 - DNA, 25 bp, Mus musculus
gtggctcaagggacatgtatagttt

SEQ ID NO: 710651 - DNA, 25 bp, Mus musculus
gtggctcaagggtcatgtatagttt

SEQ ID NO: 710652 - DNA, 25 bp, Mus musculus
gtggctcaatatataaagctttgtc

SEQ ID NO: 710653 - DNA, 25 bp, Mus musculus
gtggctcaatatttaaagctttgtc

SEQ ID NO: 710654 - DNA, 25 bp, Mus musculus
gtggctcaattgacaggatgcttgc

SEQ ID NO: 710655 - DNA, 25 bp, Mus musculus
gtggctcaattgtcaggatgcttgc

SEQ ID NO: 710656 - DNA, 25 bp, Mus musculus
gtggctcacaccaaaagtctcaaaa

SEQ ID NO: 710657 - DNA, 25 bp, Mus musculus
gtggctcacacctaaagtctcaaaa

SEQ ID NO: 710658 - DNA, 25 bp, Mus musculus
gtggctcacatcaggaattccaatt

SEQ ID NO: 710659 - DNA, 25 bp, Mus musculus
gtggctcacatctggaattccaatt

SEQ ID NO: 710660 - DNA, 25 bp, Mus musculus
gtggctcacgaaatccaggaactgt

SEQ ID NO: 710661 - DNA, 25 bp, Mus musculus
gtggctcacgaacgtgtcaggactt

SEQ ID NO: 710662 - DNA, 25 bp, Mus musculus
gtggctcacgaaggtgtcaggactt

SEQ ID NO: 710663 - DNA, 25 bp, Mus musculus
gtggctcacgaattccaggaactgt

SEQ ID NO: 710664 - DNA, 25 bp, Mus musculus
gtggctcactgcctgggatctttac

SEQ ID NO: 710665 - DNA, 25 bp, Mus musculus
gtggctcactgcgtgggatctttac

SEQ ID NO: 710666 - DNA, 25 bp, Mus musculus
gtggctcactggcaacctgtcatgg

SEQ ID NO: 710667 - DNA, 25 bp, Mus musculus
gtggctcactgggaacctgtcatgg

SEQ ID NO: 710668 - DNA, 25 bp, Mus musculus
gtggctcagagcacggcagatctga

SEQ ID NO: 710669 - DNA, 25 bp, Mus musculus
gtggctcagagcagtgccacacacc

SEQ ID NO: 710670 - DNA, 25 bp, Mus musculus
gtggctcagagctcggcagatctga

SEQ ID NO: 710671 - DNA, 25 bp, Mus musculus
gtggctcagagctgtgccacacacc

SEQ ID NO: 710672 - DNA, 25 bp, Mus musculus
gtggctcagaggcactaatgcacaa

SEQ ID NO: 710673 - DNA, 25 bp, Mus musculus
gtggctcagagggactaatgcacaa

SEQ ID NO: 710674 - DNA, 25 bp, Mus musculus
gtggctcagatacatactagggttg

SEQ ID NO: 710675 - DNA, 25 bp, Mus musculus
gtggctcagatagatactagggttg

SEQ ID NO: 710676 - DNA, 25 bp, Mus musculus
gtggctcagccactatgttatgtct

SEQ ID NO: 710677 - DNA, 25 bp, Mus musculus
gtggctcagccagtatgttatgtct

SEQ ID NO: 710678 - DNA, 25 bp, Mus musculus
gtggctcaggagcagaccctaagta

SEQ ID NO: 710679 - DNA, 25 bp, Mus musculus
gtggctcaggaggagaccctaagta

SEQ ID NO: 710680 - DNA, 25 bp, Mus musculus
gtggctcaggcaagcgctgctaccc

SEQ ID NO: 710681 - DNA, 25 bp, Mus musculus
gtggctcaggcatgcgctgctaccc

SEQ ID NO: 710682 - DNA, 25 bp, Mus musculus
gtggctcaggcgacaagaatacttc

SEQ ID NO: 710683 - DNA, 25 bp, Mus musculus
gtggctcaggcgtcaagaatacttc

SEQ ID NO: 710684 - DNA, 25 bp, Mus musculus
gtggctcagggacatattgcctcaa

SEQ ID NO: 710685 - DNA, 25 bp, Mus musculus
gtggctcagggagatattgcctcaa

SEQ ID NO: 710686 - DNA, 25 bp, Mus musculus
gtggctcaggttcactacataaata

SEQ ID NO: 710687 - DNA, 25 bp, Mus musculus
gtggctcaggttgactacataaata

SEQ ID NO: 710688 - DNA, 25 bp, Mus musculus
gtggctcagtcacatccacttgtga

SEQ ID NO: 710689 - DNA, 25 bp, Mus musculus
gtggctcagtcagatccacttgtga

SEQ ID NO: 710690 - DNA, 25 bp, Mus musculus
gtggctcagtggaccggagttcaat

SEQ ID NO: 710691 - DNA, 25 bp, Mus musculus
gtggctcagtggtccggagttcaat

SEQ ID NO: 710692 - DNA, 25 bp, Mus musculus
gtggctcagttcaatgacaacaacc

SEQ ID NO: 710693 - DNA, 25 bp, Mus musculus
gtggctcagttctatgacaacaacc

SEQ ID NO: 710694 - DNA, 25 bp, Mus musculus
gtggctcataatcgatcccctgaag

SEQ ID NO: 710695 - DNA, 25 bp, Mus musculus
gtggctcataatggatcccctgaag

SEQ ID NO: 710696 - DNA, 25 bp, Mus musculus
gtggctcatacacttgtgagcatga

SEQ ID NO: 710697 - DNA, 25 bp, Mus musculus
gtggctcatacagttgtgagcatga

SEQ ID NO: 710698 - DNA, 25 bp, Mus musculus
gtggctcatagtagacactgaacca

SEQ ID NO: 710699 - DNA, 25 bp, Mus musculus
gtggctcatagttgacactgaacca

SEQ ID NO: 710700 - DNA, 25 bp, Mus musculus
gtggctcatatgactggacttcctg

SEQ ID NO: 710701 - DNA, 25 bp, Mus musculus
gtggctcatatgtctggacttcctg

SEQ ID NO: 710702 - DNA, 25 bp, Mus musculus
gtggctcatcaccaggttttcagag

SEQ ID NO: 710703 - DNA, 25 bp, Mus musculus
gtggctcatcacgaggttttcagag

SEQ ID NO: 710704 - DNA, 25 bp, Mus musculus
gtggctcatccaaagtgattcccta

SEQ ID NO: 710705 - DNA, 25 bp, Mus musculus
gtggctcatccatagtgattcccta

SEQ ID NO: 710706 - DNA, 25 bp, Mus musculus
gtggctcatcgaatttggcaagacc

SEQ ID NO: 710707 - DNA, 25 bp, Mus musculus
gtggctcatcgattttggcaagacc

SEQ ID NO: 710708 - DNA, 25 bp, Mus musculus
gtggctcatgccactttattcctag

SEQ ID NO: 710709 - DNA, 25 bp, Mus musculus
gtggctcatgcctctttattcctag

SEQ ID NO: 710710 - DNA, 25 bp, Mus musculus
gtggctcatggtcctttcaataaat

SEQ ID NO: 710711 - DNA, 25 bp, Mus musculus
gtggctcatggtctcaaaacaggtc

SEQ ID NO: 710712 - DNA, 25 bp, Mus musculus
gtggctcatggtgctttcaataaat

SEQ ID NO: 710713 - DNA, 25 bp, Mus musculus
gtggctcatggtgtcaaaacaggtc

SEQ ID NO: 710714 - DNA, 25 bp, Mus musculus
gtggctccaacccaagtggcagcga

SEQ ID NO: 710715 - DNA, 25 bp, Mus musculus
gtggctccaaccgaagtggcagcga

SEQ ID NO: 710716 - DNA, 25 bp, Mus musculus
gtggctccacaaaggattaggccct

SEQ ID NO: 710717 - DNA, 25 bp, Mus musculus
gtggctccacaatggattaggccct

SEQ ID NO: 710718 - DNA, 25 bp, Mus musculus
gtggctccaccgaatgaaccagaga

SEQ ID NO: 710719 - DNA, 25 bp, Mus musculus
gtggctccaccgtatgaaccagaga

SEQ ID NO: 710720 - DNA, 25 bp, Mus musculus
gtggctccagagacaatggcatcaa

SEQ ID NO: 710721 - DNA, 25 bp, Mus musculus
gtggctccagagtcaatggcatcaa

SEQ ID NO: 710722 - DNA, 25 bp, Mus musculus
gtggctccatggcacagtcaccgag

SEQ ID NO: 710723 - DNA, 25 bp, Mus musculus
gtggctccatgggacagtcaccgag

SEQ ID NO: 710724 - DNA, 25 bp, Mus musculus
gtggctcccaagagtgagttgttca

SEQ ID NO: 710725 - DNA, 25 bp, Mus musculus
gtggctcccaagtgtgagttgttca

SEQ ID NO: 710726 - DNA, 25 bp, Mus musculus
gtggctcccaggattggcagaacat

SEQ ID NO: 710727 - DNA, 25 bp, Mus musculus
gtggctcccaggtttggcagaacat

SEQ ID NO: 710728 - DNA, 25 bp, Mus musculus
gtggctccctagactcagtatctca

SEQ ID NO: 710729 - DNA, 25 bp, Mus musculus
gtggctccctagtctcagtatctca

SEQ ID NO: 710730 - DNA, 25 bp, Mus musculus
gtggctccctcaagcagcaaagcgg

SEQ ID NO: 710731 - DNA, 25 bp, Mus musculus
gtggctccctcatgcagcaaagcgg

SEQ ID NO: 710732 - DNA, 25 bp, Mus musculus
gtggctcccttaattggcagtatcc

SEQ ID NO: 710733 - DNA, 25 bp, Mus musculus
gtggctcccttatttggcagtatcc

SEQ ID NO: 710734 - DNA, 25 bp, Mus musculus
gtggctcccttgaacacagtgcaga

SEQ ID NO: 710735 - DNA, 25 bp, Mus musculus
gtggctcccttgtacacagtgcaga

SEQ ID NO: 710736 - DNA, 25 bp, Mus musculus
gtggctccgaggagacgttcagcta

SEQ ID NO: 710737 - DNA, 25 bp, Mus musculus
gtggctccgaggtgacgttcagcta

SEQ ID NO: 710738 - DNA, 25 bp, Mus musculus
gtggctccgttacactatgtggatt

SEQ ID NO: 710739 - DNA, 25 bp, Mus musculus
gtggctccgttagactatgtggatt

SEQ ID NO: 710740 - DNA, 25 bp, Mus musculus
gtggctcctacaagccccaagagga

SEQ ID NO: 710741 - DNA, 25 bp, Mus musculus
gtggctcctacactgactgactgtg

SEQ ID NO: 710742 - DNA, 25 bp, Mus musculus
gtggctcctacagtgactgactgtg

SEQ ID NO: 710743 - DNA, 25 bp, Mus musculus
gtggctcctacatgccccaagagga

SEQ ID NO: 710744 - DNA, 25 bp, Mus musculus
gtggctcctcacataggtttacctg

SEQ ID NO: 710745 - DNA, 25 bp, Mus musculus
gtggctcctcacttaggtttacctg

SEQ ID NO: 710746 - DNA, 25 bp, Mus musculus
gtggctcctctgatcaggtctaaag

SEQ ID NO: 710747 - DNA, 25 bp, Mus musculus
gtggctcctctgttcaggtctaaag

SEQ ID NO: 710748 - DNA, 25 bp, Mus musculus
gtggctcctggccacagtatgatcg

SEQ ID NO: 710749 - DNA, 25 bp, Mus musculus
gtggctcctggcgacagtatgatcg

SEQ ID NO: 710750 - DNA, 25 bp, Mus musculus
gtggctcctgtgatttcatgctgca

SEQ ID NO: 710751 - DNA, 25 bp, Mus musculus
gtggctcctgtgttttcatgctgca

SEQ ID NO: 710752 - DNA, 25 bp, Mus musculus
gtggctcctttaccaaactccgggc

SEQ ID NO: 710753 - DNA, 25 bp, Mus musculus
gtggctcctttagcaaactccgggc

SEQ ID NO: 710754 - DNA, 25 bp, Mus musculus
gtggctcctttgcatcagcaggctt

SEQ ID NO: 710755 - DNA, 25 bp, Mus musculus
gtggctcctttggatcagcaggctt

SEQ ID NO: 710756 - DNA, 25 bp, Mus musculus
gtggctcgcaacagccgcaagatgg

SEQ ID NO: 710757 - DNA, 25 bp, Mus musculus
gtggctcgcaacagcttgttagaaa

SEQ ID NO: 710758 - DNA, 25 bp, Mus musculus
gtggctcgcaactgccgcaagatgg

SEQ ID NO: 710759 - DNA, 25 bp, Mus musculus
gtggctcgcaactgcttgttagaaa

SEQ ID NO: 710760 - DNA, 25 bp, Mus musculus
gtggctcgcactcaggctcctgaga

SEQ ID NO: 710761 - DNA, 25 bp, Mus musculus
gtggctcgcactgaggctcctgaga

SEQ ID NO: 710762 - DNA, 25 bp, Mus musculus
gtggctcgggccatgtgacatcgtc

SEQ ID NO: 710763 - DNA, 25 bp, Mus musculus
gtggctcgggccttgtgacatcgtc

SEQ ID NO: 710764 - DNA, 25 bp, Mus musculus
gtggctcggtgacttcaagcacata

SEQ ID NO: 710765 - DNA, 25 bp, Mus musculus
gtggctcggtgagttcaagcacata

SEQ ID NO: 710766 - DNA, 25 bp, Mus musculus
gtggctcgtaaaccacttgtggcag

SEQ ID NO: 710767 - DNA, 25 bp, Mus musculus
gtggctcgtaaagcacttgtggcag

SEQ ID NO: 710768 - DNA, 25 bp, Mus musculus
gtggctcgtgacagtaattccagca

SEQ ID NO: 710769 - DNA, 25 bp, Mus musculus
gtggctcgtgactgtaattccagca

SEQ ID NO: 710770 - DNA, 25 bp, Mus musculus
gtggctctaagtagtaaaatgtttt

SEQ ID NO: 710771 - DNA, 25 bp, Mus musculus
gtggctctaagttgtaaaatgtttt

SEQ ID NO: 710772 - DNA, 25 bp, Mus musculus
gtggctctacaactctcctcaggag

SEQ ID NO: 710773 - DNA, 25 bp, Mus musculus
gtggctctacaagtctcctcaggag

SEQ ID NO: 710774 - DNA, 25 bp, Mus musculus
gtggctctaccaaatgtccttggat

SEQ ID NO: 710775 - DNA, 25 bp, Mus musculus
gtggctctaccatatgtccttggat

SEQ ID NO: 710776 - DNA, 25 bp, Mus musculus
gtggctctagcaaaacagttccaga

SEQ ID NO: 710777 - DNA, 25 bp, Mus musculus
gtggctctagcataacagttccaga

SEQ ID NO: 710778 - DNA, 25 bp, Mus musculus
gtggctctaggaacaagggatctac

SEQ ID NO: 710779 - DNA, 25 bp, Mus musculus
gtggctctaggatcaagggatctac

SEQ ID NO: 710780 - DNA, 25 bp, Mus musculus
gtggctctataaagagaccttgctc

SEQ ID NO: 710781 - DNA, 25 bp, Mus musculus
gtggctctataatgagaccttgctc

SEQ ID NO: 710782 - DNA, 25 bp, Mus musculus
gtggctctatccatttacacaggga

SEQ ID NO: 710783 - DNA, 25 bp, Mus musculus
gtggctctatccttttacacaggga

SEQ ID NO: 710784 - DNA, 25 bp, Mus musculus
gtggctctcagcagtcgcagacata

SEQ ID NO: 710785 - DNA, 25 bp, Mus musculus
gtggctctcagcagtcgttgtgcac

SEQ ID NO: 710786 - DNA, 25 bp, Mus musculus
gtggctctcagctgtcgcagacata

SEQ ID NO: 710787 - DNA, 25 bp, Mus musculus
gtggctctcagctgtcgttgtgcac

SEQ ID NO: 710788 - DNA, 25 bp, Mus musculus
gtggctctcccactgtggtggctct

SEQ ID NO: 710789 - DNA, 25 bp, Mus musculus
gtggctctcccagtgtggtggctct

SEQ ID NO: 710790 - DNA, 25 bp, Mus musculus
gtggctctctgcaaagcagcttaag

SEQ ID NO: 710791 - DNA, 25 bp, Mus musculus
gtggctctctgctaagcagcttaag

SEQ ID NO: 710792 - DNA, 25 bp, Mus musculus
gtggctctgacaaacttgtctgttg

SEQ ID NO: 710793 - DNA, 25 bp, Mus musculus
gtggctctgacatacttgtctgttg

SEQ ID NO: 710794 - DNA, 25 bp, Mus musculus
gtggctctgacgataaggtttctgt

SEQ ID NO: 710795 - DNA, 25 bp, Mus musculus
gtggctctgacgttaaggtttctgt

SEQ ID NO: 710796 - DNA, 25 bp, Mus musculus
gtggctctgactactctaagatcgc

SEQ ID NO: 710797 - DNA, 25 bp, Mus musculus
gtggctctgacttctctaagatcgc

SEQ ID NO: 710798 - DNA, 25 bp, Mus musculus
gtggctctgatgcattgagaactgt

SEQ ID NO: 710799 - DNA, 25 bp, Mus musculus
gtggctctgatggattgagaactgt

SEQ ID NO: 710800 - DNA, 25 bp, Mus musculus
gtggctctgcacattacccgtgagg

SEQ ID NO: 710801 - DNA, 25 bp, Mus musculus
gtggctctgcactttacccgtgagg

SEQ ID NO: 710802 - DNA, 25 bp, Mus musculus
gtggctctggccagcttgatattaa

SEQ ID NO: 710803 - DNA, 25 bp, Mus musculus
gtggctctggcctgcttgatattaa

SEQ ID NO: 710804 - DNA, 25 bp, Mus musculus
gtggctctggttacttggctgcatg

SEQ ID NO: 710805 - DNA, 25 bp, Mus musculus
gtggctctggtttcttggctgcatg

SEQ ID NO: 710806 - DNA, 25 bp, Mus musculus
gtggctctgtgcaggtgcgtctcat

SEQ ID NO: 710807 - DNA, 25 bp, Mus musculus
gtggctctgtgctggtgcgtctcat

SEQ ID NO: 710808 - DNA, 25 bp, Mus musculus
gtggctctgtggagacttttactac

SEQ ID NO: 710809 - DNA, 25 bp, Mus musculus
gtggctctgtggtgacttttactac

SEQ ID NO: 710810 - DNA, 25 bp, Mus musculus
gtggctctgttaccttcagactgta

SEQ ID NO: 710811 - DNA, 25 bp, Mus musculus
gtggctctgttagcttcagactgta

SEQ ID NO: 710812 - DNA, 25 bp, Mus musculus
gtggctcttaaaccatggccttcat

SEQ ID NO: 710813 - DNA, 25 bp, Mus musculus
gtggctcttaaagcatggccttcat

SEQ ID NO: 710814 - DNA, 25 bp, Mus musculus
gtggctcttaacatattgcccaaca

SEQ ID NO: 710815 - DNA, 25 bp, Mus musculus
gtggctcttaacttattgcccaaca

SEQ ID NO: 710816 - DNA, 25 bp, Mus musculus
gtggctcttaccctgtgggtctcaa

SEQ ID NO: 710817 - DNA, 25 bp, Mus musculus
gtggctcttaccgtgtgggtctcaa

SEQ ID NO: 710818 - DNA, 25 bp, Mus musculus
gtggctcttatacattcaacatgaa

SEQ ID NO: 710819 - DNA, 25 bp, Mus musculus
gtggctcttatagattcaacatgaa

SEQ ID NO: 710820 - DNA, 25 bp, Mus musculus
gtggctcttcaacacctcttgggca

SEQ ID NO: 710821 - DNA, 25 bp, Mus musculus
gtggctcttcaagacctcttgggca

SEQ ID NO: 710822 - DNA, 25 bp, Mus musculus
gtggctcttcccataaagggtggaa

SEQ ID NO: 710823 - DNA, 25 bp, Mus musculus
gtggctcttcccttaaagggtggaa

SEQ ID NO: 710824 - DNA, 25 bp, Mus musculus
gtggctcttcctaagtaacatgtca

SEQ ID NO: 710825 - DNA, 25 bp, Mus musculus
gtggctcttccttagtaacatgtca

SEQ ID NO: 710826 - DNA, 25 bp, Mus musculus
gtggctcttctgaatacctacaggc

SEQ ID NO: 710827 - DNA, 25 bp, Mus musculus
gtggctcttctgtatacctacaggc

SEQ ID NO: 710828 - DNA, 25 bp, Mus musculus
gtggctcttcttacaggagtttccc

SEQ ID NO: 710829 - DNA, 25 bp, Mus musculus
gtggctcttctttcaggagtttccc

SEQ ID NO: 710830 - DNA, 25 bp, Mus musculus
gtggctcttgggacacttatcagtg

SEQ ID NO: 710831 - DNA, 25 bp, Mus musculus
gtggctcttgggtcacttatcagtg

SEQ ID NO: 710832 - DNA, 25 bp, Mus musculus
gtggctctttccctgaaaagtcctg

SEQ ID NO: 710833 - DNA, 25 bp, Mus musculus
gtggctctttccgtgaaaagtcctg

SEQ ID NO: 710834 - DNA, 25 bp, Mus musculus
gtggctgaaagacacgctgctctct

SEQ ID NO: 710835 - DNA, 25 bp, Mus musculus
gtggctgaaagagacgctgctctct

SEQ ID NO: 710836 - DNA, 25 bp, Mus musculus
gtggctgaacagcatgcaatctttt

SEQ ID NO: 710837 - DNA, 25 bp, Mus musculus
gtggctgaacaggatgcaatctttt

SEQ ID NO: 710838 - DNA, 25 bp, Mus musculus
gtggctgaagaaccaagaactccca

SEQ ID NO: 710839 - DNA, 25 bp, Mus musculus
gtggctgaagaagcaagaactccca

SEQ ID NO: 710840 - DNA, 25 bp, Mus musculus
gtggctgaagacagaggcctccctg

SEQ ID NO: 710841 - DNA, 25 bp, Mus musculus
gtggctgaagactgaggcctccctg

SEQ ID NO: 710842 - DNA, 25 bp, Mus musculus
gtggctgaagttattagcccttgct

SEQ ID NO: 710843 - DNA, 25 bp, Mus musculus
gtggctgaagttcacgtctgacgac

SEQ ID NO: 710844 - DNA, 25 bp, Mus musculus
gtggctgaagttgacgtctgacgac

SEQ ID NO: 710845 - DNA, 25 bp, Mus musculus
gtggctgaagtttttagcccttgct

SEQ ID NO: 710846 - DNA, 25 bp, Mus musculus
gtggctgaatccaaggcaactgttc

SEQ ID NO: 710847 - DNA, 25 bp, Mus musculus
gtggctgaatcctaggcaactgttc

SEQ ID NO: 710848 - DNA, 25 bp, Mus musculus
gtggctgacacaaaaatgcagggaa

SEQ ID NO: 710849 - DNA, 25 bp, Mus musculus
gtggctgacacataaatgcagggaa

SEQ ID NO: 710850 - DNA, 25 bp, Mus musculus
gtggctgaccacaggctgaggttaa

SEQ ID NO: 710851 - DNA, 25 bp, Mus musculus
gtggctgaccactggctgaggttaa

SEQ ID NO: 710852 - DNA, 25 bp, Mus musculus
gtggctgacctcatcgagtccatgc

SEQ ID NO: 710853 - DNA, 25 bp, Mus musculus
gtggctgacctcttcgagtccatgc

SEQ ID NO: 710854 - DNA, 25 bp, Mus musculus
gtggctgacgatcgtcctttagcac

SEQ ID NO: 710855 - DNA, 25 bp, Mus musculus
gtggctgacgatggtcctttagcac

SEQ ID NO: 710856 - DNA, 25 bp, Mus musculus
gtggctgacgcactggagcacatta

SEQ ID NO: 710857 - DNA, 25 bp, Mus musculus
gtggctgacgcagtggagcacatta

SEQ ID NO: 710858 - DNA, 25 bp, Mus musculus
gtggctgactaccaggacccaaggc

SEQ ID NO: 710859 - DNA, 25 bp, Mus musculus
gtggctgactacgaggacccaaggc

SEQ ID NO: 710860 - DNA, 25 bp, Mus musculus
gtggctgactcacaccctgattata

SEQ ID NO: 710861 - DNA, 25 bp, Mus musculus
gtggctgactcagaccctgattata

SEQ ID NO: 710862 - DNA, 25 bp, Mus musculus
gtggctgactctactttcgaatgtt

SEQ ID NO: 710863 - DNA, 25 bp, Mus musculus
gtggctgactcttctttcgaatgtt

SEQ ID NO: 710864 - DNA, 25 bp, Mus musculus
gtggctgactggagatgacatcccc

SEQ ID NO: 710865 - DNA, 25 bp, Mus musculus
gtggctgactggtgatgacatcccc

SEQ ID NO: 710866 - DNA, 25 bp, Mus musculus
gtggctgacttaacccagaagcttg

SEQ ID NO: 710867 - DNA, 25 bp, Mus musculus
gtggctgacttatcccagaagcttg

SEQ ID NO: 710868 - DNA, 25 bp, Mus musculus
gtggctgacttcatattcatcaatt

SEQ ID NO: 710869 - DNA, 25 bp, Mus musculus
gtggctgacttccatgcaggaccat

SEQ ID NO: 710870 - DNA, 25 bp, Mus musculus
gtggctgacttcgatgcaggaccat

SEQ ID NO: 710871 - DNA, 25 bp, Mus musculus
gtggctgacttcttattcatcaatt

SEQ ID NO: 710872 - DNA, 25 bp, Mus musculus
gtggctgagatcaatgtcctcatcc

SEQ ID NO: 710873 - DNA, 25 bp, Mus musculus
gtggctgagatcctaattcctggga

SEQ ID NO: 710874 - DNA, 25 bp, Mus musculus
gtggctgagatcgtaattcctggga

SEQ ID NO: 710875 - DNA, 25 bp, Mus musculus
gtggctgagatctatgtcctcatcc

SEQ ID NO: 710876 - DNA, 25 bp, Mus musculus
gtggctgaggaaattcgcgaccgca

SEQ ID NO: 710877 - DNA, 25 bp, Mus musculus
gtggctgaggaatttcgcgaccgca

SEQ ID NO: 710878 - DNA, 25 bp, Mus musculus
gtggctgagtaccaggtttactttt

SEQ ID NO: 710879 - DNA, 25 bp, Mus musculus
gtggctgagtacgaggtttactttt

SEQ ID NO: 710880 - DNA, 25 bp, Mus musculus
gtggctgataccaaaaatcccaaca

SEQ ID NO: 710881 - DNA, 25 bp, Mus musculus
gtggctgatacctaaaatcccaaca

SEQ ID NO: 710882 - DNA, 25 bp, Mus musculus
gtggctgataggatttgcctgcaga

SEQ ID NO: 710883 - DNA, 25 bp, Mus musculus
gtggctgataggttttgcctgcaga

SEQ ID NO: 710884 - DNA, 25 bp, Mus musculus
gtggctgatattatcttagacctgt

SEQ ID NO: 710885 - DNA, 25 bp, Mus musculus
gtggctgatattttcttagacctgt

SEQ ID NO: 710886 - DNA, 25 bp, Mus musculus
gtggctgatcagatggatctgcaga

SEQ ID NO: 710887 - DNA, 25 bp, Mus musculus
gtggctgatcagttggatctgcaga

SEQ ID NO: 710888 - DNA, 25 bp, Mus musculus
gtggctgatcccagacagtgcggac

SEQ ID NO: 710889 - DNA, 25 bp, Mus musculus
gtggctgatccctgacagtgcggac

SEQ ID NO: 710890 - DNA, 25 bp, Mus musculus
gtggctgatgatcctcttacagaga

SEQ ID NO: 710891 - DNA, 25 bp, Mus musculus
gtggctgatgatgctcttacagaga

SEQ ID NO: 710892 - DNA, 25 bp, Mus musculus
gtggctgatgccagtcaagatgaca

SEQ ID NO: 710893 - DNA, 25 bp, Mus musculus
gtggctgatgcctgtcaagatgaca

SEQ ID NO: 710894 - DNA, 25 bp, Mus musculus
gtggctgatgctcaataaatcctgg

SEQ ID NO: 710895 - DNA, 25 bp, Mus musculus
gtggctgatgctgaataaatcctgg

SEQ ID NO: 710896 - DNA, 25 bp, Mus musculus
gtggctgcagctcttcttaaatata

SEQ ID NO: 710897 - DNA, 25 bp, Mus musculus
gtggctgcagctgttcttaaatata

SEQ ID NO: 710898 - DNA, 25 bp, Mus musculus
gtggctgcaggaacctctggaaatg

SEQ ID NO: 710899 - DNA, 25 bp, Mus musculus
gtggctgcaggatcctctggaaatg

SEQ ID NO: 710900 - DNA, 25 bp, Mus musculus
gtggctgcagttcttcagattcagt

SEQ ID NO: 710901 - DNA, 25 bp, Mus musculus
gtggctgcagttgttcagattcagt

SEQ ID NO: 710902 - DNA, 25 bp, Mus musculus
gtggctgcattaatggcttttgcct

SEQ ID NO: 710903 - DNA, 25 bp, Mus musculus
gtggctgcattattggcttttgcct

SEQ ID NO: 710904 - DNA, 25 bp, Mus musculus
gtggctgccccaacataaatattta

SEQ ID NO: 710905 - DNA, 25 bp, Mus musculus
gtggctgccccatcataaatattta

SEQ ID NO: 710906 - DNA, 25 bp, Mus musculus
gtggctgcccctcgaaatatgaatc

SEQ ID NO: 710907 - DNA, 25 bp, Mus musculus
gtggctgcccctggaaatatgaatc

SEQ ID NO: 710908 - DNA, 25 bp, Mus musculus
gtggctgcccgacaagtctgacttt

SEQ ID NO: 710909 - DNA, 25 bp, Mus musculus
gtggctgcccgagaagtctgacttt

SEQ ID NO: 710910 - DNA, 25 bp, Mus musculus
gtggctgccctccaaatccaacgga

SEQ ID NO: 710911 - DNA, 25 bp, Mus musculus
gtggctgccctcgaaatccaacgga

SEQ ID NO: 710912 - DNA, 25 bp, Mus musculus
gtggctgccgatactgttaaacgaa

SEQ ID NO: 710913 - DNA, 25 bp, Mus musculus
gtggctgccgattctgttaaacgaa

SEQ ID NO: 710914 - DNA, 25 bp, Mus musculus
gtggctgcctaaagccagctagtct

SEQ ID NO: 710915 - DNA, 25 bp, Mus musculus
gtggctgcctaatgccagctagtct

SEQ ID NO: 710916 - DNA, 25 bp, Mus musculus
gtggctgcctcactgtactggctga

SEQ ID NO: 710917 - DNA, 25 bp, Mus musculus
gtggctgcctcagtgtactggctga

SEQ ID NO: 710918 - DNA, 25 bp, Mus musculus
gtggctgccttgattttgacagatt

SEQ ID NO: 710919 - DNA, 25 bp, Mus musculus
gtggctgccttgtttttgacagatt

SEQ ID NO: 710920 - DNA, 25 bp, Mus musculus
gtggctgctatcatttttccagtaa

SEQ ID NO: 710921 - DNA, 25 bp, Mus musculus
gtggctgctatcttttttccagtaa

SEQ ID NO: 710922 - DNA, 25 bp, Mus musculus
gtggctgctcagatgcatgatctaa

SEQ ID NO: 710923 - DNA, 25 bp, Mus musculus
gtggctgctcagttgcatgatctaa

SEQ ID NO: 710924 - DNA, 25 bp, Mus musculus
gtggctgctgacagggcttagctac

SEQ ID NO: 710925 - DNA, 25 bp, Mus musculus
gtggctgctgactgggcttagctac

SEQ ID NO: 710926 - DNA, 25 bp, Mus musculus
gtggctgctgcaagaagcgagcttt

SEQ ID NO: 710927 - DNA, 25 bp, Mus musculus
gtggctgctgcatgaagcgagcttt

SEQ ID NO: 710928 - DNA, 25 bp, Mus musculus
gtggctgctgctctaatgatactgc

SEQ ID NO: 710929 - DNA, 25 bp, Mus musculus
gtggctgctgctgtaatgatactgc

SEQ ID NO: 710930 - DNA, 25 bp, Mus musculus
gtggctgctgttcggaacaccatct

SEQ ID NO: 710931 - DNA, 25 bp, Mus musculus
gtggctgctgttgggaacaccatct

SEQ ID NO: 710932 - DNA, 25 bp, Mus musculus
gtggctgcttaaccatgcaaggatt

SEQ ID NO: 710933 - DNA, 25 bp, Mus musculus
gtggctgcttaagcatgcaaggatt

SEQ ID NO: 710934 - DNA, 25 bp, Mus musculus
gtggctgctttcattggtactctct

SEQ ID NO: 710935 - DNA, 25 bp, Mus musculus
gtggctgctttctttggtactctct

SEQ ID NO: 710936 - DNA, 25 bp, Mus musculus
gtggctgctttgaagtttgcccaga

SEQ ID NO: 710937 - DNA, 25 bp, Mus musculus
gtggctgctttgtagtttgcccaga

SEQ ID NO: 710938 - DNA, 25 bp, Mus musculus
gtggctggaaccactctcgggcttc

SEQ ID NO: 710939 - DNA, 25 bp, Mus musculus
gtggctggaacctctctcgggcttc

SEQ ID NO: 710940 - DNA, 25 bp, Mus musculus
gtggctggacacactcaaaacagaa

SEQ ID NO: 710941 - DNA, 25 bp, Mus musculus
gtggctggacactctcaaaacagaa

SEQ ID NO: 710942 - DNA, 25 bp, Mus musculus
gtggctggacttaagttctggaaga

SEQ ID NO: 710943 - DNA, 25 bp, Mus musculus
gtggctggactttagttctggaaga

SEQ ID NO: 710944 - DNA, 25 bp, Mus musculus
gtggctggagccatctcatctgtgg

SEQ ID NO: 710945 - DNA, 25 bp, Mus musculus
gtggctggagccttctcatctgtgg

SEQ ID NO: 710946 - DNA, 25 bp, Mus musculus
gtggctggatgcatacctccataaa

SEQ ID NO: 710947 - DNA, 25 bp, Mus musculus
gtggctggatgcttacctccataaa

SEQ ID NO: 710948 - DNA, 25 bp, Mus musculus
gtggctggccaaaaagttcagagtt

SEQ ID NO: 710949 - DNA, 25 bp, Mus musculus
gtggctggccaataagttcagagtt

SEQ ID NO: 710950 - DNA, 25 bp, Mus musculus
gtggctggccagcatgatcattgct

SEQ ID NO: 710951 - DNA, 25 bp, Mus musculus
gtggctggccaggatgatcattgct

SEQ ID NO: 710952 - DNA, 25 bp, Mus musculus
gtggctggcctcaacggagcagaca

SEQ ID NO: 710953 - DNA, 25 bp, Mus musculus
gtggctggcctcagctaagcggctt

SEQ ID NO: 710954 - DNA, 25 bp, Mus musculus
gtggctggcctcatgaacacagtca

SEQ ID NO: 710955 - DNA, 25 bp, Mus musculus
gtggctggcctctacggagcagaca

SEQ ID NO: 710956 - DNA, 25 bp, Mus musculus
gtggctggcctctgctaagcggctt

SEQ ID NO: 710957 - DNA, 25 bp, Mus musculus
gtggctggcctcttgaacacagtca

SEQ ID NO: 710958 - DNA, 25 bp, Mus musculus
gtggctggcgggaaatccaatttct

SEQ ID NO: 710959 - DNA, 25 bp, Mus musculus
gtggctggcgggtaatccaatttct

SEQ ID NO: 710960 - DNA, 25 bp, Mus musculus
gtggctggctacaaagtcacccaaa

SEQ ID NO: 710961 - DNA, 25 bp, Mus musculus
gtggctggctacagttggtccttca

SEQ ID NO: 710962 - DNA, 25 bp, Mus musculus
gtggctggctactaagtcacccaaa

SEQ ID NO: 710963 - DNA, 25 bp, Mus musculus
gtggctggctactgttggtccttca

SEQ ID NO: 710964 - DNA, 25 bp, Mus musculus
gtggctgggaacagttgttctctaa

SEQ ID NO: 710965 - DNA, 25 bp, Mus musculus
gtggctgggaactgttgttctctaa

SEQ ID NO: 710966 - DNA, 25 bp, Mus musculus
gtggctgggaatctctgtaatgaat

SEQ ID NO: 710967 - DNA, 25 bp, Mus musculus
gtggctgggaatgtctgtaatgaat

SEQ ID NO: 710968 - DNA, 25 bp, Mus musculus
gtggctgggcagaactttgtgatta

SEQ ID NO: 710969 - DNA, 25 bp, Mus musculus
gtggctgggcagtactttgtgatta

SEQ ID NO: 710970 - DNA, 25 bp, Mus musculus
gtggctggtcacaaaccctgattga

SEQ ID NO: 710971 - DNA, 25 bp, Mus musculus
gtggctggtcactaaccctgattga

SEQ ID NO: 710972 - DNA, 25 bp, Mus musculus
gtggctggtcagcaaagtcctcgaa

SEQ ID NO: 710973 - DNA, 25 bp, Mus musculus
gtggctggtcaggaaagtcctcgaa

SEQ ID NO: 710974 - DNA, 25 bp, Mus musculus
gtggctggtccaattattaaatctt

SEQ ID NO: 710975 - DNA, 25 bp, Mus musculus
gtggctggtccatttattaaatctt

SEQ ID NO: 710976 - DNA, 25 bp, Mus musculus
gtggctggtctacggatataactca

SEQ ID NO: 710977 - DNA, 25 bp, Mus musculus
gtggctggtctagggatataactca

SEQ ID NO: 710978 - DNA, 25 bp, Mus musculus
gtggctggttttatcaacagatgca

SEQ ID NO: 710979 - DNA, 25 bp, Mus musculus
gtggctggttttttcaacagatgca

SEQ ID NO: 710980 - DNA, 25 bp, Mus musculus
gtggctgtaactatgggttgctctt

SEQ ID NO: 710981 - DNA, 25 bp, Mus musculus
gtggctgtaactttgggttgctctt

SEQ ID NO: 710982 - DNA, 25 bp, Mus musculus
gtggctgtacaaaatcccattgtct

SEQ ID NO: 710983 - DNA, 25 bp, Mus musculus
gtggctgtacaatatcccattgtct

SEQ ID NO: 710984 - DNA, 25 bp, Mus musculus
gtggctgtagcacggctcttgtcca

SEQ ID NO: 710985 - DNA, 25 bp, Mus musculus
gtggctgtagcagggctcttgtcca

SEQ ID NO: 710986 - DNA, 25 bp, Mus musculus
gtggctgtatagaacttgaaccgtg

SEQ ID NO: 710987 - DNA, 25 bp, Mus musculus
gtggctgtatagtacttgaaccgtg

SEQ ID NO: 710988 - DNA, 25 bp, Mus musculus
gtggctgtatctaacctcatgagta

SEQ ID NO: 710989 - DNA, 25 bp, Mus musculus
gtggctgtatcttacctcatgagta

SEQ ID NO: 710990 - DNA, 25 bp, Mus musculus
gtggctgtatgtacaatgttccatc

SEQ ID NO: 710991 - DNA, 25 bp, Mus musculus
gtggctgtatgttcaatgttccatc

SEQ ID NO: 710992 - DNA, 25 bp, Mus musculus
gtggctgtattaaaggatcctgtca

SEQ ID NO: 710993 - DNA, 25 bp, Mus musculus
gtggctgtattataggatcctgtca

SEQ ID NO: 710994 - DNA, 25 bp, Mus musculus
gtggctgtcactcgctagggtaaac

SEQ ID NO: 710995 - DNA, 25 bp, Mus musculus
gtggctgtcactggctagggtaaac

SEQ ID NO: 710996 - DNA, 25 bp, Mus musculus
gtggctgtcagaaacttcaggctct

SEQ ID NO: 710997 - DNA, 25 bp, Mus musculus
gtggctgtcagaccccaaactggcg

SEQ ID NO: 710998 - DNA, 25 bp, Mus musculus
gtggctgtcagagcccaaactggcg

SEQ ID NO: 710999 - DNA, 25 bp, Mus musculus
gtggctgtcagatacttcaggctct

SEQ ID NO: 711000 - DNA, 25 bp, Mus musculus
gtggctgtcagtagatacctttgtt

SEQ ID NO: 711001 - DNA, 25 bp, Mus musculus
gtggctgtcagttgatacctttgtt

SEQ ID NO: 711002 - DNA, 25 bp, Mus musculus
gtggctgtccatctggtctccatgg

SEQ ID NO: 711003 - DNA, 25 bp, Mus musculus
gtggctgtccatgtggtctccatgg

SEQ ID NO: 711004 - DNA, 25 bp, Mus musculus
gtggctgtccttacttatgatccaa

SEQ ID NO: 711005 - DNA, 25 bp, Mus musculus
gtggctgtcctttcttatgatccaa

SEQ ID NO: 711006 - DNA, 25 bp, Mus musculus
gtggctgtctagagatttttggaac

SEQ ID NO: 711007 - DNA, 25 bp, Mus musculus
gtggctgtctagtgatttttggaac

SEQ ID NO: 711008 - DNA, 25 bp, Mus musculus
gtggctgtctttctagccaaagctt

SEQ ID NO: 711009 - DNA, 25 bp, Mus musculus
gtggctgtctttgtagccaaagctt

SEQ ID NO: 711010 - DNA, 25 bp, Mus musculus
gtggctgtgaccattctggaataac

SEQ ID NO: 711011 - DNA, 25 bp, Mus musculus
gtggctgtgacctttctggaataac

SEQ ID NO: 711012 - DNA, 25 bp, Mus musculus
gtggctgtgagcatttcacaatcca

SEQ ID NO: 711013 - DNA, 25 bp, Mus musculus
gtggctgtgagcttttcacaatcca

SEQ ID NO: 711014 - DNA, 25 bp, Mus musculus
gtggctgtgcccagtgcgcataatg

SEQ ID NO: 711015 - DNA, 25 bp, Mus musculus
gtggctgtgccctgtgcgcataatg

SEQ ID NO: 711016 - DNA, 25 bp, Mus musculus
gtggctgtgctcataggaccgccct

SEQ ID NO: 711017 - DNA, 25 bp, Mus musculus
gtggctgtgctcttaggaccgccct

SEQ ID NO: 711018 - DNA, 25 bp, Mus musculus
gtggctgtggagcaacgctcactca

SEQ ID NO: 711019 - DNA, 25 bp, Mus musculus
gtggctgtggaggaacgctcactca

SEQ ID NO: 711020 - DNA, 25 bp, Mus musculus
gtggctgtggccaattgggtatttt

SEQ ID NO: 711021 - DNA, 25 bp, Mus musculus
gtggctgtggcctattgggtatttt

SEQ ID NO: 711022 - DNA, 25 bp, Mus musculus
gtggctgtggcgctcactatcactg

SEQ ID NO: 711023 - DNA, 25 bp, Mus musculus
gtggctgtggcggtcactatcactg

SEQ ID NO: 711024 - DNA, 25 bp, Mus musculus
gtggctgtggctcactatgtggaac

SEQ ID NO: 711025 - DNA, 25 bp, Mus musculus
gtggctgtggctgactatgtggaac

SEQ ID NO: 711026 - DNA, 25 bp, Mus musculus
gtggctgtgggcatccccatgatga

SEQ ID NO: 711027 - DNA, 25 bp, Mus musculus
gtggctgtgggcttccccatgatga

SEQ ID NO: 711028 - DNA, 25 bp, Mus musculus
gtggctgtggtcacatgcatcccca

SEQ ID NO: 711029 - DNA, 25 bp, Mus musculus
gtggctgtggtcatcactttgacag

SEQ ID NO: 711030 - DNA, 25 bp, Mus musculus
gtggctgtggtctcatgcatcccca

SEQ ID NO: 711031 - DNA, 25 bp, Mus musculus
gtggctgtggtcttcactttgacag

SEQ ID NO: 711032 - DNA, 25 bp, Mus musculus
gtggctgttccaacactgcttgtga

SEQ ID NO: 711033 - DNA, 25 bp, Mus musculus
gtggctgttccactttacagcgaca

SEQ ID NO: 711034 - DNA, 25 bp, Mus musculus
gtggctgttccagtttacagcgaca

SEQ ID NO: 711035 - DNA, 25 bp, Mus musculus
gtggctgttccatcactgcttgtga

SEQ ID NO: 711036 - DNA, 25 bp, Mus musculus
gtggctgttgatctacacttcgcaa

SEQ ID NO: 711037 - DNA, 25 bp, Mus musculus
gtggctgttgatgtacacttcgcaa

SEQ ID NO: 711038 - DNA, 25 bp, Mus musculus
gtggctgttggcagcatgttgacac

SEQ ID NO: 711039 - DNA, 25 bp, Mus musculus
gtggctgttggctgcatgttgacac

SEQ ID NO: 711040 - DNA, 25 bp, Mus musculus
gtggctgttgttctcaagtatgctg

SEQ ID NO: 711041 - DNA, 25 bp, Mus musculus
gtggctgttgttgtcaagtatgctg

SEQ ID NO: 711042 - DNA, 25 bp, Mus musculus
gtggctgtttcgctcgttgcctaac

SEQ ID NO: 711043 - DNA, 25 bp, Mus musculus
gtggctgtttcggtcgttgcctaac

SEQ ID NO: 711044 - DNA, 25 bp, Mus musculus
gtggctgtttctattgttcccaagc

SEQ ID NO: 711045 - DNA, 25 bp, Mus musculus
gtggctgtttcttttgttcccaagc

SEQ ID NO: 711046 - DNA, 25 bp, Mus musculus
gtggctgttttgcaacagtccctca

SEQ ID NO: 711047 - DNA, 25 bp, Mus musculus
gtggctgttttggaacagtccctca

SEQ ID NO: 711048 - DNA, 25 bp, Mus musculus
gtggcttaaacaatgacagcacttt

SEQ ID NO: 711049 - DNA, 25 bp, Mus musculus
gtggcttaaacattgacagcacttt

SEQ ID NO: 711050 - DNA, 25 bp, Mus musculus
gtggcttaaaccacctgatcagaaa

SEQ ID NO: 711051 - DNA, 25 bp, Mus musculus
gtggcttaaacctcctgatcagaaa

SEQ ID NO: 711052 - DNA, 25 bp, Mus musculus
gtggcttaaagcacagactacatgc

SEQ ID NO: 711053 - DNA, 25 bp, Mus musculus
gtggcttaaagctcagactacatgc

SEQ ID NO: 711054 - DNA, 25 bp, Mus musculus
gtggcttaacagaggagtgcttgca

SEQ ID NO: 711055 - DNA, 25 bp, Mus musculus
gtggcttaacagtggagtgcttgca

SEQ ID NO: 711056 - DNA, 25 bp, Mus musculus
gtggcttaaccaatctctgaagttg

SEQ ID NO: 711057 - DNA, 25 bp, Mus musculus
gtggcttaaccattctctgaagttg

SEQ ID NO: 711058 - DNA, 25 bp, Mus musculus
gtggcttaactgcagactactcaca

SEQ ID NO: 711059 - DNA, 25 bp, Mus musculus
gtggcttaactggagactactcaca

SEQ ID NO: 711060 - DNA, 25 bp, Mus musculus
gtggcttaagacatttttctgtaca

SEQ ID NO: 711061 - DNA, 25 bp, Mus musculus
gtggcttaagacttttttctgtaca

SEQ ID NO: 711062 - DNA, 25 bp, Mus musculus
gtggcttaatacaacctacatgagg

SEQ ID NO: 711063 - DNA, 25 bp, Mus musculus
gtggcttaatactacctacatgagg

SEQ ID NO: 711064 - DNA, 25 bp, Mus musculus
gtggcttacaacagctcctaaccgc

SEQ ID NO: 711065 - DNA, 25 bp, Mus musculus
gtggcttacaactgctcctaaccgc

SEQ ID NO: 711066 - DNA, 25 bp, Mus musculus
gtggcttacagaacggtgtcactta

SEQ ID NO: 711067 - DNA, 25 bp, Mus musculus
gtggcttacagatcggtgtcactta

SEQ ID NO: 711068 - DNA, 25 bp, Mus musculus
gtggcttacatacgcgtgacgtgtc

SEQ ID NO: 711069 - DNA, 25 bp, Mus musculus
gtggcttacataggcgtgacgtgtc

SEQ ID NO: 711070 - DNA, 25 bp, Mus musculus
gtggcttaccatatatgggcatact

SEQ ID NO: 711071 - DNA, 25 bp, Mus musculus
gtggcttaccatttatgggcatact

SEQ ID NO: 711072 - DNA, 25 bp, Mus musculus
gtggcttacctgaatggcatcatca

SEQ ID NO: 711073 - DNA, 25 bp, Mus musculus
gtggcttacctgtatggcatcatca

SEQ ID NO: 711074 - DNA, 25 bp, Mus musculus
gtggcttaccttccaatgtatacat

SEQ ID NO: 711075 - DNA, 25 bp, Mus musculus
gtggcttaccttgcaatgtatacat

SEQ ID NO: 711076 - DNA, 25 bp, Mus musculus
gtggcttacggtctcctagcgcaca

SEQ ID NO: 711077 - DNA, 25 bp, Mus musculus
gtggcttacggtgtcctagcgcaca

SEQ ID NO: 711078 - DNA, 25 bp, Mus musculus
gtggcttactagagaggttgctgtt

SEQ ID NO: 711079 - DNA, 25 bp, Mus musculus
gtggcttactagtgaggttgctgtt

SEQ ID NO: 711080 - DNA, 25 bp, Mus musculus
gtggcttactcaactggttttctta

SEQ ID NO: 711081 - DNA, 25 bp, Mus musculus
gtggcttactcatctggttttctta

SEQ ID NO: 711082 - DNA, 25 bp, Mus musculus
gtggcttactctaggaagctaattt

SEQ ID NO: 711083 - DNA, 25 bp, Mus musculus
gtggcttactcttggaagctaattt

SEQ ID NO: 711084 - DNA, 25 bp, Mus musculus
gtggcttactgtcacttgagatgaa

SEQ ID NO: 711085 - DNA, 25 bp, Mus musculus
gtggcttactgtgacttgagatgaa

SEQ ID NO: 711086 - DNA, 25 bp, Mus musculus
gtggcttagaagagttggatctgct

SEQ ID NO: 711087 - DNA, 25 bp, Mus musculus
gtggcttagaagtgttggatctgct

SEQ ID NO: 711088 - DNA, 25 bp, Mus musculus
gtggcttagaccagagtctccagag

SEQ ID NO: 711089 - DNA, 25 bp, Mus musculus
gtggcttagacctgagtctccagag

SEQ ID NO: 711090 - DNA, 25 bp, Mus musculus
gtggcttagcaacacttcgttctga

SEQ ID NO: 711091 - DNA, 25 bp, Mus musculus
gtggcttagcaagacttcgttctga

SEQ ID NO: 711092 - DNA, 25 bp, Mus musculus
gtggcttagctcagtgtgacccaga

SEQ ID NO: 711093 - DNA, 25 bp, Mus musculus
gtggcttagctctgtgtgacccaga

SEQ ID NO: 711094 - DNA, 25 bp, Mus musculus
gtggcttaggcaactccgtgattca

SEQ ID NO: 711095 - DNA, 25 bp, Mus musculus
gtggcttaggcatctccgtgattca

SEQ ID NO: 711096 - DNA, 25 bp, Mus musculus
gtggcttaggctatgtgagccccta

SEQ ID NO: 711097 - DNA, 25 bp, Mus musculus
gtggcttaggctttgtgagccccta

SEQ ID NO: 711098 - DNA, 25 bp, Mus musculus
gtggcttagggcatctacctctggg

SEQ ID NO: 711099 - DNA, 25 bp, Mus musculus
gtggcttagggcttctacctctggg

SEQ ID NO: 711100 - DNA, 25 bp, Mus musculus
gtggcttagtagagtttctttgcat

SEQ ID NO: 711101 - DNA, 25 bp, Mus musculus
gtggcttagtagtgtttctttgcat

SEQ ID NO: 711102 - DNA, 25 bp, Mus musculus
gtggcttatactctaggtccttttt

SEQ ID NO: 711103 - DNA, 25 bp, Mus musculus
gtggcttatactgtaggtccttttt

SEQ ID NO: 711104 - DNA, 25 bp, Mus musculus
gtggcttatcacatttactatttta

SEQ ID NO: 711105 - DNA, 25 bp, Mus musculus
gtggcttatcacttttactatttta

SEQ ID NO: 711106 - DNA, 25 bp, Mus musculus
gtggcttattatccccacactttgt

SEQ ID NO: 711107 - DNA, 25 bp, Mus musculus
gtggcttattatgcccacactttgt

SEQ ID NO: 711108 - DNA, 25 bp, Mus musculus
gtggcttattttctggatttcttgc

SEQ ID NO: 711109 - DNA, 25 bp, Mus musculus
gtggcttattttgtggatttcttgc

SEQ ID NO: 711110 - DNA, 25 bp, Mus musculus
gtggcttcaaagatcccattcagga

SEQ ID NO: 711111 - DNA, 25 bp, Mus musculus
gtggcttcaaagttcccattcagga

SEQ ID NO: 711112 - DNA, 25 bp, Mus musculus
gtggcttcaagcaaccagcacatag

SEQ ID NO: 711113 - DNA, 25 bp, Mus musculus
gtggcttcaagcaactctggtctgg

SEQ ID NO: 711114 - DNA, 25 bp, Mus musculus
gtggcttcaagctaccagcacatag

SEQ ID NO: 711115 - DNA, 25 bp, Mus musculus
gtggcttcaagctactctggtctgg

SEQ ID NO: 711116 - DNA, 25 bp, Mus musculus
gtggcttcacccattttaactaaat

SEQ ID NO: 711117 - DNA, 25 bp, Mus musculus
gtggcttcaccctttttaactaaat

SEQ ID NO: 711118 - DNA, 25 bp, Mus musculus
gtggcttcacttatcaggtagcaag

SEQ ID NO: 711119 - DNA, 25 bp, Mus musculus
gtggcttcacttttcaggtagcaag

SEQ ID NO: 711120 - DNA, 25 bp, Mus musculus
gtggcttcagccaattagggcggca

SEQ ID NO: 711121 - DNA, 25 bp, Mus musculus
gtggcttcagcctattagggcggca

SEQ ID NO: 711122 - DNA, 25 bp, Mus musculus
gtggcttcagctctactgggactta

SEQ ID NO: 711123 - DNA, 25 bp, Mus musculus
gtggcttcagctgtactgggactta

SEQ ID NO: 711124 - DNA, 25 bp, Mus musculus
gtggcttcagtgattaccctgcggt

SEQ ID NO: 711125 - DNA, 25 bp, Mus musculus
gtggcttcagtgtttaccctgcggt

SEQ ID NO: 711126 - DNA, 25 bp, Mus musculus
gtggcttcatgaccgctttgagata

SEQ ID NO: 711127 - DNA, 25 bp, Mus musculus
gtggcttcatgagcgctttgagata

SEQ ID NO: 711128 - DNA, 25 bp, Mus musculus
gtggcttcatggcaggccttcagaa

SEQ ID NO: 711129 - DNA, 25 bp, Mus musculus
gtggcttcatgggaggccttcagaa

SEQ ID NO: 711130 - DNA, 25 bp, Mus musculus
gtggcttcattacccgggaaaggct

SEQ ID NO: 711131 - DNA, 25 bp, Mus musculus
gtggcttcattagccgggaaaggct

SEQ ID NO: 711132 - DNA, 25 bp, Mus musculus
gtggcttcccagattacaacctggc

SEQ ID NO: 711133 - DNA, 25 bp, Mus musculus
gtggcttcccagtttacaacctggc

SEQ ID NO: 711134 - DNA, 25 bp, Mus musculus
gtggcttcccataactgcatcagga

SEQ ID NO: 711135 - DNA, 25 bp, Mus musculus
gtggcttcccattactgcatcagga

SEQ ID NO: 711136 - DNA, 25 bp, Mus musculus
gtggcttccgagctataaagcagct

SEQ ID NO: 711137 - DNA, 25 bp, Mus musculus
gtggcttccgaggtataaagcagct

SEQ ID NO: 711138 - DNA, 25 bp, Mus musculus
gtggcttcctcacacttgatgagaa

SEQ ID NO: 711139 - DNA, 25 bp, Mus musculus
gtggcttcctcagacttgatgagaa

SEQ ID NO: 711140 - DNA, 25 bp, Mus musculus
gtggcttcctcccagttggtgatct

SEQ ID NO: 711141 - DNA, 25 bp, Mus musculus
gtggcttcctccgagttggtgatct

SEQ ID NO: 711142 - DNA, 25 bp, Mus musculus
gtggcttcgaacaccatggaaaccc

SEQ ID NO: 711143 - DNA, 25 bp, Mus musculus
gtggcttcgaactccatggaaaccc

SEQ ID NO: 711144 - DNA, 25 bp, Mus musculus
gtggcttcggagagcttttcagaac

SEQ ID NO: 711145 - DNA, 25 bp, Mus musculus
gtggcttcggagtgcttttcagaac

SEQ ID NO: 711146 - DNA, 25 bp, Mus musculus
gtggcttcggcaccgtcctatgacc

SEQ ID NO: 711147 - DNA, 25 bp, Mus musculus
gtggcttcggcagcgtcctatgacc

SEQ ID NO: 711148 - DNA, 25 bp, Mus musculus
gtggcttctacactttcttgttcag

SEQ ID NO: 711149 - DNA, 25 bp, Mus musculus
gtggcttctacagtttcttgttcag

SEQ ID NO: 711150 - DNA, 25 bp, Mus musculus
gtggcttctcagactggttctgcgg

SEQ ID NO: 711151 - DNA, 25 bp, Mus musculus
gtggcttctcagtctggttctgcgg

SEQ ID NO: 711152 - DNA, 25 bp, Mus musculus
gtggcttctccgagaacagcgagca

SEQ ID NO: 711153 - DNA, 25 bp, Mus musculus
gtggcttctccgtgaacagcgagca

SEQ ID NO: 711154 - DNA, 25 bp, Mus musculus
gtggcttctcgtcggattgctctag

SEQ ID NO: 711155 - DNA, 25 bp, Mus musculus
gtggcttctcgtgggattgctctag

SEQ ID NO: 711156 - DNA, 25 bp, Mus musculus
gtggcttctgagatgaatttcatat

SEQ ID NO: 711157 - DNA, 25 bp, Mus musculus
gtggcttctgagttgaatttcatat

SEQ ID NO: 711158 - DNA, 25 bp, Mus musculus
gtggcttctgctaatgtgaacatga

SEQ ID NO: 711159 - DNA, 25 bp, Mus musculus
gtggcttctgctactgctctcactc

SEQ ID NO: 711160 - DNA, 25 bp, Mus musculus
gtggcttctgcttatgtgaacatga

SEQ ID NO: 711161 - DNA, 25 bp, Mus musculus
gtggcttctgcttctgctctcactc

SEQ ID NO: 711162 - DNA, 25 bp, Mus musculus
gtggcttctgggactcagacttcag

SEQ ID NO: 711163 - DNA, 25 bp, Mus musculus
gtggcttctgggtctcagacttcag

SEQ ID NO: 711164 - DNA, 25 bp, Mus musculus
gtggcttctttaaacctgtgtgcta

SEQ ID NO: 711165 - DNA, 25 bp, Mus musculus
gtggcttctttacgtctgacttgca

SEQ ID NO: 711166 - DNA, 25 bp, Mus musculus
gtggcttctttactgagctgctgcc

SEQ ID NO: 711167 - DNA, 25 bp, Mus musculus
gtggcttctttaggtctgacttgca

SEQ ID NO: 711168 - DNA, 25 bp, Mus musculus
gtggcttctttagtgagctgctgcc

SEQ ID NO: 711169 - DNA, 25 bp, Mus musculus
gtggcttctttatacctgtgtgcta

SEQ ID NO: 711170 - DNA, 25 bp, Mus musculus
gtggcttctttcaccacagaactgg

SEQ ID NO: 711171 - DNA, 25 bp, Mus musculus
gtggcttctttctccacagaactgg

SEQ ID NO: 711172 - DNA, 25 bp, Mus musculus
gtggcttgaaacatgctgggtgctc

SEQ ID NO: 711173 - DNA, 25 bp, Mus musculus
gtggcttgaaacttgctgggtgctc

SEQ ID NO: 711174 - DNA, 25 bp, Mus musculus
gtggcttgaacaagaactcagggat

SEQ ID NO: 711175 - DNA, 25 bp, Mus musculus
gtggcttgaacatgaactcagggat

SEQ ID NO: 711176 - DNA, 25 bp, Mus musculus
gtggcttgacatagatgctggcaat

SEQ ID NO: 711177 - DNA, 25 bp, Mus musculus
gtggcttgacattgatgctggcaat

SEQ ID NO: 711178 - DNA, 25 bp, Mus musculus
gtggcttgacccaaactcaagctta

SEQ ID NO: 711179 - DNA, 25 bp, Mus musculus
gtggcttgaccctaactcaagctta

SEQ ID NO: 711180 - DNA, 25 bp, Mus musculus
gtggcttggcctcccttgagtggat

SEQ ID NO: 711181 - DNA, 25 bp, Mus musculus
gtggcttggcctgccttgagtggat

SEQ ID NO: 711182 - DNA, 25 bp, Mus musculus
gtggcttggctcatgaggtcacaga

SEQ ID NO: 711183 - DNA, 25 bp, Mus musculus
gtggcttggctcttgaggtcacaga

SEQ ID NO: 711184 - DNA, 25 bp, Mus musculus
gtggcttggtttcctctaagtgata

SEQ ID NO: 711185 - DNA, 25 bp, Mus musculus
gtggcttggtttgctctaagtgata

SEQ ID NO: 711186 - DNA, 25 bp, Mus musculus
gtggcttgtaacacttgcagggatt

SEQ ID NO: 711187 - DNA, 25 bp, Mus musculus
gtggcttgtaactcttgcagggatt

SEQ ID NO: 711188 - DNA, 25 bp, Mus musculus
gtggcttgtacccagcctgagccta

SEQ ID NO: 711189 - DNA, 25 bp, Mus musculus
gtggcttgtaccgagcctgagccta

SEQ ID NO: 711190 - DNA, 25 bp, Mus musculus
gtggcttgtgacctcttatctaata

SEQ ID NO: 711191 - DNA, 25 bp, Mus musculus
gtggcttgtgacgtcttatctaata

SEQ ID NO: 711192 - DNA, 25 bp, Mus musculus
gtggcttgtgccagaaagttgcaga

SEQ ID NO: 711193 - DNA, 25 bp, Mus musculus
gtggcttgtgcctgaaagttgcaga

SEQ ID NO: 711194 - DNA, 25 bp, Mus musculus
gtggcttgtggtagatggtcactat

SEQ ID NO: 711195 - DNA, 25 bp, Mus musculus
gtggcttgtggttgatggtcactat

SEQ ID NO: 711196 - DNA, 25 bp, Mus musculus
gtggcttgtgtcattgtgctgcaac

SEQ ID NO: 711197 - DNA, 25 bp, Mus musculus
gtggcttgtgtctttgtgctgcaac

SEQ ID NO: 711198 - DNA, 25 bp, Mus musculus
gtggcttgtgtgatttactttaatt

SEQ ID NO: 711199 - DNA, 25 bp, Mus musculus
gtggcttgtgtgttttactttaatt

SEQ ID NO: 711200 - DNA, 25 bp, Mus musculus
gtggcttgttgcacttaccttctga

SEQ ID NO: 711201 - DNA, 25 bp, Mus musculus
gtggcttgttgctcttaccttctga

SEQ ID NO: 711202 - DNA, 25 bp, Mus musculus
gtggcttgtttcacttaatttctgc

SEQ ID NO: 711203 - DNA, 25 bp, Mus musculus
gtggcttgtttctcttaatttctgc

SEQ ID NO: 711204 - DNA, 25 bp, Mus musculus
gtggctttaaatctctccaaagctc

SEQ ID NO: 711205 - DNA, 25 bp, Mus musculus
gtggctttaaatgtctccaaagctc

SEQ ID NO: 711206 - DNA, 25 bp, Mus musculus
gtggctttaacaaccctgagaaacc

SEQ ID NO: 711207 - DNA, 25 bp, Mus musculus
gtggctttaacaacctggtactggt

SEQ ID NO: 711208 - DNA, 25 bp, Mus musculus
gtggctttaacatccctgagaaacc

SEQ ID NO: 711209 - DNA, 25 bp, Mus musculus
gtggctttaacatcctggtactggt

SEQ ID NO: 711210 - DNA, 25 bp, Mus musculus
gtggctttacaccattggagctgct

SEQ ID NO: 711211 - DNA, 25 bp, Mus musculus
gtggctttacacgattggagctgct

SEQ ID NO: 711212 - DNA, 25 bp, Mus musculus
gtggctttaggcaatccatcttcca

SEQ ID NO: 711213 - DNA, 25 bp, Mus musculus
gtggctttaggctatccatcttcca

SEQ ID NO: 711214 - DNA, 25 bp, Mus musculus
gtggctttattcagggcaactatga

SEQ ID NO: 711215 - DNA, 25 bp, Mus musculus
gtggctttattctgggcaactatga

SEQ ID NO: 711216 - DNA, 25 bp, Mus musculus
gtggctttcaccagtaaccctaaca

SEQ ID NO: 711217 - DNA, 25 bp, Mus musculus
gtggctttcacctgtaaccctaaca

SEQ ID NO: 711218 - DNA, 25 bp, Mus musculus
gtggctttcactaccagaccaagac

SEQ ID NO: 711219 - DNA, 25 bp, Mus musculus
gtggctttcactagaactatgtctc

SEQ ID NO: 711220 - DNA, 25 bp, Mus musculus
gtggctttcacttccagaccaagac

SEQ ID NO: 711221 - DNA, 25 bp, Mus musculus
gtggctttcacttgaactatgtctc

SEQ ID NO: 711222 - DNA, 25 bp, Mus musculus
gtggctttcaggactcttcttaaac

SEQ ID NO: 711223 - DNA, 25 bp, Mus musculus
gtggctttcaggtctcttcttaaac

SEQ ID NO: 711224 - DNA, 25 bp, Mus musculus
gtggctttcatgctgtaccggatga

SEQ ID NO: 711225 - DNA, 25 bp, Mus musculus
gtggctttcatggtgtaccggatga

SEQ ID NO: 711226 - DNA, 25 bp, Mus musculus
gtggctttcattcccagatgtgtgg

SEQ ID NO: 711227 - DNA, 25 bp, Mus musculus
gtggctttcattgccagatgtgtgg

SEQ ID NO: 711228 - DNA, 25 bp, Mus musculus
gtggctttccatctgaagaagacac

SEQ ID NO: 711229 - DNA, 25 bp, Mus musculus
gtggctttccatgtgaagaagacac

SEQ ID NO: 711230 - DNA, 25 bp, Mus musculus
gtggctttccgacttgagttcagca

SEQ ID NO: 711231 - DNA, 25 bp, Mus musculus
gtggctttccgagttgagttcagca

SEQ ID NO: 711232 - DNA, 25 bp, Mus musculus
gtggctttccttagcttaagtgttc

SEQ ID NO: 711233 - DNA, 25 bp, Mus musculus
gtggctttccttataatccgatcag

SEQ ID NO: 711234 - DNA, 25 bp, Mus musculus
gtggctttcctttgcttaagtgttc

SEQ ID NO: 711235 - DNA, 25 bp, Mus musculus
gtggctttccttttaatccgatcag

SEQ ID NO: 711236 - DNA, 25 bp, Mus musculus
gtggctttcgccactggagtggtcc

SEQ ID NO: 711237 - DNA, 25 bp, Mus musculus
gtggctttcgcctctggagtggtcc

SEQ ID NO: 711238 - DNA, 25 bp, Mus musculus
gtggctttcggaccagacttcacac

SEQ ID NO: 711239 - DNA, 25 bp, Mus musculus
gtggctttcggagcagacttcacac

SEQ ID NO: 711240 - DNA, 25 bp, Mus musculus
gtggctttctcaattcctgtagtgg

SEQ ID NO: 711241 - DNA, 25 bp, Mus musculus
gtggctttctcatttcctgtagtgg

SEQ ID NO: 711242 - DNA, 25 bp, Mus musculus
gtggctttctctcaccgaagattta

SEQ ID NO: 711243 - DNA, 25 bp, Mus musculus
gtggctttctctgaccgaagattta

SEQ ID NO: 711244 - DNA, 25 bp, Mus musculus
gtggctttgaatcaaatccagttga

SEQ ID NO: 711245 - DNA, 25 bp, Mus musculus
gtggctttgaatgaaatccagttga

SEQ ID NO: 711246 - DNA, 25 bp, Mus musculus
gtggctttgcacactgagctgtagt

SEQ ID NO: 711247 - DNA, 25 bp, Mus musculus
gtggctttgcacattctttttcaat

SEQ ID NO: 711248 - DNA, 25 bp, Mus musculus
gtggctttgcactctgagctgtagt

SEQ ID NO: 711249 - DNA, 25 bp, Mus musculus
gtggctttgcactttctttttcaat

SEQ ID NO: 711250 - DNA, 25 bp, Mus musculus
gtggctttgcccactgcttctggct

SEQ ID NO: 711251 - DNA, 25 bp, Mus musculus
gtggctttgccctctgcttctggct

SEQ ID NO: 711252 - DNA, 25 bp, Mus musculus
gtggctttgcttcagtaagtaggcc

SEQ ID NO: 711253 - DNA, 25 bp, Mus musculus
gtggctttgcttgagtaagtaggcc

SEQ ID NO: 711254 - DNA, 25 bp, Mus musculus
gtggctttgtcactggaaggtttct

SEQ ID NO: 711255 - DNA, 25 bp, Mus musculus
gtggctttgtcagtggaaggtttct

SEQ ID NO: 711256 - DNA, 25 bp, Mus musculus
gtggctttgtgcaaacaagcatcca

SEQ ID NO: 711257 - DNA, 25 bp, Mus musculus
gtggctttgtgctaacaagcatcca

SEQ ID NO: 711258 - DNA, 25 bp, Mus musculus
gtggctttgttcatgaccttcattc

SEQ ID NO: 711259 - DNA, 25 bp, Mus musculus
gtggctttgttcttgaccttcattc

SEQ ID NO: 711260 - DNA, 25 bp, Mus musculus
gtggcttttaacagtttacaatagg

SEQ ID NO: 711261 - DNA, 25 bp, Mus musculus
gtggcttttaacatattgcttccct

SEQ ID NO: 711262 - DNA, 25 bp, Mus musculus
gtggcttttaactgtttacaatagg

SEQ ID NO: 711263 - DNA, 25 bp, Mus musculus
gtggcttttaacttattgcttccct

SEQ ID NO: 711264 - DNA, 25 bp, Mus musculus
gtggcttttagtattaagacaacag

SEQ ID NO: 711265 - DNA, 25 bp, Mus musculus
gtggcttttagttttaagacaacag

SEQ ID NO: 711266 - DNA, 25 bp, Mus musculus
gtggcttttatacaatctacagaat

SEQ ID NO: 711267 - DNA, 25 bp, Mus musculus
gtggcttttatagaatctacagaat

SEQ ID NO: 711268 - DNA, 25 bp, Mus musculus
gtggcttttatcacatttgtagtca

SEQ ID NO: 711269 - DNA, 25 bp, Mus musculus
gtggcttttatctcatttgtagtca

SEQ ID NO: 711270 - DNA, 25 bp, Mus musculus
gtggcttttattacctgggtacatt

SEQ ID NO: 711271 - DNA, 25 bp, Mus musculus
gtggcttttatttcctgggtacatt

SEQ ID NO: 711272 - DNA, 25 bp, Mus musculus
gtggcttttcatctgttctttagat

SEQ ID NO: 711273 - DNA, 25 bp, Mus musculus
gtggcttttcatgtgttctttagat

SEQ ID NO: 711274 - DNA, 25 bp, Mus musculus
gtggcttttccacaaggagtcatat

SEQ ID NO: 711275 - DNA, 25 bp, Mus musculus
gtggcttttccagaaggagtcatat

SEQ ID NO: 711276 - DNA, 25 bp, Mus musculus
gtggcttttcccaagctgaggctca

SEQ ID NO: 711277 - DNA, 25 bp, Mus musculus
gtggcttttccctagctgaggctca

SEQ ID NO: 711278 - DNA, 25 bp, Mus musculus
gtggcttttcgaaaaataatacaat

SEQ ID NO: 711279 - DNA, 25 bp, Mus musculus
gtggcttttcgataaataatacaat

SEQ ID NO: 711280 - DNA, 25 bp, Mus musculus
gtggcttttcttagaatcatccaaa

SEQ ID NO: 711281 - DNA, 25 bp, Mus musculus
gtggcttttcttcctactatgtata

SEQ ID NO: 711282 - DNA, 25 bp, Mus musculus
gtggcttttcttgctactatgtata

SEQ ID NO: 711283 - DNA, 25 bp, Mus musculus
gtggcttttctttgaatcatccaaa

SEQ ID NO: 711284 - DNA, 25 bp, Mus musculus
gtggcttttgaccatctgtaataaa

SEQ ID NO: 711285 - DNA, 25 bp, Mus musculus
gtggcttttgacgatctgtaataaa

SEQ ID NO: 711286 - DNA, 25 bp, Mus musculus
gtggcttttgagacccagggaatcc

SEQ ID NO: 711287 - DNA, 25 bp, Mus musculus
gtggcttttgagtcccagggaatcc

SEQ ID NO: 711288 - DNA, 25 bp, Mus musculus
gtggcttttgttaaattggcttggg

SEQ ID NO: 711289 - DNA, 25 bp, Mus musculus
gtggcttttgtttaattggcttggg

SEQ ID NO: 711290 - DNA, 25 bp, Mus musculus
gtggctttttggaaaggctgcttag

SEQ ID NO: 711291 - DNA, 25 bp, Mus musculus
gtggctttttggtaaggctgcttag

SEQ ID NO: 711292 - DNA, 25 bp, Mus musculus
gtggcttttttaaaccagctgtggt

SEQ ID NO: 711293 - DNA, 25 bp, Mus musculus
gtggcttttttaacactgtaactag

SEQ ID NO: 711294 - DNA, 25 bp, Mus musculus
gtggcttttttataccagctgtggt

SEQ ID NO: 711295 - DNA, 25 bp, Mus musculus
gtggcttttttatcactgtaactag

SEQ ID NO: 711296 - DNA, 25 bp, Mus musculus
gtgggaaaacagagctttactaaga

SEQ ID NO: 711297 - DNA, 25 bp, Mus musculus
gtgggaaaacagtgctttactaaga

SEQ ID NO: 711298 - DNA, 25 bp, Mus musculus
gtgggaaaacatacagccggagctc

SEQ ID NO: 711299 - DNA, 25 bp, Mus musculus
gtgggaaaacattcagccggagctc

SEQ ID NO: 711300 - DNA, 25 bp, Mus musculus
gtgggaaaaccaaactgtctacgtt

SEQ ID NO: 711301 - DNA, 25 bp, Mus musculus
gtgggaaaaccatactgtctacgtt

SEQ ID NO: 711302 - DNA, 25 bp, Mus musculus
gtgggaaaacctactgtagcaagtc

SEQ ID NO: 711303 - DNA, 25 bp, Mus musculus
gtgggaaaacctatcagcccagtgc

SEQ ID NO: 711304 - DNA, 25 bp, Mus musculus
gtgggaaaaccttctgtagcaagtc

SEQ ID NO: 711305 - DNA, 25 bp, Mus musculus
gtgggaaaacctttcagcccagtgc

SEQ ID NO: 711306 - DNA, 25 bp, Mus musculus
gtgggaaaacggctccttcataaat

SEQ ID NO: 711307 - DNA, 25 bp, Mus musculus
gtgggaaaacgggtccttcataaat

SEQ ID NO: 711308 - DNA, 25 bp, Mus musculus
gtgggaaaacttatgctgtgcactc

SEQ ID NO: 711309 - DNA, 25 bp, Mus musculus
gtgggaaaacttttgctgtgcactc

SEQ ID NO: 711310 - DNA, 25 bp, Mus musculus
gtgggaaacaaactctcttgcagac

SEQ ID NO: 711311 - DNA, 25 bp, Mus musculus
gtgggaaacaaagtctcttgcagac

SEQ ID NO: 711312 - DNA, 25 bp, Mus musculus
gtgggaaagaagacacctgtttctg

SEQ ID NO: 711313 - DNA, 25 bp, Mus musculus
gtgggaaagaagtcacctgtttctg

SEQ ID NO: 711314 - DNA, 25 bp, Mus musculus
gtgggaaagacaccagaactccctc

SEQ ID NO: 711315 - DNA, 25 bp, Mus musculus
gtgggaaagacagcagaactccctc

SEQ ID NO: 711316 - DNA, 25 bp, Mus musculus
gtgggaaagccaccaaacgttccta

SEQ ID NO: 711317 - DNA, 25 bp, Mus musculus
gtgggaaagccagcaaacgttccta

SEQ ID NO: 711318 - DNA, 25 bp, Mus musculus
gtgggaaaggctatactctgaattc

SEQ ID NO: 711319 - DNA, 25 bp, Mus musculus
gtgggaaaggctttactctgaattc

SEQ ID NO: 711320 - DNA, 25 bp, Mus musculus
gtgggaaatcctacagtactcatgg

SEQ ID NO: 711321 - DNA, 25 bp, Mus musculus
gtgggaaatccttcagtactcatgg

SEQ ID NO: 711322 - DNA, 25 bp, Mus musculus
gtgggaaatcgaatactctatcgct

SEQ ID NO: 711323 - DNA, 25 bp, Mus musculus
gtgggaaatcgattactctatcgct

SEQ ID NO: 711324 - DNA, 25 bp, Mus musculus
gtgggaaattgccaggaacctcacc

SEQ ID NO: 711325 - DNA, 25 bp, Mus musculus
gtgggaaattgcgaggaacctcacc

SEQ ID NO: 711326 - DNA, 25 bp, Mus musculus
gtgggaacacttatacaaacatcca

SEQ ID NO: 711327 - DNA, 25 bp, Mus musculus
gtgggaacacttttacaaacatcca

SEQ ID NO: 711328 - DNA, 25 bp, Mus musculus
gtgggaacagcaccacagcgccttc

SEQ ID NO: 711329 - DNA, 25 bp, Mus musculus
gtgggaacagcagcacagcgccttc

SEQ ID NO: 711330 - DNA, 25 bp, Mus musculus
gtgggaacagggaagactaatcagt

SEQ ID NO: 711331 - DNA, 25 bp, Mus musculus
gtgggaacagggtagactaatcagt

SEQ ID NO: 711332 - DNA, 25 bp, Mus musculus
gtgggaacatgtacctggcctctgt

SEQ ID NO: 711333 - DNA, 25 bp, Mus musculus
gtgggaacatgttcctggcctctgt

SEQ ID NO: 711334 - DNA, 25 bp, Mus musculus
gtgggaaccatacacactgtctcag

SEQ ID NO: 711335 - DNA, 25 bp, Mus musculus
gtgggaaccatagacactgtctcag

SEQ ID NO: 711336 - DNA, 25 bp, Mus musculus
gtgggaacccatctaaataagtaga

SEQ ID NO: 711337 - DNA, 25 bp, Mus musculus
gtgggaacccatgtaaataagtaga

SEQ ID NO: 711338 - DNA, 25 bp, Mus musculus
gtgggaacccctcgatatgcaactg

SEQ ID NO: 711339 - DNA, 25 bp, Mus musculus
gtgggaacccctggatatgcaactg

SEQ ID NO: 711340 - DNA, 25 bp, Mus musculus
gtgggaaccgcgacattccaaagtg

SEQ ID NO: 711341 - DNA, 25 bp, Mus musculus
gtgggaaccgcgtcattccaaagtg

SEQ ID NO: 711342 - DNA, 25 bp, Mus musculus
gtgggaaccgtgatctccagctgtc

SEQ ID NO: 711343 - DNA, 25 bp, Mus musculus
gtgggaaccgtgttctccagctgtc

SEQ ID NO: 711344 - DNA, 25 bp, Mus musculus
gtgggaacctcgcaagttgtgacct

SEQ ID NO: 711345 - DNA, 25 bp, Mus musculus
gtgggaacctcggaagttgtgacct

SEQ ID NO: 711346 - DNA, 25 bp, Mus musculus
gtgggaacctggcaaccggctctct

SEQ ID NO: 711347 - DNA, 25 bp, Mus musculus
gtgggaacctgggaaccggctctct

SEQ ID NO: 711348 - DNA, 25 bp, Mus musculus
gtgggaacgctgacctcgtacatgg

SEQ ID NO: 711349 - DNA, 25 bp, Mus musculus
gtgggaacgctgtcctcgtacatgg

SEQ ID NO: 711350 - DNA, 25 bp, Mus musculus
gtgggaacgtacaatcctgacacaa

SEQ ID NO: 711351 - DNA, 25 bp, Mus musculus
gtgggaacgtactatcctgacacaa

SEQ ID NO: 711352 - DNA, 25 bp, Mus musculus
gtgggaactcacaactcgggaagaa

SEQ ID NO: 711353 - DNA, 25 bp, Mus musculus
gtgggaactcactactcgggaagaa

SEQ ID NO: 711354 - DNA, 25 bp, Mus musculus
gtgggaactgaccaattctagagga

SEQ ID NO: 711355 - DNA, 25 bp, Mus musculus
gtgggaactgacgaattctagagga

SEQ ID NO: 711356 - DNA, 25 bp, Mus musculus
gtgggaactgtaactcaacaatttg

SEQ ID NO: 711357 - DNA, 25 bp, Mus musculus
gtgggaactgtatctcaacaatttg

SEQ ID NO: 711358 - DNA, 25 bp, Mus musculus
gtgggaactgttatccagctctttc

SEQ ID NO: 711359 - DNA, 25 bp, Mus musculus
gtgggaactgttttccagctctttc

SEQ ID NO: 711360 - DNA, 25 bp, Mus musculus
gtgggaacttggaaccataattact

SEQ ID NO: 711361 - DNA, 25 bp, Mus musculus
gtgggaacttggtaccataattact

SEQ ID NO: 711362 - DNA, 25 bp, Mus musculus
gtgggaactttaatcttaaggcaag

SEQ ID NO: 711363 - DNA, 25 bp, Mus musculus
gtgggaactttattcttaaggcaag

SEQ ID NO: 711364 - DNA, 25 bp, Mus musculus
gtgggaactttcctccattaatgta

SEQ ID NO: 711365 - DNA, 25 bp, Mus musculus
gtgggaactttcgtccattaatgta

SEQ ID NO: 711366 - DNA, 25 bp, Mus musculus
gtgggaagcagcagtgaactgtgac

SEQ ID NO: 711367 - DNA, 25 bp, Mus musculus
gtgggaagcagctgtgaactgtgac

SEQ ID NO: 711368 - DNA, 25 bp, Mus musculus
gtgggaagcagtattgtaccgcact

SEQ ID NO: 711369 - DNA, 25 bp, Mus musculus
gtgggaagcagttttgtaccgcact

SEQ ID NO: 711370 - DNA, 25 bp, Mus musculus
gtgggaagccggatagctcctgacc

SEQ ID NO: 711371 - DNA, 25 bp, Mus musculus
gtgggaagccggttagctcctgacc

SEQ ID NO: 711372 - DNA, 25 bp, Mus musculus
gtgggaagccgtcaacaatcgccat

SEQ ID NO: 711373 - DNA, 25 bp, Mus musculus
gtgggaagccgtgaacaatcgccat

SEQ ID NO: 711374 - DNA, 25 bp, Mus musculus
gtgggaagctccaggtggtctacct

SEQ ID NO: 711375 - DNA, 25 bp, Mus musculus
gtgggaagctcctggtggtctacct

SEQ ID NO: 711376 - DNA, 25 bp, Mus musculus
gtgggaaggaatacatctggagctc

SEQ ID NO: 711377 - DNA, 25 bp, Mus musculus
gtgggaaggaattcatctggagctc

SEQ ID NO: 711378 - DNA, 25 bp, Mus musculus
gtgggaagggcgattcattctacat

SEQ ID NO: 711379 - DNA, 25 bp, Mus musculus
gtgggaagggcgtttcattctacat

SEQ ID NO: 711380 - DNA, 25 bp, Mus musculus
gtgggaaggtctatgctagatcaga

SEQ ID NO: 711381 - DNA, 25 bp, Mus musculus
gtgggaaggtctttgctagatcaga

SEQ ID NO: 711382 - DNA, 25 bp, Mus musculus
gtgggaagttcacaccagttaatcc

SEQ ID NO: 711383 - DNA, 25 bp, Mus musculus
gtgggaagttcagaccagttaatcc

SEQ ID NO: 711384 - DNA, 25 bp, Mus musculus
gtgggaataattcaatctgtgcctt

SEQ ID NO: 711385 - DNA, 25 bp, Mus musculus
gtgggaataattgaatctgtgcctt

SEQ ID NO: 711386 - DNA, 25 bp, Mus musculus
gtgggaatacacatactacagcaga

SEQ ID NO: 711387 - DNA, 25 bp, Mus musculus
gtgggaatacacttactacagcaga

SEQ ID NO: 711388 - DNA, 25 bp, Mus musculus
gtgggaataggcaccgactacgcct

SEQ ID NO: 711389 - DNA, 25 bp, Mus musculus
gtgggaataggccctaccgaggaag

SEQ ID NO: 711390 - DNA, 25 bp, Mus musculus
gtgggaataggcgctaccgaggaag

SEQ ID NO: 711391 - DNA, 25 bp, Mus musculus
gtgggaataggctccgactacgcct

SEQ ID NO: 711392 - DNA, 25 bp, Mus musculus
gtgggaataggtataaacctcattt

SEQ ID NO: 711393 - DNA, 25 bp, Mus musculus
gtgggaataggtttaaacctcattt

SEQ ID NO: 711394 - DNA, 25 bp, Mus musculus
gtgggaatatcccagtgctgcagaa

SEQ ID NO: 711395 - DNA, 25 bp, Mus musculus
gtgggaatatccgagtgctgcagaa

SEQ ID NO: 711396 - DNA, 25 bp, Mus musculus
gtgggaatcactcgccactggtgca

SEQ ID NO: 711397 - DNA, 25 bp, Mus musculus
gtgggaatcactggccactggtgca

SEQ ID NO: 711398 - DNA, 25 bp, Mus musculus
gtgggaatccctcatccctttttga

SEQ ID NO: 711399 - DNA, 25 bp, Mus musculus
gtgggaatccctgatccctttttga

SEQ ID NO: 711400 - DNA, 25 bp, Mus musculus
gtgggaatctcccaggctcttagaa

SEQ ID NO: 711401 - DNA, 25 bp, Mus musculus
gtgggaatctccgaggctcttagaa

SEQ ID NO: 711402 - DNA, 25 bp, Mus musculus
gtgggaatctgtccccttaattgcc

SEQ ID NO: 711403 - DNA, 25 bp, Mus musculus
gtgggaatctgtgcccttaattgcc

SEQ ID NO: 711404 - DNA, 25 bp, Mus musculus
gtgggaatcttgaatatatctgtaa

SEQ ID NO: 711405 - DNA, 25 bp, Mus musculus
gtgggaatcttgtatatatctgtaa

SEQ ID NO: 711406 - DNA, 25 bp, Mus musculus
gtgggaatgcctagccagatgtata

SEQ ID NO: 711407 - DNA, 25 bp, Mus musculus
gtgggaatgccttgccagatgtata

SEQ ID NO: 711408 - DNA, 25 bp, Mus musculus
gtgggaatggaaaccatgcccgcct

SEQ ID NO: 711409 - DNA, 25 bp, Mus musculus
gtgggaatggaatccatgcccgcct

SEQ ID NO: 711410 - DNA, 25 bp, Mus musculus
gtgggaatggtgattccagctctgt

SEQ ID NO: 711411 - DNA, 25 bp, Mus musculus
gtgggaatggtgtttccagctctgt

SEQ ID NO: 711412 - DNA, 25 bp, Mus musculus
gtgggaatgtatctctctgtgtgta

SEQ ID NO: 711413 - DNA, 25 bp, Mus musculus
gtgggaatgtatgtctctgtgtgta

SEQ ID NO: 711414 - DNA, 25 bp, Mus musculus
gtgggaattaggcatatgttcagaa

SEQ ID NO: 711415 - DNA, 25 bp, Mus musculus
gtgggaattagggatatgttcagaa

SEQ ID NO: 711416 - DNA, 25 bp, Mus musculus
gtgggaattcaacaggtactactaa

SEQ ID NO: 711417 - DNA, 25 bp, Mus musculus
gtgggaattcaagaggtactactaa

SEQ ID NO: 711418 - DNA, 25 bp, Mus musculus
gtgggaattgtccttggtctcctcc

SEQ ID NO: 711419 - DNA, 25 bp, Mus musculus
gtgggaattgtcgttggtctcctcc

SEQ ID NO: 711420 - DNA, 25 bp, Mus musculus
gtgggaattgtgatatttcaaacca

SEQ ID NO: 711421 - DNA, 25 bp, Mus musculus
gtgggaattgtgttatttcaaacca

SEQ ID NO: 711422 - DNA, 25 bp, Mus musculus
gtgggaattttgcaacgataagtat

SEQ ID NO: 711423 - DNA, 25 bp, Mus musculus
gtgggaattttggaacgataagtat

SEQ ID NO: 711424 - DNA, 25 bp, Mus musculus
gtgggacaaagtcattcctgactca

SEQ ID NO: 711425 - DNA, 25 bp, Mus musculus
gtgggacaaagtgattcctgactca

SEQ ID NO: 711426 - DNA, 25 bp, Mus musculus
gtgggacaagacaatacaccttctt

SEQ ID NO: 711427 - DNA, 25 bp, Mus musculus
gtgggacaagactatacaccttctt

SEQ ID NO: 711428 - DNA, 25 bp, Mus musculus
gtgggacaagcaatttggctaatta

SEQ ID NO: 711429 - DNA, 25 bp, Mus musculus
gtgggacaagcattttggctaatta

SEQ ID NO: 711430 - DNA, 25 bp, Mus musculus
gtgggacaaggcataaacagacacc

SEQ ID NO: 711431 - DNA, 25 bp, Mus musculus
gtgggacaaggcttaaacagacacc

SEQ ID NO: 711432 - DNA, 25 bp, Mus musculus
gtgggacaaggtattgagcattaat

SEQ ID NO: 711433 - DNA, 25 bp, Mus musculus
gtgggacaaggttttgagcattaat

SEQ ID NO: 711434 - DNA, 25 bp, Mus musculus
gtgggacaatcaccctccaactggt

SEQ ID NO: 711435 - DNA, 25 bp, Mus musculus
gtgggacaatcagcctccaactggt

SEQ ID NO: 711436 - DNA, 25 bp, Mus musculus
gtgggacacccaagaaaatccgatt

SEQ ID NO: 711437 - DNA, 25 bp, Mus musculus
gtgggacacccatgaaaatccgatt

SEQ ID NO: 711438 - DNA, 25 bp, Mus musculus
gtgggacactgaaggattgctttct

SEQ ID NO: 711439 - DNA, 25 bp, Mus musculus
gtgggacactgatggattgctttct

SEQ ID NO: 711440 - DNA, 25 bp, Mus musculus
gtgggacactgcaaacaggtatttt

SEQ ID NO: 711441 - DNA, 25 bp, Mus musculus
gtgggacactgcaattttactccag

SEQ ID NO: 711442 - DNA, 25 bp, Mus musculus
gtgggacactgctaacaggtatttt

SEQ ID NO: 711443 - DNA, 25 bp, Mus musculus
gtgggacactgctattttactccag

SEQ ID NO: 711444 - DNA, 25 bp, Mus musculus
gtgggacagagaacctagtaccttt

SEQ ID NO: 711445 - DNA, 25 bp, Mus musculus
gtgggacagagatcctagtaccttt

SEQ ID NO: 711446 - DNA, 25 bp, Mus musculus
gtgggacagggcaccatgggagacc

SEQ ID NO: 711447 - DNA, 25 bp, Mus musculus
gtgggacagggctccatgggagacc

SEQ ID NO: 711448 - DNA, 25 bp, Mus musculus
gtgggacatcaacagcttcgaccag

SEQ ID NO: 711449 - DNA, 25 bp, Mus musculus
gtgggacatcaagagcttcgaccag

SEQ ID NO: 711450 - DNA, 25 bp, Mus musculus
gtgggacatcctaaccaaagccagt

SEQ ID NO: 711451 - DNA, 25 bp, Mus musculus
gtgggacatccttaccaaagccagt

SEQ ID NO: 711452 - DNA, 25 bp, Mus musculus
gtgggaccacacaagacggtactct

SEQ ID NO: 711453 - DNA, 25 bp, Mus musculus
gtgggaccacacagcaaggccgtag

SEQ ID NO: 711454 - DNA, 25 bp, Mus musculus
gtgggaccacactagacggtactct

SEQ ID NO: 711455 - DNA, 25 bp, Mus musculus
gtgggaccacactgcaaggccgtag

SEQ ID NO: 711456 - DNA, 25 bp, Mus musculus
gtgggacccacaaggttactgggaa

SEQ ID NO: 711457 - DNA, 25 bp, Mus musculus
gtgggacccacatggttactgggaa

SEQ ID NO: 711458 - DNA, 25 bp, Mus musculus
gtgggacccactattcatatggaac

SEQ ID NO: 711459 - DNA, 25 bp, Mus musculus
gtgggacccacttttcatatggaac

SEQ ID NO: 711460 - DNA, 25 bp, Mus musculus
gtgggacccataattctatgttgtc

SEQ ID NO: 711461 - DNA, 25 bp, Mus musculus
gtgggacccatatttctatgttgtc

SEQ ID NO: 711462 - DNA, 25 bp, Mus musculus
gtgggaccctaaactagtcaaggag

SEQ ID NO: 711463 - DNA, 25 bp, Mus musculus
gtgggaccctaatctagtcaaggag

SEQ ID NO: 711464 - DNA, 25 bp, Mus musculus
gtgggaccctggacacacggacaca

SEQ ID NO: 711465 - DNA, 25 bp, Mus musculus
gtgggaccctggtcacacggacaca

SEQ ID NO: 711466 - DNA, 25 bp, Mus musculus
gtgggaccgatcactgaagcctatg

SEQ ID NO: 711467 - DNA, 25 bp, Mus musculus
gtgggaccgatctctgaagcctatg

SEQ ID NO: 711468 - DNA, 25 bp, Mus musculus
gtgggacctaggcaggatttccaca

SEQ ID NO: 711469 - DNA, 25 bp, Mus musculus
gtgggacctagggaggatttccaca

SEQ ID NO: 711470 - DNA, 25 bp, Mus musculus
gtgggacctcgcacggcagacagca

SEQ ID NO: 711471 - DNA, 25 bp, Mus musculus
gtgggacctcgctcggcagacagca

SEQ ID NO: 711472 - DNA, 25 bp, Mus musculus
gtgggacctgaaacgatccaggctt

SEQ ID NO: 711473 - DNA, 25 bp, Mus musculus
gtgggacctgaatcgatccaggctt

SEQ ID NO: 711474 - DNA, 25 bp, Mus musculus
gtgggaccttacaccagacttagag

SEQ ID NO: 711475 - DNA, 25 bp, Mus musculus
gtgggaccttactccagacttagag

SEQ ID NO: 711476 - DNA, 25 bp, Mus musculus
gtgggacgaataatttgatcttaat

SEQ ID NO: 711477 - DNA, 25 bp, Mus musculus
gtgggacgaatattttgatcttaat

SEQ ID NO: 711478 - DNA, 25 bp, Mus musculus
gtgggacgcctgaggtcctccatca

SEQ ID NO: 711479 - DNA, 25 bp, Mus musculus
gtgggacgcctgtggtcctccatca

SEQ ID NO: 711480 - DNA, 25 bp, Mus musculus
gtgggacgcgacaaatggtgccaaa

SEQ ID NO: 711481 - DNA, 25 bp, Mus musculus
gtgggacgcgactaatggtgccaaa

SEQ ID NO: 711482 - DNA, 25 bp, Mus musculus
gtgggacggctcacaagtgtccgaa

SEQ ID NO: 711483 - DNA, 25 bp, Mus musculus
gtgggacggctctcaagtgtccgaa

SEQ ID NO: 711484 - DNA, 25 bp, Mus musculus
gtgggacgtctgatacgacctgagc

SEQ ID NO: 711485 - DNA, 25 bp, Mus musculus
gtgggacgtctgttacgacctgagc

SEQ ID NO: 711486 - DNA, 25 bp, Mus musculus
gtgggactactaaagcatttggaat

SEQ ID NO: 711487 - DNA, 25 bp, Mus musculus
gtgggactactatagcatttggaat

SEQ ID NO: 711488 - DNA, 25 bp, Mus musculus
gtgggactagttcagcacagtgtac

SEQ ID NO: 711489 - DNA, 25 bp, Mus musculus
gtgggactagttgagcacagtgtac

SEQ ID NO: 711490 - DNA, 25 bp, Mus musculus
gtgggactcacgacttggctttgac

SEQ ID NO: 711491 - DNA, 25 bp, Mus musculus
gtgggactcacgtcttggctttgac

SEQ ID NO: 711492 - DNA, 25 bp, Mus musculus
gtgggactcatacggtagtcctaat

SEQ ID NO: 711493 - DNA, 25 bp, Mus musculus
gtgggactcatagggtagtcctaat

SEQ ID NO: 711494 - DNA, 25 bp, Mus musculus
gtgggactcatcatcatatctttat

SEQ ID NO: 711495 - DNA, 25 bp, Mus musculus
gtgggactcatcttcatatctttat

SEQ ID NO: 711496 - DNA, 25 bp, Mus musculus
gtgggactccaaactgaatcctcta

SEQ ID NO: 711497 - DNA, 25 bp, Mus musculus
gtgggactccaatctgaatcctcta

SEQ ID NO: 711498 - DNA, 25 bp, Mus musculus
gtgggactcccaaccaaacaacatt

SEQ ID NO: 711499 - DNA, 25 bp, Mus musculus
gtgggactcccatccaaacaacatt

SEQ ID NO: 711500 - DNA, 25 bp, Mus musculus
gtgggactcggtcatccaagcgcat

SEQ ID NO: 711501 - DNA, 25 bp, Mus musculus
gtgggactcggtgatccaagcgcat

SEQ ID NO: 711502 - DNA, 25 bp, Mus musculus
gtgggactctggaatatgaactatc

SEQ ID NO: 711503 - DNA, 25 bp, Mus musculus
gtgggactctggtatatgaactatc

SEQ ID NO: 711504 - DNA, 25 bp, Mus musculus
gtgggactgctacattatttcgcaa

SEQ ID NO: 711505 - DNA, 25 bp, Mus musculus
gtgggactgctagattatttcgcaa

SEQ ID NO: 711506 - DNA, 25 bp, Mus musculus
gtgggactgctgcagcccatcaaca

SEQ ID NO: 711507 - DNA, 25 bp, Mus musculus
gtgggactgctggagcccatcaaca

SEQ ID NO: 711508 - DNA, 25 bp, Mus musculus
gtgggactggaaagggctgcggcat

SEQ ID NO: 711509 - DNA, 25 bp, Mus musculus
gtgggactggaatgggctgcggcat

SEQ ID NO: 711510 - DNA, 25 bp, Mus musculus
gtgggactgtccacataatggctca

SEQ ID NO: 711511 - DNA, 25 bp, Mus musculus
gtgggactgtcctcataatggctca

SEQ ID NO: 711512 - DNA, 25 bp, Mus musculus
gtgggacttagtacatgctcaataa

SEQ ID NO: 711513 - DNA, 25 bp, Mus musculus
gtgggacttagttcatgctcaataa

SEQ ID NO: 711514 - DNA, 25 bp, Mus musculus
gtgggacttcgtcatttaatttctt

SEQ ID NO: 711515 - DNA, 25 bp, Mus musculus
gtgggacttcgtgatttaatttctt

SEQ ID NO: 711516 - DNA, 25 bp, Mus musculus
gtgggacttgtgcaatacgattttt

SEQ ID NO: 711517 - DNA, 25 bp, Mus musculus
gtgggacttgtggaatacgattttt

SEQ ID NO: 711518 - DNA, 25 bp, Mus musculus
gtgggagaacctctcctgggtacct

SEQ ID NO: 711519 - DNA, 25 bp, Mus musculus
gtgggagaacctgtcctgggtacct

SEQ ID NO: 711520 - DNA, 25 bp, Mus musculus
gtgggagaagccaacctcgctctgg

SEQ ID NO: 711521 - DNA, 25 bp, Mus musculus
gtgggagaagcctacctcgctctgg

SEQ ID NO: 711522 - DNA, 25 bp, Mus musculus
gtgggagaatcccaacgtcctgtgc

SEQ ID NO: 711523 - DNA, 25 bp, Mus musculus
gtgggagaatccgaacgtcctgtgc

SEQ ID NO: 711524 - DNA, 25 bp, Mus musculus
gtgggagaccttcaccaatgcactg

SEQ ID NO: 711525 - DNA, 25 bp, Mus musculus
gtgggagaccttgaccaatgcactg

SEQ ID NO: 711526 - DNA, 25 bp, Mus musculus
gtgggagacgaacctcctaacctca

SEQ ID NO: 711527 - DNA, 25 bp, Mus musculus
gtgggagacgaagctcctaacctca

SEQ ID NO: 711528 - DNA, 25 bp, Mus musculus
gtgggagactggatctaggacaata

SEQ ID NO: 711529 - DNA, 25 bp, Mus musculus
gtgggagactggttctaggacaata

SEQ ID NO: 711530 - DNA, 25 bp, Mus musculus
gtgggagagacacccatagcccctc

SEQ ID NO: 711531 - DNA, 25 bp, Mus musculus
gtgggagagacagccatagcccctc

SEQ ID NO: 711532 - DNA, 25 bp, Mus musculus
gtgggagagcccacggatccctgat

SEQ ID NO: 711533 - DNA, 25 bp, Mus musculus
gtgggagagccctcggatccctgat

SEQ ID NO: 711534 - DNA, 25 bp, Mus musculus
gtgggagagcgcatatgtaacctgc

SEQ ID NO: 711535 - DNA, 25 bp, Mus musculus
gtgggagagcgcttatgtaacctgc

SEQ ID NO: 711536 - DNA, 25 bp, Mus musculus
gtgggagaggccatactcttaagtt

SEQ ID NO: 711537 - DNA, 25 bp, Mus musculus
gtgggagaggccttactcttaagtt

SEQ ID NO: 711538 - DNA, 25 bp, Mus musculus
gtgggagagttcaatctacactatt

SEQ ID NO: 711539 - DNA, 25 bp, Mus musculus
gtgggagagttctatctacactatt

SEQ ID NO: 711540 - DNA, 25 bp, Mus musculus
gtgggagatccacttcacaggtcat

SEQ ID NO: 711541 - DNA, 25 bp, Mus musculus
gtgggagatccagttcacaggtcat

SEQ ID NO: 711542 - DNA, 25 bp, Mus musculus
gtgggagatctaccatctgcttgca

SEQ ID NO: 711543 - DNA, 25 bp, Mus musculus
gtgggagatctagcatctgcttgca

SEQ ID NO: 711544 - DNA, 25 bp, Mus musculus
gtgggagatgacctcacggtaacca

SEQ ID NO: 711545 - DNA, 25 bp, Mus musculus
gtgggagatgacgtcacggtaacca

SEQ ID NO: 711546 - DNA, 25 bp, Mus musculus
gtgggagattccagtgctagctcag

SEQ ID NO: 711547 - DNA, 25 bp, Mus musculus
gtgggagattcctgtgctagctcag

SEQ ID NO: 711548 - DNA, 25 bp, Mus musculus
gtgggagcaaggactgtctccctca

SEQ ID NO: 711549 - DNA, 25 bp, Mus musculus
gtgggagcaaggtctgtctccctca

SEQ ID NO: 711550 - DNA, 25 bp, Mus musculus
gtgggagcaataagacgtgacctat

SEQ ID NO: 711551 - DNA, 25 bp, Mus musculus
gtgggagcaatatgacgtgacctat

SEQ ID NO: 711552 - DNA, 25 bp, Mus musculus
gtgggagcactgatcataggaacat

SEQ ID NO: 711553 - DNA, 25 bp, Mus musculus
gtgggagcactgttcataggaacat

SEQ ID NO: 711554 - DNA, 25 bp, Mus musculus
gtgggagcagacacgttctgtgact

SEQ ID NO: 711555 - DNA, 25 bp, Mus musculus
gtgggagcagacaggccaccggcct

SEQ ID NO: 711556 - DNA, 25 bp, Mus musculus
gtgggagcagactcgttctgtgact

SEQ ID NO: 711557 - DNA, 25 bp, Mus musculus
gtgggagcagactggccaccggcct

SEQ ID NO: 711558 - DNA, 25 bp, Mus musculus
gtgggagcagtgcaagctcaaccaa

SEQ ID NO: 711559 - DNA, 25 bp, Mus musculus
gtgggagcagtggaagctcaaccaa

SEQ ID NO: 711560 - DNA, 25 bp, Mus musculus
gtgggagcatgcattcatcttctcg

SEQ ID NO: 711561 - DNA, 25 bp, Mus musculus
gtgggagcatgctttcatcttctcg

SEQ ID NO: 711562 - DNA, 25 bp, Mus musculus
gtgggagccagtaaagttattttct

SEQ ID NO: 711563 - DNA, 25 bp, Mus musculus
gtgggagccagtattctcttagcgg

SEQ ID NO: 711564 - DNA, 25 bp, Mus musculus
gtgggagccagttaagttattttct

SEQ ID NO: 711565 - DNA, 25 bp, Mus musculus
gtgggagccagttttctcttagcgg

SEQ ID NO: 711566 - DNA, 25 bp, Mus musculus
gtgggagccatgacggtcaaaaatt

SEQ ID NO: 711567 - DNA, 25 bp, Mus musculus
gtgggagccatgtcggtcaaaaatt

SEQ ID NO: 711568 - DNA, 25 bp, Mus musculus
gtgggagcccagagaagactcctga

SEQ ID NO: 711569 - DNA, 25 bp, Mus musculus
gtgggagcccagtgaagactcctga

SEQ ID NO: 711570 - DNA, 25 bp, Mus musculus
gtgggagcccataggagatctcttt

SEQ ID NO: 711571 - DNA, 25 bp, Mus musculus
gtgggagcccattggagatctcttt

SEQ ID NO: 711572 - DNA, 25 bp, Mus musculus
gtgggagcctgaccttgacttccag

SEQ ID NO: 711573 - DNA, 25 bp, Mus musculus
gtgggagcctgagcttgacttccag

SEQ ID NO: 711574 - DNA, 25 bp, Mus musculus
gtgggagcctgtaactaactaccag

SEQ ID NO: 711575 - DNA, 25 bp, Mus musculus
gtgggagcctgttactaactaccag

SEQ ID NO: 711576 - DNA, 25 bp, Mus musculus
gtgggagcgctgaggcactcttcca

SEQ ID NO: 711577 - DNA, 25 bp, Mus musculus
gtgggagcgctgtggcactcttcca

SEQ ID NO: 711578 - DNA, 25 bp, Mus musculus
gtgggaggatcaatagttcaagccc

SEQ ID NO: 711579 - DNA, 25 bp, Mus musculus
gtgggaggatcattagttcaagccc

SEQ ID NO: 711580 - DNA, 25 bp, Mus musculus
gtgggaggatccagctcctaaactg

SEQ ID NO: 711581 - DNA, 25 bp, Mus musculus
gtgggaggatcctgctcctaaactg

SEQ ID NO: 711582 - DNA, 25 bp, Mus musculus
gtgggaggcatgacacacccgtgca

SEQ ID NO: 711583 - DNA, 25 bp, Mus musculus
gtgggaggcatgtcacacccgtgca

SEQ ID NO: 711584 - DNA, 25 bp, Mus musculus
gtgggaggccatatgattttgttct

SEQ ID NO: 711585 - DNA, 25 bp, Mus musculus
gtgggaggccatttgattttgttct

SEQ ID NO: 711586 - DNA, 25 bp, Mus musculus
gtgggagggtacacttcatctccac

SEQ ID NO: 711587 - DNA, 25 bp, Mus musculus
gtgggagggtactcttcatctccac

SEQ ID NO: 711588 - DNA, 25 bp, Mus musculus
gtgggaggtctacagctgcttttta

SEQ ID NO: 711589 - DNA, 25 bp, Mus musculus
gtgggaggtctagagctgcttttta

SEQ ID NO: 711590 - DNA, 25 bp, Mus musculus
gtgggagtaataatagcttaattgt

SEQ ID NO: 711591 - DNA, 25 bp, Mus musculus
gtgggagtaatattagcttaattgt

SEQ ID NO: 711592 - DNA, 25 bp, Mus musculus
gtgggagtatggataatgctgaact

SEQ ID NO: 711593 - DNA, 25 bp, Mus musculus
gtgggagtatggttaatgctgaact

SEQ ID NO: 711594 - DNA, 25 bp, Mus musculus
gtgggagtcactcgcatgagtcact

SEQ ID NO: 711595 - DNA, 25 bp, Mus musculus
gtgggagtcactggcatgagtcact

SEQ ID NO: 711596 - DNA, 25 bp, Mus musculus
gtgggagtcctcactggtaacgaaa

SEQ ID NO: 711597 - DNA, 25 bp, Mus musculus
gtgggagtcctctctggtaacgaaa

SEQ ID NO: 711598 - DNA, 25 bp, Mus musculus
gtgggagtcggcagctgtttcacac

SEQ ID NO: 711599 - DNA, 25 bp, Mus musculus
gtgggagtcggctgctgtttcacac

SEQ ID NO: 711600 - DNA, 25 bp, Mus musculus
gtgggagtgaacaatcttagacatc

SEQ ID NO: 711601 - DNA, 25 bp, Mus musculus
gtgggagtgaactatcttagacatc

SEQ ID NO: 711602 - DNA, 25 bp, Mus musculus
gtgggagttcccagtcaacaatgaa

SEQ ID NO: 711603 - DNA, 25 bp, Mus musculus
gtgggagttccctgtcaacaatgaa

SEQ ID NO: 711604 - DNA, 25 bp, Mus musculus
gtgggataacctaccgtgatcagat

SEQ ID NO: 711605 - DNA, 25 bp, Mus musculus
gtgggataaccttccgtgatcagat

SEQ ID NO: 711606 - DNA, 25 bp, Mus musculus
gtgggatactcactgtggatactca

SEQ ID NO: 711607 - DNA, 25 bp, Mus musculus
gtgggatactcagtgtggatactca

SEQ ID NO: 711608 - DNA, 25 bp, Mus musculus
gtgggatatgacagcagcgttccag

SEQ ID NO: 711609 - DNA, 25 bp, Mus musculus
gtgggatatgactgcagcgttccag

SEQ ID NO: 711610 - DNA, 25 bp, Mus musculus
gtgggatcaaaacccagccctttga

SEQ ID NO: 711611 - DNA, 25 bp, Mus musculus
gtgggatcaaaagccagccctttga

SEQ ID NO: 711612 - DNA, 25 bp, Mus musculus
gtgggatcaaggctaactcctgctt

SEQ ID NO: 711613 - DNA, 25 bp, Mus musculus
gtgggatcaagggtaactcctgctt

SEQ ID NO: 711614 - DNA, 25 bp, Mus musculus
gtgggatcaattaaccctgctgttt

SEQ ID NO: 711615 - DNA, 25 bp, Mus musculus
gtgggatcaatttaccctgctgttt

SEQ ID NO: 711616 - DNA, 25 bp, Mus musculus
gtgggatcactacctatttgacttc

SEQ ID NO: 711617 - DNA, 25 bp, Mus musculus
gtgggatcactagctatttgacttc

SEQ ID NO: 711618 - DNA, 25 bp, Mus musculus
gtgggatcagagcttactatctttt

SEQ ID NO: 711619 - DNA, 25 bp, Mus musculus
gtgggatcagaggttactatctttt

SEQ ID NO: 711620 - DNA, 25 bp, Mus musculus
gtgggatccaagcatgttccttgtt

SEQ ID NO: 711621 - DNA, 25 bp, Mus musculus
gtgggatccaaggatgttccttgtt

SEQ ID NO: 711622 - DNA, 25 bp, Mus musculus
gtgggatccaataggttaagtgcct

SEQ ID NO: 711623 - DNA, 25 bp, Mus musculus
gtgggatccaattggttaagtgcct

SEQ ID NO: 711624 - DNA, 25 bp, Mus musculus
gtgggatccccgaactaaagatggt

SEQ ID NO: 711625 - DNA, 25 bp, Mus musculus
gtgggatccccgtactaaagatggt

SEQ ID NO: 711626 - DNA, 25 bp, Mus musculus
gtgggatccctcaaaaatctcagtt

SEQ ID NO: 711627 - DNA, 25 bp, Mus musculus
gtgggatccctctaaaatctcagtt

SEQ ID NO: 711628 - DNA, 25 bp, Mus musculus
gtgggatccgaccttaatggcagtt

SEQ ID NO: 711629 - DNA, 25 bp, Mus musculus
gtgggatccgacgttaatggcagtt

SEQ ID NO: 711630 - DNA, 25 bp, Mus musculus
gtgggatcggacaaccccatggaga

SEQ ID NO: 711631 - DNA, 25 bp, Mus musculus
gtgggatcggactaccccatggaga

SEQ ID NO: 711632 - DNA, 25 bp, Mus musculus
gtgggatctttgacctcaggctgga

SEQ ID NO: 711633 - DNA, 25 bp, Mus musculus
gtgggatctttgtcctcaggctgga

SEQ ID NO: 711634 - DNA, 25 bp, Mus musculus
gtgggatgacatcggctacagtttc

SEQ ID NO: 711635 - DNA, 25 bp, Mus musculus
gtgggatgacatgggctacagtttc

SEQ ID NO: 711636 - DNA, 25 bp, Mus musculus
gtgggatgaccacgtttgattttca

SEQ ID NO: 711637 - DNA, 25 bp, Mus musculus
gtgggatgaccaggtttgattttca

SEQ ID NO: 711638 - DNA, 25 bp, Mus musculus
gtgggatgcttactgccaggttaca

SEQ ID NO: 711639 - DNA, 25 bp, Mus musculus
gtgggatgcttagtgccaggttaca

SEQ ID NO: 711640 - DNA, 25 bp, Mus musculus
gtgggatggataagcctgtgtttac

SEQ ID NO: 711641 - DNA, 25 bp, Mus musculus
gtgggatggatatgcctgtgtttac

SEQ ID NO: 711642 - DNA, 25 bp, Mus musculus
gtgggatgtaacctcgtcactagat

SEQ ID NO: 711643 - DNA, 25 bp, Mus musculus
gtgggatgtaacgtcgtcactagat

SEQ ID NO: 711644 - DNA, 25 bp, Mus musculus
gtgggatgtgccaacattttgtagt

SEQ ID NO: 711645 - DNA, 25 bp, Mus musculus
gtgggatgtgcctacattttgtagt

SEQ ID NO: 711646 - DNA, 25 bp, Mus musculus
gtgggatgttgaccactacagacct

SEQ ID NO: 711647 - DNA, 25 bp, Mus musculus
gtgggatgttgagcactacagacct

SEQ ID NO: 711648 - DNA, 25 bp, Mus musculus
gtgggattaagcagcagtctacaaa

SEQ ID NO: 711649 - DNA, 25 bp, Mus musculus
gtgggattaagctgcagtctacaaa

SEQ ID NO: 711650 - DNA, 25 bp, Mus musculus
gtgggattcatgacccgaaaccatt

SEQ ID NO: 711651 - DNA, 25 bp, Mus musculus
gtgggattcatgtcccgaaaccatt

SEQ ID NO: 711652 - DNA, 25 bp, Mus musculus
gtgggattccagacatgagcctcta

SEQ ID NO: 711653 - DNA, 25 bp, Mus musculus
gtgggattccagtcatgagcctcta

SEQ ID NO: 711654 - DNA, 25 bp, Mus musculus
gtgggattcctactacactctgcag

SEQ ID NO: 711655 - DNA, 25 bp, Mus musculus
gtgggattcctagtacactctgcag

SEQ ID NO: 711656 - DNA, 25 bp, Mus musculus
gtgggattcgatcagtgagcttcta

SEQ ID NO: 711657 - DNA, 25 bp, Mus musculus
gtgggattcgatgagtgagcttcta

SEQ ID NO: 711658 - DNA, 25 bp, Mus musculus
gtgggattcttaccagcactgtgtt

SEQ ID NO: 711659 - DNA, 25 bp, Mus musculus
gtgggattcttagcagcactgtgtt

SEQ ID NO: 711660 - DNA, 25 bp, Mus musculus
gtgggattgagcactggccacactc

SEQ ID NO: 711661 - DNA, 25 bp, Mus musculus
gtgggattgagctctggccacactc

SEQ ID NO: 711662 - DNA, 25 bp, Mus musculus
gtgggattgagtactctgctttttt

SEQ ID NO: 711663 - DNA, 25 bp, Mus musculus
gtgggattgagttctctgctttttt

SEQ ID NO: 711664 - DNA, 25 bp, Mus musculus
gtgggattgggaatggcctactcca

SEQ ID NO: 711665 - DNA, 25 bp, Mus musculus
gtgggattgggattggcctactcca

SEQ ID NO: 711666 - DNA, 25 bp, Mus musculus
gtgggattgtcactggcgtactccc

SEQ ID NO: 711667 - DNA, 25 bp, Mus musculus
gtgggattgtcagtggcgtactccc

SEQ ID NO: 711668 - DNA, 25 bp, Mus musculus
gtgggatttaaaaatgttggacctg

SEQ ID NO: 711669 - DNA, 25 bp, Mus musculus
gtgggatttaaatatgttggacctg

SEQ ID NO: 711670 - DNA, 25 bp, Mus musculus
gtgggatttaggatctcatcacttt

SEQ ID NO: 711671 - DNA, 25 bp, Mus musculus
gtgggatttaggttctcatcacttt

SEQ ID NO: 711672 - DNA, 25 bp, Mus musculus
gtgggatttatacaggctcacctgt

SEQ ID NO: 711673 - DNA, 25 bp, Mus musculus
gtgggatttatagaggctcacctgt

SEQ ID NO: 711674 - DNA, 25 bp, Mus musculus
gtgggatttcccagctacagagagg

SEQ ID NO: 711675 - DNA, 25 bp, Mus musculus
gtgggatttccctgctacagagagg

SEQ ID NO: 711676 - DNA, 25 bp, Mus musculus
gtgggattttataatgctcattttt

SEQ ID NO: 711677 - DNA, 25 bp, Mus musculus
gtgggattttattatgctcattttt

SEQ ID NO: 711678 - DNA, 25 bp, Mus musculus
gtgggattttgtccacaggaaccat

SEQ ID NO: 711679 - DNA, 25 bp, Mus musculus
gtgggattttgtgcacaggaaccat

SEQ ID NO: 711680 - DNA, 25 bp, Mus musculus
gtgggcaaagctatgcatctgtcct

SEQ ID NO: 711681 - DNA, 25 bp, Mus musculus
gtgggcaaagctttgcatctgtcct

SEQ ID NO: 711682 - DNA, 25 bp, Mus musculus
gtgggcaaaggtcaatccattctca

SEQ ID NO: 711683 - DNA, 25 bp, Mus musculus
gtgggcaaaggtgaatccattctca

SEQ ID NO: 711684 - DNA, 25 bp, Mus musculus
gtgggcaacccgctggtagccaata

SEQ ID NO: 711685 - DNA, 25 bp, Mus musculus
gtgggcaacccggtggtagccaata

SEQ ID NO: 711686 - DNA, 25 bp, Mus musculus
gtgggcaactacactgggtcactgc

SEQ ID NO: 711687 - DNA, 25 bp, Mus musculus
gtgggcaactactctgggtcactgc

SEQ ID NO: 711688 - DNA, 25 bp, Mus musculus
gtgggcaactgaaaacttctgtggc

SEQ ID NO: 711689 - DNA, 25 bp, Mus musculus
gtgggcaactgataacttctgtggc

SEQ ID NO: 711690 - DNA, 25 bp, Mus musculus
gtgggcaacttgaaaaggccatttg

SEQ ID NO: 711691 - DNA, 25 bp, Mus musculus
gtgggcaacttgtaaaggccatttg

SEQ ID NO: 711692 - DNA, 25 bp, Mus musculus
gtgggcaagaatacatcctgaacct

SEQ ID NO: 711693 - DNA, 25 bp, Mus musculus
gtgggcaagaattcatcctgaacct

SEQ ID NO: 711694 - DNA, 25 bp, Mus musculus
gtgggcaagacacccatcgagaccc

SEQ ID NO: 711695 - DNA, 25 bp, Mus musculus
gtgggcaagacagccatcgagaccc

SEQ ID NO: 711696 - DNA, 25 bp, Mus musculus
gtgggcaagatgactcaacagataa

SEQ ID NO: 711697 - DNA, 25 bp, Mus musculus
gtgggcaagatgtctcaacagataa

SEQ ID NO: 711698 - DNA, 25 bp, Mus musculus
gtgggcaagccccaatctccagaga

SEQ ID NO: 711699 - DNA, 25 bp, Mus musculus
gtgggcaagcccgaatctccagaga

SEQ ID NO: 711700 - DNA, 25 bp, Mus musculus
gtgggcaagcgcatgtatgaacagc

SEQ ID NO: 711701 - DNA, 25 bp, Mus musculus
gtgggcaagcgcttgtatgaacagc

SEQ ID NO: 711702 - DNA, 25 bp, Mus musculus
gtgggcaagcttcttttgggcatcc

SEQ ID NO: 711703 - DNA, 25 bp, Mus musculus
gtgggcaagcttgttttgggcatcc

SEQ ID NO: 711704 - DNA, 25 bp, Mus musculus
gtgggcaagggtctgccaagacagg

SEQ ID NO: 711705 - DNA, 25 bp, Mus musculus
gtgggcaagggtgtgccaagacagg

SEQ ID NO: 711706 - DNA, 25 bp, Mus musculus
gtgggcaatgatactggtcgagtaa

SEQ ID NO: 711707 - DNA, 25 bp, Mus musculus
gtgggcaatgattctggtcgagtaa

SEQ ID NO: 711708 - DNA, 25 bp, Mus musculus
gtgggcaatgctcacacagactcat

SEQ ID NO: 711709 - DNA, 25 bp, Mus musculus
gtgggcaatgctgacacagactcat

SEQ ID NO: 711710 - DNA, 25 bp, Mus musculus
gtgggcaatgtgacaccagctcgcc

SEQ ID NO: 711711 - DNA, 25 bp, Mus musculus
gtgggcaatgtgtcaccagctcgcc

SEQ ID NO: 711712 - DNA, 25 bp, Mus musculus
gtgggcacacaaaggagaggtacat

SEQ ID NO: 711713 - DNA, 25 bp, Mus musculus
gtgggcacacaatggagaggtacat

SEQ ID NO: 711714 - DNA, 25 bp, Mus musculus
gtgggcacacctctgtattaattgt

SEQ ID NO: 711715 - DNA, 25 bp, Mus musculus
gtgggcacacctgtgtattaattgt

SEQ ID NO: 711716 - DNA, 25 bp, Mus musculus
gtgggcacactgaattgtttcctaa

SEQ ID NO: 711717 - DNA, 25 bp, Mus musculus
gtgggcacactgtattgtttcctaa

SEQ ID NO: 711718 - DNA, 25 bp, Mus musculus
gtgggcacagcaagcgcatgtgcct

SEQ ID NO: 711719 - DNA, 25 bp, Mus musculus
gtgggcacagcatgcgcatgtgcct

SEQ ID NO: 711720 - DNA, 25 bp, Mus musculus
gtgggcacagtgctgccccttgcaa

SEQ ID NO: 711721 - DNA, 25 bp, Mus musculus
gtgggcacagtggtgccccttgcaa

SEQ ID NO: 711722 - DNA, 25 bp, Mus musculus
gtgggcacagttcttgcagagacca

SEQ ID NO: 711723 - DNA, 25 bp, Mus musculus
gtgggcacagttgttgcagagacca

SEQ ID NO: 711724 - DNA, 25 bp, Mus musculus
gtgggcaccaagctccaggttgaaa

SEQ ID NO: 711725 - DNA, 25 bp, Mus musculus
gtgggcaccaaggtccaggttgaaa

SEQ ID NO: 711726 - DNA, 25 bp, Mus musculus
gtgggcaccagacaccaatagtgtc

SEQ ID NO: 711727 - DNA, 25 bp, Mus musculus
gtgggcaccagagaccaatagtgtc

SEQ ID NO: 711728 - DNA, 25 bp, Mus musculus
gtgggcaccagcaatgcattcagtg

SEQ ID NO: 711729 - DNA, 25 bp, Mus musculus
gtgggcaccagctatgcattcagtg

SEQ ID NO: 711730 - DNA, 25 bp, Mus musculus
gtgggcaccatcattgacagtggtc

SEQ ID NO: 711731 - DNA, 25 bp, Mus musculus
gtgggcaccatctttgacagtggtc

SEQ ID NO: 711732 - DNA, 25 bp, Mus musculus
gtgggcaccattctatggaacaggt

SEQ ID NO: 711733 - DNA, 25 bp, Mus musculus
gtgggcaccattgtatggaacaggt

SEQ ID NO: 711734 - DNA, 25 bp, Mus musculus
gtgggcacccgcattaagatagcct

SEQ ID NO: 711735 - DNA, 25 bp, Mus musculus
gtgggcacccgctttaagatagcct

SEQ ID NO: 711736 - DNA, 25 bp, Mus musculus
gtgggcaccctacacttagttgtta

SEQ ID NO: 711737 - DNA, 25 bp, Mus musculus
gtgggcaccctagacttagttgtta

SEQ ID NO: 711738 - DNA, 25 bp, Mus musculus
gtgggcaccgtgatcatgatgaaaa

SEQ ID NO: 711739 - DNA, 25 bp, Mus musculus
gtgggcaccgtgttcatgatgaaaa

SEQ ID NO: 711740 - DNA, 25 bp, Mus musculus
gtgggcaccttcatggtgcgcgaca

SEQ ID NO: 711741 - DNA, 25 bp, Mus musculus
gtgggcaccttcttggtgcgcgaca

SEQ ID NO: 711742 - DNA, 25 bp, Mus musculus
gtgggcacgattatgtacttagaat

SEQ ID NO: 711743 - DNA, 25 bp, Mus musculus
gtgggcacgattttgtacttagaat

SEQ ID NO: 711744 - DNA, 25 bp, Mus musculus
gtgggcacgcagagagtcctttgat

SEQ ID NO: 711745 - DNA, 25 bp, Mus musculus
gtgggcacgcagtgagtcctttgat

SEQ ID NO: 711746 - DNA, 25 bp, Mus musculus
gtgggcactataactctagcttgca

SEQ ID NO: 711747 - DNA, 25 bp, Mus musculus
gtgggcactatatctctagcttgca

SEQ ID NO: 711748 - DNA, 25 bp, Mus musculus
gtgggcactcatatcatcaacaagc

SEQ ID NO: 711749 - DNA, 25 bp, Mus musculus
gtgggcactcatttcatcaacaagc

SEQ ID NO: 711750 - DNA, 25 bp, Mus musculus
gtgggcactggaattggatgatttc

SEQ ID NO: 711751 - DNA, 25 bp, Mus musculus
gtgggcactggatttggatgatttc

SEQ ID NO: 711752 - DNA, 25 bp, Mus musculus
gtgggcacttacacctaagacagga

SEQ ID NO: 711753 - DNA, 25 bp, Mus musculus
gtgggcacttactcctaagacagga

SEQ ID NO: 711754 - DNA, 25 bp, Mus musculus
gtgggcagaatgatgttgtacaagt

SEQ ID NO: 711755 - DNA, 25 bp, Mus musculus
gtgggcagaatgttgttgtacaagt

SEQ ID NO: 711756 - DNA, 25 bp, Mus musculus
gtgggcagactgagacaccaagcct

SEQ ID NO: 711757 - DNA, 25 bp, Mus musculus
gtgggcagactgtgacaccaagcct

SEQ ID NO: 711758 - DNA, 25 bp, Mus musculus
gtgggcagagatcaacagccttccc

SEQ ID NO: 711759 - DNA, 25 bp, Mus musculus
gtgggcagagatgaacagccttccc

SEQ ID NO: 711760 - DNA, 25 bp, Mus musculus
gtgggcagagtgaattgcctccaca

SEQ ID NO: 711761 - DNA, 25 bp, Mus musculus
gtgggcagagtgtattgcctccaca

SEQ ID NO: 711762 - DNA, 25 bp, Mus musculus
gtgggcagagttagcagacctttaa

SEQ ID NO: 711763 - DNA, 25 bp, Mus musculus
gtgggcagagtttgcagacctttaa

SEQ ID NO: 711764 - DNA, 25 bp, Mus musculus
gtgggcagataaactacttccctct

SEQ ID NO: 711765 - DNA, 25 bp, Mus musculus
gtgggcagataatctacttccctct

SEQ ID NO: 711766 - DNA, 25 bp, Mus musculus
gtgggcagattcaagctcagaccat

SEQ ID NO: 711767 - DNA, 25 bp, Mus musculus
gtgggcagattctagctcagaccat

SEQ ID NO: 711768 - DNA, 25 bp, Mus musculus
gtgggcagcacacatttgcactgta

SEQ ID NO: 711769 - DNA, 25 bp, Mus musculus
gtgggcagcacaccattggctccct

SEQ ID NO: 711770 - DNA, 25 bp, Mus musculus
gtgggcagcacagatttgcactgta

SEQ ID NO: 711771 - DNA, 25 bp, Mus musculus
gtgggcagcacagcattggctccct

SEQ ID NO: 711772 - DNA, 25 bp, Mus musculus
gtgggcagccaactaatgaagacct

SEQ ID NO: 711773 - DNA, 25 bp, Mus musculus
gtgggcagccaagtaatgaagacct

SEQ ID NO: 711774 - DNA, 25 bp, Mus musculus
gtgggcagcctgatgagaagtctca

SEQ ID NO: 711775 - DNA, 25 bp, Mus musculus
gtgggcagcctgttgagaagtctca

SEQ ID NO: 711776 - DNA, 25 bp, Mus musculus
gtgggcagctatatctacgacaagg

SEQ ID NO: 711777 - DNA, 25 bp, Mus musculus
gtgggcagctatttctacgacaagg

SEQ ID NO: 711778 - DNA, 25 bp, Mus musculus
gtgggcaggagtctaccccctacat

SEQ ID NO: 711779 - DNA, 25 bp, Mus musculus
gtgggcaggagtgtaccccctacat

SEQ ID NO: 711780 - DNA, 25 bp, Mus musculus
gtgggcaggcagacctctagtttaa

SEQ ID NO: 711781 - DNA, 25 bp, Mus musculus
gtgggcaggcagtcctctagtttaa

SEQ ID NO: 711782 - DNA, 25 bp, Mus musculus
gtgggcaggccaataatcctagcac

SEQ ID NO: 711783 - DNA, 25 bp, Mus musculus
gtgggcaggccattaatcctagcac

SEQ ID NO: 711784 - DNA, 25 bp, Mus musculus
gtgggcaggtcaaccagatacctgt

SEQ ID NO: 711785 - DNA, 25 bp, Mus musculus
gtgggcaggtcatccagatacctgt

SEQ ID NO: 711786 - DNA, 25 bp, Mus musculus
gtgggcagtatgacatctttatttt

SEQ ID NO: 711787 - DNA, 25 bp, Mus musculus
gtgggcagtatgtcatctttatttt

SEQ ID NO: 711788 - DNA, 25 bp, Mus musculus
gtgggcagtgatcgcattactctgc

SEQ ID NO: 711789 - DNA, 25 bp, Mus musculus
gtgggcagtgatggcattactctgc

SEQ ID NO: 711790 - DNA, 25 bp, Mus musculus
gtgggcagtgcacttttagtaccta

SEQ ID NO: 711791 - DNA, 25 bp, Mus musculus
gtgggcagtgcagttttagtaccta

SEQ ID NO: 711792 - DNA, 25 bp, Mus musculus
gtgggcagtgtgaatacacctgctg

SEQ ID NO: 711793 - DNA, 25 bp, Mus musculus
gtgggcagtgtgtatacacctgctg

SEQ ID NO: 711794 - DNA, 25 bp, Mus musculus
gtgggcagttccacaaaggtggcat

SEQ ID NO: 711795 - DNA, 25 bp, Mus musculus
gtgggcagttccattcagtgtatcc

SEQ ID NO: 711796 - DNA, 25 bp, Mus musculus
gtgggcagttcctcaaaggtggcat

SEQ ID NO: 711797 - DNA, 25 bp, Mus musculus
gtgggcagttcctttcagtgtatcc

SEQ ID NO: 711798 - DNA, 25 bp, Mus musculus
gtgggcatatacacatggccatggt

SEQ ID NO: 711799 - DNA, 25 bp, Mus musculus
gtgggcatatactcatggccatggt

SEQ ID NO: 711800 - DNA, 25 bp, Mus musculus
gtgggcatcagcatcgtggccggtg

SEQ ID NO: 711801 - DNA, 25 bp, Mus musculus
gtgggcatcagcttcgtggccggtg

SEQ ID NO: 711802 - DNA, 25 bp, Mus musculus
gtgggcatcattagtccttgtaaca

SEQ ID NO: 711803 - DNA, 25 bp, Mus musculus
gtgggcatcatttgtccttgtaaca

SEQ ID NO: 711804 - DNA, 25 bp, Mus musculus
gtgggcatccatatagcttcaggtt

SEQ ID NO: 711805 - DNA, 25 bp, Mus musculus
gtgggcatccatttagcttcaggtt

SEQ ID NO: 711806 - DNA, 25 bp, Mus musculus
gtgggcatccctactctggtggcaa

SEQ ID NO: 711807 - DNA, 25 bp, Mus musculus
gtgggcatcccttctctggtggcaa

SEQ ID NO: 711808 - DNA, 25 bp, Mus musculus
gtgggcatctccaacatagaacgtg

SEQ ID NO: 711809 - DNA, 25 bp, Mus musculus
gtgggcatctcctacatagaacgtg

SEQ ID NO: 711810 - DNA, 25 bp, Mus musculus
gtgggcatctctcgccaatctgtaa

SEQ ID NO: 711811 - DNA, 25 bp, Mus musculus
gtgggcatctctggccaatctgtaa

SEQ ID NO: 711812 - DNA, 25 bp, Mus musculus
gtgggcatgaaccagtgcgccacat

SEQ ID NO: 711813 - DNA, 25 bp, Mus musculus
gtgggcatgaacgagtgcgccacat

SEQ ID NO: 711814 - DNA, 25 bp, Mus musculus
gtgggcatggaaaccttgccttact

SEQ ID NO: 711815 - DNA, 25 bp, Mus musculus
gtgggcatggaatccttgccttact

SEQ ID NO: 711816 - DNA, 25 bp, Mus musculus
gtgggcatggccacttgctgcctgt

SEQ ID NO: 711817 - DNA, 25 bp, Mus musculus
gtgggcatggccatatctggttgat

SEQ ID NO: 711818 - DNA, 25 bp, Mus musculus
gtgggcatggcctcttgctgcctgt

SEQ ID NO: 711819 - DNA, 25 bp, Mus musculus
gtgggcatggccttatctggttgat

SEQ ID NO: 711820 - DNA, 25 bp, Mus musculus
gtgggcatgtgtctatccttccaca

SEQ ID NO: 711821 - DNA, 25 bp, Mus musculus
gtgggcatgtgtgtatccttccaca

SEQ ID NO: 711822 - DNA, 25 bp, Mus musculus
gtgggcattaatcttctgacttcag

SEQ ID NO: 711823 - DNA, 25 bp, Mus musculus
gtgggcattaatgttctgacttcag

SEQ ID NO: 711824 - DNA, 25 bp, Mus musculus
gtgggcattattagagactcttatg

SEQ ID NO: 711825 - DNA, 25 bp, Mus musculus
gtgggcattatttgagactcttatg

SEQ ID NO: 711826 - DNA, 25 bp, Mus musculus
gtgggcattctgcaggaagcaatac

SEQ ID NO: 711827 - DNA, 25 bp, Mus musculus
gtgggcattctggaggaagcaatac

SEQ ID NO: 711828 - DNA, 25 bp, Mus musculus
gtgggcattcttcatacttcaagtt

SEQ ID NO: 711829 - DNA, 25 bp, Mus musculus
gtgggcattcttgatacttcaagtt

SEQ ID NO: 711830 - DNA, 25 bp, Mus musculus
gtgggcattgtgcacaccaactgca

SEQ ID NO: 711831 - DNA, 25 bp, Mus musculus
gtgggcattgtggacaccaactgca

SEQ ID NO: 711832 - DNA, 25 bp, Mus musculus
gtgggcatttaaaccataagagtca

SEQ ID NO: 711833 - DNA, 25 bp, Mus musculus
gtgggcatttaatccataagagtca

SEQ ID NO: 711834 - DNA, 25 bp, Mus musculus
gtgggccaaacgaatgctatctctc

SEQ ID NO: 711835 - DNA, 25 bp, Mus musculus
gtgggccaaacgtatgctatctctc

SEQ ID NO: 711836 - DNA, 25 bp, Mus musculus
gtgggccaaaggaactgtttctctt

SEQ ID NO: 711837 - DNA, 25 bp, Mus musculus
gtgggccaaaggtactgtttctctt

SEQ ID NO: 711838 - DNA, 25 bp, Mus musculus
gtgggccaaatgctgcaaagtctca

SEQ ID NO: 711839 - DNA, 25 bp, Mus musculus
gtgggccaaatggtgcaaagtctca

SEQ ID NO: 711840 - DNA, 25 bp, Mus musculus
gtgggccaacagatcacaccatttt

SEQ ID NO: 711841 - DNA, 25 bp, Mus musculus
gtgggccaacagttcacaccatttt

SEQ ID NO: 711842 - DNA, 25 bp, Mus musculus
gtgggccaagcgagcaggaaacatt

SEQ ID NO: 711843 - DNA, 25 bp, Mus musculus
gtgggccaagcgtgcaggaaacatt

SEQ ID NO: 711844 - DNA, 25 bp, Mus musculus
gtgggccacgcgagatagcttagct

SEQ ID NO: 711845 - DNA, 25 bp, Mus musculus
gtgggccacgcgtgatagcttagct

SEQ ID NO: 711846 - DNA, 25 bp, Mus musculus
gtgggccactcgcacaatcgctgtg

SEQ ID NO: 711847 - DNA, 25 bp, Mus musculus
gtgggccactcggacaatcgctgtg

SEQ ID NO: 711848 - DNA, 25 bp, Mus musculus
gtgggccagaaacacctaactgagt

SEQ ID NO: 711849 - DNA, 25 bp, Mus musculus
gtgggccagaaacacttcaagtggt

SEQ ID NO: 711850 - DNA, 25 bp, Mus musculus
gtgggccagaaagacctaactgagt

SEQ ID NO: 711851 - DNA, 25 bp, Mus musculus
gtgggccagaaagacttcaagtggt

SEQ ID NO: 711852 - DNA, 25 bp, Mus musculus
gtgggccaggaaagtgcctaagttt

SEQ ID NO: 711853 - DNA, 25 bp, Mus musculus
gtgggccaggaatgtgcctaagttt

SEQ ID NO: 711854 - DNA, 25 bp, Mus musculus
gtgggccaggtaactatggttgcct

SEQ ID NO: 711855 - DNA, 25 bp, Mus musculus
gtgggccaggtatctatggttgcct

SEQ ID NO: 711856 - DNA, 25 bp, Mus musculus
gtgggccatcatacatagctaacaa

SEQ ID NO: 711857 - DNA, 25 bp, Mus musculus
gtgggccatcattcatagctaacaa

SEQ ID NO: 711858 - DNA, 25 bp, Mus musculus
gtgggccatctgcagggtcacctca

SEQ ID NO: 711859 - DNA, 25 bp, Mus musculus
gtgggccatctggagggtcacctca

SEQ ID NO: 711860 - DNA, 25 bp, Mus musculus
gtgggccattcaaaacagttgctta

SEQ ID NO: 711861 - DNA, 25 bp, Mus musculus
gtgggccattcataacagttgctta

SEQ ID NO: 711862 - DNA, 25 bp, Mus musculus
gtgggcccagtcacaaccaagaatg

SEQ ID NO: 711863 - DNA, 25 bp, Mus musculus
gtgggcccagtctcaaccaagaatg

SEQ ID NO: 711864 - DNA, 25 bp, Mus musculus
gtgggcccagtgctggctgccagca

SEQ ID NO: 711865 - DNA, 25 bp, Mus musculus
gtgggcccagtggtggctgccagca

SEQ ID NO: 711866 - DNA, 25 bp, Mus musculus
gtgggccccaacagaatgtctttct

SEQ ID NO: 711867 - DNA, 25 bp, Mus musculus
gtgggccccaactgaatgtctttct

SEQ ID NO: 711868 - DNA, 25 bp, Mus musculus
gtgggcccccaacttctagttagag

SEQ ID NO: 711869 - DNA, 25 bp, Mus musculus
gtgggcccccaagttctagttagag

SEQ ID NO: 711870 - DNA, 25 bp, Mus musculus
gtgggcccggtcataacagaggact

SEQ ID NO: 711871 - DNA, 25 bp, Mus musculus
gtgggcccggtcttaacagaggact

SEQ ID NO: 711872 - DNA, 25 bp, Mus musculus
gtgggccctgaacacatgacgctgt

SEQ ID NO: 711873 - DNA, 25 bp, Mus musculus
gtgggccctgaagacatgacgctgt

SEQ ID NO: 711874 - DNA, 25 bp, Mus musculus
gtgggccctgctaggcagtgaccaa

SEQ ID NO: 711875 - DNA, 25 bp, Mus musculus
gtgggccctgcttggcagtgaccaa

SEQ ID NO: 711876 - DNA, 25 bp, Mus musculus
gtgggccctggaaagtacgtatttg

SEQ ID NO: 711877 - DNA, 25 bp, Mus musculus
gtgggccctggatagtacgtatttg

SEQ ID NO: 711878 - DNA, 25 bp, Mus musculus
gtgggcccttgaacttgtctgcttt

SEQ ID NO: 711879 - DNA, 25 bp, Mus musculus
gtgggcccttgatcttgtctgcttt

SEQ ID NO: 711880 - DNA, 25 bp, Mus musculus
gtgggccctttacctttcttctgga

SEQ ID NO: 711881 - DNA, 25 bp, Mus musculus
gtgggccctttagctttcttctgga

SEQ ID NO: 711882 - DNA, 25 bp, Mus musculus
gtgggccgcactagaaagcaagtcc

SEQ ID NO: 711883 - DNA, 25 bp, Mus musculus
gtgggccgcacttgaaagcaagtcc

SEQ ID NO: 711884 - DNA, 25 bp, Mus musculus
gtgggccgcttcatgatgagccttg

SEQ ID NO: 711885 - DNA, 25 bp, Mus musculus
gtgggccgcttcattgggaataact

SEQ ID NO: 711886 - DNA, 25 bp, Mus musculus
gtgggccgcttcttgatgagccttg

SEQ ID NO: 711887 - DNA, 25 bp, Mus musculus
gtgggccgcttctttgggaataact

SEQ ID NO: 711888 - DNA, 25 bp, Mus musculus
gtgggcctagcaaaaactgtaaatc

SEQ ID NO: 711889 - DNA, 25 bp, Mus musculus
gtgggcctagcataaactgtaaatc

SEQ ID NO: 711890 - DNA, 25 bp, Mus musculus
gtgggcctagtccatgtttagtgaa

SEQ ID NO: 711891 - DNA, 25 bp, Mus musculus
gtgggcctagtcgatgtttagtgaa

SEQ ID NO: 711892 - DNA, 25 bp, Mus musculus
gtgggcctatctaacactgggagaa

SEQ ID NO: 711893 - DNA, 25 bp, Mus musculus
gtgggcctatcttacactgggagaa

SEQ ID NO: 711894 - DNA, 25 bp, Mus musculus
gtgggcctcatacataagacttcaa

SEQ ID NO: 711895 - DNA, 25 bp, Mus musculus
gtgggcctcatactcctggagagaa

SEQ ID NO: 711896 - DNA, 25 bp, Mus musculus
gtgggcctcatagataagacttcaa

SEQ ID NO: 711897 - DNA, 25 bp, Mus musculus
gtgggcctcatagtcctggagagaa

SEQ ID NO: 711898 - DNA, 25 bp, Mus musculus
gtgggcctcggaagcaccagtgtaa

SEQ ID NO: 711899 - DNA, 25 bp, Mus musculus
gtgggcctcggatgcaccagtgtaa

SEQ ID NO: 711900 - DNA, 25 bp, Mus musculus
gtgggcctctggaattacatctcta

SEQ ID NO: 711901 - DNA, 25 bp, Mus musculus
gtgggcctctggtattacatctcta

SEQ ID NO: 711902 - DNA, 25 bp, Mus musculus
gtgggcctctgtacagttgttactg

SEQ ID NO: 711903 - DNA, 25 bp, Mus musculus
gtgggcctctgttcagttgttactg

SEQ ID NO: 711904 - DNA, 25 bp, Mus musculus
gtgggcctgctcagctaataaggac

SEQ ID NO: 711905 - DNA, 25 bp, Mus musculus
gtgggcctgctctgctaataaggac

SEQ ID NO: 711906 - DNA, 25 bp, Mus musculus
gtgggcctggaactgaaaccatgaa

SEQ ID NO: 711907 - DNA, 25 bp, Mus musculus
gtgggcctggaagtgaaaccatgaa

SEQ ID NO: 711908 - DNA, 25 bp, Mus musculus
gtgggcctggctaatgccctcagaa

SEQ ID NO: 711909 - DNA, 25 bp, Mus musculus
gtgggcctggcttatgccctcagaa

SEQ ID NO: 711910 - DNA, 25 bp, Mus musculus
gtgggcctggtgaatagctataaat

SEQ ID NO: 711911 - DNA, 25 bp, Mus musculus
gtgggcctggtgctgtacatctcca

SEQ ID NO: 711912 - DNA, 25 bp, Mus musculus
gtgggcctggtggtgtacatctcca

SEQ ID NO: 711913 - DNA, 25 bp, Mus musculus
gtgggcctggtgtatagctataaat

SEQ ID NO: 711914 - DNA, 25 bp, Mus musculus
gtgggcctgtcacaaagcagcacgc

SEQ ID NO: 711915 - DNA, 25 bp, Mus musculus
gtgggcctgtcagaaagcagcacgc

SEQ ID NO: 711916 - DNA, 25 bp, Mus musculus
gtgggcctgtgtacgaatccccagg

SEQ ID NO: 711917 - DNA, 25 bp, Mus musculus
gtgggcctgtgttcgaatccccagg

SEQ ID NO: 711918 - DNA, 25 bp, Mus musculus
gtgggcctgttgcaatactttaaaa

SEQ ID NO: 711919 - DNA, 25 bp, Mus musculus
gtgggcctgttggaatactttaaaa

SEQ ID NO: 711920 - DNA, 25 bp, Mus musculus
gtgggccttattccagaagtccaga

SEQ ID NO: 711921 - DNA, 25 bp, Mus musculus
gtgggccttattgcagaagtccaga

SEQ ID NO: 711922 - DNA, 25 bp, Mus musculus
gtgggccttctgctggtaaacatgc

SEQ ID NO: 711923 - DNA, 25 bp, Mus musculus
gtgggccttctggtggtaaacatgc

SEQ ID NO: 711924 - DNA, 25 bp, Mus musculus
gtgggcgaataaaaacagatcggcc

SEQ ID NO: 711925 - DNA, 25 bp, Mus musculus
gtgggcgaataataacagatcggcc

SEQ ID NO: 711926 - DNA, 25 bp, Mus musculus
gtgggcgaccccatggatctgaaga

SEQ ID NO: 711927 - DNA, 25 bp, Mus musculus
gtgggcgaccccttggatctgaaga

SEQ ID NO: 711928 - DNA, 25 bp, Mus musculus
gtgggcgcaaaactcacatctttga

SEQ ID NO: 711929 - DNA, 25 bp, Mus musculus
gtgggcgcaaaagtcacatctttga

SEQ ID NO: 711930 - DNA, 25 bp, Mus musculus
gtgggcgcaagtacacataccgctt

SEQ ID NO: 711931 - DNA, 25 bp, Mus musculus
gtgggcgcaagttcacataccgctt

SEQ ID NO: 711932 - DNA, 25 bp, Mus musculus
gtgggcgcacacaacaaagggtgtt

SEQ ID NO: 711933 - DNA, 25 bp, Mus musculus
gtgggcgcacactacaaagggtgtt

SEQ ID NO: 711934 - DNA, 25 bp, Mus musculus
gtgggcgcacccaaggaactcagaa

SEQ ID NO: 711935 - DNA, 25 bp, Mus musculus
gtgggcgcaccctaggaactcagaa

SEQ ID NO: 711936 - DNA, 25 bp, Mus musculus
gtgggcgcctccattgacccagtta

SEQ ID NO: 711937 - DNA, 25 bp, Mus musculus
gtgggcgcctcctttgacccagtta

SEQ ID NO: 711938 - DNA, 25 bp, Mus musculus
gtgggcgctatgcaagaactcttaa

SEQ ID NO: 711939 - DNA, 25 bp, Mus musculus
gtgggcgctatggaagaactcttaa

SEQ ID NO: 711940 - DNA, 25 bp, Mus musculus
gtgggcgggccgctgcgctttgtga

SEQ ID NO: 711941 - DNA, 25 bp, Mus musculus
gtgggcgggccggtgcgctttgtga

SEQ ID NO: 711942 - DNA, 25 bp, Mus musculus
gtgggcggtgacacaacgcctttaa

SEQ ID NO: 711943 - DNA, 25 bp, Mus musculus
gtgggcggtgactcaacgcctttaa

SEQ ID NO: 711944 - DNA, 25 bp, Mus musculus
gtgggcgtatttctaagctgtctat

SEQ ID NO: 711945 - DNA, 25 bp, Mus musculus
gtgggcgtatttgtaagctgtctat

SEQ ID NO: 711946 - DNA, 25 bp, Mus musculus
gtgggcgtcactactcttttgggag

SEQ ID NO: 711947 - DNA, 25 bp, Mus musculus
gtgggcgtcactcttagtctgatga

SEQ ID NO: 711948 - DNA, 25 bp, Mus musculus
gtgggcgtcactgttagtctgatga

SEQ ID NO: 711949 - DNA, 25 bp, Mus musculus
gtgggcgtcacttctcttttgggag

SEQ ID NO: 711950 - DNA, 25 bp, Mus musculus
gtgggcgtcttcattctaagcctct

SEQ ID NO: 711951 - DNA, 25 bp, Mus musculus
gtgggcgtcttctttctaagcctct

SEQ ID NO: 711952 - DNA, 25 bp, Mus musculus
gtgggcgtgccgctgctaattacaa

SEQ ID NO: 711953 - DNA, 25 bp, Mus musculus
gtgggcgtgccggtgctaattacaa

SEQ ID NO: 711954 - DNA, 25 bp, Mus musculus
gtgggcgtgttcatgcacagcaaag

SEQ ID NO: 711955 - DNA, 25 bp, Mus musculus
gtgggcgtgttcttgcacagcaaag

SEQ ID NO: 711956 - DNA, 25 bp, Mus musculus
gtgggctacagaataaatccttctc

SEQ ID NO: 711957 - DNA, 25 bp, Mus musculus
gtgggctacagattaaatccttctc

SEQ ID NO: 711958 - DNA, 25 bp, Mus musculus
gtgggctacatgaacctcaagatag

SEQ ID NO: 711959 - DNA, 25 bp, Mus musculus
gtgggctacatgtacctcaagatag

SEQ ID NO: 711960 - DNA, 25 bp, Mus musculus
gtgggctacattccatgccagtaca

SEQ ID NO: 711961 - DNA, 25 bp, Mus musculus
gtgggctacattgcatgccagtaca

SEQ ID NO: 711962 - DNA, 25 bp, Mus musculus
gtgggctacctgacagggttcgtca

SEQ ID NO: 711963 - DNA, 25 bp, Mus musculus
gtgggctacctgtcagggttcgtca

SEQ ID NO: 711964 - DNA, 25 bp, Mus musculus
gtgggctagattcctcattttcttt

SEQ ID NO: 711965 - DNA, 25 bp, Mus musculus
gtgggctagattgctcattttcttt

SEQ ID NO: 711966 - DNA, 25 bp, Mus musculus
gtgggctatccacattgttcagaat

SEQ ID NO: 711967 - DNA, 25 bp, Mus musculus
gtgggctatccagattgttcagaat

SEQ ID NO: 711968 - DNA, 25 bp, Mus musculus
gtgggctatggtctaatgttcaaag

SEQ ID NO: 711969 - DNA, 25 bp, Mus musculus
gtgggctatggtgtaatgttcaaag

SEQ ID NO: 711970 - DNA, 25 bp, Mus musculus
gtgggctatgtcaagtgtaatggtc

SEQ ID NO: 711971 - DNA, 25 bp, Mus musculus
gtgggctatgtctagtgtaatggtc

SEQ ID NO: 711972 - DNA, 25 bp, Mus musculus
gtgggctatgtgactcattggcatt

SEQ ID NO: 711973 - DNA, 25 bp, Mus musculus
gtgggctatgtgtctcattggcatt

SEQ ID NO: 711974 - DNA, 25 bp, Mus musculus
gtgggctcaacactggacaggacat

SEQ ID NO: 711975 - DNA, 25 bp, Mus musculus
gtgggctcaacagtggacaggacat

SEQ ID NO: 711976 - DNA, 25 bp, Mus musculus
gtgggctcaaggaactttctcagat

SEQ ID NO: 711977 - DNA, 25 bp, Mus musculus
gtgggctcaaggtactttctcagat

SEQ ID NO: 711978 - DNA, 25 bp, Mus musculus
gtgggctcacatatacaccatacta

SEQ ID NO: 711979 - DNA, 25 bp, Mus musculus
gtgggctcacatttacaccatacta

SEQ ID NO: 711980 - DNA, 25 bp, Mus musculus
gtgggctcacctcaccactgaagac

SEQ ID NO: 711981 - DNA, 25 bp, Mus musculus
gtgggctcacctgaccactgaagac

SEQ ID NO: 711982 - DNA, 25 bp, Mus musculus
gtgggctcagaaaacttgtgcccta

SEQ ID NO: 711983 - DNA, 25 bp, Mus musculus
gtgggctcagaatacttgtgcccta

SEQ ID NO: 711984 - DNA, 25 bp, Mus musculus
gtgggctcagcacttatcattttga

SEQ ID NO: 711985 - DNA, 25 bp, Mus musculus
gtgggctcagcagttatcattttga

SEQ ID NO: 711986 - DNA, 25 bp, Mus musculus
gtgggctcatttcttgttaagactt

SEQ ID NO: 711987 - DNA, 25 bp, Mus musculus
gtgggctcatttgttgttaagactt

SEQ ID NO: 711988 - DNA, 25 bp, Mus musculus
gtgggctccaccattacaagtagga

SEQ ID NO: 711989 - DNA, 25 bp, Mus musculus
gtgggctccacctttacaagtagga

SEQ ID NO: 711990 - DNA, 25 bp, Mus musculus
gtgggctccagcatatgcagactgt

SEQ ID NO: 711991 - DNA, 25 bp, Mus musculus
gtgggctccagcttatgcagactgt

SEQ ID NO: 711992 - DNA, 25 bp, Mus musculus
gtgggctccatcaacgccaggacca

SEQ ID NO: 711993 - DNA, 25 bp, Mus musculus
gtgggctccatctacgccaggacca

SEQ ID NO: 711994 - DNA, 25 bp, Mus musculus
gtgggctcccaacgcagattcgtga

SEQ ID NO: 711995 - DNA, 25 bp, Mus musculus
gtgggctcccaaggcagattcgtga

SEQ ID NO: 711996 - DNA, 25 bp, Mus musculus
gtgggctcctataccttgagtggga

SEQ ID NO: 711997 - DNA, 25 bp, Mus musculus
gtgggctcctattccttgagtggga

SEQ ID NO: 711998 - DNA, 25 bp, Mus musculus
gtgggctcctcgatacaactgtaga

SEQ ID NO: 711999 - DNA, 25 bp, Mus musculus
gtgggctcctcgttacaactgtaga

SEQ ID NO: 712000 - DNA, 25 bp, Mus musculus
gtgggctcctggattggctttgcca

SEQ ID NO: 712001 - DNA, 25 bp, Mus musculus
gtgggctcctggtttggctttgcca

SEQ ID NO: 712002 - DNA, 25 bp, Mus musculus
gtgggctcggtcagcataaggattt

SEQ ID NO: 712003 - DNA, 25 bp, Mus musculus
gtgggctcggtctgcataaggattt

SEQ ID NO: 712004 - DNA, 25 bp, Mus musculus
gtgggctctaagctcctatgctcaa

SEQ ID NO: 712005 - DNA, 25 bp, Mus musculus
gtgggctctaaggtcctatgctcaa

SEQ ID NO: 712006 - DNA, 25 bp, Mus musculus
gtgggctctatgacctacagcgcct

SEQ ID NO: 712007 - DNA, 25 bp, Mus musculus
gtgggctctatgtcctacagcgcct

SEQ ID NO: 712008 - DNA, 25 bp, Mus musculus
gtgggctctcagagttccccaagaa

SEQ ID NO: 712009 - DNA, 25 bp, Mus musculus
gtgggctctcagtgttccccaagaa

SEQ ID NO: 712010 - DNA, 25 bp, Mus musculus
gtgggctctgcactagaaaatctgg

SEQ ID NO: 712011 - DNA, 25 bp, Mus musculus
gtgggctctgcagtagaaaatctgg

SEQ ID NO: 712012 - DNA, 25 bp, Mus musculus
gtgggctctgtgcaaaccagcagca

SEQ ID NO: 712013 - DNA, 25 bp, Mus musculus
gtgggctctgtggaaaccagcagca

SEQ ID NO: 712014 - DNA, 25 bp, Mus musculus
gtgggctctgttctactagtttgta

SEQ ID NO: 712015 - DNA, 25 bp, Mus musculus
gtgggctctgttgtactagtttgta

SEQ ID NO: 712016 - DNA, 25 bp, Mus musculus
gtgggctcttagcaaatacttgtga

SEQ ID NO: 712017 - DNA, 25 bp, Mus musculus
gtgggctcttaggaaatacttgtga

SEQ ID NO: 712018 - DNA, 25 bp, Mus musculus
gtgggctgaacactgtaacactgta

SEQ ID NO: 712019 - DNA, 25 bp, Mus musculus
gtgggctgaacagtgtaacactgta

SEQ ID NO: 712020 - DNA, 25 bp, Mus musculus
gtgggctgacaacacggctttgaaa

SEQ ID NO: 712021 - DNA, 25 bp, Mus musculus
gtgggctgacaagacggctttgaaa

SEQ ID NO: 712022 - DNA, 25 bp, Mus musculus
gtgggctgactgcagctaaacttca

SEQ ID NO: 712023 - DNA, 25 bp, Mus musculus
gtgggctgactggagctaaacttca

SEQ ID NO: 712024 - DNA, 25 bp, Mus musculus
gtgggctgagtaccaacatccttca

SEQ ID NO: 712025 - DNA, 25 bp, Mus musculus
gtgggctgagtagcaacatccttca

SEQ ID NO: 712026 - DNA, 25 bp, Mus musculus
gtgggctgagttatgcaagcttgta

SEQ ID NO: 712027 - DNA, 25 bp, Mus musculus
gtgggctgagttttgcaagcttgta

SEQ ID NO: 712028 - DNA, 25 bp, Mus musculus
gtgggctgcaaaagctggcgtcaca

SEQ ID NO: 712029 - DNA, 25 bp, Mus musculus
gtgggctgcaaatgctggcgtcaca

SEQ ID NO: 712030 - DNA, 25 bp, Mus musculus
gtgggctgcaccacggtgtagcttc

SEQ ID NO: 712031 - DNA, 25 bp, Mus musculus
gtgggctgcacctcggtgtagcttc

SEQ ID NO: 712032 - DNA, 25 bp, Mus musculus
gtgggctgcagcacaatactgtctg

SEQ ID NO: 712033 - DNA, 25 bp, Mus musculus
gtgggctgcagctcaatactgtctg

SEQ ID NO: 712034 - DNA, 25 bp, Mus musculus
gtgggctgctcccataatgtacctg

SEQ ID NO: 712035 - DNA, 25 bp, Mus musculus
gtgggctgctccgataatgtacctg

SEQ ID NO: 712036 - DNA, 25 bp, Mus musculus
gtgggctgctgtcatttgatcctag

SEQ ID NO: 712037 - DNA, 25 bp, Mus musculus
gtgggctgctgtgatttgatcctag

SEQ ID NO: 712038 - DNA, 25 bp, Mus musculus
gtgggctggatgatattcactagta

SEQ ID NO: 712039 - DNA, 25 bp, Mus musculus
gtgggctggatgttattcactagta

SEQ ID NO: 712040 - DNA, 25 bp, Mus musculus
gtgggctggccactgagaaaccaaa

SEQ ID NO: 712041 - DNA, 25 bp, Mus musculus
gtgggctggccagtgagaaaccaaa

SEQ ID NO: 712042 - DNA, 25 bp, Mus musculus
gtgggctgggctaaatatgaaatta

SEQ ID NO: 712043 - DNA, 25 bp, Mus musculus
gtgggctgggcttaatatgaaatta

SEQ ID NO: 712044 - DNA, 25 bp, Mus musculus
gtgggctgtatactgcatgttcttt

SEQ ID NO: 712045 - DNA, 25 bp, Mus musculus
gtgggctgtatagtgcatgttcttt

SEQ ID NO: 712046 - DNA, 25 bp, Mus musculus
gtgggctgtcagagtactgcacagt

SEQ ID NO: 712047 - DNA, 25 bp, Mus musculus
gtgggctgtcagtgtactgcacagt

SEQ ID NO: 712048 - DNA, 25 bp, Mus musculus
gtgggctgtgatctgacagaaccat

SEQ ID NO: 712049 - DNA, 25 bp, Mus musculus
gtgggctgtgatgtgacagaaccat

SEQ ID NO: 712050 - DNA, 25 bp, Mus musculus
gtgggctgtgccaatagatttacta

SEQ ID NO: 712051 - DNA, 25 bp, Mus musculus
gtgggctgtgcctatagatttacta

SEQ ID NO: 712052 - DNA, 25 bp, Mus musculus
gtgggctgttacacatacatcagaa

SEQ ID NO: 712053 - DNA, 25 bp, Mus musculus
gtgggctgttactcatacatcagaa

SEQ ID NO: 712054 - DNA, 25 bp, Mus musculus
gtgggctgttgcatctaagatcact

SEQ ID NO: 712055 - DNA, 25 bp, Mus musculus
gtgggctgttgcttctaagatcact

SEQ ID NO: 712056 - DNA, 25 bp, Mus musculus
gtgggctgtttacacactccaggaa

SEQ ID NO: 712057 - DNA, 25 bp, Mus musculus
gtgggctgtttagacactccaggaa

SEQ ID NO: 712058 - DNA, 25 bp, Mus musculus
gtgggcttacccagagtggagcaca

SEQ ID NO: 712059 - DNA, 25 bp, Mus musculus
gtgggcttaccctgagtggagcaca

SEQ ID NO: 712060 - DNA, 25 bp, Mus musculus
gtgggcttagtgatgctgtttgaaa

SEQ ID NO: 712061 - DNA, 25 bp, Mus musculus
gtgggcttagtgttgctgtttgaaa

SEQ ID NO: 712062 - DNA, 25 bp, Mus musculus
gtgggcttatgcacaaaggacctct

SEQ ID NO: 712063 - DNA, 25 bp, Mus musculus
gtgggcttatgctcaaaggacctct

SEQ ID NO: 712064 - DNA, 25 bp, Mus musculus
gtgggcttccaacattatccagaga

SEQ ID NO: 712065 - DNA, 25 bp, Mus musculus
gtgggcttccaagattatccagaga

SEQ ID NO: 712066 - DNA, 25 bp, Mus musculus
gtgggcttctcacacaggacaaaag

SEQ ID NO: 712067 - DNA, 25 bp, Mus musculus
gtgggcttctcagacaggacaaaag

SEQ ID NO: 712068 - DNA, 25 bp, Mus musculus
gtgggcttgaacatcttcagcgcca

SEQ ID NO: 712069 - DNA, 25 bp, Mus musculus
gtgggcttgaacttcttcagcgcca

SEQ ID NO: 712070 - DNA, 25 bp, Mus musculus
gtgggcttggtcctatacatctcca

SEQ ID NO: 712071 - DNA, 25 bp, Mus musculus
gtgggcttggtcgtatacatctcca

SEQ ID NO: 712072 - DNA, 25 bp, Mus musculus
gtgggcttggtgctcaagtttttca

SEQ ID NO: 712073 - DNA, 25 bp, Mus musculus
gtgggcttggtggtcaagtttttca

SEQ ID NO: 712074 - DNA, 25 bp, Mus musculus
gtgggctttaggcttctcttggttt

SEQ ID NO: 712075 - DNA, 25 bp, Mus musculus
gtgggctttagggttctcttggttt

SEQ ID NO: 712076 - DNA, 25 bp, Mus musculus
gtgggctttatcatccctgttaatt

SEQ ID NO: 712077 - DNA, 25 bp, Mus musculus
gtgggctttatcttccctgttaatt

SEQ ID NO: 712078 - DNA, 25 bp, Mus musculus
gtgggctttcggctatttctgtccc

SEQ ID NO: 712079 - DNA, 25 bp, Mus musculus
gtgggctttcgggtatttctgtccc

SEQ ID NO: 712080 - DNA, 25 bp, Mus musculus
gtggggaggcccattcctgcccttg

SEQ ID NO: 712081 - DNA, 25 bp, Mus musculus
gtggggaggccctttcctgcccttg

SEQ ID NO: 712082 - DNA, 25 bp, Mus musculus
gtggggatcctcatttttctgctgc

SEQ ID NO: 712083 - DNA, 25 bp, Mus musculus
gtggggatcctcttttttctgctgc

SEQ ID NO: 712084 - DNA, 25 bp, Mus musculus
gtgggggctcgacacttctgttcct

SEQ ID NO: 712085 - DNA, 25 bp, Mus musculus
gtgggggctcgagacttctgttcct

SEQ ID NO: 712086 - DNA, 25 bp, Mus musculus
gtggggtggcacatttcaaagagca

SEQ ID NO: 712087 - DNA, 25 bp, Mus musculus
gtggggtggcacttttcaaagagca

SEQ ID NO: 712088 - DNA, 25 bp, Mus musculus
gtgggtaaacagctgttgactgaca

SEQ ID NO: 712089 - DNA, 25 bp, Mus musculus
gtgggtaaacaggtgttgactgaca

SEQ ID NO: 712090 - DNA, 25 bp, Mus musculus
gtgggtaaacttctcagtgctttga

SEQ ID NO: 712091 - DNA, 25 bp, Mus musculus
gtgggtaaacttgtcagtgctttga

SEQ ID NO: 712092 - DNA, 25 bp, Mus musculus
gtgggtaacagccatttgtaattcc

SEQ ID NO: 712093 - DNA, 25 bp, Mus musculus
gtgggtaacagcgatttgtaattcc

SEQ ID NO: 712094 - DNA, 25 bp, Mus musculus
gtgggtaagaacaccggctattctc

SEQ ID NO: 712095 - DNA, 25 bp, Mus musculus
gtgggtaagaactccggctattctc

SEQ ID NO: 712096 - DNA, 25 bp, Mus musculus
gtgggtaagcagactggcacatgaa

SEQ ID NO: 712097 - DNA, 25 bp, Mus musculus
gtgggtaagcagtctggcacatgaa

SEQ ID NO: 712098 - DNA, 25 bp, Mus musculus
gtgggtaagccaaaagtaatcttct

SEQ ID NO: 712099 - DNA, 25 bp, Mus musculus
gtgggtaagccataagtaatcttct

SEQ ID NO: 712100 - DNA, 25 bp, Mus musculus
gtgggtaatcatcggctgcctttag

SEQ ID NO: 712101 - DNA, 25 bp, Mus musculus
gtgggtaatcatgggctgcctttag

SEQ ID NO: 712102 - DNA, 25 bp, Mus musculus
gtgggtaatccaaaagcttcctcta

SEQ ID NO: 712103 - DNA, 25 bp, Mus musculus
gtgggtaatccataagcttcctcta

SEQ ID NO: 712104 - DNA, 25 bp, Mus musculus
gtgggtaatgcaccactcaacagca

SEQ ID NO: 712105 - DNA, 25 bp, Mus musculus
gtgggtaatgcagcactcaacagca

SEQ ID NO: 712106 - DNA, 25 bp, Mus musculus
gtgggtacaaaacgataagctcttt

SEQ ID NO: 712107 - DNA, 25 bp, Mus musculus
gtgggtacaaaaggataagctcttt

SEQ ID NO: 712108 - DNA, 25 bp, Mus musculus
gtgggtacacaaaactgctcagaag

SEQ ID NO: 712109 - DNA, 25 bp, Mus musculus
gtgggtacacaatactgctcagaag

SEQ ID NO: 712110 - DNA, 25 bp, Mus musculus
gtgggtacacacatgtcacagtatg

SEQ ID NO: 712111 - DNA, 25 bp, Mus musculus
gtgggtacacacttgtcacagtatg

SEQ ID NO: 712112 - DNA, 25 bp, Mus musculus
gtgggtacagccatcatgacggacc

SEQ ID NO: 712113 - DNA, 25 bp, Mus musculus
gtgggtacagccttcatgacggacc

SEQ ID NO: 712114 - DNA, 25 bp, Mus musculus
gtgggtacagttaccagacttgcaa

SEQ ID NO: 712115 - DNA, 25 bp, Mus musculus
gtgggtacagtttccagacttgcaa

SEQ ID NO: 712116 - DNA, 25 bp, Mus musculus
gtgggtacattcagtgactcagctc

SEQ ID NO: 712117 - DNA, 25 bp, Mus musculus
gtgggtacattctgtgactcagctc

SEQ ID NO: 712118 - DNA, 25 bp, Mus musculus
gtgggtacatttcaaacactgttta

SEQ ID NO: 712119 - DNA, 25 bp, Mus musculus
gtgggtacatttgaaacactgttta

SEQ ID NO: 712120 - DNA, 25 bp, Mus musculus
gtgggtaccaagcacacaagcagta

SEQ ID NO: 712121 - DNA, 25 bp, Mus musculus
gtgggtaccaaggacacaagcagta

SEQ ID NO: 712122 - DNA, 25 bp, Mus musculus
gtgggtaccgtgagcgctgacacac

SEQ ID NO: 712123 - DNA, 25 bp, Mus musculus
gtgggtaccgtgtgcgctgacacac

SEQ ID NO: 712124 - DNA, 25 bp, Mus musculus
gtgggtactcaaaaaggtctatcct

SEQ ID NO: 712125 - DNA, 25 bp, Mus musculus
gtgggtactcaataaggtctatcct

SEQ ID NO: 712126 - DNA, 25 bp, Mus musculus
gtgggtactcagaacagaccctcgg

SEQ ID NO: 712127 - DNA, 25 bp, Mus musculus
gtgggtactcagaattgtctaactc

SEQ ID NO: 712128 - DNA, 25 bp, Mus musculus
gtgggtactcagtacagaccctcgg

SEQ ID NO: 712129 - DNA, 25 bp, Mus musculus
gtgggtactcagtattgtctaactc

SEQ ID NO: 712130 - DNA, 25 bp, Mus musculus
gtgggtagcaatacgtgcagccgct

SEQ ID NO: 712131 - DNA, 25 bp, Mus musculus
gtgggtagcaattcgtgcagccgct

SEQ ID NO: 712132 - DNA, 25 bp, Mus musculus
gtgggtagtatcaattttctcctaa

SEQ ID NO: 712133 - DNA, 25 bp, Mus musculus
gtgggtagtatctattttctcctaa

SEQ ID NO: 712134 - DNA, 25 bp, Mus musculus
gtgggtagtgatcgacacccaggaa

SEQ ID NO: 712135 - DNA, 25 bp, Mus musculus
gtgggtagtgatggacacccaggaa

SEQ ID NO: 712136 - DNA, 25 bp, Mus musculus
gtgggtagtgctagctgtacaaaca

SEQ ID NO: 712137 - DNA, 25 bp, Mus musculus
gtgggtagtgcttgctgtacaaaca

SEQ ID NO: 712138 - DNA, 25 bp, Mus musculus
gtgggtagtgttcctgtcatataaa

SEQ ID NO: 712139 - DNA, 25 bp, Mus musculus
gtgggtagtgttgctgtcatataaa

SEQ ID NO: 712140 - DNA, 25 bp, Mus musculus
gtgggtatcaggcaaaccccagcct

SEQ ID NO: 712141 - DNA, 25 bp, Mus musculus
gtgggtatcagggaaaccccagcct

SEQ ID NO: 712142 - DNA, 25 bp, Mus musculus
gtgggtatctggaggtactcaagaa

SEQ ID NO: 712143 - DNA, 25 bp, Mus musculus
gtgggtatctggtggtactcaagaa

SEQ ID NO: 712144 - DNA, 25 bp, Mus musculus
gtgggtatgataatgccctgttaaa

SEQ ID NO: 712145 - DNA, 25 bp, Mus musculus
gtgggtatgatattgccctgttaaa

SEQ ID NO: 712146 - DNA, 25 bp, Mus musculus
gtgggtatgcctcattcactcatga

SEQ ID NO: 712147 - DNA, 25 bp, Mus musculus
gtgggtatgcctgattcactcatga

SEQ ID NO: 712148 - DNA, 25 bp, Mus musculus
gtgggtattaataaactttcatctg

SEQ ID NO: 712149 - DNA, 25 bp, Mus musculus
gtgggtattaattaactttcatctg

SEQ ID NO: 712150 - DNA, 25 bp, Mus musculus
gtgggtattcagattacagtgtata

SEQ ID NO: 712151 - DNA, 25 bp, Mus musculus
gtgggtattcagtttacagtgtata

SEQ ID NO: 712152 - DNA, 25 bp, Mus musculus
gtgggtattctacactcctgttcag

SEQ ID NO: 712153 - DNA, 25 bp, Mus musculus
gtgggtattctagactcctgttcag

SEQ ID NO: 712154 - DNA, 25 bp, Mus musculus
gtgggtattttacttcatgaatctt

SEQ ID NO: 712155 - DNA, 25 bp, Mus musculus
gtgggtattttagttcatgaatctt

SEQ ID NO: 712156 - DNA, 25 bp, Mus musculus
gtgggtcaaccactcgtgcagtcga

SEQ ID NO: 712157 - DNA, 25 bp, Mus musculus
gtgggtcaaccagtcgtgcagtcga

SEQ ID NO: 712158 - DNA, 25 bp, Mus musculus
gtgggtcacagaccctaaactacat

SEQ ID NO: 712159 - DNA, 25 bp, Mus musculus
gtgggtcacagagcctaaactacat

SEQ ID NO: 712160 - DNA, 25 bp, Mus musculus
gtgggtcacataacttgctttacac

SEQ ID NO: 712161 - DNA, 25 bp, Mus musculus
gtgggtcacatatcttgctttacac

SEQ ID NO: 712162 - DNA, 25 bp, Mus musculus
gtgggtcacatgaccgggcagcact

SEQ ID NO: 712163 - DNA, 25 bp, Mus musculus
gtgggtcacatgtccgggcagcact

SEQ ID NO: 712164 - DNA, 25 bp, Mus musculus
gtgggtcaccataaaattagagctg

SEQ ID NO: 712165 - DNA, 25 bp, Mus musculus
gtgggtcaccattaaattagagctg

SEQ ID NO: 712166 - DNA, 25 bp, Mus musculus
gtgggtcacgccatatacaaaatct

SEQ ID NO: 712167 - DNA, 25 bp, Mus musculus
gtgggtcacgccttatacaaaatct

SEQ ID NO: 712168 - DNA, 25 bp, Mus musculus
gtgggtcactctcagacatttagta

SEQ ID NO: 712169 - DNA, 25 bp, Mus musculus
gtgggtcactctgagacatttagta

SEQ ID NO: 712170 - DNA, 25 bp, Mus musculus
gtgggtcactggattgtcactgtca

SEQ ID NO: 712171 - DNA, 25 bp, Mus musculus
gtgggtcactggtttgtcactgtca

SEQ ID NO: 712172 - DNA, 25 bp, Mus musculus
gtgggtcagacacttgctgtgcaaa

SEQ ID NO: 712173 - DNA, 25 bp, Mus musculus
gtgggtcagacagttgctgtgcaaa

SEQ ID NO: 712174 - DNA, 25 bp, Mus musculus
gtgggtcagcaactgcagtgcccat

SEQ ID NO: 712175 - DNA, 25 bp, Mus musculus
gtgggtcagcaagtgcagtgcccat

SEQ ID NO: 712176 - DNA, 25 bp, Mus musculus
gtgggtcaggacaactaactattaa

SEQ ID NO: 712177 - DNA, 25 bp, Mus musculus
gtgggtcaggactactaactattaa

SEQ ID NO: 712178 - DNA, 25 bp, Mus musculus
gtgggtcagtgtcctctccgtcctg

SEQ ID NO: 712179 - DNA, 25 bp, Mus musculus
gtgggtcagtgtgctctccgtcctg

SEQ ID NO: 712180 - DNA, 25 bp, Mus musculus
gtgggtcatactcgactacattcaa

SEQ ID NO: 712181 - DNA, 25 bp, Mus musculus
gtgggtcatactggactacattcaa

SEQ ID NO: 712182 - DNA, 25 bp, Mus musculus
gtgggtcatagtcataccttctgat

SEQ ID NO: 712183 - DNA, 25 bp, Mus musculus
gtgggtcatagtgataccttctgat

SEQ ID NO: 712184 - DNA, 25 bp, Mus musculus
gtgggtcatccacaacatgtcaaac

SEQ ID NO: 712185 - DNA, 25 bp, Mus musculus
gtgggtcatccagaacatgtcaaac

SEQ ID NO: 712186 - DNA, 25 bp, Mus musculus
gtgggtcatgagactttccccaaag

SEQ ID NO: 712187 - DNA, 25 bp, Mus musculus
gtgggtcatgagtctttccccaaag

SEQ ID NO: 712188 - DNA, 25 bp, Mus musculus
gtgggtcatgtgaaaaagtcttcaa

SEQ ID NO: 712189 - DNA, 25 bp, Mus musculus
gtgggtcatgtgtaaaagtcttcaa

SEQ ID NO: 712190 - DNA, 25 bp, Mus musculus
gtgggtcattcaataacaactagct

SEQ ID NO: 712191 - DNA, 25 bp, Mus musculus
gtgggtcattcattaacaactagct

SEQ ID NO: 712192 - DNA, 25 bp, Mus musculus
gtgggtccactgaaactcgaagcgg

SEQ ID NO: 712193 - DNA, 25 bp, Mus musculus
gtgggtccactgtaactcgaagcgg

SEQ ID NO: 712194 - DNA, 25 bp, Mus musculus
gtgggtccagcacgagcttagtcat

SEQ ID NO: 712195 - DNA, 25 bp, Mus musculus
gtgggtccagcaggagcttagtcat

SEQ ID NO: 712196 - DNA, 25 bp, Mus musculus
gtgggtccagggattaaactcagct

SEQ ID NO: 712197 - DNA, 25 bp, Mus musculus
gtgggtccagggtttaaactcagct

SEQ ID NO: 712198 - DNA, 25 bp, Mus musculus
gtgggtccagttacaaggcatgtac

SEQ ID NO: 712199 - DNA, 25 bp, Mus musculus
gtgggtccagtttcaaggcatgtac

SEQ ID NO: 712200 - DNA, 25 bp, Mus musculus
gtgggtccatgtatatactctagat

SEQ ID NO: 712201 - DNA, 25 bp, Mus musculus
gtgggtccatgtttatactctagat

SEQ ID NO: 712202 - DNA, 25 bp, Mus musculus
gtgggtcccacgctgattaaccaga

SEQ ID NO: 712203 - DNA, 25 bp, Mus musculus
gtgggtcccacggtgattaaccaga

SEQ ID NO: 712204 - DNA, 25 bp, Mus musculus
gtgggtcccagcacagctctggcca

SEQ ID NO: 712205 - DNA, 25 bp, Mus musculus
gtgggtcccagctcagctctggcca

SEQ ID NO: 712206 - DNA, 25 bp, Mus musculus
gtgggtccccagcatgcttgtctct

SEQ ID NO: 712207 - DNA, 25 bp, Mus musculus
gtgggtccccaggatgcttgtctct

SEQ ID NO: 712208 - DNA, 25 bp, Mus musculus
gtgggtcctcataatcttttggttt

SEQ ID NO: 712209 - DNA, 25 bp, Mus musculus
gtgggtcctcattatcttttggttt

SEQ ID NO: 712210 - DNA, 25 bp, Mus musculus
gtgggtcctccccaggtcaccctgg

SEQ ID NO: 712211 - DNA, 25 bp, Mus musculus
gtgggtcctcccgaggtcaccctgg

SEQ ID NO: 712212 - DNA, 25 bp, Mus musculus
gtgggtcctgataaccaatacttac

SEQ ID NO: 712213 - DNA, 25 bp, Mus musculus
gtgggtcctgattaccaatacttac

SEQ ID NO: 712214 - DNA, 25 bp, Mus musculus
gtgggtcctgcaattgatctaaata

SEQ ID NO: 712215 - DNA, 25 bp, Mus musculus
gtgggtcctgcatttgatctaaata

SEQ ID NO: 712216 - DNA, 25 bp, Mus musculus
gtgggtcctggaaatacaattgcaa

SEQ ID NO: 712217 - DNA, 25 bp, Mus musculus
gtgggtcctggaatggcctgtcttt

SEQ ID NO: 712218 - DNA, 25 bp, Mus musculus
gtgggtcctggatatacaattgcaa

SEQ ID NO: 712219 - DNA, 25 bp, Mus musculus
gtgggtcctggattggcctgtcttt

SEQ ID NO: 712220 - DNA, 25 bp, Mus musculus
gtgggtcctgtcataaactgtgcgc

SEQ ID NO: 712221 - DNA, 25 bp, Mus musculus
gtgggtcctgtcttaaactgtgcgc

SEQ ID NO: 712222 - DNA, 25 bp, Mus musculus
gtgggtcgaatcacagcgctgtcag

SEQ ID NO: 712223 - DNA, 25 bp, Mus musculus
gtgggtcgaatctcagcgctgtcag

SEQ ID NO: 712224 - DNA, 25 bp, Mus musculus
gtgggtcgcctaagagcatcgcaaa

SEQ ID NO: 712225 - DNA, 25 bp, Mus musculus
gtgggtcgcctatgagcatcgcaaa

SEQ ID NO: 712226 - DNA, 25 bp, Mus musculus
gtgggtcggttgagtatttatcctc

SEQ ID NO: 712227 - DNA, 25 bp, Mus musculus
gtgggtcggttgtgtatttatcctc

SEQ ID NO: 712228 - DNA, 25 bp, Mus musculus
gtgggtctaaatcctgtcattatgt

SEQ ID NO: 712229 - DNA, 25 bp, Mus musculus
gtgggtctaaatgctgtcattatgt

SEQ ID NO: 712230 - DNA, 25 bp, Mus musculus
gtgggtctaaccatacaccagcatt

SEQ ID NO: 712231 - DNA, 25 bp, Mus musculus
gtgggtctaaccttacaccagcatt

SEQ ID NO: 712232 - DNA, 25 bp, Mus musculus
gtgggtctacacatgagatttgtac

SEQ ID NO: 712233 - DNA, 25 bp, Mus musculus
gtgggtctacacttgagatttgtac

SEQ ID NO: 712234 - DNA, 25 bp, Mus musculus
gtgggtctagccctacttgggatcc

SEQ ID NO: 712235 - DNA, 25 bp, Mus musculus
gtgggtctagccgtacttgggatcc

SEQ ID NO: 712236 - DNA, 25 bp, Mus musculus
gtgggtctatggactatgtctactg

SEQ ID NO: 712237 - DNA, 25 bp, Mus musculus
gtgggtctatggtctatgtctactg

SEQ ID NO: 712238 - DNA, 25 bp, Mus musculus
gtgggtctcaccaggttccatatgc

SEQ ID NO: 712239 - DNA, 25 bp, Mus musculus
gtgggtctcacctggttccatatgc

SEQ ID NO: 712240 - DNA, 25 bp, Mus musculus
gtgggtctcactctagtgtgtaaca

SEQ ID NO: 712241 - DNA, 25 bp, Mus musculus
gtgggtctcactgtagtgtgtaaca

SEQ ID NO: 712242 - DNA, 25 bp, Mus musculus
gtgggtctccaacaagtggttccat

SEQ ID NO: 712243 - DNA, 25 bp, Mus musculus
gtgggtctccaagaagtggttccat

SEQ ID NO: 712244 - DNA, 25 bp, Mus musculus
gtgggtctccagaacaaaacggcaa

SEQ ID NO: 712245 - DNA, 25 bp, Mus musculus
gtgggtctccagtacaaaacggcaa

SEQ ID NO: 712246 - DNA, 25 bp, Mus musculus
gtgggtctctcaaagctttgctcca

SEQ ID NO: 712247 - DNA, 25 bp, Mus musculus
gtgggtctctcatagctttgctcca

SEQ ID NO: 712248 - DNA, 25 bp, Mus musculus
gtgggtctctgtaagcctagtctat

SEQ ID NO: 712249 - DNA, 25 bp, Mus musculus
gtgggtctctgttagcctagtctat

SEQ ID NO: 712250 - DNA, 25 bp, Mus musculus
gtgggtctctttatattcttctgga

SEQ ID NO: 712251 - DNA, 25 bp, Mus musculus
gtgggtctctttttattcttctgga

SEQ ID NO: 712252 - DNA, 25 bp, Mus musculus
gtgggtctgacccagagcatcccct

SEQ ID NO: 712253 - DNA, 25 bp, Mus musculus
gtgggtctgaccgagagcatcccct

SEQ ID NO: 712254 - DNA, 25 bp, Mus musculus
gtgggtctgatgatgcttagcttcc

SEQ ID NO: 712255 - DNA, 25 bp, Mus musculus
gtgggtctgatgttgcttagcttcc

SEQ ID NO: 712256 - DNA, 25 bp, Mus musculus
gtgggtctggagactcacttcccct

SEQ ID NO: 712257 - DNA, 25 bp, Mus musculus
gtgggtctggagtctcacttcccct

SEQ ID NO: 712258 - DNA, 25 bp, Mus musculus
gtgggtctgtgtcagccattctcag

SEQ ID NO: 712259 - DNA, 25 bp, Mus musculus
gtgggtctgtgtgagccattctcag

SEQ ID NO: 712260 - DNA, 25 bp, Mus musculus
gtgggtcttaatattgtgatactaa

SEQ ID NO: 712261 - DNA, 25 bp, Mus musculus
gtgggtcttaattttgtgatactaa

SEQ ID NO: 712262 - DNA, 25 bp, Mus musculus
gtgggtcttaccactggagtcaaca

SEQ ID NO: 712263 - DNA, 25 bp, Mus musculus
gtgggtcttacctctggagtcaaca

SEQ ID NO: 712264 - DNA, 25 bp, Mus musculus
gtgggtcttagtagcgtttgtcaaa

SEQ ID NO: 712265 - DNA, 25 bp, Mus musculus
gtgggtcttagttgcgtttgtcaaa

SEQ ID NO: 712266 - DNA, 25 bp, Mus musculus
gtgggtcttattcttgccctgcact

SEQ ID NO: 712267 - DNA, 25 bp, Mus musculus
gtgggtcttattgttgccctgcact

SEQ ID NO: 712268 - DNA, 25 bp, Mus musculus
gtgggtcttgagcaagccatgacaa

SEQ ID NO: 712269 - DNA, 25 bp, Mus musculus
gtgggtcttgaggaagccatgacaa

SEQ ID NO: 712270 - DNA, 25 bp, Mus musculus
gtgggtcttggccacacagcactga

SEQ ID NO: 712271 - DNA, 25 bp, Mus musculus
gtgggtcttggcgacacagcactga

SEQ ID NO: 712272 - DNA, 25 bp, Mus musculus
gtgggtctttcaatctaagtcctct

SEQ ID NO: 712273 - DNA, 25 bp, Mus musculus
gtgggtctttcattctaagtcctct

SEQ ID NO: 712274 - DNA, 25 bp, Mus musculus
gtgggtgaaatactaagtcttgcat

SEQ ID NO: 712275 - DNA, 25 bp, Mus musculus
gtgggtgaaatagtaagtcttgcat

SEQ ID NO: 712276 - DNA, 25 bp, Mus musculus
gtgggtgaacacaagataacgaaag

SEQ ID NO: 712277 - DNA, 25 bp, Mus musculus
gtgggtgaacactagataacgaaag

SEQ ID NO: 712278 - DNA, 25 bp, Mus musculus
gtgggtgacctaattttgctgtgct

SEQ ID NO: 712279 - DNA, 25 bp, Mus musculus
gtgggtgacctaccccaagctttgt

SEQ ID NO: 712280 - DNA, 25 bp, Mus musculus
gtgggtgacctagcccaagctttgt

SEQ ID NO: 712281 - DNA, 25 bp, Mus musculus
gtgggtgacctatttttgctgtgct

SEQ ID NO: 712282 - DNA, 25 bp, Mus musculus
gtgggtgatactcactccagggcat

SEQ ID NO: 712283 - DNA, 25 bp, Mus musculus
gtgggtgatactgactccagggcat

SEQ ID NO: 712284 - DNA, 25 bp, Mus musculus
gtgggtgcaatgagaactgtattct

SEQ ID NO: 712285 - DNA, 25 bp, Mus musculus
gtgggtgcaatgtgaactgtattct

SEQ ID NO: 712286 - DNA, 25 bp, Mus musculus
gtgggtgcagccacttatgttaaat

SEQ ID NO: 712287 - DNA, 25 bp, Mus musculus
gtgggtgcagcctcttatgttaaat

SEQ ID NO: 712288 - DNA, 25 bp, Mus musculus
gtgggtgcaggtacacataagcaga

SEQ ID NO: 712289 - DNA, 25 bp, Mus musculus
gtgggtgcaggttcacataagcaga

SEQ ID NO: 712290 - DNA, 25 bp, Mus musculus
gtgggtgcatcaagccgggcatcat

SEQ ID NO: 712291 - DNA, 25 bp, Mus musculus
gtgggtgcatcatgccgggcatcat

SEQ ID NO: 712292 - DNA, 25 bp, Mus musculus
gtgggtgccgatatcactgctgcct

SEQ ID NO: 712293 - DNA, 25 bp, Mus musculus
gtgggtgccgatttcactgctgcct

SEQ ID NO: 712294 - DNA, 25 bp, Mus musculus
gtgggtgcctagcaagaccctgtct

SEQ ID NO: 712295 - DNA, 25 bp, Mus musculus
gtgggtgcctaggaagaccctgtct

SEQ ID NO: 712296 - DNA, 25 bp, Mus musculus
gtgggtgccttgagcagtctctaaa

SEQ ID NO: 712297 - DNA, 25 bp, Mus musculus
gtgggtgccttgtgcagtctctaaa

SEQ ID NO: 712298 - DNA, 25 bp, Mus musculus
gtgggtgctagaccctgagctctct

SEQ ID NO: 712299 - DNA, 25 bp, Mus musculus
gtgggtgctagagcctgagctctct

SEQ ID NO: 712300 - DNA, 25 bp, Mus musculus
gtgggtgctcacactatgccctgta

SEQ ID NO: 712301 - DNA, 25 bp, Mus musculus
gtgggtgctcactctatgccctgta

SEQ ID NO: 712302 - DNA, 25 bp, Mus musculus
gtgggtgctcctcgactttttgacc

SEQ ID NO: 712303 - DNA, 25 bp, Mus musculus
gtgggtgctcctggactttttgacc

SEQ ID NO: 712304 - DNA, 25 bp, Mus musculus
gtgggtgctggcctgtcgggtcccc

SEQ ID NO: 712305 - DNA, 25 bp, Mus musculus
gtgggtgctggcgtgtcgggtcccc

SEQ ID NO: 712306 - DNA, 25 bp, Mus musculus
gtgggtggaggaatccttcagtttt

SEQ ID NO: 712307 - DNA, 25 bp, Mus musculus
gtgggtggaggattccttcagtttt

SEQ ID NO: 712308 - DNA, 25 bp, Mus musculus
gtgggtggattactctttcagtata

SEQ ID NO: 712309 - DNA, 25 bp, Mus musculus
gtgggtggattagtctttcagtata

SEQ ID NO: 712310 - DNA, 25 bp, Mus musculus
gtgggtggcactatttattcctgtg

SEQ ID NO: 712311 - DNA, 25 bp, Mus musculus
gtgggtggcactttttattcctgtg

SEQ ID NO: 712312 - DNA, 25 bp, Mus musculus
gtgggtggcagaatctcgaacattt

SEQ ID NO: 712313 - DNA, 25 bp, Mus musculus
gtgggtggcagattctcgaacattt

SEQ ID NO: 712314 - DNA, 25 bp, Mus musculus
gtgggtggcattccatccacagtca

SEQ ID NO: 712315 - DNA, 25 bp, Mus musculus
gtgggtggcattgcatccacagtca

SEQ ID NO: 712316 - DNA, 25 bp, Mus musculus
gtgggtggcctgcatccattctcat

SEQ ID NO: 712317 - DNA, 25 bp, Mus musculus
gtgggtggcctggatccattctcat

SEQ ID NO: 712318 - DNA, 25 bp, Mus musculus
gtgggtggtcacatttgagcactta

SEQ ID NO: 712319 - DNA, 25 bp, Mus musculus
gtgggtggtcacttttgagcactta

SEQ ID NO: 712320 - DNA, 25 bp, Mus musculus
gtgggtggtggtatctctctgttct

SEQ ID NO: 712321 - DNA, 25 bp, Mus musculus
gtgggtggtggtttctctctgttct

SEQ ID NO: 712322 - DNA, 25 bp, Mus musculus
gtgggtgtatcacttctagatcccc

SEQ ID NO: 712323 - DNA, 25 bp, Mus musculus
gtgggtgtatcagttctagatcccc

SEQ ID NO: 712324 - DNA, 25 bp, Mus musculus
gtgggtgtcaaacgcgcgctcgaga

SEQ ID NO: 712325 - DNA, 25 bp, Mus musculus
gtgggtgtcaaaggcgcgctcgaga

SEQ ID NO: 712326 - DNA, 25 bp, Mus musculus
gtgggtgtctttatctgctctgaaa

SEQ ID NO: 712327 - DNA, 25 bp, Mus musculus
gtgggtgtctttttctgctctgaaa

SEQ ID NO: 712328 - DNA, 25 bp, Mus musculus
gtgggtgtgatcatctaccagtgtc

SEQ ID NO: 712329 - DNA, 25 bp, Mus musculus
gtgggtgtgatcttctaccagtgtc

SEQ ID NO: 712330 - DNA, 25 bp, Mus musculus
gtgggtgtgcacagagccacccatg

SEQ ID NO: 712331 - DNA, 25 bp, Mus musculus
gtgggtgtgcactgagccacccatg

SEQ ID NO: 712332 - DNA, 25 bp, Mus musculus
gtgggtgtggccagcaacttcacgt

SEQ ID NO: 712333 - DNA, 25 bp, Mus musculus
gtgggtgtggcctgcaacttcacgt

SEQ ID NO: 712334 - DNA, 25 bp, Mus musculus
gtgggtgtgtctagctgtaaatatt

SEQ ID NO: 712335 - DNA, 25 bp, Mus musculus
gtgggtgtgtcttgctgtaaatatt

SEQ ID NO: 712336 - DNA, 25 bp, Mus musculus
gtgggtgttactcctgtcccaagtc

SEQ ID NO: 712337 - DNA, 25 bp, Mus musculus
gtgggtgttactgctgtcccaagtc

SEQ ID NO: 712338 - DNA, 25 bp, Mus musculus
gtgggtgttctgctgtgttcccttc

SEQ ID NO: 712339 - DNA, 25 bp, Mus musculus
gtgggtgttctggtgtgttcccttc

SEQ ID NO: 712340 - DNA, 25 bp, Mus musculus
gtgggtgttgccaaatcacaagttt

SEQ ID NO: 712341 - DNA, 25 bp, Mus musculus
gtgggtgttgcctaatcacaagttt

SEQ ID NO: 712342 - DNA, 25 bp, Mus musculus
gtgggttaaacacggcacctgtgct

SEQ ID NO: 712343 - DNA, 25 bp, Mus musculus
gtgggttaaacagggcacctgtgct

SEQ ID NO: 712344 - DNA, 25 bp, Mus musculus
gtgggttaacatatcactggagatg

SEQ ID NO: 712345 - DNA, 25 bp, Mus musculus
gtgggttaacatttcactggagatg

SEQ ID NO: 712346 - DNA, 25 bp, Mus musculus
gtgggttaaggcatccatcttataa

SEQ ID NO: 712347 - DNA, 25 bp, Mus musculus
gtgggttaaggcttccatcttataa

SEQ ID NO: 712348 - DNA, 25 bp, Mus musculus
gtgggttaatgcaccaggcttacta

SEQ ID NO: 712349 - DNA, 25 bp, Mus musculus
gtgggttaatgctccaggcttacta

SEQ ID NO: 712350 - DNA, 25 bp, Mus musculus
gtgggttaattgagcactgggaact

SEQ ID NO: 712351 - DNA, 25 bp, Mus musculus
gtgggttaattgtgcactgggaact

SEQ ID NO: 712352 - DNA, 25 bp, Mus musculus
gtgggttagcctcagacataatcac

SEQ ID NO: 712353 - DNA, 25 bp, Mus musculus
gtgggttagcctgagacataatcac

SEQ ID NO: 712354 - DNA, 25 bp, Mus musculus
gtgggttagtaaccctcacatagag

SEQ ID NO: 712355 - DNA, 25 bp, Mus musculus
gtgggttagtaagcctcacatagag

SEQ ID NO: 712356 - DNA, 25 bp, Mus musculus
gtgggttatactaagcatgcctcaa

SEQ ID NO: 712357 - DNA, 25 bp, Mus musculus
gtgggttatacttagcatgcctcaa

SEQ ID NO: 712358 - DNA, 25 bp, Mus musculus
gtgggttatcttatcttattctgag

SEQ ID NO: 712359 - DNA, 25 bp, Mus musculus
gtgggttatcttttcttattctgag

SEQ ID NO: 712360 - DNA, 25 bp, Mus musculus
gtgggttattgaaactgcattttca

SEQ ID NO: 712361 - DNA, 25 bp, Mus musculus
gtgggttattgatactgcattttca

SEQ ID NO: 712362 - DNA, 25 bp, Mus musculus
gtgggttcacacagagtccaaggaa

SEQ ID NO: 712363 - DNA, 25 bp, Mus musculus
gtgggttcacactgagtccaaggaa

SEQ ID NO: 712364 - DNA, 25 bp, Mus musculus
gtgggttcatcaagcccctgcctaa

SEQ ID NO: 712365 - DNA, 25 bp, Mus musculus
gtgggttcatcatgcccctgcctaa

SEQ ID NO: 712366 - DNA, 25 bp, Mus musculus
gtgggttccaacaagtacggcgtgt

SEQ ID NO: 712367 - DNA, 25 bp, Mus musculus
gtgggttccaactagtacggcgtgt

SEQ ID NO: 712368 - DNA, 25 bp, Mus musculus
gtgggttccaggaccaacagtccag

SEQ ID NO: 712369 - DNA, 25 bp, Mus musculus
gtgggttccaggtccaacagtccag

SEQ ID NO: 712370 - DNA, 25 bp, Mus musculus
gtgggttccgaaccctgttcatacc

SEQ ID NO: 712371 - DNA, 25 bp, Mus musculus
gtgggttccgaagcctgttcatacc

SEQ ID NO: 712372 - DNA, 25 bp, Mus musculus
gtgggttctcggacatccccaccag

SEQ ID NO: 712373 - DNA, 25 bp, Mus musculus
gtgggttctcggtcatccccaccag

SEQ ID NO: 712374 - DNA, 25 bp, Mus musculus
gtgggttctctcaagcttaattatg

SEQ ID NO: 712375 - DNA, 25 bp, Mus musculus
gtgggttctctctagcttaattatg

SEQ ID NO: 712376 - DNA, 25 bp, Mus musculus
gtgggttctgcaagtgttcctggca

SEQ ID NO: 712377 - DNA, 25 bp, Mus musculus
gtgggttctgcatgtgttcctggca

SEQ ID NO: 712378 - DNA, 25 bp, Mus musculus
gtgggttctgctataggcttctaga

SEQ ID NO: 712379 - DNA, 25 bp, Mus musculus
gtgggttctgctttaggcttctaga

SEQ ID NO: 712380 - DNA, 25 bp, Mus musculus
gtgggttctggtaaagctcttttat

SEQ ID NO: 712381 - DNA, 25 bp, Mus musculus
gtgggttctggttaagctcttttat

SEQ ID NO: 712382 - DNA, 25 bp, Mus musculus
gtgggttctgtaagtggcactgatt

SEQ ID NO: 712383 - DNA, 25 bp, Mus musculus
gtgggttctgtatgtggcactgatt

SEQ ID NO: 712384 - DNA, 25 bp, Mus musculus
gtgggttctgttactgtttgtggct

SEQ ID NO: 712385 - DNA, 25 bp, Mus musculus
gtgggttctgtttctgtttgtggct

SEQ ID NO: 712386 - DNA, 25 bp, Mus musculus
gtgggttcttcaccctgttgtctga

SEQ ID NO: 712387 - DNA, 25 bp, Mus musculus
gtgggttcttcagcctgttgtctga

SEQ ID NO: 712388 - DNA, 25 bp, Mus musculus
gtgggttgaactccgtcacaacctt

SEQ ID NO: 712389 - DNA, 25 bp, Mus musculus
gtgggttgaactgcgtcacaacctt

SEQ ID NO: 712390 - DNA, 25 bp, Mus musculus
gtgggttgatggcaccttcaccctc

SEQ ID NO: 712391 - DNA, 25 bp, Mus musculus
gtgggttgatgggaccttcaccctc

SEQ ID NO: 712392 - DNA, 25 bp, Mus musculus
gtgggttgcaaacacaaacaggcca

SEQ ID NO: 712393 - DNA, 25 bp, Mus musculus
gtgggttgcaaagacaaacaggcca

SEQ ID NO: 712394 - DNA, 25 bp, Mus musculus
gtgggttgcaatcgcttgatcagta

SEQ ID NO: 712395 - DNA, 25 bp, Mus musculus
gtgggttgcaatggcttgatcagta

SEQ ID NO: 712396 - DNA, 25 bp, Mus musculus
gtgggttgcagtaaacactgtggat

SEQ ID NO: 712397 - DNA, 25 bp, Mus musculus
gtgggttgcagttaacactgtggat

SEQ ID NO: 712398 - DNA, 25 bp, Mus musculus
gtgggttgcctaacgtgacgatgta

SEQ ID NO: 712399 - DNA, 25 bp, Mus musculus
gtgggttgcctatcgtgacgatgta

SEQ ID NO: 712400 - DNA, 25 bp, Mus musculus
gtgggttgctggaatgttgtcttca

SEQ ID NO: 712401 - DNA, 25 bp, Mus musculus
gtgggttgctggtatgttgtcttca

SEQ ID NO: 712402 - DNA, 25 bp, Mus musculus
gtgggttgctgtaccaattggttgc

SEQ ID NO: 712403 - DNA, 25 bp, Mus musculus
gtgggttgctgttccaattggttgc

SEQ ID NO: 712404 - DNA, 25 bp, Mus musculus
gtgggttggttcctcatatgctcaa

SEQ ID NO: 712405 - DNA, 25 bp, Mus musculus
gtgggttggttcgtcatatgctcaa

SEQ ID NO: 712406 - DNA, 25 bp, Mus musculus
gtgggttggtttacccataacactg

SEQ ID NO: 712407 - DNA, 25 bp, Mus musculus
gtgggttggttttcccataacactg

SEQ ID NO: 712408 - DNA, 25 bp, Mus musculus
gtgggttgtaatacatctctataga

SEQ ID NO: 712409 - DNA, 25 bp, Mus musculus
gtgggttgtaattcatctctataga

SEQ ID NO: 712410 - DNA, 25 bp, Mus musculus
gtgggttgtactacccaccactaca

SEQ ID NO: 712411 - DNA, 25 bp, Mus musculus
gtgggttgtacttcccaccactaca

SEQ ID NO: 712412 - DNA, 25 bp, Mus musculus
gtgggttgtatcaatactcttagta

SEQ ID NO: 712413 - DNA, 25 bp, Mus musculus
gtgggttgtatctatactcttagta

SEQ ID NO: 712414 - DNA, 25 bp, Mus musculus
gtgggtttacgtacatctgttcagt

SEQ ID NO: 712415 - DNA, 25 bp, Mus musculus
gtgggtttacgttcatctgttcagt

SEQ ID NO: 712416 - DNA, 25 bp, Mus musculus
gtgggtttactcagtattaactggt

SEQ ID NO: 712417 - DNA, 25 bp, Mus musculus
gtgggtttactctgtattaactggt

SEQ ID NO: 712418 - DNA, 25 bp, Mus musculus
gtgggtttagggatcatatctagga

SEQ ID NO: 712419 - DNA, 25 bp, Mus musculus
gtgggtttagggttcatatctagga

SEQ ID NO: 712420 - DNA, 25 bp, Mus musculus
gtgggtttatatactgctttgctca

SEQ ID NO: 712421 - DNA, 25 bp, Mus musculus
gtgggtttatattctgctttgctca

SEQ ID NO: 712422 - DNA, 25 bp, Mus musculus
gtgggtttatgcacttgtaatctca

SEQ ID NO: 712423 - DNA, 25 bp, Mus musculus
gtgggtttatgctcttgtaatctca

SEQ ID NO: 712424 - DNA, 25 bp, Mus musculus
gtgggtttatttctgagtcctcaag

SEQ ID NO: 712425 - DNA, 25 bp, Mus musculus
gtgggtttatttgtgagtcctcaag

SEQ ID NO: 712426 - DNA, 25 bp, Mus musculus
gtgggtttcattcactatgtgacct

SEQ ID NO: 712427 - DNA, 25 bp, Mus musculus
gtgggtttcattgactatgtgacct

SEQ ID NO: 712428 - DNA, 25 bp, Mus musculus
gtgggtttccacacgaatgctcaag

SEQ ID NO: 712429 - DNA, 25 bp, Mus musculus
gtgggtttccactcgaatgctcaag

SEQ ID NO: 712430 - DNA, 25 bp, Mus musculus
gtgggtttcccacagcttagcatgc

SEQ ID NO: 712431 - DNA, 25 bp, Mus musculus
gtgggtttcccagagcttagcatgc

SEQ ID NO: 712432 - DNA, 25 bp, Mus musculus
gtgggtttcgtcatagctgatgtta

SEQ ID NO: 712433 - DNA, 25 bp, Mus musculus
gtgggtttcgtcttagctgatgtta

SEQ ID NO: 712434 - DNA, 25 bp, Mus musculus
gtgggtttctcaaactggaccagga

SEQ ID NO: 712435 - DNA, 25 bp, Mus musculus
gtgggtttctcatactggaccagga

SEQ ID NO: 712436 - DNA, 25 bp, Mus musculus
gtgggtttgagaaagtgtttgcttt

SEQ ID NO: 712437 - DNA, 25 bp, Mus musculus
gtgggtttgagatagtgtttgcttt

SEQ ID NO: 712438 - DNA, 25 bp, Mus musculus
gtgggtttgcctaggcccatatttc

SEQ ID NO: 712439 - DNA, 25 bp, Mus musculus
gtgggtttgcctccagctcatgagc

SEQ ID NO: 712440 - DNA, 25 bp, Mus musculus
gtgggtttgcctgcagctcatgagc

SEQ ID NO: 712441 - DNA, 25 bp, Mus musculus
gtgggtttgccttggcccatatttc

SEQ ID NO: 712442 - DNA, 25 bp, Mus musculus
gtgggtttggaaacctcatgggaaa

SEQ ID NO: 712443 - DNA, 25 bp, Mus musculus
gtgggtttggaatcctcatgggaaa

SEQ ID NO: 712444 - DNA, 25 bp, Mus musculus
gtgggtttgtcacccagggctcaac

SEQ ID NO: 712445 - DNA, 25 bp, Mus musculus
gtgggtttgtcagccagggctcaac

SEQ ID NO: 712446 - DNA, 25 bp, Mus musculus
gtgggttttattcttatactcatta

SEQ ID NO: 712447 - DNA, 25 bp, Mus musculus
gtgggttttattgttatactcatta

SEQ ID NO: 712448 - DNA, 25 bp, Mus musculus
gtgggttttcacaagatggtcagtg

SEQ ID NO: 712449 - DNA, 25 bp, Mus musculus
gtgggttttcactagatggtcagtg

SEQ ID NO: 712450 - DNA, 25 bp, Mus musculus
gtgggttttctacatgttcagtgtc

SEQ ID NO: 712451 - DNA, 25 bp, Mus musculus
gtgggttttctagatgttcagtgtc

SEQ ID NO: 712452 - DNA, 25 bp, Mus musculus
gtgggtttttctatgaagtacagag

SEQ ID NO: 712453 - DNA, 25 bp, Mus musculus
gtgggtttttctttgaagtacagag

SEQ ID NO: 712454 - DNA, 25 bp, Mus musculus
gtggtaaaactactgcaccttccaa

SEQ ID NO: 712455 - DNA, 25 bp, Mus musculus
gtggtaaaactagtgcaccttccaa

SEQ ID NO: 712456 - DNA, 25 bp, Mus musculus
gtggtaaactagcaacaatacatgt

SEQ ID NO: 712457 - DNA, 25 bp, Mus musculus
gtggtaaactaggaacaatacatgt

SEQ ID NO: 712458 - DNA, 25 bp, Mus musculus
gtggtaaatagacttccaagtcctc

SEQ ID NO: 712459 - DNA, 25 bp, Mus musculus
gtggtaaatagagttccaagtcctc

SEQ ID NO: 712460 - DNA, 25 bp, Mus musculus
gtggtaaatccacggtccaagccca

SEQ ID NO: 712461 - DNA, 25 bp, Mus musculus
gtggtaaatccagggtccaagccca

SEQ ID NO: 712462 - DNA, 25 bp, Mus musculus
gtggtaacacgtcctggtaatctca

SEQ ID NO: 712463 - DNA, 25 bp, Mus musculus
gtggtaacacgtgctggtaatctca

SEQ ID NO: 712464 - DNA, 25 bp, Mus musculus
gtggtaacacttcaggtgtctctca

SEQ ID NO: 712465 - DNA, 25 bp, Mus musculus
gtggtaacacttgaggtgtctctca

SEQ ID NO: 712466 - DNA, 25 bp, Mus musculus
gtggtaacataaaactacatgcaga

SEQ ID NO: 712467 - DNA, 25 bp, Mus musculus
gtggtaacataatactacatgcaga

SEQ ID NO: 712468 - DNA, 25 bp, Mus musculus
gtggtaacccctcagtaattgggca

SEQ ID NO: 712469 - DNA, 25 bp, Mus musculus
gtggtaacccctgagtaattgggca

SEQ ID NO: 712470 - DNA, 25 bp, Mus musculus
gtggtaacccgcagggtacgtgcca

SEQ ID NO: 712471 - DNA, 25 bp, Mus musculus
gtggtaacccgctgggtacgtgcca

SEQ ID NO: 712472 - DNA, 25 bp, Mus musculus
gtggtaactcagagctccaagctaa

SEQ ID NO: 712473 - DNA, 25 bp, Mus musculus
gtggtaactcagtgctccaagctaa

SEQ ID NO: 712474 - DNA, 25 bp, Mus musculus
gtggtaactgagagtccctgcgttc

SEQ ID NO: 712475 - DNA, 25 bp, Mus musculus
gtggtaactgagtgtccctgcgttc

SEQ ID NO: 712476 - DNA, 25 bp, Mus musculus
gtggtaactgttagaaggccttact

SEQ ID NO: 712477 - DNA, 25 bp, Mus musculus
gtggtaactgtttgaaggccttact

SEQ ID NO: 712478 - DNA, 25 bp, Mus musculus
gtggtaacttgcagtcattggccaa

SEQ ID NO: 712479 - DNA, 25 bp, Mus musculus
gtggtaacttgctgtcattggccaa

SEQ ID NO: 712480 - DNA, 25 bp, Mus musculus
gtggtaagactgcacttctgcctct

SEQ ID NO: 712481 - DNA, 25 bp, Mus musculus
gtggtaagactggacttctgcctct

SEQ ID NO: 712482 - DNA, 25 bp, Mus musculus
gtggtaaggatgaccgtgttccctc

SEQ ID NO: 712483 - DNA, 25 bp, Mus musculus
gtggtaaggatgtccgtgttccctc

SEQ ID NO: 712484 - DNA, 25 bp, Mus musculus
gtggtaaggctgagccctacatgac

SEQ ID NO: 712485 - DNA, 25 bp, Mus musculus
gtggtaaggctgtgccctacatgac

SEQ ID NO: 712486 - DNA, 25 bp, Mus musculus
gtggtaagtgatcacgagccgttga

SEQ ID NO: 712487 - DNA, 25 bp, Mus musculus
gtggtaagtgatgacgagccgttga

SEQ ID NO: 712488 - DNA, 25 bp, Mus musculus
gtggtaatgcctcttttcatctgta

SEQ ID NO: 712489 - DNA, 25 bp, Mus musculus
gtggtaatgcctgttttcatctgta

SEQ ID NO: 712490 - DNA, 25 bp, Mus musculus
gtggtaatgcttctacctgccatac

SEQ ID NO: 712491 - DNA, 25 bp, Mus musculus
gtggtaatgcttgtacctgccatac

SEQ ID NO: 712492 - DNA, 25 bp, Mus musculus
gtggtaatgttcattttacgactac

SEQ ID NO: 712493 - DNA, 25 bp, Mus musculus
gtggtaatgttctttttacgactac

SEQ ID NO: 712494 - DNA, 25 bp, Mus musculus
gtggtaattattctgcttgcttcaa

SEQ ID NO: 712495 - DNA, 25 bp, Mus musculus
gtggtaattattgtgcttgcttcaa

SEQ ID NO: 712496 - DNA, 25 bp, Mus musculus
gtggtacaaactcaacagggcccct

SEQ ID NO: 712497 - DNA, 25 bp, Mus musculus
gtggtacaaactgaacagggcccct

SEQ ID NO: 712498 - DNA, 25 bp, Mus musculus
gtggtacaaagtctcacctcagtgg

SEQ ID NO: 712499 - DNA, 25 bp, Mus musculus
gtggtacaaagtgtcacctcagtgg

SEQ ID NO: 712500 - DNA, 25 bp, Mus musculus
gtggtacaaggcatattttgtctat

SEQ ID NO: 712501 - DNA, 25 bp, Mus musculus
gtggtacaaggcttattttgtctat

SEQ ID NO: 712502 - DNA, 25 bp, Mus musculus
gtggtacacatgagtgccggcaaaa

SEQ ID NO: 712503 - DNA, 25 bp, Mus musculus
gtggtacacatgtgtgccggcaaaa

SEQ ID NO: 712504 - DNA, 25 bp, Mus musculus
gtggtacacctgagtacattgcccc

SEQ ID NO: 712505 - DNA, 25 bp, Mus musculus
gtggtacacctgtgtacattgcccc

SEQ ID NO: 712506 - DNA, 25 bp, Mus musculus
gtggtacacgtcacggatgacctga

SEQ ID NO: 712507 - DNA, 25 bp, Mus musculus
gtggtacacgtctcggatgacctga

SEQ ID NO: 712508 - DNA, 25 bp, Mus musculus
gtggtacactgtcacagtggctcta

SEQ ID NO: 712509 - DNA, 25 bp, Mus musculus
gtggtacactgtgacagtggctcta

SEQ ID NO: 712510 - DNA, 25 bp, Mus musculus
gtggtacacttgaccactgcattca

SEQ ID NO: 712511 - DNA, 25 bp, Mus musculus
gtggtacacttgtccactgcattca

SEQ ID NO: 712512 - DNA, 25 bp, Mus musculus
gtggtacataggacagctactgctg

SEQ ID NO: 712513 - DNA, 25 bp, Mus musculus
gtggtacataggtcagctactgctg

SEQ ID NO: 712514 - DNA, 25 bp, Mus musculus
gtggtacatgctagtgattttagca

SEQ ID NO: 712515 - DNA, 25 bp, Mus musculus
gtggtacatgcttgtgattttagca

SEQ ID NO: 712516 - DNA, 25 bp, Mus musculus
gtggtaccaaagaactgcagcccta

SEQ ID NO: 712517 - DNA, 25 bp, Mus musculus
gtggtaccaaagtactgcagcccta

SEQ ID NO: 712518 - DNA, 25 bp, Mus musculus
gtggtaccactgcatttgctggctc

SEQ ID NO: 712519 - DNA, 25 bp, Mus musculus
gtggtaccactggatttgctggctc

SEQ ID NO: 712520 - DNA, 25 bp, Mus musculus
gtggtaccagcaagcaagggccatc

SEQ ID NO: 712521 - DNA, 25 bp, Mus musculus
gtggtaccagcatgcaagggccatc

SEQ ID NO: 712522 - DNA, 25 bp, Mus musculus
gtggtaccaggaaaggagctatgta

SEQ ID NO: 712523 - DNA, 25 bp, Mus musculus
gtggtaccaggataggagctatgta

SEQ ID NO: 712524 - DNA, 25 bp, Mus musculus
gtggtaccattgactgtttacttaa

SEQ ID NO: 712525 - DNA, 25 bp, Mus musculus
gtggtaccattgtctgtttacttaa

SEQ ID NO: 712526 - DNA, 25 bp, Mus musculus
gtggtacccacacgaccagagtgat

SEQ ID NO: 712527 - DNA, 25 bp, Mus musculus
gtggtacccacaggaccagagtgat

SEQ ID NO: 712528 - DNA, 25 bp, Mus musculus
gtggtaccctgcacagggagacatt

SEQ ID NO: 712529 - DNA, 25 bp, Mus musculus
gtggtaccctgctcagggagacatt

SEQ ID NO: 712530 - DNA, 25 bp, Mus musculus
gtggtaccgcccaggccttaaatca

SEQ ID NO: 712531 - DNA, 25 bp, Mus musculus
gtggtaccgccctggccttaaatca

SEQ ID NO: 712532 - DNA, 25 bp, Mus musculus
gtggtaccgtggacctcaggctgaa

SEQ ID NO: 712533 - DNA, 25 bp, Mus musculus
gtggtaccgtggtcctcaggctgaa

SEQ ID NO: 712534 - DNA, 25 bp, Mus musculus
gtggtacctaaccttgtcctgacta

SEQ ID NO: 712535 - DNA, 25 bp, Mus musculus
gtggtacctaacgttgtcctgacta

SEQ ID NO: 712536 - DNA, 25 bp, Mus musculus
gtggtacctatgatcatgcggcaga

SEQ ID NO: 712537 - DNA, 25 bp, Mus musculus
gtggtacctatgttcatgcggcaga

SEQ ID NO: 712538 - DNA, 25 bp, Mus musculus
gtggtacctcaaacagaagaggcta

SEQ ID NO: 712539 - DNA, 25 bp, Mus musculus
gtggtacctcaatcagaagaggcta

SEQ ID NO: 712540 - DNA, 25 bp, Mus musculus
gtggtacctcgaattagttcccatc

SEQ ID NO: 712541 - DNA, 25 bp, Mus musculus
gtggtacctcgatttagttcccatc

SEQ ID NO: 712542 - DNA, 25 bp, Mus musculus
gtggtacgaacacccatgcttgtct

SEQ ID NO: 712543 - DNA, 25 bp, Mus musculus
gtggtacgaacagccatgcttgtct

SEQ ID NO: 712544 - DNA, 25 bp, Mus musculus
gtggtacggagaaaacgctacagca

SEQ ID NO: 712545 - DNA, 25 bp, Mus musculus
gtggtacggagataacgctacagca

SEQ ID NO: 712546 - DNA, 25 bp, Mus musculus
gtggtacggtcaacatggtctccaa

SEQ ID NO: 712547 - DNA, 25 bp, Mus musculus
gtggtacggtcatcatggtctccaa

SEQ ID NO: 712548 - DNA, 25 bp, Mus musculus
gtggtactactgactgccaggtctg

SEQ ID NO: 712549 - DNA, 25 bp, Mus musculus
gtggtactactgtctgccaggtctg

SEQ ID NO: 712550 - DNA, 25 bp, Mus musculus
gtggtactatttcagttttaagtgt

SEQ ID NO: 712551 - DNA, 25 bp, Mus musculus
gtggtactatttgagttttaagtgt

SEQ ID NO: 712552 - DNA, 25 bp, Mus musculus
gtggtactcaaacccttggaagtca

SEQ ID NO: 712553 - DNA, 25 bp, Mus musculus
gtggtactcaaagccttggaagtca

SEQ ID NO: 712554 - DNA, 25 bp, Mus musculus
gtggtactggttcaagtgacatctt

SEQ ID NO: 712555 - DNA, 25 bp, Mus musculus
gtggtactggttgaagtgacatctt

SEQ ID NO: 712556 - DNA, 25 bp, Mus musculus
gtggtacttcagagtccctcccctg

SEQ ID NO: 712557 - DNA, 25 bp, Mus musculus
gtggtacttcagtgtccctcccctg

SEQ ID NO: 712558 - DNA, 25 bp, Mus musculus
gtggtacttctgaaatctggttagt

SEQ ID NO: 712559 - DNA, 25 bp, Mus musculus
gtggtacttctgtaatctggttagt

SEQ ID NO: 712560 - DNA, 25 bp, Mus musculus
gtggtacttgaacacgtctctgaag

SEQ ID NO: 712561 - DNA, 25 bp, Mus musculus
gtggtacttgaagacgtctctgaag

SEQ ID NO: 712562 - DNA, 25 bp, Mus musculus
gtggtacttgatatgtaacgctgct

SEQ ID NO: 712563 - DNA, 25 bp, Mus musculus
gtggtacttgatttgtaacgctgct

SEQ ID NO: 712564 - DNA, 25 bp, Mus musculus
gtggtagaaaccatatgcctggtac

SEQ ID NO: 712565 - DNA, 25 bp, Mus musculus
gtggtagaaaccttatgcctggtac

SEQ ID NO: 712566 - DNA, 25 bp, Mus musculus
gtggtagaacagaagctatgagctt

SEQ ID NO: 712567 - DNA, 25 bp, Mus musculus
gtggtagaacagtagctatgagctt

SEQ ID NO: 712568 - DNA, 25 bp, Mus musculus
gtggtagaacccaatctatcatgtt

SEQ ID NO: 712569 - DNA, 25 bp, Mus musculus
gtggtagaaccctatctatcatgtt

SEQ ID NO: 712570 - DNA, 25 bp, Mus musculus
gtggtagaactgcacattgcctgag

SEQ ID NO: 712571 - DNA, 25 bp, Mus musculus
gtggtagaactggacattgcctgag

SEQ ID NO: 712572 - DNA, 25 bp, Mus musculus
gtggtagacatgagcttatcagtca

SEQ ID NO: 712573 - DNA, 25 bp, Mus musculus
gtggtagacatgtgcttatcagtca

SEQ ID NO: 712574 - DNA, 25 bp, Mus musculus
gtggtagaccgtcgctctccaggtt

SEQ ID NO: 712575 - DNA, 25 bp, Mus musculus
gtggtagaccgtggctctccaggtt

SEQ ID NO: 712576 - DNA, 25 bp, Mus musculus
gtggtagactggatcctgaccagaa

SEQ ID NO: 712577 - DNA, 25 bp, Mus musculus
gtggtagactggttcctgaccagaa

SEQ ID NO: 712578 - DNA, 25 bp, Mus musculus
gtggtagactttacagagaaccctt

SEQ ID NO: 712579 - DNA, 25 bp, Mus musculus
gtggtagacttttcagagaaccctt

SEQ ID NO: 712580 - DNA, 25 bp, Mus musculus
gtggtagagcacatgttcaatccca

SEQ ID NO: 712581 - DNA, 25 bp, Mus musculus
gtggtagagcacttgttcaatccca

SEQ ID NO: 712582 - DNA, 25 bp, Mus musculus
gtggtagagcgacttcattgcccag

SEQ ID NO: 712583 - DNA, 25 bp, Mus musculus
gtggtagagcgagttcattgcccag

SEQ ID NO: 712584 - DNA, 25 bp, Mus musculus
gtggtagagcgcatgcctagcaagc

SEQ ID NO: 712585 - DNA, 25 bp, Mus musculus
gtggtagagcgcttgcctagcaagc

SEQ ID NO: 712586 - DNA, 25 bp, Mus musculus
gtggtagagctcactcttaacatgg

SEQ ID NO: 712587 - DNA, 25 bp, Mus musculus
gtggtagagctctctcttaacatgg

SEQ ID NO: 712588 - DNA, 25 bp, Mus musculus
gtggtagagcttctccatcctgcag

SEQ ID NO: 712589 - DNA, 25 bp, Mus musculus
gtggtagagcttgtccatcctgcag

SEQ ID NO: 712590 - DNA, 25 bp, Mus musculus
gtggtagagtttctgtaggtaacta

SEQ ID NO: 712591 - DNA, 25 bp, Mus musculus
gtggtagagtttgtgtaggtaacta

SEQ ID NO: 712592 - DNA, 25 bp, Mus musculus
gtggtagatagcactgggtcctagt

SEQ ID NO: 712593 - DNA, 25 bp, Mus musculus
gtggtagatagctctgggtcctagt

SEQ ID NO: 712594 - DNA, 25 bp, Mus musculus
gtggtagcaacgagccccacataaa

SEQ ID NO: 712595 - DNA, 25 bp, Mus musculus
gtggtagcaacgtgccccacataaa

SEQ ID NO: 712596 - DNA, 25 bp, Mus musculus
gtggtagccatactggacctcaaga

SEQ ID NO: 712597 - DNA, 25 bp, Mus musculus
gtggtagccatagtggacctcaaga

SEQ ID NO: 712598 - DNA, 25 bp, Mus musculus
gtggtagcctataccttggatccca

SEQ ID NO: 712599 - DNA, 25 bp, Mus musculus
gtggtagcctattccttggatccca

SEQ ID NO: 712600 - DNA, 25 bp, Mus musculus
gtggtagcgccaaggtaaggcccct

SEQ ID NO: 712601 - DNA, 25 bp, Mus musculus
gtggtagcgccatggtaaggcccct

SEQ ID NO: 712602 - DNA, 25 bp, Mus musculus
gtggtagcgtggcacttcagccttt

SEQ ID NO: 712603 - DNA, 25 bp, Mus musculus
gtggtagcgtgggacttcagccttt

SEQ ID NO: 712604 - DNA, 25 bp, Mus musculus
gtggtagctccaaaccatctgtcac

SEQ ID NO: 712605 - DNA, 25 bp, Mus musculus
gtggtagctccataccatctgtcac

SEQ ID NO: 712606 - DNA, 25 bp, Mus musculus
gtggtagctgtgatctctgcaatac

SEQ ID NO: 712607 - DNA, 25 bp, Mus musculus
gtggtagctgtgttctctgcaatac

SEQ ID NO: 712608 - DNA, 25 bp, Mus musculus
gtggtaggaattcaacccctcctct

SEQ ID NO: 712609 - DNA, 25 bp, Mus musculus
gtggtaggaattgaacccctcctct

SEQ ID NO: 712610 - DNA, 25 bp, Mus musculus
gtggtaggagataaccagtcttgtt

SEQ ID NO: 712611 - DNA, 25 bp, Mus musculus
gtggtaggagattaccagtcttgtt

SEQ ID NO: 712612 - DNA, 25 bp, Mus musculus
gtggtaggatatccctgtgacccca

SEQ ID NO: 712613 - DNA, 25 bp, Mus musculus
gtggtaggatatgcctgtgacccca

SEQ ID NO: 712614 - DNA, 25 bp, Mus musculus
gtggtaggcatgacaacaatcttag

SEQ ID NO: 712615 - DNA, 25 bp, Mus musculus
gtggtaggcatgtcaacaatcttag

SEQ ID NO: 712616 - DNA, 25 bp, Mus musculus
gtggtaggtttacgctcacttcctt

SEQ ID NO: 712617 - DNA, 25 bp, Mus musculus
gtggtaggtttaggctcacttcctt

SEQ ID NO: 712618 - DNA, 25 bp, Mus musculus
gtggtagtacatcacagaggcatta

SEQ ID NO: 712619 - DNA, 25 bp, Mus musculus
gtggtagtacatgacagaggcatta

SEQ ID NO: 712620 - DNA, 25 bp, Mus musculus
gtggtagtacttagaacatgcattt

SEQ ID NO: 712621 - DNA, 25 bp, Mus musculus
gtggtagtactttgaacatgcattt

SEQ ID NO: 712622 - DNA, 25 bp, Mus musculus
gtggtagtataacgtctctcttctg

SEQ ID NO: 712623 - DNA, 25 bp, Mus musculus
gtggtagtataaggtctctcttctg

SEQ ID NO: 712624 - DNA, 25 bp, Mus musculus
gtggtagtccacacatcaactgaca

SEQ ID NO: 712625 - DNA, 25 bp, Mus musculus
gtggtagtccactcatcaactgaca

SEQ ID NO: 712626 - DNA, 25 bp, Mus musculus
gtggtagtgattataggtcgtcctg

SEQ ID NO: 712627 - DNA, 25 bp, Mus musculus
gtggtagtgattttaggtcgtcctg

SEQ ID NO: 712628 - DNA, 25 bp, Mus musculus
gtggtagtgcacaactgttattcca

SEQ ID NO: 712629 - DNA, 25 bp, Mus musculus
gtggtagtgcactactgttattcca

SEQ ID NO: 712630 - DNA, 25 bp, Mus musculus
gtggtagtgcgtactacagccacgc

SEQ ID NO: 712631 - DNA, 25 bp, Mus musculus
gtggtagtgcgttctacagccacgc

SEQ ID NO: 712632 - DNA, 25 bp, Mus musculus
gtggtagtgtaaacagtggccctat

SEQ ID NO: 712633 - DNA, 25 bp, Mus musculus
gtggtagtgtaatcagtggccctat

SEQ ID NO: 712634 - DNA, 25 bp, Mus musculus
gtggtagttatacccggaccgttca

SEQ ID NO: 712635 - DNA, 25 bp, Mus musculus
gtggtagttatagccggaccgttca

SEQ ID NO: 712636 - DNA, 25 bp, Mus musculus
gtggtataagaccagcccttgggaa

SEQ ID NO: 712637 - DNA, 25 bp, Mus musculus
gtggtataagacgagcccttgggaa

SEQ ID NO: 712638 - DNA, 25 bp, Mus musculus
gtggtatacactccctatgtcttca

SEQ ID NO: 712639 - DNA, 25 bp, Mus musculus
gtggtatacactgcctatgtcttca

SEQ ID NO: 712640 - DNA, 25 bp, Mus musculus
gtggtatacattcacaatggcattg

SEQ ID NO: 712641 - DNA, 25 bp, Mus musculus
gtggtatacattgacaatggcattg

SEQ ID NO: 712642 - DNA, 25 bp, Mus musculus
gtggtataccatctctgctgtggac

SEQ ID NO: 712643 - DNA, 25 bp, Mus musculus
gtggtataccatgtctgctgtggac

SEQ ID NO: 712644 - DNA, 25 bp, Mus musculus
gtggtatacgctctaaccctagcac

SEQ ID NO: 712645 - DNA, 25 bp, Mus musculus
gtggtatacgctgtaaccctagcac

SEQ ID NO: 712646 - DNA, 25 bp, Mus musculus
gtggtatagcatatagcatgggcaa

SEQ ID NO: 712647 - DNA, 25 bp, Mus musculus
gtggtatagcatttagcatgggcaa

SEQ ID NO: 712648 - DNA, 25 bp, Mus musculus
gtggtatatgtaaggtacaaaccca

SEQ ID NO: 712649 - DNA, 25 bp, Mus musculus
gtggtatatgtatggtacaaaccca

SEQ ID NO: 712650 - DNA, 25 bp, Mus musculus
gtggtatcacctatgaccgcaagga

SEQ ID NO: 712651 - DNA, 25 bp, Mus musculus
gtggtatcacctttgaccgcaagga

SEQ ID NO: 712652 - DNA, 25 bp, Mus musculus
gtggtatcatcaagtctcctggttc

SEQ ID NO: 712653 - DNA, 25 bp, Mus musculus
gtggtatcatcaatcttagcccttt

SEQ ID NO: 712654 - DNA, 25 bp, Mus musculus
gtggtatcatcatgtctcctggttc

SEQ ID NO: 712655 - DNA, 25 bp, Mus musculus
gtggtatcatcattcttagcccttt

SEQ ID NO: 712656 - DNA, 25 bp, Mus musculus
gtggtatccagcacttgaagcggga

SEQ ID NO: 712657 - DNA, 25 bp, Mus musculus
gtggtatccagctcttgaagcggga

SEQ ID NO: 712658 - DNA, 25 bp, Mus musculus
gtggtatcgactccaggactctaga

SEQ ID NO: 712659 - DNA, 25 bp, Mus musculus
gtggtatcgactgcaggactctaga

SEQ ID NO: 712660 - DNA, 25 bp, Mus musculus
gtggtatgacttcttgatgaatgca

SEQ ID NO: 712661 - DNA, 25 bp, Mus musculus
gtggtatgacttgttgatgaatgca

SEQ ID NO: 712662 - DNA, 25 bp, Mus musculus
gtggtatgatacaggtattccccaa

SEQ ID NO: 712663 - DNA, 25 bp, Mus musculus
gtggtatgatacatggtttgaatgc

SEQ ID NO: 712664 - DNA, 25 bp, Mus musculus
gtggtatgatactggtattccccaa

SEQ ID NO: 712665 - DNA, 25 bp, Mus musculus
gtggtatgatacttggtttgaatgc

SEQ ID NO: 712666 - DNA, 25 bp, Mus musculus
gtggtatgcaggaatcaacccctca

SEQ ID NO: 712667 - DNA, 25 bp, Mus musculus
gtggtatgcaggtatcaacccctca

SEQ ID NO: 712668 - DNA, 25 bp, Mus musculus
gtggtatgccataaacctcaggact

SEQ ID NO: 712669 - DNA, 25 bp, Mus musculus
gtggtatgccattaacctcaggact

SEQ ID NO: 712670 - DNA, 25 bp, Mus musculus
gtggtatgcctactgagctgcctca

SEQ ID NO: 712671 - DNA, 25 bp, Mus musculus
gtggtatgcctagtgagctgcctca

SEQ ID NO: 712672 - DNA, 25 bp, Mus musculus
gtggtatggcatattctcaaacaaa

SEQ ID NO: 712673 - DNA, 25 bp, Mus musculus
gtggtatggcattttctcaaacaaa

SEQ ID NO: 712674 - DNA, 25 bp, Mus musculus
gtggtatgttcaagggtgttcccct

SEQ ID NO: 712675 - DNA, 25 bp, Mus musculus
gtggtatgttcatgggtgttcccct

SEQ ID NO: 712676 - DNA, 25 bp, Mus musculus
gtggtatgttttctggttcttgtag

SEQ ID NO: 712677 - DNA, 25 bp, Mus musculus
gtggtatgttttgtggttcttgtag

SEQ ID NO: 712678 - DNA, 25 bp, Mus musculus
gtggtattacatcttagtgtatgga

SEQ ID NO: 712679 - DNA, 25 bp, Mus musculus
gtggtattacatgttagtgtatgga

SEQ ID NO: 712680 - DNA, 25 bp, Mus musculus
gtggtattcagcactactaaacagg

SEQ ID NO: 712681 - DNA, 25 bp, Mus musculus
gtggtattcagctctactaaacagg

SEQ ID NO: 712682 - DNA, 25 bp, Mus musculus
gtggtattcctcctcaggcgatgga

SEQ ID NO: 712683 - DNA, 25 bp, Mus musculus
gtggtattcctcgtcaggcgatgga

SEQ ID NO: 712684 - DNA, 25 bp, Mus musculus
gtggtattgccaactgtggctctaa

SEQ ID NO: 712685 - DNA, 25 bp, Mus musculus
gtggtattgccatctgtggctctaa

SEQ ID NO: 712686 - DNA, 25 bp, Mus musculus
gtggtattggagcaccctcattgag

SEQ ID NO: 712687 - DNA, 25 bp, Mus musculus
gtggtattggaggaccctcattgag

SEQ ID NO: 712688 - DNA, 25 bp, Mus musculus
gtggtattggtacccgcttatgtta

SEQ ID NO: 712689 - DNA, 25 bp, Mus musculus
gtggtattggtagccgcttatgtta

SEQ ID NO: 712690 - DNA, 25 bp, Mus musculus
gtggtattgtaaagcctgtctcaaa

SEQ ID NO: 712691 - DNA, 25 bp, Mus musculus
gtggtattgtaatgcctgtctcaaa

SEQ ID NO: 712692 - DNA, 25 bp, Mus musculus
gtggtatttaatatcccaacaaatg

SEQ ID NO: 712693 - DNA, 25 bp, Mus musculus
gtggtatttaatttcccaacaaatg

SEQ ID NO: 712694 - DNA, 25 bp, Mus musculus
gtggtatttgatctattctcacatg

SEQ ID NO: 712695 - DNA, 25 bp, Mus musculus
gtggtatttgatgtattctcacatg

SEQ ID NO: 712696 - DNA, 25 bp, Mus musculus
gtggtattttcgagtacatgttaaa

SEQ ID NO: 712697 - DNA, 25 bp, Mus musculus
gtggtattttcgtgtacatgttaaa

SEQ ID NO: 712698 - DNA, 25 bp, Mus musculus
gtggtcaaaaccagtggacactagg

SEQ ID NO: 712699 - DNA, 25 bp, Mus musculus
gtggtcaaaacctgtggacactagg

SEQ ID NO: 712700 - DNA, 25 bp, Mus musculus
gtggtcaaacaactagtgcccagct

SEQ ID NO: 712701 - DNA, 25 bp, Mus musculus
gtggtcaaacaagtagtgcccagct

SEQ ID NO: 712702 - DNA, 25 bp, Mus musculus
gtggtcaaacctatccacctctagt

SEQ ID NO: 712703 - DNA, 25 bp, Mus musculus
gtggtcaaacctttccacctctagt

SEQ ID NO: 712704 - DNA, 25 bp, Mus musculus
gtggtcaaatccctgttggtgaaca

SEQ ID NO: 712705 - DNA, 25 bp, Mus musculus
gtggtcaaatccgtgttggtgaaca

SEQ ID NO: 712706 - DNA, 25 bp, Mus musculus
gtggtcaaccaaaccaggaaccttg

SEQ ID NO: 712707 - DNA, 25 bp, Mus musculus
gtggtcaaccaatccaggaaccttg

SEQ ID NO: 712708 - DNA, 25 bp, Mus musculus
gtggtcaactccatttcaattttag

SEQ ID NO: 712709 - DNA, 25 bp, Mus musculus
gtggtcaactccttttcaattttag

SEQ ID NO: 712710 - DNA, 25 bp, Mus musculus
gtggtcaactgtccactgcatgcgt

SEQ ID NO: 712711 - DNA, 25 bp, Mus musculus
gtggtcaactgtgcactgcatgcgt

SEQ ID NO: 712712 - DNA, 25 bp, Mus musculus
gtggtcaacttacggcatcttttct

SEQ ID NO: 712713 - DNA, 25 bp, Mus musculus
gtggtcaacttagggcatcttttct

SEQ ID NO: 712714 - DNA, 25 bp, Mus musculus
gtggtcaatacactctgtaggtcat

SEQ ID NO: 712715 - DNA, 25 bp, Mus musculus
gtggtcaatacagtctgtaggtcat

SEQ ID NO: 712716 - DNA, 25 bp, Mus musculus
gtggtcaatatcaatgttcagtcct

SEQ ID NO: 712717 - DNA, 25 bp, Mus musculus
gtggtcaatatctatgttcagtcct

SEQ ID NO: 712718 - DNA, 25 bp, Mus musculus
gtggtcaatcatcactgtccctctg

SEQ ID NO: 712719 - DNA, 25 bp, Mus musculus
gtggtcaatcatgactgtccctctg

SEQ ID NO: 712720 - DNA, 25 bp, Mus musculus
gtggtcaattgaactctagaataat

SEQ ID NO: 712721 - DNA, 25 bp, Mus musculus
gtggtcaattgatctctagaataat

SEQ ID NO: 712722 - DNA, 25 bp, Mus musculus
gtggtcacaaggatactgaagtctc

SEQ ID NO: 712723 - DNA, 25 bp, Mus musculus
gtggtcacaaggttactgaagtctc

SEQ ID NO: 712724 - DNA, 25 bp, Mus musculus
gtggtcacagctccacatggccgag

SEQ ID NO: 712725 - DNA, 25 bp, Mus musculus
gtggtcacagctgcacatggccgag

SEQ ID NO: 712726 - DNA, 25 bp, Mus musculus
gtggtcacaggcacagaggttctga

SEQ ID NO: 712727 - DNA, 25 bp, Mus musculus
gtggtcacaggctcagaggttctga

SEQ ID NO: 712728 - DNA, 25 bp, Mus musculus
gtggtcacagtgcttatcctgagct

SEQ ID NO: 712729 - DNA, 25 bp, Mus musculus
gtggtcacagtggttatcctgagct

SEQ ID NO: 712730 - DNA, 25 bp, Mus musculus
gtggtcacataaacctagcaagagt

SEQ ID NO: 712731 - DNA, 25 bp, Mus musculus
gtggtcacataatcctagcaagagt

SEQ ID NO: 712732 - DNA, 25 bp, Mus musculus
gtggtcacatacatacacaatgaag

SEQ ID NO: 712733 - DNA, 25 bp, Mus musculus
gtggtcacatacttacacaatgaag

SEQ ID NO: 712734 - DNA, 25 bp, Mus musculus
gtggtcaccaccagcgcctgaggat

SEQ ID NO: 712735 - DNA, 25 bp, Mus musculus
gtggtcaccacctgcgcctgaggat

SEQ ID NO: 712736 - DNA, 25 bp, Mus musculus
gtggtcaccctgatataaggacact

SEQ ID NO: 712737 - DNA, 25 bp, Mus musculus
gtggtcaccctgttataaggacact

SEQ ID NO: 712738 - DNA, 25 bp, Mus musculus
gtggtcaccggccacaatattctag

SEQ ID NO: 712739 - DNA, 25 bp, Mus musculus
gtggtcaccggcgacaatattctag

SEQ ID NO: 712740 - DNA, 25 bp, Mus musculus
gtggtcaccggtcggttcagccttt

SEQ ID NO: 712741 - DNA, 25 bp, Mus musculus
gtggtcaccggtgggttcagccttt

SEQ ID NO: 712742 - DNA, 25 bp, Mus musculus
gtggtcacgattatgcagagcagct

SEQ ID NO: 712743 - DNA, 25 bp, Mus musculus
gtggtcacgattttgcagagcagct

SEQ ID NO: 712744 - DNA, 25 bp, Mus musculus
gtggtcactagcactgtctcctaaa

SEQ ID NO: 712745 - DNA, 25 bp, Mus musculus
gtggtcactagctctgtctcctaaa

SEQ ID NO: 712746 - DNA, 25 bp, Mus musculus
gtggtcactagtctctgagaacagt

SEQ ID NO: 712747 - DNA, 25 bp, Mus musculus
gtggtcactagtgtctgagaacagt

SEQ ID NO: 712748 - DNA, 25 bp, Mus musculus
gtggtcactcagctcaacaaggttg

SEQ ID NO: 712749 - DNA, 25 bp, Mus musculus
gtggtcactcaggtcaacaaggttg

SEQ ID NO: 712750 - DNA, 25 bp, Mus musculus
gtggtcactcttagtacttgtttat

SEQ ID NO: 712751 - DNA, 25 bp, Mus musculus
gtggtcactctttgtacttgtttat

SEQ ID NO: 712752 - DNA, 25 bp, Mus musculus
gtggtcactgaaataccccaggaga

SEQ ID NO: 712753 - DNA, 25 bp, Mus musculus
gtggtcactgaattaccccaggaga

SEQ ID NO: 712754 - DNA, 25 bp, Mus musculus
gtggtcacttacctctatcaactaa

SEQ ID NO: 712755 - DNA, 25 bp, Mus musculus
gtggtcacttacgtctatcaactaa

SEQ ID NO: 712756 - DNA, 25 bp, Mus musculus
gtggtcacttggagggttgtacttt

SEQ ID NO: 712757 - DNA, 25 bp, Mus musculus
gtggtcacttggtgggttgtacttt

SEQ ID NO: 712758 - DNA, 25 bp, Mus musculus
gtggtcagaagacagttttggaatt

SEQ ID NO: 712759 - DNA, 25 bp, Mus musculus
gtggtcagaagagagttttggaatt

SEQ ID NO: 712760 - DNA, 25 bp, Mus musculus
gtggtcagagagaggcctccaacac

SEQ ID NO: 712761 - DNA, 25 bp, Mus musculus
gtggtcagagagtggcctccaacac

SEQ ID NO: 712762 - DNA, 25 bp, Mus musculus
gtggtcagcacaatgttaatttcct

SEQ ID NO: 712763 - DNA, 25 bp, Mus musculus
gtggtcagcacattgttaatttcct

SEQ ID NO: 712764 - DNA, 25 bp, Mus musculus
gtggtcagcactacatgcaggtatt

SEQ ID NO: 712765 - DNA, 25 bp, Mus musculus
gtggtcagcacttcatgcaggtatt

SEQ ID NO: 712766 - DNA, 25 bp, Mus musculus
gtggtcagcagtcgctttattctca

SEQ ID NO: 712767 - DNA, 25 bp, Mus musculus
gtggtcagcagtggctttattctca

SEQ ID NO: 712768 - DNA, 25 bp, Mus musculus
gtggtcagccaacacagatgcacat

SEQ ID NO: 712769 - DNA, 25 bp, Mus musculus
gtggtcagccaagacagatgcacat

SEQ ID NO: 712770 - DNA, 25 bp, Mus musculus
gtggtcagctgaatagaacactgtt

SEQ ID NO: 712771 - DNA, 25 bp, Mus musculus
gtggtcagctgattagaacactgtt

SEQ ID NO: 712772 - DNA, 25 bp, Mus musculus
gtggtcaggccaagagagttcacag

SEQ ID NO: 712773 - DNA, 25 bp, Mus musculus
gtggtcaggccacccagacaagtca

SEQ ID NO: 712774 - DNA, 25 bp, Mus musculus
gtggtcaggccagccagacaagtca

SEQ ID NO: 712775 - DNA, 25 bp, Mus musculus
gtggtcaggccatgagagttcacag

SEQ ID NO: 712776 - DNA, 25 bp, Mus musculus
gtggtcagtgctcccagcatctttg

SEQ ID NO: 712777 - DNA, 25 bp, Mus musculus
gtggtcagtgctgccagcatctttg

SEQ ID NO: 712778 - DNA, 25 bp, Mus musculus
gtggtcagtgttagaatttttctca

SEQ ID NO: 712779 - DNA, 25 bp, Mus musculus
gtggtcagtgtttgaatttttctca

SEQ ID NO: 712780 - DNA, 25 bp, Mus musculus
gtggtcataaggctaggacatctaa

SEQ ID NO: 712781 - DNA, 25 bp, Mus musculus
gtggtcataagggtaggacatctaa

SEQ ID NO: 712782 - DNA, 25 bp, Mus musculus
gtggtcatagacaaagtgcagccta

SEQ ID NO: 712783 - DNA, 25 bp, Mus musculus
gtggtcatagactaagtgcagccta

SEQ ID NO: 712784 - DNA, 25 bp, Mus musculus
gtggtcatcagcaagaagctccgcc

SEQ ID NO: 712785 - DNA, 25 bp, Mus musculus
gtggtcatcagctagaagctccgcc

SEQ ID NO: 712786 - DNA, 25 bp, Mus musculus
gtggtcatcatacaaagtccttctc

SEQ ID NO: 712787 - DNA, 25 bp, Mus musculus
gtggtcatcatagaaagtccttctc

SEQ ID NO: 712788 - DNA, 25 bp, Mus musculus
gtggtcatccaaagaaggttccaag

SEQ ID NO: 712789 - DNA, 25 bp, Mus musculus
gtggtcatccaatgaaggttccaag

SEQ ID NO: 712790 - DNA, 25 bp, Mus musculus
gtggtcatcctgaaatacatgtcca

SEQ ID NO: 712791 - DNA, 25 bp, Mus musculus
gtggtcatcctgtaatacatgtcca

SEQ ID NO: 712792 - DNA, 25 bp, Mus musculus
gtggtcatctacaatcggagcagcc

SEQ ID NO: 712793 - DNA, 25 bp, Mus musculus
gtggtcatctactatcggagcagcc

SEQ ID NO: 712794 - DNA, 25 bp, Mus musculus
gtggtcatctccagcttgaagagct

SEQ ID NO: 712795 - DNA, 25 bp, Mus musculus
gtggtcatctcctgcttgaagagct

SEQ ID NO: 712796 - DNA, 25 bp, Mus musculus
gtggtcatgggacaacacttcccag

SEQ ID NO: 712797 - DNA, 25 bp, Mus musculus
gtggtcatgggagaacacttcccag

SEQ ID NO: 712798 - DNA, 25 bp, Mus musculus
gtggtcatgtgacagcactcacgca

SEQ ID NO: 712799 - DNA, 25 bp, Mus musculus
gtggtcatgtgagagcactcacgca

SEQ ID NO: 712800 - DNA, 25 bp, Mus musculus
gtggtcatgttgagtttgcaggcaa

SEQ ID NO: 712801 - DNA, 25 bp, Mus musculus
gtggtcatgttgtgtttgcaggcaa

SEQ ID NO: 712802 - DNA, 25 bp, Mus musculus
gtggtcattctaacaacctgcgccc

SEQ ID NO: 712803 - DNA, 25 bp, Mus musculus
gtggtcattctatcaacctgcgccc

SEQ ID NO: 712804 - DNA, 25 bp, Mus musculus
gtggtcattggaatacaggcatgta

SEQ ID NO: 712805 - DNA, 25 bp, Mus musculus
gtggtcattggattacaggcatgta

SEQ ID NO: 712806 - DNA, 25 bp, Mus musculus
gtggtcatttgaataagaaccccat

SEQ ID NO: 712807 - DNA, 25 bp, Mus musculus
gtggtcatttgattaagaaccccat

SEQ ID NO: 712808 - DNA, 25 bp, Mus musculus
gtggtcattttcattaaactacagc

SEQ ID NO: 712809 - DNA, 25 bp, Mus musculus
gtggtcattttctttaaactacagc

SEQ ID NO: 712810 - DNA, 25 bp, Mus musculus
gtggtccaaaccagggtctgcacgc

SEQ ID NO: 712811 - DNA, 25 bp, Mus musculus
gtggtccaaacctgggtctgcacgc

SEQ ID NO: 712812 - DNA, 25 bp, Mus musculus
gtggtccaaggtacgagctctgtaa

SEQ ID NO: 712813 - DNA, 25 bp, Mus musculus
gtggtccaaggttcgagctctgtaa

SEQ ID NO: 712814 - DNA, 25 bp, Mus musculus
gtggtccaatttaaacatcaacaat

SEQ ID NO: 712815 - DNA, 25 bp, Mus musculus
gtggtccaattttaacatcaacaat

SEQ ID NO: 712816 - DNA, 25 bp, Mus musculus
gtggtccaccagctcactgactgaa

SEQ ID NO: 712817 - DNA, 25 bp, Mus musculus
gtggtccaccaggtcactgactgaa

SEQ ID NO: 712818 - DNA, 25 bp, Mus musculus
gtggtccagcagacaagcacaaaaa

SEQ ID NO: 712819 - DNA, 25 bp, Mus musculus
gtggtccagcagtcaagcacaaaaa

SEQ ID NO: 712820 - DNA, 25 bp, Mus musculus
gtggtccagccaaacattacttatg

SEQ ID NO: 712821 - DNA, 25 bp, Mus musculus
gtggtccagccatacattacttatg

SEQ ID NO: 712822 - DNA, 25 bp, Mus musculus
gtggtccaggacacaggtctcacaa

SEQ ID NO: 712823 - DNA, 25 bp, Mus musculus
gtggtccaggactcaggtctcacaa

SEQ ID NO: 712824 - DNA, 25 bp, Mus musculus
gtggtccaggcacattgagggtgaa

SEQ ID NO: 712825 - DNA, 25 bp, Mus musculus
gtggtccaggcagattgagggtgaa

SEQ ID NO: 712826 - DNA, 25 bp, Mus musculus
gtggtccagggacatatactatgct

SEQ ID NO: 712827 - DNA, 25 bp, Mus musculus
gtggtccagggagatatactatgct

SEQ ID NO: 712828 - DNA, 25 bp, Mus musculus
gtggtccaggtcagtttgctgagaa

SEQ ID NO: 712829 - DNA, 25 bp, Mus musculus
gtggtccaggtctgtttgctgagaa

SEQ ID NO: 712830 - DNA, 25 bp, Mus musculus
gtggtccagtaaccagaacctctga

SEQ ID NO: 712831 - DNA, 25 bp, Mus musculus
gtggtccagtaagcagaacctctga

SEQ ID NO: 712832 - DNA, 25 bp, Mus musculus
gtggtccagtccaatagtacgtgca

SEQ ID NO: 712833 - DNA, 25 bp, Mus musculus
gtggtccagtcctatagtacgtgca

SEQ ID NO: 712834 - DNA, 25 bp, Mus musculus
gtggtccagttaatcatctcatggt

SEQ ID NO: 712835 - DNA, 25 bp, Mus musculus
gtggtccagttattcatctcatggt

SEQ ID NO: 712836 - DNA, 25 bp, Mus musculus
gtggtccataaccatccataactgc

SEQ ID NO: 712837 - DNA, 25 bp, Mus musculus
gtggtccataacgatccataactgc

SEQ ID NO: 712838 - DNA, 25 bp, Mus musculus
gtggtccatccccaaaagcacatga

SEQ ID NO: 712839 - DNA, 25 bp, Mus musculus
gtggtccatcccgaaaagcacatga

SEQ ID NO: 712840 - DNA, 25 bp, Mus musculus
gtggtccatctaaaatactactcct

SEQ ID NO: 712841 - DNA, 25 bp, Mus musculus
gtggtccatctataatactactcct

SEQ ID NO: 712842 - DNA, 25 bp, Mus musculus
gtggtccatggtaggtatgaaatcc

SEQ ID NO: 712843 - DNA, 25 bp, Mus musculus
gtggtccatggttggtatgaaatcc

SEQ ID NO: 712844 - DNA, 25 bp, Mus musculus
gtggtccatttacttgaatcaggcc

SEQ ID NO: 712845 - DNA, 25 bp, Mus musculus
gtggtccatttagttgaatcaggcc

SEQ ID NO: 712846 - DNA, 25 bp, Mus musculus
gtggtcccactgcaattatcctgat

SEQ ID NO: 712847 - DNA, 25 bp, Mus musculus
gtggtcccactggaattatcctgat

SEQ ID NO: 712848 - DNA, 25 bp, Mus musculus
gtggtcccagcaattaggttgtaag

SEQ ID NO: 712849 - DNA, 25 bp, Mus musculus
gtggtcccagcatttaggttgtaag

SEQ ID NO: 712850 - DNA, 25 bp, Mus musculus
gtggtcccaggaaacggtcatgcag

SEQ ID NO: 712851 - DNA, 25 bp, Mus musculus
gtggtcccaggactgtcagtgtctt

SEQ ID NO: 712852 - DNA, 25 bp, Mus musculus
gtggtcccaggagtgtcagtgtctt

SEQ ID NO: 712853 - DNA, 25 bp, Mus musculus
gtggtcccaggatacggtcatgcag

SEQ ID NO: 712854 - DNA, 25 bp, Mus musculus
gtggtccccaagaaacaaagatgtt

SEQ ID NO: 712855 - DNA, 25 bp, Mus musculus
gtggtccccaagcagcatctgacaa

SEQ ID NO: 712856 - DNA, 25 bp, Mus musculus
gtggtccccaaggagcatctgacaa

SEQ ID NO: 712857 - DNA, 25 bp, Mus musculus
gtggtccccaagtaacaaagatgtt

SEQ ID NO: 712858 - DNA, 25 bp, Mus musculus
gtggtccccggaatttgaagagctc

SEQ ID NO: 712859 - DNA, 25 bp, Mus musculus
gtggtccccggattttgaagagctc

SEQ ID NO: 712860 - DNA, 25 bp, Mus musculus
gtggtcccctagctaaaatgactca

SEQ ID NO: 712861 - DNA, 25 bp, Mus musculus
gtggtcccctaggtaaaatgactca

SEQ ID NO: 712862 - DNA, 25 bp, Mus musculus
gtggtcccgttgaggtcctaaatga

SEQ ID NO: 712863 - DNA, 25 bp, Mus musculus
gtggtcccgttgtggtcctaaatga

SEQ ID NO: 712864 - DNA, 25 bp, Mus musculus
gtggtccctacgcatgagtcccagg

SEQ ID NO: 712865 - DNA, 25 bp, Mus musculus
gtggtccctacggatgagtcccagg

SEQ ID NO: 712866 - DNA, 25 bp, Mus musculus
gtggtccctcttctttggagtcaga

SEQ ID NO: 712867 - DNA, 25 bp, Mus musculus
gtggtccctcttgtttggagtcaga

SEQ ID NO: 712868 - DNA, 25 bp, Mus musculus
gtggtcccttcactcgtttcctgtt

SEQ ID NO: 712869 - DNA, 25 bp, Mus musculus
gtggtcccttcagtcgtttcctgtt

SEQ ID NO: 712870 - DNA, 25 bp, Mus musculus
gtggtcccttttcataacttcttca

SEQ ID NO: 712871 - DNA, 25 bp, Mus musculus
gtggtcccttttgataacttcttca

SEQ ID NO: 712872 - DNA, 25 bp, Mus musculus
gtggtccgagacatcttgctgattg

SEQ ID NO: 712873 - DNA, 25 bp, Mus musculus
gtggtccgagacttcttgctgattg

SEQ ID NO: 712874 - DNA, 25 bp, Mus musculus
gtggtccggcaaacagcaccaagga

SEQ ID NO: 712875 - DNA, 25 bp, Mus musculus
gtggtccggcaatcagcaccaagga

SEQ ID NO: 712876 - DNA, 25 bp, Mus musculus
gtggtccggttgatagttctctata

SEQ ID NO: 712877 - DNA, 25 bp, Mus musculus
gtggtccggttgttagttctctata

SEQ ID NO: 712878 - DNA, 25 bp, Mus musculus
gtggtcctaataaatgtggtccttt

SEQ ID NO: 712879 - DNA, 25 bp, Mus musculus
gtggtcctaatatatgtggtccttt

SEQ ID NO: 712880 - DNA, 25 bp, Mus musculus
gtggtcctaatgagcttgacagctt

SEQ ID NO: 712881 - DNA, 25 bp, Mus musculus
gtggtcctaatgtgcttgacagctt

SEQ ID NO: 712882 - DNA, 25 bp, Mus musculus
gtggtcctacacactgcatttcttt

SEQ ID NO: 712883 - DNA, 25 bp, Mus musculus
gtggtcctacactctgcatttcttt

SEQ ID NO: 712884 - DNA, 25 bp, Mus musculus
gtggtcctagaaaacttctctacgt

SEQ ID NO: 712885 - DNA, 25 bp, Mus musculus
gtggtcctagaatacttctctacgt

SEQ ID NO: 712886 - DNA, 25 bp, Mus musculus
gtggtcctattgactctttacagag

SEQ ID NO: 712887 - DNA, 25 bp, Mus musculus
gtggtcctattgtctctttacagag

SEQ ID NO: 712888 - DNA, 25 bp, Mus musculus
gtggtcctccagcaagaggtcctaa

SEQ ID NO: 712889 - DNA, 25 bp, Mus musculus
gtggtcctccaggaagaggtcctaa

SEQ ID NO: 712890 - DNA, 25 bp, Mus musculus
gtggtcctcccacaaagtgaagatg

SEQ ID NO: 712891 - DNA, 25 bp, Mus musculus
gtggtcctcccagaaagtgaagatg

SEQ ID NO: 712892 - DNA, 25 bp, Mus musculus
gtggtcctctatcactacgtggcag

SEQ ID NO: 712893 - DNA, 25 bp, Mus musculus
gtggtcctctatgactacgtggcag

SEQ ID NO: 712894 - DNA, 25 bp, Mus musculus
gtggtcctctgaaatagggattctg

SEQ ID NO: 712895 - DNA, 25 bp, Mus musculus
gtggtcctctgatatagggattctg

SEQ ID NO: 712896 - DNA, 25 bp, Mus musculus
gtggtcctctttcttacaaggtgtc

SEQ ID NO: 712897 - DNA, 25 bp, Mus musculus
gtggtcctctttgttacaaggtgtc

SEQ ID NO: 712898 - DNA, 25 bp, Mus musculus
gtggtcctgctgaagaacgccggaa

SEQ ID NO: 712899 - DNA, 25 bp, Mus musculus
gtggtcctgctgtagaacgccggaa

SEQ ID NO: 712900 - DNA, 25 bp, Mus musculus
gtggtcctggagagcataagaaatc

SEQ ID NO: 712901 - DNA, 25 bp, Mus musculus
gtggtcctggagtgcataagaaatc

SEQ ID NO: 712902 - DNA, 25 bp, Mus musculus
gtggtcctgtgcactacagtccaga

SEQ ID NO: 712903 - DNA, 25 bp, Mus musculus
gtggtcctgtgctctacagtccaga

SEQ ID NO: 712904 - DNA, 25 bp, Mus musculus
gtggtcctgttaaccatcctatgga

SEQ ID NO: 712905 - DNA, 25 bp, Mus musculus
gtggtcctgttatccatcctatgga

SEQ ID NO: 712906 - DNA, 25 bp, Mus musculus
gtggtccttacaatgccgagcatag

SEQ ID NO: 712907 - DNA, 25 bp, Mus musculus
gtggtccttacattgccgagcatag

SEQ ID NO: 712908 - DNA, 25 bp, Mus musculus
gtggtccttggaattattatcagat

SEQ ID NO: 712909 - DNA, 25 bp, Mus musculus
gtggtccttggatttattatcagat

SEQ ID NO: 712910 - DNA, 25 bp, Mus musculus
gtggtcctttacaaacttcttccag

SEQ ID NO: 712911 - DNA, 25 bp, Mus musculus
gtggtcctttacacagatggaggtg

SEQ ID NO: 712912 - DNA, 25 bp, Mus musculus
gtggtcctttactaacttcttccag

SEQ ID NO: 712913 - DNA, 25 bp, Mus musculus
gtggtcctttactcagatggaggtg

SEQ ID NO: 712914 - DNA, 25 bp, Mus musculus
gtggtcctttcaagattctgtggtc

SEQ ID NO: 712915 - DNA, 25 bp, Mus musculus
gtggtcctttcatgattctgtggtc

SEQ ID NO: 712916 - DNA, 25 bp, Mus musculus
gtggtcctttccaaaggaggataag

SEQ ID NO: 712917 - DNA, 25 bp, Mus musculus
gtggtcctttcctaaggaggataag

SEQ ID NO: 712918 - DNA, 25 bp, Mus musculus
gtggtcgataccaccaatgatctaa

SEQ ID NO: 712919 - DNA, 25 bp, Mus musculus
gtggtcgatacctccaatgatctaa

SEQ ID NO: 712920 - DNA, 25 bp, Mus musculus
gtggtcgatgctatgtgatataaat

SEQ ID NO: 712921 - DNA, 25 bp, Mus musculus
gtggtcgatgctttgtgatataaat

SEQ ID NO: 712922 - DNA, 25 bp, Mus musculus
gtggtcgccactaagccaatttcta

SEQ ID NO: 712923 - DNA, 25 bp, Mus musculus
gtggtcgccacttagccaatttcta

SEQ ID NO: 712924 - DNA, 25 bp, Mus musculus
gtggtcgctgggaaacaaacagcat

SEQ ID NO: 712925 - DNA, 25 bp, Mus musculus
gtggtcgctgggtaacaaacagcat

SEQ ID NO: 712926 - DNA, 25 bp, Mus musculus
gtggtcgcttccactggtttggaga

SEQ ID NO: 712927 - DNA, 25 bp, Mus musculus
gtggtcgcttcctctggtttggaga

SEQ ID NO: 712928 - DNA, 25 bp, Mus musculus
gtggtcggatcaacatgtgcggctt

SEQ ID NO: 712929 - DNA, 25 bp, Mus musculus
gtggtcggatcatcatgtgcggctt

SEQ ID NO: 712930 - DNA, 25 bp, Mus musculus
gtggtcgggcacaacatctagcaaa

SEQ ID NO: 712931 - DNA, 25 bp, Mus musculus
gtggtcgggcactacatctagcaaa

SEQ ID NO: 712932 - DNA, 25 bp, Mus musculus
gtggtcgtccaaataactcaatctt

SEQ ID NO: 712933 - DNA, 25 bp, Mus musculus
gtggtcgtccaattaactcaatctt

SEQ ID NO: 712934 - DNA, 25 bp, Mus musculus
gtggtcgtggctctatttattgtct

SEQ ID NO: 712935 - DNA, 25 bp, Mus musculus
gtggtcgtggctgtatttattgtct

SEQ ID NO: 712936 - DNA, 25 bp, Mus musculus
gtggtctaaagaaacctatagccct

SEQ ID NO: 712937 - DNA, 25 bp, Mus musculus
gtggtctaaagatacctatagccct

SEQ ID NO: 712938 - DNA, 25 bp, Mus musculus
gtggtctaaatcaatataaacagtt

SEQ ID NO: 712939 - DNA, 25 bp, Mus musculus
gtggtctaaatctatataaacagtt

SEQ ID NO: 712940 - DNA, 25 bp, Mus musculus
gtggtctaacacatatttttgtctt

SEQ ID NO: 712941 - DNA, 25 bp, Mus musculus
gtggtctaacacttatttttgtctt

SEQ ID NO: 712942 - DNA, 25 bp, Mus musculus
gtggtctaagaccagaggaatgtcc

SEQ ID NO: 712943 - DNA, 25 bp, Mus musculus
gtggtctaagacgagaggaatgtcc

SEQ ID NO: 712944 - DNA, 25 bp, Mus musculus
gtggtctaagctagtgggtcccaga

SEQ ID NO: 712945 - DNA, 25 bp, Mus musculus
gtggtctaagcttgtgggtcccaga

SEQ ID NO: 712946 - DNA, 25 bp, Mus musculus
gtggtctaagtaaagaacccaatat

SEQ ID NO: 712947 - DNA, 25 bp, Mus musculus
gtggtctaagtatagaacccaatat

SEQ ID NO: 712948 - DNA, 25 bp, Mus musculus
gtggtctacataaattggcctttat

SEQ ID NO: 712949 - DNA, 25 bp, Mus musculus
gtggtctacatatattggcctttat

SEQ ID NO: 712950 - DNA, 25 bp, Mus musculus
gtggtctaccacaaagttctgattt

SEQ ID NO: 712951 - DNA, 25 bp, Mus musculus
gtggtctaccactaagttctgattt

SEQ ID NO: 712952 - DNA, 25 bp, Mus musculus
gtggtctaccatctggaggcaactt

SEQ ID NO: 712953 - DNA, 25 bp, Mus musculus
gtggtctaccatgtggaggcaactt

SEQ ID NO: 712954 - DNA, 25 bp, Mus musculus
gtggtctactgcattcatcattaca

SEQ ID NO: 712955 - DNA, 25 bp, Mus musculus
gtggtctactgctttcatcattaca

SEQ ID NO: 712956 - DNA, 25 bp, Mus musculus
gtggtctactgtatataacatctaa

SEQ ID NO: 712957 - DNA, 25 bp, Mus musculus
gtggtctactgtttataacatctaa

SEQ ID NO: 712958 - DNA, 25 bp, Mus musculus
gtggtctactttaacaatggactgt

SEQ ID NO: 712959 - DNA, 25 bp, Mus musculus
gtggtctacttttacaatggactgt

SEQ ID NO: 712960 - DNA, 25 bp, Mus musculus
gtggtctatgggaccgaggcatctc

SEQ ID NO: 712961 - DNA, 25 bp, Mus musculus
gtggtctatgggtccgaggcatctc

SEQ ID NO: 712962 - DNA, 25 bp, Mus musculus
gtggtctatgtcctcatatatcagt

SEQ ID NO: 712963 - DNA, 25 bp, Mus musculus
gtggtctatgtcgtcatatatcagt

SEQ ID NO: 712964 - DNA, 25 bp, Mus musculus
gtggtctcaaagctctccagaagat

SEQ ID NO: 712965 - DNA, 25 bp, Mus musculus
gtggtctcaaaggtctccagaagat

SEQ ID NO: 712966 - DNA, 25 bp, Mus musculus
gtggtctcaaatctcacaactcaga

SEQ ID NO: 712967 - DNA, 25 bp, Mus musculus
gtggtctcaaatgtcacaactcaga

SEQ ID NO: 712968 - DNA, 25 bp, Mus musculus
gtggtctcagcaaacggagaggctt

SEQ ID NO: 712969 - DNA, 25 bp, Mus musculus
gtggtctcagcatacggagaggctt

SEQ ID NO: 712970 - DNA, 25 bp, Mus musculus
gtggtctcagccactggtcgtacag

SEQ ID NO: 712971 - DNA, 25 bp, Mus musculus
gtggtctcagcctctggtcgtacag

SEQ ID NO: 712972 - DNA, 25 bp, Mus musculus
gtggtctcattgatactagttgtat

SEQ ID NO: 712973 - DNA, 25 bp, Mus musculus
gtggtctcattgttactagttgtat

SEQ ID NO: 712974 - DNA, 25 bp, Mus musculus
gtggtctccaataacttcaccaaag

SEQ ID NO: 712975 - DNA, 25 bp, Mus musculus
gtggtctccaattacttcaccaaag

SEQ ID NO: 712976 - DNA, 25 bp, Mus musculus
gtggtctccactaaaatactttctt

SEQ ID NO: 712977 - DNA, 25 bp, Mus musculus
gtggtctccacttaaatactttctt

SEQ ID NO: 712978 - DNA, 25 bp, Mus musculus
gtggtctccctacacaaccaaaggt

SEQ ID NO: 712979 - DNA, 25 bp, Mus musculus
gtggtctccctagacaaccaaaggt

SEQ ID NO: 712980 - DNA, 25 bp, Mus musculus
gtggtctccggacccttcttgatga

SEQ ID NO: 712981 - DNA, 25 bp, Mus musculus
gtggtctccggagccttcttgatga

SEQ ID NO: 712982 - DNA, 25 bp, Mus musculus
gtggtctccttcagcagttatttaa

SEQ ID NO: 712983 - DNA, 25 bp, Mus musculus
gtggtctccttctgcagttatttaa

SEQ ID NO: 712984 - DNA, 25 bp, Mus musculus
gtggtctcgagcaatcccggccctg

SEQ ID NO: 712985 - DNA, 25 bp, Mus musculus
gtggtctcgagctatcccggccctg

SEQ ID NO: 712986 - DNA, 25 bp, Mus musculus
gtggtctctccaacctcatttgaaa

SEQ ID NO: 712987 - DNA, 25 bp, Mus musculus
gtggtctctccatcctcatttgaaa

SEQ ID NO: 712988 - DNA, 25 bp, Mus musculus
gtggtctctgaccagcactttataa

SEQ ID NO: 712989 - DNA, 25 bp, Mus musculus
gtggtctctgacgagcactttataa

SEQ ID NO: 712990 - DNA, 25 bp, Mus musculus
gtggtctctgttctttctataattt

SEQ ID NO: 712991 - DNA, 25 bp, Mus musculus
gtggtctctgttgtttctataattt

SEQ ID NO: 712992 - DNA, 25 bp, Mus musculus
gtggtctgaagaacaatctatggga

SEQ ID NO: 712993 - DNA, 25 bp, Mus musculus
gtggtctgaagatcaatctatggga

SEQ ID NO: 712994 - DNA, 25 bp, Mus musculus
gtggtctgaatgagatgtcccctgc

SEQ ID NO: 712995 - DNA, 25 bp, Mus musculus
gtggtctgaatgtgatgtcccctgc

SEQ ID NO: 712996 - DNA, 25 bp, Mus musculus
gtggtctgcatcagctgcggtaaag

SEQ ID NO: 712997 - DNA, 25 bp, Mus musculus
gtggtctgcatctgctgcggtaaag

SEQ ID NO: 712998 - DNA, 25 bp, Mus musculus
gtggtctgctctcccatgttgtaga

SEQ ID NO: 712999 - DNA, 25 bp, Mus musculus
gtggtctgctctgccatgttgtaga

SEQ ID NO: 713000 - DNA, 25 bp, Mus musculus
gtggtctggataactgtatccttct

SEQ ID NO: 713001 - DNA, 25 bp, Mus musculus
gtggtctggatatctgtatccttct

SEQ ID NO: 713002 - DNA, 25 bp, Mus musculus
gtggtctggcagctgtactatccga

SEQ ID NO: 713003 - DNA, 25 bp, Mus musculus
gtggtctggcaggtgtactatccga

SEQ ID NO: 713004 - DNA, 25 bp, Mus musculus
gtggtctggctcctatcactggttc

SEQ ID NO: 713005 - DNA, 25 bp, Mus musculus
gtggtctggctccttgcttttcttt

SEQ ID NO: 713006 - DNA, 25 bp, Mus musculus
gtggtctggctcgtatcactggttc

SEQ ID NO: 713007 - DNA, 25 bp, Mus musculus
gtggtctggctcgttgcttttcttt

SEQ ID NO: 713008 - DNA, 25 bp, Mus musculus
gtggtctgtagtcctggaacgttca

SEQ ID NO: 713009 - DNA, 25 bp, Mus musculus
gtggtctgtagtgctggaacgttca

SEQ ID NO: 713010 - DNA, 25 bp, Mus musculus
gtggtctgttaaatttaacagcctt

SEQ ID NO: 713011 - DNA, 25 bp, Mus musculus
gtggtctgttaattttaacagcctt

SEQ ID NO: 713012 - DNA, 25 bp, Mus musculus
gtggtctgttacatgttacttctcg

SEQ ID NO: 713013 - DNA, 25 bp, Mus musculus
gtggtctgttacttgttacttctcg

SEQ ID NO: 713014 - DNA, 25 bp, Mus musculus
gtggtctgttctaaactgcttcggc

SEQ ID NO: 713015 - DNA, 25 bp, Mus musculus
gtggtctgttcttaactgcttcggc

SEQ ID NO: 713016 - DNA, 25 bp, Mus musculus
gtggtctgtttcatgaaccgcatgc

SEQ ID NO: 713017 - DNA, 25 bp, Mus musculus
gtggtctgtttcttgaaccgcatgc

SEQ ID NO: 713018 - DNA, 25 bp, Mus musculus
gtggtcttagccaacacactgagat

SEQ ID NO: 713019 - DNA, 25 bp, Mus musculus
gtggtcttagcctacacactgagat

SEQ ID NO: 713020 - DNA, 25 bp, Mus musculus
gtggtcttatttctcattcttctga

SEQ ID NO: 713021 - DNA, 25 bp, Mus musculus
gtggtcttatttgtcattcttctga

SEQ ID NO: 713022 - DNA, 25 bp, Mus musculus
gtggtcttcaatcacaccaagcttg

SEQ ID NO: 713023 - DNA, 25 bp, Mus musculus
gtggtcttcaatgacaccaagcttg

SEQ ID NO: 713024 - DNA, 25 bp, Mus musculus
gtggtcttcataaaacatactgtgt

SEQ ID NO: 713025 - DNA, 25 bp, Mus musculus
gtggtcttcatataacatactgtgt

SEQ ID NO: 713026 - DNA, 25 bp, Mus musculus
gtggtcttcatcaaggctggcccta

SEQ ID NO: 713027 - DNA, 25 bp, Mus musculus
gtggtcttcatctaggctggcccta

SEQ ID NO: 713028 - DNA, 25 bp, Mus musculus
gtggtcttccagacagtgtgcaaat

SEQ ID NO: 713029 - DNA, 25 bp, Mus musculus
gtggtcttccagtcagtgtgcaaat

SEQ ID NO: 713030 - DNA, 25 bp, Mus musculus
gtggtcttgatgctctggttcccag

SEQ ID NO: 713031 - DNA, 25 bp, Mus musculus
gtggtcttgatggtctggttcccag

SEQ ID NO: 713032 - DNA, 25 bp, Mus musculus
gtggtcttgccacatctttgcgaat

SEQ ID NO: 713033 - DNA, 25 bp, Mus musculus
gtggtcttgccagatctttgcgaat

SEQ ID NO: 713034 - DNA, 25 bp, Mus musculus
gtggtcttgctgacacattgcagac

SEQ ID NO: 713035 - DNA, 25 bp, Mus musculus
gtggtcttgctgtcacattgcagac

SEQ ID NO: 713036 - DNA, 25 bp, Mus musculus
gtggtctttatgcttctctttctgt

SEQ ID NO: 713037 - DNA, 25 bp, Mus musculus
gtggtctttatggttctctttctgt

SEQ ID NO: 713038 - DNA, 25 bp, Mus musculus
gtggtcttttcacttccttttaatg

SEQ ID NO: 713039 - DNA, 25 bp, Mus musculus
gtggtcttttcagttccttttaatg

SEQ ID NO: 713040 - DNA, 25 bp, Mus musculus
gtggtgaaaaagctccatgactcaa

SEQ ID NO: 713041 - DNA, 25 bp, Mus musculus
gtggtgaaaaaggtccatgactcaa

SEQ ID NO: 713042 - DNA, 25 bp, Mus musculus
gtggtgaaaacgaggccttactgct

SEQ ID NO: 713043 - DNA, 25 bp, Mus musculus
gtggtgaaaacgtggccttactgct

SEQ ID NO: 713044 - DNA, 25 bp, Mus musculus
gtggtgaaacctcctcatcagagaa

SEQ ID NO: 713045 - DNA, 25 bp, Mus musculus
gtggtgaaacctgctcatcagagaa

SEQ ID NO: 713046 - DNA, 25 bp, Mus musculus
gtggtgaaacttaggcctggtgtcc

SEQ ID NO: 713047 - DNA, 25 bp, Mus musculus
gtggtgaaactttggcctggtgtcc

SEQ ID NO: 713048 - DNA, 25 bp, Mus musculus
gtggtgaacaccatacagctctttg

SEQ ID NO: 713049 - DNA, 25 bp, Mus musculus
gtggtgaacaccttacagctctttg

SEQ ID NO: 713050 - DNA, 25 bp, Mus musculus
gtggtgaaccggacagtactacgct

SEQ ID NO: 713051 - DNA, 25 bp, Mus musculus
gtggtgaaccggtcagtactacgct

SEQ ID NO: 713052 - DNA, 25 bp, Mus musculus
gtggtgaacgacagaaagatgatac

SEQ ID NO: 713053 - DNA, 25 bp, Mus musculus
gtggtgaacgactgaaagatgatac

SEQ ID NO: 713054 - DNA, 25 bp, Mus musculus
gtggtgaaggtcaagattcttcgtc

SEQ ID NO: 713055 - DNA, 25 bp, Mus musculus
gtggtgaaggtctagattcttcgtc

SEQ ID NO: 713056 - DNA, 25 bp, Mus musculus
gtggtgaaggttagccagtagcttt

SEQ ID NO: 713057 - DNA, 25 bp, Mus musculus
gtggtgaaggtttgccagtagcttt

SEQ ID NO: 713058 - DNA, 25 bp, Mus musculus
gtggtgaagtcacatattcctgtat

SEQ ID NO: 713059 - DNA, 25 bp, Mus musculus
gtggtgaagtcagatattcctgtat

SEQ ID NO: 713060 - DNA, 25 bp, Mus musculus
gtggtgaagtcgcagcccagctctc

SEQ ID NO: 713061 - DNA, 25 bp, Mus musculus
gtggtgaagtcggagcccagctctc

SEQ ID NO: 713062 - DNA, 25 bp, Mus musculus
gtggtgaatatcacctcctgaataa

SEQ ID NO: 713063 - DNA, 25 bp, Mus musculus
gtggtgaatatctcctcctgaataa

SEQ ID NO: 713064 - DNA, 25 bp, Mus musculus
gtggtgacaacaattttattttgct

SEQ ID NO: 713065 - DNA, 25 bp, Mus musculus
gtggtgacaacatttttattttgct

SEQ ID NO: 713066 - DNA, 25 bp, Mus musculus
gtggtgacaaccaggctaatttcaa

SEQ ID NO: 713067 - DNA, 25 bp, Mus musculus
gtggtgacaacctggctaatttcaa

SEQ ID NO: 713068 - DNA, 25 bp, Mus musculus
gtggtgacaactattatgacatcag

SEQ ID NO: 713069 - DNA, 25 bp, Mus musculus
gtggtgacaacttttatgacatcag

SEQ ID NO: 713070 - DNA, 25 bp, Mus musculus
gtggtgacaatgagacctgtaacat

SEQ ID NO: 713071 - DNA, 25 bp, Mus musculus
gtggtgacaatgtgacctgtaacat

SEQ ID NO: 713072 - DNA, 25 bp, Mus musculus
gtggtgacacatcactccattccta

SEQ ID NO: 713073 - DNA, 25 bp, Mus musculus
gtggtgacacatgactccattccta

SEQ ID NO: 713074 - DNA, 25 bp, Mus musculus
gtggtgacagcacacagcatgtact

SEQ ID NO: 713075 - DNA, 25 bp, Mus musculus
gtggtgacagcagacagcatgtact

SEQ ID NO: 713076 - DNA, 25 bp, Mus musculus
gtggtgacagctccgacacatgcta

SEQ ID NO: 713077 - DNA, 25 bp, Mus musculus
gtggtgacagctgcgacacatgcta

SEQ ID NO: 713078 - DNA, 25 bp, Mus musculus
gtggtgaccacgctagaaaacggct

SEQ ID NO: 713079 - DNA, 25 bp, Mus musculus
gtggtgaccacggtagaaaacggct

SEQ ID NO: 713080 - DNA, 25 bp, Mus musculus
gtggtgaccagcagtctttaggact

SEQ ID NO: 713081 - DNA, 25 bp, Mus musculus
gtggtgaccagctgtctttaggact

SEQ ID NO: 713082 - DNA, 25 bp, Mus musculus
gtggtgacccctctagcacagtgag

SEQ ID NO: 713083 - DNA, 25 bp, Mus musculus
gtggtgacccctgtagcacagtgag

SEQ ID NO: 713084 - DNA, 25 bp, Mus musculus
gtggtgaccgcaacaagcccggagt

SEQ ID NO: 713085 - DNA, 25 bp, Mus musculus
gtggtgaccgcatcaagcccggagt

SEQ ID NO: 713086 - DNA, 25 bp, Mus musculus
gtggtgacctgtaatctgtctctaa

SEQ ID NO: 713087 - DNA, 25 bp, Mus musculus
gtggtgacctgttatctgtctctaa

SEQ ID NO: 713088 - DNA, 25 bp, Mus musculus
gtggtgactcatattcccagagact

SEQ ID NO: 713089 - DNA, 25 bp, Mus musculus
gtggtgactcattttcccagagact

SEQ ID NO: 713090 - DNA, 25 bp, Mus musculus
gtggtgactctacatggtttctcat

SEQ ID NO: 713091 - DNA, 25 bp, Mus musculus
gtggtgactctagatggtttctcat

SEQ ID NO: 713092 - DNA, 25 bp, Mus musculus
gtggtgactgacagctcatgcccag

SEQ ID NO: 713093 - DNA, 25 bp, Mus musculus
gtggtgactgactgctcatgcccag

SEQ ID NO: 713094 - DNA, 25 bp, Mus musculus
gtggtgactgatatgtgatctctga

SEQ ID NO: 713095 - DNA, 25 bp, Mus musculus
gtggtgactgatttgtgatctctga

SEQ ID NO: 713096 - DNA, 25 bp, Mus musculus
gtggtgactgttaccaagtaggact

SEQ ID NO: 713097 - DNA, 25 bp, Mus musculus
gtggtgactgtttccaagtaggact

SEQ ID NO: 713098 - DNA, 25 bp, Mus musculus
gtggtgacttgtatcacagctataa

SEQ ID NO: 713099 - DNA, 25 bp, Mus musculus
gtggtgacttgtatccaaaactgct

SEQ ID NO: 713100 - DNA, 25 bp, Mus musculus
gtggtgacttgtttcacagctataa

SEQ ID NO: 713101 - DNA, 25 bp, Mus musculus
gtggtgacttgtttccaaaactgct

SEQ ID NO: 713102 - DNA, 25 bp, Mus musculus
gtggtgagaacaataaacgtgacat

SEQ ID NO: 713103 - DNA, 25 bp, Mus musculus
gtggtgagaacattaaacgtgacat

SEQ ID NO: 713104 - DNA, 25 bp, Mus musculus
gtggtgagaattcagtctgctcttc

SEQ ID NO: 713105 - DNA, 25 bp, Mus musculus
gtggtgagaattgagtctgctcttc

SEQ ID NO: 713106 - DNA, 25 bp, Mus musculus
gtggtgagacaaacctgacccgaca

SEQ ID NO: 713107 - DNA, 25 bp, Mus musculus
gtggtgagacaatcctgacccgaca

SEQ ID NO: 713108 - DNA, 25 bp, Mus musculus
gtggtgagacaccttacacaaagta

SEQ ID NO: 713109 - DNA, 25 bp, Mus musculus
gtggtgagacacgttacacaaagta

SEQ ID NO: 713110 - DNA, 25 bp, Mus musculus
gtggtgagacggctcatcagctcat

SEQ ID NO: 713111 - DNA, 25 bp, Mus musculus
gtggtgagacgggtcatcagctcat

SEQ ID NO: 713112 - DNA, 25 bp, Mus musculus
gtggtgagagctatctcccggtttc

SEQ ID NO: 713113 - DNA, 25 bp, Mus musculus
gtggtgagagctttctcccggtttc

SEQ ID NO: 713114 - DNA, 25 bp, Mus musculus
gtggtgagatccctgggttttgaac

SEQ ID NO: 713115 - DNA, 25 bp, Mus musculus
gtggtgagatccgtgggttttgaac

SEQ ID NO: 713116 - DNA, 25 bp, Mus musculus
gtggtgaggcccagaccgtgacctt

SEQ ID NO: 713117 - DNA, 25 bp, Mus musculus
gtggtgaggccctgaccgtgacctt

SEQ ID NO: 713118 - DNA, 25 bp, Mus musculus
gtggtgagggccaccttcaagtaag

SEQ ID NO: 713119 - DNA, 25 bp, Mus musculus
gtggtgagggcctccttcaagtaag

SEQ ID NO: 713120 - DNA, 25 bp, Mus musculus
gtggtgagtaggcttcatctcttaa

SEQ ID NO: 713121 - DNA, 25 bp, Mus musculus
gtggtgagtagggttcatctcttaa

SEQ ID NO: 713122 - DNA, 25 bp, Mus musculus
gtggtgatatacctatccgagtccc

SEQ ID NO: 713123 - DNA, 25 bp, Mus musculus
gtggtgatatacgtatccgagtccc

SEQ ID NO: 713124 - DNA, 25 bp, Mus musculus
gtggtgatatatccagtaacactgg

SEQ ID NO: 713125 - DNA, 25 bp, Mus musculus
gtggtgatatatgcagtaacactgg

SEQ ID NO: 713126 - DNA, 25 bp, Mus musculus
gtggtgatatgtacctgatcccaag

SEQ ID NO: 713127 - DNA, 25 bp, Mus musculus
gtggtgatatgttcctgatcccaag

SEQ ID NO: 713128 - DNA, 25 bp, Mus musculus
gtggtgatcattaatacactcaggt

SEQ ID NO: 713129 - DNA, 25 bp, Mus musculus
gtggtgatcatttatacactcaggt

SEQ ID NO: 713130 - DNA, 25 bp, Mus musculus
gtggtgatccggacacaatgcacat

SEQ ID NO: 713131 - DNA, 25 bp, Mus musculus
gtggtgatccggtcacaatgcacat

SEQ ID NO: 713132 - DNA, 25 bp, Mus musculus
gtggtgatcgtcagttgtacttcat

SEQ ID NO: 713133 - DNA, 25 bp, Mus musculus
gtggtgatcgtcatcaatgctgata

SEQ ID NO: 713134 - DNA, 25 bp, Mus musculus
gtggtgatcgtctgttgtacttcat

SEQ ID NO: 713135 - DNA, 25 bp, Mus musculus
gtggtgatcgtcttcaatgctgata

SEQ ID NO: 713136 - DNA, 25 bp, Mus musculus
gtggtgatggcacaccccaacagga

SEQ ID NO: 713137 - DNA, 25 bp, Mus musculus
gtggtgatggcagaccccaacagga

SEQ ID NO: 713138 - DNA, 25 bp, Mus musculus
gtggtgatggtcatcgcatactgcc

SEQ ID NO: 713139 - DNA, 25 bp, Mus musculus
gtggtgatggtcttcgcatactgcc

SEQ ID NO: 713140 - DNA, 25 bp, Mus musculus
gtggtgatggtgcgtacctttaatc

SEQ ID NO: 713141 - DNA, 25 bp, Mus musculus
gtggtgatggtgggtacctttaatc

SEQ ID NO: 713142 - DNA, 25 bp, Mus musculus
gtggtgatgtaaaccccaagcggca

SEQ ID NO: 713143 - DNA, 25 bp, Mus musculus
gtggtgatgtaatccccaagcggca

SEQ ID NO: 713144 - DNA, 25 bp, Mus musculus
gtggtgatgtcactgctggcactca

SEQ ID NO: 713145 - DNA, 25 bp, Mus musculus
gtggtgatgtcagtgctggcactca

SEQ ID NO: 713146 - DNA, 25 bp, Mus musculus
gtggtgattactagtgcccttgaaa

SEQ ID NO: 713147 - DNA, 25 bp, Mus musculus
gtggtgattacttgtgcccttgaaa

SEQ ID NO: 713148 - DNA, 25 bp, Mus musculus
gtggtgattccaaagtacatttttt

SEQ ID NO: 713149 - DNA, 25 bp, Mus musculus
gtggtgattccatagtacatttttt

SEQ ID NO: 713150 - DNA, 25 bp, Mus musculus
gtggtgcaaactacgagggccccgc

SEQ ID NO: 713151 - DNA, 25 bp, Mus musculus
gtggtgcaaacttcgagggccccgc

SEQ ID NO: 713152 - DNA, 25 bp, Mus musculus
gtggtgcaaggtcccattgagcttc

SEQ ID NO: 713153 - DNA, 25 bp, Mus musculus
gtggtgcaaggtgccattgagcttc

SEQ ID NO: 713154 - DNA, 25 bp, Mus musculus
gtggtgcacaaaatctttccatgta

SEQ ID NO: 713155 - DNA, 25 bp, Mus musculus
gtggtgcacaaacatgtagacactc

SEQ ID NO: 713156 - DNA, 25 bp, Mus musculus
gtggtgcacaaagatgtagacactc

SEQ ID NO: 713157 - DNA, 25 bp, Mus musculus
gtggtgcacaaattctttccatgta

SEQ ID NO: 713158 - DNA, 25 bp, Mus musculus
gtggtgcacacaactagtcccaaca

SEQ ID NO: 713159 - DNA, 25 bp, Mus musculus
gtggtgcacacatctagtcccaaca

SEQ ID NO: 713160 - DNA, 25 bp, Mus musculus
gtggtgcacatcaaacaatcttcag

SEQ ID NO: 713161 - DNA, 25 bp, Mus musculus
gtggtgcacatcagcaacttgtatt

SEQ ID NO: 713162 - DNA, 25 bp, Mus musculus
gtggtgcacatctaacaatcttcag

SEQ ID NO: 713163 - DNA, 25 bp, Mus musculus
gtggtgcacatctgcaacttgtatt

SEQ ID NO: 713164 - DNA, 25 bp, Mus musculus
gtggtgcaccaactgatgacggcat

SEQ ID NO: 713165 - DNA, 25 bp, Mus musculus
gtggtgcaccaagtgatgacggcat

SEQ ID NO: 713166 - DNA, 25 bp, Mus musculus
gtggtgcaccctagttgttgtttga

SEQ ID NO: 713167 - DNA, 25 bp, Mus musculus
gtggtgcacccttgttgttgtttga

SEQ ID NO: 713168 - DNA, 25 bp, Mus musculus
gtggtgcacttgacagacctgggat

SEQ ID NO: 713169 - DNA, 25 bp, Mus musculus
gtggtgcacttgtcagacctgggat

SEQ ID NO: 713170 - DNA, 25 bp, Mus musculus
gtggtgcataccagtgaccctaaca

SEQ ID NO: 713171 - DNA, 25 bp, Mus musculus
gtggtgcatacctgtgaccctaaca

SEQ ID NO: 713172 - DNA, 25 bp, Mus musculus
gtggtgcatcagacacttctacaag

SEQ ID NO: 713173 - DNA, 25 bp, Mus musculus
gtggtgcatcagtcacttctacaag

SEQ ID NO: 713174 - DNA, 25 bp, Mus musculus
gtggtgcatgatcctgctgagccat

SEQ ID NO: 713175 - DNA, 25 bp, Mus musculus
gtggtgcatgatgctgctgagccat

SEQ ID NO: 713176 - DNA, 25 bp, Mus musculus
gtggtgccaatgcaatctccttttc

SEQ ID NO: 713177 - DNA, 25 bp, Mus musculus
gtggtgccaatggaatctccttttc

SEQ ID NO: 713178 - DNA, 25 bp, Mus musculus
gtggtgccagcccttagtgcattca

SEQ ID NO: 713179 - DNA, 25 bp, Mus musculus
gtggtgccagccgttagtgcattca

SEQ ID NO: 713180 - DNA, 25 bp, Mus musculus
gtggtgccatccatttcccggtggt

SEQ ID NO: 713181 - DNA, 25 bp, Mus musculus
gtggtgccatccttttcccggtggt

SEQ ID NO: 713182 - DNA, 25 bp, Mus musculus
gtggtgccatggctggtccttaaca

SEQ ID NO: 713183 - DNA, 25 bp, Mus musculus
gtggtgccatgggtggtccttaaca

SEQ ID NO: 713184 - DNA, 25 bp, Mus musculus
gtggtgccatgtcgaatctaaccgt

SEQ ID NO: 713185 - DNA, 25 bp, Mus musculus
gtggtgccatgtggaatctaaccgt

SEQ ID NO: 713186 - DNA, 25 bp, Mus musculus
gtggtgccattgcaatgtcagcatt

SEQ ID NO: 713187 - DNA, 25 bp, Mus musculus
gtggtgccattggaatgtcagcatt

SEQ ID NO: 713188 - DNA, 25 bp, Mus musculus
gtggtgcccaaacatggaaagtgaa

SEQ ID NO: 713189 - DNA, 25 bp, Mus musculus
gtggtgcccaaagatggaaagtgaa

SEQ ID NO: 713190 - DNA, 25 bp, Mus musculus
gtggtgcccactatgaagactccaa

SEQ ID NO: 713191 - DNA, 25 bp, Mus musculus
gtggtgcccactttgaagactccaa

SEQ ID NO: 713192 - DNA, 25 bp, Mus musculus
gtggtgcctattcaggacccagtga

SEQ ID NO: 713193 - DNA, 25 bp, Mus musculus
gtggtgcctattgaggacccagtga

SEQ ID NO: 713194 - DNA, 25 bp, Mus musculus
gtggtgcctggaagctcttgtctgc

SEQ ID NO: 713195 - DNA, 25 bp, Mus musculus
gtggtgcctggatgctcttgtctgc

SEQ ID NO: 713196 - DNA, 25 bp, Mus musculus
gtggtgcctgggaagataattacat

SEQ ID NO: 713197 - DNA, 25 bp, Mus musculus
gtggtgcctgggtagataattacat

SEQ ID NO: 713198 - DNA, 25 bp, Mus musculus
gtggtgcctgttaataatcatgatg

SEQ ID NO: 713199 - DNA, 25 bp, Mus musculus
gtggtgcctgtttataatcatgatg

SEQ ID NO: 713200 - DNA, 25 bp, Mus musculus
gtggtgcctttgatgctctacatgc

SEQ ID NO: 713201 - DNA, 25 bp, Mus musculus
gtggtgcctttgttgctctacatgc

SEQ ID NO: 713202 - DNA, 25 bp, Mus musculus
gtggtgcgggtcacaaatatcagtt

SEQ ID NO: 713203 - DNA, 25 bp, Mus musculus
gtggtgcgggtctcaaatatcagtt

SEQ ID NO: 713204 - DNA, 25 bp, Mus musculus
gtggtgcgtcctagtaatctcagca

SEQ ID NO: 713205 - DNA, 25 bp, Mus musculus
gtggtgcgtccttgtaatctcagca

SEQ ID NO: 713206 - DNA, 25 bp, Mus musculus
gtggtgctacatcattactgctttt

SEQ ID NO: 713207 - DNA, 25 bp, Mus musculus
gtggtgctacatgattactgctttt

SEQ ID NO: 713208 - DNA, 25 bp, Mus musculus
gtggtgctaggcatgagatctttgc

SEQ ID NO: 713209 - DNA, 25 bp, Mus musculus
gtggtgctaggcttgagatctttgc

SEQ ID NO: 713210 - DNA, 25 bp, Mus musculus
gtggtgctagttattactggctaca

SEQ ID NO: 713211 - DNA, 25 bp, Mus musculus
gtggtgctagtttttactggctaca

SEQ ID NO: 713212 - DNA, 25 bp, Mus musculus
gtggtgctcaacaggactcagattc

SEQ ID NO: 713213 - DNA, 25 bp, Mus musculus
gtggtgctcaactggactcagattc

SEQ ID NO: 713214 - DNA, 25 bp, Mus musculus
gtggtgctcaatctggctgaactta

SEQ ID NO: 713215 - DNA, 25 bp, Mus musculus
gtggtgctcaatgtggctgaactta

SEQ ID NO: 713216 - DNA, 25 bp, Mus musculus
gtggtgctcactaatactctattct

SEQ ID NO: 713217 - DNA, 25 bp, Mus musculus
gtggtgctcacttatactctattct

SEQ ID NO: 713218 - DNA, 25 bp, Mus musculus
gtggtgctctgtagacattgcctaa

SEQ ID NO: 713219 - DNA, 25 bp, Mus musculus
gtggtgctctgttgacattgcctaa

SEQ ID NO: 713220 - DNA, 25 bp, Mus musculus
gtggtgctcttgcatatcagctgga

SEQ ID NO: 713221 - DNA, 25 bp, Mus musculus
gtggtgctcttgctattgtgactgc

SEQ ID NO: 713222 - DNA, 25 bp, Mus musculus
gtggtgctcttggatatcagctgga

SEQ ID NO: 713223 - DNA, 25 bp, Mus musculus
gtggtgctcttggtattgtgactgc

SEQ ID NO: 713224 - DNA, 25 bp, Mus musculus
gtggtgctgaccaagaattccgtgt

SEQ ID NO: 713225 - DNA, 25 bp, Mus musculus
gtggtgctgacctagaattccgtgt

SEQ ID NO: 713226 - DNA, 25 bp, Mus musculus
gtggtgctgtggaccaagacatcta

SEQ ID NO: 713227 - DNA, 25 bp, Mus musculus
gtggtgctgtggtccaagacatcta

SEQ ID NO: 713228 - DNA, 25 bp, Mus musculus
gtggtgcttaaacccaaggctttat

SEQ ID NO: 713229 - DNA, 25 bp, Mus musculus
gtggtgcttaaagccaaggctttat

SEQ ID NO: 713230 - DNA, 25 bp, Mus musculus
gtggtgcttaacacttctttgtatt

SEQ ID NO: 713231 - DNA, 25 bp, Mus musculus
gtggtgcttaactcttctttgtatt

SEQ ID NO: 713232 - DNA, 25 bp, Mus musculus
gtggtgcttccaccccatggccatc

SEQ ID NO: 713233 - DNA, 25 bp, Mus musculus
gtggtgcttccagcccatggccatc

SEQ ID NO: 713234 - DNA, 25 bp, Mus musculus
gtggtgcttttaacatctaaatcag

SEQ ID NO: 713235 - DNA, 25 bp, Mus musculus
gtggtgcttttatcatctaaatcag

SEQ ID NO: 713236 - DNA, 25 bp, Mus musculus
gtggtggaaactagacatcccaact

SEQ ID NO: 713237 - DNA, 25 bp, Mus musculus
gtggtggaaacttgacatcccaact

SEQ ID NO: 713238 - DNA, 25 bp, Mus musculus
gtggtggaacctacagtcccaatga

SEQ ID NO: 713239 - DNA, 25 bp, Mus musculus
gtggtggaaccttcagtcccaatga

SEQ ID NO: 713240 - DNA, 25 bp, Mus musculus
gtggtggaaggtatccaatactcct

SEQ ID NO: 713241 - DNA, 25 bp, Mus musculus
gtggtggaaggtttccaatactcct

SEQ ID NO: 713242 - DNA, 25 bp, Mus musculus
gtggtggacataagtattcgggaaa

SEQ ID NO: 713243 - DNA, 25 bp, Mus musculus
gtggtggacatatgtattcgggaaa

SEQ ID NO: 713244 - DNA, 25 bp, Mus musculus
gtggtggacattatctgcacacatt

SEQ ID NO: 713245 - DNA, 25 bp, Mus musculus
gtggtggacattttctgcacacatt

SEQ ID NO: 713246 - DNA, 25 bp, Mus musculus
gtggtggacctcatggccaaaatgg

SEQ ID NO: 713247 - DNA, 25 bp, Mus musculus
gtggtggacctcttggccaaaatgg

SEQ ID NO: 713248 - DNA, 25 bp, Mus musculus
gtggtggactaaatatacttggccc

SEQ ID NO: 713249 - DNA, 25 bp, Mus musculus
gtggtggactaattatacttggccc

SEQ ID NO: 713250 - DNA, 25 bp, Mus musculus
gtggtggagaacatgatgctgatca

SEQ ID NO: 713251 - DNA, 25 bp, Mus musculus
gtggtggagaacttgatgctgatca

SEQ ID NO: 713252 - DNA, 25 bp, Mus musculus
gtggtggagaggaggactggacata

SEQ ID NO: 713253 - DNA, 25 bp, Mus musculus
gtggtggagaggtggactggacata

SEQ ID NO: 713254 - DNA, 25 bp, Mus musculus
gtggtggagcctccggatctcacat

SEQ ID NO: 713255 - DNA, 25 bp, Mus musculus
gtggtggagcctgcggatctcacat

SEQ ID NO: 713256 - DNA, 25 bp, Mus musculus
gtggtggaggtcacctgacagcttc

SEQ ID NO: 713257 - DNA, 25 bp, Mus musculus
gtggtggaggtctcctgacagcttc

SEQ ID NO: 713258 - DNA, 25 bp, Mus musculus
gtggtggagtccaacagatccctgc

SEQ ID NO: 713259 - DNA, 25 bp, Mus musculus
gtggtggagtcctacagatccctgc

SEQ ID NO: 713260 - DNA, 25 bp, Mus musculus
gtggtggatcataaagggccccatc

SEQ ID NO: 713261 - DNA, 25 bp, Mus musculus
gtggtggatcattaagggccccatc

SEQ ID NO: 713262 - DNA, 25 bp, Mus musculus
gtggtggatcgaaacagcacccctg

SEQ ID NO: 713263 - DNA, 25 bp, Mus musculus
gtggtggatcgatacagcacccctg

SEQ ID NO: 713264 - DNA, 25 bp, Mus musculus
gtggtggcacatatccccacatgaa

SEQ ID NO: 713265 - DNA, 25 bp, Mus musculus
gtggtggcacatttccccacatgaa

SEQ ID NO: 713266 - DNA, 25 bp, Mus musculus
gtggtggcaccgagtagaagcccct

SEQ ID NO: 713267 - DNA, 25 bp, Mus musculus
gtggtggcaccgtgtagaagcccct

SEQ ID NO: 713268 - DNA, 25 bp, Mus musculus
gtggtggcacctctttgtaagccca

SEQ ID NO: 713269 - DNA, 25 bp, Mus musculus
gtggtggcacctgtttgtaagccca

SEQ ID NO: 713270 - DNA, 25 bp, Mus musculus
gtggtggcacgtacctttaaccact

SEQ ID NO: 713271 - DNA, 25 bp, Mus musculus
gtggtggcacgttcctttaaccact

SEQ ID NO: 713272 - DNA, 25 bp, Mus musculus
gtggtggcagaactgctcaacctat

SEQ ID NO: 713273 - DNA, 25 bp, Mus musculus
gtggtggcagaagtgctcaacctat

SEQ ID NO: 713274 - DNA, 25 bp, Mus musculus
gtggtggcattgctcaacactgtag

SEQ ID NO: 713275 - DNA, 25 bp, Mus musculus
gtggtggcattggtcaacactgtag

SEQ ID NO: 713276 - DNA, 25 bp, Mus musculus
gtggtggccacaaagtttgttcata

SEQ ID NO: 713277 - DNA, 25 bp, Mus musculus
gtggtggccacatagtttgttcata

SEQ ID NO: 713278 - DNA, 25 bp, Mus musculus
gtggtggcccacacactgctaggag

SEQ ID NO: 713279 - DNA, 25 bp, Mus musculus
gtggtggcccactcactgctaggag

SEQ ID NO: 713280 - DNA, 25 bp, Mus musculus
gtggtggcccagacatatctaggta

SEQ ID NO: 713281 - DNA, 25 bp, Mus musculus
gtggtggcccagtcatatctaggta

SEQ ID NO: 713282 - DNA, 25 bp, Mus musculus
gtggtggccgcgacaagtatgccaa

SEQ ID NO: 713283 - DNA, 25 bp, Mus musculus
gtggtggccgcgtcaagtatgccaa

SEQ ID NO: 713284 - DNA, 25 bp, Mus musculus
gtggtggccttgaatcgcaggactt

SEQ ID NO: 713285 - DNA, 25 bp, Mus musculus
gtggtggccttgtatcgcaggactt

SEQ ID NO: 713286 - DNA, 25 bp, Mus musculus
gtggtggcgcccatcagagcaccct

SEQ ID NO: 713287 - DNA, 25 bp, Mus musculus
gtggtggcgcccttcagagcaccct

SEQ ID NO: 713288 - DNA, 25 bp, Mus musculus
gtggtggcgttaaactgcttggcaa

SEQ ID NO: 713289 - DNA, 25 bp, Mus musculus
gtggtggcgttatactgcttggcaa

SEQ ID NO: 713290 - DNA, 25 bp, Mus musculus
gtggtggctattaagactggactct

SEQ ID NO: 713291 - DNA, 25 bp, Mus musculus
gtggtggctatttagactggactct

SEQ ID NO: 713292 - DNA, 25 bp, Mus musculus
gtggtggctcgaatcctgtctctga

SEQ ID NO: 713293 - DNA, 25 bp, Mus musculus
gtggtggctcgattcctgtctctga

SEQ ID NO: 713294 - DNA, 25 bp, Mus musculus
gtggtggcttgtcccgttagtccca

SEQ ID NO: 713295 - DNA, 25 bp, Mus musculus
gtggtggcttgtgccgttagtccca

SEQ ID NO: 713296 - DNA, 25 bp, Mus musculus
gtggtggctttgcttgctattgacc

SEQ ID NO: 713297 - DNA, 25 bp, Mus musculus
gtggtggctttggttgctattgacc

SEQ ID NO: 713298 - DNA, 25 bp, Mus musculus
gtggtgggaaatacactgtctccaa

SEQ ID NO: 713299 - DNA, 25 bp, Mus musculus
gtggtgggaaattcactgtctccaa

SEQ ID NO: 713300 - DNA, 25 bp, Mus musculus
gtggtgggatgtctacttccagcac

SEQ ID NO: 713301 - DNA, 25 bp, Mus musculus
gtggtgggatgtgtacttccagcac

SEQ ID NO: 713302 - DNA, 25 bp, Mus musculus
gtggtgggatttctctcgttagtaa

SEQ ID NO: 713303 - DNA, 25 bp, Mus musculus
gtggtgggatttgtctcgttagtaa

SEQ ID NO: 713304 - DNA, 25 bp, Mus musculus
gtggtgggcatcacgtaccagcaca

SEQ ID NO: 713305 - DNA, 25 bp, Mus musculus
gtggtgggcatctcgtaccagcaca

SEQ ID NO: 713306 - DNA, 25 bp, Mus musculus
gtggtgggcccaactgcaatcagtc

SEQ ID NO: 713307 - DNA, 25 bp, Mus musculus
gtggtgggcccatctgcaatcagtc

SEQ ID NO: 713308 - DNA, 25 bp, Mus musculus
gtggtgggtttgactaggcattaca

SEQ ID NO: 713309 - DNA, 25 bp, Mus musculus
gtggtgggtttgtctaggcattaca

SEQ ID NO: 713310 - DNA, 25 bp, Mus musculus
gtggtggtacccatacaatctttct

SEQ ID NO: 713311 - DNA, 25 bp, Mus musculus
gtggtggtacccttacaatctttct

SEQ ID NO: 713312 - DNA, 25 bp, Mus musculus
gtggtggtagctcatataccctaat

SEQ ID NO: 713313 - DNA, 25 bp, Mus musculus
gtggtggtagctgatataccctaat

SEQ ID NO: 713314 - DNA, 25 bp, Mus musculus
gtggtggtcagtactatgtgagcca

SEQ ID NO: 713315 - DNA, 25 bp, Mus musculus
gtggtggtcagttctatgtgagcca

SEQ ID NO: 713316 - DNA, 25 bp, Mus musculus
gtggtggtcccactgttcataaggc

SEQ ID NO: 713317 - DNA, 25 bp, Mus musculus
gtggtggtcccagtgttcataaggc

SEQ ID NO: 713318 - DNA, 25 bp, Mus musculus
gtggtggtcctgcaagccagtcaat

SEQ ID NO: 713319 - DNA, 25 bp, Mus musculus
gtggtggtcctggaagccagtcaat

SEQ ID NO: 713320 - DNA, 25 bp, Mus musculus
gtggtggtgactcttttaatgattc

SEQ ID NO: 713321 - DNA, 25 bp, Mus musculus
gtggtggtgactgttttaatgattc

SEQ ID NO: 713322 - DNA, 25 bp, Mus musculus
gtggtggtgcacatgttacacctgg

SEQ ID NO: 713323 - DNA, 25 bp, Mus musculus
gtggtggtgcacttgttacacctgg

SEQ ID NO: 713324 - DNA, 25 bp, Mus musculus
gtggtggtggccactacatcgagct

SEQ ID NO: 713325 - DNA, 25 bp, Mus musculus
gtggtggtggcctctacatcgagct

SEQ ID NO: 713326 - DNA, 25 bp, Mus musculus
gtggtggtgttaagctcagaaagct

SEQ ID NO: 713327 - DNA, 25 bp, Mus musculus
gtggtggtgttatgctcagaaagct

SEQ ID NO: 713328 - DNA, 25 bp, Mus musculus
gtggtggtgtttaggtctctctctc

SEQ ID NO: 713329 - DNA, 25 bp, Mus musculus
gtggtggtgttttggtctctctctc

SEQ ID NO: 713330 - DNA, 25 bp, Mus musculus
gtggtggttataacaagtttgctta

SEQ ID NO: 713331 - DNA, 25 bp, Mus musculus
gtggtggttatatcaagtttgctta

SEQ ID NO: 713332 - DNA, 25 bp, Mus musculus
gtggtggttcacaatcatttcttac

SEQ ID NO: 713333 - DNA, 25 bp, Mus musculus
gtggtggttcactatcatttcttac

SEQ ID NO: 713334 - DNA, 25 bp, Mus musculus
gtggtggttggacttatttctgttt

SEQ ID NO: 713335 - DNA, 25 bp, Mus musculus
gtggtggttggagttatttctgttt

SEQ ID NO: 713336 - DNA, 25 bp, Mus musculus
gtggtgtaaatgatgctcttgtctt

SEQ ID NO: 713337 - DNA, 25 bp, Mus musculus
gtggtgtaaatgttgctcttgtctt

SEQ ID NO: 713338 - DNA, 25 bp, Mus musculus
gtggtgtaatctacatttatctgta

SEQ ID NO: 713339 - DNA, 25 bp, Mus musculus
gtggtgtaatcttcatttatctgta

SEQ ID NO: 713340 - DNA, 25 bp, Mus musculus
gtggtgtacataatcagccccggta

SEQ ID NO: 713341 - DNA, 25 bp, Mus musculus
gtggtgtacatattcagccccggta

SEQ ID NO: 713342 - DNA, 25 bp, Mus musculus
gtggtgtactcaaacccttggaagt

SEQ ID NO: 713343 - DNA, 25 bp, Mus musculus
gtggtgtactcatacccttggaagt

SEQ ID NO: 713344 - DNA, 25 bp, Mus musculus
gtggtgtactgcagcatcgtgtact

SEQ ID NO: 713345 - DNA, 25 bp, Mus musculus
gtggtgtactgctgcatcgtgtact

SEQ ID NO: 713346 - DNA, 25 bp, Mus musculus
gtggtgtacttcaaatgccttcgga

SEQ ID NO: 713347 - DNA, 25 bp, Mus musculus
gtggtgtacttctaatgccttcgga

SEQ ID NO: 713348 - DNA, 25 bp, Mus musculus
gtggtgtagcacagatcatctctca

SEQ ID NO: 713349 - DNA, 25 bp, Mus musculus
gtggtgtagcactgatcatctctca

SEQ ID NO: 713350 - DNA, 25 bp, Mus musculus
gtggtgtagcccatgtggtaatgac

SEQ ID NO: 713351 - DNA, 25 bp, Mus musculus
gtggtgtagcccttgtggtaatgac

SEQ ID NO: 713352 - DNA, 25 bp, Mus musculus
gtggtgtatacccttcatcttagca

SEQ ID NO: 713353 - DNA, 25 bp, Mus musculus
gtggtgtataccgttcatcttagca

SEQ ID NO: 713354 - DNA, 25 bp, Mus musculus
gtggtgtatcacaagagacaacgtt

SEQ ID NO: 713355 - DNA, 25 bp, Mus musculus
gtggtgtatcactagagacaacgtt

SEQ ID NO: 713356 - DNA, 25 bp, Mus musculus
gtggtgtatggaactgctgtgctct

SEQ ID NO: 713357 - DNA, 25 bp, Mus musculus
gtggtgtatggatctgctgtgctct

SEQ ID NO: 713358 - DNA, 25 bp, Mus musculus
gtggtgtcaaaaaccttcagtgcct

SEQ ID NO: 713359 - DNA, 25 bp, Mus musculus
gtggtgtcaaaatccttcagtgcct

SEQ ID NO: 713360 - DNA, 25 bp, Mus musculus
gtggtgtcaagtcccattcatgtgg

SEQ ID NO: 713361 - DNA, 25 bp, Mus musculus
gtggtgtcaagtgccattcatgtgg

SEQ ID NO: 713362 - DNA, 25 bp, Mus musculus
gtggtgtcacaaatctgtaatctct

SEQ ID NO: 713363 - DNA, 25 bp, Mus musculus
gtggtgtcacaattctgtaatctct

SEQ ID NO: 713364 - DNA, 25 bp, Mus musculus
gtggtgtcaccaagttttgatgaca

SEQ ID NO: 713365 - DNA, 25 bp, Mus musculus
gtggtgtcaccaatcataaagcatt

SEQ ID NO: 713366 - DNA, 25 bp, Mus musculus
gtggtgtcaccatgttttgatgaca

SEQ ID NO: 713367 - DNA, 25 bp, Mus musculus
gtggtgtcaccattcataaagcatt

SEQ ID NO: 713368 - DNA, 25 bp, Mus musculus
gtggtgtcagtaaaaacttctcctc

SEQ ID NO: 713369 - DNA, 25 bp, Mus musculus
gtggtgtcagtataaacttctcctc

SEQ ID NO: 713370 - DNA, 25 bp, Mus musculus
gtggtgtcagtccttccagataatg

SEQ ID NO: 713371 - DNA, 25 bp, Mus musculus
gtggtgtcagtcgttccagataatg

SEQ ID NO: 713372 - DNA, 25 bp, Mus musculus
gtggtgtcattcatctggcaggaag

SEQ ID NO: 713373 - DNA, 25 bp, Mus musculus
gtggtgtcattcttctggcaggaag

SEQ ID NO: 713374 - DNA, 25 bp, Mus musculus
gtggtgtcattgacattacaggcat

SEQ ID NO: 713375 - DNA, 25 bp, Mus musculus
gtggtgtcattgtcattacaggcat

SEQ ID NO: 713376 - DNA, 25 bp, Mus musculus
gtggtgtccaccagccagtaggagc

SEQ ID NO: 713377 - DNA, 25 bp, Mus musculus
gtggtgtccacctgccagtaggagc

SEQ ID NO: 713378 - DNA, 25 bp, Mus musculus
gtggtgtccctaaggcttatacata

SEQ ID NO: 713379 - DNA, 25 bp, Mus musculus
gtggtgtccctatggcttatacata

SEQ ID NO: 713380 - DNA, 25 bp, Mus musculus
gtggtgtccgatactggcatctcaa

SEQ ID NO: 713381 - DNA, 25 bp, Mus musculus
gtggtgtccgattctggcatctcaa

SEQ ID NO: 713382 - DNA, 25 bp, Mus musculus
gtggtgtcctcaacctaacttctag

SEQ ID NO: 713383 - DNA, 25 bp, Mus musculus
gtggtgtcctcatcctaacttctag

SEQ ID NO: 713384 - DNA, 25 bp, Mus musculus
gtggtgtccttacttgagcagatta

SEQ ID NO: 713385 - DNA, 25 bp, Mus musculus
gtggtgtccttagttgagcagatta

SEQ ID NO: 713386 - DNA, 25 bp, Mus musculus
gtggtgtctacaagattgcctctac

SEQ ID NO: 713387 - DNA, 25 bp, Mus musculus
gtggtgtctacatgattgcctctac

SEQ ID NO: 713388 - DNA, 25 bp, Mus musculus
gtggtgtctattactgacttgccca

SEQ ID NO: 713389 - DNA, 25 bp, Mus musculus
gtggtgtctatttctgacttgccca

SEQ ID NO: 713390 - DNA, 25 bp, Mus musculus
gtggtgtctcacatcaacaagtgcc

SEQ ID NO: 713391 - DNA, 25 bp, Mus musculus
gtggtgtctcacttcaacaagtgcc

SEQ ID NO: 713392 - DNA, 25 bp, Mus musculus
gtggtgtctgaacggctgcttttca

SEQ ID NO: 713393 - DNA, 25 bp, Mus musculus
gtggtgtctgaagggctgcttttca

SEQ ID NO: 713394 - DNA, 25 bp, Mus musculus
gtggtgtctgtgctcttgaatacta

SEQ ID NO: 713395 - DNA, 25 bp, Mus musculus
gtggtgtctgtggtcttgaatacta

SEQ ID NO: 713396 - DNA, 25 bp, Mus musculus
gtggtgtcttccacagtcatgtctc

SEQ ID NO: 713397 - DNA, 25 bp, Mus musculus
gtggtgtcttcctcagtcatgtctc

SEQ ID NO: 713398 - DNA, 25 bp, Mus musculus
gtggtgtgaaaacactcacgctccc

SEQ ID NO: 713399 - DNA, 25 bp, Mus musculus
gtggtgtgaaaagactcacgctccc

SEQ ID NO: 713400 - DNA, 25 bp, Mus musculus
gtggtgtgaacaaagaagcctcaga

SEQ ID NO: 713401 - DNA, 25 bp, Mus musculus
gtggtgtgaacatagaagcctcaga

SEQ ID NO: 713402 - DNA, 25 bp, Mus musculus
gtggtgtgaactcaacccagatact

SEQ ID NO: 713403 - DNA, 25 bp, Mus musculus
gtggtgtgaactcttaaggcgtttt

SEQ ID NO: 713404 - DNA, 25 bp, Mus musculus
gtggtgtgaactgaacccagatact

SEQ ID NO: 713405 - DNA, 25 bp, Mus musculus
gtggtgtgaactgttaaggcgtttt

SEQ ID NO: 713406 - DNA, 25 bp, Mus musculus
gtggtgtgaccaatgaaaagctgca

SEQ ID NO: 713407 - DNA, 25 bp, Mus musculus
gtggtgtgaccattgaaaagctgca

SEQ ID NO: 713408 - DNA, 25 bp, Mus musculus
gtggtgtgccagagtgtagtaacct

SEQ ID NO: 713409 - DNA, 25 bp, Mus musculus
gtggtgtgccagtgtgtagtaacct

SEQ ID NO: 713410 - DNA, 25 bp, Mus musculus
gtggtgtgcgttcaccagcagacac

SEQ ID NO: 713411 - DNA, 25 bp, Mus musculus
gtggtgtgcgttgaccagcagacac

SEQ ID NO: 713412 - DNA, 25 bp, Mus musculus
gtggtgtggcttaattatctgatga

SEQ ID NO: 713413 - DNA, 25 bp, Mus musculus
gtggtgtggctttattatctgatga

SEQ ID NO: 713414 - DNA, 25 bp, Mus musculus
gtggtgtgtccaaatgcaactagaa

SEQ ID NO: 713415 - DNA, 25 bp, Mus musculus
gtggtgtgtccatatgcaactagaa

SEQ ID NO: 713416 - DNA, 25 bp, Mus musculus
gtggtgtgtgacatattactcttcc

SEQ ID NO: 713417 - DNA, 25 bp, Mus musculus
gtggtgtgtgacttattactcttcc

SEQ ID NO: 713418 - DNA, 25 bp, Mus musculus
gtggtgtgtgcgctctaacctccaa

SEQ ID NO: 713419 - DNA, 25 bp, Mus musculus
gtggtgtgtgcggtctaacctccaa

SEQ ID NO: 713420 - DNA, 25 bp, Mus musculus
gtggtgtgtgctcagattttactaa

SEQ ID NO: 713421 - DNA, 25 bp, Mus musculus
gtggtgtgtgctgagattttactaa

SEQ ID NO: 713422 - DNA, 25 bp, Mus musculus
gtggtgtgtgggactccgatatttt

SEQ ID NO: 713423 - DNA, 25 bp, Mus musculus
gtggtgtgtgggtctccgatatttt

SEQ ID NO: 713424 - DNA, 25 bp, Mus musculus
gtggtgtgtgtcactaagtttggat

SEQ ID NO: 713425 - DNA, 25 bp, Mus musculus
gtggtgtgtgtctctaagtttggat

SEQ ID NO: 713426 - DNA, 25 bp, Mus musculus
gtggtgttacatatttctcatgcaa

SEQ ID NO: 713427 - DNA, 25 bp, Mus musculus
gtggtgttacatttttctcatgcaa

SEQ ID NO: 713428 - DNA, 25 bp, Mus musculus
gtggtgttaggaattctcttttagt

SEQ ID NO: 713429 - DNA, 25 bp, Mus musculus
gtggtgttaggatttctcttttagt

SEQ ID NO: 713430 - DNA, 25 bp, Mus musculus
gtggtgttagttactcttgattctg

SEQ ID NO: 713431 - DNA, 25 bp, Mus musculus
gtggtgttagtttctcttgattctg

SEQ ID NO: 713432 - DNA, 25 bp, Mus musculus
gtggtgttcacactggtcacatata

SEQ ID NO: 713433 - DNA, 25 bp, Mus musculus
gtggtgttcacagtggtcacatata

SEQ ID NO: 713434 - DNA, 25 bp, Mus musculus
gtggtgttcacgaggcattcacatg

SEQ ID NO: 713435 - DNA, 25 bp, Mus musculus
gtggtgttcacgtggcattcacatg

SEQ ID NO: 713436 - DNA, 25 bp, Mus musculus
gtggtgttcatgacccctatggctc

SEQ ID NO: 713437 - DNA, 25 bp, Mus musculus
gtggtgttcatgtcccctatggctc

SEQ ID NO: 713438 - DNA, 25 bp, Mus musculus
gtggtgttctagaagaccaacatat

SEQ ID NO: 713439 - DNA, 25 bp, Mus musculus
gtggtgttctagtagaccaacatat

SEQ ID NO: 713440 - DNA, 25 bp, Mus musculus
gtggtgttctgccaagggacttcca

SEQ ID NO: 713441 - DNA, 25 bp, Mus musculus
gtggtgttctgcgaagggacttcca

SEQ ID NO: 713442 - DNA, 25 bp, Mus musculus
gtggtgttcttaatgcagtgcttta

SEQ ID NO: 713443 - DNA, 25 bp, Mus musculus
gtggtgttcttattgcagtgcttta

SEQ ID NO: 713444 - DNA, 25 bp, Mus musculus
gtggtgttctttaacctgtgggtct

SEQ ID NO: 713445 - DNA, 25 bp, Mus musculus
gtggtgttcttttacctgtgggtct

SEQ ID NO: 713446 - DNA, 25 bp, Mus musculus
gtggtgttgaccagctaggagccaa

SEQ ID NO: 713447 - DNA, 25 bp, Mus musculus
gtggtgttgaccattggtggcttcc

SEQ ID NO: 713448 - DNA, 25 bp, Mus musculus
gtggtgttgacctgctaggagccaa

SEQ ID NO: 713449 - DNA, 25 bp, Mus musculus
gtggtgttgacctttggtggcttcc

SEQ ID NO: 713450 - DNA, 25 bp, Mus musculus
gtggtgttgactatgagaccctcaa

SEQ ID NO: 713451 - DNA, 25 bp, Mus musculus
gtggtgttgactttgagaccctcaa

SEQ ID NO: 713452 - DNA, 25 bp, Mus musculus
gtggtgttgcacatgagattgtctt

SEQ ID NO: 713453 - DNA, 25 bp, Mus musculus
gtggtgttgcacttgagattgtctt

SEQ ID NO: 713454 - DNA, 25 bp, Mus musculus
gtggtgttgcctccccggatttctc

SEQ ID NO: 713455 - DNA, 25 bp, Mus musculus
gtggtgttgcctgcccggatttctc

SEQ ID NO: 713456 - DNA, 25 bp, Mus musculus
gtggtgttgctgatttctgccaaga

SEQ ID NO: 713457 - DNA, 25 bp, Mus musculus
gtggtgttgctgttttctgccaaga

SEQ ID NO: 713458 - DNA, 25 bp, Mus musculus
gtggtgttggtcaccctctttcctt

SEQ ID NO: 713459 - DNA, 25 bp, Mus musculus
gtggtgttggtctccctctttcctt

SEQ ID NO: 713460 - DNA, 25 bp, Mus musculus
gtggtgttggttagccacactgaaa

SEQ ID NO: 713461 - DNA, 25 bp, Mus musculus
gtggtgttggtttgccacactgaaa

SEQ ID NO: 713462 - DNA, 25 bp, Mus musculus
gtggtgttgttaaccggcttcatgc

SEQ ID NO: 713463 - DNA, 25 bp, Mus musculus
gtggtgttgttatccggcttcatgc

SEQ ID NO: 713464 - DNA, 25 bp, Mus musculus
gtggtgtttacaaactatgtatctc

SEQ ID NO: 713465 - DNA, 25 bp, Mus musculus
gtggtgtttacatactatgtatctc

SEQ ID NO: 713466 - DNA, 25 bp, Mus musculus
gtggtgtttccactcaaagcagtaa

SEQ ID NO: 713467 - DNA, 25 bp, Mus musculus
gtggtgtttccagtcaaagcagtaa

SEQ ID NO: 713468 - DNA, 25 bp, Mus musculus
gtggtgtttcccaatgctcaacaga

SEQ ID NO: 713469 - DNA, 25 bp, Mus musculus
gtggtgtttccctatgctcaacaga

SEQ ID NO: 713470 - DNA, 25 bp, Mus musculus
gtggtgtttctcctagtgtggaaca

SEQ ID NO: 713471 - DNA, 25 bp, Mus musculus
gtggtgtttctcgtagtgtggaaca

SEQ ID NO: 713472 - DNA, 25 bp, Mus musculus
gtggtgtttgctatactctttgtat

SEQ ID NO: 713473 - DNA, 25 bp, Mus musculus
gtggtgtttgctttactctttgtat

SEQ ID NO: 713474 - DNA, 25 bp, Mus musculus
gtggtgttttacaatacttctttgt

SEQ ID NO: 713475 - DNA, 25 bp, Mus musculus
gtggtgttttactatacttctttgt

SEQ ID NO: 713476 - DNA, 25 bp, Mus musculus
gtggtgtttttactgagcgtatttg

SEQ ID NO: 713477 - DNA, 25 bp, Mus musculus
gtggtgtttttagtgagcgtatttg

SEQ ID NO: 713478 - DNA, 25 bp, Mus musculus
gtggttaacaacaggctcttgtccc

SEQ ID NO: 713479 - DNA, 25 bp, Mus musculus
gtggttaacaacctgtaagacttgt

SEQ ID NO: 713480 - DNA, 25 bp, Mus musculus
gtggttaacaacgtgtaagacttgt

SEQ ID NO: 713481 - DNA, 25 bp, Mus musculus
gtggttaacaactggctcttgtccc

SEQ ID NO: 713482 - DNA, 25 bp, Mus musculus
gtggttaacactacagtagcattgc

SEQ ID NO: 713483 - DNA, 25 bp, Mus musculus
gtggttaacacttcagtagcattgc

SEQ ID NO: 713484 - DNA, 25 bp, Mus musculus
gtggttaacgcaccagagtccttct

SEQ ID NO: 713485 - DNA, 25 bp, Mus musculus
gtggttaacgcagcagagtccttct

SEQ ID NO: 713486 - DNA, 25 bp, Mus musculus
gtggttaactacacatctgttgtat

SEQ ID NO: 713487 - DNA, 25 bp, Mus musculus
gtggttaactactcatctgttgtat

SEQ ID NO: 713488 - DNA, 25 bp, Mus musculus
gtggttaactccaccaaatactttg

SEQ ID NO: 713489 - DNA, 25 bp, Mus musculus
gtggttaactcctccaaatactttg

SEQ ID NO: 713490 - DNA, 25 bp, Mus musculus
gtggttaactggctcctgtaagcat

SEQ ID NO: 713491 - DNA, 25 bp, Mus musculus
gtggttaactgggtcctgtaagcat

SEQ ID NO: 713492 - DNA, 25 bp, Mus musculus
gtggttaagaagagagcccaagttc

SEQ ID NO: 713493 - DNA, 25 bp, Mus musculus
gtggttaagaagtgagcccaagttc

SEQ ID NO: 713494 - DNA, 25 bp, Mus musculus
gtggttaagagaacctctgaccttc

SEQ ID NO: 713495 - DNA, 25 bp, Mus musculus
gtggttaagagatcctctgaccttc

SEQ ID NO: 713496 - DNA, 25 bp, Mus musculus
gtggttaagagtccctcctgatctt

SEQ ID NO: 713497 - DNA, 25 bp, Mus musculus
gtggttaagagtgcctcctgatctt

SEQ ID NO: 713498 - DNA, 25 bp, Mus musculus
gtggttaaggcacggcggattctgg

SEQ ID NO: 713499 - DNA, 25 bp, Mus musculus
gtggttaaggcagggcggattctgg

SEQ ID NO: 713500 - DNA, 25 bp, Mus musculus
gtggttaatactacatactgttctt

SEQ ID NO: 713501 - DNA, 25 bp, Mus musculus
gtggttaatacttcatactgttctt

SEQ ID NO: 713502 - DNA, 25 bp, Mus musculus
gtggttaatttactggccttggaga

SEQ ID NO: 713503 - DNA, 25 bp, Mus musculus
gtggttaatttagtggccttggaga

SEQ ID NO: 713504 - DNA, 25 bp, Mus musculus
gtggttaattttccgcgtgtccgtg

SEQ ID NO: 713505 - DNA, 25 bp, Mus musculus
gtggttaattttgcgcgtgtccgtg

SEQ ID NO: 713506 - DNA, 25 bp, Mus musculus
gtggttacactcagaagtctacctg

SEQ ID NO: 713507 - DNA, 25 bp, Mus musculus
gtggttacactctgaagtctacctg

SEQ ID NO: 713508 - DNA, 25 bp, Mus musculus
gtggttacagacattatgttctagt

SEQ ID NO: 713509 - DNA, 25 bp, Mus musculus
gtggttacagactttatgttctagt

SEQ ID NO: 713510 - DNA, 25 bp, Mus musculus
gtggttacagcaagaagccataact

SEQ ID NO: 713511 - DNA, 25 bp, Mus musculus
gtggttacagcatgaagccataact

SEQ ID NO: 713512 - DNA, 25 bp, Mus musculus
gtggttacattgattttcttcacat

SEQ ID NO: 713513 - DNA, 25 bp, Mus musculus
gtggttacattgtttttcttcacat

SEQ ID NO: 713514 - DNA, 25 bp, Mus musculus
gtggttaccaggaagcacagtactt

SEQ ID NO: 713515 - DNA, 25 bp, Mus musculus
gtggttaccaggtagcacagtactt

SEQ ID NO: 713516 - DNA, 25 bp, Mus musculus
gtggttaccatccaagtgcccttga

SEQ ID NO: 713517 - DNA, 25 bp, Mus musculus
gtggttaccatcgaagtgcccttga

SEQ ID NO: 713518 - DNA, 25 bp, Mus musculus
gtggttaccgcaagctgggcgacac

SEQ ID NO: 713519 - DNA, 25 bp, Mus musculus
gtggttaccgcatgctgggcgacac

SEQ ID NO: 713520 - DNA, 25 bp, Mus musculus
gtggttaccgtgaccaagtatgagt

SEQ ID NO: 713521 - DNA, 25 bp, Mus musculus
gtggttaccgtgtccaagtatgagt

SEQ ID NO: 713522 - DNA, 25 bp, Mus musculus
gtggttacctgcatgagacttctaa

SEQ ID NO: 713523 - DNA, 25 bp, Mus musculus
gtggttacctgcttgagacttctaa

SEQ ID NO: 713524 - DNA, 25 bp, Mus musculus
gtggttaccttacaacacttgtatc

SEQ ID NO: 713525 - DNA, 25 bp, Mus musculus
gtggttaccttagaacacttgtatc

SEQ ID NO: 713526 - DNA, 25 bp, Mus musculus
gtggttacgctgctgcagacacctc

SEQ ID NO: 713527 - DNA, 25 bp, Mus musculus
gtggttacgctggtgcagacacctc

SEQ ID NO: 713528 - DNA, 25 bp, Mus musculus
gtggttactatgatctttgtgccct

SEQ ID NO: 713529 - DNA, 25 bp, Mus musculus
gtggttactatgttctttgtgccct

SEQ ID NO: 713530 - DNA, 25 bp, Mus musculus
gtggttagacatccttgattctgca

SEQ ID NO: 713531 - DNA, 25 bp, Mus musculus
gtggttagacatgcttgattctgca

SEQ ID NO: 713532 - DNA, 25 bp, Mus musculus
gtggttagaccaagttgtcacctat

SEQ ID NO: 713533 - DNA, 25 bp, Mus musculus
gtggttagaccatgttgtcacctat

SEQ ID NO: 713534 - DNA, 25 bp, Mus musculus
gtggttagatctaacgctgagcagc

SEQ ID NO: 713535 - DNA, 25 bp, Mus musculus
gtggttagatcttacgctgagcagc

SEQ ID NO: 713536 - DNA, 25 bp, Mus musculus
gtggttagcaaacccagcaagcctg

SEQ ID NO: 713537 - DNA, 25 bp, Mus musculus
gtggttagcaaagccagcaagcctg

SEQ ID NO: 713538 - DNA, 25 bp, Mus musculus
gtggttagcccaaggcctcaagaca

SEQ ID NO: 713539 - DNA, 25 bp, Mus musculus
gtggttagcccatggcctcaagaca

SEQ ID NO: 713540 - DNA, 25 bp, Mus musculus
gtggttagcgacacatgggactcaa

SEQ ID NO: 713541 - DNA, 25 bp, Mus musculus
gtggttagcgactcatgggactcaa

SEQ ID NO: 713542 - DNA, 25 bp, Mus musculus
gtggttagctaaagtgaggatgata

SEQ ID NO: 713543 - DNA, 25 bp, Mus musculus
gtggttagctaatgtgaggatgata

SEQ ID NO: 713544 - DNA, 25 bp, Mus musculus
gtggttagttgacaagcctctgtaa

SEQ ID NO: 713545 - DNA, 25 bp, Mus musculus
gtggttagttgagaagcctctgtaa

SEQ ID NO: 713546 - DNA, 25 bp, Mus musculus
gtggttataaccctctgacgggtga

SEQ ID NO: 713547 - DNA, 25 bp, Mus musculus
gtggttataaccgtctgacgggtga

SEQ ID NO: 713548 - DNA, 25 bp, Mus musculus
gtggttatagagcacatacctagca

SEQ ID NO: 713549 - DNA, 25 bp, Mus musculus
gtggttatagaggacatacctagca

SEQ ID NO: 713550 - DNA, 25 bp, Mus musculus
gtggttatagatcccaacacctcat

SEQ ID NO: 713551 - DNA, 25 bp, Mus musculus
gtggttatagatgccaacacctcat

SEQ ID NO: 713552 - DNA, 25 bp, Mus musculus
gtggttatagcgacacactcctcat

SEQ ID NO: 713553 - DNA, 25 bp, Mus musculus
gtggttatagcgtcacactcctcat

SEQ ID NO: 713554 - DNA, 25 bp, Mus musculus
gtggttatatctatgtattgccata

SEQ ID NO: 713555 - DNA, 25 bp, Mus musculus
gtggttatatctttgtattgccata

SEQ ID NO: 713556 - DNA, 25 bp, Mus musculus
gtggttatcaatctgctaagctcca

SEQ ID NO: 713557 - DNA, 25 bp, Mus musculus
gtggttatcaatgtgctaagctcca

SEQ ID NO: 713558 - DNA, 25 bp, Mus musculus
gtggttatcacgactctacttggag

SEQ ID NO: 713559 - DNA, 25 bp, Mus musculus
gtggttatcacgtctctacttggag

SEQ ID NO: 713560 - DNA, 25 bp, Mus musculus
gtggttatccagactgtgtgccaaa

SEQ ID NO: 713561 - DNA, 25 bp, Mus musculus
gtggttatccagtctgtgtgccaaa

SEQ ID NO: 713562 - DNA, 25 bp, Mus musculus
gtggttatctcaattacccaaactt

SEQ ID NO: 713563 - DNA, 25 bp, Mus musculus
gtggttatctcatttacccaaactt

SEQ ID NO: 713564 - DNA, 25 bp, Mus musculus
gtggttatctttccatatattcttc

SEQ ID NO: 713565 - DNA, 25 bp, Mus musculus
gtggttatctttgcatatattcttc

SEQ ID NO: 713566 - DNA, 25 bp, Mus musculus
gtggttatgcacacttaaagctcct

SEQ ID NO: 713567 - DNA, 25 bp, Mus musculus
gtggttatgcactcttaaagctcct

SEQ ID NO: 713568 - DNA, 25 bp, Mus musculus
gtggttatgccacatgtcatgactt

SEQ ID NO: 713569 - DNA, 25 bp, Mus musculus
gtggttatgccagatgtcatgactt

SEQ ID NO: 713570 - DNA, 25 bp, Mus musculus
gtggttatgcttatcactttcattt

SEQ ID NO: 713571 - DNA, 25 bp, Mus musculus
gtggttatgcttttcactttcattt

SEQ ID NO: 713572 - DNA, 25 bp, Mus musculus
gtggttatgttcactttaaggtcca

SEQ ID NO: 713573 - DNA, 25 bp, Mus musculus
gtggttatgttctctttaaggtcca

SEQ ID NO: 713574 - DNA, 25 bp, Mus musculus
gtggttattaatcccatgcttacaa

SEQ ID NO: 713575 - DNA, 25 bp, Mus musculus
gtggttattaatgccatgcttacaa

SEQ ID NO: 713576 - DNA, 25 bp, Mus musculus
gtggttattctcctctagtagatat

SEQ ID NO: 713577 - DNA, 25 bp, Mus musculus
gtggttattctcgtctagtagatat

SEQ ID NO: 713578 - DNA, 25 bp, Mus musculus
gtggttattggtcatgaagtcacca

SEQ ID NO: 713579 - DNA, 25 bp, Mus musculus
gtggttattggtgatgaagtcacca

SEQ ID NO: 713580 - DNA, 25 bp, Mus musculus
gtggttatttgcagactcaatcaaa

SEQ ID NO: 713581 - DNA, 25 bp, Mus musculus
gtggttatttgctgactcaatcaaa

SEQ ID NO: 713582 - DNA, 25 bp, Mus musculus
gtggttatttgtacaaccgagcaga

SEQ ID NO: 713583 - DNA, 25 bp, Mus musculus
gtggttatttgttcaaccgagcaga

SEQ ID NO: 713584 - DNA, 25 bp, Mus musculus
gtggttcaaaacagtctatgtctag

SEQ ID NO: 713585 - DNA, 25 bp, Mus musculus
gtggttcaaaactgtctatgtctag

SEQ ID NO: 713586 - DNA, 25 bp, Mus musculus
gtggttcaaattctagtcctctatt

SEQ ID NO: 713587 - DNA, 25 bp, Mus musculus
gtggttcaaattgtagtcctctatt

SEQ ID NO: 713588 - DNA, 25 bp, Mus musculus
gtggttcaaccaaagacggcttcat

SEQ ID NO: 713589 - DNA, 25 bp, Mus musculus
gtggttcaaccatagacggcttcat

SEQ ID NO: 713590 - DNA, 25 bp, Mus musculus
gtggttcacatacccaaccctgtag

SEQ ID NO: 713591 - DNA, 25 bp, Mus musculus
gtggttcacatagccaaccctgtag

SEQ ID NO: 713592 - DNA, 25 bp, Mus musculus
gtggttcaccatcgtgcaatgtgtt

SEQ ID NO: 713593 - DNA, 25 bp, Mus musculus
gtggttcaccatggtgcaatgtgtt

SEQ ID NO: 713594 - DNA, 25 bp, Mus musculus
gtggttcactggcatcatagctagg

SEQ ID NO: 713595 - DNA, 25 bp, Mus musculus
gtggttcactgggatcatagctagg

SEQ ID NO: 713596 - DNA, 25 bp, Mus musculus
gtggttcacttacgtcttgactttt

SEQ ID NO: 713597 - DNA, 25 bp, Mus musculus
gtggttcacttaggtcttgactttt

SEQ ID NO: 713598 - DNA, 25 bp, Mus musculus
gtggttcagatgacactctcagtat

SEQ ID NO: 713599 - DNA, 25 bp, Mus musculus
gtggttcagatgtcactctcagtat

SEQ ID NO: 713600 - DNA, 25 bp, Mus musculus
gtggttcagccactcccactgacta

SEQ ID NO: 713601 - DNA, 25 bp, Mus musculus
gtggttcagccagtcccactgacta

SEQ ID NO: 713602 - DNA, 25 bp, Mus musculus
gtggttcagctcctgtttcagattc

SEQ ID NO: 713603 - DNA, 25 bp, Mus musculus
gtggttcagctcgtgtttcagattc

SEQ ID NO: 713604 - DNA, 25 bp, Mus musculus
gtggttcagtaaaggctgttcgccc

SEQ ID NO: 713605 - DNA, 25 bp, Mus musculus
gtggttcagtaatggctgttcgccc

SEQ ID NO: 713606 - DNA, 25 bp, Mus musculus
gtggttcagtgtacaatgctaagtc

SEQ ID NO: 713607 - DNA, 25 bp, Mus musculus
gtggttcagtgttcaatgctaagtc

SEQ ID NO: 713608 - DNA, 25 bp, Mus musculus
gtggttcatgtacagacatgcagac

SEQ ID NO: 713609 - DNA, 25 bp, Mus musculus
gtggttcatgtagagacatgcagac

SEQ ID NO: 713610 - DNA, 25 bp, Mus musculus
gtggttcatgtcatatacattcaca

SEQ ID NO: 713611 - DNA, 25 bp, Mus musculus
gtggttcatgtcttatacattcaca

SEQ ID NO: 713612 - DNA, 25 bp, Mus musculus
gtggttcattgtcaccatgtccctg

SEQ ID NO: 713613 - DNA, 25 bp, Mus musculus
gtggttcattgtgaccatgtccctg

SEQ ID NO: 713614 - DNA, 25 bp, Mus musculus
gtggttccaactcaacaactttttg

SEQ ID NO: 713615 - DNA, 25 bp, Mus musculus
gtggttccaactgaacaactttttg

SEQ ID NO: 713616 - DNA, 25 bp, Mus musculus
gtggttccacaaacatcatcatgtt

SEQ ID NO: 713617 - DNA, 25 bp, Mus musculus
gtggttccacaatcatcatcatgtt

SEQ ID NO: 713618 - DNA, 25 bp, Mus musculus
gtggttccagagacaagagccctga

SEQ ID NO: 713619 - DNA, 25 bp, Mus musculus
gtggttccagagtcaagagccctga

SEQ ID NO: 713620 - DNA, 25 bp, Mus musculus
gtggttccatacatgattcacctcc

SEQ ID NO: 713621 - DNA, 25 bp, Mus musculus
gtggttccatacttgattcacctcc

SEQ ID NO: 713622 - DNA, 25 bp, Mus musculus
gtggttccatctattgccattatga

SEQ ID NO: 713623 - DNA, 25 bp, Mus musculus
gtggttccatcttttgccattatga

SEQ ID NO: 713624 - DNA, 25 bp, Mus musculus
gtggttccatggagaggattacaaa

SEQ ID NO: 713625 - DNA, 25 bp, Mus musculus
gtggttccatggtgaggattacaaa

SEQ ID NO: 713626 - DNA, 25 bp, Mus musculus
gtggttcccaacaaactcataaagt

SEQ ID NO: 713627 - DNA, 25 bp, Mus musculus
gtggttcccaactaactcataaagt

SEQ ID NO: 713628 - DNA, 25 bp, Mus musculus
gtggttcccaccagaaagagatcat

SEQ ID NO: 713629 - DNA, 25 bp, Mus musculus
gtggttcccacctgaaagagatcat

SEQ ID NO: 713630 - DNA, 25 bp, Mus musculus
gtggttcccacgatttaagatacat

SEQ ID NO: 713631 - DNA, 25 bp, Mus musculus
gtggttcccacgttttaagatacat

SEQ ID NO: 713632 - DNA, 25 bp, Mus musculus
gtggttcccggcagcttacatagag

SEQ ID NO: 713633 - DNA, 25 bp, Mus musculus
gtggttcccggctgcttacatagag

SEQ ID NO: 713634 - DNA, 25 bp, Mus musculus
gtggttccctgcatcatgcatgtct

SEQ ID NO: 713635 - DNA, 25 bp, Mus musculus
gtggttccctgcttcatgcatgtct

SEQ ID NO: 713636 - DNA, 25 bp, Mus musculus
gtggttccgaaacagacatcagtgt

SEQ ID NO: 713637 - DNA, 25 bp, Mus musculus
gtggttccgaaagagacatcagtgt

SEQ ID NO: 713638 - DNA, 25 bp, Mus musculus
gtggttccgtgtattgaaggactca

SEQ ID NO: 713639 - DNA, 25 bp, Mus musculus
gtggttccgtgttttgaaggactca

SEQ ID NO: 713640 - DNA, 25 bp, Mus musculus
gtggttcctaccactgtaagatgga

SEQ ID NO: 713641 - DNA, 25 bp, Mus musculus
gtggttcctacctctgtaagatgga

SEQ ID NO: 713642 - DNA, 25 bp, Mus musculus
gtggttcctatgctcttaatttgtt

SEQ ID NO: 713643 - DNA, 25 bp, Mus musculus
gtggttcctatggtcttaatttgtt

SEQ ID NO: 713644 - DNA, 25 bp, Mus musculus
gtggttcctgagaggagacgacctt

SEQ ID NO: 713645 - DNA, 25 bp, Mus musculus
gtggttcctgagtggagacgacctt

SEQ ID NO: 713646 - DNA, 25 bp, Mus musculus
gtggttcctgcaagaaaacagtggc

SEQ ID NO: 713647 - DNA, 25 bp, Mus musculus
gtggttcctgcatgaaaacagtggc

SEQ ID NO: 713648 - DNA, 25 bp, Mus musculus
gtggttcctggaattcaaagtgtta

SEQ ID NO: 713649 - DNA, 25 bp, Mus musculus
gtggttcctggatttcaaagtgtta

SEQ ID NO: 713650 - DNA, 25 bp, Mus musculus
gtggttccttagcatatctttcaag

SEQ ID NO: 713651 - DNA, 25 bp, Mus musculus
gtggttccttaggatatctttcaag

SEQ ID NO: 713652 - DNA, 25 bp, Mus musculus
gtggttcctttaactcttcaccaag

SEQ ID NO: 713653 - DNA, 25 bp, Mus musculus
gtggttcctttatctcttcaccaag

SEQ ID NO: 713654 - DNA, 25 bp, Mus musculus
gtggttcgaagaagtctcagccctg

SEQ ID NO: 713655 - DNA, 25 bp, Mus musculus
gtggttcgaagatgtctcagccctg

SEQ ID NO: 713656 - DNA, 25 bp, Mus musculus
gtggttcgcaaccttcttagtgacc

SEQ ID NO: 713657 - DNA, 25 bp, Mus musculus
gtggttcgcaacgttcttagtgacc

SEQ ID NO: 713658 - DNA, 25 bp, Mus musculus
gtggttcgtccaaccccagcggaga

SEQ ID NO: 713659 - DNA, 25 bp, Mus musculus
gtggttcgtccatccccagcggaga

SEQ ID NO: 713660 - DNA, 25 bp, Mus musculus
gtggttcgttgaacttattctgctc

SEQ ID NO: 713661 - DNA, 25 bp, Mus musculus
gtggttcgttgatcttattctgctc

SEQ ID NO: 713662 - DNA, 25 bp, Mus musculus
gtggttctaacccagaatcacgagt

SEQ ID NO: 713663 - DNA, 25 bp, Mus musculus
gtggttctaaccgagaatcacgagt

SEQ ID NO: 713664 - DNA, 25 bp, Mus musculus
gtggttctaattcccacctagtggc

SEQ ID NO: 713665 - DNA, 25 bp, Mus musculus
gtggttctaattgccacctagtggc

SEQ ID NO: 713666 - DNA, 25 bp, Mus musculus
gtggttctacgtcggttttgttatg

SEQ ID NO: 713667 - DNA, 25 bp, Mus musculus
gtggttctacgtgggttttgttatg

SEQ ID NO: 713668 - DNA, 25 bp, Mus musculus
gtggttctactacggactgagcaga

SEQ ID NO: 713669 - DNA, 25 bp, Mus musculus
gtggttctactagggactgagcaga

SEQ ID NO: 713670 - DNA, 25 bp, Mus musculus
gtggttctcaatcaaggctcatgat

SEQ ID NO: 713671 - DNA, 25 bp, Mus musculus
gtggttctcaatccaccccaaaagg

SEQ ID NO: 713672 - DNA, 25 bp, Mus musculus
gtggttctcaatgaaggctcatgat

SEQ ID NO: 713673 - DNA, 25 bp, Mus musculus
gtggttctcaatgcaccccaaaagg

SEQ ID NO: 713674 - DNA, 25 bp, Mus musculus
gtggttctcagtctaactaacttga

SEQ ID NO: 713675 - DNA, 25 bp, Mus musculus
gtggttctcagtgtaactaacttga

SEQ ID NO: 713676 - DNA, 25 bp, Mus musculus
gtggttctccacagctggaaggtgt

SEQ ID NO: 713677 - DNA, 25 bp, Mus musculus
gtggttctccactgctggaaggtgt

SEQ ID NO: 713678 - DNA, 25 bp, Mus musculus
gtggttctcccaattacagggctca

SEQ ID NO: 713679 - DNA, 25 bp, Mus musculus
gtggttctcccaccatgatgtttga

SEQ ID NO: 713680 - DNA, 25 bp, Mus musculus
gtggttctcccagcatgatgtttga

SEQ ID NO: 713681 - DNA, 25 bp, Mus musculus
gtggttctcccatttacagggctca

SEQ ID NO: 713682 - DNA, 25 bp, Mus musculus
gtggttctcgacctgtggcttacga

SEQ ID NO: 713683 - DNA, 25 bp, Mus musculus
gtggttctcgacgtgtggcttacga

SEQ ID NO: 713684 - DNA, 25 bp, Mus musculus
gtggttctctctctgaaagccattt

SEQ ID NO: 713685 - DNA, 25 bp, Mus musculus
gtggttctctctctgtacctggaga

SEQ ID NO: 713686 - DNA, 25 bp, Mus musculus
gtggttctctctgtgaaagccattt

SEQ ID NO: 713687 - DNA, 25 bp, Mus musculus
gtggttctctctgtgtacctggaga

SEQ ID NO: 713688 - DNA, 25 bp, Mus musculus
gtggttctctggaatgttggcctga

SEQ ID NO: 713689 - DNA, 25 bp, Mus musculus
gtggttctctggtatgttggcctga

SEQ ID NO: 713690 - DNA, 25 bp, Mus musculus
gtggttctctgtcacaacttgctca

SEQ ID NO: 713691 - DNA, 25 bp, Mus musculus
gtggttctctgtgacaacttgctca

SEQ ID NO: 713692 - DNA, 25 bp, Mus musculus
gtggttctgaacacggtacaacctt

SEQ ID NO: 713693 - DNA, 25 bp, Mus musculus
gtggttctgaactcggtacaacctt

SEQ ID NO: 713694 - DNA, 25 bp, Mus musculus
gtggttctgagacccagtttatgat

SEQ ID NO: 713695 - DNA, 25 bp, Mus musculus
gtggttctgagagccagtttatgat

SEQ ID NO: 713696 - DNA, 25 bp, Mus musculus
gtggttctgatgaacgctgcttaaa

SEQ ID NO: 713697 - DNA, 25 bp, Mus musculus
gtggttctgatgtacgctgcttaaa

SEQ ID NO: 713698 - DNA, 25 bp, Mus musculus
gtggttctgcttcataatggcttcc

SEQ ID NO: 713699 - DNA, 25 bp, Mus musculus
gtggttctgcttgataatggcttcc

SEQ ID NO: 713700 - DNA, 25 bp, Mus musculus
gtggttctgtcactctggactagaa

SEQ ID NO: 713701 - DNA, 25 bp, Mus musculus
gtggttctgtcagtctggactagaa

SEQ ID NO: 713702 - DNA, 25 bp, Mus musculus
gtggttcttagcaaccttttgcgat

SEQ ID NO: 713703 - DNA, 25 bp, Mus musculus
gtggttcttagctaccttttgcgat

SEQ ID NO: 713704 - DNA, 25 bp, Mus musculus
gtggttcttcataattctgtatata

SEQ ID NO: 713705 - DNA, 25 bp, Mus musculus
gtggttcttcattattctgtatata

SEQ ID NO: 713706 - DNA, 25 bp, Mus musculus
gtggttcttgagcttcctgacaaca

SEQ ID NO: 713707 - DNA, 25 bp, Mus musculus
gtggttcttgaggttcctgacaaca

SEQ ID NO: 713708 - DNA, 25 bp, Mus musculus
gtggttgaaaatctccttagctact

SEQ ID NO: 713709 - DNA, 25 bp, Mus musculus
gtggttgaaaatgtccttagctact

SEQ ID NO: 713710 - DNA, 25 bp, Mus musculus
gtggttgaatcgagaggaacacctt

SEQ ID NO: 713711 - DNA, 25 bp, Mus musculus
gtggttgaatcgtgaggaacacctt

SEQ ID NO: 713712 - DNA, 25 bp, Mus musculus
gtggttgacatgatccagaccgtga

SEQ ID NO: 713713 - DNA, 25 bp, Mus musculus
gtggttgacatgttccagaccgtga

SEQ ID NO: 713714 - DNA, 25 bp, Mus musculus
gtggttgaccttcaagtcaccgtta

SEQ ID NO: 713715 - DNA, 25 bp, Mus musculus
gtggttgaccttgaagtcaccgtta

SEQ ID NO: 713716 - DNA, 25 bp, Mus musculus
gtggttgacttccaactcaagcgaa

SEQ ID NO: 713717 - DNA, 25 bp, Mus musculus
gtggttgacttcgaactcaagcgaa

SEQ ID NO: 713718 - DNA, 25 bp, Mus musculus
gtggttgagatcctctctggtcaac

SEQ ID NO: 713719 - DNA, 25 bp, Mus musculus
gtggttgagatcgtctctggtcaac

SEQ ID NO: 713720 - DNA, 25 bp, Mus musculus
gtggttgagcacatccaagcctgac

SEQ ID NO: 713721 - DNA, 25 bp, Mus musculus
gtggttgagcacttccaagcctgac

SEQ ID NO: 713722 - DNA, 25 bp, Mus musculus
gtggttgatcagatcagcacgtcac

SEQ ID NO: 713723 - DNA, 25 bp, Mus musculus
gtggttgatcagttcagcacgtcac

SEQ ID NO: 713724 - DNA, 25 bp, Mus musculus
gtggttgatggcaaggtcctgcaca

SEQ ID NO: 713725 - DNA, 25 bp, Mus musculus
gtggttgatggctaggtcctgcaca

SEQ ID NO: 713726 - DNA, 25 bp, Mus musculus
gtggttgattgcattatctctcgaa

SEQ ID NO: 713727 - DNA, 25 bp, Mus musculus
gtggttgattgctttatctctcgaa

SEQ ID NO: 713728 - DNA, 25 bp, Mus musculus
gtggttgcacgaattcactttgtgt

SEQ ID NO: 713729 - DNA, 25 bp, Mus musculus
gtggttgcacgatttcactttgtgt

SEQ ID NO: 713730 - DNA, 25 bp, Mus musculus
gtggttgcagatacttcttcaatag

SEQ ID NO: 713731 - DNA, 25 bp, Mus musculus
gtggttgcagattcttcttcaatag

SEQ ID NO: 713732 - DNA, 25 bp, Mus musculus
gtggttgcagcacccttgccaatgt

SEQ ID NO: 713733 - DNA, 25 bp, Mus musculus
gtggttgcagcagccttgccaatgt

SEQ ID NO: 713734 - DNA, 25 bp, Mus musculus
gtggttgcagctctacctgaaataa

SEQ ID NO: 713735 - DNA, 25 bp, Mus musculus
gtggttgcagctgtacctgaaataa

SEQ ID NO: 713736 - DNA, 25 bp, Mus musculus
gtggttgccaaacccctctgtgtct

SEQ ID NO: 713737 - DNA, 25 bp, Mus musculus
gtggttgccaaagccctctgtgtct

SEQ ID NO: 713738 - DNA, 25 bp, Mus musculus
gtggttgcccgaaagctcgaactca

SEQ ID NO: 713739 - DNA, 25 bp, Mus musculus
gtggttgcccgatagctcgaactca

SEQ ID NO: 713740 - DNA, 25 bp, Mus musculus
gtggttgcctctctcacaacagtta

SEQ ID NO: 713741 - DNA, 25 bp, Mus musculus
gtggttgcctctgtcacaacagtta

SEQ ID NO: 713742 - DNA, 25 bp, Mus musculus
gtggttgcgcagacttggtaccttc

SEQ ID NO: 713743 - DNA, 25 bp, Mus musculus
gtggttgcgcagtcttggtaccttc

SEQ ID NO: 713744 - DNA, 25 bp, Mus musculus
gtggttgcggttccgtcctaaacat

SEQ ID NO: 713745 - DNA, 25 bp, Mus musculus
gtggttgcggttgcgtcctaaacat

SEQ ID NO: 713746 - DNA, 25 bp, Mus musculus
gtggttgcgtggcacaccgattaac

SEQ ID NO: 713747 - DNA, 25 bp, Mus musculus
gtggttgcgtgggacaccgattaac

SEQ ID NO: 713748 - DNA, 25 bp, Mus musculus
gtggttgctccaaaatcacaaagtt

SEQ ID NO: 713749 - DNA, 25 bp, Mus musculus
gtggttgctccataatcacaaagtt

SEQ ID NO: 713750 - DNA, 25 bp, Mus musculus
gtggttgctgagaatcgaactcgtg

SEQ ID NO: 713751 - DNA, 25 bp, Mus musculus
gtggttgctgagtatcgaactcgtg

SEQ ID NO: 713752 - DNA, 25 bp, Mus musculus
gtggttgctgttcaggctgacctcc

SEQ ID NO: 713753 - DNA, 25 bp, Mus musculus
gtggttgctgttgaggctgacctcc

SEQ ID NO: 713754 - DNA, 25 bp, Mus musculus
gtggttgcttcaagtattattccaa

SEQ ID NO: 713755 - DNA, 25 bp, Mus musculus
gtggttgcttcatgtattattccaa

SEQ ID NO: 713756 - DNA, 25 bp, Mus musculus
gtggttgcttcgattttgtttaaag

SEQ ID NO: 713757 - DNA, 25 bp, Mus musculus
gtggttgcttcgtttttgtttaaag

SEQ ID NO: 713758 - DNA, 25 bp, Mus musculus
gtggttgctttcatttattggatgt

SEQ ID NO: 713759 - DNA, 25 bp, Mus musculus
gtggttgctttcttttattggatgt

SEQ ID NO: 713760 - DNA, 25 bp, Mus musculus
gtggttggattcaggccatggccac

SEQ ID NO: 713761 - DNA, 25 bp, Mus musculus
gtggttggattctggccatggccac

SEQ ID NO: 713762 - DNA, 25 bp, Mus musculus
gtggttggtcaccttgtctcttggc

SEQ ID NO: 713763 - DNA, 25 bp, Mus musculus
gtggttggtcacgttgtctcttggc

SEQ ID NO: 713764 - DNA, 25 bp, Mus musculus
gtggttggtggcagagcctcaatcc

SEQ ID NO: 713765 - DNA, 25 bp, Mus musculus
gtggttggtggctgagcctcaatcc

SEQ ID NO: 713766 - DNA, 25 bp, Mus musculus
gtggttggttccaggaccacagtgt

SEQ ID NO: 713767 - DNA, 25 bp, Mus musculus
gtggttggttcctggaccacagtgt

SEQ ID NO: 713768 - DNA, 25 bp, Mus musculus
gtggttggttgaatcctagagttac

SEQ ID NO: 713769 - DNA, 25 bp, Mus musculus
gtggttggttgattcctagagttac

SEQ ID NO: 713770 - DNA, 25 bp, Mus musculus
gtggttgtacaccaacagggatcaa

SEQ ID NO: 713771 - DNA, 25 bp, Mus musculus
gtggttgtacacgaacagggatcaa

SEQ ID NO: 713772 - DNA, 25 bp, Mus musculus
gtggttgtactccatttttggatcc

SEQ ID NO: 713773 - DNA, 25 bp, Mus musculus
gtggttgtactcgatttttggatcc

SEQ ID NO: 713774 - DNA, 25 bp, Mus musculus
gtggttgtctcacatacctgttcag

SEQ ID NO: 713775 - DNA, 25 bp, Mus musculus
gtggttgtctcagatacctgttcag

SEQ ID NO: 713776 - DNA, 25 bp, Mus musculus
gtggttgtggtccagcccaaagcaa

SEQ ID NO: 713777 - DNA, 25 bp, Mus musculus
gtggttgtggtcgagcccaaagcaa

SEQ ID NO: 713778 - DNA, 25 bp, Mus musculus
gtggttgtggttctgatctgtcatt

SEQ ID NO: 713779 - DNA, 25 bp, Mus musculus
gtggttgtggttgtgatctgtcatt

SEQ ID NO: 713780 - DNA, 25 bp, Mus musculus
gtggttgtgttgaagctgctgtttt

SEQ ID NO: 713781 - DNA, 25 bp, Mus musculus
gtggttgtgttgtagctgctgtttt

SEQ ID NO: 713782 - DNA, 25 bp, Mus musculus
gtggttgttggacccatccttctca

SEQ ID NO: 713783 - DNA, 25 bp, Mus musculus
gtggttgttggagccatccttctca

SEQ ID NO: 713784 - DNA, 25 bp, Mus musculus
gtggttgtttcacccacataaaagt

SEQ ID NO: 713785 - DNA, 25 bp, Mus musculus
gtggttgtttcagccacataaaagt

SEQ ID NO: 713786 - DNA, 25 bp, Mus musculus
gtggttgttttcctatgcacagtga

SEQ ID NO: 713787 - DNA, 25 bp, Mus musculus
gtggttgttttcgtatgcacagtga

SEQ ID NO: 713788 - DNA, 25 bp, Mus musculus
gtggtttaatttaatctctcagccc

SEQ ID NO: 713789 - DNA, 25 bp, Mus musculus
gtggtttaattttatctctcagccc

SEQ ID NO: 713790 - DNA, 25 bp, Mus musculus
gtggtttacatcaatcattctctga

SEQ ID NO: 713791 - DNA, 25 bp, Mus musculus
gtggtttacatctatcattctctga

SEQ ID NO: 713792 - DNA, 25 bp, Mus musculus
gtggtttacctcaattccctgatta

SEQ ID NO: 713793 - DNA, 25 bp, Mus musculus
gtggtttacctctattccctgatta

SEQ ID NO: 713794 - DNA, 25 bp, Mus musculus
gtggtttacggtatctgtgtgtgtc

SEQ ID NO: 713795 - DNA, 25 bp, Mus musculus
gtggtttacggtttctgtgtgtgtc

SEQ ID NO: 713796 - DNA, 25 bp, Mus musculus
gtggtttacttgactaaataatagt

SEQ ID NO: 713797 - DNA, 25 bp, Mus musculus
gtggtttacttgtctaaataatagt

SEQ ID NO: 713798 - DNA, 25 bp, Mus musculus
gtggtttagatacatgttcttggtt

SEQ ID NO: 713799 - DNA, 25 bp, Mus musculus
gtggtttagatagatgttcttggtt

SEQ ID NO: 713800 - DNA, 25 bp, Mus musculus
gtggtttaggtaatgttctcttgac

SEQ ID NO: 713801 - DNA, 25 bp, Mus musculus
gtggtttaggtattgttctcttgac

SEQ ID NO: 713802 - DNA, 25 bp, Mus musculus
gtggtttatcaaaggcaagtcggct

SEQ ID NO: 713803 - DNA, 25 bp, Mus musculus
gtggtttatcaatggcaagtcggct

SEQ ID NO: 713804 - DNA, 25 bp, Mus musculus
gtggtttatcctcgcaatgataatg

SEQ ID NO: 713805 - DNA, 25 bp, Mus musculus
gtggtttatcctggcaatgataatg

SEQ ID NO: 713806 - DNA, 25 bp, Mus musculus
gtggtttatgtgactctggagagtc

SEQ ID NO: 713807 - DNA, 25 bp, Mus musculus
gtggtttatgtgtctctggagagtc

SEQ ID NO: 713808 - DNA, 25 bp, Mus musculus
gtggtttcaattctggtttcctaag

SEQ ID NO: 713809 - DNA, 25 bp, Mus musculus
gtggtttcaattgtggtttcctaag

SEQ ID NO: 713810 - DNA, 25 bp, Mus musculus
gtggtttcacacaaattcccttgta

SEQ ID NO: 713811 - DNA, 25 bp, Mus musculus
gtggtttcacactaattcccttgta

SEQ ID NO: 713812 - DNA, 25 bp, Mus musculus
gtggtttcacccatgtcctatcatt

SEQ ID NO: 713813 - DNA, 25 bp, Mus musculus
gtggtttcacccttgtcctatcatt

SEQ ID NO: 713814 - DNA, 25 bp, Mus musculus
gtggtttcagaacttcatgtcaact

SEQ ID NO: 713815 - DNA, 25 bp, Mus musculus
gtggtttcagaagttcatgtcaact

SEQ ID NO: 713816 - DNA, 25 bp, Mus musculus
gtggtttcagggaactcacctcaga

SEQ ID NO: 713817 - DNA, 25 bp, Mus musculus
gtggtttcagggtactcacctcaga

SEQ ID NO: 713818 - DNA, 25 bp, Mus musculus
gtggtttcatctaccttggttttag

SEQ ID NO: 713819 - DNA, 25 bp, Mus musculus
gtggtttcatcttccttggttttag

SEQ ID NO: 713820 - DNA, 25 bp, Mus musculus
gtggtttcattccaaggtactcatt

SEQ ID NO: 713821 - DNA, 25 bp, Mus musculus
gtggtttcattcgaaggtactcatt

SEQ ID NO: 713822 - DNA, 25 bp, Mus musculus
gtggtttccacaaaacactttgagg

SEQ ID NO: 713823 - DNA, 25 bp, Mus musculus
gtggtttccacataacactttgagg

SEQ ID NO: 713824 - DNA, 25 bp, Mus musculus
gtggtttccagcaccatggacgtat

SEQ ID NO: 713825 - DNA, 25 bp, Mus musculus
gtggtttccagctccatggacgtat

SEQ ID NO: 713826 - DNA, 25 bp, Mus musculus
gtggtttcccacaagtgtgttagat

SEQ ID NO: 713827 - DNA, 25 bp, Mus musculus
gtggtttcccactagtgtgttagat

SEQ ID NO: 713828 - DNA, 25 bp, Mus musculus
gtggtttcccagatcattgtcctaa

SEQ ID NO: 713829 - DNA, 25 bp, Mus musculus
gtggtttcccagttcattgtcctaa

SEQ ID NO: 713830 - DNA, 25 bp, Mus musculus
gtggtttccgtaccaactcctactt

SEQ ID NO: 713831 - DNA, 25 bp, Mus musculus
gtggtttccgtagcaactcctactt

SEQ ID NO: 713832 - DNA, 25 bp, Mus musculus
gtggtttcctgtcagttaccttata

SEQ ID NO: 713833 - DNA, 25 bp, Mus musculus
gtggtttcctgtgagttaccttata

SEQ ID NO: 713834 - DNA, 25 bp, Mus musculus
gtggtttctccaccacattttaaga

SEQ ID NO: 713835 - DNA, 25 bp, Mus musculus
gtggtttctccagcacattttaaga

SEQ ID NO: 713836 - DNA, 25 bp, Mus musculus
gtggtttctcctacagtgtacacta

SEQ ID NO: 713837 - DNA, 25 bp, Mus musculus
gtggtttctcctctgggcgacatca

SEQ ID NO: 713838 - DNA, 25 bp, Mus musculus
gtggtttctcctgtgggcgacatca

SEQ ID NO: 713839 - DNA, 25 bp, Mus musculus
gtggtttctccttcagtgtacacta

SEQ ID NO: 713840 - DNA, 25 bp, Mus musculus
gtggtttctctcacattgaactgct

SEQ ID NO: 713841 - DNA, 25 bp, Mus musculus
gtggtttctctctcattgaactgct

SEQ ID NO: 713842 - DNA, 25 bp, Mus musculus
gtggtttctgttactagcccatgaa

SEQ ID NO: 713843 - DNA, 25 bp, Mus musculus
gtggtttctgtttctagcccatgaa

SEQ ID NO: 713844 - DNA, 25 bp, Mus musculus
gtggtttctttcaagcaggcacaaa

SEQ ID NO: 713845 - DNA, 25 bp, Mus musculus
gtggtttctttctagcaggcacaaa

SEQ ID NO: 713846 - DNA, 25 bp, Mus musculus
gtggtttgactcaacccagggcaat

SEQ ID NO: 713847 - DNA, 25 bp, Mus musculus
gtggtttgactctacccagggcaat

SEQ ID NO: 713848 - DNA, 25 bp, Mus musculus
gtggtttgatttaagcccgtgggat

SEQ ID NO: 713849 - DNA, 25 bp, Mus musculus
gtggtttgattttagcccgtgggat

SEQ ID NO: 713850 - DNA, 25 bp, Mus musculus
gtggtttgcaagctacaggccccaa

SEQ ID NO: 713851 - DNA, 25 bp, Mus musculus
gtggtttgcaaggtacaggccccaa

SEQ ID NO: 713852 - DNA, 25 bp, Mus musculus
gtggtttgcaccaaaaggctccagt

SEQ ID NO: 713853 - DNA, 25 bp, Mus musculus
gtggtttgcacctaaaggctccagt

SEQ ID NO: 713854 - DNA, 25 bp, Mus musculus
gtggtttgctgcagcatttatccca

SEQ ID NO: 713855 - DNA, 25 bp, Mus musculus
gtggtttgctgctgcatttatccca

SEQ ID NO: 713856 - DNA, 25 bp, Mus musculus
gtggtttgctttatactgctggatc

SEQ ID NO: 713857 - DNA, 25 bp, Mus musculus
gtggtttgctttttactgctggatc

SEQ ID NO: 713858 - DNA, 25 bp, Mus musculus
gtggtttggactcacagcttgatcc

SEQ ID NO: 713859 - DNA, 25 bp, Mus musculus
gtggtttggactgacagcttgatcc

SEQ ID NO: 713860 - DNA, 25 bp, Mus musculus
gtggtttggcaaaccagactacttt

SEQ ID NO: 713861 - DNA, 25 bp, Mus musculus
gtggtttggcaatccagactacttt

SEQ ID NO: 713862 - DNA, 25 bp, Mus musculus
gtggtttggtacctgcagctacttc

SEQ ID NO: 713863 - DNA, 25 bp, Mus musculus
gtggtttggtacgtgcagctacttc

SEQ ID NO: 713864 - DNA, 25 bp, Mus musculus
gtggtttgtcctaccagccacagct

SEQ ID NO: 713865 - DNA, 25 bp, Mus musculus
gtggtttgtccttccagccacagct

SEQ ID NO: 713866 - DNA, 25 bp, Mus musculus
gtggtttgtgttacagtcacttggg

SEQ ID NO: 713867 - DNA, 25 bp, Mus musculus
gtggtttgtgtttcagtcacttggg

SEQ ID NO: 713868 - DNA, 25 bp, Mus musculus
gtggtttgtttaccgtgggtccatc

SEQ ID NO: 713869 - DNA, 25 bp, Mus musculus
gtggtttgtttagcgtgggtccatc

SEQ ID NO: 713870 - DNA, 25 bp, Mus musculus
gtggttttaattcggtggcttctct

SEQ ID NO: 713871 - DNA, 25 bp, Mus musculus
gtggttttaattgggtggcttctct

SEQ ID NO: 713872 - DNA, 25 bp, Mus musculus
gtggttttacatactcctttcatta

SEQ ID NO: 713873 - DNA, 25 bp, Mus musculus
gtggttttacattctcctttcatta

SEQ ID NO: 713874 - DNA, 25 bp, Mus musculus
gtggttttagtacccagtagtcaca

SEQ ID NO: 713875 - DNA, 25 bp, Mus musculus
gtggttttagtagccagtagtcaca

SEQ ID NO: 713876 - DNA, 25 bp, Mus musculus
gtggttttcaagagtacatcttaca

SEQ ID NO: 713877 - DNA, 25 bp, Mus musculus
gtggttttcaagtgtacatcttaca

SEQ ID NO: 713878 - DNA, 25 bp, Mus musculus
gtggttttcacactacagcaagcat

SEQ ID NO: 713879 - DNA, 25 bp, Mus musculus
gtggttttcacagtacagcaagcat

SEQ ID NO: 713880 - DNA, 25 bp, Mus musculus
gtggttttcaccagttatactaaat

SEQ ID NO: 713881 - DNA, 25 bp, Mus musculus
gtggttttcacctgttatactaaat

SEQ ID NO: 713882 - DNA, 25 bp, Mus musculus
gtggttttcagcaactgcatttctt

SEQ ID NO: 713883 - DNA, 25 bp, Mus musculus
gtggttttcagctactgcatttctt

SEQ ID NO: 713884 - DNA, 25 bp, Mus musculus
gtggttttccagcagtactgtttta

SEQ ID NO: 713885 - DNA, 25 bp, Mus musculus
gtggttttccaggagtactgtttta

SEQ ID NO: 713886 - DNA, 25 bp, Mus musculus
gtggttttccgtagctttatgagca

SEQ ID NO: 713887 - DNA, 25 bp, Mus musculus
gtggttttccgttgctttatgagca

SEQ ID NO: 713888 - DNA, 25 bp, Mus musculus
gtggttttcctaaactttatatgag

SEQ ID NO: 713889 - DNA, 25 bp, Mus musculus
gtggttttcctatactttatatgag

SEQ ID NO: 713890 - DNA, 25 bp, Mus musculus
gtggttttccttaaacgatctgcag

SEQ ID NO: 713891 - DNA, 25 bp, Mus musculus
gtggttttcctttaacgatctgcag

SEQ ID NO: 713892 - DNA, 25 bp, Mus musculus
gtggttttctcaccacatagcttct

SEQ ID NO: 713893 - DNA, 25 bp, Mus musculus
gtggttttctcagcacatagcttct

SEQ ID NO: 713894 - DNA, 25 bp, Mus musculus
gtggttttctttcgaagcctgtatt

SEQ ID NO: 713895 - DNA, 25 bp, Mus musculus
gtggttttctttggaagcctgtatt

SEQ ID NO: 713896 - DNA, 25 bp, Mus musculus
gtggttttgccccaatcacctgcat

SEQ ID NO: 713897 - DNA, 25 bp, Mus musculus
gtggttttgcccgaatcacctgcat

SEQ ID NO: 713898 - DNA, 25 bp, Mus musculus
gtggttttggaaagaactctcctca

SEQ ID NO: 713899 - DNA, 25 bp, Mus musculus
gtggttttggaatgaactctcctca

SEQ ID NO: 713900 - DNA, 25 bp, Mus musculus
gtggttttgtcacagctgccaacaa

SEQ ID NO: 713901 - DNA, 25 bp, Mus musculus
gtggttttgtcagagctgccaacaa

SEQ ID NO: 713902 - DNA, 25 bp, Mus musculus
gtggttttgtgtataagccatgcac

SEQ ID NO: 713903 - DNA, 25 bp, Mus musculus
gtggttttgtgtttaagccatgcac

SEQ ID NO: 713904 - DNA, 25 bp, Mus musculus
gtggtttttcctcagtgcggacatt

SEQ ID NO: 713905 - DNA, 25 bp, Mus musculus
gtggtttttcctgagtgcggacatt

SEQ ID NO: 713906 - DNA, 25 bp, Mus musculus
gtggtttttcttacatggctcataa

SEQ ID NO: 713907 - DNA, 25 bp, Mus musculus
gtggtttttctttcatggctcataa

SEQ ID NO: 713908 - DNA, 25 bp, Mus musculus
gtggtttttgaacctcgctggacct

SEQ ID NO: 713909 - DNA, 25 bp, Mus musculus
gtggtttttgaagctcgctggacct

SEQ ID NO: 713910 - DNA, 25 bp, Mus musculus
gtggttttttgacaactacattcac

SEQ ID NO: 713911 - DNA, 25 bp, Mus musculus
gtggttttttgagaactacattcac

SEQ ID NO: 713912 - DNA, 25 bp, Mus musculus
gtgtaaaaccctaagtgatattcca

SEQ ID NO: 713913 - DNA, 25 bp, Mus musculus
gtgtaaaacccttagtgatattcca

SEQ ID NO: 713914 - DNA, 25 bp, Mus musculus
gtgtaaaacgccactggtgtctctc

SEQ ID NO: 713915 - DNA, 25 bp, Mus musculus
gtgtaaaacgcctctggtgtctctc

SEQ ID NO: 713916 - DNA, 25 bp, Mus musculus
gtgtaaaactctcttgtctcttctg

SEQ ID NO: 713917 - DNA, 25 bp, Mus musculus
gtgtaaaactctgttgtctcttctg

SEQ ID NO: 713918 - DNA, 25 bp, Mus musculus
gtgtaaaagatgcacagcctccctg

SEQ ID NO: 713919 - DNA, 25 bp, Mus musculus
gtgtaaaagatggacagcctccctg

SEQ ID NO: 713920 - DNA, 25 bp, Mus musculus
gtgtaaaatgtaacgctgctgtcca

SEQ ID NO: 713921 - DNA, 25 bp, Mus musculus
gtgtaaaatgtatcgctgctgtcca

SEQ ID NO: 713922 - DNA, 25 bp, Mus musculus
gtgtaaacaacgcattgtctctaaa

SEQ ID NO: 713923 - DNA, 25 bp, Mus musculus
gtgtaaacaacggattgtctctaaa

SEQ ID NO: 713924 - DNA, 25 bp, Mus musculus
gtgtaaacaatgactcccacaggcc

SEQ ID NO: 713925 - DNA, 25 bp, Mus musculus
gtgtaaacaatgtctcccacaggcc

SEQ ID NO: 713926 - DNA, 25 bp, Mus musculus
gtgtaaacactaacaggctgatgat

SEQ ID NO: 713927 - DNA, 25 bp, Mus musculus
gtgtaaacactatcaggctgatgat

SEQ ID NO: 713928 - DNA, 25 bp, Mus musculus
gtgtaaacactcacaaccctgattc

SEQ ID NO: 713929 - DNA, 25 bp, Mus musculus
gtgtaaacactctcaaccctgattc

SEQ ID NO: 713930 - DNA, 25 bp, Mus musculus
gtgtaaaccaaacccctgacagtcc

SEQ ID NO: 713931 - DNA, 25 bp, Mus musculus
gtgtaaaccaaagccctgacagtcc

SEQ ID NO: 713932 - DNA, 25 bp, Mus musculus
gtgtaaaccactcaactcatcttgt

SEQ ID NO: 713933 - DNA, 25 bp, Mus musculus
gtgtaaaccactgaactcatcttgt

SEQ ID NO: 713934 - DNA, 25 bp, Mus musculus
gtgtaaaccaggctgacctttagct

SEQ ID NO: 713935 - DNA, 25 bp, Mus musculus
gtgtaaaccagggtgacctttagct

SEQ ID NO: 713936 - DNA, 25 bp, Mus musculus
gtgtaaaccggacacactccaactg

SEQ ID NO: 713937 - DNA, 25 bp, Mus musculus
gtgtaaaccggagacactccaactg

SEQ ID NO: 713938 - DNA, 25 bp, Mus musculus
gtgtaaaccgttcacacctccactt

SEQ ID NO: 713939 - DNA, 25 bp, Mus musculus
gtgtaaaccgttgacacctccactt

SEQ ID NO: 713940 - DNA, 25 bp, Mus musculus
gtgtaaacctgacactccttggcct

SEQ ID NO: 713941 - DNA, 25 bp, Mus musculus
gtgtaaacctgagactccttggcct

SEQ ID NO: 713942 - DNA, 25 bp, Mus musculus
gtgtaaactaggcttctgcctttca

SEQ ID NO: 713943 - DNA, 25 bp, Mus musculus
gtgtaaactagggttctgcctttca

SEQ ID NO: 713944 - DNA, 25 bp, Mus musculus
gtgtaaactagtaatggcccaaata

SEQ ID NO: 713945 - DNA, 25 bp, Mus musculus
gtgtaaactagttatggcccaaata

SEQ ID NO: 713946 - DNA, 25 bp, Mus musculus
gtgtaaactattaattattctggat

SEQ ID NO: 713947 - DNA, 25 bp, Mus musculus
gtgtaaactatttattattctggat

SEQ ID NO: 713948 - DNA, 25 bp, Mus musculus
gtgtaaactcttcttgtgctcgaat

SEQ ID NO: 713949 - DNA, 25 bp, Mus musculus
gtgtaaactcttctttcctctgcag

SEQ ID NO: 713950 - DNA, 25 bp, Mus musculus
gtgtaaactcttgttgtgctcgaat

SEQ ID NO: 713951 - DNA, 25 bp, Mus musculus
gtgtaaactcttgtttcctctgcag

SEQ ID NO: 713952 - DNA, 25 bp, Mus musculus
gtgtaaactgaaaatgcttggactg

SEQ ID NO: 713953 - DNA, 25 bp, Mus musculus
gtgtaaactgaatatgcttggactg

SEQ ID NO: 713954 - DNA, 25 bp, Mus musculus
gtgtaaactgacacttccgataagc

SEQ ID NO: 713955 - DNA, 25 bp, Mus musculus
gtgtaaactgactcttccgataagc

SEQ ID NO: 713956 - DNA, 25 bp, Mus musculus
gtgtaaactgtgacctgtccccacc

SEQ ID NO: 713957 - DNA, 25 bp, Mus musculus
gtgtaaactgtgtcctgtccccacc

SEQ ID NO: 713958 - DNA, 25 bp, Mus musculus
gtgtaaactttcattgtcagatcta

SEQ ID NO: 713959 - DNA, 25 bp, Mus musculus
gtgtaaactttctttgtcagatcta

SEQ ID NO: 713960 - DNA, 25 bp, Mus musculus
gtgtaaagaaccattatgcatctcg

SEQ ID NO: 713961 - DNA, 25 bp, Mus musculus
gtgtaaagaacctttatgcatctcg

SEQ ID NO: 713962 - DNA, 25 bp, Mus musculus
gtgtaaagcagtagattaaccccaa

SEQ ID NO: 713963 - DNA, 25 bp, Mus musculus
gtgtaaagcagttgattaaccccaa

SEQ ID NO: 713964 - DNA, 25 bp, Mus musculus
gtgtaaagcattccaacaaaaggtt

SEQ ID NO: 713965 - DNA, 25 bp, Mus musculus
gtgtaaagcattgcaacaaaaggtt

SEQ ID NO: 713966 - DNA, 25 bp, Mus musculus
gtgtaaagccccattcccattatca

SEQ ID NO: 713967 - DNA, 25 bp, Mus musculus
gtgtaaagcccctttcccattatca

SEQ ID NO: 713968 - DNA, 25 bp, Mus musculus
gtgtaaagctccatcttacaacctc

SEQ ID NO: 713969 - DNA, 25 bp, Mus musculus
gtgtaaagctccttcttacaacctc

SEQ ID NO: 713970 - DNA, 25 bp, Mus musculus
gtgtaaaggttcctctggtgaactt

SEQ ID NO: 713971 - DNA, 25 bp, Mus musculus
gtgtaaaggttcgtctggtgaactt

SEQ ID NO: 713972 - DNA, 25 bp, Mus musculus
gtgtaaagtgtcacctgtttaggtg

SEQ ID NO: 713973 - DNA, 25 bp, Mus musculus
gtgtaaagtgtctcctgtttaggtg

SEQ ID NO: 713974 - DNA, 25 bp, Mus musculus
gtgtaaagttgccacaggaagatat

SEQ ID NO: 713975 - DNA, 25 bp, Mus musculus
gtgtaaagttgcgacaggaagatat

SEQ ID NO: 713976 - DNA, 25 bp, Mus musculus
gtgtaaataacacgccctgggcagt

SEQ ID NO: 713977 - DNA, 25 bp, Mus musculus
gtgtaaataacaggccctgggcagt

SEQ ID NO: 713978 - DNA, 25 bp, Mus musculus
gtgtaaataagcactttcccataaa

SEQ ID NO: 713979 - DNA, 25 bp, Mus musculus
gtgtaaataagcagctgcaattagt

SEQ ID NO: 713980 - DNA, 25 bp, Mus musculus
gtgtaaataagctctttcccataaa

SEQ ID NO: 713981 - DNA, 25 bp, Mus musculus
gtgtaaataagctgctgcaattagt

SEQ ID NO: 713982 - DNA, 25 bp, Mus musculus
gtgtaaatcacacctgctgatgtca

SEQ ID NO: 713983 - DNA, 25 bp, Mus musculus
gtgtaaatcacagctgctgatgtca

SEQ ID NO: 713984 - DNA, 25 bp, Mus musculus
gtgtaaatcactcttctagtaattt

SEQ ID NO: 713985 - DNA, 25 bp, Mus musculus
gtgtaaatcactgttctagtaattt

SEQ ID NO: 713986 - DNA, 25 bp, Mus musculus
gtgtaaatccatcatgtgctcaagg

SEQ ID NO: 713987 - DNA, 25 bp, Mus musculus
gtgtaaatccatgatgtgctcaagg

SEQ ID NO: 713988 - DNA, 25 bp, Mus musculus
gtgtaaatcccaatgactttccctc

SEQ ID NO: 713989 - DNA, 25 bp, Mus musculus
gtgtaaatcccattgactttccctc

SEQ ID NO: 713990 - DNA, 25 bp, Mus musculus
gtgtaaatgctaatttaaacactaa

SEQ ID NO: 713991 - DNA, 25 bp, Mus musculus
gtgtaaatgctattttaaacactaa

SEQ ID NO: 713992 - DNA, 25 bp, Mus musculus
gtgtaaatgtgcacagatgctgtct

SEQ ID NO: 713993 - DNA, 25 bp, Mus musculus
gtgtaaatgtgcagtacttatgttc

SEQ ID NO: 713994 - DNA, 25 bp, Mus musculus
gtgtaaatgtgctcagatgctgtct

SEQ ID NO: 713995 - DNA, 25 bp, Mus musculus
gtgtaaatgtgctgtacttatgttc

SEQ ID NO: 713996 - DNA, 25 bp, Mus musculus
gtgtaaattagacctttatccaaca

SEQ ID NO: 713997 - DNA, 25 bp, Mus musculus
gtgtaaattagagctttatccaaca

SEQ ID NO: 713998 - DNA, 25 bp, Mus musculus
gtgtaaattgtactttcccctccat

SEQ ID NO: 713999 - DNA, 25 bp, Mus musculus
gtgtaaattgtagtttcccctccat

SEQ ID NO: 714000 - DNA, 25 bp, Mus musculus
gtgtaacaacatcacatacttctga

SEQ ID NO: 714001 - DNA, 25 bp, Mus musculus
gtgtaacaacatgacatacttctga

SEQ ID NO: 714002 - DNA, 25 bp, Mus musculus
gtgtaacaattcaggctgtgcctca

SEQ ID NO: 714003 - DNA, 25 bp, Mus musculus
gtgtaacaattctggctgtgcctca

SEQ ID NO: 714004 - DNA, 25 bp, Mus musculus
gtgtaacacgagcatctgcagaatt

SEQ ID NO: 714005 - DNA, 25 bp, Mus musculus
gtgtaacacgaggatctgcagaatt

SEQ ID NO: 714006 - DNA, 25 bp, Mus musculus
gtgtaacacgctctacctggctttt

SEQ ID NO: 714007 - DNA, 25 bp, Mus musculus
gtgtaacacgctgtacctggctttt

SEQ ID NO: 714008 - DNA, 25 bp, Mus musculus
gtgtaacactcaactctttagcacc

SEQ ID NO: 714009 - DNA, 25 bp, Mus musculus
gtgtaacactcatctctttagcacc

SEQ ID NO: 714010 - DNA, 25 bp, Mus musculus
gtgtaacacttaataacaattcagg

SEQ ID NO: 714011 - DNA, 25 bp, Mus musculus
gtgtaacacttattaacaattcagg

SEQ ID NO: 714012 - DNA, 25 bp, Mus musculus
gtgtaacagatacaaggccttgggt

SEQ ID NO: 714013 - DNA, 25 bp, Mus musculus
gtgtaacagatagaaggccttgggt

SEQ ID NO: 714014 - DNA, 25 bp, Mus musculus
gtgtaacagcacaagtatgttccta

SEQ ID NO: 714015 - DNA, 25 bp, Mus musculus
gtgtaacagcactagtatgttccta

SEQ ID NO: 714016 - DNA, 25 bp, Mus musculus
gtgtaacagcttcggaggtattcat

SEQ ID NO: 714017 - DNA, 25 bp, Mus musculus
gtgtaacagcttgggaggtattcat

SEQ ID NO: 714018 - DNA, 25 bp, Mus musculus
gtgtaacaggaaacagggtcaggca

SEQ ID NO: 714019 - DNA, 25 bp, Mus musculus
gtgtaacaggaatcagggtcaggca

SEQ ID NO: 714020 - DNA, 25 bp, Mus musculus
gtgtaacagtgcattgaaaccaaaa

SEQ ID NO: 714021 - DNA, 25 bp, Mus musculus
gtgtaacagtgcatttgaatccctt

SEQ ID NO: 714022 - DNA, 25 bp, Mus musculus
gtgtaacagtgctttgaaaccaaaa

SEQ ID NO: 714023 - DNA, 25 bp, Mus musculus
gtgtaacagtgcttttgaatccctt

SEQ ID NO: 714024 - DNA, 25 bp, Mus musculus
gtgtaacagttaattccctgcctgg

SEQ ID NO: 714025 - DNA, 25 bp, Mus musculus
gtgtaacagttatttccctgcctgg

SEQ ID NO: 714026 - DNA, 25 bp, Mus musculus
gtgtaaccaatacttcttgtgtgct

SEQ ID NO: 714027 - DNA, 25 bp, Mus musculus
gtgtaaccaatagttcttgtgtgct

SEQ ID NO: 714028 - DNA, 25 bp, Mus musculus
gtgtaaccacagatttcctatttat

SEQ ID NO: 714029 - DNA, 25 bp, Mus musculus
gtgtaaccacagttttcctatttat

SEQ ID NO: 714030 - DNA, 25 bp, Mus musculus
gtgtaaccacatcgcagaccactca

SEQ ID NO: 714031 - DNA, 25 bp, Mus musculus
gtgtaaccacatggcagaccactca

SEQ ID NO: 714032 - DNA, 25 bp, Mus musculus
gtgtaaccacggctctagagctctt

SEQ ID NO: 714033 - DNA, 25 bp, Mus musculus
gtgtaaccacgggtctagagctctt

SEQ ID NO: 714034 - DNA, 25 bp, Mus musculus
gtgtaaccatacactggtaccggca

SEQ ID NO: 714035 - DNA, 25 bp, Mus musculus
gtgtaaccatactctggtaccggca

SEQ ID NO: 714036 - DNA, 25 bp, Mus musculus
gtgtaaccatcaaatcaacagctca

SEQ ID NO: 714037 - DNA, 25 bp, Mus musculus
gtgtaaccatcatatcaacagctca

SEQ ID NO: 714038 - DNA, 25 bp, Mus musculus
gtgtaacccaaccattgtatatgaa

SEQ ID NO: 714039 - DNA, 25 bp, Mus musculus
gtgtaacccaacgattgtatatgaa

SEQ ID NO: 714040 - DNA, 25 bp, Mus musculus
gtgtaacctgctccagaccagacca

SEQ ID NO: 714041 - DNA, 25 bp, Mus musculus
gtgtaacctgctgcagaccagacca

SEQ ID NO: 714042 - DNA, 25 bp, Mus musculus
gtgtaacctggtcgtcataaagtgt

SEQ ID NO: 714043 - DNA, 25 bp, Mus musculus
gtgtaacctggtggtcataaagtgt

SEQ ID NO: 714044 - DNA, 25 bp, Mus musculus
gtgtaactaaatctccctccaggta

SEQ ID NO: 714045 - DNA, 25 bp, Mus musculus
gtgtaactaaatgtccctccaggta

SEQ ID NO: 714046 - DNA, 25 bp, Mus musculus
gtgtaactaatgactcttgtgtatt

SEQ ID NO: 714047 - DNA, 25 bp, Mus musculus
gtgtaactaatgtctcttgtgtatt

SEQ ID NO: 714048 - DNA, 25 bp, Mus musculus
gtgtaactccaaataagctccctat

SEQ ID NO: 714049 - DNA, 25 bp, Mus musculus
gtgtaactccaattaagctccctat

SEQ ID NO: 714050 - DNA, 25 bp, Mus musculus
gtgtaactccgcaggaactgggcat

SEQ ID NO: 714051 - DNA, 25 bp, Mus musculus
gtgtaactccgctggaactgggcat

SEQ ID NO: 714052 - DNA, 25 bp, Mus musculus
gtgtaactctgcatgaggccttggc

SEQ ID NO: 714053 - DNA, 25 bp, Mus musculus
gtgtaactctgcttgaggccttggc

SEQ ID NO: 714054 - DNA, 25 bp, Mus musculus
gtgtaactctgtatggtgcaccatg

SEQ ID NO: 714055 - DNA, 25 bp, Mus musculus
gtgtaactctgtttggtgcaccatg

SEQ ID NO: 714056 - DNA, 25 bp, Mus musculus
gtgtaactgcaaaagtttctgatgg

SEQ ID NO: 714057 - DNA, 25 bp, Mus musculus
gtgtaactgcaatagtttctgatgg

SEQ ID NO: 714058 - DNA, 25 bp, Mus musculus
gtgtaactgctaaacaaattccacc

SEQ ID NO: 714059 - DNA, 25 bp, Mus musculus
gtgtaactgctatacaaattccacc

SEQ ID NO: 714060 - DNA, 25 bp, Mus musculus
gtgtaactgctgcattcttataaat

SEQ ID NO: 714061 - DNA, 25 bp, Mus musculus
gtgtaactgctggattcttataaat

SEQ ID NO: 714062 - DNA, 25 bp, Mus musculus
gtgtaactggacagttctacacatg

SEQ ID NO: 714063 - DNA, 25 bp, Mus musculus
gtgtaactggactgttctacacatg

SEQ ID NO: 714064 - DNA, 25 bp, Mus musculus
gtgtaactgggcagcatggcgttcc

SEQ ID NO: 714065 - DNA, 25 bp, Mus musculus
gtgtaactgggctgcatggcgttcc

SEQ ID NO: 714066 - DNA, 25 bp, Mus musculus
gtgtaactggtaaaatactgtgact

SEQ ID NO: 714067 - DNA, 25 bp, Mus musculus
gtgtaactggtataatactgtgact

SEQ ID NO: 714068 - DNA, 25 bp, Mus musculus
gtgtaactggtcacaaggcctaatt

SEQ ID NO: 714069 - DNA, 25 bp, Mus musculus
gtgtaactggtctcaaggcctaatt

SEQ ID NO: 714070 - DNA, 25 bp, Mus musculus
gtgtaactgttgaaattcctccttt

SEQ ID NO: 714071 - DNA, 25 bp, Mus musculus
gtgtaactgttgcttactgccaggc

SEQ ID NO: 714072 - DNA, 25 bp, Mus musculus
gtgtaactgttggttactgccaggc

SEQ ID NO: 714073 - DNA, 25 bp, Mus musculus
gtgtaactgttgtaattcctccttt

SEQ ID NO: 714074 - DNA, 25 bp, Mus musculus
gtgtaacttaagaggctgcagaacc

SEQ ID NO: 714075 - DNA, 25 bp, Mus musculus
gtgtaacttaagtggctgcagaacc

SEQ ID NO: 714076 - DNA, 25 bp, Mus musculus
gtgtaacttactagtggccacacct

SEQ ID NO: 714077 - DNA, 25 bp, Mus musculus
gtgtaacttacttgtggccacacct

SEQ ID NO: 714078 - DNA, 25 bp, Mus musculus
gtgtaacttagcaattgctgtcgct

SEQ ID NO: 714079 - DNA, 25 bp, Mus musculus
gtgtaacttagctattgctgtcgct

SEQ ID NO: 714080 - DNA, 25 bp, Mus musculus
gtgtaacttatgagcctggcatgga

SEQ ID NO: 714081 - DNA, 25 bp, Mus musculus
gtgtaacttatgtgcctggcatgga

SEQ ID NO: 714082 - DNA, 25 bp, Mus musculus
gtgtaacttcctaaccatggacagt

SEQ ID NO: 714083 - DNA, 25 bp, Mus musculus
gtgtaacttcctccaaacatcatag

SEQ ID NO: 714084 - DNA, 25 bp, Mus musculus
gtgtaacttcctgcaaacatcatag

SEQ ID NO: 714085 - DNA, 25 bp, Mus musculus
gtgtaacttccttaccatggacagt

SEQ ID NO: 714086 - DNA, 25 bp, Mus musculus
gtgtaacttctgacacaggcaaatg

SEQ ID NO: 714087 - DNA, 25 bp, Mus musculus
gtgtaacttctgtcacaggcaaatg

SEQ ID NO: 714088 - DNA, 25 bp, Mus musculus
gtgtaacttggaactgcagtattgc

SEQ ID NO: 714089 - DNA, 25 bp, Mus musculus
gtgtaacttggatctgcagtattgc

SEQ ID NO: 714090 - DNA, 25 bp, Mus musculus
gtgtaacttgtaaattactgtttct

SEQ ID NO: 714091 - DNA, 25 bp, Mus musculus
gtgtaacttgtatattactgtttct

SEQ ID NO: 714092 - DNA, 25 bp, Mus musculus
gtgtaagaaactccacatccgtgtg

SEQ ID NO: 714093 - DNA, 25 bp, Mus musculus
gtgtaagaaactgcacatccgtgtg

SEQ ID NO: 714094 - DNA, 25 bp, Mus musculus
gtgtaagacaaactgactaaatcct

SEQ ID NO: 714095 - DNA, 25 bp, Mus musculus
gtgtaagacaaagtgactaaatcct

SEQ ID NO: 714096 - DNA, 25 bp, Mus musculus
gtgtaagcacacataattaacaaat

SEQ ID NO: 714097 - DNA, 25 bp, Mus musculus
gtgtaagcacacttaattaacaaat

SEQ ID NO: 714098 - DNA, 25 bp, Mus musculus
gtgtaagcacatctacatgagtgtg

SEQ ID NO: 714099 - DNA, 25 bp, Mus musculus
gtgtaagcacatgtacatgagtgtg

SEQ ID NO: 714100 - DNA, 25 bp, Mus musculus
gtgtaagcactgagtctaagctgca

SEQ ID NO: 714101 - DNA, 25 bp, Mus musculus
gtgtaagcactgtgtctaagctgca

SEQ ID NO: 714102 - DNA, 25 bp, Mus musculus
gtgtaagcagatagacccattcctc

SEQ ID NO: 714103 - DNA, 25 bp, Mus musculus
gtgtaagcagattgacccattcctc

SEQ ID NO: 714104 - DNA, 25 bp, Mus musculus
gtgtaagcatgccacgttctcagag

SEQ ID NO: 714105 - DNA, 25 bp, Mus musculus
gtgtaagcatgcgacgttctcagag

SEQ ID NO: 714106 - DNA, 25 bp, Mus musculus
gtgtaagccaccattcattgatttt

SEQ ID NO: 714107 - DNA, 25 bp, Mus musculus
gtgtaagccacctttcattgatttt

SEQ ID NO: 714108 - DNA, 25 bp, Mus musculus
gtgtaagccatactcgtgtaacatt

SEQ ID NO: 714109 - DNA, 25 bp, Mus musculus
gtgtaagccatagtcgtgtaacatt

SEQ ID NO: 714110 - DNA, 25 bp, Mus musculus
gtgtaagccatgctaagctcgctgt

SEQ ID NO: 714111 - DNA, 25 bp, Mus musculus
gtgtaagccatgcttgaacctgtat

SEQ ID NO: 714112 - DNA, 25 bp, Mus musculus
gtgtaagccatggtaagctcgctgt

SEQ ID NO: 714113 - DNA, 25 bp, Mus musculus
gtgtaagccatggttgaacctgtat

SEQ ID NO: 714114 - DNA, 25 bp, Mus musculus
gtgtaagccccaagtaaggtgaata

SEQ ID NO: 714115 - DNA, 25 bp, Mus musculus
gtgtaagccccatgtaaggtgaata

SEQ ID NO: 714116 - DNA, 25 bp, Mus musculus
gtgtaagcccctattcaagataaat

SEQ ID NO: 714117 - DNA, 25 bp, Mus musculus
gtgtaagccccttttcaagataaat

SEQ ID NO: 714118 - DNA, 25 bp, Mus musculus
gtgtaagccctacccagtgatctga

SEQ ID NO: 714119 - DNA, 25 bp, Mus musculus
gtgtaagccctagccagtgatctga

SEQ ID NO: 714120 - DNA, 25 bp, Mus musculus
gtgtaagcctaactagcttttctgg

SEQ ID NO: 714121 - DNA, 25 bp, Mus musculus
gtgtaagcctaagtagcttttctgg

SEQ ID NO: 714122 - DNA, 25 bp, Mus musculus
gtgtaagcctacatttgactggatg

SEQ ID NO: 714123 - DNA, 25 bp, Mus musculus
gtgtaagcctacttttgactggatg

SEQ ID NO: 714124 - DNA, 25 bp, Mus musculus
gtgtaagctcaactctaaatgtttt

SEQ ID NO: 714125 - DNA, 25 bp, Mus musculus
gtgtaagctcaagtctaaatgtttt

SEQ ID NO: 714126 - DNA, 25 bp, Mus musculus
gtgtaagcttttaatactgatatct

SEQ ID NO: 714127 - DNA, 25 bp, Mus musculus
gtgtaagctttttatactgatatct

SEQ ID NO: 714128 - DNA, 25 bp, Mus musculus
gtgtaaggaggcatctgattttctg

SEQ ID NO: 714129 - DNA, 25 bp, Mus musculus
gtgtaaggaggcttctgattttctg

SEQ ID NO: 714130 - DNA, 25 bp, Mus musculus
gtgtaaggctataggcttagtcact

SEQ ID NO: 714131 - DNA, 25 bp, Mus musculus
gtgtaaggctattggcttagtcact

SEQ ID NO: 714132 - DNA, 25 bp, Mus musculus
gtgtaagggcggatgctccgaaata

SEQ ID NO: 714133 - DNA, 25 bp, Mus musculus
gtgtaagggcggttgctccgaaata

SEQ ID NO: 714134 - DNA, 25 bp, Mus musculus
gtgtaagtaactcatgtaaattctg

SEQ ID NO: 714135 - DNA, 25 bp, Mus musculus
gtgtaagtaactgatgtaaattctg

SEQ ID NO: 714136 - DNA, 25 bp, Mus musculus
gtgtaagtacagactcagtgtgctg

SEQ ID NO: 714137 - DNA, 25 bp, Mus musculus
gtgtaagtacagtctcagtgtgctg

SEQ ID NO: 714138 - DNA, 25 bp, Mus musculus
gtgtaagtatcaacatttgtggcaa

SEQ ID NO: 714139 - DNA, 25 bp, Mus musculus
gtgtaagtatcatcatttgtggcaa

SEQ ID NO: 714140 - DNA, 25 bp, Mus musculus
gtgtaagtcacactagcctagagtc

SEQ ID NO: 714141 - DNA, 25 bp, Mus musculus
gtgtaagtcacagtagcctagagtc

SEQ ID NO: 714142 - DNA, 25 bp, Mus musculus
gtgtaagtcactatctttctcaaat

SEQ ID NO: 714143 - DNA, 25 bp, Mus musculus
gtgtaagtcactttctttctcaaat

SEQ ID NO: 714144 - DNA, 25 bp, Mus musculus
gtgtaagtctggctttgaccctcga

SEQ ID NO: 714145 - DNA, 25 bp, Mus musculus
gtgtaagtctgggtttgaccctcga

SEQ ID NO: 714146 - DNA, 25 bp, Mus musculus
gtgtaagtgacaagatgtggccaaa

SEQ ID NO: 714147 - DNA, 25 bp, Mus musculus
gtgtaagtgacatgatgtggccaaa

SEQ ID NO: 714148 - DNA, 25 bp, Mus musculus
gtgtaagtgccacagccgctcacag

SEQ ID NO: 714149 - DNA, 25 bp, Mus musculus
gtgtaagtgccagagccgctcacag

SEQ ID NO: 714150 - DNA, 25 bp, Mus musculus
gtgtaagttacactagtgcagggta

SEQ ID NO: 714151 - DNA, 25 bp, Mus musculus
gtgtaagttacagtagtgcagggta

SEQ ID NO: 714152 - DNA, 25 bp, Mus musculus
gtgtaagttctgctaactttcactg

SEQ ID NO: 714153 - DNA, 25 bp, Mus musculus
gtgtaagttctggtaactttcactg

SEQ ID NO: 714154 - DNA, 25 bp, Mus musculus
gtgtaagttgttaccattgttgaac

SEQ ID NO: 714155 - DNA, 25 bp, Mus musculus
gtgtaagttgtttccattgttgaac

SEQ ID NO: 714156 - DNA, 25 bp, Mus musculus
gtgtaatatcctactctattcctga

SEQ ID NO: 714157 - DNA, 25 bp, Mus musculus
gtgtaatatcctattctgaaagtca

SEQ ID NO: 714158 - DNA, 25 bp, Mus musculus
gtgtaatatcctcccattagggtct

SEQ ID NO: 714159 - DNA, 25 bp, Mus musculus
gtgtaatatcctgccattagggtct

SEQ ID NO: 714160 - DNA, 25 bp, Mus musculus
gtgtaatatccttctctattcctga

SEQ ID NO: 714161 - DNA, 25 bp, Mus musculus
gtgtaatatccttttctgaaagtca

SEQ ID NO: 714162 - DNA, 25 bp, Mus musculus
gtgtaatatctccacagtctgaata

SEQ ID NO: 714163 - DNA, 25 bp, Mus musculus
gtgtaatatctcgacagtctgaata

SEQ ID NO: 714164 - DNA, 25 bp, Mus musculus
gtgtaatattctctacctgttctgt

SEQ ID NO: 714165 - DNA, 25 bp, Mus musculus
gtgtaatattctgtacctgttctgt

SEQ ID NO: 714166 - DNA, 25 bp, Mus musculus
gtgtaatcaaatcacttcccatgga

SEQ ID NO: 714167 - DNA, 25 bp, Mus musculus
gtgtaatcaaatgacttcccatgga

SEQ ID NO: 714168 - DNA, 25 bp, Mus musculus
gtgtaatcagacaagtttgtcccat

SEQ ID NO: 714169 - DNA, 25 bp, Mus musculus
gtgtaatcagactagtttgtcccat

SEQ ID NO: 714170 - DNA, 25 bp, Mus musculus
gtgtaatcagttctttagccttttc

SEQ ID NO: 714171 - DNA, 25 bp, Mus musculus
gtgtaatcagttgtttagccttttc

SEQ ID NO: 714172 - DNA, 25 bp, Mus musculus
gtgtaatcattgaagtcatgggtta

SEQ ID NO: 714173 - DNA, 25 bp, Mus musculus
gtgtaatcattgtagtcatgggtta

SEQ ID NO: 714174 - DNA, 25 bp, Mus musculus
gtgtaatccctactatgcctcaaat

SEQ ID NO: 714175 - DNA, 25 bp, Mus musculus
gtgtaatccctagtatgcctcaaat

SEQ ID NO: 714176 - DNA, 25 bp, Mus musculus
gtgtaatccgatcatcacaaaactg

SEQ ID NO: 714177 - DNA, 25 bp, Mus musculus
gtgtaatccgatgatcacaaaactg

SEQ ID NO: 714178 - DNA, 25 bp, Mus musculus
gtgtaatctcgtcttcagctacata

SEQ ID NO: 714179 - DNA, 25 bp, Mus musculus
gtgtaatctcgtgttcagctacata

SEQ ID NO: 714180 - DNA, 25 bp, Mus musculus
gtgtaatgaagacttgtgacacctg

SEQ ID NO: 714181 - DNA, 25 bp, Mus musculus
gtgtaatgaagagttgtgacacctg

SEQ ID NO: 714182 - DNA, 25 bp, Mus musculus
gtgtaatgacttcctaacctttgaa

SEQ ID NO: 714183 - DNA, 25 bp, Mus musculus
gtgtaatgacttgctaacctttgaa

SEQ ID NO: 714184 - DNA, 25 bp, Mus musculus
gtgtaatgcccaaaattagcccgta

SEQ ID NO: 714185 - DNA, 25 bp, Mus musculus
gtgtaatgcccataattagcccgta

SEQ ID NO: 714186 - DNA, 25 bp, Mus musculus
gtgtaatgccccaccagccaagcag

SEQ ID NO: 714187 - DNA, 25 bp, Mus musculus
gtgtaatgcccctccagccaagcag

SEQ ID NO: 714188 - DNA, 25 bp, Mus musculus
gtgtaatgggccagcatgcgtgcac

SEQ ID NO: 714189 - DNA, 25 bp, Mus musculus
gtgtaatgggcctgcatgcgtgcac

SEQ ID NO: 714190 - DNA, 25 bp, Mus musculus
gtgtaatgggctatataaagtctta

SEQ ID NO: 714191 - DNA, 25 bp, Mus musculus
gtgtaatgggctttataaagtctta

SEQ ID NO: 714192 - DNA, 25 bp, Mus musculus
gtgtaatggtacctctagcaactaa

SEQ ID NO: 714193 - DNA, 25 bp, Mus musculus
gtgtaatggtacgtctagcaactaa

SEQ ID NO: 714194 - DNA, 25 bp, Mus musculus
gtgtaatggttcctcccaccctgaa

SEQ ID NO: 714195 - DNA, 25 bp, Mus musculus
gtgtaatggttcgtcccaccctgaa

SEQ ID NO: 714196 - DNA, 25 bp, Mus musculus
gtgtaatgttatatactgtgtccaa

SEQ ID NO: 714197 - DNA, 25 bp, Mus musculus
gtgtaatgttatttactgtgtccaa

SEQ ID NO: 714198 - DNA, 25 bp, Mus musculus
gtgtaatgtttcagattgcaaggtg

SEQ ID NO: 714199 - DNA, 25 bp, Mus musculus
gtgtaatgtttctgattgcaaggtg

SEQ ID NO: 714200 - DNA, 25 bp, Mus musculus
gtgtaattaaacctctatgcacaaa

SEQ ID NO: 714201 - DNA, 25 bp, Mus musculus
gtgtaattaaacgtctatgcacaaa

SEQ ID NO: 714202 - DNA, 25 bp, Mus musculus
gtgtaattaagcatccaggatcact

SEQ ID NO: 714203 - DNA, 25 bp, Mus musculus
gtgtaattaagcttccaggatcact

SEQ ID NO: 714204 - DNA, 25 bp, Mus musculus
gtgtaattatcaaacatcccacagg

SEQ ID NO: 714205 - DNA, 25 bp, Mus musculus
gtgtaattatcatacatcccacagg

SEQ ID NO: 714206 - DNA, 25 bp, Mus musculus
gtgtaattctgcatccctaagggaa

SEQ ID NO: 714207 - DNA, 25 bp, Mus musculus
gtgtaattctgcttccctaagggaa

SEQ ID NO: 714208 - DNA, 25 bp, Mus musculus
gtgtaattgctacattctctgatgt

SEQ ID NO: 714209 - DNA, 25 bp, Mus musculus
gtgtaattgctagattctctgatgt

SEQ ID NO: 714210 - DNA, 25 bp, Mus musculus
gtgtaattgctgctcttgccaagtt

SEQ ID NO: 714211 - DNA, 25 bp, Mus musculus
gtgtaattgctggtcttgccaagtt

SEQ ID NO: 714212 - DNA, 25 bp, Mus musculus
gtgtaattggccacattagacagtg

SEQ ID NO: 714213 - DNA, 25 bp, Mus musculus
gtgtaattggcctcattagacagtg

SEQ ID NO: 714214 - DNA, 25 bp, Mus musculus
gtgtaattgtcaatctccgtaaaca

SEQ ID NO: 714215 - DNA, 25 bp, Mus musculus
gtgtaattgtcattctccgtaaaca

SEQ ID NO: 714216 - DNA, 25 bp, Mus musculus
gtgtaatttccaacgtatgtcctaa

SEQ ID NO: 714217 - DNA, 25 bp, Mus musculus
gtgtaatttccatcgtatgtcctaa

SEQ ID NO: 714218 - DNA, 25 bp, Mus musculus
gtgtaatttctgcacaggactctgt

SEQ ID NO: 714219 - DNA, 25 bp, Mus musculus
gtgtaatttctggacaggactctgt

SEQ ID NO: 714220 - DNA, 25 bp, Mus musculus
gtgtaattttccatcacgctatatt

SEQ ID NO: 714221 - DNA, 25 bp, Mus musculus
gtgtaattttccttcacgctatatt

SEQ ID NO: 714222 - DNA, 25 bp, Mus musculus
gtgtacaaaaccatttggcatgttc

SEQ ID NO: 714223 - DNA, 25 bp, Mus musculus
gtgtacaaaaccttttggcatgttc

SEQ ID NO: 714224 - DNA, 25 bp, Mus musculus
gtgtacaaacaccagacatccagga

SEQ ID NO: 714225 - DNA, 25 bp, Mus musculus
gtgtacaaacacgagacatccagga

SEQ ID NO: 714226 - DNA, 25 bp, Mus musculus
gtgtacaaaccacggcaccggtgtg

SEQ ID NO: 714227 - DNA, 25 bp, Mus musculus
gtgtacaaaccactgcttttggcta

SEQ ID NO: 714228 - DNA, 25 bp, Mus musculus
gtgtacaaaccagggcaccggtgtg

SEQ ID NO: 714229 - DNA, 25 bp, Mus musculus
gtgtacaaaccagtgcttttggcta

SEQ ID NO: 714230 - DNA, 25 bp, Mus musculus
gtgtacaaagcgcatgctctaccat

SEQ ID NO: 714231 - DNA, 25 bp, Mus musculus
gtgtacaaagcggatgctctaccat

SEQ ID NO: 714232 - DNA, 25 bp, Mus musculus
gtgtacaaagctagcgcgcagcctg

SEQ ID NO: 714233 - DNA, 25 bp, Mus musculus
gtgtacaaagcttgcgcgcagcctg

SEQ ID NO: 714234 - DNA, 25 bp, Mus musculus
gtgtacaaaggaccactggcttccc

SEQ ID NO: 714235 - DNA, 25 bp, Mus musculus
gtgtacaaaggagcactggcttccc

SEQ ID NO: 714236 - DNA, 25 bp, Mus musculus
gtgtacaaaggcatgcttggcatat

SEQ ID NO: 714237 - DNA, 25 bp, Mus musculus
gtgtacaaaggcttgcttggcatat

SEQ ID NO: 714238 - DNA, 25 bp, Mus musculus
gtgtacaaatctaattccgtttctg

SEQ ID NO: 714239 - DNA, 25 bp, Mus musculus
gtgtacaaatcttattccgtttctg

SEQ ID NO: 714240 - DNA, 25 bp, Mus musculus
gtgtacaaatgtacccttagaccat

SEQ ID NO: 714241 - DNA, 25 bp, Mus musculus
gtgtacaaatgttcccttagaccat

SEQ ID NO: 714242 - DNA, 25 bp, Mus musculus
gtgtacaacaatccggttttcaccc

SEQ ID NO: 714243 - DNA, 25 bp, Mus musculus
gtgtacaacaatgcggttttcaccc

SEQ ID NO: 714244 - DNA, 25 bp, Mus musculus
gtgtacaaccttaaaaacatcaatg

SEQ ID NO: 714245 - DNA, 25 bp, Mus musculus
gtgtacaacctttaaaacatcaatg

SEQ ID NO: 714246 - DNA, 25 bp, Mus musculus
gtgtacaagaccagagcttcatgga

SEQ ID NO: 714247 - DNA, 25 bp, Mus musculus
gtgtacaagacctgagcttcatgga

SEQ ID NO: 714248 - DNA, 25 bp, Mus musculus
gtgtacaagcatcaacatcctgggt

SEQ ID NO: 714249 - DNA, 25 bp, Mus musculus
gtgtacaagcatgaacatcctgggt

SEQ ID NO: 714250 - DNA, 25 bp, Mus musculus
gtgtacaaggccatgatttccagcc

SEQ ID NO: 714251 - DNA, 25 bp, Mus musculus
gtgtacaaggccttgatttccagcc

SEQ ID NO: 714252 - DNA, 25 bp, Mus musculus
gtgtacaagggcagtgtgaacaaca

SEQ ID NO: 714253 - DNA, 25 bp, Mus musculus
gtgtacaagggctgtgtgaacaaca

SEQ ID NO: 714254 - DNA, 25 bp, Mus musculus
gtgtacaatcacaatctctccatga

SEQ ID NO: 714255 - DNA, 25 bp, Mus musculus
gtgtacaatcactatctctccatga

SEQ ID NO: 714256 - DNA, 25 bp, Mus musculus
gtgtacaatctgatcccacattaaa

SEQ ID NO: 714257 - DNA, 25 bp, Mus musculus
gtgtacaatctgttcccacattaaa

SEQ ID NO: 714258 - DNA, 25 bp, Mus musculus
gtgtacaattgaaccacatttgctg

SEQ ID NO: 714259 - DNA, 25 bp, Mus musculus
gtgtacaattgatccacatttgctg

SEQ ID NO: 714260 - DNA, 25 bp, Mus musculus
gtgtacacacaaccagccaaacgaa

SEQ ID NO: 714261 - DNA, 25 bp, Mus musculus
gtgtacacacaagcagccaaacgaa

SEQ ID NO: 714262 - DNA, 25 bp, Mus musculus
gtgtacacacatccaaattaagtaa

SEQ ID NO: 714263 - DNA, 25 bp, Mus musculus
gtgtacacacatgcaaattaagtaa

SEQ ID NO: 714264 - DNA, 25 bp, Mus musculus
gtgtacacactcagccagcaggtag

SEQ ID NO: 714265 - DNA, 25 bp, Mus musculus
gtgtacacactcatgaacaaagacg

SEQ ID NO: 714266 - DNA, 25 bp, Mus musculus
gtgtacacactctgccagcaggtag

SEQ ID NO: 714267 - DNA, 25 bp, Mus musculus
gtgtacacactcttgaacaaagacg

SEQ ID NO: 714268 - DNA, 25 bp, Mus musculus
gtgtacacagacatttgtttcactt

SEQ ID NO: 714269 - DNA, 25 bp, Mus musculus
gtgtacacagacttttgtttcactt

SEQ ID NO: 714270 - DNA, 25 bp, Mus musculus
gtgtacacagatctggccacatctc

SEQ ID NO: 714271 - DNA, 25 bp, Mus musculus
gtgtacacagatgtggccacatctc

SEQ ID NO: 714272 - DNA, 25 bp, Mus musculus
gtgtacacataacatactgttcgtt

SEQ ID NO: 714273 - DNA, 25 bp, Mus musculus
gtgtacacataagatactgttcgtt

SEQ ID NO: 714274 - DNA, 25 bp, Mus musculus
gtgtacacatctcggtgcagcggca

SEQ ID NO: 714275 - DNA, 25 bp, Mus musculus
gtgtacacatctgggtgcagcggca

SEQ ID NO: 714276 - DNA, 25 bp, Mus musculus
gtgtacacatgcaactagactgttt

SEQ ID NO: 714277 - DNA, 25 bp, Mus musculus
gtgtacacatgctactagactgttt

SEQ ID NO: 714278 - DNA, 25 bp, Mus musculus
gtgtacacattcatcaggaggccag

SEQ ID NO: 714279 - DNA, 25 bp, Mus musculus
gtgtacacattcttcaggaggccag

SEQ ID NO: 714280 - DNA, 25 bp, Mus musculus
gtgtacacatttcaccagaactgca

SEQ ID NO: 714281 - DNA, 25 bp, Mus musculus
gtgtacacatttgaccagaactgca

SEQ ID NO: 714282 - DNA, 25 bp, Mus musculus
gtgtacaccaatactcctgtatatt

SEQ ID NO: 714283 - DNA, 25 bp, Mus musculus
gtgtacaccaattctcctgtatatt

SEQ ID NO: 714284 - DNA, 25 bp, Mus musculus
gtgtacaccagtatttggcattcag

SEQ ID NO: 714285 - DNA, 25 bp, Mus musculus
gtgtacaccagtttttggcattcag

SEQ ID NO: 714286 - DNA, 25 bp, Mus musculus
gtgtacaccgttactcagagtggaa

SEQ ID NO: 714287 - DNA, 25 bp, Mus musculus
gtgtacaccgtttctcagagtggaa

SEQ ID NO: 714288 - DNA, 25 bp, Mus musculus
gtgtacactacaagtttttctaata

SEQ ID NO: 714289 - DNA, 25 bp, Mus musculus
gtgtacactacatgtttttctaata

SEQ ID NO: 714290 - DNA, 25 bp, Mus musculus
gtgtacactgatcagttttggcaaa

SEQ ID NO: 714291 - DNA, 25 bp, Mus musculus
gtgtacactgatgagttttggcaaa

SEQ ID NO: 714292 - DNA, 25 bp, Mus musculus
gtgtacacttaaagcggtgcccttc

SEQ ID NO: 714293 - DNA, 25 bp, Mus musculus
gtgtacacttaatgcggtgcccttc

SEQ ID NO: 714294 - DNA, 25 bp, Mus musculus
gtgtacagaacacaccaagcgcaag

SEQ ID NO: 714295 - DNA, 25 bp, Mus musculus
gtgtacagaacagaccaagcgcaag

SEQ ID NO: 714296 - DNA, 25 bp, Mus musculus
gtgtacagatttaatcatcccaacc

SEQ ID NO: 714297 - DNA, 25 bp, Mus musculus
gtgtacagatttctcaaccagacaa

SEQ ID NO: 714298 - DNA, 25 bp, Mus musculus
gtgtacagatttgtcaaccagacaa

SEQ ID NO: 714299 - DNA, 25 bp, Mus musculus
gtgtacagattttatcatcccaacc

SEQ ID NO: 714300 - DNA, 25 bp, Mus musculus
gtgtacagcatgaaactcacctcta

SEQ ID NO: 714301 - DNA, 25 bp, Mus musculus
gtgtacagcatgtaactcacctcta

SEQ ID NO: 714302 - DNA, 25 bp, Mus musculus
gtgtacagccagacactcttgtgtg

SEQ ID NO: 714303 - DNA, 25 bp, Mus musculus
gtgtacagccagtcactcttgtgtg

SEQ ID NO: 714304 - DNA, 25 bp, Mus musculus
gtgtacagctgtaatctatttaagc

SEQ ID NO: 714305 - DNA, 25 bp, Mus musculus
gtgtacagctgttatctatttaagc

SEQ ID NO: 714306 - DNA, 25 bp, Mus musculus
gtgtacaggcggatgaactcaagct

SEQ ID NO: 714307 - DNA, 25 bp, Mus musculus
gtgtacaggcggttgaactcaagct

SEQ ID NO: 714308 - DNA, 25 bp, Mus musculus
gtgtacagggttaacttttcccatg

SEQ ID NO: 714309 - DNA, 25 bp, Mus musculus
gtgtacagggtttacttttcccatg

SEQ ID NO: 714310 - DNA, 25 bp, Mus musculus
gtgtacaggtatcaactcaggaaga

SEQ ID NO: 714311 - DNA, 25 bp, Mus musculus
gtgtacaggtatgaactcaggaaga

SEQ ID NO: 714312 - DNA, 25 bp, Mus musculus
gtgtacagtattatagttcttcaat

SEQ ID NO: 714313 - DNA, 25 bp, Mus musculus
gtgtacagtattttagttcttcaat

SEQ ID NO: 714314 - DNA, 25 bp, Mus musculus
gtgtacagttcgcagtggatccact

SEQ ID NO: 714315 - DNA, 25 bp, Mus musculus
gtgtacagttcggagtggatccact

SEQ ID NO: 714316 - DNA, 25 bp, Mus musculus
gtgtacatacatatagtgccccgtg

SEQ ID NO: 714317 - DNA, 25 bp, Mus musculus
gtgtacatacatttagtgccccgtg

SEQ ID NO: 714318 - DNA, 25 bp, Mus musculus
gtgtacatactcagtgttagactcc

SEQ ID NO: 714319 - DNA, 25 bp, Mus musculus
gtgtacatactctgtgttagactcc

SEQ ID NO: 714320 - DNA, 25 bp, Mus musculus
gtgtacatagctcagccagtgctgg

SEQ ID NO: 714321 - DNA, 25 bp, Mus musculus
gtgtacatagctgagccagtgctgg

SEQ ID NO: 714322 - DNA, 25 bp, Mus musculus
gtgtacatattcagccccggtacag

SEQ ID NO: 714323 - DNA, 25 bp, Mus musculus
gtgtacatattctgccccggtacag

SEQ ID NO: 714324 - DNA, 25 bp, Mus musculus
gtgtacatatttactctgcccctgc

SEQ ID NO: 714325 - DNA, 25 bp, Mus musculus
gtgtacatattttctctgcccctgc

SEQ ID NO: 714326 - DNA, 25 bp, Mus musculus
gtgtacatccaccactttggtgcga

SEQ ID NO: 714327 - DNA, 25 bp, Mus musculus
gtgtacatccacgactttggtgcga

SEQ ID NO: 714328 - DNA, 25 bp, Mus musculus
gtgtacatcctcatttccaagatga

SEQ ID NO: 714329 - DNA, 25 bp, Mus musculus
gtgtacatcctcttttccaagatga

SEQ ID NO: 714330 - DNA, 25 bp, Mus musculus
gtgtacatgactcttgttctgttgt

SEQ ID NO: 714331 - DNA, 25 bp, Mus musculus
gtgtacatgactgttgttctgttgt

SEQ ID NO: 714332 - DNA, 25 bp, Mus musculus
gtgtacatgagcctacgatcgtaca

SEQ ID NO: 714333 - DNA, 25 bp, Mus musculus
gtgtacatgagcgtacgatcgtaca

SEQ ID NO: 714334 - DNA, 25 bp, Mus musculus
gtgtacatgcacacagtactcatag

SEQ ID NO: 714335 - DNA, 25 bp, Mus musculus
gtgtacatgcactcagtactcatag

SEQ ID NO: 714336 - DNA, 25 bp, Mus musculus
gtgtacatggtcatgaacatgctca

SEQ ID NO: 714337 - DNA, 25 bp, Mus musculus
gtgtacatggtcttgaacatgctca

SEQ ID NO: 714338 - DNA, 25 bp, Mus musculus
gtgtacatgtacacgataacggctt

SEQ ID NO: 714339 - DNA, 25 bp, Mus musculus
gtgtacatgtactcgataacggctt

SEQ ID NO: 714340 - DNA, 25 bp, Mus musculus
gtgtacatgtcacatcacaggcatc

SEQ ID NO: 714341 - DNA, 25 bp, Mus musculus
gtgtacatgtcagatcacaggcatc

SEQ ID NO: 714342 - DNA, 25 bp, Mus musculus
gtgtacatgtgcagcgttatctatc

SEQ ID NO: 714343 - DNA, 25 bp, Mus musculus
gtgtacatgtgctgcgttatctatc

SEQ ID NO: 714344 - DNA, 25 bp, Mus musculus
gtgtacattgacagcataccagcgt

SEQ ID NO: 714345 - DNA, 25 bp, Mus musculus
gtgtacattgactgcataccagcgt

SEQ ID NO: 714346 - DNA, 25 bp, Mus musculus
gtgtacattgcccctttttgctttt

SEQ ID NO: 714347 - DNA, 25 bp, Mus musculus
gtgtacattgccgctttttgctttt

SEQ ID NO: 714348 - DNA, 25 bp, Mus musculus
gtgtacattgctcttgtttcatcat

SEQ ID NO: 714349 - DNA, 25 bp, Mus musculus
gtgtacattgctgttgtttcatcat

SEQ ID NO: 714350 - DNA, 25 bp, Mus musculus
gtgtacatttgtaatgaggctgcct

SEQ ID NO: 714351 - DNA, 25 bp, Mus musculus
gtgtacatttgtagctacccgaatt

SEQ ID NO: 714352 - DNA, 25 bp, Mus musculus
gtgtacatttgttatgaggctgcct

SEQ ID NO: 714353 - DNA, 25 bp, Mus musculus
gtgtacatttgttgctacccgaatt

SEQ ID NO: 714354 - DNA, 25 bp, Mus musculus
gtgtacattttaaccactgatatta

SEQ ID NO: 714355 - DNA, 25 bp, Mus musculus
gtgtacattttatccactgatatta

SEQ ID NO: 714356 - DNA, 25 bp, Mus musculus
gtgtaccaaggtctgaagccacctc

SEQ ID NO: 714357 - DNA, 25 bp, Mus musculus
gtgtaccaaggtgtgaagccacctc

SEQ ID NO: 714358 - DNA, 25 bp, Mus musculus
gtgtaccaagtactctgggacagaa

SEQ ID NO: 714359 - DNA, 25 bp, Mus musculus
gtgtaccaagtactttcagcagttt

SEQ ID NO: 714360 - DNA, 25 bp, Mus musculus
gtgtaccaagtagtctgggacagaa

SEQ ID NO: 714361 - DNA, 25 bp, Mus musculus
gtgtaccaagtagtttcagcagttt

SEQ ID NO: 714362 - DNA, 25 bp, Mus musculus
gtgtaccacaaaagagaccttgctc

SEQ ID NO: 714363 - DNA, 25 bp, Mus musculus
gtgtaccacaaatgagaccttgctc

SEQ ID NO: 714364 - DNA, 25 bp, Mus musculus
gtgtaccacagtactgagattttca

SEQ ID NO: 714365 - DNA, 25 bp, Mus musculus
gtgtaccacagttctgagattttca

SEQ ID NO: 714366 - DNA, 25 bp, Mus musculus
gtgtaccacctgcatacagtccctc

SEQ ID NO: 714367 - DNA, 25 bp, Mus musculus
gtgtaccacctggatacagtccctc

SEQ ID NO: 714368 - DNA, 25 bp, Mus musculus
gtgtaccaccttcaaaatgatcctt

SEQ ID NO: 714369 - DNA, 25 bp, Mus musculus
gtgtaccaccttcataccagctgta

SEQ ID NO: 714370 - DNA, 25 bp, Mus musculus
gtgtaccaccttgaaaatgatcctt

SEQ ID NO: 714371 - DNA, 25 bp, Mus musculus
gtgtaccaccttgataccagctgta

SEQ ID NO: 714372 - DNA, 25 bp, Mus musculus
gtgtaccacgacaatggtgggaaaa

SEQ ID NO: 714373 - DNA, 25 bp, Mus musculus
gtgtaccacgactatggtgggaaaa

SEQ ID NO: 714374 - DNA, 25 bp, Mus musculus
gtgtaccacgttaaaatgaccagtc

SEQ ID NO: 714375 - DNA, 25 bp, Mus musculus
gtgtaccacgtttaaatgaccagtc

SEQ ID NO: 714376 - DNA, 25 bp, Mus musculus
gtgtaccactatcctcagtttacag

SEQ ID NO: 714377 - DNA, 25 bp, Mus musculus
gtgtaccactatgctcagtttacag

SEQ ID NO: 714378 - DNA, 25 bp, Mus musculus
gtgtaccactgcagcaggcatcttc

SEQ ID NO: 714379 - DNA, 25 bp, Mus musculus
gtgtaccactgctgcaggcatcttc

SEQ ID NO: 714380 - DNA, 25 bp, Mus musculus
gtgtaccagcagagtgtcaggtgct

SEQ ID NO: 714381 - DNA, 25 bp, Mus musculus
gtgtaccagcagcaaatattgactt

SEQ ID NO: 714382 - DNA, 25 bp, Mus musculus
gtgtaccagcaggaaatattgactt

SEQ ID NO: 714383 - DNA, 25 bp, Mus musculus
gtgtaccagcagtgtgtcaggtgct

SEQ ID NO: 714384 - DNA, 25 bp, Mus musculus
gtgtaccatcacacttggcccagaa

SEQ ID NO: 714385 - DNA, 25 bp, Mus musculus
gtgtaccatcactcttggcccagaa

SEQ ID NO: 714386 - DNA, 25 bp, Mus musculus
gtgtaccattcaatttcgtgtccaa

SEQ ID NO: 714387 - DNA, 25 bp, Mus musculus
gtgtaccattcattttcgtgtccaa

SEQ ID NO: 714388 - DNA, 25 bp, Mus musculus
gtgtacccaacacgtaactcattgt

SEQ ID NO: 714389 - DNA, 25 bp, Mus musculus
gtgtacccaacaggtaactcattgt

SEQ ID NO: 714390 - DNA, 25 bp, Mus musculus
gtgtacccaatcacgacaggaggat

SEQ ID NO: 714391 - DNA, 25 bp, Mus musculus
gtgtacccaatctcgacaggaggat

SEQ ID NO: 714392 - DNA, 25 bp, Mus musculus
gtgtacccaatgcacttcactgatg

SEQ ID NO: 714393 - DNA, 25 bp, Mus musculus
gtgtacccaatggacttcactgatg

SEQ ID NO: 714394 - DNA, 25 bp, Mus musculus
gtgtacccagtaacaacgatcctac

SEQ ID NO: 714395 - DNA, 25 bp, Mus musculus
gtgtacccagtatcaacgatcctac

SEQ ID NO: 714396 - DNA, 25 bp, Mus musculus
gtgtacccctcacattcatggagta

SEQ ID NO: 714397 - DNA, 25 bp, Mus musculus
gtgtacccctcagattcatggagta

SEQ ID NO: 714398 - DNA, 25 bp, Mus musculus
gtgtacccctcgatgcagggccagg

SEQ ID NO: 714399 - DNA, 25 bp, Mus musculus
gtgtacccctcgttgcagggccagg

SEQ ID NO: 714400 - DNA, 25 bp, Mus musculus
gtgtacccctctaggctggattatg

SEQ ID NO: 714401 - DNA, 25 bp, Mus musculus
gtgtacccctctatatatatgttac

SEQ ID NO: 714402 - DNA, 25 bp, Mus musculus
gtgtacccctcttggctggattatg

SEQ ID NO: 714403 - DNA, 25 bp, Mus musculus
gtgtacccctctttatatatgttac

SEQ ID NO: 714404 - DNA, 25 bp, Mus musculus
gtgtaccctgaacagctgtatgaat

SEQ ID NO: 714405 - DNA, 25 bp, Mus musculus
gtgtaccctgaagagctgtatgaat

SEQ ID NO: 714406 - DNA, 25 bp, Mus musculus
gtgtaccctgcactcatgaatgtat

SEQ ID NO: 714407 - DNA, 25 bp, Mus musculus
gtgtaccctgcagtcatgaatgtat

SEQ ID NO: 714408 - DNA, 25 bp, Mus musculus
gtgtaccgagtaaatggccaaagtc

SEQ ID NO: 714409 - DNA, 25 bp, Mus musculus
gtgtaccgagtatatggccaaagtc

SEQ ID NO: 714410 - DNA, 25 bp, Mus musculus
gtgtaccgctacagtgttgcagttc

SEQ ID NO: 714411 - DNA, 25 bp, Mus musculus
gtgtaccgctactgtgttgcagttc

SEQ ID NO: 714412 - DNA, 25 bp, Mus musculus
gtgtaccggaagcaacgtggtctat

SEQ ID NO: 714413 - DNA, 25 bp, Mus musculus
gtgtaccggaaggaacgtggtctat

SEQ ID NO: 714414 - DNA, 25 bp, Mus musculus
gtgtaccggcttagggcatttggac

SEQ ID NO: 714415 - DNA, 25 bp, Mus musculus
gtgtaccggctttgggcatttggac

SEQ ID NO: 714416 - DNA, 25 bp, Mus musculus
gtgtacctaaaccagatgccactag

SEQ ID NO: 714417 - DNA, 25 bp, Mus musculus
gtgtacctaaacgagatgccactag

SEQ ID NO: 714418 - DNA, 25 bp, Mus musculus
gtgtacctaaagcttcttgaaatga

SEQ ID NO: 714419 - DNA, 25 bp, Mus musculus
gtgtacctaaaggttcttgaaatga

SEQ ID NO: 714420 - DNA, 25 bp, Mus musculus
gtgtacctaagactgtgtgttccta

SEQ ID NO: 714421 - DNA, 25 bp, Mus musculus
gtgtacctaagagtgtgtgttccta

SEQ ID NO: 714422 - DNA, 25 bp, Mus musculus
gtgtacctaatgatcaatcgtgatt

SEQ ID NO: 714423 - DNA, 25 bp, Mus musculus
gtgtacctaatgttcaatcgtgatt

SEQ ID NO: 714424 - DNA, 25 bp, Mus musculus
gtgtacctagagcaacacccttcct

SEQ ID NO: 714425 - DNA, 25 bp, Mus musculus
gtgtacctagaggaacacccttcct

SEQ ID NO: 714426 - DNA, 25 bp, Mus musculus
gtgtacctatccagggtatcaccct

SEQ ID NO: 714427 - DNA, 25 bp, Mus musculus
gtgtacctatcctgggtatcaccct

SEQ ID NO: 714428 - DNA, 25 bp, Mus musculus
gtgtacctcaccagagggtattcgg

SEQ ID NO: 714429 - DNA, 25 bp, Mus musculus
gtgtacctcacctgagggtattcgg

SEQ ID NO: 714430 - DNA, 25 bp, Mus musculus
gtgtacctcatgatgttttgctgaa

SEQ ID NO: 714431 - DNA, 25 bp, Mus musculus
gtgtacctcatgttgttttgctgaa

SEQ ID NO: 714432 - DNA, 25 bp, Mus musculus
gtgtacctccagacattgtcctgga

SEQ ID NO: 714433 - DNA, 25 bp, Mus musculus
gtgtacctccagtcattgtcctgga

SEQ ID NO: 714434 - DNA, 25 bp, Mus musculus
gtgtacctcgccaatacagaggaga

SEQ ID NO: 714435 - DNA, 25 bp, Mus musculus
gtgtacctcgcctatacagaggaga

SEQ ID NO: 714436 - DNA, 25 bp, Mus musculus
gtgtacctctaacgagctccctgta

SEQ ID NO: 714437 - DNA, 25 bp, Mus musculus
gtgtacctctaaggagctccctgta

SEQ ID NO: 714438 - DNA, 25 bp, Mus musculus
gtgtacctctacagcagagcgcaga

SEQ ID NO: 714439 - DNA, 25 bp, Mus musculus
gtgtacctctactgcagagcgcaga

SEQ ID NO: 714440 - DNA, 25 bp, Mus musculus
gtgtacctctagctgttctgaaact

SEQ ID NO: 714441 - DNA, 25 bp, Mus musculus
gtgtacctctaggtgttctgaaact

SEQ ID NO: 714442 - DNA, 25 bp, Mus musculus
gtgtacctctatagatctctcaata

SEQ ID NO: 714443 - DNA, 25 bp, Mus musculus
gtgtacctctattgatctctcaata

SEQ ID NO: 714444 - DNA, 25 bp, Mus musculus
gtgtacctctgccttatcaatcatg

SEQ ID NO: 714445 - DNA, 25 bp, Mus musculus
gtgtacctctgcgttatcaatcatg

SEQ ID NO: 714446 - DNA, 25 bp, Mus musculus
gtgtacctgaaaccatagcactggg

SEQ ID NO: 714447 - DNA, 25 bp, Mus musculus
gtgtacctgaaagcatagcactggg

SEQ ID NO: 714448 - DNA, 25 bp, Mus musculus
gtgtacctgaagatcattgtggaat

SEQ ID NO: 714449 - DNA, 25 bp, Mus musculus
gtgtacctgaagttcattgtggaat

SEQ ID NO: 714450 - DNA, 25 bp, Mus musculus
gtgtacctgggtctcttatagattt

SEQ ID NO: 714451 - DNA, 25 bp, Mus musculus
gtgtacctgggtgtcttatagattt

SEQ ID NO: 714452 - DNA, 25 bp, Mus musculus
gtgtacctggtaatcatggaggcta

SEQ ID NO: 714453 - DNA, 25 bp, Mus musculus
gtgtacctggtattcatggaggcta

SEQ ID NO: 714454 - DNA, 25 bp, Mus musculus
gtgtacctgtataccatggtgtttg

SEQ ID NO: 714455 - DNA, 25 bp, Mus musculus
gtgtacctgtattccatggtgtttg

SEQ ID NO: 714456 - DNA, 25 bp, Mus musculus
gtgtacctgtctatttctctggata

SEQ ID NO: 714457 - DNA, 25 bp, Mus musculus
gtgtacctgtctttttctctggata

SEQ ID NO: 714458 - DNA, 25 bp, Mus musculus
gtgtacgagctgaggtattccttgt

SEQ ID NO: 714459 - DNA, 25 bp, Mus musculus
gtgtacgagctgtggtattccttgt

SEQ ID NO: 714460 - DNA, 25 bp, Mus musculus
gtgtacgagttgatctctttctcaa

SEQ ID NO: 714461 - DNA, 25 bp, Mus musculus
gtgtacgagttgttctctttctcaa

SEQ ID NO: 714462 - DNA, 25 bp, Mus musculus
gtgtacgatcgtatgctttctctat

SEQ ID NO: 714463 - DNA, 25 bp, Mus musculus
gtgtacgatcgtttgctttctctat

SEQ ID NO: 714464 - DNA, 25 bp, Mus musculus
gtgtacgatgtgctttgatcatatc

SEQ ID NO: 714465 - DNA, 25 bp, Mus musculus
gtgtacgatgtggtttgatcatatc

SEQ ID NO: 714466 - DNA, 25 bp, Mus musculus
gtgtacgctctcatttcagaatgtg

SEQ ID NO: 714467 - DNA, 25 bp, Mus musculus
gtgtacgctctcttttcagaatgtg

SEQ ID NO: 714468 - DNA, 25 bp, Mus musculus
gtgtacgcttgtaggcatatacata

SEQ ID NO: 714469 - DNA, 25 bp, Mus musculus
gtgtacgcttgttggcatatacata

SEQ ID NO: 714470 - DNA, 25 bp, Mus musculus
gtgtacggagaaccagtgtccccag

SEQ ID NO: 714471 - DNA, 25 bp, Mus musculus
gtgtacggagaagcagtgtccccag

SEQ ID NO: 714472 - DNA, 25 bp, Mus musculus
gtgtacggagtgacacgcacagcta

SEQ ID NO: 714473 - DNA, 25 bp, Mus musculus
gtgtacggagtgtcacgcacagcta

SEQ ID NO: 714474 - DNA, 25 bp, Mus musculus
gtgtacgggcacactatgactacga

SEQ ID NO: 714475 - DNA, 25 bp, Mus musculus
gtgtacgggcactctatgactacga

SEQ ID NO: 714476 - DNA, 25 bp, Mus musculus
gtgtacgtccatcatgcatatcttg

SEQ ID NO: 714477 - DNA, 25 bp, Mus musculus
gtgtacgtccatgatgcatatcttg

SEQ ID NO: 714478 - DNA, 25 bp, Mus musculus
gtgtacgtccttccatcttaaggaa

SEQ ID NO: 714479 - DNA, 25 bp, Mus musculus
gtgtacgtccttgcatcttaaggaa

SEQ ID NO: 714480 - DNA, 25 bp, Mus musculus
gtgtacgtgcagatgtgcacatgta

SEQ ID NO: 714481 - DNA, 25 bp, Mus musculus
gtgtacgtgcagttgtgcacatgta

SEQ ID NO: 714482 - DNA, 25 bp, Mus musculus
gtgtacgtgtaaccctcagttaacc

SEQ ID NO: 714483 - DNA, 25 bp, Mus musculus
gtgtacgtgtaagcctcagttaacc

SEQ ID NO: 714484 - DNA, 25 bp, Mus musculus
gtgtacgtgtctctccacacaaaaa

SEQ ID NO: 714485 - DNA, 25 bp, Mus musculus
gtgtacgtgtctgtccacacaaaaa

SEQ ID NO: 714486 - DNA, 25 bp, Mus musculus
gtgtactagcccacctgacatgtga

SEQ ID NO: 714487 - DNA, 25 bp, Mus musculus
gtgtactagccctcctgacatgtga

SEQ ID NO: 714488 - DNA, 25 bp, Mus musculus
gtgtactagtcactgcattttttct

SEQ ID NO: 714489 - DNA, 25 bp, Mus musculus
gtgtactagtcagtgcattttttct

SEQ ID NO: 714490 - DNA, 25 bp, Mus musculus
gtgtactataaactgtctgtagaga

SEQ ID NO: 714491 - DNA, 25 bp, Mus musculus
gtgtactataaagtgtctgtagaga

SEQ ID NO: 714492 - DNA, 25 bp, Mus musculus
gtgtactatccactgtctgcaggaa

SEQ ID NO: 714493 - DNA, 25 bp, Mus musculus
gtgtactatccagtgtctgcaggaa

SEQ ID NO: 714494 - DNA, 25 bp, Mus musculus
gtgtactatcgccttcaaaatgtct

SEQ ID NO: 714495 - DNA, 25 bp, Mus musculus
gtgtactatcgcgttcaaaatgtct

SEQ ID NO: 714496 - DNA, 25 bp, Mus musculus
gtgtactatgtcagaaaatgctttt

SEQ ID NO: 714497 - DNA, 25 bp, Mus musculus
gtgtactatgtctgaaaatgctttt

SEQ ID NO: 714498 - DNA, 25 bp, Mus musculus
gtgtactcactgctgtgtgcattat

SEQ ID NO: 714499 - DNA, 25 bp, Mus musculus
gtgtactcactggtgtgtgcattat

SEQ ID NO: 714500 - DNA, 25 bp, Mus musculus
gtgtactcagatctgtcttcagtga

SEQ ID NO: 714501 - DNA, 25 bp, Mus musculus
gtgtactcagatgtgtcttcagtga

SEQ ID NO: 714502 - DNA, 25 bp, Mus musculus
gtgtactcaggacagaatccagaga

SEQ ID NO: 714503 - DNA, 25 bp, Mus musculus
gtgtactcaggagagaatccagaga

SEQ ID NO: 714504 - DNA, 25 bp, Mus musculus
gtgtactcaggcatctatgtggcca

SEQ ID NO: 714505 - DNA, 25 bp, Mus musculus
gtgtactcaggcttctatgtggcca

SEQ ID NO: 714506 - DNA, 25 bp, Mus musculus
gtgtactcagtgatggcggcacgtc

SEQ ID NO: 714507 - DNA, 25 bp, Mus musculus
gtgtactcagtgttggcggcacgtc

SEQ ID NO: 714508 - DNA, 25 bp, Mus musculus
gtgtactccattcccacaccgagag

SEQ ID NO: 714509 - DNA, 25 bp, Mus musculus
gtgtactccattgccacaccgagag

SEQ ID NO: 714510 - DNA, 25 bp, Mus musculus
gtgtactcccaaccacagaaactgg

SEQ ID NO: 714511 - DNA, 25 bp, Mus musculus
gtgtactcccaaccagggtatattc

SEQ ID NO: 714512 - DNA, 25 bp, Mus musculus
gtgtactcccaagcacagaaactgg

SEQ ID NO: 714513 - DNA, 25 bp, Mus musculus
gtgtactcccaagcagggtatattc

SEQ ID NO: 714514 - DNA, 25 bp, Mus musculus
gtgtactcccagaccttggaattga

SEQ ID NO: 714515 - DNA, 25 bp, Mus musculus
gtgtactcccagtccttggaattga

SEQ ID NO: 714516 - DNA, 25 bp, Mus musculus
gtgtactcggtaccagcttatacct

SEQ ID NO: 714517 - DNA, 25 bp, Mus musculus
gtgtactcggtagcagcttatacct

SEQ ID NO: 714518 - DNA, 25 bp, Mus musculus
gtgtactcgtgtagtgtttaagatt

SEQ ID NO: 714519 - DNA, 25 bp, Mus musculus
gtgtactcgtgttgtgtttaagatt

SEQ ID NO: 714520 - DNA, 25 bp, Mus musculus
gtgtactctcgactcatagagaaat

SEQ ID NO: 714521 - DNA, 25 bp, Mus musculus
gtgtactctcgagtcatagagaaat

SEQ ID NO: 714522 - DNA, 25 bp, Mus musculus
gtgtactctctaaacgtgcatcagc

SEQ ID NO: 714523 - DNA, 25 bp, Mus musculus
gtgtactctctatacgtgcatcagc

SEQ ID NO: 714524 - DNA, 25 bp, Mus musculus
gtgtactcttaactataccccacag

SEQ ID NO: 714525 - DNA, 25 bp, Mus musculus
gtgtactcttaagtataccccacag

SEQ ID NO: 714526 - DNA, 25 bp, Mus musculus
gtgtactcttcaagtcagcgttgta

SEQ ID NO: 714527 - DNA, 25 bp, Mus musculus
gtgtactcttcatgtcagcgttgta

SEQ ID NO: 714528 - DNA, 25 bp, Mus musculus
gtgtactctttccaccaaagtagtg

SEQ ID NO: 714529 - DNA, 25 bp, Mus musculus
gtgtactctttcgaccaaagtagtg

SEQ ID NO: 714530 - DNA, 25 bp, Mus musculus
gtgtactgagttcagcgcaagtgca

SEQ ID NO: 714531 - DNA, 25 bp, Mus musculus
gtgtactgagttgagcgcaagtgca

SEQ ID NO: 714532 - DNA, 25 bp, Mus musculus
gtgtactgcatcatggatatcacca

SEQ ID NO: 714533 - DNA, 25 bp, Mus musculus
gtgtactgcatcttggatatcacca

SEQ ID NO: 714534 - DNA, 25 bp, Mus musculus
gtgtactgccatagtaactaccatg

SEQ ID NO: 714535 - DNA, 25 bp, Mus musculus
gtgtactgccattgtaactaccatg

SEQ ID NO: 714536 - DNA, 25 bp, Mus musculus
gtgtactgctcacattttcacgctg

SEQ ID NO: 714537 - DNA, 25 bp, Mus musculus
gtgtactgctcagattttcacgctg

SEQ ID NO: 714538 - DNA, 25 bp, Mus musculus
gtgtactggcatccttaaaatactt

SEQ ID NO: 714539 - DNA, 25 bp, Mus musculus
gtgtactggcatgcttaaaatactt

SEQ ID NO: 714540 - DNA, 25 bp, Mus musculus
gtgtactgtattagcttctccacat

SEQ ID NO: 714541 - DNA, 25 bp, Mus musculus
gtgtactgtatttgcttctccacat

SEQ ID NO: 714542 - DNA, 25 bp, Mus musculus
gtgtactgtgccaaatgcttcaccg

SEQ ID NO: 714543 - DNA, 25 bp, Mus musculus
gtgtactgtgcctaatgcttcaccg

SEQ ID NO: 714544 - DNA, 25 bp, Mus musculus
gtgtactgtgggattacatccgata

SEQ ID NO: 714545 - DNA, 25 bp, Mus musculus
gtgtactgtgggtttacatccgata

SEQ ID NO: 714546 - DNA, 25 bp, Mus musculus
gtgtactgtgtcatgggtccattat

SEQ ID NO: 714547 - DNA, 25 bp, Mus musculus
gtgtactgtgtcttgggtccattat

SEQ ID NO: 714548 - DNA, 25 bp, Mus musculus
gtgtactgtttcatatcaactttac

SEQ ID NO: 714549 - DNA, 25 bp, Mus musculus
gtgtactgtttcttatcaactttac

SEQ ID NO: 714550 - DNA, 25 bp, Mus musculus
gtgtacttaaaacaggccacgtggg

SEQ ID NO: 714551 - DNA, 25 bp, Mus musculus
gtgtacttaaaagaggccacgtggg

SEQ ID NO: 714552 - DNA, 25 bp, Mus musculus
gtgtacttaaacaaaatatgtctgt

SEQ ID NO: 714553 - DNA, 25 bp, Mus musculus
gtgtacttaaactaaatatgtctgt

SEQ ID NO: 714554 - DNA, 25 bp, Mus musculus
gtgtacttcaagacttggagctcgg

SEQ ID NO: 714555 - DNA, 25 bp, Mus musculus
gtgtacttcaagtcttggagctcgg

SEQ ID NO: 714556 - DNA, 25 bp, Mus musculus
gtgtacttcctacaagaagcagctg

SEQ ID NO: 714557 - DNA, 25 bp, Mus musculus
gtgtacttcctagaagaagcagctg

SEQ ID NO: 714558 - DNA, 25 bp, Mus musculus
gtgtacttctcactgttaaccctga

SEQ ID NO: 714559 - DNA, 25 bp, Mus musculus
gtgtacttctcagtgttaaccctga

SEQ ID NO: 714560 - DNA, 25 bp, Mus musculus
gtgtacttggctatgggatcagcat

SEQ ID NO: 714561 - DNA, 25 bp, Mus musculus
gtgtacttggctttgggatcagcat

SEQ ID NO: 714562 - DNA, 25 bp, Mus musculus
gtgtacttgtggacatattcacata

SEQ ID NO: 714563 - DNA, 25 bp, Mus musculus
gtgtacttgtggtcatattcacata

SEQ ID NO: 714564 - DNA, 25 bp, Mus musculus
gtgtacttgttcatgatgtccatac

SEQ ID NO: 714565 - DNA, 25 bp, Mus musculus
gtgtacttgttcttgatgtccatac

SEQ ID NO: 714566 - DNA, 25 bp, Mus musculus
gtgtacttgtttcaattaactgtat

SEQ ID NO: 714567 - DNA, 25 bp, Mus musculus
gtgtacttgtttgaattaactgtat

SEQ ID NO: 714568 - DNA, 25 bp, Mus musculus
gtgtactttaccaagataacttcag

SEQ ID NO: 714569 - DNA, 25 bp, Mus musculus
gtgtactttacctagataacttcag

SEQ ID NO: 714570 - DNA, 25 bp, Mus musculus
gtgtactttcttcaaacccatctct

SEQ ID NO: 714571 - DNA, 25 bp, Mus musculus
gtgtactttcttgaaacccatctct

SEQ ID NO: 714572 - DNA, 25 bp, Mus musculus
gtgtactttgaaagttggcagattt

SEQ ID NO: 714573 - DNA, 25 bp, Mus musculus
gtgtactttgaatgttggcagattt

SEQ ID NO: 714574 - DNA, 25 bp, Mus musculus
gtgtactttgttacacaggacttca

SEQ ID NO: 714575 - DNA, 25 bp, Mus musculus
gtgtactttgtttcacaggacttca

SEQ ID NO: 714576 - DNA, 25 bp, Mus musculus
gtgtacttttgcatcccagatgcaa

SEQ ID NO: 714577 - DNA, 25 bp, Mus musculus
gtgtacttttgcttcccagatgcaa

SEQ ID NO: 714578 - DNA, 25 bp, Mus musculus
gtgtagaaacacaccttgctattct

SEQ ID NO: 714579 - DNA, 25 bp, Mus musculus
gtgtagaaacacctgccccaaacag

SEQ ID NO: 714580 - DNA, 25 bp, Mus musculus
gtgtagaaacacgtgccccaaacag

SEQ ID NO: 714581 - DNA, 25 bp, Mus musculus
gtgtagaaacactccttgctattct

SEQ ID NO: 714582 - DNA, 25 bp, Mus musculus
gtgtagaacagactgcggcatccca

SEQ ID NO: 714583 - DNA, 25 bp, Mus musculus
gtgtagaacagagtgcggcatccca

SEQ ID NO: 714584 - DNA, 25 bp, Mus musculus
gtgtagaacagcctgtgtcaccgtc

SEQ ID NO: 714585 - DNA, 25 bp, Mus musculus
gtgtagaacagcgtgtgtcaccgtc

SEQ ID NO: 714586 - DNA, 25 bp, Mus musculus
gtgtagaacattccccagcacttag

SEQ ID NO: 714587 - DNA, 25 bp, Mus musculus
gtgtagaacattccttaaaactaat

SEQ ID NO: 714588 - DNA, 25 bp, Mus musculus
gtgtagaacattgcccagcacttag

SEQ ID NO: 714589 - DNA, 25 bp, Mus musculus
gtgtagaacattgcttaaaactaat

SEQ ID NO: 714590 - DNA, 25 bp, Mus musculus
gtgtagaactatacctccacagtaa

SEQ ID NO: 714591 - DNA, 25 bp, Mus musculus
gtgtagaactattcctccacagtaa

SEQ ID NO: 714592 - DNA, 25 bp, Mus musculus
gtgtagaacttgcttgcttgcacta

SEQ ID NO: 714593 - DNA, 25 bp, Mus musculus
gtgtagaacttggttgcttgcacta

SEQ ID NO: 714594 - DNA, 25 bp, Mus musculus
gtgtagaagcccaagtgtgaccaga

SEQ ID NO: 714595 - DNA, 25 bp, Mus musculus
gtgtagaagccctagtgtgaccaga

SEQ ID NO: 714596 - DNA, 25 bp, Mus musculus
gtgtagaatttcattttcctagcaa

SEQ ID NO: 714597 - DNA, 25 bp, Mus musculus
gtgtagaatttctttttcctagcaa

SEQ ID NO: 714598 - DNA, 25 bp, Mus musculus
gtgtagacaataaactccctaccct

SEQ ID NO: 714599 - DNA, 25 bp, Mus musculus
gtgtagacaatatactccctaccct

SEQ ID NO: 714600 - DNA, 25 bp, Mus musculus
gtgtagacaggaatcccgaaaactt

SEQ ID NO: 714601 - DNA, 25 bp, Mus musculus
gtgtagacaggattcccgaaaactt

SEQ ID NO: 714602 - DNA, 25 bp, Mus musculus
gtgtagaccaaacgctctcactagt

SEQ ID NO: 714603 - DNA, 25 bp, Mus musculus
gtgtagaccaaaggctctcactagt

SEQ ID NO: 714604 - DNA, 25 bp, Mus musculus
gtgtagaccacgctgtgaaacccat

SEQ ID NO: 714605 - DNA, 25 bp, Mus musculus
gtgtagaccacggtgtgaaacccat

SEQ ID NO: 714606 - DNA, 25 bp, Mus musculus
gtgtagaccaggagcagagcatcat

SEQ ID NO: 714607 - DNA, 25 bp, Mus musculus
gtgtagaccaggtgcagagcatcat

SEQ ID NO: 714608 - DNA, 25 bp, Mus musculus
gtgtagaccatgatgccctaagaga

SEQ ID NO: 714609 - DNA, 25 bp, Mus musculus
gtgtagaccatgttgccctaagaga

SEQ ID NO: 714610 - DNA, 25 bp, Mus musculus
gtgtagacccttaagaatcagctgt

SEQ ID NO: 714611 - DNA, 25 bp, Mus musculus
gtgtagaccctttagaatcagctgt

SEQ ID NO: 714612 - DNA, 25 bp, Mus musculus
gtgtagaccgttactaagtcctaat

SEQ ID NO: 714613 - DNA, 25 bp, Mus musculus
gtgtagaccgtttctaagtcctaat

SEQ ID NO: 714614 - DNA, 25 bp, Mus musculus
gtgtagacgacccagagagccccgc

SEQ ID NO: 714615 - DNA, 25 bp, Mus musculus
gtgtagacgaccgagagagccccgc

SEQ ID NO: 714616 - DNA, 25 bp, Mus musculus
gtgtagacggttccctgttctctgc

SEQ ID NO: 714617 - DNA, 25 bp, Mus musculus
gtgtagacggttgcctgttctctgc

SEQ ID NO: 714618 - DNA, 25 bp, Mus musculus
gtgtagacgtcaaaccaatactggg

SEQ ID NO: 714619 - DNA, 25 bp, Mus musculus
gtgtagacgtcataccaatactggg

SEQ ID NO: 714620 - DNA, 25 bp, Mus musculus
gtgtagactttgactgccggctgaa

SEQ ID NO: 714621 - DNA, 25 bp, Mus musculus
gtgtagactttgtctgccggctgaa

SEQ ID NO: 714622 - DNA, 25 bp, Mus musculus
gtgtagagaataccttctccaagta

SEQ ID NO: 714623 - DNA, 25 bp, Mus musculus
gtgtagagaatagcttctccaagta

SEQ ID NO: 714624 - DNA, 25 bp, Mus musculus
gtgtagagacggagtcagactaagt

SEQ ID NO: 714625 - DNA, 25 bp, Mus musculus
gtgtagagacggtgtcagactaagt

SEQ ID NO: 714626 - DNA, 25 bp, Mus musculus
gtgtagagcattccagcactatgac

SEQ ID NO: 714627 - DNA, 25 bp, Mus musculus
gtgtagagcattgcagcactatgac

SEQ ID NO: 714628 - DNA, 25 bp, Mus musculus
gtgtagaggaatccgtcttccctgc

SEQ ID NO: 714629 - DNA, 25 bp, Mus musculus
gtgtagaggaatgcgtcttccctgc

SEQ ID NO: 714630 - DNA, 25 bp, Mus musculus
gtgtagagtaccacatgtccactta

SEQ ID NO: 714631 - DNA, 25 bp, Mus musculus
gtgtagagtaccattcagtaatcag

SEQ ID NO: 714632 - DNA, 25 bp, Mus musculus
gtgtagagtacctcatgtccactta

SEQ ID NO: 714633 - DNA, 25 bp, Mus musculus
gtgtagagtacctttcagtaatcag

SEQ ID NO: 714634 - DNA, 25 bp, Mus musculus
gtgtagagtctaccccattgttcag

SEQ ID NO: 714635 - DNA, 25 bp, Mus musculus
gtgtagagtctagcccattgttcag

SEQ ID NO: 714636 - DNA, 25 bp, Mus musculus
gtgtagatatttactaaccattttc

SEQ ID NO: 714637 - DNA, 25 bp, Mus musculus
gtgtagatattttctaaccattttc

SEQ ID NO: 714638 - DNA, 25 bp, Mus musculus
gtgtagatctgtccccatacagtgt

SEQ ID NO: 714639 - DNA, 25 bp, Mus musculus
gtgtagatctgtgcccatacagtgt

SEQ ID NO: 714640 - DNA, 25 bp, Mus musculus
gtgtagatgaaacccatgtctaaat

SEQ ID NO: 714641 - DNA, 25 bp, Mus musculus
gtgtagatgaaagccatgtctaaat

SEQ ID NO: 714642 - DNA, 25 bp, Mus musculus
gtgtagatgggaccttccacaaata

SEQ ID NO: 714643 - DNA, 25 bp, Mus musculus
gtgtagatgggagcttccacaaata

SEQ ID NO: 714644 - DNA, 25 bp, Mus musculus
gtgtagatgtttcatcacccgtagt

SEQ ID NO: 714645 - DNA, 25 bp, Mus musculus
gtgtagatgtttgatcacccgtagt

SEQ ID NO: 714646 - DNA, 25 bp, Mus musculus
gtgtagattggccagcaagcttccc

SEQ ID NO: 714647 - DNA, 25 bp, Mus musculus
gtgtagattggcgagcaagcttccc

SEQ ID NO: 714648 - DNA, 25 bp, Mus musculus
gtgtagatttccatgtagttcacta

SEQ ID NO: 714649 - DNA, 25 bp, Mus musculus
gtgtagatttccttgtagttcacta

SEQ ID NO: 714650 - DNA, 25 bp, Mus musculus
gtgtagcaacacacttggatcgtgt

SEQ ID NO: 714651 - DNA, 25 bp, Mus musculus
gtgtagcaacactcttggatcgtgt

SEQ ID NO: 714652 - DNA, 25 bp, Mus musculus
gtgtagcaacgcaagattccagata

SEQ ID NO: 714653 - DNA, 25 bp, Mus musculus
gtgtagcaacgctagattccagata

SEQ ID NO: 714654 - DNA, 25 bp, Mus musculus
gtgtagcaaggtcctttctcagaaa

SEQ ID NO: 714655 - DNA, 25 bp, Mus musculus
gtgtagcaaggtgctttctcagaaa

SEQ ID NO: 714656 - DNA, 25 bp, Mus musculus
gtgtagcaagtcctttcactcctgt

SEQ ID NO: 714657 - DNA, 25 bp, Mus musculus
gtgtagcaagtcgtttcactcctgt

SEQ ID NO: 714658 - DNA, 25 bp, Mus musculus
gtgtagcactacaaactgctccaga

SEQ ID NO: 714659 - DNA, 25 bp, Mus musculus
gtgtagcactactaactgctccaga

SEQ ID NO: 714660 - DNA, 25 bp, Mus musculus
gtgtagcacttgaccgacctcacga

SEQ ID NO: 714661 - DNA, 25 bp, Mus musculus
gtgtagcacttgtccgacctcacga

SEQ ID NO: 714662 - DNA, 25 bp, Mus musculus
gtgtagcagagtactcacactcctc

SEQ ID NO: 714663 - DNA, 25 bp, Mus musculus
gtgtagcagagttctcacactcctc

SEQ ID NO: 714664 - DNA, 25 bp, Mus musculus
gtgtagcagcctactcctcatagga

SEQ ID NO: 714665 - DNA, 25 bp, Mus musculus
gtgtagcagccttctcctcatagga

SEQ ID NO: 714666 - DNA, 25 bp, Mus musculus
gtgtagcagtataatcaccggaggg

SEQ ID NO: 714667 - DNA, 25 bp, Mus musculus
gtgtagcagtattatcaccggaggg

SEQ ID NO: 714668 - DNA, 25 bp, Mus musculus
gtgtagcatactcagtttttccttt

SEQ ID NO: 714669 - DNA, 25 bp, Mus musculus
gtgtagcatactgagtttttccttt

SEQ ID NO: 714670 - DNA, 25 bp, Mus musculus
gtgtagcatccccatttcaagcaaa

SEQ ID NO: 714671 - DNA, 25 bp, Mus musculus
gtgtagcatcccgatttcaagcaaa

SEQ ID NO: 714672 - DNA, 25 bp, Mus musculus
gtgtagcatgctctgtgcactttca

SEQ ID NO: 714673 - DNA, 25 bp, Mus musculus
gtgtagcatgctgtgtgcactttca

SEQ ID NO: 714674 - DNA, 25 bp, Mus musculus
gtgtagcattgcaaaagcccaccca

SEQ ID NO: 714675 - DNA, 25 bp, Mus musculus
gtgtagcattgctaaagcccaccca

SEQ ID NO: 714676 - DNA, 25 bp, Mus musculus
gtgtagccaagaatccttctgctca

SEQ ID NO: 714677 - DNA, 25 bp, Mus musculus
gtgtagccaagattccttctgctca

SEQ ID NO: 714678 - DNA, 25 bp, Mus musculus
gtgtagccaccccagagtattcaga

SEQ ID NO: 714679 - DNA, 25 bp, Mus musculus
gtgtagccacccgagagtattcaga

SEQ ID NO: 714680 - DNA, 25 bp, Mus musculus
gtgtagccataaacttactttggta

SEQ ID NO: 714681 - DNA, 25 bp, Mus musculus
gtgtagccataatcttactttggta

SEQ ID NO: 714682 - DNA, 25 bp, Mus musculus
gtgtagcccaagatgctccggtacc

SEQ ID NO: 714683 - DNA, 25 bp, Mus musculus
gtgtagcccaagttgctccggtacc

SEQ ID NO: 714684 - DNA, 25 bp, Mus musculus
gtgtagcccacaccacctaaaatat

SEQ ID NO: 714685 - DNA, 25 bp, Mus musculus
gtgtagcccacagcacctaaaatat

SEQ ID NO: 714686 - DNA, 25 bp, Mus musculus
gtgtagccccgtcacaacaaaggta

SEQ ID NO: 714687 - DNA, 25 bp, Mus musculus
gtgtagccccgtgacaacaaaggta

SEQ ID NO: 714688 - DNA, 25 bp, Mus musculus
gtgtagccctagagtctcagaaatc

SEQ ID NO: 714689 - DNA, 25 bp, Mus musculus
gtgtagccctagtgtctcagaaatc

SEQ ID NO: 714690 - DNA, 25 bp, Mus musculus
gtgtagccctggagccctggctaga

SEQ ID NO: 714691 - DNA, 25 bp, Mus musculus
gtgtagccctggtgccctggctaga

SEQ ID NO: 714692 - DNA, 25 bp, Mus musculus
gtgtagccctgtcgtgcaatgcgac

SEQ ID NO: 714693 - DNA, 25 bp, Mus musculus
gtgtagccctgtggtgcaatgcgac

SEQ ID NO: 714694 - DNA, 25 bp, Mus musculus
gtgtagcctactctcaaccctagat

SEQ ID NO: 714695 - DNA, 25 bp, Mus musculus
gtgtagcctactgtcaaccctagat

SEQ ID NO: 714696 - DNA, 25 bp, Mus musculus
gtgtagcctagtacgtggagcacat

SEQ ID NO: 714697 - DNA, 25 bp, Mus musculus
gtgtagcctagttcgtggagcacat

SEQ ID NO: 714698 - DNA, 25 bp, Mus musculus
gtgtagccttctctttgggtgtgaa

SEQ ID NO: 714699 - DNA, 25 bp, Mus musculus
gtgtagccttctgtttgggtgtgaa

SEQ ID NO: 714700 - DNA, 25 bp, Mus musculus
gtgtagcgagttcagcatcgcccgt

SEQ ID NO: 714701 - DNA, 25 bp, Mus musculus
gtgtagcgagttgagcatcgcccgt

SEQ ID NO: 714702 - DNA, 25 bp, Mus musculus
gtgtagcgcaagctggccctgaact

SEQ ID NO: 714703 - DNA, 25 bp, Mus musculus
gtgtagcgcaaggtggccctgaact

SEQ ID NO: 714704 - DNA, 25 bp, Mus musculus
gtgtagctaaaaaccgtatgtattt

SEQ ID NO: 714705 - DNA, 25 bp, Mus musculus
gtgtagctaaaactaccctcatcca

SEQ ID NO: 714706 - DNA, 25 bp, Mus musculus
gtgtagctaaaagtaccctcatcca

SEQ ID NO: 714707 - DNA, 25 bp, Mus musculus
gtgtagctaaaatccgtatgtattt

SEQ ID NO: 714708 - DNA, 25 bp, Mus musculus
gtgtagctaaagctggttcaaactc

SEQ ID NO: 714709 - DNA, 25 bp, Mus musculus
gtgtagctaaaggtggttcaaactc

SEQ ID NO: 714710 - DNA, 25 bp, Mus musculus
gtgtagctagccactgtgcacctcc

SEQ ID NO: 714711 - DNA, 25 bp, Mus musculus
gtgtagctagcctctgtgcacctcc

SEQ ID NO: 714712 - DNA, 25 bp, Mus musculus
gtgtagctatgccatgcggttcaaa

SEQ ID NO: 714713 - DNA, 25 bp, Mus musculus
gtgtagctatgcgatgcggttcaaa

SEQ ID NO: 714714 - DNA, 25 bp, Mus musculus
gtgtagctcaagaccagcagacaaa

SEQ ID NO: 714715 - DNA, 25 bp, Mus musculus
gtgtagctcaagactatttgtgatc

SEQ ID NO: 714716 - DNA, 25 bp, Mus musculus
gtgtagctcaagtccagcagacaaa

SEQ ID NO: 714717 - DNA, 25 bp, Mus musculus
gtgtagctcaagtctatttgtgatc

SEQ ID NO: 714718 - DNA, 25 bp, Mus musculus
gtgtagctcaggaacataactcttg

SEQ ID NO: 714719 - DNA, 25 bp, Mus musculus
gtgtagctcaggtacataactcttg

SEQ ID NO: 714720 - DNA, 25 bp, Mus musculus
gtgtagctccaactggcttacatta

SEQ ID NO: 714721 - DNA, 25 bp, Mus musculus
gtgtagctccaagtggcttacatta

SEQ ID NO: 714722 - DNA, 25 bp, Mus musculus
gtgtagctccacagaattccatgat

SEQ ID NO: 714723 - DNA, 25 bp, Mus musculus
gtgtagctccactgaattccatgat

SEQ ID NO: 714724 - DNA, 25 bp, Mus musculus
gtgtagctctggattcctgtagacc

SEQ ID NO: 714725 - DNA, 25 bp, Mus musculus
gtgtagctctggtttcctgtagacc

SEQ ID NO: 714726 - DNA, 25 bp, Mus musculus
gtgtagctgtgtcccacgtgcctga

SEQ ID NO: 714727 - DNA, 25 bp, Mus musculus
gtgtagctgtgtgccacgtgcctga

SEQ ID NO: 714728 - DNA, 25 bp, Mus musculus
gtgtagctgttcagcatgtgaatgc

SEQ ID NO: 714729 - DNA, 25 bp, Mus musculus
gtgtagctgttctgcatgtgaatgc

SEQ ID NO: 714730 - DNA, 25 bp, Mus musculus
gtgtagcttaacaagaatgttcctt

SEQ ID NO: 714731 - DNA, 25 bp, Mus musculus
gtgtagcttaactagaatgttcctt

SEQ ID NO: 714732 - DNA, 25 bp, Mus musculus
gtgtagcttccaaaattcactgctt

SEQ ID NO: 714733 - DNA, 25 bp, Mus musculus
gtgtagcttccataattcactgctt

SEQ ID NO: 714734 - DNA, 25 bp, Mus musculus
gtgtagcttgagatttacccagcat

SEQ ID NO: 714735 - DNA, 25 bp, Mus musculus
gtgtagcttgagttttacccagcat

SEQ ID NO: 714736 - DNA, 25 bp, Mus musculus
gtgtagctttgcacaccaactgtgc

SEQ ID NO: 714737 - DNA, 25 bp, Mus musculus
gtgtagctttgccatcaatactcca

SEQ ID NO: 714738 - DNA, 25 bp, Mus musculus
gtgtagctttgcgatcaatactcca

SEQ ID NO: 714739 - DNA, 25 bp, Mus musculus
gtgtagctttgctcaccaactgtgc

SEQ ID NO: 714740 - DNA, 25 bp, Mus musculus
gtgtagcttttaattttgtcctttg

SEQ ID NO: 714741 - DNA, 25 bp, Mus musculus
gtgtagcttttatttttgtcctttg

SEQ ID NO: 714742 - DNA, 25 bp, Mus musculus
gtgtagcttttcaacagtttgtgta

SEQ ID NO: 714743 - DNA, 25 bp, Mus musculus
gtgtagcttttctacagtttgtgta

SEQ ID NO: 714744 - DNA, 25 bp, Mus musculus
gtgtagctttttcagcctggaactt

SEQ ID NO: 714745 - DNA, 25 bp, Mus musculus
gtgtagctttttgagcctggaactt

SEQ ID NO: 714746 - DNA, 25 bp, Mus musculus
gtgtaggaaacaaccccacacattc

SEQ ID NO: 714747 - DNA, 25 bp, Mus musculus
gtgtaggaaacatccccacacattc

SEQ ID NO: 714748 - DNA, 25 bp, Mus musculus
gtgtaggaacacatcctgtccttgt

SEQ ID NO: 714749 - DNA, 25 bp, Mus musculus
gtgtaggaacacttcctgtccttgt

SEQ ID NO: 714750 - DNA, 25 bp, Mus musculus
gtgtaggaacggacaccttcagatt

SEQ ID NO: 714751 - DNA, 25 bp, Mus musculus
gtgtaggaacggtcaccttcagatt

SEQ ID NO: 714752 - DNA, 25 bp, Mus musculus
gtgtaggaccaccagagccagaccc

SEQ ID NO: 714753 - DNA, 25 bp, Mus musculus
gtgtaggaccacgagagccagaccc

SEQ ID NO: 714754 - DNA, 25 bp, Mus musculus
gtgtaggcaagtatttaattactct

SEQ ID NO: 714755 - DNA, 25 bp, Mus musculus
gtgtaggcaagtttttaattactct

SEQ ID NO: 714756 - DNA, 25 bp, Mus musculus
gtgtaggccttgaacgtgtggctaa

SEQ ID NO: 714757 - DNA, 25 bp, Mus musculus
gtgtaggccttgtacgtgtggctaa

SEQ ID NO: 714758 - DNA, 25 bp, Mus musculus
gtgtaggctttacttagcttatcaa

SEQ ID NO: 714759 - DNA, 25 bp, Mus musculus
gtgtaggctttagttagcttatcaa

SEQ ID NO: 714760 - DNA, 25 bp, Mus musculus
gtgtagggataccaatccggcattt

SEQ ID NO: 714761 - DNA, 25 bp, Mus musculus
gtgtagggatacgaatccggcattt

SEQ ID NO: 714762 - DNA, 25 bp, Mus musculus
gtgtagggtgttatacctgcttgta

SEQ ID NO: 714763 - DNA, 25 bp, Mus musculus
gtgtagggtgttttacctgcttgta

SEQ ID NO: 714764 - DNA, 25 bp, Mus musculus
gtgtaggtactcaaccatatatgca

SEQ ID NO: 714765 - DNA, 25 bp, Mus musculus
gtgtaggtactcacctccaaatgta

SEQ ID NO: 714766 - DNA, 25 bp, Mus musculus
gtgtaggtactctaccatatatgca

SEQ ID NO: 714767 - DNA, 25 bp, Mus musculus
gtgtaggtactctcctccaaatgta

SEQ ID NO: 714768 - DNA, 25 bp, Mus musculus
gtgtaggtatgtctcaattattgta

SEQ ID NO: 714769 - DNA, 25 bp, Mus musculus
gtgtaggtatgtgtcaattattgta

SEQ ID NO: 714770 - DNA, 25 bp, Mus musculus
gtgtaggtcataacagctgctttga

SEQ ID NO: 714771 - DNA, 25 bp, Mus musculus
gtgtaggtcatacgacaactatcat

SEQ ID NO: 714772 - DNA, 25 bp, Mus musculus
gtgtaggtcataggacaactatcat

SEQ ID NO: 714773 - DNA, 25 bp, Mus musculus
gtgtaggtcatatcagctgctttga

SEQ ID NO: 714774 - DNA, 25 bp, Mus musculus
gtgtaggtgaccaaatgcttcttgt

SEQ ID NO: 714775 - DNA, 25 bp, Mus musculus
gtgtaggtgacctaatgcttcttgt

SEQ ID NO: 714776 - DNA, 25 bp, Mus musculus
gtgtaggtgcctctgaaagtcatgt

SEQ ID NO: 714777 - DNA, 25 bp, Mus musculus
gtgtaggtgcctgtgaaagtcatgt

SEQ ID NO: 714778 - DNA, 25 bp, Mus musculus
gtgtaggtgctgagagctgaaccca

SEQ ID NO: 714779 - DNA, 25 bp, Mus musculus
gtgtaggtgctgtgagctgaaccca

SEQ ID NO: 714780 - DNA, 25 bp, Mus musculus
gtgtaggttaaacgtcacagagctg

SEQ ID NO: 714781 - DNA, 25 bp, Mus musculus
gtgtaggttaaaggtcacagagctg

SEQ ID NO: 714782 - DNA, 25 bp, Mus musculus
gtgtaggttcatctgaccatctcga

SEQ ID NO: 714783 - DNA, 25 bp, Mus musculus
gtgtaggttcatgtgaccatctcga

SEQ ID NO: 714784 - DNA, 25 bp, Mus musculus
gtgtaggttgcacccctatatgaag

SEQ ID NO: 714785 - DNA, 25 bp, Mus musculus
gtgtaggttgcagccctatatgaag

SEQ ID NO: 714786 - DNA, 25 bp, Mus musculus
gtgtaggttttaagtctggtttctt

SEQ ID NO: 714787 - DNA, 25 bp, Mus musculus
gtgtaggttttatgtctggtttctt

SEQ ID NO: 714788 - DNA, 25 bp, Mus musculus
gtgtagtaaaagctgcatatcatta

SEQ ID NO: 714789 - DNA, 25 bp, Mus musculus
gtgtagtaaaaggtgcatatcatta

SEQ ID NO: 714790 - DNA, 25 bp, Mus musculus
gtgtagtaagccaagagtcagccaa

SEQ ID NO: 714791 - DNA, 25 bp, Mus musculus
gtgtagtaagcctagagtcagccaa

SEQ ID NO: 714792 - DNA, 25 bp, Mus musculus
gtgtagtaccttaacctttggatgg

SEQ ID NO: 714793 - DNA, 25 bp, Mus musculus
gtgtagtacctttacctttggatgg

SEQ ID NO: 714794 - DNA, 25 bp, Mus musculus
gtgtagtacttcaaagagcctgcgg

SEQ ID NO: 714795 - DNA, 25 bp, Mus musculus
gtgtagtacttctaagagcctgcgg

SEQ ID NO: 714796 - DNA, 25 bp, Mus musculus
gtgtagtagtgcatacctgtaatct

SEQ ID NO: 714797 - DNA, 25 bp, Mus musculus
gtgtagtagtgcttacctgtaatct

SEQ ID NO: 714798 - DNA, 25 bp, Mus musculus
gtgtagtatcacactgtgtttcctc

SEQ ID NO: 714799 - DNA, 25 bp, Mus musculus
gtgtagtatcactctgtgtttcctc

SEQ ID NO: 714800 - DNA, 25 bp, Mus musculus
gtgtagtccaggctattccagaagt

SEQ ID NO: 714801 - DNA, 25 bp, Mus musculus
gtgtagtccagggtattccagaagt

SEQ ID NO: 714802 - DNA, 25 bp, Mus musculus
gtgtagtcctccataatttcaactc

SEQ ID NO: 714803 - DNA, 25 bp, Mus musculus
gtgtagtcctccttaatttcaactc

SEQ ID NO: 714804 - DNA, 25 bp, Mus musculus
gtgtagtcttgcaaatgttaccaac

SEQ ID NO: 714805 - DNA, 25 bp, Mus musculus
gtgtagtcttgctaatgttaccaac

SEQ ID NO: 714806 - DNA, 25 bp, Mus musculus
gtgtagtctttaagatggtcaccac

SEQ ID NO: 714807 - DNA, 25 bp, Mus musculus
gtgtagtctttatgatggtcaccac

SEQ ID NO: 714808 - DNA, 25 bp, Mus musculus
gtgtagtgacccatggcccagttgt

SEQ ID NO: 714809 - DNA, 25 bp, Mus musculus
gtgtagtgacccttggcccagttgt

SEQ ID NO: 714810 - DNA, 25 bp, Mus musculus
gtgtagtgacgaatttgaccatgtt

SEQ ID NO: 714811 - DNA, 25 bp, Mus musculus
gtgtagtgacgattttgaccatgtt

SEQ ID NO: 714812 - DNA, 25 bp, Mus musculus
gtgtagtgcctcagagcagtgtcta

SEQ ID NO: 714813 - DNA, 25 bp, Mus musculus
gtgtagtgcctctgagcagtgtcta

SEQ ID NO: 714814 - DNA, 25 bp, Mus musculus
gtgtagtggtgaattttctttgcat

SEQ ID NO: 714815 - DNA, 25 bp, Mus musculus
gtgtagtggtgatttttctttgcat

SEQ ID NO: 714816 - DNA, 25 bp, Mus musculus
gtgtagtggtgtatcctggtctgta

SEQ ID NO: 714817 - DNA, 25 bp, Mus musculus
gtgtagtggtgtttcctggtctgta

SEQ ID NO: 714818 - DNA, 25 bp, Mus musculus
gtgtagtgtatgcacatgttcatgt

SEQ ID NO: 714819 - DNA, 25 bp, Mus musculus
gtgtagtgtatggacatgttcatgt

SEQ ID NO: 714820 - DNA, 25 bp, Mus musculus
gtgtagtgtcacacttggctatata

SEQ ID NO: 714821 - DNA, 25 bp, Mus musculus
gtgtagtgtcactcttggctatata

SEQ ID NO: 714822 - DNA, 25 bp, Mus musculus
gtgtagttcaccctgtagagataga

SEQ ID NO: 714823 - DNA, 25 bp, Mus musculus
gtgtagttcaccgtgtagagataga

SEQ ID NO: 714824 - DNA, 25 bp, Mus musculus
gtgtagttcagtaacctcttatttg

SEQ ID NO: 714825 - DNA, 25 bp, Mus musculus
gtgtagttcagttacctcttatttg

SEQ ID NO: 714826 - DNA, 25 bp, Mus musculus
gtgtagttccttagacttcatcaga

SEQ ID NO: 714827 - DNA, 25 bp, Mus musculus
gtgtagttcctttgacttcatcaga

SEQ ID NO: 714828 - DNA, 25 bp, Mus musculus
gtgtagttgctaagagctgctcttc

SEQ ID NO: 714829 - DNA, 25 bp, Mus musculus
gtgtagttgctatgagctgctcttc

SEQ ID NO: 714830 - DNA, 25 bp, Mus musculus
gtgtagttgcttatattctgtgttt

SEQ ID NO: 714831 - DNA, 25 bp, Mus musculus
gtgtagttgcttttattctgtgttt

SEQ ID NO: 714832 - DNA, 25 bp, Mus musculus
gtgtagttgtcaccaccctggacga

SEQ ID NO: 714833 - DNA, 25 bp, Mus musculus
gtgtagttgtcagcaccctggacga

SEQ ID NO: 714834 - DNA, 25 bp, Mus musculus
gtgtagttgttcaggtagaccccaa

SEQ ID NO: 714835 - DNA, 25 bp, Mus musculus
gtgtagttgttctggtagaccccaa

SEQ ID NO: 714836 - DNA, 25 bp, Mus musculus
gtgtagtttatgaattccagcagag

SEQ ID NO: 714837 - DNA, 25 bp, Mus musculus
gtgtagtttatgtattccagcagag

SEQ ID NO: 714838 - DNA, 25 bp, Mus musculus
gtgtagtttcaaccaacaaatgtag

SEQ ID NO: 714839 - DNA, 25 bp, Mus musculus
gtgtagtttcaagcaacaaatgtag

SEQ ID NO: 714840 - DNA, 25 bp, Mus musculus
gtgtagtttgaaagtgacccctgtg

SEQ ID NO: 714841 - DNA, 25 bp, Mus musculus
gtgtagtttgaatgtgacccctgtg

SEQ ID NO: 714842 - DNA, 25 bp, Mus musculus
gtgtataaacaccaacctgcacctt

SEQ ID NO: 714843 - DNA, 25 bp, Mus musculus
gtgtataaacacgaacctgcacctt

SEQ ID NO: 714844 - DNA, 25 bp, Mus musculus
gtgtataaactcacttaactgctga

SEQ ID NO: 714845 - DNA, 25 bp, Mus musculus
gtgtataaactctcttaactgctga

SEQ ID NO: 714846 - DNA, 25 bp, Mus musculus
gtgtataaattcaacaacccaagtt

SEQ ID NO: 714847 - DNA, 25 bp, Mus musculus
gtgtataaattctacaacccaagtt

SEQ ID NO: 714848 - DNA, 25 bp, Mus musculus
gtgtataaattgactctcctgtgta

SEQ ID NO: 714849 - DNA, 25 bp, Mus musculus
gtgtataaattgtctctcctgtgta

SEQ ID NO: 714850 - DNA, 25 bp, Mus musculus
gtgtataactaaacactgttcagta

SEQ ID NO: 714851 - DNA, 25 bp, Mus musculus
gtgtataactaatcactgttcagta

SEQ ID NO: 714852 - DNA, 25 bp, Mus musculus
gtgtataagaccctacgcttttcca

SEQ ID NO: 714853 - DNA, 25 bp, Mus musculus
gtgtataagaccgtacgcttttcca

SEQ ID NO: 714854 - DNA, 25 bp, Mus musculus
gtgtataatgacatagctaattttt

SEQ ID NO: 714855 - DNA, 25 bp, Mus musculus
gtgtataatgacttagctaattttt

SEQ ID NO: 714856 - DNA, 25 bp, Mus musculus
gtgtataatgagattttcctatgac

SEQ ID NO: 714857 - DNA, 25 bp, Mus musculus
gtgtataatgagtttttcctatgac

SEQ ID NO: 714858 - DNA, 25 bp, Mus musculus
gtgtataatggcagccttttccctg

SEQ ID NO: 714859 - DNA, 25 bp, Mus musculus
gtgtataatggctgccttttccctg

SEQ ID NO: 714860 - DNA, 25 bp, Mus musculus
gtgtataattctaactgaccatggt

SEQ ID NO: 714861 - DNA, 25 bp, Mus musculus
gtgtataattcttactgaccatggt

SEQ ID NO: 714862 - DNA, 25 bp, Mus musculus
gtgtataattgcacttttagctcaa

SEQ ID NO: 714863 - DNA, 25 bp, Mus musculus
gtgtataattgctcttttagctcaa

SEQ ID NO: 714864 - DNA, 25 bp, Mus musculus
gtgtataatttgaacagctagatgt

SEQ ID NO: 714865 - DNA, 25 bp, Mus musculus
gtgtataatttgtacagctagatgt

SEQ ID NO: 714866 - DNA, 25 bp, Mus musculus
gtgtatacaaccatggccagcagcc

SEQ ID NO: 714867 - DNA, 25 bp, Mus musculus
gtgtatacaaccttggccagcagcc

SEQ ID NO: 714868 - DNA, 25 bp, Mus musculus
gtgtatacagcaacttgccttctat

SEQ ID NO: 714869 - DNA, 25 bp, Mus musculus
gtgtatacagcatcttgccttctat

SEQ ID NO: 714870 - DNA, 25 bp, Mus musculus
gtgtatacatgaccctcatgtgcac

SEQ ID NO: 714871 - DNA, 25 bp, Mus musculus
gtgtatacatgagcctcatgtgcac

SEQ ID NO: 714872 - DNA, 25 bp, Mus musculus
gtgtatacatttagtttgttcctgt

SEQ ID NO: 714873 - DNA, 25 bp, Mus musculus
gtgtatacattttgtttgttcctgt

SEQ ID NO: 714874 - DNA, 25 bp, Mus musculus
gtgtataccataagtgaagtcctta

SEQ ID NO: 714875 - DNA, 25 bp, Mus musculus
gtgtataccatatgtgaagtcctta

SEQ ID NO: 714876 - DNA, 25 bp, Mus musculus
gtgtatactattactttataagcat

SEQ ID NO: 714877 - DNA, 25 bp, Mus musculus
gtgtatactatttctttataagcat

SEQ ID NO: 714878 - DNA, 25 bp, Mus musculus
gtgtatactgtaaatcctccacctc

SEQ ID NO: 714879 - DNA, 25 bp, Mus musculus
gtgtatactgtatatcctccacctc

SEQ ID NO: 714880 - DNA, 25 bp, Mus musculus
gtgtatacttacaatttctgttatc

SEQ ID NO: 714881 - DNA, 25 bp, Mus musculus
gtgtatacttactatttctgttatc

SEQ ID NO: 714882 - DNA, 25 bp, Mus musculus
gtgtatacttctcctcttccgaagc

SEQ ID NO: 714883 - DNA, 25 bp, Mus musculus
gtgtatacttctgctcttccgaagc

SEQ ID NO: 714884 - DNA, 25 bp, Mus musculus
gtgtatacttgtctagactttgcat

SEQ ID NO: 714885 - DNA, 25 bp, Mus musculus
gtgtatacttgtgtagactttgcat

SEQ ID NO: 714886 - DNA, 25 bp, Mus musculus
gtgtatagaactatatagccctggg

SEQ ID NO: 714887 - DNA, 25 bp, Mus musculus
gtgtatagaactttatagccctggg

SEQ ID NO: 714888 - DNA, 25 bp, Mus musculus
gtgtatagatgaacacacacatact

SEQ ID NO: 714889 - DNA, 25 bp, Mus musculus
gtgtatagatgatcacacacatact

SEQ ID NO: 714890 - DNA, 25 bp, Mus musculus
gtgtatagatgcagccgttgcaggc

SEQ ID NO: 714891 - DNA, 25 bp, Mus musculus
gtgtatagatgctgccgttgcaggc

SEQ ID NO: 714892 - DNA, 25 bp, Mus musculus
gtgtatagcactatgtctaccacca

SEQ ID NO: 714893 - DNA, 25 bp, Mus musculus
gtgtatagcactttgtctaccacca

SEQ ID NO: 714894 - DNA, 25 bp, Mus musculus
gtgtatagcagactcaggtgttcat

SEQ ID NO: 714895 - DNA, 25 bp, Mus musculus
gtgtatagcagactccctttgcttt

SEQ ID NO: 714896 - DNA, 25 bp, Mus musculus
gtgtatagcagagtcaggtgttcat

SEQ ID NO: 714897 - DNA, 25 bp, Mus musculus
gtgtatagcagagtccctttgcttt

SEQ ID NO: 714898 - DNA, 25 bp, Mus musculus
gtgtataggcttccatctagagttt

SEQ ID NO: 714899 - DNA, 25 bp, Mus musculus
gtgtataggcttgcatctagagttt

SEQ ID NO: 714900 - DNA, 25 bp, Mus musculus
gtgtatagtcctcttcaacaatctg

SEQ ID NO: 714901 - DNA, 25 bp, Mus musculus
gtgtatagtcctgttcaacaatctg

SEQ ID NO: 714902 - DNA, 25 bp, Mus musculus
gtgtatagtgtgactgtggcccaga

SEQ ID NO: 714903 - DNA, 25 bp, Mus musculus
gtgtatagtgtgtctgtggcccaga

SEQ ID NO: 714904 - DNA, 25 bp, Mus musculus
gtgtatagttttcacctctgagaat

SEQ ID NO: 714905 - DNA, 25 bp, Mus musculus
gtgtatagttttgacctctgagaat

SEQ ID NO: 714906 - DNA, 25 bp, Mus musculus
gtgtatatacacaaggtactctaaa

SEQ ID NO: 714907 - DNA, 25 bp, Mus musculus
gtgtatatacactaggtactctaaa

SEQ ID NO: 714908 - DNA, 25 bp, Mus musculus
gtgtatatacagatcctagtaaagt

SEQ ID NO: 714909 - DNA, 25 bp, Mus musculus
gtgtatatacagttcctagtaaagt

SEQ ID NO: 714910 - DNA, 25 bp, Mus musculus
gtgtatatacctaggttgttcttta

SEQ ID NO: 714911 - DNA, 25 bp, Mus musculus
gtgtatataccttggttgttcttta

SEQ ID NO: 714912 - DNA, 25 bp, Mus musculus
gtgtatatagcaaaactccctggag

SEQ ID NO: 714913 - DNA, 25 bp, Mus musculus
gtgtatatagcataactccctggag

SEQ ID NO: 714914 - DNA, 25 bp, Mus musculus
gtgtatatccctctgcctacagaga

SEQ ID NO: 714915 - DNA, 25 bp, Mus musculus
gtgtatatccctgtgcctacagaga

SEQ ID NO: 714916 - DNA, 25 bp, Mus musculus
gtgtatatctaacctctgtgagtct

SEQ ID NO: 714917 - DNA, 25 bp, Mus musculus
gtgtatatctaagctctgtgagtct

SEQ ID NO: 714918 - DNA, 25 bp, Mus musculus
gtgtatatgtgcaaaggtccggaaa

SEQ ID NO: 714919 - DNA, 25 bp, Mus musculus
gtgtatatgtgctaaggtccggaaa

SEQ ID NO: 714920 - DNA, 25 bp, Mus musculus
gtgtatattacaccaatgccactgt

SEQ ID NO: 714921 - DNA, 25 bp, Mus musculus
gtgtatattacactgtcctttagaa

SEQ ID NO: 714922 - DNA, 25 bp, Mus musculus
gtgtatattacagcaatgccactgt

SEQ ID NO: 714923 - DNA, 25 bp, Mus musculus
gtgtatattacagtgtcctttagaa

SEQ ID NO: 714924 - DNA, 25 bp, Mus musculus
gtgtatattatgacccctgaaactg

SEQ ID NO: 714925 - DNA, 25 bp, Mus musculus
gtgtatattatgtcccctgaaactg

SEQ ID NO: 714926 - DNA, 25 bp, Mus musculus
gtgtatattccaagactgttccctg

SEQ ID NO: 714927 - DNA, 25 bp, Mus musculus
gtgtatattccatgactgttccctg

SEQ ID NO: 714928 - DNA, 25 bp, Mus musculus
gtgtatattctgatccactttgaaa

SEQ ID NO: 714929 - DNA, 25 bp, Mus musculus
gtgtatattctgttccactttgaaa

SEQ ID NO: 714930 - DNA, 25 bp, Mus musculus
gtgtatatttttctactaccagact

SEQ ID NO: 714931 - DNA, 25 bp, Mus musculus
gtgtatatttttgtactaccagact

SEQ ID NO: 714932 - DNA, 25 bp, Mus musculus
gtgtatcaagttatctctttgttaa

SEQ ID NO: 714933 - DNA, 25 bp, Mus musculus
gtgtatcaagttttctctttgttaa

SEQ ID NO: 714934 - DNA, 25 bp, Mus musculus
gtgtatcacatgcatgtctgcctag

SEQ ID NO: 714935 - DNA, 25 bp, Mus musculus
gtgtatcacatggatgtctgcctag

SEQ ID NO: 714936 - DNA, 25 bp, Mus musculus
gtgtatcacattctcacttacgcat

SEQ ID NO: 714937 - DNA, 25 bp, Mus musculus
gtgtatcacattgtcacttacgcat

SEQ ID NO: 714938 - DNA, 25 bp, Mus musculus
gtgtatcacgcacactcacagagca

SEQ ID NO: 714939 - DNA, 25 bp, Mus musculus
gtgtatcacgcagactcacagagca

SEQ ID NO: 714940 - DNA, 25 bp, Mus musculus
gtgtatcacgtgatattcttcctgt

SEQ ID NO: 714941 - DNA, 25 bp, Mus musculus
gtgtatcacgtgttattcttcctgt

SEQ ID NO: 714942 - DNA, 25 bp, Mus musculus
gtgtatcactagacagtcttttctt

SEQ ID NO: 714943 - DNA, 25 bp, Mus musculus
gtgtatcactagtcagtcttttctt

SEQ ID NO: 714944 - DNA, 25 bp, Mus musculus
gtgtatcacttcagtggtaaacatg

SEQ ID NO: 714945 - DNA, 25 bp, Mus musculus
gtgtatcacttctgtggtaaacatg

SEQ ID NO: 714946 - DNA, 25 bp, Mus musculus
gtgtatcactttacccaccagttgt

SEQ ID NO: 714947 - DNA, 25 bp, Mus musculus
gtgtatcacttttcccaccagttgt

SEQ ID NO: 714948 - DNA, 25 bp, Mus musculus
gtgtatcagcacctccagatcagaa

SEQ ID NO: 714949 - DNA, 25 bp, Mus musculus
gtgtatcagcacgtccagatcagaa

SEQ ID NO: 714950 - DNA, 25 bp, Mus musculus
gtgtatcagggaataactatctgct

SEQ ID NO: 714951 - DNA, 25 bp, Mus musculus
gtgtatcagggattaactatctgct

SEQ ID NO: 714952 - DNA, 25 bp, Mus musculus
gtgtatcatagaaactttcctacca

SEQ ID NO: 714953 - DNA, 25 bp, Mus musculus
gtgtatcatagatactttcctacca

SEQ ID NO: 714954 - DNA, 25 bp, Mus musculus
gtgtatcatctgccaaaccaacgag

SEQ ID NO: 714955 - DNA, 25 bp, Mus musculus
gtgtatcatctggcaaaccaacgag

SEQ ID NO: 714956 - DNA, 25 bp, Mus musculus
gtgtatcatgtaatttctgccttat

SEQ ID NO: 714957 - DNA, 25 bp, Mus musculus
gtgtatcatgtattttctgccttat

SEQ ID NO: 714958 - DNA, 25 bp, Mus musculus
gtgtatccaagtactaccactaggt

SEQ ID NO: 714959 - DNA, 25 bp, Mus musculus
gtgtatccaagttctaccactaggt

SEQ ID NO: 714960 - DNA, 25 bp, Mus musculus
gtgtatccaggacaggttcccatcc

SEQ ID NO: 714961 - DNA, 25 bp, Mus musculus
gtgtatccaggagaggttcccatcc

SEQ ID NO: 714962 - DNA, 25 bp, Mus musculus
gtgtatccatgcacaagattgctgt

SEQ ID NO: 714963 - DNA, 25 bp, Mus musculus
gtgtatccatgctcaagattgctgt

SEQ ID NO: 714964 - DNA, 25 bp, Mus musculus
gtgtatccccttaatctaaaagtga

SEQ ID NO: 714965 - DNA, 25 bp, Mus musculus
gtgtatcccctttatctaaaagtga

SEQ ID NO: 714966 - DNA, 25 bp, Mus musculus
gtgtatccctaaataagtggctcta

SEQ ID NO: 714967 - DNA, 25 bp, Mus musculus
gtgtatccctaattaagtggctcta

SEQ ID NO: 714968 - DNA, 25 bp, Mus musculus
gtgtatccctgtcaggagtacccag

SEQ ID NO: 714969 - DNA, 25 bp, Mus musculus
gtgtatccctgtgaggagtacccag

SEQ ID NO: 714970 - DNA, 25 bp, Mus musculus
gtgtatcctcatatcgggtgtaaga

SEQ ID NO: 714971 - DNA, 25 bp, Mus musculus
gtgtatcctcatttcgggtgtaaga

SEQ ID NO: 714972 - DNA, 25 bp, Mus musculus
gtgtatcctgggaaccctctgagct

SEQ ID NO: 714973 - DNA, 25 bp, Mus musculus
gtgtatcctgggtaccctctgagct

SEQ ID NO: 714974 - DNA, 25 bp, Mus musculus
gtgtatcctttgcacaccatactat

SEQ ID NO: 714975 - DNA, 25 bp, Mus musculus
gtgtatcctttggacaccatactat

SEQ ID NO: 714976 - DNA, 25 bp, Mus musculus
gtgtatcgacagaactgggctgact

SEQ ID NO: 714977 - DNA, 25 bp, Mus musculus
gtgtatcgacagtactgggctgact

SEQ ID NO: 714978 - DNA, 25 bp, Mus musculus
gtgtatcgactaacactgtgaatcc

SEQ ID NO: 714979 - DNA, 25 bp, Mus musculus
gtgtatcgactatcactgtgaatcc

SEQ ID NO: 714980 - DNA, 25 bp, Mus musculus
gtgtatcgagtgaagccagtttcca

SEQ ID NO: 714981 - DNA, 25 bp, Mus musculus
gtgtatcgagtgtagccagtttcca

SEQ ID NO: 714982 - DNA, 25 bp, Mus musculus
gtgtatcgattactactaattccag

SEQ ID NO: 714983 - DNA, 25 bp, Mus musculus
gtgtatcgattagtactaattccag

SEQ ID NO: 714984 - DNA, 25 bp, Mus musculus
gtgtatcgtcataccagtttgtaaa

SEQ ID NO: 714985 - DNA, 25 bp, Mus musculus
gtgtatcgtcattccagtttgtaaa

SEQ ID NO: 714986 - DNA, 25 bp, Mus musculus
gtgtatcgtgttctctttgagctga

SEQ ID NO: 714987 - DNA, 25 bp, Mus musculus
gtgtatcgtgttgtctttgagctga

SEQ ID NO: 714988 - DNA, 25 bp, Mus musculus
gtgtatctaagtctgaattcctcca

SEQ ID NO: 714989 - DNA, 25 bp, Mus musculus
gtgtatctaagtgtgaattcctcca

SEQ ID NO: 714990 - DNA, 25 bp, Mus musculus
gtgtatctaataagcccaggttcag

SEQ ID NO: 714991 - DNA, 25 bp, Mus musculus
gtgtatctaatatgcccaggttcag

SEQ ID NO: 714992 - DNA, 25 bp, Mus musculus
gtgtatctacagatcacaggtttaa

SEQ ID NO: 714993 - DNA, 25 bp, Mus musculus
gtgtatctacagttcacaggtttaa

SEQ ID NO: 714994 - DNA, 25 bp, Mus musculus
gtgtatctactgatactctggtgac

SEQ ID NO: 714995 - DNA, 25 bp, Mus musculus
gtgtatctactgttactctggtgac

SEQ ID NO: 714996 - DNA, 25 bp, Mus musculus
gtgtatctcaacagcacacgtgcgc

SEQ ID NO: 714997 - DNA, 25 bp, Mus musculus
gtgtatctcaactgcacacgtgcgc

SEQ ID NO: 714998 - DNA, 25 bp, Mus musculus
gtgtatctccttaagttctcaattc

SEQ ID NO: 714999 - DNA, 25 bp, Mus musculus
gtgtatctcctttagttctcaattc

SEQ ID NO: 715000 - DNA, 25 bp, Mus musculus
gtgtatctcgtgcaatcagtggtta

SEQ ID NO: 715001 - DNA, 25 bp, Mus musculus
gtgtatctcgtggaatcagtggtta

SEQ ID NO: 715002 - DNA, 25 bp, Mus musculus
gtgtatctctctatctttgtatctg

SEQ ID NO: 715003 - DNA, 25 bp, Mus musculus
gtgtatctctctttctttgtatctg

SEQ ID NO: 715004 - DNA, 25 bp, Mus musculus
gtgtatctgaatactctgtatggtt

SEQ ID NO: 715005 - DNA, 25 bp, Mus musculus
gtgtatctgaattctctgtatggtt

SEQ ID NO: 715006 - DNA, 25 bp, Mus musculus
gtgtatctgagcacattatgagttc

SEQ ID NO: 715007 - DNA, 25 bp, Mus musculus
gtgtatctgagctcattatgagttc

SEQ ID NO: 715008 - DNA, 25 bp, Mus musculus
gtgtatctgctgacagtccatccat

SEQ ID NO: 715009 - DNA, 25 bp, Mus musculus
gtgtatctgctgtcagtccatccat

SEQ ID NO: 715010 - DNA, 25 bp, Mus musculus
gtgtatctggctactttgcacatct

SEQ ID NO: 715011 - DNA, 25 bp, Mus musculus
gtgtatctggcttctttgcacatct

SEQ ID NO: 715012 - DNA, 25 bp, Mus musculus
gtgtatctgtggcagctagactgtt

SEQ ID NO: 715013 - DNA, 25 bp, Mus musculus
gtgtatctgtgggagctagactgtt

SEQ ID NO: 715014 - DNA, 25 bp, Mus musculus
gtgtatctgttgagccaggcagctg

SEQ ID NO: 715015 - DNA, 25 bp, Mus musculus
gtgtatctgttgtgccaggcagctg

SEQ ID NO: 715016 - DNA, 25 bp, Mus musculus
gtgtatcttacacgcagatccttgg

SEQ ID NO: 715017 - DNA, 25 bp, Mus musculus
gtgtatcttacaggcagatccttgg

SEQ ID NO: 715018 - DNA, 25 bp, Mus musculus
gtgtatcttatgcaagaaacccctt

SEQ ID NO: 715019 - DNA, 25 bp, Mus musculus
gtgtatcttatggaagaaacccctt

SEQ ID NO: 715020 - DNA, 25 bp, Mus musculus
gtgtatcttattacttaaacccata

SEQ ID NO: 715021 - DNA, 25 bp, Mus musculus
gtgtatcttatttcttaaacccata

SEQ ID NO: 715022 - DNA, 25 bp, Mus musculus
gtgtatcttcctactactgtggata

SEQ ID NO: 715023 - DNA, 25 bp, Mus musculus
gtgtatcttccttctactgtggata

SEQ ID NO: 715024 - DNA, 25 bp, Mus musculus
gtgtatcttctcaaaccaagtaccg

SEQ ID NO: 715025 - DNA, 25 bp, Mus musculus
gtgtatcttctctaaccaagtaccg

SEQ ID NO: 715026 - DNA, 25 bp, Mus musculus
gtgtatcttgatatcattaacaggt

SEQ ID NO: 715027 - DNA, 25 bp, Mus musculus
gtgtatcttgatttcattaacaggt

SEQ ID NO: 715028 - DNA, 25 bp, Mus musculus
gtgtatgaatacacaggctcagtcc

SEQ ID NO: 715029 - DNA, 25 bp, Mus musculus
gtgtatgaatactcaggctcagtcc

SEQ ID NO: 715030 - DNA, 25 bp, Mus musculus
gtgtatgacaatctacaggcccagt

SEQ ID NO: 715031 - DNA, 25 bp, Mus musculus
gtgtatgacaatgtacaggcccagt

SEQ ID NO: 715032 - DNA, 25 bp, Mus musculus
gtgtatgacatcctgacagctccgg

SEQ ID NO: 715033 - DNA, 25 bp, Mus musculus
gtgtatgacatcgtgacagctccgg

SEQ ID NO: 715034 - DNA, 25 bp, Mus musculus
gtgtatgaccagcagcgttttgata

SEQ ID NO: 715035 - DNA, 25 bp, Mus musculus
gtgtatgaccaggagcgttttgata

SEQ ID NO: 715036 - DNA, 25 bp, Mus musculus
gtgtatgacgtaactcccattctac

SEQ ID NO: 715037 - DNA, 25 bp, Mus musculus
gtgtatgacgtatctcccattctac

SEQ ID NO: 715038 - DNA, 25 bp, Mus musculus
gtgtatgactctagatgacggtctt

SEQ ID NO: 715039 - DNA, 25 bp, Mus musculus
gtgtatgactcttgatgacggtctt

SEQ ID NO: 715040 - DNA, 25 bp, Mus musculus
gtgtatgacttcagccttggggcaa

SEQ ID NO: 715041 - DNA, 25 bp, Mus musculus
gtgtatgacttctgccttggggcaa

SEQ ID NO: 715042 - DNA, 25 bp, Mus musculus
gtgtatgagcaaactaagcccctac

SEQ ID NO: 715043 - DNA, 25 bp, Mus musculus
gtgtatgagcaatctaagcccctac

SEQ ID NO: 715044 - DNA, 25 bp, Mus musculus
gtgtatgaggtgaccgtgcagccta

SEQ ID NO: 715045 - DNA, 25 bp, Mus musculus
gtgtatgaggtgtccgtgcagccta

SEQ ID NO: 715046 - DNA, 25 bp, Mus musculus
gtgtatgatctgaccaaaacctttc

SEQ ID NO: 715047 - DNA, 25 bp, Mus musculus
gtgtatgatctgtccaaaacctttc

SEQ ID NO: 715048 - DNA, 25 bp, Mus musculus
gtgtatgattacaggccttttccat

SEQ ID NO: 715049 - DNA, 25 bp, Mus musculus
gtgtatgattactggccttttccat

SEQ ID NO: 715050 - DNA, 25 bp, Mus musculus
gtgtatgcaatacccttggaggcca

SEQ ID NO: 715051 - DNA, 25 bp, Mus musculus
gtgtatgcaatagccttggaggcca

SEQ ID NO: 715052 - DNA, 25 bp, Mus musculus
gtgtatgcacaactcactcgtccaa

SEQ ID NO: 715053 - DNA, 25 bp, Mus musculus
gtgtatgcacaagtcactcgtccaa

SEQ ID NO: 715054 - DNA, 25 bp, Mus musculus
gtgtatgcacatacgctgagtactg

SEQ ID NO: 715055 - DNA, 25 bp, Mus musculus
gtgtatgcacatatctcagttctgc

SEQ ID NO: 715056 - DNA, 25 bp, Mus musculus
gtgtatgcacatcccaagtgtggag

SEQ ID NO: 715057 - DNA, 25 bp, Mus musculus
gtgtatgcacatgccaagtgtggag

SEQ ID NO: 715058 - DNA, 25 bp, Mus musculus
gtgtatgcacattcgctgagtactg

SEQ ID NO: 715059 - DNA, 25 bp, Mus musculus
gtgtatgcacatttctcagttctgc

SEQ ID NO: 715060 - DNA, 25 bp, Mus musculus
gtgtatgcacgacttgcggtccaaa

SEQ ID NO: 715061 - DNA, 25 bp, Mus musculus
gtgtatgcacgagttgcggtccaaa

SEQ ID NO: 715062 - DNA, 25 bp, Mus musculus
gtgtatgcagctcggaagcagtccc

SEQ ID NO: 715063 - DNA, 25 bp, Mus musculus
gtgtatgcagctgggaagcagtccc

SEQ ID NO: 715064 - DNA, 25 bp, Mus musculus
gtgtatgcatttccaagcaccgtgg

SEQ ID NO: 715065 - DNA, 25 bp, Mus musculus
gtgtatgcatttgcaagcaccgtgg

SEQ ID NO: 715066 - DNA, 25 bp, Mus musculus
gtgtatgccaagattttcggtttct

SEQ ID NO: 715067 - DNA, 25 bp, Mus musculus
gtgtatgccaagtttttcggtttct

SEQ ID NO: 715068 - DNA, 25 bp, Mus musculus
gtgtatgccccacgagagcaccgga

SEQ ID NO: 715069 - DNA, 25 bp, Mus musculus
gtgtatgccccaggagagcaccgga

SEQ ID NO: 715070 - DNA, 25 bp, Mus musculus
gtgtatgcccttcatggtgtgtccc

SEQ ID NO: 715071 - DNA, 25 bp, Mus musculus
gtgtatgcccttgatggtgtgtccc

SEQ ID NO: 715072 - DNA, 25 bp, Mus musculus
gtgtatgccttaattctggcactga

SEQ ID NO: 715073 - DNA, 25 bp, Mus musculus
gtgtatgccttatttctggcactga

SEQ ID NO: 715074 - DNA, 25 bp, Mus musculus
gtgtatgcgcctcagtgagcactgc

SEQ ID NO: 715075 - DNA, 25 bp, Mus musculus
gtgtatgcgcctgagtgagcactgc

SEQ ID NO: 715076 - DNA, 25 bp, Mus musculus
gtgtatgctaggaaatatccataac

SEQ ID NO: 715077 - DNA, 25 bp, Mus musculus
gtgtatgctaggtaatatccataac

SEQ ID NO: 715078 - DNA, 25 bp, Mus musculus
gtgtatgcttacatgcccaacgggt

SEQ ID NO: 715079 - DNA, 25 bp, Mus musculus
gtgtatgcttacctattgagtccag

SEQ ID NO: 715080 - DNA, 25 bp, Mus musculus
gtgtatgcttacgtattgagtccag

SEQ ID NO: 715081 - DNA, 25 bp, Mus musculus
gtgtatgcttacttgcccaacgggt

SEQ ID NO: 715082 - DNA, 25 bp, Mus musculus
gtgtatggagctcgatctatctttt

SEQ ID NO: 715083 - DNA, 25 bp, Mus musculus
gtgtatggagctggatctatctttt

SEQ ID NO: 715084 - DNA, 25 bp, Mus musculus
gtgtatggatctatgagctctcttt

SEQ ID NO: 715085 - DNA, 25 bp, Mus musculus
gtgtatggatctttgagctctcttt

SEQ ID NO: 715086 - DNA, 25 bp, Mus musculus
gtgtatggccatagagtgatatctt

SEQ ID NO: 715087 - DNA, 25 bp, Mus musculus
gtgtatggccattgagtgatatctt

SEQ ID NO: 715088 - DNA, 25 bp, Mus musculus
gtgtatgggctcacaacttgtttgg

SEQ ID NO: 715089 - DNA, 25 bp, Mus musculus
gtgtatgggctctcaacttgtttgg

SEQ ID NO: 715090 - DNA, 25 bp, Mus musculus
gtgtatggtctcaactttggcagca

SEQ ID NO: 715091 - DNA, 25 bp, Mus musculus
gtgtatggtctctactttggcagca

SEQ ID NO: 715092 - DNA, 25 bp, Mus musculus
gtgtatggtgacaactgtccaaaca

SEQ ID NO: 715093 - DNA, 25 bp, Mus musculus
gtgtatggtgactactgtccaaaca

SEQ ID NO: 715094 - DNA, 25 bp, Mus musculus
gtgtatgtaagtccagggcctgcca

SEQ ID NO: 715095 - DNA, 25 bp, Mus musculus
gtgtatgtaagtgcagggcctgcca

SEQ ID NO: 715096 - DNA, 25 bp, Mus musculus
gtgtatgtacctcacgcatgcctgg

SEQ ID NO: 715097 - DNA, 25 bp, Mus musculus
gtgtatgtacctgacgcatgcctgg

SEQ ID NO: 715098 - DNA, 25 bp, Mus musculus
gtgtatgtatgcaatctcagattct

SEQ ID NO: 715099 - DNA, 25 bp, Mus musculus
gtgtatgtatgctatctcagattct

SEQ ID NO: 715100 - DNA, 25 bp, Mus musculus
gtgtatgtattcctgtactggtaac

SEQ ID NO: 715101 - DNA, 25 bp, Mus musculus
gtgtatgtattcgtgtactggtaac

SEQ ID NO: 715102 - DNA, 25 bp, Mus musculus
gtgtatgtcaagctggccagcctct

SEQ ID NO: 715103 - DNA, 25 bp, Mus musculus
gtgtatgtcaaggtggccagcctct

SEQ ID NO: 715104 - DNA, 25 bp, Mus musculus
gtgtatgtgagcacagtaactggtc

SEQ ID NO: 715105 - DNA, 25 bp, Mus musculus
gtgtatgtgagctcagtaactggtc

SEQ ID NO: 715106 - DNA, 25 bp, Mus musculus
gtgtatgtgatcactgtttttctgt

SEQ ID NO: 715107 - DNA, 25 bp, Mus musculus
gtgtatgtgatctctgtttttctgt

SEQ ID NO: 715108 - DNA, 25 bp, Mus musculus
gtgtatgtgcatcagaacccagtat

SEQ ID NO: 715109 - DNA, 25 bp, Mus musculus
gtgtatgtgcatgagaacccagtat

SEQ ID NO: 715110 - DNA, 25 bp, Mus musculus
gtgtatgtgggcacactgtcaccat

SEQ ID NO: 715111 - DNA, 25 bp, Mus musculus
gtgtatgtgggctcactgtcaccat

SEQ ID NO: 715112 - DNA, 25 bp, Mus musculus
gtgtatgtgtaaacgctccaagtag

SEQ ID NO: 715113 - DNA, 25 bp, Mus musculus
gtgtatgtgtaatcgctccaagtag

SEQ ID NO: 715114 - DNA, 25 bp, Mus musculus
gtgtatgtgtctacgtctatgtatg

SEQ ID NO: 715115 - DNA, 25 bp, Mus musculus
gtgtatgtgtcttcgtctatgtatg

SEQ ID NO: 715116 - DNA, 25 bp, Mus musculus
gtgtatgtgtggataaaaggtcaat

SEQ ID NO: 715117 - DNA, 25 bp, Mus musculus
gtgtatgtgtggttaaaaggtcaat

SEQ ID NO: 715118 - DNA, 25 bp, Mus musculus
gtgtatgtgttgataatgttgttta

SEQ ID NO: 715119 - DNA, 25 bp, Mus musculus
gtgtatgtgttgttaatgttgttta

SEQ ID NO: 715120 - DNA, 25 bp, Mus musculus
gtgtatgtgtttaacctggtgtgaa

SEQ ID NO: 715121 - DNA, 25 bp, Mus musculus
gtgtatgtgtttactaccatcattt

SEQ ID NO: 715122 - DNA, 25 bp, Mus musculus
gtgtatgtgttttacctggtgtgaa

SEQ ID NO: 715123 - DNA, 25 bp, Mus musculus
gtgtatgtgttttctaccatcattt

SEQ ID NO: 715124 - DNA, 25 bp, Mus musculus
gtgtatgttactcacattttatgta

SEQ ID NO: 715125 - DNA, 25 bp, Mus musculus
gtgtatgttactgacattttatgta

SEQ ID NO: 715126 - DNA, 25 bp, Mus musculus
gtgtatgttctgagaaggcctctga

SEQ ID NO: 715127 - DNA, 25 bp, Mus musculus
gtgtatgttctgtgaaggcctctga

SEQ ID NO: 715128 - DNA, 25 bp, Mus musculus
gtgtatgtttatcacttccacaaaa

SEQ ID NO: 715129 - DNA, 25 bp, Mus musculus
gtgtatgtttatgacttccacaaaa

SEQ ID NO: 715130 - DNA, 25 bp, Mus musculus
gtgtattagcatcctttgaggcaag

SEQ ID NO: 715131 - DNA, 25 bp, Mus musculus
gtgtattagcatgctttgaggcaag

SEQ ID NO: 715132 - DNA, 25 bp, Mus musculus
gtgtattataggctcctgcattttt

SEQ ID NO: 715133 - DNA, 25 bp, Mus musculus
gtgtattatagggtcctgcattttt

SEQ ID NO: 715134 - DNA, 25 bp, Mus musculus
gtgtattatcttactcccacaaaac

SEQ ID NO: 715135 - DNA, 25 bp, Mus musculus
gtgtattatctttctcccacaaaac

SEQ ID NO: 715136 - DNA, 25 bp, Mus musculus
gtgtattattacctctatgtaccaa

SEQ ID NO: 715137 - DNA, 25 bp, Mus musculus
gtgtattattacgtctatgtaccaa

SEQ ID NO: 715138 - DNA, 25 bp, Mus musculus
gtgtattatttgagttgattcttta

SEQ ID NO: 715139 - DNA, 25 bp, Mus musculus
gtgtattatttgtgttgattcttta

SEQ ID NO: 715140 - DNA, 25 bp, Mus musculus
gtgtattcagacatcagtcctgaaa

SEQ ID NO: 715141 - DNA, 25 bp, Mus musculus
gtgtattcagacttcagtcctgaaa

SEQ ID NO: 715142 - DNA, 25 bp, Mus musculus
gtgtattcagagacaaccacgggaa

SEQ ID NO: 715143 - DNA, 25 bp, Mus musculus
gtgtattcagagtcaaccacgggaa

SEQ ID NO: 715144 - DNA, 25 bp, Mus musculus
gtgtattcagtgatcacagtcagca

SEQ ID NO: 715145 - DNA, 25 bp, Mus musculus
gtgtattcagtgttcacagtcagca

SEQ ID NO: 715146 - DNA, 25 bp, Mus musculus
gtgtattcatggaactctaaggaaa

SEQ ID NO: 715147 - DNA, 25 bp, Mus musculus
gtgtattcatggacaccccagtatg

SEQ ID NO: 715148 - DNA, 25 bp, Mus musculus
gtgtattcatggtactctaaggaaa

SEQ ID NO: 715149 - DNA, 25 bp, Mus musculus
gtgtattcatggtcaccccagtatg

SEQ ID NO: 715150 - DNA, 25 bp, Mus musculus
gtgtattcccttcgaatgtatcaaa

SEQ ID NO: 715151 - DNA, 25 bp, Mus musculus
gtgtattcccttggaatgtatcaaa

SEQ ID NO: 715152 - DNA, 25 bp, Mus musculus
gtgtattcctcaagaatgctctcta

SEQ ID NO: 715153 - DNA, 25 bp, Mus musculus
gtgtattcctcacaacctgtttttg

SEQ ID NO: 715154 - DNA, 25 bp, Mus musculus
gtgtattcctcacatctgcaaccca

SEQ ID NO: 715155 - DNA, 25 bp, Mus musculus
gtgtattcctcagaacctgtttttg

SEQ ID NO: 715156 - DNA, 25 bp, Mus musculus
gtgtattcctcagatctgcaaccca

SEQ ID NO: 715157 - DNA, 25 bp, Mus musculus
gtgtattcctcatgaatgctctcta

SEQ ID NO: 715158 - DNA, 25 bp, Mus musculus
gtgtattcctggactcggagcaaat

SEQ ID NO: 715159 - DNA, 25 bp, Mus musculus
gtgtattcctggtctcggagcaaat

SEQ ID NO: 715160 - DNA, 25 bp, Mus musculus
gtgtattcctttcatttagttgcta

SEQ ID NO: 715161 - DNA, 25 bp, Mus musculus
gtgtattcctttgatttagttgcta

SEQ ID NO: 715162 - DNA, 25 bp, Mus musculus
gtgtattctacgagaactttatggt

SEQ ID NO: 715163 - DNA, 25 bp, Mus musculus
gtgtattctacgtgaactttatggt

SEQ ID NO: 715164 - DNA, 25 bp, Mus musculus
gtgtattctcacattatgactgaca

SEQ ID NO: 715165 - DNA, 25 bp, Mus musculus
gtgtattctcactttatgactgaca

SEQ ID NO: 715166 - DNA, 25 bp, Mus musculus
gtgtattctctacctcagggctata

SEQ ID NO: 715167 - DNA, 25 bp, Mus musculus
gtgtattctctagctcagggctata

SEQ ID NO: 715168 - DNA, 25 bp, Mus musculus
gtgtattctctgcatccctaagtgc

SEQ ID NO: 715169 - DNA, 25 bp, Mus musculus
gtgtattctctggatccctaagtgc

SEQ ID NO: 715170 - DNA, 25 bp, Mus musculus
gtgtattctgatccttaatccctga

SEQ ID NO: 715171 - DNA, 25 bp, Mus musculus
gtgtattctgatgcttaatccctga

SEQ ID NO: 715172 - DNA, 25 bp, Mus musculus
gtgtattcttcaaataacttcccag

SEQ ID NO: 715173 - DNA, 25 bp, Mus musculus
gtgtattcttcatataacttcccag

SEQ ID NO: 715174 - DNA, 25 bp, Mus musculus
gtgtattctttgaatgctgctgact

SEQ ID NO: 715175 - DNA, 25 bp, Mus musculus
gtgtattctttgtatgctgctgact

SEQ ID NO: 715176 - DNA, 25 bp, Mus musculus
gtgtattgaagccacatcacccagg

SEQ ID NO: 715177 - DNA, 25 bp, Mus musculus
gtgtattgaagcgacatcacccagg

SEQ ID NO: 715178 - DNA, 25 bp, Mus musculus
gtgtattgaattaactgtgtgctca

SEQ ID NO: 715179 - DNA, 25 bp, Mus musculus
gtgtattgaatttactgtgtgctca

SEQ ID NO: 715180 - DNA, 25 bp, Mus musculus
gtgtattgatcacaaacatcacaga

SEQ ID NO: 715181 - DNA, 25 bp, Mus musculus
gtgtattgatcagaaacatcacaga

SEQ ID NO: 715182 - DNA, 25 bp, Mus musculus
gtgtattgcccactttctagtgaat

SEQ ID NO: 715183 - DNA, 25 bp, Mus musculus
gtgtattgcccagtttctagtgaat

SEQ ID NO: 715184 - DNA, 25 bp, Mus musculus
gtgtattgccccagcggagagaaat

SEQ ID NO: 715185 - DNA, 25 bp, Mus musculus
gtgtattgcccctgcggagagaaat

SEQ ID NO: 715186 - DNA, 25 bp, Mus musculus
gtgtattgtcaacgttaaaccaagt

SEQ ID NO: 715187 - DNA, 25 bp, Mus musculus
gtgtattgtcaaggttaaaccaagt

SEQ ID NO: 715188 - DNA, 25 bp, Mus musculus
gtgtattgttggatggcaagcccat

SEQ ID NO: 715189 - DNA, 25 bp, Mus musculus
gtgtattgttggttggcaagcccat

SEQ ID NO: 715190 - DNA, 25 bp, Mus musculus
gtgtatttaaatacccctgaattct

SEQ ID NO: 715191 - DNA, 25 bp, Mus musculus
gtgtatttaaatccttgtgcctatg

SEQ ID NO: 715192 - DNA, 25 bp, Mus musculus
gtgtatttaaatgcttgtgcctatg

SEQ ID NO: 715193 - DNA, 25 bp, Mus musculus
gtgtatttaaattcccctgaattct

SEQ ID NO: 715194 - DNA, 25 bp, Mus musculus
gtgtatttaatgagcacaagcttgg

SEQ ID NO: 715195 - DNA, 25 bp, Mus musculus
gtgtatttaatgtgcacaagcttgg

SEQ ID NO: 715196 - DNA, 25 bp, Mus musculus
gtgtatttacagatgcccttttttg

SEQ ID NO: 715197 - DNA, 25 bp, Mus musculus
gtgtatttacagttgcccttttttg

SEQ ID NO: 715198 - DNA, 25 bp, Mus musculus
gtgtatttactcatcacagacctcc

SEQ ID NO: 715199 - DNA, 25 bp, Mus musculus
gtgtatttactcttcacagacctcc

SEQ ID NO: 715200 - DNA, 25 bp, Mus musculus
gtgtatttagccataagcttctccc

SEQ ID NO: 715201 - DNA, 25 bp, Mus musculus
gtgtatttagccttaagcttctccc

SEQ ID NO: 715202 - DNA, 25 bp, Mus musculus
gtgtatttagtcacatctttccgag

SEQ ID NO: 715203 - DNA, 25 bp, Mus musculus
gtgtatttagtctcatctttccgag

SEQ ID NO: 715204 - DNA, 25 bp, Mus musculus
gtgtatttatgcattgattcatagt

SEQ ID NO: 715205 - DNA, 25 bp, Mus musculus
gtgtatttatgctttgattcatagt

SEQ ID NO: 715206 - DNA, 25 bp, Mus musculus
gtgtatttattcaaggtgactgctt

SEQ ID NO: 715207 - DNA, 25 bp, Mus musculus
gtgtatttattctaggtgactgctt

SEQ ID NO: 715208 - DNA, 25 bp, Mus musculus
gtgtatttcccactgataactttaa

SEQ ID NO: 715209 - DNA, 25 bp, Mus musculus
gtgtatttcccagtgataactttaa

SEQ ID NO: 715210 - DNA, 25 bp, Mus musculus
gtgtatttccccagtcgggcacatg

SEQ ID NO: 715211 - DNA, 25 bp, Mus musculus
gtgtatttcccctgtcgggcacatg

SEQ ID NO: 715212 - DNA, 25 bp, Mus musculus
gtgtatttcctcagttcatagtctt

SEQ ID NO: 715213 - DNA, 25 bp, Mus musculus
gtgtatttcctctgttcatagtctt

SEQ ID NO: 715214 - DNA, 25 bp, Mus musculus
gtgtatttcggtcgacttgctttta

SEQ ID NO: 715215 - DNA, 25 bp, Mus musculus
gtgtatttcggtggacttgctttta

SEQ ID NO: 715216 - DNA, 25 bp, Mus musculus
gtgtatttctggcttctttataaaa

SEQ ID NO: 715217 - DNA, 25 bp, Mus musculus
gtgtatttctgggttctttataaaa

SEQ ID NO: 715218 - DNA, 25 bp, Mus musculus
gtgtatttctgtacattttctgttc

SEQ ID NO: 715219 - DNA, 25 bp, Mus musculus
gtgtatttctgtatcccacatttgt

SEQ ID NO: 715220 - DNA, 25 bp, Mus musculus
gtgtatttctgttcattttctgttc

SEQ ID NO: 715221 - DNA, 25 bp, Mus musculus
gtgtatttctgtttcccacatttgt

SEQ ID NO: 715222 - DNA, 25 bp, Mus musculus
gtgtatttcttcaatagccgagcat

SEQ ID NO: 715223 - DNA, 25 bp, Mus musculus
gtgtatttcttctatagccgagcat

SEQ ID NO: 715224 - DNA, 25 bp, Mus musculus
gtgtatttgattaacttcctcacca

SEQ ID NO: 715225 - DNA, 25 bp, Mus musculus
gtgtatttgatttacttcctcacca

SEQ ID NO: 715226 - DNA, 25 bp, Mus musculus
gtgtatttgcacctatttaatgttt

SEQ ID NO: 715227 - DNA, 25 bp, Mus musculus
gtgtatttgcacgtatttaatgttt

SEQ ID NO: 715228 - DNA, 25 bp, Mus musculus
gtgtatttggctattactctacttt

SEQ ID NO: 715229 - DNA, 25 bp, Mus musculus
gtgtatttggcttttactctacttt

SEQ ID NO: 715230 - DNA, 25 bp, Mus musculus
gtgtatttgtgaacagctactgtga

SEQ ID NO: 715231 - DNA, 25 bp, Mus musculus
gtgtatttgtgatcagctactgtga

SEQ ID NO: 715232 - DNA, 25 bp, Mus musculus
gtgtatttgttacagtttcaagtta

SEQ ID NO: 715233 - DNA, 25 bp, Mus musculus
gtgtatttgttagagtttcaagtta

SEQ ID NO: 715234 - DNA, 25 bp, Mus musculus
gtgtattttatactctcctctgcag

SEQ ID NO: 715235 - DNA, 25 bp, Mus musculus
gtgtattttatagtctcctctgcag

SEQ ID NO: 715236 - DNA, 25 bp, Mus musculus
gtgtattttatcacacacatgtttt

SEQ ID NO: 715237 - DNA, 25 bp, Mus musculus
gtgtattttatctcacacatgtttt

SEQ ID NO: 715238 - DNA, 25 bp, Mus musculus
gtgtattttatgagcctgtcttagt

SEQ ID NO: 715239 - DNA, 25 bp, Mus musculus
gtgtattttatgtgcctgtcttagt

SEQ ID NO: 715240 - DNA, 25 bp, Mus musculus
gtgtattttcaactgctatggcaaa

SEQ ID NO: 715241 - DNA, 25 bp, Mus musculus
gtgtattttcaagtgctatggcaaa

SEQ ID NO: 715242 - DNA, 25 bp, Mus musculus
gtgtattttcatcatgtgcccaata

SEQ ID NO: 715243 - DNA, 25 bp, Mus musculus
gtgtattttcatgatgtgcccaata

SEQ ID NO: 715244 - DNA, 25 bp, Mus musculus
gtgtattttctaagtgctccttctg

SEQ ID NO: 715245 - DNA, 25 bp, Mus musculus
gtgtattttctatgtgctccttctg

SEQ ID NO: 715246 - DNA, 25 bp, Mus musculus
gtgtattttctcatttgatccttgg

SEQ ID NO: 715247 - DNA, 25 bp, Mus musculus
gtgtattttctcttttgatccttgg

SEQ ID NO: 715248 - DNA, 25 bp, Mus musculus
gtgtattttgtactctttttctaga

SEQ ID NO: 715249 - DNA, 25 bp, Mus musculus
gtgtattttgtagtctttttctaga

SEQ ID NO: 715250 - DNA, 25 bp, Mus musculus
gtgtcaaaaaccacaatcaaaaggt

SEQ ID NO: 715251 - DNA, 25 bp, Mus musculus
gtgtcaaaaacctcaatcaaaaggt

SEQ ID NO: 715252 - DNA, 25 bp, Mus musculus
gtgtcaaaaactatctgcctactgg

SEQ ID NO: 715253 - DNA, 25 bp, Mus musculus
gtgtcaaaaactttctgcctactgg

SEQ ID NO: 715254 - DNA, 25 bp, Mus musculus
gtgtcaaaatagaacctatccctgg

SEQ ID NO: 715255 - DNA, 25 bp, Mus musculus
gtgtcaaaatagtacctatccctgg

SEQ ID NO: 715256 - DNA, 25 bp, Mus musculus
gtgtcaaaatatcagccagtcagtt

SEQ ID NO: 715257 - DNA, 25 bp, Mus musculus
gtgtcaaaatatgagccagtcagtt

SEQ ID NO: 715258 - DNA, 25 bp, Mus musculus
gtgtcaaaattaatatttcccatag

SEQ ID NO: 715259 - DNA, 25 bp, Mus musculus
gtgtcaaaattattatttcccatag

SEQ ID NO: 715260 - DNA, 25 bp, Mus musculus
gtgtcaaacaatctcagtgctttat

SEQ ID NO: 715261 - DNA, 25 bp, Mus musculus
gtgtcaaacaatgtcagtgctttat

SEQ ID NO: 715262 - DNA, 25 bp, Mus musculus
gtgtcaaacagcatgtggcttctta

SEQ ID NO: 715263 - DNA, 25 bp, Mus musculus
gtgtcaaacagcctgagacctctgc

SEQ ID NO: 715264 - DNA, 25 bp, Mus musculus
gtgtcaaacagcgtgagacctctgc

SEQ ID NO: 715265 - DNA, 25 bp, Mus musculus
gtgtcaaacagcttgtggcttctta

SEQ ID NO: 715266 - DNA, 25 bp, Mus musculus
gtgtcaaactcacaggcactttcag

SEQ ID NO: 715267 - DNA, 25 bp, Mus musculus
gtgtcaaactcagaggcactttcag

SEQ ID NO: 715268 - DNA, 25 bp, Mus musculus
gtgtcaaagaagaagccacccactc

SEQ ID NO: 715269 - DNA, 25 bp, Mus musculus
gtgtcaaagaagtagccacccactc

SEQ ID NO: 715270 - DNA, 25 bp, Mus musculus
gtgtcaaagacgagcctgcctacta

SEQ ID NO: 715271 - DNA, 25 bp, Mus musculus
gtgtcaaagacgtgcctgcctacta

SEQ ID NO: 715272 - DNA, 25 bp, Mus musculus
gtgtcaaagactaacactgctgggt

SEQ ID NO: 715273 - DNA, 25 bp, Mus musculus
gtgtcaaagacttacactgctgggt

SEQ ID NO: 715274 - DNA, 25 bp, Mus musculus
gtgtcaaagagaaagctgggccgcc

SEQ ID NO: 715275 - DNA, 25 bp, Mus musculus
gtgtcaaagagatagctgggccgcc

SEQ ID NO: 715276 - DNA, 25 bp, Mus musculus
gtgtcaaagattacccaatgccagg

SEQ ID NO: 715277 - DNA, 25 bp, Mus musculus
gtgtcaaagatttcccaatgccagg

SEQ ID NO: 715278 - DNA, 25 bp, Mus musculus
gtgtcaaaggtgacactctcagata

SEQ ID NO: 715279 - DNA, 25 bp, Mus musculus
gtgtcaaaggtgtcactctcagata

SEQ ID NO: 715280 - DNA, 25 bp, Mus musculus
gtgtcaaagtccatactagctcaga

SEQ ID NO: 715281 - DNA, 25 bp, Mus musculus
gtgtcaaagtccttactagctcaga

SEQ ID NO: 715282 - DNA, 25 bp, Mus musculus
gtgtcaaataatagcttgtacccta

SEQ ID NO: 715283 - DNA, 25 bp, Mus musculus
gtgtcaaataattgcttgtacccta

SEQ ID NO: 715284 - DNA, 25 bp, Mus musculus
gtgtcaaatctgaagagaagtcaat

SEQ ID NO: 715285 - DNA, 25 bp, Mus musculus
gtgtcaaatctgtagagaagtcaat

SEQ ID NO: 715286 - DNA, 25 bp, Mus musculus
gtgtcaaatcttaaaccctcacggg

SEQ ID NO: 715287 - DNA, 25 bp, Mus musculus
gtgtcaaatctttaaccctcacggg

SEQ ID NO: 715288 - DNA, 25 bp, Mus musculus
gtgtcaacaactcaacacagcctac

SEQ ID NO: 715289 - DNA, 25 bp, Mus musculus
gtgtcaacaactgaacacagcctac

SEQ ID NO: 715290 - DNA, 25 bp, Mus musculus
gtgtcaacacagctggtcccagtca

SEQ ID NO: 715291 - DNA, 25 bp, Mus musculus
gtgtcaacacaggtggtcccagtca

SEQ ID NO: 715292 - DNA, 25 bp, Mus musculus
gtgtcaacacatccgtccaagtaga

SEQ ID NO: 715293 - DNA, 25 bp, Mus musculus
gtgtcaacacatgcgtccaagtaga

SEQ ID NO: 715294 - DNA, 25 bp, Mus musculus
gtgtcaacacctatctcttcatata

SEQ ID NO: 715295 - DNA, 25 bp, Mus musculus
gtgtcaacacctttctcttcatata

SEQ ID NO: 715296 - DNA, 25 bp, Mus musculus
gtgtcaacaggacgctctgagtttt

SEQ ID NO: 715297 - DNA, 25 bp, Mus musculus
gtgtcaacaggaggctctgagtttt

SEQ ID NO: 715298 - DNA, 25 bp, Mus musculus
gtgtcaacatcccagtatgcagaga

SEQ ID NO: 715299 - DNA, 25 bp, Mus musculus
gtgtcaacatccgagtatgcagaga

SEQ ID NO: 715300 - DNA, 25 bp, Mus musculus
gtgtcaaccactctgctagtagaag

SEQ ID NO: 715301 - DNA, 25 bp, Mus musculus
gtgtcaaccactgtgctagtagaag

SEQ ID NO: 715302 - DNA, 25 bp, Mus musculus
gtgtcaacccttacatctatggctt

SEQ ID NO: 715303 - DNA, 25 bp, Mus musculus
gtgtcaaccctttcatctatggctt

SEQ ID NO: 715304 - DNA, 25 bp, Mus musculus
gtgtcaactgttcgatgctctgagt

SEQ ID NO: 715305 - DNA, 25 bp, Mus musculus
gtgtcaactgttggatgctctgagt

SEQ ID NO: 715306 - DNA, 25 bp, Mus musculus
gtgtcaagagatcggctcctcacca

SEQ ID NO: 715307 - DNA, 25 bp, Mus musculus
gtgtcaagagatgggctcctcacca

SEQ ID NO: 715308 - DNA, 25 bp, Mus musculus
gtgtcaagagccattccatgtgctg

SEQ ID NO: 715309 - DNA, 25 bp, Mus musculus
gtgtcaagagcctttccatgtgctg

SEQ ID NO: 715310 - DNA, 25 bp, Mus musculus
gtgtcaagcatgaggaacctgtccc

SEQ ID NO: 715311 - DNA, 25 bp, Mus musculus
gtgtcaagcatgtggaacctgtccc

SEQ ID NO: 715312 - DNA, 25 bp, Mus musculus
gtgtcaagccccagcaaggaactgc

SEQ ID NO: 715313 - DNA, 25 bp, Mus musculus
gtgtcaagcccctgcaaggaactgc

SEQ ID NO: 715314 - DNA, 25 bp, Mus musculus
gtgtcaagctggcttctgttctgtc

SEQ ID NO: 715315 - DNA, 25 bp, Mus musculus
gtgtcaagctgggttctgttctgtc

SEQ ID NO: 715316 - DNA, 25 bp, Mus musculus
gtgtcaagcttaaccttgctactaa

SEQ ID NO: 715317 - DNA, 25 bp, Mus musculus
gtgtcaagcttatccttgctactaa

SEQ ID NO: 715318 - DNA, 25 bp, Mus musculus
gtgtcaagtcacagaggcaaaccca

SEQ ID NO: 715319 - DNA, 25 bp, Mus musculus
gtgtcaagtcactgaggcaaaccca

SEQ ID NO: 715320 - DNA, 25 bp, Mus musculus
gtgtcaagtcagaagtacccatggt

SEQ ID NO: 715321 - DNA, 25 bp, Mus musculus
gtgtcaagtcagtagtacccatggt

SEQ ID NO: 715322 - DNA, 25 bp, Mus musculus
gtgtcaagtcgcaagtgtggtattt

SEQ ID NO: 715323 - DNA, 25 bp, Mus musculus
gtgtcaagtcgctagtgtggtattt

SEQ ID NO: 715324 - DNA, 25 bp, Mus musculus
gtgtcaagtggcactggcctctatg

SEQ ID NO: 715325 - DNA, 25 bp, Mus musculus
gtgtcaagtggctctggcctctatg

SEQ ID NO: 715326 - DNA, 25 bp, Mus musculus
gtgtcaataccaacttaggaccctg

SEQ ID NO: 715327 - DNA, 25 bp, Mus musculus
gtgtcaataccatcttaggaccctg

SEQ ID NO: 715328 - DNA, 25 bp, Mus musculus
gtgtcaatatatctctagtgctcca

SEQ ID NO: 715329 - DNA, 25 bp, Mus musculus
gtgtcaatatatgtctagtgctcca

SEQ ID NO: 715330 - DNA, 25 bp, Mus musculus
gtgtcaatattaccttatctctccc

SEQ ID NO: 715331 - DNA, 25 bp, Mus musculus
gtgtcaatattagcttatctctccc

SEQ ID NO: 715332 - DNA, 25 bp, Mus musculus
gtgtcaatcaccagcagatccagac

SEQ ID NO: 715333 - DNA, 25 bp, Mus musculus
gtgtcaatcacctgcagatccagac

SEQ ID NO: 715334 - DNA, 25 bp, Mus musculus
gtgtcaatcactcgcaactgagcgg

SEQ ID NO: 715335 - DNA, 25 bp, Mus musculus
gtgtcaatcactggcaactgagcgg

SEQ ID NO: 715336 - DNA, 25 bp, Mus musculus
gtgtcaatcataactcagtcccagt

SEQ ID NO: 715337 - DNA, 25 bp, Mus musculus
gtgtcaatcatatctcagtcccagt

SEQ ID NO: 715338 - DNA, 25 bp, Mus musculus
gtgtcaatcccacgtcattatgagt

SEQ ID NO: 715339 - DNA, 25 bp, Mus musculus
gtgtcaatcccaggtcattatgagt

SEQ ID NO: 715340 - DNA, 25 bp, Mus musculus
gtgtcaattggtctcagcatcacaa

SEQ ID NO: 715341 - DNA, 25 bp, Mus musculus
gtgtcaattggtgtcagcatcacaa

SEQ ID NO: 715342 - DNA, 25 bp, Mus musculus
gtgtcaatttataaagtgccttata

SEQ ID NO: 715343 - DNA, 25 bp, Mus musculus
gtgtcaatttattaagtgccttata

SEQ ID NO: 715344 - DNA, 25 bp, Mus musculus
gtgtcaatttgcataacgttctaac

SEQ ID NO: 715345 - DNA, 25 bp, Mus musculus
gtgtcaatttgcttaacgttctaac

SEQ ID NO: 715346 - DNA, 25 bp, Mus musculus
gtgtcaatttggcacaagttatagt

SEQ ID NO: 715347 - DNA, 25 bp, Mus musculus
gtgtcaatttgggacaagttatagt

SEQ ID NO: 715348 - DNA, 25 bp, Mus musculus
gtgtcacaaagaagtctacccggaa

SEQ ID NO: 715349 - DNA, 25 bp, Mus musculus
gtgtcacaaagatgtctacccggaa

SEQ ID NO: 715350 - DNA, 25 bp, Mus musculus
gtgtcacaaatgcttactatacagt

SEQ ID NO: 715351 - DNA, 25 bp, Mus musculus
gtgtcacaaatggttactatacagt

SEQ ID NO: 715352 - DNA, 25 bp, Mus musculus
gtgtcacacaatcacactgtaggtc

SEQ ID NO: 715353 - DNA, 25 bp, Mus musculus
gtgtcacacaatgacactgtaggtc

SEQ ID NO: 715354 - DNA, 25 bp, Mus musculus
gtgtcacaccacaccgaagtcaggg

SEQ ID NO: 715355 - DNA, 25 bp, Mus musculus
gtgtcacaccactccgaagtcaggg

SEQ ID NO: 715356 - DNA, 25 bp, Mus musculus
gtgtcacacgggaaggtgcagcctc

SEQ ID NO: 715357 - DNA, 25 bp, Mus musculus
gtgtcacacgggtaggtgcagcctc

SEQ ID NO: 715358 - DNA, 25 bp, Mus musculus
gtgtcacacgttcttacgcatgctt

SEQ ID NO: 715359 - DNA, 25 bp, Mus musculus
gtgtcacacgttgttacgcatgctt

SEQ ID NO: 715360 - DNA, 25 bp, Mus musculus
gtgtcacactcaaaacctgtgattg

SEQ ID NO: 715361 - DNA, 25 bp, Mus musculus
gtgtcacactcataacctgtgattg

SEQ ID NO: 715362 - DNA, 25 bp, Mus musculus
gtgtcacacttgagtccatagtatg

SEQ ID NO: 715363 - DNA, 25 bp, Mus musculus
gtgtcacacttgtgtccatagtatg

SEQ ID NO: 715364 - DNA, 25 bp, Mus musculus
gtgtcacagacgctcagtcccatga

SEQ ID NO: 715365 - DNA, 25 bp, Mus musculus
gtgtcacagacggtcagtcccatga

SEQ ID NO: 715366 - DNA, 25 bp, Mus musculus
gtgtcacagccaaagctaccactga

SEQ ID NO: 715367 - DNA, 25 bp, Mus musculus
gtgtcacagccatagctaccactga

SEQ ID NO: 715368 - DNA, 25 bp, Mus musculus
gtgtcacagcctatggttatgtcta

SEQ ID NO: 715369 - DNA, 25 bp, Mus musculus
gtgtcacagcctttggttatgtcta

SEQ ID NO: 715370 - DNA, 25 bp, Mus musculus
gtgtcacagctgaaaatgaaccctt

SEQ ID NO: 715371 - DNA, 25 bp, Mus musculus
gtgtcacagctgtaaatgaaccctt

SEQ ID NO: 715372 - DNA, 25 bp, Mus musculus
gtgtcacagtgccttttcatctacc

SEQ ID NO: 715373 - DNA, 25 bp, Mus musculus
gtgtcacagtgcgttttcatctacc

SEQ ID NO: 715374 - DNA, 25 bp, Mus musculus
gtgtcacatcaaacaagttcctggt

SEQ ID NO: 715375 - DNA, 25 bp, Mus musculus
gtgtcacatcaatcaagttcctggt

SEQ ID NO: 715376 - DNA, 25 bp, Mus musculus
gtgtcacatctaattctgggcttgc

SEQ ID NO: 715377 - DNA, 25 bp, Mus musculus
gtgtcacatctatttctgggcttgc

SEQ ID NO: 715378 - DNA, 25 bp, Mus musculus
gtgtcacatgcaccacaagatagaa

SEQ ID NO: 715379 - DNA, 25 bp, Mus musculus
gtgtcacatgcagcacaagatagaa

SEQ ID NO: 715380 - DNA, 25 bp, Mus musculus
gtgtcacattacagggcaaactgtt

SEQ ID NO: 715381 - DNA, 25 bp, Mus musculus
gtgtcacattactgggcaaactgtt

SEQ ID NO: 715382 - DNA, 25 bp, Mus musculus
gtgtcacattcaagcttttagctaa

SEQ ID NO: 715383 - DNA, 25 bp, Mus musculus
gtgtcacattcatgcttttagctaa

SEQ ID NO: 715384 - DNA, 25 bp, Mus musculus
gtgtcaccaactcctggtggatgca

SEQ ID NO: 715385 - DNA, 25 bp, Mus musculus
gtgtcaccaactgctggtggatgca

SEQ ID NO: 715386 - DNA, 25 bp, Mus musculus
gtgtcaccaagtcaagtttgtgcct

SEQ ID NO: 715387 - DNA, 25 bp, Mus musculus
gtgtcaccaagtgaagtttgtgcct

SEQ ID NO: 715388 - DNA, 25 bp, Mus musculus
gtgtcaccaataagctttcctactt

SEQ ID NO: 715389 - DNA, 25 bp, Mus musculus
gtgtcaccaatatgctttcctactt

SEQ ID NO: 715390 - DNA, 25 bp, Mus musculus
gtgtcaccaattcgtgtgttcccaa

SEQ ID NO: 715391 - DNA, 25 bp, Mus musculus
gtgtcaccaattggtgtgttcccaa

SEQ ID NO: 715392 - DNA, 25 bp, Mus musculus
gtgtcaccaccaaggcatcgttgag

SEQ ID NO: 715393 - DNA, 25 bp, Mus musculus
gtgtcaccaccatggcatcgttgag

SEQ ID NO: 715394 - DNA, 25 bp, Mus musculus
gtgtcaccacctcagaagaaactta

SEQ ID NO: 715395 - DNA, 25 bp, Mus musculus
gtgtcaccacctgagaagaaactta

SEQ ID NO: 715396 - DNA, 25 bp, Mus musculus
gtgtcaccactactgactgtgagta

SEQ ID NO: 715397 - DNA, 25 bp, Mus musculus
gtgtcaccactagtgactgtgagta

SEQ ID NO: 715398 - DNA, 25 bp, Mus musculus
gtgtcaccagctctgcttatgggaa

SEQ ID NO: 715399 - DNA, 25 bp, Mus musculus
gtgtcaccagctgtgcttatgggaa

SEQ ID NO: 715400 - DNA, 25 bp, Mus musculus
gtgtcaccagtcactgggtctagga

SEQ ID NO: 715401 - DNA, 25 bp, Mus musculus
gtgtcaccagtcagtttgtcaccag

SEQ ID NO: 715402 - DNA, 25 bp, Mus musculus
gtgtcaccagtctctgggtctagga

SEQ ID NO: 715403 - DNA, 25 bp, Mus musculus
gtgtcaccagtctgtttgtcaccag

SEQ ID NO: 715404 - DNA, 25 bp, Mus musculus
gtgtcaccataccaggttaactcgg

SEQ ID NO: 715405 - DNA, 25 bp, Mus musculus
gtgtcaccatacgaggttaactcgg

SEQ ID NO: 715406 - DNA, 25 bp, Mus musculus
gtgtcaccatcgagcagagcctgag

SEQ ID NO: 715407 - DNA, 25 bp, Mus musculus
gtgtcaccatcgtgcagagcctgag

SEQ ID NO: 715408 - DNA, 25 bp, Mus musculus
gtgtcaccatgcagaagtctcccaa

SEQ ID NO: 715409 - DNA, 25 bp, Mus musculus
gtgtcaccatgctgaagtctcccaa

SEQ ID NO: 715410 - DNA, 25 bp, Mus musculus
gtgtcacccatcattaataccagca

SEQ ID NO: 715411 - DNA, 25 bp, Mus musculus
gtgtcacccatctttaataccagca

SEQ ID NO: 715412 - DNA, 25 bp, Mus musculus
gtgtcaccctttccttacaacatga

SEQ ID NO: 715413 - DNA, 25 bp, Mus musculus
gtgtcaccctttgcttacaacatga

SEQ ID NO: 715414 - DNA, 25 bp, Mus musculus
gtgtcaccgattctgctcacacaga

SEQ ID NO: 715415 - DNA, 25 bp, Mus musculus
gtgtcaccgattgtgctcacacaga

SEQ ID NO: 715416 - DNA, 25 bp, Mus musculus
gtgtcaccgcatcaactcgccggga

SEQ ID NO: 715417 - DNA, 25 bp, Mus musculus
gtgtcaccgcatgaactcgccggga

SEQ ID NO: 715418 - DNA, 25 bp, Mus musculus
gtgtcacctaatctgggccacgcta

SEQ ID NO: 715419 - DNA, 25 bp, Mus musculus
gtgtcacctaatgtgggccacgcta

SEQ ID NO: 715420 - DNA, 25 bp, Mus musculus
gtgtcacctcccatagtgactggaa

SEQ ID NO: 715421 - DNA, 25 bp, Mus musculus
gtgtcacctcccttagtgactggaa

SEQ ID NO: 715422 - DNA, 25 bp, Mus musculus
gtgtcacctctcaaaaactttctgt

SEQ ID NO: 715423 - DNA, 25 bp, Mus musculus
gtgtcacctctctaaaactttctgt

SEQ ID NO: 715424 - DNA, 25 bp, Mus musculus
gtgtcacctgcacataggcccaaga

SEQ ID NO: 715425 - DNA, 25 bp, Mus musculus
gtgtcacctgcagataggcccaaga

SEQ ID NO: 715426 - DNA, 25 bp, Mus musculus
gtgtcacctgctcagtgttcttaga

SEQ ID NO: 715427 - DNA, 25 bp, Mus musculus
gtgtcacctgctcccgaactagaag

SEQ ID NO: 715428 - DNA, 25 bp, Mus musculus
gtgtcacctgctgagtgttcttaga

SEQ ID NO: 715429 - DNA, 25 bp, Mus musculus
gtgtcacctgctgccgaactagaag

SEQ ID NO: 715430 - DNA, 25 bp, Mus musculus
gtgtcacctggtaaatgaagtcatt

SEQ ID NO: 715431 - DNA, 25 bp, Mus musculus
gtgtcacctggttaatgaagtcatt

SEQ ID NO: 715432 - DNA, 25 bp, Mus musculus
gtgtcacctgtgaaaatcaaatcaa

SEQ ID NO: 715433 - DNA, 25 bp, Mus musculus
gtgtcacctgtgctctgtgaggcta

SEQ ID NO: 715434 - DNA, 25 bp, Mus musculus
gtgtcacctgtggtctgtgaggcta

SEQ ID NO: 715435 - DNA, 25 bp, Mus musculus
gtgtcacctgtgtaaatcaaatcaa

SEQ ID NO: 715436 - DNA, 25 bp, Mus musculus
gtgtcaccttagacacgagagcaga

SEQ ID NO: 715437 - DNA, 25 bp, Mus musculus
gtgtcaccttagtcacgagagcaga

SEQ ID NO: 715438 - DNA, 25 bp, Mus musculus
gtgtcacgactgataggcgccatgg

SEQ ID NO: 715439 - DNA, 25 bp, Mus musculus
gtgtcacgactgttaggcgccatgg

SEQ ID NO: 715440 - DNA, 25 bp, Mus musculus
gtgtcacgagttcacagacgagcta

SEQ ID NO: 715441 - DNA, 25 bp, Mus musculus
gtgtcacgagttgacagacgagcta

SEQ ID NO: 715442 - DNA, 25 bp, Mus musculus
gtgtcacgatttcaaaaaccattca

SEQ ID NO: 715443 - DNA, 25 bp, Mus musculus
gtgtcacgatttgaaaaaccattca

SEQ ID NO: 715444 - DNA, 25 bp, Mus musculus
gtgtcacgcagcatggtcacattgc

SEQ ID NO: 715445 - DNA, 25 bp, Mus musculus
gtgtcacgcagcttggtcacattgc

SEQ ID NO: 715446 - DNA, 25 bp, Mus musculus
gtgtcacgtttgctaaggctgatgc

SEQ ID NO: 715447 - DNA, 25 bp, Mus musculus
gtgtcacgtttggtaaggctgatgc

SEQ ID NO: 715448 - DNA, 25 bp, Mus musculus
gtgtcactaaaaaccgtgtgctact

SEQ ID NO: 715449 - DNA, 25 bp, Mus musculus
gtgtcactaaaatccgtgtgctact

SEQ ID NO: 715450 - DNA, 25 bp, Mus musculus
gtgtcactatccactggtcccatgt

SEQ ID NO: 715451 - DNA, 25 bp, Mus musculus
gtgtcactatcctctggtcccatgt

SEQ ID NO: 715452 - DNA, 25 bp, Mus musculus
gtgtcactcaatcctgtggctttgg

SEQ ID NO: 715453 - DNA, 25 bp, Mus musculus
gtgtcactcaatgctgtggctttgg

SEQ ID NO: 715454 - DNA, 25 bp, Mus musculus
gtgtcactcactatatgtaataaga

SEQ ID NO: 715455 - DNA, 25 bp, Mus musculus
gtgtcactcactttatgtaataaga

SEQ ID NO: 715456 - DNA, 25 bp, Mus musculus
gtgtcactctgcaaacctgaacggt

SEQ ID NO: 715457 - DNA, 25 bp, Mus musculus
gtgtcactctgctaacctgaacggt

SEQ ID NO: 715458 - DNA, 25 bp, Mus musculus
gtgtcactctggaatgtgcaggcaa

SEQ ID NO: 715459 - DNA, 25 bp, Mus musculus
gtgtcactctggtatgtgcaggcaa

SEQ ID NO: 715460 - DNA, 25 bp, Mus musculus
gtgtcactcttcagtggcaagctag

SEQ ID NO: 715461 - DNA, 25 bp, Mus musculus
gtgtcactcttctgtggcaagctag

SEQ ID NO: 715462 - DNA, 25 bp, Mus musculus
gtgtcactgagcctcaagatcgaga

SEQ ID NO: 715463 - DNA, 25 bp, Mus musculus
gtgtcactgagcgtcaagatcgaga

SEQ ID NO: 715464 - DNA, 25 bp, Mus musculus
gtgtcactgataagtaccctgtggg

SEQ ID NO: 715465 - DNA, 25 bp, Mus musculus
gtgtcactgatatgtaccctgtggg

SEQ ID NO: 715466 - DNA, 25 bp, Mus musculus
gtgtcactgcaacatgacattgtca

SEQ ID NO: 715467 - DNA, 25 bp, Mus musculus
gtgtcactgcaagatgacattgtca

SEQ ID NO: 715468 - DNA, 25 bp, Mus musculus
gtgtcactgcagaggcacctaagaa

SEQ ID NO: 715469 - DNA, 25 bp, Mus musculus
gtgtcactgcagtggcacctaagaa

SEQ ID NO: 715470 - DNA, 25 bp, Mus musculus
gtgtcactggagagtcgttcctgta

SEQ ID NO: 715471 - DNA, 25 bp, Mus musculus
gtgtcactggagtgtcgttcctgta

SEQ ID NO: 715472 - DNA, 25 bp, Mus musculus
gtgtcactggatcacaggaccttgg

SEQ ID NO: 715473 - DNA, 25 bp, Mus musculus
gtgtcactggatgacaggaccttgg

SEQ ID NO: 715474 - DNA, 25 bp, Mus musculus
gtgtcactgggtctgcatattgagt

SEQ ID NO: 715475 - DNA, 25 bp, Mus musculus
gtgtcactgggtgtgcatattgagt

SEQ ID NO: 715476 - DNA, 25 bp, Mus musculus
gtgtcactggtgctgatgtccctat

SEQ ID NO: 715477 - DNA, 25 bp, Mus musculus
gtgtcactggtggtgatgtccctat

SEQ ID NO: 715478 - DNA, 25 bp, Mus musculus
gtgtcactgtacatctctatcattt

SEQ ID NO: 715479 - DNA, 25 bp, Mus musculus
gtgtcactgtacttctctatcattt

SEQ ID NO: 715480 - DNA, 25 bp, Mus musculus
gtgtcactgtgacgcatactggtaa

SEQ ID NO: 715481 - DNA, 25 bp, Mus musculus
gtgtcactgtgaggcatactggtaa

SEQ ID NO: 715482 - DNA, 25 bp, Mus musculus
gtgtcactgtggacatcggcctcat

SEQ ID NO: 715483 - DNA, 25 bp, Mus musculus
gtgtcactgtggtcatcggcctcat

SEQ ID NO: 715484 - DNA, 25 bp, Mus musculus
gtgtcactgtttctagcgcaatctc

SEQ ID NO: 715485 - DNA, 25 bp, Mus musculus
gtgtcactgtttgtagcgcaatctc

SEQ ID NO: 715486 - DNA, 25 bp, Mus musculus
gtgtcacttcgcatcaattaaacta

SEQ ID NO: 715487 - DNA, 25 bp, Mus musculus
gtgtcacttcgcttcaattaaacta

SEQ ID NO: 715488 - DNA, 25 bp, Mus musculus
gtgtcacttgagactatgtgcggat

SEQ ID NO: 715489 - DNA, 25 bp, Mus musculus
gtgtcacttgagtctatgtgcggat

SEQ ID NO: 715490 - DNA, 25 bp, Mus musculus
gtgtcacttgccctggagctagaat

SEQ ID NO: 715491 - DNA, 25 bp, Mus musculus
gtgtcacttgccgtggagctagaat

SEQ ID NO: 715492 - DNA, 25 bp, Mus musculus
gtgtcacttgggaactcgctggcga

SEQ ID NO: 715493 - DNA, 25 bp, Mus musculus
gtgtcacttgggtactcgctggcga

SEQ ID NO: 715494 - DNA, 25 bp, Mus musculus
gtgtcactttatccattctctttaa

SEQ ID NO: 715495 - DNA, 25 bp, Mus musculus
gtgtcactttatgcattctctttaa

SEQ ID NO: 715496 - DNA, 25 bp, Mus musculus
gtgtcactttctaacctttgccagt

SEQ ID NO: 715497 - DNA, 25 bp, Mus musculus
gtgtcactttcttacctttgccagt

SEQ ID NO: 715498 - DNA, 25 bp, Mus musculus
gtgtcactttgtcggtggactttga

SEQ ID NO: 715499 - DNA, 25 bp, Mus musculus
gtgtcactttgtgggtggactttga

SEQ ID NO: 715500 - DNA, 25 bp, Mus musculus
gtgtcagaacacattaggccatatt

SEQ ID NO: 715501 - DNA, 25 bp, Mus musculus
gtgtcagaacactttaggccatatt

SEQ ID NO: 715502 - DNA, 25 bp, Mus musculus
gtgtcagaacttcaccacactccga

SEQ ID NO: 715503 - DNA, 25 bp, Mus musculus
gtgtcagaacttgaccacactccga

SEQ ID NO: 715504 - DNA, 25 bp, Mus musculus
gtgtcagaagaccatggctccagtg

SEQ ID NO: 715505 - DNA, 25 bp, Mus musculus
gtgtcagaagacgatggctccagtg

SEQ ID NO: 715506 - DNA, 25 bp, Mus musculus
gtgtcagaatgaagcagcttcctgt

SEQ ID NO: 715507 - DNA, 25 bp, Mus musculus
gtgtcagaatgatgcagcttcctgt

SEQ ID NO: 715508 - DNA, 25 bp, Mus musculus
gtgtcagacagcagattctaccctc

SEQ ID NO: 715509 - DNA, 25 bp, Mus musculus
gtgtcagacagctgattctaccctc

SEQ ID NO: 715510 - DNA, 25 bp, Mus musculus
gtgtcagacctcataatgggccagt

SEQ ID NO: 715511 - DNA, 25 bp, Mus musculus
gtgtcagacctcttaatgggccagt

SEQ ID NO: 715512 - DNA, 25 bp, Mus musculus
gtgtcagacgaaagttcatcagtga

SEQ ID NO: 715513 - DNA, 25 bp, Mus musculus
gtgtcagacgaatgttcatcagtga

SEQ ID NO: 715514 - DNA, 25 bp, Mus musculus
gtgtcagacgacctctgtcaagtgt

SEQ ID NO: 715515 - DNA, 25 bp, Mus musculus
gtgtcagacgacgtctgtcaagtgt

SEQ ID NO: 715516 - DNA, 25 bp, Mus musculus
gtgtcagactagatttccaaccaga

SEQ ID NO: 715517 - DNA, 25 bp, Mus musculus
gtgtcagactagttttccaaccaga

SEQ ID NO: 715518 - DNA, 25 bp, Mus musculus
gtgtcagactcaaggcatatagcta

SEQ ID NO: 715519 - DNA, 25 bp, Mus musculus
gtgtcagactcatggcatatagcta

SEQ ID NO: 715520 - DNA, 25 bp, Mus musculus
gtgtcagagggaacttttctacttc

SEQ ID NO: 715521 - DNA, 25 bp, Mus musculus
gtgtcagagggactcacaagtgtcc

SEQ ID NO: 715522 - DNA, 25 bp, Mus musculus
gtgtcagagggagtcacaagtgtcc

SEQ ID NO: 715523 - DNA, 25 bp, Mus musculus
gtgtcagagggatcttttctacttc

SEQ ID NO: 715524 - DNA, 25 bp, Mus musculus
gtgtcagaggtaatttcaggagctt

SEQ ID NO: 715525 - DNA, 25 bp, Mus musculus
gtgtcagaggtattttcaggagctt

SEQ ID NO: 715526 - DNA, 25 bp, Mus musculus
gtgtcagaggtcatcaacagcccat

SEQ ID NO: 715527 - DNA, 25 bp, Mus musculus
gtgtcagaggtcttcaacagcccat

SEQ ID NO: 715528 - DNA, 25 bp, Mus musculus
gtgtcagatacacccttaacaattg

SEQ ID NO: 715529 - DNA, 25 bp, Mus musculus
gtgtcagatacagccttaacaattg

SEQ ID NO: 715530 - DNA, 25 bp, Mus musculus
gtgtcagatacgcaataaactcctt

SEQ ID NO: 715531 - DNA, 25 bp, Mus musculus
gtgtcagatacggaataaactcctt

SEQ ID NO: 715532 - DNA, 25 bp, Mus musculus
gtgtcagataggaccctttaaattc

SEQ ID NO: 715533 - DNA, 25 bp, Mus musculus
gtgtcagataggtccctttaaattc

SEQ ID NO: 715534 - DNA, 25 bp, Mus musculus
gtgtcagatccaaatattcctttct

SEQ ID NO: 715535 - DNA, 25 bp, Mus musculus
gtgtcagatccacggccacatacaa

SEQ ID NO: 715536 - DNA, 25 bp, Mus musculus
gtgtcagatccagggccacatacaa

SEQ ID NO: 715537 - DNA, 25 bp, Mus musculus
gtgtcagatccatatattcctttct

SEQ ID NO: 715538 - DNA, 25 bp, Mus musculus
gtgtcagatcccctaagattggagt

SEQ ID NO: 715539 - DNA, 25 bp, Mus musculus
gtgtcagatcccgtaagattggagt

SEQ ID NO: 715540 - DNA, 25 bp, Mus musculus
gtgtcagattcgatagcagtctaat

SEQ ID NO: 715541 - DNA, 25 bp, Mus musculus
gtgtcagattcgttagcagtctaat

SEQ ID NO: 715542 - DNA, 25 bp, Mus musculus
gtgtcagcaactaaccatcaatggc

SEQ ID NO: 715543 - DNA, 25 bp, Mus musculus
gtgtcagcaactacatcttaacagt

SEQ ID NO: 715544 - DNA, 25 bp, Mus musculus
gtgtcagcaacttaccatcaatggc

SEQ ID NO: 715545 - DNA, 25 bp, Mus musculus
gtgtcagcaacttcatcttaacagt

SEQ ID NO: 715546 - DNA, 25 bp, Mus musculus
gtgtcagcacgtaatttctttttgt

SEQ ID NO: 715547 - DNA, 25 bp, Mus musculus
gtgtcagcacgttatttctttttgt

SEQ ID NO: 715548 - DNA, 25 bp, Mus musculus
gtgtcagcactgacaattctgctac

SEQ ID NO: 715549 - DNA, 25 bp, Mus musculus
gtgtcagcactgtcaattctgctac

SEQ ID NO: 715550 - DNA, 25 bp, Mus musculus
gtgtcagcacttactatctgaacaa

SEQ ID NO: 715551 - DNA, 25 bp, Mus musculus
gtgtcagcactttctatctgaacaa

SEQ ID NO: 715552 - DNA, 25 bp, Mus musculus
gtgtcagcattcatctccataacga

SEQ ID NO: 715553 - DNA, 25 bp, Mus musculus
gtgtcagcattcttctccataacga

SEQ ID NO: 715554 - DNA, 25 bp, Mus musculus
gtgtcagccatgagcactcatgcaa

SEQ ID NO: 715555 - DNA, 25 bp, Mus musculus
gtgtcagccatgtgcactcatgcaa

SEQ ID NO: 715556 - DNA, 25 bp, Mus musculus
gtgtcagcgcggatctatggcagaa

SEQ ID NO: 715557 - DNA, 25 bp, Mus musculus
gtgtcagcgcggttctatggcagaa

SEQ ID NO: 715558 - DNA, 25 bp, Mus musculus
gtgtcagcggctctggtttccagaa

SEQ ID NO: 715559 - DNA, 25 bp, Mus musculus
gtgtcagcggctgtggtttccagaa

SEQ ID NO: 715560 - DNA, 25 bp, Mus musculus
gtgtcagctaaccataccaattaaa

SEQ ID NO: 715561 - DNA, 25 bp, Mus musculus
gtgtcagctaacgataccaattaaa

SEQ ID NO: 715562 - DNA, 25 bp, Mus musculus
gtgtcagctacaacactccagctag

SEQ ID NO: 715563 - DNA, 25 bp, Mus musculus
gtgtcagctacatcactccagctag

SEQ ID NO: 715564 - DNA, 25 bp, Mus musculus
gtgtcagctatgaccactagccagg

SEQ ID NO: 715565 - DNA, 25 bp, Mus musculus
gtgtcagctatgtccactagccagg

SEQ ID NO: 715566 - DNA, 25 bp, Mus musculus
gtgtcagctcagacctagacgagaa

SEQ ID NO: 715567 - DNA, 25 bp, Mus musculus
gtgtcagctcagagaccagaggcat

SEQ ID NO: 715568 - DNA, 25 bp, Mus musculus
gtgtcagctcagtcctagacgagaa

SEQ ID NO: 715569 - DNA, 25 bp, Mus musculus
gtgtcagctcagtgaccagaggcat

SEQ ID NO: 715570 - DNA, 25 bp, Mus musculus
gtgtcagctcctcacatgggaatga

SEQ ID NO: 715571 - DNA, 25 bp, Mus musculus
gtgtcagctcctgacatgggaatga

SEQ ID NO: 715572 - DNA, 25 bp, Mus musculus
gtgtcagctgaacatattgggccaa

SEQ ID NO: 715573 - DNA, 25 bp, Mus musculus
gtgtcagctgaagatattgggccaa

SEQ ID NO: 715574 - DNA, 25 bp, Mus musculus
gtgtcagctgatcacctcctcaaga

SEQ ID NO: 715575 - DNA, 25 bp, Mus musculus
gtgtcagctgatgacctcctcaaga

SEQ ID NO: 715576 - DNA, 25 bp, Mus musculus
gtgtcagctgctagaccacttatgg

SEQ ID NO: 715577 - DNA, 25 bp, Mus musculus
gtgtcagctgcttgaccacttatgg

SEQ ID NO: 715578 - DNA, 25 bp, Mus musculus
gtgtcagctttcactaagggacctg

SEQ ID NO: 715579 - DNA, 25 bp, Mus musculus
gtgtcagctttctctaagggacctg

SEQ ID NO: 715580 - DNA, 25 bp, Mus musculus
gtgtcaggaatgattaatcccctat

SEQ ID NO: 715581 - DNA, 25 bp, Mus musculus
gtgtcaggaatgtttaatcccctat

SEQ ID NO: 715582 - DNA, 25 bp, Mus musculus
gtgtcaggacagaccaaggactgca

SEQ ID NO: 715583 - DNA, 25 bp, Mus musculus
gtgtcaggacagtccaaggactgca

SEQ ID NO: 715584 - DNA, 25 bp, Mus musculus
gtgtcaggatctcagaacattactt

SEQ ID NO: 715585 - DNA, 25 bp, Mus musculus
gtgtcaggatctgagaacattactt

SEQ ID NO: 715586 - DNA, 25 bp, Mus musculus
gtgtcaggcaacatcagatttgaat

SEQ ID NO: 715587 - DNA, 25 bp, Mus musculus
gtgtcaggcaacttcagatttgaat

SEQ ID NO: 715588 - DNA, 25 bp, Mus musculus
gtgtcaggcacacgtggtattcctt

SEQ ID NO: 715589 - DNA, 25 bp, Mus musculus
gtgtcaggcacaggtggtattcctt

SEQ ID NO: 715590 - DNA, 25 bp, Mus musculus
gtgtcaggcagtacgccacctgtta

SEQ ID NO: 715591 - DNA, 25 bp, Mus musculus
gtgtcaggcagttcgccacctgtta

SEQ ID NO: 715592 - DNA, 25 bp, Mus musculus
gtgtcaggccaaactcagttatcta

SEQ ID NO: 715593 - DNA, 25 bp, Mus musculus
gtgtcaggccaatctcagttatcta

SEQ ID NO: 715594 - DNA, 25 bp, Mus musculus
gtgtcaggccagaggaatcctctaa

SEQ ID NO: 715595 - DNA, 25 bp, Mus musculus
gtgtcaggccagtggaatcctctaa

SEQ ID NO: 715596 - DNA, 25 bp, Mus musculus
gtgtcaggcctaccatggttaactt

SEQ ID NO: 715597 - DNA, 25 bp, Mus musculus
gtgtcaggcctagcatggttaactt

SEQ ID NO: 715598 - DNA, 25 bp, Mus musculus
gtgtcaggctgactccgtgtgagca

SEQ ID NO: 715599 - DNA, 25 bp, Mus musculus
gtgtcaggctgagtccgtgtgagca

SEQ ID NO: 715600 - DNA, 25 bp, Mus musculus
gtgtcagggaacatcaatgtacttt

SEQ ID NO: 715601 - DNA, 25 bp, Mus musculus
gtgtcagggaacttcaatgtacttt

SEQ ID NO: 715602 - DNA, 25 bp, Mus musculus
gtgtcagggtctctttacatagtcc

SEQ ID NO: 715603 - DNA, 25 bp, Mus musculus
gtgtcagggtctgtttacatagtcc

SEQ ID NO: 715604 - DNA, 25 bp, Mus musculus
gtgtcaggttacagggcttctcacc

SEQ ID NO: 715605 - DNA, 25 bp, Mus musculus
gtgtcaggttactgggcttctcacc

SEQ ID NO: 715606 - DNA, 25 bp, Mus musculus
gtgtcagtagcaacagcctgcaatc

SEQ ID NO: 715607 - DNA, 25 bp, Mus musculus
gtgtcagtagcatcagcctgcaatc

SEQ ID NO: 715608 - DNA, 25 bp, Mus musculus
gtgtcagtatctagcttacatgtat

SEQ ID NO: 715609 - DNA, 25 bp, Mus musculus
gtgtcagtatcttgcttacatgtat

SEQ ID NO: 715610 - DNA, 25 bp, Mus musculus
gtgtcagtcaaacctcaggcccagc

SEQ ID NO: 715611 - DNA, 25 bp, Mus musculus
gtgtcagtcaaagctcaggcccagc

SEQ ID NO: 715612 - DNA, 25 bp, Mus musculus
gtgtcagtcaatcacagagctgtca

SEQ ID NO: 715613 - DNA, 25 bp, Mus musculus
gtgtcagtcaatgacagagctgtca

SEQ ID NO: 715614 - DNA, 25 bp, Mus musculus
gtgtcagtcagtcttttgtggaaat

SEQ ID NO: 715615 - DNA, 25 bp, Mus musculus
gtgtcagtcagtgttttgtggaaat

SEQ ID NO: 715616 - DNA, 25 bp, Mus musculus
gtgtcagtgaccagtttttcatagt

SEQ ID NO: 715617 - DNA, 25 bp, Mus musculus
gtgtcagtgacctgtttttcatagt

SEQ ID NO: 715618 - DNA, 25 bp, Mus musculus
gtgtcagtgcccaggtccgagagaa

SEQ ID NO: 715619 - DNA, 25 bp, Mus musculus
gtgtcagtgccctggtccgagagaa

SEQ ID NO: 715620 - DNA, 25 bp, Mus musculus
gtgtcagtggaccaatattccaact

SEQ ID NO: 715621 - DNA, 25 bp, Mus musculus
gtgtcagtggacgaatattccaact

SEQ ID NO: 715622 - DNA, 25 bp, Mus musculus
gtgtcagtggtgaccttgatgccct

SEQ ID NO: 715623 - DNA, 25 bp, Mus musculus
gtgtcagtggtgtccttgatgccct

SEQ ID NO: 715624 - DNA, 25 bp, Mus musculus
gtgtcagtgtcgctcaatagaatca

SEQ ID NO: 715625 - DNA, 25 bp, Mus musculus
gtgtcagtgtcggtcaatagaatca

SEQ ID NO: 715626 - DNA, 25 bp, Mus musculus
gtgtcagttaaaacgccccagcgcc

SEQ ID NO: 715627 - DNA, 25 bp, Mus musculus
gtgtcagttaaatcgccccagcgcc

SEQ ID NO: 715628 - DNA, 25 bp, Mus musculus
gtgtcagttagcagcaggtatagct

SEQ ID NO: 715629 - DNA, 25 bp, Mus musculus
gtgtcagttagctgcaggtatagct

SEQ ID NO: 715630 - DNA, 25 bp, Mus musculus
gtgtcagttcacctcttaaggaaga

SEQ ID NO: 715631 - DNA, 25 bp, Mus musculus
gtgtcagttcacgtcttaaggaaga

SEQ ID NO: 715632 - DNA, 25 bp, Mus musculus
gtgtcagttcagagggcactggatt

SEQ ID NO: 715633 - DNA, 25 bp, Mus musculus
gtgtcagttcagtgggcactggatt

SEQ ID NO: 715634 - DNA, 25 bp, Mus musculus
gtgtcagttcataacctattatatt

SEQ ID NO: 715635 - DNA, 25 bp, Mus musculus
gtgtcagttcattacctattatatt

SEQ ID NO: 715636 - DNA, 25 bp, Mus musculus
gtgtcagttcctccacgaggaccca

SEQ ID NO: 715637 - DNA, 25 bp, Mus musculus
gtgtcagttcctgcacgaggaccca

SEQ ID NO: 715638 - DNA, 25 bp, Mus musculus
gtgtcagttgttcgactcatggtct

SEQ ID NO: 715639 - DNA, 25 bp, Mus musculus
gtgtcagttgttggactcatggtct

SEQ ID NO: 715640 - DNA, 25 bp, Mus musculus
gtgtcataaaacctctcaccagact

SEQ ID NO: 715641 - DNA, 25 bp, Mus musculus
gtgtcataaaacgtctcaccagact

SEQ ID NO: 715642 - DNA, 25 bp, Mus musculus
gtgtcataagcccaataagtatttt

SEQ ID NO: 715643 - DNA, 25 bp, Mus musculus
gtgtcataagccgaataagtatttt

SEQ ID NO: 715644 - DNA, 25 bp, Mus musculus
gtgtcataccacatgctgaggtcca

SEQ ID NO: 715645 - DNA, 25 bp, Mus musculus
gtgtcataccacttgctgaggtcca

SEQ ID NO: 715646 - DNA, 25 bp, Mus musculus
gtgtcatagataaacaaccagctcc

SEQ ID NO: 715647 - DNA, 25 bp, Mus musculus
gtgtcatagatatacaaccagctcc

SEQ ID NO: 715648 - DNA, 25 bp, Mus musculus
gtgtcatagttaacttctgaagcgc

SEQ ID NO: 715649 - DNA, 25 bp, Mus musculus
gtgtcatagttatcttctgaagcgc

SEQ ID NO: 715650 - DNA, 25 bp, Mus musculus
gtgtcatatctcaccttccatgggt

SEQ ID NO: 715651 - DNA, 25 bp, Mus musculus
gtgtcatatctctccttccatgggt

SEQ ID NO: 715652 - DNA, 25 bp, Mus musculus
gtgtcatattctcctggtagcgatg

SEQ ID NO: 715653 - DNA, 25 bp, Mus musculus
gtgtcatattctgctggtagcgatg

SEQ ID NO: 715654 - DNA, 25 bp, Mus musculus
gtgtcatcaaagcttacatactgga

SEQ ID NO: 715655 - DNA, 25 bp, Mus musculus
gtgtcatcaaaggttacatactgga

SEQ ID NO: 715656 - DNA, 25 bp, Mus musculus
gtgtcatcaacaacggtgtaggcaa

SEQ ID NO: 715657 - DNA, 25 bp, Mus musculus
gtgtcatcaacatcggtgtaggcaa

SEQ ID NO: 715658 - DNA, 25 bp, Mus musculus
gtgtcatcaaggagtcagaccgctt

SEQ ID NO: 715659 - DNA, 25 bp, Mus musculus
gtgtcatcaaggtgtcagaccgctt

SEQ ID NO: 715660 - DNA, 25 bp, Mus musculus
gtgtcatcacagctcagaaatccca

SEQ ID NO: 715661 - DNA, 25 bp, Mus musculus
gtgtcatcacaggtcagaaatccca

SEQ ID NO: 715662 - DNA, 25 bp, Mus musculus
gtgtcatcacctccagagctactaa

SEQ ID NO: 715663 - DNA, 25 bp, Mus musculus
gtgtcatcacctgcagagctactaa

SEQ ID NO: 715664 - DNA, 25 bp, Mus musculus
gtgtcatcactgatacactcctgat

SEQ ID NO: 715665 - DNA, 25 bp, Mus musculus
gtgtcatcactgttacactcctgat

SEQ ID NO: 715666 - DNA, 25 bp, Mus musculus
gtgtcatcagtcacgaactggcaaa

SEQ ID NO: 715667 - DNA, 25 bp, Mus musculus
gtgtcatcagtctcgaactggcaaa

SEQ ID NO: 715668 - DNA, 25 bp, Mus musculus
gtgtcatcatcaatgttcttaacgc

SEQ ID NO: 715669 - DNA, 25 bp, Mus musculus
gtgtcatcatcattgttcttaacgc

SEQ ID NO: 715670 - DNA, 25 bp, Mus musculus
gtgtcatcattgagtaacctgttct

SEQ ID NO: 715671 - DNA, 25 bp, Mus musculus
gtgtcatcattgtgtaacctgttct

SEQ ID NO: 715672 - DNA, 25 bp, Mus musculus
gtgtcatccactccacttggttata

SEQ ID NO: 715673 - DNA, 25 bp, Mus musculus
gtgtcatccactgcacttggttata

SEQ ID NO: 715674 - DNA, 25 bp, Mus musculus
gtgtcatcctgaccaaactctacag

SEQ ID NO: 715675 - DNA, 25 bp, Mus musculus
gtgtcatcctgagcaaactctacag

SEQ ID NO: 715676 - DNA, 25 bp, Mus musculus
gtgtcatccttacatactatgctag

SEQ ID NO: 715677 - DNA, 25 bp, Mus musculus
gtgtcatccttagatactatgctag

SEQ ID NO: 715678 - DNA, 25 bp, Mus musculus
gtgtcatcggacagtttttagccaa

SEQ ID NO: 715679 - DNA, 25 bp, Mus musculus
gtgtcatcggactgtttttagccaa

SEQ ID NO: 715680 - DNA, 25 bp, Mus musculus
gtgtcatctagaaacttggtggctg

SEQ ID NO: 715681 - DNA, 25 bp, Mus musculus
gtgtcatctagatacttggtggctg

SEQ ID NO: 715682 - DNA, 25 bp, Mus musculus
gtgtcatctcgtcttttcaattccc

SEQ ID NO: 715683 - DNA, 25 bp, Mus musculus
gtgtcatctcgtgttttcaattccc

SEQ ID NO: 715684 - DNA, 25 bp, Mus musculus
gtgtcatctctaagatcaccctcag

SEQ ID NO: 715685 - DNA, 25 bp, Mus musculus
gtgtcatctctatgatcaccctcag

SEQ ID NO: 715686 - DNA, 25 bp, Mus musculus
gtgtcatctcttagatctcttgaga

SEQ ID NO: 715687 - DNA, 25 bp, Mus musculus
gtgtcatctctttgatctcttgaga

SEQ ID NO: 715688 - DNA, 25 bp, Mus musculus
gtgtcatctggtatggccggaagac

SEQ ID NO: 715689 - DNA, 25 bp, Mus musculus
gtgtcatctggtttggccggaagac

SEQ ID NO: 715690 - DNA, 25 bp, Mus musculus
gtgtcatctgtgaagttttcccagt

SEQ ID NO: 715691 - DNA, 25 bp, Mus musculus
gtgtcatctgtgtagttttcccagt

SEQ ID NO: 715692 - DNA, 25 bp, Mus musculus
gtgtcatcttctacctcagggacaa

SEQ ID NO: 715693 - DNA, 25 bp, Mus musculus
gtgtcatcttcttcctcagggacaa

SEQ ID NO: 715694 - DNA, 25 bp, Mus musculus
gtgtcatgaaatacccaaagactga

SEQ ID NO: 715695 - DNA, 25 bp, Mus musculus
gtgtcatgaaattcccaaagactga

SEQ ID NO: 715696 - DNA, 25 bp, Mus musculus
gtgtcatgagaacttaccagcagaa

SEQ ID NO: 715697 - DNA, 25 bp, Mus musculus
gtgtcatgagaagttaccagcagaa

SEQ ID NO: 715698 - DNA, 25 bp, Mus musculus
gtgtcatgatgtctctgtgaacccc

SEQ ID NO: 715699 - DNA, 25 bp, Mus musculus
gtgtcatgatgtgtctgtgaacccc

SEQ ID NO: 715700 - DNA, 25 bp, Mus musculus
gtgtcatgattgacgtggcaacaaa

SEQ ID NO: 715701 - DNA, 25 bp, Mus musculus
gtgtcatgattgtcgtggcaacaaa

SEQ ID NO: 715702 - DNA, 25 bp, Mus musculus
gtgtcatgccctacgttggtataat

SEQ ID NO: 715703 - DNA, 25 bp, Mus musculus
gtgtcatgcccttcgttggtataat

SEQ ID NO: 715704 - DNA, 25 bp, Mus musculus
gtgtcatgctagcgacagtggcaca

SEQ ID NO: 715705 - DNA, 25 bp, Mus musculus
gtgtcatgctagggacagtggcaca

SEQ ID NO: 715706 - DNA, 25 bp, Mus musculus
gtgtcatgctgtcgtgcgaacccaa

SEQ ID NO: 715707 - DNA, 25 bp, Mus musculus
gtgtcatgctgtggtgcgaacccaa

SEQ ID NO: 715708 - DNA, 25 bp, Mus musculus
gtgtcatggagaaggcttcccacta

SEQ ID NO: 715709 - DNA, 25 bp, Mus musculus
gtgtcatggagatggcttcccacta

SEQ ID NO: 715710 - DNA, 25 bp, Mus musculus
gtgtcatggatgctgtcctgcgcca

SEQ ID NO: 715711 - DNA, 25 bp, Mus musculus
gtgtcatggatggtgtcctgcgcca

SEQ ID NO: 715712 - DNA, 25 bp, Mus musculus
gtgtcatggcatcggtcattcctag

SEQ ID NO: 715713 - DNA, 25 bp, Mus musculus
gtgtcatggcatgggtcattcctag

SEQ ID NO: 715714 - DNA, 25 bp, Mus musculus
gtgtcatggcggaaaggccttccca

SEQ ID NO: 715715 - DNA, 25 bp, Mus musculus
gtgtcatggcggtaaggccttccca

SEQ ID NO: 715716 - DNA, 25 bp, Mus musculus
gtgtcatgtagactcatcgctctct

SEQ ID NO: 715717 - DNA, 25 bp, Mus musculus
gtgtcatgtagagtcatcgctctct

SEQ ID NO: 715718 - DNA, 25 bp, Mus musculus
gtgtcatgtcagacgactgcctaac

SEQ ID NO: 715719 - DNA, 25 bp, Mus musculus
gtgtcatgtcagtcgactgcctaac

SEQ ID NO: 715720 - DNA, 25 bp, Mus musculus
gtgtcatgtcgcagttactctttca

SEQ ID NO: 715721 - DNA, 25 bp, Mus musculus
gtgtcatgtcgctgttactctttca

SEQ ID NO: 715722 - DNA, 25 bp, Mus musculus
gtgtcatgtggaccatactctttcc

SEQ ID NO: 715723 - DNA, 25 bp, Mus musculus
gtgtcatgtggagcatactctttcc

SEQ ID NO: 715724 - DNA, 25 bp, Mus musculus
gtgtcatgttaaaggagcgacctgc

SEQ ID NO: 715725 - DNA, 25 bp, Mus musculus
gtgtcatgttaatggagcgacctgc

SEQ ID NO: 715726 - DNA, 25 bp, Mus musculus
gtgtcatgttacaggactcagcaac

SEQ ID NO: 715727 - DNA, 25 bp, Mus musculus
gtgtcatgttacattgtctctgtga

SEQ ID NO: 715728 - DNA, 25 bp, Mus musculus
gtgtcatgttactggactcagcaac

SEQ ID NO: 715729 - DNA, 25 bp, Mus musculus
gtgtcatgttactttgtctctgtga

SEQ ID NO: 715730 - DNA, 25 bp, Mus musculus
gtgtcatgtttccaggcagcctgaa

SEQ ID NO: 715731 - DNA, 25 bp, Mus musculus
gtgtcatgtttcgaggcagcctgaa

SEQ ID NO: 715732 - DNA, 25 bp, Mus musculus
gtgtcatgtttgcttcttgaatctg

SEQ ID NO: 715733 - DNA, 25 bp, Mus musculus
gtgtcatgtttggttcttgaatctg

SEQ ID NO: 715734 - DNA, 25 bp, Mus musculus
gtgtcatgttttccagtaatttctc

SEQ ID NO: 715735 - DNA, 25 bp, Mus musculus
gtgtcatgttttgcagtaatttctc

SEQ ID NO: 715736 - DNA, 25 bp, Mus musculus
gtgtcattagcccagccaaagtgat

SEQ ID NO: 715737 - DNA, 25 bp, Mus musculus
gtgtcattagccgagccaaagtgat

SEQ ID NO: 715738 - DNA, 25 bp, Mus musculus
gtgtcattattcattggtttcatca

SEQ ID NO: 715739 - DNA, 25 bp, Mus musculus
gtgtcattattctttggtttcatca

SEQ ID NO: 715740 - DNA, 25 bp, Mus musculus
gtgtcattcacgagccaccattagt

SEQ ID NO: 715741 - DNA, 25 bp, Mus musculus
gtgtcattcacgtgccaccattagt

SEQ ID NO: 715742 - DNA, 25 bp, Mus musculus
gtgtcattcagcatgtttccacaga

SEQ ID NO: 715743 - DNA, 25 bp, Mus musculus
gtgtcattcagcttgtttccacaga

SEQ ID NO: 715744 - DNA, 25 bp, Mus musculus
gtgtcattcggtcagtctgtactga

SEQ ID NO: 715745 - DNA, 25 bp, Mus musculus
gtgtcattcggtgagtctgtactga

SEQ ID NO: 715746 - DNA, 25 bp, Mus musculus
gtgtcattctacattttcatacaga

SEQ ID NO: 715747 - DNA, 25 bp, Mus musculus
gtgtcattctactttttcatacaga

SEQ ID NO: 715748 - DNA, 25 bp, Mus musculus
gtgtcattctcacgagctggctgca

SEQ ID NO: 715749 - DNA, 25 bp, Mus musculus
gtgtcattctcaggagctggctgca

SEQ ID NO: 715750 - DNA, 25 bp, Mus musculus
gtgtcattcttcaggcaggaagttc

SEQ ID NO: 715751 - DNA, 25 bp, Mus musculus
gtgtcattcttctggcaggaagttc

SEQ ID NO: 715752 - DNA, 25 bp, Mus musculus
gtgtcattggttatccagtgttgga

SEQ ID NO: 715753 - DNA, 25 bp, Mus musculus
gtgtcattggttatcttgaggatca

SEQ ID NO: 715754 - DNA, 25 bp, Mus musculus
gtgtcattggttttccagtgttgga

SEQ ID NO: 715755 - DNA, 25 bp, Mus musculus
gtgtcattggttttcttgaggatca

SEQ ID NO: 715756 - DNA, 25 bp, Mus musculus
gtgtcattgtcacaggtcatccaga

SEQ ID NO: 715757 - DNA, 25 bp, Mus musculus
gtgtcattgtcagaggtcatccaga

SEQ ID NO: 715758 - DNA, 25 bp, Mus musculus
gtgtcattgttgatcacattgtcat

SEQ ID NO: 715759 - DNA, 25 bp, Mus musculus
gtgtcattgttgttcacattgtcat

SEQ ID NO: 715760 - DNA, 25 bp, Mus musculus
gtgtcatttcaacagctatgcctta

SEQ ID NO: 715761 - DNA, 25 bp, Mus musculus
gtgtcatttcaagagctatgcctta

SEQ ID NO: 715762 - DNA, 25 bp, Mus musculus
gtgtcatttgcaacccagatgtaaa

SEQ ID NO: 715763 - DNA, 25 bp, Mus musculus
gtgtcatttgcatcccagatgtaaa

SEQ ID NO: 715764 - DNA, 25 bp, Mus musculus
gtgtcatttgtgaactggtgtgatc

SEQ ID NO: 715765 - DNA, 25 bp, Mus musculus
gtgtcatttgtgtactggtgtgatc

SEQ ID NO: 715766 - DNA, 25 bp, Mus musculus
gtgtcattttctcctgcagattctg

SEQ ID NO: 715767 - DNA, 25 bp, Mus musculus
gtgtcattttctgctgcagattctg

SEQ ID NO: 715768 - DNA, 25 bp, Mus musculus
gtgtccaaaatactcatgcccagtg

SEQ ID NO: 715769 - DNA, 25 bp, Mus musculus
gtgtccaaaatagtcatgcccagtg

SEQ ID NO: 715770 - DNA, 25 bp, Mus musculus
gtgtccaaagccaccagctgtgttc

SEQ ID NO: 715771 - DNA, 25 bp, Mus musculus
gtgtccaaagcctccagctgtgttc

SEQ ID NO: 715772 - DNA, 25 bp, Mus musculus
gtgtccaaagctatagtggcattgt

SEQ ID NO: 715773 - DNA, 25 bp, Mus musculus
gtgtccaaagctttagtggcattgt

SEQ ID NO: 715774 - DNA, 25 bp, Mus musculus
gtgtccaaaggccaagggtctcggg

SEQ ID NO: 715775 - DNA, 25 bp, Mus musculus
gtgtccaaaggcgaagggtctcggg

SEQ ID NO: 715776 - DNA, 25 bp, Mus musculus
gtgtccaaatggatcagccctgctg

SEQ ID NO: 715777 - DNA, 25 bp, Mus musculus
gtgtccaaatggttcagccctgctg

SEQ ID NO: 715778 - DNA, 25 bp, Mus musculus
gtgtccaaattaatttgtgtcatag

SEQ ID NO: 715779 - DNA, 25 bp, Mus musculus
gtgtccaaattactgcatgtagtga

SEQ ID NO: 715780 - DNA, 25 bp, Mus musculus
gtgtccaaattagtgcatgtagtga

SEQ ID NO: 715781 - DNA, 25 bp, Mus musculus
gtgtccaaattattttgtgtcatag

SEQ ID NO: 715782 - DNA, 25 bp, Mus musculus
gtgtccaaccccaggttgtgatggt

SEQ ID NO: 715783 - DNA, 25 bp, Mus musculus
gtgtccaacccctggttgtgatggt

SEQ ID NO: 715784 - DNA, 25 bp, Mus musculus
gtgtccaacctgaagatgggtcata

SEQ ID NO: 715785 - DNA, 25 bp, Mus musculus
gtgtccaacctgtagatgggtcata

SEQ ID NO: 715786 - DNA, 25 bp, Mus musculus
gtgtccaacgttctgacattgtgac

SEQ ID NO: 715787 - DNA, 25 bp, Mus musculus
gtgtccaacgttgtgacattgtgac

SEQ ID NO: 715788 - DNA, 25 bp, Mus musculus
gtgtccaactgaaatcatcgctttt

SEQ ID NO: 715789 - DNA, 25 bp, Mus musculus
gtgtccaactgatatcatcgctttt

SEQ ID NO: 715790 - DNA, 25 bp, Mus musculus
gtgtccaacttacatgtggtgaacc

SEQ ID NO: 715791 - DNA, 25 bp, Mus musculus
gtgtccaacttagatgtggtgaacc

SEQ ID NO: 715792 - DNA, 25 bp, Mus musculus
gtgtccaagacgctctcttggttta

SEQ ID NO: 715793 - DNA, 25 bp, Mus musculus
gtgtccaagacggtctcttggttta

SEQ ID NO: 715794 - DNA, 25 bp, Mus musculus
gtgtccaagattagagtcctcagag

SEQ ID NO: 715795 - DNA, 25 bp, Mus musculus
gtgtccaagatttgagtcctcagag

SEQ ID NO: 715796 - DNA, 25 bp, Mus musculus
gtgtccaagcccactgagagcaggt

SEQ ID NO: 715797 - DNA, 25 bp, Mus musculus
gtgtccaagccctctgagagcaggt

SEQ ID NO: 715798 - DNA, 25 bp, Mus musculus
gtgtccaagctgcaagtggaatttt

SEQ ID NO: 715799 - DNA, 25 bp, Mus musculus
gtgtccaagctggaagtggaatttt

SEQ ID NO: 715800 - DNA, 25 bp, Mus musculus
gtgtccaaggaaatactgcaaacta

SEQ ID NO: 715801 - DNA, 25 bp, Mus musculus
gtgtccaaggaattactgcaaacta

SEQ ID NO: 715802 - DNA, 25 bp, Mus musculus
gtgtccaaggagaagctattatatt

SEQ ID NO: 715803 - DNA, 25 bp, Mus musculus
gtgtccaaggagtagctattatatt

SEQ ID NO: 715804 - DNA, 25 bp, Mus musculus
gtgtccaaggccatgtgaaggatag

SEQ ID NO: 715805 - DNA, 25 bp, Mus musculus
gtgtccaaggccttgtgaaggatag

SEQ ID NO: 715806 - DNA, 25 bp, Mus musculus
gtgtccaagggcattcatggttttt

SEQ ID NO: 715807 - DNA, 25 bp, Mus musculus
gtgtccaagggctttcatggttttt

SEQ ID NO: 715808 - DNA, 25 bp, Mus musculus
gtgtccaaggtaaaaccacaacaat

SEQ ID NO: 715809 - DNA, 25 bp, Mus musculus
gtgtccaaggtataaccacaacaat

SEQ ID NO: 715810 - DNA, 25 bp, Mus musculus
gtgtccaataccaaaatgcttcagt

SEQ ID NO: 715811 - DNA, 25 bp, Mus musculus
gtgtccaatacctaaatgcttcagt

SEQ ID NO: 715812 - DNA, 25 bp, Mus musculus
gtgtccaatactcgagggattgttt

SEQ ID NO: 715813 - DNA, 25 bp, Mus musculus
gtgtccaatactggagggattgttt

SEQ ID NO: 715814 - DNA, 25 bp, Mus musculus
gtgtccaatatgagttaactttttc

SEQ ID NO: 715815 - DNA, 25 bp, Mus musculus
gtgtccaatatgtgttaactttttc

SEQ ID NO: 715816 - DNA, 25 bp, Mus musculus
gtgtccaatgttattaaaatggccg

SEQ ID NO: 715817 - DNA, 25 bp, Mus musculus
gtgtccaatgtttttaaaatggccg

SEQ ID NO: 715818 - DNA, 25 bp, Mus musculus
gtgtccaattcaattatcctctcaa

SEQ ID NO: 715819 - DNA, 25 bp, Mus musculus
gtgtccaattcatttatcctctcaa

SEQ ID NO: 715820 - DNA, 25 bp, Mus musculus
gtgtccacaaccacttcaaactaag

SEQ ID NO: 715821 - DNA, 25 bp, Mus musculus
gtgtccacaacctcttcaaactaag

SEQ ID NO: 715822 - DNA, 25 bp, Mus musculus
gtgtccacacacattaagccaatat

SEQ ID NO: 715823 - DNA, 25 bp, Mus musculus
gtgtccacacactttaagccaatat

SEQ ID NO: 715824 - DNA, 25 bp, Mus musculus
gtgtccacacccagaaagacttcta

SEQ ID NO: 715825 - DNA, 25 bp, Mus musculus
gtgtccacaccctgaaagacttcta

SEQ ID NO: 715826 - DNA, 25 bp, Mus musculus
gtgtccacagaacctcttgtctgag

SEQ ID NO: 715827 - DNA, 25 bp, Mus musculus
gtgtccacagaagctcttgtctgag

SEQ ID NO: 715828 - DNA, 25 bp, Mus musculus
gtgtccacagggattgtgtactgtt

SEQ ID NO: 715829 - DNA, 25 bp, Mus musculus
gtgtccacagggtttgtgtactgtt

SEQ ID NO: 715830 - DNA, 25 bp, Mus musculus
gtgtccacagttagtcactgatgga

SEQ ID NO: 715831 - DNA, 25 bp, Mus musculus
gtgtccacagtttgtcactgatgga

SEQ ID NO: 715832 - DNA, 25 bp, Mus musculus
gtgtccacatagcaaagtacctcag

SEQ ID NO: 715833 - DNA, 25 bp, Mus musculus
gtgtccacataggaaagtacctcag

SEQ ID NO: 715834 - DNA, 25 bp, Mus musculus
gtgtccaccaggaatactgtctcca

SEQ ID NO: 715835 - DNA, 25 bp, Mus musculus
gtgtccaccaggtatactgtctcca

SEQ ID NO: 715836 - DNA, 25 bp, Mus musculus
gtgtccacccaaaagtttggaaaag

SEQ ID NO: 715837 - DNA, 25 bp, Mus musculus
gtgtccacccaatagtttggaaaag

SEQ ID NO: 715838 - DNA, 25 bp, Mus musculus
gtgtccacggtgctttgatcaacaa

SEQ ID NO: 715839 - DNA, 25 bp, Mus musculus
gtgtccacggtggtttgatcaacaa

SEQ ID NO: 715840 - DNA, 25 bp, Mus musculus
gtgtccacgtgccaagccatcgatg

SEQ ID NO: 715841 - DNA, 25 bp, Mus musculus
gtgtccacgtgcgaagccatcgatg

SEQ ID NO: 715842 - DNA, 25 bp, Mus musculus
gtgtccacgtttctgtatgcctaca

SEQ ID NO: 715843 - DNA, 25 bp, Mus musculus
gtgtccacgtttgtgtatgcctaca

SEQ ID NO: 715844 - DNA, 25 bp, Mus musculus
gtgtccactgctaagaagggctcca

SEQ ID NO: 715845 - DNA, 25 bp, Mus musculus
gtgtccactgcttagaagggctcca

SEQ ID NO: 715846 - DNA, 25 bp, Mus musculus
gtgtccactgtgctaaaggcactta

SEQ ID NO: 715847 - DNA, 25 bp, Mus musculus
gtgtccactgtggtaaaggcactta

SEQ ID NO: 715848 - DNA, 25 bp, Mus musculus
gtgtccagaaatcctccctatgaac

SEQ ID NO: 715849 - DNA, 25 bp, Mus musculus
gtgtccagaaatgctccctatgaac

SEQ ID NO: 715850 - DNA, 25 bp, Mus musculus
gtgtccagaacacagagagtccagt

SEQ ID NO: 715851 - DNA, 25 bp, Mus musculus
gtgtccagaacactcgctctgagta

SEQ ID NO: 715852 - DNA, 25 bp, Mus musculus
gtgtccagaacagagagagtccagt

SEQ ID NO: 715853 - DNA, 25 bp, Mus musculus
gtgtccagaacagtcgctctgagta

SEQ ID NO: 715854 - DNA, 25 bp, Mus musculus
gtgtccagaattaacctaatctggt

SEQ ID NO: 715855 - DNA, 25 bp, Mus musculus
gtgtccagaatttacctaatctggt

SEQ ID NO: 715856 - DNA, 25 bp, Mus musculus
gtgtccagactcaccaaggttggta

SEQ ID NO: 715857 - DNA, 25 bp, Mus musculus
gtgtccagactctccaaggttggta

SEQ ID NO: 715858 - DNA, 25 bp, Mus musculus
gtgtccagagacacaattgctttgc

SEQ ID NO: 715859 - DNA, 25 bp, Mus musculus
gtgtccagagaccttaactgctgag

SEQ ID NO: 715860 - DNA, 25 bp, Mus musculus
gtgtccagagacgttaactgctgag

SEQ ID NO: 715861 - DNA, 25 bp, Mus musculus
gtgtccagagactcaattgctttgc

SEQ ID NO: 715862 - DNA, 25 bp, Mus musculus
gtgtccagagccagtctgtttttag

SEQ ID NO: 715863 - DNA, 25 bp, Mus musculus
gtgtccagagcccagggaacctcag

SEQ ID NO: 715864 - DNA, 25 bp, Mus musculus
gtgtccagagccgagggaacctcag

SEQ ID NO: 715865 - DNA, 25 bp, Mus musculus
gtgtccagagcctgtctgtttttag

SEQ ID NO: 715866 - DNA, 25 bp, Mus musculus
gtgtccagagctactatactccgcg

SEQ ID NO: 715867 - DNA, 25 bp, Mus musculus
gtgtccagagcttctatactccgcg

SEQ ID NO: 715868 - DNA, 25 bp, Mus musculus
gtgtccagaggtagtcacagcagct

SEQ ID NO: 715869 - DNA, 25 bp, Mus musculus
gtgtccagaggttgtcacagcagct

SEQ ID NO: 715870 - DNA, 25 bp, Mus musculus
gtgtccagatggagctagtcaagaa

SEQ ID NO: 715871 - DNA, 25 bp, Mus musculus
gtgtccagatggtgctagtcaagaa

SEQ ID NO: 715872 - DNA, 25 bp, Mus musculus
gtgtccagcaatactgtcctttgta

SEQ ID NO: 715873 - DNA, 25 bp, Mus musculus
gtgtccagcaattctgtcctttgta

SEQ ID NO: 715874 - DNA, 25 bp, Mus musculus
gtgtccagctacaacgccctgagag

SEQ ID NO: 715875 - DNA, 25 bp, Mus musculus
gtgtccagctactacgccctgagag

SEQ ID NO: 715876 - DNA, 25 bp, Mus musculus
gtgtccagctgcaactgcaagtttc

SEQ ID NO: 715877 - DNA, 25 bp, Mus musculus
gtgtccagctgctactgcaagtttc

SEQ ID NO: 715878 - DNA, 25 bp, Mus musculus
gtgtccagctgtcaacttccagttc

SEQ ID NO: 715879 - DNA, 25 bp, Mus musculus
gtgtccagctgtgaacttccagttc

SEQ ID NO: 715880 - DNA, 25 bp, Mus musculus
gtgtccagcttgatgttttactcca

SEQ ID NO: 715881 - DNA, 25 bp, Mus musculus
gtgtccagcttgttgttttactcca

SEQ ID NO: 715882 - DNA, 25 bp, Mus musculus
gtgtccaggaagaactgtcatccca

SEQ ID NO: 715883 - DNA, 25 bp, Mus musculus
gtgtccaggaagtactgtcatccca

SEQ ID NO: 715884 - DNA, 25 bp, Mus musculus
gtgtccaggcctcagcagtaaatat

SEQ ID NO: 715885 - DNA, 25 bp, Mus musculus
gtgtccaggcctgagcagtaaatat

SEQ ID NO: 715886 - DNA, 25 bp, Mus musculus
gtgtccagggtccagatgtttcagt

SEQ ID NO: 715887 - DNA, 25 bp, Mus musculus
gtgtccagggtcgagatgtttcagt

SEQ ID NO: 715888 - DNA, 25 bp, Mus musculus
gtgtccaggtgaccaggtacccatg

SEQ ID NO: 715889 - DNA, 25 bp, Mus musculus
gtgtccaggtgagcaggtacccatg

SEQ ID NO: 715890 - DNA, 25 bp, Mus musculus
gtgtccaggtgtatccaacttggga

SEQ ID NO: 715891 - DNA, 25 bp, Mus musculus
gtgtccaggtgtttccaacttggga

SEQ ID NO: 715892 - DNA, 25 bp, Mus musculus
gtgtccagtaacatgcgtgggcata

SEQ ID NO: 715893 - DNA, 25 bp, Mus musculus
gtgtccagtaacttgcgtgggcata

SEQ ID NO: 715894 - DNA, 25 bp, Mus musculus
gtgtccagtatgatatttgcacaga

SEQ ID NO: 715895 - DNA, 25 bp, Mus musculus
gtgtccagtatgttatttgcacaga

SEQ ID NO: 715896 - DNA, 25 bp, Mus musculus
gtgtccagtccacgtgaactagcag

SEQ ID NO: 715897 - DNA, 25 bp, Mus musculus
gtgtccagtccaggtgaactagcag

SEQ ID NO: 715898 - DNA, 25 bp, Mus musculus
gtgtccagtgaaattccgctttgat

SEQ ID NO: 715899 - DNA, 25 bp, Mus musculus
gtgtccagtgaatttccgctttgat

SEQ ID NO: 715900 - DNA, 25 bp, Mus musculus
gtgtccatacaaactaatctaggcc

SEQ ID NO: 715901 - DNA, 25 bp, Mus musculus
gtgtccatacaatctaatctaggcc

SEQ ID NO: 715902 - DNA, 25 bp, Mus musculus
gtgtccatacctcatgttctatcaa

SEQ ID NO: 715903 - DNA, 25 bp, Mus musculus
gtgtccatacctgatgttctatcaa

SEQ ID NO: 715904 - DNA, 25 bp, Mus musculus
gtgtccatagatagtgctcatctgg

SEQ ID NO: 715905 - DNA, 25 bp, Mus musculus
gtgtccatagattgtgctcatctgg

SEQ ID NO: 715906 - DNA, 25 bp, Mus musculus
gtgtccatagctctgtgtattctca

SEQ ID NO: 715907 - DNA, 25 bp, Mus musculus
gtgtccatagctgtgtgtattctca

SEQ ID NO: 715908 - DNA, 25 bp, Mus musculus
gtgtccatatccaactgaaactctg

SEQ ID NO: 715909 - DNA, 25 bp, Mus musculus
gtgtccatatcctactgaaactctg

SEQ ID NO: 715910 - DNA, 25 bp, Mus musculus
gtgtccatcactattttacaagcct

SEQ ID NO: 715911 - DNA, 25 bp, Mus musculus
gtgtccatcacttttttacaagcct

SEQ ID NO: 715912 - DNA, 25 bp, Mus musculus
gtgtccatcagtagacgaatgcata

SEQ ID NO: 715913 - DNA, 25 bp, Mus musculus
gtgtccatcagttgacgaatgcata

SEQ ID NO: 715914 - DNA, 25 bp, Mus musculus
gtgtccatcctgacaagcatttgta

SEQ ID NO: 715915 - DNA, 25 bp, Mus musculus
gtgtccatcctgtcaagcatttgta

SEQ ID NO: 715916 - DNA, 25 bp, Mus musculus
gtgtccatcttaaagactgctgtgc

SEQ ID NO: 715917 - DNA, 25 bp, Mus musculus
gtgtccatcttatagactgctgtgc

SEQ ID NO: 715918 - DNA, 25 bp, Mus musculus
gtgtccatctttcgtaatgctagta

SEQ ID NO: 715919 - DNA, 25 bp, Mus musculus
gtgtccatctttggtaatgctagta

SEQ ID NO: 715920 - DNA, 25 bp, Mus musculus
gtgtccatgaacaaggccaaagctt

SEQ ID NO: 715921 - DNA, 25 bp, Mus musculus
gtgtccatgaactaggccaaagctt

SEQ ID NO: 715922 - DNA, 25 bp, Mus musculus
gtgtccatgactaaatcttatcttt

SEQ ID NO: 715923 - DNA, 25 bp, Mus musculus
gtgtccatgacttaatcttatcttt

SEQ ID NO: 715924 - DNA, 25 bp, Mus musculus
gtgtccatgattagtctattgctat

SEQ ID NO: 715925 - DNA, 25 bp, Mus musculus
gtgtccatgatttgtctattgctat

SEQ ID NO: 715926 - DNA, 25 bp, Mus musculus
gtgtccatgcccctaatgttataac

SEQ ID NO: 715927 - DNA, 25 bp, Mus musculus
gtgtccatgcccgtaatgttataac

SEQ ID NO: 715928 - DNA, 25 bp, Mus musculus
gtgtccatgcttaaacccagggatg

SEQ ID NO: 715929 - DNA, 25 bp, Mus musculus
gtgtccatgctttaacccagggatg

SEQ ID NO: 715930 - DNA, 25 bp, Mus musculus
gtgtccatggcacaccaactaggca

SEQ ID NO: 715931 - DNA, 25 bp, Mus musculus
gtgtccatggcagaccaactaggca

SEQ ID NO: 715932 - DNA, 25 bp, Mus musculus
gtgtccatgtgtcaacttatcgctc

SEQ ID NO: 715933 - DNA, 25 bp, Mus musculus
gtgtccatgtgtcaagctacaagta

SEQ ID NO: 715934 - DNA, 25 bp, Mus musculus
gtgtccatgtgtcacccttagcaga

SEQ ID NO: 715935 - DNA, 25 bp, Mus musculus
gtgtccatgtgtgaacttatcgctc

SEQ ID NO: 715936 - DNA, 25 bp, Mus musculus
gtgtccatgtgtgaagctacaagta

SEQ ID NO: 715937 - DNA, 25 bp, Mus musculus
gtgtccatgtgtgacccttagcaga

SEQ ID NO: 715938 - DNA, 25 bp, Mus musculus
gtgtccatgttgagccagagattgt

SEQ ID NO: 715939 - DNA, 25 bp, Mus musculus
gtgtccatgttgtgccagagattgt

SEQ ID NO: 715940 - DNA, 25 bp, Mus musculus
gtgtccattccaacactcataaaat

SEQ ID NO: 715941 - DNA, 25 bp, Mus musculus
gtgtccattccatcactcataaaat

SEQ ID NO: 715942 - DNA, 25 bp, Mus musculus
gtgtccattctaactgtaaccaagt

SEQ ID NO: 715943 - DNA, 25 bp, Mus musculus
gtgtccattctatctgtaaccaagt

SEQ ID NO: 715944 - DNA, 25 bp, Mus musculus
gtgtccattgatctgggtccaagtt

SEQ ID NO: 715945 - DNA, 25 bp, Mus musculus
gtgtccattgatgtgggtccaagtt

SEQ ID NO: 715946 - DNA, 25 bp, Mus musculus
gtgtccatttgtattcctaggtttg

SEQ ID NO: 715947 - DNA, 25 bp, Mus musculus
gtgtccatttgtctgacattgcctc

SEQ ID NO: 715948 - DNA, 25 bp, Mus musculus
gtgtccatttgtgtgacattgcctc

SEQ ID NO: 715949 - DNA, 25 bp, Mus musculus
gtgtccatttgttttcctaggtttg

SEQ ID NO: 715950 - DNA, 25 bp, Mus musculus
gtgtcccaatccaccctagaagtta

SEQ ID NO: 715951 - DNA, 25 bp, Mus musculus
gtgtcccaatcctccctagaagtta

SEQ ID NO: 715952 - DNA, 25 bp, Mus musculus
gtgtcccacaccagctattattaaa

SEQ ID NO: 715953 - DNA, 25 bp, Mus musculus
gtgtcccacacctgctattattaaa

SEQ ID NO: 715954 - DNA, 25 bp, Mus musculus
gtgtcccacatacattgcaatgagt

SEQ ID NO: 715955 - DNA, 25 bp, Mus musculus
gtgtcccacatagattgcaatgagt

SEQ ID NO: 715956 - DNA, 25 bp, Mus musculus
gtgtcccaccaacagcactttcatt

SEQ ID NO: 715957 - DNA, 25 bp, Mus musculus
gtgtcccaccaagagcactttcatt

SEQ ID NO: 715958 - DNA, 25 bp, Mus musculus
gtgtcccaccatacagtgagtccaa

SEQ ID NO: 715959 - DNA, 25 bp, Mus musculus
gtgtcccaccattcagtgagtccaa

SEQ ID NO: 715960 - DNA, 25 bp, Mus musculus
gtgtcccaccgaactggggaaactg

SEQ ID NO: 715961 - DNA, 25 bp, Mus musculus
gtgtcccaccgatctggggaaactg

SEQ ID NO: 715962 - DNA, 25 bp, Mus musculus
gtgtcccactccatagttctgagaa

SEQ ID NO: 715963 - DNA, 25 bp, Mus musculus
gtgtcccactccttagttctgagaa

SEQ ID NO: 715964 - DNA, 25 bp, Mus musculus
gtgtcccacttgatttgctagtaat

SEQ ID NO: 715965 - DNA, 25 bp, Mus musculus
gtgtcccacttgttttgctagtaat

SEQ ID NO: 715966 - DNA, 25 bp, Mus musculus
gtgtcccagactattggctatttgt

SEQ ID NO: 715967 - DNA, 25 bp, Mus musculus
gtgtcccagacttttggctatttgt

SEQ ID NO: 715968 - DNA, 25 bp, Mus musculus
gtgtcccagcctacatgactggaga

SEQ ID NO: 715969 - DNA, 25 bp, Mus musculus
gtgtcccagccttcatgactggaga

SEQ ID NO: 715970 - DNA, 25 bp, Mus musculus
gtgtcccagcgaagcaaagaactga

SEQ ID NO: 715971 - DNA, 25 bp, Mus musculus
gtgtcccagcgatgcaaagaactga

SEQ ID NO: 715972 - DNA, 25 bp, Mus musculus
gtgtcccagctactgtggattgaaa

SEQ ID NO: 715973 - DNA, 25 bp, Mus musculus
gtgtcccagctagtgtggattgaaa

SEQ ID NO: 715974 - DNA, 25 bp, Mus musculus
gtgtcccaggagaagaaaacactcc

SEQ ID NO: 715975 - DNA, 25 bp, Mus musculus
gtgtcccaggagtagaaaacactcc

SEQ ID NO: 715976 - DNA, 25 bp, Mus musculus
gtgtcccagggcagcaaacttctct

SEQ ID NO: 715977 - DNA, 25 bp, Mus musculus
gtgtcccagggctgcaaacttctct

SEQ ID NO: 715978 - DNA, 25 bp, Mus musculus
gtgtcccaggtcaggcttggctaca

SEQ ID NO: 715979 - DNA, 25 bp, Mus musculus
gtgtcccaggtctggcttggctaca

SEQ ID NO: 715980 - DNA, 25 bp, Mus musculus
gtgtcccagtgtccttatttgttgc

SEQ ID NO: 715981 - DNA, 25 bp, Mus musculus
gtgtcccagtgtgcttatttgttgc

SEQ ID NO: 715982 - DNA, 25 bp, Mus musculus
gtgtcccatctaaggaggacctgca

SEQ ID NO: 715983 - DNA, 25 bp, Mus musculus
gtgtcccatctatggaggacctgca

SEQ ID NO: 715984 - DNA, 25 bp, Mus musculus
gtgtcccatgctatcacattacgtt

SEQ ID NO: 715985 - DNA, 25 bp, Mus musculus
gtgtcccatgctttcacattacgtt

SEQ ID NO: 715986 - DNA, 25 bp, Mus musculus
gtgtcccattcacggtggcttagac

SEQ ID NO: 715987 - DNA, 25 bp, Mus musculus
gtgtcccattcagggtggcttagac

SEQ ID NO: 715988 - DNA, 25 bp, Mus musculus
gtgtccccaacactgcccgaaggaa

SEQ ID NO: 715989 - DNA, 25 bp, Mus musculus
gtgtccccaacagtgcccgaaggaa

SEQ ID NO: 715990 - DNA, 25 bp, Mus musculus
gtgtccccaactcttatctagtaag

SEQ ID NO: 715991 - DNA, 25 bp, Mus musculus
gtgtccccaactgttatctagtaag

SEQ ID NO: 715992 - DNA, 25 bp, Mus musculus
gtgtccccaagtactgtgtcctctt

SEQ ID NO: 715993 - DNA, 25 bp, Mus musculus
gtgtccccaagttctgtgtcctctt

SEQ ID NO: 715994 - DNA, 25 bp, Mus musculus
gtgtccccacacagaaatgctgcag

SEQ ID NO: 715995 - DNA, 25 bp, Mus musculus
gtgtccccacactgaaatgctgcag

SEQ ID NO: 715996 - DNA, 25 bp, Mus musculus
gtgtccccacagactggatctgtca

SEQ ID NO: 715997 - DNA, 25 bp, Mus musculus
gtgtccccacagtctggatctgtca

SEQ ID NO: 715998 - DNA, 25 bp, Mus musculus
gtgtccccagatatccttgtaataa

SEQ ID NO: 715999 - DNA, 25 bp, Mus musculus
gtgtccccagatttccttgtaataa

SEQ ID NO: 716000 - DNA, 25 bp, Mus musculus
gtgtccccatatcttacagacgtta

SEQ ID NO: 716001 - DNA, 25 bp, Mus musculus
gtgtccccatatgttacagacgtta

SEQ ID NO: 716002 - DNA, 25 bp, Mus musculus
gtgtccccgaagcagctaggcaatt

SEQ ID NO: 716003 - DNA, 25 bp, Mus musculus
gtgtccccgaaggagctaggcaatt

SEQ ID NO: 716004 - DNA, 25 bp, Mus musculus
gtgtccccgataccagctgtcattc

SEQ ID NO: 716005 - DNA, 25 bp, Mus musculus
gtgtccccgatagcagctgtcattc

SEQ ID NO: 716006 - DNA, 25 bp, Mus musculus
gtgtccccggcaatgaattcaggca

SEQ ID NO: 716007 - DNA, 25 bp, Mus musculus
gtgtccccggcattgaattcaggca

SEQ ID NO: 716008 - DNA, 25 bp, Mus musculus
gtgtcccctgggagaccggcatgtc

SEQ ID NO: 716009 - DNA, 25 bp, Mus musculus
gtgtcccctgggtgaccggcatgtc

SEQ ID NO: 716010 - DNA, 25 bp, Mus musculus
gtgtcccctgtcagatttgtaggaa

SEQ ID NO: 716011 - DNA, 25 bp, Mus musculus
gtgtcccctgtctgatttgtaggaa

SEQ ID NO: 716012 - DNA, 25 bp, Mus musculus
gtgtcccgcttgaactgtttggaaa

SEQ ID NO: 716013 - DNA, 25 bp, Mus musculus
gtgtcccgcttgtactgtttggaaa

SEQ ID NO: 716014 - DNA, 25 bp, Mus musculus
gtgtcccggatgcaggaaaccgcaa

SEQ ID NO: 716015 - DNA, 25 bp, Mus musculus
gtgtcccggatggaggaaaccgcaa

SEQ ID NO: 716016 - DNA, 25 bp, Mus musculus
gtgtcccgttacagttaagtcatca

SEQ ID NO: 716017 - DNA, 25 bp, Mus musculus
gtgtcccgttactgttaagtcatca

SEQ ID NO: 716018 - DNA, 25 bp, Mus musculus
gtgtcccgttgtatgtggccaagag

SEQ ID NO: 716019 - DNA, 25 bp, Mus musculus
gtgtcccgttgtttgtggccaagag

SEQ ID NO: 716020 - DNA, 25 bp, Mus musculus
gtgtcccgttttaaacgcattcctg

SEQ ID NO: 716021 - DNA, 25 bp, Mus musculus
gtgtcccgtttttaacgcattcctg

SEQ ID NO: 716022 - DNA, 25 bp, Mus musculus
gtgtccctaaatctctattcttttg

SEQ ID NO: 716023 - DNA, 25 bp, Mus musculus
gtgtccctaaatgtctattcttttg

SEQ ID NO: 716024 - DNA, 25 bp, Mus musculus
gtgtccctactaatgcatgtgcaat

SEQ ID NO: 716025 - DNA, 25 bp, Mus musculus
gtgtccctactattgcatgtgcaat

SEQ ID NO: 716026 - DNA, 25 bp, Mus musculus
gtgtccctataaccctaagaagtgc

SEQ ID NO: 716027 - DNA, 25 bp, Mus musculus
gtgtccctataagcctaagaagtgc

SEQ ID NO: 716028 - DNA, 25 bp, Mus musculus
gtgtccctatcaagtcaggatgttc

SEQ ID NO: 716029 - DNA, 25 bp, Mus musculus
gtgtccctatcaagtgtagcatgct

SEQ ID NO: 716030 - DNA, 25 bp, Mus musculus
gtgtccctatcatgtcaggatgttc

SEQ ID NO: 716031 - DNA, 25 bp, Mus musculus
gtgtccctatcatgtgtagcatgct

SEQ ID NO: 716032 - DNA, 25 bp, Mus musculus
gtgtccctcaagatacagactctaa

SEQ ID NO: 716033 - DNA, 25 bp, Mus musculus
gtgtccctcaagttacagactctaa

SEQ ID NO: 716034 - DNA, 25 bp, Mus musculus
gtgtccctcaggcagactactgaaa

SEQ ID NO: 716035 - DNA, 25 bp, Mus musculus
gtgtccctcagggagactactgaaa

SEQ ID NO: 716036 - DNA, 25 bp, Mus musculus
gtgtccctcagtacttcatgggctg

SEQ ID NO: 716037 - DNA, 25 bp, Mus musculus
gtgtccctcagttcttcatgggctg

SEQ ID NO: 716038 - DNA, 25 bp, Mus musculus
gtgtccctccacagacagatggaaa

SEQ ID NO: 716039 - DNA, 25 bp, Mus musculus
gtgtccctccactgacagatggaaa

SEQ ID NO: 716040 - DNA, 25 bp, Mus musculus
gtgtccctgaagactctcaagtttt

SEQ ID NO: 716041 - DNA, 25 bp, Mus musculus
gtgtccctgaagatcagtagcttct

SEQ ID NO: 716042 - DNA, 25 bp, Mus musculus
gtgtccctgaagtctctcaagtttt

SEQ ID NO: 716043 - DNA, 25 bp, Mus musculus
gtgtccctgaagttcagtagcttct

SEQ ID NO: 716044 - DNA, 25 bp, Mus musculus
gtgtccctgagacatcatggcttgt

SEQ ID NO: 716045 - DNA, 25 bp, Mus musculus
gtgtccctgagagatcatggcttgt

SEQ ID NO: 716046 - DNA, 25 bp, Mus musculus
gtgtccctggatctcaaagcaagtg

SEQ ID NO: 716047 - DNA, 25 bp, Mus musculus
gtgtccctggatgtcaaagcaagtg

SEQ ID NO: 716048 - DNA, 25 bp, Mus musculus
gtgtccctggctccaagaaagtcat

SEQ ID NO: 716049 - DNA, 25 bp, Mus musculus
gtgtccctggctgcaagaaagtcat

SEQ ID NO: 716050 - DNA, 25 bp, Mus musculus
gtgtccctgtgaaaaattcttgtat

SEQ ID NO: 716051 - DNA, 25 bp, Mus musculus
gtgtccctgtgaatctgctcttggc

SEQ ID NO: 716052 - DNA, 25 bp, Mus musculus
gtgtccctgtgataaattcttgtat

SEQ ID NO: 716053 - DNA, 25 bp, Mus musculus
gtgtccctgtgattctgctcttggc

SEQ ID NO: 716054 - DNA, 25 bp, Mus musculus
gtgtccctgtgcattaatggtcctc

SEQ ID NO: 716055 - DNA, 25 bp, Mus musculus
gtgtccctgtgctttaatggtcctc

SEQ ID NO: 716056 - DNA, 25 bp, Mus musculus
gtgtcccttcatacttggaattgtg

SEQ ID NO: 716057 - DNA, 25 bp, Mus musculus
gtgtcccttcattcttggaattgtg

SEQ ID NO: 716058 - DNA, 25 bp, Mus musculus
gtgtcccttcttagagggaagaaag

SEQ ID NO: 716059 - DNA, 25 bp, Mus musculus
gtgtcccttctttgagggaagaaag

SEQ ID NO: 716060 - DNA, 25 bp, Mus musculus
gtgtcccttgatctaagctttgcca

SEQ ID NO: 716061 - DNA, 25 bp, Mus musculus
gtgtcccttgatgtaagctttgcca

SEQ ID NO: 716062 - DNA, 25 bp, Mus musculus
gtgtcccttgctaccttgaagaaag

SEQ ID NO: 716063 - DNA, 25 bp, Mus musculus
gtgtcccttgcttccttgaagaaag

SEQ ID NO: 716064 - DNA, 25 bp, Mus musculus
gtgtccctttacaatctgttcaaga

SEQ ID NO: 716065 - DNA, 25 bp, Mus musculus
gtgtccctttactatctgttcaaga

SEQ ID NO: 716066 - DNA, 25 bp, Mus musculus
gtgtccctttcaaaacctttgttct

SEQ ID NO: 716067 - DNA, 25 bp, Mus musculus
gtgtccctttcataacctttgttct

SEQ ID NO: 716068 - DNA, 25 bp, Mus musculus
gtgtccctttctctaataattcatt

SEQ ID NO: 716069 - DNA, 25 bp, Mus musculus
gtgtccctttctgtaataattcatt

SEQ ID NO: 716070 - DNA, 25 bp, Mus musculus
gtgtcccttttcagagcttgtagca

SEQ ID NO: 716071 - DNA, 25 bp, Mus musculus
gtgtcccttttctgagcttgtagca

SEQ ID NO: 716072 - DNA, 25 bp, Mus musculus
gtgtccgatatgatgagccgttagg

SEQ ID NO: 716073 - DNA, 25 bp, Mus musculus
gtgtccgatatgttgagccgttagg

SEQ ID NO: 716074 - DNA, 25 bp, Mus musculus
gtgtccgcacgcaggaaaagatccg

SEQ ID NO: 716075 - DNA, 25 bp, Mus musculus
gtgtccgcacgctggaaaagatccg

SEQ ID NO: 716076 - DNA, 25 bp, Mus musculus
gtgtccgcagagattgtgcccaagg

SEQ ID NO: 716077 - DNA, 25 bp, Mus musculus
gtgtccgcagagtttgtgcccaagg

SEQ ID NO: 716078 - DNA, 25 bp, Mus musculus
gtgtccgcgcacactgtgaagtttg

SEQ ID NO: 716079 - DNA, 25 bp, Mus musculus
gtgtccgcgcactctgtgaagtttg

SEQ ID NO: 716080 - DNA, 25 bp, Mus musculus
gtgtccgctcttacagtattctaaa

SEQ ID NO: 716081 - DNA, 25 bp, Mus musculus
gtgtccgctctttcagtattctaaa

SEQ ID NO: 716082 - DNA, 25 bp, Mus musculus
gtgtccggagaacagagttgcacaa

SEQ ID NO: 716083 - DNA, 25 bp, Mus musculus
gtgtccggagaagagagttgcacaa

SEQ ID NO: 716084 - DNA, 25 bp, Mus musculus
gtgtccggagacatactttatatat

SEQ ID NO: 716085 - DNA, 25 bp, Mus musculus
gtgtccggagacttactttatatat

SEQ ID NO: 716086 - DNA, 25 bp, Mus musculus
gtgtccggagatagcactgcagcgt

SEQ ID NO: 716087 - DNA, 25 bp, Mus musculus
gtgtccggagattgcactgcagcgt

SEQ ID NO: 716088 - DNA, 25 bp, Mus musculus
gtgtccggagtgagtctatatcttc

SEQ ID NO: 716089 - DNA, 25 bp, Mus musculus
gtgtccggagtgtgtctatatcttc

SEQ ID NO: 716090 - DNA, 25 bp, Mus musculus
gtgtccggcataatcagatactacg

SEQ ID NO: 716091 - DNA, 25 bp, Mus musculus
gtgtccggcatattcagatactacg

SEQ ID NO: 716092 - DNA, 25 bp, Mus musculus
gtgtccggcggtcgcgacgtcttgc

SEQ ID NO: 716093 - DNA, 25 bp, Mus musculus
gtgtccggcggtggcgacgtcttgc

SEQ ID NO: 716094 - DNA, 25 bp, Mus musculus
gtgtccggcgtcaggctatattgaa

SEQ ID NO: 716095 - DNA, 25 bp, Mus musculus
gtgtccggcgtctggctatattgaa

SEQ ID NO: 716096 - DNA, 25 bp, Mus musculus
gtgtccggctggagctagcaacaga

SEQ ID NO: 716097 - DNA, 25 bp, Mus musculus
gtgtccggctggcaacaaaccacta

SEQ ID NO: 716098 - DNA, 25 bp, Mus musculus
gtgtccggctgggaacaaaccacta

SEQ ID NO: 716099 - DNA, 25 bp, Mus musculus
gtgtccggctggtgctagcaacaga

SEQ ID NO: 716100 - DNA, 25 bp, Mus musculus
gtgtccgggacgagatccacatgac

SEQ ID NO: 716101 - DNA, 25 bp, Mus musculus
gtgtccgggacgtgatccacatgac

SEQ ID NO: 716102 - DNA, 25 bp, Mus musculus
gtgtccgtccccagtatgggtttag

SEQ ID NO: 716103 - DNA, 25 bp, Mus musculus
gtgtccgtcccctgtatgggtttag

SEQ ID NO: 716104 - DNA, 25 bp, Mus musculus
gtgtccgtgcacactgctatgtcat

SEQ ID NO: 716105 - DNA, 25 bp, Mus musculus
gtgtccgtgcactctgctatgtcat

SEQ ID NO: 716106 - DNA, 25 bp, Mus musculus
gtgtccgtggacactgtgtcaccga

SEQ ID NO: 716107 - DNA, 25 bp, Mus musculus
gtgtccgtggactctgtgtcaccga

SEQ ID NO: 716108 - DNA, 25 bp, Mus musculus
gtgtccgtggcaaagttctcatcaa

SEQ ID NO: 716109 - DNA, 25 bp, Mus musculus
gtgtccgtggcatagttctcatcaa

SEQ ID NO: 716110 - DNA, 25 bp, Mus musculus
gtgtccgtgggaaccctttactctg

SEQ ID NO: 716111 - DNA, 25 bp, Mus musculus
gtgtccgtgggatccctttactctg

SEQ ID NO: 716112 - DNA, 25 bp, Mus musculus
gtgtccgttgtgcatatgatgtgcc

SEQ ID NO: 716113 - DNA, 25 bp, Mus musculus
gtgtccgttgtggatatgatgtgcc

SEQ ID NO: 716114 - DNA, 25 bp, Mus musculus
gtgtcctaaaaactgtctttctaat

SEQ ID NO: 716115 - DNA, 25 bp, Mus musculus
gtgtcctaaaaagtgtctttctaat

SEQ ID NO: 716116 - DNA, 25 bp, Mus musculus
gtgtcctaaccacgcaaccagataa

SEQ ID NO: 716117 - DNA, 25 bp, Mus musculus
gtgtcctaaccaggcaaccagataa

SEQ ID NO: 716118 - DNA, 25 bp, Mus musculus
gtgtcctaagaacaagttgttgccc

SEQ ID NO: 716119 - DNA, 25 bp, Mus musculus
gtgtcctaagaagaagttgttgccc

SEQ ID NO: 716120 - DNA, 25 bp, Mus musculus
gtgtcctaagacactgaaacccagt

SEQ ID NO: 716121 - DNA, 25 bp, Mus musculus
gtgtcctaagactctgaaacccagt

SEQ ID NO: 716122 - DNA, 25 bp, Mus musculus
gtgtcctaaggaaagccaggcatgg

SEQ ID NO: 716123 - DNA, 25 bp, Mus musculus
gtgtcctaaggatagccaggcatgg

SEQ ID NO: 716124 - DNA, 25 bp, Mus musculus
gtgtcctaatccaacatgtgagaac

SEQ ID NO: 716125 - DNA, 25 bp, Mus musculus
gtgtcctaatcctacatgtgagaac

SEQ ID NO: 716126 - DNA, 25 bp, Mus musculus
gtgtcctacacaaacatacatctgt

SEQ ID NO: 716127 - DNA, 25 bp, Mus musculus
gtgtcctacacatacatacatctgt

SEQ ID NO: 716128 - DNA, 25 bp, Mus musculus
gtgtcctacagcagcagtttctgtc

SEQ ID NO: 716129 - DNA, 25 bp, Mus musculus
gtgtcctacagctgcagtttctgtc

SEQ ID NO: 716130 - DNA, 25 bp, Mus musculus
gtgtcctaccacaatctggagggcc

SEQ ID NO: 716131 - DNA, 25 bp, Mus musculus
gtgtcctaccactatctggagggcc

SEQ ID NO: 716132 - DNA, 25 bp, Mus musculus
gtgtcctagaatcaactctgtgctt

SEQ ID NO: 716133 - DNA, 25 bp, Mus musculus
gtgtcctagaatgaactctgtgctt

SEQ ID NO: 716134 - DNA, 25 bp, Mus musculus
gtgtcctagcggcaaccatcaagta

SEQ ID NO: 716135 - DNA, 25 bp, Mus musculus
gtgtcctagcgggaaccatcaagta

SEQ ID NO: 716136 - DNA, 25 bp, Mus musculus
gtgtcctaggaactggttggctttt

SEQ ID NO: 716137 - DNA, 25 bp, Mus musculus
gtgtcctaggaagtggttggctttt

SEQ ID NO: 716138 - DNA, 25 bp, Mus musculus
gtgtcctaggagaggtttgcacctg

SEQ ID NO: 716139 - DNA, 25 bp, Mus musculus
gtgtcctaggagtggtttgcacctg

SEQ ID NO: 716140 - DNA, 25 bp, Mus musculus
gtgtcctataaaaacccatctctga

SEQ ID NO: 716141 - DNA, 25 bp, Mus musculus
gtgtcctataaatacccatctctga

SEQ ID NO: 716142 - DNA, 25 bp, Mus musculus
gtgtcctattgaaaccttttctact

SEQ ID NO: 716143 - DNA, 25 bp, Mus musculus
gtgtcctattgataccttttctact

SEQ ID NO: 716144 - DNA, 25 bp, Mus musculus
gtgtcctattggaatgctggcattc

SEQ ID NO: 716145 - DNA, 25 bp, Mus musculus
gtgtcctattggtatgctggcattc

SEQ ID NO: 716146 - DNA, 25 bp, Mus musculus
gtgtcctcaagtaaagtgcactgaa

SEQ ID NO: 716147 - DNA, 25 bp, Mus musculus
gtgtcctcaagttaagtgcactgaa

SEQ ID NO: 716148 - DNA, 25 bp, Mus musculus
gtgtcctcaccaaggagctgggaaa

SEQ ID NO: 716149 - DNA, 25 bp, Mus musculus
gtgtcctcaccatggagctgggaaa

SEQ ID NO: 716150 - DNA, 25 bp, Mus musculus
gtgtcctcacgcaaatgtttatgct

SEQ ID NO: 716151 - DNA, 25 bp, Mus musculus
gtgtcctcacgctaatgtttatgct

SEQ ID NO: 716152 - DNA, 25 bp, Mus musculus
gtgtcctcactaaggccaagccttg

SEQ ID NO: 716153 - DNA, 25 bp, Mus musculus
gtgtcctcactatggccaagccttg

SEQ ID NO: 716154 - DNA, 25 bp, Mus musculus
gtgtcctcaggaagccggtgtccac

SEQ ID NO: 716155 - DNA, 25 bp, Mus musculus
gtgtcctcaggatgccggtgtccac

SEQ ID NO: 716156 - DNA, 25 bp, Mus musculus
gtgtcctcagggaattataggaaca

SEQ ID NO: 716157 - DNA, 25 bp, Mus musculus
gtgtcctcagggtattataggaaca

SEQ ID NO: 716158 - DNA, 25 bp, Mus musculus
gtgtcctcagtcagcatgtaacttt

SEQ ID NO: 716159 - DNA, 25 bp, Mus musculus
gtgtcctcagtctgcatgtaacttt

SEQ ID NO: 716160 - DNA, 25 bp, Mus musculus
gtgtcctcatggacattctgtctta

SEQ ID NO: 716161 - DNA, 25 bp, Mus musculus
gtgtcctcatggtcattctgtctta

SEQ ID NO: 716162 - DNA, 25 bp, Mus musculus
gtgtcctccaatcttggtgcctaca

SEQ ID NO: 716163 - DNA, 25 bp, Mus musculus
gtgtcctccaatgttggtgcctaca

SEQ ID NO: 716164 - DNA, 25 bp, Mus musculus
gtgtcctccagacgctctggcacat

SEQ ID NO: 716165 - DNA, 25 bp, Mus musculus
gtgtcctccagaggctctggcacat

SEQ ID NO: 716166 - DNA, 25 bp, Mus musculus
gtgtcctccccgagtaactcacagg

SEQ ID NO: 716167 - DNA, 25 bp, Mus musculus
gtgtcctccccgtgtaactcacagg

SEQ ID NO: 716168 - DNA, 25 bp, Mus musculus
gtgtcctcccgtattacagataaga

SEQ ID NO: 716169 - DNA, 25 bp, Mus musculus
gtgtcctcccgttttacagataaga

SEQ ID NO: 716170 - DNA, 25 bp, Mus musculus
gtgtcctcctccaggtcatctggaa

SEQ ID NO: 716171 - DNA, 25 bp, Mus musculus
gtgtcctcctcctggtcatctggaa

SEQ ID NO: 716172 - DNA, 25 bp, Mus musculus
gtgtcctcctgaatctgagagccaa

SEQ ID NO: 716173 - DNA, 25 bp, Mus musculus
gtgtcctcctgattctgagagccaa

SEQ ID NO: 716174 - DNA, 25 bp, Mus musculus
gtgtcctccttgctgaacggcagag

SEQ ID NO: 716175 - DNA, 25 bp, Mus musculus
gtgtcctccttggtgaacggcagag

SEQ ID NO: 716176 - DNA, 25 bp, Mus musculus
gtgtcctcgagaaatttgtaactgt

SEQ ID NO: 716177 - DNA, 25 bp, Mus musculus
gtgtcctcgagatatttgtaactgt

SEQ ID NO: 716178 - DNA, 25 bp, Mus musculus
gtgtcctctaggcatccaaattggg

SEQ ID NO: 716179 - DNA, 25 bp, Mus musculus
gtgtcctctagggatccaaattggg

SEQ ID NO: 716180 - DNA, 25 bp, Mus musculus
gtgtcctctagtagcccagtattga

SEQ ID NO: 716181 - DNA, 25 bp, Mus musculus
gtgtcctctagttgcccagtattga

SEQ ID NO: 716182 - DNA, 25 bp, Mus musculus
gtgtcctctcgtctagatatgactt

SEQ ID NO: 716183 - DNA, 25 bp, Mus musculus
gtgtcctctcgtgtagatatgactt

SEQ ID NO: 716184 - DNA, 25 bp, Mus musculus
gtgtcctctgcaacattgagtcttt

SEQ ID NO: 716185 - DNA, 25 bp, Mus musculus
gtgtcctctgcatcattgagtcttt

SEQ ID NO: 716186 - DNA, 25 bp, Mus musculus
gtgtcctctggaacaagaacaattg

SEQ ID NO: 716187 - DNA, 25 bp, Mus musculus
gtgtcctctggatcaagaacaattg

SEQ ID NO: 716188 - DNA, 25 bp, Mus musculus
gtgtcctctggtcggctccaatgtc

SEQ ID NO: 716189 - DNA, 25 bp, Mus musculus
gtgtcctctggtgggctccaatgtc

SEQ ID NO: 716190 - DNA, 25 bp, Mus musculus
gtgtcctctgtgagctacagggata

SEQ ID NO: 716191 - DNA, 25 bp, Mus musculus
gtgtcctctgtgtgctacagggata

SEQ ID NO: 716192 - DNA, 25 bp, Mus musculus
gtgtcctctttgatccacatgagca

SEQ ID NO: 716193 - DNA, 25 bp, Mus musculus
gtgtcctctttgttccacatgagca

SEQ ID NO: 716194 - DNA, 25 bp, Mus musculus
gtgtcctgaattatgcacattgtga

SEQ ID NO: 716195 - DNA, 25 bp, Mus musculus
gtgtcctgaattttgcacattgtga

SEQ ID NO: 716196 - DNA, 25 bp, Mus musculus
gtgtcctgacagaaccgtgttagcc

SEQ ID NO: 716197 - DNA, 25 bp, Mus musculus
gtgtcctgacagtaccgtgttagcc

SEQ ID NO: 716198 - DNA, 25 bp, Mus musculus
gtgtcctgacgtcaatacctgttaa

SEQ ID NO: 716199 - DNA, 25 bp, Mus musculus
gtgtcctgacgtgaatacctgttaa

SEQ ID NO: 716200 - DNA, 25 bp, Mus musculus
gtgtcctgataaccacttagactga

SEQ ID NO: 716201 - DNA, 25 bp, Mus musculus
gtgtcctgataagcacttagactga

SEQ ID NO: 716202 - DNA, 25 bp, Mus musculus
gtgtcctgattcctggtcagcagtt

SEQ ID NO: 716203 - DNA, 25 bp, Mus musculus
gtgtcctgattcgtggtcagcagtt

SEQ ID NO: 716204 - DNA, 25 bp, Mus musculus
gtgtcctgcaacacaaacgccgacg

SEQ ID NO: 716205 - DNA, 25 bp, Mus musculus
gtgtcctgcaactcaaacgccgacg

SEQ ID NO: 716206 - DNA, 25 bp, Mus musculus
gtgtcctgcacaagcaggtgccata

SEQ ID NO: 716207 - DNA, 25 bp, Mus musculus
gtgtcctgcacatgcaggtgccata

SEQ ID NO: 716208 - DNA, 25 bp, Mus musculus
gtgtcctgcacgcttttggaagtca

SEQ ID NO: 716209 - DNA, 25 bp, Mus musculus
gtgtcctgcacggttttggaagtca

SEQ ID NO: 716210 - DNA, 25 bp, Mus musculus
gtgtcctgcataaacctgtccttaa

SEQ ID NO: 716211 - DNA, 25 bp, Mus musculus
gtgtcctgcatatacctgtccttaa

SEQ ID NO: 716212 - DNA, 25 bp, Mus musculus
gtgtcctgcattattgagatctgta

SEQ ID NO: 716213 - DNA, 25 bp, Mus musculus
gtgtcctgcatttttgagatctgta

SEQ ID NO: 716214 - DNA, 25 bp, Mus musculus
gtgtcctgcctcattaatccttaaa

SEQ ID NO: 716215 - DNA, 25 bp, Mus musculus
gtgtcctgcctctttaatccttaaa

SEQ ID NO: 716216 - DNA, 25 bp, Mus musculus
gtgtcctgctgtagccaaatagcct

SEQ ID NO: 716217 - DNA, 25 bp, Mus musculus
gtgtcctgctgttgccaaatagcct

SEQ ID NO: 716218 - DNA, 25 bp, Mus musculus
gtgtcctgcttactcctagcgggca

SEQ ID NO: 716219 - DNA, 25 bp, Mus musculus
gtgtcctgcttagtcctagcgggca

SEQ ID NO: 716220 - DNA, 25 bp, Mus musculus
gtgtcctggacacatgttctgtcat

SEQ ID NO: 716221 - DNA, 25 bp, Mus musculus
gtgtcctggacagatgttctgtcat

SEQ ID NO: 716222 - DNA, 25 bp, Mus musculus
gtgtcctggctcacactgtggttag

SEQ ID NO: 716223 - DNA, 25 bp, Mus musculus
gtgtcctggctctcactgtggttag

SEQ ID NO: 716224 - DNA, 25 bp, Mus musculus
gtgtcctggttcagaacgcactgaa

SEQ ID NO: 716225 - DNA, 25 bp, Mus musculus
gtgtcctggttcatacatcttccta

SEQ ID NO: 716226 - DNA, 25 bp, Mus musculus
gtgtcctggttctgaacgcactgaa

SEQ ID NO: 716227 - DNA, 25 bp, Mus musculus
gtgtcctggttcttacatcttccta

SEQ ID NO: 716228 - DNA, 25 bp, Mus musculus
gtgtcctgtctcctattgtattata

SEQ ID NO: 716229 - DNA, 25 bp, Mus musculus
gtgtcctgtctcgtattgtattata

SEQ ID NO: 716230 - DNA, 25 bp, Mus musculus
gtgtcctgtctgatgccactagaaa

SEQ ID NO: 716231 - DNA, 25 bp, Mus musculus
gtgtcctgtctgttgccactagaaa

SEQ ID NO: 716232 - DNA, 25 bp, Mus musculus
gtgtcctgttaaaaggtactgtact

SEQ ID NO: 716233 - DNA, 25 bp, Mus musculus
gtgtcctgttaaagcatattgccct

SEQ ID NO: 716234 - DNA, 25 bp, Mus musculus
gtgtcctgttaataggtactgtact

SEQ ID NO: 716235 - DNA, 25 bp, Mus musculus
gtgtcctgttaatgcatattgccct

SEQ ID NO: 716236 - DNA, 25 bp, Mus musculus
gtgtcctgttatatgggtcccagat

SEQ ID NO: 716237 - DNA, 25 bp, Mus musculus
gtgtcctgttatttgggtcccagat

SEQ ID NO: 716238 - DNA, 25 bp, Mus musculus
gtgtcctgttccacttttcgtagaa

SEQ ID NO: 716239 - DNA, 25 bp, Mus musculus
gtgtcctgttcctcttttcgtagaa

SEQ ID NO: 716240 - DNA, 25 bp, Mus musculus
gtgtccttaaagcacactgttcgct

SEQ ID NO: 716241 - DNA, 25 bp, Mus musculus
gtgtccttaaaggacactgttcgct

SEQ ID NO: 716242 - DNA, 25 bp, Mus musculus
gtgtccttacagactgaccttgctg

SEQ ID NO: 716243 - DNA, 25 bp, Mus musculus
gtgtccttacagtctgaccttgctg

SEQ ID NO: 716244 - DNA, 25 bp, Mus musculus
gtgtccttagtaacatccaggcagc

SEQ ID NO: 716245 - DNA, 25 bp, Mus musculus
gtgtccttagtatcatccaggcagc

SEQ ID NO: 716246 - DNA, 25 bp, Mus musculus
gtgtccttattaaatgacccctaaa

SEQ ID NO: 716247 - DNA, 25 bp, Mus musculus
gtgtccttattaaccttgtggagta

SEQ ID NO: 716248 - DNA, 25 bp, Mus musculus
gtgtccttattatatgacccctaaa

SEQ ID NO: 716249 - DNA, 25 bp, Mus musculus
gtgtccttattatccttgtggagta

SEQ ID NO: 716250 - DNA, 25 bp, Mus musculus
gtgtccttattcatcaaaaccatac

SEQ ID NO: 716251 - DNA, 25 bp, Mus musculus
gtgtccttattcttcaaaaccatac

SEQ ID NO: 716252 - DNA, 25 bp, Mus musculus
gtgtccttcaacagacatctgctac

SEQ ID NO: 716253 - DNA, 25 bp, Mus musculus
gtgtccttcaactgacatctgctac

SEQ ID NO: 716254 - DNA, 25 bp, Mus musculus
gtgtccttcagcacgggagagagaa

SEQ ID NO: 716255 - DNA, 25 bp, Mus musculus
gtgtccttcagctcgggagagagaa

SEQ ID NO: 716256 - DNA, 25 bp, Mus musculus
gtgtccttcatgaccttttgaactt

SEQ ID NO: 716257 - DNA, 25 bp, Mus musculus
gtgtccttcatgtccttttgaactt

SEQ ID NO: 716258 - DNA, 25 bp, Mus musculus
gtgtccttcattcctggtataactg

SEQ ID NO: 716259 - DNA, 25 bp, Mus musculus
gtgtccttcattgctggtataactg

SEQ ID NO: 716260 - DNA, 25 bp, Mus musculus
gtgtccttccacagatggttttact

SEQ ID NO: 716261 - DNA, 25 bp, Mus musculus
gtgtccttccactgatggttttact

SEQ ID NO: 716262 - DNA, 25 bp, Mus musculus
gtgtccttccttccagttttgagaa

SEQ ID NO: 716263 - DNA, 25 bp, Mus musculus
gtgtccttccttgcagttttgagaa

SEQ ID NO: 716264 - DNA, 25 bp, Mus musculus
gtgtccttctatatctttactttat

SEQ ID NO: 716265 - DNA, 25 bp, Mus musculus
gtgtccttctatttctttactttat

SEQ ID NO: 716266 - DNA, 25 bp, Mus musculus
gtgtccttgaggatctgtatctctt

SEQ ID NO: 716267 - DNA, 25 bp, Mus musculus
gtgtccttgaggttctgtatctctt

SEQ ID NO: 716268 - DNA, 25 bp, Mus musculus
gtgtccttgcaacacaaaacgccga

SEQ ID NO: 716269 - DNA, 25 bp, Mus musculus
gtgtccttgcaagacaaaacgccga

SEQ ID NO: 716270 - DNA, 25 bp, Mus musculus
gtgtccttgggtagtcttcaacact

SEQ ID NO: 716271 - DNA, 25 bp, Mus musculus
gtgtccttgggttgtcttcaacact

SEQ ID NO: 716272 - DNA, 25 bp, Mus musculus
gtgtccttgtgtagaccggcaataa

SEQ ID NO: 716273 - DNA, 25 bp, Mus musculus
gtgtccttgtgttgaccggcaataa

SEQ ID NO: 716274 - DNA, 25 bp, Mus musculus
gtgtccttgtttatggagtgttctc

SEQ ID NO: 716275 - DNA, 25 bp, Mus musculus
gtgtccttgtttcactgtgcgaata

SEQ ID NO: 716276 - DNA, 25 bp, Mus musculus
gtgtccttgtttgactgtgcgaata

SEQ ID NO: 716277 - DNA, 25 bp, Mus musculus
gtgtccttgtttttggagtgttctc

SEQ ID NO: 716278 - DNA, 25 bp, Mus musculus
gtgtcctttactccctagtgagagc

SEQ ID NO: 716279 - DNA, 25 bp, Mus musculus
gtgtcctttactgcctagtgagagc

SEQ ID NO: 716280 - DNA, 25 bp, Mus musculus
gtgtcctttcctcattctatcaaaa

SEQ ID NO: 716281 - DNA, 25 bp, Mus musculus
gtgtcctttcctgattctatcaaaa

SEQ ID NO: 716282 - DNA, 25 bp, Mus musculus
gtgtcctttgacagtttggctttcc

SEQ ID NO: 716283 - DNA, 25 bp, Mus musculus
gtgtcctttgactgtttggctttcc

SEQ ID NO: 716284 - DNA, 25 bp, Mus musculus
gtgtcctttggtctgcgatgagatc

SEQ ID NO: 716285 - DNA, 25 bp, Mus musculus
gtgtcctttggtgtgcgatgagatc

SEQ ID NO: 716286 - DNA, 25 bp, Mus musculus
gtgtcgaaacagagcacccgaaggt

SEQ ID NO: 716287 - DNA, 25 bp, Mus musculus
gtgtcgaaacagtgcacccgaaggt

SEQ ID NO: 716288 - DNA, 25 bp, Mus musculus
gtgtcgaagatcacgtcaccggtgc

SEQ ID NO: 716289 - DNA, 25 bp, Mus musculus
gtgtcgaagatctcgtcaccggtgc

SEQ ID NO: 716290 - DNA, 25 bp, Mus musculus
gtgtcgaagcgacagtccaagtcta

SEQ ID NO: 716291 - DNA, 25 bp, Mus musculus
gtgtcgaagcgagagtccaagtcta

SEQ ID NO: 716292 - DNA, 25 bp, Mus musculus
gtgtcgaatctaagagcttcgcaat

SEQ ID NO: 716293 - DNA, 25 bp, Mus musculus
gtgtcgaatctatgagcttcgcaat

SEQ ID NO: 716294 - DNA, 25 bp, Mus musculus
gtgtcgaatgctctactttaatact

SEQ ID NO: 716295 - DNA, 25 bp, Mus musculus
gtgtcgaatgctgtactttaatact

SEQ ID NO: 716296 - DNA, 25 bp, Mus musculus
gtgtcgacctgcctaagcgatcgga

SEQ ID NO: 716297 - DNA, 25 bp, Mus musculus
gtgtcgacctgcgtaagcgatcgga

SEQ ID NO: 716298 - DNA, 25 bp, Mus musculus
gtgtcgagcgaaccactggatgcca

SEQ ID NO: 716299 - DNA, 25 bp, Mus musculus
gtgtcgagcgaagcactggatgcca

SEQ ID NO: 716300 - DNA, 25 bp, Mus musculus
gtgtcgagctctaggttgcacaaaa

SEQ ID NO: 716301 - DNA, 25 bp, Mus musculus
gtgtcgagctcttggttgcacaaaa

SEQ ID NO: 716302 - DNA, 25 bp, Mus musculus
gtgtcgaggctgcaccctaacaaaa

SEQ ID NO: 716303 - DNA, 25 bp, Mus musculus
gtgtcgaggctggaccctaacaaaa

SEQ ID NO: 716304 - DNA, 25 bp, Mus musculus
gtgtcgaggtccagcatcagtacga

SEQ ID NO: 716305 - DNA, 25 bp, Mus musculus
gtgtcgaggtcctgcatcagtacga

SEQ ID NO: 716306 - DNA, 25 bp, Mus musculus
gtgtcgagtcccatggagctacaga

SEQ ID NO: 716307 - DNA, 25 bp, Mus musculus
gtgtcgagtcccttggagctacaga

SEQ ID NO: 716308 - DNA, 25 bp, Mus musculus
gtgtcgatcactccaaaggtttccc

SEQ ID NO: 716309 - DNA, 25 bp, Mus musculus
gtgtcgatcactgcaaaggtttccc

SEQ ID NO: 716310 - DNA, 25 bp, Mus musculus
gtgtcgcacacacaggaggtccatt

SEQ ID NO: 716311 - DNA, 25 bp, Mus musculus
gtgtcgcacacagaggaggtccatt

SEQ ID NO: 716312 - DNA, 25 bp, Mus musculus
gtgtcgcatcaaagcaatcaggaac

SEQ ID NO: 716313 - DNA, 25 bp, Mus musculus
gtgtcgcatcaatgcaatcaggaac

SEQ ID NO: 716314 - DNA, 25 bp, Mus musculus
gtgtcgccagttagaaaacatagct

SEQ ID NO: 716315 - DNA, 25 bp, Mus musculus
gtgtcgccagtttgaaaacatagct

SEQ ID NO: 716316 - DNA, 25 bp, Mus musculus
gtgtcgccatggctatcctggaagt

SEQ ID NO: 716317 - DNA, 25 bp, Mus musculus
gtgtcgccatgggtatcctggaagt

SEQ ID NO: 716318 - DNA, 25 bp, Mus musculus
gtgtcgcctcttctgtcagcctgaa

SEQ ID NO: 716319 - DNA, 25 bp, Mus musculus
gtgtcgcctcttgtgtcagcctgaa

SEQ ID NO: 716320 - DNA, 25 bp, Mus musculus
gtgtcgcctggacacttgctttgat

SEQ ID NO: 716321 - DNA, 25 bp, Mus musculus
gtgtcgcctggagacttgctttgat

SEQ ID NO: 716322 - DNA, 25 bp, Mus musculus
gtgtcgccttctagtaaatgttgta

SEQ ID NO: 716323 - DNA, 25 bp, Mus musculus
gtgtcgccttcttgtaaatgttgta

SEQ ID NO: 716324 - DNA, 25 bp, Mus musculus
gtgtcgcgatcaatcacagcttaag

SEQ ID NO: 716325 - DNA, 25 bp, Mus musculus
gtgtcgcgatcattcacagcttaag

SEQ ID NO: 716326 - DNA, 25 bp, Mus musculus
gtgtcgctaggcatgaactccggat

SEQ ID NO: 716327 - DNA, 25 bp, Mus musculus
gtgtcgctaggcttgaactccggat

SEQ ID NO: 716328 - DNA, 25 bp, Mus musculus
gtgtcgctggagcttactgtctgtt

SEQ ID NO: 716329 - DNA, 25 bp, Mus musculus
gtgtcgctggaggttactgtctgtt

SEQ ID NO: 716330 - DNA, 25 bp, Mus musculus
gtgtcgctgggaatctcgaattcaa

SEQ ID NO: 716331 - DNA, 25 bp, Mus musculus
gtgtcgctgggattctcgaattcaa

SEQ ID NO: 716332 - DNA, 25 bp, Mus musculus
gtgtcgcttcacaacttcagtgcaa

SEQ ID NO: 716333 - DNA, 25 bp, Mus musculus
gtgtcgcttcactacttcagtgcaa

SEQ ID NO: 716334 - DNA, 25 bp, Mus musculus
gtgtcggccattaatgctgcagagc

SEQ ID NO: 716335 - DNA, 25 bp, Mus musculus
gtgtcggccatttatgctgcagagc

SEQ ID NO: 716336 - DNA, 25 bp, Mus musculus
gtgtcggcctttatgtaatctgtat

SEQ ID NO: 716337 - DNA, 25 bp, Mus musculus
gtgtcggcctttttgtaatctgtat

SEQ ID NO: 716338 - DNA, 25 bp, Mus musculus
gtgtcggctcccaacaagtatatat

SEQ ID NO: 716339 - DNA, 25 bp, Mus musculus
gtgtcggctccctacaagtatatat

SEQ ID NO: 716340 - DNA, 25 bp, Mus musculus
gtgtcgggaatgattatgtagcttc

SEQ ID NO: 716341 - DNA, 25 bp, Mus musculus
gtgtcgggaatgtttatgtagcttc

SEQ ID NO: 716342 - DNA, 25 bp, Mus musculus
gtgtcgggcccacggatcccatgac

SEQ ID NO: 716343 - DNA, 25 bp, Mus musculus
gtgtcgggcccagggatcccatgac

SEQ ID NO: 716344 - DNA, 25 bp, Mus musculus
gtgtcgggtttcagccgcaagcgca

SEQ ID NO: 716345 - DNA, 25 bp, Mus musculus
gtgtcgggtttctgccgcaagcgca

SEQ ID NO: 716346 - DNA, 25 bp, Mus musculus
gtgtcggtaagcaccagactccaaa

SEQ ID NO: 716347 - DNA, 25 bp, Mus musculus
gtgtcggtaagctccagactccaaa

SEQ ID NO: 716348 - DNA, 25 bp, Mus musculus
gtgtcggtcttcattttaaatctgg

SEQ ID NO: 716349 - DNA, 25 bp, Mus musculus
gtgtcggtcttctttttaaatctgg

SEQ ID NO: 716350 - DNA, 25 bp, Mus musculus
gtgtcggtgtctccttcaagagatg

SEQ ID NO: 716351 - DNA, 25 bp, Mus musculus
gtgtcggtgtctgcttcaagagatg

SEQ ID NO: 716352 - DNA, 25 bp, Mus musculus
gtgtcgtagaccagtggtgtgtctt

SEQ ID NO: 716353 - DNA, 25 bp, Mus musculus
gtgtcgtagacctgtggtgtgtctt

SEQ ID NO: 716354 - DNA, 25 bp, Mus musculus
gtgtcgtagcctacaagtgccagag

SEQ ID NO: 716355 - DNA, 25 bp, Mus musculus
gtgtcgtagccttcaagtgccagag

SEQ ID NO: 716356 - DNA, 25 bp, Mus musculus
gtgtcgtcacagctggtttatgtag

SEQ ID NO: 716357 - DNA, 25 bp, Mus musculus
gtgtcgtcacaggtggtttatgtag

SEQ ID NO: 716358 - DNA, 25 bp, Mus musculus
gtgtcgtcctgtagtgtgctatgag

SEQ ID NO: 716359 - DNA, 25 bp, Mus musculus
gtgtcgtcctgttgtgtgctatgag

SEQ ID NO: 716360 - DNA, 25 bp, Mus musculus
gtgtcgtccttgatcttgctttgag

SEQ ID NO: 716361 - DNA, 25 bp, Mus musculus
gtgtcgtccttgttcttgctttgag

SEQ ID NO: 716362 - DNA, 25 bp, Mus musculus
gtgtcgtcgtgaacgtgtgcagctc

SEQ ID NO: 716363 - DNA, 25 bp, Mus musculus
gtgtcgtcgtgatcgtgtgcagctc

SEQ ID NO: 716364 - DNA, 25 bp, Mus musculus
gtgtcgtctcttccttgaatgtaaa

SEQ ID NO: 716365 - DNA, 25 bp, Mus musculus
gtgtcgtctcttgcttgaatgtaaa

SEQ ID NO: 716366 - DNA, 25 bp, Mus musculus
gtgtcgtgagtacccgtcattctca

SEQ ID NO: 716367 - DNA, 25 bp, Mus musculus
gtgtcgtgagtagccgtcattctca

SEQ ID NO: 716368 - DNA, 25 bp, Mus musculus
gtgtcgtgcacgatcccgacaagaa

SEQ ID NO: 716369 - DNA, 25 bp, Mus musculus
gtgtcgtgcacgttcccgacaagaa

SEQ ID NO: 716370 - DNA, 25 bp, Mus musculus
gtgtcgtgccaccttccagttaggg

SEQ ID NO: 716371 - DNA, 25 bp, Mus musculus
gtgtcgtgccacgttccagttaggg

SEQ ID NO: 716372 - DNA, 25 bp, Mus musculus
gtgtcgtggagacgtccagccccaa

SEQ ID NO: 716373 - DNA, 25 bp, Mus musculus
gtgtcgtggagaggtccagccccaa

SEQ ID NO: 716374 - DNA, 25 bp, Mus musculus
gtgtcgtggtcccagctgcaactgc

SEQ ID NO: 716375 - DNA, 25 bp, Mus musculus
gtgtcgtggtccgagctgcaactgc

SEQ ID NO: 716376 - DNA, 25 bp, Mus musculus
gtgtcgtgttctacgagcaggtcag

SEQ ID NO: 716377 - DNA, 25 bp, Mus musculus
gtgtcgtgttcttcgagcaggtcag

SEQ ID NO: 716378 - DNA, 25 bp, Mus musculus
gtgtcgttatacatctcatcagcaa

SEQ ID NO: 716379 - DNA, 25 bp, Mus musculus
gtgtcgttatacttctcatcagcaa

SEQ ID NO: 716380 - DNA, 25 bp, Mus musculus
gtgtcgttcaagacacctctataat

SEQ ID NO: 716381 - DNA, 25 bp, Mus musculus
gtgtcgttcaagtcacctctataat

SEQ ID NO: 716382 - DNA, 25 bp, Mus musculus
gtgtcgttcctgactacaaatgagt

SEQ ID NO: 716383 - DNA, 25 bp, Mus musculus
gtgtcgttcctgtctacaaatgagt

SEQ ID NO: 716384 - DNA, 25 bp, Mus musculus
gtgtcgtttcaaatgagctcagtca

SEQ ID NO: 716385 - DNA, 25 bp, Mus musculus
gtgtcgtttcaattgagctcagtca

SEQ ID NO: 716386 - DNA, 25 bp, Mus musculus
gtgtcgtttgtaaattgctccgcat

SEQ ID NO: 716387 - DNA, 25 bp, Mus musculus
gtgtcgtttgtatattgctccgcat

SEQ ID NO: 716388 - DNA, 25 bp, Mus musculus
gtgtctaaagtgaactatgccgtgt

SEQ ID NO: 716389 - DNA, 25 bp, Mus musculus
gtgtctaaagtgtactatgccgtgt

SEQ ID NO: 716390 - DNA, 25 bp, Mus musculus
gtgtctaacaagcatctgtcctgga

SEQ ID NO: 716391 - DNA, 25 bp, Mus musculus
gtgtctaacaaggatctgtcctgga

SEQ ID NO: 716392 - DNA, 25 bp, Mus musculus
gtgtctaacagacatctaccgccaa

SEQ ID NO: 716393 - DNA, 25 bp, Mus musculus
gtgtctaacagagatctaccgccaa

SEQ ID NO: 716394 - DNA, 25 bp, Mus musculus
gtgtctaacaggagaatctgggact

SEQ ID NO: 716395 - DNA, 25 bp, Mus musculus
gtgtctaacaggtgaatctgggact

SEQ ID NO: 716396 - DNA, 25 bp, Mus musculus
gtgtctaactgtcagtcacactgga

SEQ ID NO: 716397 - DNA, 25 bp, Mus musculus
gtgtctaactgtgagtcacactgga

SEQ ID NO: 716398 - DNA, 25 bp, Mus musculus
gtgtctaagacaccctggagtccaa

SEQ ID NO: 716399 - DNA, 25 bp, Mus musculus
gtgtctaagacagcctggagtccaa

SEQ ID NO: 716400 - DNA, 25 bp, Mus musculus
gtgtctaagcatcttggcagggtat

SEQ ID NO: 716401 - DNA, 25 bp, Mus musculus
gtgtctaagcatgttggcagggtat

SEQ ID NO: 716402 - DNA, 25 bp, Mus musculus
gtgtctaatacactggaggacttcc

SEQ ID NO: 716403 - DNA, 25 bp, Mus musculus
gtgtctaatacagtggaggacttcc

SEQ ID NO: 716404 - DNA, 25 bp, Mus musculus
gtgtctaatttaacggatgtaccat

SEQ ID NO: 716405 - DNA, 25 bp, Mus musculus
gtgtctaatttatcggatgtaccat

SEQ ID NO: 716406 - DNA, 25 bp, Mus musculus
gtgtctacaatgcagttaatcccta

SEQ ID NO: 716407 - DNA, 25 bp, Mus musculus
gtgtctacaatggagttaatcccta

SEQ ID NO: 716408 - DNA, 25 bp, Mus musculus
gtgtctacaccaaggtgtgcaagta

SEQ ID NO: 716409 - DNA, 25 bp, Mus musculus
gtgtctacaccaatctctgcaagtt

SEQ ID NO: 716410 - DNA, 25 bp, Mus musculus
gtgtctacaccatggtgtgcaagta

SEQ ID NO: 716411 - DNA, 25 bp, Mus musculus
gtgtctacaccattctctgcaagtt

SEQ ID NO: 716412 - DNA, 25 bp, Mus musculus
gtgtctacagaaaccccatcatgta

SEQ ID NO: 716413 - DNA, 25 bp, Mus musculus
gtgtctacagaatccccatcatgta

SEQ ID NO: 716414 - DNA, 25 bp, Mus musculus
gtgtctacagacctgcattcatgtg

SEQ ID NO: 716415 - DNA, 25 bp, Mus musculus
gtgtctacagacgtgcattcatgtg

SEQ ID NO: 716416 - DNA, 25 bp, Mus musculus
gtgtctacagccattgcggtagaga

SEQ ID NO: 716417 - DNA, 25 bp, Mus musculus
gtgtctacagcctttgcggtagaga

SEQ ID NO: 716418 - DNA, 25 bp, Mus musculus
gtgtctactaggattggtccatgga

SEQ ID NO: 716419 - DNA, 25 bp, Mus musculus
gtgtctactaggtttggtccatgga

SEQ ID NO: 716420 - DNA, 25 bp, Mus musculus
gtgtctagagtcagctacagtctga

SEQ ID NO: 716421 - DNA, 25 bp, Mus musculus
gtgtctagagtctgctacagtctga

SEQ ID NO: 716422 - DNA, 25 bp, Mus musculus
gtgtctagcaaaattaactggtaat

SEQ ID NO: 716423 - DNA, 25 bp, Mus musculus
gtgtctagcaaatttaactggtaat

SEQ ID NO: 716424 - DNA, 25 bp, Mus musculus
gtgtctagcagaaaacaaatattat

SEQ ID NO: 716425 - DNA, 25 bp, Mus musculus
gtgtctagcagataacaaatattat

SEQ ID NO: 716426 - DNA, 25 bp, Mus musculus
gtgtctagcttaagggcactccctg

SEQ ID NO: 716427 - DNA, 25 bp, Mus musculus
gtgtctagcttatgggcactccctg

SEQ ID NO: 716428 - DNA, 25 bp, Mus musculus
gtgtctaggctcagatttttggtaa

SEQ ID NO: 716429 - DNA, 25 bp, Mus musculus
gtgtctaggctctgatttttggtaa

SEQ ID NO: 716430 - DNA, 25 bp, Mus musculus
gtgtctagggcacttttaaggcagt

SEQ ID NO: 716431 - DNA, 25 bp, Mus musculus
gtgtctagggcagttttaaggcagt

SEQ ID NO: 716432 - DNA, 25 bp, Mus musculus
gtgtctagtccacttgggaccacat

SEQ ID NO: 716433 - DNA, 25 bp, Mus musculus
gtgtctagtccagttgggaccacat

SEQ ID NO: 716434 - DNA, 25 bp, Mus musculus
gtgtctagtgacattgcaactccaa

SEQ ID NO: 716435 - DNA, 25 bp, Mus musculus
gtgtctagtgactttgcaactccaa

SEQ ID NO: 716436 - DNA, 25 bp, Mus musculus
gtgtctagtgcacagaaaagccaga

SEQ ID NO: 716437 - DNA, 25 bp, Mus musculus
gtgtctagtgcagagaaaagccaga

SEQ ID NO: 716438 - DNA, 25 bp, Mus musculus
gtgtctagtgccacttaagctggtg

SEQ ID NO: 716439 - DNA, 25 bp, Mus musculus
gtgtctagtgcctcttaagctggtg

SEQ ID NO: 716440 - DNA, 25 bp, Mus musculus
gtgtctagtggtaaagcgggctctt

SEQ ID NO: 716441 - DNA, 25 bp, Mus musculus
gtgtctagtggtcggaacatcctct

SEQ ID NO: 716442 - DNA, 25 bp, Mus musculus
gtgtctagtggtgggaacatcctct

SEQ ID NO: 716443 - DNA, 25 bp, Mus musculus
gtgtctagtggttaagcgggctctt

SEQ ID NO: 716444 - DNA, 25 bp, Mus musculus
gtgtctataccactgaaccctaagg

SEQ ID NO: 716445 - DNA, 25 bp, Mus musculus
gtgtctataccagtgaaccctaagg

SEQ ID NO: 716446 - DNA, 25 bp, Mus musculus
gtgtctatagtaagttggcctcctt

SEQ ID NO: 716447 - DNA, 25 bp, Mus musculus
gtgtctatagtatgttggcctcctt

SEQ ID NO: 716448 - DNA, 25 bp, Mus musculus
gtgtctatatccactgagttcttgg

SEQ ID NO: 716449 - DNA, 25 bp, Mus musculus
gtgtctatatcctctgagttcttgg

SEQ ID NO: 716450 - DNA, 25 bp, Mus musculus
gtgtctatcagaatctcaagtgctt

SEQ ID NO: 716451 - DNA, 25 bp, Mus musculus
gtgtctatcagattctcaagtgctt

SEQ ID NO: 716452 - DNA, 25 bp, Mus musculus
gtgtctatgatgattccaggatggg

SEQ ID NO: 716453 - DNA, 25 bp, Mus musculus
gtgtctatgatgtttccaggatggg

SEQ ID NO: 716454 - DNA, 25 bp, Mus musculus
gtgtctatgccccaaaatctagcac

SEQ ID NO: 716455 - DNA, 25 bp, Mus musculus
gtgtctatgcccgaaaatctagcac

SEQ ID NO: 716456 - DNA, 25 bp, Mus musculus
gtgtctatgctcacccttagagtag

SEQ ID NO: 716457 - DNA, 25 bp, Mus musculus
gtgtctatgctctcccttagagtag

SEQ ID NO: 716458 - DNA, 25 bp, Mus musculus
gtgtctatggagatgtgttgtcttc

SEQ ID NO: 716459 - DNA, 25 bp, Mus musculus
gtgtctatggagttgtgttgtcttc

SEQ ID NO: 716460 - DNA, 25 bp, Mus musculus
gtgtctatggcaagttaacctttat

SEQ ID NO: 716461 - DNA, 25 bp, Mus musculus
gtgtctatggcaccctacaatcaga

SEQ ID NO: 716462 - DNA, 25 bp, Mus musculus
gtgtctatggcagcctacaatcaga

SEQ ID NO: 716463 - DNA, 25 bp, Mus musculus
gtgtctatggcatgttaacctttat

SEQ ID NO: 716464 - DNA, 25 bp, Mus musculus
gtgtctattcgcacacatcagcaca

SEQ ID NO: 716465 - DNA, 25 bp, Mus musculus
gtgtctattcgctcacatcagcaca

SEQ ID NO: 716466 - DNA, 25 bp, Mus musculus
gtgtctattgatacttggtccccaa

SEQ ID NO: 716467 - DNA, 25 bp, Mus musculus
gtgtctattgattcttggtccccaa

SEQ ID NO: 716468 - DNA, 25 bp, Mus musculus
gtgtctatttctcacttgcccataa

SEQ ID NO: 716469 - DNA, 25 bp, Mus musculus
gtgtctatttctgacttgcccataa

SEQ ID NO: 716470 - DNA, 25 bp, Mus musculus
gtgtctcaaccaaaacagcttatat

SEQ ID NO: 716471 - DNA, 25 bp, Mus musculus
gtgtctcaaccataacagcttatat

SEQ ID NO: 716472 - DNA, 25 bp, Mus musculus
gtgtctcaagcaatccatagttaag

SEQ ID NO: 716473 - DNA, 25 bp, Mus musculus
gtgtctcaagcattccatagttaag

SEQ ID NO: 716474 - DNA, 25 bp, Mus musculus
gtgtctcacactcgagtagaagttt

SEQ ID NO: 716475 - DNA, 25 bp, Mus musculus
gtgtctcacactggagtagaagttt

SEQ ID NO: 716476 - DNA, 25 bp, Mus musculus
gtgtctcaccagagatatttctgtc

SEQ ID NO: 716477 - DNA, 25 bp, Mus musculus
gtgtctcaccagtgatatttctgtc

SEQ ID NO: 716478 - DNA, 25 bp, Mus musculus
gtgtctcacgacatacagtaattaa

SEQ ID NO: 716479 - DNA, 25 bp, Mus musculus
gtgtctcacgacttacagtaattaa

SEQ ID NO: 716480 - DNA, 25 bp, Mus musculus
gtgtctcactgaaaataggcctgtt

SEQ ID NO: 716481 - DNA, 25 bp, Mus musculus
gtgtctcactgataataggcctgtt

SEQ ID NO: 716482 - DNA, 25 bp, Mus musculus
gtgtctcagacacttggcatgcatg

SEQ ID NO: 716483 - DNA, 25 bp, Mus musculus
gtgtctcagacagttggcatgcatg

SEQ ID NO: 716484 - DNA, 25 bp, Mus musculus
gtgtctcagacgacctttgaagtgg

SEQ ID NO: 716485 - DNA, 25 bp, Mus musculus
gtgtctcagacgtcctttgaagtgg

SEQ ID NO: 716486 - DNA, 25 bp, Mus musculus
gtgtctcagcttcaattgaccaatc

SEQ ID NO: 716487 - DNA, 25 bp, Mus musculus
gtgtctcagcttgaattgaccaatc

SEQ ID NO: 716488 - DNA, 25 bp, Mus musculus
gtgtctcaggaaactctgtgatttt

SEQ ID NO: 716489 - DNA, 25 bp, Mus musculus
gtgtctcaggaatctctgtgatttt

SEQ ID NO: 716490 - DNA, 25 bp, Mus musculus
gtgtctcagggacccctttataggt

SEQ ID NO: 716491 - DNA, 25 bp, Mus musculus
gtgtctcagggagccctttataggt

SEQ ID NO: 716492 - DNA, 25 bp, Mus musculus
gtgtctcagtgaagtcttccaacca

SEQ ID NO: 716493 - DNA, 25 bp, Mus musculus
gtgtctcagtgatgtcttccaacca

SEQ ID NO: 716494 - DNA, 25 bp, Mus musculus
gtgtctcagtgcaggctgggaaata

SEQ ID NO: 716495 - DNA, 25 bp, Mus musculus
gtgtctcagtgctggctgggaaata

SEQ ID NO: 716496 - DNA, 25 bp, Mus musculus
gtgtctcagttgagaaggtctattc

SEQ ID NO: 716497 - DNA, 25 bp, Mus musculus
gtgtctcagttgtgaaggtctattc

SEQ ID NO: 716498 - DNA, 25 bp, Mus musculus
gtgtctcatcagctactgagcagtg

SEQ ID NO: 716499 - DNA, 25 bp, Mus musculus
gtgtctcatcaggtactgagcagtg

SEQ ID NO: 716500 - DNA, 25 bp, Mus musculus
gtgtctcatcataatgtccttgcag

SEQ ID NO: 716501 - DNA, 25 bp, Mus musculus
gtgtctcatcattatgtccttgcag

SEQ ID NO: 716502 - DNA, 25 bp, Mus musculus
gtgtctccaaagcaggtcactcaat

SEQ ID NO: 716503 - DNA, 25 bp, Mus musculus
gtgtctccaaaggaggtcactcaat

SEQ ID NO: 716504 - DNA, 25 bp, Mus musculus
gtgtctccaaccatgttgcacacag

SEQ ID NO: 716505 - DNA, 25 bp, Mus musculus
gtgtctccaaccttgttgcacacag

SEQ ID NO: 716506 - DNA, 25 bp, Mus musculus
gtgtctccacaaatgaagccagtcc

SEQ ID NO: 716507 - DNA, 25 bp, Mus musculus
gtgtctccacaattgaagccagtcc

SEQ ID NO: 716508 - DNA, 25 bp, Mus musculus
gtgtctccacgtatcaattttgttt

SEQ ID NO: 716509 - DNA, 25 bp, Mus musculus
gtgtctccacgtttcaattttgttt

SEQ ID NO: 716510 - DNA, 25 bp, Mus musculus
gtgtctccagagcacgttgtagcca

SEQ ID NO: 716511 - DNA, 25 bp, Mus musculus
gtgtctccagaggacgttgtagcca

SEQ ID NO: 716512 - DNA, 25 bp, Mus musculus
gtgtctccaggaccctttctaaaaa

SEQ ID NO: 716513 - DNA, 25 bp, Mus musculus
gtgtctccaggagcctttctaaaaa

SEQ ID NO: 716514 - DNA, 25 bp, Mus musculus
gtgtctccatacaccctgcaaagaa

SEQ ID NO: 716515 - DNA, 25 bp, Mus musculus
gtgtctccatactccctgcaaagaa

SEQ ID NO: 716516 - DNA, 25 bp, Mus musculus
gtgtctccatatcgcacatggtcta

SEQ ID NO: 716517 - DNA, 25 bp, Mus musculus
gtgtctccatatggcacatggtcta

SEQ ID NO: 716518 - DNA, 25 bp, Mus musculus
gtgtctccattgcttatgtttctga

SEQ ID NO: 716519 - DNA, 25 bp, Mus musculus
gtgtctccattggttatgtttctga

SEQ ID NO: 716520 - DNA, 25 bp, Mus musculus
gtgtctcccaggcattccaaggtgg

SEQ ID NO: 716521 - DNA, 25 bp, Mus musculus
gtgtctcccagggattccaaggtgg

SEQ ID NO: 716522 - DNA, 25 bp, Mus musculus
gtgtctccccggcattaggttttcg

SEQ ID NO: 716523 - DNA, 25 bp, Mus musculus
gtgtctccccgggattaggttttcg

SEQ ID NO: 716524 - DNA, 25 bp, Mus musculus
gtgtctccccgtctatatgtatgta

SEQ ID NO: 716525 - DNA, 25 bp, Mus musculus
gtgtctccccgtgtatatgtatgta

SEQ ID NO: 716526 - DNA, 25 bp, Mus musculus
gtgtctcccctgatttgtgctgaag

SEQ ID NO: 716527 - DNA, 25 bp, Mus musculus
gtgtctcccctgttttgtgctgaag

SEQ ID NO: 716528 - DNA, 25 bp, Mus musculus
gtgtctccctctctgagtagcttgc

SEQ ID NO: 716529 - DNA, 25 bp, Mus musculus
gtgtctccctctgtgagtagcttgc

SEQ ID NO: 716530 - DNA, 25 bp, Mus musculus
gtgtctccctgcaggtcactggata

SEQ ID NO: 716531 - DNA, 25 bp, Mus musculus
gtgtctccctgctggtcactggata

SEQ ID NO: 716532 - DNA, 25 bp, Mus musculus
gtgtctcccttgatgttacagtact

SEQ ID NO: 716533 - DNA, 25 bp, Mus musculus
gtgtctcccttgttgttacagtact

SEQ ID NO: 716534 - DNA, 25 bp, Mus musculus
gtgtctccgcaacttctcaagttca

SEQ ID NO: 716535 - DNA, 25 bp, Mus musculus
gtgtctccgcaagttctcaagttca

SEQ ID NO: 716536 - DNA, 25 bp, Mus musculus
gtgtctccgggcacttgtgaatgaa

SEQ ID NO: 716537 - DNA, 25 bp, Mus musculus
gtgtctccgggctcttgtgaatgaa

SEQ ID NO: 716538 - DNA, 25 bp, Mus musculus
gtgtctcctactctggatagtgtca

SEQ ID NO: 716539 - DNA, 25 bp, Mus musculus
gtgtctcctactgtggatagtgtca

SEQ ID NO: 716540 - DNA, 25 bp, Mus musculus
gtgtctcctatcatctgagtcctga

SEQ ID NO: 716541 - DNA, 25 bp, Mus musculus
gtgtctcctatcttctgagtcctga

SEQ ID NO: 716542 - DNA, 25 bp, Mus musculus
gtgtctcctattctgaactactcta

SEQ ID NO: 716543 - DNA, 25 bp, Mus musculus
gtgtctcctattgtgaactactcta

SEQ ID NO: 716544 - DNA, 25 bp, Mus musculus
gtgtctcctgacagaaccagcttag

SEQ ID NO: 716545 - DNA, 25 bp, Mus musculus
gtgtctcctgactgaaccagcttag

SEQ ID NO: 716546 - DNA, 25 bp, Mus musculus
gtgtctcctgagacaaatgccttgt

SEQ ID NO: 716547 - DNA, 25 bp, Mus musculus
gtgtctcctgagtcaaatgccttgt

SEQ ID NO: 716548 - DNA, 25 bp, Mus musculus
gtgtctcctgatcggacagcattct

SEQ ID NO: 716549 - DNA, 25 bp, Mus musculus
gtgtctcctgatgggacagcattct

SEQ ID NO: 716550 - DNA, 25 bp, Mus musculus
gtgtctcctggcaacaatttcaggt

SEQ ID NO: 716551 - DNA, 25 bp, Mus musculus
gtgtctcctggctacaatttcaggt

SEQ ID NO: 716552 - DNA, 25 bp, Mus musculus
gtgtctcctgtaaagctaagtgaac

SEQ ID NO: 716553 - DNA, 25 bp, Mus musculus
gtgtctcctgtatagctaagtgaac

SEQ ID NO: 716554 - DNA, 25 bp, Mus musculus
gtgtctccttagaaacagctctgcc

SEQ ID NO: 716555 - DNA, 25 bp, Mus musculus
gtgtctccttagtaacagctctgcc

SEQ ID NO: 716556 - DNA, 25 bp, Mus musculus
gtgtctccttcaacttcacaaggtc

SEQ ID NO: 716557 - DNA, 25 bp, Mus musculus
gtgtctccttcatcttcacaaggtc

SEQ ID NO: 716558 - DNA, 25 bp, Mus musculus
gtgtctccttgtcatttcacagtga

SEQ ID NO: 716559 - DNA, 25 bp, Mus musculus
gtgtctccttgtgatttcacagtga

SEQ ID NO: 716560 - DNA, 25 bp, Mus musculus
gtgtctccttttcgaaatctatgga

SEQ ID NO: 716561 - DNA, 25 bp, Mus musculus
gtgtctccttttggaaatctatgga

SEQ ID NO: 716562 - DNA, 25 bp, Mus musculus
gtgtctcgaaccatgaacaggatgt

SEQ ID NO: 716563 - DNA, 25 bp, Mus musculus
gtgtctcgaaccttgaacaggatgt

SEQ ID NO: 716564 - DNA, 25 bp, Mus musculus
gtgtctcgaccaactcatcaaagtt

SEQ ID NO: 716565 - DNA, 25 bp, Mus musculus
gtgtctcgaccatctcatcaaagtt

SEQ ID NO: 716566 - DNA, 25 bp, Mus musculus
gtgtctcgacctatcgctgacaaag

SEQ ID NO: 716567 - DNA, 25 bp, Mus musculus
gtgtctcgacctttcgctgacaaag

SEQ ID NO: 716568 - DNA, 25 bp, Mus musculus
gtgtctcgatgtatagcttacctgc

SEQ ID NO: 716569 - DNA, 25 bp, Mus musculus
gtgtctcgatgtttagcttacctgc

SEQ ID NO: 716570 - DNA, 25 bp, Mus musculus
gtgtctcggcatagtgttcctaatg

SEQ ID NO: 716571 - DNA, 25 bp, Mus musculus
gtgtctcggcattgtgttcctaatg

SEQ ID NO: 716572 - DNA, 25 bp, Mus musculus
gtgtctcggccaaaaatgccttcat

SEQ ID NO: 716573 - DNA, 25 bp, Mus musculus
gtgtctcggccataaatgccttcat

SEQ ID NO: 716574 - DNA, 25 bp, Mus musculus
gtgtctcggtttaggacggtcacct

SEQ ID NO: 716575 - DNA, 25 bp, Mus musculus
gtgtctcggttttggacggtcacct

SEQ ID NO: 716576 - DNA, 25 bp, Mus musculus
gtgtctcgtctccacaatatgatat

SEQ ID NO: 716577 - DNA, 25 bp, Mus musculus
gtgtctcgtctcgacaatatgatat

SEQ ID NO: 716578 - DNA, 25 bp, Mus musculus
gtgtctctaatcacgtgtgcgaact

SEQ ID NO: 716579 - DNA, 25 bp, Mus musculus
gtgtctctaatctcgtgtgcgaact

SEQ ID NO: 716580 - DNA, 25 bp, Mus musculus
gtgtctctacagctttacctttata

SEQ ID NO: 716581 - DNA, 25 bp, Mus musculus
gtgtctctacaggtttacctttata

SEQ ID NO: 716582 - DNA, 25 bp, Mus musculus
gtgtctctagccaggaggtgaccta

SEQ ID NO: 716583 - DNA, 25 bp, Mus musculus
gtgtctctagcctggaggtgaccta

SEQ ID NO: 716584 - DNA, 25 bp, Mus musculus
gtgtctctagctccaagggatttga

SEQ ID NO: 716585 - DNA, 25 bp, Mus musculus
gtgtctctagctgcaagggatttga

SEQ ID NO: 716586 - DNA, 25 bp, Mus musculus
gtgtctctatgtcaccaatgtgagc

SEQ ID NO: 716587 - DNA, 25 bp, Mus musculus
gtgtctctatgtcacgtttcacctt

SEQ ID NO: 716588 - DNA, 25 bp, Mus musculus
gtgtctctatgtgaccaatgtgagc

SEQ ID NO: 716589 - DNA, 25 bp, Mus musculus
gtgtctctatgtgacgtttcacctt

SEQ ID NO: 716590 - DNA, 25 bp, Mus musculus
gtgtctctcattaatattttcatca

SEQ ID NO: 716591 - DNA, 25 bp, Mus musculus
gtgtctctcatttatattttcatca

SEQ ID NO: 716592 - DNA, 25 bp, Mus musculus
gtgtctctcgctctgaatatcattg

SEQ ID NO: 716593 - DNA, 25 bp, Mus musculus
gtgtctctcgctgtgaatatcattg

SEQ ID NO: 716594 - DNA, 25 bp, Mus musculus
gtgtctctgaagaacgttttcctgg

SEQ ID NO: 716595 - DNA, 25 bp, Mus musculus
gtgtctctgaagatgttcctgttcc

SEQ ID NO: 716596 - DNA, 25 bp, Mus musculus
gtgtctctgaagtacgttttcctgg

SEQ ID NO: 716597 - DNA, 25 bp, Mus musculus
gtgtctctgaagttgttcctgttcc

SEQ ID NO: 716598 - DNA, 25 bp, Mus musculus
gtgtctctgagaaaatatgctgcta

SEQ ID NO: 716599 - DNA, 25 bp, Mus musculus
gtgtctctgagataatatgctgcta

SEQ ID NO: 716600 - DNA, 25 bp, Mus musculus
gtgtctctgagtcgcttgaatccat

SEQ ID NO: 716601 - DNA, 25 bp, Mus musculus
gtgtctctgagtctaaaccagaaga

SEQ ID NO: 716602 - DNA, 25 bp, Mus musculus
gtgtctctgagtggcttgaatccat

SEQ ID NO: 716603 - DNA, 25 bp, Mus musculus
gtgtctctgagtgtaaaccagaaga

SEQ ID NO: 716604 - DNA, 25 bp, Mus musculus
gtgtctctgcacaggtactggtgga

SEQ ID NO: 716605 - DNA, 25 bp, Mus musculus
gtgtctctgcactggtactggtgga

SEQ ID NO: 716606 - DNA, 25 bp, Mus musculus
gtgtctctgctgagacatctgtcta

SEQ ID NO: 716607 - DNA, 25 bp, Mus musculus
gtgtctctgctgtgacatctgtcta

SEQ ID NO: 716608 - DNA, 25 bp, Mus musculus
gtgtctctggacctgcaaagtcatg

SEQ ID NO: 716609 - DNA, 25 bp, Mus musculus
gtgtctctggacgtgcaaagtcatg

SEQ ID NO: 716610 - DNA, 25 bp, Mus musculus
gtgtctctggtacccaggacagcca

SEQ ID NO: 716611 - DNA, 25 bp, Mus musculus
gtgtctctggtagccaggacagcca

SEQ ID NO: 716612 - DNA, 25 bp, Mus musculus
gtgtctctggtcacagtttcataag

SEQ ID NO: 716613 - DNA, 25 bp, Mus musculus
gtgtctctggtctcagtttcataag

SEQ ID NO: 716614 - DNA, 25 bp, Mus musculus
gtgtctctgtctagagtggtagata

SEQ ID NO: 716615 - DNA, 25 bp, Mus musculus
gtgtctctgtctcagcctaggaaca

SEQ ID NO: 716616 - DNA, 25 bp, Mus musculus
gtgtctctgtctgagcctaggaaca

SEQ ID NO: 716617 - DNA, 25 bp, Mus musculus
gtgtctctgtcttgagtggtagata

SEQ ID NO: 716618 - DNA, 25 bp, Mus musculus
gtgtctctgtgaccccaacaggcca

SEQ ID NO: 716619 - DNA, 25 bp, Mus musculus
gtgtctctgtgagcccaacaggcca

SEQ ID NO: 716620 - DNA, 25 bp, Mus musculus
gtgtctcttaagatccaggacccag

SEQ ID NO: 716621 - DNA, 25 bp, Mus musculus
gtgtctcttaagcaccacccgaagg

SEQ ID NO: 716622 - DNA, 25 bp, Mus musculus
gtgtctcttaaggaccacccgaagg

SEQ ID NO: 716623 - DNA, 25 bp, Mus musculus
gtgtctcttaagttccaggacccag

SEQ ID NO: 716624 - DNA, 25 bp, Mus musculus
gtgtctcttaatactgtcatcttga

SEQ ID NO: 716625 - DNA, 25 bp, Mus musculus
gtgtctcttaattctgtcatcttga

SEQ ID NO: 716626 - DNA, 25 bp, Mus musculus
gtgtctcttatacgtttaaatgtgt

SEQ ID NO: 716627 - DNA, 25 bp, Mus musculus
gtgtctcttataggtttaaatgtgt

SEQ ID NO: 716628 - DNA, 25 bp, Mus musculus
gtgtctcttctgatccttaggtaac

SEQ ID NO: 716629 - DNA, 25 bp, Mus musculus
gtgtctcttctgcaattatacatta

SEQ ID NO: 716630 - DNA, 25 bp, Mus musculus
gtgtctcttctggaattatacatta

SEQ ID NO: 716631 - DNA, 25 bp, Mus musculus
gtgtctcttctgttccttaggtaac

SEQ ID NO: 716632 - DNA, 25 bp, Mus musculus
gtgtctcttgttcccttcattagaa

SEQ ID NO: 716633 - DNA, 25 bp, Mus musculus
gtgtctcttgttgccttcattagaa

SEQ ID NO: 716634 - DNA, 25 bp, Mus musculus
gtgtctctttacctctgtataggca

SEQ ID NO: 716635 - DNA, 25 bp, Mus musculus
gtgtctctttacgtctgtataggca

SEQ ID NO: 716636 - DNA, 25 bp, Mus musculus
gtgtctctttccaatattgatattt

SEQ ID NO: 716637 - DNA, 25 bp, Mus musculus
gtgtctctttcctatattgatattt

SEQ ID NO: 716638 - DNA, 25 bp, Mus musculus
gtgtctctttgcatcttgactatga

SEQ ID NO: 716639 - DNA, 25 bp, Mus musculus
gtgtctctttgcttcttgactatga

SEQ ID NO: 716640 - DNA, 25 bp, Mus musculus
gtgtctctttgtcctacttctgttt

SEQ ID NO: 716641 - DNA, 25 bp, Mus musculus
gtgtctctttgtgctacttctgttt

SEQ ID NO: 716642 - DNA, 25 bp, Mus musculus
gtgtctgaaaccctaaggcctggca

SEQ ID NO: 716643 - DNA, 25 bp, Mus musculus
gtgtctgaaaccgtaaggcctggca

SEQ ID NO: 716644 - DNA, 25 bp, Mus musculus
gtgtctgaaactcacctgtagttaa

SEQ ID NO: 716645 - DNA, 25 bp, Mus musculus
gtgtctgaaactgacctgtagttaa

SEQ ID NO: 716646 - DNA, 25 bp, Mus musculus
gtgtctgaacaccagccattggaga

SEQ ID NO: 716647 - DNA, 25 bp, Mus musculus
gtgtctgaacacgagccattggaga

SEQ ID NO: 716648 - DNA, 25 bp, Mus musculus
gtgtctgaactcagacagggtgaca

SEQ ID NO: 716649 - DNA, 25 bp, Mus musculus
gtgtctgaactccatgttgtgcgaa

SEQ ID NO: 716650 - DNA, 25 bp, Mus musculus
gtgtctgaactcgatgttgtgcgaa

SEQ ID NO: 716651 - DNA, 25 bp, Mus musculus
gtgtctgaactctgacagggtgaca

SEQ ID NO: 716652 - DNA, 25 bp, Mus musculus
gtgtctgaagacagctacagtgtct

SEQ ID NO: 716653 - DNA, 25 bp, Mus musculus
gtgtctgaagactgctacagtgtct

SEQ ID NO: 716654 - DNA, 25 bp, Mus musculus
gtgtctgaatctataatggccttaa

SEQ ID NO: 716655 - DNA, 25 bp, Mus musculus
gtgtctgaatctttaatggccttaa

SEQ ID NO: 716656 - DNA, 25 bp, Mus musculus
gtgtctgacacaaggcgagaactca

SEQ ID NO: 716657 - DNA, 25 bp, Mus musculus
gtgtctgacacatggcgagaactca

SEQ ID NO: 716658 - DNA, 25 bp, Mus musculus
gtgtctgacaccagcagtgcctggt

SEQ ID NO: 716659 - DNA, 25 bp, Mus musculus
gtgtctgacacctgcagtgcctggt

SEQ ID NO: 716660 - DNA, 25 bp, Mus musculus
gtgtctgacattattagaagccttg

SEQ ID NO: 716661 - DNA, 25 bp, Mus musculus
gtgtctgacatttttagaagccttg

SEQ ID NO: 716662 - DNA, 25 bp, Mus musculus
gtgtctgaccatatactgctttgag

SEQ ID NO: 716663 - DNA, 25 bp, Mus musculus
gtgtctgaccatctctgcacaaggt

SEQ ID NO: 716664 - DNA, 25 bp, Mus musculus
gtgtctgaccatgtctgcacaaggt

SEQ ID NO: 716665 - DNA, 25 bp, Mus musculus
gtgtctgaccatttactgctttgag

SEQ ID NO: 716666 - DNA, 25 bp, Mus musculus
gtgtctgaccccattcaaacatgca

SEQ ID NO: 716667 - DNA, 25 bp, Mus musculus
gtgtctgacccctttcaaacatgca

SEQ ID NO: 716668 - DNA, 25 bp, Mus musculus
gtgtctgacctaatatccttggagt

SEQ ID NO: 716669 - DNA, 25 bp, Mus musculus
gtgtctgacctattatccttggagt

SEQ ID NO: 716670 - DNA, 25 bp, Mus musculus
gtgtctgactatactactgtacttt

SEQ ID NO: 716671 - DNA, 25 bp, Mus musculus
gtgtctgactattctactgtacttt

SEQ ID NO: 716672 - DNA, 25 bp, Mus musculus
gtgtctgactgcacagcttggaaaa

SEQ ID NO: 716673 - DNA, 25 bp, Mus musculus
gtgtctgactgctcagcttggaaaa

SEQ ID NO: 716674 - DNA, 25 bp, Mus musculus
gtgtctgagaaaattcccatacctt

SEQ ID NO: 716675 - DNA, 25 bp, Mus musculus
gtgtctgagaaatttcccatacctt

SEQ ID NO: 716676 - DNA, 25 bp, Mus musculus
gtgtctgagcaccattgaggcccag

SEQ ID NO: 716677 - DNA, 25 bp, Mus musculus
gtgtctgagcacgattgaggcccag

SEQ ID NO: 716678 - DNA, 25 bp, Mus musculus
gtgtctgagccgacggcgtcgctaa

SEQ ID NO: 716679 - DNA, 25 bp, Mus musculus
gtgtctgagccgtcggcgtcgctaa

SEQ ID NO: 716680 - DNA, 25 bp, Mus musculus
gtgtctgagctcatggacgactgtt

SEQ ID NO: 716681 - DNA, 25 bp, Mus musculus
gtgtctgagctcttggacgactgtt

SEQ ID NO: 716682 - DNA, 25 bp, Mus musculus
gtgtctgaggagcaaagcacctgaa

SEQ ID NO: 716683 - DNA, 25 bp, Mus musculus
gtgtctgaggaggaaagcacctgaa

SEQ ID NO: 716684 - DNA, 25 bp, Mus musculus
gtgtctgaggcaattgtgactccgc

SEQ ID NO: 716685 - DNA, 25 bp, Mus musculus
gtgtctgaggcatttgtgactccgc

SEQ ID NO: 716686 - DNA, 25 bp, Mus musculus
gtgtctgaggtcaccatgggatcat

SEQ ID NO: 716687 - DNA, 25 bp, Mus musculus
gtgtctgaggtctccatgggatcat

SEQ ID NO: 716688 - DNA, 25 bp, Mus musculus
gtgtctgagtttagactcattcttc

SEQ ID NO: 716689 - DNA, 25 bp, Mus musculus
gtgtctgagttttgactcattcttc

SEQ ID NO: 716690 - DNA, 25 bp, Mus musculus
gtgtctgataatcagccctgtgcct

SEQ ID NO: 716691 - DNA, 25 bp, Mus musculus
gtgtctgataatgagccctgtgcct

SEQ ID NO: 716692 - DNA, 25 bp, Mus musculus
gtgtctgatagaagctaaacatgtc

SEQ ID NO: 716693 - DNA, 25 bp, Mus musculus
gtgtctgatagatgctaaacatgtc

SEQ ID NO: 716694 - DNA, 25 bp, Mus musculus
gtgtctgatattatggtcagctact

SEQ ID NO: 716695 - DNA, 25 bp, Mus musculus
gtgtctgatattttggtcagctact

SEQ ID NO: 716696 - DNA, 25 bp, Mus musculus
gtgtctgatggaacagccaggccca

SEQ ID NO: 716697 - DNA, 25 bp, Mus musculus
gtgtctgatggatcagccaggccca

SEQ ID NO: 716698 - DNA, 25 bp, Mus musculus
gtgtctgatgtcaaaccagtgctta

SEQ ID NO: 716699 - DNA, 25 bp, Mus musculus
gtgtctgatgtctaaccagtgctta

SEQ ID NO: 716700 - DNA, 25 bp, Mus musculus
gtgtctgatttccaacttttccccg

SEQ ID NO: 716701 - DNA, 25 bp, Mus musculus
gtgtctgatttcgaacttttccccg

SEQ ID NO: 716702 - DNA, 25 bp, Mus musculus
gtgtctgcaacaacaacgccatcat

SEQ ID NO: 716703 - DNA, 25 bp, Mus musculus
gtgtctgcaacacagtacgagatgt

SEQ ID NO: 716704 - DNA, 25 bp, Mus musculus
gtgtctgcaacagagtacgagatgt

SEQ ID NO: 716705 - DNA, 25 bp, Mus musculus
gtgtctgcaacatcaacgccatcat

SEQ ID NO: 716706 - DNA, 25 bp, Mus musculus
gtgtctgcacagcttcagcatctca

SEQ ID NO: 716707 - DNA, 25 bp, Mus musculus
gtgtctgcacaggttcagcatctca

SEQ ID NO: 716708 - DNA, 25 bp, Mus musculus
gtgtctgcacccagatatctggcta

SEQ ID NO: 716709 - DNA, 25 bp, Mus musculus
gtgtctgcaccctgatatctggcta

SEQ ID NO: 716710 - DNA, 25 bp, Mus musculus
gtgtctgcacctctgatcctagact

SEQ ID NO: 716711 - DNA, 25 bp, Mus musculus
gtgtctgcacctgtgatcctagact

SEQ ID NO: 716712 - DNA, 25 bp, Mus musculus
gtgtctgcagacaacagcaaatggt

SEQ ID NO: 716713 - DNA, 25 bp, Mus musculus
gtgtctgcagacagcaacagcgaga

SEQ ID NO: 716714 - DNA, 25 bp, Mus musculus
gtgtctgcagactacagcaaatggt

SEQ ID NO: 716715 - DNA, 25 bp, Mus musculus
gtgtctgcagactgcaacagcgaga

SEQ ID NO: 716716 - DNA, 25 bp, Mus musculus
gtgtctgcagagagaaccaggagtt

SEQ ID NO: 716717 - DNA, 25 bp, Mus musculus
gtgtctgcagagtgaaccaggagtt

SEQ ID NO: 716718 - DNA, 25 bp, Mus musculus
gtgtctgcaggacctcagattgtac

SEQ ID NO: 716719 - DNA, 25 bp, Mus musculus
gtgtctgcaggagctcagattgtac

SEQ ID NO: 716720 - DNA, 25 bp, Mus musculus
gtgtctgcagttctggcatatgtaa

SEQ ID NO: 716721 - DNA, 25 bp, Mus musculus
gtgtctgcagttgtggcatatgtaa

SEQ ID NO: 716722 - DNA, 25 bp, Mus musculus
gtgtctgcatctatccagtaaacca

SEQ ID NO: 716723 - DNA, 25 bp, Mus musculus
gtgtctgcatctttccagtaaacca

SEQ ID NO: 716724 - DNA, 25 bp, Mus musculus
gtgtctgccaagcaatttgccccgg

SEQ ID NO: 716725 - DNA, 25 bp, Mus musculus
gtgtctgccaaggaatttgccccgg

SEQ ID NO: 716726 - DNA, 25 bp, Mus musculus
gtgtctgccaatcttttgaccgttc

SEQ ID NO: 716727 - DNA, 25 bp, Mus musculus
gtgtctgccaatgttttgaccgttc

SEQ ID NO: 716728 - DNA, 25 bp, Mus musculus
gtgtctgccatactatactgttcat

SEQ ID NO: 716729 - DNA, 25 bp, Mus musculus
gtgtctgccatagtatactgttcat

SEQ ID NO: 716730 - DNA, 25 bp, Mus musculus
gtgtctgccatcctgattttataag

SEQ ID NO: 716731 - DNA, 25 bp, Mus musculus
gtgtctgccatcgtgattttataag

SEQ ID NO: 716732 - DNA, 25 bp, Mus musculus
gtgtctgccatgctctgggtcaaaa

SEQ ID NO: 716733 - DNA, 25 bp, Mus musculus
gtgtctgccatggtctgggtcaaaa

SEQ ID NO: 716734 - DNA, 25 bp, Mus musculus
gtgtctgcccatagatgtttctcta

SEQ ID NO: 716735 - DNA, 25 bp, Mus musculus
gtgtctgcccattgatgtttctcta

SEQ ID NO: 716736 - DNA, 25 bp, Mus musculus
gtgtctgcccctaccagttttgaaa

SEQ ID NO: 716737 - DNA, 25 bp, Mus musculus
gtgtctgccccttccagttttgaaa

SEQ ID NO: 716738 - DNA, 25 bp, Mus musculus
gtgtctgccgtgaagagtgtgccaa

SEQ ID NO: 716739 - DNA, 25 bp, Mus musculus
gtgtctgccgtgtagagtgtgccaa

SEQ ID NO: 716740 - DNA, 25 bp, Mus musculus
gtgtctgcggctcgattgccaccat

SEQ ID NO: 716741 - DNA, 25 bp, Mus musculus
gtgtctgcggctggattgccaccat

SEQ ID NO: 716742 - DNA, 25 bp, Mus musculus
gtgtctgcgtgcacaggctccagta

SEQ ID NO: 716743 - DNA, 25 bp, Mus musculus
gtgtctgcgtgctcaggctccagta

SEQ ID NO: 716744 - DNA, 25 bp, Mus musculus
gtgtctgctaagcaacacagacttc

SEQ ID NO: 716745 - DNA, 25 bp, Mus musculus
gtgtctgctaaggaacacagacttc

SEQ ID NO: 716746 - DNA, 25 bp, Mus musculus
gtgtctgctcaaagccgggtgtaaa

SEQ ID NO: 716747 - DNA, 25 bp, Mus musculus
gtgtctgctcaatgccgggtgtaaa

SEQ ID NO: 716748 - DNA, 25 bp, Mus musculus
gtgtctgctcgcagaccaatgtcca

SEQ ID NO: 716749 - DNA, 25 bp, Mus musculus
gtgtctgctcgcagatgcagctctc

SEQ ID NO: 716750 - DNA, 25 bp, Mus musculus
gtgtctgctcgctgaccaatgtcca

SEQ ID NO: 716751 - DNA, 25 bp, Mus musculus
gtgtctgctcgctgatgcagctctc

SEQ ID NO: 716752 - DNA, 25 bp, Mus musculus
gtgtctgctgacacatctttaaaag

SEQ ID NO: 716753 - DNA, 25 bp, Mus musculus
gtgtctgctgactcatctttaaaag

SEQ ID NO: 716754 - DNA, 25 bp, Mus musculus
gtgtctgctggacacagccaggcac

SEQ ID NO: 716755 - DNA, 25 bp, Mus musculus
gtgtctgctggagacagccaggcac

SEQ ID NO: 716756 - DNA, 25 bp, Mus musculus
gtgtctgcttttactgtcattctct

SEQ ID NO: 716757 - DNA, 25 bp, Mus musculus
gtgtctgctttttctgtcattctct

SEQ ID NO: 716758 - DNA, 25 bp, Mus musculus
gtgtctggaaccctgatgttctgga

SEQ ID NO: 716759 - DNA, 25 bp, Mus musculus
gtgtctggaaccgtgatgttctgga

SEQ ID NO: 716760 - DNA, 25 bp, Mus musculus
gtgtctggaagcatcttgtgtctcc

SEQ ID NO: 716761 - DNA, 25 bp, Mus musculus
gtgtctggaagcttcttgtgtctcc

SEQ ID NO: 716762 - DNA, 25 bp, Mus musculus
gtgtctggaagtcaagccccccaag

SEQ ID NO: 716763 - DNA, 25 bp, Mus musculus
gtgtctggaagtgaagccccccaag

SEQ ID NO: 716764 - DNA, 25 bp, Mus musculus
gtgtctggcaacagcaataacaata

SEQ ID NO: 716765 - DNA, 25 bp, Mus musculus
gtgtctggcaactgcaataacaata

SEQ ID NO: 716766 - DNA, 25 bp, Mus musculus
gtgtctggcacaaataattgtttct

SEQ ID NO: 716767 - DNA, 25 bp, Mus musculus
gtgtctggcacatataattgtttct

SEQ ID NO: 716768 - DNA, 25 bp, Mus musculus
gtgtctggcactccaagcctggatg

SEQ ID NO: 716769 - DNA, 25 bp, Mus musculus
gtgtctggcactgcaagcctggatg

SEQ ID NO: 716770 - DNA, 25 bp, Mus musculus
gtgtctggccacactgccaagtgaa

SEQ ID NO: 716771 - DNA, 25 bp, Mus musculus
gtgtctggccactctgccaagtgaa

SEQ ID NO: 716772 - DNA, 25 bp, Mus musculus
gtgtctggccataacatactctttg

SEQ ID NO: 716773 - DNA, 25 bp, Mus musculus
gtgtctggccattacatactctttg

SEQ ID NO: 716774 - DNA, 25 bp, Mus musculus
gtgtctggcctgagatagataagaa

SEQ ID NO: 716775 - DNA, 25 bp, Mus musculus
gtgtctggcctgtgatagataagaa

SEQ ID NO: 716776 - DNA, 25 bp, Mus musculus
gtgtctggctaactgtgctgcacat

SEQ ID NO: 716777 - DNA, 25 bp, Mus musculus
gtgtctggctaagtgtgctgcacat

SEQ ID NO: 716778 - DNA, 25 bp, Mus musculus
gtgtctggcttgctagttttcataa

SEQ ID NO: 716779 - DNA, 25 bp, Mus musculus
gtgtctggcttggtagttttcataa

SEQ ID NO: 716780 - DNA, 25 bp, Mus musculus
gtgtctgggaggaaccgaacgacct

SEQ ID NO: 716781 - DNA, 25 bp, Mus musculus
gtgtctgggaggtaccgaacgacct

SEQ ID NO: 716782 - DNA, 25 bp, Mus musculus
gtgtctggtgtaatgtatcctggtt

SEQ ID NO: 716783 - DNA, 25 bp, Mus musculus
gtgtctggtgtattgtatcctggtt

SEQ ID NO: 716784 - DNA, 25 bp, Mus musculus
gtgtctggttctcatatttcttcat

SEQ ID NO: 716785 - DNA, 25 bp, Mus musculus
gtgtctggttctgatatttcttcat

SEQ ID NO: 716786 - DNA, 25 bp, Mus musculus
gtgtctggtttcactagctattgca

SEQ ID NO: 716787 - DNA, 25 bp, Mus musculus
gtgtctggtttctctagctattgca

SEQ ID NO: 716788 - DNA, 25 bp, Mus musculus
gtgtctgtaaagaacccgggtcttg

SEQ ID NO: 716789 - DNA, 25 bp, Mus musculus
gtgtctgtaaagtacccgggtcttg

SEQ ID NO: 716790 - DNA, 25 bp, Mus musculus
gtgtctgtaacaagctggatccctg

SEQ ID NO: 716791 - DNA, 25 bp, Mus musculus
gtgtctgtaacatgctggatccctg

SEQ ID NO: 716792 - DNA, 25 bp, Mus musculus
gtgtctgtaaggagccatttaggat

SEQ ID NO: 716793 - DNA, 25 bp, Mus musculus
gtgtctgtaaggctggctcattttc

SEQ ID NO: 716794 - DNA, 25 bp, Mus musculus
gtgtctgtaagggtggctcattttc

SEQ ID NO: 716795 - DNA, 25 bp, Mus musculus
gtgtctgtaaggtgccatttaggat

SEQ ID NO: 716796 - DNA, 25 bp, Mus musculus
gtgtctgtacagcttatcatctaat

SEQ ID NO: 716797 - DNA, 25 bp, Mus musculus
gtgtctgtacaggttatcatctaat

SEQ ID NO: 716798 - DNA, 25 bp, Mus musculus
gtgtctgtacttcagtgggctctgt

SEQ ID NO: 716799 - DNA, 25 bp, Mus musculus
gtgtctgtacttgagtgggctctgt

SEQ ID NO: 716800 - DNA, 25 bp, Mus musculus
gtgtctgtagacatgcatgaatgaa

SEQ ID NO: 716801 - DNA, 25 bp, Mus musculus
gtgtctgtagacttgcatgaatgaa

SEQ ID NO: 716802 - DNA, 25 bp, Mus musculus
gtgtctgtatacactcaaacgtttg

SEQ ID NO: 716803 - DNA, 25 bp, Mus musculus
gtgtctgtatactctcaaacgtttg

SEQ ID NO: 716804 - DNA, 25 bp, Mus musculus
gtgtctgtcagaaaagccaagctct

SEQ ID NO: 716805 - DNA, 25 bp, Mus musculus
gtgtctgtcagaaggatggctttgc

SEQ ID NO: 716806 - DNA, 25 bp, Mus musculus
gtgtctgtcagataagccaagctct

SEQ ID NO: 716807 - DNA, 25 bp, Mus musculus
gtgtctgtcagatggatggctttgc

SEQ ID NO: 716808 - DNA, 25 bp, Mus musculus
gtgtctgtcataaaaccattcctga

SEQ ID NO: 716809 - DNA, 25 bp, Mus musculus
gtgtctgtcatataaccattcctga

SEQ ID NO: 716810 - DNA, 25 bp, Mus musculus
gtgtctgtcattcatcataattcat

SEQ ID NO: 716811 - DNA, 25 bp, Mus musculus
gtgtctgtcattgatcataattcat

SEQ ID NO: 716812 - DNA, 25 bp, Mus musculus
gtgtctgtcgatacatgtttgtttt

SEQ ID NO: 716813 - DNA, 25 bp, Mus musculus
gtgtctgtcgattcatgtttgtttt

SEQ ID NO: 716814 - DNA, 25 bp, Mus musculus
gtgtctgtctgaaaaggtttcacca

SEQ ID NO: 716815 - DNA, 25 bp, Mus musculus
gtgtctgtctgataaggtttcacca

SEQ ID NO: 716816 - DNA, 25 bp, Mus musculus
gtgtctgtgacaactggtgctgctc

SEQ ID NO: 716817 - DNA, 25 bp, Mus musculus
gtgtctgtgacatctggtgctgctc

SEQ ID NO: 716818 - DNA, 25 bp, Mus musculus
gtgtctgtgaccaggcaagtctttc

SEQ ID NO: 716819 - DNA, 25 bp, Mus musculus
gtgtctgtgacctggcaagtctttc

SEQ ID NO: 716820 - DNA, 25 bp, Mus musculus
gtgtctgtgatccagcgaaacgctc

SEQ ID NO: 716821 - DNA, 25 bp, Mus musculus
gtgtctgtgatcgagcgaaacgctc

SEQ ID NO: 716822 - DNA, 25 bp, Mus musculus
gtgtctgtgcaacttaacatataat

SEQ ID NO: 716823 - DNA, 25 bp, Mus musculus
gtgtctgtgcaagttaacatataat

SEQ ID NO: 716824 - DNA, 25 bp, Mus musculus
gtgtctgtgcacagtatgctgctac

SEQ ID NO: 716825 - DNA, 25 bp, Mus musculus
gtgtctgtgcactgtatgctgctac

SEQ ID NO: 716826 - DNA, 25 bp, Mus musculus
gtgtctgtgcatcaggaccagctcc

SEQ ID NO: 716827 - DNA, 25 bp, Mus musculus
gtgtctgtgcatccctgtggacacc

SEQ ID NO: 716828 - DNA, 25 bp, Mus musculus
gtgtctgtgcatgaggaccagctcc

SEQ ID NO: 716829 - DNA, 25 bp, Mus musculus
gtgtctgtgcatgcctgtggacacc

SEQ ID NO: 716830 - DNA, 25 bp, Mus musculus
gtgtctgtgcccagaatccagatga

SEQ ID NO: 716831 - DNA, 25 bp, Mus musculus
gtgtctgtgccctgaatccagatga

SEQ ID NO: 716832 - DNA, 25 bp, Mus musculus
gtgtctgtggaacattttgtctcca

SEQ ID NO: 716833 - DNA, 25 bp, Mus musculus
gtgtctgtggaagattttgtctcca

SEQ ID NO: 716834 - DNA, 25 bp, Mus musculus
gtgtctgtggcaatccctataaagt

SEQ ID NO: 716835 - DNA, 25 bp, Mus musculus
gtgtctgtggcattccctataaagt

SEQ ID NO: 716836 - DNA, 25 bp, Mus musculus
gtgtctgtgggacgcctgccctttt

SEQ ID NO: 716837 - DNA, 25 bp, Mus musculus
gtgtctgtgggaggcctgccctttt

SEQ ID NO: 716838 - DNA, 25 bp, Mus musculus
gtgtctgtggttaagtccttctgaa

SEQ ID NO: 716839 - DNA, 25 bp, Mus musculus
gtgtctgtggtttagtccttctgaa

SEQ ID NO: 716840 - DNA, 25 bp, Mus musculus
gtgtctgtgtccagctgtaacatat

SEQ ID NO: 716841 - DNA, 25 bp, Mus musculus
gtgtctgtgtcctgctgtaacatat

SEQ ID NO: 716842 - DNA, 25 bp, Mus musculus
gtgtctgtgtctcgtatgaggatca

SEQ ID NO: 716843 - DNA, 25 bp, Mus musculus
gtgtctgtgtctggtatgaggatca

SEQ ID NO: 716844 - DNA, 25 bp, Mus musculus
gtgtctgtgtttaaatgaccccgtc

SEQ ID NO: 716845 - DNA, 25 bp, Mus musculus
gtgtctgtgttttaatgaccccgtc

SEQ ID NO: 716846 - DNA, 25 bp, Mus musculus
gtgtctgttacacaacctgggaact

SEQ ID NO: 716847 - DNA, 25 bp, Mus musculus
gtgtctgttacacgtgagccttgtt

SEQ ID NO: 716848 - DNA, 25 bp, Mus musculus
gtgtctgttacagaacctgggaact

SEQ ID NO: 716849 - DNA, 25 bp, Mus musculus
gtgtctgttacaggtgagccttgtt

SEQ ID NO: 716850 - DNA, 25 bp, Mus musculus
gtgtctgttcacacttaggagccac

SEQ ID NO: 716851 - DNA, 25 bp, Mus musculus
gtgtctgttcactcttaggagccac

SEQ ID NO: 716852 - DNA, 25 bp, Mus musculus
gtgtctgttctcactgcaatagtat

SEQ ID NO: 716853 - DNA, 25 bp, Mus musculus
gtgtctgttctcagcgaggaaaacc

SEQ ID NO: 716854 - DNA, 25 bp, Mus musculus
gtgtctgttctctctgcaatagtat

SEQ ID NO: 716855 - DNA, 25 bp, Mus musculus
gtgtctgttctctgcgaggaaaacc

SEQ ID NO: 716856 - DNA, 25 bp, Mus musculus
gtgtctgttcttacgttgagctgca

SEQ ID NO: 716857 - DNA, 25 bp, Mus musculus
gtgtctgttctttcgttgagctgca

SEQ ID NO: 716858 - DNA, 25 bp, Mus musculus
gtgtctgttgtgaggcaaagctgaa

SEQ ID NO: 716859 - DNA, 25 bp, Mus musculus
gtgtctgttgtgtggcaaagctgaa

SEQ ID NO: 716860 - DNA, 25 bp, Mus musculus
gtgtctgtttatacacccaactgat

SEQ ID NO: 716861 - DNA, 25 bp, Mus musculus
gtgtctgtttatatgggtcagcaat

SEQ ID NO: 716862 - DNA, 25 bp, Mus musculus
gtgtctgtttattcacccaactgat

SEQ ID NO: 716863 - DNA, 25 bp, Mus musculus
gtgtctgtttatttgggtcagcaat

SEQ ID NO: 716864 - DNA, 25 bp, Mus musculus
gtgtctgtttgcatactcatctgta

SEQ ID NO: 716865 - DNA, 25 bp, Mus musculus
gtgtctgtttgcttactcatctgta

SEQ ID NO: 716866 - DNA, 25 bp, Mus musculus
gtgtctgttttcattggcgggtgct

SEQ ID NO: 716867 - DNA, 25 bp, Mus musculus
gtgtctgttttctttggcgggtgct

SEQ ID NO: 716868 - DNA, 25 bp, Mus musculus
gtgtcttaaccaatgctttgcctgt

SEQ ID NO: 716869 - DNA, 25 bp, Mus musculus
gtgtcttaaccattgctttgcctgt

SEQ ID NO: 716870 - DNA, 25 bp, Mus musculus
gtgtcttaagacaaccttggtagag

SEQ ID NO: 716871 - DNA, 25 bp, Mus musculus
gtgtcttaagacaactttccagagg

SEQ ID NO: 716872 - DNA, 25 bp, Mus musculus
gtgtcttaagactaccttggtagag

SEQ ID NO: 716873 - DNA, 25 bp, Mus musculus
gtgtcttaagactactttccagagg

SEQ ID NO: 716874 - DNA, 25 bp, Mus musculus
gtgtcttaatttatgtcccactccg

SEQ ID NO: 716875 - DNA, 25 bp, Mus musculus
gtgtcttaatttttgtcccactccg

SEQ ID NO: 716876 - DNA, 25 bp, Mus musculus
gtgtcttacacacatagcggctcag

SEQ ID NO: 716877 - DNA, 25 bp, Mus musculus
gtgtcttacacagatagcggctcag

SEQ ID NO: 716878 - DNA, 25 bp, Mus musculus
gtgtcttacttacaagccatggctc

SEQ ID NO: 716879 - DNA, 25 bp, Mus musculus
gtgtcttacttagaagccatggctc

SEQ ID NO: 716880 - DNA, 25 bp, Mus musculus
gtgtcttactttcacaggccttgtg

SEQ ID NO: 716881 - DNA, 25 bp, Mus musculus
gtgtcttactttgacaggccttgtg

SEQ ID NO: 716882 - DNA, 25 bp, Mus musculus
gtgtcttagaacagctactctcttg

SEQ ID NO: 716883 - DNA, 25 bp, Mus musculus
gtgtcttagaactgctactctcttg

SEQ ID NO: 716884 - DNA, 25 bp, Mus musculus
gtgtcttagacaaaatttggctgtg

SEQ ID NO: 716885 - DNA, 25 bp, Mus musculus
gtgtcttagacataatttggctgtg

SEQ ID NO: 716886 - DNA, 25 bp, Mus musculus
gtgtcttaggccagaagtacgctgt

SEQ ID NO: 716887 - DNA, 25 bp, Mus musculus
gtgtcttaggcctgaagtacgctgt

SEQ ID NO: 716888 - DNA, 25 bp, Mus musculus
gtgtcttagggcatctattgttatg

SEQ ID NO: 716889 - DNA, 25 bp, Mus musculus
gtgtcttagggcttctattgttatg

SEQ ID NO: 716890 - DNA, 25 bp, Mus musculus
gtgtcttagtgacattcctagtgca

SEQ ID NO: 716891 - DNA, 25 bp, Mus musculus
gtgtcttagtgagattcctagtgca

SEQ ID NO: 716892 - DNA, 25 bp, Mus musculus
gtgtcttagtttctagcttcagtca

SEQ ID NO: 716893 - DNA, 25 bp, Mus musculus
gtgtcttagtttgtagcttcagtca

SEQ ID NO: 716894 - DNA, 25 bp, Mus musculus
gtgtcttatactccctgtgactgtt

SEQ ID NO: 716895 - DNA, 25 bp, Mus musculus
gtgtcttatactgcctgtgactgtt

SEQ ID NO: 716896 - DNA, 25 bp, Mus musculus
gtgtcttatagaaaggtgttcacta

SEQ ID NO: 716897 - DNA, 25 bp, Mus musculus
gtgtcttatagataggtgttcacta

SEQ ID NO: 716898 - DNA, 25 bp, Mus musculus
gtgtcttatagcaggtcacctgcaa

SEQ ID NO: 716899 - DNA, 25 bp, Mus musculus
gtgtcttatagctggtcacctgcaa

SEQ ID NO: 716900 - DNA, 25 bp, Mus musculus
gtgtcttattctatgtcaatcctta

SEQ ID NO: 716901 - DNA, 25 bp, Mus musculus
gtgtcttattctttgtcaatcctta

SEQ ID NO: 716902 - DNA, 25 bp, Mus musculus
gtgtcttattggagagtcatagaaa

SEQ ID NO: 716903 - DNA, 25 bp, Mus musculus
gtgtcttattggtgagtcatagaaa

SEQ ID NO: 716904 - DNA, 25 bp, Mus musculus
gtgtcttatttcactcatgtactcc

SEQ ID NO: 716905 - DNA, 25 bp, Mus musculus
gtgtcttatttctctcatgtactcc

SEQ ID NO: 716906 - DNA, 25 bp, Mus musculus
gtgtcttcaacgactgccgtgacat

SEQ ID NO: 716907 - DNA, 25 bp, Mus musculus
gtgtcttcaacgtctgccgtgacat

SEQ ID NO: 716908 - DNA, 25 bp, Mus musculus
gtgtcttcaagtacgaatcccttca

SEQ ID NO: 716909 - DNA, 25 bp, Mus musculus
gtgtcttcaagttcgaatcccttca

SEQ ID NO: 716910 - DNA, 25 bp, Mus musculus
gtgtcttcagatcgcatggactcta

SEQ ID NO: 716911 - DNA, 25 bp, Mus musculus
gtgtcttcagatggcatggactcta

SEQ ID NO: 716912 - DNA, 25 bp, Mus musculus
gtgtcttcagggatggctcagtgca

SEQ ID NO: 716913 - DNA, 25 bp, Mus musculus
gtgtcttcagggttggctcagtgca

SEQ ID NO: 716914 - DNA, 25 bp, Mus musculus
gtgtcttccacaaatgcttctggga

SEQ ID NO: 716915 - DNA, 25 bp, Mus musculus
gtgtcttccacatatgcttctggga

SEQ ID NO: 716916 - DNA, 25 bp, Mus musculus
gtgtcttcccataaagatcagctaa

SEQ ID NO: 716917 - DNA, 25 bp, Mus musculus
gtgtcttcccattaagatcagctaa

SEQ ID NO: 716918 - DNA, 25 bp, Mus musculus
gtgtcttcccggacacagacagaag

SEQ ID NO: 716919 - DNA, 25 bp, Mus musculus
gtgtcttcccggtcacagacagaag

SEQ ID NO: 716920 - DNA, 25 bp, Mus musculus
gtgtcttccctgaactatgtgtgaa

SEQ ID NO: 716921 - DNA, 25 bp, Mus musculus
gtgtcttccctgtactatgtgtgaa

SEQ ID NO: 716922 - DNA, 25 bp, Mus musculus
gtgtcttcctacaatgccattattt

SEQ ID NO: 716923 - DNA, 25 bp, Mus musculus
gtgtcttcctactatgccattattt

SEQ ID NO: 716924 - DNA, 25 bp, Mus musculus
gtgtcttcctatctactaaggtgac

SEQ ID NO: 716925 - DNA, 25 bp, Mus musculus
gtgtcttcctatgtactaaggtgac

SEQ ID NO: 716926 - DNA, 25 bp, Mus musculus
gtgtcttcctgcagatgatcgctaa

SEQ ID NO: 716927 - DNA, 25 bp, Mus musculus
gtgtcttcctgctgatgatcgctaa

SEQ ID NO: 716928 - DNA, 25 bp, Mus musculus
gtgtcttcgaaaccttggcatccat

SEQ ID NO: 716929 - DNA, 25 bp, Mus musculus
gtgtcttcgaaagcttggcatccat

SEQ ID NO: 716930 - DNA, 25 bp, Mus musculus
gtgtcttcgagacctgggtacccca

SEQ ID NO: 716931 - DNA, 25 bp, Mus musculus
gtgtcttcgagagctgggtacccca

SEQ ID NO: 716932 - DNA, 25 bp, Mus musculus
gtgtcttcgccaagcagtatgcaga

SEQ ID NO: 716933 - DNA, 25 bp, Mus musculus
gtgtcttcgccatgcagtatgcaga

SEQ ID NO: 716934 - DNA, 25 bp, Mus musculus
gtgtcttcgcttattactctttctc

SEQ ID NO: 716935 - DNA, 25 bp, Mus musculus
gtgtcttcgctttttactctttctc

SEQ ID NO: 716936 - DNA, 25 bp, Mus musculus
gtgtcttcgtgtaccagctcatgat

SEQ ID NO: 716937 - DNA, 25 bp, Mus musculus
gtgtcttcgtgttccagctcatgat

SEQ ID NO: 716938 - DNA, 25 bp, Mus musculus
gtgtcttctacacttatccacataa

SEQ ID NO: 716939 - DNA, 25 bp, Mus musculus
gtgtcttctacagttatccacataa

SEQ ID NO: 716940 - DNA, 25 bp, Mus musculus
gtgtcttctagactctatcatgggt

SEQ ID NO: 716941 - DNA, 25 bp, Mus musculus
gtgtcttctagagtctatcatgggt

SEQ ID NO: 716942 - DNA, 25 bp, Mus musculus
gtgtcttctcagcacatcaggtgag

SEQ ID NO: 716943 - DNA, 25 bp, Mus musculus
gtgtcttctcaggacatcaggtgag

SEQ ID NO: 716944 - DNA, 25 bp, Mus musculus
gtgtcttctcatacccggaaggaga

SEQ ID NO: 716945 - DNA, 25 bp, Mus musculus
gtgtcttctcattcccggaaggaga

SEQ ID NO: 716946 - DNA, 25 bp, Mus musculus
gtgtcttctccaactaatccttgga

SEQ ID NO: 716947 - DNA, 25 bp, Mus musculus
gtgtcttctccatctaatccttgga

SEQ ID NO: 716948 - DNA, 25 bp, Mus musculus
gtgtcttctccgaagccttaggaag

SEQ ID NO: 716949 - DNA, 25 bp, Mus musculus
gtgtcttctccgtagccttaggaag

SEQ ID NO: 716950 - DNA, 25 bp, Mus musculus
gtgtcttctcttcacagtcgtgagc

SEQ ID NO: 716951 - DNA, 25 bp, Mus musculus
gtgtcttctcttgacagtcgtgagc

SEQ ID NO: 716952 - DNA, 25 bp, Mus musculus
gtgtcttctgacaattccatcgtga

SEQ ID NO: 716953 - DNA, 25 bp, Mus musculus
gtgtcttctgactattccatcgtga

SEQ ID NO: 716954 - DNA, 25 bp, Mus musculus
gtgtcttctggtcgcaaaacgactt

SEQ ID NO: 716955 - DNA, 25 bp, Mus musculus
gtgtcttctggtggcaaaacgactt

SEQ ID NO: 716956 - DNA, 25 bp, Mus musculus
gtgtcttctgtccagtccgaaggac

SEQ ID NO: 716957 - DNA, 25 bp, Mus musculus
gtgtcttctgtcgagtccgaaggac

SEQ ID NO: 716958 - DNA, 25 bp, Mus musculus
gtgtcttcttcacataagtttggga

SEQ ID NO: 716959 - DNA, 25 bp, Mus musculus
gtgtcttcttcagataagtttggga

SEQ ID NO: 716960 - DNA, 25 bp, Mus musculus
gtgtcttgaagaccctggtgtcaga

SEQ ID NO: 716961 - DNA, 25 bp, Mus musculus
gtgtcttgaagagcctggtgtcaga

SEQ ID NO: 716962 - DNA, 25 bp, Mus musculus
gtgtcttgaatcagccaatctgtat

SEQ ID NO: 716963 - DNA, 25 bp, Mus musculus
gtgtcttgaatctgccaatctgtat

SEQ ID NO: 716964 - DNA, 25 bp, Mus musculus
gtgtcttgacacatgggtcatgttc

SEQ ID NO: 716965 - DNA, 25 bp, Mus musculus
gtgtcttgacacttgggtcatgttc

SEQ ID NO: 716966 - DNA, 25 bp, Mus musculus
gtgtcttgagccaattctgagatgt

SEQ ID NO: 716967 - DNA, 25 bp, Mus musculus
gtgtcttgagcctattctgagatgt

SEQ ID NO: 716968 - DNA, 25 bp, Mus musculus
gtgtcttgagtcatagtcttgccta

SEQ ID NO: 716969 - DNA, 25 bp, Mus musculus
gtgtcttgagtcttagtcttgccta

SEQ ID NO: 716970 - DNA, 25 bp, Mus musculus
gtgtcttgatttagagctgctccag

SEQ ID NO: 716971 - DNA, 25 bp, Mus musculus
gtgtcttgattttgagctgctccag

SEQ ID NO: 716972 - DNA, 25 bp, Mus musculus
gtgtcttgcaatagtctggaagtag

SEQ ID NO: 716973 - DNA, 25 bp, Mus musculus
gtgtcttgcaattgtctggaagtag

SEQ ID NO: 716974 - DNA, 25 bp, Mus musculus
gtgtcttgccgaagtgaacgtgcca

SEQ ID NO: 716975 - DNA, 25 bp, Mus musculus
gtgtcttgccgatgtgaacgtgcca

SEQ ID NO: 716976 - DNA, 25 bp, Mus musculus
gtgtcttgccttcttttcaggatga

SEQ ID NO: 716977 - DNA, 25 bp, Mus musculus
gtgtcttgccttgttttcaggatga

SEQ ID NO: 716978 - DNA, 25 bp, Mus musculus
gtgtcttgctaaacataagcacttg

SEQ ID NO: 716979 - DNA, 25 bp, Mus musculus
gtgtcttgctaaccagatctcctcc

SEQ ID NO: 716980 - DNA, 25 bp, Mus musculus
gtgtcttgctaagcagatctcctcc

SEQ ID NO: 716981 - DNA, 25 bp, Mus musculus
gtgtcttgctaatcataagcacttg

SEQ ID NO: 716982 - DNA, 25 bp, Mus musculus
gtgtcttgctcacataggccaaact

SEQ ID NO: 716983 - DNA, 25 bp, Mus musculus
gtgtcttgctcagataggccaaact

SEQ ID NO: 716984 - DNA, 25 bp, Mus musculus
gtgtcttggcgactaatcagtttca

SEQ ID NO: 716985 - DNA, 25 bp, Mus musculus
gtgtcttggcgagtaatcagtttca

SEQ ID NO: 716986 - DNA, 25 bp, Mus musculus
gtgtcttgggcaagcagggattccc

SEQ ID NO: 716987 - DNA, 25 bp, Mus musculus
gtgtcttgggcatgcagggattccc

SEQ ID NO: 716988 - DNA, 25 bp, Mus musculus
gtgtcttgggccagaaaccaggagc

SEQ ID NO: 716989 - DNA, 25 bp, Mus musculus
gtgtcttgggcctgaaaccaggagc

SEQ ID NO: 716990 - DNA, 25 bp, Mus musculus
gtgtcttggtgtatctaagcactga

SEQ ID NO: 716991 - DNA, 25 bp, Mus musculus
gtgtcttggtgtttctaagcactga

SEQ ID NO: 716992 - DNA, 25 bp, Mus musculus
gtgtcttgtcctacagaaactctag

SEQ ID NO: 716993 - DNA, 25 bp, Mus musculus
gtgtcttgtccttcagaaactctag

SEQ ID NO: 716994 - DNA, 25 bp, Mus musculus
gtgtcttgttttcttattcttggca

SEQ ID NO: 716995 - DNA, 25 bp, Mus musculus
gtgtcttgttttgttattcttggca

SEQ ID NO: 716996 - DNA, 25 bp, Mus musculus
gtgtctttaagcagtaaggcatgaa

SEQ ID NO: 716997 - DNA, 25 bp, Mus musculus
gtgtctttaagctgtaaggcatgaa

SEQ ID NO: 716998 - DNA, 25 bp, Mus musculus
gtgtctttaaggacactttctcccg

SEQ ID NO: 716999 - DNA, 25 bp, Mus musculus
gtgtctttaaggtcactttctcccg

SEQ ID NO: 717000 - DNA, 25 bp, Mus musculus
gtgtctttaataacacctgctattt

SEQ ID NO: 717001 - DNA, 25 bp, Mus musculus
gtgtctttaatatcacctgctattt

SEQ ID NO: 717002 - DNA, 25 bp, Mus musculus
gtgtctttacacctcataagtccag

SEQ ID NO: 717003 - DNA, 25 bp, Mus musculus
gtgtctttacacctggagcagcttt

SEQ ID NO: 717004 - DNA, 25 bp, Mus musculus
gtgtctttacacgtcataagtccag

SEQ ID NO: 717005 - DNA, 25 bp, Mus musculus
gtgtctttacacgtggagcagcttt

SEQ ID NO: 717006 - DNA, 25 bp, Mus musculus
gtgtctttacttaagctgatggttc

SEQ ID NO: 717007 - DNA, 25 bp, Mus musculus
gtgtctttacttcgctttgctttga

SEQ ID NO: 717008 - DNA, 25 bp, Mus musculus
gtgtctttacttggctttgctttga

SEQ ID NO: 717009 - DNA, 25 bp, Mus musculus
gtgtctttactttagctgatggttc

SEQ ID NO: 717010 - DNA, 25 bp, Mus musculus
gtgtctttagttacgtggctgcgca

SEQ ID NO: 717011 - DNA, 25 bp, Mus musculus
gtgtctttagtttcgtggctgcgca

SEQ ID NO: 717012 - DNA, 25 bp, Mus musculus
gtgtctttatctctgcgtctgccct

SEQ ID NO: 717013 - DNA, 25 bp, Mus musculus
gtgtctttatctgtgcgtctgccct

SEQ ID NO: 717014 - DNA, 25 bp, Mus musculus
gtgtctttattccatctgcttgtgg

SEQ ID NO: 717015 - DNA, 25 bp, Mus musculus
gtgtctttattcgatctgcttgtgg

SEQ ID NO: 717016 - DNA, 25 bp, Mus musculus
gtgtctttcataacacatactgctt

SEQ ID NO: 717017 - DNA, 25 bp, Mus musculus
gtgtctttcatatcacatactgctt

SEQ ID NO: 717018 - DNA, 25 bp, Mus musculus
gtgtctttcattagctttccagtag

SEQ ID NO: 717019 - DNA, 25 bp, Mus musculus
gtgtctttcatttgctttccagtag

SEQ ID NO: 717020 - DNA, 25 bp, Mus musculus
gtgtctttccacctgaaatcagcta

SEQ ID NO: 717021 - DNA, 25 bp, Mus musculus
gtgtctttccacgtgaaatcagcta

SEQ ID NO: 717022 - DNA, 25 bp, Mus musculus
gtgtctttccgaaggtgagaccgac

SEQ ID NO: 717023 - DNA, 25 bp, Mus musculus
gtgtctttccgatggtgagaccgac

SEQ ID NO: 717024 - DNA, 25 bp, Mus musculus
gtgtctttcctaaacttaatcccat

SEQ ID NO: 717025 - DNA, 25 bp, Mus musculus
gtgtctttcctaacagggctcagtt

SEQ ID NO: 717026 - DNA, 25 bp, Mus musculus
gtgtctttcctatacttaatcccat

SEQ ID NO: 717027 - DNA, 25 bp, Mus musculus
gtgtctttcctatcagggctcagtt

SEQ ID NO: 717028 - DNA, 25 bp, Mus musculus
gtgtctttctacagatagttctcca

SEQ ID NO: 717029 - DNA, 25 bp, Mus musculus
gtgtctttctactgatagttctcca

SEQ ID NO: 717030 - DNA, 25 bp, Mus musculus
gtgtctttctagagtggctttgtat

SEQ ID NO: 717031 - DNA, 25 bp, Mus musculus
gtgtctttctagtgtggctttgtat

SEQ ID NO: 717032 - DNA, 25 bp, Mus musculus
gtgtctttctcacactgggagaagc

SEQ ID NO: 717033 - DNA, 25 bp, Mus musculus
gtgtctttctcagactgggagaagc

SEQ ID NO: 717034 - DNA, 25 bp, Mus musculus
gtgtctttgaaactcatatccatca

SEQ ID NO: 717035 - DNA, 25 bp, Mus musculus
gtgtctttgaaagtcatatccatca

SEQ ID NO: 717036 - DNA, 25 bp, Mus musculus
gtgtctttgaccactatggctcttt

SEQ ID NO: 717037 - DNA, 25 bp, Mus musculus
gtgtctttgacctctatggctcttt

SEQ ID NO: 717038 - DNA, 25 bp, Mus musculus
gtgtctttgacgagtgagaacgcat

SEQ ID NO: 717039 - DNA, 25 bp, Mus musculus
gtgtctttgacgtgtgagaacgcat

SEQ ID NO: 717040 - DNA, 25 bp, Mus musculus
gtgtctttgagaaccaacttccagc

SEQ ID NO: 717041 - DNA, 25 bp, Mus musculus
gtgtctttgagaacccattgtggtt

SEQ ID NO: 717042 - DNA, 25 bp, Mus musculus
gtgtctttgagatccaacttccagc

SEQ ID NO: 717043 - DNA, 25 bp, Mus musculus
gtgtctttgagatcccattgtggtt

SEQ ID NO: 717044 - DNA, 25 bp, Mus musculus
gtgtctttgagtacagcaactgtta

SEQ ID NO: 717045 - DNA, 25 bp, Mus musculus
gtgtctttgagttcagcaactgtta

SEQ ID NO: 717046 - DNA, 25 bp, Mus musculus
gtgtctttgggcaggtctcactaca

SEQ ID NO: 717047 - DNA, 25 bp, Mus musculus
gtgtctttgggctggtctcactaca

SEQ ID NO: 717048 - DNA, 25 bp, Mus musculus
gtgtctttgtaccttattggctggc

SEQ ID NO: 717049 - DNA, 25 bp, Mus musculus
gtgtctttgtacgttattggctggc

SEQ ID NO: 717050 - DNA, 25 bp, Mus musculus
gtgtctttgtcaacgggcggccact

SEQ ID NO: 717051 - DNA, 25 bp, Mus musculus
gtgtctttgtcatcgggcggccact

SEQ ID NO: 717052 - DNA, 25 bp, Mus musculus
gtgtctttgtggatagctctcgttc

SEQ ID NO: 717053 - DNA, 25 bp, Mus musculus
gtgtctttgtggttagctctcgttc

SEQ ID NO: 717054 - DNA, 25 bp, Mus musculus
gtgtctttgttgcagaaggtatttc

SEQ ID NO: 717055 - DNA, 25 bp, Mus musculus
gtgtctttgttggagaaggtatttc

SEQ ID NO: 717056 - DNA, 25 bp, Mus musculus
gtgtctttgtttcgcactgtgtaaa

SEQ ID NO: 717057 - DNA, 25 bp, Mus musculus
gtgtctttgtttggcactgtgtaaa

SEQ ID NO: 717058 - DNA, 25 bp, Mus musculus
gtgtcttttaacaactatggcatga

SEQ ID NO: 717059 - DNA, 25 bp, Mus musculus
gtgtcttttaactactatggcatga

SEQ ID NO: 717060 - DNA, 25 bp, Mus musculus
gtgtcttttatgagggctagctgaa

SEQ ID NO: 717061 - DNA, 25 bp, Mus musculus
gtgtcttttatgtgggctagctgaa

SEQ ID NO: 717062 - DNA, 25 bp, Mus musculus
gtgtcttttccaaatgtgctacctt

SEQ ID NO: 717063 - DNA, 25 bp, Mus musculus
gtgtcttttccatatgtgctacctt

SEQ ID NO: 717064 - DNA, 25 bp, Mus musculus
gtgtcttttcgtatcccagttgagc

SEQ ID NO: 717065 - DNA, 25 bp, Mus musculus
gtgtcttttcgtttcccagttgagc

SEQ ID NO: 717066 - DNA, 25 bp, Mus musculus
gtgtcttttcttcaccagatacagt

SEQ ID NO: 717067 - DNA, 25 bp, Mus musculus
gtgtcttttcttgaccagatacagt

SEQ ID NO: 717068 - DNA, 25 bp, Mus musculus
gtgtcttttgcaagattctctggat

SEQ ID NO: 717069 - DNA, 25 bp, Mus musculus
gtgtcttttgcatgattctctggat

SEQ ID NO: 717070 - DNA, 25 bp, Mus musculus
gtgtcttttgctatgggttatggtc

SEQ ID NO: 717071 - DNA, 25 bp, Mus musculus
gtgtcttttgctttgggttatggtc

SEQ ID NO: 717072 - DNA, 25 bp, Mus musculus
gtgtcttttggacctaacttcagaa

SEQ ID NO: 717073 - DNA, 25 bp, Mus musculus
gtgtcttttggagctaacttcagaa

SEQ ID NO: 717074 - DNA, 25 bp, Mus musculus
gtgtctttttagaggctgtcatgcc

SEQ ID NO: 717075 - DNA, 25 bp, Mus musculus
gtgtctttttagtggctgtcatgcc

SEQ ID NO: 717076 - DNA, 25 bp, Mus musculus
gtgtctttttatctcagtgcagttc

SEQ ID NO: 717077 - DNA, 25 bp, Mus musculus
gtgtctttttatgtcagtgcagttc

SEQ ID NO: 717078 - DNA, 25 bp, Mus musculus
gtgtgaaaacacatcagaattgaat

SEQ ID NO: 717079 - DNA, 25 bp, Mus musculus
gtgtgaaaacacttcagaattgaat

SEQ ID NO: 717080 - DNA, 25 bp, Mus musculus
gtgtgaaaattaattcttcccattt

SEQ ID NO: 717081 - DNA, 25 bp, Mus musculus
gtgtgaaaattatttcttcccattt

SEQ ID NO: 717082 - DNA, 25 bp, Mus musculus
gtgtgaaaattcagctatattagct

SEQ ID NO: 717083 - DNA, 25 bp, Mus musculus
gtgtgaaaattctgctatattagct

SEQ ID NO: 717084 - DNA, 25 bp, Mus musculus
gtgtgaaaatttacccttactgaag

SEQ ID NO: 717085 - DNA, 25 bp, Mus musculus
gtgtgaaaattttcccttactgaag

SEQ ID NO: 717086 - DNA, 25 bp, Mus musculus
gtgtgaaacatgactcccttcatct

SEQ ID NO: 717087 - DNA, 25 bp, Mus musculus
gtgtgaaacatgtctcccttcatct

SEQ ID NO: 717088 - DNA, 25 bp, Mus musculus
gtgtgaaacctaattctttagccat

SEQ ID NO: 717089 - DNA, 25 bp, Mus musculus
gtgtgaaacctatttctttagccat

SEQ ID NO: 717090 - DNA, 25 bp, Mus musculus
gtgtgaaacctcattagctgcaaaa

SEQ ID NO: 717091 - DNA, 25 bp, Mus musculus
gtgtgaaacctctttagctgcaaaa

SEQ ID NO: 717092 - DNA, 25 bp, Mus musculus
gtgtgaaactgcaccagagagtgga

SEQ ID NO: 717093 - DNA, 25 bp, Mus musculus
gtgtgaaactgctccagagagtgga

SEQ ID NO: 717094 - DNA, 25 bp, Mus musculus
gtgtgaaagcttccttcaagattga

SEQ ID NO: 717095 - DNA, 25 bp, Mus musculus
gtgtgaaagcttgcttcaagattga

SEQ ID NO: 717096 - DNA, 25 bp, Mus musculus
gtgtgaaaggctcggatccactcct

SEQ ID NO: 717097 - DNA, 25 bp, Mus musculus
gtgtgaaaggctgggatccactcct

SEQ ID NO: 717098 - DNA, 25 bp, Mus musculus
gtgtgaaatcacacataggcctaga

SEQ ID NO: 717099 - DNA, 25 bp, Mus musculus
gtgtgaaatcactcataggcctaga

SEQ ID NO: 717100 - DNA, 25 bp, Mus musculus
gtgtgaaatcctatgcttttaagct

SEQ ID NO: 717101 - DNA, 25 bp, Mus musculus
gtgtgaaatcctctgctctctcaag

SEQ ID NO: 717102 - DNA, 25 bp, Mus musculus
gtgtgaaatcctgtgctctctcaag

SEQ ID NO: 717103 - DNA, 25 bp, Mus musculus
gtgtgaaatcctttgcttttaagct

SEQ ID NO: 717104 - DNA, 25 bp, Mus musculus
gtgtgaacaatcatctgttccccat

SEQ ID NO: 717105 - DNA, 25 bp, Mus musculus
gtgtgaacaatcttctgttccccat

SEQ ID NO: 717106 - DNA, 25 bp, Mus musculus
gtgtgaacacaaacaacctgccaag

SEQ ID NO: 717107 - DNA, 25 bp, Mus musculus
gtgtgaacacaatcaacctgccaag

SEQ ID NO: 717108 - DNA, 25 bp, Mus musculus
gtgtgaacactaacaggctgatgat

SEQ ID NO: 717109 - DNA, 25 bp, Mus musculus
gtgtgaacactatcaggctgatgat

SEQ ID NO: 717110 - DNA, 25 bp, Mus musculus
gtgtgaacactccatcaatatgcag

SEQ ID NO: 717111 - DNA, 25 bp, Mus musculus
gtgtgaacactcgatcaatatgcag

SEQ ID NO: 717112 - DNA, 25 bp, Mus musculus
gtgtgaacacttctgactacgacag

SEQ ID NO: 717113 - DNA, 25 bp, Mus musculus
gtgtgaacacttgtgactacgacag

SEQ ID NO: 717114 - DNA, 25 bp, Mus musculus
gtgtgaacatatccctattgtgtgc

SEQ ID NO: 717115 - DNA, 25 bp, Mus musculus
gtgtgaacatatgcctattgtgtgc

SEQ ID NO: 717116 - DNA, 25 bp, Mus musculus
gtgtgaacatcgaccctctgactgg

SEQ ID NO: 717117 - DNA, 25 bp, Mus musculus
gtgtgaacatcgtccctctgactgg

SEQ ID NO: 717118 - DNA, 25 bp, Mus musculus
gtgtgaacatgaacatgctgctgtg

SEQ ID NO: 717119 - DNA, 25 bp, Mus musculus
gtgtgaacatgatcatgctgctgtg

SEQ ID NO: 717120 - DNA, 25 bp, Mus musculus
gtgtgaaccacaccattgggcatag

SEQ ID NO: 717121 - DNA, 25 bp, Mus musculus
gtgtgaaccacacccagacctggag

SEQ ID NO: 717122 - DNA, 25 bp, Mus musculus
gtgtgaaccacagcattgggcatag

SEQ ID NO: 717123 - DNA, 25 bp, Mus musculus
gtgtgaaccacagccagacctggag

SEQ ID NO: 717124 - DNA, 25 bp, Mus musculus
gtgtgaaccaggcatactgcatctt

SEQ ID NO: 717125 - DNA, 25 bp, Mus musculus
gtgtgaaccagggatactgcatctt

SEQ ID NO: 717126 - DNA, 25 bp, Mus musculus
gtgtgaaccatgatacctagcttgt

SEQ ID NO: 717127 - DNA, 25 bp, Mus musculus
gtgtgaaccatgttacctagcttgt

SEQ ID NO: 717128 - DNA, 25 bp, Mus musculus
gtgtgaacccatcctgttatatgta

SEQ ID NO: 717129 - DNA, 25 bp, Mus musculus
gtgtgaacccatgctgttatatgta

SEQ ID NO: 717130 - DNA, 25 bp, Mus musculus
gtgtgaacccgtcaagaactttctt

SEQ ID NO: 717131 - DNA, 25 bp, Mus musculus
gtgtgaacccgtgaagaactttctt

SEQ ID NO: 717132 - DNA, 25 bp, Mus musculus
gtgtgaacctcgctgccaaggagac

SEQ ID NO: 717133 - DNA, 25 bp, Mus musculus
gtgtgaacctcggtgccaaggagac

SEQ ID NO: 717134 - DNA, 25 bp, Mus musculus
gtgtgaacgtatccactctggtgcc

SEQ ID NO: 717135 - DNA, 25 bp, Mus musculus
gtgtgaacgtatgcactctggtgcc

SEQ ID NO: 717136 - DNA, 25 bp, Mus musculus
gtgtgaacgttactgcatggccaaa

SEQ ID NO: 717137 - DNA, 25 bp, Mus musculus
gtgtgaacgttagtgcatggccaaa

SEQ ID NO: 717138 - DNA, 25 bp, Mus musculus
gtgtgaactataaatggcatggata

SEQ ID NO: 717139 - DNA, 25 bp, Mus musculus
gtgtgaactatatatggcatggata

SEQ ID NO: 717140 - DNA, 25 bp, Mus musculus
gtgtgaactctaacttctttcctga

SEQ ID NO: 717141 - DNA, 25 bp, Mus musculus
gtgtgaactctatcttctttcctga

SEQ ID NO: 717142 - DNA, 25 bp, Mus musculus
gtgtgaactgcactgatgctccaaa

SEQ ID NO: 717143 - DNA, 25 bp, Mus musculus
gtgtgaactgcagtgatgctccaaa

SEQ ID NO: 717144 - DNA, 25 bp, Mus musculus
gtgtgaactgtcaatcataaggtag

SEQ ID NO: 717145 - DNA, 25 bp, Mus musculus
gtgtgaactgtctatcataaggtag

SEQ ID NO: 717146 - DNA, 25 bp, Mus musculus
gtgtgaacttccacgagacagtatt

SEQ ID NO: 717147 - DNA, 25 bp, Mus musculus
gtgtgaacttcctcgagacagtatt

SEQ ID NO: 717148 - DNA, 25 bp, Mus musculus
gtgtgaagaacaccagccgcatcta

SEQ ID NO: 717149 - DNA, 25 bp, Mus musculus
gtgtgaagaacagcagccgcatcta

SEQ ID NO: 717150 - DNA, 25 bp, Mus musculus
gtgtgaagacctaggagcagccctc

SEQ ID NO: 717151 - DNA, 25 bp, Mus musculus
gtgtgaagaccttggagcagccctc

SEQ ID NO: 717152 - DNA, 25 bp, Mus musculus
gtgtgaagactactgagagcctcca

SEQ ID NO: 717153 - DNA, 25 bp, Mus musculus
gtgtgaagactagtgagagcctcca

SEQ ID NO: 717154 - DNA, 25 bp, Mus musculus
gtgtgaagcaacatcccgaacagta

SEQ ID NO: 717155 - DNA, 25 bp, Mus musculus
gtgtgaagcaacttcccgaacagta

SEQ ID NO: 717156 - DNA, 25 bp, Mus musculus
gtgtgaagcagccatgtatccccac

SEQ ID NO: 717157 - DNA, 25 bp, Mus musculus
gtgtgaagcagcgatgtatccccac

SEQ ID NO: 717158 - DNA, 25 bp, Mus musculus
gtgtgaagcctacgatcacttccgt

SEQ ID NO: 717159 - DNA, 25 bp, Mus musculus
gtgtgaagcctaggatcacttccgt

SEQ ID NO: 717160 - DNA, 25 bp, Mus musculus
gtgtgaagctctcttgagtgtcctc

SEQ ID NO: 717161 - DNA, 25 bp, Mus musculus
gtgtgaagctctgttgagtgtcctc

SEQ ID NO: 717162 - DNA, 25 bp, Mus musculus
gtgtgaagtgacattatactgtcat

SEQ ID NO: 717163 - DNA, 25 bp, Mus musculus
gtgtgaagtgactttatactgtcat

SEQ ID NO: 717164 - DNA, 25 bp, Mus musculus
gtgtgaagtgagcatctttcattat

SEQ ID NO: 717165 - DNA, 25 bp, Mus musculus
gtgtgaagtgaggatctttcattat

SEQ ID NO: 717166 - DNA, 25 bp, Mus musculus
gtgtgaagtggcatgatttccctcc

SEQ ID NO: 717167 - DNA, 25 bp, Mus musculus
gtgtgaagtggcttgatttccctcc

SEQ ID NO: 717168 - DNA, 25 bp, Mus musculus
gtgtgaagttcacagttctggaaaa

SEQ ID NO: 717169 - DNA, 25 bp, Mus musculus
gtgtgaagttcagagttctggaaaa

SEQ ID NO: 717170 - DNA, 25 bp, Mus musculus
gtgtgaagttccaaacatctttaac

SEQ ID NO: 717171 - DNA, 25 bp, Mus musculus
gtgtgaagttcctaacatctttaac

SEQ ID NO: 717172 - DNA, 25 bp, Mus musculus
gtgtgaataaagagactcttcctaa

SEQ ID NO: 717173 - DNA, 25 bp, Mus musculus
gtgtgaataaagtgactcttcctaa

SEQ ID NO: 717174 - DNA, 25 bp, Mus musculus
gtgtgaataaccagtgtgaatcatt

SEQ ID NO: 717175 - DNA, 25 bp, Mus musculus
gtgtgaataacctgtgtgaatcatt

SEQ ID NO: 717176 - DNA, 25 bp, Mus musculus
gtgtgaataacgcttgacttcaggg

SEQ ID NO: 717177 - DNA, 25 bp, Mus musculus
gtgtgaataacggttgacttcaggg

SEQ ID NO: 717178 - DNA, 25 bp, Mus musculus
gtgtgaatattaccaccgcctgaag

SEQ ID NO: 717179 - DNA, 25 bp, Mus musculus
gtgtgaatattagcaccgcctgaag

SEQ ID NO: 717180 - DNA, 25 bp, Mus musculus
gtgtgaatcactagagtctcgggac

SEQ ID NO: 717181 - DNA, 25 bp, Mus musculus
gtgtgaatcacttgagtctcgggac

SEQ ID NO: 717182 - DNA, 25 bp, Mus musculus
gtgtgaatccccattccaggagatt

SEQ ID NO: 717183 - DNA, 25 bp, Mus musculus
gtgtgaatcccctttccaggagatt

SEQ ID NO: 717184 - DNA, 25 bp, Mus musculus
gtgtgaatctctactggtgactata

SEQ ID NO: 717185 - DNA, 25 bp, Mus musculus
gtgtgaatctcttctggtgactata

SEQ ID NO: 717186 - DNA, 25 bp, Mus musculus
gtgtgaatgagtctgcttcctggca

SEQ ID NO: 717187 - DNA, 25 bp, Mus musculus
gtgtgaatgagtgtgcttcctggca

SEQ ID NO: 717188 - DNA, 25 bp, Mus musculus
gtgtgaatgatccaagcagccccag

SEQ ID NO: 717189 - DNA, 25 bp, Mus musculus
gtgtgaatgatcgaagcagccccag

SEQ ID NO: 717190 - DNA, 25 bp, Mus musculus
gtgtgaatgatgattctatcctagt

SEQ ID NO: 717191 - DNA, 25 bp, Mus musculus
gtgtgaatgatgtttctatcctagt

SEQ ID NO: 717192 - DNA, 25 bp, Mus musculus
gtgtgaatggtgaagatccttgatt

SEQ ID NO: 717193 - DNA, 25 bp, Mus musculus
gtgtgaatggtgaccagacctccca

SEQ ID NO: 717194 - DNA, 25 bp, Mus musculus
gtgtgaatggtgtagatccttgatt

SEQ ID NO: 717195 - DNA, 25 bp, Mus musculus
gtgtgaatggtgtccagacctccca

SEQ ID NO: 717196 - DNA, 25 bp, Mus musculus
gtgtgaattcaacccctggacatgg

SEQ ID NO: 717197 - DNA, 25 bp, Mus musculus
gtgtgaattcaagccctggacatgg

SEQ ID NO: 717198 - DNA, 25 bp, Mus musculus
gtgtgaatttccacagcgctgttgg

SEQ ID NO: 717199 - DNA, 25 bp, Mus musculus
gtgtgaatttcctcagcgctgttgg

SEQ ID NO: 717200 - DNA, 25 bp, Mus musculus
gtgtgaatttgaagaatgtaagacc

SEQ ID NO: 717201 - DNA, 25 bp, Mus musculus
gtgtgaatttgatgaatgtaagacc

SEQ ID NO: 717202 - DNA, 25 bp, Mus musculus
gtgtgaatttgcagacgtgtttttt

SEQ ID NO: 717203 - DNA, 25 bp, Mus musculus
gtgtgaatttgctgacgtgtttttt

SEQ ID NO: 717204 - DNA, 25 bp, Mus musculus
gtgtgacaaagcaacattactgaat

SEQ ID NO: 717205 - DNA, 25 bp, Mus musculus
gtgtgacaaagctacattactgaat

SEQ ID NO: 717206 - DNA, 25 bp, Mus musculus
gtgtgacaacaaagcttatggactt

SEQ ID NO: 717207 - DNA, 25 bp, Mus musculus
gtgtgacaacaatgcttatggactt

SEQ ID NO: 717208 - DNA, 25 bp, Mus musculus
gtgtgacaacctagcttatggagtt

SEQ ID NO: 717209 - DNA, 25 bp, Mus musculus
gtgtgacaaccttgcttatggagtt

SEQ ID NO: 717210 - DNA, 25 bp, Mus musculus
gtgtgacaagccagtttcttaaccc

SEQ ID NO: 717211 - DNA, 25 bp, Mus musculus
gtgtgacaagcctgtttcttaaccc

SEQ ID NO: 717212 - DNA, 25 bp, Mus musculus
gtgtgacaatgaccttcctatggac

SEQ ID NO: 717213 - DNA, 25 bp, Mus musculus
gtgtgacaatgagcttcctatggac

SEQ ID NO: 717214 - DNA, 25 bp, Mus musculus
gtgtgacaatttctttggagaccct

SEQ ID NO: 717215 - DNA, 25 bp, Mus musculus
gtgtgacaatttgtttggagaccct

SEQ ID NO: 717216 - DNA, 25 bp, Mus musculus
gtgtgacacacaccccaactaggaa

SEQ ID NO: 717217 - DNA, 25 bp, Mus musculus
gtgtgacacacagcccaactaggaa

SEQ ID NO: 717218 - DNA, 25 bp, Mus musculus
gtgtgacacattaccactgttaaca

SEQ ID NO: 717219 - DNA, 25 bp, Mus musculus
gtgtgacacatttccactgttaaca

SEQ ID NO: 717220 - DNA, 25 bp, Mus musculus
gtgtgacaccctagtaagagagcta

SEQ ID NO: 717221 - DNA, 25 bp, Mus musculus
gtgtgacacccttgtaagagagcta

SEQ ID NO: 717222 - DNA, 25 bp, Mus musculus
gtgtgacaccttatctaggaagcaa

SEQ ID NO: 717223 - DNA, 25 bp, Mus musculus
gtgtgacaccttttctaggaagcaa

SEQ ID NO: 717224 - DNA, 25 bp, Mus musculus
gtgtgacactgtatggtccagcacc

SEQ ID NO: 717225 - DNA, 25 bp, Mus musculus
gtgtgacactgtttggtccagcacc

SEQ ID NO: 717226 - DNA, 25 bp, Mus musculus
gtgtgacacttgagtccccagcaga

SEQ ID NO: 717227 - DNA, 25 bp, Mus musculus
gtgtgacacttgtgtccccagcaga

SEQ ID NO: 717228 - DNA, 25 bp, Mus musculus
gtgtgacagggccaccatcaggcac

SEQ ID NO: 717229 - DNA, 25 bp, Mus musculus
gtgtgacagggcgaccatcaggcac

SEQ ID NO: 717230 - DNA, 25 bp, Mus musculus
gtgtgacagtccaattttcaaggtg

SEQ ID NO: 717231 - DNA, 25 bp, Mus musculus
gtgtgacagtcctattttcaaggtg

SEQ ID NO: 717232 - DNA, 25 bp, Mus musculus
gtgtgacagtgaacacctcattcct

SEQ ID NO: 717233 - DNA, 25 bp, Mus musculus
gtgtgacagtgatcacctcattcct

SEQ ID NO: 717234 - DNA, 25 bp, Mus musculus
gtgtgacagtgtatccagttatgca

SEQ ID NO: 717235 - DNA, 25 bp, Mus musculus
gtgtgacagtgtttccagttatgca

SEQ ID NO: 717236 - DNA, 25 bp, Mus musculus
gtgtgacagtttctccagagtccct

SEQ ID NO: 717237 - DNA, 25 bp, Mus musculus
gtgtgacagtttgtccagagtccct

SEQ ID NO: 717238 - DNA, 25 bp, Mus musculus
gtgtgacatatgagaccaggcattt

SEQ ID NO: 717239 - DNA, 25 bp, Mus musculus
gtgtgacatatgtgaccaggcattt

SEQ ID NO: 717240 - DNA, 25 bp, Mus musculus
gtgtgacatcgaaatccgcaaagac

SEQ ID NO: 717241 - DNA, 25 bp, Mus musculus
gtgtgacatcgatatccgcaaagac

SEQ ID NO: 717242 - DNA, 25 bp, Mus musculus
gtgtgacatctaaggaaactcaggt

SEQ ID NO: 717243 - DNA, 25 bp, Mus musculus
gtgtgacatctatggaaactcaggt

SEQ ID NO: 717244 - DNA, 25 bp, Mus musculus
gtgtgacatctgcaccgtcgtgaga

SEQ ID NO: 717245 - DNA, 25 bp, Mus musculus
gtgtgacatctgcatcatctagtat

SEQ ID NO: 717246 - DNA, 25 bp, Mus musculus
gtgtgacatctggaccgtcgtgaga

SEQ ID NO: 717247 - DNA, 25 bp, Mus musculus
gtgtgacatctggatcatctagtat

SEQ ID NO: 717248 - DNA, 25 bp, Mus musculus
gtgtgacatgacagaaccctgcact

SEQ ID NO: 717249 - DNA, 25 bp, Mus musculus
gtgtgacatgactgaaccctgcact

SEQ ID NO: 717250 - DNA, 25 bp, Mus musculus
gtgtgacatgcacctatctttgggc

SEQ ID NO: 717251 - DNA, 25 bp, Mus musculus
gtgtgacatgcagctatctttgggc

SEQ ID NO: 717252 - DNA, 25 bp, Mus musculus
gtgtgacattgaagccccattgctg

SEQ ID NO: 717253 - DNA, 25 bp, Mus musculus
gtgtgacattgatgccccattgctg

SEQ ID NO: 717254 - DNA, 25 bp, Mus musculus
gtgtgacatttgacctgcacgagga

SEQ ID NO: 717255 - DNA, 25 bp, Mus musculus
gtgtgacatttgtcctgcacgagga

SEQ ID NO: 717256 - DNA, 25 bp, Mus musculus
gtgtgaccaagaaccagcttcaagg

SEQ ID NO: 717257 - DNA, 25 bp, Mus musculus
gtgtgaccaagatccagcttcaagg

SEQ ID NO: 717258 - DNA, 25 bp, Mus musculus
gtgtgaccaccaccagacaggaaga

SEQ ID NO: 717259 - DNA, 25 bp, Mus musculus
gtgtgaccaccagcagacaggaaga

SEQ ID NO: 717260 - DNA, 25 bp, Mus musculus
gtgtgaccacgaagatagactgcaa

SEQ ID NO: 717261 - DNA, 25 bp, Mus musculus
gtgtgaccacgatgatagactgcaa

SEQ ID NO: 717262 - DNA, 25 bp, Mus musculus
gtgtgaccagccagatgaccggcca

SEQ ID NO: 717263 - DNA, 25 bp, Mus musculus
gtgtgaccagcctgatgaccggcca

SEQ ID NO: 717264 - DNA, 25 bp, Mus musculus
gtgtgaccagtacccaaacacgtgg

SEQ ID NO: 717265 - DNA, 25 bp, Mus musculus
gtgtgaccagtagccaaacacgtgg

SEQ ID NO: 717266 - DNA, 25 bp, Mus musculus
gtgtgaccagtcctacatatgatac

SEQ ID NO: 717267 - DNA, 25 bp, Mus musculus
gtgtgaccagtcgtacatatgatac

SEQ ID NO: 717268 - DNA, 25 bp, Mus musculus
gtgtgaccatcaatcttactgcaag

SEQ ID NO: 717269 - DNA, 25 bp, Mus musculus
gtgtgaccatcattcttactgcaag

SEQ ID NO: 717270 - DNA, 25 bp, Mus musculus
gtgtgacccacgaacaaaccccatg

SEQ ID NO: 717271 - DNA, 25 bp, Mus musculus
gtgtgacccacgtacaaaccccatg

SEQ ID NO: 717272 - DNA, 25 bp, Mus musculus
gtgtgacccaggatgctgtatcaga

SEQ ID NO: 717273 - DNA, 25 bp, Mus musculus
gtgtgacccaggctgtgtccaatct

SEQ ID NO: 717274 - DNA, 25 bp, Mus musculus
gtgtgacccagggtgtgtccaatct

SEQ ID NO: 717275 - DNA, 25 bp, Mus musculus
gtgtgacccaggttgctgtatcaga

SEQ ID NO: 717276 - DNA, 25 bp, Mus musculus
gtgtgacccatgaccaccatagctg

SEQ ID NO: 717277 - DNA, 25 bp, Mus musculus
gtgtgacccatgcttattaccgaga

SEQ ID NO: 717278 - DNA, 25 bp, Mus musculus
gtgtgacccatggttattaccgaga

SEQ ID NO: 717279 - DNA, 25 bp, Mus musculus
gtgtgacccatgtccaccatagctg

SEQ ID NO: 717280 - DNA, 25 bp, Mus musculus
gtgtgaccccaaccactatcaacag

SEQ ID NO: 717281 - DNA, 25 bp, Mus musculus
gtgtgaccccaagcactatcaacag

SEQ ID NO: 717282 - DNA, 25 bp, Mus musculus
gtgtgaccccaccacaattaacagc

SEQ ID NO: 717283 - DNA, 25 bp, Mus musculus
gtgtgaccccacgacaattaacagc

SEQ ID NO: 717284 - DNA, 25 bp, Mus musculus
gtgtgaccccgtcggaaggcaacac

SEQ ID NO: 717285 - DNA, 25 bp, Mus musculus
gtgtgaccccgtgggaaggcaacac

SEQ ID NO: 717286 - DNA, 25 bp, Mus musculus
gtgtgaccggcaaccataactgttc

SEQ ID NO: 717287 - DNA, 25 bp, Mus musculus
gtgtgaccggcatccataactgttc

SEQ ID NO: 717288 - DNA, 25 bp, Mus musculus
gtgtgacctcacctttgacttttat

SEQ ID NO: 717289 - DNA, 25 bp, Mus musculus
gtgtgacctcacgtttgacttttat

SEQ ID NO: 717290 - DNA, 25 bp, Mus musculus
gtgtgacctctgagatccctaagaa

SEQ ID NO: 717291 - DNA, 25 bp, Mus musculus
gtgtgacctctgtgatccctaagaa

SEQ ID NO: 717292 - DNA, 25 bp, Mus musculus
gtgtgacctggccagatgagcatcc

SEQ ID NO: 717293 - DNA, 25 bp, Mus musculus
gtgtgacctggcgagatgagcatcc

SEQ ID NO: 717294 - DNA, 25 bp, Mus musculus
gtgtgacctgtgcactacgagttta

SEQ ID NO: 717295 - DNA, 25 bp, Mus musculus
gtgtgacctgtggactacgagttta

SEQ ID NO: 717296 - DNA, 25 bp, Mus musculus
gtgtgacctgttcctgtacaaaaga

SEQ ID NO: 717297 - DNA, 25 bp, Mus musculus
gtgtgacctgttgctgtacaaaaga

SEQ ID NO: 717298 - DNA, 25 bp, Mus musculus
gtgtgaccttccaacatatgtaaaa

SEQ ID NO: 717299 - DNA, 25 bp, Mus musculus
gtgtgaccttcctacatatgtaaaa

SEQ ID NO: 717300 - DNA, 25 bp, Mus musculus
gtgtgaccttgtatgagagtggtac

SEQ ID NO: 717301 - DNA, 25 bp, Mus musculus
gtgtgaccttgtttgagagtggtac

SEQ ID NO: 717302 - DNA, 25 bp, Mus musculus
gtgtgacgctatagatgtctccatt

SEQ ID NO: 717303 - DNA, 25 bp, Mus musculus
gtgtgacgctattgatgtctccatt

SEQ ID NO: 717304 - DNA, 25 bp, Mus musculus
gtgtgacgctgcagcacatgtgtgc

SEQ ID NO: 717305 - DNA, 25 bp, Mus musculus
gtgtgacgctgctgcacatgtgtgc

SEQ ID NO: 717306 - DNA, 25 bp, Mus musculus
gtgtgacggtgtcgcttcctcacct

SEQ ID NO: 717307 - DNA, 25 bp, Mus musculus
gtgtgacggtgtggcttcctcacct

SEQ ID NO: 717308 - DNA, 25 bp, Mus musculus
gtgtgacgtacacaccagggcgaca

SEQ ID NO: 717309 - DNA, 25 bp, Mus musculus
gtgtgacgtacagaccagggcgaca

SEQ ID NO: 717310 - DNA, 25 bp, Mus musculus
gtgtgacgtcaaaggctttagcttt

SEQ ID NO: 717311 - DNA, 25 bp, Mus musculus
gtgtgacgtcaatggctttagcttt

SEQ ID NO: 717312 - DNA, 25 bp, Mus musculus
gtgtgacgtcatattccgtataaat

SEQ ID NO: 717313 - DNA, 25 bp, Mus musculus
gtgtgacgtcattttccgtataaat

SEQ ID NO: 717314 - DNA, 25 bp, Mus musculus
gtgtgactacatattgctctcatcc

SEQ ID NO: 717315 - DNA, 25 bp, Mus musculus
gtgtgactacattttgctctcatcc

SEQ ID NO: 717316 - DNA, 25 bp, Mus musculus
gtgtgactatccagtaagactccct

SEQ ID NO: 717317 - DNA, 25 bp, Mus musculus
gtgtgactatcctgtaagactccct

SEQ ID NO: 717318 - DNA, 25 bp, Mus musculus
gtgtgactattgaacttgaaacctt

SEQ ID NO: 717319 - DNA, 25 bp, Mus musculus
gtgtgactattgtacttgaaacctt

SEQ ID NO: 717320 - DNA, 25 bp, Mus musculus
gtgtgactcacaagtgggcaaactt

SEQ ID NO: 717321 - DNA, 25 bp, Mus musculus
gtgtgactcacatgtgggcaaactt

SEQ ID NO: 717322 - DNA, 25 bp, Mus musculus
gtgtgactcagtaaagtgaattttt

SEQ ID NO: 717323 - DNA, 25 bp, Mus musculus
gtgtgactcagttaagtgaattttt

SEQ ID NO: 717324 - DNA, 25 bp, Mus musculus
gtgtgactccacaactgaacagtgt

SEQ ID NO: 717325 - DNA, 25 bp, Mus musculus
gtgtgactccactactgaacagtgt

SEQ ID NO: 717326 - DNA, 25 bp, Mus musculus
gtgtgactccgtaatctactctaac

SEQ ID NO: 717327 - DNA, 25 bp, Mus musculus
gtgtgactccgttatctactctaac

SEQ ID NO: 717328 - DNA, 25 bp, Mus musculus
gtgtgactctcaactgtgggagctg

SEQ ID NO: 717329 - DNA, 25 bp, Mus musculus
gtgtgactctcatctgtgggagctg

SEQ ID NO: 717330 - DNA, 25 bp, Mus musculus
gtgtgactcttcaaaactcatccac

SEQ ID NO: 717331 - DNA, 25 bp, Mus musculus
gtgtgactcttcaacatcaagtttt

SEQ ID NO: 717332 - DNA, 25 bp, Mus musculus
gtgtgactcttctaaactcatccac

SEQ ID NO: 717333 - DNA, 25 bp, Mus musculus
gtgtgactcttctacatcaagtttt

SEQ ID NO: 717334 - DNA, 25 bp, Mus musculus
gtgtgactcttgactcgtgtgtgcc

SEQ ID NO: 717335 - DNA, 25 bp, Mus musculus
gtgtgactcttgtctcgtgtgtgcc

SEQ ID NO: 717336 - DNA, 25 bp, Mus musculus
gtgtgactgataattcccatcttgt

SEQ ID NO: 717337 - DNA, 25 bp, Mus musculus
gtgtgactgatatttcccatcttgt

SEQ ID NO: 717338 - DNA, 25 bp, Mus musculus
gtgtgactgcatcatgaccctggaa

SEQ ID NO: 717339 - DNA, 25 bp, Mus musculus
gtgtgactgcatgatgaccctggaa

SEQ ID NO: 717340 - DNA, 25 bp, Mus musculus
gtgtgactggttccctcagaggtca

SEQ ID NO: 717341 - DNA, 25 bp, Mus musculus
gtgtgactggttgcctcagaggtca

SEQ ID NO: 717342 - DNA, 25 bp, Mus musculus
gtgtgactgtcaccactgggcagta

SEQ ID NO: 717343 - DNA, 25 bp, Mus musculus
gtgtgactgtcagcactgggcagta

SEQ ID NO: 717344 - DNA, 25 bp, Mus musculus
gtgtgacttcagaagtgcccagaga

SEQ ID NO: 717345 - DNA, 25 bp, Mus musculus
gtgtgacttcagatgatcctgctgc

SEQ ID NO: 717346 - DNA, 25 bp, Mus musculus
gtgtgacttcagtagtgcccagaga

SEQ ID NO: 717347 - DNA, 25 bp, Mus musculus
gtgtgacttcagttgatcctgctgc

SEQ ID NO: 717348 - DNA, 25 bp, Mus musculus
gtgtgacttcataagatacgtttag

SEQ ID NO: 717349 - DNA, 25 bp, Mus musculus
gtgtgacttcattagatacgtttag

SEQ ID NO: 717350 - DNA, 25 bp, Mus musculus
gtgtgacttcctaagacttgcagta

SEQ ID NO: 717351 - DNA, 25 bp, Mus musculus
gtgtgacttccttagacttgcagta

SEQ ID NO: 717352 - DNA, 25 bp, Mus musculus
gtgtgacttcttatcatatactgtt

SEQ ID NO: 717353 - DNA, 25 bp, Mus musculus
gtgtgacttcttttcatatactgtt

SEQ ID NO: 717354 - DNA, 25 bp, Mus musculus
gtgtgacttgcccaggttggctttc

SEQ ID NO: 717355 - DNA, 25 bp, Mus musculus
gtgtgacttgccgaggttggctttc

SEQ ID NO: 717356 - DNA, 25 bp, Mus musculus
gtgtgacttggtactaattctgact

SEQ ID NO: 717357 - DNA, 25 bp, Mus musculus
gtgtgacttggttctaattctgact

SEQ ID NO: 717358 - DNA, 25 bp, Mus musculus
gtgtgacttgttatgatgccttgtt

SEQ ID NO: 717359 - DNA, 25 bp, Mus musculus
gtgtgacttgttttgatgccttgtt

SEQ ID NO: 717360 - DNA, 25 bp, Mus musculus
gtgtgactttacctggcatcttcca

SEQ ID NO: 717361 - DNA, 25 bp, Mus musculus
gtgtgactttacgtggcatcttcca

SEQ ID NO: 717362 - DNA, 25 bp, Mus musculus
gtgtgactttgtcgcatgacttggt

SEQ ID NO: 717363 - DNA, 25 bp, Mus musculus
gtgtgactttgtggcatgacttggt

SEQ ID NO: 717364 - DNA, 25 bp, Mus musculus
gtgtgacttttaacttggccatcta

SEQ ID NO: 717365 - DNA, 25 bp, Mus musculus
gtgtgacttttatcttggccatcta

SEQ ID NO: 717366 - DNA, 25 bp, Mus musculus
gtgtgactttttcactattcctttt

SEQ ID NO: 717367 - DNA, 25 bp, Mus musculus
gtgtgactttttgactattcctttt

SEQ ID NO: 717368 - DNA, 25 bp, Mus musculus
gtgtgagaacgcagacgctcgggca

SEQ ID NO: 717369 - DNA, 25 bp, Mus musculus
gtgtgagaacgctgacgctcgggca

SEQ ID NO: 717370 - DNA, 25 bp, Mus musculus
gtgtgagaactcagcccactttgct

SEQ ID NO: 717371 - DNA, 25 bp, Mus musculus
gtgtgagaactctgcccactttgct

SEQ ID NO: 717372 - DNA, 25 bp, Mus musculus
gtgtgagaacttagacctgtgcgtg

SEQ ID NO: 717373 - DNA, 25 bp, Mus musculus
gtgtgagaactttgacctgtgcgtg

SEQ ID NO: 717374 - DNA, 25 bp, Mus musculus
gtgtgagaagttatcaagtgtcatg

SEQ ID NO: 717375 - DNA, 25 bp, Mus musculus
gtgtgagaagttttcaagtgtcatg

SEQ ID NO: 717376 - DNA, 25 bp, Mus musculus
gtgtgagaatctaataccaaagttt

SEQ ID NO: 717377 - DNA, 25 bp, Mus musculus
gtgtgagaatcttataccaaagttt

SEQ ID NO: 717378 - DNA, 25 bp, Mus musculus
gtgtgagacaaaccaacattcccct

SEQ ID NO: 717379 - DNA, 25 bp, Mus musculus
gtgtgagacaaagcaacattcccct

SEQ ID NO: 717380 - DNA, 25 bp, Mus musculus
gtgtgagacaatcttaactgttgca

SEQ ID NO: 717381 - DNA, 25 bp, Mus musculus
gtgtgagacaatgttaactgttgca

SEQ ID NO: 717382 - DNA, 25 bp, Mus musculus
gtgtgagaccaacagacagatgcct

SEQ ID NO: 717383 - DNA, 25 bp, Mus musculus
gtgtgagaccaagagacagatgcct

SEQ ID NO: 717384 - DNA, 25 bp, Mus musculus
gtgtgagaccctccaggaccaaaat

SEQ ID NO: 717385 - DNA, 25 bp, Mus musculus
gtgtgagaccctgcaggaccaaaat

SEQ ID NO: 717386 - DNA, 25 bp, Mus musculus
gtgtgagagtgcattgtgtgaccct

SEQ ID NO: 717387 - DNA, 25 bp, Mus musculus
gtgtgagagtgctttgtgtgaccct

SEQ ID NO: 717388 - DNA, 25 bp, Mus musculus
gtgtgagatcttctccaaaatggtc

SEQ ID NO: 717389 - DNA, 25 bp, Mus musculus
gtgtgagatcttgtccaaaatggtc

SEQ ID NO: 717390 - DNA, 25 bp, Mus musculus
gtgtgagattgtcggtttaatcccc

SEQ ID NO: 717391 - DNA, 25 bp, Mus musculus
gtgtgagattgtgggtttaatcccc

SEQ ID NO: 717392 - DNA, 25 bp, Mus musculus
gtgtgagcaacccagagcctcagtg

SEQ ID NO: 717393 - DNA, 25 bp, Mus musculus
gtgtgagcaaccgagagcctcagtg

SEQ ID NO: 717394 - DNA, 25 bp, Mus musculus
gtgtgagcacacagggaacctgtcc

SEQ ID NO: 717395 - DNA, 25 bp, Mus musculus
gtgtgagcacactgggaacctgtcc

SEQ ID NO: 717396 - DNA, 25 bp, Mus musculus
gtgtgagcacctactaagtggccca

SEQ ID NO: 717397 - DNA, 25 bp, Mus musculus
gtgtgagcaccttctaagtggccca

SEQ ID NO: 717398 - DNA, 25 bp, Mus musculus
gtgtgagcagctaaaaatagtctaa

SEQ ID NO: 717399 - DNA, 25 bp, Mus musculus
gtgtgagcagcttaaaatagtctaa

SEQ ID NO: 717400 - DNA, 25 bp, Mus musculus
gtgtgagcattgacatccaggctgc

SEQ ID NO: 717401 - DNA, 25 bp, Mus musculus
gtgtgagcattgtcatccaggctgc

SEQ ID NO: 717402 - DNA, 25 bp, Mus musculus
gtgtgagccagtatcttgttagtca

SEQ ID NO: 717403 - DNA, 25 bp, Mus musculus
gtgtgagccagtttcttgttagtca

SEQ ID NO: 717404 - DNA, 25 bp, Mus musculus
gtgtgagcccagactgttttacata

SEQ ID NO: 717405 - DNA, 25 bp, Mus musculus
gtgtgagcccagtctgttttacata

SEQ ID NO: 717406 - DNA, 25 bp, Mus musculus
gtgtgagctactacttggaccactc

SEQ ID NO: 717407 - DNA, 25 bp, Mus musculus
gtgtgagctacttcttggaccactc

SEQ ID NO: 717408 - DNA, 25 bp, Mus musculus
gtgtgagctcagctgttgcctgtca

SEQ ID NO: 717409 - DNA, 25 bp, Mus musculus
gtgtgagctcaggtgttgcctgtca

SEQ ID NO: 717410 - DNA, 25 bp, Mus musculus
gtgtgagctctcagtaggaggcttc

SEQ ID NO: 717411 - DNA, 25 bp, Mus musculus
gtgtgagctctctgtaggaggcttc

SEQ ID NO: 717412 - DNA, 25 bp, Mus musculus
gtgtgaggacatacagtttctactg

SEQ ID NO: 717413 - DNA, 25 bp, Mus musculus
gtgtgaggacattcagtttctactg

SEQ ID NO: 717414 - DNA, 25 bp, Mus musculus
gtgtgaggaccaaagagcaggccca

SEQ ID NO: 717415 - DNA, 25 bp, Mus musculus
gtgtgaggaccatagagcaggccca

SEQ ID NO: 717416 - DNA, 25 bp, Mus musculus
gtgtgaggcacactccacgaagcat

SEQ ID NO: 717417 - DNA, 25 bp, Mus musculus
gtgtgaggcacagtccacgaagcat

SEQ ID NO: 717418 - DNA, 25 bp, Mus musculus
gtgtgaggcactcaacgcgacattt

SEQ ID NO: 717419 - DNA, 25 bp, Mus musculus
gtgtgaggcactgaacgcgacattt

SEQ ID NO: 717420 - DNA, 25 bp, Mus musculus
gtgtgaggcagtatcttacagatgt

SEQ ID NO: 717421 - DNA, 25 bp, Mus musculus
gtgtgaggcagtttcttacagatgt

SEQ ID NO: 717422 - DNA, 25 bp, Mus musculus
gtgtgaggcccaacgcatagagcag

SEQ ID NO: 717423 - DNA, 25 bp, Mus musculus
gtgtgaggcccatcgcatagagcag

SEQ ID NO: 717424 - DNA, 25 bp, Mus musculus
gtgtgaggcgtgagtgcccaatctt

SEQ ID NO: 717425 - DNA, 25 bp, Mus musculus
gtgtgaggcgtgtgtgcccaatctt

SEQ ID NO: 717426 - DNA, 25 bp, Mus musculus
gtgtgaggctcaagctgtgaaaaga

SEQ ID NO: 717427 - DNA, 25 bp, Mus musculus
gtgtgaggctcatgctgtgaaaaga

SEQ ID NO: 717428 - DNA, 25 bp, Mus musculus
gtgtgaggctctcaacggtcgccac

SEQ ID NO: 717429 - DNA, 25 bp, Mus musculus
gtgtgaggctctgaacggtcgccac

SEQ ID NO: 717430 - DNA, 25 bp, Mus musculus
gtgtgaggcttcagaactgtgacct

SEQ ID NO: 717431 - DNA, 25 bp, Mus musculus
gtgtgaggcttctgaactgtgacct

SEQ ID NO: 717432 - DNA, 25 bp, Mus musculus
gtgtgagggcctacacacttcactt

SEQ ID NO: 717433 - DNA, 25 bp, Mus musculus
gtgtgagggccttcacacttcactt

SEQ ID NO: 717434 - DNA, 25 bp, Mus musculus
gtgtgagggtacagtggactttcct

SEQ ID NO: 717435 - DNA, 25 bp, Mus musculus
gtgtgagggtactgtggactttcct

SEQ ID NO: 717436 - DNA, 25 bp, Mus musculus
gtgtgaggtggtacatccctaagaa

SEQ ID NO: 717437 - DNA, 25 bp, Mus musculus
gtgtgaggtggttcatccctaagaa

SEQ ID NO: 717438 - DNA, 25 bp, Mus musculus
gtgtgaggttacaatcacctccaaa

SEQ ID NO: 717439 - DNA, 25 bp, Mus musculus
gtgtgaggttactatcacctccaaa

SEQ ID NO: 717440 - DNA, 25 bp, Mus musculus
gtgtgagtacccctcttttgaaagg

SEQ ID NO: 717441 - DNA, 25 bp, Mus musculus
gtgtgagtacccgtcttttgaaagg

SEQ ID NO: 717442 - DNA, 25 bp, Mus musculus
gtgtgagtatcgagctctcccgttc

SEQ ID NO: 717443 - DNA, 25 bp, Mus musculus
gtgtgagtatcgtgctctcccgttc

SEQ ID NO: 717444 - DNA, 25 bp, Mus musculus
gtgtgagtcaacagcctgcatcttt

SEQ ID NO: 717445 - DNA, 25 bp, Mus musculus
gtgtgagtcaaccaagccagtgtcc

SEQ ID NO: 717446 - DNA, 25 bp, Mus musculus
gtgtgagtcaacgaagccagtgtcc

SEQ ID NO: 717447 - DNA, 25 bp, Mus musculus
gtgtgagtcaactgcctgcatcttt

SEQ ID NO: 717448 - DNA, 25 bp, Mus musculus
gtgtgagtcacaccaacagctacag

SEQ ID NO: 717449 - DNA, 25 bp, Mus musculus
gtgtgagtcacagcaacagctacag

SEQ ID NO: 717450 - DNA, 25 bp, Mus musculus
gtgtgagtccacattgtgatcgtca

SEQ ID NO: 717451 - DNA, 25 bp, Mus musculus
gtgtgagtccactttgtgatcgtca

SEQ ID NO: 717452 - DNA, 25 bp, Mus musculus
gtgtgagtctcacgcaaactcctca

SEQ ID NO: 717453 - DNA, 25 bp, Mus musculus
gtgtgagtctcaggcaaactcctca

SEQ ID NO: 717454 - DNA, 25 bp, Mus musculus
gtgtgagtctctatccctgtaaaaa

SEQ ID NO: 717455 - DNA, 25 bp, Mus musculus
gtgtgagtctctttccctgtaaaaa

SEQ ID NO: 717456 - DNA, 25 bp, Mus musculus
gtgtgagtgactatctttcaaggac

SEQ ID NO: 717457 - DNA, 25 bp, Mus musculus
gtgtgagtgactttctttcaaggac

SEQ ID NO: 717458 - DNA, 25 bp, Mus musculus
gtgtgagtgagtacagaccttgtct

SEQ ID NO: 717459 - DNA, 25 bp, Mus musculus
gtgtgagtgagttcagaccttgtct

SEQ ID NO: 717460 - DNA, 25 bp, Mus musculus
gtgtgagtgcatagaaggattccat

SEQ ID NO: 717461 - DNA, 25 bp, Mus musculus
gtgtgagtgcattgaaggattccat

SEQ ID NO: 717462 - DNA, 25 bp, Mus musculus
gtgtgagtgctgctatctgaaccca

SEQ ID NO: 717463 - DNA, 25 bp, Mus musculus
gtgtgagtgctggtatctgaaccca

SEQ ID NO: 717464 - DNA, 25 bp, Mus musculus
gtgtgagtgttcatttccccgacat

SEQ ID NO: 717465 - DNA, 25 bp, Mus musculus
gtgtgagtgttcttttccccgacat

SEQ ID NO: 717466 - DNA, 25 bp, Mus musculus
gtgtgagttaccatcatgcatgagt

SEQ ID NO: 717467 - DNA, 25 bp, Mus musculus
gtgtgagttaccttcatgcatgagt

SEQ ID NO: 717468 - DNA, 25 bp, Mus musculus
gtgtgagttcttcaacattgcgagt

SEQ ID NO: 717469 - DNA, 25 bp, Mus musculus
gtgtgagttcttgaacattgcgagt

SEQ ID NO: 717470 - DNA, 25 bp, Mus musculus
gtgtgagtttcaccaggaagaccct

SEQ ID NO: 717471 - DNA, 25 bp, Mus musculus
gtgtgagtttcagcaggaagaccct

SEQ ID NO: 717472 - DNA, 25 bp, Mus musculus
gtgtgagttttccttttgtcacagt

SEQ ID NO: 717473 - DNA, 25 bp, Mus musculus
gtgtgagttttcgttttgtcacagt

SEQ ID NO: 717474 - DNA, 25 bp, Mus musculus
gtgtgagttttgacctgtatcatct

SEQ ID NO: 717475 - DNA, 25 bp, Mus musculus
gtgtgagttttgtcctgtatcatct

SEQ ID NO: 717476 - DNA, 25 bp, Mus musculus
gtgtgataagatatttaccttcctt

SEQ ID NO: 717477 - DNA, 25 bp, Mus musculus
gtgtgataagatttttaccttcctt

SEQ ID NO: 717478 - DNA, 25 bp, Mus musculus
gtgtgataagctcaaaggtcagaca

SEQ ID NO: 717479 - DNA, 25 bp, Mus musculus
gtgtgataagctgaaaggtcagaca

SEQ ID NO: 717480 - DNA, 25 bp, Mus musculus
gtgtgatacacaaaattatacagat

SEQ ID NO: 717481 - DNA, 25 bp, Mus musculus
gtgtgatacacataattatacagat

SEQ ID NO: 717482 - DNA, 25 bp, Mus musculus
gtgtgataccctcgctcaacgatgc

SEQ ID NO: 717483 - DNA, 25 bp, Mus musculus
gtgtgataccctggctcaacgatgc

SEQ ID NO: 717484 - DNA, 25 bp, Mus musculus
gtgtgatactacatttgggctattg

SEQ ID NO: 717485 - DNA, 25 bp, Mus musculus
gtgtgatactacttttgggctattg

SEQ ID NO: 717486 - DNA, 25 bp, Mus musculus
gtgtgatagagcaagcctgcaatcc

SEQ ID NO: 717487 - DNA, 25 bp, Mus musculus
gtgtgatagagctagcctgcaatcc

SEQ ID NO: 717488 - DNA, 25 bp, Mus musculus
gtgtgatagcatctgcagttctctc

SEQ ID NO: 717489 - DNA, 25 bp, Mus musculus
gtgtgatagcatgtgcagttctctc

SEQ ID NO: 717490 - DNA, 25 bp, Mus musculus
gtgtgatagggaactctgcaaactt

SEQ ID NO: 717491 - DNA, 25 bp, Mus musculus
gtgtgatagggatctctgcaaactt

SEQ ID NO: 717492 - DNA, 25 bp, Mus musculus
gtgtgatatgtgagatgcccttaga

SEQ ID NO: 717493 - DNA, 25 bp, Mus musculus
gtgtgatatgtgtgatgcccttaga

SEQ ID NO: 717494 - DNA, 25 bp, Mus musculus
gtgtgatcaacaatcccacttctgg

SEQ ID NO: 717495 - DNA, 25 bp, Mus musculus
gtgtgatcaacattcccacttctgg

SEQ ID NO: 717496 - DNA, 25 bp, Mus musculus
gtgtgatcagagagacctcagcccc

SEQ ID NO: 717497 - DNA, 25 bp, Mus musculus
gtgtgatcagagtgacctcagcccc

SEQ ID NO: 717498 - DNA, 25 bp, Mus musculus
gtgtgatcagtactcagctctctcc

SEQ ID NO: 717499 - DNA, 25 bp, Mus musculus
gtgtgatcagtagtcagctctctcc

SEQ ID NO: 717500 - DNA, 25 bp, Mus musculus
gtgtgatccaagatgtacatgaatc

SEQ ID NO: 717501 - DNA, 25 bp, Mus musculus
gtgtgatccaagttgtacatgaatc

SEQ ID NO: 717502 - DNA, 25 bp, Mus musculus
gtgtgatcccctaaactgaggcagg

SEQ ID NO: 717503 - DNA, 25 bp, Mus musculus
gtgtgatccccttaactgaggcagg

SEQ ID NO: 717504 - DNA, 25 bp, Mus musculus
gtgtgatcccgacgaccaagatgta

SEQ ID NO: 717505 - DNA, 25 bp, Mus musculus
gtgtgatcccgaggaccaagatgta

SEQ ID NO: 717506 - DNA, 25 bp, Mus musculus
gtgtgatccttcaggcgcaatgtta

SEQ ID NO: 717507 - DNA, 25 bp, Mus musculus
gtgtgatccttctggcgcaatgtta

SEQ ID NO: 717508 - DNA, 25 bp, Mus musculus
gtgtgatcggagaaccgaacttgcc

SEQ ID NO: 717509 - DNA, 25 bp, Mus musculus
gtgtgatcggagtaccgaacttgcc

SEQ ID NO: 717510 - DNA, 25 bp, Mus musculus
gtgtgatcgtcacatgctctgcaag

SEQ ID NO: 717511 - DNA, 25 bp, Mus musculus
gtgtgatcgtcagatgctctgcaag

SEQ ID NO: 717512 - DNA, 25 bp, Mus musculus
gtgtgatctactaggccatcatcag

SEQ ID NO: 717513 - DNA, 25 bp, Mus musculus
gtgtgatctacttggccatcatcag

SEQ ID NO: 717514 - DNA, 25 bp, Mus musculus
gtgtgatctatacctattttgacct

SEQ ID NO: 717515 - DNA, 25 bp, Mus musculus
gtgtgatctatagctattttgacct

SEQ ID NO: 717516 - DNA, 25 bp, Mus musculus
gtgtgatctgccaaaagtgaacggg

SEQ ID NO: 717517 - DNA, 25 bp, Mus musculus
gtgtgatctgcctaaagtgaacggg

SEQ ID NO: 717518 - DNA, 25 bp, Mus musculus
gtgtgatcttctaccagtgtcttta

SEQ ID NO: 717519 - DNA, 25 bp, Mus musculus
gtgtgatcttcttccagtgtcttta

SEQ ID NO: 717520 - DNA, 25 bp, Mus musculus
gtgtgatcttgaacgtagccatttg

SEQ ID NO: 717521 - DNA, 25 bp, Mus musculus
gtgtgatcttgatcgtagccatttg

SEQ ID NO: 717522 - DNA, 25 bp, Mus musculus
gtgtgatcttgcacattgcactgga

SEQ ID NO: 717523 - DNA, 25 bp, Mus musculus
gtgtgatcttgctcattgcactgga

SEQ ID NO: 717524 - DNA, 25 bp, Mus musculus
gtgtgatcttggacaaatcccttca

SEQ ID NO: 717525 - DNA, 25 bp, Mus musculus
gtgtgatcttggtcaaatcccttca

SEQ ID NO: 717526 - DNA, 25 bp, Mus musculus
gtgtgatcttgtctattggtttttt

SEQ ID NO: 717527 - DNA, 25 bp, Mus musculus
gtgtgatcttgtgtattggtttttt

SEQ ID NO: 717528 - DNA, 25 bp, Mus musculus
gtgtgatgaagacccacaactcttt

SEQ ID NO: 717529 - DNA, 25 bp, Mus musculus
gtgtgatgaagagccacaactcttt

SEQ ID NO: 717530 - DNA, 25 bp, Mus musculus
gtgtgatgagccaccacagcgcggc

SEQ ID NO: 717531 - DNA, 25 bp, Mus musculus
gtgtgatgagcctccacagcgcggc

SEQ ID NO: 717532 - DNA, 25 bp, Mus musculus
gtgtgatgcccaaggtgccaaatcc

SEQ ID NO: 717533 - DNA, 25 bp, Mus musculus
gtgtgatgcccatggtgccaaatcc

SEQ ID NO: 717534 - DNA, 25 bp, Mus musculus
gtgtgatgctcacacccaattctaa

SEQ ID NO: 717535 - DNA, 25 bp, Mus musculus
gtgtgatgctcagacccaattctaa

SEQ ID NO: 717536 - DNA, 25 bp, Mus musculus
gtgtgatgctttaaacctctgggaa

SEQ ID NO: 717537 - DNA, 25 bp, Mus musculus
gtgtgatgctttaagaaatcccaac

SEQ ID NO: 717538 - DNA, 25 bp, Mus musculus
gtgtgatgcttttaacctctgggaa

SEQ ID NO: 717539 - DNA, 25 bp, Mus musculus
gtgtgatgcttttagaaatcccaac

SEQ ID NO: 717540 - DNA, 25 bp, Mus musculus
gtgtgatggagcaacatgaaaccaa

SEQ ID NO: 717541 - DNA, 25 bp, Mus musculus
gtgtgatggagctacatgaaaccaa

SEQ ID NO: 717542 - DNA, 25 bp, Mus musculus
gtgtgatggcacacaaaatgcttca

SEQ ID NO: 717543 - DNA, 25 bp, Mus musculus
gtgtgatggcactcaaaatgcttca

SEQ ID NO: 717544 - DNA, 25 bp, Mus musculus
gtgtgatggtgtcactataaccaaa

SEQ ID NO: 717545 - DNA, 25 bp, Mus musculus
gtgtgatggtgtgactataaccaaa

SEQ ID NO: 717546 - DNA, 25 bp, Mus musculus
gtgtgatgtggaaaattccagggta

SEQ ID NO: 717547 - DNA, 25 bp, Mus musculus
gtgtgatgtggataattccagggta

SEQ ID NO: 717548 - DNA, 25 bp, Mus musculus
gtgtgatgtgggaattgttttgaat

SEQ ID NO: 717549 - DNA, 25 bp, Mus musculus
gtgtgatgtgggtattgttttgaat

SEQ ID NO: 717550 - DNA, 25 bp, Mus musculus
gtgtgatgttgaccgtcactaccaa

SEQ ID NO: 717551 - DNA, 25 bp, Mus musculus
gtgtgatgttgagcgtcactaccaa

SEQ ID NO: 717552 - DNA, 25 bp, Mus musculus
gtgtgattactcatggctaccttag

SEQ ID NO: 717553 - DNA, 25 bp, Mus musculus
gtgtgattactcttggctaccttag

SEQ ID NO: 717554 - DNA, 25 bp, Mus musculus
gtgtgattcaagaaccttttactaa

SEQ ID NO: 717555 - DNA, 25 bp, Mus musculus
gtgtgattcaagtaccttttactaa

SEQ ID NO: 717556 - DNA, 25 bp, Mus musculus
gtgtgattcagaaccactggccagc

SEQ ID NO: 717557 - DNA, 25 bp, Mus musculus
gtgtgattcagatccactggccagc

SEQ ID NO: 717558 - DNA, 25 bp, Mus musculus
gtgtgattccagcaccttgaaggca

SEQ ID NO: 717559 - DNA, 25 bp, Mus musculus
gtgtgattccaggaccttgaaggca

SEQ ID NO: 717560 - DNA, 25 bp, Mus musculus
gtgtgattctagcacctggcaggca

SEQ ID NO: 717561 - DNA, 25 bp, Mus musculus
gtgtgattctaggacctggcaggca

SEQ ID NO: 717562 - DNA, 25 bp, Mus musculus
gtgtgattctgcatcctaaaaaccc

SEQ ID NO: 717563 - DNA, 25 bp, Mus musculus
gtgtgattctgcttcctaaaaaccc

SEQ ID NO: 717564 - DNA, 25 bp, Mus musculus
gtgtgattcttgacaaactgtaatt

SEQ ID NO: 717565 - DNA, 25 bp, Mus musculus
gtgtgattcttgtcaaactgtaatt

SEQ ID NO: 717566 - DNA, 25 bp, Mus musculus
gtgtgattgaaactttttgcttatt

SEQ ID NO: 717567 - DNA, 25 bp, Mus musculus
gtgtgattgaaagtttttgcttatt

SEQ ID NO: 717568 - DNA, 25 bp, Mus musculus
gtgtgattgagtactggtgcccaaa

SEQ ID NO: 717569 - DNA, 25 bp, Mus musculus
gtgtgattgagttctggtgcccaaa

SEQ ID NO: 717570 - DNA, 25 bp, Mus musculus
gtgtgattgcctcgagcagcagcct

SEQ ID NO: 717571 - DNA, 25 bp, Mus musculus
gtgtgattgcctggagcagcagcct

SEQ ID NO: 717572 - DNA, 25 bp, Mus musculus
gtgtgattggcacctgtcaaatgct

SEQ ID NO: 717573 - DNA, 25 bp, Mus musculus
gtgtgattggcagctgtcaaatgct

SEQ ID NO: 717574 - DNA, 25 bp, Mus musculus
gtgtgattggttcttaggcatctct

SEQ ID NO: 717575 - DNA, 25 bp, Mus musculus
gtgtgattggttgttaggcatctct

SEQ ID NO: 717576 - DNA, 25 bp, Mus musculus
gtgtgatttaataaccaggttgctt

SEQ ID NO: 717577 - DNA, 25 bp, Mus musculus
gtgtgatttaattaccaggttgctt

SEQ ID NO: 717578 - DNA, 25 bp, Mus musculus
gtgtgatttccaacaattctgctct

SEQ ID NO: 717579 - DNA, 25 bp, Mus musculus
gtgtgatttccatcaattctgctct

SEQ ID NO: 717580 - DNA, 25 bp, Mus musculus
gtgtgatttccgacttcttttccag

SEQ ID NO: 717581 - DNA, 25 bp, Mus musculus
gtgtgatttccgtcttcttttccag

SEQ ID NO: 717582 - DNA, 25 bp, Mus musculus
gtgtgatttctgcttttgtttccca

SEQ ID NO: 717583 - DNA, 25 bp, Mus musculus
gtgtgatttctggttttgtttccca

SEQ ID NO: 717584 - DNA, 25 bp, Mus musculus
gtgtgatttggtactgtctccagca

SEQ ID NO: 717585 - DNA, 25 bp, Mus musculus
gtgtgatttggttctgtctccagca

SEQ ID NO: 717586 - DNA, 25 bp, Mus musculus
gtgtgattttacctgcattggtgaa

SEQ ID NO: 717587 - DNA, 25 bp, Mus musculus
gtgtgattttacgtgcattggtgaa

SEQ ID NO: 717588 - DNA, 25 bp, Mus musculus
gtgtgcaaaacgattacaatccttt

SEQ ID NO: 717589 - DNA, 25 bp, Mus musculus
gtgtgcaaaacgtttacaatccttt

SEQ ID NO: 717590 - DNA, 25 bp, Mus musculus
gtgtgcaaatacatagccaggattc

SEQ ID NO: 717591 - DNA, 25 bp, Mus musculus
gtgtgcaaatacttagccaggattc

SEQ ID NO: 717592 - DNA, 25 bp, Mus musculus
gtgtgcaaatgcacctggcgctcgc

SEQ ID NO: 717593 - DNA, 25 bp, Mus musculus
gtgtgcaaatgctcctggcgctcgc

SEQ ID NO: 717594 - DNA, 25 bp, Mus musculus
gtgtgcaacagtaattcgatacttt

SEQ ID NO: 717595 - DNA, 25 bp, Mus musculus
gtgtgcaacagttattcgatacttt

SEQ ID NO: 717596 - DNA, 25 bp, Mus musculus
gtgtgcaacgtacgcagtgtttact

SEQ ID NO: 717597 - DNA, 25 bp, Mus musculus
gtgtgcaacgtaggcagtgtttact

SEQ ID NO: 717598 - DNA, 25 bp, Mus musculus
gtgtgcaactaaccccaattttgat

SEQ ID NO: 717599 - DNA, 25 bp, Mus musculus
gtgtgcaactaacggtacgcagaat

SEQ ID NO: 717600 - DNA, 25 bp, Mus musculus
gtgtgcaactaagcccaattttgat

SEQ ID NO: 717601 - DNA, 25 bp, Mus musculus
gtgtgcaactaagggtacgcagaat

SEQ ID NO: 717602 - DNA, 25 bp, Mus musculus
gtgtgcaactgaatatacaaacata

SEQ ID NO: 717603 - DNA, 25 bp, Mus musculus
gtgtgcaactgattatacaaacata

SEQ ID NO: 717604 - DNA, 25 bp, Mus musculus
gtgtgcaagcatacagtaggtcctt

SEQ ID NO: 717605 - DNA, 25 bp, Mus musculus
gtgtgcaagcattcagtaggtcctt

SEQ ID NO: 717606 - DNA, 25 bp, Mus musculus
gtgtgcaaggtgactcacaaagctg

SEQ ID NO: 717607 - DNA, 25 bp, Mus musculus
gtgtgcaaggtgtctcacaaagctg

SEQ ID NO: 717608 - DNA, 25 bp, Mus musculus
gtgtgcaagtatctgaactggattc

SEQ ID NO: 717609 - DNA, 25 bp, Mus musculus
gtgtgcaagtatgtgaactggattc

SEQ ID NO: 717610 - DNA, 25 bp, Mus musculus
gtgtgcaatgcaacttcaagcttta

SEQ ID NO: 717611 - DNA, 25 bp, Mus musculus
gtgtgcaatgcatcttcaagcttta

SEQ ID NO: 717612 - DNA, 25 bp, Mus musculus
gtgtgcaatgccagcatagccacca

SEQ ID NO: 717613 - DNA, 25 bp, Mus musculus
gtgtgcaatgcctgcatagccacca

SEQ ID NO: 717614 - DNA, 25 bp, Mus musculus
gtgtgcaatgtgacaccagtgtctt

SEQ ID NO: 717615 - DNA, 25 bp, Mus musculus
gtgtgcaatgtgtcaccagtgtctt

SEQ ID NO: 717616 - DNA, 25 bp, Mus musculus
gtgtgcaattttaaactcggcattg

SEQ ID NO: 717617 - DNA, 25 bp, Mus musculus
gtgtgcaatttttaactcggcattg

SEQ ID NO: 717618 - DNA, 25 bp, Mus musculus
gtgtgcacaaacataaccttttcta

SEQ ID NO: 717619 - DNA, 25 bp, Mus musculus
gtgtgcacaaacttaaccttttcta

SEQ ID NO: 717620 - DNA, 25 bp, Mus musculus
gtgtgcacaaccagtcggacagcct

SEQ ID NO: 717621 - DNA, 25 bp, Mus musculus
gtgtgcacaacctgtcggacagcct

SEQ ID NO: 717622 - DNA, 25 bp, Mus musculus
gtgtgcacacacacctgaatataca

SEQ ID NO: 717623 - DNA, 25 bp, Mus musculus
gtgtgcacacaccagaacacatgtg

SEQ ID NO: 717624 - DNA, 25 bp, Mus musculus
gtgtgcacacacgagaacacatgtg

SEQ ID NO: 717625 - DNA, 25 bp, Mus musculus
gtgtgcacacactcctgaatataca

SEQ ID NO: 717626 - DNA, 25 bp, Mus musculus
gtgtgcacacataaggcccacagtg

SEQ ID NO: 717627 - DNA, 25 bp, Mus musculus
gtgtgcacacatagaacgttagcat

SEQ ID NO: 717628 - DNA, 25 bp, Mus musculus
gtgtgcacacatagcactgttgctc

SEQ ID NO: 717629 - DNA, 25 bp, Mus musculus
gtgtgcacacatatactcttaggga

SEQ ID NO: 717630 - DNA, 25 bp, Mus musculus
gtgtgcacacatcttcttaactctt

SEQ ID NO: 717631 - DNA, 25 bp, Mus musculus
gtgtgcacacatgttcttaactctt

SEQ ID NO: 717632 - DNA, 25 bp, Mus musculus
gtgtgcacacattaggcccacagtg

SEQ ID NO: 717633 - DNA, 25 bp, Mus musculus
gtgtgcacacattgaacgttagcat

SEQ ID NO: 717634 - DNA, 25 bp, Mus musculus
gtgtgcacacattgcactgttgctc

SEQ ID NO: 717635 - DNA, 25 bp, Mus musculus
gtgtgcacacatttactcttaggga

SEQ ID NO: 717636 - DNA, 25 bp, Mus musculus
gtgtgcacagcaagtcggaattcca

SEQ ID NO: 717637 - DNA, 25 bp, Mus musculus
gtgtgcacagcatgtcggaattcca

SEQ ID NO: 717638 - DNA, 25 bp, Mus musculus
gtgtgcacaggcctctcagagtgtc

SEQ ID NO: 717639 - DNA, 25 bp, Mus musculus
gtgtgcacaggcgtctcagagtgtc

SEQ ID NO: 717640 - DNA, 25 bp, Mus musculus
gtgtgcacaggtcaatgcaaaggcc

SEQ ID NO: 717641 - DNA, 25 bp, Mus musculus
gtgtgcacaggtgaatgcaaaggcc

SEQ ID NO: 717642 - DNA, 25 bp, Mus musculus
gtgtgcacagtcatcaagggtcata

SEQ ID NO: 717643 - DNA, 25 bp, Mus musculus
gtgtgcacagtcttcaagggtcata

SEQ ID NO: 717644 - DNA, 25 bp, Mus musculus
gtgtgcacagtgaagcccggcctca

SEQ ID NO: 717645 - DNA, 25 bp, Mus musculus
gtgtgcacagtgaagtccggcctca

SEQ ID NO: 717646 - DNA, 25 bp, Mus musculus
gtgtgcacagtgtagcccggcctca

SEQ ID NO: 717647 - DNA, 25 bp, Mus musculus
gtgtgcacagtgtagtccggcctca

SEQ ID NO: 717648 - DNA, 25 bp, Mus musculus
gtgtgcacatacaaaatgaatagct

SEQ ID NO: 717649 - DNA, 25 bp, Mus musculus
gtgtgcacatactaaatgaatagct

SEQ ID NO: 717650 - DNA, 25 bp, Mus musculus
gtgtgcacatccagcgggctttgat

SEQ ID NO: 717651 - DNA, 25 bp, Mus musculus
gtgtgcacatcctgcgggctttgat

SEQ ID NO: 717652 - DNA, 25 bp, Mus musculus
gtgtgcacatgacccttcagagata

SEQ ID NO: 717653 - DNA, 25 bp, Mus musculus
gtgtgcacatgagccttcagagata

SEQ ID NO: 717654 - DNA, 25 bp, Mus musculus
gtgtgcacattgacttctcatacta

SEQ ID NO: 717655 - DNA, 25 bp, Mus musculus
gtgtgcacattgtcttctcatacta

SEQ ID NO: 717656 - DNA, 25 bp, Mus musculus
gtgtgcaccaggactgactgctctg

SEQ ID NO: 717657 - DNA, 25 bp, Mus musculus
gtgtgcaccaggtctgactgctctg

SEQ ID NO: 717658 - DNA, 25 bp, Mus musculus
gtgtgcaccattacatgcaatgcca

SEQ ID NO: 717659 - DNA, 25 bp, Mus musculus
gtgtgcaccatttcatgcaatgcca

SEQ ID NO: 717660 - DNA, 25 bp, Mus musculus
gtgtgcacccctaagcttgaaattg

SEQ ID NO: 717661 - DNA, 25 bp, Mus musculus
gtgtgcaccccttagcttgaaattg

SEQ ID NO: 717662 - DNA, 25 bp, Mus musculus
gtgtgcaccctaacatcttatataa

SEQ ID NO: 717663 - DNA, 25 bp, Mus musculus
gtgtgcaccctatcatcttatataa

SEQ ID NO: 717664 - DNA, 25 bp, Mus musculus
gtgtgcaccctcctgtaacattgtt

SEQ ID NO: 717665 - DNA, 25 bp, Mus musculus
gtgtgcaccctcgtgtaacattgtt

SEQ ID NO: 717666 - DNA, 25 bp, Mus musculus
gtgtgcacccttagtgaacttctgt

SEQ ID NO: 717667 - DNA, 25 bp, Mus musculus
gtgtgcaccctttgtgaacttctgt

SEQ ID NO: 717668 - DNA, 25 bp, Mus musculus
gtgtgcaccgcaatggacagacaaa

SEQ ID NO: 717669 - DNA, 25 bp, Mus musculus
gtgtgcaccgcattggacagacaaa

SEQ ID NO: 717670 - DNA, 25 bp, Mus musculus
gtgtgcaccgttactcagatgttca

SEQ ID NO: 717671 - DNA, 25 bp, Mus musculus
gtgtgcaccgttcgcttgaaggtat

SEQ ID NO: 717672 - DNA, 25 bp, Mus musculus
gtgtgcaccgttggcttgaaggtat

SEQ ID NO: 717673 - DNA, 25 bp, Mus musculus
gtgtgcaccgtttctcagatgttca

SEQ ID NO: 717674 - DNA, 25 bp, Mus musculus
gtgtgcacgactcccaaagtgttct

SEQ ID NO: 717675 - DNA, 25 bp, Mus musculus
gtgtgcacgactgccaaagtgttct

SEQ ID NO: 717676 - DNA, 25 bp, Mus musculus
gtgtgcacgcgtatgtacgtacgta

SEQ ID NO: 717677 - DNA, 25 bp, Mus musculus
gtgtgcacgcgtttgtacgtacgta

SEQ ID NO: 717678 - DNA, 25 bp, Mus musculus
gtgtgcactcagctcacagacacaa

SEQ ID NO: 717679 - DNA, 25 bp, Mus musculus
gtgtgcactcaggtcacagacacaa

SEQ ID NO: 717680 - DNA, 25 bp, Mus musculus
gtgtgcactcttacttaactgggtt

SEQ ID NO: 717681 - DNA, 25 bp, Mus musculus
gtgtgcactctttcttaactgggtt

SEQ ID NO: 717682 - DNA, 25 bp, Mus musculus
gtgtgcactgtcctgactgctaata

SEQ ID NO: 717683 - DNA, 25 bp, Mus musculus
gtgtgcactgtcgtgactgctaata

SEQ ID NO: 717684 - DNA, 25 bp, Mus musculus
gtgtgcagaagaaaccccaggaacc

SEQ ID NO: 717685 - DNA, 25 bp, Mus musculus
gtgtgcagaagataccccaggaacc

SEQ ID NO: 717686 - DNA, 25 bp, Mus musculus
gtgtgcagaagtattgggaaaccct

SEQ ID NO: 717687 - DNA, 25 bp, Mus musculus
gtgtgcagaagttttgggaaaccct

SEQ ID NO: 717688 - DNA, 25 bp, Mus musculus
gtgtgcagaataagaggctccccgc

SEQ ID NO: 717689 - DNA, 25 bp, Mus musculus
gtgtgcagaatatgaggctccccgc

SEQ ID NO: 717690 - DNA, 25 bp, Mus musculus
gtgtgcagacacacagaccaatatt

SEQ ID NO: 717691 - DNA, 25 bp, Mus musculus
gtgtgcagacactcagaccaatatt

SEQ ID NO: 717692 - DNA, 25 bp, Mus musculus
gtgtgcagacatattcttgaagcta

SEQ ID NO: 717693 - DNA, 25 bp, Mus musculus
gtgtgcagacattttcttgaagcta

SEQ ID NO: 717694 - DNA, 25 bp, Mus musculus
gtgtgcagacttcctattctggtta

SEQ ID NO: 717695 - DNA, 25 bp, Mus musculus
gtgtgcagacttgctattctggtta

SEQ ID NO: 717696 - DNA, 25 bp, Mus musculus
gtgtgcagatataacccatgttaaa

SEQ ID NO: 717697 - DNA, 25 bp, Mus musculus
gtgtgcagatattacccatgttaaa

SEQ ID NO: 717698 - DNA, 25 bp, Mus musculus
gtgtgcagcaaaagcttcaaccgga

SEQ ID NO: 717699 - DNA, 25 bp, Mus musculus
gtgtgcagcaaatgcttcaaccgga

SEQ ID NO: 717700 - DNA, 25 bp, Mus musculus
gtgtgcagcattccaacatcccaga

SEQ ID NO: 717701 - DNA, 25 bp, Mus musculus
gtgtgcagcattgcaacatcccaga

SEQ ID NO: 717702 - DNA, 25 bp, Mus musculus
gtgtgcaggacacccttcaaaagga

SEQ ID NO: 717703 - DNA, 25 bp, Mus musculus
gtgtgcaggacagccttcaaaagga

SEQ ID NO: 717704 - DNA, 25 bp, Mus musculus
gtgtgcaggcagaacgctataatac

SEQ ID NO: 717705 - DNA, 25 bp, Mus musculus
gtgtgcaggcagtacgctataatac

SEQ ID NO: 717706 - DNA, 25 bp, Mus musculus
gtgtgcaggcataccacgtgtgcta

SEQ ID NO: 717707 - DNA, 25 bp, Mus musculus
gtgtgcaggcattccacgtgtgcta

SEQ ID NO: 717708 - DNA, 25 bp, Mus musculus
gtgtgcaggtcaatctctcgtaaag

SEQ ID NO: 717709 - DNA, 25 bp, Mus musculus
gtgtgcaggtcattctctcgtaaag

SEQ ID NO: 717710 - DNA, 25 bp, Mus musculus
gtgtgcaggttcatacttgtaaatt

SEQ ID NO: 717711 - DNA, 25 bp, Mus musculus
gtgtgcaggttcttacttgtaaatt

SEQ ID NO: 717712 - DNA, 25 bp, Mus musculus
gtgtgcagtgttattaaatagccca

SEQ ID NO: 717713 - DNA, 25 bp, Mus musculus
gtgtgcagtgtttttaaatagccca

SEQ ID NO: 717714 - DNA, 25 bp, Mus musculus
gtgtgcagttcccaactttctgcag

SEQ ID NO: 717715 - DNA, 25 bp, Mus musculus
gtgtgcagttccgaactttctgcag

SEQ ID NO: 717716 - DNA, 25 bp, Mus musculus
gtgtgcagttgcattgcccaggata

SEQ ID NO: 717717 - DNA, 25 bp, Mus musculus
gtgtgcagttgctttgcccaggata

SEQ ID NO: 717718 - DNA, 25 bp, Mus musculus
gtgtgcagtttcaatcagcgtgtac

SEQ ID NO: 717719 - DNA, 25 bp, Mus musculus
gtgtgcagtttctatcagcgtgtac

SEQ ID NO: 717720 - DNA, 25 bp, Mus musculus
gtgtgcatacagacagtgctatcta

SEQ ID NO: 717721 - DNA, 25 bp, Mus musculus
gtgtgcatacagtcagtgctatcta

SEQ ID NO: 717722 - DNA, 25 bp, Mus musculus
gtgtgcatagctatactccggcact

SEQ ID NO: 717723 - DNA, 25 bp, Mus musculus
gtgtgcatagctttactccggcact

SEQ ID NO: 717724 - DNA, 25 bp, Mus musculus
gtgtgcatagtaagtccatgtacat

SEQ ID NO: 717725 - DNA, 25 bp, Mus musculus
gtgtgcatagtatgtccatgtacat

SEQ ID NO: 717726 - DNA, 25 bp, Mus musculus
gtgtgcatagttaaatcctgtgttt

SEQ ID NO: 717727 - DNA, 25 bp, Mus musculus
gtgtgcatagttactttattttgtg

SEQ ID NO: 717728 - DNA, 25 bp, Mus musculus
gtgtgcatagtttaatcctgtgttt

SEQ ID NO: 717729 - DNA, 25 bp, Mus musculus
gtgtgcatagtttctttattttgtg

SEQ ID NO: 717730 - DNA, 25 bp, Mus musculus
gtgtgcatatatataagacccttgt

SEQ ID NO: 717731 - DNA, 25 bp, Mus musculus
gtgtgcatatatctatctgcgcatg

SEQ ID NO: 717732 - DNA, 25 bp, Mus musculus
gtgtgcatatatgtatctgcgcatg

SEQ ID NO: 717733 - DNA, 25 bp, Mus musculus
gtgtgcatatatttaagacccttgt

SEQ ID NO: 717734 - DNA, 25 bp, Mus musculus
gtgtgcatatgcatgtgctttggca

SEQ ID NO: 717735 - DNA, 25 bp, Mus musculus
gtgtgcatatgcttgtgctttggca

SEQ ID NO: 717736 - DNA, 25 bp, Mus musculus
gtgtgcatattgacaattccttaca

SEQ ID NO: 717737 - DNA, 25 bp, Mus musculus
gtgtgcatattgtcaattccttaca

SEQ ID NO: 717738 - DNA, 25 bp, Mus musculus
gtgtgcatcacaagctcggtgagca

SEQ ID NO: 717739 - DNA, 25 bp, Mus musculus
gtgtgcatcacatgctcggtgagca

SEQ ID NO: 717740 - DNA, 25 bp, Mus musculus
gtgtgcatcatgaacactcatgctc

SEQ ID NO: 717741 - DNA, 25 bp, Mus musculus
gtgtgcatcatgtacactcatgctc

SEQ ID NO: 717742 - DNA, 25 bp, Mus musculus
gtgtgcatccttatagagctgttgt

SEQ ID NO: 717743 - DNA, 25 bp, Mus musculus
gtgtgcatccttttagagctgttgt

SEQ ID NO: 717744 - DNA, 25 bp, Mus musculus
gtgtgcatctggacaggcgtccgct

SEQ ID NO: 717745 - DNA, 25 bp, Mus musculus
gtgtgcatctggtcaggcgtccgct

SEQ ID NO: 717746 - DNA, 25 bp, Mus musculus
gtgtgcatcttgaaatcctgttaat

SEQ ID NO: 717747 - DNA, 25 bp, Mus musculus
gtgtgcatcttgtaatcctgttaat

SEQ ID NO: 717748 - DNA, 25 bp, Mus musculus
gtgtgcatgagcaagaccgtctctg

SEQ ID NO: 717749 - DNA, 25 bp, Mus musculus
gtgtgcatgagctagaccgtctctg

SEQ ID NO: 717750 - DNA, 25 bp, Mus musculus
gtgtgcatgcacatcctcactcact

SEQ ID NO: 717751 - DNA, 25 bp, Mus musculus
gtgtgcatgcacatcttggagtcca

SEQ ID NO: 717752 - DNA, 25 bp, Mus musculus
gtgtgcatgcacttcctcactcact

SEQ ID NO: 717753 - DNA, 25 bp, Mus musculus
gtgtgcatgcacttcttggagtcca

SEQ ID NO: 717754 - DNA, 25 bp, Mus musculus
gtgtgcatgcctagttttgcagtca

SEQ ID NO: 717755 - DNA, 25 bp, Mus musculus
gtgtgcatgccttgttttgcagtca

SEQ ID NO: 717756 - DNA, 25 bp, Mus musculus
gtgtgcatggtcattgtcaattgat

SEQ ID NO: 717757 - DNA, 25 bp, Mus musculus
gtgtgcatggtctttgtcaattgat

SEQ ID NO: 717758 - DNA, 25 bp, Mus musculus
gtgtgcatgtgcacatgcgtagaaa

SEQ ID NO: 717759 - DNA, 25 bp, Mus musculus
gtgtgcatgtgctcatgcgtagaaa

SEQ ID NO: 717760 - DNA, 25 bp, Mus musculus
gtgtgcatgtgtcctctacatggaa

SEQ ID NO: 717761 - DNA, 25 bp, Mus musculus
gtgtgcatgtgtgctctacatggaa

SEQ ID NO: 717762 - DNA, 25 bp, Mus musculus
gtgtgcattaacacagctggttcca

SEQ ID NO: 717763 - DNA, 25 bp, Mus musculus
gtgtgcattaactcagctggttcca

SEQ ID NO: 717764 - DNA, 25 bp, Mus musculus
gtgtgcattcacaagactccaactg

SEQ ID NO: 717765 - DNA, 25 bp, Mus musculus
gtgtgcattcactagactccaactg

SEQ ID NO: 717766 - DNA, 25 bp, Mus musculus
gtgtgcattcctattgccactggag

SEQ ID NO: 717767 - DNA, 25 bp, Mus musculus
gtgtgcattccttttgccactggag

SEQ ID NO: 717768 - DNA, 25 bp, Mus musculus
gtgtgcattgtacgcatgttcacaa

SEQ ID NO: 717769 - DNA, 25 bp, Mus musculus
gtgtgcattgtaggcatgttcacaa

SEQ ID NO: 717770 - DNA, 25 bp, Mus musculus
gtgtgccaaagcagtggttctcatc

SEQ ID NO: 717771 - DNA, 25 bp, Mus musculus
gtgtgccaaagctgtggttctcatc

SEQ ID NO: 717772 - DNA, 25 bp, Mus musculus
gtgtgccaacataccatgtatttta

SEQ ID NO: 717773 - DNA, 25 bp, Mus musculus
gtgtgccaacattccatgtatttta

SEQ ID NO: 717774 - DNA, 25 bp, Mus musculus
gtgtgccaacctctgttgattaaca

SEQ ID NO: 717775 - DNA, 25 bp, Mus musculus
gtgtgccaacctgtgttgattaaca

SEQ ID NO: 717776 - DNA, 25 bp, Mus musculus
gtgtgccaagaaacgcaggctctgg

SEQ ID NO: 717777 - DNA, 25 bp, Mus musculus
gtgtgccaagaatcgcaggctctgg

SEQ ID NO: 717778 - DNA, 25 bp, Mus musculus
gtgtgccaaggtattaaagttggag

SEQ ID NO: 717779 - DNA, 25 bp, Mus musculus
gtgtgccaaggttttaaagttggag

SEQ ID NO: 717780 - DNA, 25 bp, Mus musculus
gtgtgccaccctcttccagggatgg

SEQ ID NO: 717781 - DNA, 25 bp, Mus musculus
gtgtgccaccctgttccagggatgg

SEQ ID NO: 717782 - DNA, 25 bp, Mus musculus
gtgtgccaccgacaccgagaacatc

SEQ ID NO: 717783 - DNA, 25 bp, Mus musculus
gtgtgccaccgagaccgagaacatc

SEQ ID NO: 717784 - DNA, 25 bp, Mus musculus
gtgtgccacctcactgtgcggatca

SEQ ID NO: 717785 - DNA, 25 bp, Mus musculus
gtgtgccacctctctgtgcggatca

SEQ ID NO: 717786 - DNA, 25 bp, Mus musculus
gtgtgccagaaaacatgtcttattt

SEQ ID NO: 717787 - DNA, 25 bp, Mus musculus
gtgtgccagaaatcatgtcttattt

SEQ ID NO: 717788 - DNA, 25 bp, Mus musculus
gtgtgccagaacaccaaatcctgag

SEQ ID NO: 717789 - DNA, 25 bp, Mus musculus
gtgtgccagaactccaaatcctgag

SEQ ID NO: 717790 - DNA, 25 bp, Mus musculus
gtgtgccagaagagccctgtgtgcc

SEQ ID NO: 717791 - DNA, 25 bp, Mus musculus
gtgtgccagaagtgccctgtgtgcc

SEQ ID NO: 717792 - DNA, 25 bp, Mus musculus
gtgtgccagacactgactccacagg

SEQ ID NO: 717793 - DNA, 25 bp, Mus musculus
gtgtgccagacagtgactccacagg

SEQ ID NO: 717794 - DNA, 25 bp, Mus musculus
gtgtgccaggcaaactaagctccac

SEQ ID NO: 717795 - DNA, 25 bp, Mus musculus
gtgtgccaggcatactaagctccac

SEQ ID NO: 717796 - DNA, 25 bp, Mus musculus
gtgtgccatatacatgcagtgccta

SEQ ID NO: 717797 - DNA, 25 bp, Mus musculus
gtgtgccatatagatgcagtgccta

SEQ ID NO: 717798 - DNA, 25 bp, Mus musculus
gtgtgccatatgcttccatctataa

SEQ ID NO: 717799 - DNA, 25 bp, Mus musculus
gtgtgccatatggttccatctataa

SEQ ID NO: 717800 - DNA, 25 bp, Mus musculus
gtgtgccatctaaataaccttccag

SEQ ID NO: 717801 - DNA, 25 bp, Mus musculus
gtgtgccatctatataaccttccag

SEQ ID NO: 717802 - DNA, 25 bp, Mus musculus
gtgtgccatctgaactttaactttg

SEQ ID NO: 717803 - DNA, 25 bp, Mus musculus
gtgtgccatctgtactttaactttg

SEQ ID NO: 717804 - DNA, 25 bp, Mus musculus
gtgtgccatggcatatgtgacccaa

SEQ ID NO: 717805 - DNA, 25 bp, Mus musculus
gtgtgccatggcttatgtgacccaa

SEQ ID NO: 717806 - DNA, 25 bp, Mus musculus
gtgtgccattgaatctgtgctggat

SEQ ID NO: 717807 - DNA, 25 bp, Mus musculus
gtgtgccattgattctgtgctggat

SEQ ID NO: 717808 - DNA, 25 bp, Mus musculus
gtgtgcccaattcctgtattacttt

SEQ ID NO: 717809 - DNA, 25 bp, Mus musculus
gtgtgcccaattgctgtattacttt

SEQ ID NO: 717810 - DNA, 25 bp, Mus musculus
gtgtgcccaccactcttaccataga

SEQ ID NO: 717811 - DNA, 25 bp, Mus musculus
gtgtgcccaccagtcttaccataga

SEQ ID NO: 717812 - DNA, 25 bp, Mus musculus
gtgtgcccactgctaaagtccactg

SEQ ID NO: 717813 - DNA, 25 bp, Mus musculus
gtgtgcccactggtaaagtccactg

SEQ ID NO: 717814 - DNA, 25 bp, Mus musculus
gtgtgcccacttaaatcatcatcaa

SEQ ID NO: 717815 - DNA, 25 bp, Mus musculus
gtgtgcccactttaatcatcatcaa

SEQ ID NO: 717816 - DNA, 25 bp, Mus musculus
gtgtgcccagaaacaaacctgctgt

SEQ ID NO: 717817 - DNA, 25 bp, Mus musculus
gtgtgcccagaatcaaacctgctgt

SEQ ID NO: 717818 - DNA, 25 bp, Mus musculus
gtgtgcccagtgaaaggcccatgtc

SEQ ID NO: 717819 - DNA, 25 bp, Mus musculus
gtgtgcccagtgtaaggcccatgtc

SEQ ID NO: 717820 - DNA, 25 bp, Mus musculus
gtgtgcccatcactctgtaagtgtg

SEQ ID NO: 717821 - DNA, 25 bp, Mus musculus
gtgtgcccatcagtctgtaagtgtg

SEQ ID NO: 717822 - DNA, 25 bp, Mus musculus
gtgtgcccatctatttcagtctaat

SEQ ID NO: 717823 - DNA, 25 bp, Mus musculus
gtgtgcccatctttttcagtctaat

SEQ ID NO: 717824 - DNA, 25 bp, Mus musculus
gtgtgcccattgaaataaaactcaa

SEQ ID NO: 717825 - DNA, 25 bp, Mus musculus
gtgtgcccattgagatcttctttac

SEQ ID NO: 717826 - DNA, 25 bp, Mus musculus
gtgtgcccattgtaataaaactcaa

SEQ ID NO: 717827 - DNA, 25 bp, Mus musculus
gtgtgcccattgtgatcttctttac

SEQ ID NO: 717828 - DNA, 25 bp, Mus musculus
gtgtgccccggaattgttaaggact

SEQ ID NO: 717829 - DNA, 25 bp, Mus musculus
gtgtgccccggatttgttaaggact

SEQ ID NO: 717830 - DNA, 25 bp, Mus musculus
gtgtgcccgagtacacaaaacatgt

SEQ ID NO: 717831 - DNA, 25 bp, Mus musculus
gtgtgcccgagttcacaaaacatgt

SEQ ID NO: 717832 - DNA, 25 bp, Mus musculus
gtgtgccctaaacatccggaataac

SEQ ID NO: 717833 - DNA, 25 bp, Mus musculus
gtgtgccctaaagatccggaataac

SEQ ID NO: 717834 - DNA, 25 bp, Mus musculus
gtgtgccctccaatgttagatttta

SEQ ID NO: 717835 - DNA, 25 bp, Mus musculus
gtgtgccctccattgttagatttta

SEQ ID NO: 717836 - DNA, 25 bp, Mus musculus
gtgtgcccttcaactggttggaaac

SEQ ID NO: 717837 - DNA, 25 bp, Mus musculus
gtgtgcccttcatctggttggaaac

SEQ ID NO: 717838 - DNA, 25 bp, Mus musculus
gtgtgcccttcccttttactaagag

SEQ ID NO: 717839 - DNA, 25 bp, Mus musculus
gtgtgcccttccgttttactaagag

SEQ ID NO: 717840 - DNA, 25 bp, Mus musculus
gtgtgcccttggacttggtagatga

SEQ ID NO: 717841 - DNA, 25 bp, Mus musculus
gtgtgcccttggagtctgacttcag

SEQ ID NO: 717842 - DNA, 25 bp, Mus musculus
gtgtgcccttggtcttggtagatga

SEQ ID NO: 717843 - DNA, 25 bp, Mus musculus
gtgtgcccttggtgtctgacttcag

SEQ ID NO: 717844 - DNA, 25 bp, Mus musculus
gtgtgccctttacacaaatcctgtt

SEQ ID NO: 717845 - DNA, 25 bp, Mus musculus
gtgtgccctttagacaaatcctgtt

SEQ ID NO: 717846 - DNA, 25 bp, Mus musculus
gtgtgccgattcaccatgatctgta

SEQ ID NO: 717847 - DNA, 25 bp, Mus musculus
gtgtgccgattctccatgatctgta

SEQ ID NO: 717848 - DNA, 25 bp, Mus musculus
gtgtgccgcaatagtgtaattatca

SEQ ID NO: 717849 - DNA, 25 bp, Mus musculus
gtgtgccgcaattgtgtaattatca

SEQ ID NO: 717850 - DNA, 25 bp, Mus musculus
gtgtgccgcagtcatgaggatcttt

SEQ ID NO: 717851 - DNA, 25 bp, Mus musculus
gtgtgccgcagtgatgaggatcttt

SEQ ID NO: 717852 - DNA, 25 bp, Mus musculus
gtgtgccgcgtcagtcatgccgaag

SEQ ID NO: 717853 - DNA, 25 bp, Mus musculus
gtgtgccgcgtctgtcatgccgaag

SEQ ID NO: 717854 - DNA, 25 bp, Mus musculus
gtgtgccgtacccaagaaagattct

SEQ ID NO: 717855 - DNA, 25 bp, Mus musculus
gtgtgccgtaccgaagaaagattct

SEQ ID NO: 717856 - DNA, 25 bp, Mus musculus
gtgtgcctacatcgaagagcttttc

SEQ ID NO: 717857 - DNA, 25 bp, Mus musculus
gtgtgcctacatggaagagcttttc

SEQ ID NO: 717858 - DNA, 25 bp, Mus musculus
gtgtgcctaccgcatgcatgagtgc

SEQ ID NO: 717859 - DNA, 25 bp, Mus musculus
gtgtgcctaccggatgcatgagtgc

SEQ ID NO: 717860 - DNA, 25 bp, Mus musculus
gtgtgcctagccagcactctggaga

SEQ ID NO: 717861 - DNA, 25 bp, Mus musculus
gtgtgcctagcctgcactctggaga

SEQ ID NO: 717862 - DNA, 25 bp, Mus musculus
gtgtgcctagtgagggctctatccc

SEQ ID NO: 717863 - DNA, 25 bp, Mus musculus
gtgtgcctagtgtgggctctatccc

SEQ ID NO: 717864 - DNA, 25 bp, Mus musculus
gtgtgcctatgactgcccagaagtc

SEQ ID NO: 717865 - DNA, 25 bp, Mus musculus
gtgtgcctatgagtgcccagaagtc

SEQ ID NO: 717866 - DNA, 25 bp, Mus musculus
gtgtgcctcaccatgacagggacat

SEQ ID NO: 717867 - DNA, 25 bp, Mus musculus
gtgtgcctcaccttgacagggacat

SEQ ID NO: 717868 - DNA, 25 bp, Mus musculus
gtgtgcctccatatcaggccaggtc

SEQ ID NO: 717869 - DNA, 25 bp, Mus musculus
gtgtgcctccatttcaggccaggtc

SEQ ID NO: 717870 - DNA, 25 bp, Mus musculus
gtgtgcctctctccaggaagatggt

SEQ ID NO: 717871 - DNA, 25 bp, Mus musculus
gtgtgcctctctgcaggaagatggt

SEQ ID NO: 717872 - DNA, 25 bp, Mus musculus
gtgtgcctctggagtgaattctgtc

SEQ ID NO: 717873 - DNA, 25 bp, Mus musculus
gtgtgcctctggtgtgaattctgtc

SEQ ID NO: 717874 - DNA, 25 bp, Mus musculus
gtgtgcctctgtatggaaaattggt

SEQ ID NO: 717875 - DNA, 25 bp, Mus musculus
gtgtgcctctgtttggaaaattggt

SEQ ID NO: 717876 - DNA, 25 bp, Mus musculus
gtgtgcctcttcaggcaggagtgca

SEQ ID NO: 717877 - DNA, 25 bp, Mus musculus
gtgtgcctcttctggcaggagtgca

SEQ ID NO: 717878 - DNA, 25 bp, Mus musculus
gtgtgcctgcacatgtgaaggtcca

SEQ ID NO: 717879 - DNA, 25 bp, Mus musculus
gtgtgcctgcacttgtgaaggtcca

SEQ ID NO: 717880 - DNA, 25 bp, Mus musculus
gtgtgcctgcctaagagaaaacata

SEQ ID NO: 717881 - DNA, 25 bp, Mus musculus
gtgtgcctgcctccataacaaaaat

SEQ ID NO: 717882 - DNA, 25 bp, Mus musculus
gtgtgcctgcctgcataacaaaaat

SEQ ID NO: 717883 - DNA, 25 bp, Mus musculus
gtgtgcctgccttagagaaaacata

SEQ ID NO: 717884 - DNA, 25 bp, Mus musculus
gtgtgcctgctaaagacgcattcta

SEQ ID NO: 717885 - DNA, 25 bp, Mus musculus
gtgtgcctgctatagacgcattcta

SEQ ID NO: 717886 - DNA, 25 bp, Mus musculus
gtgtgcctggaaatgcatcatgctc

SEQ ID NO: 717887 - DNA, 25 bp, Mus musculus
gtgtgcctggaacccaaaagatctt

SEQ ID NO: 717888 - DNA, 25 bp, Mus musculus
gtgtgcctggaagccaaaagatctt

SEQ ID NO: 717889 - DNA, 25 bp, Mus musculus
gtgtgcctggaattgcatcatgctc

SEQ ID NO: 717890 - DNA, 25 bp, Mus musculus
gtgtgcctggagattctgaagttca

SEQ ID NO: 717891 - DNA, 25 bp, Mus musculus
gtgtgcctggagtttctgaagttca

SEQ ID NO: 717892 - DNA, 25 bp, Mus musculus
gtgtgcctggcacaacgatctgcac

SEQ ID NO: 717893 - DNA, 25 bp, Mus musculus
gtgtgcctggcagaacgatctgcac

SEQ ID NO: 717894 - DNA, 25 bp, Mus musculus
gtgtgcctggctcctatgaaatcat

SEQ ID NO: 717895 - DNA, 25 bp, Mus musculus
gtgtgcctggctgctatgaaatcat

SEQ ID NO: 717896 - DNA, 25 bp, Mus musculus
gtgtgcctgtccatcctggaggaag

SEQ ID NO: 717897 - DNA, 25 bp, Mus musculus
gtgtgcctgtccttcctggaggaag

SEQ ID NO: 717898 - DNA, 25 bp, Mus musculus
gtgtgcctgttgagtctggtaatga

SEQ ID NO: 717899 - DNA, 25 bp, Mus musculus
gtgtgcctgttgtgtctggtaatga

SEQ ID NO: 717900 - DNA, 25 bp, Mus musculus
gtgtgccttaaaactctatgtgaat

SEQ ID NO: 717901 - DNA, 25 bp, Mus musculus
gtgtgccttaaatctctatgtgaat

SEQ ID NO: 717902 - DNA, 25 bp, Mus musculus
gtgtgccttcaaaaaagttctagct

SEQ ID NO: 717903 - DNA, 25 bp, Mus musculus
gtgtgccttcaataaagttctagct

SEQ ID NO: 717904 - DNA, 25 bp, Mus musculus
gtgtgccttgaaatatttagcttat

SEQ ID NO: 717905 - DNA, 25 bp, Mus musculus
gtgtgccttgaattatttagcttat

SEQ ID NO: 717906 - DNA, 25 bp, Mus musculus
gtgtgccttgtaatgtctaatggac

SEQ ID NO: 717907 - DNA, 25 bp, Mus musculus
gtgtgccttgtactatatgcataca

SEQ ID NO: 717908 - DNA, 25 bp, Mus musculus
gtgtgccttgtagtatatgcataca

SEQ ID NO: 717909 - DNA, 25 bp, Mus musculus
gtgtgccttgtattgtctaatggac

SEQ ID NO: 717910 - DNA, 25 bp, Mus musculus
gtgtgcctttcaagcagtgcccaaa

SEQ ID NO: 717911 - DNA, 25 bp, Mus musculus
gtgtgcctttcatgcagtgcccaaa

SEQ ID NO: 717912 - DNA, 25 bp, Mus musculus
gtgtgcctttggcactcagggacta

SEQ ID NO: 717913 - DNA, 25 bp, Mus musculus
gtgtgcctttgggactcagggacta

SEQ ID NO: 717914 - DNA, 25 bp, Mus musculus
gtgtgcgaatatagaccctggtctg

SEQ ID NO: 717915 - DNA, 25 bp, Mus musculus
gtgtgcgaatattgaccctggtctg

SEQ ID NO: 717916 - DNA, 25 bp, Mus musculus
gtgtgcgaattcaagctcggaccct

SEQ ID NO: 717917 - DNA, 25 bp, Mus musculus
gtgtgcgaattctagctcggaccct

SEQ ID NO: 717918 - DNA, 25 bp, Mus musculus
gtgtgcgacaacagcgaacagttac

SEQ ID NO: 717919 - DNA, 25 bp, Mus musculus
gtgtgcgacaactgcgaacagttac

SEQ ID NO: 717920 - DNA, 25 bp, Mus musculus
gtgtgcgacatccttcaaggacaac

SEQ ID NO: 717921 - DNA, 25 bp, Mus musculus
gtgtgcgacatcgttcaaggacaac

SEQ ID NO: 717922 - DNA, 25 bp, Mus musculus
gtgtgcgaccatcacctgggctgca

SEQ ID NO: 717923 - DNA, 25 bp, Mus musculus
gtgtgcgaccatgacctgggctgca

SEQ ID NO: 717924 - DNA, 25 bp, Mus musculus
gtgtgcgagaccatgggaacgactc

SEQ ID NO: 717925 - DNA, 25 bp, Mus musculus
gtgtgcgagaccttgggaacgactc

SEQ ID NO: 717926 - DNA, 25 bp, Mus musculus
gtgtgcgaggaaatcaccattatca

SEQ ID NO: 717927 - DNA, 25 bp, Mus musculus
gtgtgcgaggaattcaccattatca

SEQ ID NO: 717928 - DNA, 25 bp, Mus musculus
gtgtgcgaggagatcgccattatcc

SEQ ID NO: 717929 - DNA, 25 bp, Mus musculus
gtgtgcgaggagttcgccattatcc

SEQ ID NO: 717930 - DNA, 25 bp, Mus musculus
gtgtgcgagtgaagtcaccaggccc

SEQ ID NO: 717931 - DNA, 25 bp, Mus musculus
gtgtgcgagtgatgtcaccaggccc

SEQ ID NO: 717932 - DNA, 25 bp, Mus musculus
gtgtgcgcacacaataagggcttgc

SEQ ID NO: 717933 - DNA, 25 bp, Mus musculus
gtgtgcgcacactataagggcttgc

SEQ ID NO: 717934 - DNA, 25 bp, Mus musculus
gtgtgcgcacatcgctatgtgagca

SEQ ID NO: 717935 - DNA, 25 bp, Mus musculus
gtgtgcgcacatggctatgtgagca

SEQ ID NO: 717936 - DNA, 25 bp, Mus musculus
gtgtgcgccattattcatgtgtcat

SEQ ID NO: 717937 - DNA, 25 bp, Mus musculus
gtgtgcgccatttttcatgtgtcat

SEQ ID NO: 717938 - DNA, 25 bp, Mus musculus
gtgtgcgcctctcttgatcttgcag

SEQ ID NO: 717939 - DNA, 25 bp, Mus musculus
gtgtgcgcctctgttgatcttgcag

SEQ ID NO: 717940 - DNA, 25 bp, Mus musculus
gtgtgcgcgcgtctttttgtttttg

SEQ ID NO: 717941 - DNA, 25 bp, Mus musculus
gtgtgcgcgcgtgtttttgtttttg

SEQ ID NO: 717942 - DNA, 25 bp, Mus musculus
gtgtgcgcgctacatatgtctatat

SEQ ID NO: 717943 - DNA, 25 bp, Mus musculus
gtgtgcgcgctagatatgtctatat

SEQ ID NO: 717944 - DNA, 25 bp, Mus musculus
gtgtgcgcgtgcatgaacttctaca

SEQ ID NO: 717945 - DNA, 25 bp, Mus musculus
gtgtgcgcgtgcttgaacttctaca

SEQ ID NO: 717946 - DNA, 25 bp, Mus musculus
gtgtgcgctgctaaggccatggtaa

SEQ ID NO: 717947 - DNA, 25 bp, Mus musculus
gtgtgcgctgcttaggccatggtaa

SEQ ID NO: 717948 - DNA, 25 bp, Mus musculus
gtgtgcggtaaaaaccattcctaat

SEQ ID NO: 717949 - DNA, 25 bp, Mus musculus
gtgtgcggtaaataccattcctaat

SEQ ID NO: 717950 - DNA, 25 bp, Mus musculus
gtgtgcgtatgcatgtgtatttaca

SEQ ID NO: 717951 - DNA, 25 bp, Mus musculus
gtgtgcgtatgcttgtgtatttaca

SEQ ID NO: 717952 - DNA, 25 bp, Mus musculus
gtgtgcgtgacccactgatgaatgt

SEQ ID NO: 717953 - DNA, 25 bp, Mus musculus
gtgtgcgtgaccgactgatgaatgt

SEQ ID NO: 717954 - DNA, 25 bp, Mus musculus
gtgtgcgtgtcacctgtgccatcat

SEQ ID NO: 717955 - DNA, 25 bp, Mus musculus
gtgtgcgtgtcagctgtgccatcat

SEQ ID NO: 717956 - DNA, 25 bp, Mus musculus
gtgtgcgtgtgaatttaattccagg

SEQ ID NO: 717957 - DNA, 25 bp, Mus musculus
gtgtgcgtgtgattttaattccagg

SEQ ID NO: 717958 - DNA, 25 bp, Mus musculus
gtgtgcgtttctctctttgagacac

SEQ ID NO: 717959 - DNA, 25 bp, Mus musculus
gtgtgcgtttctgtctttgagacac

SEQ ID NO: 717960 - DNA, 25 bp, Mus musculus
gtgtgctaaccacttacttgattct

SEQ ID NO: 717961 - DNA, 25 bp, Mus musculus
gtgtgctaaccagttacttgattct

SEQ ID NO: 717962 - DNA, 25 bp, Mus musculus
gtgtgctaacccataccaccttgtt

SEQ ID NO: 717963 - DNA, 25 bp, Mus musculus
gtgtgctaacccttaccaccttgtt

SEQ ID NO: 717964 - DNA, 25 bp, Mus musculus
gtgtgctaactgcaaagccttgtca

SEQ ID NO: 717965 - DNA, 25 bp, Mus musculus
gtgtgctaactggaaagccttgtca

SEQ ID NO: 717966 - DNA, 25 bp, Mus musculus
gtgtgctaatgtagtccacatttat

SEQ ID NO: 717967 - DNA, 25 bp, Mus musculus
gtgtgctaatgttgtccacatttat

SEQ ID NO: 717968 - DNA, 25 bp, Mus musculus
gtgtgctacaagaggctttcataga

SEQ ID NO: 717969 - DNA, 25 bp, Mus musculus
gtgtgctacaagtggctttcataga

SEQ ID NO: 717970 - DNA, 25 bp, Mus musculus
gtgtgctacacccttgcaattatta

SEQ ID NO: 717971 - DNA, 25 bp, Mus musculus
gtgtgctacaccgttgcaattatta

SEQ ID NO: 717972 - DNA, 25 bp, Mus musculus
gtgtgctacataaattacagctctt

SEQ ID NO: 717973 - DNA, 25 bp, Mus musculus
gtgtgctacatatattacagctctt

SEQ ID NO: 717974 - DNA, 25 bp, Mus musculus
gtgtgctacatcaactttaccagga

SEQ ID NO: 717975 - DNA, 25 bp, Mus musculus
gtgtgctacatctactttaccagga

SEQ ID NO: 717976 - DNA, 25 bp, Mus musculus
gtgtgctaccacaacctggcacaga

SEQ ID NO: 717977 - DNA, 25 bp, Mus musculus
gtgtgctaccacatatgactgaaca

SEQ ID NO: 717978 - DNA, 25 bp, Mus musculus
gtgtgctaccactacctggcacaga

SEQ ID NO: 717979 - DNA, 25 bp, Mus musculus
gtgtgctaccacttatgactgaaca

SEQ ID NO: 717980 - DNA, 25 bp, Mus musculus
gtgtgctaccttaagtattactgcc

SEQ ID NO: 717981 - DNA, 25 bp, Mus musculus
gtgtgctacctttagtattactgcc

SEQ ID NO: 717982 - DNA, 25 bp, Mus musculus
gtgtgctacttcagagtcctcagtg

SEQ ID NO: 717983 - DNA, 25 bp, Mus musculus
gtgtgctacttctgagtcctcagtg

SEQ ID NO: 717984 - DNA, 25 bp, Mus musculus
gtgtgctagcacatcattataatcc

SEQ ID NO: 717985 - DNA, 25 bp, Mus musculus
gtgtgctagcacttcattataatcc

SEQ ID NO: 717986 - DNA, 25 bp, Mus musculus
gtgtgctaggcaccatcatgggcat

SEQ ID NO: 717987 - DNA, 25 bp, Mus musculus
gtgtgctaggcagcatcatgggcat

SEQ ID NO: 717988 - DNA, 25 bp, Mus musculus
gtgtgctatatgacccagtatccaa

SEQ ID NO: 717989 - DNA, 25 bp, Mus musculus
gtgtgctatatgtcccagtatccaa

SEQ ID NO: 717990 - DNA, 25 bp, Mus musculus
gtgtgctatctgactggaggagtat

SEQ ID NO: 717991 - DNA, 25 bp, Mus musculus
gtgtgctatctgtctggaggagtat

SEQ ID NO: 717992 - DNA, 25 bp, Mus musculus
gtgtgctatgatagaactctgtgaa

SEQ ID NO: 717993 - DNA, 25 bp, Mus musculus
gtgtgctatgattgaactctgtgaa

SEQ ID NO: 717994 - DNA, 25 bp, Mus musculus
gtgtgctatgcaacagcctgtggta

SEQ ID NO: 717995 - DNA, 25 bp, Mus musculus
gtgtgctatgcatcagcctgtggta

SEQ ID NO: 717996 - DNA, 25 bp, Mus musculus
gtgtgctatgttattgtagatcctc

SEQ ID NO: 717997 - DNA, 25 bp, Mus musculus
gtgtgctatgtttttgtagatcctc

SEQ ID NO: 717998 - DNA, 25 bp, Mus musculus
gtgtgctcaagaccctaggttcagt

SEQ ID NO: 717999 - DNA, 25 bp, Mus musculus
gtgtgctcaagagcctaggttcagt

SEQ ID NO: 718000 - DNA, 25 bp, Mus musculus
gtgtgctcaagtcattaatcccaga

SEQ ID NO: 718001 - DNA, 25 bp, Mus musculus
gtgtgctcaagtcttagtgtggaac

SEQ ID NO: 718002 - DNA, 25 bp, Mus musculus
gtgtgctcaagtgattaatcccaga

SEQ ID NO: 718003 - DNA, 25 bp, Mus musculus
gtgtgctcaagtgttagtgtggaac

SEQ ID NO: 718004 - DNA, 25 bp, Mus musculus
gtgtgctcacaccagagaccttaat

SEQ ID NO: 718005 - DNA, 25 bp, Mus musculus
gtgtgctcacacgagagaccttaat

SEQ ID NO: 718006 - DNA, 25 bp, Mus musculus
gtgtgctcacagctcatgtgtgtta

SEQ ID NO: 718007 - DNA, 25 bp, Mus musculus
gtgtgctcacaggtcatgtgtgtta

SEQ ID NO: 718008 - DNA, 25 bp, Mus musculus
gtgtgctcacctaatgaaaggttat

SEQ ID NO: 718009 - DNA, 25 bp, Mus musculus
gtgtgctcaccttatgaaaggttat

SEQ ID NO: 718010 - DNA, 25 bp, Mus musculus
gtgtgctcagaactctctttaccaa

SEQ ID NO: 718011 - DNA, 25 bp, Mus musculus
gtgtgctcagaagtctctttaccaa

SEQ ID NO: 718012 - DNA, 25 bp, Mus musculus
gtgtgctcattcatacacgtctgta

SEQ ID NO: 718013 - DNA, 25 bp, Mus musculus
gtgtgctcattcttacacgtctgta

SEQ ID NO: 718014 - DNA, 25 bp, Mus musculus
gtgtgctccagaatctactcgataa

SEQ ID NO: 718015 - DNA, 25 bp, Mus musculus
gtgtgctccagattctactcgataa

SEQ ID NO: 718016 - DNA, 25 bp, Mus musculus
gtgtgctccaggctgcaaacactgc

SEQ ID NO: 718017 - DNA, 25 bp, Mus musculus
gtgtgctccagggtgcaaacactgc

SEQ ID NO: 718018 - DNA, 25 bp, Mus musculus
gtgtgctccattatgatgtaaaagt

SEQ ID NO: 718019 - DNA, 25 bp, Mus musculus
gtgtgctccattttgatgtaaaagt

SEQ ID NO: 718020 - DNA, 25 bp, Mus musculus
gtgtgctcctaaatcatcctgggat

SEQ ID NO: 718021 - DNA, 25 bp, Mus musculus
gtgtgctcctaattcatcctgggat

SEQ ID NO: 718022 - DNA, 25 bp, Mus musculus
gtgtgctcctctcgtagaatctgga

SEQ ID NO: 718023 - DNA, 25 bp, Mus musculus
gtgtgctcctctggtagaatctgga

SEQ ID NO: 718024 - DNA, 25 bp, Mus musculus
gtgtgctcctgtaactcagaattct

SEQ ID NO: 718025 - DNA, 25 bp, Mus musculus
gtgtgctcctgttactcagaattct

SEQ ID NO: 718026 - DNA, 25 bp, Mus musculus
gtgtgctcgagaaccaatagctcag

SEQ ID NO: 718027 - DNA, 25 bp, Mus musculus
gtgtgctcgagacccatctagacct

SEQ ID NO: 718028 - DNA, 25 bp, Mus musculus
gtgtgctcgagagccatctagacct

SEQ ID NO: 718029 - DNA, 25 bp, Mus musculus
gtgtgctcgagatccaatagctcag

SEQ ID NO: 718030 - DNA, 25 bp, Mus musculus
gtgtgctctagacgagcctcagcca

SEQ ID NO: 718031 - DNA, 25 bp, Mus musculus
gtgtgctctagaggagcctcagcca

SEQ ID NO: 718032 - DNA, 25 bp, Mus musculus
gtgtgctctcaaccttgcattaatt

SEQ ID NO: 718033 - DNA, 25 bp, Mus musculus
gtgtgctctcaagcttgcattaatt

SEQ ID NO: 718034 - DNA, 25 bp, Mus musculus
gtgtgctctctgatcttgtataatc

SEQ ID NO: 718035 - DNA, 25 bp, Mus musculus
gtgtgctctctgttcttgtataatc

SEQ ID NO: 718036 - DNA, 25 bp, Mus musculus
gtgtgctctgacatctttaataagg

SEQ ID NO: 718037 - DNA, 25 bp, Mus musculus
gtgtgctctgacttctttaataagg

SEQ ID NO: 718038 - DNA, 25 bp, Mus musculus
gtgtgctctggacaccaatgtgaag

SEQ ID NO: 718039 - DNA, 25 bp, Mus musculus
gtgtgctctggagaccaatgtgaag

SEQ ID NO: 718040 - DNA, 25 bp, Mus musculus
gtgtgctctgggcaagttcttccca

SEQ ID NO: 718041 - DNA, 25 bp, Mus musculus
gtgtgctctggggaagttcttccca

SEQ ID NO: 718042 - DNA, 25 bp, Mus musculus
gtgtgctctgtaagaaagacttcct

SEQ ID NO: 718043 - DNA, 25 bp, Mus musculus
gtgtgctctgtacaagtgcagccat

SEQ ID NO: 718044 - DNA, 25 bp, Mus musculus
gtgtgctctgtagaagtgcagccat

SEQ ID NO: 718045 - DNA, 25 bp, Mus musculus
gtgtgctctgtatgaaagacttcct

SEQ ID NO: 718046 - DNA, 25 bp, Mus musculus
gtgtgctctgtcactgcggcataaa

SEQ ID NO: 718047 - DNA, 25 bp, Mus musculus
gtgtgctctgtctctgcggcataaa

SEQ ID NO: 718048 - DNA, 25 bp, Mus musculus
gtgtgctcttaacgttgtatgtttt

SEQ ID NO: 718049 - DNA, 25 bp, Mus musculus
gtgtgctcttaaggttgtatgtttt

SEQ ID NO: 718050 - DNA, 25 bp, Mus musculus
gtgtgctgagaactgaaaccagctc

SEQ ID NO: 718051 - DNA, 25 bp, Mus musculus
gtgtgctgagaagtgaaaccagctc

SEQ ID NO: 718052 - DNA, 25 bp, Mus musculus
gtgtgctgagccagcagttctcaac

SEQ ID NO: 718053 - DNA, 25 bp, Mus musculus
gtgtgctgagcctgcagttctcaac

SEQ ID NO: 718054 - DNA, 25 bp, Mus musculus
gtgtgctgagttatgcagccttgca

SEQ ID NO: 718055 - DNA, 25 bp, Mus musculus
gtgtgctgagttttgcagccttgca

SEQ ID NO: 718056 - DNA, 25 bp, Mus musculus
gtgtgctgcactaaatttcatggac

SEQ ID NO: 718057 - DNA, 25 bp, Mus musculus
gtgtgctgcactattgaattcccct

SEQ ID NO: 718058 - DNA, 25 bp, Mus musculus
gtgtgctgcactcatcaatgggtat

SEQ ID NO: 718059 - DNA, 25 bp, Mus musculus
gtgtgctgcactgatcaatgggtat

SEQ ID NO: 718060 - DNA, 25 bp, Mus musculus
gtgtgctgcacttaatttcatggac

SEQ ID NO: 718061 - DNA, 25 bp, Mus musculus
gtgtgctgcacttttgaattcccct

SEQ ID NO: 718062 - DNA, 25 bp, Mus musculus
gtgtgctgccgaaaccatatgttca

SEQ ID NO: 718063 - DNA, 25 bp, Mus musculus
gtgtgctgccgataccatatgttca

SEQ ID NO: 718064 - DNA, 25 bp, Mus musculus
gtgtgctgcctgatgcatctaggga

SEQ ID NO: 718065 - DNA, 25 bp, Mus musculus
gtgtgctgcctgcaggactcagtaa

SEQ ID NO: 718066 - DNA, 25 bp, Mus musculus
gtgtgctgcctggaggactcagtaa

SEQ ID NO: 718067 - DNA, 25 bp, Mus musculus
gtgtgctgcctgttgcatctaggga

SEQ ID NO: 718068 - DNA, 25 bp, Mus musculus
gtgtgctgctttatactccagtaca

SEQ ID NO: 718069 - DNA, 25 bp, Mus musculus
gtgtgctgctttttactccagtaca

SEQ ID NO: 718070 - DNA, 25 bp, Mus musculus
gtgtgctggaacactacacctatgg

SEQ ID NO: 718071 - DNA, 25 bp, Mus musculus
gtgtgctggaactctacacctatgg

SEQ ID NO: 718072 - DNA, 25 bp, Mus musculus
gtgtgctggaatcacctaagcctgt

SEQ ID NO: 718073 - DNA, 25 bp, Mus musculus
gtgtgctggaatgacctaagcctgt

SEQ ID NO: 718074 - DNA, 25 bp, Mus musculus
gtgtgctggagtatgcaaacctcgt

SEQ ID NO: 718075 - DNA, 25 bp, Mus musculus
gtgtgctggagtttgcaaacctcgt

SEQ ID NO: 718076 - DNA, 25 bp, Mus musculus
gtgtgctgggcaacaaagtgaagat

SEQ ID NO: 718077 - DNA, 25 bp, Mus musculus
gtgtgctgggcaatgcagccattat

SEQ ID NO: 718078 - DNA, 25 bp, Mus musculus
gtgtgctgggcatcaaagtgaagat

SEQ ID NO: 718079 - DNA, 25 bp, Mus musculus
gtgtgctgggcattgcagccattat

SEQ ID NO: 718080 - DNA, 25 bp, Mus musculus
gtgtgctgggcgagtgttcactaat

SEQ ID NO: 718081 - DNA, 25 bp, Mus musculus
gtgtgctgggcgtgtgttcactaat

SEQ ID NO: 718082 - DNA, 25 bp, Mus musculus
gtgtgctggtccacaggccgaatca

SEQ ID NO: 718083 - DNA, 25 bp, Mus musculus
gtgtgctggtcctcaggccgaatca

SEQ ID NO: 718084 - DNA, 25 bp, Mus musculus
gtgtgctggttcaagagcaacccat

SEQ ID NO: 718085 - DNA, 25 bp, Mus musculus
gtgtgctggttctagagcaacccat

SEQ ID NO: 718086 - DNA, 25 bp, Mus musculus
gtgtgctgtcaaagtgtgcttagct

SEQ ID NO: 718087 - DNA, 25 bp, Mus musculus
gtgtgctgtcaatgtgtgcttagct

SEQ ID NO: 718088 - DNA, 25 bp, Mus musculus
gtgtgctgtcagagtcgagttgttc

SEQ ID NO: 718089 - DNA, 25 bp, Mus musculus
gtgtgctgtcagctttggaaagcca

SEQ ID NO: 718090 - DNA, 25 bp, Mus musculus
gtgtgctgtcaggtttggaaagcca

SEQ ID NO: 718091 - DNA, 25 bp, Mus musculus
gtgtgctgtcagtgtcgagttgttc

SEQ ID NO: 718092 - DNA, 25 bp, Mus musculus
gtgtgctgtcctctcccagaaggac

SEQ ID NO: 718093 - DNA, 25 bp, Mus musculus
gtgtgctgtcctgtcccagaaggac

SEQ ID NO: 718094 - DNA, 25 bp, Mus musculus
gtgtgctgtgagaaagatggctttc

SEQ ID NO: 718095 - DNA, 25 bp, Mus musculus
gtgtgctgtgagtaagatggctttc

SEQ ID NO: 718096 - DNA, 25 bp, Mus musculus
gtgtgctgtgcaacattttgctaca

SEQ ID NO: 718097 - DNA, 25 bp, Mus musculus
gtgtgctgtgcatcattttgctaca

SEQ ID NO: 718098 - DNA, 25 bp, Mus musculus
gtgtgctgtggcatcaggcttcacc

SEQ ID NO: 718099 - DNA, 25 bp, Mus musculus
gtgtgctgtggcttcaggcttcacc

SEQ ID NO: 718100 - DNA, 25 bp, Mus musculus
gtgtgctgtgttacctttaccctgt

SEQ ID NO: 718101 - DNA, 25 bp, Mus musculus
gtgtgctgtgttctcttgcagatgt

SEQ ID NO: 718102 - DNA, 25 bp, Mus musculus
gtgtgctgtgttgtcttgcagatgt

SEQ ID NO: 718103 - DNA, 25 bp, Mus musculus
gtgtgctgtgtttcctttaccctgt

SEQ ID NO: 718104 - DNA, 25 bp, Mus musculus
gtgtgctgttgaacctgggacatgt

SEQ ID NO: 718105 - DNA, 25 bp, Mus musculus
gtgtgctgttgatcctgggacatgt

SEQ ID NO: 718106 - DNA, 25 bp, Mus musculus
gtgtgctgttggcatcattctggaa

SEQ ID NO: 718107 - DNA, 25 bp, Mus musculus
gtgtgctgttgggatcattctggaa

SEQ ID NO: 718108 - DNA, 25 bp, Mus musculus
gtgtgctgtttactcctgatcagat

SEQ ID NO: 718109 - DNA, 25 bp, Mus musculus
gtgtgctgtttagtcctgatcagat

SEQ ID NO: 718110 - DNA, 25 bp, Mus musculus
gtgtgctgtttccaatggcattctt

SEQ ID NO: 718111 - DNA, 25 bp, Mus musculus
gtgtgctgtttcgaatggcattctt

SEQ ID NO: 718112 - DNA, 25 bp, Mus musculus
gtgtgctgttttctaagctgaatga

SEQ ID NO: 718113 - DNA, 25 bp, Mus musculus
gtgtgctgttttgtaagctgaatga

SEQ ID NO: 718114 - DNA, 25 bp, Mus musculus
gtgtgcttactacaccagaggtgac

SEQ ID NO: 718115 - DNA, 25 bp, Mus musculus
gtgtgcttactagaccagaggtgac

SEQ ID NO: 718116 - DNA, 25 bp, Mus musculus
gtgtgcttactgcttttcatgttct

SEQ ID NO: 718117 - DNA, 25 bp, Mus musculus
gtgtgcttactggttttcatgttct

SEQ ID NO: 718118 - DNA, 25 bp, Mus musculus
gtgtgcttagcaacagtctgacccc

SEQ ID NO: 718119 - DNA, 25 bp, Mus musculus
gtgtgcttagcaacttaggtggcaa

SEQ ID NO: 718120 - DNA, 25 bp, Mus musculus
gtgtgcttagcatcagtctgacccc

SEQ ID NO: 718121 - DNA, 25 bp, Mus musculus
gtgtgcttagcatcttaggtggcaa

SEQ ID NO: 718122 - DNA, 25 bp, Mus musculus
gtgtgcttatccatagcaattccat

SEQ ID NO: 718123 - DNA, 25 bp, Mus musculus
gtgtgcttatccttagcaattccat

SEQ ID NO: 718124 - DNA, 25 bp, Mus musculus
gtgtgcttatgtatttattcgtcaa

SEQ ID NO: 718125 - DNA, 25 bp, Mus musculus
gtgtgcttatgtttttattcgtcaa

SEQ ID NO: 718126 - DNA, 25 bp, Mus musculus
gtgtgcttcaagcagctaggtgcaa

SEQ ID NO: 718127 - DNA, 25 bp, Mus musculus
gtgtgcttcaaggagctaggtgcaa

SEQ ID NO: 718128 - DNA, 25 bp, Mus musculus
gtgtgcttcaggacactgtgcgaaa

SEQ ID NO: 718129 - DNA, 25 bp, Mus musculus
gtgtgcttcaggtcactgtgcgaaa

SEQ ID NO: 718130 - DNA, 25 bp, Mus musculus
gtgtgcttccagaaggttaacttcc

SEQ ID NO: 718131 - DNA, 25 bp, Mus musculus
gtgtgcttccagacctatccctgag

SEQ ID NO: 718132 - DNA, 25 bp, Mus musculus
gtgtgcttccagactgatcaatcaa

SEQ ID NO: 718133 - DNA, 25 bp, Mus musculus
gtgtgcttccagtaggttaacttcc

SEQ ID NO: 718134 - DNA, 25 bp, Mus musculus
gtgtgcttccagtcctatccctgag

SEQ ID NO: 718135 - DNA, 25 bp, Mus musculus
gtgtgcttccagtctgatcaatcaa

SEQ ID NO: 718136 - DNA, 25 bp, Mus musculus
gtgtgcttccttatgaactgctgac

SEQ ID NO: 718137 - DNA, 25 bp, Mus musculus
gtgtgcttccttttgaactgctgac

SEQ ID NO: 718138 - DNA, 25 bp, Mus musculus
gtgtgcttcggtacattatggagag

SEQ ID NO: 718139 - DNA, 25 bp, Mus musculus
gtgtgcttcggttcattatggagag

SEQ ID NO: 718140 - DNA, 25 bp, Mus musculus
gtgtgcttctcacgtgtattcaata

SEQ ID NO: 718141 - DNA, 25 bp, Mus musculus
gtgtgcttctcaggtgtattcaata

SEQ ID NO: 718142 - DNA, 25 bp, Mus musculus
gtgtgcttctctagaataggacccc

SEQ ID NO: 718143 - DNA, 25 bp, Mus musculus
gtgtgcttctcttgaataggacccc

SEQ ID NO: 718144 - DNA, 25 bp, Mus musculus
gtgtgcttcttgatcatccaagagg

SEQ ID NO: 718145 - DNA, 25 bp, Mus musculus
gtgtgcttcttgttcatccaagagg

SEQ ID NO: 718146 - DNA, 25 bp, Mus musculus
gtgtgcttgaagaatctgttctttt

SEQ ID NO: 718147 - DNA, 25 bp, Mus musculus
gtgtgcttgaagtatctgttctttt

SEQ ID NO: 718148 - DNA, 25 bp, Mus musculus
gtgtgcttgactatagcagcttacc

SEQ ID NO: 718149 - DNA, 25 bp, Mus musculus
gtgtgcttgactttagcagcttacc

SEQ ID NO: 718150 - DNA, 25 bp, Mus musculus
gtgtgcttgagtactgccttaaaag

SEQ ID NO: 718151 - DNA, 25 bp, Mus musculus
gtgtgcttgagttctgccttaaaag

SEQ ID NO: 718152 - DNA, 25 bp, Mus musculus
gtgtgcttgcaccagtgcgtgtacc

SEQ ID NO: 718153 - DNA, 25 bp, Mus musculus
gtgtgcttgcacgagtgcgtgtacc

SEQ ID NO: 718154 - DNA, 25 bp, Mus musculus
gtgtgcttggtacaccatggcacgc

SEQ ID NO: 718155 - DNA, 25 bp, Mus musculus
gtgtgcttggtagaccatggcacgc

SEQ ID NO: 718156 - DNA, 25 bp, Mus musculus
gtgtgcttgtggcattccctccatc

SEQ ID NO: 718157 - DNA, 25 bp, Mus musculus
gtgtgcttgtgggattccctccatc

SEQ ID NO: 718158 - DNA, 25 bp, Mus musculus
gtgtgcttgtgtattctaccacaga

SEQ ID NO: 718159 - DNA, 25 bp, Mus musculus
gtgtgcttgtgtcactgtgtataat

SEQ ID NO: 718160 - DNA, 25 bp, Mus musculus
gtgtgcttgtgtgactgtgtataat

SEQ ID NO: 718161 - DNA, 25 bp, Mus musculus
gtgtgcttgtgttttctaccacaga

SEQ ID NO: 718162 - DNA, 25 bp, Mus musculus
gtgtgctttacaaactgtgtatcat

SEQ ID NO: 718163 - DNA, 25 bp, Mus musculus
gtgtgctttacatactgtgtatcat

SEQ ID NO: 718164 - DNA, 25 bp, Mus musculus
gtgtgctttactctcacagggccaa

SEQ ID NO: 718165 - DNA, 25 bp, Mus musculus
gtgtgctttactgtcacagggccaa

SEQ ID NO: 718166 - DNA, 25 bp, Mus musculus
gtgtgctttagtccgttctggttgc

SEQ ID NO: 718167 - DNA, 25 bp, Mus musculus
gtgtgctttagtgcgttctggttgc

SEQ ID NO: 718168 - DNA, 25 bp, Mus musculus
gtgtgctttattcacaaagccaaga

SEQ ID NO: 718169 - DNA, 25 bp, Mus musculus
gtgtgctttattgacaaagccaaga

SEQ ID NO: 718170 - DNA, 25 bp, Mus musculus
gtgtgctttcaaatcaatatggaat

SEQ ID NO: 718171 - DNA, 25 bp, Mus musculus
gtgtgctttcaattcaatatggaat

SEQ ID NO: 718172 - DNA, 25 bp, Mus musculus
gtgtgctttcatcacaggctaatta

SEQ ID NO: 718173 - DNA, 25 bp, Mus musculus
gtgtgctttcatgacaggctaatta

SEQ ID NO: 718174 - DNA, 25 bp, Mus musculus
gtgtgctttcccagtctatgggcca

SEQ ID NO: 718175 - DNA, 25 bp, Mus musculus
gtgtgctttccctgtctatgggcca

SEQ ID NO: 718176 - DNA, 25 bp, Mus musculus
gtgtgctttcttcgtttaggtatac

SEQ ID NO: 718177 - DNA, 25 bp, Mus musculus
gtgtgctttcttggtttaggtatac

SEQ ID NO: 718178 - DNA, 25 bp, Mus musculus
gtgtgctttgcaatttagaagatca

SEQ ID NO: 718179 - DNA, 25 bp, Mus musculus
gtgtgctttgcattttagaagatca

SEQ ID NO: 718180 - DNA, 25 bp, Mus musculus
gtgtgcttttgtaacatggtcagac

SEQ ID NO: 718181 - DNA, 25 bp, Mus musculus
gtgtgcttttgttacatggtcagac

SEQ ID NO: 718182 - DNA, 25 bp, Mus musculus
gtgtggaaaactcttcagtctgact

SEQ ID NO: 718183 - DNA, 25 bp, Mus musculus
gtgtggaaaactgttcagtctgact

SEQ ID NO: 718184 - DNA, 25 bp, Mus musculus
gtgtggaaagatcattttttaaaga

SEQ ID NO: 718185 - DNA, 25 bp, Mus musculus
gtgtggaaagatcctttggcagcca

SEQ ID NO: 718186 - DNA, 25 bp, Mus musculus
gtgtggaaagatgattttttaaaga

SEQ ID NO: 718187 - DNA, 25 bp, Mus musculus
gtgtggaaagatgctttggcagcca

SEQ ID NO: 718188 - DNA, 25 bp, Mus musculus
gtgtggaaagcgacccagaagcccc

SEQ ID NO: 718189 - DNA, 25 bp, Mus musculus
gtgtggaaagcgtcccagaagcccc

SEQ ID NO: 718190 - DNA, 25 bp, Mus musculus
gtgtggaaaggacagcctcctcctg

SEQ ID NO: 718191 - DNA, 25 bp, Mus musculus
gtgtggaaaggagagcctcctcctg

SEQ ID NO: 718192 - DNA, 25 bp, Mus musculus
gtgtggaaatgcaggctcagcaatt

SEQ ID NO: 718193 - DNA, 25 bp, Mus musculus
gtgtggaaatgctggctcagcaatt

SEQ ID NO: 718194 - DNA, 25 bp, Mus musculus
gtgtggaaattcattacattcgcag

SEQ ID NO: 718195 - DNA, 25 bp, Mus musculus
gtgtggaaattctttacattcgcag

SEQ ID NO: 718196 - DNA, 25 bp, Mus musculus
gtgtggaacacaagtgaccctgaca

SEQ ID NO: 718197 - DNA, 25 bp, Mus musculus
gtgtggaacacatgtgaccctgaca

SEQ ID NO: 718198 - DNA, 25 bp, Mus musculus
gtgtggaaccatatcaagtgcattt

SEQ ID NO: 718199 - DNA, 25 bp, Mus musculus
gtgtggaaccatttcaagtgcattt

SEQ ID NO: 718200 - DNA, 25 bp, Mus musculus
gtgtggaaccctcgacaaccttgac

SEQ ID NO: 718201 - DNA, 25 bp, Mus musculus
gtgtggaaccctggacaaccttgac

SEQ ID NO: 718202 - DNA, 25 bp, Mus musculus
gtgtggaagtccacgtaggtcccca

SEQ ID NO: 718203 - DNA, 25 bp, Mus musculus
gtgtggaagtcctcgtaggtcccca

SEQ ID NO: 718204 - DNA, 25 bp, Mus musculus
gtgtggaatatactccgtctctgtc

SEQ ID NO: 718205 - DNA, 25 bp, Mus musculus
gtgtggaatatagtccgtctctgtc

SEQ ID NO: 718206 - DNA, 25 bp, Mus musculus
gtgtggaatgctagatcttggacat

SEQ ID NO: 718207 - DNA, 25 bp, Mus musculus
gtgtggaatgcttgatcttggacat

SEQ ID NO: 718208 - DNA, 25 bp, Mus musculus
gtgtggacaaagacccttggacttt

SEQ ID NO: 718209 - DNA, 25 bp, Mus musculus
gtgtggacaaagtcccttggacttt

SEQ ID NO: 718210 - DNA, 25 bp, Mus musculus
gtgtggacaacaaaggtatctctga

SEQ ID NO: 718211 - DNA, 25 bp, Mus musculus
gtgtggacaacataggtatctctga

SEQ ID NO: 718212 - DNA, 25 bp, Mus musculus
gtgtggacaaccattccatgaaata

SEQ ID NO: 718213 - DNA, 25 bp, Mus musculus
gtgtggacaacctttccatgaaata

SEQ ID NO: 718214 - DNA, 25 bp, Mus musculus
gtgtggacacggcactgacgcaaca

SEQ ID NO: 718215 - DNA, 25 bp, Mus musculus
gtgtggacacgggactgacgcaaca

SEQ ID NO: 718216 - DNA, 25 bp, Mus musculus
gtgtggacacttcaaatcccaccaa

SEQ ID NO: 718217 - DNA, 25 bp, Mus musculus
gtgtggacacttgaaatcccaccaa

SEQ ID NO: 718218 - DNA, 25 bp, Mus musculus
gtgtggacagaaacccgtgatcact

SEQ ID NO: 718219 - DNA, 25 bp, Mus musculus
gtgtggacagaatcccgtgatcact

SEQ ID NO: 718220 - DNA, 25 bp, Mus musculus
gtgtggacagagagcccctgctgaa

SEQ ID NO: 718221 - DNA, 25 bp, Mus musculus
gtgtggacagagtgcccctgctgaa

SEQ ID NO: 718222 - DNA, 25 bp, Mus musculus
gtgtggacagccctgcactgttttc

SEQ ID NO: 718223 - DNA, 25 bp, Mus musculus
gtgtggacagccgtgcactgttttc

SEQ ID NO: 718224 - DNA, 25 bp, Mus musculus
gtgtggacagtgaagctccatgtct

SEQ ID NO: 718225 - DNA, 25 bp, Mus musculus
gtgtggacagtgagtttctatgttt

SEQ ID NO: 718226 - DNA, 25 bp, Mus musculus
gtgtggacagtgtagctccatgtct

SEQ ID NO: 718227 - DNA, 25 bp, Mus musculus
gtgtggacagtgtgtttctatgttt

SEQ ID NO: 718228 - DNA, 25 bp, Mus musculus
gtgtggacatctccaaaggccagcc

SEQ ID NO: 718229 - DNA, 25 bp, Mus musculus
gtgtggacatctcgccaagtctgat

SEQ ID NO: 718230 - DNA, 25 bp, Mus musculus
gtgtggacatctgcaaaggccagcc

SEQ ID NO: 718231 - DNA, 25 bp, Mus musculus
gtgtggacatctggccaagtctgat

SEQ ID NO: 718232 - DNA, 25 bp, Mus musculus
gtgtggacattacctttttctgtaa

SEQ ID NO: 718233 - DNA, 25 bp, Mus musculus
gtgtggacattagctttttctgtaa

SEQ ID NO: 718234 - DNA, 25 bp, Mus musculus
gtgtggaccaagctgactggattta

SEQ ID NO: 718235 - DNA, 25 bp, Mus musculus
gtgtggaccaaggtgactggattta

SEQ ID NO: 718236 - DNA, 25 bp, Mus musculus
gtgtggaccacactccagcttaatt

SEQ ID NO: 718237 - DNA, 25 bp, Mus musculus
gtgtggaccacagtccagcttaatt

SEQ ID NO: 718238 - DNA, 25 bp, Mus musculus
gtgtggaccaccagacaaatgccat

SEQ ID NO: 718239 - DNA, 25 bp, Mus musculus
gtgtggaccacctgacaaatgccat

SEQ ID NO: 718240 - DNA, 25 bp, Mus musculus
gtgtggaccatgaacatatgtttac

SEQ ID NO: 718241 - DNA, 25 bp, Mus musculus
gtgtggaccatgtacatatgtttac

SEQ ID NO: 718242 - DNA, 25 bp, Mus musculus
gtgtggaccctgagactatggatga

SEQ ID NO: 718243 - DNA, 25 bp, Mus musculus
gtgtggaccctgtgactatggatga

SEQ ID NO: 718244 - DNA, 25 bp, Mus musculus
gtgtggacctctctgatgggacatc

SEQ ID NO: 718245 - DNA, 25 bp, Mus musculus
gtgtggacctctgtgatgggacatc

SEQ ID NO: 718246 - DNA, 25 bp, Mus musculus
gtgtggacgaccagttactggacat

SEQ ID NO: 718247 - DNA, 25 bp, Mus musculus
gtgtggacgacctgttactggacat

SEQ ID NO: 718248 - DNA, 25 bp, Mus musculus
gtgtggacgatgactttgtattcat

SEQ ID NO: 718249 - DNA, 25 bp, Mus musculus
gtgtggacgatgtctttgtattcat

SEQ ID NO: 718250 - DNA, 25 bp, Mus musculus
gtgtggactctaaaccatcgtggtc

SEQ ID NO: 718251 - DNA, 25 bp, Mus musculus
gtgtggactctataccatcgtggtc

SEQ ID NO: 718252 - DNA, 25 bp, Mus musculus
gtgtggactgaactctgttcactgt

SEQ ID NO: 718253 - DNA, 25 bp, Mus musculus
gtgtggactgaagtctgttcactgt

SEQ ID NO: 718254 - DNA, 25 bp, Mus musculus
gtgtggactgttacgcattaagctt

SEQ ID NO: 718255 - DNA, 25 bp, Mus musculus
gtgtggactgtttcgcattaagctt

SEQ ID NO: 718256 - DNA, 25 bp, Mus musculus
gtgtggagacgacgacccacttgaa

SEQ ID NO: 718257 - DNA, 25 bp, Mus musculus
gtgtggagacgaggacccacttgaa

SEQ ID NO: 718258 - DNA, 25 bp, Mus musculus
gtgtggagagatccacctcacttgt

SEQ ID NO: 718259 - DNA, 25 bp, Mus musculus
gtgtggagagatgcacctcacttgt

SEQ ID NO: 718260 - DNA, 25 bp, Mus musculus
gtgtggagcactagcatggagcact

SEQ ID NO: 718261 - DNA, 25 bp, Mus musculus
gtgtggagcacttgcatggagcact

SEQ ID NO: 718262 - DNA, 25 bp, Mus musculus
gtgtggagcagaaccgcagttacat

SEQ ID NO: 718263 - DNA, 25 bp, Mus musculus
gtgtggagcagatccgcagttacat

SEQ ID NO: 718264 - DNA, 25 bp, Mus musculus
gtgtggagcataattccttactctt

SEQ ID NO: 718265 - DNA, 25 bp, Mus musculus
gtgtggagcatatttccttactctt

SEQ ID NO: 718266 - DNA, 25 bp, Mus musculus
gtgtggagccaacttgaatttactt

SEQ ID NO: 718267 - DNA, 25 bp, Mus musculus
gtgtggagccaagttgaatttactt

SEQ ID NO: 718268 - DNA, 25 bp, Mus musculus
gtgtggagccagatggtctccggca

SEQ ID NO: 718269 - DNA, 25 bp, Mus musculus
gtgtggagccagttggtctccggca

SEQ ID NO: 718270 - DNA, 25 bp, Mus musculus
gtgtggagccttctttggtccagaa

SEQ ID NO: 718271 - DNA, 25 bp, Mus musculus
gtgtggagccttgtttggtccagaa

SEQ ID NO: 718272 - DNA, 25 bp, Mus musculus
gtgtggagcgttacgatccgagtaa

SEQ ID NO: 718273 - DNA, 25 bp, Mus musculus
gtgtggagcgtttcgatccgagtaa

SEQ ID NO: 718274 - DNA, 25 bp, Mus musculus
gtgtggagctagactcgggcaccat

SEQ ID NO: 718275 - DNA, 25 bp, Mus musculus
gtgtggagctagtctcgggcaccat

SEQ ID NO: 718276 - DNA, 25 bp, Mus musculus
gtgtggagtaacctcctacagcaag

SEQ ID NO: 718277 - DNA, 25 bp, Mus musculus
gtgtggagtaacgtcctacagcaag

SEQ ID NO: 718278 - DNA, 25 bp, Mus musculus
gtgtggagtcatcagctataatctt

SEQ ID NO: 718279 - DNA, 25 bp, Mus musculus
gtgtggagtcatgagctataatctt

SEQ ID NO: 718280 - DNA, 25 bp, Mus musculus
gtgtggataactagcgtgacccatc

SEQ ID NO: 718281 - DNA, 25 bp, Mus musculus
gtgtggataacttgcgtgacccatc

SEQ ID NO: 718282 - DNA, 25 bp, Mus musculus
gtgtggatacatatcatcgatggta

SEQ ID NO: 718283 - DNA, 25 bp, Mus musculus
gtgtggatacatttcatcgatggta

SEQ ID NO: 718284 - DNA, 25 bp, Mus musculus
gtgtggataggcaacgtttcctcgg

SEQ ID NO: 718285 - DNA, 25 bp, Mus musculus
gtgtggataggctacgtttcctcgg

SEQ ID NO: 718286 - DNA, 25 bp, Mus musculus
gtgtggatatcaagggctcggctac

SEQ ID NO: 718287 - DNA, 25 bp, Mus musculus
gtgtggatatcatgggctcggctac

SEQ ID NO: 718288 - DNA, 25 bp, Mus musculus
gtgtggatatgacttccactcaccc

SEQ ID NO: 718289 - DNA, 25 bp, Mus musculus
gtgtggatatgagttccactcaccc

SEQ ID NO: 718290 - DNA, 25 bp, Mus musculus
gtgtggatattacctccagtgtgtt

SEQ ID NO: 718291 - DNA, 25 bp, Mus musculus
gtgtggatattagctccagtgtgtt

SEQ ID NO: 718292 - DNA, 25 bp, Mus musculus
gtgtggatccaactagattgctttt

SEQ ID NO: 718293 - DNA, 25 bp, Mus musculus
gtgtggatccaagtagattgctttt

SEQ ID NO: 718294 - DNA, 25 bp, Mus musculus
gtgtggatcccgagcaagcaagcgc

SEQ ID NO: 718295 - DNA, 25 bp, Mus musculus
gtgtggatcccgtgcaagcaagcgc

SEQ ID NO: 718296 - DNA, 25 bp, Mus musculus
gtgtggatccgaagggccagccttt

SEQ ID NO: 718297 - DNA, 25 bp, Mus musculus
gtgtggatccgatgggccagccttt

SEQ ID NO: 718298 - DNA, 25 bp, Mus musculus
gtgtggatgatgacactgtaaacaa

SEQ ID NO: 718299 - DNA, 25 bp, Mus musculus
gtgtggatgatgatgagcagcgtgt

SEQ ID NO: 718300 - DNA, 25 bp, Mus musculus
gtgtggatgatgtcactgtaaacaa

SEQ ID NO: 718301 - DNA, 25 bp, Mus musculus
gtgtggatgatgttgagcagcgtgt

SEQ ID NO: 718302 - DNA, 25 bp, Mus musculus
gtgtggatggtaccagcagacttcc

SEQ ID NO: 718303 - DNA, 25 bp, Mus musculus
gtgtggatggtagcagcagacttcc

SEQ ID NO: 718304 - DNA, 25 bp, Mus musculus
gtgtggattaacctcagtcaactgt

SEQ ID NO: 718305 - DNA, 25 bp, Mus musculus
gtgtggattaacgtcagtcaactgt

SEQ ID NO: 718306 - DNA, 25 bp, Mus musculus
gtgtggattatcacgccctggactt

SEQ ID NO: 718307 - DNA, 25 bp, Mus musculus
gtgtggattatcacgtttcaaataa

SEQ ID NO: 718308 - DNA, 25 bp, Mus musculus
gtgtggattatctcgccctggactt

SEQ ID NO: 718309 - DNA, 25 bp, Mus musculus
gtgtggattatctcgtttcaaataa

SEQ ID NO: 718310 - DNA, 25 bp, Mus musculus
gtgtggattcttctagaaacttcaa

SEQ ID NO: 718311 - DNA, 25 bp, Mus musculus
gtgtggattcttgtagaaacttcaa

SEQ ID NO: 718312 - DNA, 25 bp, Mus musculus
gtgtggatttcgcagcatcattccc

SEQ ID NO: 718313 - DNA, 25 bp, Mus musculus
gtgtggatttcggagcatcattccc

SEQ ID NO: 718314 - DNA, 25 bp, Mus musculus
gtgtggcaaacactattcactgagc

SEQ ID NO: 718315 - DNA, 25 bp, Mus musculus
gtgtggcaaacagtattcactgagc

SEQ ID NO: 718316 - DNA, 25 bp, Mus musculus
gtgtggcaaacgcttcagtcagtcc

SEQ ID NO: 718317 - DNA, 25 bp, Mus musculus
gtgtggcaaacggttcagtcagtcc

SEQ ID NO: 718318 - DNA, 25 bp, Mus musculus
gtgtggcaaagacttttagtcagca

SEQ ID NO: 718319 - DNA, 25 bp, Mus musculus
gtgtggcaaagagttttagtcagca

SEQ ID NO: 718320 - DNA, 25 bp, Mus musculus
gtgtggcaaccactatagtccttag

SEQ ID NO: 718321 - DNA, 25 bp, Mus musculus
gtgtggcaaccagtatagtccttag

SEQ ID NO: 718322 - DNA, 25 bp, Mus musculus
gtgtggcaaggcattgccagcagca

SEQ ID NO: 718323 - DNA, 25 bp, Mus musculus
gtgtggcaaggctttgccagcagca

SEQ ID NO: 718324 - DNA, 25 bp, Mus musculus
gtgtggcacagaactgcactcagaa

SEQ ID NO: 718325 - DNA, 25 bp, Mus musculus
gtgtggcacagatctgcactcagaa

SEQ ID NO: 718326 - DNA, 25 bp, Mus musculus
gtgtggcaccctcatgaatgtttaa

SEQ ID NO: 718327 - DNA, 25 bp, Mus musculus
gtgtggcaccctctgtaaattgtca

SEQ ID NO: 718328 - DNA, 25 bp, Mus musculus
gtgtggcaccctgatgaatgtttaa

SEQ ID NO: 718329 - DNA, 25 bp, Mus musculus
gtgtggcaccctgtgtaaattgtca

SEQ ID NO: 718330 - DNA, 25 bp, Mus musculus
gtgtggcaccgtattatttgttact

SEQ ID NO: 718331 - DNA, 25 bp, Mus musculus
gtgtggcaccgttttatttgttact

SEQ ID NO: 718332 - DNA, 25 bp, Mus musculus
gtgtggcacctaacacgttgttaga

SEQ ID NO: 718333 - DNA, 25 bp, Mus musculus
gtgtggcacctatcacgttgttaga

SEQ ID NO: 718334 - DNA, 25 bp, Mus musculus
gtgtggcacctgcaaacaagcaacc

SEQ ID NO: 718335 - DNA, 25 bp, Mus musculus
gtgtggcacctggaaacaagcaacc

SEQ ID NO: 718336 - DNA, 25 bp, Mus musculus
gtgtggcactagacaagcttctcag

SEQ ID NO: 718337 - DNA, 25 bp, Mus musculus
gtgtggcactagtcaagcttctcag

SEQ ID NO: 718338 - DNA, 25 bp, Mus musculus
gtgtggcagagcagacggctatgtg

SEQ ID NO: 718339 - DNA, 25 bp, Mus musculus
gtgtggcagagctgacggctatgtg

SEQ ID NO: 718340 - DNA, 25 bp, Mus musculus
gtgtggcaggatacagcctcttttc

SEQ ID NO: 718341 - DNA, 25 bp, Mus musculus
gtgtggcaggatacaggcaatgcta

SEQ ID NO: 718342 - DNA, 25 bp, Mus musculus
gtgtggcaggattcagcctcttttc

SEQ ID NO: 718343 - DNA, 25 bp, Mus musculus
gtgtggcaggattcaggcaatgcta

SEQ ID NO: 718344 - DNA, 25 bp, Mus musculus
gtgtggcaggcaatgctcgagcatc

SEQ ID NO: 718345 - DNA, 25 bp, Mus musculus
gtgtggcaggcattgctcgagcatc

SEQ ID NO: 718346 - DNA, 25 bp, Mus musculus
gtgtggcagggcatccattatctgg

SEQ ID NO: 718347 - DNA, 25 bp, Mus musculus
gtgtggcagggcttccattatctgg

SEQ ID NO: 718348 - DNA, 25 bp, Mus musculus
gtgtggcatagcaacctcactgctg

SEQ ID NO: 718349 - DNA, 25 bp, Mus musculus
gtgtggcatagctacctcactgctg

SEQ ID NO: 718350 - DNA, 25 bp, Mus musculus
gtgtggcatcctctgtaaaaatgtc

SEQ ID NO: 718351 - DNA, 25 bp, Mus musculus
gtgtggcatcctgtgtaaaaatgtc

SEQ ID NO: 718352 - DNA, 25 bp, Mus musculus
gtgtggcatcttactgagcttcgca

SEQ ID NO: 718353 - DNA, 25 bp, Mus musculus
gtgtggcatctttctgagcttcgca

SEQ ID NO: 718354 - DNA, 25 bp, Mus musculus
gtgtggcatggaaaccttaccgaca

SEQ ID NO: 718355 - DNA, 25 bp, Mus musculus
gtgtggcatggataccttaccgaca

SEQ ID NO: 718356 - DNA, 25 bp, Mus musculus
gtgtggcattctcagtcttgtggac

SEQ ID NO: 718357 - DNA, 25 bp, Mus musculus
gtgtggcattctgagtcttgtggac

SEQ ID NO: 718358 - DNA, 25 bp, Mus musculus
gtgtggccaaccaactgatagcaat

SEQ ID NO: 718359 - DNA, 25 bp, Mus musculus
gtgtggccaacctactgatagcaat

SEQ ID NO: 718360 - DNA, 25 bp, Mus musculus
gtgtggccaatgactttgggcatga

SEQ ID NO: 718361 - DNA, 25 bp, Mus musculus
gtgtggccaatgtctttgggcatga

SEQ ID NO: 718362 - DNA, 25 bp, Mus musculus
gtgtggccacatcaactggctggca

SEQ ID NO: 718363 - DNA, 25 bp, Mus musculus
gtgtggccacatgaactggctggca

SEQ ID NO: 718364 - DNA, 25 bp, Mus musculus
gtgtggccacctcaatatcatttat

SEQ ID NO: 718365 - DNA, 25 bp, Mus musculus
gtgtggccacctgaatatcatttat

SEQ ID NO: 718366 - DNA, 25 bp, Mus musculus
gtgtggccactcctccttaacaaat

SEQ ID NO: 718367 - DNA, 25 bp, Mus musculus
gtgtggccactcgtccttaacaaat

SEQ ID NO: 718368 - DNA, 25 bp, Mus musculus
gtgtggccagcaaccgtgtcatcaa

SEQ ID NO: 718369 - DNA, 25 bp, Mus musculus
gtgtggccagcatccgtgtcatcaa

SEQ ID NO: 718370 - DNA, 25 bp, Mus musculus
gtgtggccataaccacctgtgcctg

SEQ ID NO: 718371 - DNA, 25 bp, Mus musculus
gtgtggccataagcacctgtgcctg

SEQ ID NO: 718372 - DNA, 25 bp, Mus musculus
gtgtggcccacaatcttattttaca

SEQ ID NO: 718373 - DNA, 25 bp, Mus musculus
gtgtggcccacattcttattttaca

SEQ ID NO: 718374 - DNA, 25 bp, Mus musculus
gtgtggccccaaacatattcacgat

SEQ ID NO: 718375 - DNA, 25 bp, Mus musculus
gtgtggccccaatcatattcacgat

SEQ ID NO: 718376 - DNA, 25 bp, Mus musculus
gtgtggccccgtcggtgcgcatgtg

SEQ ID NO: 718377 - DNA, 25 bp, Mus musculus
gtgtggccccgtgggtgcgcatgtg

SEQ ID NO: 718378 - DNA, 25 bp, Mus musculus
gtgtggcccctgcaaaacaattgct

SEQ ID NO: 718379 - DNA, 25 bp, Mus musculus
gtgtggcccctggaaaacaattgct

SEQ ID NO: 718380 - DNA, 25 bp, Mus musculus
gtgtggccccttatcagtgtgactg

SEQ ID NO: 718381 - DNA, 25 bp, Mus musculus
gtgtggccccttttcagtgtgactg

SEQ ID NO: 718382 - DNA, 25 bp, Mus musculus
gtgtggccctacactcagaaacata

SEQ ID NO: 718383 - DNA, 25 bp, Mus musculus
gtgtggccctactctcagaaacata

SEQ ID NO: 718384 - DNA, 25 bp, Mus musculus
gtgtggccctgaagccttggctgaa

SEQ ID NO: 718385 - DNA, 25 bp, Mus musculus
gtgtggccctgatgccttggctgaa

SEQ ID NO: 718386 - DNA, 25 bp, Mus musculus
gtgtggccctgtagtaattacctag

SEQ ID NO: 718387 - DNA, 25 bp, Mus musculus
gtgtggccctgttgtaattacctag

SEQ ID NO: 718388 - DNA, 25 bp, Mus musculus
gtgtggccgacaagcctactgctgt

SEQ ID NO: 718389 - DNA, 25 bp, Mus musculus
gtgtggccgacaagcctactgcttt

SEQ ID NO: 718390 - DNA, 25 bp, Mus musculus
gtgtggccgacatgcctactgctgt

SEQ ID NO: 718391 - DNA, 25 bp, Mus musculus
gtgtggccgacatgcctactgcttt

SEQ ID NO: 718392 - DNA, 25 bp, Mus musculus
gtgtggcctgaacaccatgtgttca

SEQ ID NO: 718393 - DNA, 25 bp, Mus musculus
gtgtggcctgaagaccatgtgttca

SEQ ID NO: 718394 - DNA, 25 bp, Mus musculus
gtgtggcctggcagaaaacctcact

SEQ ID NO: 718395 - DNA, 25 bp, Mus musculus
gtgtggcctggctgaaaacctcact

SEQ ID NO: 718396 - DNA, 25 bp, Mus musculus
gtgtggcctttcaatatgtattctc

SEQ ID NO: 718397 - DNA, 25 bp, Mus musculus
gtgtggcctttctatatgtattctc

SEQ ID NO: 718398 - DNA, 25 bp, Mus musculus
gtgtggccttttccaataccctgga

SEQ ID NO: 718399 - DNA, 25 bp, Mus musculus
gtgtggccttttgcaataccctgga

SEQ ID NO: 718400 - DNA, 25 bp, Mus musculus
gtgtggcgtccacatgagcattgta

SEQ ID NO: 718401 - DNA, 25 bp, Mus musculus
gtgtggcgtccagatgagcattgta

SEQ ID NO: 718402 - DNA, 25 bp, Mus musculus
gtgtggcgttctatcccagttagct

SEQ ID NO: 718403 - DNA, 25 bp, Mus musculus
gtgtggcgttctttcccagttagct

SEQ ID NO: 718404 - DNA, 25 bp, Mus musculus
gtgtggctaaggatatgtcatgcta

SEQ ID NO: 718405 - DNA, 25 bp, Mus musculus
gtgtggctaaggttatgtcatgcta

SEQ ID NO: 718406 - DNA, 25 bp, Mus musculus
gtgtggctacaaatcactcatcaga

SEQ ID NO: 718407 - DNA, 25 bp, Mus musculus
gtgtggctacaattcactcatcaga

SEQ ID NO: 718408 - DNA, 25 bp, Mus musculus
gtgtggctatataatgctttgctta

SEQ ID NO: 718409 - DNA, 25 bp, Mus musculus
gtgtggctatattatgctttgctta

SEQ ID NO: 718410 - DNA, 25 bp, Mus musculus
gtgtggctatgacatccgactcaaa

SEQ ID NO: 718411 - DNA, 25 bp, Mus musculus
gtgtggctatgagatccgactcaaa

SEQ ID NO: 718412 - DNA, 25 bp, Mus musculus
gtgtggctcactataacttttctac

SEQ ID NO: 718413 - DNA, 25 bp, Mus musculus
gtgtggctcactttaacttttctac

SEQ ID NO: 718414 - DNA, 25 bp, Mus musculus
gtgtggctcagcagatcccgtgtgc

SEQ ID NO: 718415 - DNA, 25 bp, Mus musculus
gtgtggctcagctgatcccgtgtgc

SEQ ID NO: 718416 - DNA, 25 bp, Mus musculus
gtgtggctccacatcattggaaaga

SEQ ID NO: 718417 - DNA, 25 bp, Mus musculus
gtgtggctccacttcattggaaaga

SEQ ID NO: 718418 - DNA, 25 bp, Mus musculus
gtgtggctcccacttgacaagatac

SEQ ID NO: 718419 - DNA, 25 bp, Mus musculus
gtgtggctcccagttgacaagatac

SEQ ID NO: 718420 - DNA, 25 bp, Mus musculus
gtgtggctctcacggctgtgatcaa

SEQ ID NO: 718421 - DNA, 25 bp, Mus musculus
gtgtggctctcagggctgtgatcaa

SEQ ID NO: 718422 - DNA, 25 bp, Mus musculus
gtgtggctctctcggtgtaaaagta

SEQ ID NO: 718423 - DNA, 25 bp, Mus musculus
gtgtggctctctgggtgtaaaagta

SEQ ID NO: 718424 - DNA, 25 bp, Mus musculus
gtgtggctctgtcaacccgaaaagc

SEQ ID NO: 718425 - DNA, 25 bp, Mus musculus
gtgtggctctgtgaacccgaaaagc

SEQ ID NO: 718426 - DNA, 25 bp, Mus musculus
gtgtggctgagcattcccgtgatat

SEQ ID NO: 718427 - DNA, 25 bp, Mus musculus
gtgtggctgagctttcccgtgatat

SEQ ID NO: 718428 - DNA, 25 bp, Mus musculus
gtgtggctgcacatgacctttcata

SEQ ID NO: 718429 - DNA, 25 bp, Mus musculus
gtgtggctgcacttgacctttcata

SEQ ID NO: 718430 - DNA, 25 bp, Mus musculus
gtgtggctgcataggaaatattatt

SEQ ID NO: 718431 - DNA, 25 bp, Mus musculus
gtgtggctgcattggaaatattatt

SEQ ID NO: 718432 - DNA, 25 bp, Mus musculus
gtgtggctgctcacttaatgtgcca

SEQ ID NO: 718433 - DNA, 25 bp, Mus musculus
gtgtggctgctcaggtaactgactg

SEQ ID NO: 718434 - DNA, 25 bp, Mus musculus
gtgtggctgctctcttaatgtgcca

SEQ ID NO: 718435 - DNA, 25 bp, Mus musculus
gtgtggctgctctggtaactgactg

SEQ ID NO: 718436 - DNA, 25 bp, Mus musculus
gtgtggctgtagatttatctgtatt

SEQ ID NO: 718437 - DNA, 25 bp, Mus musculus
gtgtggctgtagttttatctgtatt

SEQ ID NO: 718438 - DNA, 25 bp, Mus musculus
gtgtggctgtcacaggtctaagcct

SEQ ID NO: 718439 - DNA, 25 bp, Mus musculus
gtgtggctgtcagaggtctaagcct

SEQ ID NO: 718440 - DNA, 25 bp, Mus musculus
gtgtggctgtctagagccgctgcac

SEQ ID NO: 718441 - DNA, 25 bp, Mus musculus
gtgtggctgtcttgagccgctgcac

SEQ ID NO: 718442 - DNA, 25 bp, Mus musculus
gtgtggcttaagatgctgcagtcgt

SEQ ID NO: 718443 - DNA, 25 bp, Mus musculus
gtgtggcttaagttgctgcagtcgt

SEQ ID NO: 718444 - DNA, 25 bp, Mus musculus
gtgtggcttacaacaacatggtccc

SEQ ID NO: 718445 - DNA, 25 bp, Mus musculus
gtgtggcttacatcaacatggtccc

SEQ ID NO: 718446 - DNA, 25 bp, Mus musculus
gtgtggcttagactgcacctgtgca

SEQ ID NO: 718447 - DNA, 25 bp, Mus musculus
gtgtggcttagagtgcacctgtgca

SEQ ID NO: 718448 - DNA, 25 bp, Mus musculus
gtgtggcttccccaaggatgtgcct

SEQ ID NO: 718449 - DNA, 25 bp, Mus musculus
gtgtggcttcccgaaggatgtgcct

SEQ ID NO: 718450 - DNA, 25 bp, Mus musculus
gtgtggcttccgaggcttaaatttt

SEQ ID NO: 718451 - DNA, 25 bp, Mus musculus
gtgtggcttccgtggcttaaatttt

SEQ ID NO: 718452 - DNA, 25 bp, Mus musculus
gtgtggcttcgtctttatattttgt

SEQ ID NO: 718453 - DNA, 25 bp, Mus musculus
gtgtggcttcgtgtttatattttgt

SEQ ID NO: 718454 - DNA, 25 bp, Mus musculus
gtgtggcttctcagttgtgcaggac

SEQ ID NO: 718455 - DNA, 25 bp, Mus musculus
gtgtggcttctctgttgtgcaggac

SEQ ID NO: 718456 - DNA, 25 bp, Mus musculus
gtgtggcttcttagttctaaccaca

SEQ ID NO: 718457 - DNA, 25 bp, Mus musculus
gtgtggcttctttgttctaaccaca

SEQ ID NO: 718458 - DNA, 25 bp, Mus musculus
gtgtggcttgaaactgttacctgat

SEQ ID NO: 718459 - DNA, 25 bp, Mus musculus
gtgtggcttgaatctgttacctgat

SEQ ID NO: 718460 - DNA, 25 bp, Mus musculus
gtgtggcttgctcaccaatataaat

SEQ ID NO: 718461 - DNA, 25 bp, Mus musculus
gtgtggcttgctgaccaatataaat

SEQ ID NO: 718462 - DNA, 25 bp, Mus musculus
gtgtggcttggcctttcaaaggaca

SEQ ID NO: 718463 - DNA, 25 bp, Mus musculus
gtgtggcttggcgtttcaaaggaca

SEQ ID NO: 718464 - DNA, 25 bp, Mus musculus
gtgtggctttggatgggtaacttac

SEQ ID NO: 718465 - DNA, 25 bp, Mus musculus
gtgtggctttggttgggtaacttac

SEQ ID NO: 718466 - DNA, 25 bp, Mus musculus
gtgtgggaactcataggcccggata

SEQ ID NO: 718467 - DNA, 25 bp, Mus musculus
gtgtgggaactcttaggcccggata

SEQ ID NO: 718468 - DNA, 25 bp, Mus musculus
gtgtgggaataaccctcccttactg

SEQ ID NO: 718469 - DNA, 25 bp, Mus musculus
gtgtgggaataagcctcccttactg

SEQ ID NO: 718470 - DNA, 25 bp, Mus musculus
gtgtgggaattgcatgctctgcata

SEQ ID NO: 718471 - DNA, 25 bp, Mus musculus
gtgtgggaattggatgctctgcata

SEQ ID NO: 718472 - DNA, 25 bp, Mus musculus
gtgtgggactagagccatgcaccat

SEQ ID NO: 718473 - DNA, 25 bp, Mus musculus
gtgtgggactagtgccatgcaccat

SEQ ID NO: 718474 - DNA, 25 bp, Mus musculus
gtgtgggagatccttcaccagcagt

SEQ ID NO: 718475 - DNA, 25 bp, Mus musculus
gtgtgggagatcgttcaccagcagt

SEQ ID NO: 718476 - DNA, 25 bp, Mus musculus
gtgtgggagcttaaacccaccttgc

SEQ ID NO: 718477 - DNA, 25 bp, Mus musculus
gtgtgggagctttaacccaccttgc

SEQ ID NO: 718478 - DNA, 25 bp, Mus musculus
gtgtgggagtttcagacactttctc

SEQ ID NO: 718479 - DNA, 25 bp, Mus musculus
gtgtgggagtttgagacactttctc

SEQ ID NO: 718480 - DNA, 25 bp, Mus musculus
gtgtgggatccaaccatttcccagg

SEQ ID NO: 718481 - DNA, 25 bp, Mus musculus
gtgtgggatccatccatttcccagg

SEQ ID NO: 718482 - DNA, 25 bp, Mus musculus
gtgtgggatcccaaggcactgccat

SEQ ID NO: 718483 - DNA, 25 bp, Mus musculus
gtgtgggatccctaggcactgccat

SEQ ID NO: 718484 - DNA, 25 bp, Mus musculus
gtgtgggcaaaaactccaggactgt

SEQ ID NO: 718485 - DNA, 25 bp, Mus musculus
gtgtgggcaaaatctccaggactgt

SEQ ID NO: 718486 - DNA, 25 bp, Mus musculus
gtgtgggcacagattcttacgacca

SEQ ID NO: 718487 - DNA, 25 bp, Mus musculus
gtgtgggcacagtttcttacgacca

SEQ ID NO: 718488 - DNA, 25 bp, Mus musculus
gtgtgggcacccaagtcattaggct

SEQ ID NO: 718489 - DNA, 25 bp, Mus musculus
gtgtgggcaccctagtcattaggct

SEQ ID NO: 718490 - DNA, 25 bp, Mus musculus
gtgtgggccaccatcacctgactgt

SEQ ID NO: 718491 - DNA, 25 bp, Mus musculus
gtgtgggccaccttcacctgactgt

SEQ ID NO: 718492 - DNA, 25 bp, Mus musculus
gtgtgggccttaaagaacattcaac

SEQ ID NO: 718493 - DNA, 25 bp, Mus musculus
gtgtgggccttatagaacattcaac

SEQ ID NO: 718494 - DNA, 25 bp, Mus musculus
gtgtgggctaagcaatagtttcttt

SEQ ID NO: 718495 - DNA, 25 bp, Mus musculus
gtgtgggctaaggaatagtttcttt

SEQ ID NO: 718496 - DNA, 25 bp, Mus musculus
gtgtgggcttttacttattatggtt

SEQ ID NO: 718497 - DNA, 25 bp, Mus musculus
gtgtgggctttttcttattatggtt

SEQ ID NO: 718498 - DNA, 25 bp, Mus musculus
gtgtggggaattaatctaacctggg

SEQ ID NO: 718499 - DNA, 25 bp, Mus musculus
gtgtggggaatttatctaacctggg

SEQ ID NO: 718500 - DNA, 25 bp, Mus musculus
gtgtgggtacaacaaatctcagtgt

SEQ ID NO: 718501 - DNA, 25 bp, Mus musculus
gtgtgggtacaagaaatctcagtgt

SEQ ID NO: 718502 - DNA, 25 bp, Mus musculus
gtgtgggtactgacaacatttggaa

SEQ ID NO: 718503 - DNA, 25 bp, Mus musculus
gtgtgggtactgtcaacatttggaa

SEQ ID NO: 718504 - DNA, 25 bp, Mus musculus
gtgtgggtatatctgctaagcctta

SEQ ID NO: 718505 - DNA, 25 bp, Mus musculus
gtgtgggtatatgtgctaagcctta

SEQ ID NO: 718506 - DNA, 25 bp, Mus musculus
gtgtgggtcaaaacttctctccagt

SEQ ID NO: 718507 - DNA, 25 bp, Mus musculus
gtgtgggtcaaatcttctctccagt

SEQ ID NO: 718508 - DNA, 25 bp, Mus musculus
gtgtgggtcctccaagtataggctt

SEQ ID NO: 718509 - DNA, 25 bp, Mus musculus
gtgtgggtcctcgaagtataggctt

SEQ ID NO: 718510 - DNA, 25 bp, Mus musculus
gtgtgggtctctaccataagcacag

SEQ ID NO: 718511 - DNA, 25 bp, Mus musculus
gtgtgggtctcttccataagcacag

SEQ ID NO: 718512 - DNA, 25 bp, Mus musculus
gtgtgggtgaccatctactctgtca

SEQ ID NO: 718513 - DNA, 25 bp, Mus musculus
gtgtgggtgaccttctactctgtca

SEQ ID NO: 718514 - DNA, 25 bp, Mus musculus
gtgtgggtgcccataaatcctcaag

SEQ ID NO: 718515 - DNA, 25 bp, Mus musculus
gtgtgggtgcccttaaatcctcaag

SEQ ID NO: 718516 - DNA, 25 bp, Mus musculus
gtgtgggtgtcacactcctggaatt

SEQ ID NO: 718517 - DNA, 25 bp, Mus musculus
gtgtgggtgtcagactcctggaatt

SEQ ID NO: 718518 - DNA, 25 bp, Mus musculus
gtgtgggtgtggaagccactcactc

SEQ ID NO: 718519 - DNA, 25 bp, Mus musculus
gtgtgggtgtggtagccactcactc

SEQ ID NO: 718520 - DNA, 25 bp, Mus musculus
gtgtgggttcatcaagcccctgcct

SEQ ID NO: 718521 - DNA, 25 bp, Mus musculus
gtgtgggttcatgaagcccctgcct

SEQ ID NO: 718522 - DNA, 25 bp, Mus musculus
gtgtgggtttagactttgaaactgg

SEQ ID NO: 718523 - DNA, 25 bp, Mus musculus
gtgtgggtttagtctttgaaactgg

SEQ ID NO: 718524 - DNA, 25 bp, Mus musculus
gtgtgggtttctagctttcgtcctc

SEQ ID NO: 718525 - DNA, 25 bp, Mus musculus
gtgtgggtttcttgctttcgtcctc

SEQ ID NO: 718526 - DNA, 25 bp, Mus musculus
gtgtggtaaagcaaatgggcatcat

SEQ ID NO: 718527 - DNA, 25 bp, Mus musculus
gtgtggtaaagctaatgggcatcat

SEQ ID NO: 718528 - DNA, 25 bp, Mus musculus
gtgtggtacaagcatggagaccaca

SEQ ID NO: 718529 - DNA, 25 bp, Mus musculus
gtgtggtacaaggatggagaccaca

SEQ ID NO: 718530 - DNA, 25 bp, Mus musculus
gtgtggtacaccagggcagctcctt

SEQ ID NO: 718531 - DNA, 25 bp, Mus musculus
gtgtggtacacctgggcagctcctt

SEQ ID NO: 718532 - DNA, 25 bp, Mus musculus
gtgtggtacagacaacccagcttgt

SEQ ID NO: 718533 - DNA, 25 bp, Mus musculus
gtgtggtacagagaacccagcttgt

SEQ ID NO: 718534 - DNA, 25 bp, Mus musculus
gtgtggtagaaaccctgcacgccta

SEQ ID NO: 718535 - DNA, 25 bp, Mus musculus
gtgtggtagaaagcctgcacgccta

SEQ ID NO: 718536 - DNA, 25 bp, Mus musculus
gtgtggtagcacaaacagatgcttt

SEQ ID NO: 718537 - DNA, 25 bp, Mus musculus
gtgtggtagcactaacagatgcttt

SEQ ID NO: 718538 - DNA, 25 bp, Mus musculus
gtgtggtatatgatccttgctccaa

SEQ ID NO: 718539 - DNA, 25 bp, Mus musculus
gtgtggtatatgttccttgctccaa

SEQ ID NO: 718540 - DNA, 25 bp, Mus musculus
gtgtggtatcccatagaactccatg

SEQ ID NO: 718541 - DNA, 25 bp, Mus musculus
gtgtggtatcccttagaactccatg

SEQ ID NO: 718542 - DNA, 25 bp, Mus musculus
gtgtggtatggcatcaatctgtaga

SEQ ID NO: 718543 - DNA, 25 bp, Mus musculus
gtgtggtatggcttcaatctgtaga

SEQ ID NO: 718544 - DNA, 25 bp, Mus musculus
gtgtggtatggtacttccattccat

SEQ ID NO: 718545 - DNA, 25 bp, Mus musculus
gtgtggtatggttcttccattccat

SEQ ID NO: 718546 - DNA, 25 bp, Mus musculus
gtgtggtcaaaactctctactttgg

SEQ ID NO: 718547 - DNA, 25 bp, Mus musculus
gtgtggtcaaaagtctctactttgg

SEQ ID NO: 718548 - DNA, 25 bp, Mus musculus
gtgtggtcaacaacacatgtcataa

SEQ ID NO: 718549 - DNA, 25 bp, Mus musculus
gtgtggtcaacaaccatgagcatgg

SEQ ID NO: 718550 - DNA, 25 bp, Mus musculus
gtgtggtcaacatcacatgtcataa

SEQ ID NO: 718551 - DNA, 25 bp, Mus musculus
gtgtggtcaacatccatgagcatgg

SEQ ID NO: 718552 - DNA, 25 bp, Mus musculus
gtgtggtcaagcaccacattgccaa

SEQ ID NO: 718553 - DNA, 25 bp, Mus musculus
gtgtggtcaagctccacattgccaa

SEQ ID NO: 718554 - DNA, 25 bp, Mus musculus
gtgtggtcacagctgacagcttcct

SEQ ID NO: 718555 - DNA, 25 bp, Mus musculus
gtgtggtcacaggtgacagcttcct

SEQ ID NO: 718556 - DNA, 25 bp, Mus musculus
gtgtggtcaccaaccagagtgccaa

SEQ ID NO: 718557 - DNA, 25 bp, Mus musculus
gtgtggtcaccatccagagtgccaa

SEQ ID NO: 718558 - DNA, 25 bp, Mus musculus
gtgtggtcacggctcatcagcaaga

SEQ ID NO: 718559 - DNA, 25 bp, Mus musculus
gtgtggtcacgggtcatcagcaaga

SEQ ID NO: 718560 - DNA, 25 bp, Mus musculus
gtgtggtcactcaatgctagcactc

SEQ ID NO: 718561 - DNA, 25 bp, Mus musculus
gtgtggtcactctatgctagcactc

SEQ ID NO: 718562 - DNA, 25 bp, Mus musculus
gtgtggtcagacacagccacacgca

SEQ ID NO: 718563 - DNA, 25 bp, Mus musculus
gtgtggtcagactcagccacacgca

SEQ ID NO: 718564 - DNA, 25 bp, Mus musculus
gtgtggtcagcactagcgtgctact

SEQ ID NO: 718565 - DNA, 25 bp, Mus musculus
gtgtggtcagcagtagcgtgctact

SEQ ID NO: 718566 - DNA, 25 bp, Mus musculus
gtgtggtcagctcttcctttcatca

SEQ ID NO: 718567 - DNA, 25 bp, Mus musculus
gtgtggtcagctgttcctttcatca

SEQ ID NO: 718568 - DNA, 25 bp, Mus musculus
gtgtggtcagttatgcacgggtctt

SEQ ID NO: 718569 - DNA, 25 bp, Mus musculus
gtgtggtcagttttgcacgggtctt

SEQ ID NO: 718570 - DNA, 25 bp, Mus musculus
gtgtggtcattcaaacaacctgcgc

SEQ ID NO: 718571 - DNA, 25 bp, Mus musculus
gtgtggtcattctaacaacctgcgc

SEQ ID NO: 718572 - DNA, 25 bp, Mus musculus
gtgtggtccagccatcaagtacgga

SEQ ID NO: 718573 - DNA, 25 bp, Mus musculus
gtgtggtccagcgatcaagtacgga

SEQ ID NO: 718574 - DNA, 25 bp, Mus musculus
gtgtggtccaggctatgaattacaa

SEQ ID NO: 718575 - DNA, 25 bp, Mus musculus
gtgtggtccagggtatgaattacaa

SEQ ID NO: 718576 - DNA, 25 bp, Mus musculus
gtgtggtcccctaatacccttctgc

SEQ ID NO: 718577 - DNA, 25 bp, Mus musculus
gtgtggtccccttatacccttctgc

SEQ ID NO: 718578 - DNA, 25 bp, Mus musculus
gtgtggtccctgcataatggagcaa

SEQ ID NO: 718579 - DNA, 25 bp, Mus musculus
gtgtggtccctgctaggttcagaat

SEQ ID NO: 718580 - DNA, 25 bp, Mus musculus
gtgtggtccctggataatggagcaa

SEQ ID NO: 718581 - DNA, 25 bp, Mus musculus
gtgtggtccctggtaggttcagaat

SEQ ID NO: 718582 - DNA, 25 bp, Mus musculus
gtgtggtccttacagctagccaata

SEQ ID NO: 718583 - DNA, 25 bp, Mus musculus
gtgtggtccttagagctagccaata

SEQ ID NO: 718584 - DNA, 25 bp, Mus musculus
gtgtggtcgctaatgaggttcctca

SEQ ID NO: 718585 - DNA, 25 bp, Mus musculus
gtgtggtcgctattgaggttcctca

SEQ ID NO: 718586 - DNA, 25 bp, Mus musculus
gtgtggtctggcataaacacagaca

SEQ ID NO: 718587 - DNA, 25 bp, Mus musculus
gtgtggtctggcttaaacacagaca

SEQ ID NO: 718588 - DNA, 25 bp, Mus musculus
gtgtggtcttcccattaaatgtgaa

SEQ ID NO: 718589 - DNA, 25 bp, Mus musculus
gtgtggtcttccgattaaatgtgaa

SEQ ID NO: 718590 - DNA, 25 bp, Mus musculus
gtgtggtctttaatactcttggtac

SEQ ID NO: 718591 - DNA, 25 bp, Mus musculus
gtgtggtctttattactcttggtac

SEQ ID NO: 718592 - DNA, 25 bp, Mus musculus
gtgtggtgaacaagtcctatttcta

SEQ ID NO: 718593 - DNA, 25 bp, Mus musculus
gtgtggtgaacatgtcctatttcta

SEQ ID NO: 718594 - DNA, 25 bp, Mus musculus
gtgtggtgaatacgtctgaccccga

SEQ ID NO: 718595 - DNA, 25 bp, Mus musculus
gtgtggtgaataggtctgaccccga

SEQ ID NO: 718596 - DNA, 25 bp, Mus musculus
gtgtggtgacctctgactaccagta

SEQ ID NO: 718597 - DNA, 25 bp, Mus musculus
gtgtggtgacctgtgactaccagta

SEQ ID NO: 718598 - DNA, 25 bp, Mus musculus
gtgtggtgactcatgcaggaattct

SEQ ID NO: 718599 - DNA, 25 bp, Mus musculus
gtgtggtgactcttgcaggaattct

SEQ ID NO: 718600 - DNA, 25 bp, Mus musculus
gtgtggtgagatcttgccccttgaa

SEQ ID NO: 718601 - DNA, 25 bp, Mus musculus
gtgtggtgagatgttgccccttgaa

SEQ ID NO: 718602 - DNA, 25 bp, Mus musculus
gtgtggtgcatgaagtaacctgtga

SEQ ID NO: 718603 - DNA, 25 bp, Mus musculus
gtgtggtgcatgtagtaacctgtga

SEQ ID NO: 718604 - DNA, 25 bp, Mus musculus
gtgtggtgcttacacatacccattt

SEQ ID NO: 718605 - DNA, 25 bp, Mus musculus
gtgtggtgcttagacatacccattt

SEQ ID NO: 718606 - DNA, 25 bp, Mus musculus
gtgtggtggagtacttagcttctaa

SEQ ID NO: 718607 - DNA, 25 bp, Mus musculus
gtgtggtggagttcttagcttctaa

SEQ ID NO: 718608 - DNA, 25 bp, Mus musculus
gtgtggtggcacacaagtcttgcaa

SEQ ID NO: 718609 - DNA, 25 bp, Mus musculus
gtgtggtggcactcaagtcttgcaa

SEQ ID NO: 718610 - DNA, 25 bp, Mus musculus
gtgtggtggcatccattctgagaca

SEQ ID NO: 718611 - DNA, 25 bp, Mus musculus
gtgtggtggcatgcattctgagaca

SEQ ID NO: 718612 - DNA, 25 bp, Mus musculus
gtgtggtgggtccagtttaacacta

SEQ ID NO: 718613 - DNA, 25 bp, Mus musculus
gtgtggtgggtcgagtttaacacta

SEQ ID NO: 718614 - DNA, 25 bp, Mus musculus
gtgtggtggtaccagcacatcttta

SEQ ID NO: 718615 - DNA, 25 bp, Mus musculus
gtgtggtggtacgagcacatcttta

SEQ ID NO: 718616 - DNA, 25 bp, Mus musculus
gtgtggtggtatccatgcagctcta

SEQ ID NO: 718617 - DNA, 25 bp, Mus musculus
gtgtggtggtatgcatgcagctcta

SEQ ID NO: 718618 - DNA, 25 bp, Mus musculus
gtgtggtggttcagccttagtccca

SEQ ID NO: 718619 - DNA, 25 bp, Mus musculus
gtgtggtggttctgccttagtccca

SEQ ID NO: 718620 - DNA, 25 bp, Mus musculus
gtgtggtgtgcaaggtacccagtct

SEQ ID NO: 718621 - DNA, 25 bp, Mus musculus
gtgtggtgtgcatggtacccagtct

SEQ ID NO: 718622 - DNA, 25 bp, Mus musculus
gtgtggtgttgcctgccttgactcc

SEQ ID NO: 718623 - DNA, 25 bp, Mus musculus
gtgtggtgttgcgtgccttgactcc

SEQ ID NO: 718624 - DNA, 25 bp, Mus musculus
gtgtggttacacaaacccttctgct

SEQ ID NO: 718625 - DNA, 25 bp, Mus musculus
gtgtggttacactaacccttctgct

SEQ ID NO: 718626 - DNA, 25 bp, Mus musculus
gtgtggttatgtactttcttataga

SEQ ID NO: 718627 - DNA, 25 bp, Mus musculus
gtgtggttatgttctttcttataga

SEQ ID NO: 718628 - DNA, 25 bp, Mus musculus
gtgtggttattaagcttccagataa

SEQ ID NO: 718629 - DNA, 25 bp, Mus musculus
gtgtggttattatgcttccagataa

SEQ ID NO: 718630 - DNA, 25 bp, Mus musculus
gtgtggttcagtaagattcagctct

SEQ ID NO: 718631 - DNA, 25 bp, Mus musculus
gtgtggttcagttagattcagctct

SEQ ID NO: 718632 - DNA, 25 bp, Mus musculus
gtgtggttcatgcattgtctttgat

SEQ ID NO: 718633 - DNA, 25 bp, Mus musculus
gtgtggttcatggattgtctttgat

SEQ ID NO: 718634 - DNA, 25 bp, Mus musculus
gtgtggttccatcctgtgtactaaa

SEQ ID NO: 718635 - DNA, 25 bp, Mus musculus
gtgtggttccatgctgtgtactaaa

SEQ ID NO: 718636 - DNA, 25 bp, Mus musculus
gtgtggttcccaagacaggatgctg

SEQ ID NO: 718637 - DNA, 25 bp, Mus musculus
gtgtggttcccatgacaggatgctg

SEQ ID NO: 718638 - DNA, 25 bp, Mus musculus
gtgtggttcctgactgaaatgctta

SEQ ID NO: 718639 - DNA, 25 bp, Mus musculus
gtgtggttcctgtctgaaatgctta

SEQ ID NO: 718640 - DNA, 25 bp, Mus musculus
gtgtggttctcaaggtactttctta

SEQ ID NO: 718641 - DNA, 25 bp, Mus musculus
gtgtggttctcatggtactttctta

SEQ ID NO: 718642 - DNA, 25 bp, Mus musculus
gtgtggttcttgatcatttctgtaa

SEQ ID NO: 718643 - DNA, 25 bp, Mus musculus
gtgtggttcttgttcatttctgtaa

SEQ ID NO: 718644 - DNA, 25 bp, Mus musculus
gtgtggttgagtctgccagtaacat

SEQ ID NO: 718645 - DNA, 25 bp, Mus musculus
gtgtggttgagtgtgccagtaacat

SEQ ID NO: 718646 - DNA, 25 bp, Mus musculus
gtgtggttgggtagcttgcctactc

SEQ ID NO: 718647 - DNA, 25 bp, Mus musculus
gtgtggttgggttgcttgcctactc

SEQ ID NO: 718648 - DNA, 25 bp, Mus musculus
gtgtggttgttactctttcctggaa

SEQ ID NO: 718649 - DNA, 25 bp, Mus musculus
gtgtggttgttagtctttcctggaa

SEQ ID NO: 718650 - DNA, 25 bp, Mus musculus
gtgtggtttagaagcccagtggcta

SEQ ID NO: 718651 - DNA, 25 bp, Mus musculus
gtgtggtttagatgcccagtggcta

SEQ ID NO: 718652 - DNA, 25 bp, Mus musculus
gtgtggtttatccagaggctattga

SEQ ID NO: 718653 - DNA, 25 bp, Mus musculus
gtgtggtttatcgagaggctattga

SEQ ID NO: 718654 - DNA, 25 bp, Mus musculus
gtgtggtttattaaacctctgttca

SEQ ID NO: 718655 - DNA, 25 bp, Mus musculus
gtgtggtttatttaacctctgttca

SEQ ID NO: 718656 - DNA, 25 bp, Mus musculus
gtgtggtttccaacttgaacataaa

SEQ ID NO: 718657 - DNA, 25 bp, Mus musculus
gtgtggtttccatcttgaacataaa

SEQ ID NO: 718658 - DNA, 25 bp, Mus musculus
gtgtggtttcccagtagaccagaat

SEQ ID NO: 718659 - DNA, 25 bp, Mus musculus
gtgtggtttccctgtagaccagaat

SEQ ID NO: 718660 - DNA, 25 bp, Mus musculus
gtgtggtttgacctggatctttcca

SEQ ID NO: 718661 - DNA, 25 bp, Mus musculus
gtgtggtttgacgtggatctttcca

SEQ ID NO: 718662 - DNA, 25 bp, Mus musculus
gtgtggtttggtaactgcacagctg

SEQ ID NO: 718663 - DNA, 25 bp, Mus musculus
gtgtggtttggttactgcacagctg

SEQ ID NO: 718664 - DNA, 25 bp, Mus musculus
gtgtggtttgtaagtacgctctgta

SEQ ID NO: 718665 - DNA, 25 bp, Mus musculus
gtgtggtttgtatgtacgctctgta

SEQ ID NO: 718666 - DNA, 25 bp, Mus musculus
gtgtggtttttcctcagtgcggaca

SEQ ID NO: 718667 - DNA, 25 bp, Mus musculus
gtgtggtttttcgtcagtgcggaca

SEQ ID NO: 718668 - DNA, 25 bp, Mus musculus
gtgtgtaaaacactaccctgtatca

SEQ ID NO: 718669 - DNA, 25 bp, Mus musculus
gtgtgtaaaacagtaccctgtatca

SEQ ID NO: 718670 - DNA, 25 bp, Mus musculus
gtgtgtaaaaccctcttggacgtat

SEQ ID NO: 718671 - DNA, 25 bp, Mus musculus
gtgtgtaaaaccgtcttggacgtat

SEQ ID NO: 718672 - DNA, 25 bp, Mus musculus
gtgtgtaaacccacatactggccca

SEQ ID NO: 718673 - DNA, 25 bp, Mus musculus
gtgtgtaaaccctcatactggccca

SEQ ID NO: 718674 - DNA, 25 bp, Mus musculus
gtgtgtaaaggacccacctagagct

SEQ ID NO: 718675 - DNA, 25 bp, Mus musculus
gtgtgtaaaggagccacctagagct

SEQ ID NO: 718676 - DNA, 25 bp, Mus musculus
gtgtgtaaagtgaggcccacctgca

SEQ ID NO: 718677 - DNA, 25 bp, Mus musculus
gtgtgtaaagtgtggcccacctgca

SEQ ID NO: 718678 - DNA, 25 bp, Mus musculus
gtgtgtaaattcacatgctaagaat

SEQ ID NO: 718679 - DNA, 25 bp, Mus musculus
gtgtgtaaattctcatgctaagaat

SEQ ID NO: 718680 - DNA, 25 bp, Mus musculus
gtgtgtaacactaccattgtatctg

SEQ ID NO: 718681 - DNA, 25 bp, Mus musculus
gtgtgtaacacttccattgtatctg

SEQ ID NO: 718682 - DNA, 25 bp, Mus musculus
gtgtgtaacaggctcatacccctcc

SEQ ID NO: 718683 - DNA, 25 bp, Mus musculus
gtgtgtaacagggtcatacccctcc

SEQ ID NO: 718684 - DNA, 25 bp, Mus musculus
gtgtgtaacatcatcagctctcaaa

SEQ ID NO: 718685 - DNA, 25 bp, Mus musculus
gtgtgtaacatcttcagctctcaaa

SEQ ID NO: 718686 - DNA, 25 bp, Mus musculus
gtgtgtaactgaatgcttgggcttt

SEQ ID NO: 718687 - DNA, 25 bp, Mus musculus
gtgtgtaactgattgcttgggcttt

SEQ ID NO: 718688 - DNA, 25 bp, Mus musculus
gtgtgtaactgcatagacttggtca

SEQ ID NO: 718689 - DNA, 25 bp, Mus musculus
gtgtgtaactgcttagacttggtca

SEQ ID NO: 718690 - DNA, 25 bp, Mus musculus
gtgtgtaactgtacgcatacctgtc

SEQ ID NO: 718691 - DNA, 25 bp, Mus musculus
gtgtgtaactgttcgcatacctgtc

SEQ ID NO: 718692 - DNA, 25 bp, Mus musculus
gtgtgtaatataccacttagttttg

SEQ ID NO: 718693 - DNA, 25 bp, Mus musculus
gtgtgtaatatagcacttagttttg

SEQ ID NO: 718694 - DNA, 25 bp, Mus musculus
gtgtgtaatccaacacttctgctct

SEQ ID NO: 718695 - DNA, 25 bp, Mus musculus
gtgtgtaatccatcacttctgctct

SEQ ID NO: 718696 - DNA, 25 bp, Mus musculus
gtgtgtaatgagatttgtctggcaa

SEQ ID NO: 718697 - DNA, 25 bp, Mus musculus
gtgtgtaatgagttttgtctggcaa

SEQ ID NO: 718698 - DNA, 25 bp, Mus musculus
gtgtgtaatgccaactgctacgtaa

SEQ ID NO: 718699 - DNA, 25 bp, Mus musculus
gtgtgtaatgcctactgctacgtaa

SEQ ID NO: 718700 - DNA, 25 bp, Mus musculus
gtgtgtaatgtcaacgccatcttcc

SEQ ID NO: 718701 - DNA, 25 bp, Mus musculus
gtgtgtaatgtctacgccatcttcc

SEQ ID NO: 718702 - DNA, 25 bp, Mus musculus
gtgtgtacaatgatctctgtcaggc

SEQ ID NO: 718703 - DNA, 25 bp, Mus musculus
gtgtgtacaatgttctctgtcaggc

SEQ ID NO: 718704 - DNA, 25 bp, Mus musculus
gtgtgtacacaaactcaactctata

SEQ ID NO: 718705 - DNA, 25 bp, Mus musculus
gtgtgtacacaatctcaactctata

SEQ ID NO: 718706 - DNA, 25 bp, Mus musculus
gtgtgtacacacagatcaatgtctt

SEQ ID NO: 718707 - DNA, 25 bp, Mus musculus
gtgtgtacacaccagtggagtcaca

SEQ ID NO: 718708 - DNA, 25 bp, Mus musculus
gtgtgtacacacgagtggagtcaca

SEQ ID NO: 718709 - DNA, 25 bp, Mus musculus
gtgtgtacacactgatcaatgtctt

SEQ ID NO: 718710 - DNA, 25 bp, Mus musculus
gtgtgtacacatcattggagagtgt

SEQ ID NO: 718711 - DNA, 25 bp, Mus musculus
gtgtgtacacatgattggagagtgt

SEQ ID NO: 718712 - DNA, 25 bp, Mus musculus
gtgtgtacacccctttattaatctt

SEQ ID NO: 718713 - DNA, 25 bp, Mus musculus
gtgtgtacacccgtttattaatctt

SEQ ID NO: 718714 - DNA, 25 bp, Mus musculus
gtgtgtacacttaacctgcttgagc

SEQ ID NO: 718715 - DNA, 25 bp, Mus musculus
gtgtgtacacttagcattcgtgagt

SEQ ID NO: 718716 - DNA, 25 bp, Mus musculus
gtgtgtacactttacctgcttgagc

SEQ ID NO: 718717 - DNA, 25 bp, Mus musculus
gtgtgtacactttgcattcgtgagt

SEQ ID NO: 718718 - DNA, 25 bp, Mus musculus
gtgtgtacatgcaaagactggacca

SEQ ID NO: 718719 - DNA, 25 bp, Mus musculus
gtgtgtacatgctaagactggacca

SEQ ID NO: 718720 - DNA, 25 bp, Mus musculus
gtgtgtaccaacacacccggcgagt

SEQ ID NO: 718721 - DNA, 25 bp, Mus musculus
gtgtgtaccaactcacccggcgagt

SEQ ID NO: 718722 - DNA, 25 bp, Mus musculus
gtgtgtaccaccatgacaagcttat

SEQ ID NO: 718723 - DNA, 25 bp, Mus musculus
gtgtgtaccaccttgacaagcttat

SEQ ID NO: 718724 - DNA, 25 bp, Mus musculus
gtgtgtaccagacactgcccgtgta

SEQ ID NO: 718725 - DNA, 25 bp, Mus musculus
gtgtgtaccagagactgcccgtgta

SEQ ID NO: 718726 - DNA, 25 bp, Mus musculus
gtgtgtaccataccagtggcgcata

SEQ ID NO: 718727 - DNA, 25 bp, Mus musculus
gtgtgtaccatagcagtggcgcata

SEQ ID NO: 718728 - DNA, 25 bp, Mus musculus
gtgtgtaccatgagtatgcatggtg

SEQ ID NO: 718729 - DNA, 25 bp, Mus musculus
gtgtgtaccatgtgtatgcatggtg

SEQ ID NO: 718730 - DNA, 25 bp, Mus musculus
gtgtgtacctccatttcggatttta

SEQ ID NO: 718731 - DNA, 25 bp, Mus musculus
gtgtgtacctccttttcggatttta

SEQ ID NO: 718732 - DNA, 25 bp, Mus musculus
gtgtgtacctgtactgattgcccct

SEQ ID NO: 718733 - DNA, 25 bp, Mus musculus
gtgtgtacctgttctgattgcccct

SEQ ID NO: 718734 - DNA, 25 bp, Mus musculus
gtgtgtacgactaggcttttaaaat

SEQ ID NO: 718735 - DNA, 25 bp, Mus musculus
gtgtgtacgacttggcttttaaaat

SEQ ID NO: 718736 - DNA, 25 bp, Mus musculus
gtgtgtacgatgagctttgatcata

SEQ ID NO: 718737 - DNA, 25 bp, Mus musculus
gtgtgtacgatgtgctttgatcata

SEQ ID NO: 718738 - DNA, 25 bp, Mus musculus
gtgtgtacgtatctacccttgtgtg

SEQ ID NO: 718739 - DNA, 25 bp, Mus musculus
gtgtgtacgtatgtacccttgtgtg

SEQ ID NO: 718740 - DNA, 25 bp, Mus musculus
gtgtgtactatgacagatactgtgg

SEQ ID NO: 718741 - DNA, 25 bp, Mus musculus
gtgtgtactatgtcagatactgtgg

SEQ ID NO: 718742 - DNA, 25 bp, Mus musculus
gtgtgtactcagcacagaatccaga

SEQ ID NO: 718743 - DNA, 25 bp, Mus musculus
gtgtgtactcaggacagaatccaga

SEQ ID NO: 718744 - DNA, 25 bp, Mus musculus
gtgtgtactcgaagctactcttcat

SEQ ID NO: 718745 - DNA, 25 bp, Mus musculus
gtgtgtactcgatgctactcttcat

SEQ ID NO: 718746 - DNA, 25 bp, Mus musculus
gtgtgtactgaaaactacatatgta

SEQ ID NO: 718747 - DNA, 25 bp, Mus musculus
gtgtgtactgaatactacatatgta

SEQ ID NO: 718748 - DNA, 25 bp, Mus musculus
gtgtgtactgcccatgtataattcc

SEQ ID NO: 718749 - DNA, 25 bp, Mus musculus
gtgtgtactgccgatgtataattcc

SEQ ID NO: 718750 - DNA, 25 bp, Mus musculus
gtgtgtagaggaacttttccccact

SEQ ID NO: 718751 - DNA, 25 bp, Mus musculus
gtgtgtagaggatcttttccccact

SEQ ID NO: 718752 - DNA, 25 bp, Mus musculus
gtgtgtagcaaccaagccacctgca

SEQ ID NO: 718753 - DNA, 25 bp, Mus musculus
gtgtgtagcaacgaagccacctgca

SEQ ID NO: 718754 - DNA, 25 bp, Mus musculus
gtgtgtagcctgctctcagaatgtc

SEQ ID NO: 718755 - DNA, 25 bp, Mus musculus
gtgtgtagcctggtctcagaatgtc

SEQ ID NO: 718756 - DNA, 25 bp, Mus musculus
gtgtgtagcgtgagcatcagtgact

SEQ ID NO: 718757 - DNA, 25 bp, Mus musculus
gtgtgtagcgtgtgcatcagtgact

SEQ ID NO: 718758 - DNA, 25 bp, Mus musculus
gtgtgtagctacaacttgacattca

SEQ ID NO: 718759 - DNA, 25 bp, Mus musculus
gtgtgtagctactacttgacattca

SEQ ID NO: 718760 - DNA, 25 bp, Mus musculus
gtgtgtagctggatagtctattcat

SEQ ID NO: 718761 - DNA, 25 bp, Mus musculus
gtgtgtagctggttagtctattcat

SEQ ID NO: 718762 - DNA, 25 bp, Mus musculus
gtgtgtagcttaaaatactgcgtat

SEQ ID NO: 718763 - DNA, 25 bp, Mus musculus
gtgtgtagcttataatactgcgtat

SEQ ID NO: 718764 - DNA, 25 bp, Mus musculus
gtgtgtaggaccaaccagccagaaa

SEQ ID NO: 718765 - DNA, 25 bp, Mus musculus
gtgtgtaggacctaccagccagaaa

SEQ ID NO: 718766 - DNA, 25 bp, Mus musculus
gtgtgtaggtgcattaacctgcatt

SEQ ID NO: 718767 - DNA, 25 bp, Mus musculus
gtgtgtaggtgctttaacctgcatt

SEQ ID NO: 718768 - DNA, 25 bp, Mus musculus
gtgtgtagtaccagctgtgctaagt

SEQ ID NO: 718769 - DNA, 25 bp, Mus musculus
gtgtgtagtacctgctgtgctaagt

SEQ ID NO: 718770 - DNA, 25 bp, Mus musculus
gtgtgtagtcacacttttgcactta

SEQ ID NO: 718771 - DNA, 25 bp, Mus musculus
gtgtgtagtcacctgtggccaaaca

SEQ ID NO: 718772 - DNA, 25 bp, Mus musculus
gtgtgtagtcacgtgtggccaaaca

SEQ ID NO: 718773 - DNA, 25 bp, Mus musculus
gtgtgtagtcactcttttgcactta

SEQ ID NO: 718774 - DNA, 25 bp, Mus musculus
gtgtgtagtctgatggagccatgct

SEQ ID NO: 718775 - DNA, 25 bp, Mus musculus
gtgtgtagtctgttggagccatgct

SEQ ID NO: 718776 - DNA, 25 bp, Mus musculus
gtgtgtagtgggattataattatgg

SEQ ID NO: 718777 - DNA, 25 bp, Mus musculus
gtgtgtagtgggtttataattatgg

SEQ ID NO: 718778 - DNA, 25 bp, Mus musculus
gtgtgtagttgacagatacttgcaa

SEQ ID NO: 718779 - DNA, 25 bp, Mus musculus
gtgtgtagttgagagatacttgcaa

SEQ ID NO: 718780 - DNA, 25 bp, Mus musculus
gtgtgtatagtcagcatgcctgcct

SEQ ID NO: 718781 - DNA, 25 bp, Mus musculus
gtgtgtatagtctgcatgcctgcct

SEQ ID NO: 718782 - DNA, 25 bp, Mus musculus
gtgtgtatagttctgtgtccaagtt

SEQ ID NO: 718783 - DNA, 25 bp, Mus musculus
gtgtgtatagttgtgtgtccaagtt

SEQ ID NO: 718784 - DNA, 25 bp, Mus musculus
gtgtgtatatagatgtctctcagta

SEQ ID NO: 718785 - DNA, 25 bp, Mus musculus
gtgtgtatatagttgtctctcagta

SEQ ID NO: 718786 - DNA, 25 bp, Mus musculus
gtgtgtatatctcccgctttagacc

SEQ ID NO: 718787 - DNA, 25 bp, Mus musculus
gtgtgtatatctgccgctttagacc

SEQ ID NO: 718788 - DNA, 25 bp, Mus musculus
gtgtgtatatgtatctctaccttgt

SEQ ID NO: 718789 - DNA, 25 bp, Mus musculus
gtgtgtatatgtttctctaccttgt

SEQ ID NO: 718790 - DNA, 25 bp, Mus musculus
gtgtgtatcagtccagaattcttca

SEQ ID NO: 718791 - DNA, 25 bp, Mus musculus
gtgtgtatcagtgcagaattcttca

SEQ ID NO: 718792 - DNA, 25 bp, Mus musculus
gtgtgtatcattagtgtgctttcat

SEQ ID NO: 718793 - DNA, 25 bp, Mus musculus
gtgtgtatcatttgtgtgctttcat

SEQ ID NO: 718794 - DNA, 25 bp, Mus musculus
gtgtgtatccagattaactcctctc

SEQ ID NO: 718795 - DNA, 25 bp, Mus musculus
gtgtgtatccagtttaactcctctc

SEQ ID NO: 718796 - DNA, 25 bp, Mus musculus
gtgtgtatccatacatgggcttggt

SEQ ID NO: 718797 - DNA, 25 bp, Mus musculus
gtgtgtatccattcatgggcttggt

SEQ ID NO: 718798 - DNA, 25 bp, Mus musculus
gtgtgtatcctcagtatctggtgat

SEQ ID NO: 718799 - DNA, 25 bp, Mus musculus
gtgtgtatcctctgtatctggtgat

SEQ ID NO: 718800 - DNA, 25 bp, Mus musculus
gtgtgtatctatatacatgccttag

SEQ ID NO: 718801 - DNA, 25 bp, Mus musculus
gtgtgtatctatctctctgtcagaa

SEQ ID NO: 718802 - DNA, 25 bp, Mus musculus
gtgtgtatctatgtctctgtcagaa

SEQ ID NO: 718803 - DNA, 25 bp, Mus musculus
gtgtgtatctatttacatgccttag

SEQ ID NO: 718804 - DNA, 25 bp, Mus musculus
gtgtgtatctcaaagcaggtttggt

SEQ ID NO: 718805 - DNA, 25 bp, Mus musculus
gtgtgtatctcatagcaggtttggt

SEQ ID NO: 718806 - DNA, 25 bp, Mus musculus
gtgtgtatctctaattagtttctta

SEQ ID NO: 718807 - DNA, 25 bp, Mus musculus
gtgtgtatctcttattagtttctta

SEQ ID NO: 718808 - DNA, 25 bp, Mus musculus
gtgtgtatctgtatcaatgggtgta

SEQ ID NO: 718809 - DNA, 25 bp, Mus musculus
gtgtgtatctgtttcaatgggtgta

SEQ ID NO: 718810 - DNA, 25 bp, Mus musculus
gtgtgtatctttctgcagccaatgc

SEQ ID NO: 718811 - DNA, 25 bp, Mus musculus
gtgtgtatctttgtgcagccaatgc

SEQ ID NO: 718812 - DNA, 25 bp, Mus musculus
gtgtgtatgactcaggcagcgcacc

SEQ ID NO: 718813 - DNA, 25 bp, Mus musculus
gtgtgtatgactgaggcagcgcacc

SEQ ID NO: 718814 - DNA, 25 bp, Mus musculus
gtgtgtatgcaaatgtgggaacccc

SEQ ID NO: 718815 - DNA, 25 bp, Mus musculus
gtgtgtatgcaattgtgggaacccc

SEQ ID NO: 718816 - DNA, 25 bp, Mus musculus
gtgtgtatgctgcttttctaaccaa

SEQ ID NO: 718817 - DNA, 25 bp, Mus musculus
gtgtgtatgctggttttctaaccaa

SEQ ID NO: 718818 - DNA, 25 bp, Mus musculus
gtgtgtatgtataattccctggatg

SEQ ID NO: 718819 - DNA, 25 bp, Mus musculus
gtgtgtatgtatcactggctcaaga

SEQ ID NO: 718820 - DNA, 25 bp, Mus musculus
gtgtgtatgtatcatcacctaatca

SEQ ID NO: 718821 - DNA, 25 bp, Mus musculus
gtgtgtatgtatgactggctcaaga

SEQ ID NO: 718822 - DNA, 25 bp, Mus musculus
gtgtgtatgtatgatcacctaatca

SEQ ID NO: 718823 - DNA, 25 bp, Mus musculus
gtgtgtatgtattattccctggatg

SEQ ID NO: 718824 - DNA, 25 bp, Mus musculus
gtgtgtatgtcaagtctaacacatg

SEQ ID NO: 718825 - DNA, 25 bp, Mus musculus
gtgtgtatgtcatgtctaacacatg

SEQ ID NO: 718826 - DNA, 25 bp, Mus musculus
gtgtgtatgtgtactccaatgtgga

SEQ ID NO: 718827 - DNA, 25 bp, Mus musculus
gtgtgtatgtgtcccgcaattgtgt

SEQ ID NO: 718828 - DNA, 25 bp, Mus musculus
gtgtgtatgtgtgccgcaattgtgt

SEQ ID NO: 718829 - DNA, 25 bp, Mus musculus
gtgtgtatgtgttctccaatgtgga

SEQ ID NO: 718830 - DNA, 25 bp, Mus musculus
gtgtgtattaataattgcagaattt

SEQ ID NO: 718831 - DNA, 25 bp, Mus musculus
gtgtgtattaattattgcagaattt

SEQ ID NO: 718832 - DNA, 25 bp, Mus musculus
gtgtgtattcagaatgcctttcttt

SEQ ID NO: 718833 - DNA, 25 bp, Mus musculus
gtgtgtattcagctcaatatggtta

SEQ ID NO: 718834 - DNA, 25 bp, Mus musculus
gtgtgtattcaggtcaatatggtta

SEQ ID NO: 718835 - DNA, 25 bp, Mus musculus
gtgtgtattcagtatgcctttcttt

SEQ ID NO: 718836 - DNA, 25 bp, Mus musculus
gtgtgtattctaatgtctaagctaa

SEQ ID NO: 718837 - DNA, 25 bp, Mus musculus
gtgtgtattctattgtctaagctaa

SEQ ID NO: 718838 - DNA, 25 bp, Mus musculus
gtgtgtattcttctcaatgtcattc

SEQ ID NO: 718839 - DNA, 25 bp, Mus musculus
gtgtgtattcttgtcaatgtcattc

SEQ ID NO: 718840 - DNA, 25 bp, Mus musculus
gtgtgtattgaacctctaatcgttc

SEQ ID NO: 718841 - DNA, 25 bp, Mus musculus
gtgtgtattgaagctctaatcgttc

SEQ ID NO: 718842 - DNA, 25 bp, Mus musculus
gtgtgtattgccagttggtgtcagt

SEQ ID NO: 718843 - DNA, 25 bp, Mus musculus
gtgtgtattgcctgttggtgtcagt

SEQ ID NO: 718844 - DNA, 25 bp, Mus musculus
gtgtgtattgtcagaatttccggaa

SEQ ID NO: 718845 - DNA, 25 bp, Mus musculus
gtgtgtattgtctgaatttccggaa

SEQ ID NO: 718846 - DNA, 25 bp, Mus musculus
gtgtgtatttctatatctcttactc

SEQ ID NO: 718847 - DNA, 25 bp, Mus musculus
gtgtgtatttctttatctcttactc

SEQ ID NO: 718848 - DNA, 25 bp, Mus musculus
gtgtgtattttcagagcactggctc

SEQ ID NO: 718849 - DNA, 25 bp, Mus musculus
gtgtgtattttctgagcactggctc

SEQ ID NO: 718850 - DNA, 25 bp, Mus musculus
gtgtgtcaaactctattcttttcga

SEQ ID NO: 718851 - DNA, 25 bp, Mus musculus
gtgtgtcaaactgtattcttttcga

SEQ ID NO: 718852 - DNA, 25 bp, Mus musculus
gtgtgtcaacacaacattgcaaatc

SEQ ID NO: 718853 - DNA, 25 bp, Mus musculus
gtgtgtcaacactacattgcaaatc

SEQ ID NO: 718854 - DNA, 25 bp, Mus musculus
gtgtgtcaacagctaattccagtat

SEQ ID NO: 718855 - DNA, 25 bp, Mus musculus
gtgtgtcaacaggtaattccagtat

SEQ ID NO: 718856 - DNA, 25 bp, Mus musculus
gtgtgtcaacatctaatgcccctga

SEQ ID NO: 718857 - DNA, 25 bp, Mus musculus
gtgtgtcaacatgtaatgcccctga

SEQ ID NO: 718858 - DNA, 25 bp, Mus musculus
gtgtgtcaaccgcatcattacagaa

SEQ ID NO: 718859 - DNA, 25 bp, Mus musculus
gtgtgtcaaccggatcattacagaa

SEQ ID NO: 718860 - DNA, 25 bp, Mus musculus
gtgtgtcaaggcatcaaccaggtcc

SEQ ID NO: 718861 - DNA, 25 bp, Mus musculus
gtgtgtcaaggcttcaaccaggtcc

SEQ ID NO: 718862 - DNA, 25 bp, Mus musculus
gtgtgtcacaagaaggaacccctgt

SEQ ID NO: 718863 - DNA, 25 bp, Mus musculus
gtgtgtcacaagtaggaacccctgt

SEQ ID NO: 718864 - DNA, 25 bp, Mus musculus
gtgtgtcacacaaacatttaacgat

SEQ ID NO: 718865 - DNA, 25 bp, Mus musculus
gtgtgtcacacaacaaggccaacca

SEQ ID NO: 718866 - DNA, 25 bp, Mus musculus
gtgtgtcacacaatttcacctggga

SEQ ID NO: 718867 - DNA, 25 bp, Mus musculus
gtgtgtcacacatacatttaacgat

SEQ ID NO: 718868 - DNA, 25 bp, Mus musculus
gtgtgtcacacatcaaggccaacca

SEQ ID NO: 718869 - DNA, 25 bp, Mus musculus
gtgtgtcacacattttcacctggga

SEQ ID NO: 718870 - DNA, 25 bp, Mus musculus
gtgtgtcacataagtgcactgcctg

SEQ ID NO: 718871 - DNA, 25 bp, Mus musculus
gtgtgtcacatatgtgcactgcctg

SEQ ID NO: 718872 - DNA, 25 bp, Mus musculus
gtgtgtcaccacactttggtttctg

SEQ ID NO: 718873 - DNA, 25 bp, Mus musculus
gtgtgtcaccactctttggtttctg

SEQ ID NO: 718874 - DNA, 25 bp, Mus musculus
gtgtgtcaccttataaagatcagtg

SEQ ID NO: 718875 - DNA, 25 bp, Mus musculus
gtgtgtcaccttttaaagatcagtg

SEQ ID NO: 718876 - DNA, 25 bp, Mus musculus
gtgtgtcacgatctataattctcaa

SEQ ID NO: 718877 - DNA, 25 bp, Mus musculus
gtgtgtcacgatgtataattctcaa

SEQ ID NO: 718878 - DNA, 25 bp, Mus musculus
gtgtgtcacgtaacactgaaactga

SEQ ID NO: 718879 - DNA, 25 bp, Mus musculus
gtgtgtcacgtatcactgaaactga

SEQ ID NO: 718880 - DNA, 25 bp, Mus musculus
gtgtgtcactagcactttccgagga

SEQ ID NO: 718881 - DNA, 25 bp, Mus musculus
gtgtgtcactaggactttccgagga

SEQ ID NO: 718882 - DNA, 25 bp, Mus musculus
gtgtgtcacttacggccatttgcca

SEQ ID NO: 718883 - DNA, 25 bp, Mus musculus
gtgtgtcacttagggccatttgcca

SEQ ID NO: 718884 - DNA, 25 bp, Mus musculus
gtgtgtcactttcttattctttccc

SEQ ID NO: 718885 - DNA, 25 bp, Mus musculus
gtgtgtcactttgttattctttccc

SEQ ID NO: 718886 - DNA, 25 bp, Mus musculus
gtgtgtcagaccacactagtgacag

SEQ ID NO: 718887 - DNA, 25 bp, Mus musculus
gtgtgtcagacctcactagtgacag

SEQ ID NO: 718888 - DNA, 25 bp, Mus musculus
gtgtgtcagagcaccggaagtcaag

SEQ ID NO: 718889 - DNA, 25 bp, Mus musculus
gtgtgtcagagctccggaagtcaag

SEQ ID NO: 718890 - DNA, 25 bp, Mus musculus
gtgtgtcagcatcttgcagatgtaa

SEQ ID NO: 718891 - DNA, 25 bp, Mus musculus
gtgtgtcagcatgttgcagatgtaa

SEQ ID NO: 718892 - DNA, 25 bp, Mus musculus
gtgtgtcagcctaccatgaagacga

SEQ ID NO: 718893 - DNA, 25 bp, Mus musculus
gtgtgtcagccttccatgaagacga

SEQ ID NO: 718894 - DNA, 25 bp, Mus musculus
gtgtgtcaggacatacggccaaaga

SEQ ID NO: 718895 - DNA, 25 bp, Mus musculus
gtgtgtcaggacttacggccaaaga

SEQ ID NO: 718896 - DNA, 25 bp, Mus musculus
gtgtgtcaggcaacatcagatttga

SEQ ID NO: 718897 - DNA, 25 bp, Mus musculus
gtgtgtcaggcatcatcagatttga

SEQ ID NO: 718898 - DNA, 25 bp, Mus musculus
gtgtgtcagtacaacttcaccttat

SEQ ID NO: 718899 - DNA, 25 bp, Mus musculus
gtgtgtcagtacagaatctcatgga

SEQ ID NO: 718900 - DNA, 25 bp, Mus musculus
gtgtgtcagtacatgggcattgcca

SEQ ID NO: 718901 - DNA, 25 bp, Mus musculus
gtgtgtcagtactacttcaccttat

SEQ ID NO: 718902 - DNA, 25 bp, Mus musculus
gtgtgtcagtactgaatctcatgga

SEQ ID NO: 718903 - DNA, 25 bp, Mus musculus
gtgtgtcagtacttgggcattgcca

SEQ ID NO: 718904 - DNA, 25 bp, Mus musculus
gtgtgtcagtgaagaacgtttctag

SEQ ID NO: 718905 - DNA, 25 bp, Mus musculus
gtgtgtcagtgatgaacgtttctag

SEQ ID NO: 718906 - DNA, 25 bp, Mus musculus
gtgtgtcatcaactattatagtcag

SEQ ID NO: 718907 - DNA, 25 bp, Mus musculus
gtgtgtcatcaagtattatagtcag

SEQ ID NO: 718908 - DNA, 25 bp, Mus musculus
gtgtgtcatgccaccggactgatag

SEQ ID NO: 718909 - DNA, 25 bp, Mus musculus
gtgtgtcatgcctccggactgatag

SEQ ID NO: 718910 - DNA, 25 bp, Mus musculus
gtgtgtcattacagagtcacgcctg

SEQ ID NO: 718911 - DNA, 25 bp, Mus musculus
gtgtgtcattactgagtcacgcctg

SEQ ID NO: 718912 - DNA, 25 bp, Mus musculus
gtgtgtcattcccagaatttcgcaa

SEQ ID NO: 718913 - DNA, 25 bp, Mus musculus
gtgtgtcattccgagaatttcgcaa

SEQ ID NO: 718914 - DNA, 25 bp, Mus musculus
gtgtgtccaactctgtggattccaa

SEQ ID NO: 718915 - DNA, 25 bp, Mus musculus
gtgtgtccaactgtgtggattccaa

SEQ ID NO: 718916 - DNA, 25 bp, Mus musculus
gtgtgtccaagtacattcaaaagtg

SEQ ID NO: 718917 - DNA, 25 bp, Mus musculus
gtgtgtccaagttcattcaaaagtg

SEQ ID NO: 718918 - DNA, 25 bp, Mus musculus
gtgtgtccaattctgtctcataatg

SEQ ID NO: 718919 - DNA, 25 bp, Mus musculus
gtgtgtccaattgtgtctcataatg

SEQ ID NO: 718920 - DNA, 25 bp, Mus musculus
gtgtgtccacatatgtgtctgcatc

SEQ ID NO: 718921 - DNA, 25 bp, Mus musculus
gtgtgtccacatttgtgtctgcatc

SEQ ID NO: 718922 - DNA, 25 bp, Mus musculus
gtgtgtccacgcagggtccgctgca

SEQ ID NO: 718923 - DNA, 25 bp, Mus musculus
gtgtgtccacgctgggtccgctgca

SEQ ID NO: 718924 - DNA, 25 bp, Mus musculus
gtgtgtccacggattctcaaaccaa

SEQ ID NO: 718925 - DNA, 25 bp, Mus musculus
gtgtgtccacggtttctcaaaccaa

SEQ ID NO: 718926 - DNA, 25 bp, Mus musculus
gtgtgtccactaaaaacggccattg

SEQ ID NO: 718927 - DNA, 25 bp, Mus musculus
gtgtgtccactaacccaatcaaaga

SEQ ID NO: 718928 - DNA, 25 bp, Mus musculus
gtgtgtccactataaacggccattg

SEQ ID NO: 718929 - DNA, 25 bp, Mus musculus
gtgtgtccactatcccaatcaaaga

SEQ ID NO: 718930 - DNA, 25 bp, Mus musculus
gtgtgtccagctatttacacgagtt

SEQ ID NO: 718931 - DNA, 25 bp, Mus musculus
gtgtgtccagctttttacacgagtt

SEQ ID NO: 718932 - DNA, 25 bp, Mus musculus
gtgtgtccaggcctgctgtaaaagt

SEQ ID NO: 718933 - DNA, 25 bp, Mus musculus
gtgtgtccaggcgtgctgtaaaagt

SEQ ID NO: 718934 - DNA, 25 bp, Mus musculus
gtgtgtccagtaataggcagaacct

SEQ ID NO: 718935 - DNA, 25 bp, Mus musculus
gtgtgtccagtattaggcagaacct

SEQ ID NO: 718936 - DNA, 25 bp, Mus musculus
gtgtgtcccagcctgagtatcggca

SEQ ID NO: 718937 - DNA, 25 bp, Mus musculus
gtgtgtcccagcgtgagtatcggca

SEQ ID NO: 718938 - DNA, 25 bp, Mus musculus
gtgtgtcccaggatctggaaccact

SEQ ID NO: 718939 - DNA, 25 bp, Mus musculus
gtgtgtcccaggttctggaaccact

SEQ ID NO: 718940 - DNA, 25 bp, Mus musculus
gtgtgtcccatcacttaaacatcat

SEQ ID NO: 718941 - DNA, 25 bp, Mus musculus
gtgtgtcccatctcttaaacatcat

SEQ ID NO: 718942 - DNA, 25 bp, Mus musculus
gtgtgtccctacacactgttttagg

SEQ ID NO: 718943 - DNA, 25 bp, Mus musculus
gtgtgtccctactcactgttttagg

SEQ ID NO: 718944 - DNA, 25 bp, Mus musculus
gtgtgtccctgaattaaacctcctg

SEQ ID NO: 718945 - DNA, 25 bp, Mus musculus
gtgtgtccctgatttaaacctcctg

SEQ ID NO: 718946 - DNA, 25 bp, Mus musculus
gtgtgtccgtgcaatggaccagcat

SEQ ID NO: 718947 - DNA, 25 bp, Mus musculus
gtgtgtccgtgctatggaccagcat

SEQ ID NO: 718948 - DNA, 25 bp, Mus musculus
gtgtgtccgtgtccatggcctgttt

SEQ ID NO: 718949 - DNA, 25 bp, Mus musculus
gtgtgtccgtgtgcatggcctgttt

SEQ ID NO: 718950 - DNA, 25 bp, Mus musculus
gtgtgtccgtttaaattctgcctag

SEQ ID NO: 718951 - DNA, 25 bp, Mus musculus
gtgtgtccgttttaattctgcctag

SEQ ID NO: 718952 - DNA, 25 bp, Mus musculus
gtgtgtcctacaatcttaaccgagg

SEQ ID NO: 718953 - DNA, 25 bp, Mus musculus
gtgtgtcctacattcttaaccgagg

SEQ ID NO: 718954 - DNA, 25 bp, Mus musculus
gtgtgtcctatacatttgtacattt

SEQ ID NO: 718955 - DNA, 25 bp, Mus musculus
gtgtgtcctatagatttgtacattt

SEQ ID NO: 718956 - DNA, 25 bp, Mus musculus
gtgtgtcctcaaatgtcaactccag

SEQ ID NO: 718957 - DNA, 25 bp, Mus musculus
gtgtgtcctcaattgtcaactccag

SEQ ID NO: 718958 - DNA, 25 bp, Mus musculus
gtgtgtcctcccaggaacacggctg

SEQ ID NO: 718959 - DNA, 25 bp, Mus musculus
gtgtgtcctccctggaacacggctg

SEQ ID NO: 718960 - DNA, 25 bp, Mus musculus
gtgtgtcctgaacaagctggcacca

SEQ ID NO: 718961 - DNA, 25 bp, Mus musculus
gtgtgtcctgaacgcaacagcagca

SEQ ID NO: 718962 - DNA, 25 bp, Mus musculus
gtgtgtcctgaagaagctggcacca

SEQ ID NO: 718963 - DNA, 25 bp, Mus musculus
gtgtgtcctgaaggcaacagcagca

SEQ ID NO: 718964 - DNA, 25 bp, Mus musculus
gtgtgtcctgagaacaagtgattaa

SEQ ID NO: 718965 - DNA, 25 bp, Mus musculus
gtgtgtcctgagtacaagtgattaa

SEQ ID NO: 718966 - DNA, 25 bp, Mus musculus
gtgtgtcctgatacattctgttctc

SEQ ID NO: 718967 - DNA, 25 bp, Mus musculus
gtgtgtcctgattcattctgttctc

SEQ ID NO: 718968 - DNA, 25 bp, Mus musculus
gtgtgtcctgtgataaggcccagct

SEQ ID NO: 718969 - DNA, 25 bp, Mus musculus
gtgtgtcctgtgttaaggcccagct

SEQ ID NO: 718970 - DNA, 25 bp, Mus musculus
gtgtgtccttagaaaggcttgtgta

SEQ ID NO: 718971 - DNA, 25 bp, Mus musculus
gtgtgtccttagtaaggcttgtgta

SEQ ID NO: 718972 - DNA, 25 bp, Mus musculus
gtgtgtccttgtaaaactgccccag

SEQ ID NO: 718973 - DNA, 25 bp, Mus musculus
gtgtgtccttgttaaactgccccag

SEQ ID NO: 718974 - DNA, 25 bp, Mus musculus
gtgtgtcctttacaaaacgcctgtc

SEQ ID NO: 718975 - DNA, 25 bp, Mus musculus
gtgtgtcctttacagttcccacaga

SEQ ID NO: 718976 - DNA, 25 bp, Mus musculus
gtgtgtcctttagaaaacgcctgtc

SEQ ID NO: 718977 - DNA, 25 bp, Mus musculus
gtgtgtcctttagagttcccacaga

SEQ ID NO: 718978 - DNA, 25 bp, Mus musculus
gtgtgtcctttccatgggctttctt

SEQ ID NO: 718979 - DNA, 25 bp, Mus musculus
gtgtgtcctttcgatgggctttctt

SEQ ID NO: 718980 - DNA, 25 bp, Mus musculus
gtgtgtcgagggacatctccagcta

SEQ ID NO: 718981 - DNA, 25 bp, Mus musculus
gtgtgtcgagggtcatctccagcta

SEQ ID NO: 718982 - DNA, 25 bp, Mus musculus
gtgtgtcgatgaaagcgtcacctaa

SEQ ID NO: 718983 - DNA, 25 bp, Mus musculus
gtgtgtcgatgatagcgtcacctaa

SEQ ID NO: 718984 - DNA, 25 bp, Mus musculus
gtgtgtcgcgagagcaaagaaactt

SEQ ID NO: 718985 - DNA, 25 bp, Mus musculus
gtgtgtcgcgagtgcaaagaaactt

SEQ ID NO: 718986 - DNA, 25 bp, Mus musculus
gtgtgtctacacatgacctgaaggt

SEQ ID NO: 718987 - DNA, 25 bp, Mus musculus
gtgtgtctacacttgacctgaaggt

SEQ ID NO: 718988 - DNA, 25 bp, Mus musculus
gtgtgtctacttaccaggttaggca

SEQ ID NO: 718989 - DNA, 25 bp, Mus musculus
gtgtgtctactttccaggttaggca

SEQ ID NO: 718990 - DNA, 25 bp, Mus musculus
gtgtgtctagaactcatggtctcaa

SEQ ID NO: 718991 - DNA, 25 bp, Mus musculus
gtgtgtctagaagtcatggtctcaa

SEQ ID NO: 718992 - DNA, 25 bp, Mus musculus
gtgtgtctagttcccagcagaccac

SEQ ID NO: 718993 - DNA, 25 bp, Mus musculus
gtgtgtctagttgccagcagaccac

SEQ ID NO: 718994 - DNA, 25 bp, Mus musculus
gtgtgtctatccatatacttaccat

SEQ ID NO: 718995 - DNA, 25 bp, Mus musculus
gtgtgtctatccttatacttaccat

SEQ ID NO: 718996 - DNA, 25 bp, Mus musculus
gtgtgtctatgactggtttgcatgt

SEQ ID NO: 718997 - DNA, 25 bp, Mus musculus
gtgtgtctatgagtggtttgcatgt

SEQ ID NO: 718998 - DNA, 25 bp, Mus musculus
gtgtgtctatgtctcagagtgcaca

SEQ ID NO: 718999 - DNA, 25 bp, Mus musculus
gtgtgtctatgtgtcagagtgcaca

SEQ ID NO: 719000 - DNA, 25 bp, Mus musculus
gtgtgtctcaaaacagctgtcaaca

SEQ ID NO: 719001 - DNA, 25 bp, Mus musculus
gtgtgtctcaaatcagctgtcaaca

SEQ ID NO: 719002 - DNA, 25 bp, Mus musculus
gtgtgtctccaacattaaccagaaa

SEQ ID NO: 719003 - DNA, 25 bp, Mus musculus
gtgtgtctccaagattaaccagaaa

SEQ ID NO: 719004 - DNA, 25 bp, Mus musculus
gtgtgtctcgttacagagggcttat

SEQ ID NO: 719005 - DNA, 25 bp, Mus musculus
gtgtgtctcgttctggtagcattaa

SEQ ID NO: 719006 - DNA, 25 bp, Mus musculus
gtgtgtctcgttgtggtagcattaa

SEQ ID NO: 719007 - DNA, 25 bp, Mus musculus
gtgtgtctcgtttcagagggcttat

SEQ ID NO: 719008 - DNA, 25 bp, Mus musculus
gtgtgtctctagattcttaagcaga

SEQ ID NO: 719009 - DNA, 25 bp, Mus musculus
gtgtgtctctagtttcttaagcaga

SEQ ID NO: 719010 - DNA, 25 bp, Mus musculus
gtgtgtctctcacgcctggttagaa

SEQ ID NO: 719011 - DNA, 25 bp, Mus musculus
gtgtgtctctcaggcctggttagaa

SEQ ID NO: 719012 - DNA, 25 bp, Mus musculus
gtgtgtctctgaatctcaaagcctg

SEQ ID NO: 719013 - DNA, 25 bp, Mus musculus
gtgtgtctctgattctcaaagcctg

SEQ ID NO: 719014 - DNA, 25 bp, Mus musculus
gtgtgtctgaacaacttcgatgatc

SEQ ID NO: 719015 - DNA, 25 bp, Mus musculus
gtgtgtctgaactacttcgatgatc

SEQ ID NO: 719016 - DNA, 25 bp, Mus musculus
gtgtgtctgaagacagctacagtgt

SEQ ID NO: 719017 - DNA, 25 bp, Mus musculus
gtgtgtctgaagtcagctacagtgt

SEQ ID NO: 719018 - DNA, 25 bp, Mus musculus
gtgtgtctgattctctgagacgctc

SEQ ID NO: 719019 - DNA, 25 bp, Mus musculus
gtgtgtctgattgtctgagacgctc

SEQ ID NO: 719020 - DNA, 25 bp, Mus musculus
gtgtgtctgcacacttgtcctttct

SEQ ID NO: 719021 - DNA, 25 bp, Mus musculus
gtgtgtctgcacagggctcaattga

SEQ ID NO: 719022 - DNA, 25 bp, Mus musculus
gtgtgtctgcactcttgtcctttct

SEQ ID NO: 719023 - DNA, 25 bp, Mus musculus
gtgtgtctgcactgggctcaattga

SEQ ID NO: 719024 - DNA, 25 bp, Mus musculus
gtgtgtctgcatattaactcttgtt

SEQ ID NO: 719025 - DNA, 25 bp, Mus musculus
gtgtgtctgcattttaactcttgtt

SEQ ID NO: 719026 - DNA, 25 bp, Mus musculus
gtgtgtctgccaagcggagaccgaa

SEQ ID NO: 719027 - DNA, 25 bp, Mus musculus
gtgtgtctgccatgcggagaccgaa

SEQ ID NO: 719028 - DNA, 25 bp, Mus musculus
gtgtgtctggcaaataaacctgtga

SEQ ID NO: 719029 - DNA, 25 bp, Mus musculus
gtgtgtctggcaacgaacttcttta

SEQ ID NO: 719030 - DNA, 25 bp, Mus musculus
gtgtgtctggcatataaacctgtga

SEQ ID NO: 719031 - DNA, 25 bp, Mus musculus
gtgtgtctggcatcgaacttcttta

SEQ ID NO: 719032 - DNA, 25 bp, Mus musculus
gtgtgtctgtacaagaccctccatg

SEQ ID NO: 719033 - DNA, 25 bp, Mus musculus
gtgtgtctgtactagaccctccatg

SEQ ID NO: 719034 - DNA, 25 bp, Mus musculus
gtgtgtctgtccaggaatctcagat

SEQ ID NO: 719035 - DNA, 25 bp, Mus musculus
gtgtgtctgtcctggaatctcagat

SEQ ID NO: 719036 - DNA, 25 bp, Mus musculus
gtgtgtctgtctctaaagcaaccac

SEQ ID NO: 719037 - DNA, 25 bp, Mus musculus
gtgtgtctgtctgtaaagcaaccac

SEQ ID NO: 719038 - DNA, 25 bp, Mus musculus
gtgtgtctgtgcatcgctcctacca

SEQ ID NO: 719039 - DNA, 25 bp, Mus musculus
gtgtgtctgtgcattcactttctgc

SEQ ID NO: 719040 - DNA, 25 bp, Mus musculus
gtgtgtctgtgccttgagaaaaaga

SEQ ID NO: 719041 - DNA, 25 bp, Mus musculus
gtgtgtctgtgcgttgagaaaaaga

SEQ ID NO: 719042 - DNA, 25 bp, Mus musculus
gtgtgtctgtgcttcgctcctacca

SEQ ID NO: 719043 - DNA, 25 bp, Mus musculus
gtgtgtctgtgctttcactttctgc

SEQ ID NO: 719044 - DNA, 25 bp, Mus musculus
gtgtgtctgttacctgtgtattcca

SEQ ID NO: 719045 - DNA, 25 bp, Mus musculus
gtgtgtctgttagctgtgtattcca

SEQ ID NO: 719046 - DNA, 25 bp, Mus musculus
gtgtgtctgtttaccaagtgtgtgc

SEQ ID NO: 719047 - DNA, 25 bp, Mus musculus
gtgtgtctgttttccaagtgtgtgc

SEQ ID NO: 719048 - DNA, 25 bp, Mus musculus
gtgtgtcttaggagccagggcctcc

SEQ ID NO: 719049 - DNA, 25 bp, Mus musculus
gtgtgtcttaggtgccagggcctcc

SEQ ID NO: 719050 - DNA, 25 bp, Mus musculus
gtgtgtcttatcaacgaaatcagat

SEQ ID NO: 719051 - DNA, 25 bp, Mus musculus
gtgtgtcttatctacgaaatcagat

SEQ ID NO: 719052 - DNA, 25 bp, Mus musculus
gtgtgtcttcagctgactgctttta

SEQ ID NO: 719053 - DNA, 25 bp, Mus musculus
gtgtgtcttcaggtgactgctttta

SEQ ID NO: 719054 - DNA, 25 bp, Mus musculus
gtgtgtcttcataccaaggaacctg

SEQ ID NO: 719055 - DNA, 25 bp, Mus musculus
gtgtgtcttcatcaaactctatggg

SEQ ID NO: 719056 - DNA, 25 bp, Mus musculus
gtgtgtcttcatcccaagtaaccaa

SEQ ID NO: 719057 - DNA, 25 bp, Mus musculus
gtgtgtcttcatgaaactctatggg

SEQ ID NO: 719058 - DNA, 25 bp, Mus musculus
gtgtgtcttcatgccaagtaaccaa

SEQ ID NO: 719059 - DNA, 25 bp, Mus musculus
gtgtgtcttcattccaaggaacctg

SEQ ID NO: 719060 - DNA, 25 bp, Mus musculus
gtgtgtcttctaatagctgcccaga

SEQ ID NO: 719061 - DNA, 25 bp, Mus musculus
gtgtgtcttctattagctgcccaga

SEQ ID NO: 719062 - DNA, 25 bp, Mus musculus
gtgtgtcttctcagactcttacata

SEQ ID NO: 719063 - DNA, 25 bp, Mus musculus
gtgtgtcttctctgactcttacata

SEQ ID NO: 719064 - DNA, 25 bp, Mus musculus
gtgtgtcttctgagagccaattaac

SEQ ID NO: 719065 - DNA, 25 bp, Mus musculus
gtgtgtcttctgatggtcatagttt

SEQ ID NO: 719066 - DNA, 25 bp, Mus musculus
gtgtgtcttctgtgagccaattaac

SEQ ID NO: 719067 - DNA, 25 bp, Mus musculus
gtgtgtcttctgttggtcatagttt

SEQ ID NO: 719068 - DNA, 25 bp, Mus musculus
gtgtgtcttcttcccactgtgcttt

SEQ ID NO: 719069 - DNA, 25 bp, Mus musculus
gtgtgtcttcttgccactgtgcttt

SEQ ID NO: 719070 - DNA, 25 bp, Mus musculus
gtgtgtcttgacaggcgtgttacta

SEQ ID NO: 719071 - DNA, 25 bp, Mus musculus
gtgtgtcttgacattctatcaaaaa

SEQ ID NO: 719072 - DNA, 25 bp, Mus musculus
gtgtgtcttgactggcgtgttacta

SEQ ID NO: 719073 - DNA, 25 bp, Mus musculus
gtgtgtcttgactttctatcaaaaa

SEQ ID NO: 719074 - DNA, 25 bp, Mus musculus
gtgtgtcttgcaaaggctcatgtga

SEQ ID NO: 719075 - DNA, 25 bp, Mus musculus
gtgtgtcttgcataggctcatgtga

SEQ ID NO: 719076 - DNA, 25 bp, Mus musculus
gtgtgtcttggaaatgactgagttc

SEQ ID NO: 719077 - DNA, 25 bp, Mus musculus
gtgtgtcttggatatgactgagttc

SEQ ID NO: 719078 - DNA, 25 bp, Mus musculus
gtgtgtcttggcagagattccccag

SEQ ID NO: 719079 - DNA, 25 bp, Mus musculus
gtgtgtcttggctgagattccccag

SEQ ID NO: 719080 - DNA, 25 bp, Mus musculus
gtgtgtcttgtaattccagtgtttt

SEQ ID NO: 719081 - DNA, 25 bp, Mus musculus
gtgtgtcttgtatttccagtgtttt

SEQ ID NO: 719082 - DNA, 25 bp, Mus musculus
gtgtgtcttgttaatgcaaactgat

SEQ ID NO: 719083 - DNA, 25 bp, Mus musculus
gtgtgtcttgtttatgcaaactgat

SEQ ID NO: 719084 - DNA, 25 bp, Mus musculus
gtgtgtctttatatcctcactagag

SEQ ID NO: 719085 - DNA, 25 bp, Mus musculus
gtgtgtctttatttcctcactagag

SEQ ID NO: 719086 - DNA, 25 bp, Mus musculus
gtgtgtctttcgattggtgcagtca

SEQ ID NO: 719087 - DNA, 25 bp, Mus musculus
gtgtgtctttcgtttggtgcagtca

SEQ ID NO: 719088 - DNA, 25 bp, Mus musculus
gtgtgtctttgcaaacggaggccct

SEQ ID NO: 719089 - DNA, 25 bp, Mus musculus
gtgtgtctttgctaacggaggccct

SEQ ID NO: 719090 - DNA, 25 bp, Mus musculus
gtgtgtcttttcctttcccagttga

SEQ ID NO: 719091 - DNA, 25 bp, Mus musculus
gtgtgtcttttcgtttcccagttga

SEQ ID NO: 719092 - DNA, 25 bp, Mus musculus
gtgtgtcttttgatgctaagtcact

SEQ ID NO: 719093 - DNA, 25 bp, Mus musculus
gtgtgtcttttgttgctaagtcact

SEQ ID NO: 719094 - DNA, 25 bp, Mus musculus
gtgtgtgaaaagactaagtggctgt

SEQ ID NO: 719095 - DNA, 25 bp, Mus musculus
gtgtgtgaaaagtctaagtggctgt

SEQ ID NO: 719096 - DNA, 25 bp, Mus musculus
gtgtgtgaaacgcatcttccgacat

SEQ ID NO: 719097 - DNA, 25 bp, Mus musculus
gtgtgtgaaacggatcttccgacat

SEQ ID NO: 719098 - DNA, 25 bp, Mus musculus
gtgtgtgaaagtatgctctgattta

SEQ ID NO: 719099 - DNA, 25 bp, Mus musculus
gtgtgtgaaagtttgctctgattta

SEQ ID NO: 719100 - DNA, 25 bp, Mus musculus
gtgtgtgaaatactgtcctcccgtt

SEQ ID NO: 719101 - DNA, 25 bp, Mus musculus
gtgtgtgaaatagtgtcctcccgtt

SEQ ID NO: 719102 - DNA, 25 bp, Mus musculus
gtgtgtgaacacatgcatcatatca

SEQ ID NO: 719103 - DNA, 25 bp, Mus musculus
gtgtgtgaacacttgcatcatatca

SEQ ID NO: 719104 - DNA, 25 bp, Mus musculus
gtgtgtgaaccccaataccgggaag

SEQ ID NO: 719105 - DNA, 25 bp, Mus musculus
gtgtgtgaacccgaataccgggaag

SEQ ID NO: 719106 - DNA, 25 bp, Mus musculus
gtgtgtgaacctataaaaataaaca

SEQ ID NO: 719107 - DNA, 25 bp, Mus musculus
gtgtgtgaacctttaaaaataaaca

SEQ ID NO: 719108 - DNA, 25 bp, Mus musculus
gtgtgtgaactcatacattgtctga

SEQ ID NO: 719109 - DNA, 25 bp, Mus musculus
gtgtgtgaactcttacattgtctga

SEQ ID NO: 719110 - DNA, 25 bp, Mus musculus
gtgtgtgaaggccatgattctcctc

SEQ ID NO: 719111 - DNA, 25 bp, Mus musculus
gtgtgtgaaggcgatgattctcctc

SEQ ID NO: 719112 - DNA, 25 bp, Mus musculus
gtgtgtgaagtcatacccagcactt

SEQ ID NO: 719113 - DNA, 25 bp, Mus musculus
gtgtgtgaagtcttacccagcactt

SEQ ID NO: 719114 - DNA, 25 bp, Mus musculus
gtgtgtgaagttagaccggcctcgt

SEQ ID NO: 719115 - DNA, 25 bp, Mus musculus
gtgtgtgaagttatatcctccgacc

SEQ ID NO: 719116 - DNA, 25 bp, Mus musculus
gtgtgtgaagtttgaccggcctcgt

SEQ ID NO: 719117 - DNA, 25 bp, Mus musculus
gtgtgtgaagttttatcctccgacc

SEQ ID NO: 719118 - DNA, 25 bp, Mus musculus
gtgtgtgaatgaaaaccggatccat

SEQ ID NO: 719119 - DNA, 25 bp, Mus musculus
gtgtgtgaatgataaccggatccat

SEQ ID NO: 719120 - DNA, 25 bp, Mus musculus
gtgtgtgaatggagacaaccctttt

SEQ ID NO: 719121 - DNA, 25 bp, Mus musculus
gtgtgtgaatggtgacaaccctttt

SEQ ID NO: 719122 - DNA, 25 bp, Mus musculus
gtgtgtgaatgtatgctggagtttt

SEQ ID NO: 719123 - DNA, 25 bp, Mus musculus
gtgtgtgaatgtcatagccctgaga

SEQ ID NO: 719124 - DNA, 25 bp, Mus musculus
gtgtgtgaatgtgatagccctgaga

SEQ ID NO: 719125 - DNA, 25 bp, Mus musculus
gtgtgtgaatgtttgctggagtttt

SEQ ID NO: 719126 - DNA, 25 bp, Mus musculus
gtgtgtgacaacaccatgaattctt

SEQ ID NO: 719127 - DNA, 25 bp, Mus musculus
gtgtgtgacaactccatgaattctt

SEQ ID NO: 719128 - DNA, 25 bp, Mus musculus
gtgtgtgacaatcctgtcatgccta

SEQ ID NO: 719129 - DNA, 25 bp, Mus musculus
gtgtgtgacaatgctgtcatgccta

SEQ ID NO: 719130 - DNA, 25 bp, Mus musculus
gtgtgtgacagcaagggcacctaca

SEQ ID NO: 719131 - DNA, 25 bp, Mus musculus
gtgtgtgacagctagggcacctaca

SEQ ID NO: 719132 - DNA, 25 bp, Mus musculus
gtgtgtgacattccattaattccat

SEQ ID NO: 719133 - DNA, 25 bp, Mus musculus
gtgtgtgacattctgtcctctcacc

SEQ ID NO: 719134 - DNA, 25 bp, Mus musculus
gtgtgtgacattgcattaattccat

SEQ ID NO: 719135 - DNA, 25 bp, Mus musculus
gtgtgtgacattgtgtcctctcacc

SEQ ID NO: 719136 - DNA, 25 bp, Mus musculus
gtgtgtgaccacatgcgtgcatacc

SEQ ID NO: 719137 - DNA, 25 bp, Mus musculus
gtgtgtgaccacttgcgtgcatacc

SEQ ID NO: 719138 - DNA, 25 bp, Mus musculus
gtgtgtgacctaacatcctgtgact

SEQ ID NO: 719139 - DNA, 25 bp, Mus musculus
gtgtgtgacctatcatcctgtgact

SEQ ID NO: 719140 - DNA, 25 bp, Mus musculus
gtgtgtgactagacctctcatttta

SEQ ID NO: 719141 - DNA, 25 bp, Mus musculus
gtgtgtgactagtcctctcatttta

SEQ ID NO: 719142 - DNA, 25 bp, Mus musculus
gtgtgtgactcaaatccaggaaccc

SEQ ID NO: 719143 - DNA, 25 bp, Mus musculus
gtgtgtgactcatatccaggaaccc

SEQ ID NO: 719144 - DNA, 25 bp, Mus musculus
gtgtgtgagactatgaccgagtgct

SEQ ID NO: 719145 - DNA, 25 bp, Mus musculus
gtgtgtgagactttgaccgagtgct

SEQ ID NO: 719146 - DNA, 25 bp, Mus musculus
gtgtgtgagatacatcccttggcct

SEQ ID NO: 719147 - DNA, 25 bp, Mus musculus
gtgtgtgagatagatcccttggcct

SEQ ID NO: 719148 - DNA, 25 bp, Mus musculus
gtgtgtgagcaaagtcccagatccc

SEQ ID NO: 719149 - DNA, 25 bp, Mus musculus
gtgtgtgagcaatgtcccagatccc

SEQ ID NO: 719150 - DNA, 25 bp, Mus musculus
gtgtgtgagcacaggtgccctcaga

SEQ ID NO: 719151 - DNA, 25 bp, Mus musculus
gtgtgtgagcactggtgccctcaga

SEQ ID NO: 719152 - DNA, 25 bp, Mus musculus
gtgtgtgagcatccaaaggtgactt

SEQ ID NO: 719153 - DNA, 25 bp, Mus musculus
gtgtgtgagcatgcaaaggtgactt

SEQ ID NO: 719154 - DNA, 25 bp, Mus musculus
gtgtgtgagctaacagcttctgcat

SEQ ID NO: 719155 - DNA, 25 bp, Mus musculus
gtgtgtgagctatcagcttctgcat

SEQ ID NO: 719156 - DNA, 25 bp, Mus musculus
gtgtgtgaggaccagtggcgcccag

SEQ ID NO: 719157 - DNA, 25 bp, Mus musculus
gtgtgtgaggacgagtggcgcccag

SEQ ID NO: 719158 - DNA, 25 bp, Mus musculus
gtgtgtgagtggctgtatcttacct

SEQ ID NO: 719159 - DNA, 25 bp, Mus musculus
gtgtgtgagtgggtgtatcttacct

SEQ ID NO: 719160 - DNA, 25 bp, Mus musculus
gtgtgtgatataatcctgtaatccc

SEQ ID NO: 719161 - DNA, 25 bp, Mus musculus
gtgtgtgatatacctagccagaaat

SEQ ID NO: 719162 - DNA, 25 bp, Mus musculus
gtgtgtgatatagctagccagaaat

SEQ ID NO: 719163 - DNA, 25 bp, Mus musculus
gtgtgtgatatattcctgtaatccc

SEQ ID NO: 719164 - DNA, 25 bp, Mus musculus
gtgtgtgatcccaatgcacctcgag

SEQ ID NO: 719165 - DNA, 25 bp, Mus musculus
gtgtgtgatccctatgcacctcgag

SEQ ID NO: 719166 - DNA, 25 bp, Mus musculus
gtgtgtgatctccatattaaaagga

SEQ ID NO: 719167 - DNA, 25 bp, Mus musculus
gtgtgtgatctcgatattaaaagga

SEQ ID NO: 719168 - DNA, 25 bp, Mus musculus
gtgtgtgatgtccatctactgggac

SEQ ID NO: 719169 - DNA, 25 bp, Mus musculus
gtgtgtgatgtcgatctactgggac

SEQ ID NO: 719170 - DNA, 25 bp, Mus musculus
gtgtgtgattatctgacctatgcaa

SEQ ID NO: 719171 - DNA, 25 bp, Mus musculus
gtgtgtgattatgtgacctatgcaa

SEQ ID NO: 719172 - DNA, 25 bp, Mus musculus
gtgtgtgcacaaccttggcaagcat

SEQ ID NO: 719173 - DNA, 25 bp, Mus musculus
gtgtgtgcacaagcttggcaagcat

SEQ ID NO: 719174 - DNA, 25 bp, Mus musculus
gtgtgtgcacaccaccgacctcaga

SEQ ID NO: 719175 - DNA, 25 bp, Mus musculus
gtgtgtgcacacgaccgacctcaga

SEQ ID NO: 719176 - DNA, 25 bp, Mus musculus
gtgtgtgcaccaccatcaaacattg

SEQ ID NO: 719177 - DNA, 25 bp, Mus musculus
gtgtgtgcaccagcatcaaacattg

SEQ ID NO: 719178 - DNA, 25 bp, Mus musculus
gtgtgtgcacttcagcttagaaagc

SEQ ID NO: 719179 - DNA, 25 bp, Mus musculus
gtgtgtgcacttcagttaatacaat

SEQ ID NO: 719180 - DNA, 25 bp, Mus musculus
gtgtgtgcacttgagcttagaaagc

SEQ ID NO: 719181 - DNA, 25 bp, Mus musculus
gtgtgtgcacttgagttaatacaat

SEQ ID NO: 719182 - DNA, 25 bp, Mus musculus
gtgtgtgcagaaatctccaatacca

SEQ ID NO: 719183 - DNA, 25 bp, Mus musculus
gtgtgtgcagaattctccaatacca

SEQ ID NO: 719184 - DNA, 25 bp, Mus musculus
gtgtgtgcagctaatttcttctgtt

SEQ ID NO: 719185 - DNA, 25 bp, Mus musculus
gtgtgtgcagcttatttcttctgtt

SEQ ID NO: 719186 - DNA, 25 bp, Mus musculus
gtgtgtgcaggaataaagcagccca

SEQ ID NO: 719187 - DNA, 25 bp, Mus musculus
gtgtgtgcaggattaaagcagccca

SEQ ID NO: 719188 - DNA, 25 bp, Mus musculus
gtgtgtgcaggcatagcttcgccac

SEQ ID NO: 719189 - DNA, 25 bp, Mus musculus
gtgtgtgcaggcttagcttcgccac

SEQ ID NO: 719190 - DNA, 25 bp, Mus musculus
gtgtgtgcagtcacatacagcactg

SEQ ID NO: 719191 - DNA, 25 bp, Mus musculus
gtgtgtgcagtctcatacagcactg

SEQ ID NO: 719192 - DNA, 25 bp, Mus musculus
gtgtgtgcatctaccactagtttat

SEQ ID NO: 719193 - DNA, 25 bp, Mus musculus
gtgtgtgcatcttccactagtttat

SEQ ID NO: 719194 - DNA, 25 bp, Mus musculus
gtgtgtgcattaatgggccaggtta

SEQ ID NO: 719195 - DNA, 25 bp, Mus musculus
gtgtgtgcattattgggccaggtta

SEQ ID NO: 719196 - DNA, 25 bp, Mus musculus
gtgtgtgcatttagccccaaagggc

SEQ ID NO: 719197 - DNA, 25 bp, Mus musculus
gtgtgtgcattttgccccaaagggc

SEQ ID NO: 719198 - DNA, 25 bp, Mus musculus
gtgtgtgccaaacatgccaccaaag

SEQ ID NO: 719199 - DNA, 25 bp, Mus musculus
gtgtgtgccaaagatgccaccaaag

SEQ ID NO: 719200 - DNA, 25 bp, Mus musculus
gtgtgtgccacaagttcatggtgtt

SEQ ID NO: 719201 - DNA, 25 bp, Mus musculus
gtgtgtgccacatgttcatggtgtt

SEQ ID NO: 719202 - DNA, 25 bp, Mus musculus
gtgtgtgccactcaggttttcaaga

SEQ ID NO: 719203 - DNA, 25 bp, Mus musculus
gtgtgtgccactgaggttttcaaga

SEQ ID NO: 719204 - DNA, 25 bp, Mus musculus
gtgtgtgccatccatgcctaagatt

SEQ ID NO: 719205 - DNA, 25 bp, Mus musculus
gtgtgtgccatcgatgcctaagatt

SEQ ID NO: 719206 - DNA, 25 bp, Mus musculus
gtgtgtgccattctgctcaaaacta

SEQ ID NO: 719207 - DNA, 25 bp, Mus musculus
gtgtgtgccattgtgctcaaaacta

SEQ ID NO: 719208 - DNA, 25 bp, Mus musculus
gtgtgtgcccacagctaaagtccac

SEQ ID NO: 719209 - DNA, 25 bp, Mus musculus
gtgtgtgcccactgctaaagtccac

SEQ ID NO: 719210 - DNA, 25 bp, Mus musculus
gtgtgtgcccatccatacatatgac

SEQ ID NO: 719211 - DNA, 25 bp, Mus musculus
gtgtgtgcccatgcatacatatgac

SEQ ID NO: 719212 - DNA, 25 bp, Mus musculus
gtgtgtgccgcgacagtcatgccga

SEQ ID NO: 719213 - DNA, 25 bp, Mus musculus
gtgtgtgccgcgtcagtcatgccga

SEQ ID NO: 719214 - DNA, 25 bp, Mus musculus
gtgtgtgcctagaacctgtggagac

SEQ ID NO: 719215 - DNA, 25 bp, Mus musculus
gtgtgtgcctagtacctgtggagac

SEQ ID NO: 719216 - DNA, 25 bp, Mus musculus
gtgtgtgcctataaaggccagagat

SEQ ID NO: 719217 - DNA, 25 bp, Mus musculus
gtgtgtgcctattaaggccagagat

SEQ ID NO: 719218 - DNA, 25 bp, Mus musculus
gtgtgtgccttcaatacagcagtca

SEQ ID NO: 719219 - DNA, 25 bp, Mus musculus
gtgtgtgccttcacaggtgtgtgca

SEQ ID NO: 719220 - DNA, 25 bp, Mus musculus
gtgtgtgccttctatacagcagtca

SEQ ID NO: 719221 - DNA, 25 bp, Mus musculus
gtgtgtgccttctcaggtgtgtgca

SEQ ID NO: 719222 - DNA, 25 bp, Mus musculus
gtgtgtgcgcccaggtttcagcaag

SEQ ID NO: 719223 - DNA, 25 bp, Mus musculus
gtgtgtgcgccctggtttcagcaag

SEQ ID NO: 719224 - DNA, 25 bp, Mus musculus
gtgtgtgcgcgtacagctcatctga

SEQ ID NO: 719225 - DNA, 25 bp, Mus musculus
gtgtgtgcgcgttcagctcatctga

SEQ ID NO: 719226 - DNA, 25 bp, Mus musculus
gtgtgtgcggtcactccttcatggt

SEQ ID NO: 719227 - DNA, 25 bp, Mus musculus
gtgtgtgcggtctctccttcatggt

SEQ ID NO: 719228 - DNA, 25 bp, Mus musculus
gtgtgtgctaacctgagttcctgag

SEQ ID NO: 719229 - DNA, 25 bp, Mus musculus
gtgtgtgctaacgtgagttcctgag

SEQ ID NO: 719230 - DNA, 25 bp, Mus musculus
gtgtgtgctacaaactctcatgacc

SEQ ID NO: 719231 - DNA, 25 bp, Mus musculus
gtgtgtgctacatactctcatgacc

SEQ ID NO: 719232 - DNA, 25 bp, Mus musculus
gtgtgtgctaccctgtttgcttttt

SEQ ID NO: 719233 - DNA, 25 bp, Mus musculus
gtgtgtgctaccgtgtttgcttttt

SEQ ID NO: 719234 - DNA, 25 bp, Mus musculus
gtgtgtgctctgcaaacaaacctgg

SEQ ID NO: 719235 - DNA, 25 bp, Mus musculus
gtgtgtgctctgctttttataaaac

SEQ ID NO: 719236 - DNA, 25 bp, Mus musculus
gtgtgtgctctggaaacaaacctgg

SEQ ID NO: 719237 - DNA, 25 bp, Mus musculus
gtgtgtgctctggtttttataaaac

SEQ ID NO: 719238 - DNA, 25 bp, Mus musculus
gtgtgtgctgacatactgtagcaac

SEQ ID NO: 719239 - DNA, 25 bp, Mus musculus
gtgtgtgctgacttactgtagcaac

SEQ ID NO: 719240 - DNA, 25 bp, Mus musculus
gtgtgtgctgctcactatgacatgt

SEQ ID NO: 719241 - DNA, 25 bp, Mus musculus
gtgtgtgctgctccttaaaccactg

SEQ ID NO: 719242 - DNA, 25 bp, Mus musculus
gtgtgtgctgctgactatgacatgt

SEQ ID NO: 719243 - DNA, 25 bp, Mus musculus
gtgtgtgctgctgcttaaaccactg

SEQ ID NO: 719244 - DNA, 25 bp, Mus musculus
gtgtgtgctggccacttaacaaaca

SEQ ID NO: 719245 - DNA, 25 bp, Mus musculus
gtgtgtgctggcgacttaacaaaca

SEQ ID NO: 719246 - DNA, 25 bp, Mus musculus
gtgtgtgctgtgagaaaggtctctt

SEQ ID NO: 719247 - DNA, 25 bp, Mus musculus
gtgtgtgctgtgtgaaaggtctctt

SEQ ID NO: 719248 - DNA, 25 bp, Mus musculus
gtgtgtgcttatacagatactgttt

SEQ ID NO: 719249 - DNA, 25 bp, Mus musculus
gtgtgtgcttatcaagataccctct

SEQ ID NO: 719250 - DNA, 25 bp, Mus musculus
gtgtgtgcttatgaagataccctct

SEQ ID NO: 719251 - DNA, 25 bp, Mus musculus
gtgtgtgcttattcagatactgttt

SEQ ID NO: 719252 - DNA, 25 bp, Mus musculus
gtgtgtgcttctatgtgctagtaca

SEQ ID NO: 719253 - DNA, 25 bp, Mus musculus
gtgtgtgcttctttgtgctagtaca

SEQ ID NO: 719254 - DNA, 25 bp, Mus musculus
gtgtgtgcttgccatcttagcactt

SEQ ID NO: 719255 - DNA, 25 bp, Mus musculus
gtgtgtgcttgcgatcttagcactt

SEQ ID NO: 719256 - DNA, 25 bp, Mus musculus
gtgtgtgcttggactcacatctaga

SEQ ID NO: 719257 - DNA, 25 bp, Mus musculus
gtgtgtgcttggctatatgccgcat

SEQ ID NO: 719258 - DNA, 25 bp, Mus musculus
gtgtgtgcttgggtatatgccgcat

SEQ ID NO: 719259 - DNA, 25 bp, Mus musculus
gtgtgtgcttggtctcacatctaga

SEQ ID NO: 719260 - DNA, 25 bp, Mus musculus
gtgtgtgctttcaatggtcacgtca

SEQ ID NO: 719261 - DNA, 25 bp, Mus musculus
gtgtgtgctttctatggtcacgtca

SEQ ID NO: 719262 - DNA, 25 bp, Mus musculus
gtgtgtgcttttcgcatgcagatac

SEQ ID NO: 719263 - DNA, 25 bp, Mus musculus
gtgtgtgcttttggcatgcagatac

SEQ ID NO: 719264 - DNA, 25 bp, Mus musculus
gtgtgtggaaacactccagacccaa

SEQ ID NO: 719265 - DNA, 25 bp, Mus musculus
gtgtgtggaaactctccagacccaa

SEQ ID NO: 719266 - DNA, 25 bp, Mus musculus
gtgtgtggaccaaaatgctggtgat

SEQ ID NO: 719267 - DNA, 25 bp, Mus musculus
gtgtgtggaccataatgctggtgat

SEQ ID NO: 719268 - DNA, 25 bp, Mus musculus
gtgtgtggacttcctgttttatgtg

SEQ ID NO: 719269 - DNA, 25 bp, Mus musculus
gtgtgtggacttgctgttttatgtg

SEQ ID NO: 719270 - DNA, 25 bp, Mus musculus
gtgtgtggagaaatatcatactttt

SEQ ID NO: 719271 - DNA, 25 bp, Mus musculus
gtgtgtggagaaatgcgctttcagt

SEQ ID NO: 719272 - DNA, 25 bp, Mus musculus
gtgtgtggagaattatcatactttt

SEQ ID NO: 719273 - DNA, 25 bp, Mus musculus
gtgtgtggagaattgcgctttcagt

SEQ ID NO: 719274 - DNA, 25 bp, Mus musculus
gtgtgtggagacagctttctttgtt

SEQ ID NO: 719275 - DNA, 25 bp, Mus musculus
gtgtgtggagactgctttctttgtt

SEQ ID NO: 719276 - DNA, 25 bp, Mus musculus
gtgtgtggagctagaaaacctcagt

SEQ ID NO: 719277 - DNA, 25 bp, Mus musculus
gtgtgtggagcttgaaaacctcagt

SEQ ID NO: 719278 - DNA, 25 bp, Mus musculus
gtgtgtggatatagctgcctcttaa

SEQ ID NO: 719279 - DNA, 25 bp, Mus musculus
gtgtgtggatattgctgcctcttaa

SEQ ID NO: 719280 - DNA, 25 bp, Mus musculus
gtgtgtggatccagctctctcttga

SEQ ID NO: 719281 - DNA, 25 bp, Mus musculus
gtgtgtggatcctgctctctcttga

SEQ ID NO: 719282 - DNA, 25 bp, Mus musculus
gtgtgtggatgtctgacctcaaatg

SEQ ID NO: 719283 - DNA, 25 bp, Mus musculus
gtgtgtggatgtgtgacctcaaatg

SEQ ID NO: 719284 - DNA, 25 bp, Mus musculus
gtgtgtggatttagatcaaacttca

SEQ ID NO: 719285 - DNA, 25 bp, Mus musculus
gtgtgtggattttgatcaaacttca

SEQ ID NO: 719286 - DNA, 25 bp, Mus musculus
gtgtgtggcaaccttacagtagtaa

SEQ ID NO: 719287 - DNA, 25 bp, Mus musculus
gtgtgtggcaacgttacagtagtaa

SEQ ID NO: 719288 - DNA, 25 bp, Mus musculus
gtgtgtggcacaatcgctttatgaa

SEQ ID NO: 719289 - DNA, 25 bp, Mus musculus
gtgtgtggcacattcgctttatgaa

SEQ ID NO: 719290 - DNA, 25 bp, Mus musculus
gtgtgtggcaccctcaggaatgtat

SEQ ID NO: 719291 - DNA, 25 bp, Mus musculus
gtgtgtggcaccgtcaggaatgtat

SEQ ID NO: 719292 - DNA, 25 bp, Mus musculus
gtgtgtggcagtaagcagctgtatc

SEQ ID NO: 719293 - DNA, 25 bp, Mus musculus
gtgtgtggcagttagcagctgtatc

SEQ ID NO: 719294 - DNA, 25 bp, Mus musculus
gtgtgtggcccacaaattgaaattt

SEQ ID NO: 719295 - DNA, 25 bp, Mus musculus
gtgtgtggcccacgatttgatcccc

SEQ ID NO: 719296 - DNA, 25 bp, Mus musculus
gtgtgtggcccagaaattgaaattt

SEQ ID NO: 719297 - DNA, 25 bp, Mus musculus
gtgtgtggcccaggatttgatcccc

SEQ ID NO: 719298 - DNA, 25 bp, Mus musculus
gtgtgtggccttccaacttttgaaa

SEQ ID NO: 719299 - DNA, 25 bp, Mus musculus
gtgtgtggccttgcaacttttgaaa

SEQ ID NO: 719300 - DNA, 25 bp, Mus musculus
gtgtgtggcggtaccttcagagtcc

SEQ ID NO: 719301 - DNA, 25 bp, Mus musculus
gtgtgtggcggttccttcagagtcc

SEQ ID NO: 719302 - DNA, 25 bp, Mus musculus
gtgtgtggctaacacacaagtcaaa

SEQ ID NO: 719303 - DNA, 25 bp, Mus musculus
gtgtgtggctaagacacaagtcaaa

SEQ ID NO: 719304 - DNA, 25 bp, Mus musculus
gtgtgtgggatcctacaacctggac

SEQ ID NO: 719305 - DNA, 25 bp, Mus musculus
gtgtgtgggatcgtacaacctggac

SEQ ID NO: 719306 - DNA, 25 bp, Mus musculus
gtgtgtgggcgcacccacgtgcata

SEQ ID NO: 719307 - DNA, 25 bp, Mus musculus
gtgtgtgggcgctcccacgtgcata

SEQ ID NO: 719308 - DNA, 25 bp, Mus musculus
gtgtgtggtccccaaaaaagcccag

SEQ ID NO: 719309 - DNA, 25 bp, Mus musculus
gtgtgtggtccccttatacccttct

SEQ ID NO: 719310 - DNA, 25 bp, Mus musculus
gtgtgtggtcccgaaaaaagcccag

SEQ ID NO: 719311 - DNA, 25 bp, Mus musculus
gtgtgtggtcccgttatacccttct

SEQ ID NO: 719312 - DNA, 25 bp, Mus musculus
gtgtgtggtcttctcctagtagctg

SEQ ID NO: 719313 - DNA, 25 bp, Mus musculus
gtgtgtggtcttgtcctagtagctg

SEQ ID NO: 719314 - DNA, 25 bp, Mus musculus
gtgtgtggtggtccatttcccaccc

SEQ ID NO: 719315 - DNA, 25 bp, Mus musculus
gtgtgtggtggtgcatttcccaccc

SEQ ID NO: 719316 - DNA, 25 bp, Mus musculus
gtgtgtggttagcttcaaggtcaac

SEQ ID NO: 719317 - DNA, 25 bp, Mus musculus
gtgtgtggttaggttcaaggtcaac

SEQ ID NO: 719318 - DNA, 25 bp, Mus musculus
gtgtgtggttcaaactttttcaaga

SEQ ID NO: 719319 - DNA, 25 bp, Mus musculus
gtgtgtggttcatactttttcaaga

SEQ ID NO: 719320 - DNA, 25 bp, Mus musculus
gtgtgtggttgaatttcctactcag

SEQ ID NO: 719321 - DNA, 25 bp, Mus musculus
gtgtgtggttgattttcctactcag

SEQ ID NO: 719322 - DNA, 25 bp, Mus musculus
gtgtgtgtaaatactcatgctaaga

SEQ ID NO: 719323 - DNA, 25 bp, Mus musculus
gtgtgtgtaaattctcatgctaaga

SEQ ID NO: 719324 - DNA, 25 bp, Mus musculus
gtgtgtgtaacaatggccaaaagtg

SEQ ID NO: 719325 - DNA, 25 bp, Mus musculus
gtgtgtgtaacattggccaaaagtg

SEQ ID NO: 719326 - DNA, 25 bp, Mus musculus
gtgtgtgtaattccctacagtccta

SEQ ID NO: 719327 - DNA, 25 bp, Mus musculus
gtgtgtgtaattgcctacagtccta

SEQ ID NO: 719328 - DNA, 25 bp, Mus musculus
gtgtgtgtaccactgcagcaggcat

SEQ ID NO: 719329 - DNA, 25 bp, Mus musculus
gtgtgtgtaccagtgcagcaggcat

SEQ ID NO: 719330 - DNA, 25 bp, Mus musculus
gtgtgtgtaccgaaacatgtgttca

SEQ ID NO: 719331 - DNA, 25 bp, Mus musculus
gtgtgtgtaccgtaacatgtgttca

SEQ ID NO: 719332 - DNA, 25 bp, Mus musculus
gtgtgtgtagagatgacgcctgtca

SEQ ID NO: 719333 - DNA, 25 bp, Mus musculus
gtgtgtgtagagttgacgcctgtca

SEQ ID NO: 719334 - DNA, 25 bp, Mus musculus
gtgtgtgtagccagctctcagaatg

SEQ ID NO: 719335 - DNA, 25 bp, Mus musculus
gtgtgtgtagcctgctctcagaatg

SEQ ID NO: 719336 - DNA, 25 bp, Mus musculus
gtgtgtgtagctaagcgcctggaac

SEQ ID NO: 719337 - DNA, 25 bp, Mus musculus
gtgtgtgtagcttagcgcctggaac

SEQ ID NO: 719338 - DNA, 25 bp, Mus musculus
gtgtgtgtagttatacttgttcaac

SEQ ID NO: 719339 - DNA, 25 bp, Mus musculus
gtgtgtgtagttttacttgttcaac

SEQ ID NO: 719340 - DNA, 25 bp, Mus musculus
gtgtgtgtatatatgctgagccatt

SEQ ID NO: 719341 - DNA, 25 bp, Mus musculus
gtgtgtgtatatttgctgagccatt

SEQ ID NO: 719342 - DNA, 25 bp, Mus musculus
gtgtgtgtatcacctaggtctcaat

SEQ ID NO: 719343 - DNA, 25 bp, Mus musculus
gtgtgtgtatcagctaggtctcaat

SEQ ID NO: 719344 - DNA, 25 bp, Mus musculus
gtgtgtgtattcagtatgtattgaa

SEQ ID NO: 719345 - DNA, 25 bp, Mus musculus
gtgtgtgtattctgtatgtattgaa

SEQ ID NO: 719346 - DNA, 25 bp, Mus musculus
gtgtgtgtcaacctgcacagcttca

SEQ ID NO: 719347 - DNA, 25 bp, Mus musculus
gtgtgtgtcaacgtgcacagcttca

SEQ ID NO: 719348 - DNA, 25 bp, Mus musculus
gtgtgtgtcaatagaactagcctag

SEQ ID NO: 719349 - DNA, 25 bp, Mus musculus
gtgtgtgtcaattgaactagcctag

SEQ ID NO: 719350 - DNA, 25 bp, Mus musculus
gtgtgtgtcacaatccacccaagac

SEQ ID NO: 719351 - DNA, 25 bp, Mus musculus
gtgtgtgtcacacgtgtttttactg

SEQ ID NO: 719352 - DNA, 25 bp, Mus musculus
gtgtgtgtcacaggtgtttttactg

SEQ ID NO: 719353 - DNA, 25 bp, Mus musculus
gtgtgtgtcacattccacccaagac

SEQ ID NO: 719354 - DNA, 25 bp, Mus musculus
gtgtgtgtcataaatatctttcagt

SEQ ID NO: 719355 - DNA, 25 bp, Mus musculus
gtgtgtgtcatatatatctttcagt

SEQ ID NO: 719356 - DNA, 25 bp, Mus musculus
gtgtgtgtccatataacttcacgat

SEQ ID NO: 719357 - DNA, 25 bp, Mus musculus
gtgtgtgtccatttaacttcacgat

SEQ ID NO: 719358 - DNA, 25 bp, Mus musculus
gtgtgtgtccccacaggaggctgct

SEQ ID NO: 719359 - DNA, 25 bp, Mus musculus
gtgtgtgtcccctcaggaggctgct

SEQ ID NO: 719360 - DNA, 25 bp, Mus musculus
gtgtgtgtctacatttcctttgtat

SEQ ID NO: 719361 - DNA, 25 bp, Mus musculus
gtgtgtgtctacttttcctttgtat

SEQ ID NO: 719362 - DNA, 25 bp, Mus musculus
gtgtgtgtctcaaaccaatggtcat

SEQ ID NO: 719363 - DNA, 25 bp, Mus musculus
gtgtgtgtctcataccaatggtcat

SEQ ID NO: 719364 - DNA, 25 bp, Mus musculus
gtgtgtgtctggatttaggctagat

SEQ ID NO: 719365 - DNA, 25 bp, Mus musculus
gtgtgtgtctggcacatcagcaccc

SEQ ID NO: 719366 - DNA, 25 bp, Mus musculus
gtgtgtgtctgggacatcagcaccc

SEQ ID NO: 719367 - DNA, 25 bp, Mus musculus
gtgtgtgtctggttttaggctagat

SEQ ID NO: 719368 - DNA, 25 bp, Mus musculus
gtgtgtgtgacacatctttgaggtt

SEQ ID NO: 719369 - DNA, 25 bp, Mus musculus
gtgtgtgtgacactactgtaaacac

SEQ ID NO: 719370 - DNA, 25 bp, Mus musculus
gtgtgtgtgacagatctttgaggtt

SEQ ID NO: 719371 - DNA, 25 bp, Mus musculus
gtgtgtgtgacagtactgtaaacac

SEQ ID NO: 719372 - DNA, 25 bp, Mus musculus
gtgtgtgtgactaacccttactatt

SEQ ID NO: 719373 - DNA, 25 bp, Mus musculus
gtgtgtgtgacttacccttactatt

SEQ ID NO: 719374 - DNA, 25 bp, Mus musculus
gtgtgtgtgcaactacaggttcagt

SEQ ID NO: 719375 - DNA, 25 bp, Mus musculus
gtgtgtgtgcaagtacaggttcagt

SEQ ID NO: 719376 - DNA, 25 bp, Mus musculus
gtgtgtgtgcacaataaactacctc

SEQ ID NO: 719377 - DNA, 25 bp, Mus musculus
gtgtgtgtgcactataaactacctc

SEQ ID NO: 719378 - DNA, 25 bp, Mus musculus
gtgtgtgtgctcaaaagtatgccac

SEQ ID NO: 719379 - DNA, 25 bp, Mus musculus
gtgtgtgtgctctaaagtatgccac

SEQ ID NO: 719380 - DNA, 25 bp, Mus musculus
gtgtgtgtgcttcctgtcactagaa

SEQ ID NO: 719381 - DNA, 25 bp, Mus musculus
gtgtgtgtgcttgctgtcactagaa

SEQ ID NO: 719382 - DNA, 25 bp, Mus musculus
gtgtgtgtggtaattggccctctga

SEQ ID NO: 719383 - DNA, 25 bp, Mus musculus
gtgtgtgtggtatttggccctctga

SEQ ID NO: 719384 - DNA, 25 bp, Mus musculus
gtgtgtgtgtgcaataccttaatgg

SEQ ID NO: 719385 - DNA, 25 bp, Mus musculus
gtgtgtgtgtgctataccttaatgg

SEQ ID NO: 719386 - DNA, 25 bp, Mus musculus
gtgtgtgttacaatacaggcatcct

SEQ ID NO: 719387 - DNA, 25 bp, Mus musculus
gtgtgtgttacattacaggcatcct

SEQ ID NO: 719388 - DNA, 25 bp, Mus musculus
gtgtgtgttactcttagccatgctg

SEQ ID NO: 719389 - DNA, 25 bp, Mus musculus
gtgtgtgttactgttagccatgctg

SEQ ID NO: 719390 - DNA, 25 bp, Mus musculus
gtgtgtgttcagaagcaaacagagg

SEQ ID NO: 719391 - DNA, 25 bp, Mus musculus
gtgtgtgttcagtagcaaacagagg

SEQ ID NO: 719392 - DNA, 25 bp, Mus musculus
gtgtgtgttctcagtggcataacag

SEQ ID NO: 719393 - DNA, 25 bp, Mus musculus
gtgtgtgttctccattcacaagctt

SEQ ID NO: 719394 - DNA, 25 bp, Mus musculus
gtgtgtgttctcgattcacaagctt

SEQ ID NO: 719395 - DNA, 25 bp, Mus musculus
gtgtgtgttctctgtggcataacag

SEQ ID NO: 719396 - DNA, 25 bp, Mus musculus
gtgtgtgttgccattatatcctctt

SEQ ID NO: 719397 - DNA, 25 bp, Mus musculus
gtgtgtgttgcctttatatcctctt

SEQ ID NO: 719398 - DNA, 25 bp, Mus musculus
gtgtgtgttgtaagattgcttgttc

SEQ ID NO: 719399 - DNA, 25 bp, Mus musculus
gtgtgtgttgtatgattgcttgttc

SEQ ID NO: 719400 - DNA, 25 bp, Mus musculus
gtgtgtgtttaaactgtgccgtggc

SEQ ID NO: 719401 - DNA, 25 bp, Mus musculus
gtgtgtgtttaatctgtgccgtggc

SEQ ID NO: 719402 - DNA, 25 bp, Mus musculus
gtgtgtgtttacataccaatacatg

SEQ ID NO: 719403 - DNA, 25 bp, Mus musculus
gtgtgtgtttacttaccaatacatg

SEQ ID NO: 719404 - DNA, 25 bp, Mus musculus
gtgtgtgtttatcttcacctgtaca

SEQ ID NO: 719405 - DNA, 25 bp, Mus musculus
gtgtgtgtttatgttcacctgtaca

SEQ ID NO: 719406 - DNA, 25 bp, Mus musculus
gtgtgtgtttcactacacccatata

SEQ ID NO: 719407 - DNA, 25 bp, Mus musculus
gtgtgtgtttcagtacacccatata

SEQ ID NO: 719408 - DNA, 25 bp, Mus musculus
gtgtgtgtttctcataccatattgg

SEQ ID NO: 719409 - DNA, 25 bp, Mus musculus
gtgtgtgtttctgataccatattgg

SEQ ID NO: 719410 - DNA, 25 bp, Mus musculus
gtgtgtgtttggatcagtagagacc

SEQ ID NO: 719411 - DNA, 25 bp, Mus musculus
gtgtgtgtttggttcagtagagacc

SEQ ID NO: 719412 - DNA, 25 bp, Mus musculus
gtgtgtgtttgtagtcctaagggaa

SEQ ID NO: 719413 - DNA, 25 bp, Mus musculus
gtgtgtgtttgttgtcctaagggaa

SEQ ID NO: 719414 - DNA, 25 bp, Mus musculus
gtgtgtgttttaagcccagttactt

SEQ ID NO: 719415 - DNA, 25 bp, Mus musculus
gtgtgtgttttatgcccagttactt

SEQ ID NO: 719416 - DNA, 25 bp, Mus musculus
gtgtgtgttttcctgccgctgaata

SEQ ID NO: 719417 - DNA, 25 bp, Mus musculus
gtgtgtgttttcgtgccgctgaata

SEQ ID NO: 719418 - DNA, 25 bp, Mus musculus
gtgtgttaaatccatctttctctca

SEQ ID NO: 719419 - DNA, 25 bp, Mus musculus
gtgtgttaaatcgatctttctctca

SEQ ID NO: 719420 - DNA, 25 bp, Mus musculus
gtgtgttaaccaatcacagtttaat

SEQ ID NO: 719421 - DNA, 25 bp, Mus musculus
gtgtgttaaccaatgccttaccagt

SEQ ID NO: 719422 - DNA, 25 bp, Mus musculus
gtgtgttaaccattcacagtttaat

SEQ ID NO: 719423 - DNA, 25 bp, Mus musculus
gtgtgttaaccattgccttaccagt

SEQ ID NO: 719424 - DNA, 25 bp, Mus musculus
gtgtgttaacttctgctgtagctga

SEQ ID NO: 719425 - DNA, 25 bp, Mus musculus
gtgtgttaacttgtgctgtagctga

SEQ ID NO: 719426 - DNA, 25 bp, Mus musculus
gtgtgttaatacaaggagccgaaaa

SEQ ID NO: 719427 - DNA, 25 bp, Mus musculus
gtgtgttaatactaggagccgaaaa

SEQ ID NO: 719428 - DNA, 25 bp, Mus musculus
gtgtgttacaaactaaaaggctctg

SEQ ID NO: 719429 - DNA, 25 bp, Mus musculus
gtgtgttacaaagtaaaaggctctg

SEQ ID NO: 719430 - DNA, 25 bp, Mus musculus
gtgtgttacacacacgcagatgcag

SEQ ID NO: 719431 - DNA, 25 bp, Mus musculus
gtgtgttacacagacgcagatgcag

SEQ ID NO: 719432 - DNA, 25 bp, Mus musculus
gtgtgttaccagaccaagcctgtgc

SEQ ID NO: 719433 - DNA, 25 bp, Mus musculus
gtgtgttaccagtccaagcctgtgc

SEQ ID NO: 719434 - DNA, 25 bp, Mus musculus
gtgtgttactacataaggctaatac

SEQ ID NO: 719435 - DNA, 25 bp, Mus musculus
gtgtgttactacttaaggctaatac

SEQ ID NO: 719436 - DNA, 25 bp, Mus musculus
gtgtgttactcccacatacaactac

SEQ ID NO: 719437 - DNA, 25 bp, Mus musculus
gtgtgttactccgacatacaactac

SEQ ID NO: 719438 - DNA, 25 bp, Mus musculus
gtgtgttactgtagtgcacagcctt

SEQ ID NO: 719439 - DNA, 25 bp, Mus musculus
gtgtgttactgttgtgcacagcctt

SEQ ID NO: 719440 - DNA, 25 bp, Mus musculus
gtgtgttagccaaagcaacagtcaa

SEQ ID NO: 719441 - DNA, 25 bp, Mus musculus
gtgtgttagccatagcaacagtcaa

SEQ ID NO: 719442 - DNA, 25 bp, Mus musculus
gtgtgttagcttatgcaaaccaaga

SEQ ID NO: 719443 - DNA, 25 bp, Mus musculus
gtgtgttagcttttgcaaaccaaga

SEQ ID NO: 719444 - DNA, 25 bp, Mus musculus
gtgtgttagtgcactgaaaatagca

SEQ ID NO: 719445 - DNA, 25 bp, Mus musculus
gtgtgttagtgctctgaaaatagca

SEQ ID NO: 719446 - DNA, 25 bp, Mus musculus
gtgtgttatcagacaagatagttat

SEQ ID NO: 719447 - DNA, 25 bp, Mus musculus
gtgtgttatcagtcaagatagttat

SEQ ID NO: 719448 - DNA, 25 bp, Mus musculus
gtgtgttattcaatgtatccattgt

SEQ ID NO: 719449 - DNA, 25 bp, Mus musculus
gtgtgttattcattgtatccattgt

SEQ ID NO: 719450 - DNA, 25 bp, Mus musculus
gtgtgttattttactaccgagtagc

SEQ ID NO: 719451 - DNA, 25 bp, Mus musculus
gtgtgttattttactgcataaactt

SEQ ID NO: 719452 - DNA, 25 bp, Mus musculus
gtgtgttatttttctaccgagtagc

SEQ ID NO: 719453 - DNA, 25 bp, Mus musculus
gtgtgttatttttctgcataaactt

SEQ ID NO: 719454 - DNA, 25 bp, Mus musculus
gtgtgttcaaatacggcatcagctg

SEQ ID NO: 719455 - DNA, 25 bp, Mus musculus
gtgtgttcaaattcggcatcagctg

SEQ ID NO: 719456 - DNA, 25 bp, Mus musculus
gtgtgttcaagtcatgtttagcatt

SEQ ID NO: 719457 - DNA, 25 bp, Mus musculus
gtgtgttcaagtgatgtttagcatt

SEQ ID NO: 719458 - DNA, 25 bp, Mus musculus
gtgtgttcaataccccataactgta

SEQ ID NO: 719459 - DNA, 25 bp, Mus musculus
gtgtgttcaatagcccataactgta

SEQ ID NO: 719460 - DNA, 25 bp, Mus musculus
gtgtgttcacacagcgcgtggtcca

SEQ ID NO: 719461 - DNA, 25 bp, Mus musculus
gtgtgttcacacctggctagtaaga

SEQ ID NO: 719462 - DNA, 25 bp, Mus musculus
gtgtgttcacacgtggctagtaaga

SEQ ID NO: 719463 - DNA, 25 bp, Mus musculus
gtgtgttcacactgcgcgtggtcca

SEQ ID NO: 719464 - DNA, 25 bp, Mus musculus
gtgtgttcactgaaatcagcccttt

SEQ ID NO: 719465 - DNA, 25 bp, Mus musculus
gtgtgttcactgtaatcagcccttt

SEQ ID NO: 719466 - DNA, 25 bp, Mus musculus
gtgtgttcagcccacgatgagccag

SEQ ID NO: 719467 - DNA, 25 bp, Mus musculus
gtgtgttcagccctagttgaatgtt

SEQ ID NO: 719468 - DNA, 25 bp, Mus musculus
gtgtgttcagccgacgatgagccag

SEQ ID NO: 719469 - DNA, 25 bp, Mus musculus
gtgtgttcagccgtagttgaatgtt

SEQ ID NO: 719470 - DNA, 25 bp, Mus musculus
gtgtgttcataaagaccctctgtct

SEQ ID NO: 719471 - DNA, 25 bp, Mus musculus
gtgtgttcataatgaccctctgtct

SEQ ID NO: 719472 - DNA, 25 bp, Mus musculus
gtgtgttcatctcaaatgtgataaa

SEQ ID NO: 719473 - DNA, 25 bp, Mus musculus
gtgtgttcatctgaaatgtgataaa

SEQ ID NO: 719474 - DNA, 25 bp, Mus musculus
gtgtgttcatgcatgcctcgtgtgc

SEQ ID NO: 719475 - DNA, 25 bp, Mus musculus
gtgtgttcatgcttgcctcgtgtgc

SEQ ID NO: 719476 - DNA, 25 bp, Mus musculus
gtgtgttcatgtcccacatgcatgc

SEQ ID NO: 719477 - DNA, 25 bp, Mus musculus
gtgtgttcatgtgccacatgcatgc

SEQ ID NO: 719478 - DNA, 25 bp, Mus musculus
gtgtgttcattcatcagcctagagc

SEQ ID NO: 719479 - DNA, 25 bp, Mus musculus
gtgtgttcattcttcagcctagagc

SEQ ID NO: 719480 - DNA, 25 bp, Mus musculus
gtgtgttcatttatgccctgatgtg

SEQ ID NO: 719481 - DNA, 25 bp, Mus musculus
gtgtgttcatttttgccctgatgtg

SEQ ID NO: 719482 - DNA, 25 bp, Mus musculus
gtgtgttccagcctaatttccagga

SEQ ID NO: 719483 - DNA, 25 bp, Mus musculus
gtgtgttccagcgtaatttccagga

SEQ ID NO: 719484 - DNA, 25 bp, Mus musculus
gtgtgttccagtaaacttgaggtac

SEQ ID NO: 719485 - DNA, 25 bp, Mus musculus
gtgtgttccagttaacttgaggtac

SEQ ID NO: 719486 - DNA, 25 bp, Mus musculus
gtgtgttccatgcagagtatggatt

SEQ ID NO: 719487 - DNA, 25 bp, Mus musculus
gtgtgttccatggagagtatggatt

SEQ ID NO: 719488 - DNA, 25 bp, Mus musculus
gtgtgttccattatgtgctagtaac

SEQ ID NO: 719489 - DNA, 25 bp, Mus musculus
gtgtgttccattttgtgctagtaac

SEQ ID NO: 719490 - DNA, 25 bp, Mus musculus
gtgtgttcccatattatacccattt

SEQ ID NO: 719491 - DNA, 25 bp, Mus musculus
gtgtgttcccatcacatctgatgta

SEQ ID NO: 719492 - DNA, 25 bp, Mus musculus
gtgtgttcccatgacatctgatgta

SEQ ID NO: 719493 - DNA, 25 bp, Mus musculus
gtgtgttcccattttatacccattt

SEQ ID NO: 719494 - DNA, 25 bp, Mus musculus
gtgtgttccctgacacgatttggtt

SEQ ID NO: 719495 - DNA, 25 bp, Mus musculus
gtgtgttccctgtcacgatttggtt

SEQ ID NO: 719496 - DNA, 25 bp, Mus musculus
gtgtgttcctccatggtagtgatat

SEQ ID NO: 719497 - DNA, 25 bp, Mus musculus
gtgtgttcctccttggtagtgatat

SEQ ID NO: 719498 - DNA, 25 bp, Mus musculus
gtgtgttcctgcaatacaatctcca

SEQ ID NO: 719499 - DNA, 25 bp, Mus musculus
gtgtgttcctgctatacaatctcca

SEQ ID NO: 719500 - DNA, 25 bp, Mus musculus
gtgtgttccttaagggatgcactca

SEQ ID NO: 719501 - DNA, 25 bp, Mus musculus
gtgtgttccttatgggatgcactca

SEQ ID NO: 719502 - DNA, 25 bp, Mus musculus
gtgtgttcctttaaatagtgctaga

SEQ ID NO: 719503 - DNA, 25 bp, Mus musculus
gtgtgttccttttaatagtgctaga

SEQ ID NO: 719504 - DNA, 25 bp, Mus musculus
gtgtgttcgccgagcgctactcacg

SEQ ID NO: 719505 - DNA, 25 bp, Mus musculus
gtgtgttcgccgtgcgctactcacg

SEQ ID NO: 719506 - DNA, 25 bp, Mus musculus
gtgtgttctaacaggaattctcaag

SEQ ID NO: 719507 - DNA, 25 bp, Mus musculus
gtgtgttctaacctgcatgcaactt

SEQ ID NO: 719508 - DNA, 25 bp, Mus musculus
gtgtgttctaacgtgcatgcaactt

SEQ ID NO: 719509 - DNA, 25 bp, Mus musculus
gtgtgttctaactggaattctcaag

SEQ ID NO: 719510 - DNA, 25 bp, Mus musculus
gtgtgttctagcagtcaacttctct

SEQ ID NO: 719511 - DNA, 25 bp, Mus musculus
gtgtgttctagctgtcaacttctct

SEQ ID NO: 719512 - DNA, 25 bp, Mus musculus
gtgtgttctcgtctatcagctccca

SEQ ID NO: 719513 - DNA, 25 bp, Mus musculus
gtgtgttctcgtgtatcagctccca

SEQ ID NO: 719514 - DNA, 25 bp, Mus musculus
gtgtgttctctaaagctagctagcc

SEQ ID NO: 719515 - DNA, 25 bp, Mus musculus
gtgtgttctctatagctagctagcc

SEQ ID NO: 719516 - DNA, 25 bp, Mus musculus
gtgtgttctgagattctgtccagat

SEQ ID NO: 719517 - DNA, 25 bp, Mus musculus
gtgtgttctgagtttctgtccagat

SEQ ID NO: 719518 - DNA, 25 bp, Mus musculus
gtgtgttctgcactaggctggaact

SEQ ID NO: 719519 - DNA, 25 bp, Mus musculus
gtgtgttctgcagtaggctggaact

SEQ ID NO: 719520 - DNA, 25 bp, Mus musculus
gtgtgttctggacagattctttttt

SEQ ID NO: 719521 - DNA, 25 bp, Mus musculus
gtgtgttctggagagattctttttt

SEQ ID NO: 719522 - DNA, 25 bp, Mus musculus
gtgtgttctgtccttgttcatttaa

SEQ ID NO: 719523 - DNA, 25 bp, Mus musculus
gtgtgttctgtcgttgttcatttaa

SEQ ID NO: 719524 - DNA, 25 bp, Mus musculus
gtgtgttcttgtacattttgctgtt

SEQ ID NO: 719525 - DNA, 25 bp, Mus musculus
gtgtgttcttgttcattttgctgtt

SEQ ID NO: 719526 - DNA, 25 bp, Mus musculus
gtgtgttgaactatctaaaccacta

SEQ ID NO: 719527 - DNA, 25 bp, Mus musculus
gtgtgttgaactttctaaaccacta

SEQ ID NO: 719528 - DNA, 25 bp, Mus musculus
gtgtgttgaccaatgaacccgacgg

SEQ ID NO: 719529 - DNA, 25 bp, Mus musculus
gtgtgttgaccattgaacccgacgg

SEQ ID NO: 719530 - DNA, 25 bp, Mus musculus
gtgtgttgacctaaactatatgcca

SEQ ID NO: 719531 - DNA, 25 bp, Mus musculus
gtgtgttgaccttaactatatgcca

SEQ ID NO: 719532 - DNA, 25 bp, Mus musculus
gtgtgttgacttcatgcataattgt

SEQ ID NO: 719533 - DNA, 25 bp, Mus musculus
gtgtgttgacttgatgcataattgt

SEQ ID NO: 719534 - DNA, 25 bp, Mus musculus
gtgtgttgagctaagtggttcccca

SEQ ID NO: 719535 - DNA, 25 bp, Mus musculus
gtgtgttgagcttagtggttcccca

SEQ ID NO: 719536 - DNA, 25 bp, Mus musculus
gtgtgttgatgtacgtgctaggcct

SEQ ID NO: 719537 - DNA, 25 bp, Mus musculus
gtgtgttgatgttcgtgctaggcct

SEQ ID NO: 719538 - DNA, 25 bp, Mus musculus
gtgtgttgcaccaagacatgttgat

SEQ ID NO: 719539 - DNA, 25 bp, Mus musculus
gtgtgttgcacctagacatgttgat

SEQ ID NO: 719540 - DNA, 25 bp, Mus musculus
gtgtgttgcattctcctgggatcta

SEQ ID NO: 719541 - DNA, 25 bp, Mus musculus
gtgtgttgcattgtcctgggatcta

SEQ ID NO: 719542 - DNA, 25 bp, Mus musculus
gtgtgttgccggcacgccaccagaa

SEQ ID NO: 719543 - DNA, 25 bp, Mus musculus
gtgtgttgccgggacgccaccagaa

SEQ ID NO: 719544 - DNA, 25 bp, Mus musculus
gtgtgttgctccaataaagtttgta

SEQ ID NO: 719545 - DNA, 25 bp, Mus musculus
gtgtgttgctcctataaagtttgta

SEQ ID NO: 719546 - DNA, 25 bp, Mus musculus
gtgtgttgctggactttcaccattc

SEQ ID NO: 719547 - DNA, 25 bp, Mus musculus
gtgtgttgctggtctttcaccattc

SEQ ID NO: 719548 - DNA, 25 bp, Mus musculus
gtgtgttggtgtattttcctctcta

SEQ ID NO: 719549 - DNA, 25 bp, Mus musculus
gtgtgttggtgttttttcctctcta

SEQ ID NO: 719550 - DNA, 25 bp, Mus musculus
gtgtgttgtaagattgcttgttcaa

SEQ ID NO: 719551 - DNA, 25 bp, Mus musculus
gtgtgttgtaagtttgcttgttcaa

SEQ ID NO: 719552 - DNA, 25 bp, Mus musculus
gtgtgttgtagcacatttgtttcaa

SEQ ID NO: 719553 - DNA, 25 bp, Mus musculus
gtgtgttgtagctcatttgtttcaa

SEQ ID NO: 719554 - DNA, 25 bp, Mus musculus
gtgtgttgtatgcttgtgtttgacc

SEQ ID NO: 719555 - DNA, 25 bp, Mus musculus
gtgtgttgtatggttgtgtttgacc

SEQ ID NO: 719556 - DNA, 25 bp, Mus musculus
gtgtgttgtgttaaggcagggtctt

SEQ ID NO: 719557 - DNA, 25 bp, Mus musculus
gtgtgttgtgttaatgtgcttgtgt

SEQ ID NO: 719558 - DNA, 25 bp, Mus musculus
gtgtgttgtgtttaggcagggtctt

SEQ ID NO: 719559 - DNA, 25 bp, Mus musculus
gtgtgttgtgtttatgtgcttgtgt

SEQ ID NO: 719560 - DNA, 25 bp, Mus musculus
gtgtgttgttatatagtagcccctg

SEQ ID NO: 719561 - DNA, 25 bp, Mus musculus
gtgtgttgttatttagtagcccctg

SEQ ID NO: 719562 - DNA, 25 bp, Mus musculus
gtgtgtttaagtacagggctagcct

SEQ ID NO: 719563 - DNA, 25 bp, Mus musculus
gtgtgtttaagtctttaccagcaaa

SEQ ID NO: 719564 - DNA, 25 bp, Mus musculus
gtgtgtttaagtgtttaccagcaaa

SEQ ID NO: 719565 - DNA, 25 bp, Mus musculus
gtgtgtttaagttcagggctagcct

SEQ ID NO: 719566 - DNA, 25 bp, Mus musculus
gtgtgtttaataccactagcgagag

SEQ ID NO: 719567 - DNA, 25 bp, Mus musculus
gtgtgtttaatagcactagcgagag

SEQ ID NO: 719568 - DNA, 25 bp, Mus musculus
gtgtgtttaattacattatcccctt

SEQ ID NO: 719569 - DNA, 25 bp, Mus musculus
gtgtgtttaatttcattatcccctt

SEQ ID NO: 719570 - DNA, 25 bp, Mus musculus
gtgtgtttacacatatgcatacgtg

SEQ ID NO: 719571 - DNA, 25 bp, Mus musculus
gtgtgtttacacttatgcatacgtg

SEQ ID NO: 719572 - DNA, 25 bp, Mus musculus
gtgtgtttacagctgacgacttgga

SEQ ID NO: 719573 - DNA, 25 bp, Mus musculus
gtgtgtttacaggtgacgacttgga

SEQ ID NO: 719574 - DNA, 25 bp, Mus musculus
gtgtgtttacatatgtcaagcactc

SEQ ID NO: 719575 - DNA, 25 bp, Mus musculus
gtgtgtttacatttgtcaagcactc

SEQ ID NO: 719576 - DNA, 25 bp, Mus musculus
gtgtgtttacccaccataaggaata

SEQ ID NO: 719577 - DNA, 25 bp, Mus musculus
gtgtgtttaccctccataaggaata

SEQ ID NO: 719578 - DNA, 25 bp, Mus musculus
gtgtgtttacgtacactagctgcat

SEQ ID NO: 719579 - DNA, 25 bp, Mus musculus
gtgtgtttacgttcactagctgcat

SEQ ID NO: 719580 - DNA, 25 bp, Mus musculus
gtgtgtttactacggactggccgta

SEQ ID NO: 719581 - DNA, 25 bp, Mus musculus
gtgtgtttactagggactggccgta

SEQ ID NO: 719582 - DNA, 25 bp, Mus musculus
gtgtgtttactcacaaagcacagca

SEQ ID NO: 719583 - DNA, 25 bp, Mus musculus
gtgtgtttactctcaaagcacagca

SEQ ID NO: 719584 - DNA, 25 bp, Mus musculus
gtgtgtttactgctcagatgctcta

SEQ ID NO: 719585 - DNA, 25 bp, Mus musculus
gtgtgtttactggtcagatgctcta

SEQ ID NO: 719586 - DNA, 25 bp, Mus musculus
gtgtgtttagcaatcgtggccaggc

SEQ ID NO: 719587 - DNA, 25 bp, Mus musculus
gtgtgtttagcattcgtggccaggc

SEQ ID NO: 719588 - DNA, 25 bp, Mus musculus
gtgtgtttagtgcttgctttgtatt

SEQ ID NO: 719589 - DNA, 25 bp, Mus musculus
gtgtgtttagtggttgctttgtatt

SEQ ID NO: 719590 - DNA, 25 bp, Mus musculus
gtgtgtttagttcctgctatctagt

SEQ ID NO: 719591 - DNA, 25 bp, Mus musculus
gtgtgtttagttgctgctatctagt

SEQ ID NO: 719592 - DNA, 25 bp, Mus musculus
gtgtgtttatcacccatcagttatt

SEQ ID NO: 719593 - DNA, 25 bp, Mus musculus
gtgtgtttatcagccatcagttatt

SEQ ID NO: 719594 - DNA, 25 bp, Mus musculus
gtgtgtttatgcagtggtgtatatg

SEQ ID NO: 719595 - DNA, 25 bp, Mus musculus
gtgtgtttatgctgtggtgtatatg

SEQ ID NO: 719596 - DNA, 25 bp, Mus musculus
gtgtgtttcaagactctatgtgtat

SEQ ID NO: 719597 - DNA, 25 bp, Mus musculus
gtgtgtttcaagtctctatgtgtat

SEQ ID NO: 719598 - DNA, 25 bp, Mus musculus
gtgtgtttcacaactgcggtggaac

SEQ ID NO: 719599 - DNA, 25 bp, Mus musculus
gtgtgtttcacatctgcggtggaac

SEQ ID NO: 719600 - DNA, 25 bp, Mus musculus
gtgtgtttccaactggctagagctt

SEQ ID NO: 719601 - DNA, 25 bp, Mus musculus
gtgtgtttccaagtggctagagctt

SEQ ID NO: 719602 - DNA, 25 bp, Mus musculus
gtgtgtttccccatatatagcttcc

SEQ ID NO: 719603 - DNA, 25 bp, Mus musculus
gtgtgtttccccttatatagcttcc

SEQ ID NO: 719604 - DNA, 25 bp, Mus musculus
gtgtgtttcctaatattcttttaag

SEQ ID NO: 719605 - DNA, 25 bp, Mus musculus
gtgtgtttcctacatggtgatctga

SEQ ID NO: 719606 - DNA, 25 bp, Mus musculus
gtgtgtttcctagatggtgatctga

SEQ ID NO: 719607 - DNA, 25 bp, Mus musculus
gtgtgtttcctattattcttttaag

SEQ ID NO: 719608 - DNA, 25 bp, Mus musculus
gtgtgtttccttaagtgcagagtca

SEQ ID NO: 719609 - DNA, 25 bp, Mus musculus
gtgtgtttcctttagtgcagagtca

SEQ ID NO: 719610 - DNA, 25 bp, Mus musculus
gtgtgtttctccagggttttcagtc

SEQ ID NO: 719611 - DNA, 25 bp, Mus musculus
gtgtgtttctcctgggttttcagtc

SEQ ID NO: 719612 - DNA, 25 bp, Mus musculus
gtgtgtttctgtaccaacaccgtat

SEQ ID NO: 719613 - DNA, 25 bp, Mus musculus
gtgtgtttctgtcctctaggaaatc

SEQ ID NO: 719614 - DNA, 25 bp, Mus musculus
gtgtgtttctgtgctctaggaaatc

SEQ ID NO: 719615 - DNA, 25 bp, Mus musculus
gtgtgtttctgttccaacaccgtat

SEQ ID NO: 719616 - DNA, 25 bp, Mus musculus
gtgtgtttcttgaatctaggctcat

SEQ ID NO: 719617 - DNA, 25 bp, Mus musculus
gtgtgtttcttgacgtcagcaacca

SEQ ID NO: 719618 - DNA, 25 bp, Mus musculus
gtgtgtttcttgagtctagagtcct

SEQ ID NO: 719619 - DNA, 25 bp, Mus musculus
gtgtgtttcttgtatctaggctcat

SEQ ID NO: 719620 - DNA, 25 bp, Mus musculus
gtgtgtttcttgtcgtcagcaacca

SEQ ID NO: 719621 - DNA, 25 bp, Mus musculus
gtgtgtttcttgtgtctagagtcct

SEQ ID NO: 719622 - DNA, 25 bp, Mus musculus
gtgtgtttgcacatttcagaccttc

SEQ ID NO: 719623 - DNA, 25 bp, Mus musculus
gtgtgtttgcacttttcagaccttc

SEQ ID NO: 719624 - DNA, 25 bp, Mus musculus
gtgtgtttgcataagctaacctaaa

SEQ ID NO: 719625 - DNA, 25 bp, Mus musculus
gtgtgtttgcattagctaacctaaa

SEQ ID NO: 719626 - DNA, 25 bp, Mus musculus
gtgtgtttgcccattatgtatgtaa

SEQ ID NO: 719627 - DNA, 25 bp, Mus musculus
gtgtgtttgccctttatgtatgtaa

SEQ ID NO: 719628 - DNA, 25 bp, Mus musculus
gtgtgtttgcctacatcctgtatgt

SEQ ID NO: 719629 - DNA, 25 bp, Mus musculus
gtgtgtttgccttcatcctgtatgt

SEQ ID NO: 719630 - DNA, 25 bp, Mus musculus
gtgtgtttgctaagttgatagtgaa

SEQ ID NO: 719631 - DNA, 25 bp, Mus musculus
gtgtgtttgctaatcattgactgta

SEQ ID NO: 719632 - DNA, 25 bp, Mus musculus
gtgtgtttgctatgttgatagtgaa

SEQ ID NO: 719633 - DNA, 25 bp, Mus musculus
gtgtgtttgctattcattgactgta

SEQ ID NO: 719634 - DNA, 25 bp, Mus musculus
gtgtgtttgctcaaggagactctgt

SEQ ID NO: 719635 - DNA, 25 bp, Mus musculus
gtgtgtttgctctaggagactctgt

SEQ ID NO: 719636 - DNA, 25 bp, Mus musculus
gtgtgtttgggcagtaccagataat

SEQ ID NO: 719637 - DNA, 25 bp, Mus musculus
gtgtgtttgggctgtaccagataat

SEQ ID NO: 719638 - DNA, 25 bp, Mus musculus
gtgtgtttgtcaaagtacccagtgt

SEQ ID NO: 719639 - DNA, 25 bp, Mus musculus
gtgtgtttgtcatagtacccagtgt

SEQ ID NO: 719640 - DNA, 25 bp, Mus musculus
gtgtgtttgtccatctggatttggg

SEQ ID NO: 719641 - DNA, 25 bp, Mus musculus
gtgtgtttgtccttctggatttggg

SEQ ID NO: 719642 - DNA, 25 bp, Mus musculus
gtgtgtttgtctcgcatatttcttt

SEQ ID NO: 719643 - DNA, 25 bp, Mus musculus
gtgtgtttgtctggcatatttcttt

SEQ ID NO: 719644 - DNA, 25 bp, Mus musculus
gtgtgtttgtgtaccttctgcatct

SEQ ID NO: 719645 - DNA, 25 bp, Mus musculus
gtgtgtttgtgttccttctgcatct

SEQ ID NO: 719646 - DNA, 25 bp, Mus musculus
gtgtgtttgttccacagcatcaaaa

SEQ ID NO: 719647 - DNA, 25 bp, Mus musculus
gtgtgtttgttcgacagcatcaaaa

SEQ ID NO: 719648 - DNA, 25 bp, Mus musculus
gtgtgttttaaaccagtgaacctca

SEQ ID NO: 719649 - DNA, 25 bp, Mus musculus
gtgtgttttaaagcagtgaacctca

SEQ ID NO: 719650 - DNA, 25 bp, Mus musculus
gtgtgttttactccagtagccagaa

SEQ ID NO: 719651 - DNA, 25 bp, Mus musculus
gtgtgttttactgcagtagccagaa

SEQ ID NO: 719652 - DNA, 25 bp, Mus musculus
gtgtgttttcacatgttcttgcata

SEQ ID NO: 719653 - DNA, 25 bp, Mus musculus
gtgtgttttcacttgttcttgcata

SEQ ID NO: 719654 - DNA, 25 bp, Mus musculus
gtgtgttttcccaaggttctgaaat

SEQ ID NO: 719655 - DNA, 25 bp, Mus musculus
gtgtgttttccctaggttctgaaat

SEQ ID NO: 719656 - DNA, 25 bp, Mus musculus
gtgtgttttctaccgaagcccgcgg

SEQ ID NO: 719657 - DNA, 25 bp, Mus musculus
gtgtgttttctagcgaagcccgcgg

SEQ ID NO: 719658 - DNA, 25 bp, Mus musculus
gtgtgttttctgatatttgtctctc

SEQ ID NO: 719659 - DNA, 25 bp, Mus musculus
gtgtgttttctgttatttgtctctc

SEQ ID NO: 719660 - DNA, 25 bp, Mus musculus
gtgtgttttcttagactataagtat

SEQ ID NO: 719661 - DNA, 25 bp, Mus musculus
gtgtgttttcttcccttagggaagg

SEQ ID NO: 719662 - DNA, 25 bp, Mus musculus
gtgtgttttcttgccttagggaagg

SEQ ID NO: 719663 - DNA, 25 bp, Mus musculus
gtgtgttttctttgactataagtat

SEQ ID NO: 719664 - DNA, 25 bp, Mus musculus
gtgtgttttgatatggaagtcctgg

SEQ ID NO: 719665 - DNA, 25 bp, Mus musculus
gtgtgttttgatttggaagtcctgg

SEQ ID NO: 719666 - DNA, 25 bp, Mus musculus
gtgtgttttgctcaatggttttcat

SEQ ID NO: 719667 - DNA, 25 bp, Mus musculus
gtgtgttttgctgaatggttttcat

SEQ ID NO: 719668 - DNA, 25 bp, Mus musculus
gtgtgttttggtatgcagttctttt

SEQ ID NO: 719669 - DNA, 25 bp, Mus musculus
gtgtgttttggtttgcagttctttt

SEQ ID NO: 719670 - DNA, 25 bp, Mus musculus
gtgtgttttgtgaactgaaccaaac

SEQ ID NO: 719671 - DNA, 25 bp, Mus musculus
gtgtgttttgtgtactgaaccaaac

SEQ ID NO: 719672 - DNA, 25 bp, Mus musculus
gtgtgtttttatcctggttgcccaa

SEQ ID NO: 719673 - DNA, 25 bp, Mus musculus
gtgtgtttttatgctggttgcccaa

SEQ ID NO: 719674 - DNA, 25 bp, Mus musculus
gtgtgtttttcccagttctctagcc

SEQ ID NO: 719675 - DNA, 25 bp, Mus musculus
gtgtgtttttccgagttctctagcc

SEQ ID NO: 719676 - DNA, 25 bp, Mus musculus
gtgtgttttttacaccatggctgta

SEQ ID NO: 719677 - DNA, 25 bp, Mus musculus
gtgtgttttttagaccatggctgta

SEQ ID NO: 719678 - DNA, 25 bp, Mus musculus
gtgtgtttttttatgaagtctgtac

SEQ ID NO: 719679 - DNA, 25 bp, Mus musculus
gtgtgtttttttttgaagtctgtac

SEQ ID NO: 719680 - DNA, 25 bp, Mus musculus
gtgttaaaactgatctccctctgga

SEQ ID NO: 719681 - DNA, 25 bp, Mus musculus
gtgttaaaactgttctccctctgga

SEQ ID NO: 719682 - DNA, 25 bp, Mus musculus
gtgttaaaatggcactatccataaa

SEQ ID NO: 719683 - DNA, 25 bp, Mus musculus
gtgttaaaatgggactatccataaa

SEQ ID NO: 719684 - DNA, 25 bp, Mus musculus
gtgttaaacagcagagttcatctct

SEQ ID NO: 719685 - DNA, 25 bp, Mus musculus
gtgttaaacagctgagttcatctct

SEQ ID NO: 719686 - DNA, 25 bp, Mus musculus
gtgttaaacctgagagctgagccaa

SEQ ID NO: 719687 - DNA, 25 bp, Mus musculus
gtgttaaacctgtgagctgagccaa

SEQ ID NO: 719688 - DNA, 25 bp, Mus musculus
gtgttaaactaactcccattgggtg

SEQ ID NO: 719689 - DNA, 25 bp, Mus musculus
gtgttaaactaagtcccattgggtg

SEQ ID NO: 719690 - DNA, 25 bp, Mus musculus
gtgttaaagagactgttccccaggg

SEQ ID NO: 719691 - DNA, 25 bp, Mus musculus
gtgttaaagagagtgttccccaggg

SEQ ID NO: 719692 - DNA, 25 bp, Mus musculus
gtgttaaagctcagtcatgattgtg

SEQ ID NO: 719693 - DNA, 25 bp, Mus musculus
gtgttaaagctctgtcatgattgtg

SEQ ID NO: 719694 - DNA, 25 bp, Mus musculus
gtgttaaatacccttgtgtgtccaa

SEQ ID NO: 719695 - DNA, 25 bp, Mus musculus
gtgttaaataccgttgtgtgtccaa

SEQ ID NO: 719696 - DNA, 25 bp, Mus musculus
gtgttaaatagcatcccacgagctg

SEQ ID NO: 719697 - DNA, 25 bp, Mus musculus
gtgttaaatagcttcccacgagctg

SEQ ID NO: 719698 - DNA, 25 bp, Mus musculus
gtgttaaatctcagctttctagtaa

SEQ ID NO: 719699 - DNA, 25 bp, Mus musculus
gtgttaaatctcatggacctttagc

SEQ ID NO: 719700 - DNA, 25 bp, Mus musculus
gtgttaaatctctgctttctagtaa

SEQ ID NO: 719701 - DNA, 25 bp, Mus musculus
gtgttaaatctcttggacctttagc

SEQ ID NO: 719702 - DNA, 25 bp, Mus musculus
gtgttaaattctacattggttcctg

SEQ ID NO: 719703 - DNA, 25 bp, Mus musculus
gtgttaaattcttcattggttcctg

SEQ ID NO: 719704 - DNA, 25 bp, Mus musculus
gtgttaacaaagacttacaggatgc

SEQ ID NO: 719705 - DNA, 25 bp, Mus musculus
gtgttaacaaagtcttacaggatgc

SEQ ID NO: 719706 - DNA, 25 bp, Mus musculus
gtgttaacaagcagccccaatttta

SEQ ID NO: 719707 - DNA, 25 bp, Mus musculus
gtgttaacaagctgccccaatttta

SEQ ID NO: 719708 - DNA, 25 bp, Mus musculus
gtgttaacccccatcatgataaatg

SEQ ID NO: 719709 - DNA, 25 bp, Mus musculus
gtgttaacccccttcatgataaatg

SEQ ID NO: 719710 - DNA, 25 bp, Mus musculus
gtgttaactacaccgacttcacttg

SEQ ID NO: 719711 - DNA, 25 bp, Mus musculus
gtgttaactacagcgacttcacttg

SEQ ID NO: 719712 - DNA, 25 bp, Mus musculus
gtgttaagaacgactctgtgagttt

SEQ ID NO: 719713 - DNA, 25 bp, Mus musculus
gtgttaagaacgtctctgtgagttt

SEQ ID NO: 719714 - DNA, 25 bp, Mus musculus
gtgttaagaccacctgtgtgcatgc

SEQ ID NO: 719715 - DNA, 25 bp, Mus musculus
gtgttaagaccagctgtgtgcatgc

SEQ ID NO: 719716 - DNA, 25 bp, Mus musculus
gtgttaagattcaatgactcatttc

SEQ ID NO: 719717 - DNA, 25 bp, Mus musculus
gtgttaagattctatgactcatttc

SEQ ID NO: 719718 - DNA, 25 bp, Mus musculus
gtgttaagctgtacatgcacgtgcc

SEQ ID NO: 719719 - DNA, 25 bp, Mus musculus
gtgttaagctgttcatgcacgtgcc

SEQ ID NO: 719720 - DNA, 25 bp, Mus musculus
gtgttaagcttcaggccatacaaaa

SEQ ID NO: 719721 - DNA, 25 bp, Mus musculus
gtgttaagcttctggccatacaaaa

SEQ ID NO: 719722 - DNA, 25 bp, Mus musculus
gtgttaagtacaagagaagcctcca

SEQ ID NO: 719723 - DNA, 25 bp, Mus musculus
gtgttaagtacacccacattgtgtg

SEQ ID NO: 719724 - DNA, 25 bp, Mus musculus
gtgttaagtacagccacattgtgtg

SEQ ID NO: 719725 - DNA, 25 bp, Mus musculus
gtgttaagtacatgagaagcctcca

SEQ ID NO: 719726 - DNA, 25 bp, Mus musculus
gtgttaagtgaaagagccaggctcg

SEQ ID NO: 719727 - DNA, 25 bp, Mus musculus
gtgttaagtgaatgagccaggctcg

SEQ ID NO: 719728 - DNA, 25 bp, Mus musculus
gtgttaagttttaccttcagctact

SEQ ID NO: 719729 - DNA, 25 bp, Mus musculus
gtgttaagtttttccttcagctact

SEQ ID NO: 719730 - DNA, 25 bp, Mus musculus
gtgttaatacatcgtgtctccctga

SEQ ID NO: 719731 - DNA, 25 bp, Mus musculus
gtgttaatacatggtgtctccctga

SEQ ID NO: 719732 - DNA, 25 bp, Mus musculus
gtgttaatagagactttatcagatt

SEQ ID NO: 719733 - DNA, 25 bp, Mus musculus
gtgttaatagagtctttatcagatt

SEQ ID NO: 719734 - DNA, 25 bp, Mus musculus
gtgttaatcactaccactgacagaa

SEQ ID NO: 719735 - DNA, 25 bp, Mus musculus
gtgttaatcacttccactgacagaa

SEQ ID NO: 719736 - DNA, 25 bp, Mus musculus
gtgttaatgatgcttctgcggcctc

SEQ ID NO: 719737 - DNA, 25 bp, Mus musculus
gtgttaatgatggttctgcggcctc

SEQ ID NO: 719738 - DNA, 25 bp, Mus musculus
gtgttaatgtgtcattacctccata

SEQ ID NO: 719739 - DNA, 25 bp, Mus musculus
gtgttaatgtgtgattacctccata

SEQ ID NO: 719740 - DNA, 25 bp, Mus musculus
gtgttaattaaacagagcccctgtc

SEQ ID NO: 719741 - DNA, 25 bp, Mus musculus
gtgttaattaaagagagcccctgtc

SEQ ID NO: 719742 - DNA, 25 bp, Mus musculus
gtgttaattctccaggacctatact

SEQ ID NO: 719743 - DNA, 25 bp, Mus musculus
gtgttaattctcgaggacctatact

SEQ ID NO: 719744 - DNA, 25 bp, Mus musculus
gtgttaattgctaaccattgcgcat

SEQ ID NO: 719745 - DNA, 25 bp, Mus musculus
gtgttaattgcttaccattgcgcat

SEQ ID NO: 719746 - DNA, 25 bp, Mus musculus
gtgttaatttgaagggaactctgct

SEQ ID NO: 719747 - DNA, 25 bp, Mus musculus
gtgttaatttgatgggaactctgct

SEQ ID NO: 719748 - DNA, 25 bp, Mus musculus
gtgttacaattacttaccttcggag

SEQ ID NO: 719749 - DNA, 25 bp, Mus musculus
gtgttacaattagttaccttcggag

SEQ ID NO: 719750 - DNA, 25 bp, Mus musculus
gtgttacacaaacatgtgggacaca

SEQ ID NO: 719751 - DNA, 25 bp, Mus musculus
gtgttacacaaagatgtgggacaca

SEQ ID NO: 719752 - DNA, 25 bp, Mus musculus
gtgttacactagaatcttttgtgag

SEQ ID NO: 719753 - DNA, 25 bp, Mus musculus
gtgttacactagtatcttttgtgag

SEQ ID NO: 719754 - DNA, 25 bp, Mus musculus
gtgttacagcgactccttagcagaa

SEQ ID NO: 719755 - DNA, 25 bp, Mus musculus
gtgttacagcgagtccttagcagaa

SEQ ID NO: 719756 - DNA, 25 bp, Mus musculus
gtgttacaggtaattcgtcagtttg

SEQ ID NO: 719757 - DNA, 25 bp, Mus musculus
gtgttacaggtatttcgtcagtttg

SEQ ID NO: 719758 - DNA, 25 bp, Mus musculus
gtgttacagtatattaccgtcggaa

SEQ ID NO: 719759 - DNA, 25 bp, Mus musculus
gtgttacagtattttaccgtcggaa

SEQ ID NO: 719760 - DNA, 25 bp, Mus musculus
gtgttacagtttaccattgctatac

SEQ ID NO: 719761 - DNA, 25 bp, Mus musculus
gtgttacagttttccattgctatac

SEQ ID NO: 719762 - DNA, 25 bp, Mus musculus
gtgttacatgctctgtttttccata

SEQ ID NO: 719763 - DNA, 25 bp, Mus musculus
gtgttacatgctgtgtttttccata

SEQ ID NO: 719764 - DNA, 25 bp, Mus musculus
gtgttacatgtgattggaggtcaaa

SEQ ID NO: 719765 - DNA, 25 bp, Mus musculus
gtgttacatgtgtttggaggtcaaa

SEQ ID NO: 719766 - DNA, 25 bp, Mus musculus
gtgttacattgacagtagatacgat

SEQ ID NO: 719767 - DNA, 25 bp, Mus musculus
gtgttacattgagagtagatacgat

SEQ ID NO: 719768 - DNA, 25 bp, Mus musculus
gtgttaccaacaaaaccattctcag

SEQ ID NO: 719769 - DNA, 25 bp, Mus musculus
gtgttaccaacataaccattctcag

SEQ ID NO: 719770 - DNA, 25 bp, Mus musculus
gtgttacccaagcttgtgtctgtaa

SEQ ID NO: 719771 - DNA, 25 bp, Mus musculus
gtgttacccaaggttgtgtctgtaa

SEQ ID NO: 719772 - DNA, 25 bp, Mus musculus
gtgttacccactactgagattgttc

SEQ ID NO: 719773 - DNA, 25 bp, Mus musculus
gtgttacccacttctgagattgttc

SEQ ID NO: 719774 - DNA, 25 bp, Mus musculus
gtgttacccttgaactagcttagtt

SEQ ID NO: 719775 - DNA, 25 bp, Mus musculus
gtgttacccttgtactagcttagtt

SEQ ID NO: 719776 - DNA, 25 bp, Mus musculus
gtgttacctaccacattccttagaa

SEQ ID NO: 719777 - DNA, 25 bp, Mus musculus
gtgttacctacctcattccttagaa

SEQ ID NO: 719778 - DNA, 25 bp, Mus musculus
gtgttacctattaagatttaccaag

SEQ ID NO: 719779 - DNA, 25 bp, Mus musculus
gtgttacctatttagatttaccaag

SEQ ID NO: 719780 - DNA, 25 bp, Mus musculus
gtgttaccttatacggattcattgt

SEQ ID NO: 719781 - DNA, 25 bp, Mus musculus
gtgttaccttattcggattcattgt

SEQ ID NO: 719782 - DNA, 25 bp, Mus musculus
gtgttaccttggatctagagagtga

SEQ ID NO: 719783 - DNA, 25 bp, Mus musculus
gtgttaccttggttctagagagtga

SEQ ID NO: 719784 - DNA, 25 bp, Mus musculus
gtgttacgaaagagcttacggccat

SEQ ID NO: 719785 - DNA, 25 bp, Mus musculus
gtgttacgaaagtgcttacggccat

SEQ ID NO: 719786 - DNA, 25 bp, Mus musculus
gtgttacgggttacattggtccaga

SEQ ID NO: 719787 - DNA, 25 bp, Mus musculus
gtgttacgggtttcattggtccaga

SEQ ID NO: 719788 - DNA, 25 bp, Mus musculus
gtgttacgtgccactgttagattaa

SEQ ID NO: 719789 - DNA, 25 bp, Mus musculus
gtgttacgtgcctctgttagattaa

SEQ ID NO: 719790 - DNA, 25 bp, Mus musculus
gtgttacgttgcaaagttactcaga

SEQ ID NO: 719791 - DNA, 25 bp, Mus musculus
gtgttacgttgctaagttactcaga

SEQ ID NO: 719792 - DNA, 25 bp, Mus musculus
gtgttactagagacctcatctgtga

SEQ ID NO: 719793 - DNA, 25 bp, Mus musculus
gtgttactagagtcctcatctgtga

SEQ ID NO: 719794 - DNA, 25 bp, Mus musculus
gtgttactaggaattgtgacagcta

SEQ ID NO: 719795 - DNA, 25 bp, Mus musculus
gtgttactaggatttgtgacagcta

SEQ ID NO: 719796 - DNA, 25 bp, Mus musculus
gtgttactattactcatcctgctga

SEQ ID NO: 719797 - DNA, 25 bp, Mus musculus
gtgttactattagtcatcctgctga

SEQ ID NO: 719798 - DNA, 25 bp, Mus musculus
gtgttactcacccacattactgtgc

SEQ ID NO: 719799 - DNA, 25 bp, Mus musculus
gtgttactcaccgacattactgtgc

SEQ ID NO: 719800 - DNA, 25 bp, Mus musculus
gtgttactgcagagaactgccctac

SEQ ID NO: 719801 - DNA, 25 bp, Mus musculus
gtgttactgcagtgaactgccctac

SEQ ID NO: 719802 - DNA, 25 bp, Mus musculus
gtgttactgcgccaagaagcatcca

SEQ ID NO: 719803 - DNA, 25 bp, Mus musculus
gtgttactgcgcgaagaagcatcca

SEQ ID NO: 719804 - DNA, 25 bp, Mus musculus
gtgttactgtgaccatagtttcccc

SEQ ID NO: 719805 - DNA, 25 bp, Mus musculus
gtgttactgtgagcatagtttcccc

SEQ ID NO: 719806 - DNA, 25 bp, Mus musculus
gtgttacttcccatgattccagtta

SEQ ID NO: 719807 - DNA, 25 bp, Mus musculus
gtgttacttcccttgattccagtta

SEQ ID NO: 719808 - DNA, 25 bp, Mus musculus
gtgttactttcaaattgcacccaag

SEQ ID NO: 719809 - DNA, 25 bp, Mus musculus
gtgttactttcatattgcacccaag

SEQ ID NO: 719810 - DNA, 25 bp, Mus musculus
gtgttactttccaacaaggagccca

SEQ ID NO: 719811 - DNA, 25 bp, Mus musculus
gtgttactttcctacaaggagccca

SEQ ID NO: 719812 - DNA, 25 bp, Mus musculus
gtgttagaactgaagccatcccaag

SEQ ID NO: 719813 - DNA, 25 bp, Mus musculus
gtgttagaactgtagccatcccaag

SEQ ID NO: 719814 - DNA, 25 bp, Mus musculus
gtgttagaatacacggtctccagtt

SEQ ID NO: 719815 - DNA, 25 bp, Mus musculus
gtgttagaatactcggtctccagtt

SEQ ID NO: 719816 - DNA, 25 bp, Mus musculus
gtgttagagatgctgtctgctacca

SEQ ID NO: 719817 - DNA, 25 bp, Mus musculus
gtgttagagatggtgtctgctacca

SEQ ID NO: 719818 - DNA, 25 bp, Mus musculus
gtgttagatcccagaatttgtcatt

SEQ ID NO: 719819 - DNA, 25 bp, Mus musculus
gtgttagatcccatgagatatcctg

SEQ ID NO: 719820 - DNA, 25 bp, Mus musculus
gtgttagatccctgaatttgtcatt

SEQ ID NO: 719821 - DNA, 25 bp, Mus musculus
gtgttagatcccttgagatatcctg

SEQ ID NO: 719822 - DNA, 25 bp, Mus musculus
gtgttagatgacagctgcctgtaac

SEQ ID NO: 719823 - DNA, 25 bp, Mus musculus
gtgttagatgactgctgcctgtaac

SEQ ID NO: 719824 - DNA, 25 bp, Mus musculus
gtgttagatgagagtcctgcatact

SEQ ID NO: 719825 - DNA, 25 bp, Mus musculus
gtgttagatgagcttgttatcccca

SEQ ID NO: 719826 - DNA, 25 bp, Mus musculus
gtgttagatgaggttgttatcccca

SEQ ID NO: 719827 - DNA, 25 bp, Mus musculus
gtgttagatgagtgtcctgcatact

SEQ ID NO: 719828 - DNA, 25 bp, Mus musculus
gtgttagatgttaaaaataccggag

SEQ ID NO: 719829 - DNA, 25 bp, Mus musculus
gtgttagatgtttaaaataccggag

SEQ ID NO: 719830 - DNA, 25 bp, Mus musculus
gtgttagattgcaaggctgcgataa

SEQ ID NO: 719831 - DNA, 25 bp, Mus musculus
gtgttagattgctaggctgcgataa

SEQ ID NO: 719832 - DNA, 25 bp, Mus musculus
gtgttagccaatcaacctgaccgaa

SEQ ID NO: 719833 - DNA, 25 bp, Mus musculus
gtgttagccaatgaacctgaccgaa

SEQ ID NO: 719834 - DNA, 25 bp, Mus musculus
gtgttagccactatgttacttctta

SEQ ID NO: 719835 - DNA, 25 bp, Mus musculus
gtgttagccactttgttacttctta

SEQ ID NO: 719836 - DNA, 25 bp, Mus musculus
gtgttagccccaaactttcatgaag

SEQ ID NO: 719837 - DNA, 25 bp, Mus musculus
gtgttagccccatactttcatgaag

SEQ ID NO: 719838 - DNA, 25 bp, Mus musculus
gtgttagccctcactagttcttcta

SEQ ID NO: 719839 - DNA, 25 bp, Mus musculus
gtgttagccctctctagttcttcta

SEQ ID NO: 719840 - DNA, 25 bp, Mus musculus
gtgttagcgaaaccatgactgagga

SEQ ID NO: 719841 - DNA, 25 bp, Mus musculus
gtgttagcgaaagcatgactgagga

SEQ ID NO: 719842 - DNA, 25 bp, Mus musculus
gtgttagcgctaccagtgtcatgta

SEQ ID NO: 719843 - DNA, 25 bp, Mus musculus
gtgttagcgctactcagattctgaa

SEQ ID NO: 719844 - DNA, 25 bp, Mus musculus
gtgttagcgctagcagtgtcatgta

SEQ ID NO: 719845 - DNA, 25 bp, Mus musculus
gtgttagcgctagtcagattctgaa

SEQ ID NO: 719846 - DNA, 25 bp, Mus musculus
gtgttagctttcctattgactcaga

SEQ ID NO: 719847 - DNA, 25 bp, Mus musculus
gtgttagctttcgtattgactcaga

SEQ ID NO: 719848 - DNA, 25 bp, Mus musculus
gtgttaggaacaactccactggcgg

SEQ ID NO: 719849 - DNA, 25 bp, Mus musculus
gtgttaggaacatctccactggcgg

SEQ ID NO: 719850 - DNA, 25 bp, Mus musculus
gtgttaggaaccacagagctctgcc

SEQ ID NO: 719851 - DNA, 25 bp, Mus musculus
gtgttaggaacctcagagctctgcc

SEQ ID NO: 719852 - DNA, 25 bp, Mus musculus
gtgttaggcacacatacccttctgt

SEQ ID NO: 719853 - DNA, 25 bp, Mus musculus
gtgttaggcacagatacccttctgt

SEQ ID NO: 719854 - DNA, 25 bp, Mus musculus
gtgttagggcacctcaaaccttggg

SEQ ID NO: 719855 - DNA, 25 bp, Mus musculus
gtgttagggcacgtcaaaccttggg

SEQ ID NO: 719856 - DNA, 25 bp, Mus musculus
gtgttagtaaaaccacatctgctag

SEQ ID NO: 719857 - DNA, 25 bp, Mus musculus
gtgttagtaaaagcacatctgctag

SEQ ID NO: 719858 - DNA, 25 bp, Mus musculus
gtgttagtaccactacactccatcc

SEQ ID NO: 719859 - DNA, 25 bp, Mus musculus
gtgttagtaccagtacactccatcc

SEQ ID NO: 719860 - DNA, 25 bp, Mus musculus
gtgttagtcattcttcattgtgttc

SEQ ID NO: 719861 - DNA, 25 bp, Mus musculus
gtgttagtcattgttcattgtgttc

SEQ ID NO: 719862 - DNA, 25 bp, Mus musculus
gtgttagtctacaatcccagcaacc

SEQ ID NO: 719863 - DNA, 25 bp, Mus musculus
gtgttagtctactatcccagcaacc

SEQ ID NO: 719864 - DNA, 25 bp, Mus musculus
gtgttagtgagcattctactctgaa

SEQ ID NO: 719865 - DNA, 25 bp, Mus musculus
gtgttagtgagctttctactctgaa

SEQ ID NO: 719866 - DNA, 25 bp, Mus musculus
gtgttagtgcagacaggccagaact

SEQ ID NO: 719867 - DNA, 25 bp, Mus musculus
gtgttagtgcagaccaggctgcgcc

SEQ ID NO: 719868 - DNA, 25 bp, Mus musculus
gtgttagtgcagtcaggccagaact

SEQ ID NO: 719869 - DNA, 25 bp, Mus musculus
gtgttagtgcagtccaggctgcgcc

SEQ ID NO: 719870 - DNA, 25 bp, Mus musculus
gtgttagtgcgtaagaattccttca

SEQ ID NO: 719871 - DNA, 25 bp, Mus musculus
gtgttagtgcgttagaattccttca

SEQ ID NO: 719872 - DNA, 25 bp, Mus musculus
gtgttagtgtaacctcagatccgag

SEQ ID NO: 719873 - DNA, 25 bp, Mus musculus
gtgttagtgtaagctcagatccgag

SEQ ID NO: 719874 - DNA, 25 bp, Mus musculus
gtgttagtgtagacatcttgccttc

SEQ ID NO: 719875 - DNA, 25 bp, Mus musculus
gtgttagtgtagtcatcttgccttc

SEQ ID NO: 719876 - DNA, 25 bp, Mus musculus
gtgttagtgtatcccacagtgcaaa

SEQ ID NO: 719877 - DNA, 25 bp, Mus musculus
gtgttagtgtatgccacagtgcaaa

SEQ ID NO: 719878 - DNA, 25 bp, Mus musculus
gtgttagtgtcaacaatttgcctgt

SEQ ID NO: 719879 - DNA, 25 bp, Mus musculus
gtgttagtgtcatcaatttgcctgt

SEQ ID NO: 719880 - DNA, 25 bp, Mus musculus
gtgttagtgtttctgctcagaagtc

SEQ ID NO: 719881 - DNA, 25 bp, Mus musculus
gtgttagtgtttgtgctcagaagtc

SEQ ID NO: 719882 - DNA, 25 bp, Mus musculus
gtgttagttcttatccggataagct

SEQ ID NO: 719883 - DNA, 25 bp, Mus musculus
gtgttagttcttttccggataagct

SEQ ID NO: 719884 - DNA, 25 bp, Mus musculus
gtgttatactttagtcctggcttta

SEQ ID NO: 719885 - DNA, 25 bp, Mus musculus
gtgttatacttttgtcctggcttta

SEQ ID NO: 719886 - DNA, 25 bp, Mus musculus
gtgttataggtactctcggccttca

SEQ ID NO: 719887 - DNA, 25 bp, Mus musculus
gtgttataggtagtctcggccttca

SEQ ID NO: 719888 - DNA, 25 bp, Mus musculus
gtgttatatactcagagagtcccaa

SEQ ID NO: 719889 - DNA, 25 bp, Mus musculus
gtgttatatactgagagagtcccaa

SEQ ID NO: 719890 - DNA, 25 bp, Mus musculus
gtgttatatcacacttcatacagca

SEQ ID NO: 719891 - DNA, 25 bp, Mus musculus
gtgttatatcactcttcatacagca

SEQ ID NO: 719892 - DNA, 25 bp, Mus musculus
gtgttatatcttcagaccgttctcc

SEQ ID NO: 719893 - DNA, 25 bp, Mus musculus
gtgttatatcttgagaccgttctcc

SEQ ID NO: 719894 - DNA, 25 bp, Mus musculus
gtgttatatttgatctctcctgaga

SEQ ID NO: 719895 - DNA, 25 bp, Mus musculus
gtgttatatttgttctctcctgaga

SEQ ID NO: 719896 - DNA, 25 bp, Mus musculus
gtgttatcacacatattttcccctt

SEQ ID NO: 719897 - DNA, 25 bp, Mus musculus
gtgttatcacacttattttcccctt

SEQ ID NO: 719898 - DNA, 25 bp, Mus musculus
gtgttatcacagaatacgtggccta

SEQ ID NO: 719899 - DNA, 25 bp, Mus musculus
gtgttatcacagtatacgtggccta

SEQ ID NO: 719900 - DNA, 25 bp, Mus musculus
gtgttatcacttaatgcccatgtct

SEQ ID NO: 719901 - DNA, 25 bp, Mus musculus
gtgttatcactttatgcccatgtct

SEQ ID NO: 719902 - DNA, 25 bp, Mus musculus
gtgttatcatttaaggtcactgttc

SEQ ID NO: 719903 - DNA, 25 bp, Mus musculus
gtgttatcattttaggtcactgttc

SEQ ID NO: 719904 - DNA, 25 bp, Mus musculus
gtgttatccacaaggcagtccagga

SEQ ID NO: 719905 - DNA, 25 bp, Mus musculus
gtgttatccacatggcagtccagga

SEQ ID NO: 719906 - DNA, 25 bp, Mus musculus
gtgttatccagactgcttcaggtaa

SEQ ID NO: 719907 - DNA, 25 bp, Mus musculus
gtgttatccagagtgcttcaggtaa

SEQ ID NO: 719908 - DNA, 25 bp, Mus musculus
gtgttatccagtacccttcatactt

SEQ ID NO: 719909 - DNA, 25 bp, Mus musculus
gtgttatccagttcccttcatactt

SEQ ID NO: 719910 - DNA, 25 bp, Mus musculus
gtgttatcctctatggaaccaacaa

SEQ ID NO: 719911 - DNA, 25 bp, Mus musculus
gtgttatcctctttggaaccaacaa

SEQ ID NO: 719912 - DNA, 25 bp, Mus musculus
gtgttatcctgactggaacccacaa

SEQ ID NO: 719913 - DNA, 25 bp, Mus musculus
gtgttatcctgagtggaacccacaa

SEQ ID NO: 719914 - DNA, 25 bp, Mus musculus
gtgttatccttcacaaggcctggga

SEQ ID NO: 719915 - DNA, 25 bp, Mus musculus
gtgttatccttctcaaggcctggga

SEQ ID NO: 719916 - DNA, 25 bp, Mus musculus
gtgttatctatcacactgataagca

SEQ ID NO: 719917 - DNA, 25 bp, Mus musculus
gtgttatctatctcactgataagca

SEQ ID NO: 719918 - DNA, 25 bp, Mus musculus
gtgttatctcacatctaggaagaat

SEQ ID NO: 719919 - DNA, 25 bp, Mus musculus
gtgttatctcacttctaggaagaat

SEQ ID NO: 719920 - DNA, 25 bp, Mus musculus
gtgttatctccaccagcattagaag

SEQ ID NO: 719921 - DNA, 25 bp, Mus musculus
gtgttatctccagcagcattagaag

SEQ ID NO: 719922 - DNA, 25 bp, Mus musculus
gtgttatctgcacatggactggatt

SEQ ID NO: 719923 - DNA, 25 bp, Mus musculus
gtgttatctgcagatggactggatt

SEQ ID NO: 719924 - DNA, 25 bp, Mus musculus
gtgttatgccatatcatgtagccaa

SEQ ID NO: 719925 - DNA, 25 bp, Mus musculus
gtgttatgccatttcatgtagccaa

SEQ ID NO: 719926 - DNA, 25 bp, Mus musculus
gtgttatgctaacatatgacccagg

SEQ ID NO: 719927 - DNA, 25 bp, Mus musculus
gtgttatgctaagatatgacccagg

SEQ ID NO: 719928 - DNA, 25 bp, Mus musculus
gtgttatggttcagcaaccaccagg

SEQ ID NO: 719929 - DNA, 25 bp, Mus musculus
gtgttatggttccaactctcatata

SEQ ID NO: 719930 - DNA, 25 bp, Mus musculus
gtgttatggttcgaactctcatata

SEQ ID NO: 719931 - DNA, 25 bp, Mus musculus
gtgttatggttctgcaaccaccagg

SEQ ID NO: 719932 - DNA, 25 bp, Mus musculus
gtgttatgtaaccaaaccagtcctt

SEQ ID NO: 719933 - DNA, 25 bp, Mus musculus
gtgttatgtaacgaaaccagtcctt

SEQ ID NO: 719934 - DNA, 25 bp, Mus musculus
gtgttatgtacaaatcctggttttt

SEQ ID NO: 719935 - DNA, 25 bp, Mus musculus
gtgttatgtacatatcctggttttt

SEQ ID NO: 719936 - DNA, 25 bp, Mus musculus
gtgttatgtcctcctcactggcata

SEQ ID NO: 719937 - DNA, 25 bp, Mus musculus
gtgttatgtcctgctcactggcata

SEQ ID NO: 719938 - DNA, 25 bp, Mus musculus
gtgttattaacaatccttttatgag

SEQ ID NO: 719939 - DNA, 25 bp, Mus musculus
gtgttattaacattccttttatgag

SEQ ID NO: 719940 - DNA, 25 bp, Mus musculus
gtgttattacccatggagccactga

SEQ ID NO: 719941 - DNA, 25 bp, Mus musculus
gtgttattacccttggagccactga

SEQ ID NO: 719942 - DNA, 25 bp, Mus musculus
gtgttattactccaactgtagtttt

SEQ ID NO: 719943 - DNA, 25 bp, Mus musculus
gtgttattactcgaactgtagtttt

SEQ ID NO: 719944 - DNA, 25 bp, Mus musculus
gtgttattcaaactgaccaatcata

SEQ ID NO: 719945 - DNA, 25 bp, Mus musculus
gtgttattcaaagtgaccaatcata

SEQ ID NO: 719946 - DNA, 25 bp, Mus musculus
gtgttattcactactgttctcatga

SEQ ID NO: 719947 - DNA, 25 bp, Mus musculus
gtgttattcacttctgttctcatga

SEQ ID NO: 719948 - DNA, 25 bp, Mus musculus
gtgttattgcacatggtttggctct

SEQ ID NO: 719949 - DNA, 25 bp, Mus musculus
gtgttattgcacttggtttggctct

SEQ ID NO: 719950 - DNA, 25 bp, Mus musculus
gtgttattgcttcaacctaagaaaa

SEQ ID NO: 719951 - DNA, 25 bp, Mus musculus
gtgttattgcttgaacctaagaaaa

SEQ ID NO: 719952 - DNA, 25 bp, Mus musculus
gtgttattggtaatctttgagcctt

SEQ ID NO: 719953 - DNA, 25 bp, Mus musculus
gtgttattggtattctttgagcctt

SEQ ID NO: 719954 - DNA, 25 bp, Mus musculus
gtgttatttactactctaactatga

SEQ ID NO: 719955 - DNA, 25 bp, Mus musculus
gtgttatttacttctctaactatga

SEQ ID NO: 719956 - DNA, 25 bp, Mus musculus
gtgttatttcctccactgttcatac

SEQ ID NO: 719957 - DNA, 25 bp, Mus musculus
gtgttatttcctgcactgttcatac

SEQ ID NO: 719958 - DNA, 25 bp, Mus musculus
gtgttatttctgaaagctgccaatt

SEQ ID NO: 719959 - DNA, 25 bp, Mus musculus
gtgttatttctgtaagctgccaatt

SEQ ID NO: 719960 - DNA, 25 bp, Mus musculus
gtgttatttcttatgtccacaagca

SEQ ID NO: 719961 - DNA, 25 bp, Mus musculus
gtgttatttcttttgtccacaagca

SEQ ID NO: 719962 - DNA, 25 bp, Mus musculus
gtgttcaaaatgaacaattcacttt

SEQ ID NO: 719963 - DNA, 25 bp, Mus musculus
gtgttcaaaatgtacaattcacttt

SEQ ID NO: 719964 - DNA, 25 bp, Mus musculus
gtgttcaaacagcacctttcggttg

SEQ ID NO: 719965 - DNA, 25 bp, Mus musculus
gtgttcaaacaggacctttcggttg

SEQ ID NO: 719966 - DNA, 25 bp, Mus musculus
gtgttcaacaccatgtttccagatg

SEQ ID NO: 719967 - DNA, 25 bp, Mus musculus
gtgttcaacaccttgtttccagatg

SEQ ID NO: 719968 - DNA, 25 bp, Mus musculus
gtgttcaacactctggaggactggt

SEQ ID NO: 719969 - DNA, 25 bp, Mus musculus
gtgttcaacactgtggaggactggt

SEQ ID NO: 719970 - DNA, 25 bp, Mus musculus
gtgttcaacctgcagagccacattc

SEQ ID NO: 719971 - DNA, 25 bp, Mus musculus
gtgttcaacctggagagccacattc

SEQ ID NO: 719972 - DNA, 25 bp, Mus musculus
gtgttcaactctacaaatacatcag

SEQ ID NO: 719973 - DNA, 25 bp, Mus musculus
gtgttcaactcttcaaatacatcag

SEQ ID NO: 719974 - DNA, 25 bp, Mus musculus
gtgttcaagggtcccctagttctca

SEQ ID NO: 719975 - DNA, 25 bp, Mus musculus
gtgttcaagggtgccctagttctca

SEQ ID NO: 719976 - DNA, 25 bp, Mus musculus
gtgttcaagtgtatttgcatcctca

SEQ ID NO: 719977 - DNA, 25 bp, Mus musculus
gtgttcaagtgtttttgcatcctca

SEQ ID NO: 719978 - DNA, 25 bp, Mus musculus
gtgttcaatatcatttccgctgcaa

SEQ ID NO: 719979 - DNA, 25 bp, Mus musculus
gtgttcaatatcttttccgctgcaa

SEQ ID NO: 719980 - DNA, 25 bp, Mus musculus
gtgttcaatcataattgcacattaa

SEQ ID NO: 719981 - DNA, 25 bp, Mus musculus
gtgttcaatcattattgcacattaa

SEQ ID NO: 719982 - DNA, 25 bp, Mus musculus
gtgttcaatcccattttagagcgtg

SEQ ID NO: 719983 - DNA, 25 bp, Mus musculus
gtgttcaatccctttttagagcgtg

SEQ ID NO: 719984 - DNA, 25 bp, Mus musculus
gtgttcaatctcatatgcccatggg

SEQ ID NO: 719985 - DNA, 25 bp, Mus musculus
gtgttcaatctcttatgcccatggg

SEQ ID NO: 719986 - DNA, 25 bp, Mus musculus
gtgttcaattaaccggcatggagcc

SEQ ID NO: 719987 - DNA, 25 bp, Mus musculus
gtgttcaattaagcggcatggagcc

SEQ ID NO: 719988 - DNA, 25 bp, Mus musculus
gtgttcaattcaatgccctaggctg

SEQ ID NO: 719989 - DNA, 25 bp, Mus musculus
gtgttcaattcattgccctaggctg

SEQ ID NO: 719990 - DNA, 25 bp, Mus musculus
gtgttcaattgactacaaattggca

SEQ ID NO: 719991 - DNA, 25 bp, Mus musculus
gtgttcaattgagtacaaattggca

SEQ ID NO: 719992 - DNA, 25 bp, Mus musculus
gtgttcacaaagaactcccctttag

SEQ ID NO: 719993 - DNA, 25 bp, Mus musculus
gtgttcacaaagtactcccctttag

SEQ ID NO: 719994 - DNA, 25 bp, Mus musculus
gtgttcacacctcctgcaggcgtgt

SEQ ID NO: 719995 - DNA, 25 bp, Mus musculus
gtgttcacacctgctgcaggcgtgt

SEQ ID NO: 719996 - DNA, 25 bp, Mus musculus
gtgttcacagacatgggtccatcca

SEQ ID NO: 719997 - DNA, 25 bp, Mus musculus
gtgttcacagacttgggtccatcca

SEQ ID NO: 719998 - DNA, 25 bp, Mus musculus
gtgttcacaggtactgcgttacaac

SEQ ID NO: 719999 - DNA, 25 bp, Mus musculus
gtgttcacaggttctgcgttacaac

SEQ ID NO: 720000 - DNA, 25 bp, Mus musculus
gtgttcacataacatcttctgtctg

SEQ ID NO: 720001 - DNA, 25 bp, Mus musculus
gtgttcacataagatcttctgtctg

SEQ ID NO: 720002 - DNA, 25 bp, Mus musculus
gtgttcacatgcatatgtgtcccca

SEQ ID NO: 720003 - DNA, 25 bp, Mus musculus
gtgttcacatgcttatgtgtcccca

SEQ ID NO: 720004 - DNA, 25 bp, Mus musculus
gtgttcacatttcagaatacatgtt

SEQ ID NO: 720005 - DNA, 25 bp, Mus musculus
gtgttcacatttccatgacttccct

SEQ ID NO: 720006 - DNA, 25 bp, Mus musculus
gtgttcacatttgagaatacatgtt

SEQ ID NO: 720007 - DNA, 25 bp, Mus musculus
gtgttcacatttgcatgacttccct

SEQ ID NO: 720008 - DNA, 25 bp, Mus musculus
gtgttcaccaacacgggaggcttca

SEQ ID NO: 720009 - DNA, 25 bp, Mus musculus
gtgttcaccaaccactgacgtgttt

SEQ ID NO: 720010 - DNA, 25 bp, Mus musculus
gtgttcaccaacgactgacgtgttt

SEQ ID NO: 720011 - DNA, 25 bp, Mus musculus
gtgttcaccaactcgggaggcttca

SEQ ID NO: 720012 - DNA, 25 bp, Mus musculus
gtgttcacccttacagcaagttatg

SEQ ID NO: 720013 - DNA, 25 bp, Mus musculus
gtgttcaccctttcagcaagttatg

SEQ ID NO: 720014 - DNA, 25 bp, Mus musculus
gtgttcaccgagatggccaatagca

SEQ ID NO: 720015 - DNA, 25 bp, Mus musculus
gtgttcaccgagttggccaatagca

SEQ ID NO: 720016 - DNA, 25 bp, Mus musculus
gtgttcacctataaagaagtccaga

SEQ ID NO: 720017 - DNA, 25 bp, Mus musculus
gtgttcacctattaagaagtccaga

SEQ ID NO: 720018 - DNA, 25 bp, Mus musculus
gtgttcacctcccaactgtgatgag

SEQ ID NO: 720019 - DNA, 25 bp, Mus musculus
gtgttcacctccgaactgtgatgag

SEQ ID NO: 720020 - DNA, 25 bp, Mus musculus
gtgttcacctctctggtagatgtct

SEQ ID NO: 720021 - DNA, 25 bp, Mus musculus
gtgttcacctctgtggtagatgtct

SEQ ID NO: 720022 - DNA, 25 bp, Mus musculus
gtgttcaccttaaaacttattggat

SEQ ID NO: 720023 - DNA, 25 bp, Mus musculus
gtgttcaccttaaattcctaaatgc

SEQ ID NO: 720024 - DNA, 25 bp, Mus musculus
gtgttcaccttataacttattggat

SEQ ID NO: 720025 - DNA, 25 bp, Mus musculus
gtgttcaccttatattcctaaatgc

SEQ ID NO: 720026 - DNA, 25 bp, Mus musculus
gtgttcaccttcctaattctgagca

SEQ ID NO: 720027 - DNA, 25 bp, Mus musculus
gtgttcaccttcgtaattctgagca

SEQ ID NO: 720028 - DNA, 25 bp, Mus musculus
gtgttcacgagtctgtttccacttg

SEQ ID NO: 720029 - DNA, 25 bp, Mus musculus
gtgttcacgagtgtgtttccacttg

SEQ ID NO: 720030 - DNA, 25 bp, Mus musculus
gtgttcacgatgctgtggttgccta

SEQ ID NO: 720031 - DNA, 25 bp, Mus musculus
gtgttcacgatggtgtggttgccta

SEQ ID NO: 720032 - DNA, 25 bp, Mus musculus
gtgttcacggacacgggcatccata

SEQ ID NO: 720033 - DNA, 25 bp, Mus musculus
gtgttcacggactcgggcatccata

SEQ ID NO: 720034 - DNA, 25 bp, Mus musculus
gtgttcacgtttaacttcagttaag

SEQ ID NO: 720035 - DNA, 25 bp, Mus musculus
gtgttcacgttttacttcagttaag

SEQ ID NO: 720036 - DNA, 25 bp, Mus musculus
gtgttcactagcaagattccctggt

SEQ ID NO: 720037 - DNA, 25 bp, Mus musculus
gtgttcactagctagattccctggt

SEQ ID NO: 720038 - DNA, 25 bp, Mus musculus
gtgttcactcagacaaaccttcatt

SEQ ID NO: 720039 - DNA, 25 bp, Mus musculus
gtgttcactcagtcaaaccttcatt

SEQ ID NO: 720040 - DNA, 25 bp, Mus musculus
gtgttcactgagagtaccacctctg

SEQ ID NO: 720041 - DNA, 25 bp, Mus musculus
gtgttcactgagtgtaccacctctg

SEQ ID NO: 720042 - DNA, 25 bp, Mus musculus
gtgttcactgccaggctgctgtgga

SEQ ID NO: 720043 - DNA, 25 bp, Mus musculus
gtgttcactgcctggctgctgtgga

SEQ ID NO: 720044 - DNA, 25 bp, Mus musculus
gtgttcactgggattggctgagcaa

SEQ ID NO: 720045 - DNA, 25 bp, Mus musculus
gtgttcactgggtttggctgagcaa

SEQ ID NO: 720046 - DNA, 25 bp, Mus musculus
gtgttcactgtcagcactgttctga

SEQ ID NO: 720047 - DNA, 25 bp, Mus musculus
gtgttcactgtctgcactgttctga

SEQ ID NO: 720048 - DNA, 25 bp, Mus musculus
gtgttcacttccatttcatttttag

SEQ ID NO: 720049 - DNA, 25 bp, Mus musculus
gtgttcacttccttttcatttttag

SEQ ID NO: 720050 - DNA, 25 bp, Mus musculus
gtgttcagaaacatacgcagatgta

SEQ ID NO: 720051 - DNA, 25 bp, Mus musculus
gtgttcagaaacttacgcagatgta

SEQ ID NO: 720052 - DNA, 25 bp, Mus musculus
gtgttcagaccaaggcaggaggcat

SEQ ID NO: 720053 - DNA, 25 bp, Mus musculus
gtgttcagaccatggcaggaggcat

SEQ ID NO: 720054 - DNA, 25 bp, Mus musculus
gtgttcagatacaccatggaatatt

SEQ ID NO: 720055 - DNA, 25 bp, Mus musculus
gtgttcagatactccatggaatatt

SEQ ID NO: 720056 - DNA, 25 bp, Mus musculus
gtgttcagatgcacgcagaggccag

SEQ ID NO: 720057 - DNA, 25 bp, Mus musculus
gtgttcagatgctcgcagaggccag

SEQ ID NO: 720058 - DNA, 25 bp, Mus musculus
gtgttcagcacaactttattgtcat

SEQ ID NO: 720059 - DNA, 25 bp, Mus musculus
gtgttcagcacatctttattgtcat

SEQ ID NO: 720060 - DNA, 25 bp, Mus musculus
gtgttcagcaggaaacagccaactt

SEQ ID NO: 720061 - DNA, 25 bp, Mus musculus
gtgttcagcaggtaacagccaactt

SEQ ID NO: 720062 - DNA, 25 bp, Mus musculus
gtgttcagcctgaaaggtcctcgct

SEQ ID NO: 720063 - DNA, 25 bp, Mus musculus
gtgttcagcctgtaaggtcctcgct

SEQ ID NO: 720064 - DNA, 25 bp, Mus musculus
gtgttcagcgcacgactcaagtgga

SEQ ID NO: 720065 - DNA, 25 bp, Mus musculus
gtgttcagcgcaggactcaagtgga

SEQ ID NO: 720066 - DNA, 25 bp, Mus musculus
gtgttcaggacaccttcccaagaag

SEQ ID NO: 720067 - DNA, 25 bp, Mus musculus
gtgttcaggacagcttcccaagaag

SEQ ID NO: 720068 - DNA, 25 bp, Mus musculus
gtgttcagggctcctcggagctccc

SEQ ID NO: 720069 - DNA, 25 bp, Mus musculus
gtgttcagggctgctcggagctccc

SEQ ID NO: 720070 - DNA, 25 bp, Mus musculus
gtgttcagtagtacgcttttaccat

SEQ ID NO: 720071 - DNA, 25 bp, Mus musculus
gtgttcagtagttcgcttttaccat

SEQ ID NO: 720072 - DNA, 25 bp, Mus musculus
gtgttcagtgtccagctgtcctgtg

SEQ ID NO: 720073 - DNA, 25 bp, Mus musculus
gtgttcagtgtcgagctgtcctgtg

SEQ ID NO: 720074 - DNA, 25 bp, Mus musculus
gtgttcagtgttctaggttggccca

SEQ ID NO: 720075 - DNA, 25 bp, Mus musculus
gtgttcagtgttgtaggttggccca

SEQ ID NO: 720076 - DNA, 25 bp, Mus musculus
gtgttcagttagcagccccgtgaga

SEQ ID NO: 720077 - DNA, 25 bp, Mus musculus
gtgttcagttaggagccccgtgaga

SEQ ID NO: 720078 - DNA, 25 bp, Mus musculus
gtgttcagttccaatgttttccaaa

SEQ ID NO: 720079 - DNA, 25 bp, Mus musculus
gtgttcagttcctatgttttccaaa

SEQ ID NO: 720080 - DNA, 25 bp, Mus musculus
gtgttcagttctcactttagttggt

SEQ ID NO: 720081 - DNA, 25 bp, Mus musculus
gtgttcagttctgactttagttggt

SEQ ID NO: 720082 - DNA, 25 bp, Mus musculus
gtgttcagttgcacctgaagcaaga

SEQ ID NO: 720083 - DNA, 25 bp, Mus musculus
gtgttcagttgctcctgaagcaaga

SEQ ID NO: 720084 - DNA, 25 bp, Mus musculus
gtgttcataatgaccctctgtctcc

SEQ ID NO: 720085 - DNA, 25 bp, Mus musculus
gtgttcataatgtccctctgtctcc

SEQ ID NO: 720086 - DNA, 25 bp, Mus musculus
gtgttcatagctaactgctcatttg

SEQ ID NO: 720087 - DNA, 25 bp, Mus musculus
gtgttcatagcttactgctcatttg

SEQ ID NO: 720088 - DNA, 25 bp, Mus musculus
gtgttcatatcccaaatccaggtat

SEQ ID NO: 720089 - DNA, 25 bp, Mus musculus
gtgttcatatccgaaatccaggtat

SEQ ID NO: 720090 - DNA, 25 bp, Mus musculus
gtgttcatattgacattggagccga

SEQ ID NO: 720091 - DNA, 25 bp, Mus musculus
gtgttcatattgtcattggagccga

SEQ ID NO: 720092 - DNA, 25 bp, Mus musculus
gtgttcatcaaaaggacattttctc

SEQ ID NO: 720093 - DNA, 25 bp, Mus musculus
gtgttcatcaaactcctcagtgatc

SEQ ID NO: 720094 - DNA, 25 bp, Mus musculus
gtgttcatcaaagtcctcagtgatc

SEQ ID NO: 720095 - DNA, 25 bp, Mus musculus
gtgttcatcaaatggacattttctc

SEQ ID NO: 720096 - DNA, 25 bp, Mus musculus
gtgttcatcaagctgcactgtttct

SEQ ID NO: 720097 - DNA, 25 bp, Mus musculus
gtgttcatcaaggtgcactgtttct

SEQ ID NO: 720098 - DNA, 25 bp, Mus musculus
gtgttcatctacagccaagtaggag

SEQ ID NO: 720099 - DNA, 25 bp, Mus musculus
gtgttcatctactgccaagtaggag

SEQ ID NO: 720100 - DNA, 25 bp, Mus musculus
gtgttcatctgcaaatgagtcatta

SEQ ID NO: 720101 - DNA, 25 bp, Mus musculus
gtgttcatctgctaatgagtcatta

SEQ ID NO: 720102 - DNA, 25 bp, Mus musculus
gtgttcatctggagcgtggaataaa

SEQ ID NO: 720103 - DNA, 25 bp, Mus musculus
gtgttcatctggtgcgtggaataaa

SEQ ID NO: 720104 - DNA, 25 bp, Mus musculus
gtgttcatgaagactatctccctat

SEQ ID NO: 720105 - DNA, 25 bp, Mus musculus
gtgttcatgaagtctatctccctat

SEQ ID NO: 720106 - DNA, 25 bp, Mus musculus
gtgttcatgaccaccaactacattg

SEQ ID NO: 720107 - DNA, 25 bp, Mus musculus
gtgttcatgacctccaactacattg

SEQ ID NO: 720108 - DNA, 25 bp, Mus musculus
gtgttcatgagcacttttctactga

SEQ ID NO: 720109 - DNA, 25 bp, Mus musculus
gtgttcatgagctcttttctactga

SEQ ID NO: 720110 - DNA, 25 bp, Mus musculus
gtgttcatgcccaatgactgctgtt

SEQ ID NO: 720111 - DNA, 25 bp, Mus musculus
gtgttcatgccctatgactgctgtt

SEQ ID NO: 720112 - DNA, 25 bp, Mus musculus
gtgttcatggctacttatttaagac

SEQ ID NO: 720113 - DNA, 25 bp, Mus musculus
gtgttcatggcttcttatttaagac

SEQ ID NO: 720114 - DNA, 25 bp, Mus musculus
gtgttcatgtaccatacctgtattg

SEQ ID NO: 720115 - DNA, 25 bp, Mus musculus
gtgttcatgtacgatacctgtattg

SEQ ID NO: 720116 - DNA, 25 bp, Mus musculus
gtgttcatgtctatcagggaccgca

SEQ ID NO: 720117 - DNA, 25 bp, Mus musculus
gtgttcatgtctttcagggaccgca

SEQ ID NO: 720118 - DNA, 25 bp, Mus musculus
gtgttcatgtgtcaccgcaactgta

SEQ ID NO: 720119 - DNA, 25 bp, Mus musculus
gtgttcatgtgtgaccgcaactgta

SEQ ID NO: 720120 - DNA, 25 bp, Mus musculus
gtgttcattataaagctcattttag

SEQ ID NO: 720121 - DNA, 25 bp, Mus musculus
gtgttcattatatagctcattttag

SEQ ID NO: 720122 - DNA, 25 bp, Mus musculus
gtgttcattctaacaacaggtggaa

SEQ ID NO: 720123 - DNA, 25 bp, Mus musculus
gtgttcattctaagtcacagggcag

SEQ ID NO: 720124 - DNA, 25 bp, Mus musculus
gtgttcattctatcaacaggtggaa

SEQ ID NO: 720125 - DNA, 25 bp, Mus musculus
gtgttcattctatgtcacagggcag

SEQ ID NO: 720126 - DNA, 25 bp, Mus musculus
gtgttcattgaacttgattctgttg

SEQ ID NO: 720127 - DNA, 25 bp, Mus musculus
gtgttcattgaagttgattctgttg

SEQ ID NO: 720128 - DNA, 25 bp, Mus musculus
gtgttcatttccagaaaagcctgag

SEQ ID NO: 720129 - DNA, 25 bp, Mus musculus
gtgttcatttcctgaaaagcctgag

SEQ ID NO: 720130 - DNA, 25 bp, Mus musculus
gtgttcatttttactatgcttctga

SEQ ID NO: 720131 - DNA, 25 bp, Mus musculus
gtgttcattttttctatgcttctga

SEQ ID NO: 720132 - DNA, 25 bp, Mus musculus
gtgttccaaactcatatgtgtccca

SEQ ID NO: 720133 - DNA, 25 bp, Mus musculus
gtgttccaaactgatatgtgtccca

SEQ ID NO: 720134 - DNA, 25 bp, Mus musculus
gtgttccaaagcacacctttagtcc

SEQ ID NO: 720135 - DNA, 25 bp, Mus musculus
gtgttccaaagctcacctttagtcc

SEQ ID NO: 720136 - DNA, 25 bp, Mus musculus
gtgttccaaccaatcgatctgacat

SEQ ID NO: 720137 - DNA, 25 bp, Mus musculus
gtgttccaaccattcgatctgacat

SEQ ID NO: 720138 - DNA, 25 bp, Mus musculus
gtgttccaagatcactggacctgtc

SEQ ID NO: 720139 - DNA, 25 bp, Mus musculus
gtgttccaagatgactggacctgtc

SEQ ID NO: 720140 - DNA, 25 bp, Mus musculus
gtgttccaaggaagtcgcgtcacaa

SEQ ID NO: 720141 - DNA, 25 bp, Mus musculus
gtgttccaaggatgtcgcgtcacaa

SEQ ID NO: 720142 - DNA, 25 bp, Mus musculus
gtgttccaatctcaacctttttgta

SEQ ID NO: 720143 - DNA, 25 bp, Mus musculus
gtgttccaatctgaacctttttgta

SEQ ID NO: 720144 - DNA, 25 bp, Mus musculus
gtgttccagaacataacagtccact

SEQ ID NO: 720145 - DNA, 25 bp, Mus musculus
gtgttccagaacttaacagtccact

SEQ ID NO: 720146 - DNA, 25 bp, Mus musculus
gtgttccagcagagaccaggagtct

SEQ ID NO: 720147 - DNA, 25 bp, Mus musculus
gtgttccagcagtgaccaggagtct

SEQ ID NO: 720148 - DNA, 25 bp, Mus musculus
gtgttccagcctagtggtcacaaat

SEQ ID NO: 720149 - DNA, 25 bp, Mus musculus
gtgttccagccttgtggtcacaaat

SEQ ID NO: 720150 - DNA, 25 bp, Mus musculus
gtgttccaggaaagggttgctacct

SEQ ID NO: 720151 - DNA, 25 bp, Mus musculus
gtgttccaggaatgggttgctacct

SEQ ID NO: 720152 - DNA, 25 bp, Mus musculus
gtgttccagttccacttatgtatct

SEQ ID NO: 720153 - DNA, 25 bp, Mus musculus
gtgttccagttcgacttatgtatct

SEQ ID NO: 720154 - DNA, 25 bp, Mus musculus
gtgttccataatatataccccgtgt

SEQ ID NO: 720155 - DNA, 25 bp, Mus musculus
gtgttccataatttataccccgtgt

SEQ ID NO: 720156 - DNA, 25 bp, Mus musculus
gtgttccatatccttgttctccatt

SEQ ID NO: 720157 - DNA, 25 bp, Mus musculus
gtgttccatatcgttgttctccatt

SEQ ID NO: 720158 - DNA, 25 bp, Mus musculus
gtgttccatctccttcttagtgtcc

SEQ ID NO: 720159 - DNA, 25 bp, Mus musculus
gtgttccatctcgttcttagtgtcc

SEQ ID NO: 720160 - DNA, 25 bp, Mus musculus
gtgttccatcttaatttgagctcat

SEQ ID NO: 720161 - DNA, 25 bp, Mus musculus
gtgttccatctttatttgagctcat

SEQ ID NO: 720162 - DNA, 25 bp, Mus musculus
gtgttccatgtaaacaccttccatt

SEQ ID NO: 720163 - DNA, 25 bp, Mus musculus
gtgttccatgtatacaccttccatt

SEQ ID NO: 720164 - DNA, 25 bp, Mus musculus
gtgttccattagaacagcctagcat

SEQ ID NO: 720165 - DNA, 25 bp, Mus musculus
gtgttccattagtacagcctagcat

SEQ ID NO: 720166 - DNA, 25 bp, Mus musculus
gtgttccattgacctgtaagttaat

SEQ ID NO: 720167 - DNA, 25 bp, Mus musculus
gtgttccattgagctgtaagttaat

SEQ ID NO: 720168 - DNA, 25 bp, Mus musculus
gtgttccattggagtttctgtccaa

SEQ ID NO: 720169 - DNA, 25 bp, Mus musculus
gtgttccattggtgtttctgtccaa

SEQ ID NO: 720170 - DNA, 25 bp, Mus musculus
gtgttccattttccttaagtaggtt

SEQ ID NO: 720171 - DNA, 25 bp, Mus musculus
gtgttccattttgcttaagtaggtt

SEQ ID NO: 720172 - DNA, 25 bp, Mus musculus
gtgttcccaaatctgacagttcaga

SEQ ID NO: 720173 - DNA, 25 bp, Mus musculus
gtgttcccaaatgtgacagttcaga

SEQ ID NO: 720174 - DNA, 25 bp, Mus musculus
gtgttcccaacaacatattagactc

SEQ ID NO: 720175 - DNA, 25 bp, Mus musculus
gtgttcccaacatcatattagactc

SEQ ID NO: 720176 - DNA, 25 bp, Mus musculus
gtgttcccaactctaagaattccag

SEQ ID NO: 720177 - DNA, 25 bp, Mus musculus
gtgttcccaactgtaagaattccag

SEQ ID NO: 720178 - DNA, 25 bp, Mus musculus
gtgttcccaatcatcctgcgaacaa

SEQ ID NO: 720179 - DNA, 25 bp, Mus musculus
gtgttcccaatcttcctgcgaacaa

SEQ ID NO: 720180 - DNA, 25 bp, Mus musculus
gtgttcccacaacacagactgttga

SEQ ID NO: 720181 - DNA, 25 bp, Mus musculus
gtgttcccacaagacagactgttga

SEQ ID NO: 720182 - DNA, 25 bp, Mus musculus
gtgttcccacatcaagttatcctat

SEQ ID NO: 720183 - DNA, 25 bp, Mus musculus
gtgttcccacatgaagttatcctat

SEQ ID NO: 720184 - DNA, 25 bp, Mus musculus
gtgttcccactgcaagccagtaact

SEQ ID NO: 720185 - DNA, 25 bp, Mus musculus
gtgttcccactgcagtgacatctgt

SEQ ID NO: 720186 - DNA, 25 bp, Mus musculus
gtgttcccactggaagccagtaact

SEQ ID NO: 720187 - DNA, 25 bp, Mus musculus
gtgttcccactggagtgacatctgt

SEQ ID NO: 720188 - DNA, 25 bp, Mus musculus
gtgttcccacttcattagtgtcatg

SEQ ID NO: 720189 - DNA, 25 bp, Mus musculus
gtgttcccacttgattagtgtcatg

SEQ ID NO: 720190 - DNA, 25 bp, Mus musculus
gtgttcccatgactgtcttttacat

SEQ ID NO: 720191 - DNA, 25 bp, Mus musculus
gtgttcccatgagtgtcttttacat

SEQ ID NO: 720192 - DNA, 25 bp, Mus musculus
gtgttcccatgcaattaggaagtgt

SEQ ID NO: 720193 - DNA, 25 bp, Mus musculus
gtgttcccatgctattaggaagtgt

SEQ ID NO: 720194 - DNA, 25 bp, Mus musculus
gtgttcccatttctcactggcatag

SEQ ID NO: 720195 - DNA, 25 bp, Mus musculus
gtgttcccatttgtcactggcatag

SEQ ID NO: 720196 - DNA, 25 bp, Mus musculus
gtgttccccagtctaacttgaagcg

SEQ ID NO: 720197 - DNA, 25 bp, Mus musculus
gtgttccccagtgtaacttgaagcg

SEQ ID NO: 720198 - DNA, 25 bp, Mus musculus
gtgttccccatgactattatgtttc

SEQ ID NO: 720199 - DNA, 25 bp, Mus musculus
gtgttccccatgtctattatgtttc

SEQ ID NO: 720200 - DNA, 25 bp, Mus musculus
gtgttccccctgcatatggtctatt

SEQ ID NO: 720201 - DNA, 25 bp, Mus musculus
gtgttccccctggatatggtctatt

SEQ ID NO: 720202 - DNA, 25 bp, Mus musculus
gtgttccccgatcggacatttgtga

SEQ ID NO: 720203 - DNA, 25 bp, Mus musculus
gtgttccccgatgggacatttgtga

SEQ ID NO: 720204 - DNA, 25 bp, Mus musculus
gtgttccccttcatatgagagccaa

SEQ ID NO: 720205 - DNA, 25 bp, Mus musculus
gtgttccccttcttatgagagccaa

SEQ ID NO: 720206 - DNA, 25 bp, Mus musculus
gtgttcccggcacggcttttggatc

SEQ ID NO: 720207 - DNA, 25 bp, Mus musculus
gtgttcccggcagggcttttggatc

SEQ ID NO: 720208 - DNA, 25 bp, Mus musculus
gtgttcccgtccaatcattttggga

SEQ ID NO: 720209 - DNA, 25 bp, Mus musculus
gtgttcccgtcctatcattttggga

SEQ ID NO: 720210 - DNA, 25 bp, Mus musculus
gtgttccctcgaaaggttcatgtct

SEQ ID NO: 720211 - DNA, 25 bp, Mus musculus
gtgttccctcgataggttcatgtct

SEQ ID NO: 720212 - DNA, 25 bp, Mus musculus
gtgttccctgaacaatgtttatttt

SEQ ID NO: 720213 - DNA, 25 bp, Mus musculus
gtgttccctgaagaatgtttatttt

SEQ ID NO: 720214 - DNA, 25 bp, Mus musculus
gtgttccctggacccatgaaatctg

SEQ ID NO: 720215 - DNA, 25 bp, Mus musculus
gtgttccctggagccatgaaatctg

SEQ ID NO: 720216 - DNA, 25 bp, Mus musculus
gtgttccctggtatggctatgatta

SEQ ID NO: 720217 - DNA, 25 bp, Mus musculus
gtgttccctggtttggctatgatta

SEQ ID NO: 720218 - DNA, 25 bp, Mus musculus
gtgttccctgtgctatttctagtga

SEQ ID NO: 720219 - DNA, 25 bp, Mus musculus
gtgttccctgtggtatttctagtga

SEQ ID NO: 720220 - DNA, 25 bp, Mus musculus
gtgttccctgttcagtactctgaaa

SEQ ID NO: 720221 - DNA, 25 bp, Mus musculus
gtgttccctgttgagtactctgaaa

SEQ ID NO: 720222 - DNA, 25 bp, Mus musculus
gtgttccgtgaaccagttactctca

SEQ ID NO: 720223 - DNA, 25 bp, Mus musculus
gtgttccgtgaagcagttactctca

SEQ ID NO: 720224 - DNA, 25 bp, Mus musculus
gtgttccgtgacctagctcctcagg

SEQ ID NO: 720225 - DNA, 25 bp, Mus musculus
gtgttccgtgacgtagctcctcagg

SEQ ID NO: 720226 - DNA, 25 bp, Mus musculus
gtgttccgtttgaccagcacagaaa

SEQ ID NO: 720227 - DNA, 25 bp, Mus musculus
gtgttccgtttgtccagcacagaaa

SEQ ID NO: 720228 - DNA, 25 bp, Mus musculus
gtgttcctaaaaactctgtggcaat

SEQ ID NO: 720229 - DNA, 25 bp, Mus musculus
gtgttcctaaaatctctgtggcaat

SEQ ID NO: 720230 - DNA, 25 bp, Mus musculus
gtgttcctaaatccggagctgtctc

SEQ ID NO: 720231 - DNA, 25 bp, Mus musculus
gtgttcctaaatgcggagctgtctc

SEQ ID NO: 720232 - DNA, 25 bp, Mus musculus
gtgttcctacgaattgctgctttta

SEQ ID NO: 720233 - DNA, 25 bp, Mus musculus
gtgttcctacgatttgctgctttta

SEQ ID NO: 720234 - DNA, 25 bp, Mus musculus
gtgttcctatccattcaaagtgtct

SEQ ID NO: 720235 - DNA, 25 bp, Mus musculus
gtgttcctatcctttcaaagtgtct

SEQ ID NO: 720236 - DNA, 25 bp, Mus musculus
gtgttcctcacacaagctgctagaa

SEQ ID NO: 720237 - DNA, 25 bp, Mus musculus
gtgttcctcacagaagctgctagaa

SEQ ID NO: 720238 - DNA, 25 bp, Mus musculus
gtgttcctcactagaagaaaatgct

SEQ ID NO: 720239 - DNA, 25 bp, Mus musculus
gtgttcctcacttgaagaaaatgct

SEQ ID NO: 720240 - DNA, 25 bp, Mus musculus
gtgttcctcagccaccttggaggag

SEQ ID NO: 720241 - DNA, 25 bp, Mus musculus
gtgttcctcagcgaccttggaggag

SEQ ID NO: 720242 - DNA, 25 bp, Mus musculus
gtgttcctcccactgagagtagatt

SEQ ID NO: 720243 - DNA, 25 bp, Mus musculus
gtgttcctcccagtgagagtagatt

SEQ ID NO: 720244 - DNA, 25 bp, Mus musculus
gtgttcctccttatctgagatttca

SEQ ID NO: 720245 - DNA, 25 bp, Mus musculus
gtgttcctccttttctgagatttca

SEQ ID NO: 720246 - DNA, 25 bp, Mus musculus
gtgttcctcgttctgatgctttcag

SEQ ID NO: 720247 - DNA, 25 bp, Mus musculus
gtgttcctcgttgtgatgctttcag

SEQ ID NO: 720248 - DNA, 25 bp, Mus musculus
gtgttcctctgtaccataaaagctt

SEQ ID NO: 720249 - DNA, 25 bp, Mus musculus
gtgttcctctgtatcaagctatgta

SEQ ID NO: 720250 - DNA, 25 bp, Mus musculus
gtgttcctctgttccataaaagctt

SEQ ID NO: 720251 - DNA, 25 bp, Mus musculus
gtgttcctctgtttcaagctatgta

SEQ ID NO: 720252 - DNA, 25 bp, Mus musculus
gtgttcctctttcttatgaactcag

SEQ ID NO: 720253 - DNA, 25 bp, Mus musculus
gtgttcctctttgttatgaactcag

SEQ ID NO: 720254 - DNA, 25 bp, Mus musculus
gtgttcctgagcactttgcaagaga

SEQ ID NO: 720255 - DNA, 25 bp, Mus musculus
gtgttcctgagctctttgcaagaga

SEQ ID NO: 720256 - DNA, 25 bp, Mus musculus
gtgttcctgattcacttgactcaag

SEQ ID NO: 720257 - DNA, 25 bp, Mus musculus
gtgttcctgattgacttgactcaag

SEQ ID NO: 720258 - DNA, 25 bp, Mus musculus
gtgttcctgcacaaagtagcccgtc

SEQ ID NO: 720259 - DNA, 25 bp, Mus musculus
gtgttcctgcactaagtagcccgtc

SEQ ID NO: 720260 - DNA, 25 bp, Mus musculus
gtgttcctgctgagagaagtgtgtt

SEQ ID NO: 720261 - DNA, 25 bp, Mus musculus
gtgttcctgctgtgagaagtgtgtt

SEQ ID NO: 720262 - DNA, 25 bp, Mus musculus
gtgttcctggctcagagtgcactgc

SEQ ID NO: 720263 - DNA, 25 bp, Mus musculus
gtgttcctggctcagcttgttgctg

SEQ ID NO: 720264 - DNA, 25 bp, Mus musculus
gtgttcctggctgagagtgcactgc

SEQ ID NO: 720265 - DNA, 25 bp, Mus musculus
gtgttcctggctgagcttgttgctg

SEQ ID NO: 720266 - DNA, 25 bp, Mus musculus
gtgttcctgtaaactactcctgttt

SEQ ID NO: 720267 - DNA, 25 bp, Mus musculus
gtgttcctgtaatctactcctgttt

SEQ ID NO: 720268 - DNA, 25 bp, Mus musculus
gtgttccttcacaacattaaagttt

SEQ ID NO: 720269 - DNA, 25 bp, Mus musculus
gtgttccttcactacattaaagttt

SEQ ID NO: 720270 - DNA, 25 bp, Mus musculus
gtgttccttctacaagtacagagtg

SEQ ID NO: 720271 - DNA, 25 bp, Mus musculus
gtgttccttctagaagtacagagtg

SEQ ID NO: 720272 - DNA, 25 bp, Mus musculus
gtgttccttcttccaaattagcacc

SEQ ID NO: 720273 - DNA, 25 bp, Mus musculus
gtgttccttcttgcaaattagcacc

SEQ ID NO: 720274 - DNA, 25 bp, Mus musculus
gtgttccttgtaaagagtactggcc

SEQ ID NO: 720275 - DNA, 25 bp, Mus musculus
gtgttccttgtatagagtactggcc

SEQ ID NO: 720276 - DNA, 25 bp, Mus musculus
gtgttcctttacagacgttacttgg

SEQ ID NO: 720277 - DNA, 25 bp, Mus musculus
gtgttcctttactgacgttacttgg

SEQ ID NO: 720278 - DNA, 25 bp, Mus musculus
gtgttcctttatcacgcgatcaagt

SEQ ID NO: 720279 - DNA, 25 bp, Mus musculus
gtgttcctttatgacgcgatcaagt

SEQ ID NO: 720280 - DNA, 25 bp, Mus musculus
gtgttcgaattaaaatccctcagat

SEQ ID NO: 720281 - DNA, 25 bp, Mus musculus
gtgttcgaattataatccctcagat

SEQ ID NO: 720282 - DNA, 25 bp, Mus musculus
gtgttcgacattcagtgtgacttta

SEQ ID NO: 720283 - DNA, 25 bp, Mus musculus
gtgttcgacattgagtgtgacttta

SEQ ID NO: 720284 - DNA, 25 bp, Mus musculus
gtgttcgacccacttttcatctctt

SEQ ID NO: 720285 - DNA, 25 bp, Mus musculus
gtgttcgacccagttttcatctctt

SEQ ID NO: 720286 - DNA, 25 bp, Mus musculus
gtgttcgactggagatcccggcagc

SEQ ID NO: 720287 - DNA, 25 bp, Mus musculus
gtgttcgactggtgatcccggcagc

SEQ ID NO: 720288 - DNA, 25 bp, Mus musculus
gtgttcgacttaaagccgtggctga

SEQ ID NO: 720289 - DNA, 25 bp, Mus musculus
gtgttcgacttatagccgtggctga

SEQ ID NO: 720290 - DNA, 25 bp, Mus musculus
gtgttcgagaacacggccaagcggc

SEQ ID NO: 720291 - DNA, 25 bp, Mus musculus
gtgttcgagaactcggccaagcggc

SEQ ID NO: 720292 - DNA, 25 bp, Mus musculus
gtgttcgatgtcacctctgggaagg

SEQ ID NO: 720293 - DNA, 25 bp, Mus musculus
gtgttcgatgtctcctctgggaagg

SEQ ID NO: 720294 - DNA, 25 bp, Mus musculus
gtgttcgcaaagcttacgtgtctgt

SEQ ID NO: 720295 - DNA, 25 bp, Mus musculus
gtgttcgcaaaggttacgtgtctgt

SEQ ID NO: 720296 - DNA, 25 bp, Mus musculus
gtgttcgcaaatacacatggcagtt

SEQ ID NO: 720297 - DNA, 25 bp, Mus musculus
gtgttcgcaaattcacatggcagtt

SEQ ID NO: 720298 - DNA, 25 bp, Mus musculus
gtgttcgccccaatgactatttgat

SEQ ID NO: 720299 - DNA, 25 bp, Mus musculus
gtgttcgccccattgactatttgat

SEQ ID NO: 720300 - DNA, 25 bp, Mus musculus
gtgttcgcggacctccagccgaaac

SEQ ID NO: 720301 - DNA, 25 bp, Mus musculus
gtgttcgcggacgtccagccgaaac

SEQ ID NO: 720302 - DNA, 25 bp, Mus musculus
gtgttcgctaatacccaaaagtaca

SEQ ID NO: 720303 - DNA, 25 bp, Mus musculus
gtgttcgctaattcccaaaagtaca

SEQ ID NO: 720304 - DNA, 25 bp, Mus musculus
gtgttcgcttgactgtgtgtagctt

SEQ ID NO: 720305 - DNA, 25 bp, Mus musculus
gtgttcgcttgagtgtgtgtagctt

SEQ ID NO: 720306 - DNA, 25 bp, Mus musculus
gtgttcggccacctaagaaaagttg

SEQ ID NO: 720307 - DNA, 25 bp, Mus musculus
gtgttcggccacgtaagaaaagttg

SEQ ID NO: 720308 - DNA, 25 bp, Mus musculus
gtgttcggcctgctacagcagaact

SEQ ID NO: 720309 - DNA, 25 bp, Mus musculus
gtgttcggcctggtacagcagaact

SEQ ID NO: 720310 - DNA, 25 bp, Mus musculus
gtgttcggggtgacccagcacgacc

SEQ ID NO: 720311 - DNA, 25 bp, Mus musculus
gtgttcggggtgtcccagcacgacc

SEQ ID NO: 720312 - DNA, 25 bp, Mus musculus
gtgttcggtataaattgtttgttct

SEQ ID NO: 720313 - DNA, 25 bp, Mus musculus
gtgttcggtatatattgtttgttct

SEQ ID NO: 720314 - DNA, 25 bp, Mus musculus
gtgttcgtaataaatatcctgggca

SEQ ID NO: 720315 - DNA, 25 bp, Mus musculus
gtgttcgtaatatatatcctgggca

SEQ ID NO: 720316 - DNA, 25 bp, Mus musculus
gtgttcgtagaactaattgcctttc

SEQ ID NO: 720317 - DNA, 25 bp, Mus musculus
gtgttcgtagaagtaattgcctttc

SEQ ID NO: 720318 - DNA, 25 bp, Mus musculus
gtgttcgtcagcaactttggtggcc

SEQ ID NO: 720319 - DNA, 25 bp, Mus musculus
gtgttcgtcagcacaggcactccag

SEQ ID NO: 720320 - DNA, 25 bp, Mus musculus
gtgttcgtcagctactttggtggcc

SEQ ID NO: 720321 - DNA, 25 bp, Mus musculus
gtgttcgtcagctcaggcactccag

SEQ ID NO: 720322 - DNA, 25 bp, Mus musculus
gtgttcgtccacatcaaaatggtag

SEQ ID NO: 720323 - DNA, 25 bp, Mus musculus
gtgttcgtccacttcaaaatggtag

SEQ ID NO: 720324 - DNA, 25 bp, Mus musculus
gtgttcgtcgctcttaacttttact

SEQ ID NO: 720325 - DNA, 25 bp, Mus musculus
gtgttcgtcgctgttaacttttact

SEQ ID NO: 720326 - DNA, 25 bp, Mus musculus
gtgttcgtgtacaaccattaacggg

SEQ ID NO: 720327 - DNA, 25 bp, Mus musculus
gtgttcgtgtactaccattaacggg

SEQ ID NO: 720328 - DNA, 25 bp, Mus musculus
gtgttcgtgtgtattcttctcttcc

SEQ ID NO: 720329 - DNA, 25 bp, Mus musculus
gtgttcgtgtgttttcttctcttcc

SEQ ID NO: 720330 - DNA, 25 bp, Mus musculus
gtgttcgtgttgagatagctgagat

SEQ ID NO: 720331 - DNA, 25 bp, Mus musculus
gtgttcgtgttgtgatagctgagat

SEQ ID NO: 720332 - DNA, 25 bp, Mus musculus
gtgttcgtgtttctcggcctcatcc

SEQ ID NO: 720333 - DNA, 25 bp, Mus musculus
gtgttcgtgtttgtcggcctcatcc

SEQ ID NO: 720334 - DNA, 25 bp, Mus musculus
gtgttcgttccacagctgtttgaaa

SEQ ID NO: 720335 - DNA, 25 bp, Mus musculus
gtgttcgttccagagctgtttgaaa

SEQ ID NO: 720336 - DNA, 25 bp, Mus musculus
gtgttcgttcctacaatggttgaga

SEQ ID NO: 720337 - DNA, 25 bp, Mus musculus
gtgttcgttccttcaatggttgaga

SEQ ID NO: 720338 - DNA, 25 bp, Mus musculus
gtgttcgttcgtcttttatagttca

SEQ ID NO: 720339 - DNA, 25 bp, Mus musculus
gtgttcgttcgtgttttatagttca

SEQ ID NO: 720340 - DNA, 25 bp, Mus musculus
gtgttctaacataatactctaagca

SEQ ID NO: 720341 - DNA, 25 bp, Mus musculus
gtgttctaacattatactctaagca

SEQ ID NO: 720342 - DNA, 25 bp, Mus musculus
gtgttctaatcacatacaagatgga

SEQ ID NO: 720343 - DNA, 25 bp, Mus musculus
gtgttctaatcagatacaagatgga

SEQ ID NO: 720344 - DNA, 25 bp, Mus musculus
gtgttctaatctcccacttcaggat

SEQ ID NO: 720345 - DNA, 25 bp, Mus musculus
gtgttctaatctgccacttcaggat

SEQ ID NO: 720346 - DNA, 25 bp, Mus musculus
gtgttctacatgcaggactacctaa

SEQ ID NO: 720347 - DNA, 25 bp, Mus musculus
gtgttctacatggaggactacctaa

SEQ ID NO: 720348 - DNA, 25 bp, Mus musculus
gtgttctaccacagaactccaaact

SEQ ID NO: 720349 - DNA, 25 bp, Mus musculus
gtgttctaccactgaactccaaact

SEQ ID NO: 720350 - DNA, 25 bp, Mus musculus
gtgttctactagagcttgtcctatc

SEQ ID NO: 720351 - DNA, 25 bp, Mus musculus
gtgttctactagtgcttgtcctatc

SEQ ID NO: 720352 - DNA, 25 bp, Mus musculus
gtgttctacttactgagtctcttag

SEQ ID NO: 720353 - DNA, 25 bp, Mus musculus
gtgttctacttagtgagtctcttag

SEQ ID NO: 720354 - DNA, 25 bp, Mus musculus
gtgttctagctgattgcatcaaagg

SEQ ID NO: 720355 - DNA, 25 bp, Mus musculus
gtgttctagctgtttgcatcaaagg

SEQ ID NO: 720356 - DNA, 25 bp, Mus musculus
gtgttctaggaaagagctctggctt

SEQ ID NO: 720357 - DNA, 25 bp, Mus musculus
gtgttctaggaatgagctctggctt

SEQ ID NO: 720358 - DNA, 25 bp, Mus musculus
gtgttctagggccttcaggatcctg

SEQ ID NO: 720359 - DNA, 25 bp, Mus musculus
gtgttctagggcgttcaggatcctg

SEQ ID NO: 720360 - DNA, 25 bp, Mus musculus
gtgttctagtgtacacttggctcac

SEQ ID NO: 720361 - DNA, 25 bp, Mus musculus
gtgttctagtgttcacttggctcac

SEQ ID NO: 720362 - DNA, 25 bp, Mus musculus
gtgttctataaccacagacgatgag

SEQ ID NO: 720363 - DNA, 25 bp, Mus musculus
gtgttctataacgacagacgatgag

SEQ ID NO: 720364 - DNA, 25 bp, Mus musculus
gtgttctatagacctggactttcca

SEQ ID NO: 720365 - DNA, 25 bp, Mus musculus
gtgttctatagagctggactttcca

SEQ ID NO: 720366 - DNA, 25 bp, Mus musculus
gtgttctatatacagctacagccaa

SEQ ID NO: 720367 - DNA, 25 bp, Mus musculus
gtgttctatatagagctacagccaa

SEQ ID NO: 720368 - DNA, 25 bp, Mus musculus
gtgttctatctgagtacacctatac

SEQ ID NO: 720369 - DNA, 25 bp, Mus musculus
gtgttctatctgtgtacacctatac

SEQ ID NO: 720370 - DNA, 25 bp, Mus musculus
gtgttctatggactgtttacattac

SEQ ID NO: 720371 - DNA, 25 bp, Mus musculus
gtgttctatggagtgtttacattac

SEQ ID NO: 720372 - DNA, 25 bp, Mus musculus
gtgttctcaaaaaccatgcttcata

SEQ ID NO: 720373 - DNA, 25 bp, Mus musculus
gtgttctcaaaatccatgcttcata

SEQ ID NO: 720374 - DNA, 25 bp, Mus musculus
gtgttctcaatcagcagtcctaatt

SEQ ID NO: 720375 - DNA, 25 bp, Mus musculus
gtgttctcaatctgcagtcctaatt

SEQ ID NO: 720376 - DNA, 25 bp, Mus musculus
gtgttctcaattctacagctagcct

SEQ ID NO: 720377 - DNA, 25 bp, Mus musculus
gtgttctcaattgtacagctagcct

SEQ ID NO: 720378 - DNA, 25 bp, Mus musculus
gtgttctcaccaccgcctcagaata

SEQ ID NO: 720379 - DNA, 25 bp, Mus musculus
gtgttctcaccagcgcctcagaata

SEQ ID NO: 720380 - DNA, 25 bp, Mus musculus
gtgttctcacctccagtgtaaatac

SEQ ID NO: 720381 - DNA, 25 bp, Mus musculus
gtgttctcacctctagaaaactagt

SEQ ID NO: 720382 - DNA, 25 bp, Mus musculus
gtgttctcacctgcagtgtaaatac

SEQ ID NO: 720383 - DNA, 25 bp, Mus musculus
gtgttctcacctgtagaaaactagt

SEQ ID NO: 720384 - DNA, 25 bp, Mus musculus
gtgttctcactgaaaagcctttatg

SEQ ID NO: 720385 - DNA, 25 bp, Mus musculus
gtgttctcactgaactgtactcgga

SEQ ID NO: 720386 - DNA, 25 bp, Mus musculus
gtgttctcactgtaaagcctttatg

SEQ ID NO: 720387 - DNA, 25 bp, Mus musculus
gtgttctcactgtactgtactcgga

SEQ ID NO: 720388 - DNA, 25 bp, Mus musculus
gtgttctcagaaatagaccccacct

SEQ ID NO: 720389 - DNA, 25 bp, Mus musculus
gtgttctcagaattagaccccacct

SEQ ID NO: 720390 - DNA, 25 bp, Mus musculus
gtgttctcagcaccgtgatctgtca

SEQ ID NO: 720391 - DNA, 25 bp, Mus musculus
gtgttctcagcagcgtgatctgtca

SEQ ID NO: 720392 - DNA, 25 bp, Mus musculus
gtgttctcagctagcagactcagtt

SEQ ID NO: 720393 - DNA, 25 bp, Mus musculus
gtgttctcagcttgcagactcagtt

SEQ ID NO: 720394 - DNA, 25 bp, Mus musculus
gtgttctcatccctcattaatacat

SEQ ID NO: 720395 - DNA, 25 bp, Mus musculus
gtgttctcatccgtcattaatacat

SEQ ID NO: 720396 - DNA, 25 bp, Mus musculus
gtgttctccgagatgtgaggaaaga

SEQ ID NO: 720397 - DNA, 25 bp, Mus musculus
gtgttctccgagttgtgaggaaaga

SEQ ID NO: 720398 - DNA, 25 bp, Mus musculus
gtgttctcctgcaattccagaattt

SEQ ID NO: 720399 - DNA, 25 bp, Mus musculus
gtgttctcctgctattccagaattt

SEQ ID NO: 720400 - DNA, 25 bp, Mus musculus
gtgttctcggcaccaccaacggtgg

SEQ ID NO: 720401 - DNA, 25 bp, Mus musculus
gtgttctcggcagcaccaacggtgg

SEQ ID NO: 720402 - DNA, 25 bp, Mus musculus
gtgttctcggtgaccagcaagcagt

SEQ ID NO: 720403 - DNA, 25 bp, Mus musculus
gtgttctcggtgtccagcaagcagt

SEQ ID NO: 720404 - DNA, 25 bp, Mus musculus
gtgttctctactacactgggagtga

SEQ ID NO: 720405 - DNA, 25 bp, Mus musculus
gtgttctctactctcacagaagcct

SEQ ID NO: 720406 - DNA, 25 bp, Mus musculus
gtgttctctactgtcacagaagcct

SEQ ID NO: 720407 - DNA, 25 bp, Mus musculus
gtgttctctacttcactgggagtga

SEQ ID NO: 720408 - DNA, 25 bp, Mus musculus
gtgttctctcatatacagtggccat

SEQ ID NO: 720409 - DNA, 25 bp, Mus musculus
gtgttctctcatttacagtggccat

SEQ ID NO: 720410 - DNA, 25 bp, Mus musculus
gtgttctctccaaagatcgaatgtg

SEQ ID NO: 720411 - DNA, 25 bp, Mus musculus
gtgttctctccatagatcgaatgtg

SEQ ID NO: 720412 - DNA, 25 bp, Mus musculus
gtgttctctgacctcagtcagtaag

SEQ ID NO: 720413 - DNA, 25 bp, Mus musculus
gtgttctctgacgtcagtcagtaag

SEQ ID NO: 720414 - DNA, 25 bp, Mus musculus
gtgttctcttaacccagacatttta

SEQ ID NO: 720415 - DNA, 25 bp, Mus musculus
gtgttctcttaagccagacatttta

SEQ ID NO: 720416 - DNA, 25 bp, Mus musculus
gtgttctcttgtaacctgggagaga

SEQ ID NO: 720417 - DNA, 25 bp, Mus musculus
gtgttctcttgttacctgggagaga

SEQ ID NO: 720418 - DNA, 25 bp, Mus musculus
gtgttctgaattatgagatgatgaa

SEQ ID NO: 720419 - DNA, 25 bp, Mus musculus
gtgttctgaattttgagatgatgaa

SEQ ID NO: 720420 - DNA, 25 bp, Mus musculus
gtgttctgacacattgaagagcctt

SEQ ID NO: 720421 - DNA, 25 bp, Mus musculus
gtgttctgacactttgaagagcctt

SEQ ID NO: 720422 - DNA, 25 bp, Mus musculus
gtgttctgaccaatcaactcattgt

SEQ ID NO: 720423 - DNA, 25 bp, Mus musculus
gtgttctgaccattcaactcattgt

SEQ ID NO: 720424 - DNA, 25 bp, Mus musculus
gtgttctgacctaagtaccattttg

SEQ ID NO: 720425 - DNA, 25 bp, Mus musculus
gtgttctgaccttagtaccattttg

SEQ ID NO: 720426 - DNA, 25 bp, Mus musculus
gtgttctgagttccatttactgccc

SEQ ID NO: 720427 - DNA, 25 bp, Mus musculus
gtgttctgagttgcatttactgccc

SEQ ID NO: 720428 - DNA, 25 bp, Mus musculus
gtgttctgccaaacaactaattgag

SEQ ID NO: 720429 - DNA, 25 bp, Mus musculus
gtgttctgccaatcaactaattgag

SEQ ID NO: 720430 - DNA, 25 bp, Mus musculus
gtgttctgcggcactcctttacaca

SEQ ID NO: 720431 - DNA, 25 bp, Mus musculus
gtgttctgcggctctcctttacaca

SEQ ID NO: 720432 - DNA, 25 bp, Mus musculus
gtgttctggcagctgaaaccctaac

SEQ ID NO: 720433 - DNA, 25 bp, Mus musculus
gtgttctggcaggtgaaaccctaac

SEQ ID NO: 720434 - DNA, 25 bp, Mus musculus
gtgttctgggaaattgctcgacgct

SEQ ID NO: 720435 - DNA, 25 bp, Mus musculus
gtgttctgggaatttgctcgacgct

SEQ ID NO: 720436 - DNA, 25 bp, Mus musculus
gtgttctgggataagcaatctgatt

SEQ ID NO: 720437 - DNA, 25 bp, Mus musculus
gtgttctgggattagcaatctgatt

SEQ ID NO: 720438 - DNA, 25 bp, Mus musculus
gtgttctgggctccctacagtgctg

SEQ ID NO: 720439 - DNA, 25 bp, Mus musculus
gtgttctgggctgcctacagtgctg

SEQ ID NO: 720440 - DNA, 25 bp, Mus musculus
gtgttctgtaggaatttctctgtgt

SEQ ID NO: 720441 - DNA, 25 bp, Mus musculus
gtgttctgtaggtatttctctgtgt

SEQ ID NO: 720442 - DNA, 25 bp, Mus musculus
gtgttctgtagtcttaggaacttct

SEQ ID NO: 720443 - DNA, 25 bp, Mus musculus
gtgttctgtagtgttaggaacttct

SEQ ID NO: 720444 - DNA, 25 bp, Mus musculus
gtgttctgtatgatacatcgcctcc

SEQ ID NO: 720445 - DNA, 25 bp, Mus musculus
gtgttctgtatgttacatcgcctcc

SEQ ID NO: 720446 - DNA, 25 bp, Mus musculus
gtgttctgtcttccatgctcaacat

SEQ ID NO: 720447 - DNA, 25 bp, Mus musculus
gtgttctgtcttgcatgctcaacat

SEQ ID NO: 720448 - DNA, 25 bp, Mus musculus
gtgttctgtgaaccttctaaaacca

SEQ ID NO: 720449 - DNA, 25 bp, Mus musculus
gtgttctgtgaagcttctaaaacca

SEQ ID NO: 720450 - DNA, 25 bp, Mus musculus
gtgttctgtgaccttgcagtcatga

SEQ ID NO: 720451 - DNA, 25 bp, Mus musculus
gtgttctgtgacgttgcagtcatga

SEQ ID NO: 720452 - DNA, 25 bp, Mus musculus
gtgttctgtgatctttgctcatggc

SEQ ID NO: 720453 - DNA, 25 bp, Mus musculus
gtgttctgtgatgtttgctcatggc

SEQ ID NO: 720454 - DNA, 25 bp, Mus musculus
gtgttctgtgtaagctcctcctcca

SEQ ID NO: 720455 - DNA, 25 bp, Mus musculus
gtgttctgtgtatgctcctcctcca

SEQ ID NO: 720456 - DNA, 25 bp, Mus musculus
gtgttctgttaacttcctcatgcta

SEQ ID NO: 720457 - DNA, 25 bp, Mus musculus
gtgttctgttaagttcctcatgcta

SEQ ID NO: 720458 - DNA, 25 bp, Mus musculus
gtgttctgttcacatagcatccttc

SEQ ID NO: 720459 - DNA, 25 bp, Mus musculus
gtgttctgttcagatagcatccttc

SEQ ID NO: 720460 - DNA, 25 bp, Mus musculus
gtgttcttaaacattcttttcatca

SEQ ID NO: 720461 - DNA, 25 bp, Mus musculus
gtgttcttaaactttcttttcatca

SEQ ID NO: 720462 - DNA, 25 bp, Mus musculus
gtgttcttaaatcctgtcctatgtc

SEQ ID NO: 720463 - DNA, 25 bp, Mus musculus
gtgttcttaaatgctgtcctatgtc

SEQ ID NO: 720464 - DNA, 25 bp, Mus musculus
gtgttcttaacaattatgcttggat

SEQ ID NO: 720465 - DNA, 25 bp, Mus musculus
gtgttcttaacatttatgcttggat

SEQ ID NO: 720466 - DNA, 25 bp, Mus musculus
gtgttcttaactatactgtgatttt

SEQ ID NO: 720467 - DNA, 25 bp, Mus musculus
gtgttcttaactttactgtgatttt

SEQ ID NO: 720468 - DNA, 25 bp, Mus musculus
gtgttcttaaggaacctctaacaag

SEQ ID NO: 720469 - DNA, 25 bp, Mus musculus
gtgttcttaaggtacctctaacaag

SEQ ID NO: 720470 - DNA, 25 bp, Mus musculus
gtgttcttaagtatccttagcttca

SEQ ID NO: 720471 - DNA, 25 bp, Mus musculus
gtgttcttaagtttccttagcttca

SEQ ID NO: 720472 - DNA, 25 bp, Mus musculus
gtgttcttagccaactgtactgcat

SEQ ID NO: 720473 - DNA, 25 bp, Mus musculus
gtgttcttagcctactgtactgcat

SEQ ID NO: 720474 - DNA, 25 bp, Mus musculus
gtgttcttagtcattgaagttttca

SEQ ID NO: 720475 - DNA, 25 bp, Mus musculus
gtgttcttagtctttgaagttttca

SEQ ID NO: 720476 - DNA, 25 bp, Mus musculus
gtgttcttatagctgcctacatgtt

SEQ ID NO: 720477 - DNA, 25 bp, Mus musculus
gtgttcttataggtgcctacatgtt

SEQ ID NO: 720478 - DNA, 25 bp, Mus musculus
gtgttcttatttaatcatgcagtct

SEQ ID NO: 720479 - DNA, 25 bp, Mus musculus
gtgttcttattttatcatgcagtct

SEQ ID NO: 720480 - DNA, 25 bp, Mus musculus
gtgttcttcactaagacccgaggca

SEQ ID NO: 720481 - DNA, 25 bp, Mus musculus
gtgttcttcactagaactaatcaaa

SEQ ID NO: 720482 - DNA, 25 bp, Mus musculus
gtgttcttcacttagacccgaggca

SEQ ID NO: 720483 - DNA, 25 bp, Mus musculus
gtgttcttcacttgaactaatcaaa

SEQ ID NO: 720484 - DNA, 25 bp, Mus musculus
gtgttcttcaggactctatgtgcat

SEQ ID NO: 720485 - DNA, 25 bp, Mus musculus
gtgttcttcaggtctctatgtgcat

SEQ ID NO: 720486 - DNA, 25 bp, Mus musculus
gtgttcttcataaccagtctctcag

SEQ ID NO: 720487 - DNA, 25 bp, Mus musculus
gtgttcttcatatccagtctctcag

SEQ ID NO: 720488 - DNA, 25 bp, Mus musculus
gtgttcttcccgcaagaagtactga

SEQ ID NO: 720489 - DNA, 25 bp, Mus musculus
gtgttcttcccggaagaagtactga

SEQ ID NO: 720490 - DNA, 25 bp, Mus musculus
gtgttcttcggtctctattcaacca

SEQ ID NO: 720491 - DNA, 25 bp, Mus musculus
gtgttcttcggtgtctattcaacca

SEQ ID NO: 720492 - DNA, 25 bp, Mus musculus
gtgttcttctaacagccctgatggc

SEQ ID NO: 720493 - DNA, 25 bp, Mus musculus
gtgttcttctaacccttcaggttag

SEQ ID NO: 720494 - DNA, 25 bp, Mus musculus
gtgttcttctaagagccctgatggc

SEQ ID NO: 720495 - DNA, 25 bp, Mus musculus
gtgttcttctaagccttcaggttag

SEQ ID NO: 720496 - DNA, 25 bp, Mus musculus
gtgttcttctggcaacgtttttgat

SEQ ID NO: 720497 - DNA, 25 bp, Mus musculus
gtgttcttctgggaacgtttttgat

SEQ ID NO: 720498 - DNA, 25 bp, Mus musculus
gtgttcttgactacacagagtgcag

SEQ ID NO: 720499 - DNA, 25 bp, Mus musculus
gtgttcttgacttcacagagtgcag

SEQ ID NO: 720500 - DNA, 25 bp, Mus musculus
gtgttcttgatgctaggtctgcctg

SEQ ID NO: 720501 - DNA, 25 bp, Mus musculus
gtgttcttgatggtaggtctgcctg

SEQ ID NO: 720502 - DNA, 25 bp, Mus musculus
gtgttcttgcatctgaagtactcca

SEQ ID NO: 720503 - DNA, 25 bp, Mus musculus
gtgttcttgcatgtgaagtactcca

SEQ ID NO: 720504 - DNA, 25 bp, Mus musculus
gtgttcttgctactaacttccatag

SEQ ID NO: 720505 - DNA, 25 bp, Mus musculus
gtgttcttgctagtaacttccatag

SEQ ID NO: 720506 - DNA, 25 bp, Mus musculus
gtgttcttgcttagaacccaacttg

SEQ ID NO: 720507 - DNA, 25 bp, Mus musculus
gtgttcttgctttgaacccaacttg

SEQ ID NO: 720508 - DNA, 25 bp, Mus musculus
gtgttcttggatctcagacaatgca

SEQ ID NO: 720509 - DNA, 25 bp, Mus musculus
gtgttcttggatgtcagacaatgca

SEQ ID NO: 720510 - DNA, 25 bp, Mus musculus
gtgttcttgtatcacaaacgcacca

SEQ ID NO: 720511 - DNA, 25 bp, Mus musculus
gtgttcttgtatgacaaacgcacca

SEQ ID NO: 720512 - DNA, 25 bp, Mus musculus
gtgttcttgtgtctttaattggccc

SEQ ID NO: 720513 - DNA, 25 bp, Mus musculus
gtgttcttgtgtgtttaattggccc

SEQ ID NO: 720514 - DNA, 25 bp, Mus musculus
gtgttctttaaaccagacgaggtct

SEQ ID NO: 720515 - DNA, 25 bp, Mus musculus
gtgttctttaaagcagacgaggtct

SEQ ID NO: 720516 - DNA, 25 bp, Mus musculus
gtgttctttaccactggactcaaac

SEQ ID NO: 720517 - DNA, 25 bp, Mus musculus
gtgttctttacctctggactcaaac

SEQ ID NO: 720518 - DNA, 25 bp, Mus musculus
gtgttctttattaggcgcttcccgt

SEQ ID NO: 720519 - DNA, 25 bp, Mus musculus
gtgttctttatttggcgcttcccgt

SEQ ID NO: 720520 - DNA, 25 bp, Mus musculus
gtgttctttcccataggtgccaatt

SEQ ID NO: 720521 - DNA, 25 bp, Mus musculus
gtgttctttcccttaggtgccaatt

SEQ ID NO: 720522 - DNA, 25 bp, Mus musculus
gtgttctttgcccttatgaaactgg

SEQ ID NO: 720523 - DNA, 25 bp, Mus musculus
gtgttctttgccgttatgaaactgg

SEQ ID NO: 720524 - DNA, 25 bp, Mus musculus
gtgttctttgggatctgatgtgaga

SEQ ID NO: 720525 - DNA, 25 bp, Mus musculus
gtgttctttgggttctgatgtgaga

SEQ ID NO: 720526 - DNA, 25 bp, Mus musculus
gtgttctttgtaagtctgtgtatgt

SEQ ID NO: 720527 - DNA, 25 bp, Mus musculus
gtgttctttgtatgtctgtgtatgt

SEQ ID NO: 720528 - DNA, 25 bp, Mus musculus
gtgttcttttcaatttcgagggcaa

SEQ ID NO: 720529 - DNA, 25 bp, Mus musculus
gtgttcttttcattttcgagggcaa

SEQ ID NO: 720530 - DNA, 25 bp, Mus musculus
gtgttcttttccagacttagttctc

SEQ ID NO: 720531 - DNA, 25 bp, Mus musculus
gtgttcttttcctgacttagttctc

SEQ ID NO: 720532 - DNA, 25 bp, Mus musculus
gtgttcttttctcggtgaccttaga

SEQ ID NO: 720533 - DNA, 25 bp, Mus musculus
gtgttcttttctgggtgaccttaga

SEQ ID NO: 720534 - DNA, 25 bp, Mus musculus
gtgttcttttgaaatgcccatctga

SEQ ID NO: 720535 - DNA, 25 bp, Mus musculus
gtgttcttttgatatgcccatctga

SEQ ID NO: 720536 - DNA, 25 bp, Mus musculus
gtgttcttttgtactctgttatttg

SEQ ID NO: 720537 - DNA, 25 bp, Mus musculus
gtgttcttttgttctctgttatttg

SEQ ID NO: 720538 - DNA, 25 bp, Mus musculus
gtgttctttttgaattggcagtaaa

SEQ ID NO: 720539 - DNA, 25 bp, Mus musculus
gtgttctttttgtattggcagtaaa

SEQ ID NO: 720540 - DNA, 25 bp, Mus musculus
gtgttgaaacataatcctttggctg

SEQ ID NO: 720541 - DNA, 25 bp, Mus musculus
gtgttgaaacattatcctttggctg

SEQ ID NO: 720542 - DNA, 25 bp, Mus musculus
gtgttgaaacccatcactacctatg

SEQ ID NO: 720543 - DNA, 25 bp, Mus musculus
gtgttgaaacccttcactacctatg

SEQ ID NO: 720544 - DNA, 25 bp, Mus musculus
gtgttgaaactcagctctttgtgta

SEQ ID NO: 720545 - DNA, 25 bp, Mus musculus
gtgttgaaactctgctctttgtgta

SEQ ID NO: 720546 - DNA, 25 bp, Mus musculus
gtgttgaacaacaaagtcagtaatt

SEQ ID NO: 720547 - DNA, 25 bp, Mus musculus
gtgttgaacaaccatgtgctgtctg

SEQ ID NO: 720548 - DNA, 25 bp, Mus musculus
gtgttgaacaacgatgtgctgtctg

SEQ ID NO: 720549 - DNA, 25 bp, Mus musculus
gtgttgaacaactaagtcagtaatt

SEQ ID NO: 720550 - DNA, 25 bp, Mus musculus
gtgttgaacagcctttactcacaaa

SEQ ID NO: 720551 - DNA, 25 bp, Mus musculus
gtgttgaacagcgtttactcacaaa

SEQ ID NO: 720552 - DNA, 25 bp, Mus musculus
gtgttgaagcccatggatgctcccc

SEQ ID NO: 720553 - DNA, 25 bp, Mus musculus
gtgttgaagcccttggatgctcccc

SEQ ID NO: 720554 - DNA, 25 bp, Mus musculus
gtgttgaatcacagaatcgcaggta

SEQ ID NO: 720555 - DNA, 25 bp, Mus musculus
gtgttgaatcactgaatcgcaggta

SEQ ID NO: 720556 - DNA, 25 bp, Mus musculus
gtgttgaattctagactaccgtctc

SEQ ID NO: 720557 - DNA, 25 bp, Mus musculus
gtgttgaattcttgactaccgtctc

SEQ ID NO: 720558 - DNA, 25 bp, Mus musculus
gtgttgaattgtagtccgcagccca

SEQ ID NO: 720559 - DNA, 25 bp, Mus musculus
gtgttgaattgttgtccgcagccca

SEQ ID NO: 720560 - DNA, 25 bp, Mus musculus
gtgttgacaataagcccattgaaga

SEQ ID NO: 720561 - DNA, 25 bp, Mus musculus
gtgttgacaatatgcccattgaaga

SEQ ID NO: 720562 - DNA, 25 bp, Mus musculus
gtgttgacacacagggttagagaag

SEQ ID NO: 720563 - DNA, 25 bp, Mus musculus
gtgttgacacactgggttagagaag

SEQ ID NO: 720564 - DNA, 25 bp, Mus musculus
gtgttgacactaaacagcacctcag

SEQ ID NO: 720565 - DNA, 25 bp, Mus musculus
gtgttgacactatacagcacctcag

SEQ ID NO: 720566 - DNA, 25 bp, Mus musculus
gtgttgaccaaaagccgttctctgt

SEQ ID NO: 720567 - DNA, 25 bp, Mus musculus
gtgttgaccaaatgccgttctctgt

SEQ ID NO: 720568 - DNA, 25 bp, Mus musculus
gtgttgaccacaaacatcacctggt

SEQ ID NO: 720569 - DNA, 25 bp, Mus musculus
gtgttgaccacatacatcacctggt

SEQ ID NO: 720570 - DNA, 25 bp, Mus musculus
gtgttgacctctcatctatgtagca

SEQ ID NO: 720571 - DNA, 25 bp, Mus musculus
gtgttgacctctgatctatgtagca

SEQ ID NO: 720572 - DNA, 25 bp, Mus musculus
gtgttgacctgcaccatgccaagga

SEQ ID NO: 720573 - DNA, 25 bp, Mus musculus
gtgttgacctgctccatgccaagga

SEQ ID NO: 720574 - DNA, 25 bp, Mus musculus
gtgttgacgcttcccttggacattt

SEQ ID NO: 720575 - DNA, 25 bp, Mus musculus
gtgttgacgcttgccttggacattt

SEQ ID NO: 720576 - DNA, 25 bp, Mus musculus
gtgttgactcataactgtagtccca

SEQ ID NO: 720577 - DNA, 25 bp, Mus musculus
gtgttgactcatatattccttttgg

SEQ ID NO: 720578 - DNA, 25 bp, Mus musculus
gtgttgactcattactgtagtccca

SEQ ID NO: 720579 - DNA, 25 bp, Mus musculus
gtgttgactcatttattccttttgg

SEQ ID NO: 720580 - DNA, 25 bp, Mus musculus
gtgttgactctgagaatctgtacga

SEQ ID NO: 720581 - DNA, 25 bp, Mus musculus
gtgttgactctgtgaatctgtacga

SEQ ID NO: 720582 - DNA, 25 bp, Mus musculus
gtgttgactgatcctctgtggatga

SEQ ID NO: 720583 - DNA, 25 bp, Mus musculus
gtgttgactgatgctctgtggatga

SEQ ID NO: 720584 - DNA, 25 bp, Mus musculus
gtgttgactgtaccctaatggtgtg

SEQ ID NO: 720585 - DNA, 25 bp, Mus musculus
gtgttgactgtagcctaatggtgtg

SEQ ID NO: 720586 - DNA, 25 bp, Mus musculus
gtgttgacttcaatattcccatggt

SEQ ID NO: 720587 - DNA, 25 bp, Mus musculus
gtgttgacttcattattcccatggt

SEQ ID NO: 720588 - DNA, 25 bp, Mus musculus
gtgttgagagaccacatcttcttat

SEQ ID NO: 720589 - DNA, 25 bp, Mus musculus
gtgttgagagacgacatcttcttat

SEQ ID NO: 720590 - DNA, 25 bp, Mus musculus
gtgttgagagctactctgactaccc

SEQ ID NO: 720591 - DNA, 25 bp, Mus musculus
gtgttgagagcttctctgactaccc

SEQ ID NO: 720592 - DNA, 25 bp, Mus musculus
gtgttgagatcaaccgcatggcgtc

SEQ ID NO: 720593 - DNA, 25 bp, Mus musculus
gtgttgagatcatccgcatggcgtc

SEQ ID NO: 720594 - DNA, 25 bp, Mus musculus
gtgttgagattccaagttcgctgct

SEQ ID NO: 720595 - DNA, 25 bp, Mus musculus
gtgttgagattcgaagttcgctgct

SEQ ID NO: 720596 - DNA, 25 bp, Mus musculus
gtgttgagcaagcttagccctttgt

SEQ ID NO: 720597 - DNA, 25 bp, Mus musculus
gtgttgagcaaggttagccctttgt

SEQ ID NO: 720598 - DNA, 25 bp, Mus musculus
gtgttgagcatcacaaagccatcag

SEQ ID NO: 720599 - DNA, 25 bp, Mus musculus
gtgttgagcatctcaaagccatcag

SEQ ID NO: 720600 - DNA, 25 bp, Mus musculus
gtgttgagcatgaacacagcttcct

SEQ ID NO: 720601 - DNA, 25 bp, Mus musculus
gtgttgagcatgtacacagcttcct

SEQ ID NO: 720602 - DNA, 25 bp, Mus musculus
gtgttgagcctcattctgaattgac

SEQ ID NO: 720603 - DNA, 25 bp, Mus musculus
gtgttgagcctctttctgaattgac

SEQ ID NO: 720604 - DNA, 25 bp, Mus musculus
gtgttgagcggcactgtctcgcgca

SEQ ID NO: 720605 - DNA, 25 bp, Mus musculus
gtgttgagcggctctgtctcgcgca

SEQ ID NO: 720606 - DNA, 25 bp, Mus musculus
gtgttgagctctctttactgttgaa

SEQ ID NO: 720607 - DNA, 25 bp, Mus musculus
gtgttgagctctgtttactgttgaa

SEQ ID NO: 720608 - DNA, 25 bp, Mus musculus
gtgttgagtacaatccagtttgttt

SEQ ID NO: 720609 - DNA, 25 bp, Mus musculus
gtgttgagtacattccagtttgttt

SEQ ID NO: 720610 - DNA, 25 bp, Mus musculus
gtgttgagtgagatctgtggttcct

SEQ ID NO: 720611 - DNA, 25 bp, Mus musculus
gtgttgagtgagttctgtggttcct

SEQ ID NO: 720612 - DNA, 25 bp, Mus musculus
gtgttgagtgctaggaataaatgaa

SEQ ID NO: 720613 - DNA, 25 bp, Mus musculus
gtgttgagtgcttggaataaatgaa

SEQ ID NO: 720614 - DNA, 25 bp, Mus musculus
gtgttgatagctctttcatctttat

SEQ ID NO: 720615 - DNA, 25 bp, Mus musculus
gtgttgatagctgtttcatctttat

SEQ ID NO: 720616 - DNA, 25 bp, Mus musculus
gtgttgatccaaagccaacttcacc

SEQ ID NO: 720617 - DNA, 25 bp, Mus musculus
gtgttgatccaatgccaacttcacc

SEQ ID NO: 720618 - DNA, 25 bp, Mus musculus
gtgttgatctctatcctgttgacag

SEQ ID NO: 720619 - DNA, 25 bp, Mus musculus
gtgttgatctctttcctgttgacag

SEQ ID NO: 720620 - DNA, 25 bp, Mus musculus
gtgttgatctgtacattggtaactc

SEQ ID NO: 720621 - DNA, 25 bp, Mus musculus
gtgttgatctgttcattggtaactc

SEQ ID NO: 720622 - DNA, 25 bp, Mus musculus
gtgttgatgaccactactctggagt

SEQ ID NO: 720623 - DNA, 25 bp, Mus musculus
gtgttgatgacctctactctggagt

SEQ ID NO: 720624 - DNA, 25 bp, Mus musculus
gtgttgatgcttatttgctgtctgg

SEQ ID NO: 720625 - DNA, 25 bp, Mus musculus
gtgttgatgcttttttgctgtctgg

SEQ ID NO: 720626 - DNA, 25 bp, Mus musculus
gtgttgatggacctgtgggctgctc

SEQ ID NO: 720627 - DNA, 25 bp, Mus musculus
gtgttgatggacgtgtgggctgctc

SEQ ID NO: 720628 - DNA, 25 bp, Mus musculus
gtgttgatttatcccagggcatcat

SEQ ID NO: 720629 - DNA, 25 bp, Mus musculus
gtgttgatttatgccagggcatcat

SEQ ID NO: 720630 - DNA, 25 bp, Mus musculus
gtgttgatttgcatcatttatggag

SEQ ID NO: 720631 - DNA, 25 bp, Mus musculus
gtgttgatttgcttcatttatggag

SEQ ID NO: 720632 - DNA, 25 bp, Mus musculus
gtgttgcaagagcacatggatctta

SEQ ID NO: 720633 - DNA, 25 bp, Mus musculus
gtgttgcaagaggacatggatctta

SEQ ID NO: 720634 - DNA, 25 bp, Mus musculus
gtgttgcaagcccacagtctcgtaa

SEQ ID NO: 720635 - DNA, 25 bp, Mus musculus
gtgttgcaagccgacagtctcgtaa

SEQ ID NO: 720636 - DNA, 25 bp, Mus musculus
gtgttgcaatttagtctttatcaca

SEQ ID NO: 720637 - DNA, 25 bp, Mus musculus
gtgttgcaattttgtctttatcaca

SEQ ID NO: 720638 - DNA, 25 bp, Mus musculus
gtgttgcaccctaggcattaggtca

SEQ ID NO: 720639 - DNA, 25 bp, Mus musculus
gtgttgcacccttggcattaggtca

SEQ ID NO: 720640 - DNA, 25 bp, Mus musculus
gtgttgcagtctatggagtgttttc

SEQ ID NO: 720641 - DNA, 25 bp, Mus musculus
gtgttgcagtctttggagtgttttc

SEQ ID NO: 720642 - DNA, 25 bp, Mus musculus
gtgttgcagtgtatctaatacttct

SEQ ID NO: 720643 - DNA, 25 bp, Mus musculus
gtgttgcagtgtttctaatacttct

SEQ ID NO: 720644 - DNA, 25 bp, Mus musculus
gtgttgcagtttctcccaggttgaa

SEQ ID NO: 720645 - DNA, 25 bp, Mus musculus
gtgttgcagtttgtcccaggttgaa

SEQ ID NO: 720646 - DNA, 25 bp, Mus musculus
gtgttgcatcaaaccagctattatg

SEQ ID NO: 720647 - DNA, 25 bp, Mus musculus
gtgttgcatcaatccagctattatg

SEQ ID NO: 720648 - DNA, 25 bp, Mus musculus
gtgttgcatcatacatagagcccat

SEQ ID NO: 720649 - DNA, 25 bp, Mus musculus
gtgttgcatcattcatagagcccat

SEQ ID NO: 720650 - DNA, 25 bp, Mus musculus
gtgttgcatgcacagcctgaacaaa

SEQ ID NO: 720651 - DNA, 25 bp, Mus musculus
gtgttgcatgcagagcctgaacaaa

SEQ ID NO: 720652 - DNA, 25 bp, Mus musculus
gtgttgcatgctatggttccaccaa

SEQ ID NO: 720653 - DNA, 25 bp, Mus musculus
gtgttgcatgctttggttccaccaa

SEQ ID NO: 720654 - DNA, 25 bp, Mus musculus
gtgttgccaactcggcatgggacct

SEQ ID NO: 720655 - DNA, 25 bp, Mus musculus
gtgttgccaactgggcatgggacct

SEQ ID NO: 720656 - DNA, 25 bp, Mus musculus
gtgttgccaaggacagccatgggct

SEQ ID NO: 720657 - DNA, 25 bp, Mus musculus
gtgttgccaaggtcagccatgggct

SEQ ID NO: 720658 - DNA, 25 bp, Mus musculus
gtgttgccagcacgcggcatcagct

SEQ ID NO: 720659 - DNA, 25 bp, Mus musculus
gtgttgccagcaggcggcatcagct

SEQ ID NO: 720660 - DNA, 25 bp, Mus musculus
gtgttgccatgtcaacttcaatagt

SEQ ID NO: 720661 - DNA, 25 bp, Mus musculus
gtgttgccatgtgaacttcaatagt

SEQ ID NO: 720662 - DNA, 25 bp, Mus musculus
gtgttgccatttccagccgccatga

SEQ ID NO: 720663 - DNA, 25 bp, Mus musculus
gtgttgccatttgcagccgccatga

SEQ ID NO: 720664 - DNA, 25 bp, Mus musculus
gtgttgcccacaatacatgaccata

SEQ ID NO: 720665 - DNA, 25 bp, Mus musculus
gtgttgcccacattacatgaccata

SEQ ID NO: 720666 - DNA, 25 bp, Mus musculus
gtgttgcccgcacactgttttaaca

SEQ ID NO: 720667 - DNA, 25 bp, Mus musculus
gtgttgcccgcagactgttttaaca

SEQ ID NO: 720668 - DNA, 25 bp, Mus musculus
gtgttgccgcgcacgagcaagccaa

SEQ ID NO: 720669 - DNA, 25 bp, Mus musculus
gtgttgccgcgctcgagcaagccaa

SEQ ID NO: 720670 - DNA, 25 bp, Mus musculus
gtgttgcctactctgttatcttcaa

SEQ ID NO: 720671 - DNA, 25 bp, Mus musculus
gtgttgcctactgtgttatcttcaa

SEQ ID NO: 720672 - DNA, 25 bp, Mus musculus
gtgttgcctcagcaattcttcagat

SEQ ID NO: 720673 - DNA, 25 bp, Mus musculus
gtgttgcctcaggaattcttcagat

SEQ ID NO: 720674 - DNA, 25 bp, Mus musculus
gtgttgcctgcaaagtcacatcaag

SEQ ID NO: 720675 - DNA, 25 bp, Mus musculus
gtgttgcctgcatagtcacatcaag

SEQ ID NO: 720676 - DNA, 25 bp, Mus musculus
gtgttgcctgtgctcttggtcccgc

SEQ ID NO: 720677 - DNA, 25 bp, Mus musculus
gtgttgcctgtggtcttggtcccgc

SEQ ID NO: 720678 - DNA, 25 bp, Mus musculus
gtgttgcgccgaaggaagagcttaa

SEQ ID NO: 720679 - DNA, 25 bp, Mus musculus
gtgttgcgccgatggaagagcttaa

SEQ ID NO: 720680 - DNA, 25 bp, Mus musculus
gtgttgcgctcactcacaaataagg

SEQ ID NO: 720681 - DNA, 25 bp, Mus musculus
gtgttgcgctcagtcacaaataagg

SEQ ID NO: 720682 - DNA, 25 bp, Mus musculus
gtgttgcggcgaagtccagtgtggg

SEQ ID NO: 720683 - DNA, 25 bp, Mus musculus
gtgttgcggcgatgtccagtgtggg

SEQ ID NO: 720684 - DNA, 25 bp, Mus musculus
gtgttgcggcgccagcacaagccac

SEQ ID NO: 720685 - DNA, 25 bp, Mus musculus
gtgttgcggcgcgagcacaagccac

SEQ ID NO: 720686 - DNA, 25 bp, Mus musculus
gtgttgctaattcctgtctggttcc

SEQ ID NO: 720687 - DNA, 25 bp, Mus musculus
gtgttgctaattgctgtctggttcc

SEQ ID NO: 720688 - DNA, 25 bp, Mus musculus
gtgttgctatgaatcactctcttga

SEQ ID NO: 720689 - DNA, 25 bp, Mus musculus
gtgttgctatgattcactctcttga

SEQ ID NO: 720690 - DNA, 25 bp, Mus musculus
gtgttgctcataagtcacccatcag

SEQ ID NO: 720691 - DNA, 25 bp, Mus musculus
gtgttgctcatatgtcacccatcag

SEQ ID NO: 720692 - DNA, 25 bp, Mus musculus
gtgttgctctctatctataacctgt

SEQ ID NO: 720693 - DNA, 25 bp, Mus musculus
gtgttgctctctttctataacctgt

SEQ ID NO: 720694 - DNA, 25 bp, Mus musculus
gtgttgctcttaacacttttaacct

SEQ ID NO: 720695 - DNA, 25 bp, Mus musculus
gtgttgctcttatcacttttaacct

SEQ ID NO: 720696 - DNA, 25 bp, Mus musculus
gtgttgctcttgatcgttctaaaaa

SEQ ID NO: 720697 - DNA, 25 bp, Mus musculus
gtgttgctcttgttcgttctaaaaa

SEQ ID NO: 720698 - DNA, 25 bp, Mus musculus
gtgttgctctttaatttcacattcc

SEQ ID NO: 720699 - DNA, 25 bp, Mus musculus
gtgttgctcttttatttcacattcc

SEQ ID NO: 720700 - DNA, 25 bp, Mus musculus
gtgttgctgacccaggaatggttta

SEQ ID NO: 720701 - DNA, 25 bp, Mus musculus
gtgttgctgaccgaggaatggttta

SEQ ID NO: 720702 - DNA, 25 bp, Mus musculus
gtgttgctggtgctaactctaaaat

SEQ ID NO: 720703 - DNA, 25 bp, Mus musculus
gtgttgctggtggtaactctaaaat

SEQ ID NO: 720704 - DNA, 25 bp, Mus musculus
gtgttgctgtaaccctgtgtgctgt

SEQ ID NO: 720705 - DNA, 25 bp, Mus musculus
gtgttgctgtaagcctgtgtgctgt

SEQ ID NO: 720706 - DNA, 25 bp, Mus musculus
gtgttgcttcttccttatgcttgaa

SEQ ID NO: 720707 - DNA, 25 bp, Mus musculus
gtgttgcttcttgcttatgcttgaa

SEQ ID NO: 720708 - DNA, 25 bp, Mus musculus
gtgttgcttgtgatttcatttggga

SEQ ID NO: 720709 - DNA, 25 bp, Mus musculus
gtgttgcttgtgttttcatttggga

SEQ ID NO: 720710 - DNA, 25 bp, Mus musculus
gtgttgcttttgagtgtgataatat

SEQ ID NO: 720711 - DNA, 25 bp, Mus musculus
gtgttgcttttgtgtgtgataatat

SEQ ID NO: 720712 - DNA, 25 bp, Mus musculus
gtgttggaaacacgctctcttcatc

SEQ ID NO: 720713 - DNA, 25 bp, Mus musculus
gtgttggaaacaggctctcttcatc

SEQ ID NO: 720714 - DNA, 25 bp, Mus musculus
gtgttggaacggactttggaagtct

SEQ ID NO: 720715 - DNA, 25 bp, Mus musculus
gtgttggaacggtctttggaagtct

SEQ ID NO: 720716 - DNA, 25 bp, Mus musculus
gtgttggaattgctcattgggattt

SEQ ID NO: 720717 - DNA, 25 bp, Mus musculus
gtgttggaattggtcattgggattt

SEQ ID NO: 720718 - DNA, 25 bp, Mus musculus
gtgttggacaccaaggctggttgca

SEQ ID NO: 720719 - DNA, 25 bp, Mus musculus
gtgttggacaccatcatagcgtagt

SEQ ID NO: 720720 - DNA, 25 bp, Mus musculus
gtgttggacacctaggctggttgca

SEQ ID NO: 720721 - DNA, 25 bp, Mus musculus
gtgttggacaccttcatagcgtagt

SEQ ID NO: 720722 - DNA, 25 bp, Mus musculus
gtgttggactatagtctttttccct

SEQ ID NO: 720723 - DNA, 25 bp, Mus musculus
gtgttggactattgtctttttccct

SEQ ID NO: 720724 - DNA, 25 bp, Mus musculus
gtgttggaggtacgcttccctccca

SEQ ID NO: 720725 - DNA, 25 bp, Mus musculus
gtgttggaggtaggcttccctccca

SEQ ID NO: 720726 - DNA, 25 bp, Mus musculus
gtgttggagtcacattccagtggaa

SEQ ID NO: 720727 - DNA, 25 bp, Mus musculus
gtgttggagtcagattccagtggaa

SEQ ID NO: 720728 - DNA, 25 bp, Mus musculus
gtgttggagtctagtgtcctttagc

SEQ ID NO: 720729 - DNA, 25 bp, Mus musculus
gtgttggagtcttgtgtcctttagc

SEQ ID NO: 720730 - DNA, 25 bp, Mus musculus
gtgttggagtgtacaaagcccaatt

SEQ ID NO: 720731 - DNA, 25 bp, Mus musculus
gtgttggagtgttcaaagcccaatt

SEQ ID NO: 720732 - DNA, 25 bp, Mus musculus
gtgttggatcacatgctgaaatgaa

SEQ ID NO: 720733 - DNA, 25 bp, Mus musculus
gtgttggatcacttgctgaaatgaa

SEQ ID NO: 720734 - DNA, 25 bp, Mus musculus
gtgttggatccccaagaactgaagt

SEQ ID NO: 720735 - DNA, 25 bp, Mus musculus
gtgttggatcccgaagaactgaagt

SEQ ID NO: 720736 - DNA, 25 bp, Mus musculus
gtgttggatggcagctttgactctg

SEQ ID NO: 720737 - DNA, 25 bp, Mus musculus
gtgttggatggctgctttgactctg

SEQ ID NO: 720738 - DNA, 25 bp, Mus musculus
gtgttggatgtcacctaagtctcag

SEQ ID NO: 720739 - DNA, 25 bp, Mus musculus
gtgttggatgtctcctaagtctcag

SEQ ID NO: 720740 - DNA, 25 bp, Mus musculus
gtgttggatgttctcgtgaccacag

SEQ ID NO: 720741 - DNA, 25 bp, Mus musculus
gtgttggatgttgtcgtgaccacag

SEQ ID NO: 720742 - DNA, 25 bp, Mus musculus
gtgttggcacctatgaaatctagaa

SEQ ID NO: 720743 - DNA, 25 bp, Mus musculus
gtgttggcacctttgaaatctagaa

SEQ ID NO: 720744 - DNA, 25 bp, Mus musculus
gtgttggcattcactttctgaggcc

SEQ ID NO: 720745 - DNA, 25 bp, Mus musculus
gtgttggcattctctttctgaggcc

SEQ ID NO: 720746 - DNA, 25 bp, Mus musculus
gtgttggccagaaaagtccagattt

SEQ ID NO: 720747 - DNA, 25 bp, Mus musculus
gtgttggccagataagtccagattt

SEQ ID NO: 720748 - DNA, 25 bp, Mus musculus
gtgttggccaggctgctgaccctcc

SEQ ID NO: 720749 - DNA, 25 bp, Mus musculus
gtgttggccagggtgctgaccctcc

SEQ ID NO: 720750 - DNA, 25 bp, Mus musculus
gtgttggcctgaagacagcactcac

SEQ ID NO: 720751 - DNA, 25 bp, Mus musculus
gtgttggcctgatgacagcactcac

SEQ ID NO: 720752 - DNA, 25 bp, Mus musculus
gtgttggcctgcaacttttatgagc

SEQ ID NO: 720753 - DNA, 25 bp, Mus musculus
gtgttggcctgctacttttatgagc

SEQ ID NO: 720754 - DNA, 25 bp, Mus musculus
gtgttggcgaaccttttcatttcct

SEQ ID NO: 720755 - DNA, 25 bp, Mus musculus
gtgttggcgaacgttttcatttcct

SEQ ID NO: 720756 - DNA, 25 bp, Mus musculus
gtgttggctaatctatctaatggtc

SEQ ID NO: 720757 - DNA, 25 bp, Mus musculus
gtgttggctaatgtatctaatggtc

SEQ ID NO: 720758 - DNA, 25 bp, Mus musculus
gtgttggctcataattcacatcggg

SEQ ID NO: 720759 - DNA, 25 bp, Mus musculus
gtgttggctcattattcacatcggg

SEQ ID NO: 720760 - DNA, 25 bp, Mus musculus
gtgttggcttacctagtcatccaca

SEQ ID NO: 720761 - DNA, 25 bp, Mus musculus
gtgttggcttacgtagtcatccaca

SEQ ID NO: 720762 - DNA, 25 bp, Mus musculus
gtgttggcttcactaagaaacgcaa

SEQ ID NO: 720763 - DNA, 25 bp, Mus musculus
gtgttggcttcagtaagaaacgcaa

SEQ ID NO: 720764 - DNA, 25 bp, Mus musculus
gtgttggcttctacagatggcgcaa

SEQ ID NO: 720765 - DNA, 25 bp, Mus musculus
gtgttggcttcttcagatggcgcaa

SEQ ID NO: 720766 - DNA, 25 bp, Mus musculus
gtgttggctttacaaatcaccacgg

SEQ ID NO: 720767 - DNA, 25 bp, Mus musculus
gtgttggctttagaaatcaccacgg

SEQ ID NO: 720768 - DNA, 25 bp, Mus musculus
gtgttgggacatcagacctcagcca

SEQ ID NO: 720769 - DNA, 25 bp, Mus musculus
gtgttgggacatgagacctcagcca

SEQ ID NO: 720770 - DNA, 25 bp, Mus musculus
gtgttgggatgcatttgatagcctt

SEQ ID NO: 720771 - DNA, 25 bp, Mus musculus
gtgttgggatgcttttgatagcctt

SEQ ID NO: 720772 - DNA, 25 bp, Mus musculus
gtgttgggattcaaggcctgagcct

SEQ ID NO: 720773 - DNA, 25 bp, Mus musculus
gtgttgggattctaggcctgagcct

SEQ ID NO: 720774 - DNA, 25 bp, Mus musculus
gtgttgggcagcattgccatcatta

SEQ ID NO: 720775 - DNA, 25 bp, Mus musculus
gtgttgggcagctttgccatcatta

SEQ ID NO: 720776 - DNA, 25 bp, Mus musculus
gtgttgggtgcgagactcagtcaca

SEQ ID NO: 720777 - DNA, 25 bp, Mus musculus
gtgttgggtgcgatgatttagatac

SEQ ID NO: 720778 - DNA, 25 bp, Mus musculus
gtgttgggtgcgtgactcagtcaca

SEQ ID NO: 720779 - DNA, 25 bp, Mus musculus
gtgttgggtgcgttgatttagatac

SEQ ID NO: 720780 - DNA, 25 bp, Mus musculus
gtgttggtagccatatatgaagaac

SEQ ID NO: 720781 - DNA, 25 bp, Mus musculus
gtgttggtagccttatatgaagaac

SEQ ID NO: 720782 - DNA, 25 bp, Mus musculus
gtgttggtaggaccttagcctgatt

SEQ ID NO: 720783 - DNA, 25 bp, Mus musculus
gtgttggtaggagcttagcctgatt

SEQ ID NO: 720784 - DNA, 25 bp, Mus musculus
gtgttggtccaaagaattctacaaa

SEQ ID NO: 720785 - DNA, 25 bp, Mus musculus
gtgttggtccaatgaattctacaaa

SEQ ID NO: 720786 - DNA, 25 bp, Mus musculus
gtgttggtgacactctttcggcaga

SEQ ID NO: 720787 - DNA, 25 bp, Mus musculus
gtgttggtgacagtctttcggcaga

SEQ ID NO: 720788 - DNA, 25 bp, Mus musculus
gtgttggtgtccatatttaaatcgt

SEQ ID NO: 720789 - DNA, 25 bp, Mus musculus
gtgttggtgtccttatttaaatcgt

SEQ ID NO: 720790 - DNA, 25 bp, Mus musculus
gtgttggttagcactttagctctac

SEQ ID NO: 720791 - DNA, 25 bp, Mus musculus
gtgttggttagctctttagctctac

SEQ ID NO: 720792 - DNA, 25 bp, Mus musculus
gtgttggttctcaaattgactatta

SEQ ID NO: 720793 - DNA, 25 bp, Mus musculus
gtgttggttctctaattgactatta

SEQ ID NO: 720794 - DNA, 25 bp, Mus musculus
gtgttggttcttagcccaggtgtga

SEQ ID NO: 720795 - DNA, 25 bp, Mus musculus
gtgttggttctttgcccaggtgtga

SEQ ID NO: 720796 - DNA, 25 bp, Mus musculus
gtgttggttgcaaagcctgatgact

SEQ ID NO: 720797 - DNA, 25 bp, Mus musculus
gtgttggttgcatagcctgatgact

SEQ ID NO: 720798 - DNA, 25 bp, Mus musculus
gtgttggttgggaggactacttact

SEQ ID NO: 720799 - DNA, 25 bp, Mus musculus
gtgttggttgggtggactacttact

SEQ ID NO: 720800 - DNA, 25 bp, Mus musculus
gtgttggtttctacatttcctttga

SEQ ID NO: 720801 - DNA, 25 bp, Mus musculus
gtgttggtttcttcatttcctttga

SEQ ID NO: 720802 - DNA, 25 bp, Mus musculus
gtgttgtaagatagcttgttcaaac

SEQ ID NO: 720803 - DNA, 25 bp, Mus musculus
gtgttgtaagattgcttgttcaaac

SEQ ID NO: 720804 - DNA, 25 bp, Mus musculus
gtgttgtaagcaaatgactcttttt

SEQ ID NO: 720805 - DNA, 25 bp, Mus musculus
gtgttgtaagcatatgactcttttt

SEQ ID NO: 720806 - DNA, 25 bp, Mus musculus
gtgttgtaagtcatctctaccatcc

SEQ ID NO: 720807 - DNA, 25 bp, Mus musculus
gtgttgtaagtcttctctaccatcc

SEQ ID NO: 720808 - DNA, 25 bp, Mus musculus
gtgttgtaatgtcttctggaccatc

SEQ ID NO: 720809 - DNA, 25 bp, Mus musculus
gtgttgtaatgtgttctggaccatc

SEQ ID NO: 720810 - DNA, 25 bp, Mus musculus
gtgttgtaccacatcacatttgatg

SEQ ID NO: 720811 - DNA, 25 bp, Mus musculus
gtgttgtaccacttcacatttgatg

SEQ ID NO: 720812 - DNA, 25 bp, Mus musculus
gtgttgtactacagagctaggccca

SEQ ID NO: 720813 - DNA, 25 bp, Mus musculus
gtgttgtactactgagctaggccca

SEQ ID NO: 720814 - DNA, 25 bp, Mus musculus
gtgttgtagtgacaaactgttttca

SEQ ID NO: 720815 - DNA, 25 bp, Mus musculus
gtgttgtagtgagaaactgttttca

SEQ ID NO: 720816 - DNA, 25 bp, Mus musculus
gtgttgtatctgattcctgttttca

SEQ ID NO: 720817 - DNA, 25 bp, Mus musculus
gtgttgtatctgtttcctgttttca

SEQ ID NO: 720818 - DNA, 25 bp, Mus musculus
gtgttgtatgtactctttggttgat

SEQ ID NO: 720819 - DNA, 25 bp, Mus musculus
gtgttgtatgtagtctttggttgat

SEQ ID NO: 720820 - DNA, 25 bp, Mus musculus
gtgttgtatttcacagcaagaccct

SEQ ID NO: 720821 - DNA, 25 bp, Mus musculus
gtgttgtatttctcagcaagaccct

SEQ ID NO: 720822 - DNA, 25 bp, Mus musculus
gtgttgtattttcggcttggtttgc

SEQ ID NO: 720823 - DNA, 25 bp, Mus musculus
gtgttgtattttgggcttggtttgc

SEQ ID NO: 720824 - DNA, 25 bp, Mus musculus
gtgttgtcaaccatgtgatccacca

SEQ ID NO: 720825 - DNA, 25 bp, Mus musculus
gtgttgtcaaccttgtgatccacca

SEQ ID NO: 720826 - DNA, 25 bp, Mus musculus
gtgttgtcacaaactgtggtttctc

SEQ ID NO: 720827 - DNA, 25 bp, Mus musculus
gtgttgtcacaatctgtggtttctc

SEQ ID NO: 720828 - DNA, 25 bp, Mus musculus
gtgttgtcacagacactgcagggat

SEQ ID NO: 720829 - DNA, 25 bp, Mus musculus
gtgttgtcacagtcactgcagggat

SEQ ID NO: 720830 - DNA, 25 bp, Mus musculus
gtgttgtcacttacccatttatgta

SEQ ID NO: 720831 - DNA, 25 bp, Mus musculus
gtgttgtcactttcccatttatgta

SEQ ID NO: 720832 - DNA, 25 bp, Mus musculus
gtgttgtcagcaaggtttcatttcc

SEQ ID NO: 720833 - DNA, 25 bp, Mus musculus
gtgttgtcagcacactgaggaactg

SEQ ID NO: 720834 - DNA, 25 bp, Mus musculus
gtgttgtcagcagactgaggaactg

SEQ ID NO: 720835 - DNA, 25 bp, Mus musculus
gtgttgtcagcatggtttcatttcc

SEQ ID NO: 720836 - DNA, 25 bp, Mus musculus
gtgttgtcatgactggatcctacaa

SEQ ID NO: 720837 - DNA, 25 bp, Mus musculus
gtgttgtcatgagtggatcctacaa

SEQ ID NO: 720838 - DNA, 25 bp, Mus musculus
gtgttgtcatgtaagcaagcgcagc

SEQ ID NO: 720839 - DNA, 25 bp, Mus musculus
gtgttgtcatgttagcaagcgcagc

SEQ ID NO: 720840 - DNA, 25 bp, Mus musculus
gtgttgtccctacttaatgctgtgt

SEQ ID NO: 720841 - DNA, 25 bp, Mus musculus
gtgttgtccctagttaatgctgtgt

SEQ ID NO: 720842 - DNA, 25 bp, Mus musculus
gtgttgtcctagaaagggtttgctt

SEQ ID NO: 720843 - DNA, 25 bp, Mus musculus
gtgttgtcctagtaagggtttgctt

SEQ ID NO: 720844 - DNA, 25 bp, Mus musculus
gtgttgtcctctcgcgggctggccg

SEQ ID NO: 720845 - DNA, 25 bp, Mus musculus
gtgttgtcctctggcgggctggccg

SEQ ID NO: 720846 - DNA, 25 bp, Mus musculus
gtgttgtcgccaatttgtatcagct

SEQ ID NO: 720847 - DNA, 25 bp, Mus musculus
gtgttgtcgccattttgtatcagct

SEQ ID NO: 720848 - DNA, 25 bp, Mus musculus
gtgttgtctaggcttcagctatcaa

SEQ ID NO: 720849 - DNA, 25 bp, Mus musculus
gtgttgtctagggttcagctatcaa

SEQ ID NO: 720850 - DNA, 25 bp, Mus musculus
gtgttgtctcctaacatttcttctc

SEQ ID NO: 720851 - DNA, 25 bp, Mus musculus
gtgttgtctccttacatttcttctc

SEQ ID NO: 720852 - DNA, 25 bp, Mus musculus
gtgttgtctcttagttcagcagtga

SEQ ID NO: 720853 - DNA, 25 bp, Mus musculus
gtgttgtctcttctttacgcatgac

SEQ ID NO: 720854 - DNA, 25 bp, Mus musculus
gtgttgtctcttgtttacgcatgac

SEQ ID NO: 720855 - DNA, 25 bp, Mus musculus
gtgttgtctctttgttcagcagtga

SEQ ID NO: 720856 - DNA, 25 bp, Mus musculus
gtgttgtcttctcccggaatcaaag

SEQ ID NO: 720857 - DNA, 25 bp, Mus musculus
gtgttgtcttctgccggaatcaaag

SEQ ID NO: 720858 - DNA, 25 bp, Mus musculus
gtgttgtgcagacaggtcctatgct

SEQ ID NO: 720859 - DNA, 25 bp, Mus musculus
gtgttgtgcagagaggtcctatgct

SEQ ID NO: 720860 - DNA, 25 bp, Mus musculus
gtgttgtgcaggctcacgctcagat

SEQ ID NO: 720861 - DNA, 25 bp, Mus musculus
gtgttgtgcagggtcacgctcagat

SEQ ID NO: 720862 - DNA, 25 bp, Mus musculus
gtgttgtgcattcttttgtctctgt

SEQ ID NO: 720863 - DNA, 25 bp, Mus musculus
gtgttgtgcattgttttgtctctgt

SEQ ID NO: 720864 - DNA, 25 bp, Mus musculus
gtgttgtgctcgatatcccaaagga

SEQ ID NO: 720865 - DNA, 25 bp, Mus musculus
gtgttgtgctcgttatcccaaagga

SEQ ID NO: 720866 - DNA, 25 bp, Mus musculus
gtgttgtgctgaagcctagcatgaa

SEQ ID NO: 720867 - DNA, 25 bp, Mus musculus
gtgttgtgctgatgcctagcatgaa

SEQ ID NO: 720868 - DNA, 25 bp, Mus musculus
gtgttgtggatcactcaaatcttag

SEQ ID NO: 720869 - DNA, 25 bp, Mus musculus
gtgttgtggatctctcaaatcttag

SEQ ID NO: 720870 - DNA, 25 bp, Mus musculus
gtgttgtggcttctctttctaatta

SEQ ID NO: 720871 - DNA, 25 bp, Mus musculus
gtgttgtggcttgtctttctaatta

SEQ ID NO: 720872 - DNA, 25 bp, Mus musculus
gtgttgtgtatcctggtgctattac

SEQ ID NO: 720873 - DNA, 25 bp, Mus musculus
gtgttgtgtatcgtggtgctattac

SEQ ID NO: 720874 - DNA, 25 bp, Mus musculus
gtgttgtgtgacaggttccctcaga

SEQ ID NO: 720875 - DNA, 25 bp, Mus musculus
gtgttgtgtgactggttccctcaga

SEQ ID NO: 720876 - DNA, 25 bp, Mus musculus
gtgttgtgtgtaacctgtacagcaa

SEQ ID NO: 720877 - DNA, 25 bp, Mus musculus
gtgttgtgtgtatcctgtacagcaa

SEQ ID NO: 720878 - DNA, 25 bp, Mus musculus
gtgttgttaaggatacttgtgtact

SEQ ID NO: 720879 - DNA, 25 bp, Mus musculus
gtgttgttaaggttacttgtgtact

SEQ ID NO: 720880 - DNA, 25 bp, Mus musculus
gtgttgttactacagccttctatga

SEQ ID NO: 720881 - DNA, 25 bp, Mus musculus
gtgttgttactagagccttctatga

SEQ ID NO: 720882 - DNA, 25 bp, Mus musculus
gtgttgttactcagaacccacagtt

SEQ ID NO: 720883 - DNA, 25 bp, Mus musculus
gtgttgttactctgaacccacagtt

SEQ ID NO: 720884 - DNA, 25 bp, Mus musculus
gtgttgttacttagtccaaatttct

SEQ ID NO: 720885 - DNA, 25 bp, Mus musculus
gtgttgttactttgtccaaatttct

SEQ ID NO: 720886 - DNA, 25 bp, Mus musculus
gtgttgttatctagacttgtcttcc

SEQ ID NO: 720887 - DNA, 25 bp, Mus musculus
gtgttgttatcttgacttgtcttcc

SEQ ID NO: 720888 - DNA, 25 bp, Mus musculus
gtgttgttcatgaccaagagtccaa

SEQ ID NO: 720889 - DNA, 25 bp, Mus musculus
gtgttgttcatgtccaagagtccaa

SEQ ID NO: 720890 - DNA, 25 bp, Mus musculus
gtgttgttccctctaatatcctggt

SEQ ID NO: 720891 - DNA, 25 bp, Mus musculus
gtgttgttccctgtaatatcctggt

SEQ ID NO: 720892 - DNA, 25 bp, Mus musculus
gtgttgttgactattactcacaagt

SEQ ID NO: 720893 - DNA, 25 bp, Mus musculus
gtgttgttgacttttactcacaagt

SEQ ID NO: 720894 - DNA, 25 bp, Mus musculus
gtgttgttgcctactgtctgagcta

SEQ ID NO: 720895 - DNA, 25 bp, Mus musculus
gtgttgttgccttctgtctgagcta

SEQ ID NO: 720896 - DNA, 25 bp, Mus musculus
gtgttgttggtgacttgcactgcaa

SEQ ID NO: 720897 - DNA, 25 bp, Mus musculus
gtgttgttggtgtcttgcactgcaa

SEQ ID NO: 720898 - DNA, 25 bp, Mus musculus
gtgttgtttaatcctccatcaagat

SEQ ID NO: 720899 - DNA, 25 bp, Mus musculus
gtgttgtttaatgctccatcaagat

SEQ ID NO: 720900 - DNA, 25 bp, Mus musculus
gtgttgtttagcacaacttgtggta

SEQ ID NO: 720901 - DNA, 25 bp, Mus musculus
gtgttgtttagctcaacttgtggta

SEQ ID NO: 720902 - DNA, 25 bp, Mus musculus
gtgttgtttcccaatattcttctca

SEQ ID NO: 720903 - DNA, 25 bp, Mus musculus
gtgttgtttccctatattcttctca

SEQ ID NO: 720904 - DNA, 25 bp, Mus musculus
gtgttgtttcttcccattacagcta

SEQ ID NO: 720905 - DNA, 25 bp, Mus musculus
gtgttgtttcttgccattacagcta

SEQ ID NO: 720906 - DNA, 25 bp, Mus musculus
gtgttgttttatactgtgcccacaa

SEQ ID NO: 720907 - DNA, 25 bp, Mus musculus
gtgttgttttattctgtgcccacaa

SEQ ID NO: 720908 - DNA, 25 bp, Mus musculus
gtgttgttttctagtagttgatctc

SEQ ID NO: 720909 - DNA, 25 bp, Mus musculus
gtgttgttttcttgtagttgatctc

SEQ ID NO: 720910 - DNA, 25 bp, Mus musculus
gtgttgttttgtaatcgtgtcttta

SEQ ID NO: 720911 - DNA, 25 bp, Mus musculus
gtgttgttttgtatgcttatgattt

SEQ ID NO: 720912 - DNA, 25 bp, Mus musculus
gtgttgttttgttatcgtgtcttta

SEQ ID NO: 720913 - DNA, 25 bp, Mus musculus
gtgttgttttgtttgcttatgattt

SEQ ID NO: 720914 - DNA, 25 bp, Mus musculus
gtgtttaaacttctgacaaccaaat

SEQ ID NO: 720915 - DNA, 25 bp, Mus musculus
gtgtttaaacttgtgacaaccaaat

SEQ ID NO: 720916 - DNA, 25 bp, Mus musculus
gtgtttaaaggaactggtgcccaga

SEQ ID NO: 720917 - DNA, 25 bp, Mus musculus
gtgtttaaaggatctggtgcccaga

SEQ ID NO: 720918 - DNA, 25 bp, Mus musculus
gtgtttaacactcctatttacatta

SEQ ID NO: 720919 - DNA, 25 bp, Mus musculus
gtgtttaacactgctatttacatta

SEQ ID NO: 720920 - DNA, 25 bp, Mus musculus
gtgtttaaccacaactcttctgaga

SEQ ID NO: 720921 - DNA, 25 bp, Mus musculus
gtgtttaaccactactcttctgaga

SEQ ID NO: 720922 - DNA, 25 bp, Mus musculus
gtgtttaagaccaggctttcgttca

SEQ ID NO: 720923 - DNA, 25 bp, Mus musculus
gtgtttaagacctggctttcgttca

SEQ ID NO: 720924 - DNA, 25 bp, Mus musculus
gtgtttaatcatcatacagtaggat

SEQ ID NO: 720925 - DNA, 25 bp, Mus musculus
gtgtttaatcatgatacagtaggat

SEQ ID NO: 720926 - DNA, 25 bp, Mus musculus
gtgtttaatggtcctgccatgctat

SEQ ID NO: 720927 - DNA, 25 bp, Mus musculus
gtgtttaatggtgctgccatgctat

SEQ ID NO: 720928 - DNA, 25 bp, Mus musculus
gtgtttaatgttaatggtccaatcc

SEQ ID NO: 720929 - DNA, 25 bp, Mus musculus
gtgtttaatgtttatggtccaatcc

SEQ ID NO: 720930 - DNA, 25 bp, Mus musculus
gtgtttaatttcattatccccttca

SEQ ID NO: 720931 - DNA, 25 bp, Mus musculus
gtgtttaatttctttatccccttca

SEQ ID NO: 720932 - DNA, 25 bp, Mus musculus
gtgtttacaataatagtttttgctt

SEQ ID NO: 720933 - DNA, 25 bp, Mus musculus
gtgtttacaatattagtttttgctt

SEQ ID NO: 720934 - DNA, 25 bp, Mus musculus
gtgtttacacctaactgtctctaaa

SEQ ID NO: 720935 - DNA, 25 bp, Mus musculus
gtgtttacaccttactgtctctaaa

SEQ ID NO: 720936 - DNA, 25 bp, Mus musculus
gtgtttacagttagcattttggatg

SEQ ID NO: 720937 - DNA, 25 bp, Mus musculus
gtgtttacagtttgcattttggatg

SEQ ID NO: 720938 - DNA, 25 bp, Mus musculus
gtgtttacattcattaggtcctggg

SEQ ID NO: 720939 - DNA, 25 bp, Mus musculus
gtgtttacattctttaggtcctggg

SEQ ID NO: 720940 - DNA, 25 bp, Mus musculus
gtgtttaccagacaggccttgtccc

SEQ ID NO: 720941 - DNA, 25 bp, Mus musculus
gtgtttaccagagaggccttgtccc

SEQ ID NO: 720942 - DNA, 25 bp, Mus musculus
gtgtttaccataactgcctttctta

SEQ ID NO: 720943 - DNA, 25 bp, Mus musculus
gtgtttaccatatctgcctttctta

SEQ ID NO: 720944 - DNA, 25 bp, Mus musculus
gtgtttacgtgtctttgctcacaat

SEQ ID NO: 720945 - DNA, 25 bp, Mus musculus
gtgtttacgtgtgtttgctcacaat

SEQ ID NO: 720946 - DNA, 25 bp, Mus musculus
gtgtttactaagatagcccagtggg

SEQ ID NO: 720947 - DNA, 25 bp, Mus musculus
gtgtttactaagttagcccagtggg

SEQ ID NO: 720948 - DNA, 25 bp, Mus musculus
gtgtttactcctagcatactacaga

SEQ ID NO: 720949 - DNA, 25 bp, Mus musculus
gtgtttactccttgcatactacaga

SEQ ID NO: 720950 - DNA, 25 bp, Mus musculus
gtgtttactcttcccaatacatttt

SEQ ID NO: 720951 - DNA, 25 bp, Mus musculus
gtgtttactcttgccaatacatttt

SEQ ID NO: 720952 - DNA, 25 bp, Mus musculus
gtgtttactgaaaaggactttgacc

SEQ ID NO: 720953 - DNA, 25 bp, Mus musculus
gtgtttactgaataggactttgacc

SEQ ID NO: 720954 - DNA, 25 bp, Mus musculus
gtgtttactgctatatcaccacggc

SEQ ID NO: 720955 - DNA, 25 bp, Mus musculus
gtgtttactgctctttgactttccc

SEQ ID NO: 720956 - DNA, 25 bp, Mus musculus
gtgtttactgctgtttgactttccc

SEQ ID NO: 720957 - DNA, 25 bp, Mus musculus
gtgtttactgctttatcaccacggc

SEQ ID NO: 720958 - DNA, 25 bp, Mus musculus
gtgtttactgtgagcccatcacaac

SEQ ID NO: 720959 - DNA, 25 bp, Mus musculus
gtgtttactgtgtgcccatcacaac

SEQ ID NO: 720960 - DNA, 25 bp, Mus musculus
gtgtttagattgacacccactcacc

SEQ ID NO: 720961 - DNA, 25 bp, Mus musculus
gtgtttagattgtcacccactcacc

SEQ ID NO: 720962 - DNA, 25 bp, Mus musculus
gtgtttagcaatctcttgctcttca

SEQ ID NO: 720963 - DNA, 25 bp, Mus musculus
gtgtttagcaatgtcttgctcttca

SEQ ID NO: 720964 - DNA, 25 bp, Mus musculus
gtgtttagcactacactgtgtctat

SEQ ID NO: 720965 - DNA, 25 bp, Mus musculus
gtgtttagcacttcactgtgtctat

SEQ ID NO: 720966 - DNA, 25 bp, Mus musculus
gtgtttagcagccttctctctaggg

SEQ ID NO: 720967 - DNA, 25 bp, Mus musculus
gtgtttagcagcgttctctctaggg

SEQ ID NO: 720968 - DNA, 25 bp, Mus musculus
gtgtttagccctcagcactgagccc

SEQ ID NO: 720969 - DNA, 25 bp, Mus musculus
gtgtttagccctgagcactgagccc

SEQ ID NO: 720970 - DNA, 25 bp, Mus musculus
gtgtttagccgaccgccaacctggg

SEQ ID NO: 720971 - DNA, 25 bp, Mus musculus
gtgtttagccgagcgccaacctggg

SEQ ID NO: 720972 - DNA, 25 bp, Mus musculus
gtgtttagtagcatgggcccagtac

SEQ ID NO: 720973 - DNA, 25 bp, Mus musculus
gtgtttagtagcttgggcccagtac

SEQ ID NO: 720974 - DNA, 25 bp, Mus musculus
gtgtttagtatacccaagcagatag

SEQ ID NO: 720975 - DNA, 25 bp, Mus musculus
gtgtttagtatagccaagcagatag

SEQ ID NO: 720976 - DNA, 25 bp, Mus musculus
gtgtttagtcccctggagcagatag

SEQ ID NO: 720977 - DNA, 25 bp, Mus musculus
gtgtttagtcccgtggagcagatag

SEQ ID NO: 720978 - DNA, 25 bp, Mus musculus
gtgtttagtgatcttgagctttgca

SEQ ID NO: 720979 - DNA, 25 bp, Mus musculus
gtgtttagtgatgttgagctttgca

SEQ ID NO: 720980 - DNA, 25 bp, Mus musculus
gtgtttagtgcaactgggagcatct

SEQ ID NO: 720981 - DNA, 25 bp, Mus musculus
gtgtttagtgcatctgggagcatct

SEQ ID NO: 720982 - DNA, 25 bp, Mus musculus
gtgtttagttgcactgtagtgtcca

SEQ ID NO: 720983 - DNA, 25 bp, Mus musculus
gtgtttagttgctctgtagtgtcca

SEQ ID NO: 720984 - DNA, 25 bp, Mus musculus
gtgtttataatcatggccctgtctc

SEQ ID NO: 720985 - DNA, 25 bp, Mus musculus
gtgtttataatcttggccctgtctc

SEQ ID NO: 720986 - DNA, 25 bp, Mus musculus
gtgtttatagagagccatacatttg

SEQ ID NO: 720987 - DNA, 25 bp, Mus musculus
gtgtttatagagtgccatacatttg

SEQ ID NO: 720988 - DNA, 25 bp, Mus musculus
gtgtttatatagcattggtgtcgac

SEQ ID NO: 720989 - DNA, 25 bp, Mus musculus
gtgtttatataggattggtgtcgac

SEQ ID NO: 720990 - DNA, 25 bp, Mus musculus
gtgtttatatctattactgtttaag

SEQ ID NO: 720991 - DNA, 25 bp, Mus musculus
gtgtttatatctcaccacttaggag

SEQ ID NO: 720992 - DNA, 25 bp, Mus musculus
gtgtttatatctgaccacttaggag

SEQ ID NO: 720993 - DNA, 25 bp, Mus musculus
gtgtttatatcttttactgtttaag

SEQ ID NO: 720994 - DNA, 25 bp, Mus musculus
gtgtttatatgaactgaactcctta

SEQ ID NO: 720995 - DNA, 25 bp, Mus musculus
gtgtttatatgatctgaactcctta

SEQ ID NO: 720996 - DNA, 25 bp, Mus musculus
gtgtttatcacaaagttatccacag

SEQ ID NO: 720997 - DNA, 25 bp, Mus musculus
gtgtttatcacatagttatccacag

SEQ ID NO: 720998 - DNA, 25 bp, Mus musculus
gtgtttatcagtccaactattcaag

SEQ ID NO: 720999 - DNA, 25 bp, Mus musculus
gtgtttatcagtgcaactattcaag

SEQ ID NO: 721000 - DNA, 25 bp, Mus musculus
gtgtttatccggcttgcattatcca

SEQ ID NO: 721001 - DNA, 25 bp, Mus musculus
gtgtttatccgggttgcattatcca

SEQ ID NO: 721002 - DNA, 25 bp, Mus musculus
gtgtttatcctcaagggatccctgg

SEQ ID NO: 721003 - DNA, 25 bp, Mus musculus
gtgtttatcctctagggatccctgg

SEQ ID NO: 721004 - DNA, 25 bp, Mus musculus
gtgtttatctgtctccgcactcttc

SEQ ID NO: 721005 - DNA, 25 bp, Mus musculus
gtgtttatctgtgtccgcactcttc

SEQ ID NO: 721006 - DNA, 25 bp, Mus musculus
gtgtttatctttctagaagctcctt

SEQ ID NO: 721007 - DNA, 25 bp, Mus musculus
gtgtttatctttgtagaagctcctt

SEQ ID NO: 721008 - DNA, 25 bp, Mus musculus
gtgtttatgatacactgcagccaga

SEQ ID NO: 721009 - DNA, 25 bp, Mus musculus
gtgtttatgatagactgcagccaga

SEQ ID NO: 721010 - DNA, 25 bp, Mus musculus
gtgtttatgatgaacatccacggac

SEQ ID NO: 721011 - DNA, 25 bp, Mus musculus
gtgtttatgatgtacatccacggac

SEQ ID NO: 721012 - DNA, 25 bp, Mus musculus
gtgtttatgcacaagcttttcccat

SEQ ID NO: 721013 - DNA, 25 bp, Mus musculus
gtgtttatgcactagcttttcccat

SEQ ID NO: 721014 - DNA, 25 bp, Mus musculus
gtgtttatgcccatgggagccccaa

SEQ ID NO: 721015 - DNA, 25 bp, Mus musculus
gtgtttatgcccttgggagccccaa

SEQ ID NO: 721016 - DNA, 25 bp, Mus musculus
gtgtttatgctcatttcgtgttcat

SEQ ID NO: 721017 - DNA, 25 bp, Mus musculus
gtgtttatgctcttttcgtgttcat

SEQ ID NO: 721018 - DNA, 25 bp, Mus musculus
gtgtttatggagaccttgccagcta

SEQ ID NO: 721019 - DNA, 25 bp, Mus musculus
gtgtttatggagtccttgccagcta

SEQ ID NO: 721020 - DNA, 25 bp, Mus musculus
gtgtttatgtacacacaccactttc

SEQ ID NO: 721021 - DNA, 25 bp, Mus musculus
gtgtttatgtactcacaccactttc

SEQ ID NO: 721022 - DNA, 25 bp, Mus musculus
gtgtttatgtgcaccatgccaaaag

SEQ ID NO: 721023 - DNA, 25 bp, Mus musculus
gtgtttatgtgctccatgccaaaag

SEQ ID NO: 721024 - DNA, 25 bp, Mus musculus
gtgtttatgtgtccatgacatgcct

SEQ ID NO: 721025 - DNA, 25 bp, Mus musculus
gtgtttatgtgtgcatgacatgcct

SEQ ID NO: 721026 - DNA, 25 bp, Mus musculus
gtgtttattcacaatgctctttagg

SEQ ID NO: 721027 - DNA, 25 bp, Mus musculus
gtgtttattcactatgctctttagg

SEQ ID NO: 721028 - DNA, 25 bp, Mus musculus
gtgtttattcctcactagctggttt

SEQ ID NO: 721029 - DNA, 25 bp, Mus musculus
gtgtttattcctgactagctggttt

SEQ ID NO: 721030 - DNA, 25 bp, Mus musculus
gtgtttattttaccgtcaaagcaca

SEQ ID NO: 721031 - DNA, 25 bp, Mus musculus
gtgtttattttagcgtcaaagcaca

SEQ ID NO: 721032 - DNA, 25 bp, Mus musculus
gtgtttattttcaccacagtggctg

SEQ ID NO: 721033 - DNA, 25 bp, Mus musculus
gtgtttattttctccacagtggctg

SEQ ID NO: 721034 - DNA, 25 bp, Mus musculus
gtgtttcaaagtaatggcagattca

SEQ ID NO: 721035 - DNA, 25 bp, Mus musculus
gtgtttcaaagttatggcagattca

SEQ ID NO: 721036 - DNA, 25 bp, Mus musculus
gtgtttcaacaccatgacttccaac

SEQ ID NO: 721037 - DNA, 25 bp, Mus musculus
gtgtttcaacacgatgacttccaac

SEQ ID NO: 721038 - DNA, 25 bp, Mus musculus
gtgtttcaaggtctgcagacatcaa

SEQ ID NO: 721039 - DNA, 25 bp, Mus musculus
gtgtttcaaggtgtgcagacatcaa

SEQ ID NO: 721040 - DNA, 25 bp, Mus musculus
gtgtttcacacaatagctgtgtcct

SEQ ID NO: 721041 - DNA, 25 bp, Mus musculus
gtgtttcacacattagctgtgtcct

SEQ ID NO: 721042 - DNA, 25 bp, Mus musculus
gtgtttcacagaaattaccacatca

SEQ ID NO: 721043 - DNA, 25 bp, Mus musculus
gtgtttcacagaccttcaattattt

SEQ ID NO: 721044 - DNA, 25 bp, Mus musculus
gtgtttcacagagcttcaattattt

SEQ ID NO: 721045 - DNA, 25 bp, Mus musculus
gtgtttcacagatattaccacatca

SEQ ID NO: 721046 - DNA, 25 bp, Mus musculus
gtgtttcaccagacatctcttgcta

SEQ ID NO: 721047 - DNA, 25 bp, Mus musculus
gtgtttcaccagtcatctcttgcta

SEQ ID NO: 721048 - DNA, 25 bp, Mus musculus
gtgtttcactgtataactaaaggtg

SEQ ID NO: 721049 - DNA, 25 bp, Mus musculus
gtgtttcactgtttaactaaaggtg

SEQ ID NO: 721050 - DNA, 25 bp, Mus musculus
gtgtttcagagcagcaattcctcaa

SEQ ID NO: 721051 - DNA, 25 bp, Mus musculus
gtgtttcagagctgcaattcctcaa

SEQ ID NO: 721052 - DNA, 25 bp, Mus musculus
gtgtttcagcccaagtgcagctgca

SEQ ID NO: 721053 - DNA, 25 bp, Mus musculus
gtgtttcagccctagtgcagctgca

SEQ ID NO: 721054 - DNA, 25 bp, Mus musculus
gtgtttcagcctaaacctgaagatc

SEQ ID NO: 721055 - DNA, 25 bp, Mus musculus
gtgtttcagccttaacctgaagatc

SEQ ID NO: 721056 - DNA, 25 bp, Mus musculus
gtgtttcagcttcggattacaaacc

SEQ ID NO: 721057 - DNA, 25 bp, Mus musculus
gtgtttcagcttgggattacaaacc

SEQ ID NO: 721058 - DNA, 25 bp, Mus musculus
gtgtttcaggaccttttactcccag

SEQ ID NO: 721059 - DNA, 25 bp, Mus musculus
gtgtttcaggacgttttactcccag

SEQ ID NO: 721060 - DNA, 25 bp, Mus musculus
gtgtttcagtcacggacatgagcat

SEQ ID NO: 721061 - DNA, 25 bp, Mus musculus
gtgtttcagtcagggacatgagcat

SEQ ID NO: 721062 - DNA, 25 bp, Mus musculus
gtgtttcatacaagtcaccattcat

SEQ ID NO: 721063 - DNA, 25 bp, Mus musculus
gtgtttcatacatgtcaccattcat

SEQ ID NO: 721064 - DNA, 25 bp, Mus musculus
gtgtttcatacgaatgctttgcttt

SEQ ID NO: 721065 - DNA, 25 bp, Mus musculus
gtgtttcatacgtatgctttgcttt

SEQ ID NO: 721066 - DNA, 25 bp, Mus musculus
gtgtttcatatgacccattttttcc

SEQ ID NO: 721067 - DNA, 25 bp, Mus musculus
gtgtttcatatgtcccattttttcc

SEQ ID NO: 721068 - DNA, 25 bp, Mus musculus
gtgtttcatcaaatccctttactga

SEQ ID NO: 721069 - DNA, 25 bp, Mus musculus
gtgtttcatcaattccctttactga

SEQ ID NO: 721070 - DNA, 25 bp, Mus musculus
gtgtttcatccaacgatctgcaaga

SEQ ID NO: 721071 - DNA, 25 bp, Mus musculus
gtgtttcatccatcgatctgcaaga

SEQ ID NO: 721072 - DNA, 25 bp, Mus musculus
gtgtttcatcctacttcatttaccc

SEQ ID NO: 721073 - DNA, 25 bp, Mus musculus
gtgtttcatccttcttcatttaccc

SEQ ID NO: 721074 - DNA, 25 bp, Mus musculus
gtgtttcatgctagcctaaaaaatg

SEQ ID NO: 721075 - DNA, 25 bp, Mus musculus
gtgtttcatgcttgcctaaaaaatg

SEQ ID NO: 721076 - DNA, 25 bp, Mus musculus
gtgtttcattaacccctggacagcc

SEQ ID NO: 721077 - DNA, 25 bp, Mus musculus
gtgtttcattaagccctggacagcc

SEQ ID NO: 721078 - DNA, 25 bp, Mus musculus
gtgtttccacatacatagttttact

SEQ ID NO: 721079 - DNA, 25 bp, Mus musculus
gtgtttccacatcataacaaagttc

SEQ ID NO: 721080 - DNA, 25 bp, Mus musculus
gtgtttccacatgataacaaagttc

SEQ ID NO: 721081 - DNA, 25 bp, Mus musculus
gtgtttccacattcatagttttact

SEQ ID NO: 721082 - DNA, 25 bp, Mus musculus
gtgtttccacttacaaaccttgctg

SEQ ID NO: 721083 - DNA, 25 bp, Mus musculus
gtgtttccactttcaaaccttgctg

SEQ ID NO: 721084 - DNA, 25 bp, Mus musculus
gtgtttccagagatcactgtgcagg

SEQ ID NO: 721085 - DNA, 25 bp, Mus musculus
gtgtttccagagttcactgtgcagg

SEQ ID NO: 721086 - DNA, 25 bp, Mus musculus
gtgtttccaggcatttctacagtag

SEQ ID NO: 721087 - DNA, 25 bp, Mus musculus
gtgtttccaggcttttctacagtag

SEQ ID NO: 721088 - DNA, 25 bp, Mus musculus
gtgtttccagttagtctctttaccg

SEQ ID NO: 721089 - DNA, 25 bp, Mus musculus
gtgtttccagtttgtctctttaccg

SEQ ID NO: 721090 - DNA, 25 bp, Mus musculus
gtgtttccatataaattctctagta

SEQ ID NO: 721091 - DNA, 25 bp, Mus musculus
gtgtttccatattaattctctagta

SEQ ID NO: 721092 - DNA, 25 bp, Mus musculus
gtgtttccatcccatcacagaagag

SEQ ID NO: 721093 - DNA, 25 bp, Mus musculus
gtgtttccatccgatcacagaagag

SEQ ID NO: 721094 - DNA, 25 bp, Mus musculus
gtgtttccatctagaggcactggca

SEQ ID NO: 721095 - DNA, 25 bp, Mus musculus
gtgtttccatcttgaggcactggca

SEQ ID NO: 721096 - DNA, 25 bp, Mus musculus
gtgtttcccaagatggagctgcttc

SEQ ID NO: 721097 - DNA, 25 bp, Mus musculus
gtgtttcccaagttggagctgcttc

SEQ ID NO: 721098 - DNA, 25 bp, Mus musculus
gtgtttcccaatcttttctttctga

SEQ ID NO: 721099 - DNA, 25 bp, Mus musculus
gtgtttcccaatgttttctttctga

SEQ ID NO: 721100 - DNA, 25 bp, Mus musculus
gtgtttcccagaagaacagcttagt

SEQ ID NO: 721101 - DNA, 25 bp, Mus musculus
gtgtttcccagatgaacagcttagt

SEQ ID NO: 721102 - DNA, 25 bp, Mus musculus
gtgtttcccagcaaacagatactga

SEQ ID NO: 721103 - DNA, 25 bp, Mus musculus
gtgtttcccagctaacagatactga

SEQ ID NO: 721104 - DNA, 25 bp, Mus musculus
gtgtttcccagtctgagtgaccaat

SEQ ID NO: 721105 - DNA, 25 bp, Mus musculus
gtgtttcccagtgtgagtgaccaat

SEQ ID NO: 721106 - DNA, 25 bp, Mus musculus
gtgtttcccataccacttggtggaa

SEQ ID NO: 721107 - DNA, 25 bp, Mus musculus
gtgtttcccatagcacttggtggaa

SEQ ID NO: 721108 - DNA, 25 bp, Mus musculus
gtgtttccccaacgttgtgtgcctg

SEQ ID NO: 721109 - DNA, 25 bp, Mus musculus
gtgtttccccaaggttgtgtgcctg

SEQ ID NO: 721110 - DNA, 25 bp, Mus musculus
gtgtttccccagagctcaatgagaa

SEQ ID NO: 721111 - DNA, 25 bp, Mus musculus
gtgtttccccagtgctcaatgagaa

SEQ ID NO: 721112 - DNA, 25 bp, Mus musculus
gtgtttccccttatatagcttccca

SEQ ID NO: 721113 - DNA, 25 bp, Mus musculus
gtgtttccccttttatagcttccca

SEQ ID NO: 721114 - DNA, 25 bp, Mus musculus
gtgtttcccgaactgacgtgagcag

SEQ ID NO: 721115 - DNA, 25 bp, Mus musculus
gtgtttcccgaagtgacgtgagcag

SEQ ID NO: 721116 - DNA, 25 bp, Mus musculus
gtgtttccctgaaatgactctcttc

SEQ ID NO: 721117 - DNA, 25 bp, Mus musculus
gtgtttccctgatatgactctcttc

SEQ ID NO: 721118 - DNA, 25 bp, Mus musculus
gtgtttccgggtatttgtatcatgt

SEQ ID NO: 721119 - DNA, 25 bp, Mus musculus
gtgtttccgggtttttgtatcatgt

SEQ ID NO: 721120 - DNA, 25 bp, Mus musculus
gtgtttcctagcaatgtgcttcgga

SEQ ID NO: 721121 - DNA, 25 bp, Mus musculus
gtgtttcctagctatgtgcttcgga

SEQ ID NO: 721122 - DNA, 25 bp, Mus musculus
gtgtttcctaggaaggtgctcaaaa

SEQ ID NO: 721123 - DNA, 25 bp, Mus musculus
gtgtttcctaggtaggtgctcaaaa

SEQ ID NO: 721124 - DNA, 25 bp, Mus musculus
gtgtttcctcaaactcttggctcct

SEQ ID NO: 721125 - DNA, 25 bp, Mus musculus
gtgtttcctcaatctcttggctcct

SEQ ID NO: 721126 - DNA, 25 bp, Mus musculus
gtgtttcctcccacttggtgggaga

SEQ ID NO: 721127 - DNA, 25 bp, Mus musculus
gtgtttcctcccagcagagattgcg

SEQ ID NO: 721128 - DNA, 25 bp, Mus musculus
gtgtttcctccctcttggtgggaga

SEQ ID NO: 721129 - DNA, 25 bp, Mus musculus
gtgtttcctccctgcagagattgcg

SEQ ID NO: 721130 - DNA, 25 bp, Mus musculus
gtgtttcctcctaatttgagacaac

SEQ ID NO: 721131 - DNA, 25 bp, Mus musculus
gtgtttcctccttatttgagacaac

SEQ ID NO: 721132 - DNA, 25 bp, Mus musculus
gtgtttcctcggattccagcagttt

SEQ ID NO: 721133 - DNA, 25 bp, Mus musculus
gtgtttcctcggtttccagcagttt

SEQ ID NO: 721134 - DNA, 25 bp, Mus musculus
gtgtttcctgtcatgtaaaaccagc

SEQ ID NO: 721135 - DNA, 25 bp, Mus musculus
gtgtttcctgtcttgtaaaaccagc

SEQ ID NO: 721136 - DNA, 25 bp, Mus musculus
gtgtttccttaaagcggttctattt

SEQ ID NO: 721137 - DNA, 25 bp, Mus musculus
gtgtttccttaatgcggttctattt

SEQ ID NO: 721138 - DNA, 25 bp, Mus musculus
gtgtttccttgtaaagatttatata

SEQ ID NO: 721139 - DNA, 25 bp, Mus musculus
gtgtttccttgtagtagctttgaga

SEQ ID NO: 721140 - DNA, 25 bp, Mus musculus
gtgtttccttgttaagatttatata

SEQ ID NO: 721141 - DNA, 25 bp, Mus musculus
gtgtttccttgttgtagctttgaga

SEQ ID NO: 721142 - DNA, 25 bp, Mus musculus
gtgtttcgacgacgatgtcaatgac

SEQ ID NO: 721143 - DNA, 25 bp, Mus musculus
gtgtttcgacgaggatgtcaatgac

SEQ ID NO: 721144 - DNA, 25 bp, Mus musculus
gtgtttcggatgatcttcaagcttt

SEQ ID NO: 721145 - DNA, 25 bp, Mus musculus
gtgtttcggatgttcttcaagcttt

SEQ ID NO: 721146 - DNA, 25 bp, Mus musculus
gtgtttcgttttactgtctgtacta

SEQ ID NO: 721147 - DNA, 25 bp, Mus musculus
gtgtttcgtttttctgtctgtacta

SEQ ID NO: 721148 - DNA, 25 bp, Mus musculus
gtgtttctaaaaagcatcttgccaa

SEQ ID NO: 721149 - DNA, 25 bp, Mus musculus
gtgtttctaaaatgcatcttgccaa

SEQ ID NO: 721150 - DNA, 25 bp, Mus musculus
gtgtttctaaagagcaccacttttt

SEQ ID NO: 721151 - DNA, 25 bp, Mus musculus
gtgtttctaaagtgcaccacttttt

SEQ ID NO: 721152 - DNA, 25 bp, Mus musculus
gtgtttctaacaagctctctgcata

SEQ ID NO: 721153 - DNA, 25 bp, Mus musculus
gtgtttctaacatgctctctgcata

SEQ ID NO: 721154 - DNA, 25 bp, Mus musculus
gtgtttctaactctgacctgagagc

SEQ ID NO: 721155 - DNA, 25 bp, Mus musculus
gtgtttctaactgtgacctgagagc

SEQ ID NO: 721156 - DNA, 25 bp, Mus musculus
gtgtttctacatctgtctcttcatt

SEQ ID NO: 721157 - DNA, 25 bp, Mus musculus
gtgtttctacatgtgtctcttcatt

SEQ ID NO: 721158 - DNA, 25 bp, Mus musculus
gtgtttctactaagctatacttgat

SEQ ID NO: 721159 - DNA, 25 bp, Mus musculus
gtgtttctactatgctatacttgat

SEQ ID NO: 721160 - DNA, 25 bp, Mus musculus
gtgtttctactcaaatccaagctgc

SEQ ID NO: 721161 - DNA, 25 bp, Mus musculus
gtgtttctactctaatccaagctgc

SEQ ID NO: 721162 - DNA, 25 bp, Mus musculus
gtgtttctataaaccctctattaga

SEQ ID NO: 721163 - DNA, 25 bp, Mus musculus
gtgtttctataatccctctattaga

SEQ ID NO: 721164 - DNA, 25 bp, Mus musculus
gtgtttctatccagtttcagtaccc

SEQ ID NO: 721165 - DNA, 25 bp, Mus musculus
gtgtttctatcctgtttcagtaccc

SEQ ID NO: 721166 - DNA, 25 bp, Mus musculus
gtgtttctatcgacttctttttaag

SEQ ID NO: 721167 - DNA, 25 bp, Mus musculus
gtgtttctatcgtcttctttttaag

SEQ ID NO: 721168 - DNA, 25 bp, Mus musculus
gtgtttctattgacgtggttaagct

SEQ ID NO: 721169 - DNA, 25 bp, Mus musculus
gtgtttctattgtcgtggttaagct

SEQ ID NO: 721170 - DNA, 25 bp, Mus musculus
gtgtttctcagacccatgcaatagg

SEQ ID NO: 721171 - DNA, 25 bp, Mus musculus
gtgtttctcagagccatgcaatagg

SEQ ID NO: 721172 - DNA, 25 bp, Mus musculus
gtgtttctcagtcgtcacaagcaat

SEQ ID NO: 721173 - DNA, 25 bp, Mus musculus
gtgtttctcagtggtcacaagcaat

SEQ ID NO: 721174 - DNA, 25 bp, Mus musculus
gtgtttctccgacggacttttgaag

SEQ ID NO: 721175 - DNA, 25 bp, Mus musculus
gtgtttctccgagggacttttgaag

SEQ ID NO: 721176 - DNA, 25 bp, Mus musculus
gtgtttctctcaacctgaccagtga

SEQ ID NO: 721177 - DNA, 25 bp, Mus musculus
gtgtttctctcatcctgaccagtga

SEQ ID NO: 721178 - DNA, 25 bp, Mus musculus
gtgtttctctgacaagggactgcaa

SEQ ID NO: 721179 - DNA, 25 bp, Mus musculus
gtgtttctctgagaagggactgcaa

SEQ ID NO: 721180 - DNA, 25 bp, Mus musculus
gtgtttctctgtatatggacccgga

SEQ ID NO: 721181 - DNA, 25 bp, Mus musculus
gtgtttctctgtttatggacccgga

SEQ ID NO: 721182 - DNA, 25 bp, Mus musculus
gtgtttctctttaatgtagcgcctt

SEQ ID NO: 721183 - DNA, 25 bp, Mus musculus
gtgtttctctttcttcatgcctgaa

SEQ ID NO: 721184 - DNA, 25 bp, Mus musculus
gtgtttctctttgttcatgcctgaa

SEQ ID NO: 721185 - DNA, 25 bp, Mus musculus
gtgtttctcttttatgtagcgcctt

SEQ ID NO: 721186 - DNA, 25 bp, Mus musculus
gtgtttctgattactgacctccagc

SEQ ID NO: 721187 - DNA, 25 bp, Mus musculus
gtgtttctgatttctgacctccagc

SEQ ID NO: 721188 - DNA, 25 bp, Mus musculus
gtgtttctggctctgctctagtgac

SEQ ID NO: 721189 - DNA, 25 bp, Mus musculus
gtgtttctggctgtgctctagtgac

SEQ ID NO: 721190 - DNA, 25 bp, Mus musculus
gtgtttctgggaactcaagggctgt

SEQ ID NO: 721191 - DNA, 25 bp, Mus musculus
gtgtttctgggatctcaagggctgt

SEQ ID NO: 721192 - DNA, 25 bp, Mus musculus
gtgtttctgtaacctgatggacatg

SEQ ID NO: 721193 - DNA, 25 bp, Mus musculus
gtgtttctgtaagctgatggacatg

SEQ ID NO: 721194 - DNA, 25 bp, Mus musculus
gtgtttctgtcaatactgtaggtac

SEQ ID NO: 721195 - DNA, 25 bp, Mus musculus
gtgtttctgtcattactgtaggtac

SEQ ID NO: 721196 - DNA, 25 bp, Mus musculus
gtgtttctgtgaccctggtgtgact

SEQ ID NO: 721197 - DNA, 25 bp, Mus musculus
gtgtttctgtgacctgtcattgtgg

SEQ ID NO: 721198 - DNA, 25 bp, Mus musculus
gtgtttctgtgagcctggtgtgact

SEQ ID NO: 721199 - DNA, 25 bp, Mus musculus
gtgtttctgtgagctgtcattgtgg

SEQ ID NO: 721200 - DNA, 25 bp, Mus musculus
gtgtttcttaacaatctctcttttg

SEQ ID NO: 721201 - DNA, 25 bp, Mus musculus
gtgtttcttaactatctctcttttg

SEQ ID NO: 721202 - DNA, 25 bp, Mus musculus
gtgtttcttagccttttgggatgct

SEQ ID NO: 721203 - DNA, 25 bp, Mus musculus
gtgtttcttagcgttttgggatgct

SEQ ID NO: 721204 - DNA, 25 bp, Mus musculus
gtgtttcttcacacgggcatgactg

SEQ ID NO: 721205 - DNA, 25 bp, Mus musculus
gtgtttcttcactcgggcatgactg

SEQ ID NO: 721206 - DNA, 25 bp, Mus musculus
gtgtttcttcatagcttccttgatt

SEQ ID NO: 721207 - DNA, 25 bp, Mus musculus
gtgtttcttcattgcttccttgatt

SEQ ID NO: 721208 - DNA, 25 bp, Mus musculus
gtgtttcttctcaatacatcggtgc

SEQ ID NO: 721209 - DNA, 25 bp, Mus musculus
gtgtttcttctctatacatcggtgc

SEQ ID NO: 721210 - DNA, 25 bp, Mus musculus
gtgtttcttgagcaggtagcttttt

SEQ ID NO: 721211 - DNA, 25 bp, Mus musculus
gtgtttcttgaggaggtagcttttt

SEQ ID NO: 721212 - DNA, 25 bp, Mus musculus
gtgtttctttccacacgtgcagaga

SEQ ID NO: 721213 - DNA, 25 bp, Mus musculus
gtgtttctttcctcacgtgcagaga

SEQ ID NO: 721214 - DNA, 25 bp, Mus musculus
gtgtttctttggacatgttacctaa

SEQ ID NO: 721215 - DNA, 25 bp, Mus musculus
gtgtttctttggtcatgttacctaa

SEQ ID NO: 721216 - DNA, 25 bp, Mus musculus
gtgtttctttgtatcctatacctaa

SEQ ID NO: 721217 - DNA, 25 bp, Mus musculus
gtgtttctttgtttcctatacctaa

SEQ ID NO: 721218 - DNA, 25 bp, Mus musculus
gtgtttcttttcatggcttatttat

SEQ ID NO: 721219 - DNA, 25 bp, Mus musculus
gtgtttcttttcttggcttatttat

SEQ ID NO: 721220 - DNA, 25 bp, Mus musculus
gtgtttctttttctactgcaagcac

SEQ ID NO: 721221 - DNA, 25 bp, Mus musculus
gtgtttctttttgtactgcaagcac

SEQ ID NO: 721222 - DNA, 25 bp, Mus musculus
gtgtttgaaaaactgatccttctgt

SEQ ID NO: 721223 - DNA, 25 bp, Mus musculus
gtgtttgaaaaagtgatccttctgt

SEQ ID NO: 721224 - DNA, 25 bp, Mus musculus
gtgtttgaaacactaactaccatat

SEQ ID NO: 721225 - DNA, 25 bp, Mus musculus
gtgtttgaaacagtaactaccatat

SEQ ID NO: 721226 - DNA, 25 bp, Mus musculus
gtgtttgaactcaaattgcaggcag

SEQ ID NO: 721227 - DNA, 25 bp, Mus musculus
gtgtttgaactctaattgcaggcag

SEQ ID NO: 721228 - DNA, 25 bp, Mus musculus
gtgtttgaactgacccagtggcatg

SEQ ID NO: 721229 - DNA, 25 bp, Mus musculus
gtgtttgaactgtcccagtggcatg

SEQ ID NO: 721230 - DNA, 25 bp, Mus musculus
gtgtttgaacttatctgaccattaa

SEQ ID NO: 721231 - DNA, 25 bp, Mus musculus
gtgtttgaacttttctgaccattaa

SEQ ID NO: 721232 - DNA, 25 bp, Mus musculus
gtgtttgaagagcagtgatccgtct

SEQ ID NO: 721233 - DNA, 25 bp, Mus musculus
gtgtttgaagaggagtgatccgtct

SEQ ID NO: 721234 - DNA, 25 bp, Mus musculus
gtgtttgaagcaaagaacgtctctt

SEQ ID NO: 721235 - DNA, 25 bp, Mus musculus
gtgtttgaagcatagaacgtctctt

SEQ ID NO: 721236 - DNA, 25 bp, Mus musculus
gtgtttgaatgtaatccttgcacaa

SEQ ID NO: 721237 - DNA, 25 bp, Mus musculus
gtgtttgaatgtagcctgtaccagt

SEQ ID NO: 721238 - DNA, 25 bp, Mus musculus
gtgtttgaatgttatccttgcacaa

SEQ ID NO: 721239 - DNA, 25 bp, Mus musculus
gtgtttgaatgttgcctgtaccagt

SEQ ID NO: 721240 - DNA, 25 bp, Mus musculus
gtgtttgaccacctggattgggcaa

SEQ ID NO: 721241 - DNA, 25 bp, Mus musculus
gtgtttgaccacgtggattgggcaa

SEQ ID NO: 721242 - DNA, 25 bp, Mus musculus
gtgtttgactacagtgagtactggg

SEQ ID NO: 721243 - DNA, 25 bp, Mus musculus
gtgtttgactactgtgagtactggg

SEQ ID NO: 721244 - DNA, 25 bp, Mus musculus
gtgtttgactctagtctcatgttca

SEQ ID NO: 721245 - DNA, 25 bp, Mus musculus
gtgtttgactcttgtctcatgttca

SEQ ID NO: 721246 - DNA, 25 bp, Mus musculus
gtgtttgactgcaaggattgtaatt

SEQ ID NO: 721247 - DNA, 25 bp, Mus musculus
gtgtttgactgctaggattgtaatt

SEQ ID NO: 721248 - DNA, 25 bp, Mus musculus
gtgtttgactttatccaacttgtat

SEQ ID NO: 721249 - DNA, 25 bp, Mus musculus
gtgtttgactttttccaacttgtat

SEQ ID NO: 721250 - DNA, 25 bp, Mus musculus
gtgtttgagaagacacccctgcgtg

SEQ ID NO: 721251 - DNA, 25 bp, Mus musculus
gtgtttgagaagtcacccctgcgtg

SEQ ID NO: 721252 - DNA, 25 bp, Mus musculus
gtgtttgagaatactgcaccctgca

SEQ ID NO: 721253 - DNA, 25 bp, Mus musculus
gtgtttgagaattctgcaccctgca

SEQ ID NO: 721254 - DNA, 25 bp, Mus musculus
gtgtttgagataacctgagtccatt

SEQ ID NO: 721255 - DNA, 25 bp, Mus musculus
gtgtttgagatatcctgagtccatt

SEQ ID NO: 721256 - DNA, 25 bp, Mus musculus
gtgtttgagccaccagaacctgatg

SEQ ID NO: 721257 - DNA, 25 bp, Mus musculus
gtgtttgagccagcagaacctgatg

SEQ ID NO: 721258 - DNA, 25 bp, Mus musculus
gtgtttgagcccctaaaggagccag

SEQ ID NO: 721259 - DNA, 25 bp, Mus musculus
gtgtttgagcccgtaaaggagccag

SEQ ID NO: 721260 - DNA, 25 bp, Mus musculus
gtgtttgaggacattgcccggctcc

SEQ ID NO: 721261 - DNA, 25 bp, Mus musculus
gtgtttgaggactttgcccggctcc

SEQ ID NO: 721262 - DNA, 25 bp, Mus musculus
gtgtttgaggctctgtctgccctgc

SEQ ID NO: 721263 - DNA, 25 bp, Mus musculus
gtgtttgaggctgtgtctgccctgc

SEQ ID NO: 721264 - DNA, 25 bp, Mus musculus
gtgtttgagtgtctcttttgaagca

SEQ ID NO: 721265 - DNA, 25 bp, Mus musculus
gtgtttgagtgtgtcttttgaagca

SEQ ID NO: 721266 - DNA, 25 bp, Mus musculus
gtgtttgagttcactgaaccgaaac

SEQ ID NO: 721267 - DNA, 25 bp, Mus musculus
gtgtttgagttctctgaaccgaaac

SEQ ID NO: 721268 - DNA, 25 bp, Mus musculus
gtgtttgagtttctttgcagttccc

SEQ ID NO: 721269 - DNA, 25 bp, Mus musculus
gtgtttgagtttgtttgcagttccc

SEQ ID NO: 721270 - DNA, 25 bp, Mus musculus
gtgtttgatcagcaagtcaggagtc

SEQ ID NO: 721271 - DNA, 25 bp, Mus musculus
gtgtttgatcaggaagtcaggagtc

SEQ ID NO: 721272 - DNA, 25 bp, Mus musculus
gtgtttgatccaccggagaccatct

SEQ ID NO: 721273 - DNA, 25 bp, Mus musculus
gtgtttgatccagcggagaccatct

SEQ ID NO: 721274 - DNA, 25 bp, Mus musculus
gtgtttgatctcaacaactctgcta

SEQ ID NO: 721275 - DNA, 25 bp, Mus musculus
gtgtttgatctctacaactctgcta

SEQ ID NO: 721276 - DNA, 25 bp, Mus musculus
gtgtttgatctgattggtctagcat

SEQ ID NO: 721277 - DNA, 25 bp, Mus musculus
gtgtttgatctgcaagaggctgtca

SEQ ID NO: 721278 - DNA, 25 bp, Mus musculus
gtgtttgatctggaagaggctgtca

SEQ ID NO: 721279 - DNA, 25 bp, Mus musculus
gtgtttgatctgtttggtctagcat

SEQ ID NO: 721280 - DNA, 25 bp, Mus musculus
gtgtttgatgtgatccagtttgcta

SEQ ID NO: 721281 - DNA, 25 bp, Mus musculus
gtgtttgatgtgttccagtttgcta

SEQ ID NO: 721282 - DNA, 25 bp, Mus musculus
gtgtttgattatctacctttcaatc

SEQ ID NO: 721283 - DNA, 25 bp, Mus musculus
gtgtttgattatgtacctttcaatc

SEQ ID NO: 721284 - DNA, 25 bp, Mus musculus
gtgtttgcaaatcattaccgcgagg

SEQ ID NO: 721285 - DNA, 25 bp, Mus musculus
gtgtttgcaaatgattaccgcgagg

SEQ ID NO: 721286 - DNA, 25 bp, Mus musculus
gtgtttgcacacactggtagctatg

SEQ ID NO: 721287 - DNA, 25 bp, Mus musculus
gtgtttgcacactctggtagctatg

SEQ ID NO: 721288 - DNA, 25 bp, Mus musculus
gtgtttgcacagctttaactttgtc

SEQ ID NO: 721289 - DNA, 25 bp, Mus musculus
gtgtttgcacaggtttaactttgtc

SEQ ID NO: 721290 - DNA, 25 bp, Mus musculus
gtgtttgcacttagtaatgatacct

SEQ ID NO: 721291 - DNA, 25 bp, Mus musculus
gtgtttgcacttcagggagagccct

SEQ ID NO: 721292 - DNA, 25 bp, Mus musculus
gtgtttgcacttgagggagagccct

SEQ ID NO: 721293 - DNA, 25 bp, Mus musculus
gtgtttgcactttgtaatgatacct

SEQ ID NO: 721294 - DNA, 25 bp, Mus musculus
gtgtttgcataacttctctttcttt

SEQ ID NO: 721295 - DNA, 25 bp, Mus musculus
gtgtttgcataagttctctttcttt

SEQ ID NO: 721296 - DNA, 25 bp, Mus musculus
gtgtttgcatatatgattgttctaa

SEQ ID NO: 721297 - DNA, 25 bp, Mus musculus
gtgtttgcatatcgctggcctcaga

SEQ ID NO: 721298 - DNA, 25 bp, Mus musculus
gtgtttgcatatggctggcctcaga

SEQ ID NO: 721299 - DNA, 25 bp, Mus musculus
gtgtttgcatatttgattgttctaa

SEQ ID NO: 721300 - DNA, 25 bp, Mus musculus
gtgtttgcattcatggtcagatcta

SEQ ID NO: 721301 - DNA, 25 bp, Mus musculus
gtgtttgcattcttggtcagatcta

SEQ ID NO: 721302 - DNA, 25 bp, Mus musculus
gtgtttgcatttccataacaagcac

SEQ ID NO: 721303 - DNA, 25 bp, Mus musculus
gtgtttgcatttgcataacaagcac

SEQ ID NO: 721304 - DNA, 25 bp, Mus musculus
gtgtttgccaagagtcgccgggtac

SEQ ID NO: 721305 - DNA, 25 bp, Mus musculus
gtgtttgccaagtgtcgccgggtac

SEQ ID NO: 721306 - DNA, 25 bp, Mus musculus
gtgtttgccaatcctccagactcag

SEQ ID NO: 721307 - DNA, 25 bp, Mus musculus
gtgtttgccaatgctccagactcag

SEQ ID NO: 721308 - DNA, 25 bp, Mus musculus
gtgtttgccaggcttaaacgcttgc

SEQ ID NO: 721309 - DNA, 25 bp, Mus musculus
gtgtttgccagggttaaacgcttgc

SEQ ID NO: 721310 - DNA, 25 bp, Mus musculus
gtgtttgccatccttgatcacttgg

SEQ ID NO: 721311 - DNA, 25 bp, Mus musculus
gtgtttgccatcgttgatcacttgg

SEQ ID NO: 721312 - DNA, 25 bp, Mus musculus
gtgtttgcctacctggtcactctga

SEQ ID NO: 721313 - DNA, 25 bp, Mus musculus
gtgtttgcctacgtggtcactctga

SEQ ID NO: 721314 - DNA, 25 bp, Mus musculus
gtgtttgcctggatagcatgcacaa

SEQ ID NO: 721315 - DNA, 25 bp, Mus musculus
gtgtttgcctggttagcatgcacaa

SEQ ID NO: 721316 - DNA, 25 bp, Mus musculus
gtgtttgcctttcctgacctaaaat

SEQ ID NO: 721317 - DNA, 25 bp, Mus musculus
gtgtttgcctttgctgacctaaaat

SEQ ID NO: 721318 - DNA, 25 bp, Mus musculus
gtgtttgcgactcaccaatagccca

SEQ ID NO: 721319 - DNA, 25 bp, Mus musculus
gtgtttgcgactgaccaatagccca

SEQ ID NO: 721320 - DNA, 25 bp, Mus musculus
gtgtttgctaacatcatgggtaatc

SEQ ID NO: 721321 - DNA, 25 bp, Mus musculus
gtgtttgctaacttcatgggtaatc

SEQ ID NO: 721322 - DNA, 25 bp, Mus musculus
gtgtttgctacccaagtatgaggac

SEQ ID NO: 721323 - DNA, 25 bp, Mus musculus
gtgtttgctaccgaagtatgaggac

SEQ ID NO: 721324 - DNA, 25 bp, Mus musculus
gtgtttgctattctctgtgctactt

SEQ ID NO: 721325 - DNA, 25 bp, Mus musculus
gtgtttgctattgtctgtgctactt

SEQ ID NO: 721326 - DNA, 25 bp, Mus musculus
gtgtttgctcaccaaaccagttaca

SEQ ID NO: 721327 - DNA, 25 bp, Mus musculus
gtgtttgctcacgaaaccagttaca

SEQ ID NO: 721328 - DNA, 25 bp, Mus musculus
gtgtttgctcgaaccgggccagagc

SEQ ID NO: 721329 - DNA, 25 bp, Mus musculus
gtgtttgctcgatccgggccagagc

SEQ ID NO: 721330 - DNA, 25 bp, Mus musculus
gtgtttgctcttcatcactacaagc

SEQ ID NO: 721331 - DNA, 25 bp, Mus musculus
gtgtttgctcttgatcactacaagc

SEQ ID NO: 721332 - DNA, 25 bp, Mus musculus
gtgtttgctgagagcctaagtgata

SEQ ID NO: 721333 - DNA, 25 bp, Mus musculus
gtgtttgctgagtgcctaagtgata

SEQ ID NO: 721334 - DNA, 25 bp, Mus musculus
gtgtttgctgcacctgacagtcaga

SEQ ID NO: 721335 - DNA, 25 bp, Mus musculus
gtgtttgctgcagctgacagtcaga

SEQ ID NO: 721336 - DNA, 25 bp, Mus musculus
gtgtttgctgcgactatgtgccctt

SEQ ID NO: 721337 - DNA, 25 bp, Mus musculus
gtgtttgctgcgtctatgtgccctt

SEQ ID NO: 721338 - DNA, 25 bp, Mus musculus
gtgtttgctggaaaatggcctggaa

SEQ ID NO: 721339 - DNA, 25 bp, Mus musculus
gtgtttgctggataatggcctggaa

SEQ ID NO: 721340 - DNA, 25 bp, Mus musculus
gtgtttgctgtcaagagttagctca

SEQ ID NO: 721341 - DNA, 25 bp, Mus musculus
gtgtttgctgtctagagttagctca

SEQ ID NO: 721342 - DNA, 25 bp, Mus musculus
gtgtttgctgttatcagtttctcct

SEQ ID NO: 721343 - DNA, 25 bp, Mus musculus
gtgtttgctgttttcagtttctcct

SEQ ID NO: 721344 - DNA, 25 bp, Mus musculus
gtgtttgctttacaactccctgtag

SEQ ID NO: 721345 - DNA, 25 bp, Mus musculus
gtgtttgctttagaactccctgtag

SEQ ID NO: 721346 - DNA, 25 bp, Mus musculus
gtgtttgctttcacacacgtgagcg

SEQ ID NO: 721347 - DNA, 25 bp, Mus musculus
gtgtttgctttctcacacgtgagcg

SEQ ID NO: 721348 - DNA, 25 bp, Mus musculus
gtgtttgcttttcactttcgttagt

SEQ ID NO: 721349 - DNA, 25 bp, Mus musculus
gtgtttgcttttgactttcgttagt

SEQ ID NO: 721350 - DNA, 25 bp, Mus musculus
gtgtttggaacaacactgactgatt

SEQ ID NO: 721351 - DNA, 25 bp, Mus musculus
gtgtttggaacacacgttccctgct

SEQ ID NO: 721352 - DNA, 25 bp, Mus musculus
gtgtttggaacagacgttccctgct

SEQ ID NO: 721353 - DNA, 25 bp, Mus musculus
gtgtttggaacatcactgactgatt

SEQ ID NO: 721354 - DNA, 25 bp, Mus musculus
gtgtttggcaccacagggatgctgc

SEQ ID NO: 721355 - DNA, 25 bp, Mus musculus
gtgtttggcacctcagggatgctgc

SEQ ID NO: 721356 - DNA, 25 bp, Mus musculus
gtgtttggcagtaacctgctttgtt

SEQ ID NO: 721357 - DNA, 25 bp, Mus musculus
gtgtttggcagttacctgctttgtt

SEQ ID NO: 721358 - DNA, 25 bp, Mus musculus
gtgtttggcatacaaatactactgt

SEQ ID NO: 721359 - DNA, 25 bp, Mus musculus
gtgtttggcatagaaatactactgt

SEQ ID NO: 721360 - DNA, 25 bp, Mus musculus
gtgtttggcctactgtagcctttaa

SEQ ID NO: 721361 - DNA, 25 bp, Mus musculus
gtgtttggcctagtgtagcctttaa

SEQ ID NO: 721362 - DNA, 25 bp, Mus musculus
gtgtttggcgacagtactattcaat

SEQ ID NO: 721363 - DNA, 25 bp, Mus musculus
gtgtttggcgactgtactattcaat

SEQ ID NO: 721364 - DNA, 25 bp, Mus musculus
gtgtttggctttctgtttcatatgg

SEQ ID NO: 721365 - DNA, 25 bp, Mus musculus
gtgtttggctttgtgtttcatatgg

SEQ ID NO: 721366 - DNA, 25 bp, Mus musculus
gtgtttgggatacatttaccctgaa

SEQ ID NO: 721367 - DNA, 25 bp, Mus musculus
gtgtttgggatagatttaccctgaa

SEQ ID NO: 721368 - DNA, 25 bp, Mus musculus
gtgtttgggccaaagccacattttt

SEQ ID NO: 721369 - DNA, 25 bp, Mus musculus
gtgtttgggccatagccacattttt

SEQ ID NO: 721370 - DNA, 25 bp, Mus musculus
gtgtttgggcttacacctggcaaag

SEQ ID NO: 721371 - DNA, 25 bp, Mus musculus
gtgtttgggctttcacctggcaaag

SEQ ID NO: 721372 - DNA, 25 bp, Mus musculus
gtgtttggtctgcacagatgcctta

SEQ ID NO: 721373 - DNA, 25 bp, Mus musculus
gtgtttggtctggacagatgcctta

SEQ ID NO: 721374 - DNA, 25 bp, Mus musculus
gtgtttggttgcacatcacaggact

SEQ ID NO: 721375 - DNA, 25 bp, Mus musculus
gtgtttggttgctcatcacaggact

SEQ ID NO: 721376 - DNA, 25 bp, Mus musculus
gtgtttgtaaatactctggcttcct

SEQ ID NO: 721377 - DNA, 25 bp, Mus musculus
gtgtttgtaaatcgagaccctctta

SEQ ID NO: 721378 - DNA, 25 bp, Mus musculus
gtgtttgtaaatggagaccctctta

SEQ ID NO: 721379 - DNA, 25 bp, Mus musculus
gtgtttgtaaattctctggcttcct

SEQ ID NO: 721380 - DNA, 25 bp, Mus musculus
gtgtttgtaaccctttgtctctgga

SEQ ID NO: 721381 - DNA, 25 bp, Mus musculus
gtgtttgtaaccgtttgtctctgga

SEQ ID NO: 721382 - DNA, 25 bp, Mus musculus
gtgtttgtaagacgcatctgcccac

SEQ ID NO: 721383 - DNA, 25 bp, Mus musculus
gtgtttgtaagaggcatctgcccac

SEQ ID NO: 721384 - DNA, 25 bp, Mus musculus
gtgtttgtacatcagcacagttgtg

SEQ ID NO: 721385 - DNA, 25 bp, Mus musculus
gtgtttgtacatctctgtgacccca

SEQ ID NO: 721386 - DNA, 25 bp, Mus musculus
gtgtttgtacatgagcacagttgtg

SEQ ID NO: 721387 - DNA, 25 bp, Mus musculus
gtgtttgtacatgtctgtgacccca

SEQ ID NO: 721388 - DNA, 25 bp, Mus musculus
gtgtttgtaccgattgtgatttgcg

SEQ ID NO: 721389 - DNA, 25 bp, Mus musculus
gtgtttgtaccgtttgtgatttgcg

SEQ ID NO: 721390 - DNA, 25 bp, Mus musculus
gtgtttgtacttctgtagagtgaaa

SEQ ID NO: 721391 - DNA, 25 bp, Mus musculus
gtgtttgtacttgtgtagagtgaaa

SEQ ID NO: 721392 - DNA, 25 bp, Mus musculus
gtgtttgtaggtcacaaagcccagt

SEQ ID NO: 721393 - DNA, 25 bp, Mus musculus
gtgtttgtaggtcactgaacagaca

SEQ ID NO: 721394 - DNA, 25 bp, Mus musculus
gtgtttgtaggtgacaaagcccagt

SEQ ID NO: 721395 - DNA, 25 bp, Mus musculus
gtgtttgtaggtgactgaacagaca

SEQ ID NO: 721396 - DNA, 25 bp, Mus musculus
gtgtttgtcaagatctatgccccat

SEQ ID NO: 721397 - DNA, 25 bp, Mus musculus
gtgtttgtcaagttctatgccccat

SEQ ID NO: 721398 - DNA, 25 bp, Mus musculus
gtgtttgtcacaaatcaacctactg

SEQ ID NO: 721399 - DNA, 25 bp, Mus musculus
gtgtttgtcacatatcaacctactg

SEQ ID NO: 721400 - DNA, 25 bp, Mus musculus
gtgtttgtcagcaaagatgtggcca

SEQ ID NO: 721401 - DNA, 25 bp, Mus musculus
gtgtttgtcagctaagatgtggcca

SEQ ID NO: 721402 - DNA, 25 bp, Mus musculus
gtgtttgtcattagcctgactagag

SEQ ID NO: 721403 - DNA, 25 bp, Mus musculus
gtgtttgtcatttgcctgactagag

SEQ ID NO: 721404 - DNA, 25 bp, Mus musculus
gtgtttgtccagaacatttcttaaa

SEQ ID NO: 721405 - DNA, 25 bp, Mus musculus
gtgtttgtccagaactcacagagtt

SEQ ID NO: 721406 - DNA, 25 bp, Mus musculus
gtgtttgtccagtacatttcttaaa

SEQ ID NO: 721407 - DNA, 25 bp, Mus musculus
gtgtttgtccagtactcacagagtt

SEQ ID NO: 721408 - DNA, 25 bp, Mus musculus
gtgtttgtcctgattctgctctgag

SEQ ID NO: 721409 - DNA, 25 bp, Mus musculus
gtgtttgtcctgtttctgctctgag

SEQ ID NO: 721410 - DNA, 25 bp, Mus musculus
gtgtttgtcgctagcctttgaaaat

SEQ ID NO: 721411 - DNA, 25 bp, Mus musculus
gtgtttgtcgcttgcctttgaaaat

SEQ ID NO: 721412 - DNA, 25 bp, Mus musculus
gtgtttgtctctcctcggtgacacc

SEQ ID NO: 721413 - DNA, 25 bp, Mus musculus
gtgtttgtctctgctcggtgacacc

SEQ ID NO: 721414 - DNA, 25 bp, Mus musculus
gtgtttgtctgtctagagattcctt

SEQ ID NO: 721415 - DNA, 25 bp, Mus musculus
gtgtttgtctgtgtagagattcctt

SEQ ID NO: 721416 - DNA, 25 bp, Mus musculus
gtgtttgtgaaacccatttgtgagt

SEQ ID NO: 721417 - DNA, 25 bp, Mus musculus
gtgtttgtgaaagccatttgtgagt

SEQ ID NO: 721418 - DNA, 25 bp, Mus musculus
gtgtttgtgaacatccaaatcgatc

SEQ ID NO: 721419 - DNA, 25 bp, Mus musculus
gtgtttgtgaacttccaaatcgatc

SEQ ID NO: 721420 - DNA, 25 bp, Mus musculus
gtgtttgtgactactacagcaatca

SEQ ID NO: 721421 - DNA, 25 bp, Mus musculus
gtgtttgtgacttctacagcaatca

SEQ ID NO: 721422 - DNA, 25 bp, Mus musculus
gtgtttgtgctaacagatgaccaga

SEQ ID NO: 721423 - DNA, 25 bp, Mus musculus
gtgtttgtgctatcagatgaccaga

SEQ ID NO: 721424 - DNA, 25 bp, Mus musculus
gtgtttgtgctgactgtgtctcata

SEQ ID NO: 721425 - DNA, 25 bp, Mus musculus
gtgtttgtgctgtctgtgtctcata

SEQ ID NO: 721426 - DNA, 25 bp, Mus musculus
gtgtttgtggttctctcttgaacat

SEQ ID NO: 721427 - DNA, 25 bp, Mus musculus
gtgtttgtggttgtctcttgaacat

SEQ ID NO: 721428 - DNA, 25 bp, Mus musculus
gtgtttgtgtgtcattatcgctatt

SEQ ID NO: 721429 - DNA, 25 bp, Mus musculus
gtgtttgtgtgtgattatcgctatt

SEQ ID NO: 721430 - DNA, 25 bp, Mus musculus
gtgtttgtgttcaggttttctgtaa

SEQ ID NO: 721431 - DNA, 25 bp, Mus musculus
gtgtttgtgttctggttttctgtaa

SEQ ID NO: 721432 - DNA, 25 bp, Mus musculus
gtgtttgtgtttatactgcttgtta

SEQ ID NO: 721433 - DNA, 25 bp, Mus musculus
gtgtttgtgtttttactgcttgtta

SEQ ID NO: 721434 - DNA, 25 bp, Mus musculus
gtgtttgttacccagtcatctgaag

SEQ ID NO: 721435 - DNA, 25 bp, Mus musculus
gtgtttgttaccgagtcatctgaag

SEQ ID NO: 721436 - DNA, 25 bp, Mus musculus
gtgtttgttcatatgggctattaag

SEQ ID NO: 721437 - DNA, 25 bp, Mus musculus
gtgtttgttcatttgggctattaag

SEQ ID NO: 721438 - DNA, 25 bp, Mus musculus
gtgtttgttgcaactcactacataa

SEQ ID NO: 721439 - DNA, 25 bp, Mus musculus
gtgtttgttgcatctcactacataa

SEQ ID NO: 721440 - DNA, 25 bp, Mus musculus
gtgtttgtttgacagcctacagcct

SEQ ID NO: 721441 - DNA, 25 bp, Mus musculus
gtgtttgtttgagagcctacagcct

SEQ ID NO: 721442 - DNA, 25 bp, Mus musculus
gtgtttgttttgatcatattcggtc

SEQ ID NO: 721443 - DNA, 25 bp, Mus musculus
gtgtttgttttgttcatattcggtc

SEQ ID NO: 721444 - DNA, 25 bp, Mus musculus
gtgttttaaaacctagtgaaccatg

SEQ ID NO: 721445 - DNA, 25 bp, Mus musculus
gtgttttaaaacgtagtgaaccatg

SEQ ID NO: 721446 - DNA, 25 bp, Mus musculus
gtgttttaatgacacttcctaggaa

SEQ ID NO: 721447 - DNA, 25 bp, Mus musculus
gtgttttaatgaccaggcttgcctg

SEQ ID NO: 721448 - DNA, 25 bp, Mus musculus
gtgttttaatgagacttcctaggaa

SEQ ID NO: 721449 - DNA, 25 bp, Mus musculus
gtgttttaatgagcaggcttgcctg

SEQ ID NO: 721450 - DNA, 25 bp, Mus musculus
gtgttttaattcctctggataccag

SEQ ID NO: 721451 - DNA, 25 bp, Mus musculus
gtgttttaattcgtctggataccag

SEQ ID NO: 721452 - DNA, 25 bp, Mus musculus
gtgttttacagtctatgcattttaa

SEQ ID NO: 721453 - DNA, 25 bp, Mus musculus
gtgttttacagtgtatgcattttaa

SEQ ID NO: 721454 - DNA, 25 bp, Mus musculus
gtgttttaccataggacatagactg

SEQ ID NO: 721455 - DNA, 25 bp, Mus musculus
gtgttttaccattggacatagactg

SEQ ID NO: 721456 - DNA, 25 bp, Mus musculus
gtgttttacctacaaaagcagtctt

SEQ ID NO: 721457 - DNA, 25 bp, Mus musculus
gtgttttacctagaaaagcagtctt

SEQ ID NO: 721458 - DNA, 25 bp, Mus musculus
gtgttttactcacgtcttggtgcaa

SEQ ID NO: 721459 - DNA, 25 bp, Mus musculus
gtgttttactcaggtcttggtgcaa

SEQ ID NO: 721460 - DNA, 25 bp, Mus musculus
gtgttttactccacttttcatacaa

SEQ ID NO: 721461 - DNA, 25 bp, Mus musculus
gtgttttactcctcttttcatacaa

SEQ ID NO: 721462 - DNA, 25 bp, Mus musculus
gtgttttactcgaggtgtgtattac

SEQ ID NO: 721463 - DNA, 25 bp, Mus musculus
gtgttttactcgtggtgtgtattac

SEQ ID NO: 721464 - DNA, 25 bp, Mus musculus
gtgttttactgtcctgtactgctaa

SEQ ID NO: 721465 - DNA, 25 bp, Mus musculus
gtgttttactgtgctgtactgctaa

SEQ ID NO: 721466 - DNA, 25 bp, Mus musculus
gtgttttagaacaattgagcttttg

SEQ ID NO: 721467 - DNA, 25 bp, Mus musculus
gtgttttagaactattgagcttttg

SEQ ID NO: 721468 - DNA, 25 bp, Mus musculus
gtgttttagaagatctgccattaag

SEQ ID NO: 721469 - DNA, 25 bp, Mus musculus
gtgttttagaagttctgccattaag

SEQ ID NO: 721470 - DNA, 25 bp, Mus musculus
gtgttttagaccacagggatttatt

SEQ ID NO: 721471 - DNA, 25 bp, Mus musculus
gtgttttagacctcagggatttatt

SEQ ID NO: 721472 - DNA, 25 bp, Mus musculus
gtgttttagattcatttccctgttt

SEQ ID NO: 721473 - DNA, 25 bp, Mus musculus
gtgttttagattgatttccctgttt

SEQ ID NO: 721474 - DNA, 25 bp, Mus musculus
gtgttttagcttcacacacttgtta

SEQ ID NO: 721475 - DNA, 25 bp, Mus musculus
gtgttttagcttcatgacaccctcg

SEQ ID NO: 721476 - DNA, 25 bp, Mus musculus
gtgttttagcttgacacacttgtta

SEQ ID NO: 721477 - DNA, 25 bp, Mus musculus
gtgttttagcttgatgacaccctcg

SEQ ID NO: 721478 - DNA, 25 bp, Mus musculus
gtgttttataccatcctacccacag

SEQ ID NO: 721479 - DNA, 25 bp, Mus musculus
gtgttttataccttcctacccacag

SEQ ID NO: 721480 - DNA, 25 bp, Mus musculus
gtgttttatcctatttcactatagt

SEQ ID NO: 721481 - DNA, 25 bp, Mus musculus
gtgttttatcctttttcactatagt

SEQ ID NO: 721482 - DNA, 25 bp, Mus musculus
gtgttttatgcacatattcgtggtt

SEQ ID NO: 721483 - DNA, 25 bp, Mus musculus
gtgttttatgcagatattcgtggtt

SEQ ID NO: 721484 - DNA, 25 bp, Mus musculus
gtgttttatgtactgcgattgtttg

SEQ ID NO: 721485 - DNA, 25 bp, Mus musculus
gtgttttatgtagtgcgattgtttg

SEQ ID NO: 721486 - DNA, 25 bp, Mus musculus
gtgttttatgtgactggccttgcct

SEQ ID NO: 721487 - DNA, 25 bp, Mus musculus
gtgttttatgtgtctggccttgcct

SEQ ID NO: 721488 - DNA, 25 bp, Mus musculus
gtgttttatgttcatgcattagtaa

SEQ ID NO: 721489 - DNA, 25 bp, Mus musculus
gtgttttatgttgatgcattagtaa

SEQ ID NO: 721490 - DNA, 25 bp, Mus musculus
gtgttttattcactccaagtgtggc

SEQ ID NO: 721491 - DNA, 25 bp, Mus musculus
gtgttttattcagtccaagtgtggc

SEQ ID NO: 721492 - DNA, 25 bp, Mus musculus
gtgttttattccatcagattttcta

SEQ ID NO: 721493 - DNA, 25 bp, Mus musculus
gtgttttattccttcagattttcta

SEQ ID NO: 721494 - DNA, 25 bp, Mus musculus
gtgttttcaaacattcctttcgaat

SEQ ID NO: 721495 - DNA, 25 bp, Mus musculus
gtgttttcaaactttcctttcgaat

SEQ ID NO: 721496 - DNA, 25 bp, Mus musculus
gtgttttcacaactacatcatagag

SEQ ID NO: 721497 - DNA, 25 bp, Mus musculus
gtgttttcacaagtacatcatagag

SEQ ID NO: 721498 - DNA, 25 bp, Mus musculus
gtgttttcaccaacactgaccaggt

SEQ ID NO: 721499 - DNA, 25 bp, Mus musculus
gtgttttcaccatcactgaccaggt

SEQ ID NO: 721500 - DNA, 25 bp, Mus musculus
gtgttttcactcactcataaactca

SEQ ID NO: 721501 - DNA, 25 bp, Mus musculus
gtgttttcactctctcataaactca

SEQ ID NO: 721502 - DNA, 25 bp, Mus musculus
gtgttttcactgcattttatctctc

SEQ ID NO: 721503 - DNA, 25 bp, Mus musculus
gtgttttcactggattttatctctc

SEQ ID NO: 721504 - DNA, 25 bp, Mus musculus
gtgttttcagaaatccctaagatta

SEQ ID NO: 721505 - DNA, 25 bp, Mus musculus
gtgttttcagaattccctaagatta

SEQ ID NO: 721506 - DNA, 25 bp, Mus musculus
gtgttttcagacaactcagactcct

SEQ ID NO: 721507 - DNA, 25 bp, Mus musculus
gtgttttcagactactcagactcct

SEQ ID NO: 721508 - DNA, 25 bp, Mus musculus
gtgttttcaggcagcagtatgctta

SEQ ID NO: 721509 - DNA, 25 bp, Mus musculus
gtgttttcaggctgcagtatgctta

SEQ ID NO: 721510 - DNA, 25 bp, Mus musculus
gtgttttcagtacgcatcggtggta

SEQ ID NO: 721511 - DNA, 25 bp, Mus musculus
gtgttttcagtaggcatcggtggta

SEQ ID NO: 721512 - DNA, 25 bp, Mus musculus
gtgttttcagtcagtggcagtcctc

SEQ ID NO: 721513 - DNA, 25 bp, Mus musculus
gtgttttcagtctgtggcagtcctc

SEQ ID NO: 721514 - DNA, 25 bp, Mus musculus
gtgttttcatctactgctgggcgcc

SEQ ID NO: 721515 - DNA, 25 bp, Mus musculus
gtgttttcatcttctgctgggcgcc

SEQ ID NO: 721516 - DNA, 25 bp, Mus musculus
gtgttttcatggacttctcttctgc

SEQ ID NO: 721517 - DNA, 25 bp, Mus musculus
gtgttttcatggtcttctcttctgc

SEQ ID NO: 721518 - DNA, 25 bp, Mus musculus
gtgttttcatgtagcttctttgcca

SEQ ID NO: 721519 - DNA, 25 bp, Mus musculus
gtgttttcatgttgcttctttgcca

SEQ ID NO: 721520 - DNA, 25 bp, Mus musculus
gtgttttcattcacgccatagcaat

SEQ ID NO: 721521 - DNA, 25 bp, Mus musculus
gtgttttcattcctccagggtatat

SEQ ID NO: 721522 - DNA, 25 bp, Mus musculus
gtgttttcattcgtccagggtatat

SEQ ID NO: 721523 - DNA, 25 bp, Mus musculus
gtgttttcattctcgccatagcaat

SEQ ID NO: 721524 - DNA, 25 bp, Mus musculus
gtgttttcattgctcatctgggcat

SEQ ID NO: 721525 - DNA, 25 bp, Mus musculus
gtgttttcattggtcatctgggcat

SEQ ID NO: 721526 - DNA, 25 bp, Mus musculus
gtgttttccaagcagctcctgtccc

SEQ ID NO: 721527 - DNA, 25 bp, Mus musculus
gtgttttccaaggagctcctgtccc

SEQ ID NO: 721528 - DNA, 25 bp, Mus musculus
gtgttttccagtactgtctgactca

SEQ ID NO: 721529 - DNA, 25 bp, Mus musculus
gtgttttccagttctgtctgactca

SEQ ID NO: 721530 - DNA, 25 bp, Mus musculus
gtgttttcctctatgatctcgggat

SEQ ID NO: 721531 - DNA, 25 bp, Mus musculus
gtgttttcctctttgatctcgggat

SEQ ID NO: 721532 - DNA, 25 bp, Mus musculus
gtgttttcctttctgtgcactcact

SEQ ID NO: 721533 - DNA, 25 bp, Mus musculus
gtgttttcctttgtgtgcactcact

SEQ ID NO: 721534 - DNA, 25 bp, Mus musculus
gtgttttctagacctccctattata

SEQ ID NO: 721535 - DNA, 25 bp, Mus musculus
gtgttttctagagctccctattata

SEQ ID NO: 721536 - DNA, 25 bp, Mus musculus
gtgttttctataataggcgtgattg

SEQ ID NO: 721537 - DNA, 25 bp, Mus musculus
gtgttttctataccagaaaccctca

SEQ ID NO: 721538 - DNA, 25 bp, Mus musculus
gtgttttctatagcagaaaccctca

SEQ ID NO: 721539 - DNA, 25 bp, Mus musculus
gtgttttctatattaggcgtgattg

SEQ ID NO: 721540 - DNA, 25 bp, Mus musculus
gtgttttctatcagaccttccaaag

SEQ ID NO: 721541 - DNA, 25 bp, Mus musculus
gtgttttctatctgaccttccaaag

SEQ ID NO: 721542 - DNA, 25 bp, Mus musculus
gtgttttctatgatagccttactct

SEQ ID NO: 721543 - DNA, 25 bp, Mus musculus
gtgttttctatgcactatgtggtag

SEQ ID NO: 721544 - DNA, 25 bp, Mus musculus
gtgttttctatggactatgtggtag

SEQ ID NO: 721545 - DNA, 25 bp, Mus musculus
gtgttttctatgttagccttactct

SEQ ID NO: 721546 - DNA, 25 bp, Mus musculus
gtgttttctcaaataagttcagagc

SEQ ID NO: 721547 - DNA, 25 bp, Mus musculus
gtgttttctcaattaagttcagagc

SEQ ID NO: 721548 - DNA, 25 bp, Mus musculus
gtgttttctcacatcagtttgagta

SEQ ID NO: 721549 - DNA, 25 bp, Mus musculus
gtgttttctcacttcagtttgagta

SEQ ID NO: 721550 - DNA, 25 bp, Mus musculus
gtgttttctgaacgcgccttgaagg

SEQ ID NO: 721551 - DNA, 25 bp, Mus musculus
gtgttttctgaaggcgccttgaagg

SEQ ID NO: 721552 - DNA, 25 bp, Mus musculus
gtgttttctgacatcttgacttaca

SEQ ID NO: 721553 - DNA, 25 bp, Mus musculus
gtgttttctgacttcttgacttaca

SEQ ID NO: 721554 - DNA, 25 bp, Mus musculus
gtgttttctgagcacagttagcata

SEQ ID NO: 721555 - DNA, 25 bp, Mus musculus
gtgttttctgaggacagttagcata

SEQ ID NO: 721556 - DNA, 25 bp, Mus musculus
gtgttttctgtgcactgtctccttg

SEQ ID NO: 721557 - DNA, 25 bp, Mus musculus
gtgttttctgtggactgtctccttg

SEQ ID NO: 721558 - DNA, 25 bp, Mus musculus
gtgttttcttagacattcttgcgta

SEQ ID NO: 721559 - DNA, 25 bp, Mus musculus
gtgttttcttagtcattcttgcgta

SEQ ID NO: 721560 - DNA, 25 bp, Mus musculus
gtgttttcttgaagtttctcccatt

SEQ ID NO: 721561 - DNA, 25 bp, Mus musculus
gtgttttcttgatgtttctcccatt

SEQ ID NO: 721562 - DNA, 25 bp, Mus musculus
gtgttttgaattatcgctgggtcta

SEQ ID NO: 721563 - DNA, 25 bp, Mus musculus
gtgttttgaattttcgctgggtcta

SEQ ID NO: 721564 - DNA, 25 bp, Mus musculus
gtgttttgactgaatcctgatttgt

SEQ ID NO: 721565 - DNA, 25 bp, Mus musculus
gtgttttgactgtatcctgatttgt

SEQ ID NO: 721566 - DNA, 25 bp, Mus musculus
gtgttttgagcaagcactttaggtc

SEQ ID NO: 721567 - DNA, 25 bp, Mus musculus
gtgttttgagcatgcactttaggtc

SEQ ID NO: 721568 - DNA, 25 bp, Mus musculus
gtgttttgagccacagaaggttttg

SEQ ID NO: 721569 - DNA, 25 bp, Mus musculus
gtgttttgagcctcagaaggttttg

SEQ ID NO: 721570 - DNA, 25 bp, Mus musculus
gtgttttgaggcagactttatttaa

SEQ ID NO: 721571 - DNA, 25 bp, Mus musculus
gtgttttgaggctgactttatttaa

SEQ ID NO: 721572 - DNA, 25 bp, Mus musculus
gtgttttgcaaacgcatgatgttca

SEQ ID NO: 721573 - DNA, 25 bp, Mus musculus
gtgttttgcaaaggcatgatgttca

SEQ ID NO: 721574 - DNA, 25 bp, Mus musculus
gtgttttgcacaccatactccatct

SEQ ID NO: 721575 - DNA, 25 bp, Mus musculus
gtgttttgcacagcatactccatct

SEQ ID NO: 721576 - DNA, 25 bp, Mus musculus
gtgttttgctatcctttttactgta

SEQ ID NO: 721577 - DNA, 25 bp, Mus musculus
gtgttttgctatgctttttactgta

SEQ ID NO: 721578 - DNA, 25 bp, Mus musculus
gtgttttgctctaggaaatgcgtgc

SEQ ID NO: 721579 - DNA, 25 bp, Mus musculus
gtgttttgctcttggaaatgcgtgc

SEQ ID NO: 721580 - DNA, 25 bp, Mus musculus
gtgttttgcttaactgagacaggat

SEQ ID NO: 721581 - DNA, 25 bp, Mus musculus
gtgttttgcttatctgagacaggat

SEQ ID NO: 721582 - DNA, 25 bp, Mus musculus
gtgttttggaacattaattgtgaga

SEQ ID NO: 721583 - DNA, 25 bp, Mus musculus
gtgttttggaactttaattgtgaga

SEQ ID NO: 721584 - DNA, 25 bp, Mus musculus
gtgttttggacacataccattcccc

SEQ ID NO: 721585 - DNA, 25 bp, Mus musculus
gtgttttggacagataccattcccc

SEQ ID NO: 721586 - DNA, 25 bp, Mus musculus
gtgttttggcggaatgtatctcaga

SEQ ID NO: 721587 - DNA, 25 bp, Mus musculus
gtgttttggcggtatgtatctcaga

SEQ ID NO: 721588 - DNA, 25 bp, Mus musculus
gtgttttgggatctatagcatgtaa

SEQ ID NO: 721589 - DNA, 25 bp, Mus musculus
gtgttttgggatgtatagcatgtaa

SEQ ID NO: 721590 - DNA, 25 bp, Mus musculus
gtgttttgtagtctcctgctagtaa

SEQ ID NO: 721591 - DNA, 25 bp, Mus musculus
gtgttttgtagtgtcctgctagtaa

SEQ ID NO: 721592 - DNA, 25 bp, Mus musculus
gtgttttgtattactgcgaagatat

SEQ ID NO: 721593 - DNA, 25 bp, Mus musculus
gtgttttgtatttctgcgaagatat

SEQ ID NO: 721594 - DNA, 25 bp, Mus musculus
gtgttttgtccaaggtcacctggca

SEQ ID NO: 721595 - DNA, 25 bp, Mus musculus
gtgttttgtccatggtcacctggca

SEQ ID NO: 721596 - DNA, 25 bp, Mus musculus
gtgttttgtgaacctgcacttcaaa

SEQ ID NO: 721597 - DNA, 25 bp, Mus musculus
gtgttttgtgaagctgcacttcaaa

SEQ ID NO: 721598 - DNA, 25 bp, Mus musculus
gtgttttgtggccatcacactcatg

SEQ ID NO: 721599 - DNA, 25 bp, Mus musculus
gtgttttgtggcgatcacactcatg

SEQ ID NO: 721600 - DNA, 25 bp, Mus musculus
gtgttttgtggtctttatcctgtat

SEQ ID NO: 721601 - DNA, 25 bp, Mus musculus
gtgttttgtggtgtttatcctgtat

SEQ ID NO: 721602 - DNA, 25 bp, Mus musculus
gtgttttgtgtgataaactgctaat

SEQ ID NO: 721603 - DNA, 25 bp, Mus musculus
gtgttttgtgtgttaaactgctaat

SEQ ID NO: 721604 - DNA, 25 bp, Mus musculus
gtgttttgtgttactctaaggcctt

SEQ ID NO: 721605 - DNA, 25 bp, Mus musculus
gtgttttgtgtttctctaaggcctt

SEQ ID NO: 721606 - DNA, 25 bp, Mus musculus
gtgttttgttccagttcatcttaag

SEQ ID NO: 721607 - DNA, 25 bp, Mus musculus
gtgttttgttcctgttcatcttaag

SEQ ID NO: 721608 - DNA, 25 bp, Mus musculus
gtgttttgtttacctctttgagaaa

SEQ ID NO: 721609 - DNA, 25 bp, Mus musculus
gtgttttgtttagctctttgagaaa

SEQ ID NO: 721610 - DNA, 25 bp, Mus musculus
gtgttttgtttcaaatacgctgtca

SEQ ID NO: 721611 - DNA, 25 bp, Mus musculus
gtgttttgtttcaagcagctatgtt

SEQ ID NO: 721612 - DNA, 25 bp, Mus musculus
gtgttttgtttctaatacgctgtca

SEQ ID NO: 721613 - DNA, 25 bp, Mus musculus
gtgttttgtttctagcagctatgtt

SEQ ID NO: 721614 - DNA, 25 bp, Mus musculus
gtgtttttacaacctgcataaccag

SEQ ID NO: 721615 - DNA, 25 bp, Mus musculus
gtgtttttacaagctgcataaccag

SEQ ID NO: 721616 - DNA, 25 bp, Mus musculus
gtgtttttactaagtctcagccctt

SEQ ID NO: 721617 - DNA, 25 bp, Mus musculus
gtgtttttactatgtctcagccctt

SEQ ID NO: 721618 - DNA, 25 bp, Mus musculus
gtgtttttactgcttttgcgataca

SEQ ID NO: 721619 - DNA, 25 bp, Mus musculus
gtgtttttactggttttgcgataca

SEQ ID NO: 721620 - DNA, 25 bp, Mus musculus
gtgtttttacttactcatggcaaga

SEQ ID NO: 721621 - DNA, 25 bp, Mus musculus
gtgtttttactttctcatggcaaga

SEQ ID NO: 721622 - DNA, 25 bp, Mus musculus
gtgtttttatctctgtttacttaca

SEQ ID NO: 721623 - DNA, 25 bp, Mus musculus
gtgtttttatctgtgtttacttaca

SEQ ID NO: 721624 - DNA, 25 bp, Mus musculus
gtgtttttattgagcctttcacaag

SEQ ID NO: 721625 - DNA, 25 bp, Mus musculus
gtgtttttattgtgcctttcacaag

SEQ ID NO: 721626 - DNA, 25 bp, Mus musculus
gtgtttttcaaactcagtgacaagg

SEQ ID NO: 721627 - DNA, 25 bp, Mus musculus
gtgtttttcaaagtcagtgacaagg

SEQ ID NO: 721628 - DNA, 25 bp, Mus musculus
gtgtttttcacacctgccaatggaa

SEQ ID NO: 721629 - DNA, 25 bp, Mus musculus
gtgtttttcacagctgccaatggaa

SEQ ID NO: 721630 - DNA, 25 bp, Mus musculus
gtgtttttcatgctgcagtctgtga

SEQ ID NO: 721631 - DNA, 25 bp, Mus musculus
gtgtttttcatggtgcagtctgtga

SEQ ID NO: 721632 - DNA, 25 bp, Mus musculus
gtgtttttccacctcaatatacctc

SEQ ID NO: 721633 - DNA, 25 bp, Mus musculus
gtgtttttccacgtcaatatacctc

SEQ ID NO: 721634 - DNA, 25 bp, Mus musculus
gtgtttttcccaccactatgtgact

SEQ ID NO: 721635 - DNA, 25 bp, Mus musculus
gtgtttttcccacttctctagcctc

SEQ ID NO: 721636 - DNA, 25 bp, Mus musculus
gtgtttttcccagcactatgtgact

SEQ ID NO: 721637 - DNA, 25 bp, Mus musculus
gtgtttttcccagttctctagcctc

SEQ ID NO: 721638 - DNA, 25 bp, Mus musculus
gtgtttttccctaatagacgcagag

SEQ ID NO: 721639 - DNA, 25 bp, Mus musculus
gtgtttttcccttatagacgcagag

SEQ ID NO: 721640 - DNA, 25 bp, Mus musculus
gtgtttttcctaagacaactagcag

SEQ ID NO: 721641 - DNA, 25 bp, Mus musculus
gtgtttttcctatgacaactagcag

SEQ ID NO: 721642 - DNA, 25 bp, Mus musculus
gtgtttttcctcactaattaattgt

SEQ ID NO: 721643 - DNA, 25 bp, Mus musculus
gtgtttttcctctctaattaattgt

SEQ ID NO: 721644 - DNA, 25 bp, Mus musculus
gtgtttttcctgcacacgtatctgt

SEQ ID NO: 721645 - DNA, 25 bp, Mus musculus
gtgtttttcctggacacgtatctgt

SEQ ID NO: 721646 - DNA, 25 bp, Mus musculus
gtgtttttcgacaacgtattctgaa

SEQ ID NO: 721647 - DNA, 25 bp, Mus musculus
gtgtttttcgactacgtattctgaa

SEQ ID NO: 721648 - DNA, 25 bp, Mus musculus
gtgtttttctcgatttgtcctggat

SEQ ID NO: 721649 - DNA, 25 bp, Mus musculus
gtgtttttctcgttttgtcctggat

SEQ ID NO: 721650 - DNA, 25 bp, Mus musculus
gtgtttttggttatttgggcaccat

SEQ ID NO: 721651 - DNA, 25 bp, Mus musculus
gtgtttttggttttttgggcaccat

SEQ ID NO: 721652 - DNA, 25 bp, Mus musculus
gtgtttttgtaactttcaaggcagt

SEQ ID NO: 721653 - DNA, 25 bp, Mus musculus
gtgtttttgtaagtttcaaggcagt

SEQ ID NO: 721654 - DNA, 25 bp, Mus musculus
gtgttttttcagaaacctctgagac

SEQ ID NO: 721655 - DNA, 25 bp, Mus musculus
gtgttttttcagtaacctctgagac

SEQ ID NO: 721656 - DNA, 25 bp, Mus musculus
gtgttttttctccagtagcattcag

SEQ ID NO: 721657 - DNA, 25 bp, Mus musculus
gtgttttttctcgagtagcattcag

SEQ ID NO: 721658 - DNA, 25 bp, Mus musculus
gtgttttttcttaccttgtagtctg

SEQ ID NO: 721659 - DNA, 25 bp, Mus musculus
gtgttttttcttcagaccaggcatc

SEQ ID NO: 721660 - DNA, 25 bp, Mus musculus
gtgttttttcttgagaccaggcatc

SEQ ID NO: 721661 - DNA, 25 bp, Mus musculus
gtgttttttctttccttgtagtctg

SEQ ID NO: 721662 - DNA, 25 bp, Mus musculus
gtgttttttgaaatgccttccgtag

SEQ ID NO: 721663 - DNA, 25 bp, Mus musculus
gtgttttttgaattgccttccgtag

SEQ ID NO: 721664 - DNA, 25 bp, Mus musculus
gttaaaaaccacaccaggcactcag

SEQ ID NO: 721665 - DNA, 25 bp, Mus musculus
gttaaaaaccactccaggcactcag

SEQ ID NO: 721666 - DNA, 25 bp, Mus musculus
gttaaaaactacctgaggagccact

SEQ ID NO: 721667 - DNA, 25 bp, Mus musculus
gttaaaaactacgtgaggagccact

SEQ ID NO: 721668 - DNA, 25 bp, Mus musculus
gttaaaaagagcaccaccgggctgg

SEQ ID NO: 721669 - DNA, 25 bp, Mus musculus
gttaaaaagagctccaccgggctgg

SEQ ID NO: 721670 - DNA, 25 bp, Mus musculus
gttaaaaagcatccactgaccgagg

SEQ ID NO: 721671 - DNA, 25 bp, Mus musculus
gttaaaaagcatgcactgaccgagg

SEQ ID NO: 721672 - DNA, 25 bp, Mus musculus
gttaaaaatcgcatcgcacatcctc

SEQ ID NO: 721673 - DNA, 25 bp, Mus musculus
gttaaaaatcgcttcgcacatcctc

SEQ ID NO: 721674 - DNA, 25 bp, Mus musculus
gttaaaaatcttacttcatctcctg

SEQ ID NO: 721675 - DNA, 25 bp, Mus musculus
gttaaaaatctttcttcatctcctg

SEQ ID NO: 721676 - DNA, 25 bp, Mus musculus
gttaaaacactcagtatccctggaa

SEQ ID NO: 721677 - DNA, 25 bp, Mus musculus
gttaaaacactctgtatccctggaa

SEQ ID NO: 721678 - DNA, 25 bp, Mus musculus
gttaaaaccaacattcatcagcaag

SEQ ID NO: 721679 - DNA, 25 bp, Mus musculus
gttaaaaccaactttcatcagcaag

SEQ ID NO: 721680 - DNA, 25 bp, Mus musculus
gttaaaaccagtatttcactcattg

SEQ ID NO: 721681 - DNA, 25 bp, Mus musculus
gttaaaaccagtttttcactcattg

SEQ ID NO: 721682 - DNA, 25 bp, Mus musculus
gttaaaacctgaaggtgtgccttaa

SEQ ID NO: 721683 - DNA, 25 bp, Mus musculus
gttaaaacctgatggtgtgccttaa

SEQ ID NO: 721684 - DNA, 25 bp, Mus musculus
gttaaaactcttctcacttatccat

SEQ ID NO: 721685 - DNA, 25 bp, Mus musculus
gttaaaactcttgtcacttatccat

SEQ ID NO: 721686 - DNA, 25 bp, Mus musculus
gttaaaactggaattcctgttctct

SEQ ID NO: 721687 - DNA, 25 bp, Mus musculus
gttaaaactggatttcctgttctct

SEQ ID NO: 721688 - DNA, 25 bp, Mus musculus
gttaaaacttacatgcctcggaatc

SEQ ID NO: 721689 - DNA, 25 bp, Mus musculus
gttaaaacttacttgcctcggaatc

SEQ ID NO: 721690 - DNA, 25 bp, Mus musculus
gttaaaagactgaccttgttcatgg

SEQ ID NO: 721691 - DNA, 25 bp, Mus musculus
gttaaaagactgtccttgttcatgg

SEQ ID NO: 721692 - DNA, 25 bp, Mus musculus
gttaaaagctatcacttcttccaga

SEQ ID NO: 721693 - DNA, 25 bp, Mus musculus
gttaaaagctatgacttcttccaga

SEQ ID NO: 721694 - DNA, 25 bp, Mus musculus
gttaaaagtacacatgctggatcaa

SEQ ID NO: 721695 - DNA, 25 bp, Mus musculus
gttaaaagtacagatgctggatcaa

SEQ ID NO: 721696 - DNA, 25 bp, Mus musculus
gttaaaatatccatctgcccaacag

SEQ ID NO: 721697 - DNA, 25 bp, Mus musculus
gttaaaatatccttctgcccaacag

SEQ ID NO: 721698 - DNA, 25 bp, Mus musculus
gttaaaatccgcaatcccaactctt

SEQ ID NO: 721699 - DNA, 25 bp, Mus musculus
gttaaaatccgctatcccaactctt

SEQ ID NO: 721700 - DNA, 25 bp, Mus musculus
gttaaaatctagaattcctgcacaa

SEQ ID NO: 721701 - DNA, 25 bp, Mus musculus
gttaaaatctagtattcctgcacaa

SEQ ID NO: 721702 - DNA, 25 bp, Mus musculus
gttaaacacaataagcggtcatcca

SEQ ID NO: 721703 - DNA, 25 bp, Mus musculus
gttaaacacaattagcggtcatcca

SEQ ID NO: 721704 - DNA, 25 bp, Mus musculus
gttaaacagacaaagcccctctttt

SEQ ID NO: 721705 - DNA, 25 bp, Mus musculus
gttaaacagacatagcccctctttt

SEQ ID NO: 721706 - DNA, 25 bp, Mus musculus
gttaaacatagcagcttcggccaca

SEQ ID NO: 721707 - DNA, 25 bp, Mus musculus
gttaaacatagctgcttcggccaca

SEQ ID NO: 721708 - DNA, 25 bp, Mus musculus
gttaaacataggctctggcacttat

SEQ ID NO: 721709 - DNA, 25 bp, Mus musculus
gttaaacatagggtctggcacttat

SEQ ID NO: 721710 - DNA, 25 bp, Mus musculus
gttaaacatgtaagatccttgccag

SEQ ID NO: 721711 - DNA, 25 bp, Mus musculus
gttaaacatgtatgatccttgccag

SEQ ID NO: 721712 - DNA, 25 bp, Mus musculus
gttaaaccagccaggcagccagagt

SEQ ID NO: 721713 - DNA, 25 bp, Mus musculus
gttaaaccagcctggcagccagagt

SEQ ID NO: 721714 - DNA, 25 bp, Mus musculus
gttaaaccagctattgagacttact

SEQ ID NO: 721715 - DNA, 25 bp, Mus musculus
gttaaaccagcttttgagacttact

SEQ ID NO: 721716 - DNA, 25 bp, Mus musculus
gttaaaccagtgatgttttcatatt

SEQ ID NO: 721717 - DNA, 25 bp, Mus musculus
gttaaaccagtgttgttttcatatt

SEQ ID NO: 721718 - DNA, 25 bp, Mus musculus
gttaaacccttaacagagaagtgtc

SEQ ID NO: 721719 - DNA, 25 bp, Mus musculus
gttaaacccttatcagagaagtgtc

SEQ ID NO: 721720 - DNA, 25 bp, Mus musculus
gttaaacctgagaaccatagtcttt

SEQ ID NO: 721721 - DNA, 25 bp, Mus musculus
gttaaacctgagtaccatagtcttt

SEQ ID NO: 721722 - DNA, 25 bp, Mus musculus
gttaaacctgcaacatagtgtttgc

SEQ ID NO: 721723 - DNA, 25 bp, Mus musculus
gttaaacctgcatcatagtgtttgc

SEQ ID NO: 721724 - DNA, 25 bp, Mus musculus
gttaaacgctttaacaccttggcat

SEQ ID NO: 721725 - DNA, 25 bp, Mus musculus
gttaaacgcttttacaccttggcat

SEQ ID NO: 721726 - DNA, 25 bp, Mus musculus
gttaaacgtatgatccatttggcag

SEQ ID NO: 721727 - DNA, 25 bp, Mus musculus
gttaaacgtatgttccatttggcag

SEQ ID NO: 721728 - DNA, 25 bp, Mus musculus
gttaaactcataagcaactacatgt

SEQ ID NO: 721729 - DNA, 25 bp, Mus musculus
gttaaactcatatgcaactacatgt

SEQ ID NO: 721730 - DNA, 25 bp, Mus musculus
gttaaactcgcacttctttgaaaca

SEQ ID NO: 721731 - DNA, 25 bp, Mus musculus
gttaaactcgcagttctttgaaaca

SEQ ID NO: 721732 - DNA, 25 bp, Mus musculus
gttaaactctacagaggacctgaca

SEQ ID NO: 721733 - DNA, 25 bp, Mus musculus
gttaaactctactgaggacctgaca

SEQ ID NO: 721734 - DNA, 25 bp, Mus musculus
gttaaactggatattagaaggcaat

SEQ ID NO: 721735 - DNA, 25 bp, Mus musculus
gttaaactggattttagaaggcaat

SEQ ID NO: 721736 - DNA, 25 bp, Mus musculus
gttaaactggttacatgtccattta

SEQ ID NO: 721737 - DNA, 25 bp, Mus musculus
gttaaactggtttcatgtccattta

SEQ ID NO: 721738 - DNA, 25 bp, Mus musculus
gttaaacttgataaccactctaggg

SEQ ID NO: 721739 - DNA, 25 bp, Mus musculus
gttaaacttgattaccactctaggg

SEQ ID NO: 721740 - DNA, 25 bp, Mus musculus
gttaaagaaaccaccagggctgtat

SEQ ID NO: 721741 - DNA, 25 bp, Mus musculus
gttaaagaaacctccagggctgtat

SEQ ID NO: 721742 - DNA, 25 bp, Mus musculus
gttaaagaatggaggcttgttttca

SEQ ID NO: 721743 - DNA, 25 bp, Mus musculus
gttaaagaatggtggcttgttttca

SEQ ID NO: 721744 - DNA, 25 bp, Mus musculus
gttaaagacattagccacacccagc

SEQ ID NO: 721745 - DNA, 25 bp, Mus musculus
gttaaagacatttgccacacccagc

SEQ ID NO: 721746 - DNA, 25 bp, Mus musculus
gttaaagaccttagctgagcaccag

SEQ ID NO: 721747 - DNA, 25 bp, Mus musculus
gttaaagacctttgctgagcaccag

SEQ ID NO: 721748 - DNA, 25 bp, Mus musculus
gttaaagacgcaaacctgagccagt

SEQ ID NO: 721749 - DNA, 25 bp, Mus musculus
gttaaagacgcatacctgagccagt

SEQ ID NO: 721750 - DNA, 25 bp, Mus musculus
gttaaagactcactcatcccgactc

SEQ ID NO: 721751 - DNA, 25 bp, Mus musculus
gttaaagactcagtcatcccgactc

SEQ ID NO: 721752 - DNA, 25 bp, Mus musculus
gttaaagatactaagttggactaca

SEQ ID NO: 721753 - DNA, 25 bp, Mus musculus
gttaaagatacttagttggactaca

SEQ ID NO: 721754 - DNA, 25 bp, Mus musculus
gttaaagatggtctatccttcctgc

SEQ ID NO: 721755 - DNA, 25 bp, Mus musculus
gttaaagatggtgtatccttcctgc

SEQ ID NO: 721756 - DNA, 25 bp, Mus musculus
gttaaagatgttagctatagcccaa

SEQ ID NO: 721757 - DNA, 25 bp, Mus musculus
gttaaagatgttcctgcagctgcag

SEQ ID NO: 721758 - DNA, 25 bp, Mus musculus
gttaaagatgttgctgcagctgcag

SEQ ID NO: 721759 - DNA, 25 bp, Mus musculus
gttaaagatgtttgctatagcccaa

SEQ ID NO: 721760 - DNA, 25 bp, Mus musculus
gttaaagcaaccctgagagactagt

SEQ ID NO: 721761 - DNA, 25 bp, Mus musculus
gttaaagcaaccgtgagagactagt

SEQ ID NO: 721762 - DNA, 25 bp, Mus musculus
gttaaagcacttcccactcttgcag

SEQ ID NO: 721763 - DNA, 25 bp, Mus musculus
gttaaagcacttgccactcttgcag

SEQ ID NO: 721764 - DNA, 25 bp, Mus musculus
gttaaagcataccttgctctccacc

SEQ ID NO: 721765 - DNA, 25 bp, Mus musculus
gttaaagcatacgttgctctccacc

SEQ ID NO: 721766 - DNA, 25 bp, Mus musculus
gttaaagccaacaagcaccagatta

SEQ ID NO: 721767 - DNA, 25 bp, Mus musculus
gttaaagccaactagcaccagatta

SEQ ID NO: 721768 - DNA, 25 bp, Mus musculus
gttaaagccatccacaaccctgttt

SEQ ID NO: 721769 - DNA, 25 bp, Mus musculus
gttaaagccatcgacaaccctgttt

SEQ ID NO: 721770 - DNA, 25 bp, Mus musculus
gttaaagctcccaagtcttttcatt

SEQ ID NO: 721771 - DNA, 25 bp, Mus musculus
gttaaagctccctagtcttttcatt

SEQ ID NO: 721772 - DNA, 25 bp, Mus musculus
gttaaagcttgtatacttgatctca

SEQ ID NO: 721773 - DNA, 25 bp, Mus musculus
gttaaagcttgtttacttgatctca

SEQ ID NO: 721774 - DNA, 25 bp, Mus musculus
gttaaaggatcaccacgatgcctgc

SEQ ID NO: 721775 - DNA, 25 bp, Mus musculus
gttaaaggatcagcacgatgcctgc

SEQ ID NO: 721776 - DNA, 25 bp, Mus musculus
gttaaaggcattacctgccaggctt

SEQ ID NO: 721777 - DNA, 25 bp, Mus musculus
gttaaaggcatttcctgccaggctt

SEQ ID NO: 721778 - DNA, 25 bp, Mus musculus
gttaaaggtactctttcatttgaat

SEQ ID NO: 721779 - DNA, 25 bp, Mus musculus
gttaaaggtactgtttcatttgaat

SEQ ID NO: 721780 - DNA, 25 bp, Mus musculus
gttaaagtattcctgtgttccttat

SEQ ID NO: 721781 - DNA, 25 bp, Mus musculus
gttaaagtattcgtgtgttccttat

SEQ ID NO: 721782 - DNA, 25 bp, Mus musculus
gttaaagtcaagcaaatcctgaaga

SEQ ID NO: 721783 - DNA, 25 bp, Mus musculus
gttaaagtcaaggaaatcctgaaga

SEQ ID NO: 721784 - DNA, 25 bp, Mus musculus
gttaaagtctcccactacaattatt

SEQ ID NO: 721785 - DNA, 25 bp, Mus musculus
gttaaagtctccgactacaattatt

SEQ ID NO: 721786 - DNA, 25 bp, Mus musculus
gttaaagtgcagacacacctgggct

SEQ ID NO: 721787 - DNA, 25 bp, Mus musculus
gttaaagtgcagtcacacctgggct

SEQ ID NO: 721788 - DNA, 25 bp, Mus musculus
gttaaataacaaacagctccaggat

SEQ ID NO: 721789 - DNA, 25 bp, Mus musculus
gttaaataacaatcagctccaggat

SEQ ID NO: 721790 - DNA, 25 bp, Mus musculus
gttaaataccccatgctttgatcag

SEQ ID NO: 721791 - DNA, 25 bp, Mus musculus
gttaaataccccttgctttgatcag

SEQ ID NO: 721792 - DNA, 25 bp, Mus musculus
gttaaatactgaccactgctgctag

SEQ ID NO: 721793 - DNA, 25 bp, Mus musculus
gttaaatactgagcactgctgctag

SEQ ID NO: 721794 - DNA, 25 bp, Mus musculus
gttaaatcatcccagcccatagact

SEQ ID NO: 721795 - DNA, 25 bp, Mus musculus
gttaaatcatccgagcccatagact

SEQ ID NO: 721796 - DNA, 25 bp, Mus musculus
gttaaatccatcatgaagacgttgg

SEQ ID NO: 721797 - DNA, 25 bp, Mus musculus
gttaaatccatcttgaagacgttgg

SEQ ID NO: 721798 - DNA, 25 bp, Mus musculus
gttaaatccatgctgttatctctct

SEQ ID NO: 721799 - DNA, 25 bp, Mus musculus
gttaaatccatggtgttatctctct

SEQ ID NO: 721800 - DNA, 25 bp, Mus musculus
gttaaatcccatcatcatactacct

SEQ ID NO: 721801 - DNA, 25 bp, Mus musculus
gttaaatcccatgatcatactacct

SEQ ID NO: 721802 - DNA, 25 bp, Mus musculus
gttaaatcctagaacactgccaggt

SEQ ID NO: 721803 - DNA, 25 bp, Mus musculus
gttaaatcctagtacactgccaggt

SEQ ID NO: 721804 - DNA, 25 bp, Mus musculus
gttaaatcgccccagcgcccggaag

SEQ ID NO: 721805 - DNA, 25 bp, Mus musculus
gttaaatcgcccgagcgcccggaag

SEQ ID NO: 721806 - DNA, 25 bp, Mus musculus
gttaaatctatcagctgtttccttc

SEQ ID NO: 721807 - DNA, 25 bp, Mus musculus
gttaaatctatctgctgtttccttc

SEQ ID NO: 721808 - DNA, 25 bp, Mus musculus
gttaaatctccacctgaccatggga

SEQ ID NO: 721809 - DNA, 25 bp, Mus musculus
gttaaatctccagctgaccatggga

SEQ ID NO: 721810 - DNA, 25 bp, Mus musculus
gttaaatctgaaatggtcaccacaa

SEQ ID NO: 721811 - DNA, 25 bp, Mus musculus
gttaaatctgaattggtcaccacaa

SEQ ID NO: 721812 - DNA, 25 bp, Mus musculus
gttaaatctgttcacattctagaag

SEQ ID NO: 721813 - DNA, 25 bp, Mus musculus
gttaaatctgttgacattctagaag

SEQ ID NO: 721814 - DNA, 25 bp, Mus musculus
gttaaatgaaccatctccgaacaag

SEQ ID NO: 721815 - DNA, 25 bp, Mus musculus
gttaaatgaaccttctccgaacaag

SEQ ID NO: 721816 - DNA, 25 bp, Mus musculus
gttaaatgcctaatcaacacagaca

SEQ ID NO: 721817 - DNA, 25 bp, Mus musculus
gttaaatgcctattcaacacagaca

SEQ ID NO: 721818 - DNA, 25 bp, Mus musculus
gttaaatgctgacttgatccacaaa

SEQ ID NO: 721819 - DNA, 25 bp, Mus musculus
gttaaatgctgagttgatccacaaa

SEQ ID NO: 721820 - DNA, 25 bp, Mus musculus
gttaaatgctttctaatctgtgaca

SEQ ID NO: 721821 - DNA, 25 bp, Mus musculus
gttaaatgctttgtaatctgtgaca

SEQ ID NO: 721822 - DNA, 25 bp, Mus musculus
gttaaatgtattagcttcctgttgc

SEQ ID NO: 721823 - DNA, 25 bp, Mus musculus
gttaaatgtatttgcttcctgttgc

SEQ ID NO: 721824 - DNA, 25 bp, Mus musculus
gttaaatgtgatctgctctctggcc

SEQ ID NO: 721825 - DNA, 25 bp, Mus musculus
gttaaatgtgatgtgctctctggcc

SEQ ID NO: 721826 - DNA, 25 bp, Mus musculus
gttaaatgtgctacccaccaatgat

SEQ ID NO: 721827 - DNA, 25 bp, Mus musculus
gttaaatgtgcttcccaccaatgat

SEQ ID NO: 721828 - DNA, 25 bp, Mus musculus
gttaaatgttgcatccctgaagtga

SEQ ID NO: 721829 - DNA, 25 bp, Mus musculus
gttaaatgttgcttccctgaagtga

SEQ ID NO: 721830 - DNA, 25 bp, Mus musculus
gttaaattcatcaatggctgacatg

SEQ ID NO: 721831 - DNA, 25 bp, Mus musculus
gttaaattcatctatggctgacatg

SEQ ID NO: 721832 - DNA, 25 bp, Mus musculus
gttaaattccagcaacaagtctttc

SEQ ID NO: 721833 - DNA, 25 bp, Mus musculus
gttaaattccaggaacaagtctttc

SEQ ID NO: 721834 - DNA, 25 bp, Mus musculus
gttaaattcgtgagtaaattgctgt

SEQ ID NO: 721835 - DNA, 25 bp, Mus musculus
gttaaattcgtgtgtaaattgctgt

SEQ ID NO: 721836 - DNA, 25 bp, Mus musculus
gttaaattctctcaagtctccaaat

SEQ ID NO: 721837 - DNA, 25 bp, Mus musculus
gttaaattctctgaagtctccaaat

SEQ ID NO: 721838 - DNA, 25 bp, Mus musculus
gttaacaaagttacgcggaggcgcg

SEQ ID NO: 721839 - DNA, 25 bp, Mus musculus
gttaacaaagtttcgcggaggcgcg

SEQ ID NO: 721840 - DNA, 25 bp, Mus musculus
gttaacaacgccagccatgtattta

SEQ ID NO: 721841 - DNA, 25 bp, Mus musculus
gttaacaacgcctgccatgtattta

SEQ ID NO: 721842 - DNA, 25 bp, Mus musculus
gttaacaagaaacaccaagctccag

SEQ ID NO: 721843 - DNA, 25 bp, Mus musculus
gttaacaagaaagaccaagctccag

SEQ ID NO: 721844 - DNA, 25 bp, Mus musculus
gttaacaagtttcattgcactttga

SEQ ID NO: 721845 - DNA, 25 bp, Mus musculus
gttaacaagtttgattgcactttga

SEQ ID NO: 721846 - DNA, 25 bp, Mus musculus
gttaacaatccaccagagagccgaa

SEQ ID NO: 721847 - DNA, 25 bp, Mus musculus
gttaacaatccagcagagagccgaa

SEQ ID NO: 721848 - DNA, 25 bp, Mus musculus
gttaacacacacatggagcactcag

SEQ ID NO: 721849 - DNA, 25 bp, Mus musculus
gttaacacacacttggagcactcag

SEQ ID NO: 721850 - DNA, 25 bp, Mus musculus
gttaacacacttagctttgcacata

SEQ ID NO: 721851 - DNA, 25 bp, Mus musculus
gttaacacactttgctttgcacata

SEQ ID NO: 721852 - DNA, 25 bp, Mus musculus
gttaacaccaacatgactgacctga

SEQ ID NO: 721853 - DNA, 25 bp, Mus musculus
gttaacaccaacttgactgacctga

SEQ ID NO: 721854 - DNA, 25 bp, Mus musculus
gttaacacctcgcatttctgccata

SEQ ID NO: 721855 - DNA, 25 bp, Mus musculus
gttaacacctcggatttctgccata

SEQ ID NO: 721856 - DNA, 25 bp, Mus musculus
gttaacactcagacccttgatcagg

SEQ ID NO: 721857 - DNA, 25 bp, Mus musculus
gttaacactcagtcccttgatcagg

SEQ ID NO: 721858 - DNA, 25 bp, Mus musculus
gttaacactttacaaagcctgcttt

SEQ ID NO: 721859 - DNA, 25 bp, Mus musculus
gttaacactttagaaagcctgcttt

SEQ ID NO: 721860 - DNA, 25 bp, Mus musculus
gttaacagaccaacatcgtatttag

SEQ ID NO: 721861 - DNA, 25 bp, Mus musculus
gttaacagaccatcatcgtatttag

SEQ ID NO: 721862 - DNA, 25 bp, Mus musculus
gttaacagagtgaacaaccaggtct

SEQ ID NO: 721863 - DNA, 25 bp, Mus musculus
gttaacagagtgtacaaccaggtct

SEQ ID NO: 721864 - DNA, 25 bp, Mus musculus
gttaacagtcgtatcgaactcaaat

SEQ ID NO: 721865 - DNA, 25 bp, Mus musculus
gttaacagtcgtttcgaactcaaat

SEQ ID NO: 721866 - DNA, 25 bp, Mus musculus
gttaacatcccaactgttgtattat

SEQ ID NO: 721867 - DNA, 25 bp, Mus musculus
gttaacatcccatctgttgtattat

SEQ ID NO: 721868 - DNA, 25 bp, Mus musculus
gttaacatcttgagctagggctgat

SEQ ID NO: 721869 - DNA, 25 bp, Mus musculus
gttaacatcttgtgctagggctgat

SEQ ID NO: 721870 - DNA, 25 bp, Mus musculus
gttaacatgtatcagcagtcattca

SEQ ID NO: 721871 - DNA, 25 bp, Mus musculus
gttaacatgtatgagcagtcattca

SEQ ID NO: 721872 - DNA, 25 bp, Mus musculus
gttaacattacgattatttgtggtg

SEQ ID NO: 721873 - DNA, 25 bp, Mus musculus
gttaacattacgtttatttgtggtg

SEQ ID NO: 721874 - DNA, 25 bp, Mus musculus
gttaacattccaaaaggtcacttca

SEQ ID NO: 721875 - DNA, 25 bp, Mus musculus
gttaacattccataaggtcacttca

SEQ ID NO: 721876 - DNA, 25 bp, Mus musculus
gttaacattgttaagtctccagaca

SEQ ID NO: 721877 - DNA, 25 bp, Mus musculus
gttaacattgtttagtctccagaca

SEQ ID NO: 721878 - DNA, 25 bp, Mus musculus
gttaacattttaaggattgacacat

SEQ ID NO: 721879 - DNA, 25 bp, Mus musculus
gttaacattttatggattgacacat

SEQ ID NO: 721880 - DNA, 25 bp, Mus musculus
gttaaccaaagtcctcttctgtcat

SEQ ID NO: 721881 - DNA, 25 bp, Mus musculus
gttaaccaaagtgctcttctgtcat

SEQ ID NO: 721882 - DNA, 25 bp, Mus musculus
gttaaccaatcaccgctacagactg

SEQ ID NO: 721883 - DNA, 25 bp, Mus musculus
gttaaccaatcagcgctacagactg

SEQ ID NO: 721884 - DNA, 25 bp, Mus musculus
gttaaccacagccaggacacagcaa

SEQ ID NO: 721885 - DNA, 25 bp, Mus musculus
gttaaccacagcgaggacacagcaa

SEQ ID NO: 721886 - DNA, 25 bp, Mus musculus
gttaaccacctgagaccagctgtga

SEQ ID NO: 721887 - DNA, 25 bp, Mus musculus
gttaaccacctgtgaccagctgtga

SEQ ID NO: 721888 - DNA, 25 bp, Mus musculus
gttaaccagagaatacttccaccca

SEQ ID NO: 721889 - DNA, 25 bp, Mus musculus
gttaaccagagattacttccaccca

SEQ ID NO: 721890 - DNA, 25 bp, Mus musculus
gttaaccaggaccacattccagcag

SEQ ID NO: 721891 - DNA, 25 bp, Mus musculus
gttaaccaggacgacattccagcag

SEQ ID NO: 721892 - DNA, 25 bp, Mus musculus
gttaaccagttaagctcacacatta

SEQ ID NO: 721893 - DNA, 25 bp, Mus musculus
gttaaccagttatgctcacacatta

SEQ ID NO: 721894 - DNA, 25 bp, Mus musculus
gttaaccatcccactggaacatttg

SEQ ID NO: 721895 - DNA, 25 bp, Mus musculus
gttaaccatccctctggaacatttg

SEQ ID NO: 721896 - DNA, 25 bp, Mus musculus
gttaaccatgaactaagcgagggct

SEQ ID NO: 721897 - DNA, 25 bp, Mus musculus
gttaaccatgaagtaagcgagggct

SEQ ID NO: 721898 - DNA, 25 bp, Mus musculus
gttaacccaacaagctcattggctt

SEQ ID NO: 721899 - DNA, 25 bp, Mus musculus
gttaacccaacatgctcattggctt

SEQ ID NO: 721900 - DNA, 25 bp, Mus musculus
gttaacccacaacgctaggctctaa

SEQ ID NO: 721901 - DNA, 25 bp, Mus musculus
gttaacccacaaggctaggctctaa

SEQ ID NO: 721902 - DNA, 25 bp, Mus musculus
gttaacccactcacagattaggtct

SEQ ID NO: 721903 - DNA, 25 bp, Mus musculus
gttaacccactctcagattaggtct

SEQ ID NO: 721904 - DNA, 25 bp, Mus musculus
gttaacccatttaacacttcaggca

SEQ ID NO: 721905 - DNA, 25 bp, Mus musculus
gttaacccattttacacttcaggca

SEQ ID NO: 721906 - DNA, 25 bp, Mus musculus
gttaaccccatactgttcttcagag

SEQ ID NO: 721907 - DNA, 25 bp, Mus musculus
gttaaccccatagtgttcttcagag

SEQ ID NO: 721908 - DNA, 25 bp, Mus musculus
gttaaccccgtaagtctgactatga

SEQ ID NO: 721909 - DNA, 25 bp, Mus musculus
gttaaccccgtatgtctgactatga

SEQ ID NO: 721910 - DNA, 25 bp, Mus musculus
gttaacccctgtcaaagactatgat

SEQ ID NO: 721911 - DNA, 25 bp, Mus musculus
gttaacccctgtgaaagactatgat

SEQ ID NO: 721912 - DNA, 25 bp, Mus musculus
gttaaccccttgagggcaggcggca

SEQ ID NO: 721913 - DNA, 25 bp, Mus musculus
gttaaccccttgtgggcaggcggca

SEQ ID NO: 721914 - DNA, 25 bp, Mus musculus
gttaaccctgtactcttaagcattt

SEQ ID NO: 721915 - DNA, 25 bp, Mus musculus
gttaaccctgtagtcttaagcattt

SEQ ID NO: 721916 - DNA, 25 bp, Mus musculus
gttaacccttagagtactggatgat

SEQ ID NO: 721917 - DNA, 25 bp, Mus musculus
gttaacccttagtgtactggatgat

SEQ ID NO: 721918 - DNA, 25 bp, Mus musculus
gttaaccgacatacagaggaacatt

SEQ ID NO: 721919 - DNA, 25 bp, Mus musculus
gttaaccgacattcagaggaacatt

SEQ ID NO: 721920 - DNA, 25 bp, Mus musculus
gttaacctatgaagtcaaggctgga

SEQ ID NO: 721921 - DNA, 25 bp, Mus musculus
gttaacctatgatgtcaaggctgga

SEQ ID NO: 721922 - DNA, 25 bp, Mus musculus
gttaacctctaaactacttgagctg

SEQ ID NO: 721923 - DNA, 25 bp, Mus musculus
gttaacctctaatctacttgagctg

SEQ ID NO: 721924 - DNA, 25 bp, Mus musculus
gttaacctctggatctacgagctga

SEQ ID NO: 721925 - DNA, 25 bp, Mus musculus
gttaacctctggttctacgagctga

SEQ ID NO: 721926 - DNA, 25 bp, Mus musculus
gttaacctggaactcaacgatctaa

SEQ ID NO: 721927 - DNA, 25 bp, Mus musculus
gttaacctggaagtcaacgatctaa

SEQ ID NO: 721928 - DNA, 25 bp, Mus musculus
gttaacctgtgcaaattgtggcatt

SEQ ID NO: 721929 - DNA, 25 bp, Mus musculus
gttaacctgtgctaattgtggcatt

SEQ ID NO: 721930 - DNA, 25 bp, Mus musculus
gttaacctgttgagcagcagttgca

SEQ ID NO: 721931 - DNA, 25 bp, Mus musculus
gttaacctgttgtgcagcagttgca

SEQ ID NO: 721932 - DNA, 25 bp, Mus musculus
gttaaccttacacacattctcttgt

SEQ ID NO: 721933 - DNA, 25 bp, Mus musculus
gttaaccttacagacattctcttgt

SEQ ID NO: 721934 - DNA, 25 bp, Mus musculus
gttaaccttatgctcacgatgccat

SEQ ID NO: 721935 - DNA, 25 bp, Mus musculus
gttaaccttatggtcacgatgccat

SEQ ID NO: 721936 - DNA, 25 bp, Mus musculus
gttaaccttgatagctagcatctta

SEQ ID NO: 721937 - DNA, 25 bp, Mus musculus
gttaaccttgattgctagcatctta

SEQ ID NO: 721938 - DNA, 25 bp, Mus musculus
gttaaccttgctctactgtagtctg

SEQ ID NO: 721939 - DNA, 25 bp, Mus musculus
gttaaccttgctgtactgtagtctg

SEQ ID NO: 721940 - DNA, 25 bp, Mus musculus
gttaacctttaaagaccactttatg

SEQ ID NO: 721941 - DNA, 25 bp, Mus musculus
gttaacctttaatgaccactttatg

SEQ ID NO: 721942 - DNA, 25 bp, Mus musculus
gttaacctttatattgatccaattg

SEQ ID NO: 721943 - DNA, 25 bp, Mus musculus
gttaacctttattttgatccaattg

SEQ ID NO: 721944 - DNA, 25 bp, Mus musculus
gttaacgacgttccattttcagcct

SEQ ID NO: 721945 - DNA, 25 bp, Mus musculus
gttaacgacgttgcattttcagcct

SEQ ID NO: 721946 - DNA, 25 bp, Mus musculus
gttaacgagccactgcttactcaca

SEQ ID NO: 721947 - DNA, 25 bp, Mus musculus
gttaacgagccagtgcttactcaca

SEQ ID NO: 721948 - DNA, 25 bp, Mus musculus
gttaacgagtttctctgagtctaag

SEQ ID NO: 721949 - DNA, 25 bp, Mus musculus
gttaacgagtttgtctgagtctaag

SEQ ID NO: 721950 - DNA, 25 bp, Mus musculus
gttaacgctgttaaggcatttgccc

SEQ ID NO: 721951 - DNA, 25 bp, Mus musculus
gttaacgctgtttaggcatttgccc

SEQ ID NO: 721952 - DNA, 25 bp, Mus musculus
gttaacggacacagttctgaacaag

SEQ ID NO: 721953 - DNA, 25 bp, Mus musculus
gttaacggacactgttctgaacaag

SEQ ID NO: 721954 - DNA, 25 bp, Mus musculus
gttaacggagataccctggctttat

SEQ ID NO: 721955 - DNA, 25 bp, Mus musculus
gttaacggagattccctggctttat

SEQ ID NO: 721956 - DNA, 25 bp, Mus musculus
gttaacgttggaaccatctcagaat

SEQ ID NO: 721957 - DNA, 25 bp, Mus musculus
gttaacgttggatccatctcagaat

SEQ ID NO: 721958 - DNA, 25 bp, Mus musculus
gttaactaaatgcagacatagcacc

SEQ ID NO: 721959 - DNA, 25 bp, Mus musculus
gttaactaaatggagacatagcacc

SEQ ID NO: 721960 - DNA, 25 bp, Mus musculus
gttaactaatttagtatgaccacta

SEQ ID NO: 721961 - DNA, 25 bp, Mus musculus
gttaactaattttgtatgaccacta

SEQ ID NO: 721962 - DNA, 25 bp, Mus musculus
gttaactacagaagtttctttgaga

SEQ ID NO: 721963 - DNA, 25 bp, Mus musculus
gttaactacagatgtttctttgaga

SEQ ID NO: 721964 - DNA, 25 bp, Mus musculus
gttaactacccacctgttttgatag

SEQ ID NO: 721965 - DNA, 25 bp, Mus musculus
gttaactacccagctgttttgatag

SEQ ID NO: 721966 - DNA, 25 bp, Mus musculus
gttaactacggcattaatccagaat

SEQ ID NO: 721967 - DNA, 25 bp, Mus musculus
gttaactacggctttaatccagaat

SEQ ID NO: 721968 - DNA, 25 bp, Mus musculus
gttaactagctgacttgtacttgaa

SEQ ID NO: 721969 - DNA, 25 bp, Mus musculus
gttaactagctgagttgaatgaagc

SEQ ID NO: 721970 - DNA, 25 bp, Mus musculus
gttaactagctgtcttgtacttgaa

SEQ ID NO: 721971 - DNA, 25 bp, Mus musculus
gttaactagctgtgttgaatgaagc

SEQ ID NO: 721972 - DNA, 25 bp, Mus musculus
gttaactatcaactcataatctaaa

SEQ ID NO: 721973 - DNA, 25 bp, Mus musculus
gttaactatcaagtcataatctaaa

SEQ ID NO: 721974 - DNA, 25 bp, Mus musculus
gttaactatgtgcagacgtctgcta

SEQ ID NO: 721975 - DNA, 25 bp, Mus musculus
gttaactatgtggagacgtctgcta

SEQ ID NO: 721976 - DNA, 25 bp, Mus musculus
gttaactcatcaacaaagcccttgt

SEQ ID NO: 721977 - DNA, 25 bp, Mus musculus
gttaactcatcatcaaagcccttgt

SEQ ID NO: 721978 - DNA, 25 bp, Mus musculus
gttaactcatggcttcaaaccaaga

SEQ ID NO: 721979 - DNA, 25 bp, Mus musculus
gttaactcatgggttcaaaccaaga

SEQ ID NO: 721980 - DNA, 25 bp, Mus musculus
gttaactctagacatctcaagttct

SEQ ID NO: 721981 - DNA, 25 bp, Mus musculus
gttaactctagagatctcaagttct

SEQ ID NO: 721982 - DNA, 25 bp, Mus musculus
gttaactctaggctttggagacagt

SEQ ID NO: 721983 - DNA, 25 bp, Mus musculus
gttaactctagggtttggagacagt

SEQ ID NO: 721984 - DNA, 25 bp, Mus musculus
gttaactctagtaggccaggaactc

SEQ ID NO: 721985 - DNA, 25 bp, Mus musculus
gttaactctagttggccaggaactc

SEQ ID NO: 721986 - DNA, 25 bp, Mus musculus
gttaactctgctctgacactataca

SEQ ID NO: 721987 - DNA, 25 bp, Mus musculus
gttaactctgctgtgacactataca

SEQ ID NO: 721988 - DNA, 25 bp, Mus musculus
gttaactcttagagccatcaagaat

SEQ ID NO: 721989 - DNA, 25 bp, Mus musculus
gttaactcttagtgccatcaagaat

SEQ ID NO: 721990 - DNA, 25 bp, Mus musculus
gttaactcttgacgcactcatccga

SEQ ID NO: 721991 - DNA, 25 bp, Mus musculus
gttaactcttgaggcactcatccga

SEQ ID NO: 721992 - DNA, 25 bp, Mus musculus
gttaactgaccaacccgcataagga

SEQ ID NO: 721993 - DNA, 25 bp, Mus musculus
gttaactgaccatcccgcataagga

SEQ ID NO: 721994 - DNA, 25 bp, Mus musculus
gttaactgattgagctcacggacat

SEQ ID NO: 721995 - DNA, 25 bp, Mus musculus
gttaactgattgtgctcacggacat

SEQ ID NO: 721996 - DNA, 25 bp, Mus musculus
gttaactgccgaccaatctctctaa

SEQ ID NO: 721997 - DNA, 25 bp, Mus musculus
gttaactgccgagcaatctctctaa

SEQ ID NO: 721998 - DNA, 25 bp, Mus musculus
gttaactgctgtacactatttaaaa

SEQ ID NO: 721999 - DNA, 25 bp, Mus musculus
gttaactgctgttcactatttaaaa

SEQ ID NO: 722000 - DNA, 25 bp, Mus musculus
gttaactggcagatacacaatgggc

SEQ ID NO: 722001 - DNA, 25 bp, Mus musculus
gttaactggcagttacacaatgggc

SEQ ID NO: 722002 - DNA, 25 bp, Mus musculus
gttaactgtaaacaaacacctactg

SEQ ID NO: 722003 - DNA, 25 bp, Mus musculus
gttaactgtaaagaaacacctactg

SEQ ID NO: 722004 - DNA, 25 bp, Mus musculus
gttaactgtcagatttcaacaggat

SEQ ID NO: 722005 - DNA, 25 bp, Mus musculus
gttaactgtcagttttcaacaggat

SEQ ID NO: 722006 - DNA, 25 bp, Mus musculus
gttaacttacttactctgttaggtg

SEQ ID NO: 722007 - DNA, 25 bp, Mus musculus
gttaacttactttctctgttaggtg

SEQ ID NO: 722008 - DNA, 25 bp, Mus musculus
gttaacttattccttggccaggcta

SEQ ID NO: 722009 - DNA, 25 bp, Mus musculus
gttaacttattcgttggccaggcta

SEQ ID NO: 722010 - DNA, 25 bp, Mus musculus
gttaacttcaaacctgactgggcta

SEQ ID NO: 722011 - DNA, 25 bp, Mus musculus
gttaacttcaaagctgactgggcta

SEQ ID NO: 722012 - DNA, 25 bp, Mus musculus
gttaacttcaacatcttcgagggca

SEQ ID NO: 722013 - DNA, 25 bp, Mus musculus
gttaacttcaacttcttcgagggca

SEQ ID NO: 722014 - DNA, 25 bp, Mus musculus
gttaacttcattcaatttcctttcg

SEQ ID NO: 722015 - DNA, 25 bp, Mus musculus
gttaacttcattgaatttcctttcg

SEQ ID NO: 722016 - DNA, 25 bp, Mus musculus
gttaacttcctgagatctgtctatg

SEQ ID NO: 722017 - DNA, 25 bp, Mus musculus
gttaacttcctgtgatctgtctatg

SEQ ID NO: 722018 - DNA, 25 bp, Mus musculus
gttaacttcttgctctaactcttaa

SEQ ID NO: 722019 - DNA, 25 bp, Mus musculus
gttaacttcttggtctaactcttaa

SEQ ID NO: 722020 - DNA, 25 bp, Mus musculus
gttaacttgattacagactgctgga

SEQ ID NO: 722021 - DNA, 25 bp, Mus musculus
gttaacttgatttcagactgctgga

SEQ ID NO: 722022 - DNA, 25 bp, Mus musculus
gttaactttatgactctgtgggaaa

SEQ ID NO: 722023 - DNA, 25 bp, Mus musculus
gttaactttatgtctctgtgggaaa

SEQ ID NO: 722024 - DNA, 25 bp, Mus musculus
gttaactttattattctgctataat

SEQ ID NO: 722025 - DNA, 25 bp, Mus musculus
gttaactttatttttctgctataat

SEQ ID NO: 722026 - DNA, 25 bp, Mus musculus
gttaactttgcgcacactgtctcca

SEQ ID NO: 722027 - DNA, 25 bp, Mus musculus
gttaactttgcggacactgtctcca

SEQ ID NO: 722028 - DNA, 25 bp, Mus musculus
gttaactttgtcagtgattgctagt

SEQ ID NO: 722029 - DNA, 25 bp, Mus musculus
gttaactttgtctgtgattgctagt

SEQ ID NO: 722030 - DNA, 25 bp, Mus musculus
gttaagaaaactctggtccgctgtt

SEQ ID NO: 722031 - DNA, 25 bp, Mus musculus
gttaagaaaactgtggtccgctgtt

SEQ ID NO: 722032 - DNA, 25 bp, Mus musculus
gttaagaaagtaaacctgctgggag

SEQ ID NO: 722033 - DNA, 25 bp, Mus musculus
gttaagaaagtatacctgctgggag

SEQ ID NO: 722034 - DNA, 25 bp, Mus musculus
gttaagaaatttcgctcacaccttt

SEQ ID NO: 722035 - DNA, 25 bp, Mus musculus
gttaagaaatttggctcacaccttt

SEQ ID NO: 722036 - DNA, 25 bp, Mus musculus
gttaagaacatgcacaacctcaagg

SEQ ID NO: 722037 - DNA, 25 bp, Mus musculus
gttaagaacatggacaacctcaagg

SEQ ID NO: 722038 - DNA, 25 bp, Mus musculus
gttaagaactgcaggtttagtgtct

SEQ ID NO: 722039 - DNA, 25 bp, Mus musculus
gttaagaactgcctcgggcccagca

SEQ ID NO: 722040 - DNA, 25 bp, Mus musculus
gttaagaactgcgtcgggcccagca

SEQ ID NO: 722041 - DNA, 25 bp, Mus musculus
gttaagaactgctggtttagtgtct

SEQ ID NO: 722042 - DNA, 25 bp, Mus musculus
gttaagaatctcaaatggcttccaa

SEQ ID NO: 722043 - DNA, 25 bp, Mus musculus
gttaagaatctctaatggcttccaa

SEQ ID NO: 722044 - DNA, 25 bp, Mus musculus
gttaagaatgacaacatcccaccca

SEQ ID NO: 722045 - DNA, 25 bp, Mus musculus
gttaagaatgactacatcccaccca

SEQ ID NO: 722046 - DNA, 25 bp, Mus musculus
gttaagacacaaacactcaaccacc

SEQ ID NO: 722047 - DNA, 25 bp, Mus musculus
gttaagacacaatcactcaaccacc

SEQ ID NO: 722048 - DNA, 25 bp, Mus musculus
gttaagacagtccttcatcttcttc

SEQ ID NO: 722049 - DNA, 25 bp, Mus musculus
gttaagacagtcgttcatcttcttc

SEQ ID NO: 722050 - DNA, 25 bp, Mus musculus
gttaagacccgtattcatgctaagt

SEQ ID NO: 722051 - DNA, 25 bp, Mus musculus
gttaagacccgttttcatgctaagt

SEQ ID NO: 722052 - DNA, 25 bp, Mus musculus
gttaagaccttacttctatggaaca

SEQ ID NO: 722053 - DNA, 25 bp, Mus musculus
gttaagaccttagttctatggaaca

SEQ ID NO: 722054 - DNA, 25 bp, Mus musculus
gttaagacttgtactcgagtgatgt

SEQ ID NO: 722055 - DNA, 25 bp, Mus musculus
gttaagacttgttctcgagtgatgt

SEQ ID NO: 722056 - DNA, 25 bp, Mus musculus
gttaagagagagaagctgttcacct

SEQ ID NO: 722057 - DNA, 25 bp, Mus musculus
gttaagagagagtagctgttcacct

SEQ ID NO: 722058 - DNA, 25 bp, Mus musculus
gttaagagcactagaagaccttcct

SEQ ID NO: 722059 - DNA, 25 bp, Mus musculus
gttaagagcacttgaagaccttcct

SEQ ID NO: 722060 - DNA, 25 bp, Mus musculus
gttaagagcgtacgttttactcctg

SEQ ID NO: 722061 - DNA, 25 bp, Mus musculus
gttaagagcgtacgttttattcctg

SEQ ID NO: 722062 - DNA, 25 bp, Mus musculus
gttaagagcgtaggttttactcctg

SEQ ID NO: 722063 - DNA, 25 bp, Mus musculus
gttaagagcgtaggttttattcctg

SEQ ID NO: 722064 - DNA, 25 bp, Mus musculus
gttaagaggcgaccagaaccttcct

SEQ ID NO: 722065 - DNA, 25 bp, Mus musculus
gttaagaggcgagcagaaccttcct

SEQ ID NO: 722066 - DNA, 25 bp, Mus musculus
gttaagagtagcatcctatttgaca

SEQ ID NO: 722067 - DNA, 25 bp, Mus musculus
gttaagagtagcttcctatttgaca

SEQ ID NO: 722068 - DNA, 25 bp, Mus musculus
gttaagagtgtccttttagaccatc

SEQ ID NO: 722069 - DNA, 25 bp, Mus musculus
gttaagagtgtcgttttagaccatc

SEQ ID NO: 722070 - DNA, 25 bp, Mus musculus
gttaagatctgcctgcccaaggagg

SEQ ID NO: 722071 - DNA, 25 bp, Mus musculus
gttaagatctgcgtgcccaaggagg

SEQ ID NO: 722072 - DNA, 25 bp, Mus musculus
gttaagatgcttccctactgtacag

SEQ ID NO: 722073 - DNA, 25 bp, Mus musculus
gttaagatgcttgcctactgtacag

SEQ ID NO: 722074 - DNA, 25 bp, Mus musculus
gttaagatggatcccactggacaat

SEQ ID NO: 722075 - DNA, 25 bp, Mus musculus
gttaagatggatgccactggacaat

SEQ ID NO: 722076 - DNA, 25 bp, Mus musculus
gttaagatgtagatgctgacactat

SEQ ID NO: 722077 - DNA, 25 bp, Mus musculus
gttaagatgtagttgctgacactat

SEQ ID NO: 722078 - DNA, 25 bp, Mus musculus
gttaagatgtcactcagtacccacc

SEQ ID NO: 722079 - DNA, 25 bp, Mus musculus
gttaagatgtcagtcagtacccacc

SEQ ID NO: 722080 - DNA, 25 bp, Mus musculus
gttaagattaacagcatcctggcag

SEQ ID NO: 722081 - DNA, 25 bp, Mus musculus
gttaagattaactgcatcctggcag

SEQ ID NO: 722082 - DNA, 25 bp, Mus musculus
gttaagatttcacatatacaaggtt

SEQ ID NO: 722083 - DNA, 25 bp, Mus musculus
gttaagatttcagatatacaaggtt

SEQ ID NO: 722084 - DNA, 25 bp, Mus musculus
gttaagcactatattattctctagg

SEQ ID NO: 722085 - DNA, 25 bp, Mus musculus
gttaagcactattttattctctagg

SEQ ID NO: 722086 - DNA, 25 bp, Mus musculus
gttaagcagactcgcctcacagaaa

SEQ ID NO: 722087 - DNA, 25 bp, Mus musculus
gttaagcagactggcctcacagaaa

SEQ ID NO: 722088 - DNA, 25 bp, Mus musculus
gttaagcagagcctgtgccaacccc

SEQ ID NO: 722089 - DNA, 25 bp, Mus musculus
gttaagcagagcgtgtgccaacccc

SEQ ID NO: 722090 - DNA, 25 bp, Mus musculus
gttaagcagtcaagtcttcccaggt

SEQ ID NO: 722091 - DNA, 25 bp, Mus musculus
gttaagcagtcatgtcttcccaggt

SEQ ID NO: 722092 - DNA, 25 bp, Mus musculus
gttaagcattaacgccttggcacgc

SEQ ID NO: 722093 - DNA, 25 bp, Mus musculus
gttaagcattaaggccttggcacgc

SEQ ID NO: 722094 - DNA, 25 bp, Mus musculus
gttaagccctggagtttagaattct

SEQ ID NO: 722095 - DNA, 25 bp, Mus musculus
gttaagccctggtgtttagaattct

SEQ ID NO: 722096 - DNA, 25 bp, Mus musculus
gttaagcctgctcggaatttcctgg

SEQ ID NO: 722097 - DNA, 25 bp, Mus musculus
gttaagcctgctgggaatttcctgg

SEQ ID NO: 722098 - DNA, 25 bp, Mus musculus
gttaagcgtttaagtcctgctgctc

SEQ ID NO: 722099 - DNA, 25 bp, Mus musculus
gttaagcgtttatgtcctgctgctc

SEQ ID NO: 722100 - DNA, 25 bp, Mus musculus
gttaagctacctagacactgtagta

SEQ ID NO: 722101 - DNA, 25 bp, Mus musculus
gttaagctaccttgacactgtagta

SEQ ID NO: 722102 - DNA, 25 bp, Mus musculus
gttaagctctgtctagaacagccac

SEQ ID NO: 722103 - DNA, 25 bp, Mus musculus
gttaagctctgtgtagaacagccac

SEQ ID NO: 722104 - DNA, 25 bp, Mus musculus
gttaagctgagacacctgcatgtgg

SEQ ID NO: 722105 - DNA, 25 bp, Mus musculus
gttaagctgagagacctgcatgtgg

SEQ ID NO: 722106 - DNA, 25 bp, Mus musculus
gttaagctgagtcagtccacctcta

SEQ ID NO: 722107 - DNA, 25 bp, Mus musculus
gttaagctgagtgagtccacctcta

SEQ ID NO: 722108 - DNA, 25 bp, Mus musculus
gttaagctgcacatggtttttctgg

SEQ ID NO: 722109 - DNA, 25 bp, Mus musculus
gttaagctgcacttggtttttctgg

SEQ ID NO: 722110 - DNA, 25 bp, Mus musculus
gttaagctggtgatacctggagaag

SEQ ID NO: 722111 - DNA, 25 bp, Mus musculus
gttaagctggtgttacctggagaag

SEQ ID NO: 722112 - DNA, 25 bp, Mus musculus
gttaagcttatgagatgagtgaatg

SEQ ID NO: 722113 - DNA, 25 bp, Mus musculus
gttaagcttatgtgatgagtgaatg

SEQ ID NO: 722114 - DNA, 25 bp, Mus musculus
gttaagcttctgagacatgaggcca

SEQ ID NO: 722115 - DNA, 25 bp, Mus musculus
gttaagcttctgtgacatgaggcca

SEQ ID NO: 722116 - DNA, 25 bp, Mus musculus
gttaagcttgacaagacgccaccag

SEQ ID NO: 722117 - DNA, 25 bp, Mus musculus
gttaagcttgactagacgccaccag

SEQ ID NO: 722118 - DNA, 25 bp, Mus musculus
gttaagcttggaaattgcactgcaa

SEQ ID NO: 722119 - DNA, 25 bp, Mus musculus
gttaagcttggatattgcactgcaa

SEQ ID NO: 722120 - DNA, 25 bp, Mus musculus
gttaaggaacccagacgctccactt

SEQ ID NO: 722121 - DNA, 25 bp, Mus musculus
gttaaggaaccctgacgctccactt

SEQ ID NO: 722122 - DNA, 25 bp, Mus musculus
gttaaggacacgactcatctcatca

SEQ ID NO: 722123 - DNA, 25 bp, Mus musculus
gttaaggacacgtctcatctcatca

SEQ ID NO: 722124 - DNA, 25 bp, Mus musculus
gttaaggacgccatgacaggccatc

SEQ ID NO: 722125 - DNA, 25 bp, Mus musculus
gttaaggacgccttgacaggccatc

SEQ ID NO: 722126 - DNA, 25 bp, Mus musculus
gttaaggagctcaagtgccctcttc

SEQ ID NO: 722127 - DNA, 25 bp, Mus musculus
gttaaggagctctagtgccctcttc

SEQ ID NO: 722128 - DNA, 25 bp, Mus musculus
gttaaggaggatactccattccaga

SEQ ID NO: 722129 - DNA, 25 bp, Mus musculus
gttaaggaggattctccattccaga

SEQ ID NO: 722130 - DNA, 25 bp, Mus musculus
gttaaggatacccacaagttcagtt

SEQ ID NO: 722131 - DNA, 25 bp, Mus musculus
gttaaggataccgacaagttcagtt

SEQ ID NO: 722132 - DNA, 25 bp, Mus musculus
gttaaggcaactagagttttctcta

SEQ ID NO: 722133 - DNA, 25 bp, Mus musculus
gttaaggcaacttgagttttctcta

SEQ ID NO: 722134 - DNA, 25 bp, Mus musculus
gttaaggcattcagtggactgtcac

SEQ ID NO: 722135 - DNA, 25 bp, Mus musculus
gttaaggcattctgtggactgtcac

SEQ ID NO: 722136 - DNA, 25 bp, Mus musculus
gttaaggccccaagcaaagcgagta

SEQ ID NO: 722137 - DNA, 25 bp, Mus musculus
gttaaggccccatgcaaagcgagta

SEQ ID NO: 722138 - DNA, 25 bp, Mus musculus
gttaaggctcatcatgtcaactgta

SEQ ID NO: 722139 - DNA, 25 bp, Mus musculus
gttaaggctcatgatgtcaactgta

SEQ ID NO: 722140 - DNA, 25 bp, Mus musculus
gttaaggctgctatgtggtaaacat

SEQ ID NO: 722141 - DNA, 25 bp, Mus musculus
gttaaggctgctttgtggtaaacat

SEQ ID NO: 722142 - DNA, 25 bp, Mus musculus
gttaagggaattcagtgccgactgc

SEQ ID NO: 722143 - DNA, 25 bp, Mus musculus
gttaagggaattgagtgccgactgc

SEQ ID NO: 722144 - DNA, 25 bp, Mus musculus
gttaagggacccacagcatgattta

SEQ ID NO: 722145 - DNA, 25 bp, Mus musculus
gttaagggaccctcagcatgattta

SEQ ID NO: 722146 - DNA, 25 bp, Mus musculus
gttaagggagctccactgtgcttta

SEQ ID NO: 722147 - DNA, 25 bp, Mus musculus
gttaagggagctgcactgtgcttta

SEQ ID NO: 722148 - DNA, 25 bp, Mus musculus
gttaagggattcattcaccagcagc

SEQ ID NO: 722149 - DNA, 25 bp, Mus musculus
gttaagggattctttcaccagcagc

SEQ ID NO: 722150 - DNA, 25 bp, Mus musculus
gttaagggcaccagatgtccttcca

SEQ ID NO: 722151 - DNA, 25 bp, Mus musculus
gttaagggcacctgatgtccttcca

SEQ ID NO: 722152 - DNA, 25 bp, Mus musculus
gttaagggcactagtgtgaccctgt

SEQ ID NO: 722153 - DNA, 25 bp, Mus musculus
gttaagggcacttgtgtgaccctgt

SEQ ID NO: 722154 - DNA, 25 bp, Mus musculus
gttaagggcattaccgtttgcagtt

SEQ ID NO: 722155 - DNA, 25 bp, Mus musculus
gttaagggcatttccgtttgcagtt

SEQ ID NO: 722156 - DNA, 25 bp, Mus musculus
gttaagggccagacactagtgctga

SEQ ID NO: 722157 - DNA, 25 bp, Mus musculus
gttaagggccagtcactagtgctga

SEQ ID NO: 722158 - DNA, 25 bp, Mus musculus
gttaaggtacctccagaactcctgg

SEQ ID NO: 722159 - DNA, 25 bp, Mus musculus
gttaaggtacctgcagaactcctgg

SEQ ID NO: 722160 - DNA, 25 bp, Mus musculus
gttaaggtatctctgagcggagctc

SEQ ID NO: 722161 - DNA, 25 bp, Mus musculus
gttaaggtatctgtgagcggagctc

SEQ ID NO: 722162 - DNA, 25 bp, Mus musculus
gttaaggtcaagctcactgcagctc

SEQ ID NO: 722163 - DNA, 25 bp, Mus musculus
gttaaggtcaaggtcactgcagctc

SEQ ID NO: 722164 - DNA, 25 bp, Mus musculus
gttaagtaaaataagtcagtctctg

SEQ ID NO: 722165 - DNA, 25 bp, Mus musculus
gttaagtaaaattagtcagtctctg

SEQ ID NO: 722166 - DNA, 25 bp, Mus musculus
gttaagtaacatatcttgaccagtt

SEQ ID NO: 722167 - DNA, 25 bp, Mus musculus
gttaagtaacatttcttgaccagtt

SEQ ID NO: 722168 - DNA, 25 bp, Mus musculus
gttaagtaagtactttcctggtgtg

SEQ ID NO: 722169 - DNA, 25 bp, Mus musculus
gttaagtaagtagtttcctggtgtg

SEQ ID NO: 722170 - DNA, 25 bp, Mus musculus
gttaagtaatcgactcttgagctac

SEQ ID NO: 722171 - DNA, 25 bp, Mus musculus
gttaagtaatcgtctcttgagctac

SEQ ID NO: 722172 - DNA, 25 bp, Mus musculus
gttaagtacacacaagccatcctgt

SEQ ID NO: 722173 - DNA, 25 bp, Mus musculus
gttaagtacacagaagccatcctgt

SEQ ID NO: 722174 - DNA, 25 bp, Mus musculus
gttaagtacagtattatcctacagt

SEQ ID NO: 722175 - DNA, 25 bp, Mus musculus
gttaagtacagttttatcctacagt

SEQ ID NO: 722176 - DNA, 25 bp, Mus musculus
gttaagtactcacttccccagcttc

SEQ ID NO: 722177 - DNA, 25 bp, Mus musculus
gttaagtactcagttccccagcttc

SEQ ID NO: 722178 - DNA, 25 bp, Mus musculus
gttaagtagattaggccctagctaa

SEQ ID NO: 722179 - DNA, 25 bp, Mus musculus
gttaagtagatttggccctagctaa

SEQ ID NO: 722180 - DNA, 25 bp, Mus musculus
gttaagtagcttaggcatctcgcct

SEQ ID NO: 722181 - DNA, 25 bp, Mus musculus
gttaagtagctttggcatctcgcct

SEQ ID NO: 722182 - DNA, 25 bp, Mus musculus
gttaagtataacagactccctaaag

SEQ ID NO: 722183 - DNA, 25 bp, Mus musculus
gttaagtataactgactccctaaag

SEQ ID NO: 722184 - DNA, 25 bp, Mus musculus
gttaagtcaaatccgtgtgtctcaa

SEQ ID NO: 722185 - DNA, 25 bp, Mus musculus
gttaagtcaaatgcgtgtgtctcaa

SEQ ID NO: 722186 - DNA, 25 bp, Mus musculus
gttaagtcacgtatgctaatgctct

SEQ ID NO: 722187 - DNA, 25 bp, Mus musculus
gttaagtcacgtttgctaatgctct

SEQ ID NO: 722188 - DNA, 25 bp, Mus musculus
gttaagtcactacgaggctgtttct

SEQ ID NO: 722189 - DNA, 25 bp, Mus musculus
gttaagtcactaggaggctgtttct

SEQ ID NO: 722190 - DNA, 25 bp, Mus musculus
gttaagtccactacaactgtgattt

SEQ ID NO: 722191 - DNA, 25 bp, Mus musculus
gttaagtccacttcaactgtgattt

SEQ ID NO: 722192 - DNA, 25 bp, Mus musculus
gttaagtcgatcagctgactctccg

SEQ ID NO: 722193 - DNA, 25 bp, Mus musculus
gttaagtcgatctgctgactctccg

SEQ ID NO: 722194 - DNA, 25 bp, Mus musculus
gttaagtcggttcttagcatgagca

SEQ ID NO: 722195 - DNA, 25 bp, Mus musculus
gttaagtcggttgttagcatgagca

SEQ ID NO: 722196 - DNA, 25 bp, Mus musculus
gttaagtgactcaggcttacccaga

SEQ ID NO: 722197 - DNA, 25 bp, Mus musculus
gttaagtgactctggcttacccaga

SEQ ID NO: 722198 - DNA, 25 bp, Mus musculus
gttaagtgagacaatattccatttt

SEQ ID NO: 722199 - DNA, 25 bp, Mus musculus
gttaagtgagactatattccatttt

SEQ ID NO: 722200 - DNA, 25 bp, Mus musculus
gttaagtgagttcctggcaaccctc

SEQ ID NO: 722201 - DNA, 25 bp, Mus musculus
gttaagtgagttgctggcaaccctc

SEQ ID NO: 722202 - DNA, 25 bp, Mus musculus
gttaagtgcactatgaaatccatgt

SEQ ID NO: 722203 - DNA, 25 bp, Mus musculus
gttaagtgcactttgaaatccatgt

SEQ ID NO: 722204 - DNA, 25 bp, Mus musculus
gttaagtgcagtagctgctcttctg

SEQ ID NO: 722205 - DNA, 25 bp, Mus musculus
gttaagtgcagttgctgctcttctg

SEQ ID NO: 722206 - DNA, 25 bp, Mus musculus
gttaagtgccatctgtatgactcca

SEQ ID NO: 722207 - DNA, 25 bp, Mus musculus
gttaagtgccatgtgtatgactcca

SEQ ID NO: 722208 - DNA, 25 bp, Mus musculus
gttaagtgctagatgctctcacaga

SEQ ID NO: 722209 - DNA, 25 bp, Mus musculus
gttaagtgctagttgctctcacaga

SEQ ID NO: 722210 - DNA, 25 bp, Mus musculus
gttaagtggaaaatgctctgattac

SEQ ID NO: 722211 - DNA, 25 bp, Mus musculus
gttaagtggaaattgctctgattac

SEQ ID NO: 722212 - DNA, 25 bp, Mus musculus
gttaagttacagagtctcacattaa

SEQ ID NO: 722213 - DNA, 25 bp, Mus musculus
gttaagttacagtgtctcacattaa

SEQ ID NO: 722214 - DNA, 25 bp, Mus musculus
gttaagttattgcagatcccacatt

SEQ ID NO: 722215 - DNA, 25 bp, Mus musculus
gttaagttattggagatcccacatt

SEQ ID NO: 722216 - DNA, 25 bp, Mus musculus
gttaagttatttatctgccattgta

SEQ ID NO: 722217 - DNA, 25 bp, Mus musculus
gttaagttatttttctgccattgta

SEQ ID NO: 722218 - DNA, 25 bp, Mus musculus
gttaagttgctaaggctggaattct

SEQ ID NO: 722219 - DNA, 25 bp, Mus musculus
gttaagttgctatggctggaattct

SEQ ID NO: 722220 - DNA, 25 bp, Mus musculus
gttaagttgtagatctttctactct

SEQ ID NO: 722221 - DNA, 25 bp, Mus musculus
gttaagttgtagttctttctactct

SEQ ID NO: 722222 - DNA, 25 bp, Mus musculus
gttaagtttcgacccgagtccaaat

SEQ ID NO: 722223 - DNA, 25 bp, Mus musculus
gttaagtttcgagccgagtccaaat

SEQ ID NO: 722224 - DNA, 25 bp, Mus musculus
gttaagtttctacaccctgagacca

SEQ ID NO: 722225 - DNA, 25 bp, Mus musculus
gttaagtttctagaccctgagacca

SEQ ID NO: 722226 - DNA, 25 bp, Mus musculus
gttaagtttgcaaattacgtagaga

SEQ ID NO: 722227 - DNA, 25 bp, Mus musculus
gttaagtttgcatattacgtagaga

SEQ ID NO: 722228 - DNA, 25 bp, Mus musculus
gttaataaagtcagtgctcccctac

SEQ ID NO: 722229 - DNA, 25 bp, Mus musculus
gttaataaagtctgtgctcccctac

SEQ ID NO: 722230 - DNA, 25 bp, Mus musculus
gttaataacattcctttcatcttgg

SEQ ID NO: 722231 - DNA, 25 bp, Mus musculus
gttaataacattgctttcatcttgg

SEQ ID NO: 722232 - DNA, 25 bp, Mus musculus
gttaataattcaagttcctgctgga

SEQ ID NO: 722233 - DNA, 25 bp, Mus musculus
gttaataattcatgttcctgctgga

SEQ ID NO: 722234 - DNA, 25 bp, Mus musculus
gttaatacaaacagatcctgaagag

SEQ ID NO: 722235 - DNA, 25 bp, Mus musculus
gttaatacaaactgatcctgaagag

SEQ ID NO: 722236 - DNA, 25 bp, Mus musculus
gttaatacaggaaacagttgcatgt

SEQ ID NO: 722237 - DNA, 25 bp, Mus musculus
gttaatacaggatacagttgcatgt

SEQ ID NO: 722238 - DNA, 25 bp, Mus musculus
gttaatacatggagtctccctgagt

SEQ ID NO: 722239 - DNA, 25 bp, Mus musculus
gttaatacatggtgtctccctgagt

SEQ ID NO: 722240 - DNA, 25 bp, Mus musculus
gttaatacctggatccacaccaatg

SEQ ID NO: 722241 - DNA, 25 bp, Mus musculus
gttaatacctggttccacaccaatg

SEQ ID NO: 722242 - DNA, 25 bp, Mus musculus
gttaatactctgaacactataaatg

SEQ ID NO: 722243 - DNA, 25 bp, Mus musculus
gttaatactctgtacactataaatg

SEQ ID NO: 722244 - DNA, 25 bp, Mus musculus
gttaatactgacacgtctgcctttg

SEQ ID NO: 722245 - DNA, 25 bp, Mus musculus
gttaatactgactcgtctgcctttg

SEQ ID NO: 722246 - DNA, 25 bp, Mus musculus
gttaatactttgagccttgacagaa

SEQ ID NO: 722247 - DNA, 25 bp, Mus musculus
gttaatactttgtgccttgacagaa

SEQ ID NO: 722248 - DNA, 25 bp, Mus musculus
gttaatagcttaagtgtttgtgtat

SEQ ID NO: 722249 - DNA, 25 bp, Mus musculus
gttaatagcttatgtgtttgtgtat

SEQ ID NO: 722250 - DNA, 25 bp, Mus musculus
gttaataggcggactcatccatcac

SEQ ID NO: 722251 - DNA, 25 bp, Mus musculus
gttaataggcggtctcatccatcac

SEQ ID NO: 722252 - DNA, 25 bp, Mus musculus
gttaatagttcacttgtacaaaaca

SEQ ID NO: 722253 - DNA, 25 bp, Mus musculus
gttaatagttcagttgtacaaaaca

SEQ ID NO: 722254 - DNA, 25 bp, Mus musculus
gttaatatacagatcatggctcaag

SEQ ID NO: 722255 - DNA, 25 bp, Mus musculus
gttaatatacagttcatggctcaag

SEQ ID NO: 722256 - DNA, 25 bp, Mus musculus
gttaatatattcctccacagtagct

SEQ ID NO: 722257 - DNA, 25 bp, Mus musculus
gttaatatattcgtccacagtagct

SEQ ID NO: 722258 - DNA, 25 bp, Mus musculus
gttaatatgcttcatgccggccgtc

SEQ ID NO: 722259 - DNA, 25 bp, Mus musculus
gttaatatgcttgatgccggccgtc

SEQ ID NO: 722260 - DNA, 25 bp, Mus musculus
gttaatatggctattttgtactact

SEQ ID NO: 722261 - DNA, 25 bp, Mus musculus
gttaatatggcttttttgtactact

SEQ ID NO: 722262 - DNA, 25 bp, Mus musculus
gttaatatgtctcatcatctctaga

SEQ ID NO: 722263 - DNA, 25 bp, Mus musculus
gttaatatgtctgatcatctctaga

SEQ ID NO: 722264 - DNA, 25 bp, Mus musculus
gttaatattcagatctatccagtct

SEQ ID NO: 722265 - DNA, 25 bp, Mus musculus
gttaatattcagttctatccagtct

SEQ ID NO: 722266 - DNA, 25 bp, Mus musculus
gttaatattgtcaggcggagcacag

SEQ ID NO: 722267 - DNA, 25 bp, Mus musculus
gttaatattgtctggcggagcacag

SEQ ID NO: 722268 - DNA, 25 bp, Mus musculus
gttaatcacagaacatcatttctct

SEQ ID NO: 722269 - DNA, 25 bp, Mus musculus
gttaatcacagatcatcatttctct

SEQ ID NO: 722270 - DNA, 25 bp, Mus musculus
gttaatcaccgcagctctatcagaa

SEQ ID NO: 722271 - DNA, 25 bp, Mus musculus
gttaatcaccgctgctctatcagaa

SEQ ID NO: 722272 - DNA, 25 bp, Mus musculus
gttaatcagatgagacccctctagg

SEQ ID NO: 722273 - DNA, 25 bp, Mus musculus
gttaatcagatgtgacccctctagg

SEQ ID NO: 722274 - DNA, 25 bp, Mus musculus
gttaatcagcctagtaaaagcactt

SEQ ID NO: 722275 - DNA, 25 bp, Mus musculus
gttaatcagccttgtaaaagcactt

SEQ ID NO: 722276 - DNA, 25 bp, Mus musculus
gttaatcagtagataatgcttgaac

SEQ ID NO: 722277 - DNA, 25 bp, Mus musculus
gttaatcagtagttaatgcttgaac

SEQ ID NO: 722278 - DNA, 25 bp, Mus musculus
gttaatccaaccagttcattggcct

SEQ ID NO: 722279 - DNA, 25 bp, Mus musculus
gttaatccaacctgttcattggcct

SEQ ID NO: 722280 - DNA, 25 bp, Mus musculus
gttaatccagcccttgacagagagt

SEQ ID NO: 722281 - DNA, 25 bp, Mus musculus
gttaatccagccgttgacagagagt

SEQ ID NO: 722282 - DNA, 25 bp, Mus musculus
gttaatccatataggcagaacgaaa

SEQ ID NO: 722283 - DNA, 25 bp, Mus musculus
gttaatccatattggcagaacgaaa

SEQ ID NO: 722284 - DNA, 25 bp, Mus musculus
gttaatcccggcaaacccatgagga

SEQ ID NO: 722285 - DNA, 25 bp, Mus musculus
gttaatcccggctaacccatgagga

SEQ ID NO: 722286 - DNA, 25 bp, Mus musculus
gttaatccctccaaagacagtttca

SEQ ID NO: 722287 - DNA, 25 bp, Mus musculus
gttaatccctcctaagacagtttca

SEQ ID NO: 722288 - DNA, 25 bp, Mus musculus
gttaatcctgaaaggtgctacttat

SEQ ID NO: 722289 - DNA, 25 bp, Mus musculus
gttaatcctgaatggtgctacttat

SEQ ID NO: 722290 - DNA, 25 bp, Mus musculus
gttaatcctgacaaaagccactgag

SEQ ID NO: 722291 - DNA, 25 bp, Mus musculus
gttaatcctgactaaagccactgag

SEQ ID NO: 722292 - DNA, 25 bp, Mus musculus
gttaatcctgagattcaccagagaa

SEQ ID NO: 722293 - DNA, 25 bp, Mus musculus
gttaatcctgagtttcaccagagaa

SEQ ID NO: 722294 - DNA, 25 bp, Mus musculus
gttaatcctgttagtgtaaagcgaa

SEQ ID NO: 722295 - DNA, 25 bp, Mus musculus
gttaatcctgtttgtgtaaagcgaa

SEQ ID NO: 722296 - DNA, 25 bp, Mus musculus
gttaatccttataggagttgtgcca

SEQ ID NO: 722297 - DNA, 25 bp, Mus musculus
gttaatccttattggagttgtgcca

SEQ ID NO: 722298 - DNA, 25 bp, Mus musculus
gttaatcgccaacttgcaatcatcc

SEQ ID NO: 722299 - DNA, 25 bp, Mus musculus
gttaatcgccaagttgcaatcatcc

SEQ ID NO: 722300 - DNA, 25 bp, Mus musculus
gttaatctaattagctcggttcgtt

SEQ ID NO: 722301 - DNA, 25 bp, Mus musculus
gttaatctaatttgctcggttcgtt

SEQ ID NO: 722302 - DNA, 25 bp, Mus musculus
gttaatctactgcaaggcaccttgc

SEQ ID NO: 722303 - DNA, 25 bp, Mus musculus
gttaatctactggaaggcaccttgc

SEQ ID NO: 722304 - DNA, 25 bp, Mus musculus
gttaatctatttcataaagagtcac

SEQ ID NO: 722305 - DNA, 25 bp, Mus musculus
gttaatctatttgataaagagtcac

SEQ ID NO: 722306 - DNA, 25 bp, Mus musculus
gttaatctccaaaacctcagacttc

SEQ ID NO: 722307 - DNA, 25 bp, Mus musculus
gttaatctccaatacctcagacttc

SEQ ID NO: 722308 - DNA, 25 bp, Mus musculus
gttaatctgatgatcatgttcacct

SEQ ID NO: 722309 - DNA, 25 bp, Mus musculus
gttaatctgatgcaccacaaccagc

SEQ ID NO: 722310 - DNA, 25 bp, Mus musculus
gttaatctgatggaccacaaccagc

SEQ ID NO: 722311 - DNA, 25 bp, Mus musculus
gttaatctgatgttcatgttcacct

SEQ ID NO: 722312 - DNA, 25 bp, Mus musculus
gttaatctggtaattcccaccagtc

SEQ ID NO: 722313 - DNA, 25 bp, Mus musculus
gttaatctggtatttcccaccagtc

SEQ ID NO: 722314 - DNA, 25 bp, Mus musculus
gttaatctgtcaatcatctgttcat

SEQ ID NO: 722315 - DNA, 25 bp, Mus musculus
gttaatctgtcattcatctgttcat

SEQ ID NO: 722316 - DNA, 25 bp, Mus musculus
gttaatcttaccaattgaccatact

SEQ ID NO: 722317 - DNA, 25 bp, Mus musculus
gttaatcttacctattgaccatact

SEQ ID NO: 722318 - DNA, 25 bp, Mus musculus
gttaatcttcagcttgctttttgtt

SEQ ID NO: 722319 - DNA, 25 bp, Mus musculus
gttaatcttcaggttgctttttgtt

SEQ ID NO: 722320 - DNA, 25 bp, Mus musculus
gttaatcttcatactgtcagtttac

SEQ ID NO: 722321 - DNA, 25 bp, Mus musculus
gttaatcttcattctgtcagtttac

SEQ ID NO: 722322 - DNA, 25 bp, Mus musculus
gttaatcttccactgtgagcttgcc

SEQ ID NO: 722323 - DNA, 25 bp, Mus musculus
gttaatcttccagtgtgagcttgcc

SEQ ID NO: 722324 - DNA, 25 bp, Mus musculus
gttaatcttgttaaccttgctagct

SEQ ID NO: 722325 - DNA, 25 bp, Mus musculus
gttaatcttgtttaccttgctagct

SEQ ID NO: 722326 - DNA, 25 bp, Mus musculus
gttaatctttatccaccagcattgg

SEQ ID NO: 722327 - DNA, 25 bp, Mus musculus
gttaatctttatgcaccagcattgg

SEQ ID NO: 722328 - DNA, 25 bp, Mus musculus
gttaatgaacgcattgctaatgacg

SEQ ID NO: 722329 - DNA, 25 bp, Mus musculus
gttaatgaacgctttgctaatgacg

SEQ ID NO: 722330 - DNA, 25 bp, Mus musculus
gttaatgaccagaaggcctttccga

SEQ ID NO: 722331 - DNA, 25 bp, Mus musculus
gttaatgaccagtaggcctttccga

SEQ ID NO: 722332 - DNA, 25 bp, Mus musculus
gttaatgacttgatgggtagctatt

SEQ ID NO: 722333 - DNA, 25 bp, Mus musculus
gttaatgacttgttgggtagctatt

SEQ ID NO: 722334 - DNA, 25 bp, Mus musculus
gttaatgagcccctaagtgctgttt

SEQ ID NO: 722335 - DNA, 25 bp, Mus musculus
gttaatgagcccgtaagtgctgttt

SEQ ID NO: 722336 - DNA, 25 bp, Mus musculus
gttaatgagttacctatgagcctat

SEQ ID NO: 722337 - DNA, 25 bp, Mus musculus
gttaatgagttagctatgagcctat

SEQ ID NO: 722338 - DNA, 25 bp, Mus musculus
gttaatgatcaacggatatactcaa

SEQ ID NO: 722339 - DNA, 25 bp, Mus musculus
gttaatgatcaagggatatactcaa

SEQ ID NO: 722340 - DNA, 25 bp, Mus musculus
gttaatgattctctttctatatgat

SEQ ID NO: 722341 - DNA, 25 bp, Mus musculus
gttaatgattctgtttctatatgat

SEQ ID NO: 722342 - DNA, 25 bp, Mus musculus
gttaatgattgaccagttagcctaa

SEQ ID NO: 722343 - DNA, 25 bp, Mus musculus
gttaatgattgagcagttagcctaa

SEQ ID NO: 722344 - DNA, 25 bp, Mus musculus
gttaatgcacaaccgtagggaccct

SEQ ID NO: 722345 - DNA, 25 bp, Mus musculus
gttaatgcacaagcgtagggaccct

SEQ ID NO: 722346 - DNA, 25 bp, Mus musculus
gttaatgcatacatcctctctaatg

SEQ ID NO: 722347 - DNA, 25 bp, Mus musculus
gttaatgcatacttcctctctaatg

SEQ ID NO: 722348 - DNA, 25 bp, Mus musculus
gttaatgccacaatgcacgatatgg

SEQ ID NO: 722349 - DNA, 25 bp, Mus musculus
gttaatgccacattgcacgatatgg

SEQ ID NO: 722350 - DNA, 25 bp, Mus musculus
gttaatgcctttacacatcacagta

SEQ ID NO: 722351 - DNA, 25 bp, Mus musculus
gttaatgccttttcacatcacagta

SEQ ID NO: 722352 - DNA, 25 bp, Mus musculus
gttaatgctaatccctccttcaaga

SEQ ID NO: 722353 - DNA, 25 bp, Mus musculus
gttaatgctaatgcctccttcaaga

SEQ ID NO: 722354 - DNA, 25 bp, Mus musculus
gttaatgctcttcgtcatatcgata

SEQ ID NO: 722355 - DNA, 25 bp, Mus musculus
gttaatgctcttggtcatatcgata

SEQ ID NO: 722356 - DNA, 25 bp, Mus musculus
gttaatgctgggaatctgcatctat

SEQ ID NO: 722357 - DNA, 25 bp, Mus musculus
gttaatgctgggtatctgcatctat

SEQ ID NO: 722358 - DNA, 25 bp, Mus musculus
gttaatggacttacgataacttcct

SEQ ID NO: 722359 - DNA, 25 bp, Mus musculus
gttaatggactttcgataacttcct

SEQ ID NO: 722360 - DNA, 25 bp, Mus musculus
gttaatggctctcatgttgaaaaat

SEQ ID NO: 722361 - DNA, 25 bp, Mus musculus
gttaatggctctgatgttgaaaaat

SEQ ID NO: 722362 - DNA, 25 bp, Mus musculus
gttaatggctgactgcaccacactt

SEQ ID NO: 722363 - DNA, 25 bp, Mus musculus
gttaatggctgagtgcaccacactt

SEQ ID NO: 722364 - DNA, 25 bp, Mus musculus
gttaatgggtctatctattcttcaa

SEQ ID NO: 722365 - DNA, 25 bp, Mus musculus
gttaatgggtctttctattcttcaa

SEQ ID NO: 722366 - DNA, 25 bp, Mus musculus
gttaatggtccacctcaactgcaga

SEQ ID NO: 722367 - DNA, 25 bp, Mus musculus
gttaatggtccagctcaactgcaga

SEQ ID NO: 722368 - DNA, 25 bp, Mus musculus
gttaatggtgctagtttctctttca

SEQ ID NO: 722369 - DNA, 25 bp, Mus musculus
gttaatggtgcttgtttctctttca

SEQ ID NO: 722370 - DNA, 25 bp, Mus musculus
gttaatggtggtatcaagtcactga

SEQ ID NO: 722371 - DNA, 25 bp, Mus musculus
gttaatggtggtttcaagtcactga

SEQ ID NO: 722372 - DNA, 25 bp, Mus musculus
gttaatgtatcaaggtcctggaggt

SEQ ID NO: 722373 - DNA, 25 bp, Mus musculus
gttaatgtatcatggtcctggaggt

SEQ ID NO: 722374 - DNA, 25 bp, Mus musculus
gttaatgtcaaaaccatgcagtatt

SEQ ID NO: 722375 - DNA, 25 bp, Mus musculus
gttaatgtcaaatccatgcagtatt

SEQ ID NO: 722376 - DNA, 25 bp, Mus musculus
gttaatgtcttaaacgagctctctt

SEQ ID NO: 722377 - DNA, 25 bp, Mus musculus
gttaatgtcttatacgagctctctt

SEQ ID NO: 722378 - DNA, 25 bp, Mus musculus
gttaatgtgaacacggctatgcagt

SEQ ID NO: 722379 - DNA, 25 bp, Mus musculus
gttaatgtgaactcggctatgcagt

SEQ ID NO: 722380 - DNA, 25 bp, Mus musculus
gttaatgttataccctgatcgacac

SEQ ID NO: 722381 - DNA, 25 bp, Mus musculus
gttaatgttatagcctgatcgacac

SEQ ID NO: 722382 - DNA, 25 bp, Mus musculus
gttaatgtttatcggtctgattcaa

SEQ ID NO: 722383 - DNA, 25 bp, Mus musculus
gttaatgtttatgggtctgattcaa

SEQ ID NO: 722384 - DNA, 25 bp, Mus musculus
gttaattagtgacatagcagcatct

SEQ ID NO: 722385 - DNA, 25 bp, Mus musculus
gttaattagtgagatagcagcatct

SEQ ID NO: 722386 - DNA, 25 bp, Mus musculus
gttaattatatacctcaatgtgcta

SEQ ID NO: 722387 - DNA, 25 bp, Mus musculus
gttaattatatagctcaatgtgcta

SEQ ID NO: 722388 - DNA, 25 bp, Mus musculus
gttaattatcgcagaggacctggta

SEQ ID NO: 722389 - DNA, 25 bp, Mus musculus
gttaattatcgctgaggacctggta

SEQ ID NO: 722390 - DNA, 25 bp, Mus musculus
gttaattatgccagagtgcttttga

SEQ ID NO: 722391 - DNA, 25 bp, Mus musculus
gttaattatgcctgagtgcttttga

SEQ ID NO: 722392 - DNA, 25 bp, Mus musculus
gttaattatggtcgcacagccttat

SEQ ID NO: 722393 - DNA, 25 bp, Mus musculus
gttaattatggtggcacagccttat

SEQ ID NO: 722394 - DNA, 25 bp, Mus musculus
gttaattcagacctctcacacaagg

SEQ ID NO: 722395 - DNA, 25 bp, Mus musculus
gttaattcagacgtctcacacaagg

SEQ ID NO: 722396 - DNA, 25 bp, Mus musculus
gttaattcagagacctacttgcaga

SEQ ID NO: 722397 - DNA, 25 bp, Mus musculus
gttaattcagagtcctacttgcaga

SEQ ID NO: 722398 - DNA, 25 bp, Mus musculus
gttaattcaggcctgtgacagccac

SEQ ID NO: 722399 - DNA, 25 bp, Mus musculus
gttaattcaggcgtgtgacagccac

SEQ ID NO: 722400 - DNA, 25 bp, Mus musculus
gttaattcccaaccagcgttcaatt

SEQ ID NO: 722401 - DNA, 25 bp, Mus musculus
gttaattcccaagcagcgttcaatt

SEQ ID NO: 722402 - DNA, 25 bp, Mus musculus
gttaattcctgcattgtttcaatgg

SEQ ID NO: 722403 - DNA, 25 bp, Mus musculus
gttaattcctgctttgtttcaatgg

SEQ ID NO: 722404 - DNA, 25 bp, Mus musculus
gttaattctgcacttccatgaggga

SEQ ID NO: 722405 - DNA, 25 bp, Mus musculus
gttaattctgcagttccatgaggga

SEQ ID NO: 722406 - DNA, 25 bp, Mus musculus
gttaattctgccacagtctgcgatc

SEQ ID NO: 722407 - DNA, 25 bp, Mus musculus
gttaattctgcctcagtctgcgatc

SEQ ID NO: 722408 - DNA, 25 bp, Mus musculus
gttaattctggactacatatgcata

SEQ ID NO: 722409 - DNA, 25 bp, Mus musculus
gttaattctggagtacatatgcata

SEQ ID NO: 722410 - DNA, 25 bp, Mus musculus
gttaattcttataacttggtgacca

SEQ ID NO: 722411 - DNA, 25 bp, Mus musculus
gttaattcttattacttggtgacca

SEQ ID NO: 722412 - DNA, 25 bp, Mus musculus
gttaattctttacccagtcagttct

SEQ ID NO: 722413 - DNA, 25 bp, Mus musculus
gttaattctttagccagtcagttct

SEQ ID NO: 722414 - DNA, 25 bp, Mus musculus
gttaattcttttaccagacacactg

SEQ ID NO: 722415 - DNA, 25 bp, Mus musculus
gttaattctttttccagacacactg

SEQ ID NO: 722416 - DNA, 25 bp, Mus musculus
gttaattgacataggctttactttc

SEQ ID NO: 722417 - DNA, 25 bp, Mus musculus
gttaattgacattggctttactttc

SEQ ID NO: 722418 - DNA, 25 bp, Mus musculus
gttaattgcaatcttggctctcaga

SEQ ID NO: 722419 - DNA, 25 bp, Mus musculus
gttaattgcaatgttggctctcaga

SEQ ID NO: 722420 - DNA, 25 bp, Mus musculus
gttaattgccacacggacttcatga

SEQ ID NO: 722421 - DNA, 25 bp, Mus musculus
gttaattgccactcggacttcatga

SEQ ID NO: 722422 - DNA, 25 bp, Mus musculus
gttaattgccagatcagggttctta

SEQ ID NO: 722423 - DNA, 25 bp, Mus musculus
gttaattgccagttcagggttctta

SEQ ID NO: 722424 - DNA, 25 bp, Mus musculus
gttaattgcgtcacaaaagctctga

SEQ ID NO: 722425 - DNA, 25 bp, Mus musculus
gttaattgcgtctcaaaagctctga

SEQ ID NO: 722426 - DNA, 25 bp, Mus musculus
gttaattgctcacttccttatcgta

SEQ ID NO: 722427 - DNA, 25 bp, Mus musculus
gttaattgctcagttccttatcgta

SEQ ID NO: 722428 - DNA, 25 bp, Mus musculus
gttaattggagcacttgggagcctt

SEQ ID NO: 722429 - DNA, 25 bp, Mus musculus
gttaattggagctcttgggagcctt

SEQ ID NO: 722430 - DNA, 25 bp, Mus musculus
gttaattgggatactgctgaaggct

SEQ ID NO: 722431 - DNA, 25 bp, Mus musculus
gttaattgggattctgctgaaggct

SEQ ID NO: 722432 - DNA, 25 bp, Mus musculus
gttaattgttcaagcacattcattt

SEQ ID NO: 722433 - DNA, 25 bp, Mus musculus
gttaattgttcatgcacattcattt

SEQ ID NO: 722434 - DNA, 25 bp, Mus musculus
gttaatttaagtactgttgctgtga

SEQ ID NO: 722435 - DNA, 25 bp, Mus musculus
gttaatttaagttctgttgctgtga

SEQ ID NO: 722436 - DNA, 25 bp, Mus musculus
gttaatttcacacattttcattttg

SEQ ID NO: 722437 - DNA, 25 bp, Mus musculus
gttaatttcacagattttcattttg

SEQ ID NO: 722438 - DNA, 25 bp, Mus musculus
gttaatttcaccaggcttcattcat

SEQ ID NO: 722439 - DNA, 25 bp, Mus musculus
gttaatttcacctggcttcattcat

SEQ ID NO: 722440 - DNA, 25 bp, Mus musculus
gttaatttccatcctcttcagactg

SEQ ID NO: 722441 - DNA, 25 bp, Mus musculus
gttaatttccatgctcttcagactg

SEQ ID NO: 722442 - DNA, 25 bp, Mus musculus
gttaatttcgcactgttgtgccact

SEQ ID NO: 722443 - DNA, 25 bp, Mus musculus
gttaatttcgcagtgttgtgccact

SEQ ID NO: 722444 - DNA, 25 bp, Mus musculus
gttaatttctccagcatttacacac

SEQ ID NO: 722445 - DNA, 25 bp, Mus musculus
gttaatttctcctgcatttacacac

SEQ ID NO: 722446 - DNA, 25 bp, Mus musculus
gttaatttggctctaatggcattta

SEQ ID NO: 722447 - DNA, 25 bp, Mus musculus
gttaatttggctgtaatggcattta

SEQ ID NO: 722448 - DNA, 25 bp, Mus musculus
gttaattttcctactacactgaagc

SEQ ID NO: 722449 - DNA, 25 bp, Mus musculus
gttaattttccttctacactgaagc

SEQ ID NO: 722450 - DNA, 25 bp, Mus musculus
gttaattttgctaagagcacctcta

SEQ ID NO: 722451 - DNA, 25 bp, Mus musculus
gttaattttgcttagagcacctcta

SEQ ID NO: 722452 - DNA, 25 bp, Mus musculus
gttaattttgttcatggctgtaagt

SEQ ID NO: 722453 - DNA, 25 bp, Mus musculus
gttaattttgttgatggctgtaagt

SEQ ID NO: 722454 - DNA, 25 bp, Mus musculus
gttaatttttggcacttcctatata

SEQ ID NO: 722455 - DNA, 25 bp, Mus musculus
gttaatttttgggacttcctatata

SEQ ID NO: 722456 - DNA, 25 bp, Mus musculus
gttacaaaagttcctcacctctcaa

SEQ ID NO: 722457 - DNA, 25 bp, Mus musculus
gttacaaaagttgctcacctctcaa

SEQ ID NO: 722458 - DNA, 25 bp, Mus musculus
gttacaaataccagccaaggtgatg

SEQ ID NO: 722459 - DNA, 25 bp, Mus musculus
gttacaaatacctgccaaggtgatg

SEQ ID NO: 722460 - DNA, 25 bp, Mus musculus
gttacaaatgtactgatgcttcact

SEQ ID NO: 722461 - DNA, 25 bp, Mus musculus
gttacaaatgtagtgatgcttcact

SEQ ID NO: 722462 - DNA, 25 bp, Mus musculus
gttacaaatgtccttcacttgctat

SEQ ID NO: 722463 - DNA, 25 bp, Mus musculus
gttacaaatgtcgttcacttgctat

SEQ ID NO: 722464 - DNA, 25 bp, Mus musculus
gttacaaatttcaaatcatacccaa

SEQ ID NO: 722465 - DNA, 25 bp, Mus musculus
gttacaaatttctaatcatacccaa

SEQ ID NO: 722466 - DNA, 25 bp, Mus musculus
gttacaacaaaccaaagtgactgag

SEQ ID NO: 722467 - DNA, 25 bp, Mus musculus
gttacaacaaacgaaagtgactgag

SEQ ID NO: 722468 - DNA, 25 bp, Mus musculus
gttacaacactaccaaaccaccaag

SEQ ID NO: 722469 - DNA, 25 bp, Mus musculus
gttacaacactagcaaaccaccaag

SEQ ID NO: 722470 - DNA, 25 bp, Mus musculus
gttacaacatgtctactgccaggat

SEQ ID NO: 722471 - DNA, 25 bp, Mus musculus
gttacaacatgtgtactgccaggat

SEQ ID NO: 722472 - DNA, 25 bp, Mus musculus
gttacaacatttatcagggccatag

SEQ ID NO: 722473 - DNA, 25 bp, Mus musculus
gttacaacatttttcagggccatag

SEQ ID NO: 722474 - DNA, 25 bp, Mus musculus
gttacaacccaaagttctaagtgtg

SEQ ID NO: 722475 - DNA, 25 bp, Mus musculus
gttacaacccaatgttctaagtgtg

SEQ ID NO: 722476 - DNA, 25 bp, Mus musculus
gttacaaccctgcaaagtctcggag

SEQ ID NO: 722477 - DNA, 25 bp, Mus musculus
gttacaaccctggaaagtctcggag

SEQ ID NO: 722478 - DNA, 25 bp, Mus musculus
gttacaacgactatgaggtggccaa

SEQ ID NO: 722479 - DNA, 25 bp, Mus musculus
gttacaacgactttgaggtggccaa

SEQ ID NO: 722480 - DNA, 25 bp, Mus musculus
gttacaacgcctcgtggccgccgaa

SEQ ID NO: 722481 - DNA, 25 bp, Mus musculus
gttacaacgcctggtggccgccgaa

SEQ ID NO: 722482 - DNA, 25 bp, Mus musculus
gttacaactcggctctaagtcaaat

SEQ ID NO: 722483 - DNA, 25 bp, Mus musculus
gttacaactcgggtctaagtcaaat

SEQ ID NO: 722484 - DNA, 25 bp, Mus musculus
gttacaactctgcagagctgtgata

SEQ ID NO: 722485 - DNA, 25 bp, Mus musculus
gttacaactctggagagctgtgata

SEQ ID NO: 722486 - DNA, 25 bp, Mus musculus
gttacaacttgaacatgctttgaat

SEQ ID NO: 722487 - DNA, 25 bp, Mus musculus
gttacaacttgaacttgaatctttt

SEQ ID NO: 722488 - DNA, 25 bp, Mus musculus
gttacaacttgatcatgctttgaat

SEQ ID NO: 722489 - DNA, 25 bp, Mus musculus
gttacaacttgatcttgaatctttt

SEQ ID NO: 722490 - DNA, 25 bp, Mus musculus
gttacaagaactccagttacaagag

SEQ ID NO: 722491 - DNA, 25 bp, Mus musculus
gttacaagaactcctaaagccctgc

SEQ ID NO: 722492 - DNA, 25 bp, Mus musculus
gttacaagaactgcagttacaagag

SEQ ID NO: 722493 - DNA, 25 bp, Mus musculus
gttacaagaactgctaaagccctgc

SEQ ID NO: 722494 - DNA, 25 bp, Mus musculus
gttacaagaagcattcttcctcctc

SEQ ID NO: 722495 - DNA, 25 bp, Mus musculus
gttacaagaagctttcttcctcctc

SEQ ID NO: 722496 - DNA, 25 bp, Mus musculus
gttacaagatgccaacgagccgctg

SEQ ID NO: 722497 - DNA, 25 bp, Mus musculus
gttacaagatgcgaacgagccgctg

SEQ ID NO: 722498 - DNA, 25 bp, Mus musculus
gttacaagccataagcatgagcccc

SEQ ID NO: 722499 - DNA, 25 bp, Mus musculus
gttacaagccattagcatgagcccc

SEQ ID NO: 722500 - DNA, 25 bp, Mus musculus
gttacaagcccaaacttcacaaatt

SEQ ID NO: 722501 - DNA, 25 bp, Mus musculus
gttacaagcccatacttcacaaatt

SEQ ID NO: 722502 - DNA, 25 bp, Mus musculus
gttacaaggaaaccgctacctcagc

SEQ ID NO: 722503 - DNA, 25 bp, Mus musculus
gttacaaggaaagcgctacctcagc

SEQ ID NO: 722504 - DNA, 25 bp, Mus musculus
gttacaagggaaatctgctgcttct

SEQ ID NO: 722505 - DNA, 25 bp, Mus musculus
gttacaagggaattctgctgcttct

SEQ ID NO: 722506 - DNA, 25 bp, Mus musculus
gttacaaggtgcacggaggccagcc

SEQ ID NO: 722507 - DNA, 25 bp, Mus musculus
gttacaaggtgctcggaggccagcc

SEQ ID NO: 722508 - DNA, 25 bp, Mus musculus
gttacaagtgctctagaacactgag

SEQ ID NO: 722509 - DNA, 25 bp, Mus musculus
gttacaagtgctgtagaacactgag

SEQ ID NO: 722510 - DNA, 25 bp, Mus musculus
gttacaataatgattaccatgcctc

SEQ ID NO: 722511 - DNA, 25 bp, Mus musculus
gttacaataatgtttaccatgcctc

SEQ ID NO: 722512 - DNA, 25 bp, Mus musculus
gttacaatacagctacatactgaac

SEQ ID NO: 722513 - DNA, 25 bp, Mus musculus
gttacaatacaggtacatactgaac

SEQ ID NO: 722514 - DNA, 25 bp, Mus musculus
gttacaatccgacagtcctacagac

SEQ ID NO: 722515 - DNA, 25 bp, Mus musculus
gttacaatccgagagtcctacagac

SEQ ID NO: 722516 - DNA, 25 bp, Mus musculus
gttacaatctggatttacggagata

SEQ ID NO: 722517 - DNA, 25 bp, Mus musculus
gttacaatctggttttacggagata

SEQ ID NO: 722518 - DNA, 25 bp, Mus musculus
gttacaatgccaaatgtcaccaagt

SEQ ID NO: 722519 - DNA, 25 bp, Mus musculus
gttacaatgccatatgtcaccaagt

SEQ ID NO: 722520 - DNA, 25 bp, Mus musculus
gttacaatggctcactaaccacacc

SEQ ID NO: 722521 - DNA, 25 bp, Mus musculus
gttacaatggctgactaaccacacc

SEQ ID NO: 722522 - DNA, 25 bp, Mus musculus
gttacaatgtggcatgttctgcata

SEQ ID NO: 722523 - DNA, 25 bp, Mus musculus
gttacaatgtgggatgttctgcata

SEQ ID NO: 722524 - DNA, 25 bp, Mus musculus
gttacaattctaccgttgcatctca

SEQ ID NO: 722525 - DNA, 25 bp, Mus musculus
gttacaattctagcgttgcatctca

SEQ ID NO: 722526 - DNA, 25 bp, Mus musculus
gttacaattcttaaagcccatggct

SEQ ID NO: 722527 - DNA, 25 bp, Mus musculus
gttacaattctttaagcccatggct

SEQ ID NO: 722528 - DNA, 25 bp, Mus musculus
gttacacaaagtcgcccattcttgt

SEQ ID NO: 722529 - DNA, 25 bp, Mus musculus
gttacacaaagtggcccattcttgt

SEQ ID NO: 722530 - DNA, 25 bp, Mus musculus
gttacacaaatgcagttttccccgt

SEQ ID NO: 722531 - DNA, 25 bp, Mus musculus
gttacacaaatggagttttccccgt

SEQ ID NO: 722532 - DNA, 25 bp, Mus musculus
gttacacaacacagagcgcaatcat

SEQ ID NO: 722533 - DNA, 25 bp, Mus musculus
gttacacaacactgagcgcaatcat

SEQ ID NO: 722534 - DNA, 25 bp, Mus musculus
gttacacaagctagataccttcagt

SEQ ID NO: 722535 - DNA, 25 bp, Mus musculus
gttacacaagcttgataccttcagt

SEQ ID NO: 722536 - DNA, 25 bp, Mus musculus
gttacacaatttcaactctctaaag

SEQ ID NO: 722537 - DNA, 25 bp, Mus musculus
gttacacaatttgaactctctaaag

SEQ ID NO: 722538 - DNA, 25 bp, Mus musculus
gttacacacaggattggtctaccta

SEQ ID NO: 722539 - DNA, 25 bp, Mus musculus
gttacacacaggtttggtctaccta

SEQ ID NO: 722540 - DNA, 25 bp, Mus musculus
gttacacacagtaaaggactcttga

SEQ ID NO: 722541 - DNA, 25 bp, Mus musculus
gttacacacagttaaggactcttga

SEQ ID NO: 722542 - DNA, 25 bp, Mus musculus
gttacacacttcctgattctgtgct

SEQ ID NO: 722543 - DNA, 25 bp, Mus musculus
gttacacacttcgtgattctgtgct

SEQ ID NO: 722544 - DNA, 25 bp, Mus musculus
gttacacactttagtctaacctgtt

SEQ ID NO: 722545 - DNA, 25 bp, Mus musculus
gttacacacttttgtctaacctgtt

SEQ ID NO: 722546 - DNA, 25 bp, Mus musculus
gttacacagagacgtccattcccac

SEQ ID NO: 722547 - DNA, 25 bp, Mus musculus
gttacacagagaggtccattcccac

SEQ ID NO: 722548 - DNA, 25 bp, Mus musculus
gttacacagattctccagttaaaag

SEQ ID NO: 722549 - DNA, 25 bp, Mus musculus
gttacacagattgtccagttaaaag

SEQ ID NO: 722550 - DNA, 25 bp, Mus musculus
gttacacagcctacctgtccttgtc

SEQ ID NO: 722551 - DNA, 25 bp, Mus musculus
gttacacagccttcctgtccttgtc

SEQ ID NO: 722552 - DNA, 25 bp, Mus musculus
gttacacagcggaggccggccagca

SEQ ID NO: 722553 - DNA, 25 bp, Mus musculus
gttacacagcggtggccggccagca

SEQ ID NO: 722554 - DNA, 25 bp, Mus musculus
gttacacaggccaccaacacaatgt

SEQ ID NO: 722555 - DNA, 25 bp, Mus musculus
gttacacaggcctccaacacaatgt

SEQ ID NO: 722556 - DNA, 25 bp, Mus musculus
gttacacagtcaagatattagtcat

SEQ ID NO: 722557 - DNA, 25 bp, Mus musculus
gttacacagtcatgatattagtcat

SEQ ID NO: 722558 - DNA, 25 bp, Mus musculus
gttacacagtttagccccacttggg

SEQ ID NO: 722559 - DNA, 25 bp, Mus musculus
gttacacagttttgccccacttggg

SEQ ID NO: 722560 - DNA, 25 bp, Mus musculus
gttacacatccacttatggcgactg

SEQ ID NO: 722561 - DNA, 25 bp, Mus musculus
gttacacatccagttatggcgactg

SEQ ID NO: 722562 - DNA, 25 bp, Mus musculus
gttacacatcgaccaacacactggt

SEQ ID NO: 722563 - DNA, 25 bp, Mus musculus
gttacacatcgagcaacacactggt

SEQ ID NO: 722564 - DNA, 25 bp, Mus musculus
gttacacatctcacaccaagacagt

SEQ ID NO: 722565 - DNA, 25 bp, Mus musculus
gttacacatctctcaccaagacagt

SEQ ID NO: 722566 - DNA, 25 bp, Mus musculus
gttacaccaattaaagaagcaggag

SEQ ID NO: 722567 - DNA, 25 bp, Mus musculus
gttacaccaatttaagaagcaggag

SEQ ID NO: 722568 - DNA, 25 bp, Mus musculus
gttacaccaggtatagccagtcgcc

SEQ ID NO: 722569 - DNA, 25 bp, Mus musculus
gttacaccaggtttagccagtcgcc

SEQ ID NO: 722570 - DNA, 25 bp, Mus musculus
gttacaccatacactctctatgagc

SEQ ID NO: 722571 - DNA, 25 bp, Mus musculus
gttacaccatactctctctatgagc

SEQ ID NO: 722572 - DNA, 25 bp, Mus musculus
gttacaccctagattcagttgtttg

SEQ ID NO: 722573 - DNA, 25 bp, Mus musculus
gttacaccctagtttcagttgtttg

SEQ ID NO: 722574 - DNA, 25 bp, Mus musculus
gttacacccttccttggaggaggag

SEQ ID NO: 722575 - DNA, 25 bp, Mus musculus
gttacacccttcgttggaggaggag

SEQ ID NO: 722576 - DNA, 25 bp, Mus musculus
gttacaccgcgacttagttcggagt

SEQ ID NO: 722577 - DNA, 25 bp, Mus musculus
gttacaccgcgagttagttcggagt

SEQ ID NO: 722578 - DNA, 25 bp, Mus musculus
gttacacctaatcacctaaactgag

SEQ ID NO: 722579 - DNA, 25 bp, Mus musculus
gttacacctaatgacctaaactgag

SEQ ID NO: 722580 - DNA, 25 bp, Mus musculus
gttacacctcaacacagtcaatcag

SEQ ID NO: 722581 - DNA, 25 bp, Mus musculus
gttacacctcaagacagtcaatcag

SEQ ID NO: 722582 - DNA, 25 bp, Mus musculus
gttacacctgagaatgcctattatt

SEQ ID NO: 722583 - DNA, 25 bp, Mus musculus
gttacacctgagtatgcctattatt

SEQ ID NO: 722584 - DNA, 25 bp, Mus musculus
gttacacgaaccactaccgggatag

SEQ ID NO: 722585 - DNA, 25 bp, Mus musculus
gttacacgaacctctaccgggatag

SEQ ID NO: 722586 - DNA, 25 bp, Mus musculus
gttacacgaccaattatcagttcaa

SEQ ID NO: 722587 - DNA, 25 bp, Mus musculus
gttacacgaccatttatcagttcaa

SEQ ID NO: 722588 - DNA, 25 bp, Mus musculus
gttacactaagactgtggttcgcaa

SEQ ID NO: 722589 - DNA, 25 bp, Mus musculus
gttacactaagagtgtggttcgcaa

SEQ ID NO: 722590 - DNA, 25 bp, Mus musculus
gttacactagaaaatccttcctgac

SEQ ID NO: 722591 - DNA, 25 bp, Mus musculus
gttacactagaatatccttcctgac

SEQ ID NO: 722592 - DNA, 25 bp, Mus musculus
gttacactcaaaactgttctctgct

SEQ ID NO: 722593 - DNA, 25 bp, Mus musculus
gttacactcaaatctgttctctgct

SEQ ID NO: 722594 - DNA, 25 bp, Mus musculus
gttacactcctaaagctttcgatga

SEQ ID NO: 722595 - DNA, 25 bp, Mus musculus
gttacactcctatagctttcgatga

SEQ ID NO: 722596 - DNA, 25 bp, Mus musculus
gttacactctttacctctttgctgt

SEQ ID NO: 722597 - DNA, 25 bp, Mus musculus
gttacactcttttcctctttgctgt

SEQ ID NO: 722598 - DNA, 25 bp, Mus musculus
gttacactgaatacatcttcttccg

SEQ ID NO: 722599 - DNA, 25 bp, Mus musculus
gttacactgaattcatcttcttccg

SEQ ID NO: 722600 - DNA, 25 bp, Mus musculus
gttacactgacacagtttgtagtct

SEQ ID NO: 722601 - DNA, 25 bp, Mus musculus
gttacactgacagagtttgtagtct

SEQ ID NO: 722602 - DNA, 25 bp, Mus musculus
gttacactggcccacatcattgcca

SEQ ID NO: 722603 - DNA, 25 bp, Mus musculus
gttacactggccgacatcattgcca

SEQ ID NO: 722604 - DNA, 25 bp, Mus musculus
gttacacttatacaccctcttgacg

SEQ ID NO: 722605 - DNA, 25 bp, Mus musculus
gttacacttatagaccctcttgacg

SEQ ID NO: 722606 - DNA, 25 bp, Mus musculus
gttacacttggacactacagggcct

SEQ ID NO: 722607 - DNA, 25 bp, Mus musculus
gttacacttggagactacagggcct

SEQ ID NO: 722608 - DNA, 25 bp, Mus musculus
gttacagaaaccatcctgcctggaa

SEQ ID NO: 722609 - DNA, 25 bp, Mus musculus
gttacagaaaccttcctgcctggaa

SEQ ID NO: 722610 - DNA, 25 bp, Mus musculus
gttacagaacgaatgggtcaataaa

SEQ ID NO: 722611 - DNA, 25 bp, Mus musculus
gttacagaacgattgggtcaataaa

SEQ ID NO: 722612 - DNA, 25 bp, Mus musculus
gttacagaactaccccatgaaggtt

SEQ ID NO: 722613 - DNA, 25 bp, Mus musculus
gttacagaactagcccatgaaggtt

SEQ ID NO: 722614 - DNA, 25 bp, Mus musculus
gttacagacagaatggtgggtgcca

SEQ ID NO: 722615 - DNA, 25 bp, Mus musculus
gttacagacagattggtgggtgcca

SEQ ID NO: 722616 - DNA, 25 bp, Mus musculus
gttacagacataccctatgccactg

SEQ ID NO: 722617 - DNA, 25 bp, Mus musculus
gttacagacatagcctatgccactg

SEQ ID NO: 722618 - DNA, 25 bp, Mus musculus
gttacagacttgagctaccacttcc

SEQ ID NO: 722619 - DNA, 25 bp, Mus musculus
gttacagacttgtgctaccacttcc

SEQ ID NO: 722620 - DNA, 25 bp, Mus musculus
gttacagagaacaggcgcgcccaca

SEQ ID NO: 722621 - DNA, 25 bp, Mus musculus
gttacagagaactggcgcgcccaca

SEQ ID NO: 722622 - DNA, 25 bp, Mus musculus
gttacagagagtacgctatgcaata

SEQ ID NO: 722623 - DNA, 25 bp, Mus musculus
gttacagagagttcgctatgcaata

SEQ ID NO: 722624 - DNA, 25 bp, Mus musculus
gttacagagcctaatgatgcctggg

SEQ ID NO: 722625 - DNA, 25 bp, Mus musculus
gttacagagccttatgatgcctggg

SEQ ID NO: 722626 - DNA, 25 bp, Mus musculus
gttacagaggagattccagctgttg

SEQ ID NO: 722627 - DNA, 25 bp, Mus musculus
gttacagaggagtttccagctgttg

SEQ ID NO: 722628 - DNA, 25 bp, Mus musculus
gttacagaggtgcttggctctccac

SEQ ID NO: 722629 - DNA, 25 bp, Mus musculus
gttacagaggtggttggctctccac

SEQ ID NO: 722630 - DNA, 25 bp, Mus musculus
gttacagagtacatgtagttccaaa

SEQ ID NO: 722631 - DNA, 25 bp, Mus musculus
gttacagagtacttgtagttccaaa

SEQ ID NO: 722632 - DNA, 25 bp, Mus musculus
gttacagatattacctaatcctaga

SEQ ID NO: 722633 - DNA, 25 bp, Mus musculus
gttacagatatttcctaatcctaga

SEQ ID NO: 722634 - DNA, 25 bp, Mus musculus
gttacagatcagagccaccacacaa

SEQ ID NO: 722635 - DNA, 25 bp, Mus musculus
gttacagatcagtgccaccacacaa

SEQ ID NO: 722636 - DNA, 25 bp, Mus musculus
gttacagatgctcaacaacccagag

SEQ ID NO: 722637 - DNA, 25 bp, Mus musculus
gttacagatgctgaacaacccagag

SEQ ID NO: 722638 - DNA, 25 bp, Mus musculus
gttacagattgaagcatcatcctta

SEQ ID NO: 722639 - DNA, 25 bp, Mus musculus
gttacagattgactctaaaaggaag

SEQ ID NO: 722640 - DNA, 25 bp, Mus musculus
gttacagattgagtctaaaaggaag

SEQ ID NO: 722641 - DNA, 25 bp, Mus musculus
gttacagattgatgcatcatcctta

SEQ ID NO: 722642 - DNA, 25 bp, Mus musculus
gttacagcaatcacacacagacact

SEQ ID NO: 722643 - DNA, 25 bp, Mus musculus
gttacagcaatctcacacagacact

SEQ ID NO: 722644 - DNA, 25 bp, Mus musculus
gttacagcagctcacggcttattta

SEQ ID NO: 722645 - DNA, 25 bp, Mus musculus
gttacagcagctgacggcttattta

SEQ ID NO: 722646 - DNA, 25 bp, Mus musculus
gttacagccaacaaactttcagagg

SEQ ID NO: 722647 - DNA, 25 bp, Mus musculus
gttacagccaactaactttcagagg

SEQ ID NO: 722648 - DNA, 25 bp, Mus musculus
gttacagccaagagccaaatgctat

SEQ ID NO: 722649 - DNA, 25 bp, Mus musculus
gttacagccaagtgccaaatgctat

SEQ ID NO: 722650 - DNA, 25 bp, Mus musculus
gttacagccaatcgttttccacagg

SEQ ID NO: 722651 - DNA, 25 bp, Mus musculus
gttacagccaatggttttccacagg

SEQ ID NO: 722652 - DNA, 25 bp, Mus musculus
gttacagccaggacacggagcatca

SEQ ID NO: 722653 - DNA, 25 bp, Mus musculus
gttacagccaggtcacggagcatca

SEQ ID NO: 722654 - DNA, 25 bp, Mus musculus
gttacagcccaactgacctggacag

SEQ ID NO: 722655 - DNA, 25 bp, Mus musculus
gttacagcccaagtgacctggacag

SEQ ID NO: 722656 - DNA, 25 bp, Mus musculus
gttacagccccacagatcaccgaag

SEQ ID NO: 722657 - DNA, 25 bp, Mus musculus
gttacagccccagagatcaccgaag

SEQ ID NO: 722658 - DNA, 25 bp, Mus musculus
gttacagccctgcttgcgttcctgc

SEQ ID NO: 722659 - DNA, 25 bp, Mus musculus
gttacagccctggttgcgttcctgc

SEQ ID NO: 722660 - DNA, 25 bp, Mus musculus
gttacagcctcgaatttcttttaag

SEQ ID NO: 722661 - DNA, 25 bp, Mus musculus
gttacagcctcgtatttcttttaag

SEQ ID NO: 722662 - DNA, 25 bp, Mus musculus
gttacagcgcagattacaccagact

SEQ ID NO: 722663 - DNA, 25 bp, Mus musculus
gttacagcgcagtttacaccagact

SEQ ID NO: 722664 - DNA, 25 bp, Mus musculus
gttacagcgcgtcacagagcaccaa

SEQ ID NO: 722665 - DNA, 25 bp, Mus musculus
gttacagcgcgtgacagagcaccaa

SEQ ID NO: 722666 - DNA, 25 bp, Mus musculus
gttacagcggcaaggcggcacacac

SEQ ID NO: 722667 - DNA, 25 bp, Mus musculus
gttacagcggcatggcggcacacac

SEQ ID NO: 722668 - DNA, 25 bp, Mus musculus
gttacagcgtgcaaagatctttatc

SEQ ID NO: 722669 - DNA, 25 bp, Mus musculus
gttacagcgtgctaagatctttatc

SEQ ID NO: 722670 - DNA, 25 bp, Mus musculus
gttacagctgagacaggaccgtctc

SEQ ID NO: 722671 - DNA, 25 bp, Mus musculus
gttacagctgagtcaggaccgtctc

SEQ ID NO: 722672 - DNA, 25 bp, Mus musculus
gttacaggaaaccaccctctcattt

SEQ ID NO: 722673 - DNA, 25 bp, Mus musculus
gttacaggaaacgaccctctcattt

SEQ ID NO: 722674 - DNA, 25 bp, Mus musculus
gttacaggagtaccagacgtggctt

SEQ ID NO: 722675 - DNA, 25 bp, Mus musculus
gttacaggagtagcagacgtggctt

SEQ ID NO: 722676 - DNA, 25 bp, Mus musculus
gttacaggatataaacttaatgttc

SEQ ID NO: 722677 - DNA, 25 bp, Mus musculus
gttacaggatattaacttaatgttc

SEQ ID NO: 722678 - DNA, 25 bp, Mus musculus
gttacaggcaataccatgtgaccat

SEQ ID NO: 722679 - DNA, 25 bp, Mus musculus
gttacaggcaattccatgtgaccat

SEQ ID NO: 722680 - DNA, 25 bp, Mus musculus
gttacaggcagcatcatgctttctg

SEQ ID NO: 722681 - DNA, 25 bp, Mus musculus
gttacaggcagcttcatgctttctg

SEQ ID NO: 722682 - DNA, 25 bp, Mus musculus
gttacaggcgacatcatgctaatga

SEQ ID NO: 722683 - DNA, 25 bp, Mus musculus
gttacaggcgacttcatgctaatga

SEQ ID NO: 722684 - DNA, 25 bp, Mus musculus
gttacaggcttaacagcaccttggc

SEQ ID NO: 722685 - DNA, 25 bp, Mus musculus
gttacaggcttatcagcaccttggc

SEQ ID NO: 722686 - DNA, 25 bp, Mus musculus
gttacagggcttcaggcacatggta

SEQ ID NO: 722687 - DNA, 25 bp, Mus musculus
gttacagggcttgaggcacatggta

SEQ ID NO: 722688 - DNA, 25 bp, Mus musculus
gttacaggtaacagctgtctttttt

SEQ ID NO: 722689 - DNA, 25 bp, Mus musculus
gttacaggtaactgctgtctttttt

SEQ ID NO: 722690 - DNA, 25 bp, Mus musculus
gttacaggtcggatcatactctttg

SEQ ID NO: 722691 - DNA, 25 bp, Mus musculus
gttacaggtcggttcatactctttg

SEQ ID NO: 722692 - DNA, 25 bp, Mus musculus
gttacaggtggcattgaaccacatc

SEQ ID NO: 722693 - DNA, 25 bp, Mus musculus
gttacaggtggctttgaaccacatc

SEQ ID NO: 722694 - DNA, 25 bp, Mus musculus
gttacaggtgtccatagagcacttg

SEQ ID NO: 722695 - DNA, 25 bp, Mus musculus
gttacaggtgtcgatagagcacttg

SEQ ID NO: 722696 - DNA, 25 bp, Mus musculus
gttacaggttacaccagacagttac

SEQ ID NO: 722697 - DNA, 25 bp, Mus musculus
gttacaggttactccagacagttac

SEQ ID NO: 722698 - DNA, 25 bp, Mus musculus
gttacaggttcactacttccaaagg

SEQ ID NO: 722699 - DNA, 25 bp, Mus musculus
gttacaggttcagtacttccaaagg

SEQ ID NO: 722700 - DNA, 25 bp, Mus musculus
gttacaggttttactatggacgcca

SEQ ID NO: 722701 - DNA, 25 bp, Mus musculus
gttacaggttttcatgttcaggaca

SEQ ID NO: 722702 - DNA, 25 bp, Mus musculus
gttacaggttttgatgttcaggaca

SEQ ID NO: 722703 - DNA, 25 bp, Mus musculus
gttacaggtttttctatggacgcca

SEQ ID NO: 722704 - DNA, 25 bp, Mus musculus
gttacagtacgtactgtacctgcca

SEQ ID NO: 722705 - DNA, 25 bp, Mus musculus
gttacagtacgttctgtacctgcca

SEQ ID NO: 722706 - DNA, 25 bp, Mus musculus
gttacagtagagagggctgaccccg

SEQ ID NO: 722707 - DNA, 25 bp, Mus musculus
gttacagtagagtgggctgaccccg

SEQ ID NO: 722708 - DNA, 25 bp, Mus musculus
gttacagtagcaactctgctccctg

SEQ ID NO: 722709 - DNA, 25 bp, Mus musculus
gttacagtagcatctctgctccctg

SEQ ID NO: 722710 - DNA, 25 bp, Mus musculus
gttacagtcaggactgagggtcatt

SEQ ID NO: 722711 - DNA, 25 bp, Mus musculus
gttacagtcaggtctgagggtcatt

SEQ ID NO: 722712 - DNA, 25 bp, Mus musculus
gttacagtccaacacgtgttcttaa

SEQ ID NO: 722713 - DNA, 25 bp, Mus musculus
gttacagtccaagacgtgttcttaa

SEQ ID NO: 722714 - DNA, 25 bp, Mus musculus
gttacagtcttacaaatggttccta

SEQ ID NO: 722715 - DNA, 25 bp, Mus musculus
gttacagtcttagaaatggttccta

SEQ ID NO: 722716 - DNA, 25 bp, Mus musculus
gttacagtcttccttgcacttaaac

SEQ ID NO: 722717 - DNA, 25 bp, Mus musculus
gttacagtcttcgttgcacttaaac

SEQ ID NO: 722718 - DNA, 25 bp, Mus musculus
gttacagtgaataccgtcagcgcta

SEQ ID NO: 722719 - DNA, 25 bp, Mus musculus
gttacagtgaattccgtcagcgcta

SEQ ID NO: 722720 - DNA, 25 bp, Mus musculus
gttacagtgcctataattcgccatg

SEQ ID NO: 722721 - DNA, 25 bp, Mus musculus
gttacagtgcctttaattcgccatg

SEQ ID NO: 722722 - DNA, 25 bp, Mus musculus
gttacagtggaacatattttcctat

SEQ ID NO: 722723 - DNA, 25 bp, Mus musculus
gttacagtggaagatattttcctat

SEQ ID NO: 722724 - DNA, 25 bp, Mus musculus
gttacagtggtaactgcagttctga

SEQ ID NO: 722725 - DNA, 25 bp, Mus musculus
gttacagtggtatctgcagttctga

SEQ ID NO: 722726 - DNA, 25 bp, Mus musculus
gttacagtgtctatattatctcaaa

SEQ ID NO: 722727 - DNA, 25 bp, Mus musculus
gttacagtgtctattgtctcctcat

SEQ ID NO: 722728 - DNA, 25 bp, Mus musculus
gttacagtgtctctttggcctctaa

SEQ ID NO: 722729 - DNA, 25 bp, Mus musculus
gttacagtgtctgtttggcctctaa

SEQ ID NO: 722730 - DNA, 25 bp, Mus musculus
gttacagtgtctttattatctcaaa

SEQ ID NO: 722731 - DNA, 25 bp, Mus musculus
gttacagtgtcttttgtctcctcat

SEQ ID NO: 722732 - DNA, 25 bp, Mus musculus
gttacagttacgaactgccatgttt

SEQ ID NO: 722733 - DNA, 25 bp, Mus musculus
gttacagttacgtactgccatgttt

SEQ ID NO: 722734 - DNA, 25 bp, Mus musculus
gttacagttagtctcctgctacctg

SEQ ID NO: 722735 - DNA, 25 bp, Mus musculus
gttacagttagtgtcctgctacctg

SEQ ID NO: 722736 - DNA, 25 bp, Mus musculus
gttacagttcacacactccaactgc

SEQ ID NO: 722737 - DNA, 25 bp, Mus musculus
gttacagttcactcactccaactgc

SEQ ID NO: 722738 - DNA, 25 bp, Mus musculus
gttacagttctcagtggaagtcatt

SEQ ID NO: 722739 - DNA, 25 bp, Mus musculus
gttacagttctctgtggaagtcatt

SEQ ID NO: 722740 - DNA, 25 bp, Mus musculus
gttacagttcttacgcttgcaagtt

SEQ ID NO: 722741 - DNA, 25 bp, Mus musculus
gttacagttctttcgcttgcaagtt

SEQ ID NO: 722742 - DNA, 25 bp, Mus musculus
gttacagttgagactacctcttctt

SEQ ID NO: 722743 - DNA, 25 bp, Mus musculus
gttacagttgagtctacctcttctt

SEQ ID NO: 722744 - DNA, 25 bp, Mus musculus
gttacagttggcactcaacagctct

SEQ ID NO: 722745 - DNA, 25 bp, Mus musculus
gttacagttggcattttgtatccat

SEQ ID NO: 722746 - DNA, 25 bp, Mus musculus
gttacagttggctctcaacagctct

SEQ ID NO: 722747 - DNA, 25 bp, Mus musculus
gttacagttggctttttgtatccat

SEQ ID NO: 722748 - DNA, 25 bp, Mus musculus
gttacagttgtaacagcctgcagtt

SEQ ID NO: 722749 - DNA, 25 bp, Mus musculus
gttacagttgtatcagcctgcagtt

SEQ ID NO: 722750 - DNA, 25 bp, Mus musculus
gttacagttgttagaggctttcact

SEQ ID NO: 722751 - DNA, 25 bp, Mus musculus
gttacagttgtttgaggctttcact

SEQ ID NO: 722752 - DNA, 25 bp, Mus musculus
gttacagtttcaagttatttatatt

SEQ ID NO: 722753 - DNA, 25 bp, Mus musculus
gttacagtttcatgttatttatatt

SEQ ID NO: 722754 - DNA, 25 bp, Mus musculus
gttacagtttctctgtgggcgagat

SEQ ID NO: 722755 - DNA, 25 bp, Mus musculus
gttacagtttctgtgtgggcgagat

SEQ ID NO: 722756 - DNA, 25 bp, Mus musculus
gttacagtttgcataaattcatctc

SEQ ID NO: 722757 - DNA, 25 bp, Mus musculus
gttacagtttgcttaaattcatctc

SEQ ID NO: 722758 - DNA, 25 bp, Mus musculus
gttacagttttaatgcttctaatca

SEQ ID NO: 722759 - DNA, 25 bp, Mus musculus
gttacagttttattgcttctaatca

SEQ ID NO: 722760 - DNA, 25 bp, Mus musculus
gttacagttttcactggagaacatg

SEQ ID NO: 722761 - DNA, 25 bp, Mus musculus
gttacagttttctctggagaacatg

SEQ ID NO: 722762 - DNA, 25 bp, Mus musculus
gttacataccagaacgccctaagtg

SEQ ID NO: 722763 - DNA, 25 bp, Mus musculus
gttacataccagtacgccctaagtg

SEQ ID NO: 722764 - DNA, 25 bp, Mus musculus
gttacataccttcaatttccaagag

SEQ ID NO: 722765 - DNA, 25 bp, Mus musculus
gttacataccttgaatttccaagag

SEQ ID NO: 722766 - DNA, 25 bp, Mus musculus
gttacatactatatagctcaaattt

SEQ ID NO: 722767 - DNA, 25 bp, Mus musculus
gttacatactatttagctcaaattt

SEQ ID NO: 722768 - DNA, 25 bp, Mus musculus
gttacatacttaatcactggataca

SEQ ID NO: 722769 - DNA, 25 bp, Mus musculus
gttacatacttattcactggataca

SEQ ID NO: 722770 - DNA, 25 bp, Mus musculus
gttacatacttcaaaacagtctgtg

SEQ ID NO: 722771 - DNA, 25 bp, Mus musculus
gttacatacttctaaacagtctgtg

SEQ ID NO: 722772 - DNA, 25 bp, Mus musculus
gttacatagctgatggtggcgcctg

SEQ ID NO: 722773 - DNA, 25 bp, Mus musculus
gttacatagctgttggtggcgcctg

SEQ ID NO: 722774 - DNA, 25 bp, Mus musculus
gttacatagtgcaaggacatcctgg

SEQ ID NO: 722775 - DNA, 25 bp, Mus musculus
gttacatagtgctaggacatcctgg

SEQ ID NO: 722776 - DNA, 25 bp, Mus musculus
gttacatagttgcatacaccacaca

SEQ ID NO: 722777 - DNA, 25 bp, Mus musculus
gttacatagttggatacaccacaca

SEQ ID NO: 722778 - DNA, 25 bp, Mus musculus
gttacatataatactgcctctgctt

SEQ ID NO: 722779 - DNA, 25 bp, Mus musculus
gttacatataattctgcctctgctt

SEQ ID NO: 722780 - DNA, 25 bp, Mus musculus
gttacatatcttactatctcatggc

SEQ ID NO: 722781 - DNA, 25 bp, Mus musculus
gttacatatctttctatctcatggc

SEQ ID NO: 722782 - DNA, 25 bp, Mus musculus
gttacatatgtgctcggtcttaggt

SEQ ID NO: 722783 - DNA, 25 bp, Mus musculus
gttacatatgtggtcggtcttaggt

SEQ ID NO: 722784 - DNA, 25 bp, Mus musculus
gttacatatgttagcatcaagctag

SEQ ID NO: 722785 - DNA, 25 bp, Mus musculus
gttacatatgttagtccatgacaac

SEQ ID NO: 722786 - DNA, 25 bp, Mus musculus
gttacatatgtttgcatcaagctag

SEQ ID NO: 722787 - DNA, 25 bp, Mus musculus
gttacatatgtttgtccatgacaac

SEQ ID NO: 722788 - DNA, 25 bp, Mus musculus
gttacatcagatcgaactctcttct

SEQ ID NO: 722789 - DNA, 25 bp, Mus musculus
gttacatcagatggaactctcttct

SEQ ID NO: 722790 - DNA, 25 bp, Mus musculus
gttacatcagtgctatataatcctt

SEQ ID NO: 722791 - DNA, 25 bp, Mus musculus
gttacatcagtggtatataatcctt

SEQ ID NO: 722792 - DNA, 25 bp, Mus musculus
gttacatcatagacctgctgtctgg

SEQ ID NO: 722793 - DNA, 25 bp, Mus musculus
gttacatcatagtcctgctgtctgg

SEQ ID NO: 722794 - DNA, 25 bp, Mus musculus
gttacatccaggcatgtagaggact

SEQ ID NO: 722795 - DNA, 25 bp, Mus musculus
gttacatccagggatgtagaggact

SEQ ID NO: 722796 - DNA, 25 bp, Mus musculus
gttacatccatacaacctaccacat

SEQ ID NO: 722797 - DNA, 25 bp, Mus musculus
gttacatccatagaacctaccacat

SEQ ID NO: 722798 - DNA, 25 bp, Mus musculus
gttacatcgtatcacgttttctgtt

SEQ ID NO: 722799 - DNA, 25 bp, Mus musculus
gttacatcgtatgacgttttctgtt

SEQ ID NO: 722800 - DNA, 25 bp, Mus musculus
gttacatctaccagtttatgggcta

SEQ ID NO: 722801 - DNA, 25 bp, Mus musculus
gttacatctacctgtttatgggcta

SEQ ID NO: 722802 - DNA, 25 bp, Mus musculus
gttacatctactccagactctctca

SEQ ID NO: 722803 - DNA, 25 bp, Mus musculus
gttacatctactgcagactctctca

SEQ ID NO: 722804 - DNA, 25 bp, Mus musculus
gttacatctataacctgtgtctgaa

SEQ ID NO: 722805 - DNA, 25 bp, Mus musculus
gttacatctatatcctgtgtctgaa

SEQ ID NO: 722806 - DNA, 25 bp, Mus musculus
gttacatctattacattaccatggt

SEQ ID NO: 722807 - DNA, 25 bp, Mus musculus
gttacatctatttcattaccatggt

SEQ ID NO: 722808 - DNA, 25 bp, Mus musculus
gttacatctgcccagtgctgtttgg

SEQ ID NO: 722809 - DNA, 25 bp, Mus musculus
gttacatctgccgagtgctgtttgg

SEQ ID NO: 722810 - DNA, 25 bp, Mus musculus
gttacatctgtaagaaactgcctat

SEQ ID NO: 722811 - DNA, 25 bp, Mus musculus
gttacatctgtatgaaactgcctat

SEQ ID NO: 722812 - DNA, 25 bp, Mus musculus
gttacatgaacacttgtccaggccc

SEQ ID NO: 722813 - DNA, 25 bp, Mus musculus
gttacatgaacagttgtccaggccc

SEQ ID NO: 722814 - DNA, 25 bp, Mus musculus
gttacatgatctatagaggagccca

SEQ ID NO: 722815 - DNA, 25 bp, Mus musculus
gttacatgatctttagaggagccca

SEQ ID NO: 722816 - DNA, 25 bp, Mus musculus
gttacatgcccaacgaggtggagct

SEQ ID NO: 722817 - DNA, 25 bp, Mus musculus
gttacatgcccatcgaggtggagct

SEQ ID NO: 722818 - DNA, 25 bp, Mus musculus
gttacatgcctgcaacccagaaaga

SEQ ID NO: 722819 - DNA, 25 bp, Mus musculus
gttacatgcctggaacccagaaaga

SEQ ID NO: 722820 - DNA, 25 bp, Mus musculus
gttacatgctcactgtgatggccta

SEQ ID NO: 722821 - DNA, 25 bp, Mus musculus
gttacatgctcagtgtgatggccta

SEQ ID NO: 722822 - DNA, 25 bp, Mus musculus
gttacatgctgaccccagcctgata

SEQ ID NO: 722823 - DNA, 25 bp, Mus musculus
gttacatgctgagcccagcctgata

SEQ ID NO: 722824 - DNA, 25 bp, Mus musculus
gttacatgctgtaagccaccaggtg

SEQ ID NO: 722825 - DNA, 25 bp, Mus musculus
gttacatgctgttagccaccaggtg

SEQ ID NO: 722826 - DNA, 25 bp, Mus musculus
gttacatggagcactatgaccttaa

SEQ ID NO: 722827 - DNA, 25 bp, Mus musculus
gttacatggagctctatgaccttaa

SEQ ID NO: 722828 - DNA, 25 bp, Mus musculus
gttacatggattactttgcttgaaa

SEQ ID NO: 722829 - DNA, 25 bp, Mus musculus
gttacatggatttctttgcttgaaa

SEQ ID NO: 722830 - DNA, 25 bp, Mus musculus
gttacatgggctcaaaggacagatt

SEQ ID NO: 722831 - DNA, 25 bp, Mus musculus
gttacatgggctgaaaggacagatt

SEQ ID NO: 722832 - DNA, 25 bp, Mus musculus
gttacatggttgagactcactgtgt

SEQ ID NO: 722833 - DNA, 25 bp, Mus musculus
gttacatggttgtgactcactgtgt

SEQ ID NO: 722834 - DNA, 25 bp, Mus musculus
gttacatgtcggactgtctagttat

SEQ ID NO: 722835 - DNA, 25 bp, Mus musculus
gttacatgtcggtctgtctagttat

SEQ ID NO: 722836 - DNA, 25 bp, Mus musculus
gttacatgtctgctttaagttcaaa

SEQ ID NO: 722837 - DNA, 25 bp, Mus musculus
gttacatgtctggtttaagttcaaa

SEQ ID NO: 722838 - DNA, 25 bp, Mus musculus
gttacatgttgaactgctgccctca

SEQ ID NO: 722839 - DNA, 25 bp, Mus musculus
gttacatgttgatctgctgccctca

SEQ ID NO: 722840 - DNA, 25 bp, Mus musculus
gttacatgtttgcacctttctagtt

SEQ ID NO: 722841 - DNA, 25 bp, Mus musculus
gttacatgtttggacctttctagtt

SEQ ID NO: 722842 - DNA, 25 bp, Mus musculus
gttacattacacatttagcaagaag

SEQ ID NO: 722843 - DNA, 25 bp, Mus musculus
gttacattacacttttagcaagaag

SEQ ID NO: 722844 - DNA, 25 bp, Mus musculus
gttacattactactctcagtattct

SEQ ID NO: 722845 - DNA, 25 bp, Mus musculus
gttacattactagtctcagtattct

SEQ ID NO: 722846 - DNA, 25 bp, Mus musculus
gttacattagtgacatcttagctcc

SEQ ID NO: 722847 - DNA, 25 bp, Mus musculus
gttacattagtgtcatcttagctcc

SEQ ID NO: 722848 - DNA, 25 bp, Mus musculus
gttacattatgacatcccgtcttta

SEQ ID NO: 722849 - DNA, 25 bp, Mus musculus
gttacattatgagatcccgtcttta

SEQ ID NO: 722850 - DNA, 25 bp, Mus musculus
gttacattcaaaaagtccaatctgt

SEQ ID NO: 722851 - DNA, 25 bp, Mus musculus
gttacattcaaatagtccaatctgt

SEQ ID NO: 722852 - DNA, 25 bp, Mus musculus
gttacattcaaccaacaggatacaa

SEQ ID NO: 722853 - DNA, 25 bp, Mus musculus
gttacattcaacgaacaggatacaa

SEQ ID NO: 722854 - DNA, 25 bp, Mus musculus
gttacattcaatattacagggcaca

SEQ ID NO: 722855 - DNA, 25 bp, Mus musculus
gttacattcaattttacagggcaca

SEQ ID NO: 722856 - DNA, 25 bp, Mus musculus
gttacattctgacgccctgcctggt

SEQ ID NO: 722857 - DNA, 25 bp, Mus musculus
gttacattctgaggccctgcctggt

SEQ ID NO: 722858 - DNA, 25 bp, Mus musculus
gttacattctggattattgagagac

SEQ ID NO: 722859 - DNA, 25 bp, Mus musculus
gttacattctggtttattgagagac

SEQ ID NO: 722860 - DNA, 25 bp, Mus musculus
gttacattgaatcaatctcagaaga

SEQ ID NO: 722861 - DNA, 25 bp, Mus musculus
gttacattgaatgaatctcagaaga

SEQ ID NO: 722862 - DNA, 25 bp, Mus musculus
gttacattgagactagatacgattt

SEQ ID NO: 722863 - DNA, 25 bp, Mus musculus
gttacattgagagtagatacgattt

SEQ ID NO: 722864 - DNA, 25 bp, Mus musculus
gttacattggaacccgttctgactc

SEQ ID NO: 722865 - DNA, 25 bp, Mus musculus
gttacattggaagccgttctgactc

SEQ ID NO: 722866 - DNA, 25 bp, Mus musculus
gttacattggatccactaaccagct

SEQ ID NO: 722867 - DNA, 25 bp, Mus musculus
gttacattggatgcactaaccagct

SEQ ID NO: 722868 - DNA, 25 bp, Mus musculus
gttacattgggtatcattcactcat

SEQ ID NO: 722869 - DNA, 25 bp, Mus musculus
gttacattgggtttcattcactcat

SEQ ID NO: 722870 - DNA, 25 bp, Mus musculus
gttacatttaccacactgaagtttt

SEQ ID NO: 722871 - DNA, 25 bp, Mus musculus
gttacatttacctcactgaagtttt

SEQ ID NO: 722872 - DNA, 25 bp, Mus musculus
gttacatttactccagactttctca

SEQ ID NO: 722873 - DNA, 25 bp, Mus musculus
gttacatttactgcagactttctca

SEQ ID NO: 722874 - DNA, 25 bp, Mus musculus
gttacatttggcattgggttcactt

SEQ ID NO: 722875 - DNA, 25 bp, Mus musculus
gttacatttggctttgggttcactt

SEQ ID NO: 722876 - DNA, 25 bp, Mus musculus
gttacatttgtgaagattccctccg

SEQ ID NO: 722877 - DNA, 25 bp, Mus musculus
gttacatttgtgtagattccctccg

SEQ ID NO: 722878 - DNA, 25 bp, Mus musculus
gttacatttgttcttgctgaagcgt

SEQ ID NO: 722879 - DNA, 25 bp, Mus musculus
gttacatttgttgttgctgaagcgt

SEQ ID NO: 722880 - DNA, 25 bp, Mus musculus
gttacattttctactttgagccaaa

SEQ ID NO: 722881 - DNA, 25 bp, Mus musculus
gttacattttcttctttgagccaaa

SEQ ID NO: 722882 - DNA, 25 bp, Mus musculus
gttaccaaaggtactgagaattctc

SEQ ID NO: 722883 - DNA, 25 bp, Mus musculus
gttaccaaaggttctgagaattctc

SEQ ID NO: 722884 - DNA, 25 bp, Mus musculus
gttaccaaatcacagaccacagctt

SEQ ID NO: 722885 - DNA, 25 bp, Mus musculus
gttaccaaatcagagaccacagctt

SEQ ID NO: 722886 - DNA, 25 bp, Mus musculus
gttaccaactgtatatgcactgtct

SEQ ID NO: 722887 - DNA, 25 bp, Mus musculus
gttaccaactgtttatgcactgtct

SEQ ID NO: 722888 - DNA, 25 bp, Mus musculus
gttaccaacttcctaagatttagct

SEQ ID NO: 722889 - DNA, 25 bp, Mus musculus
gttaccaacttcgtaagatttagct

SEQ ID NO: 722890 - DNA, 25 bp, Mus musculus
gttaccaagacaacagtacgtcatc

SEQ ID NO: 722891 - DNA, 25 bp, Mus musculus
gttaccaagacatcagtacgtcatc

SEQ ID NO: 722892 - DNA, 25 bp, Mus musculus
gttaccaatgccatacttactttaa

SEQ ID NO: 722893 - DNA, 25 bp, Mus musculus
gttaccaatgccttacttactttaa

SEQ ID NO: 722894 - DNA, 25 bp, Mus musculus
gttaccaatggtctttcataagtga

SEQ ID NO: 722895 - DNA, 25 bp, Mus musculus
gttaccaatggtgtttcataagtga

SEQ ID NO: 722896 - DNA, 25 bp, Mus musculus
gttaccacaacgctgaacctgaaga

SEQ ID NO: 722897 - DNA, 25 bp, Mus musculus
gttaccacaacggtgaacctgaaga

SEQ ID NO: 722898 - DNA, 25 bp, Mus musculus
gttaccacacagatgaatatgttgc

SEQ ID NO: 722899 - DNA, 25 bp, Mus musculus
gttaccacacagttgaatatgttgc

SEQ ID NO: 722900 - DNA, 25 bp, Mus musculus
gttaccacactaagttaccgcacaa

SEQ ID NO: 722901 - DNA, 25 bp, Mus musculus
gttaccacactatgttaccgcacaa

SEQ ID NO: 722902 - DNA, 25 bp, Mus musculus
gttaccacagatcatttgtctctta

SEQ ID NO: 722903 - DNA, 25 bp, Mus musculus
gttaccacagatgatttgtctctta

SEQ ID NO: 722904 - DNA, 25 bp, Mus musculus
gttaccaccaccctacagagctgaa

SEQ ID NO: 722905 - DNA, 25 bp, Mus musculus
gttaccaccaccgtacagagctgaa

SEQ ID NO: 722906 - DNA, 25 bp, Mus musculus
gttaccacccaacgctgtgatgaaa

SEQ ID NO: 722907 - DNA, 25 bp, Mus musculus
gttaccacccaaggctgtgatgaaa

SEQ ID NO: 722908 - DNA, 25 bp, Mus musculus
gttaccaccctcaggagacgctgaa

SEQ ID NO: 722909 - DNA, 25 bp, Mus musculus
gttaccaccctctggagacgctgaa

SEQ ID NO: 722910 - DNA, 25 bp, Mus musculus
gttaccacctatccttaaggagcca

SEQ ID NO: 722911 - DNA, 25 bp, Mus musculus
gttaccacctatgcttaaggagcca

SEQ ID NO: 722912 - DNA, 25 bp, Mus musculus
gttaccacctcgctttacattctaa

SEQ ID NO: 722913 - DNA, 25 bp, Mus musculus
gttaccacctcggtttacattctaa

SEQ ID NO: 722914 - DNA, 25 bp, Mus musculus
gttaccacgctgagagccatgtatt

SEQ ID NO: 722915 - DNA, 25 bp, Mus musculus
gttaccacgctgtgagccatgtatt

SEQ ID NO: 722916 - DNA, 25 bp, Mus musculus
gttaccacggaaacctcagtgactt

SEQ ID NO: 722917 - DNA, 25 bp, Mus musculus
gttaccacggaatcctcagtgactt

SEQ ID NO: 722918 - DNA, 25 bp, Mus musculus
gttaccacgtataacaagtatgatg

SEQ ID NO: 722919 - DNA, 25 bp, Mus musculus
gttaccacgtatcgacatagacaca

SEQ ID NO: 722920 - DNA, 25 bp, Mus musculus
gttaccacgtatggacatagacaca

SEQ ID NO: 722921 - DNA, 25 bp, Mus musculus
gttaccacgtattacaagtatgatg

SEQ ID NO: 722922 - DNA, 25 bp, Mus musculus
gttaccactgacatttacttagtac

SEQ ID NO: 722923 - DNA, 25 bp, Mus musculus
gttaccactgacttttacttagtac

SEQ ID NO: 722924 - DNA, 25 bp, Mus musculus
gttaccactgctatgtatctgggtt

SEQ ID NO: 722925 - DNA, 25 bp, Mus musculus
gttaccactgctttgtatctgggtt

SEQ ID NO: 722926 - DNA, 25 bp, Mus musculus
gttaccactggaagtaccttgcaca

SEQ ID NO: 722927 - DNA, 25 bp, Mus musculus
gttaccactggatgtaccttgcaca

SEQ ID NO: 722928 - DNA, 25 bp, Mus musculus
gttaccacttcccagcagcagatgg

SEQ ID NO: 722929 - DNA, 25 bp, Mus musculus
gttaccacttccgagcagcagatgg

SEQ ID NO: 722930 - DNA, 25 bp, Mus musculus
gttaccagaacaactccagctcttt

SEQ ID NO: 722931 - DNA, 25 bp, Mus musculus
gttaccagaacatctccagctcttt

SEQ ID NO: 722932 - DNA, 25 bp, Mus musculus
gttaccagaagaagtctctaaggat

SEQ ID NO: 722933 - DNA, 25 bp, Mus musculus
gttaccagaagatgtctctaaggat

SEQ ID NO: 722934 - DNA, 25 bp, Mus musculus
gttaccagaccaaactgtctcttta

SEQ ID NO: 722935 - DNA, 25 bp, Mus musculus
gttaccagaccatactgtctcttta

SEQ ID NO: 722936 - DNA, 25 bp, Mus musculus
gttaccagatgactgcaatgccagg

SEQ ID NO: 722937 - DNA, 25 bp, Mus musculus
gttaccagatgagtgcaatgccagg

SEQ ID NO: 722938 - DNA, 25 bp, Mus musculus
gttaccagattacacatctccagta

SEQ ID NO: 722939 - DNA, 25 bp, Mus musculus
gttaccagattagacatctccagta

SEQ ID NO: 722940 - DNA, 25 bp, Mus musculus
gttaccagatttacgtgtctcccta

SEQ ID NO: 722941 - DNA, 25 bp, Mus musculus
gttaccagattttcgtgtctcccta

SEQ ID NO: 722942 - DNA, 25 bp, Mus musculus
gttaccagcacacaacatggtgatt

SEQ ID NO: 722943 - DNA, 25 bp, Mus musculus
gttaccagcacagaacatggtgatt

SEQ ID NO: 722944 - DNA, 25 bp, Mus musculus
gttaccagcactagcatggctcaaa

SEQ ID NO: 722945 - DNA, 25 bp, Mus musculus
gttaccagcacttgcatggctcaaa

SEQ ID NO: 722946 - DNA, 25 bp, Mus musculus
gttaccaggagcatctaggcaggtc

SEQ ID NO: 722947 - DNA, 25 bp, Mus musculus
gttaccaggagcttctaggcaggtc

SEQ ID NO: 722948 - DNA, 25 bp, Mus musculus
gttaccagggtgaggcagttacact

SEQ ID NO: 722949 - DNA, 25 bp, Mus musculus
gttaccagggtgtggcagttacact

SEQ ID NO: 722950 - DNA, 25 bp, Mus musculus
gttaccaggttaagtgctcaatccc

SEQ ID NO: 722951 - DNA, 25 bp, Mus musculus
gttaccaggttatgtgctcaatccc

SEQ ID NO: 722952 - DNA, 25 bp, Mus musculus
gttaccagtactatgtgttccctca

SEQ ID NO: 722953 - DNA, 25 bp, Mus musculus
gttaccagtactttgtgttccctca

SEQ ID NO: 722954 - DNA, 25 bp, Mus musculus
gttaccagtgatatggagccatcct

SEQ ID NO: 722955 - DNA, 25 bp, Mus musculus
gttaccagtgatttggagccatcct

SEQ ID NO: 722956 - DNA, 25 bp, Mus musculus
gttaccagtggacaatgagttcatt

SEQ ID NO: 722957 - DNA, 25 bp, Mus musculus
gttaccagtggagaatgagttcatt

SEQ ID NO: 722958 - DNA, 25 bp, Mus musculus
gttaccagtggcattgagtaggatc

SEQ ID NO: 722959 - DNA, 25 bp, Mus musculus
gttaccagtggctttgagtaggatc

SEQ ID NO: 722960 - DNA, 25 bp, Mus musculus
gttaccatagttcatcgccctttga

SEQ ID NO: 722961 - DNA, 25 bp, Mus musculus
gttaccatagttgatcgccctttga

SEQ ID NO: 722962 - DNA, 25 bp, Mus musculus
gttaccatatcaactgtacatatat

SEQ ID NO: 722963 - DNA, 25 bp, Mus musculus
gttaccatatcatctgtacatatat

SEQ ID NO: 722964 - DNA, 25 bp, Mus musculus
gttaccatatggagtgcttttgtag

SEQ ID NO: 722965 - DNA, 25 bp, Mus musculus
gttaccatatggtgtgcttttgtag

SEQ ID NO: 722966 - DNA, 25 bp, Mus musculus
gttaccatcacgctgaattccaaac

SEQ ID NO: 722967 - DNA, 25 bp, Mus musculus
gttaccatcacggtgaattccaaac

SEQ ID NO: 722968 - DNA, 25 bp, Mus musculus
gttaccatcactcttaaagccttca

SEQ ID NO: 722969 - DNA, 25 bp, Mus musculus
gttaccatcactgttaaagccttca

SEQ ID NO: 722970 - DNA, 25 bp, Mus musculus
gttaccatcattaagtcactgtcca

SEQ ID NO: 722971 - DNA, 25 bp, Mus musculus
gttaccatcatttagtcactgtcca

SEQ ID NO: 722972 - DNA, 25 bp, Mus musculus
gttaccatccacatgtctgttaaag

SEQ ID NO: 722973 - DNA, 25 bp, Mus musculus
gttaccatccacttgtctgttaaag

SEQ ID NO: 722974 - DNA, 25 bp, Mus musculus
gttaccatccccatagaatttgaca

SEQ ID NO: 722975 - DNA, 25 bp, Mus musculus
gttaccatccccttagaatttgaca

SEQ ID NO: 722976 - DNA, 25 bp, Mus musculus
gttaccatcctgacctgacaagttt

SEQ ID NO: 722977 - DNA, 25 bp, Mus musculus
gttaccatcctgtcctgacaagttt

SEQ ID NO: 722978 - DNA, 25 bp, Mus musculus
gttaccatccttaagttgcactgca

SEQ ID NO: 722979 - DNA, 25 bp, Mus musculus
gttaccatcctttagttgcactgca

SEQ ID NO: 722980 - DNA, 25 bp, Mus musculus
gttaccatcttcacagttctcaggt

SEQ ID NO: 722981 - DNA, 25 bp, Mus musculus
gttaccatcttctcagttctcaggt

SEQ ID NO: 722982 - DNA, 25 bp, Mus musculus
gttaccatgaagcatcagtacactt

SEQ ID NO: 722983 - DNA, 25 bp, Mus musculus
gttaccatgaaggatcagtacactt

SEQ ID NO: 722984 - DNA, 25 bp, Mus musculus
gttaccatggagcacatctcggaga

SEQ ID NO: 722985 - DNA, 25 bp, Mus musculus
gttaccatggaggacatctcggaga

SEQ ID NO: 722986 - DNA, 25 bp, Mus musculus
gttaccatggcaatcacattcccag

SEQ ID NO: 722987 - DNA, 25 bp, Mus musculus
gttaccatggcattcacattcccag

SEQ ID NO: 722988 - DNA, 25 bp, Mus musculus
gttaccatgggtatatgctcactat

SEQ ID NO: 722989 - DNA, 25 bp, Mus musculus
gttaccatgggtttatgctcactat

SEQ ID NO: 722990 - DNA, 25 bp, Mus musculus
gttaccatggtgacgctgacaaata

SEQ ID NO: 722991 - DNA, 25 bp, Mus musculus
gttaccatggtgcagatgccaatca

SEQ ID NO: 722992 - DNA, 25 bp, Mus musculus
gttaccatggtggagatgccaatca

SEQ ID NO: 722993 - DNA, 25 bp, Mus musculus
gttaccatggtgtcgctgacaaata

SEQ ID NO: 722994 - DNA, 25 bp, Mus musculus
gttaccattatgaggtctgtctgac

SEQ ID NO: 722995 - DNA, 25 bp, Mus musculus
gttaccattatgtggtctgtctgac

SEQ ID NO: 722996 - DNA, 25 bp, Mus musculus
gttaccattcaacatggcccctgga

SEQ ID NO: 722997 - DNA, 25 bp, Mus musculus
gttaccattcaagatggcccctgga

SEQ ID NO: 722998 - DNA, 25 bp, Mus musculus
gttaccattctacgttactgtgtcc

SEQ ID NO: 722999 - DNA, 25 bp, Mus musculus
gttaccattctaggttactgtgtcc

SEQ ID NO: 723000 - DNA, 25 bp, Mus musculus
gttaccattgcgatctagctttctt

SEQ ID NO: 723001 - DNA, 25 bp, Mus musculus
gttaccattgcgttctagctttctt

SEQ ID NO: 723002 - DNA, 25 bp, Mus musculus
gttaccattggtagcaacctttgtc

SEQ ID NO: 723003 - DNA, 25 bp, Mus musculus
gttaccattggttgcaacctttgtc

SEQ ID NO: 723004 - DNA, 25 bp, Mus musculus
gttaccattgtacttacataggact

SEQ ID NO: 723005 - DNA, 25 bp, Mus musculus
gttaccattgtagttacataggact

SEQ ID NO: 723006 - DNA, 25 bp, Mus musculus
gttaccatttcactgccaggaactt

SEQ ID NO: 723007 - DNA, 25 bp, Mus musculus
gttaccatttcagtgccaggaactt

SEQ ID NO: 723008 - DNA, 25 bp, Mus musculus
gttacccaaaccagatatccaaata

SEQ ID NO: 723009 - DNA, 25 bp, Mus musculus
gttacccaaacctgatatccaaata

SEQ ID NO: 723010 - DNA, 25 bp, Mus musculus
gttacccaactactaccatatgtca

SEQ ID NO: 723011 - DNA, 25 bp, Mus musculus
gttacccaactagtaccatatgtca

SEQ ID NO: 723012 - DNA, 25 bp, Mus musculus
gttacccaattcaatgaaccagagg

SEQ ID NO: 723013 - DNA, 25 bp, Mus musculus
gttacccaattctatgaaccagagg

SEQ ID NO: 723014 - DNA, 25 bp, Mus musculus
gttacccacttccttatatatactt

SEQ ID NO: 723015 - DNA, 25 bp, Mus musculus
gttacccacttcgttatatatactt

SEQ ID NO: 723016 - DNA, 25 bp, Mus musculus
gttacccagcgaagacgtcacagaa

SEQ ID NO: 723017 - DNA, 25 bp, Mus musculus
gttacccagcgatgacgtcacagaa

SEQ ID NO: 723018 - DNA, 25 bp, Mus musculus
gttacccaggagcaagttgacttat

SEQ ID NO: 723019 - DNA, 25 bp, Mus musculus
gttacccaggaggaagttgacttat

SEQ ID NO: 723020 - DNA, 25 bp, Mus musculus
gttacccatcacaacaccatattta

SEQ ID NO: 723021 - DNA, 25 bp, Mus musculus
gttacccatcactacaccatattta

SEQ ID NO: 723022 - DNA, 25 bp, Mus musculus
gttacccatgggattacctttgcct

SEQ ID NO: 723023 - DNA, 25 bp, Mus musculus
gttacccatgggtttacctttgcct

SEQ ID NO: 723024 - DNA, 25 bp, Mus musculus
gttacccattcaaccaattcagtga

SEQ ID NO: 723025 - DNA, 25 bp, Mus musculus
gttacccattcatccaattcagtga

SEQ ID NO: 723026 - DNA, 25 bp, Mus musculus
gttaccccaaatacaggagccactg

SEQ ID NO: 723027 - DNA, 25 bp, Mus musculus
gttaccccaaattcaggagccactg

SEQ ID NO: 723028 - DNA, 25 bp, Mus musculus
gttaccccgtatattttgcttcaag

SEQ ID NO: 723029 - DNA, 25 bp, Mus musculus
gttaccccgtattttttgcttcaag

SEQ ID NO: 723030 - DNA, 25 bp, Mus musculus
gttacccctaaaatgattatcctgg

SEQ ID NO: 723031 - DNA, 25 bp, Mus musculus
gttacccctaaattgattatcctgg

SEQ ID NO: 723032 - DNA, 25 bp, Mus musculus
gttacccctgtacaataggcagcac

SEQ ID NO: 723033 - DNA, 25 bp, Mus musculus
gttacccctgtagaataggcagcac

SEQ ID NO: 723034 - DNA, 25 bp, Mus musculus
gttacccgatctacagttccgagtc

SEQ ID NO: 723035 - DNA, 25 bp, Mus musculus
gttacccgatcttcagttccgagtc

SEQ ID NO: 723036 - DNA, 25 bp, Mus musculus
gttacccggatgagttgtccacgag

SEQ ID NO: 723037 - DNA, 25 bp, Mus musculus
gttacccggatgtgttgtccacgag

SEQ ID NO: 723038 - DNA, 25 bp, Mus musculus
gttacccgggtaaggctgtgatatt

SEQ ID NO: 723039 - DNA, 25 bp, Mus musculus
gttacccgggtatggctgtgatatt

SEQ ID NO: 723040 - DNA, 25 bp, Mus musculus
gttaccctacagctgaccacgtggt

SEQ ID NO: 723041 - DNA, 25 bp, Mus musculus
gttaccctacaggtgaccacgtggt

SEQ ID NO: 723042 - DNA, 25 bp, Mus musculus
gttaccctagcacatgggattggga

SEQ ID NO: 723043 - DNA, 25 bp, Mus musculus
gttaccctagcagatgggattggga

SEQ ID NO: 723044 - DNA, 25 bp, Mus musculus
gttaccctcctcaaaatcggaagcg

SEQ ID NO: 723045 - DNA, 25 bp, Mus musculus
gttaccctcctctaaatcggaagcg

SEQ ID NO: 723046 - DNA, 25 bp, Mus musculus
gttaccctctgaacaacagtgcggt

SEQ ID NO: 723047 - DNA, 25 bp, Mus musculus
gttaccctctgatcaacagtgcggt

SEQ ID NO: 723048 - DNA, 25 bp, Mus musculus
gttaccctgcatctcttccaggaat

SEQ ID NO: 723049 - DNA, 25 bp, Mus musculus
gttaccctgcatgtcttccaggaat

SEQ ID NO: 723050 - DNA, 25 bp, Mus musculus
gttaccctggatatctctactgtgt

SEQ ID NO: 723051 - DNA, 25 bp, Mus musculus
gttaccctggatattttcattgcaa

SEQ ID NO: 723052 - DNA, 25 bp, Mus musculus
gttaccctggatttctctactgtgt

SEQ ID NO: 723053 - DNA, 25 bp, Mus musculus
gttaccctggattttttcattgcaa

SEQ ID NO: 723054 - DNA, 25 bp, Mus musculus
gttaccctgtacacctttcaattat

SEQ ID NO: 723055 - DNA, 25 bp, Mus musculus
gttaccctgtactcctttcaattat

SEQ ID NO: 723056 - DNA, 25 bp, Mus musculus
gttacccttatgcaaattattctgg

SEQ ID NO: 723057 - DNA, 25 bp, Mus musculus
gttacccttatggaaattattctgg

SEQ ID NO: 723058 - DNA, 25 bp, Mus musculus
gttacccttcctagaaacattagtg

SEQ ID NO: 723059 - DNA, 25 bp, Mus musculus
gttacccttccttgaaacattagtg

SEQ ID NO: 723060 - DNA, 25 bp, Mus musculus
gttacccttgaactagcttagttca

SEQ ID NO: 723061 - DNA, 25 bp, Mus musculus
gttacccttgaagtagcttagttca

SEQ ID NO: 723062 - DNA, 25 bp, Mus musculus
gttaccctttgcactggattttgat

SEQ ID NO: 723063 - DNA, 25 bp, Mus musculus
gttaccctttgctctggattttgat

SEQ ID NO: 723064 - DNA, 25 bp, Mus musculus
gttaccgaatcacttcctgtttgga

SEQ ID NO: 723065 - DNA, 25 bp, Mus musculus
gttaccgaatcagttcctgtttgga

SEQ ID NO: 723066 - DNA, 25 bp, Mus musculus
gttaccgactctcactccagcagaa

SEQ ID NO: 723067 - DNA, 25 bp, Mus musculus
gttaccgactctgactccagcagaa

SEQ ID NO: 723068 - DNA, 25 bp, Mus musculus
gttaccgagacaaccgagccagaga

SEQ ID NO: 723069 - DNA, 25 bp, Mus musculus
gttaccgagacacacacagaagcag

SEQ ID NO: 723070 - DNA, 25 bp, Mus musculus
gttaccgagacagacacagaagcag

SEQ ID NO: 723071 - DNA, 25 bp, Mus musculus
gttaccgagacatccgagccagaga

SEQ ID NO: 723072 - DNA, 25 bp, Mus musculus
gttaccgctgcaatttcaaaggtcg

SEQ ID NO: 723073 - DNA, 25 bp, Mus musculus
gttaccgctgcattttcaaaggtcg

SEQ ID NO: 723074 - DNA, 25 bp, Mus musculus
gttaccgctttaccgctggagatga

SEQ ID NO: 723075 - DNA, 25 bp, Mus musculus
gttaccgctttagcgctggagatga

SEQ ID NO: 723076 - DNA, 25 bp, Mus musculus
gttaccgtattaaaggaggcgtgat

SEQ ID NO: 723077 - DNA, 25 bp, Mus musculus
gttaccgtattataggaggcgtgat

SEQ ID NO: 723078 - DNA, 25 bp, Mus musculus
gttaccgtgctccagcaattactga

SEQ ID NO: 723079 - DNA, 25 bp, Mus musculus
gttaccgtgctcgagcaattactga

SEQ ID NO: 723080 - DNA, 25 bp, Mus musculus
gttaccgtggatagccccttgggtg

SEQ ID NO: 723081 - DNA, 25 bp, Mus musculus
gttaccgtggattgccccttgggtg

SEQ ID NO: 723082 - DNA, 25 bp, Mus musculus
gttaccgttttcaaagcataaggct

SEQ ID NO: 723083 - DNA, 25 bp, Mus musculus
gttaccgttttctaagcataaggct

SEQ ID NO: 723084 - DNA, 25 bp, Mus musculus
gttacctaccagagttgtccagaag

SEQ ID NO: 723085 - DNA, 25 bp, Mus musculus
gttacctaccagtgttgtccagaag

SEQ ID NO: 723086 - DNA, 25 bp, Mus musculus
gttacctaccgtcttcttaacaatg

SEQ ID NO: 723087 - DNA, 25 bp, Mus musculus
gttacctaccgtgttcttaacaatg

SEQ ID NO: 723088 - DNA, 25 bp, Mus musculus
gttacctagtaacttggtttatcat

SEQ ID NO: 723089 - DNA, 25 bp, Mus musculus
gttacctagtaagttggtttatcat

SEQ ID NO: 723090 - DNA, 25 bp, Mus musculus
gttacctatctgcatttaccaccca

SEQ ID NO: 723091 - DNA, 25 bp, Mus musculus
gttacctatctggatttaccaccca

SEQ ID NO: 723092 - DNA, 25 bp, Mus musculus
gttacctatcttcttgttctggaaa

SEQ ID NO: 723093 - DNA, 25 bp, Mus musculus
gttacctatcttgttgttctggaaa

SEQ ID NO: 723094 - DNA, 25 bp, Mus musculus
gttacctatgtacctgttaccactt

SEQ ID NO: 723095 - DNA, 25 bp, Mus musculus
gttacctatgtagctgttaccactt

SEQ ID NO: 723096 - DNA, 25 bp, Mus musculus
gttacctcaaaacacccagaacaag

SEQ ID NO: 723097 - DNA, 25 bp, Mus musculus
gttacctcaaaagacccagaacaag

SEQ ID NO: 723098 - DNA, 25 bp, Mus musculus
gttacctcacacacttaccagtttc

SEQ ID NO: 723099 - DNA, 25 bp, Mus musculus
gttacctcacactcttaccagtttc

SEQ ID NO: 723100 - DNA, 25 bp, Mus musculus
gttacctcacctctaatcactggtt

SEQ ID NO: 723101 - DNA, 25 bp, Mus musculus
gttacctcacctgtaatcactggtt

SEQ ID NO: 723102 - DNA, 25 bp, Mus musculus
gttacctcagcaatggttttccttt

SEQ ID NO: 723103 - DNA, 25 bp, Mus musculus
gttacctcagcattggttttccttt

SEQ ID NO: 723104 - DNA, 25 bp, Mus musculus
gttacctcagttcacacgtttagca

SEQ ID NO: 723105 - DNA, 25 bp, Mus musculus
gttacctcagttgacacgtttagca

SEQ ID NO: 723106 - DNA, 25 bp, Mus musculus
gttacctcatcaagtttgtctatac

SEQ ID NO: 723107 - DNA, 25 bp, Mus musculus
gttacctcatcatgtttgtctatac

SEQ ID NO: 723108 - DNA, 25 bp, Mus musculus
gttacctccctcaaatttacaagtg

SEQ ID NO: 723109 - DNA, 25 bp, Mus musculus
gttacctccctctaatttacaagtg

SEQ ID NO: 723110 - DNA, 25 bp, Mus musculus
gttacctctcccaggaagcatgcat

SEQ ID NO: 723111 - DNA, 25 bp, Mus musculus
gttacctctccctggaagcatgcat

SEQ ID NO: 723112 - DNA, 25 bp, Mus musculus
gttacctctgcactgtacgagccta

SEQ ID NO: 723113 - DNA, 25 bp, Mus musculus
gttacctctgcagtgtacgagccta

SEQ ID NO: 723114 - DNA, 25 bp, Mus musculus
gttacctctgggacatgtccctctt

SEQ ID NO: 723115 - DNA, 25 bp, Mus musculus
gttacctctgggtcatgtccctctt
